United States Patent 7,901,882 (ANALYSIS OF METHYLATION USING NUCLEIC ACID ARRAYS) - sequence listing, part 16

SEQ ID NO: 583992 - DNA, 25 bp, Rattus norvegicus
gcgcgcactcggacactttcagtca

SEQ ID NO: 583993 - DNA, 25 bp, Rattus norvegicus
aaatggtgcccacggcagcatcgga

SEQ ID NO: 583994 - DNA, 25 bp, Rattus norvegicus
gcacggtcgcgtgcacaatcacacg

SEQ ID NO: 583995 - DNA, 25 bp, Rattus norvegicus
gatggccctaactcggtggccgcgt

SEQ ID NO: 583996 - DNA, 25 bp, Rattus norvegicus
cagtggtctcttccggtcgtagaaa

SEQ ID NO: 583997 - DNA, 25 bp, Rattus norvegicus
cttccggtcgtagaaaagcattgtg

SEQ ID NO: 583998 - DNA, 25 bp, Rattus norvegicus
gcgacgcgttctttctctgctctca

SEQ ID NO: 583999 - DNA, 25 bp, Rattus norvegicus
cactccagcgggcagtggtctcttc

SEQ ID NO: 584000 - DNA, 25 bp, Rattus norvegicus
gtgagcgccctctttctaggaaatc

SEQ ID NO: 584001 - DNA, 25 bp, Rattus norvegicus
aagccgagctccgtttgcgacgtag

SEQ ID NO: 584002 - DNA, 25 bp, Rattus norvegicus
ttgcgacgtagatctccgccgcatg

SEQ ID NO: 584003 - DNA, 25 bp, Rattus norvegicus
ccaggcgcacaactgggcggaaatg

SEQ ID NO: 584004 - DNA, 25 bp, Rattus norvegicus
tctctgctctcacgcggcgcgtagt

SEQ ID NO: 584005 - DNA, 25 bp, Rattus norvegicus
cgcgtagtatgggtttcctggtagc

SEQ ID NO: 584006 - DNA, 25 bp, Rattus norvegicus
gctgtggcctgctatctagcgtgtc

SEQ ID NO: 584007 - DNA, 25 bp, Rattus norvegicus
tccgcggtagactttggcctacgtc

SEQ ID NO: 584008 - DNA, 25 bp, Rattus norvegicus
tttctaggaaatcggcgccgcagcc

SEQ ID NO: 584009 - DNA, 25 bp, Rattus norvegicus
ctatgcttacgactttgagacagga

SEQ ID NO: 584010 - DNA, 25 bp, Rattus norvegicus
gggtacccgaaaatctgccgctgga

SEQ ID NO: 584011 - DNA, 25 bp, Rattus norvegicus
acccttctgccaggaggagagatgc

SEQ ID NO: 584012 - DNA, 25 bp, Rattus norvegicus
tcgcggacatgtggatctctttctc

SEQ ID NO: 584013 - DNA, 25 bp, Rattus norvegicus
ctttgcctgcaggaagtagctgtga

SEQ ID NO: 584014 - DNA, 25 bp, Rattus norvegicus
tccactcaggaggaggaacctttgc

SEQ ID NO: 584015 - DNA, 25 bp, Rattus norvegicus
gttgtctcctcggaaccagtgtcgc

SEQ ID NO: 584016 - DNA, 25 bp, Rattus norvegicus
ctagaattcgagagagcagtccttt

SEQ ID NO: 584017 - DNA, 25 bp, Rattus norvegicus
ggatcgagtcgcgagacagttctca

SEQ ID NO: 584018 - DNA, 25 bp, Rattus norvegicus
acgcccgaggatttcgacatctatg

SEQ ID NO: 584019 - DNA, 25 bp, Rattus norvegicus
cgctccgcagattcttctgggacta

SEQ ID NO: 584020 - DNA, 25 bp, Rattus norvegicus
cccaccgagagacatccgaaggatc

SEQ ID NO: 584021 - DNA, 25 bp, Rattus norvegicus
gcgccgtgtgacaaacccgaaaatg

SEQ ID NO: 584022 - DNA, 25 bp, Rattus norvegicus
aggctccgagcctggtctctccaga

SEQ ID NO: 584023 - DNA, 25 bp, Rattus norvegicus
cctcggatctgaagctggatagccc

SEQ ID NO: 584024 - DNA, 25 bp, Rattus norvegicus
agtcgcccgagaagcgtccgcagaa

SEQ ID NO: 584025 - DNA, 25 bp, Rattus norvegicus
tcaccgcgttcgtttccctgggaga

SEQ ID NO: 584026 - DNA, 25 bp, Rattus norvegicus
gttctatggtgagccgaaggcaccc

SEQ ID NO: 584027 - DNA, 25 bp, Rattus norvegicus
agcagctcctcttctgaagaatggg

SEQ ID NO: 584028 - DNA, 25 bp, Rattus norvegicus
cggcgacctgaggacaacaagaatc

SEQ ID NO: 584029 - DNA, 25 bp, Rattus norvegicus
gaatcacctggctaaggtccgccga

SEQ ID NO: 584030 - DNA, 25 bp, Rattus norvegicus
cccaacgctagcactggagcgattc

SEQ ID NO: 584031 - DNA, 25 bp, Rattus norvegicus
tcatcccgcggagatggccaagttc

SEQ ID NO: 584032 - DNA, 25 bp, Rattus norvegicus
gatggccaagttcaagcttccttcc

SEQ ID NO: 584033 - DNA, 25 bp, Rattus norvegicus
acgtcctggaaaagccgggtgtctg

SEQ ID NO: 584034 - DNA, 25 bp, Rattus norvegicus
ctccgaggctccagggaaagttctt

SEQ ID NO: 584035 - DNA, 25 bp, Rattus norvegicus
gggtgtcggcaaaaagcctcggatc

SEQ ID NO: 584036 - DNA, 25 bp, Rattus norvegicus
gcctgtagcttctgtccgaaggtcc

SEQ ID NO: 584037 - DNA, 25 bp, Rattus norvegicus
tcgcccttgctagcagtcttctatc

SEQ ID NO: 584038 - DNA, 25 bp, Rattus norvegicus
gtggctgccggaaacccggccgcta

SEQ ID NO: 584039 - DNA, 25 bp, Rattus norvegicus
actgagtctggtgcgatgctgttcc

SEQ ID NO: 584040 - DNA, 25 bp, Rattus norvegicus
tgctgttcccgggaagcgcagtcag

SEQ ID NO: 584041 - DNA, 25 bp, Rattus norvegicus
agcgcagtcagctaccgctgaggaa

SEQ ID NO: 584042 - DNA, 25 bp, Rattus norvegicus
tggagcgaggagttgcctttccagc

SEQ ID NO: 584043 - DNA, 25 bp, Rattus norvegicus
ctatgtacgcctccctgagctcggg

SEQ ID NO: 584044 - DNA, 25 bp, Rattus norvegicus
gtgggtcgtccagcccgtttcattc

SEQ ID NO: 584045 - DNA, 25 bp, Rattus norvegicus
ttctatccgctctaggtgcgtgggt

SEQ ID NO: 584046 - DNA, 25 bp, Rattus norvegicus
tttcctctctacaccgcgagcgggg

SEQ ID NO: 584047 - DNA, 25 bp, Rattus norvegicus
agcagtcttctatccgctctaggtg

SEQ ID NO: 584048 - DNA, 25 bp, Rattus norvegicus
acaagatggcgaaggccctgtgctg

SEQ ID NO: 584049 - DNA, 25 bp, Rattus norvegicus
gcttcccgcctctaacaagatggcg

SEQ ID NO: 584050 - DNA, 25 bp, Rattus norvegicus
cgggctcgcaggtttcctctctaca

SEQ ID NO: 584051 - DNA, 25 bp, Rattus norvegicus
aacctgtatgggaaactcggccgcg

SEQ ID NO: 584052 - DNA, 25 bp, Rattus norvegicus
ctccgagacggaaccaacctgtatg

SEQ ID NO: 584053 - DNA, 25 bp, Rattus norvegicus
gcgaagaccgtccttcaagccacgt

SEQ ID NO: 584054 - DNA, 25 bp, Rattus norvegicus
gcagggtactcttctcgcgcgaaga

SEQ ID NO: 584055 - DNA, 25 bp, Rattus norvegicus
gcacctgaaaggcagggtactcttc

SEQ ID NO: 584056 - DNA, 25 bp, Rattus norvegicus
gctgaggtaactcccgcacctgaaa

SEQ ID NO: 584057 - DNA, 25 bp, Rattus norvegicus
gccgctttggaagtaggacttccgc

SEQ ID NO: 584058 - DNA, 25 bp, Rattus norvegicus
acaccagaagagtgcgcacagccgg

SEQ ID NO: 584059 - DNA, 25 bp, Rattus norvegicus
ccggactcgatggtggagaacagta

SEQ ID NO: 584060 - DNA, 25 bp, Rattus norvegicus
atgcggtgcgatgacaaccggactc

SEQ ID NO: 584061 - DNA, 25 bp, Rattus norvegicus
cgtcgcaccaagttccgctgtagcg

SEQ ID NO: 584062 - DNA, 25 bp, Rattus norvegicus
ccgagtcaacttcccgctggtgttc

SEQ ID NO: 584063 - DNA, 25 bp, Rattus norvegicus
cgctctccgaggtccgagtcaactt

SEQ ID NO: 584064 - DNA, 25 bp, Rattus norvegicus
tgtgcagcaggctgaggtaactccc

SEQ ID NO: 584065 - DNA, 25 bp, Rattus norvegicus
ggatgctcctcagctggctggacgc

SEQ ID NO: 584066 - DNA, 25 bp, Rattus norvegicus
gaagctccggttcactccagtcttg

SEQ ID NO: 584067 - DNA, 25 bp, Rattus norvegicus
catgcagttcttctcgtgcaggaac

SEQ ID NO: 584068 - DNA, 25 bp, Rattus norvegicus
ggccaggagatcagtcatgcagttc

SEQ ID NO: 584069 - DNA, 25 bp, Rattus norvegicus
tggctggacgcggaacccagctgac

SEQ ID NO: 584070 - DNA, 25 bp, Rattus norvegicus
cactccagtcttggcctcgagcttg

SEQ ID NO: 584071 - DNA, 25 bp, Rattus norvegicus
ccgagcgcgatgaagctccggttca

SEQ ID NO: 584072 - DNA, 25 bp, Rattus norvegicus
gtgcaggaaccggtcgaacctctcc

SEQ ID NO: 584073 - DNA, 25 bp, Rattus norvegicus
ttcggaggtgaaagcgagcttcacc

SEQ ID NO: 584074 - DNA, 25 bp, Rattus norvegicus
tctccctcatggctgcggacatggc

SEQ ID NO: 584075 - DNA, 25 bp, Rattus norvegicus
ggcctcgctggaagcagctggaccc

SEQ ID NO: 584076 - DNA, 25 bp, Rattus norvegicus
aagatatgggtcctcggacagtcgc

SEQ ID NO: 584077 - DNA, 25 bp, Rattus norvegicus
gacaccgcgcccaaagatatgggtc

SEQ ID NO: 584078 - DNA, 25 bp, Rattus norvegicus
ggcctcgagcttggccaggagatca

SEQ ID NO: 584079 - DNA, 25 bp, Rattus norvegicus
cgacaaggcgagaactgaggcccta

SEQ ID NO: 584080 - DNA, 25 bp, Rattus norvegicus
ctcgaccgaatgtccaccggggctg

SEQ ID NO: 584081 - DNA, 25 bp, Rattus norvegicus
tcccgaagcggcctctagcgcgagg

SEQ ID NO: 584082 - DNA, 25 bp, Rattus norvegicus
ttccaaggtcctggactggacggga

SEQ ID NO: 584083 - DNA, 25 bp, Rattus norvegicus
gcactgcagcggctggaaacccaag

SEQ ID NO: 584084 - DNA, 25 bp, Rattus norvegicus
gcagaaaagaaacccactcgaccga

SEQ ID NO: 584085 - DNA, 25 bp, Rattus norvegicus
ttctccagaacccttggcgacgtcg

SEQ ID NO: 584086 - DNA, 25 bp, Rattus norvegicus
tggcgacgtcgacaaggcgagaact

SEQ ID NO: 584087 - DNA, 25 bp, Rattus norvegicus
aactgaggccctaagtggcacggcg

SEQ ID NO: 584088 - DNA, 25 bp, Rattus norvegicus
ctagcgcgaggctgaagcgactgca

SEQ ID NO: 584089 - DNA, 25 bp, Rattus norvegicus
aggcgcagagcctccctaacggcga

SEQ ID NO: 584090 - DNA, 25 bp, Rattus norvegicus
gtcaacccggattcggcgctggacc

SEQ ID NO: 584091 - DNA, 25 bp, Rattus norvegicus
cactcgtgggttccaaggtcctgga

SEQ ID NO: 584092 - DNA, 25 bp, Rattus norvegicus
ttcctcttcccagcagaaaagaaac

SEQ ID NO: 584093 - DNA, 25 bp, Rattus norvegicus
gaaaagcagctttggccctgcccgc

SEQ ID NO: 584094 - DNA, 25 bp, Rattus norvegicus
gcgcttgttagatctgctcttggtt

SEQ ID NO: 584095 - DNA, 25 bp, Rattus norvegicus
gccacctgccgcacgctctcctgag

SEQ ID NO: 584096 - DNA, 25 bp, Rattus norvegicus
tcgcagccgcgggaaaagcagcttt

SEQ ID NO: 584097 - DNA, 25 bp, Rattus norvegicus
tatgctgctactggaccctgcctgc

SEQ ID NO: 584098 - DNA, 25 bp, Rattus norvegicus
cgctctgcccgcctatgctgctact

SEQ ID NO: 584099 - DNA, 25 bp, Rattus norvegicus
tctcctgaggggctcctgcgctctg

SEQ ID NO: 584100 - DNA, 25 bp, Rattus norvegicus
acttgctttcccatgcacagggcca

SEQ ID NO: 584101 - DNA, 25 bp, Rattus norvegicus
tgagacttgctttcccatgcacagg

SEQ ID NO: 584102 - DNA, 25 bp, Rattus norvegicus
actccgtgagacttgctttcccatg

SEQ ID NO: 584103 - DNA, 25 bp, Rattus norvegicus
ggggactccgtgagacttgctttcc

SEQ ID NO: 584104 - DNA, 25 bp, Rattus norvegicus
cgtcttgccggggactccgtgagac

SEQ ID NO: 584105 - DNA, 25 bp, Rattus norvegicus
ctgctcttggtttgctgcgtgaaaa

SEQ ID NO: 584106 - DNA, 25 bp, Rattus norvegicus
tcttggtttgctgcgtgaaaagcgg

SEQ ID NO: 584107 - DNA, 25 bp, Rattus norvegicus
caacaatacttgctccgcggaagcg

SEQ ID NO: 584108 - DNA, 25 bp, Rattus norvegicus
ttcccgcaagtctgagaaatccgcg

SEQ ID NO: 584109 - DNA, 25 bp, Rattus norvegicus
ggttagccggaacgcactataatga

SEQ ID NO: 584110 - DNA, 25 bp, Rattus norvegicus
ccgaagaattcgcagccattttcct

SEQ ID NO: 584111 - DNA, 25 bp, Rattus norvegicus
gaaatccgcgacagtggacacgccc

SEQ ID NO: 584112 - DNA, 25 bp, Rattus norvegicus
gccaatcagcggcaacaatacttgc

SEQ ID NO: 584113 - DNA, 25 bp, Rattus norvegicus
agcagctgctttttaatttcccgca

SEQ ID NO: 584114 - DNA, 25 bp, Rattus norvegicus
tctcaccatttgctgctgtgcagca

SEQ ID NO: 584115 - DNA, 25 bp, Rattus norvegicus
tggaacaccacacaaactgcatcag

SEQ ID NO: 584116 - DNA, 25 bp, Rattus norvegicus
gggcagagagaaggccaactccgca

SEQ ID NO: 584117 - DNA, 25 bp, Rattus norvegicus
ctcagacaaaggcaaggcgggcaga

SEQ ID NO: 584118 - DNA, 25 bp, Rattus norvegicus
gcggctgcagctcagacaaaggcaa

SEQ ID NO: 584119 - DNA, 25 bp, Rattus norvegicus
atgacgcccttacctctgtaagagg

SEQ ID NO: 584120 - DNA, 25 bp, Rattus norvegicus
ctgccaccgagactaccgaagaatt

SEQ ID NO: 584121 - DNA, 25 bp, Rattus norvegicus
gcacaacaacgaggcaggccgaacg

SEQ ID NO: 584122 - DNA, 25 bp, Rattus norvegicus
atctgcggctgcgactcgcatcata

SEQ ID NO: 584123 - DNA, 25 bp, Rattus norvegicus
gcccgctcagctatgaacaagcaca

SEQ ID NO: 584124 - DNA, 25 bp, Rattus norvegicus
aacaggccagatgcccgctcagcta

SEQ ID NO: 584125 - DNA, 25 bp, Rattus norvegicus
atgcacgggagaacaggccagatgc

SEQ ID NO: 584126 - DNA, 25 bp, Rattus norvegicus
cataaggggccacctggagaaggct

SEQ ID NO: 584127 - DNA, 25 bp, Rattus norvegicus
gactcgcatcataaggggccacctg

SEQ ID NO: 584128 - DNA, 25 bp, Rattus norvegicus
tgtgccgagggaacctctaccatct

SEQ ID NO: 584129 - DNA, 25 bp, Rattus norvegicus
ctatgaacaagcacaacaacgaggc

SEQ ID NO: 584130 - DNA, 25 bp, Rattus norvegicus
tcacgcgctcctgtgccgagggaac

SEQ ID NO: 584131 - DNA, 25 bp, Rattus norvegicus
gtgtagccttcgcagtcacgcgctc

SEQ ID NO: 584132 - DNA, 25 bp, Rattus norvegicus
ccatcgcctcggctggtgtagcctt

SEQ ID NO: 584133 - DNA, 25 bp, Rattus norvegicus
cgaatcggccttcgtgcatgccatc

SEQ ID NO: 584134 - DNA, 25 bp, Rattus norvegicus
ttcgtgcatgccatcgcctcggctg

SEQ ID NO: 584135 - DNA, 25 bp, Rattus norvegicus
agagcccgaccatcgagtcagtcct

SEQ ID NO: 584136 - DNA, 25 bp, Rattus norvegicus
ggacatccgtgctgaaagaccctga

SEQ ID NO: 584137 - DNA, 25 bp, Rattus norvegicus
tccgtgctgaaagaccctgattagg

SEQ ID NO: 584138 - DNA, 25 bp, Rattus norvegicus
tgattaggcggccaacagagcaccc

SEQ ID NO: 584139 - DNA, 25 bp, Rattus norvegicus
cgtgtgctaacagagcccgaccatc

SEQ ID NO: 584140 - DNA, 25 bp, Rattus norvegicus
aaagaccctgattaggcggccaaca

SEQ ID NO: 584141 - DNA, 25 bp, Rattus norvegicus
cggccgggcagtccgcgcttttgtc

SEQ ID NO: 584142 - DNA, 25 bp, Rattus norvegicus
acagccagtacgtgagtcccgctgc

SEQ ID NO: 584143 - DNA, 25 bp, Rattus norvegicus
tcctggggaagagcgtgactctcca

SEQ ID NO: 584144 - DNA, 25 bp, Rattus norvegicus
gcgtgactctccacacgcattggga

SEQ ID NO: 584145 - DNA, 25 bp, Rattus norvegicus
acacgcattgggaagcgtcctcttg

SEQ ID NO: 584146 - DNA, 25 bp, Rattus norvegicus
ttgggaagcgtcctcttggagtgaa

SEQ ID NO: 584147 - DNA, 25 bp, Rattus norvegicus
actgcgtgtcacgtgtgctaacaga

SEQ ID NO: 584148 - DNA, 25 bp, Rattus norvegicus
acagagcacccgcaaactgcgtgtc

SEQ ID NO: 584149 - DNA, 25 bp, Rattus norvegicus
catcttcgggtgcacagggacacag

SEQ ID NO: 584150 - DNA, 25 bp, Rattus norvegicus
taggcctttcggaggcggtcgcact

SEQ ID NO: 584151 - DNA, 25 bp, Rattus norvegicus
cctcacggggcacctgcacagaggg

SEQ ID NO: 584152 - DNA, 25 bp, Rattus norvegicus
gcacctgcacagagggtccgcacgg

SEQ ID NO: 584153 - DNA, 25 bp, Rattus norvegicus
gtccgcacggcagaagctccgaaga

SEQ ID NO: 584154 - DNA, 25 bp, Rattus norvegicus
ggcagaagctccgaagatctaggca

SEQ ID NO: 584155 - DNA, 25 bp, Rattus norvegicus
atctaggcagttgggggccacagac

SEQ ID NO: 584156 - DNA, 25 bp, Rattus norvegicus
acagcccgcatcttcgggtgcacag

SEQ ID NO: 584157 - DNA, 25 bp, Rattus norvegicus
gtgcacagggacacagcagcaggcc

SEQ ID NO: 584158 - DNA, 25 bp, Rattus norvegicus
caggccctgagcgtgggactctgcc

SEQ ID NO: 584159 - DNA, 25 bp, Rattus norvegicus
ggactctgccgccttctcgaagaag

SEQ ID NO: 584160 - DNA, 25 bp, Rattus norvegicus
cttctcgaagaaggagcgcagctga

SEQ ID NO: 584161 - DNA, 25 bp, Rattus norvegicus
gacacagcagcaggccctgagcgtg

SEQ ID NO: 584162 - DNA, 25 bp, Rattus norvegicus
gctggcagcggatccctgagcacgc

SEQ ID NO: 584163 - DNA, 25 bp, Rattus norvegicus
gacccggcagcgctctgcctgtgct

SEQ ID NO: 584164 - DNA, 25 bp, Rattus norvegicus
tcgcggcagcatcgggcggctatta

SEQ ID NO: 584165 - DNA, 25 bp, Rattus norvegicus
actctgaagcgctcgcggcagcatc

SEQ ID NO: 584166 - DNA, 25 bp, Rattus norvegicus
tccaactctgaagcgctcgcggcag

SEQ ID NO: 584167 - DNA, 25 bp, Rattus norvegicus
tgggcaccgccctccaactctgaag

SEQ ID NO: 584168 - DNA, 25 bp, Rattus norvegicus
agtctcctactagggtcctgggcac

SEQ ID NO: 584169 - DNA, 25 bp, Rattus norvegicus
tagtctcctactagggtcctgggca

SEQ ID NO: 584170 - DNA, 25 bp, Rattus norvegicus
ccactagtctcctactagggtcctg

SEQ ID NO: 584171 - DNA, 25 bp, Rattus norvegicus
gcgccactagtctcctactagggtc

SEQ ID NO: 584172 - DNA, 25 bp, Rattus norvegicus
tccctcggccgacacctcccaccgc

SEQ ID NO: 584173 - DNA, 25 bp, Rattus norvegicus
agctgggctccctcggccgacacct

SEQ ID NO: 584174 - DNA, 25 bp, Rattus norvegicus
ttggtacaccggactcgggcgagct

SEQ ID NO: 584175 - DNA, 25 bp, Rattus norvegicus
cctgccttggtacaccggactcggg

SEQ ID NO: 584176 - DNA, 25 bp, Rattus norvegicus
gcagcatcgggcggctattactccg

SEQ ID NO: 584177 - DNA, 25 bp, Rattus norvegicus
tgcaggccgcctcggcgggagagca

SEQ ID NO: 584178 - DNA, 25 bp, Rattus norvegicus
ccagtccagccgctagtgcggcgga

SEQ ID NO: 584179 - DNA, 25 bp, Rattus norvegicus
ggagctgtaagagccgcggtaggta

SEQ ID NO: 584180 - DNA, 25 bp, Rattus norvegicus
ccggccgcggcccagggagctgtaa

SEQ ID NO: 584181 - DNA, 25 bp, Rattus norvegicus
agcgctcagagctgctccggccgcg

SEQ ID NO: 584182 - DNA, 25 bp, Rattus norvegicus
cagcgccttttaagggcaccgtggg

SEQ ID NO: 584183 - DNA, 25 bp, Rattus norvegicus
cttgccagcgccttttaagggcacc

SEQ ID NO: 584184 - DNA, 25 bp, Rattus norvegicus
aaagaccggttggttcttgccagcg

SEQ ID NO: 584185 - DNA, 25 bp, Rattus norvegicus
ctcaaagaccggttggttcttgcca

SEQ ID NO: 584186 - DNA, 25 bp, Rattus norvegicus
ctctcctcaaagaccggttggttct

SEQ ID NO: 584187 - DNA, 25 bp, Rattus norvegicus
ggggattctgcgattagacgcgacc

SEQ ID NO: 584188 - DNA, 25 bp, Rattus norvegicus
accacgtagggctcgggcctcttcg

SEQ ID NO: 584189 - DNA, 25 bp, Rattus norvegicus
gagacaccacgtagggctcgggcct

SEQ ID NO: 584190 - DNA, 25 bp, Rattus norvegicus
ccagccgctagtgcggcggagcctt

SEQ ID NO: 584191 - DNA, 25 bp, Rattus norvegicus
gagcctcggctctgaccgtggccat

SEQ ID NO: 584192 - DNA, 25 bp, Rattus norvegicus
cttccggctaccacggtaagcgttg

SEQ ID NO: 584193 - DNA, 25 bp, Rattus norvegicus
cccgcgtccatgtggttccaggctg

SEQ ID NO: 584194 - DNA, 25 bp, Rattus norvegicus
gcgtccatgtggttccaggctgcca

SEQ ID NO: 584195 - DNA, 25 bp, Rattus norvegicus
aacctgtgtcctcgagcggagcgga

SEQ ID NO: 584196 - DNA, 25 bp, Rattus norvegicus
cgagtctgggattcgcgtcccgcct

SEQ ID NO: 584197 - DNA, 25 bp, Rattus norvegicus
actcgcagatcacggcttccggcta

SEQ ID NO: 584198 - DNA, 25 bp, Rattus norvegicus
cgggactcgcagatcacggcttccg

SEQ ID NO: 584199 - DNA, 25 bp, Rattus norvegicus
cttccggttacatccgggactcgca

SEQ ID NO: 584200 - DNA, 25 bp, Rattus norvegicus
ttggcatggcttccggttacatccg

SEQ ID NO: 584201 - DNA, 25 bp, Rattus norvegicus
cgcttggcatggcttccggttacat

SEQ ID NO: 584202 - DNA, 25 bp, Rattus norvegicus
tgccaggtcccgcttggcatggctt

SEQ ID NO: 584203 - DNA, 25 bp, Rattus norvegicus
gttccaggctgccaggtcccgcttg

SEQ ID NO: 584204 - DNA, 25 bp, Rattus norvegicus
ggtcgaacctgtgtcctcgagcgga

SEQ ID NO: 584205 - DNA, 25 bp, Rattus norvegicus
gcggaaattgcaattcccctccgga

SEQ ID NO: 584206 - DNA, 25 bp, Rattus norvegicus
ctggctgtgcctccgctcccggcca

SEQ ID NO: 584207 - DNA, 25 bp, Rattus norvegicus
gcttaaactcaacacaggaccactt

SEQ ID NO: 584208 - DNA, 25 bp, Rattus norvegicus
cacaggaccacttgaagaaagactg

SEQ ID NO: 584209 - DNA, 25 bp, Rattus norvegicus
cttgaagaaagactgggactaggga

SEQ ID NO: 584210 - DNA, 25 bp, Rattus norvegicus
agggcgatgagaacccgcccacctt

SEQ ID NO: 584211 - DNA, 25 bp, Rattus norvegicus
cctccggatcgcagggggcactgca

SEQ ID NO: 584212 - DNA, 25 bp, Rattus norvegicus
accttcttaaaaatctttggtgatg

SEQ ID NO: 584213 - DNA, 25 bp, Rattus norvegicus
aaatctttggtgatgtctgaggaga

SEQ ID NO: 584214 - DNA, 25 bp, Rattus norvegicus
tcttctaggtaccttgcatcctctc

SEQ ID NO: 584215 - DNA, 25 bp, Rattus norvegicus
gctcaacacatccatcttctaggta

SEQ ID NO: 584216 - DNA, 25 bp, Rattus norvegicus
gcaagcttaaactcaacacaggacc

SEQ ID NO: 584217 - DNA, 25 bp, Rattus norvegicus
acatccatcttctaggtaccttgca

SEQ ID NO: 584218 - DNA, 25 bp, Rattus norvegicus
gtctgaggagagcaagcttaaactc

SEQ ID NO: 584219 - DNA, 25 bp, Rattus norvegicus
gggtgcgcgccccagtttctcctgg

SEQ ID NO: 584220 - DNA, 25 bp, Rattus norvegicus
tcagagcggccggaatgtgggcagt

SEQ ID NO: 584221 - DNA, 25 bp, Rattus norvegicus
cccaggccgtcttgggggactcgct

SEQ ID NO: 584222 - DNA, 25 bp, Rattus norvegicus
tcggctagaagacgcggactgtgat

SEQ ID NO: 584223 - DNA, 25 bp, Rattus norvegicus
aaattcggctagaagacgcggactg

SEQ ID NO: 584224 - DNA, 25 bp, Rattus norvegicus
ctcaaaattcggctagaagacgcgg

SEQ ID NO: 584225 - DNA, 25 bp, Rattus norvegicus
cacgccctcggagcaggctctcgaa

SEQ ID NO: 584226 - DNA, 25 bp, Rattus norvegicus
gctctggccggcgttgcttccgcgt

SEQ ID NO: 584227 - DNA, 25 bp, Rattus norvegicus
caggacctagcggtgagtggcggcc

SEQ ID NO: 584228 - DNA, 25 bp, Rattus norvegicus
agatcctgggcctgcgctgcgcact

SEQ ID NO: 584229 - DNA, 25 bp, Rattus norvegicus
gttgcttctgttcgcggaccctacg

SEQ ID NO: 584230 - DNA, 25 bp, Rattus norvegicus
gctgttgcttctgttcgcggaccct

SEQ ID NO: 584231 - DNA, 25 bp, Rattus norvegicus
cccggtgggcaagcggctgttgctt

SEQ ID NO: 584232 - DNA, 25 bp, Rattus norvegicus
ggtccctcaaaattcggctagaaga

SEQ ID NO: 584233 - DNA, 25 bp, Rattus norvegicus
tcgctaggcagtgtcccaagaacta

SEQ ID NO: 584234 - DNA, 25 bp, Rattus norvegicus
gaaagccaggaagtgcccaaccatc

SEQ ID NO: 584235 - DNA, 25 bp, Rattus norvegicus
gcatcgcaagcctggggtcaccaga

SEQ ID NO: 584236 - DNA, 25 bp, Rattus norvegicus
cctctttaggacagggcagggtccg

SEQ ID NO: 584237 - DNA, 25 bp, Rattus norvegicus
cagtccctggactggatgaaagcca

SEQ ID NO: 584238 - DNA, 25 bp, Rattus norvegicus
tcaggactgtcctagggcaatcagg

SEQ ID NO: 584239 - DNA, 25 bp, Rattus norvegicus
ggcaatcagggttccgcaatccagg

SEQ ID NO: 584240 - DNA, 25 bp, Rattus norvegicus
caacctactgactggtggccgagta

SEQ ID NO: 584241 - DNA, 25 bp, Rattus norvegicus
gtgacacctggaaagtgaccctgtc

SEQ ID NO: 584242 - DNA, 25 bp, Rattus norvegicus
cctgtcattaatagaggctcgggtc

SEQ ID NO: 584243 - DNA, 25 bp, Rattus norvegicus
tgcgccgacccggaaacaccatata

SEQ ID NO: 584244 - DNA, 25 bp, Rattus norvegicus
cagcgccttatatggagtggcccaa

SEQ ID NO: 584245 - DNA, 25 bp, Rattus norvegicus
cgctgttccaatactaggctttcca

SEQ ID NO: 584246 - DNA, 25 bp, Rattus norvegicus
tagtctttcgattctgggtggcgca

SEQ ID NO: 584247 - DNA, 25 bp, Rattus norvegicus
aggcgtgcttcacccgcatcagaga

SEQ ID NO: 584248 - DNA, 25 bp, Rattus norvegicus
gcgctgatcgctctgggttgcagaa

SEQ ID NO: 584249 - DNA, 25 bp, Rattus norvegicus
cctgcaaggtcagaggcgcccatca

SEQ ID NO: 584250 - DNA, 25 bp, Rattus norvegicus
tgtcactggcccatacatggcgctt

SEQ ID NO: 584251 - DNA, 25 bp, Rattus norvegicus
cccttgctcgacatcctttagttgc

SEQ ID NO: 584252 - DNA, 25 bp, Rattus norvegicus
aggaacgccagacaggctgttctcc

SEQ ID NO: 584253 - DNA, 25 bp, Rattus norvegicus
gaccctgccgaggagaggaacgcca

SEQ ID NO: 584254 - DNA, 25 bp, Rattus norvegicus
atacatggcgcttccttcccggcga

SEQ ID NO: 584255 - DNA, 25 bp, Rattus norvegicus
tggagtttccttccctgtcactggc

SEQ ID NO: 584256 - DNA, 25 bp, Rattus norvegicus
accatgtatggtgcttccttcccga

SEQ ID NO: 584257 - DNA, 25 bp, Rattus norvegicus
caggccacgcatctcggagcaaggt

SEQ ID NO: 584258 - DNA, 25 bp, Rattus norvegicus
ctgggattcccagccggctggagca

SEQ ID NO: 584259 - DNA, 25 bp, Rattus norvegicus
atgcgcgcgaccaagctgggattcc

SEQ ID NO: 584260 - DNA, 25 bp, Rattus norvegicus
agggctggagcaccgcctccaagag

SEQ ID NO: 584261 - DNA, 25 bp, Rattus norvegicus
atggggcctctgatctcacttcctc

SEQ ID NO: 584262 - DNA, 25 bp, Rattus norvegicus
ttccctatcggcagcactggggtcg

SEQ ID NO: 584263 - DNA, 25 bp, Rattus norvegicus
cgctttacctaagggcccagtcctg

SEQ ID NO: 584264 - DNA, 25 bp, Rattus norvegicus
ttgcaatccgctcacatggggcctc

SEQ ID NO: 584265 - DNA, 25 bp, Rattus norvegicus
gggccgcctccaagctcttaatgag

SEQ ID NO: 584266 - DNA, 25 bp, Rattus norvegicus
tggctctccgcgtctttgcttacaa

SEQ ID NO: 584267 - DNA, 25 bp, Rattus norvegicus
ctcgctgccttgtgaggtatcggcc

SEQ ID NO: 584268 - DNA, 25 bp, Rattus norvegicus
attccgtggctctcgcgagcatttc

SEQ ID NO: 584269 - DNA, 25 bp, Rattus norvegicus
tgacccgaatggatatctgaagctc

SEQ ID NO: 584270 - DNA, 25 bp, Rattus norvegicus
tctgaagctctacgacgcaaatcta

SEQ ID NO: 584271 - DNA, 25 bp, Rattus norvegicus
gcaaatctagtttctcggacacgta

SEQ ID NO: 584272 - DNA, 25 bp, Rattus norvegicus
ttatcgcttgctgaccgagtgcggc

SEQ ID NO: 584273 - DNA, 25 bp, Rattus norvegicus
ccaggcagctgcatgtgttgcaatc

SEQ ID NO: 584274 - DNA, 25 bp, Rattus norvegicus
cggagacaccaaagaccacagagtt

SEQ ID NO: 584275 - DNA, 25 bp, Rattus norvegicus
gattacagtctccttgcgtcagttg

SEQ ID NO: 584276 - DNA, 25 bp, Rattus norvegicus
gtggctacgcttctggaaccctcca

SEQ ID NO: 584277 - DNA, 25 bp, Rattus norvegicus
gcaaggcctgccttactcgagtcgg

SEQ ID NO: 584278 - DNA, 25 bp, Rattus norvegicus
ggatactccagtgcacgcgaattta

SEQ ID NO: 584279 - DNA, 25 bp, Rattus norvegicus
gctgcagcaatgaagcccgctgttc

SEQ ID NO: 584280 - DNA, 25 bp, Rattus norvegicus
tgaagccctgtagcgcatgtgtaag

SEQ ID NO: 584281 - DNA, 25 bp, Rattus norvegicus
cccggtccttgaggcaggaaagact

SEQ ID NO: 584282 - DNA, 25 bp, Rattus norvegicus
ctttcatcacggcttctggggctgt

SEQ ID NO: 584283 - DNA, 25 bp, Rattus norvegicus
cgcgagcacgctcctcagaatgatc

SEQ ID NO: 584284 - DNA, 25 bp, Rattus norvegicus
gcatggcagctcctcacctggtgac

SEQ ID NO: 584285 - DNA, 25 bp, Rattus norvegicus
aaacttcctgtttgctgctcccgga

SEQ ID NO: 584286 - DNA, 25 bp, Rattus norvegicus
acctagcgtagtgcctgaccagaaa

SEQ ID NO: 584287 - DNA, 25 bp, Rattus norvegicus
ctgttctgctgaggcacctagcgta

SEQ ID NO: 584288 - DNA, 25 bp, Rattus norvegicus
gctccggatttctcctagagtctga

SEQ ID NO: 584289 - DNA, 25 bp, Rattus norvegicus
gctacatattcaccgggcccttcag

SEQ ID NO: 584290 - DNA, 25 bp, Rattus norvegicus
tgagcctccgctacatattcaccgg

SEQ ID NO: 584291 - DNA, 25 bp, Rattus norvegicus
cgcgccgcactgagtgacgcacact

SEQ ID NO: 584292 - DNA, 25 bp, Rattus norvegicus
caagcgcgctacttcccgcgccgca

SEQ ID NO: 584293 - DNA, 25 bp, Rattus norvegicus
ggagcatcaaagtgagcgactggtc

SEQ ID NO: 584294 - DNA, 25 bp, Rattus norvegicus
tccggccgcaggagcatcaaagtga

SEQ ID NO: 584295 - DNA, 25 bp, Rattus norvegicus
gcccttcagccacgccggcccttca

SEQ ID NO: 584296 - DNA, 25 bp, Rattus norvegicus
aaagtgagcgactggtcggagaacc

SEQ ID NO: 584297 - DNA, 25 bp, Rattus norvegicus
cccaggacctacttccggaggacag

SEQ ID NO: 584298 - DNA, 25 bp, Rattus norvegicus
ggcccttcaccttgagaaccctgta

SEQ ID NO: 584299 - DNA, 25 bp, Rattus norvegicus
agaaccctgtagaactggtgctgcc

SEQ ID NO: 584300 - DNA, 25 bp, Rattus norvegicus
tcaccttgagaaccctgtagaactg

SEQ ID NO: 584301 - DNA, 25 bp, Rattus norvegicus
gacctacttccggaggacaggcgga

SEQ ID NO: 584302 - DNA, 25 bp, Rattus norvegicus
atgggcgggcaagaacctggcgaat

SEQ ID NO: 584303 - DNA, 25 bp, Rattus norvegicus
ccgcggctgaaacttggtggtttgc

SEQ ID NO: 584304 - DNA, 25 bp, Rattus norvegicus
gttctccagcgctcttttccttaag

SEQ ID NO: 584305 - DNA, 25 bp, Rattus norvegicus
ggtctccgtgcccaaaggccataca

SEQ ID NO: 584306 - DNA, 25 bp, Rattus norvegicus
ggcgctttagggacgcgattgtttc

SEQ ID NO: 584307 - DNA, 25 bp, Rattus norvegicus
ttcgaggatttgtgtcggccactcc

SEQ ID NO: 584308 - DNA, 25 bp, Rattus norvegicus
cctcactgagggacaaccgcggcgt

SEQ ID NO: 584309 - DNA, 25 bp, Rattus norvegicus
gaggagcggacattccagcccgacc

SEQ ID NO: 584310 - DNA, 25 bp, Rattus norvegicus
gcccgacccatggagaatggaagtc

SEQ ID NO: 584311 - DNA, 25 bp, Rattus norvegicus
aagtcgtagtttcctgttctccagc

SEQ ID NO: 584312 - DNA, 25 bp, Rattus norvegicus
cgttcgccgcaggtaactcttcgta

SEQ ID NO: 584313 - DNA, 25 bp, Rattus norvegicus
cagggcggcccatttcctcctggga

SEQ ID NO: 584314 - DNA, 25 bp, Rattus norvegicus
ggctctccctagaaagcgccggctg

SEQ ID NO: 584315 - DNA, 25 bp, Rattus norvegicus
ctggagttgccaggctaccttccgg

SEQ ID NO: 584316 - DNA, 25 bp, Rattus norvegicus
actttgttcccggagcagggagcgc

SEQ ID NO: 584317 - DNA, 25 bp, Rattus norvegicus
ttcctaagccttggagaacaacgcg

SEQ ID NO: 584318 - DNA, 25 bp, Rattus norvegicus
cagttgtagtggaaggtacgcagcc

SEQ ID NO: 584319 - DNA, 25 bp, Rattus norvegicus
ctagcgcgtgccgaactagaactgg

SEQ ID NO: 584320 - DNA, 25 bp, Rattus norvegicus
cgcgagatttggttctcgttcagtc

SEQ ID NO: 584321 - DNA, 25 bp, Rattus norvegicus
tcccgctcgctgagagaggtatctc

SEQ ID NO: 584322 - DNA, 25 bp, Rattus norvegicus
ctgcgtcttttcagagccggacggc

SEQ ID NO: 584323 - DNA, 25 bp, Rattus norvegicus
ttctgcctccttcggcgctgcgtat

SEQ ID NO: 584324 - DNA, 25 bp, Rattus norvegicus
tcctgcgccctagactcgcagtggg

SEQ ID NO: 584325 - DNA, 25 bp, Rattus norvegicus
agcgttcgaagcctgagggaccgac

SEQ ID NO: 584326 - DNA, 25 bp, Rattus norvegicus
gcctgccatttgaggaggatagtta

SEQ ID NO: 584327 - DNA, 25 bp, Rattus norvegicus
ctaagtaaaagtccgtgggagcgca

SEQ ID NO: 584328 - DNA, 25 bp, Rattus norvegicus
gcaggtcccgtatagtgcgtttgcc

SEQ ID NO: 584329 - DNA, 25 bp, Rattus norvegicus
gcttgcgtgttttgaccaacgtttc

SEQ ID NO: 584330 - DNA, 25 bp, Rattus norvegicus
tgcgtttgccgtttttcctctgaaa

SEQ ID NO: 584331 - DNA, 25 bp, Rattus norvegicus
ttcttgcgttcctcagtcagtcctt

SEQ ID NO: 584332 - DNA, 25 bp, Rattus norvegicus
tttctactcactatgcgcctgcgcg

SEQ ID NO: 584333 - DNA, 25 bp, Rattus norvegicus
ccacttgggcaacaaagctcattgt

SEQ ID NO: 584334 - DNA, 25 bp, Rattus norvegicus
ggtcccgtcagacggaccgtcgtga

SEQ ID NO: 584335 - DNA, 25 bp, Rattus norvegicus
gcactccgagaaggccgaagggatt

SEQ ID NO: 584336 - DNA, 25 bp, Rattus norvegicus
gattaaaagggtcgcctaggctgtg

SEQ ID NO: 584337 - DNA, 25 bp, Rattus norvegicus
ttgacctcggttgttctggcccatt

SEQ ID NO: 584338 - DNA, 25 bp, Rattus norvegicus
tctggcccatttccgccgattttga

SEQ ID NO: 584339 - DNA, 25 bp, Rattus norvegicus
ctatctccgaaatggccgtcgctca

SEQ ID NO: 584340 - DNA, 25 bp, Rattus norvegicus
tgttgccgggatagcactttcttgc

SEQ ID NO: 584341 - DNA, 25 bp, Rattus norvegicus
gtcagccttctatccgggtcttttg

SEQ ID NO: 584342 - DNA, 25 bp, Rattus norvegicus
ccgacaggattcgttggctaccgtc

SEQ ID NO: 584343 - DNA, 25 bp, Rattus norvegicus
gatttcgattgcacagtcagccttc

SEQ ID NO: 584344 - DNA, 25 bp, Rattus norvegicus
agctcgggcaggctacatctatctc

SEQ ID NO: 584345 - DNA, 25 bp, Rattus norvegicus
agatgggcttctcggtctcacaacc

SEQ ID NO: 584346 - DNA, 25 bp, Rattus norvegicus
cctgggcaatcggactccaagtctc

SEQ ID NO: 584347 - DNA, 25 bp, Rattus norvegicus
ccgaatcgctcgctctcggaggcta

SEQ ID NO: 584348 - DNA, 25 bp, Rattus norvegicus
ggggctgttccgttgtatctacatc

SEQ ID NO: 584349 - DNA, 25 bp, Rattus norvegicus
aaggggtccttctgctgacgacttc

SEQ ID NO: 584350 - DNA, 25 bp, Rattus norvegicus
agccgggctactcgttctccaaaca

SEQ ID NO: 584351 - DNA, 25 bp, Rattus norvegicus
tgtcagatgacttcggggctgttcc

SEQ ID NO: 584352 - DNA, 25 bp, Rattus norvegicus
tatctacatctggagagggctgacc

SEQ ID NO: 584353 - DNA, 25 bp, Rattus norvegicus
gggctgaccgtctctgaaggcaata

SEQ ID NO: 584354 - DNA, 25 bp, Rattus norvegicus
ggcgactccagcttctgagttaaac

SEQ ID NO: 584355 - DNA, 25 bp, Rattus norvegicus
acgcaatgccgtcgatgaagcctgg

SEQ ID NO: 584356 - DNA, 25 bp, Rattus norvegicus
agcgacaccctgagtccattgggaa

SEQ ID NO: 584357 - DNA, 25 bp, Rattus norvegicus
aggcattccgatcctcccaggcaga

SEQ ID NO: 584358 - DNA, 25 bp, Rattus norvegicus
aggtttctgggcacacatcgtcatc

SEQ ID NO: 584359 - DNA, 25 bp, Rattus norvegicus
catctcgggccgctgcctgggactg

SEQ ID NO: 584360 - DNA, 25 bp, Rattus norvegicus
ccttcctgtgtaaacggtgtgattt

SEQ ID NO: 584361 - DNA, 25 bp, Rattus norvegicus
attttaagatccacttccgccgccg

SEQ ID NO: 584362 - DNA, 25 bp, Rattus norvegicus
tcgtggtttcgaagcttacttccgc

SEQ ID NO: 584363 - DNA, 25 bp, Rattus norvegicus
cggtgtgattttaagatccacttcc

SEQ ID NO: 584364 - DNA, 25 bp, Rattus norvegicus
ccatgctcagccactgcgggttcgg

SEQ ID NO: 584365 - DNA, 25 bp, Rattus norvegicus
cgccggacctgacgcgtgatggaca

SEQ ID NO: 584366 - DNA, 25 bp, Rattus norvegicus
cgccagctggagacccgctcgtgtt

SEQ ID NO: 584367 - DNA, 25 bp, Rattus norvegicus
ctcggcggcgacttctagtaggttt

SEQ ID NO: 584368 - DNA, 25 bp, Rattus norvegicus
ggctttttattgtcaccttcctgtg

SEQ ID NO: 584369 - DNA, 25 bp, Rattus norvegicus
cttccgtccacagttcgtggtttcg

SEQ ID NO: 584370 - DNA, 25 bp, Rattus norvegicus
tttgtgcgtccctggcccgagccga

SEQ ID NO: 584371 - DNA, 25 bp, Rattus norvegicus
agccacgtggctttttattgtcacc

SEQ ID NO: 584372 - DNA, 25 bp, Rattus norvegicus
gcgacttctagtaggtttccctgtc

SEQ ID NO: 584373 - DNA, 25 bp, Rattus norvegicus
ccggtcgccgaccaatgagaatgcg

SEQ ID NO: 584374 - DNA, 25 bp, Rattus norvegicus
gaatgcgacgccacagagcaccctg

SEQ ID NO: 584375 - DNA, 25 bp, Rattus norvegicus
ccagctcgttggaaatggcctctag

SEQ ID NO: 584376 - DNA, 25 bp, Rattus norvegicus
tctttcaccgagctctgcctgcata

SEQ ID NO: 584377 - DNA, 25 bp, Rattus norvegicus
acccaaggggcgtcgccatcttttg

SEQ ID NO: 584378 - DNA, 25 bp, Rattus norvegicus
cgaaggcgagacacacagatccaga

SEQ ID NO: 584379 - DNA, 25 bp, Rattus norvegicus
atgacgtcccgcagttgatcgaagg

SEQ ID NO: 584380 - DNA, 25 bp, Rattus norvegicus
ggacttcctctgttcgcaaggccga

SEQ ID NO: 584381 - DNA, 25 bp, Rattus norvegicus
cagctggtggatcaattcctcctga

SEQ ID NO: 584382 - DNA, 25 bp, Rattus norvegicus
tgcataccacattcctcagctggtg

SEQ ID NO: 584383 - DNA, 25 bp, Rattus norvegicus
caccctggcaactagggcggggact

SEQ ID NO: 584384 - DNA, 25 bp, Rattus norvegicus
gcgtccagcgcgatctttcaccgag

SEQ ID NO: 584385 - DNA, 25 bp, Rattus norvegicus
aaatggcctctagctgcgtgcctca

SEQ ID NO: 584386 - DNA, 25 bp, Rattus norvegicus
ttcctcctgagattcaatgacgtcc

SEQ ID NO: 584387 - DNA, 25 bp, Rattus norvegicus
tctgtcagcaagtcgactgagcctc

SEQ ID NO: 584388 - DNA, 25 bp, Rattus norvegicus
cacgctggtcattgtagtttagtac

SEQ ID NO: 584389 - DNA, 25 bp, Rattus norvegicus
cattgtagtttagtacgggtgggct

SEQ ID NO: 584390 - DNA, 25 bp, Rattus norvegicus
ggtgggctgcgcgactacaagtccc

SEQ ID NO: 584391 - DNA, 25 bp, Rattus norvegicus
tcaagtcccggaggctgaaagagaa

SEQ ID NO: 584392 - DNA, 25 bp, Rattus norvegicus
gcaagtcgactgagcctctcaagtc

SEQ ID NO: 584393 - DNA, 25 bp, Rattus norvegicus
agggcacgctggtcattgtagttta

SEQ ID NO: 584394 - DNA, 25 bp, Rattus norvegicus
ccgccatatcggttttctgtcagca

SEQ ID NO: 584395 - DNA, 25 bp, Rattus norvegicus
cagagtggccgccatatcggttttc

SEQ ID NO: 584396 - DNA, 25 bp, Rattus norvegicus
accaagtaccttgggtccagcgctc

SEQ ID NO: 584397 - DNA, 25 bp, Rattus norvegicus
ctccagtccgggaccaagtaccttg

SEQ ID NO: 584398 - DNA, 25 bp, Rattus norvegicus
tgatctctccggaacgctgccttgt

SEQ ID NO: 584399 - DNA, 25 bp, Rattus norvegicus
gggcccgcgccgacaatactctgag

SEQ ID NO: 584400 - DNA, 25 bp, Rattus norvegicus
gactgagcctctcaagtcccggagg

SEQ ID NO: 584401 - DNA, 25 bp, Rattus norvegicus
gtggccgctgctatatccaagcctt

SEQ ID NO: 584402 - DNA, 25 bp, Rattus norvegicus
tttcagggacgatcctaattgcccg

SEQ ID NO: 584403 - DNA, 25 bp, Rattus norvegicus
ccactcgctgccctgttttcaggga

SEQ ID NO: 584404 - DNA, 25 bp, Rattus norvegicus
taattgcccggagtgcttcggacca

SEQ ID NO: 584405 - DNA, 25 bp, Rattus norvegicus
ccgcagtatgctcggtcgcagatca

SEQ ID NO: 584406 - DNA, 25 bp, Rattus norvegicus
aagccttcccaagccgcagtatgct

SEQ ID NO: 584407 - DNA, 25 bp, Rattus norvegicus
gaggtagcggctacttctgttttcc

SEQ ID NO: 584408 - DNA, 25 bp, Rattus norvegicus
cccgaagttcaggtgcggagagcca

SEQ ID NO: 584409 - DNA, 25 bp, Rattus norvegicus
gcatagccagaagaggagagcctca

SEQ ID NO: 584410 - DNA, 25 bp, Rattus norvegicus
cacgcgtccgagcatagccagaaga

SEQ ID NO: 584411 - DNA, 25 bp, Rattus norvegicus
cctggcgggctaatcaagtttgacc

SEQ ID NO: 584412 - DNA, 25 bp, Rattus norvegicus
ccttagactttgtagaggtagcggc

SEQ ID NO: 584413 - DNA, 25 bp, Rattus norvegicus
cttcggaccacgagtggccttgcct

SEQ ID NO: 584414 - DNA, 25 bp, Rattus norvegicus
tctctgtcctttacggccttgggga

SEQ ID NO: 584415 - DNA, 25 bp, Rattus norvegicus
acgctggctccgcattgctgatgaa

SEQ ID NO: 584416 - DNA, 25 bp, Rattus norvegicus
ccgccgctgcctacccaccagcttt

SEQ ID NO: 584417 - DNA, 25 bp, Rattus norvegicus
ctttttgggggctggatgcgttcct

SEQ ID NO: 584418 - DNA, 25 bp, Rattus norvegicus
tcctcaggcgcagtatttctttttg

SEQ ID NO: 584419 - DNA, 25 bp, Rattus norvegicus
tgtccctcctcaggcgcagtatttc

SEQ ID NO: 584420 - DNA, 25 bp, Rattus norvegicus
tttgttgtccctcctcaggcgcagt

SEQ ID NO: 584421 - DNA, 25 bp, Rattus norvegicus
tgatgaaacggagccctttgttgtc

SEQ ID NO: 584422 - DNA, 25 bp, Rattus norvegicus
gccgccgggctcctgcatggacaaa

SEQ ID NO: 584423 - DNA, 25 bp, Rattus norvegicus
tggctccgcattgctgatgaaacgg

SEQ ID NO: 584424 - DNA, 25 bp, Rattus norvegicus
tcctgcatggacaaaggggtccttt

SEQ ID NO: 584425 - DNA, 25 bp, Rattus norvegicus
caccagctttccctcccgctcactc

SEQ ID NO: 584426 - DNA, 25 bp, Rattus norvegicus
tcctggcagggctgatgatggatgt

SEQ ID NO: 584427 - DNA, 25 bp, Rattus norvegicus
cattgctgatgaaacggagcccttt

SEQ ID NO: 584428 - DNA, 25 bp, Rattus norvegicus
tcaggcgcagtatttctttttgggg

SEQ ID NO: 584429 - DNA, 25 bp, Rattus norvegicus
tccggggctagcctggatccgggca

SEQ ID NO: 584430 - DNA, 25 bp, Rattus norvegicus
ccgggcagggtgagttgagacgatc

SEQ ID NO: 584431 - DNA, 25 bp, Rattus norvegicus
tgagttgagacgatcgggtgagctg

SEQ ID NO: 584432 - DNA, 25 bp, Rattus norvegicus
cctcccggggaaggaccacattgct

SEQ ID NO: 584433 - DNA, 25 bp, Rattus norvegicus
acattgcttgctagcaggaaggcca

SEQ ID NO: 584434 - DNA, 25 bp, Rattus norvegicus
aaggccagccagaccggaggaggcc

SEQ ID NO: 584435 - DNA, 25 bp, Rattus norvegicus
attgcttgctagcaggaaggccagc

SEQ ID NO: 584436 - DNA, 25 bp, Rattus norvegicus
ccggggaaggaccacattgcttgct

SEQ ID NO: 584437 - DNA, 25 bp, Rattus norvegicus
cggggaaggaccacattgcttgcta

SEQ ID NO: 584438 - DNA, 25 bp, Rattus norvegicus
ggaaggaccacattgcttgctagca

SEQ ID NO: 584439 - DNA, 25 bp, Rattus norvegicus
aaggaccacattgcttgctagcagg

SEQ ID NO: 584440 - DNA, 25 bp, Rattus norvegicus
ggaccacattgcttgctagcaggaa

SEQ ID NO: 584441 - DNA, 25 bp, Rattus norvegicus
ccacattgcttgctagcaggaaggc

SEQ ID NO: 584442 - DNA, 25 bp, Rattus norvegicus
ctccagcgttgggtgttgccggtcc

SEQ ID NO: 584443 - DNA, 25 bp, Rattus norvegicus
agctgccttccggtggtttcagtga

SEQ ID NO: 584444 - DNA, 25 bp, Rattus norvegicus
cccaccagaaggtgatgcttccgtc

SEQ ID NO: 584445 - DNA, 25 bp, Rattus norvegicus
tgactgaactctctccttgtttttg

SEQ ID NO: 584446 - DNA, 25 bp, Rattus norvegicus
ggaccctgactgaactctctccttg

SEQ ID NO: 584447 - DNA, 25 bp, Rattus norvegicus
ggggagcatcttgcaccaggcccac

SEQ ID NO: 584448 - DNA, 25 bp, Rattus norvegicus
ggccacggggagcatcttgcaccag

SEQ ID NO: 584449 - DNA, 25 bp, Rattus norvegicus
ctccgtcattgagccggccacgggg

SEQ ID NO: 584450 - DNA, 25 bp, Rattus norvegicus
ggtaactggccattcgttctccatg

SEQ ID NO: 584451 - DNA, 25 bp, Rattus norvegicus
cagtgatttcagtgacggccgggaa

SEQ ID NO: 584452 - DNA, 25 bp, Rattus norvegicus
aagctgccctctccgtgcaatgtca

SEQ ID NO: 584453 - DNA, 25 bp, Rattus norvegicus
tgcaatgtcacagcccgcgtggtct

SEQ ID NO: 584454 - DNA, 25 bp, Rattus norvegicus
acagcccgcgtggtctccggcaagg

SEQ ID NO: 584455 - DNA, 25 bp, Rattus norvegicus
ttcgggcgaagacaaacggatgcac

SEQ ID NO: 584456 - DNA, 25 bp, Rattus norvegicus
ccttccggtggtttcagtgatttca

SEQ ID NO: 584457 - DNA, 25 bp, Rattus norvegicus
aggcgagtgcaactgggcctcccga

SEQ ID NO: 584458 - DNA, 25 bp, Rattus norvegicus
acgaggcgagtgcaactgggcctcc

SEQ ID NO: 584459 - DNA, 25 bp, Rattus norvegicus
cttcttcccacagaaccgtggaggg

SEQ ID NO: 584460 - DNA, 25 bp, Rattus norvegicus
gccttcttcccacagaaccgtggag

SEQ ID NO: 584461 - DNA, 25 bp, Rattus norvegicus
ggcacgatcacacgggcaagacgct

SEQ ID NO: 584462 - DNA, 25 bp, Rattus norvegicus
cgctcggcacgatcacacgggcaag

SEQ ID NO: 584463 - DNA, 25 bp, Rattus norvegicus
tgtctttcccacatggccccgagtt

SEQ ID NO: 584464 - DNA, 25 bp, Rattus norvegicus
ggcactaatgtctttcccacatggc

SEQ ID NO: 584465 - DNA, 25 bp, Rattus norvegicus
gcggccggcactaatgtctttccca

SEQ ID NO: 584466 - DNA, 25 bp, Rattus norvegicus
cgtgtgagtcaccatttctgggcca

SEQ ID NO: 584467 - DNA, 25 bp, Rattus norvegicus
acgcggagcgtgtgagtcaccattt

SEQ ID NO: 584468 - DNA, 25 bp, Rattus norvegicus
gccaggcctttggtgggctgttcag

SEQ ID NO: 584469 - DNA, 25 bp, Rattus norvegicus
catccgaggcaaggaggctgagagc

SEQ ID NO: 584470 - DNA, 25 bp, Rattus norvegicus
cggcccgcagcatccgaggcaagga

SEQ ID NO: 584471 - DNA, 25 bp, Rattus norvegicus
ccatggtgaccgtgcactataaata

SEQ ID NO: 584472 - DNA, 25 bp, Rattus norvegicus
ggagagctctcagaattccctctta

SEQ ID NO: 584473 - DNA, 25 bp, Rattus norvegicus
tgagagcgctctcctaatcagaacc

SEQ ID NO: 584474 - DNA, 25 bp, Rattus norvegicus
tgccttagtttttccagcctgttta

SEQ ID NO: 584475 - DNA, 25 bp, Rattus norvegicus
ctgggaccctaaatcagctaggctc

SEQ ID NO: 584476 - DNA, 25 bp, Rattus norvegicus
cctgcggagttgtgcaccaaatata

SEQ ID NO: 584477 - DNA, 25 bp, Rattus norvegicus
cctcggcaagagaggcacatgtttc

SEQ ID NO: 584478 - DNA, 25 bp, Rattus norvegicus
gcacatgtttcctagcttggttata

SEQ ID NO: 584479 - DNA, 25 bp, Rattus norvegicus
taggcacgtgttacatggcgcagtc

SEQ ID NO: 584480 - DNA, 25 bp, Rattus norvegicus
ttcccagttgggactcggtagagtc

SEQ ID NO: 584481 - DNA, 25 bp, Rattus norvegicus
tgagcaagctgaggcacacaaaggc

SEQ ID NO: 584482 - DNA, 25 bp, Rattus norvegicus
accacagatttttcgggaccacttg

SEQ ID NO: 584483 - DNA, 25 bp, Rattus norvegicus
ccggcctgttgcaattggtgctgga

SEQ ID NO: 584484 - DNA, 25 bp, Rattus norvegicus
gcgcccaggtgcgacattcccagtt

SEQ ID NO: 584485 - DNA, 25 bp, Rattus norvegicus
caattgtgtgtttcggtctagctcc

SEQ ID NO: 584486 - DNA, 25 bp, Rattus norvegicus
cctcagccttcagggtagggttgga

SEQ ID NO: 584487 - DNA, 25 bp, Rattus norvegicus
ccatctgctcgagtggaacggcttc

SEQ ID NO: 584488 - DNA, 25 bp, Rattus norvegicus
gccgccaaagtttcacagccatctg

SEQ ID NO: 584489 - DNA, 25 bp, Rattus norvegicus
gacccaatttatctcgccgccaaag

SEQ ID NO: 584490 - DNA, 25 bp, Rattus norvegicus
gagaatcccgcccatctgtgtgccg

SEQ ID NO: 584491 - DNA, 25 bp, Rattus norvegicus
ttaaccttcacgcttcaggcctctg

SEQ ID NO: 584492 - DNA, 25 bp, Rattus norvegicus
tcggtctacgctttggtctctcctc

SEQ ID NO: 584493 - DNA, 25 bp, Rattus norvegicus
gcctgtctaggtccttcggtctacg

SEQ ID NO: 584494 - DNA, 25 bp, Rattus norvegicus
gtgtttctgtgtctaaccctccatc

SEQ ID NO: 584495 - DNA, 25 bp, Rattus norvegicus
ccagcgcggggatgttttccaatac

SEQ ID NO: 584496 - DNA, 25 bp, Rattus norvegicus
ggtctagctccgaggttcttccatc

SEQ ID NO: 584497 - DNA, 25 bp, Rattus norvegicus
gcagcttgcacctctgttcgtattt

SEQ ID NO: 584498 - DNA, 25 bp, Rattus norvegicus
gttcgtatttagtccctttgctcca

SEQ ID NO: 584499 - DNA, 25 bp, Rattus norvegicus
tgctagtctgtctcggctccgcggc

SEQ ID NO: 584500 - DNA, 25 bp, Rattus norvegicus
ggtctcatcctccttggcgatgcta

SEQ ID NO: 584501 - DNA, 25 bp, Rattus norvegicus
gtctcatcctccttggcgatgctag

SEQ ID NO: 584502 - DNA, 25 bp, Rattus norvegicus
ctcatcctccttggcgatgctagtc

SEQ ID NO: 584503 - DNA, 25 bp, Rattus norvegicus
tcctccttggcgatgctagtctgtc

SEQ ID NO: 584504 - DNA, 25 bp, Rattus norvegicus
cctccttggcgatgctagtctgtct

SEQ ID NO: 584505 - DNA, 25 bp, Rattus norvegicus
tccttggcgatgctagtctgtctcg

SEQ ID NO: 584506 - DNA, 25 bp, Rattus norvegicus
tggcgatgctagtctgtctcggctc

SEQ ID NO: 584507 - DNA, 25 bp, Rattus norvegicus
gccaccgcatcgagcggctctgatt

SEQ ID NO: 584508 - DNA, 25 bp, Rattus norvegicus
cgatgctagtctgtctcggctccgc

SEQ ID NO: 584509 - DNA, 25 bp, Rattus norvegicus
ggccaccgcatcgagcggctctgat

SEQ ID NO: 584510 - DNA, 25 bp, Rattus norvegicus
ctccttggcgatgctagtctgtctc

SEQ ID NO: 584511 - DNA, 25 bp, Rattus norvegicus
gcgatgctagtctgtctcggctccg

SEQ ID NO: 584512 - DNA, 25 bp, Rattus norvegicus
cttggcgatgctagtctgtctcggc

SEQ ID NO: 584513 - DNA, 25 bp, Rattus norvegicus
cacacgcgtgtggacacttgctctc

SEQ ID NO: 584514 - DNA, 25 bp, Rattus norvegicus
cacgcgtgtggacacttgctctcca

SEQ ID NO: 584515 - DNA, 25 bp, Rattus norvegicus
gcgtgtggacacttgctctccagcc

SEQ ID NO: 584516 - DNA, 25 bp, Rattus norvegicus
cctgaggtcgctgctgtgtccaagc

SEQ ID NO: 584517 - DNA, 25 bp, Rattus norvegicus
aggtcgctgctgtgtccaagcggct

SEQ ID NO: 584518 - DNA, 25 bp, Rattus norvegicus
gtccaagcggctgggcgcatacact

SEQ ID NO: 584519 - DNA, 25 bp, Rattus norvegicus
ggcgcatacactgtgggccagcagc

SEQ ID NO: 584520 - DNA, 25 bp, Rattus norvegicus
cgcatacactgtgggccagcagcgc

SEQ ID NO: 584521 - DNA, 25 bp, Rattus norvegicus
cggtgcagacctcgaagagaacaaa

SEQ ID NO: 584522 - DNA, 25 bp, Rattus norvegicus
tgcagacctcgaagagaacaaaggc

SEQ ID NO: 584523 - DNA, 25 bp, Rattus norvegicus
cagacctcgaagagaacaaaggccg

SEQ ID NO: 584524 - DNA, 25 bp, Rattus norvegicus
tgggcgcatacactgtgggccagca

SEQ ID NO: 584525 - DNA, 25 bp, Rattus norvegicus
ggcacacgcgtgtggacacttgctc

SEQ ID NO: 584526 - DNA, 25 bp, Rattus norvegicus
cgaggcacacgcgtgtggacacttg

SEQ ID NO: 584527 - DNA, 25 bp, Rattus norvegicus
attaatacggcgtcttcgtggtacg

SEQ ID NO: 584528 - DNA, 25 bp, Rattus norvegicus
caggctaaattaatacggcgtcttc

SEQ ID NO: 584529 - DNA, 25 bp, Rattus norvegicus
ctggatagttagtcgcaggctaaat

SEQ ID NO: 584530 - DNA, 25 bp, Rattus norvegicus
ggccaacttgtgcactggatagtta

SEQ ID NO: 584531 - DNA, 25 bp, Rattus norvegicus
caaccctggccaacttgtgcactgg

SEQ ID NO: 584532 - DNA, 25 bp, Rattus norvegicus
tctggatcctgttctcttccgccaa

SEQ ID NO: 584533 - DNA, 25 bp, Rattus norvegicus
tcctgtgctatcctagagcacgcca

SEQ ID NO: 584534 - DNA, 25 bp, Rattus norvegicus
cggtgcctcctgtgctatcctagag

SEQ ID NO: 584535 - DNA, 25 bp, Rattus norvegicus
ccgtgcaggtatccggtgcctcctg

SEQ ID NO: 584536 - DNA, 25 bp, Rattus norvegicus
gtcttcgcttttggccgtgcaggta

SEQ ID NO: 584537 - DNA, 25 bp, Rattus norvegicus
aactcgtgtcgtcttcgcttttggc

SEQ ID NO: 584538 - DNA, 25 bp, Rattus norvegicus
cttgtctgtaccctaactcgtgtcg

SEQ ID NO: 584539 - DNA, 25 bp, Rattus norvegicus
ctcaaccctgcgctgctctggatcc

SEQ ID NO: 584540 - DNA, 25 bp, Rattus norvegicus
ctgtcttcggggttcttgtctgtac

SEQ ID NO: 584541 - DNA, 25 bp, Rattus norvegicus
attcgatgccaatcaggtttgcggc

SEQ ID NO: 584542 - DNA, 25 bp, Rattus norvegicus
ccaatcaggtttgcggctcggaggc

SEQ ID NO: 584543 - DNA, 25 bp, Rattus norvegicus
cgctgagccgcggtaatttccgagt

SEQ ID NO: 584544 - DNA, 25 bp, Rattus norvegicus
gcgctacgctgagccgcggtaattt

SEQ ID NO: 584545 - DNA, 25 bp, Rattus norvegicus
tccggtcacgctgcgctacgctgag

SEQ ID NO: 584546 - DNA, 25 bp, Rattus norvegicus
aacggcctggactgccgctgcgtac

SEQ ID NO: 584547 - DNA, 25 bp, Rattus norvegicus
ccctctttcatgtctgccgcgcctc

SEQ ID NO: 584548 - DNA, 25 bp, Rattus norvegicus
gggtcattaacaacggcctggactg

SEQ ID NO: 584549 - DNA, 25 bp, Rattus norvegicus
tcccgccattatctccctccgccgc

SEQ ID NO: 584550 - DNA, 25 bp, Rattus norvegicus
gcgccgtaattcgatgccaatcagg

SEQ ID NO: 584551 - DNA, 25 bp, Rattus norvegicus
agtcggcgaccgctttgtgtgcacc

SEQ ID NO: 584552 - DNA, 25 bp, Rattus norvegicus
cctcttgctttttattgggtcatta

SEQ ID NO: 584553 - DNA, 25 bp, Rattus norvegicus
ccgcgcgccgtaattcgatgccaat

SEQ ID NO: 584554 - DNA, 25 bp, Rattus norvegicus
gccgcggtaatttccgagtcggcga

SEQ ID NO: 584555 - DNA, 25 bp, Rattus norvegicus
cagcttgaattacggaaagaagttt

SEQ ID NO: 584556 - DNA, 25 bp, Rattus norvegicus
gaccttctggagacggcgattaatc

SEQ ID NO: 584557 - DNA, 25 bp, Rattus norvegicus
tgacgaaatcgtccttttccaaggc

SEQ ID NO: 584558 - DNA, 25 bp, Rattus norvegicus
actgagttaatctgcagtggctgga

SEQ ID NO: 584559 - DNA, 25 bp, Rattus norvegicus
cgggctccctgacgaaatcgtcctt

SEQ ID NO: 584560 - DNA, 25 bp, Rattus norvegicus
tatatcatgtctgcagccgggaggg

SEQ ID NO: 584561 - DNA, 25 bp, Rattus norvegicus
ccatatatcatgtctgcagccggga

SEQ ID NO: 584562 - DNA, 25 bp, Rattus norvegicus
tcgtccttttccaaggcggatgaca

SEQ ID NO: 584563 - DNA, 25 bp, Rattus norvegicus
tcgcggtcacccgtgtcgggacgca

SEQ ID NO: 584564 - DNA, 25 bp, Rattus norvegicus
tgtgggaacaacagcttgaattacg

SEQ ID NO: 584565 - DNA, 25 bp, Rattus norvegicus
acggcgattaatcacgggccgtggc

SEQ ID NO: 584566 - DNA, 25 bp, Rattus norvegicus
tttccaaggcggatgacaggttgtg

SEQ ID NO: 584567 - DNA, 25 bp, Rattus norvegicus
cggatgacaggttgtgggaacaaca

SEQ ID NO: 584568 - DNA, 25 bp, Rattus norvegicus
tgtcgggacgcaccatatatcatgt

SEQ ID NO: 584569 - DNA, 25 bp, Rattus norvegicus
gcctcggctgttgcagctggggcgc

SEQ ID NO: 584570 - DNA, 25 bp, Rattus norvegicus
ctggggcgcgcatgtacgtgtgtgt

SEQ ID NO: 584571 - DNA, 25 bp, Rattus norvegicus
ggcaacgcggcatctcgagcctcgc

SEQ ID NO: 584572 - DNA, 25 bp, Rattus norvegicus
tggcaacgcggcatctcgagcctcg

SEQ ID NO: 584573 - DNA, 25 bp, Rattus norvegicus
atggcaacgcggcatctcgagcctc

SEQ ID NO: 584574 - DNA, 25 bp, Rattus norvegicus
tctccatggcaacgcggcatctcga

SEQ ID NO: 584575 - DNA, 25 bp, Rattus norvegicus
ggatgcggcagcgtctccatggcaa

SEQ ID NO: 584576 - DNA, 25 bp, Rattus norvegicus
caggatgcggcagcgtctccatggc

SEQ ID NO: 584577 - DNA, 25 bp, Rattus norvegicus
tcaggatgcggcagcgtctccatgg

SEQ ID NO: 584578 - DNA, 25 bp, Rattus norvegicus
gtcaggatgcggcagcgtctccatg

SEQ ID NO: 584579 - DNA, 25 bp, Rattus norvegicus
agcagtcaggatgcggcagcgtctc

SEQ ID NO: 584580 - DNA, 25 bp, Rattus norvegicus
ccgttgccaggagcagtcaggatgc

SEQ ID NO: 584581 - DNA, 25 bp, Rattus norvegicus
cccgttgccaggagcagtcaggatg

SEQ ID NO: 584582 - DNA, 25 bp, Rattus norvegicus
ctgcgggaccccgttgccaggagca

SEQ ID NO: 584583 - DNA, 25 bp, Rattus norvegicus
ggcgcacgaacagtctcacggaggt

SEQ ID NO: 584584 - DNA, 25 bp, Rattus norvegicus
gccgtagagctctcgatggccagga

SEQ ID NO: 584585 - DNA, 25 bp, Rattus norvegicus
gttgctgaaccttctacgccgcatc

SEQ ID NO: 584586 - DNA, 25 bp, Rattus norvegicus
acagtctcacggaggtctcagcgta

SEQ ID NO: 584587 - DNA, 25 bp, Rattus norvegicus
ttttccgaagttgctgaaccttcta

SEQ ID NO: 584588 - DNA, 25 bp, Rattus norvegicus
tctcacggaggtctcagcgtagggt

SEQ ID NO: 584589 - DNA, 25 bp, Rattus norvegicus
gccaaggggagaagtactgttgtac

SEQ ID NO: 584590 - DNA, 25 bp, Rattus norvegicus
tttgcgggcccactgaagacgccgt

SEQ ID NO: 584591 - DNA, 25 bp, Rattus norvegicus
aagacgccgtcgtggtttgagctct

SEQ ID NO: 584592 - DNA, 25 bp, Rattus norvegicus
cgccgtcgtggtttgagctctgaga

SEQ ID NO: 584593 - DNA, 25 bp, Rattus norvegicus
agtactgttgtaccgaggctgagtc

SEQ ID NO: 584594 - DNA, 25 bp, Rattus norvegicus
tgtaccgaggctgagtccacgcttt

SEQ ID NO: 584595 - DNA, 25 bp, Rattus norvegicus
tccacgctttgggtgggaccgcatc

SEQ ID NO: 584596 - DNA, 25 bp, Rattus norvegicus
agctctgagagggaacgcgcgccct

SEQ ID NO: 584597 - DNA, 25 bp, Rattus norvegicus
agcgcgtgcggcagtgccttttaaa

SEQ ID NO: 584598 - DNA, 25 bp, Rattus norvegicus
cgcacgtgcagcagcacctttcaaa

SEQ ID NO: 584599 - DNA, 25 bp, Rattus norvegicus
ctttcaaagcgcctcgggtagtacg

SEQ ID NO: 584600 - DNA, 25 bp, Rattus norvegicus
ctggaaacacctcgggtcgcacgtg

SEQ ID NO: 584601 - DNA, 25 bp, Rattus norvegicus
gcggcagcgcctttcgaagaacttt

SEQ ID NO: 584602 - DNA, 25 bp, Rattus norvegicus
tttaaagcacctcggatggctcgtg

SEQ ID NO: 584603 - DNA, 25 bp, Rattus norvegicus
tgcagcagcggctctcaaagcacct

SEQ ID NO: 584604 - DNA, 25 bp, Rattus norvegicus
aaagcacctcgggaagcgcgtgaag

SEQ ID NO: 584605 - DNA, 25 bp, Rattus norvegicus
gcgcgtgaagcagcgcctttcaaag

SEQ ID NO: 584606 - DNA, 25 bp, Rattus norvegicus
aactttgggtagcacgtgcagcagc

SEQ ID NO: 584607 - DNA, 25 bp, Rattus norvegicus
cctcgtgtagcacgtgcagcagcgc

SEQ ID NO: 584608 - DNA, 25 bp, Rattus norvegicus
aagcgcctcgggtagcacgtgaatc

SEQ ID NO: 584609 - DNA, 25 bp, Rattus norvegicus
aaagcacctcgggtcgcacgtgcag

SEQ ID NO: 584610 - DNA, 25 bp, Rattus norvegicus
tcttgaggcgcctcggatagcacgt

SEQ ID NO: 584611 - DNA, 25 bp, Rattus norvegicus
agtagtaagtcctgctgtccgccgc

SEQ ID NO: 584612 - DNA, 25 bp, Rattus norvegicus
aaccgctgctcaacgacagcgagtc

SEQ ID NO: 584613 - DNA, 25 bp, Rattus norvegicus
ctgcgcagccaacccgttgaggcgg

SEQ ID NO: 584614 - DNA, 25 bp, Rattus norvegicus
gcgcactcctgcgtggtctcgtact

SEQ ID NO: 584615 - DNA, 25 bp, Rattus norvegicus
tggtctcgtactcgtcgtcctccgg

SEQ ID NO: 584616 - DNA, 25 bp, Rattus norvegicus
ccgggtagtagtagctgtcgtagct

SEQ ID NO: 584617 - DNA, 25 bp, Rattus norvegicus
ctccgctctcctcggagacgtgagg

SEQ ID NO: 584618 - DNA, 25 bp, Rattus norvegicus
aggaaaggcgtgctctcggccgcca

SEQ ID NO: 584619 - DNA, 25 bp, Rattus norvegicus
ctgacacgtacctgcgggagagaca

SEQ ID NO: 584620 - DNA, 25 bp, Rattus norvegicus
tggctgtccagggagtagtaagtcc

SEQ ID NO: 584621 - DNA, 25 bp, Rattus norvegicus
tggccagcgagtagtggaagtccac

SEQ ID NO: 584622 - DNA, 25 bp, Rattus norvegicus
acgtgatctcgaaagtcggcacctg

SEQ ID NO: 584623 - DNA, 25 bp, Rattus norvegicus
gctgctccgctaggcggtagctgat

SEQ ID NO: 584624 - DNA, 25 bp, Rattus norvegicus
tcgtagctgcgctgcatgtccgctc

SEQ ID NO: 584625 - DNA, 25 bp, Rattus norvegicus
ggagggacgccctcggatctccgct

SEQ ID NO: 584626 - DNA, 25 bp, Rattus norvegicus
gtgtgctagacagcggtctccgtcc

SEQ ID NO: 584627 - DNA, 25 bp, Rattus norvegicus
tagacagcggtctccgtccgtgtcc

SEQ ID NO: 584628 - DNA, 25 bp, Rattus norvegicus
gacgcatgctgcccacttgctgggg

SEQ ID NO: 584629 - DNA, 25 bp, Rattus norvegicus
gggcgcccatcccttgcttaccctg

SEQ ID NO: 584630 - DNA, 25 bp, Rattus norvegicus
cttaccctgacccagccgcgcggat

SEQ ID NO: 584631 - DNA, 25 bp, Rattus norvegicus
gcggatccgctcgaaccgatcgcta

SEQ ID NO: 584632 - DNA, 25 bp, Rattus norvegicus
ggcggcaggtttctctcagcgaaaa

SEQ ID NO: 584633 - DNA, 25 bp, Rattus norvegicus
tctcagcgaaaaggggtttctgggc

SEQ ID NO: 584634 - DNA, 25 bp, Rattus norvegicus
ctttcttccctctcggtgcttcttg

SEQ ID NO: 584635 - DNA, 25 bp, Rattus norvegicus
ggagcgcagcgcctttcttataggc

SEQ ID NO: 584636 - DNA, 25 bp, Rattus norvegicus
cttataggcggtcacaccctccggg

SEQ ID NO: 584637 - DNA, 25 bp, Rattus norvegicus
ggagcggcgagccttaactcttccc

SEQ ID NO: 584638 - DNA, 25 bp, Rattus norvegicus
tgggcgcgccgaggtgccctacctt

SEQ ID NO: 584639 - DNA, 25 bp, Rattus norvegicus
tacgcctggtcctgcacggacttga

SEQ ID NO: 584640 - DNA, 25 bp, Rattus norvegicus
cgagccttctccagtggcggcggca

SEQ ID NO: 584641 - DNA, 25 bp, Rattus norvegicus
tagcaggcgagtgacacaccgaaga

SEQ ID NO: 584642 - DNA, 25 bp, Rattus norvegicus
accacgggtgccttgtacgcctggt

SEQ ID NO: 584643 - DNA, 25 bp, Rattus norvegicus
tctcgggtgctgttagagctggaac

SEQ ID NO: 584644 - DNA, 25 bp, Rattus norvegicus
tgagcagcaaacctgccgcatctgg

SEQ ID NO: 584645 - DNA, 25 bp, Rattus norvegicus
accgaagagcagcatcgagaagccg

SEQ ID NO: 584646 - DNA, 25 bp, Rattus norvegicus
tgcactgctttagtgcccgccttca

SEQ ID NO: 584647 - DNA, 25 bp, Rattus norvegicus
cttgggaggggaaacagagccctct

SEQ ID NO: 584648 - DNA, 25 bp, Rattus norvegicus
ggaagcttggaactgcactgcttta

SEQ ID NO: 584649 - DNA, 25 bp, Rattus norvegicus
gacctagtcaggagcgtggcttctg

SEQ ID NO: 584650 - DNA, 25 bp, Rattus norvegicus
tccctgtgcgccaggacttagagga

SEQ ID NO: 584651 - DNA, 25 bp, Rattus norvegicus
agcgtaacgttagcgcctcgaagcc

SEQ ID NO: 584652 - DNA, 25 bp, Rattus norvegicus
ctgtagctgctgcaccgagccttct

SEQ ID NO: 584653 - DNA, 25 bp, Rattus norvegicus
aggcccttaacgcagagctggcgca

SEQ ID NO: 584654 - DNA, 25 bp, Rattus norvegicus
tctcaaggccaaggtgagaccctcc

SEQ ID NO: 584655 - DNA, 25 bp, Rattus norvegicus
aaggtgagaccctcccgggagatga

SEQ ID NO: 584656 - DNA, 25 bp, Rattus norvegicus
cccgggagatgaaaggctcgctgcc

SEQ ID NO: 584657 - DNA, 25 bp, Rattus norvegicus
aaggctcgctgcctctgagctaggc

SEQ ID NO: 584658 - DNA, 25 bp, Rattus norvegicus
ccgcagtgacgctgaggcccttaac

SEQ ID NO: 584659 - DNA, 25 bp, Rattus norvegicus
agtcatcagacgctccctggggcct

SEQ ID NO: 584660 - DNA, 25 bp, Rattus norvegicus
ctgcggtgttgacgcgccaacggca

SEQ ID NO: 584661 - DNA, 25 bp, Rattus norvegicus
ccaacggcagcgagggcgcgttcac

SEQ ID NO: 584662 - DNA, 25 bp, Rattus norvegicus
gcgttcacgcgtgcgaggcagaaaa

SEQ ID NO: 584663 - DNA, 25 bp, Rattus norvegicus
gttacgcgccgacgtctggctgcca

SEQ ID NO: 584664 - DNA, 25 bp, Rattus norvegicus
cctgcccgctggagcgaaagccaga

SEQ ID NO: 584665 - DNA, 25 bp, Rattus norvegicus
ccagagcgaacgaggccggagccca

SEQ ID NO: 584666 - DNA, 25 bp, Rattus norvegicus
agtagcaccggagcccagtcatcag

SEQ ID NO: 584667 - DNA, 25 bp, Rattus norvegicus
accgggtctcgtctgtctcgtctct

SEQ ID NO: 584668 - DNA, 25 bp, Rattus norvegicus
ccctctccatgtctgtggccgtgga

SEQ ID NO: 584669 - DNA, 25 bp, Rattus norvegicus
tttcctgaagatcgctgaggtgggc

SEQ ID NO: 584670 - DNA, 25 bp, Rattus norvegicus
cgctaagggccgtttcctgaagatc

SEQ ID NO: 584671 - DNA, 25 bp, Rattus norvegicus
ctactctgctgtgctgtgaaggccc

SEQ ID NO: 584672 - DNA, 25 bp, Rattus norvegicus
ctctcccgcagatctcgcgagagtg

SEQ ID NO: 584673 - DNA, 25 bp, Rattus norvegicus
agtcagtgccctgttaccgggtctc

SEQ ID NO: 584674 - DNA, 25 bp, Rattus norvegicus
ggcaccagaactgcgacgcggcgct

SEQ ID NO: 584675 - DNA, 25 bp, Rattus norvegicus
aggctgcttagggtctggccaacag

SEQ ID NO: 584676 - DNA, 25 bp, Rattus norvegicus
cgacttctcaagtcgaggctgctta

SEQ ID NO: 584677 - DNA, 25 bp, Rattus norvegicus
ggcctgatatctgtgctcattacga

SEQ ID NO: 584678 - DNA, 25 bp, Rattus norvegicus
acatcctctctttggggtcactgga

SEQ ID NO: 584679 - DNA, 25 bp, Rattus norvegicus
ccctgctactgtactggggagtcag

SEQ ID NO: 584680 - DNA, 25 bp, Rattus norvegicus
agcatcatggcggaccgagacagcg

SEQ ID NO: 584681 - DNA, 25 bp, Rattus norvegicus
ctggcggccgagtaggccgcatcca

SEQ ID NO: 584682 - DNA, 25 bp, Rattus norvegicus
acacctctaagctggcggccgagta

SEQ ID NO: 584683 - DNA, 25 bp, Rattus norvegicus
tggggtaagacgcttcctttagaga

SEQ ID NO: 584684 - DNA, 25 bp, Rattus norvegicus
ctgagcgggcttttggcgctacctc

SEQ ID NO: 584685 - DNA, 25 bp, Rattus norvegicus
gtgtgcgcctcacagcctgggctct

SEQ ID NO: 584686 - DNA, 25 bp, Rattus norvegicus
agacctccaacctgactctcgtgtg

SEQ ID NO: 584687 - DNA, 25 bp, Rattus norvegicus
gacgcttcctttagagacctccaac

SEQ ID NO: 584688 - DNA, 25 bp, Rattus norvegicus
tcattccgctgcgaaggcggccgcg

SEQ ID NO: 584689 - DNA, 25 bp, Rattus norvegicus
tggacagctcattccgctgcgaagg

SEQ ID NO: 584690 - DNA, 25 bp, Rattus norvegicus
gcccagtgctgctgtggacagctca

SEQ ID NO: 584691 - DNA, 25 bp, Rattus norvegicus
ggcgaagaaagacgcagcttgcctc

SEQ ID NO: 584692 - DNA, 25 bp, Rattus norvegicus
gcccgctgctggagtatgcggctcc

SEQ ID NO: 584693 - DNA, 25 bp, Rattus norvegicus
ggcgctagatactggcgtgacctcg

SEQ ID NO: 584694 - DNA, 25 bp, Rattus norvegicus
gctcctggtgtggtcgcaccgcttc

SEQ ID NO: 584695 - DNA, 25 bp, Rattus norvegicus
gacgagtcgcactggctgtccaatg

SEQ ID NO: 584696 - DNA, 25 bp, Rattus norvegicus
cggatatgaatgtgaaagcgcttac

SEQ ID NO: 584697 - DNA, 25 bp, Rattus norvegicus
agcgcttaccctaacgcggagctca

SEQ ID NO: 584698 - DNA, 25 bp, Rattus norvegicus
cgcggagctcatcttcctggagata

SEQ ID NO: 584699 - DNA, 25 bp, Rattus norvegicus
cctggagatacccaacattcacgtg

SEQ ID NO: 584700 - DNA, 25 bp, Rattus norvegicus
cattcacgtgatgagggagtcactc

SEQ ID NO: 584701 - DNA, 25 bp, Rattus norvegicus
tcacgtatgcaaccaaccgtgtgtc

SEQ ID NO: 584702 - DNA, 25 bp, Rattus norvegicus
gaatacatacgggtaaacgcgtcca

SEQ ID NO: 584703 - DNA, 25 bp, Rattus norvegicus
ctggctggaatacatacgggtaaac

SEQ ID NO: 584704 - DNA, 25 bp, Rattus norvegicus
tgtccaatgtggacgggacgcactg

SEQ ID NO: 584705 - DNA, 25 bp, Rattus norvegicus
gtgtaccctgccatcgacgagtcgc

SEQ ID NO: 584706 - DNA, 25 bp, Rattus norvegicus
agttgaaggaggtcgtgtaccctgc

SEQ ID NO: 584707 - DNA, 25 bp, Rattus norvegicus
gggagtcactccgtaagttgaagga

SEQ ID NO: 584708 - DNA, 25 bp, Rattus norvegicus
gggacgcactggctggaatacatac

SEQ ID NO: 584709 - DNA, 25 bp, Rattus norvegicus
ggacacggtcagcaagcggccgctt

SEQ ID NO: 584710 - DNA, 25 bp, Rattus norvegicus
tgctcgcaaggacccggagagaaac

SEQ ID NO: 584711 - DNA, 25 bp, Rattus norvegicus
gaaacccgcccgagcatgcttggga

SEQ ID NO: 584712 - DNA, 25 bp, Rattus norvegicus
ccctcacgcgttgccagggagatca

SEQ ID NO: 584713 - DNA, 25 bp, Rattus norvegicus
gagatcaggtgactccgggcttcca

SEQ ID NO: 584714 - DNA, 25 bp, Rattus norvegicus
ggtcttcttcagtccggacacggtc

SEQ ID NO: 584715 - DNA, 25 bp, Rattus norvegicus
aagcggccgcttcgtggaacagaga

SEQ ID NO: 584716 - DNA, 25 bp, Rattus norvegicus
ccctaaggaaagagaatctcactgc

SEQ ID NO: 584717 - DNA, 25 bp, Rattus norvegicus
gcggactgagtgtctcccgcagtct

SEQ ID NO: 584718 - DNA, 25 bp, Rattus norvegicus
ctgtctccagggatgtccgccggaa

SEQ ID NO: 584719 - DNA, 25 bp, Rattus norvegicus
cgccggaagctgctggatttcttcc

SEQ ID NO: 584720 - DNA, 25 bp, Rattus norvegicus
ccttaggctgcggtttctgaggctc

SEQ ID NO: 584721 - DNA, 25 bp, Rattus norvegicus
gtttctgaggctccgcggtttctgt

SEQ ID NO: 584722 - DNA, 25 bp, Rattus norvegicus
cgctattagcgtagtcgggtccggt

SEQ ID NO: 584723 - DNA, 25 bp, Rattus norvegicus
gcgaatgaccagcaggtggcgaata

SEQ ID NO: 584724 - DNA, 25 bp, Rattus norvegicus
agcccttgaaggtccgtcaggccaa

SEQ ID NO: 584725 - DNA, 25 bp, Rattus norvegicus
caggtggcgaatacagggtcttacc

SEQ ID NO: 584726 - DNA, 25 bp, Rattus norvegicus
ttttttgggaccaggccagagcagc

SEQ ID NO: 584727 - DNA, 25 bp, Rattus norvegicus
gaggcgctcacattttttgggacca

SEQ ID NO: 584728 - DNA, 25 bp, Rattus norvegicus
gtcaggccaatcagccgcgtgcagc

SEQ ID NO: 584729 - DNA, 25 bp, Rattus norvegicus
gccgcggttagtctgtctgttcaga

SEQ ID NO: 584730 - DNA, 25 bp, Rattus norvegicus
ttgagatcctgtctgggaaccttgc

SEQ ID NO: 584731 - DNA, 25 bp, Rattus norvegicus
ccgatgcctgcttctcgttgagatc

SEQ ID NO: 584732 - DNA, 25 bp, Rattus norvegicus
gatcactttggatgcggcggccgct

SEQ ID NO: 584733 - DNA, 25 bp, Rattus norvegicus
gattccactaggcaccgtccgatgc

SEQ ID NO: 584734 - DNA, 25 bp, Rattus norvegicus
gcggaggacagcgagattccactag

SEQ ID NO: 584735 - DNA, 25 bp, Rattus norvegicus
cctacgcgggtctcggtgcaatcta

SEQ ID NO: 584736 - DNA, 25 bp, Rattus norvegicus
tctgtctgttcagagtcggtccgcg

SEQ ID NO: 584737 - DNA, 25 bp, Rattus norvegicus
gggtgttcacaaccgcctaggccta

SEQ ID NO: 584738 - DNA, 25 bp, Rattus norvegicus
ggaatccgcaccgtgaggctttttg

SEQ ID NO: 584739 - DNA, 25 bp, Rattus norvegicus
tgttccttgccttcccgggatcagc

SEQ ID NO: 584740 - DNA, 25 bp, Rattus norvegicus
agcgacagatctccgtggccaatga

SEQ ID NO: 584741 - DNA, 25 bp, Rattus norvegicus
cgatagtcacagaggctggccaata

SEQ ID NO: 584742 - DNA, 25 bp, Rattus norvegicus
tgaccgacaatatctggcgccaatg

SEQ ID NO: 584743 - DNA, 25 bp, Rattus norvegicus
tactttgctacctcgacgcctcttg

SEQ ID NO: 584744 - DNA, 25 bp, Rattus norvegicus
ttgcaggcgcctggaaatcgcaacc

SEQ ID NO: 584745 - DNA, 25 bp, Rattus norvegicus
gggcttcgctgagactgattgcttc

SEQ ID NO: 584746 - DNA, 25 bp, Rattus norvegicus
cgcgacgtcccgtgacaaaatgacc

SEQ ID NO: 584747 - DNA, 25 bp, Rattus norvegicus
acgcctcttgcatcttggacgcaca

SEQ ID NO: 584748 - DNA, 25 bp, Rattus norvegicus
ctctccaagagcagggttaggtcta

SEQ ID NO: 584749 - DNA, 25 bp, Rattus norvegicus
acttcttgcgggttctcacttcagc

SEQ ID NO: 584750 - DNA, 25 bp, Rattus norvegicus
agtccttttcccgtcacctcagatg

SEQ ID NO: 584751 - DNA, 25 bp, Rattus norvegicus
tgcgggtccctagcggacacagaca

SEQ ID NO: 584752 - DNA, 25 bp, Rattus norvegicus
aggtatccacccatacggactgctc

SEQ ID NO: 584753 - DNA, 25 bp, Rattus norvegicus
atacggactgctctgcacaattggc

SEQ ID NO: 584754 - DNA, 25 bp, Rattus norvegicus
tgcacaattggcgacttcaaatgga

SEQ ID NO: 584755 - DNA, 25 bp, Rattus norvegicus
cttcaaatggagtcaatggttcaga

SEQ ID NO: 584756 - DNA, 25 bp, Rattus norvegicus
aatggttcagagacgcttccctagc

SEQ ID NO: 584757 - DNA, 25 bp, Rattus norvegicus
atcgggtgctaagggattcttctgc

SEQ ID NO: 584758 - DNA, 25 bp, Rattus norvegicus
cgggaaatacagtgatcgggtgcta

SEQ ID NO: 584759 - DNA, 25 bp, Rattus norvegicus
agcccacgacaaggcacacactgtg

SEQ ID NO: 584760 - DNA, 25 bp, Rattus norvegicus
acacactgtggggtatgtcgcctat

SEQ ID NO: 584761 - DNA, 25 bp, Rattus norvegicus
tgggcacgagtgaaacagccacgcg

SEQ ID NO: 584762 - DNA, 25 bp, Rattus norvegicus
cgtggcactggaacgagtgagcaaa

SEQ ID NO: 584763 - DNA, 25 bp, Rattus norvegicus
tgtcgcctatgacgtggcactggaa

SEQ ID NO: 584764 - DNA, 25 bp, Rattus norvegicus
ttccctagcatcgaaggagcccacg

SEQ ID NO: 584765 - DNA, 25 bp, Rattus norvegicus
ccagcagggcagcacgtcatttccg

SEQ ID NO: 584766 - DNA, 25 bp, Rattus norvegicus
aattgtggcgggtcgttccagccgc

SEQ ID NO: 584767 - DNA, 25 bp, Rattus norvegicus
tacagctccgccatctccacttccg

SEQ ID NO: 584768 - DNA, 25 bp, Rattus norvegicus
ccgccagcagggcagcacgtcattt

SEQ ID NO: 584769 - DNA, 25 bp, Rattus norvegicus
gctcaccgggcttcacgtacagctc

SEQ ID NO: 584770 - DNA, 25 bp, Rattus norvegicus
gagagggcgagtaccaccagcccgc

SEQ ID NO: 584771 - DNA, 25 bp, Rattus norvegicus
ccaacggagcatacactggggttta

SEQ ID NO: 584772 - DNA, 25 bp, Rattus norvegicus
gaacccaagagaccaacggagcata

SEQ ID NO: 584773 - DNA, 25 bp, Rattus norvegicus
gaaacgagaccaggaacccaagaga

SEQ ID NO: 584774 - DNA, 25 bp, Rattus norvegicus
tgtgtgaaacgagaccaggaaccca

SEQ ID NO: 584775 - DNA, 25 bp, Rattus norvegicus
cgaagaagtgtgtgaaacgagacca

SEQ ID NO: 584776 - DNA, 25 bp, Rattus norvegicus
ttgttgcctgcgaaggcgaagaagt

SEQ ID NO: 584777 - DNA, 25 bp, Rattus norvegicus
ccgcgttccttgttgcctgcgaagg

SEQ ID NO: 584778 - DNA, 25 bp, Rattus norvegicus
cgggtcgttccagccgcgttccttg

SEQ ID NO: 584779 - DNA, 25 bp, Rattus norvegicus
caccagggcgcgaatgagatcatcc

SEQ ID NO: 584780 - DNA, 25 bp, Rattus norvegicus
gactggcctgcgttctcagcccaag

SEQ ID NO: 584781 - DNA, 25 bp, Rattus norvegicus
gcgcaaacaaacactgggcgggata

SEQ ID NO: 584782 - DNA, 25 bp, Rattus norvegicus
tgagctgcctgtgcgtctggtttcc

SEQ ID NO: 584783 - DNA, 25 bp, Rattus norvegicus
ctggtttcccgagtcctcgcgtgtt

SEQ ID NO: 584784 - DNA, 25 bp, Rattus norvegicus
tgtttcggtgcgtgtgtcctacgaa

SEQ ID NO: 584785 - DNA, 25 bp, Rattus norvegicus
tcctacgaagcgtactgacacgatg

SEQ ID NO: 584786 - DNA, 25 bp, Rattus norvegicus
ctgacacgatgaactccgcaccggt

SEQ ID NO: 584787 - DNA, 25 bp, Rattus norvegicus
ctccgcaccggtcggtaactaagag

SEQ ID NO: 584788 - DNA, 25 bp, Rattus norvegicus
cctccgacggcggaagaccggcaag

SEQ ID NO: 584789 - DNA, 25 bp, Rattus norvegicus
ccggcaaggagaacgtgcacactgt

SEQ ID NO: 584790 - DNA, 25 bp, Rattus norvegicus
gggccaactggcaccgcgcaaacaa

SEQ ID NO: 584791 - DNA, 25 bp, Rattus norvegicus
gcacactgtgcaccagggcgcgaat

SEQ ID NO: 584792 - DNA, 25 bp, Rattus norvegicus
catccggtggagcatgagatcatca

SEQ ID NO: 584793 - DNA, 25 bp, Rattus norvegicus
ctttagaaggtactccaggctgcga

SEQ ID NO: 584794 - DNA, 25 bp, Rattus norvegicus
ccagatttgcttccgtgtccacacg

SEQ ID NO: 584795 - DNA, 25 bp, Rattus norvegicus
gcggaccgcacagtaagcctcttca

SEQ ID NO: 584796 - DNA, 25 bp, Rattus norvegicus
atagaatctgagtaggaacccgcgc

SEQ ID NO: 584797 - DNA, 25 bp, Rattus norvegicus
cacacgcagggttccgaatagaatc

SEQ ID NO: 584798 - DNA, 25 bp, Rattus norvegicus
gccagaatatccgagcacacgcagg

SEQ ID NO: 584799 - DNA, 25 bp, Rattus norvegicus
caggtatccgttgttgcccacgaca

SEQ ID NO: 584800 - DNA, 25 bp, Rattus norvegicus
gcgcagcgctaaaacttggagggtc

SEQ ID NO: 584801 - DNA, 25 bp, Rattus norvegicus
ctgcagttctgcgagccaggtatcc

SEQ ID NO: 584802 - DNA, 25 bp, Rattus norvegicus
caggctttagccactgctgcagttc

SEQ ID NO: 584803 - DNA, 25 bp, Rattus norvegicus
ggaagacgccgacctgtttgcaaga

SEQ ID NO: 584804 - DNA, 25 bp, Rattus norvegicus
tcctttctcgcccaactcagggttg

SEQ ID NO: 584805 - DNA, 25 bp, Rattus norvegicus
acagagggccgagatcagtcctttc

SEQ ID NO: 584806 - DNA, 25 bp, Rattus norvegicus
tttcaagagtcagttcccggaggcc

SEQ ID NO: 584807 - DNA, 25 bp, Rattus norvegicus
tggttttgtccagcgcctgcgcagt

SEQ ID NO: 584808 - DNA, 25 bp, Rattus norvegicus
gtgtaccgcctagcttaattgagtc

SEQ ID NO: 584809 - DNA, 25 bp, Rattus norvegicus
agccgagtgtgtaccgcctagctta

SEQ ID NO: 584810 - DNA, 25 bp, Rattus norvegicus
ccctggctcggagccgagtgtgtac

SEQ ID NO: 584811 - DNA, 25 bp, Rattus norvegicus
aagccaggggaaatgcaaatgtggc

SEQ ID NO: 584812 - DNA, 25 bp, Rattus norvegicus
acgaggaagccaggggaaatgcaaa

SEQ ID NO: 584813 - DNA, 25 bp, Rattus norvegicus
ttttttggctgcaagatgtggggtc

SEQ ID NO: 584814 - DNA, 25 bp, Rattus norvegicus
tgcgccgggagtgactttttcttct

SEQ ID NO: 584815 - DNA, 25 bp, Rattus norvegicus
ccgtagccgccgatctctaggattt

SEQ ID NO: 584816 - DNA, 25 bp, Rattus norvegicus
attgagtcgttcctctgccaccagc

SEQ ID NO: 584817 - DNA, 25 bp, Rattus norvegicus
ccgcctagcttaattgagtcgttcc

SEQ ID NO: 584818 - DNA, 25 bp, Rattus norvegicus
ttcttctggttttgtccagcgcctg

SEQ ID NO: 584819 - DNA, 25 bp, Rattus norvegicus
tagccgccgatctctaggatttttt

SEQ ID NO: 584820 - DNA, 25 bp, Rattus norvegicus
tcctctgccaccagccctgcggaag

SEQ ID NO: 584821 - DNA, 25 bp, Rattus norvegicus
ccacgtaccgttgctggatgaaatc

SEQ ID NO: 584822 - DNA, 25 bp, Rattus norvegicus
tgtcgccgctgttttgttgaggata

SEQ ID NO: 584823 - DNA, 25 bp, Rattus norvegicus
gctttcgtggtgcattgtggataaa

SEQ ID NO: 584824 - DNA, 25 bp, Rattus norvegicus
gcacggaaggcaaagctctgtcgca

SEQ ID NO: 584825 - DNA, 25 bp, Rattus norvegicus
ggggcgggacaaatcttagcaatta

SEQ ID NO: 584826 - DNA, 25 bp, Rattus norvegicus
accctctagtctccgtcatcgattg

SEQ ID NO: 584827 - DNA, 25 bp, Rattus norvegicus
atcggaccaatagcgaccctctagt

SEQ ID NO: 584828 - DNA, 25 bp, Rattus norvegicus
ggagcacccaatcacggcctttcag

SEQ ID NO: 584829 - DNA, 25 bp, Rattus norvegicus
ttgcaccgactactcggcttgcggc

SEQ ID NO: 584830 - DNA, 25 bp, Rattus norvegicus
cgcagtacctgctttgcaccgacta

SEQ ID NO: 584831 - DNA, 25 bp, Rattus norvegicus
ctggggaacgctggcataagtgaat

SEQ ID NO: 584832 - DNA, 25 bp, Rattus norvegicus
ctccggaggtcaaggtcagagctcc

SEQ ID NO: 584833 - DNA, 25 bp, Rattus norvegicus
tcgctagcgggcaaaggtacacact

SEQ ID NO: 584834 - DNA, 25 bp, Rattus norvegicus
tatttcgcgattgctggcgctgaga

SEQ ID NO: 584835 - DNA, 25 bp, Rattus norvegicus
gtcctgcagaggactcaaacaatga

SEQ ID NO: 584836 - DNA, 25 bp, Rattus norvegicus
cctggcgttccatccgactcgagat

SEQ ID NO: 584837 - DNA, 25 bp, Rattus norvegicus
agccagtggcctggcgttccatccg

SEQ ID NO: 584838 - DNA, 25 bp, Rattus norvegicus
tgctggaagcgccagccagtggcct

SEQ ID NO: 584839 - DNA, 25 bp, Rattus norvegicus
cagaagacatcgtgctggaagcgcc

SEQ ID NO: 584840 - DNA, 25 bp, Rattus norvegicus
gactcaaacaatgaagaagaccttg

SEQ ID NO: 584841 - DNA, 25 bp, Rattus norvegicus
ccacgtgtcaagagagtcctgcaga

SEQ ID NO: 584842 - DNA, 25 bp, Rattus norvegicus
cccagcgcgcgtagatcctatggac

SEQ ID NO: 584843 - DNA, 25 bp, Rattus norvegicus
ggaagcaactacttaggccacgccc

SEQ ID NO: 584844 - DNA, 25 bp, Rattus norvegicus
gcctactcgcggaagcaactactta

SEQ ID NO: 584845 - DNA, 25 bp, Rattus norvegicus
ttccgatccggcctactcgcggaag

SEQ ID NO: 584846 - DNA, 25 bp, Rattus norvegicus
tgacgtcctcccagtgcacttccga

SEQ ID NO: 584847 - DNA, 25 bp, Rattus norvegicus
agaccttgactccacgaaggcagca

SEQ ID NO: 584848 - DNA, 25 bp, Rattus norvegicus
atccgactcgagatctgctggcagc

SEQ ID NO: 584849 - DNA, 25 bp, Rattus norvegicus
caagcagtaacgcacgtcggttcaa

SEQ ID NO: 584850 - DNA, 25 bp, Rattus norvegicus
aacgcacgtcggttcaagctaagag

SEQ ID NO: 584851 - DNA, 25 bp, Rattus norvegicus
taacgcacgtcggttcaagctaaga

SEQ ID NO: 584852 - DNA, 25 bp, Rattus norvegicus
agtaacgcacgtcggttcaagctaa

SEQ ID NO: 584853 - DNA, 25 bp, Rattus norvegicus
gttgcagggcaagcagtaacgcacg

SEQ ID NO: 584854 - DNA, 25 bp, Rattus norvegicus
ttgcagggcaagcagtaacgcacgt

SEQ ID NO: 584855 - DNA, 25 bp, Rattus norvegicus
tgcagggcaagcagtaacgcacgtc

SEQ ID NO: 584856 - DNA, 25 bp, Rattus norvegicus
gcagggcaagcagtaacgcacgtcg

SEQ ID NO: 584857 - DNA, 25 bp, Rattus norvegicus
cagggcaagcagtaacgcacgtcgg

SEQ ID NO: 584858 - DNA, 25 bp, Rattus norvegicus
agggcaagcagtaacgcacgtcggt

SEQ ID NO: 584859 - DNA, 25 bp, Rattus norvegicus
cagtaacgcacgtcggttcaagcta

SEQ ID NO: 584860 - DNA, 25 bp, Rattus norvegicus
ggcaagcagtaacgcacgtcggttc

SEQ ID NO: 584861 - DNA, 25 bp, Rattus norvegicus
agcagtaacgcacgtcggttcaagc

SEQ ID NO: 584862 - DNA, 25 bp, Rattus norvegicus
cggttgcagggcaagcagtaacgca

SEQ ID NO: 584863 - DNA, 25 bp, Rattus norvegicus
accaggagctggcaagaaggccgca

SEQ ID NO: 584864 - DNA, 25 bp, Rattus norvegicus
catcctgcggtagtcgtccgataaa

SEQ ID NO: 584865 - DNA, 25 bp, Rattus norvegicus
tcgtacacatcctgcggtagtcgtc

SEQ ID NO: 584866 - DNA, 25 bp, Rattus norvegicus
tgctcgtacacatcctgcggtagtc

SEQ ID NO: 584867 - DNA, 25 bp, Rattus norvegicus
tggtgctcgtacacatcctgcggta

SEQ ID NO: 584868 - DNA, 25 bp, Rattus norvegicus
ctaaaggtcatcattaggcggaact

SEQ ID NO: 584869 - DNA, 25 bp, Rattus norvegicus
caggccactaaaggtcatcattagg

SEQ ID NO: 584870 - DNA, 25 bp, Rattus norvegicus
agccgcggttcaggccactaaaggt

SEQ ID NO: 584871 - DNA, 25 bp, Rattus norvegicus
caaagccgcggttcaggccactaaa

SEQ ID NO: 584872 - DNA, 25 bp, Rattus norvegicus
ctggtggttgtgcagcgtagcaatg

SEQ ID NO: 584873 - DNA, 25 bp, Rattus norvegicus
cataccaggagctggcaagaaggcc

SEQ ID NO: 584874 - DNA, 25 bp, Rattus norvegicus
tcagctcgcacttctcggtacttcg

SEQ ID NO: 584875 - DNA, 25 bp, Rattus norvegicus
cgtcagctcgcacttctcggtactt

SEQ ID NO: 584876 - DNA, 25 bp, Rattus norvegicus
cgcgccgtgagctgtagcgcgcata

SEQ ID NO: 584877 - DNA, 25 bp, Rattus norvegicus
gatcgcaattttggatcacctgtac

SEQ ID NO: 584878 - DNA, 25 bp, Rattus norvegicus
tcccttcggcattcgagtttaacga

SEQ ID NO: 584879 - DNA, 25 bp, Rattus norvegicus
cgggcgtactgcgaaatccacgtgt

SEQ ID NO: 584880 - DNA, 25 bp, Rattus norvegicus
caactgcgagcagcagcgtgtcaga

SEQ ID NO: 584881 - DNA, 25 bp, Rattus norvegicus
agcgcaggtcacagcgcgcttcaca

SEQ ID NO: 584882 - DNA, 25 bp, Rattus norvegicus
cgcttcacagcgcacgtcatagcta

SEQ ID NO: 584883 - DNA, 25 bp, Rattus norvegicus
gcacgtcatagctattccgggcgta

SEQ ID NO: 584884 - DNA, 25 bp, Rattus norvegicus
ctattccgggcgtactgcgaaatcc

SEQ ID NO: 584885 - DNA, 25 bp, Rattus norvegicus
gtttcagttcccttcggcattcgag

SEQ ID NO: 584886 - DNA, 25 bp, Rattus norvegicus
gcctcttcgggaccttcctgtgcaa

SEQ ID NO: 584887 - DNA, 25 bp, Rattus norvegicus
gggaccttcctgtgcaactgcgagc

SEQ ID NO: 584888 - DNA, 25 bp, Rattus norvegicus
ctgcgaaatccacgtgtgtccctcg

SEQ ID NO: 584889 - DNA, 25 bp, Rattus norvegicus
ttaacgagttgttcctgatcgcaat

SEQ ID NO: 584890 - DNA, 25 bp, Rattus norvegicus
cgagtttaacgagttgttcctgatc

SEQ ID NO: 584891 - DNA, 25 bp, Rattus norvegicus
agcgtgagataatcggagttccacc

SEQ ID NO: 584892 - DNA, 25 bp, Rattus norvegicus
gctctccgtagccttcctgaaatcg

SEQ ID NO: 584893 - DNA, 25 bp, Rattus norvegicus
cggagttccaccatccggactaact

SEQ ID NO: 584894 - DNA, 25 bp, Rattus norvegicus
cggactaactccgagctcaggcgtt

SEQ ID NO: 584895 - DNA, 25 bp, Rattus norvegicus
ctcaggcgtttccagctctccgtag

SEQ ID NO: 584896 - DNA, 25 bp, Rattus norvegicus
ctggctaaggtggagaagacacttc

SEQ ID NO: 584897 - DNA, 25 bp, Rattus norvegicus
tcctgaaatcggactggtctcattc

SEQ ID NO: 584898 - DNA, 25 bp, Rattus norvegicus
tggtctcattcccagtcccttgacg

SEQ ID NO: 584899 - DNA, 25 bp, Rattus norvegicus
ccagtcccttgacgtctgttccaga

SEQ ID NO: 584900 - DNA, 25 bp, Rattus norvegicus
tctgttccagaaagccggcgtcctg

SEQ ID NO: 584901 - DNA, 25 bp, Rattus norvegicus
gccggcgtcctgttgcacaaatgcc

SEQ ID NO: 584902 - DNA, 25 bp, Rattus norvegicus
gtcggctgtcatagccaggtgagcc

SEQ ID NO: 584903 - DNA, 25 bp, Rattus norvegicus
ttcgtgcctagagcgtatctggcta

SEQ ID NO: 584904 - DNA, 25 bp, Rattus norvegicus
gacctgggctgcactactcggccaa

SEQ ID NO: 584905 - DNA, 25 bp, Rattus norvegicus
atcgctccagtcttaacgcagttag

SEQ ID NO: 584906 - DNA, 25 bp, Rattus norvegicus
ggtgcccttacttccgtgttgcttc

SEQ ID NO: 584907 - DNA, 25 bp, Rattus norvegicus
tgcgaggctcgaatcttattggagc

SEQ ID NO: 584908 - DNA, 25 bp, Rattus norvegicus
acggcttcccattcacttcgctgtg

SEQ ID NO: 584909 - DNA, 25 bp, Rattus norvegicus
cgcctgcgccatctccttggagtag

SEQ ID NO: 584910 - DNA, 25 bp, Rattus norvegicus
gggccaacagggctgccttagaatc

SEQ ID NO: 584911 - DNA, 25 bp, Rattus norvegicus
gggctgccttagaatcgctccagtc

SEQ ID NO: 584912 - DNA, 25 bp, Rattus norvegicus
cttcgctgtgaagatggcgtctggc

SEQ ID NO: 584913 - DNA, 25 bp, Rattus norvegicus
ttaacgcagttagaatgcgaggctc

SEQ ID NO: 584914 - DNA, 25 bp, Rattus norvegicus
cttattggagcgtgatcttgccttc

SEQ ID NO: 584915 - DNA, 25 bp, Rattus norvegicus
ccttctggctccagggcgcgtttta

SEQ ID NO: 584916 - DNA, 25 bp, Rattus norvegicus
ctccagggcgcgttttacggcattt

SEQ ID NO: 584917 - DNA, 25 bp, Rattus norvegicus
tacggcattttacggcttcccattc

SEQ ID NO: 584918 - DNA, 25 bp, Rattus norvegicus
gcttcatactccttttgcgcctgcg

SEQ ID NO: 584919 - DNA, 25 bp, Rattus norvegicus
ctgcagccgggtcactaacagtgtg

SEQ ID NO: 584920 - DNA, 25 bp, Rattus norvegicus
ttaaccgcccgagggcggctgagca

SEQ ID NO: 584921 - DNA, 25 bp, Rattus norvegicus
gaacctgggtatgcggacgctcact

SEQ ID NO: 584922 - DNA, 25 bp, Rattus norvegicus
tctgcctcggactcctccaaggtga

SEQ ID NO: 584923 - DNA, 25 bp, Rattus norvegicus
gacgctcactggagccagggaagtc

SEQ ID NO: 584924 - DNA, 25 bp, Rattus norvegicus
ctgcgctgaacctgcgcctgtggct

SEQ ID NO: 584925 - DNA, 25 bp, Rattus norvegicus
ggctgcgaacaggtcccagtcttaa

SEQ ID NO: 584926 - DNA, 25 bp, Rattus norvegicus
ccagtcttaagtctacggtgcggga

SEQ ID NO: 584927 - DNA, 25 bp, Rattus norvegicus
cggtgcgggatgaaatgcatcctta

SEQ ID NO: 584928 - DNA, 25 bp, Rattus norvegicus
gcatccttagtctggatccttcagg

SEQ ID NO: 584929 - DNA, 25 bp, Rattus norvegicus
ggatccttcaggtccttactcagtc

SEQ ID NO: 584930 - DNA, 25 bp, Rattus norvegicus
ggtcccgatcctccagcgtgaatca

SEQ ID NO: 584931 - DNA, 25 bp, Rattus norvegicus
ttgggtgcgcacttcccgacgcctt

SEQ ID NO: 584932 - DNA, 25 bp, Rattus norvegicus
acgccttgcgtctgcactggagatc

SEQ ID NO: 584933 - DNA, 25 bp, Rattus norvegicus
gtcaagtatatgtatccaggaagtg

SEQ ID NO: 584934 - DNA, 25 bp, Rattus norvegicus
gaaggactcaatggccggaacggaa

SEQ ID NO: 584935 - DNA, 25 bp, Rattus norvegicus
acggaatccgattggtctgttacca

SEQ ID NO: 584936 - DNA, 25 bp, Rattus norvegicus
ctgttaccacagaactttcaaagta

SEQ ID NO: 584937 - DNA, 25 bp, Rattus norvegicus
attcgtatgacgtaggtttctcgca

SEQ ID NO: 584938 - DNA, 25 bp, Rattus norvegicus
ggtttctcgcacagtcaagtatatg

SEQ ID NO: 584939 - DNA, 25 bp, Rattus norvegicus
cgggccagctttagctcagcggtta

SEQ ID NO: 584940 - DNA, 25 bp, Rattus norvegicus
ggttacttcgacgtgctccagtttg

SEQ ID NO: 584941 - DNA, 25 bp, Rattus norvegicus
ctccagtttgagcaggctatgtaac

SEQ ID NO: 584942 - DNA, 25 bp, Rattus norvegicus
ctatgtaacgtggtcggttcgagca

SEQ ID NO: 584943 - DNA, 25 bp, Rattus norvegicus
ctagatgagggaagtgctctgcacc

SEQ ID NO: 584944 - DNA, 25 bp, Rattus norvegicus
cagccgcttgcctatctggtgagtg

SEQ ID NO: 584945 - DNA, 25 bp, Rattus norvegicus
aggttacccactgcggactagatga

SEQ ID NO: 584946 - DNA, 25 bp, Rattus norvegicus
ttcgagcaacacaaccagccgcttg

SEQ ID NO: 584947 - DNA, 25 bp, Rattus norvegicus
tctctggtggaaagcagtccgattc

SEQ ID NO: 584948 - DNA, 25 bp, Rattus norvegicus
cgagcgcttgctatcgagttacgta

SEQ ID NO: 584949 - DNA, 25 bp, Rattus norvegicus
cgagttacgtatctgtgcacgcgga

SEQ ID NO: 584950 - DNA, 25 bp, Rattus norvegicus
attaactggcgcagtgggttcccgg

SEQ ID NO: 584951 - DNA, 25 bp, Rattus norvegicus
gcagtccgattcagaaagcctcttt

SEQ ID NO: 584952 - DNA, 25 bp, Rattus norvegicus
acggctaccgtgttggtatctctgg

SEQ ID NO: 584953 - DNA, 25 bp, Rattus norvegicus
aatgctgactgctacggctaccgtg

SEQ ID NO: 584954 - DNA, 25 bp, Rattus norvegicus
ggaccatggagagccaatgctgact

SEQ ID NO: 584955 - DNA, 25 bp, Rattus norvegicus
cagcgtctcttggtcctggtaaagg

SEQ ID NO: 584956 - DNA, 25 bp, Rattus norvegicus
cgatgtttcacgacagcgtctcttg

SEQ ID NO: 584957 - DNA, 25 bp, Rattus norvegicus
ctccctagatgaggtcgatgtttca

SEQ ID NO: 584958 - DNA, 25 bp, Rattus norvegicus
acctcctactggtggtgcacgcaac

SEQ ID NO: 584959 - DNA, 25 bp, Rattus norvegicus
atatgtggtgacgaaagtgcgcgca

SEQ ID NO: 584960 - DNA, 25 bp, Rattus norvegicus
gcctctttgccggtattaactggcg

SEQ ID NO: 584961 - DNA, 25 bp, Rattus norvegicus
atgcacaggagaacgcgttggtgtt

SEQ ID NO: 584962 - DNA, 25 bp, Rattus norvegicus
cgcgttggtgttttactcgttggtg

SEQ ID NO: 584963 - DNA, 25 bp, Rattus norvegicus
tttggaccgggaaaccacagctgag

SEQ ID NO: 584964 - DNA, 25 bp, Rattus norvegicus
agctgagtataaggtaatggtgaca

SEQ ID NO: 584965 - DNA, 25 bp, Rattus norvegicus
ttcgctgcaggccacagctaccatt

SEQ ID NO: 584966 - DNA, 25 bp, Rattus norvegicus
gcaggccacagctaccatttctgtg

SEQ ID NO: 584967 - DNA, 25 bp, Rattus norvegicus
acagctaccatttctgtggaggtgg

SEQ ID NO: 584968 - DNA, 25 bp, Rattus norvegicus
gctgacgtgaacgataatgcgcctc

SEQ ID NO: 584969 - DNA, 25 bp, Rattus norvegicus
cgtgaacgataatgcgcctctgttc

SEQ ID NO: 584970 - DNA, 25 bp, Rattus norvegicus
atgcgcctctgttcgcgcagcctga

SEQ ID NO: 584971 - DNA, 25 bp, Rattus norvegicus
acccggcgcacacatctttacagtg

SEQ ID NO: 584972 - DNA, 25 bp, Rattus norvegicus
ggaaaccacagctgagtataaggta

SEQ ID NO: 584973 - DNA, 25 bp, Rattus norvegicus
tgcagatgcacaggagaacgcgttg

SEQ ID NO: 584974 - DNA, 25 bp, Rattus norvegicus
acatctttacagtgtcggcggtgga

SEQ ID NO: 584975 - DNA, 25 bp, Rattus norvegicus
gaatctgtttatttctgaatctcga

SEQ ID NO: 584976 - DNA, 25 bp, Rattus norvegicus
agggcgcatcagatgcagacatcgg

SEQ ID NO: 584977 - DNA, 25 bp, Rattus norvegicus
gattttcgctagagggcgcatcaga

SEQ ID NO: 584978 - DNA, 25 bp, Rattus norvegicus
cccgattttcgctagagggcgcatc

SEQ ID NO: 584979 - DNA, 25 bp, Rattus norvegicus
agcttggctcccgattttcgctaga

SEQ ID NO: 584980 - DNA, 25 bp, Rattus norvegicus
tgaatctcgacagcttggctcccga

SEQ ID NO: 584981 - DNA, 25 bp, Rattus norvegicus
tttctgaatctcgacagcttggctc

SEQ ID NO: 584982 - DNA, 25 bp, Rattus norvegicus
ccagcggcctccaagaatctgttta

SEQ ID NO: 584983 - DNA, 25 bp, Rattus norvegicus
ccagtatttccagcggcctccaaga

SEQ ID NO: 584984 - DNA, 25 bp, Rattus norvegicus
gacaacccgccagtatttccagcgg

SEQ ID NO: 584985 - DNA, 25 bp, Rattus norvegicus
tgcggagtgtagcatccacttggag

SEQ ID NO: 584986 - DNA, 25 bp, Rattus norvegicus
aggagtgcggagtgtagcatccact

SEQ ID NO: 584987 - DNA, 25 bp, Rattus norvegicus
tcgacagcttggctcccgattttcg

SEQ ID NO: 584988 - DNA, 25 bp, Rattus norvegicus
cggcctccaagaatctgtttatttc

SEQ ID NO: 584989 - DNA, 25 bp, Rattus norvegicus
gcagtggacgtcttcccttccgcgt

SEQ ID NO: 584990 - DNA, 25 bp, Rattus norvegicus
gtgtcacggacagtgagttcaggac

SEQ ID NO: 584991 - DNA, 25 bp, Rattus norvegicus
acagcgcctattagtgttggtgagg

SEQ ID NO: 584992 - DNA, 25 bp, Rattus norvegicus
cccgcgacagcgcctattagtgttg

SEQ ID NO: 584993 - DNA, 25 bp, Rattus norvegicus
gatgaaacagatgccccgcgacagc

SEQ ID NO: 584994 - DNA, 25 bp, Rattus norvegicus
acacgtgtcctggatgaaacagatg

SEQ ID NO: 584995 - DNA, 25 bp, Rattus norvegicus
acgtcttcccttccgcgtgggtctg

SEQ ID NO: 584996 - DNA, 25 bp, Rattus norvegicus
cagcgggcagtggacgtcttccctt

SEQ ID NO: 584997 - DNA, 25 bp, Rattus norvegicus
gttcaggacacgtggtgacaaaggt

SEQ ID NO: 584998 - DNA, 25 bp, Rattus norvegicus
cagtgagttcaggacacgtggtgac

SEQ ID NO: 584999 - DNA, 25 bp, Rattus norvegicus
acggacagtgagttcaggacacgtg

SEQ ID NO: 585000 - DNA, 25 bp, Rattus norvegicus
tcacggacagtgagttcaggacacg

SEQ ID NO: 585001 - DNA, 25 bp, Rattus norvegicus
cgacaatgcgcccacactgctgggg

SEQ ID NO: 585002 - DNA, 25 bp, Rattus norvegicus
ccacacgtgtcctggatgaaacaga

SEQ ID NO: 585003 - DNA, 25 bp, Rattus norvegicus
cccagcaatgatggttactgccaca

SEQ ID NO: 585004 - DNA, 25 bp, Rattus norvegicus
agcctattccgtgtgggtctatata

SEQ ID NO: 585005 - DNA, 25 bp, Rattus norvegicus
caagagtcacaaacgcggaggcgtc

SEQ ID NO: 585006 - DNA, 25 bp, Rattus norvegicus
ggctccatcgcgagtgtccacaaga

SEQ ID NO: 585007 - DNA, 25 bp, Rattus norvegicus
gaatggcccgctaccaaaggctcca

SEQ ID NO: 585008 - DNA, 25 bp, Rattus norvegicus
tactgccacagtgttggtgtcgctg

SEQ ID NO: 585009 - DNA, 25 bp, Rattus norvegicus
tggaacccgaggcaggaatctctgg

SEQ ID NO: 585010 - DNA, 25 bp, Rattus norvegicus
agctgcaatcgtcagaaggcaattc

SEQ ID NO: 585011 - DNA, 25 bp, Rattus norvegicus
ggactctggctataatgcatggctc

SEQ ID NO: 585012 - DNA, 25 bp, Rattus norvegicus
agccggctagtgtccagatcagtag

SEQ ID NO: 585013 - DNA, 25 bp, Rattus norvegicus
cgcgcagcttggatgaagcagattc

SEQ ID NO: 585014 - DNA, 25 bp, Rattus norvegicus
atctctggtggaatcgtgagccggc

SEQ ID NO: 585015 - DNA, 25 bp, Rattus norvegicus
cgagattagtactacgcgcagcttg

SEQ ID NO: 585016 - DNA, 25 bp, Rattus norvegicus
ggcaattcccgtagcctattccgtg

SEQ ID NO: 585017 - DNA, 25 bp, Rattus norvegicus
ggcgcctgctgatctcctttgtgct

SEQ ID NO: 585018 - DNA, 25 bp, Rattus norvegicus
tatattcccagcgaggaagtccggg

SEQ ID NO: 585019 - DNA, 25 bp, Rattus norvegicus
atggtatattcccagcgaggaagtc

SEQ ID NO: 585020 - DNA, 25 bp, Rattus norvegicus
tattcccagcgaggaagtccgggat

SEQ ID NO: 585021 - DNA, 25 bp, Rattus norvegicus
gaagtccgggatttcggcgcctgct

SEQ ID NO: 585022 - DNA, 25 bp, Rattus norvegicus
ttcggcgcctgctgatctcctttgt

SEQ ID NO: 585023 - DNA, 25 bp, Rattus norvegicus
tgatctcctttgtgcttctcgtagc

SEQ ID NO: 585024 - DNA, 25 bp, Rattus norvegicus
cgcctgctgatctcctttgtgcttc

SEQ ID NO: 585025 - DNA, 25 bp, Rattus norvegicus
gctgatctcctttgtgcttctcgta

SEQ ID NO: 585026 - DNA, 25 bp, Rattus norvegicus
tctcctttgtgcttctcgtagcctg

SEQ ID NO: 585027 - DNA, 25 bp, Rattus norvegicus
tttgtgcttctcgtagcctgggagg

SEQ ID NO: 585028 - DNA, 25 bp, Rattus norvegicus
tgtgcttctcgtagcctgggaggca

SEQ ID NO: 585029 - DNA, 25 bp, Rattus norvegicus
gatttcggcgcctgctgatctcctt

SEQ ID NO: 585030 - DNA, 25 bp, Rattus norvegicus
cctttgtgcttctcgtagcctggga

SEQ ID NO: 585031 - DNA, 25 bp, Rattus norvegicus
ggacatgccacgtcaacgcttgttg

SEQ ID NO: 585032 - DNA, 25 bp, Rattus norvegicus
tgacgtggttgtgaccgcccgcgat

SEQ ID NO: 585033 - DNA, 25 bp, Rattus norvegicus
aattattgagttgttgtcccggcca

SEQ ID NO: 585034 - DNA, 25 bp, Rattus norvegicus
tgagttccggccatgtggttgcgaa

SEQ ID NO: 585035 - DNA, 25 bp, Rattus norvegicus
ggctacaacgcgtggttgtcttacg

SEQ ID NO: 585036 - DNA, 25 bp, Rattus norvegicus
ggttgtcttacgagctgcagccagc

SEQ ID NO: 585037 - DNA, 25 bp, Rattus norvegicus
cgagctgcagccagcgacaggcgct

SEQ ID NO: 585038 - DNA, 25 bp, Rattus norvegicus
cgtggggttatatactggtgagatc

SEQ ID NO: 585039 - DNA, 25 bp, Rattus norvegicus
ctggatgaagcggacatgccacgtc

SEQ ID NO: 585040 - DNA, 25 bp, Rattus norvegicus
cctcagggtggaggagcaattattg

SEQ ID NO: 585041 - DNA, 25 bp, Rattus norvegicus
gccacgtcaacgcttgttggtgctg

SEQ ID NO: 585042 - DNA, 25 bp, Rattus norvegicus
cacggcgagccaccgctgacagcta

SEQ ID NO: 585043 - DNA, 25 bp, Rattus norvegicus
ccacacgtgttctggatgaagcgga

SEQ ID NO: 585044 - DNA, 25 bp, Rattus norvegicus
attgagttgttgtcccggccagtga

SEQ ID NO: 585045 - DNA, 25 bp, Rattus norvegicus
ggtcctacatcaacagccaactcga

SEQ ID NO: 585046 - DNA, 25 bp, Rattus norvegicus
ctacgtacggtggaacccacggatg

SEQ ID NO: 585047 - DNA, 25 bp, Rattus norvegicus
atgaggccgcaggtaattttccgtt

SEQ ID NO: 585048 - DNA, 25 bp, Rattus norvegicus
tcgcgagtgttagccgcttggaatt

SEQ ID NO: 585049 - DNA, 25 bp, Rattus norvegicus
tatccggtcgcgagtgttagccgct

SEQ ID NO: 585050 - DNA, 25 bp, Rattus norvegicus
caccacgtgctgtatccggtcgcga

SEQ ID NO: 585051 - DNA, 25 bp, Rattus norvegicus
acagccaactcgacgaattctccaa

SEQ ID NO: 585052 - DNA, 25 bp, Rattus norvegicus
ccctgtcgctgtggtcctacatcaa

SEQ ID NO: 585053 - DNA, 25 bp, Rattus norvegicus
tctgtgcaaagaccctgtcgctgtg

SEQ ID NO: 585054 - DNA, 25 bp, Rattus norvegicus
tgttcccaggacgtctgtgcaaaga

SEQ ID NO: 585055 - DNA, 25 bp, Rattus norvegicus
cggttgtttgttcccaggacgtctg

SEQ ID NO: 585056 - DNA, 25 bp, Rattus norvegicus
ctcactcccgtgtcccggttgtttg

SEQ ID NO: 585057 - DNA, 25 bp, Rattus norvegicus
gccgcttggaattgtgggtaaatta

SEQ ID NO: 585058 - DNA, 25 bp, Rattus norvegicus
ttcgtgagctacgaccaccacgtgc

SEQ ID NO: 585059 - DNA, 25 bp, Rattus norvegicus
agcgctgatgaccacagccaccgtg

SEQ ID NO: 585060 - DNA, 25 bp, Rattus norvegicus
cctgtttcgggtaggtctgtatacg

SEQ ID NO: 585061 - DNA, 25 bp, Rattus norvegicus
ccaccgtgttagtgtctctggttga

SEQ ID NO: 585062 - DNA, 25 bp, Rattus norvegicus
gatgaccacagccaccgtgttagtg

SEQ ID NO: 585063 - DNA, 25 bp, Rattus norvegicus
acgccatcgcctattagtgctggtg

SEQ ID NO: 585064 - DNA, 25 bp, Rattus norvegicus
tgcaccacgccatcgcctattagtg

SEQ ID NO: 585065 - DNA, 25 bp, Rattus norvegicus
gaggaggcagatgcaccacgccatc

SEQ ID NO: 585066 - DNA, 25 bp, Rattus norvegicus
tgcccttgaggaggcagatgcacca

SEQ ID NO: 585067 - DNA, 25 bp, Rattus norvegicus
ttagtaccacgcgtgcccttgagga

SEQ ID NO: 585068 - DNA, 25 bp, Rattus norvegicus
tgagaacagccagactccaaaagcc

SEQ ID NO: 585069 - DNA, 25 bp, Rattus norvegicus
tccaaaagcctcttcgcgagcggca

SEQ ID NO: 585070 - DNA, 25 bp, Rattus norvegicus
aagcctcttcgcgagcggcaggctc

SEQ ID NO: 585071 - DNA, 25 bp, Rattus norvegicus
ctctggttgagaacagccagactcc

SEQ ID NO: 585072 - DNA, 25 bp, Rattus norvegicus
gggcgagattagtaccacgcgtgcc

SEQ ID NO: 585073 - DNA, 25 bp, Rattus norvegicus
ctgcaagaacgtgcacctgtttgcc

SEQ ID NO: 585074 - DNA, 25 bp, Rattus norvegicus
ctactgctcgactgcaagaacgtgc

SEQ ID NO: 585075 - DNA, 25 bp, Rattus norvegicus
tccacgctgcacgacgctcaaggga

SEQ ID NO: 585076 - DNA, 25 bp, Rattus norvegicus
gcttcagtatcgaatcagagccatc

SEQ ID NO: 585077 - DNA, 25 bp, Rattus norvegicus
tcagcttgaatatcccccgagtggc

SEQ ID NO: 585078 - DNA, 25 bp, Rattus norvegicus
gcacgacgctcaagggaacccacta

SEQ ID NO: 585079 - DNA, 25 bp, Rattus norvegicus
atctgcgctggtaccggctcaacct

SEQ ID NO: 585080 - DNA, 25 bp, Rattus norvegicus
acgtatgagcatctgcgctggtacc

SEQ ID NO: 585081 - DNA, 25 bp, Rattus norvegicus
gcggacaactacacgtatgagcatc

SEQ ID NO: 585082 - DNA, 25 bp, Rattus norvegicus
ctgccgggcggacaactacacgtat

SEQ ID NO: 585083 - DNA, 25 bp, Rattus norvegicus
aaggccagtccgtgcgcctcagctg

SEQ ID NO: 585084 - DNA, 25 bp, Rattus norvegicus
ccgaggatcccttagaaggccagtc

SEQ ID NO: 585085 - DNA, 25 bp, Rattus norvegicus
tcgaatcagagccatccgaggatcc

SEQ ID NO: 585086 - DNA, 25 bp, Rattus norvegicus
gggaacccactactgctcgactgca

SEQ ID NO: 585087 - DNA, 25 bp, Rattus norvegicus
tggacaggccgctgcaggttttcca

SEQ ID NO: 585088 - DNA, 25 bp, Rattus norvegicus
aatctgcagaatggcattttgtttg

SEQ ID NO: 585089 - DNA, 25 bp, Rattus norvegicus
aaacacggcaccttcgtgggccgca

SEQ ID NO: 585090 - DNA, 25 bp, Rattus norvegicus
aacacggcaccttcgtgggccgcat

SEQ ID NO: 585091 - DNA, 25 bp, Rattus norvegicus
ctggaggtaaatctgcagaatggca

SEQ ID NO: 585092 - DNA, 25 bp, Rattus norvegicus
ggaggtaaatctgcagaatggcatt

SEQ ID NO: 585093 - DNA, 25 bp, Rattus norvegicus
ggtaaatctgcagaatggcattttg

SEQ ID NO: 585094 - DNA, 25 bp, Rattus norvegicus
ctgcagaatggcattttgtttgtga

SEQ ID NO: 585095 - DNA, 25 bp, Rattus norvegicus
cagaatggcattttgtttgtgaatt

SEQ ID NO: 585096 - DNA, 25 bp, Rattus norvegicus
aatggcattttgtttgtgaattctc

SEQ ID NO: 585097 - DNA, 25 bp, Rattus norvegicus
ggcattttgtttgtgaattctcgga

SEQ ID NO: 585098 - DNA, 25 bp, Rattus norvegicus
ttttgtttgtgaattctcggatcga

SEQ ID NO: 585099 - DNA, 25 bp, Rattus norvegicus
acaggccgctgcaggttttccacgt

SEQ ID NO: 585100 - DNA, 25 bp, Rattus norvegicus
cattttgtttgtgaattctcggatc

SEQ ID NO: 585101 - DNA, 25 bp, Rattus norvegicus
aatgcgctggtgtcttactctctag

SEQ ID NO: 585102 - DNA, 25 bp, Rattus norvegicus
gtcttactctctagtggagcgtagg

SEQ ID NO: 585103 - DNA, 25 bp, Rattus norvegicus
cccttctctgtgtaccacggccagc

SEQ ID NO: 585104 - DNA, 25 bp, Rattus norvegicus
cttactctctagtggagcgtagggt

SEQ ID NO: 585105 - DNA, 25 bp, Rattus norvegicus
tgcgctggtgtcttactctctagtg

SEQ ID NO: 585106 - DNA, 25 bp, Rattus norvegicus
gaatgcgctggtgtcttactctcta

SEQ ID NO: 585107 - DNA, 25 bp, Rattus norvegicus
caatggatgaggatgcacaagagaa

SEQ ID NO: 585108 - DNA, 25 bp, Rattus norvegicus
tcttcacggtgtcggcaatggatga

SEQ ID NO: 585109 - DNA, 25 bp, Rattus norvegicus
cgtatcttcacggtgtcggcaatgg

SEQ ID NO: 585110 - DNA, 25 bp, Rattus norvegicus
cgcgtatcttcacggtgtcggcaat

SEQ ID NO: 585111 - DNA, 25 bp, Rattus norvegicus
agcgcgtatcttcacggtgtcggca

SEQ ID NO: 585112 - DNA, 25 bp, Rattus norvegicus
tggagcgcgtatcttcacggtgtcg

SEQ ID NO: 585113 - DNA, 25 bp, Rattus norvegicus
gcctggagcgcgtatcttcacggtg

SEQ ID NO: 585114 - DNA, 25 bp, Rattus norvegicus
gtgtcttactctctagtggagcgta

SEQ ID NO: 585115 - DNA, 25 bp, Rattus norvegicus
acgtttccagcgacacagaagactc

SEQ ID NO: 585116 - DNA, 25 bp, Rattus norvegicus
ggacattaatgacaaccctcccacg

SEQ ID NO: 585117 - DNA, 25 bp, Rattus norvegicus
gacattaatgacaaccctcccacgt

SEQ ID NO: 585118 - DNA, 25 bp, Rattus norvegicus
cattaatgacaaccctcccacgttt

SEQ ID NO: 585119 - DNA, 25 bp, Rattus norvegicus
tcccacgtttccagcgacacagaag

SEQ ID NO: 585120 - DNA, 25 bp, Rattus norvegicus
agggacattaatgacaaccctccca

SEQ ID NO: 585121 - DNA, 25 bp, Rattus norvegicus
cacgtttccagcgacacagaagact

SEQ ID NO: 585122 - DNA, 25 bp, Rattus norvegicus
acattaatgacaaccctcccacgtt

SEQ ID NO: 585123 - DNA, 25 bp, Rattus norvegicus
cgtttccagcgacacagaagactct

SEQ ID NO: 585124 - DNA, 25 bp, Rattus norvegicus
gtttccagcgacacagaagactctg

SEQ ID NO: 585125 - DNA, 25 bp, Rattus norvegicus
tttccagcgacacagaagactctgt

SEQ ID NO: 585126 - DNA, 25 bp, Rattus norvegicus
ttccagcgacacagaagactctgtt

SEQ ID NO: 585127 - DNA, 25 bp, Rattus norvegicus
tccagcgacacagaagactctgttt

SEQ ID NO: 585128 - DNA, 25 bp, Rattus norvegicus
cccacgtttccagcgacacagaaga

SEQ ID NO: 585129 - DNA, 25 bp, Rattus norvegicus
tgcgcttattgctcacggctacgga

SEQ ID NO: 585130 - DNA, 25 bp, Rattus norvegicus
gtttccactagagggcgcgtcagat

SEQ ID NO: 585131 - DNA, 25 bp, Rattus norvegicus
tccagactgcttgactcgcggtttc

SEQ ID NO: 585132 - DNA, 25 bp, Rattus norvegicus
cgtcagatgcagatgtcggttccaa

SEQ ID NO: 585133 - DNA, 25 bp, Rattus norvegicus
gatgtcggttccaatgccctgctga

SEQ ID NO: 585134 - DNA, 25 bp, Rattus norvegicus
tgccctgctgacttacagactgagc

SEQ ID NO: 585135 - DNA, 25 bp, Rattus norvegicus
cagactgagcaccaatgaacatttc

SEQ ID NO: 585136 - DNA, 25 bp, Rattus norvegicus
catttctctctggatgtaccgccca

SEQ ID NO: 585137 - DNA, 25 bp, Rattus norvegicus
tgtaccgcccaaccacgagcaggtg

SEQ ID NO: 585138 - DNA, 25 bp, Rattus norvegicus
tgcggaaacctttagacagagaaga

SEQ ID NO: 585139 - DNA, 25 bp, Rattus norvegicus
agctgcagagatgcgcttattgctc

SEQ ID NO: 585140 - DNA, 25 bp, Rattus norvegicus
tcacggctacggacggaggcaaacc

SEQ ID NO: 585141 - DNA, 25 bp, Rattus norvegicus
gaggcaaaccggagttgaccggcac

SEQ ID NO: 585142 - DNA, 25 bp, Rattus norvegicus
gcaggtgaaacctcttgggctcgtt

SEQ ID NO: 585143 - DNA, 25 bp, Rattus norvegicus
tgtgaacgacaatgcgcccctgttt

SEQ ID NO: 585144 - DNA, 25 bp, Rattus norvegicus
ccctgtttgctcagcctgaatacac

SEQ ID NO: 585145 - DNA, 25 bp, Rattus norvegicus
cctgtttgctcagcctgaatacaca

SEQ ID NO: 585146 - DNA, 25 bp, Rattus norvegicus
gtttgctcagcctgaatacacagtg

SEQ ID NO: 585147 - DNA, 25 bp, Rattus norvegicus
tttgctcagcctgaatacacagtgt

SEQ ID NO: 585148 - DNA, 25 bp, Rattus norvegicus
ttgctcagcctgaatacacagtgtt

SEQ ID NO: 585149 - DNA, 25 bp, Rattus norvegicus
ggagaacaatccaccaggtacgcat

SEQ ID NO: 585150 - DNA, 25 bp, Rattus norvegicus
gagaacaatccaccaggtacgcata

SEQ ID NO: 585151 - DNA, 25 bp, Rattus norvegicus
gaacaatccaccaggtacgcatatc

SEQ ID NO: 585152 - DNA, 25 bp, Rattus norvegicus
caatccaccaggtacgcatatcttc

SEQ ID NO: 585153 - DNA, 25 bp, Rattus norvegicus
aatccaccaggtacgcatatcttca

SEQ ID NO: 585154 - DNA, 25 bp, Rattus norvegicus
atccaccaggtacgcatatcttcac

SEQ ID NO: 585155 - DNA, 25 bp, Rattus norvegicus
tccaccaggtacgcatatcttcacg

SEQ ID NO: 585156 - DNA, 25 bp, Rattus norvegicus
gtgaacgacaatgcgcccctgtttg

SEQ ID NO: 585157 - DNA, 25 bp, Rattus norvegicus
gtgcgggacacgtggtgtcaaaggt

SEQ ID NO: 585158 - DNA, 25 bp, Rattus norvegicus
cttggctgtgttatgagcttcatac

SEQ ID NO: 585159 - DNA, 25 bp, Rattus norvegicus
tcaagcggacctatgggcgaattta

SEQ ID NO: 585160 - DNA, 25 bp, Rattus norvegicus
cctatgggcgaatttagccaacttg

SEQ ID NO: 585161 - DNA, 25 bp, Rattus norvegicus
tggggcagcagtcaagcggacctat

SEQ ID NO: 585162 - DNA, 25 bp, Rattus norvegicus
tagccaacttgtgtcgcggtcagtg

SEQ ID NO: 585163 - DNA, 25 bp, Rattus norvegicus
atgaatctgatttaccgcgccagcg

SEQ ID NO: 585164 - DNA, 25 bp, Rattus norvegicus
ttatgagcttcatacggctgtgggg

SEQ ID NO: 585165 - DNA, 25 bp, Rattus norvegicus
ggctcgccttcgctgtgtgccactg

SEQ ID NO: 585166 - DNA, 25 bp, Rattus norvegicus
tgggcgaatttagccaacttgtgtc

SEQ ID NO: 585167 - DNA, 25 bp, Rattus norvegicus
atgcacccacggtgctggggcagca

SEQ ID NO: 585168 - DNA, 25 bp, Rattus norvegicus
cgagacctggatgaatctgatttac

SEQ ID NO: 585169 - DNA, 25 bp, Rattus norvegicus
ctttccgtgtgggtctctacaccgg

SEQ ID NO: 585170 - DNA, 25 bp, Rattus norvegicus
gcacgacacgagacctggatgaatc

SEQ ID NO: 585171 - DNA, 25 bp, Rattus norvegicus
tggatgaagtagatgcgccgcgcca

SEQ ID NO: 585172 - DNA, 25 bp, Rattus norvegicus
ccgattctggttataatgcttggct

SEQ ID NO: 585173 - DNA, 25 bp, Rattus norvegicus
actcgcgccctggatgaagtagatg

SEQ ID NO: 585174 - DNA, 25 bp, Rattus norvegicus
atcagtatcactcgcgccctggatg

SEQ ID NO: 585175 - DNA, 25 bp, Rattus norvegicus
tgagatcagtatcactcgcgccctg

SEQ ID NO: 585176 - DNA, 25 bp, Rattus norvegicus
tacacaggtgagatcagtatcactc

SEQ ID NO: 585177 - DNA, 25 bp, Rattus norvegicus
cgctgtgggacacagccagcgtgtc

SEQ ID NO: 585178 - DNA, 25 bp, Rattus norvegicus
cttccgtgtgggactatacacaggt

SEQ ID NO: 585179 - DNA, 25 bp, Rattus norvegicus
atgccgattctggttataatgcttg

SEQ ID NO: 585180 - DNA, 25 bp, Rattus norvegicus
gcagtcccttccgtgtgggactata

SEQ ID NO: 585181 - DNA, 25 bp, Rattus norvegicus
agctggcagtgtgcgcagtcccttc

SEQ ID NO: 585182 - DNA, 25 bp, Rattus norvegicus
ctccaattcggagctggcagtgtgc

SEQ ID NO: 585183 - DNA, 25 bp, Rattus norvegicus
gctgtcttatgagctccaattcgga

SEQ ID NO: 585184 - DNA, 25 bp, Rattus norvegicus
ggctcaccctcgctgtgggacacag

SEQ ID NO: 585185 - DNA, 25 bp, Rattus norvegicus
caatgcttggctgtcatacgaacta

SEQ ID NO: 585186 - DNA, 25 bp, Rattus norvegicus
tacgaactacaattgggaacaggtg

SEQ ID NO: 585187 - DNA, 25 bp, Rattus norvegicus
gcgagacggtgtcaacctatgattt

SEQ ID NO: 585188 - DNA, 25 bp, Rattus norvegicus
ccctggatgaggtggacgctcctcg

SEQ ID NO: 585189 - DNA, 25 bp, Rattus norvegicus
agcacgacacgtgccctggatgagg

SEQ ID NO: 585190 - DNA, 25 bp, Rattus norvegicus
caattgggaacaggtggagtacgca

SEQ ID NO: 585191 - DNA, 25 bp, Rattus norvegicus
tggctgtcatacgaactacaattgg

SEQ ID NO: 585192 - DNA, 25 bp, Rattus norvegicus
gtcaccaaggttcgcgcagtggatg

SEQ ID NO: 585193 - DNA, 25 bp, Rattus norvegicus
tgggttcgggccatgtggtcaccaa

SEQ ID NO: 585194 - DNA, 25 bp, Rattus norvegicus
tgccccacggagctgtcggacctgg

SEQ ID NO: 585195 - DNA, 25 bp, Rattus norvegicus
tgaaaacgacaacgcacccatgctt

SEQ ID NO: 585196 - DNA, 25 bp, Rattus norvegicus
ggggttcaccttcactgtgtgccac

SEQ ID NO: 585197 - DNA, 25 bp, Rattus norvegicus
cctatgatttggttgtgacagcgcg

SEQ ID NO: 585198 - DNA, 25 bp, Rattus norvegicus
gtggagtacgcagccccttccgtgt

SEQ ID NO: 585199 - DNA, 25 bp, Rattus norvegicus
ggcttttctccagtgagctctgcta

SEQ ID NO: 585200 - DNA, 25 bp, Rattus norvegicus
ccatttccatttctgggcgtcgtca

SEQ ID NO: 585201 - DNA, 25 bp, Rattus norvegicus
ggcgttgcccatctcttttcccgga

SEQ ID NO: 585202 - DNA, 25 bp, Rattus norvegicus
tggaacccgggctcaaaatcaatgc

SEQ ID NO: 585203 - DNA, 25 bp, Rattus norvegicus
cgcccgggtctccatttttgtcagg

SEQ ID NO: 585204 - DNA, 25 bp, Rattus norvegicus
tcaccgtgtggctgaactacaattc

SEQ ID NO: 585205 - DNA, 25 bp, Rattus norvegicus
gtctcttctcggtgggattacgtca

SEQ ID NO: 585206 - DNA, 25 bp, Rattus norvegicus
caggttcccaaagacgcactgaatg

SEQ ID NO: 585207 - DNA, 25 bp, Rattus norvegicus
atcgcgtctaaccttgcctgctgga

SEQ ID NO: 585208 - DNA, 25 bp, Rattus norvegicus
tggcgctgacatcaaatcgcgtcta

SEQ ID NO: 585209 - DNA, 25 bp, Rattus norvegicus
gcctcgaagatggtgctgacctctc

SEQ ID NO: 585210 - DNA, 25 bp, Rattus norvegicus
agtactctgcatttggcggcctccc

SEQ ID NO: 585211 - DNA, 25 bp, Rattus norvegicus
tgaccgcgtggctgaacttcaattc

SEQ ID NO: 585212 - DNA, 25 bp, Rattus norvegicus
cttggtcttccagcctgcaggtgaa

SEQ ID NO: 585213 - DNA, 25 bp, Rattus norvegicus
gacgccgacgcctcctcttccgcgc

SEQ ID NO: 585214 - DNA, 25 bp, Rattus norvegicus
agcaaacaagcatcatggcggcggc

SEQ ID NO: 585215 - DNA, 25 bp, Rattus norvegicus
gctcaccgccgtctctccaacatcc

SEQ ID NO: 585216 - DNA, 25 bp, Rattus norvegicus
caacatcccggcttcctattggctg

SEQ ID NO: 585217 - DNA, 25 bp, Rattus norvegicus
cttcctattggctgacgctgctgga

SEQ ID NO: 585218 - DNA, 25 bp, Rattus norvegicus
gctgacgctgctggacgcgaccatc

SEQ ID NO: 585219 - DNA, 25 bp, Rattus norvegicus
tggacgcgaccatcccgcgtcgggt

SEQ ID NO: 585220 - DNA, 25 bp, Rattus norvegicus
tgactcctcgcagctcgacgcttta

SEQ ID NO: 585221 - DNA, 25 bp, Rattus norvegicus
cccgcgtctcagagtagtgagccgg

SEQ ID NO: 585222 - DNA, 25 bp, Rattus norvegicus
cgtctcagagtagtgagccggcccg

SEQ ID NO: 585223 - DNA, 25 bp, Rattus norvegicus
gcccccctcgttttcattgaaagca

SEQ ID NO: 585224 - DNA, 25 bp, Rattus norvegicus
acgagccgccgctacgctctgccgc

SEQ ID NO: 585225 - DNA, 25 bp, Rattus norvegicus
ttgaaagcaaacaagcatcatggcg

SEQ ID NO: 585226 - DNA, 25 bp, Rattus norvegicus
ctctctctgcgcctatgcttctccg

SEQ ID NO: 585227 - DNA, 25 bp, Rattus norvegicus
tgcaccgcgccagcgtctgttggtg

SEQ ID NO: 585228 - DNA, 25 bp, Rattus norvegicus
tgaagcagatgcaccgcgccagcgt

SEQ ID NO: 585229 - DNA, 25 bp, Rattus norvegicus
cgacgcgtgccctagatgaagcaga

SEQ ID NO: 585230 - DNA, 25 bp, Rattus norvegicus
cgtgggtctatacacgggcgagatc

SEQ ID NO: 585231 - DNA, 25 bp, Rattus norvegicus
gttccgcgtgggtctatacacgggc

SEQ ID NO: 585232 - DNA, 25 bp, Rattus norvegicus
gccatgagcagtccgttccgcgtgg

SEQ ID NO: 585233 - DNA, 25 bp, Rattus norvegicus
cagcaggggccatgagcagtccgtt

SEQ ID NO: 585234 - DNA, 25 bp, Rattus norvegicus
tgagaacgacaatgttcccacgctg

SEQ ID NO: 585235 - DNA, 25 bp, Rattus norvegicus
aaggtatttgctctgcagcctctgg

SEQ ID NO: 585236 - DNA, 25 bp, Rattus norvegicus
cgctgaaagcggcaaggtatttgct

SEQ ID NO: 585237 - DNA, 25 bp, Rattus norvegicus
agtggacacagatgcgcaggagaac

SEQ ID NO: 585238 - DNA, 25 bp, Rattus norvegicus
tgtctgcagtggacacagatgcgca

SEQ ID NO: 585239 - DNA, 25 bp, Rattus norvegicus
cgcacatctttacggtgtctgcagt

SEQ ID NO: 585240 - DNA, 25 bp, Rattus norvegicus
agcacgacgcgtgccctagatgaag

SEQ ID NO: 585241 - DNA, 25 bp, Rattus norvegicus
ggccgcagcacttcgagcttgcagt

SEQ ID NO: 585242 - DNA, 25 bp, Rattus norvegicus
tcgcttcctttccaaccacagagag

SEQ ID NO: 585243 - DNA, 25 bp, Rattus norvegicus
ctggagctgcacaaaatgcgcgttc

SEQ ID NO: 585244 - DNA, 25 bp, Rattus norvegicus
tacgagctaatgttcgaggaccctc

SEQ ID NO: 585245 - DNA, 25 bp, Rattus norvegicus
acagcttatcctgggcgtagcgaca

SEQ ID NO: 585246 - DNA, 25 bp, Rattus norvegicus
ttgcagtgcaagcaggcagaccagc

SEQ ID NO: 585247 - DNA, 25 bp, Rattus norvegicus
tctccaggagttcggagcatggtcc

SEQ ID NO: 585248 - DNA, 25 bp, Rattus norvegicus
acccggagttactgtaggcaatatc

SEQ ID NO: 585249 - DNA, 25 bp, Rattus norvegicus
cgtctcggacttgaagctgtcagca

SEQ ID NO: 585250 - DNA, 25 bp, Rattus norvegicus
cagaccagctctcacgttttacagg

SEQ ID NO: 585251 - DNA, 25 bp, Rattus norvegicus
gctgctctgtccttgcggaactttc

SEQ ID NO: 585252 - DNA, 25 bp, Rattus norvegicus
agagccctacttcggggtggacctg

SEQ ID NO: 585253 - DNA, 25 bp, Rattus norvegicus
tgcgggaccaaagctgcctgtatcc

SEQ ID NO: 585254 - DNA, 25 bp, Rattus norvegicus
cggtagcttggtggttcaagaacca

SEQ ID NO: 585255 - DNA, 25 bp, Rattus norvegicus
ctcagcttggaagtgctggctcaca

SEQ ID NO: 585256 - DNA, 25 bp, Rattus norvegicus
catagagagcgcacaggaccctgac

SEQ ID NO: 585257 - DNA, 25 bp, Rattus norvegicus
tggagcgcggtttcacatagagagc

SEQ ID NO: 585258 - DNA, 25 bp, Rattus norvegicus
ctcttcttagagcatcatcggcggc

SEQ ID NO: 585259 - DNA, 25 bp, Rattus norvegicus
gcggccggattatcagcttcaggta

SEQ ID NO: 585260 - DNA, 25 bp, Rattus norvegicus
tcttcgtcaacgagcgtatagatcg

SEQ ID NO: 585261 - DNA, 25 bp, Rattus norvegicus
ggacttgaccaacggagcgctcttc

SEQ ID NO: 585262 - DNA, 25 bp, Rattus norvegicus
ccgcgctacctggaactggacttga

SEQ ID NO: 585263 - DNA, 25 bp, Rattus norvegicus
tgtctgcgcatcaaccatctgggtg

SEQ ID NO: 585264 - DNA, 25 bp, Rattus norvegicus
ggcctcccagctacggtactctgtg

SEQ ID NO: 585265 - DNA, 25 bp, Rattus norvegicus
cgtctcgggcatttgtagtgcgtga

SEQ ID NO: 585266 - DNA, 25 bp, Rattus norvegicus
cggagcccttgagaacgcctaggag

SEQ ID NO: 585267 - DNA, 25 bp, Rattus norvegicus
ctggcagtcgcagaaaatcgggacc

SEQ ID NO: 585268 - DNA, 25 bp, Rattus norvegicus
cttcaggtaagcgaatccgtggcac

SEQ ID NO: 585269 - DNA, 25 bp, Rattus norvegicus
agctgttcgctctcagggcattaga

SEQ ID NO: 585270 - DNA, 25 bp, Rattus norvegicus
cgaagcccttcaggccttcgagttc

SEQ ID NO: 585271 - DNA, 25 bp, Rattus norvegicus
gactacgaagcccttcaggccttcg

SEQ ID NO: 585272 - DNA, 25 bp, Rattus norvegicus
attagactacgaagcccttcaggcc

SEQ ID NO: 585273 - DNA, 25 bp, Rattus norvegicus
gcattagactacgaagcccttcagg

SEQ ID NO: 585274 - DNA, 25 bp, Rattus norvegicus
tctcagggcattagactacgaagcc

SEQ ID NO: 585275 - DNA, 25 bp, Rattus norvegicus
cgctctcagggcattagactacgaa

SEQ ID NO: 585276 - DNA, 25 bp, Rattus norvegicus
cagctgttcgctctcagggcattag

SEQ ID NO: 585277 - DNA, 25 bp, Rattus norvegicus
ctgatgacccgcaactggccctcga

SEQ ID NO: 585278 - DNA, 25 bp, Rattus norvegicus
tgctgccgcctgatgacccgcaact

SEQ ID NO: 585279 - DNA, 25 bp, Rattus norvegicus
tcacttattcgctgctgccgcctga

SEQ ID NO: 585280 - DNA, 25 bp, Rattus norvegicus
atcacttattcgctgctgccgcctg

SEQ ID NO: 585281 - DNA, 25 bp, Rattus norvegicus
tgttcgctctcagggcattagacta

SEQ ID NO: 585282 - DNA, 25 bp, Rattus norvegicus
tcgctctcagggcattagactacga

SEQ ID NO: 585283 - DNA, 25 bp, Rattus norvegicus
caacgggcagctgtttgctattagg

SEQ ID NO: 585284 - DNA, 25 bp, Rattus norvegicus
gcagctgtttgctattagggcgcta

SEQ ID NO: 585285 - DNA, 25 bp, Rattus norvegicus
tgggcgcagaagaccaaggctctcc

SEQ ID NO: 585286 - DNA, 25 bp, Rattus norvegicus
agctgtttgctattagggcgctaga

SEQ ID NO: 585287 - DNA, 25 bp, Rattus norvegicus
tgtttgctattagggcgctagactt

SEQ ID NO: 585288 - DNA, 25 bp, Rattus norvegicus
ctattagggcgctagactttgagga

SEQ ID NO: 585289 - DNA, 25 bp, Rattus norvegicus
acgggcagctgtttgctattagggc

SEQ ID NO: 585290 - DNA, 25 bp, Rattus norvegicus
tttgaggacctacaagcctttgagt

SEQ ID NO: 585291 - DNA, 25 bp, Rattus norvegicus
agcctttgagttccacgtgggcgca

SEQ ID NO: 585292 - DNA, 25 bp, Rattus norvegicus
ctttgagttccacgtgggcgcagaa

SEQ ID NO: 585293 - DNA, 25 bp, Rattus norvegicus
tgagttccacgtgggcgcagaagac

SEQ ID NO: 585294 - DNA, 25 bp, Rattus norvegicus
cgctagactttgaggacctacaagc

SEQ ID NO: 585295 - DNA, 25 bp, Rattus norvegicus
tccacgtgggcgcagaagaccaagg

SEQ ID NO: 585296 - DNA, 25 bp, Rattus norvegicus
gactttgaggacctacaagcctttg

SEQ ID NO: 585297 - DNA, 25 bp, Rattus norvegicus
agcccgggctgttcaacgtatgggc

SEQ ID NO: 585298 - DNA, 25 bp, Rattus norvegicus
agactatgaggctctgcagggcttc

SEQ ID NO: 585299 - DNA, 25 bp, Rattus norvegicus
gggcgctagactatgaggctctgca

SEQ ID NO: 585300 - DNA, 25 bp, Rattus norvegicus
ctcagggcgctagactatgaggctc

SEQ ID NO: 585301 - DNA, 25 bp, Rattus norvegicus
ggcttcgagttccatgtgggcgcca

SEQ ID NO: 585302 - DNA, 25 bp, Rattus norvegicus
tcgagttccatgtgggcgccacaga

SEQ ID NO: 585303 - DNA, 25 bp, Rattus norvegicus
catgtgggcgccacagaccaaggct

SEQ ID NO: 585304 - DNA, 25 bp, Rattus norvegicus
cgccacagaccaaggctcgcccgcg

SEQ ID NO: 585305 - DNA, 25 bp, Rattus norvegicus
tacccgctgcaaaacgcctctgcac

SEQ ID NO: 585306 - DNA, 25 bp, Rattus norvegicus
aaaacgcctctgcacccttcactga

SEQ ID NO: 585307 - DNA, 25 bp, Rattus norvegicus
acggagcccgggctgttcaacgtat

SEQ ID NO: 585308 - DNA, 25 bp, Rattus norvegicus
cgggctgttcaacgtatgggcgcac

SEQ ID NO: 585309 - DNA, 25 bp, Rattus norvegicus
ctctgcagggcttcgagttccatgt

SEQ ID NO: 585310 - DNA, 25 bp, Rattus norvegicus
tctgcacccttcactgagctgctgc

SEQ ID NO: 585311 - DNA, 25 bp, Rattus norvegicus
cagtgtcatgctgcaagtgctacta

SEQ ID NO: 585312 - DNA, 25 bp, Rattus norvegicus
agaaacggagagagcactggataga

SEQ ID NO: 585313 - DNA, 25 bp, Rattus norvegicus
ttactaccacttagaaacggagaga

SEQ ID NO: 585314 - DNA, 25 bp, Rattus norvegicus
aagtgctactagtggatggcttctc

SEQ ID NO: 585315 - DNA, 25 bp, Rattus norvegicus
tcatgctgcaagtgctactagtgga

SEQ ID NO: 585316 - DNA, 25 bp, Rattus norvegicus
gagagcactggatagagagaacaga

SEQ ID NO: 585317 - DNA, 25 bp, Rattus norvegicus
acggagcccgggctatttagtgtgt

SEQ ID NO: 585318 - DNA, 25 bp, Rattus norvegicus
ggctatttagtgtgtgggcgcacaa

SEQ ID NO: 585319 - DNA, 25 bp, Rattus norvegicus
gcgtgatgtgcccaaacacaggttg

SEQ ID NO: 585320 - DNA, 25 bp, Rattus norvegicus
tgtgcccaaacacaggttgctgctg

SEQ ID NO: 585321 - DNA, 25 bp, Rattus norvegicus
tttgtgctaaaatcttctattgaaa

SEQ ID NO: 585322 - DNA, 25 bp, Rattus norvegicus
cttctattgaaaattactaccactt

SEQ ID NO: 585323 - DNA, 25 bp, Rattus norvegicus
ccaaacacaggttgctgctgctggt

SEQ ID NO: 585324 - DNA, 25 bp, Rattus norvegicus
ctactagtggatggcttctcccagc

SEQ ID NO: 585325 - DNA, 25 bp, Rattus norvegicus
acgacgaggacactctaacactgta

SEQ ID NO: 585326 - DNA, 25 bp, Rattus norvegicus
tgcaagaaggccagggcagcttctc

SEQ ID NO: 585327 - DNA, 25 bp, Rattus norvegicus
gaggacactctaacactgtacctgg

SEQ ID NO: 585328 - DNA, 25 bp, Rattus norvegicus
tgcacacgacgaggacactctaaca

SEQ ID NO: 585329 - DNA, 25 bp, Rattus norvegicus
tcctgcacacgacgaggacactcta

SEQ ID NO: 585330 - DNA, 25 bp, Rattus norvegicus
ggcgcacaatcctgcacacgacgag

SEQ ID NO: 585331 - DNA, 25 bp, Rattus norvegicus
aggtggcgcacaatcctgcacacga

SEQ ID NO: 585332 - DNA, 25 bp, Rattus norvegicus
agtgttatgttgcacgtgctagtgg

SEQ ID NO: 585333 - DNA, 25 bp, Rattus norvegicus
tgccagtgttatgttgcacgtgcta

SEQ ID NO: 585334 - DNA, 25 bp, Rattus norvegicus
gctctgccagtgttatgttgcacgt

SEQ ID NO: 585335 - DNA, 25 bp, Rattus norvegicus
cactggacagagaaagtagagctga

SEQ ID NO: 585336 - DNA, 25 bp, Rattus norvegicus
ttctgaaaaagcactggacagagaa

SEQ ID NO: 585337 - DNA, 25 bp, Rattus norvegicus
gaattttttcactctactttctgaa

SEQ ID NO: 585338 - DNA, 25 bp, Rattus norvegicus
gacactctaacactgtacctggtca

SEQ ID NO: 585339 - DNA, 25 bp, Rattus norvegicus
acctgagcgctaacaacgaaacggc

SEQ ID NO: 585340 - DNA, 25 bp, Rattus norvegicus
cctgagtaaagcagcgatgagcggt

SEQ ID NO: 585341 - DNA, 25 bp, Rattus norvegicus
atgagcggtgcgtctaccttccagt

SEQ ID NO: 585342 - DNA, 25 bp, Rattus norvegicus
cccggcaaggcgacctgagcgctaa

SEQ ID NO: 585343 - DNA, 25 bp, Rattus norvegicus
acaacgaaacggctcaggacccgca

SEQ ID NO: 585344 - DNA, 25 bp, Rattus norvegicus
ctcaaacatccgaactccggagagg

SEQ ID NO: 585345 - DNA, 25 bp, Rattus norvegicus
accttccagtttgtccgcgctttca

SEQ ID NO: 585346 - DNA, 25 bp, Rattus norvegicus
tacgtcgtctcgtgactacttctcg

SEQ ID NO: 585347 - DNA, 25 bp, Rattus norvegicus
cgcgcaggcgcattctcgtaattac

SEQ ID NO: 585348 - DNA, 25 bp, Rattus norvegicus
aagtagtaacgtcgcggcgcgcgca

SEQ ID NO: 585349 - DNA, 25 bp, Rattus norvegicus
ggcgctacgtcaaagaccggaagta

SEQ ID NO: 585350 - DNA, 25 bp, Rattus norvegicus
agcctcctcccacgcagaaaagaag

SEQ ID NO: 585351 - DNA, 25 bp, Rattus norvegicus
tccggagaggaccttgccaagcctc

SEQ ID NO: 585352 - DNA, 25 bp, Rattus norvegicus
ggctgccgctcttccggaagtagta

SEQ ID NO: 585353 - DNA, 25 bp, Rattus norvegicus
ccagaagaaaccgacaaaggctcct

SEQ ID NO: 585354 - DNA, 25 bp, Rattus norvegicus
tactccgtgccagaagaaaccgaca

SEQ ID NO: 585355 - DNA, 25 bp, Rattus norvegicus
ctccgtgccagaagaaaccgacaaa

SEQ ID NO: 585356 - DNA, 25 bp, Rattus norvegicus
actccgtgccagaagaaaccgacaa

SEQ ID NO: 585357 - DNA, 25 bp, Rattus norvegicus
ccgtgccagaagaaaccgacaaagg

SEQ ID NO: 585358 - DNA, 25 bp, Rattus norvegicus
atactccgtgccagaagaaaccgac

SEQ ID NO: 585359 - DNA, 25 bp, Rattus norvegicus
tgccagaagaaaccgacaaaggctc

SEQ ID NO: 585360 - DNA, 25 bp, Rattus norvegicus
ggagcgcaggatccgcatcgtctcc

SEQ ID NO: 585361 - DNA, 25 bp, Rattus norvegicus
gatactccgtgccagaagaaaccga

SEQ ID NO: 585362 - DNA, 25 bp, Rattus norvegicus
ctgggactggaaacccgggagctgg

SEQ ID NO: 585363 - DNA, 25 bp, Rattus norvegicus
cggagcgcaggatccgcatcgtctc

SEQ ID NO: 585364 - DNA, 25 bp, Rattus norvegicus
tgtgcgctcagagcgtgccgtgtgt

SEQ ID NO: 585365 - DNA, 25 bp, Rattus norvegicus
cgtgccagaagaaaccgacaaaggc

SEQ ID NO: 585366 - DNA, 25 bp, Rattus norvegicus
tccgtgccagaagaaaccgacaaag

SEQ ID NO: 585367 - DNA, 25 bp, Rattus norvegicus
cgcactgacattcagccggaaccgg

SEQ ID NO: 585368 - DNA, 25 bp, Rattus norvegicus
ccgccgccgcgaggaacactgggaa

SEQ ID NO: 585369 - DNA, 25 bp, Rattus norvegicus
gaaatgaagttcttgagcgaggctc

SEQ ID NO: 585370 - DNA, 25 bp, Rattus norvegicus
agcgaggctcttgacgacaggactc

SEQ ID NO: 585371 - DNA, 25 bp, Rattus norvegicus
acaggactctgcgaatggactacaa

SEQ ID NO: 585372 - DNA, 25 bp, Rattus norvegicus
ccagctccgtgagcggccaaacatg

SEQ ID NO: 585373 - DNA, 25 bp, Rattus norvegicus
tggactacaaggaccggcatgtttc

SEQ ID NO: 585374 - DNA, 25 bp, Rattus norvegicus
atgtttcgcgcgaccgtcgagagga

SEQ ID NO: 585375 - DNA, 25 bp, Rattus norvegicus
ggagagaccgccaagcaccttgatc

SEQ ID NO: 585376 - DNA, 25 bp, Rattus norvegicus
acactcacttcaggtggtccaagga

SEQ ID NO: 585377 - DNA, 25 bp, Rattus norvegicus
agcggccaaacatgtccgcagacca

SEQ ID NO: 585378 - DNA, 25 bp, Rattus norvegicus
cgtcgcctgcctcacggtttcatgt

SEQ ID NO: 585379 - DNA, 25 bp, Rattus norvegicus
ggtttcatgtccgatccgctcagcg

SEQ ID NO: 585380 - DNA, 25 bp, Rattus norvegicus
tgctcgtggcgacatctcaagccca

SEQ ID NO: 585381 - DNA, 25 bp, Rattus norvegicus
cggacttcataatctcgtggccctc

SEQ ID NO: 585382 - DNA, 25 bp, Rattus norvegicus
tcataatctcgtggccctctctttc

SEQ ID NO: 585383 - DNA, 25 bp, Rattus norvegicus
cctctctttctgtgcctggtggtca

SEQ ID NO: 585384 - DNA, 25 bp, Rattus norvegicus
ctggtggtcagcacgcagctgccac

SEQ ID NO: 585385 - DNA, 25 bp, Rattus norvegicus
tgctgtttccagctaagcgttgagc

SEQ ID NO: 585386 - DNA, 25 bp, Rattus norvegicus
gctgtgtagatttaagatgtcatca

SEQ ID NO: 585387 - DNA, 25 bp, Rattus norvegicus
aagcactacgcccacgcggttcggg

SEQ ID NO: 585388 - DNA, 25 bp, Rattus norvegicus
cacgcggttcgggaacgagacctgt

SEQ ID NO: 585389 - DNA, 25 bp, Rattus norvegicus
cgagacctgtttcaagttagcgtta

SEQ ID NO: 585390 - DNA, 25 bp, Rattus norvegicus
aaacggcgtggctacggacttcata

SEQ ID NO: 585391 - DNA, 25 bp, Rattus norvegicus
gcgactttaagacgtcattttcctg

SEQ ID NO: 585392 - DNA, 25 bp, Rattus norvegicus
ccgaaaccagtgctgtttccagcta

SEQ ID NO: 585393 - DNA, 25 bp, Rattus norvegicus
gttagcgttagtccatgcgacttta

SEQ ID NO: 585394 - DNA, 25 bp, Rattus norvegicus
ctaagcgttgagctgtgtagattta

SEQ ID NO: 585395 - DNA, 25 bp, Rattus norvegicus
gaagcgacctcaccacatcatcggg

SEQ ID NO: 585396 - DNA, 25 bp, Rattus norvegicus
aatgatccgactgggacgaggaacc

SEQ ID NO: 585397 - DNA, 25 bp, Rattus norvegicus
atttgaggtagaagttgacatcagc

SEQ ID NO: 585398 - DNA, 25 bp, Rattus norvegicus
gttgacatcagcgatattaatgata

SEQ ID NO: 585399 - DNA, 25 bp, Rattus norvegicus
ccttgtagaggataagctgaaaata

SEQ ID NO: 585400 - DNA, 25 bp, Rattus norvegicus
tactccgtgccggaggagctggaca

SEQ ID NO: 585401 - DNA, 25 bp, Rattus norvegicus
cactgagcgcggctggcttcaggca

SEQ ID NO: 585402 - DNA, 25 bp, Rattus norvegicus
acccatcgtgggaatcagaggaaaa

SEQ ID NO: 585403 - DNA, 25 bp, Rattus norvegicus
tgctcctagttttccaacggaggaa

SEQ ID NO: 585404 - DNA, 25 bp, Rattus norvegicus
gctgggacccatcgtgggaatcaga

SEQ ID NO: 585405 - DNA, 25 bp, Rattus norvegicus
catgaaagatttaactacttgaagg

SEQ ID NO: 585406 - DNA, 25 bp, Rattus norvegicus
catcatcgggcaactctgtggtgtg

SEQ ID NO: 585407 - DNA, 25 bp, Rattus norvegicus
ttaatgataatgctcctagttttcc

SEQ ID NO: 585408 - DNA, 25 bp, Rattus norvegicus
actctgtggtgtgtgaattaaatcc

SEQ ID NO: 585409 - DNA, 25 bp, Rattus norvegicus
gacctagagccgagggcgctatcgt

SEQ ID NO: 585410 - DNA, 25 bp, Rattus norvegicus
acctagagccgagggcgctatcgtc

SEQ ID NO: 585411 - DNA, 25 bp, Rattus norvegicus
gagccgagggcgctatcgtccttcg

SEQ ID NO: 585412 - DNA, 25 bp, Rattus norvegicus
agccgagggcgctatcgtccttcgt

SEQ ID NO: 585413 - DNA, 25 bp, Rattus norvegicus
gccgagggcgctatcgtccttcgtg

SEQ ID NO: 585414 - DNA, 25 bp, Rattus norvegicus
ccgagggcgctatcgtccttcgtgt

SEQ ID NO: 585415 - DNA, 25 bp, Rattus norvegicus
cgagggcgctatcgtccttcgtgtc

SEQ ID NO: 585416 - DNA, 25 bp, Rattus norvegicus
gagggcgctatcgtccttcgtgtct

SEQ ID NO: 585417 - DNA, 25 bp, Rattus norvegicus
agggcgctatcgtccttcgtgtctg

SEQ ID NO: 585418 - DNA, 25 bp, Rattus norvegicus
gggcgctatcgtccttcgtgtctgt

SEQ ID NO: 585419 - DNA, 25 bp, Rattus norvegicus
ggcgctatcgtccttcgtgtctgtg

SEQ ID NO: 585420 - DNA, 25 bp, Rattus norvegicus
agggatcgcccgcactcactgccaa

SEQ ID NO: 585421 - DNA, 25 bp, Rattus norvegicus
ggatcgcccgcactcactgccaacg

SEQ ID NO: 585422 - DNA, 25 bp, Rattus norvegicus
cgcactcactgccaacgtgagcatg

SEQ ID NO: 585423 - DNA, 25 bp, Rattus norvegicus
cagctctttgctctgaatccgcgaa

SEQ ID NO: 585424 - DNA, 25 bp, Rattus norvegicus
atccggtactctgtgccagaagagc

SEQ ID NO: 585425 - DNA, 25 bp, Rattus norvegicus
tggagcctaagaaactgggagaacg

SEQ ID NO: 585426 - DNA, 25 bp, Rattus norvegicus
tgtaggtaatctcgccgcggacctg

SEQ ID NO: 585427 - DNA, 25 bp, Rattus norvegicus
aaagggctctgctgtaggtaatctc

SEQ ID NO: 585428 - DNA, 25 bp, Rattus norvegicus
tgccagaagagctggaaaagggctc

SEQ ID NO: 585429 - DNA, 25 bp, Rattus norvegicus
cgagactgcaatggcggctccttac

SEQ ID NO: 585430 - DNA, 25 bp, Rattus norvegicus
tccgcgcggaacagatccggtactc

SEQ ID NO: 585431 - DNA, 25 bp, Rattus norvegicus
gatccctatgctacatccgcgcgga

SEQ ID NO: 585432 - DNA, 25 bp, Rattus norvegicus
tctgcatttaccttggatccctatg

SEQ ID NO: 585433 - DNA, 25 bp, Rattus norvegicus
tccagaggtaagacccagctctttg

SEQ ID NO: 585434 - DNA, 25 bp, Rattus norvegicus
atggcggctccttacggatcatacc

SEQ ID NO: 585435 - DNA, 25 bp, Rattus norvegicus
cggatcataccgcaggggactaatc

SEQ ID NO: 585436 - DNA, 25 bp, Rattus norvegicus
ggggactaatctggatctgcattta

SEQ ID NO: 585437 - DNA, 25 bp, Rattus norvegicus
cagcgacctagagccaaggtcgttg

SEQ ID NO: 585438 - DNA, 25 bp, Rattus norvegicus
tccattgctcaagtcagtgcttctg

SEQ ID NO: 585439 - DNA, 25 bp, Rattus norvegicus
ctcaagtcagtgcttctgatccaga

SEQ ID NO: 585440 - DNA, 25 bp, Rattus norvegicus
agtcagtgcttctgatccagatttg

SEQ ID NO: 585441 - DNA, 25 bp, Rattus norvegicus
gtgcttctgatccagatttgggatc

SEQ ID NO: 585442 - DNA, 25 bp, Rattus norvegicus
ggatccaatggccttgtgtcctatt

SEQ ID NO: 585443 - DNA, 25 bp, Rattus norvegicus
tgtgtcctattccatcatagccagc

SEQ ID NO: 585444 - DNA, 25 bp, Rattus norvegicus
acctagagccaaggtcgttgtcttc

SEQ ID NO: 585445 - DNA, 25 bp, Rattus norvegicus
gagccaaggtcgttgtcttcttttg

SEQ ID NO: 585446 - DNA, 25 bp, Rattus norvegicus
aggtcgttgtcttcttttgtgtcca

SEQ ID NO: 585447 - DNA, 25 bp, Rattus norvegicus
cgttgtcttcttttgtgtccatgaa

SEQ ID NO: 585448 - DNA, 25 bp, Rattus norvegicus
cttcttttgtgtccatgaaccagga

SEQ ID NO: 585449 - DNA, 25 bp, Rattus norvegicus
tttgtgtccatgaaccaggacagtg

SEQ ID NO: 585450 - DNA, 25 bp, Rattus norvegicus
tggccttgtgtcctattccatcata

SEQ ID NO: 585451 - DNA, 25 bp, Rattus norvegicus
ccaggaaatgggcagatccgctact

SEQ ID NO: 585452 - DNA, 25 bp, Rattus norvegicus
aggcgcttgatctgcaacgacctgc

SEQ ID NO: 585453 - DNA, 25 bp, Rattus norvegicus
cgcttgatctgcaacgacctgctga

SEQ ID NO: 585454 - DNA, 25 bp, Rattus norvegicus
tgatctgcaacgacctgctgacgtt

SEQ ID NO: 585455 - DNA, 25 bp, Rattus norvegicus
ctgcaacgacctgctgacgttcttc

SEQ ID NO: 585456 - DNA, 25 bp, Rattus norvegicus
cgacctgctgacgttcttcatgctg

SEQ ID NO: 585457 - DNA, 25 bp, Rattus norvegicus
cctgctgacgttcttcatgctgcta

SEQ ID NO: 585458 - DNA, 25 bp, Rattus norvegicus
ctgacgttcttcatgctgctaggga

SEQ ID NO: 585459 - DNA, 25 bp, Rattus norvegicus
ttcttcatgctgctagggacgctgt

SEQ ID NO: 585460 - DNA, 25 bp, Rattus norvegicus
ttcatgctgctagggacgctgtgcg

SEQ ID NO: 585461 - DNA, 25 bp, Rattus norvegicus
tgcgcgccaggaaatgggcagatcc

SEQ ID NO: 585462 - DNA, 25 bp, Rattus norvegicus
ccgctactctgtgcgggaggagcta

SEQ ID NO: 585463 - DNA, 25 bp, Rattus norvegicus
ccaccgaggcgcttgatctgcaacg

SEQ ID NO: 585464 - DNA, 25 bp, Rattus norvegicus
accgaggcgcttgatctgcaacgac

SEQ ID NO: 585465 - DNA, 25 bp, Rattus norvegicus
gcggggtgttcgcatcgtctccaga

SEQ ID NO: 585466 - DNA, 25 bp, Rattus norvegicus
tgcgagttgctcctgcttttcagtc

SEQ ID NO: 585467 - DNA, 25 bp, Rattus norvegicus
gagttgctcctgcttttcagtctcc

SEQ ID NO: 585468 - DNA, 25 bp, Rattus norvegicus
tgctcctgcttttcagtctcctgtg

SEQ ID NO: 585469 - DNA, 25 bp, Rattus norvegicus
cctgcttttcagtctcctgtggggc

SEQ ID NO: 585470 - DNA, 25 bp, Rattus norvegicus
ttttcagtctcctgtggggctccga

SEQ ID NO: 585471 - DNA, 25 bp, Rattus norvegicus
tccgaggctgggcagatccgctatt

SEQ ID NO: 585472 - DNA, 25 bp, Rattus norvegicus
ggctgggcagatccgctattcaatt

SEQ ID NO: 585473 - DNA, 25 bp, Rattus norvegicus
ggcagatccgctattcaattcccga

SEQ ID NO: 585474 - DNA, 25 bp, Rattus norvegicus
agatccgctattcaattcccgagga

SEQ ID NO: 585475 - DNA, 25 bp, Rattus norvegicus
cgctattcaattcccgaggaactgg

SEQ ID NO: 585476 - DNA, 25 bp, Rattus norvegicus
ctggagaaagggtccttcgtgggca

SEQ ID NO: 585477 - DNA, 25 bp, Rattus norvegicus
tgctgcgagttgctcctgcttttca

SEQ ID NO: 585478 - DNA, 25 bp, Rattus norvegicus
gagcggggtgttcgcatcgtctcca

SEQ ID NO: 585479 - DNA, 25 bp, Rattus norvegicus
caaaggggagcaaaaaagatgcggg

SEQ ID NO: 585480 - DNA, 25 bp, Rattus norvegicus
taacccggcgtctccaggctggtga

SEQ ID NO: 585481 - DNA, 25 bp, Rattus norvegicus
gtttggagcccggaatatccgcacc

SEQ ID NO: 585482 - DNA, 25 bp, Rattus norvegicus
tggagcccggaatatccgcaccacg

SEQ ID NO: 585483 - DNA, 25 bp, Rattus norvegicus
ccggaatatccgcaccacggaactt

SEQ ID NO: 585484 - DNA, 25 bp, Rattus norvegicus
ggaatatccgcaccacggaacttct

SEQ ID NO: 585485 - DNA, 25 bp, Rattus norvegicus
aatatccgcaccacggaacttcttc

SEQ ID NO: 585486 - DNA, 25 bp, Rattus norvegicus
ccggcgtctccaggctggtgagcaa

SEQ ID NO: 585487 - DNA, 25 bp, Rattus norvegicus
gtctccaggctggtgagcaagcaaa

SEQ ID NO: 585488 - DNA, 25 bp, Rattus norvegicus
gctggtgagcaagcaaaggggagca

SEQ ID NO: 585489 - DNA, 25 bp, Rattus norvegicus
gctgctgagagacgccggggacaca

SEQ ID NO: 585490 - DNA, 25 bp, Rattus norvegicus
gggacacaggcggccaatgctcctt

SEQ ID NO: 585491 - DNA, 25 bp, Rattus norvegicus
acaggcggccaatgctccttccctt

SEQ ID NO: 585492 - DNA, 25 bp, Rattus norvegicus
ctccaggctggtgagcaagcaaagg

SEQ ID NO: 585493 - DNA, 25 bp, Rattus norvegicus
ccatcgctcaagtcacagcctgtga

SEQ ID NO: 585494 - DNA, 25 bp, Rattus norvegicus
tgcggaaaacaatccgcctggagcc

SEQ ID NO: 585495 - DNA, 25 bp, Rattus norvegicus
gagtagtagtctcgcagcgcgcctt

SEQ ID NO: 585496 - DNA, 25 bp, Rattus norvegicus
cgtgactataaacgcgcagagcgga

SEQ ID NO: 585497 - DNA, 25 bp, Rattus norvegicus
atcgctgtggtcctacgtgactata

SEQ ID NO: 585498 - DNA, 25 bp, Rattus norvegicus
tagccagcgacctcgagtctgaatc

SEQ ID NO: 585499 - DNA, 25 bp, Rattus norvegicus
tggccaggtttcctactccatcata

SEQ ID NO: 585500 - DNA, 25 bp, Rattus norvegicus
tacctagtccatgttgcggaaaaca

SEQ ID NO: 585501 - DNA, 25 bp, Rattus norvegicus
acgaagggttcgtacctagtccatg

SEQ ID NO: 585502 - DNA, 25 bp, Rattus norvegicus
cgctccagttttcacgaagggttcg

SEQ ID NO: 585503 - DNA, 25 bp, Rattus norvegicus
cgatgtgaacgataacgctccagtt

SEQ ID NO: 585504 - DNA, 25 bp, Rattus norvegicus
caccttgcgtataggcgatgtgaac

SEQ ID NO: 585505 - DNA, 25 bp, Rattus norvegicus
cacagcctgtgacccggatttgggg

SEQ ID NO: 585506 - DNA, 25 bp, Rattus norvegicus
tccagctcgagtatcaccttgcgta

SEQ ID NO: 585507 - DNA, 25 bp, Rattus norvegicus
ctggagctatcggagccaccatgtg

SEQ ID NO: 585508 - DNA, 25 bp, Rattus norvegicus
tgcaattccttacgctcctggctgg

SEQ ID NO: 585509 - DNA, 25 bp, Rattus norvegicus
ccaaacagttcctggtgcgctcgga

SEQ ID NO: 585510 - DNA, 25 bp, Rattus norvegicus
ttgcgacgcaaaacgaatctcctgt

SEQ ID NO: 585511 - DNA, 25 bp, Rattus norvegicus
cgagctcttggcgacacgatagata

SEQ ID NO: 585512 - DNA, 25 bp, Rattus norvegicus
ctgggcgcacatctgcaattcctta

SEQ ID NO: 585513 - DNA, 25 bp, Rattus norvegicus
gtggtcctatgtcccagtctgccgc

SEQ ID NO: 585514 - DNA, 25 bp, Rattus norvegicus
caagctcaatcatcctgggcgcgga

SEQ ID NO: 585515 - DNA, 25 bp, Rattus norvegicus
tccatataccgggagggcgcttcct

SEQ ID NO: 585516 - DNA, 25 bp, Rattus norvegicus
cagaggtgtttccactccatatacc

SEQ ID NO: 585517 - DNA, 25 bp, Rattus norvegicus
ctcgcggaccaggagtaacgactcg

SEQ ID NO: 585518 - DNA, 25 bp, Rattus norvegicus
tggggctttccttagccaggccttc

SEQ ID NO: 585519 - DNA, 25 bp, Rattus norvegicus
tttcagagcccagaccagagagcca

SEQ ID NO: 585520 - DNA, 25 bp, Rattus norvegicus
cgacctcacctgtgcggtgtcagta

SEQ ID NO: 585521 - DNA, 25 bp, Rattus norvegicus
ccaggaagtatacagagtccgcctt

SEQ ID NO: 585522 - DNA, 25 bp, Rattus norvegicus
ggatccaagtcactgatgccaacga

SEQ ID NO: 585523 - DNA, 25 bp, Rattus norvegicus
agtcactgatgccaacgataatccc

SEQ ID NO: 585524 - DNA, 25 bp, Rattus norvegicus
gttcgaccaggaagtatacagagtc

SEQ ID NO: 585525 - DNA, 25 bp, Rattus norvegicus
aagtatacagagtccgccttccgga

SEQ ID NO: 585526 - DNA, 25 bp, Rattus norvegicus
tacagagtccgccttccggagaacg

SEQ ID NO: 585527 - DNA, 25 bp, Rattus norvegicus
tgacagctacagacaaggatgaggg

SEQ ID NO: 585528 - DNA, 25 bp, Rattus norvegicus
ccctgtgttcgaccaggaagtatac

SEQ ID NO: 585529 - DNA, 25 bp, Rattus norvegicus
atgagggcgtgaattcggagattac

SEQ ID NO: 585530 - DNA, 25 bp, Rattus norvegicus
agagtccgccttccggagaacgtgc

SEQ ID NO: 585531 - DNA, 25 bp, Rattus norvegicus
cgtgtgacagctacagacaaggatg

SEQ ID NO: 585532 - DNA, 25 bp, Rattus norvegicus
agcacgtgtgacagctacagacaag

SEQ ID NO: 585533 - DNA, 25 bp, Rattus norvegicus
acaaccgtagcacgtgtgacagcta

SEQ ID NO: 585534 - DNA, 25 bp, Rattus norvegicus
ccaggcacaaccgtagcacgtgtga

SEQ ID NO: 585535 - DNA, 25 bp, Rattus norvegicus
aataggccatggagtgcccaatcgc

SEQ ID NO: 585536 - DNA, 25 bp, Rattus norvegicus
ccacagtcttggctctcgatgtcat

SEQ ID NO: 585537 - DNA, 25 bp, Rattus norvegicus
acgtcataagcgagcgacgcgctga

SEQ ID NO: 585538 - DNA, 25 bp, Rattus norvegicus
tcataagcgagcgacgcgctgaaaa

SEQ ID NO: 585539 - DNA, 25 bp, Rattus norvegicus
ataagcgagcgacgcgctgaaaaaa

SEQ ID NO: 585540 - DNA, 25 bp, Rattus norvegicus
agcgacgcgctgaaaaaaataggcc

SEQ ID NO: 585541 - DNA, 25 bp, Rattus norvegicus
aaaataggccatggagtgcccaatc

SEQ ID NO: 585542 - DNA, 25 bp, Rattus norvegicus
gtgacgtcataagcgagcgacgcgc

SEQ ID NO: 585543 - DNA, 25 bp, Rattus norvegicus
atggagtgcccaatcgccccacagt

SEQ ID NO: 585544 - DNA, 25 bp, Rattus norvegicus
acagtcttggctctcgatgtcatca

SEQ ID NO: 585545 - DNA, 25 bp, Rattus norvegicus
tgtcatcactaagcgtccccatctt

SEQ ID NO: 585546 - DNA, 25 bp, Rattus norvegicus
ccaacaactactcggaatcgaggtg

SEQ ID NO: 585547 - DNA, 25 bp, Rattus norvegicus
tgtcgcccgtgtgcgcgggatggga

SEQ ID NO: 585548 - DNA, 25 bp, Rattus norvegicus
taggccatggagtgcccaatcgccc

SEQ ID NO: 585549 - DNA, 25 bp, Rattus norvegicus
ccatgggcgtgcagtgagtaacact

SEQ ID NO: 585550 - DNA, 25 bp, Rattus norvegicus
ccgatgacccttctgtggtcccaga

SEQ ID NO: 585551 - DNA, 25 bp, Rattus norvegicus
catcattcttccgagtgggttggtc

SEQ ID NO: 585552 - DNA, 25 bp, Rattus norvegicus
cggaggagagttaggcatcatcatt

SEQ ID NO: 585553 - DNA, 25 bp, Rattus norvegicus
ccaagtcgttgtttaaggatttcag

SEQ ID NO: 585554 - DNA, 25 bp, Rattus norvegicus
cggtctcctcagtcctttagaaata

SEQ ID NO: 585555 - DNA, 25 bp, Rattus norvegicus
aggcgctcttcttttcatcggtctc

SEQ ID NO: 585556 - DNA, 25 bp, Rattus norvegicus
caccatgaaaggtaaggcggttgcc

SEQ ID NO: 585557 - DNA, 25 bp, Rattus norvegicus
agtaacactggtgcgacttctccgg

SEQ ID NO: 585558 - DNA, 25 bp, Rattus norvegicus
gtcacactgccacaggccgactgtt

SEQ ID NO: 585559 - DNA, 25 bp, Rattus norvegicus
ctaggattggaactcagaaggctgc

SEQ ID NO: 585560 - DNA, 25 bp, Rattus norvegicus
agtttggaagtgctcaggcgctctt

SEQ ID NO: 585561 - DNA, 25 bp, Rattus norvegicus
ccaggagaggagttccacgtatttc

SEQ ID NO: 585562 - DNA, 25 bp, Rattus norvegicus
agcgtgtcctcggtcaccatgaaag

SEQ ID NO: 585563 - DNA, 25 bp, Rattus norvegicus
gccgagctgcagttctacttggtgg

SEQ ID NO: 585564 - DNA, 25 bp, Rattus norvegicus
gcaagccgagctgcagttctacttg

SEQ ID NO: 585565 - DNA, 25 bp, Rattus norvegicus
tagtattcgctgacagcttgcagga

SEQ ID NO: 585566 - DNA, 25 bp, Rattus norvegicus
gcttctagtattcgctgacagcttg

SEQ ID NO: 585567 - DNA, 25 bp, Rattus norvegicus
acgctgcttctagtattcgctgaca

SEQ ID NO: 585568 - DNA, 25 bp, Rattus norvegicus
accgccacgctgcttctagtattcg

SEQ ID NO: 585569 - DNA, 25 bp, Rattus norvegicus
agcgcctgttggttggtgttcgcga

SEQ ID NO: 585570 - DNA, 25 bp, Rattus norvegicus
tgccttgggcgaaaaggacgctgcg

SEQ ID NO: 585571 - DNA, 25 bp, Rattus norvegicus
cgcagagcggagtggtgttcgccca

SEQ ID NO: 585572 - DNA, 25 bp, Rattus norvegicus
tatgtgaccgtgaacgcgcagagcg

SEQ ID NO: 585573 - DNA, 25 bp, Rattus norvegicus
tcctatgtgaccgtgaacgcgcaga

SEQ ID NO: 585574 - DNA, 25 bp, Rattus norvegicus
cgctgtggtcctatgtgaccgtgaa

SEQ ID NO: 585575 - DNA, 25 bp, Rattus norvegicus
cctggagcctaaatcgctgtggtcc

SEQ ID NO: 585576 - DNA, 25 bp, Rattus norvegicus
gtgacctggagcctaaatcgctgtg

SEQ ID NO: 585577 - DNA, 25 bp, Rattus norvegicus
tgcagagcaagctcctctgcccgga

SEQ ID NO: 585578 - DNA, 25 bp, Rattus norvegicus
agatctacccagaacccgagccaga

SEQ ID NO: 585579 - DNA, 25 bp, Rattus norvegicus
ctgtgaagaaccgaagatctaccca

SEQ ID NO: 585580 - DNA, 25 bp, Rattus norvegicus
tcggtaggctgctctttctcctact

SEQ ID NO: 585581 - DNA, 25 bp, Rattus norvegicus
catctcggtaggctgctctttctcc

SEQ ID NO: 585582 - DNA, 25 bp, Rattus norvegicus
cctccatctcggtaggctgctcttt

SEQ ID NO: 585583 - DNA, 25 bp, Rattus norvegicus
aacggacctccatctcggtaggctg

SEQ ID NO: 585584 - DNA, 25 bp, Rattus norvegicus
ggccaaacggacctccatctcggta

SEQ ID NO: 585585 - DNA, 25 bp, Rattus norvegicus
aagacaccgattcctggcaccaaac

SEQ ID NO: 585586 - DNA, 25 bp, Rattus norvegicus
acagactaagacaccgattcctggc

SEQ ID NO: 585587 - DNA, 25 bp, Rattus norvegicus
acacaccaaggggaactctcactca

SEQ ID NO: 585588 - DNA, 25 bp, Rattus norvegicus
gcgcagaaacgaatacacaccaagg

SEQ ID NO: 585589 - DNA, 25 bp, Rattus norvegicus
ttcctgcgcagaaacgaatacacac

SEQ ID NO: 585590 - DNA, 25 bp, Rattus norvegicus
cccagaacccgagccagaaatggga

SEQ ID NO: 585591 - DNA, 25 bp, Rattus norvegicus
tctctcagagcgcaccaaactggtc

SEQ ID NO: 585592 - DNA, 25 bp, Rattus norvegicus
caatggccgctcaaaggaatctctc

SEQ ID NO: 585593 - DNA, 25 bp, Rattus norvegicus
actggtcctccttttcctatggatg

SEQ ID NO: 585594 - DNA, 25 bp, Rattus norvegicus
agatccgctactcggttcctgagga

SEQ ID NO: 585595 - DNA, 25 bp, Rattus norvegicus
gtcgctccgggaatgcgttttcctc

SEQ ID NO: 585596 - DNA, 25 bp, Rattus norvegicus
ccggatgtggacgtgaactctctac

SEQ ID NO: 585597 - DNA, 25 bp, Rattus norvegicus
ccctagtcgttcagagcggtgctaa

SEQ ID NO: 585598 - DNA, 25 bp, Rattus norvegicus
ggcgattcatcacctggtcctcgtg

SEQ ID NO: 585599 - DNA, 25 bp, Rattus norvegicus
ctcgtggcctctgacggaggaaacc

SEQ ID NO: 585600 - DNA, 25 bp, Rattus norvegicus
tctggcactgtcctcatcactgtga

SEQ ID NO: 585601 - DNA, 25 bp, Rattus norvegicus
actgtgaccgtctttgatgcaaatg

SEQ ID NO: 585602 - DNA, 25 bp, Rattus norvegicus
acctcgactgaataccgcgtgaacg

SEQ ID NO: 585603 - DNA, 25 bp, Rattus norvegicus
tgggcactcggctgctaaaggtaac

SEQ ID NO: 585604 - DNA, 25 bp, Rattus norvegicus
cgccaatggagaagtgacatacgca

SEQ ID NO: 585605 - DNA, 25 bp, Rattus norvegicus
gacctacagagaacccgagccaaca

SEQ ID NO: 585606 - DNA, 25 bp, Rattus norvegicus
acagactaagacatcgattcccgga

SEQ ID NO: 585607 - DNA, 25 bp, Rattus norvegicus
cacatcaaggggaaactctcactca

SEQ ID NO: 585608 - DNA, 25 bp, Rattus norvegicus
cgaatacacatcaaggggaaactct

SEQ ID NO: 585609 - DNA, 25 bp, Rattus norvegicus
tcctacgcacaaacgaatacacatc

SEQ ID NO: 585610 - DNA, 25 bp, Rattus norvegicus
tccgctgtcccggatccctcagtct

SEQ ID NO: 585611 - DNA, 25 bp, Rattus norvegicus
tgcagagcaagctccgctgtcccgg

SEQ ID NO: 585612 - DNA, 25 bp, Rattus norvegicus
catcgattcccggacacaaaccggg

SEQ ID NO: 585613 - DNA, 25 bp, Rattus norvegicus
tgaacgcgcctccaccgcggtaggc

SEQ ID NO: 585614 - DNA, 25 bp, Rattus norvegicus
cagagaacccgagccaacaatggga

SEQ ID NO: 585615 - DNA, 25 bp, Rattus norvegicus
gcggtaggctgcactctctcctact

SEQ ID NO: 585616 - DNA, 25 bp, Rattus norvegicus
ctgtgaagaactgaagacctacaga

SEQ ID NO: 585617 - DNA, 25 bp, Rattus norvegicus
tgaagacctacagagaacccgagcc

SEQ ID NO: 585618 - DNA, 25 bp, Rattus norvegicus
ctaagacatcgattcccggacacaa

SEQ ID NO: 585619 - DNA, 25 bp, Rattus norvegicus
cagcccggtacgtccataactcaag

SEQ ID NO: 585620 - DNA, 25 bp, Rattus norvegicus
gcgttgccagacctcgtcgatcatc

SEQ ID NO: 585621 - DNA, 25 bp, Rattus norvegicus
cctacaagaagcgttgccagacctc

SEQ ID NO: 585622 - DNA, 25 bp, Rattus norvegicus
tgcagacaccctacaagaagcgttg

SEQ ID NO: 585623 - DNA, 25 bp, Rattus norvegicus
gcttctagtttttgcagacacccta

SEQ ID NO: 585624 - DNA, 25 bp, Rattus norvegicus
gtccgctactgctacactgcttcta

SEQ ID NO: 585625 - DNA, 25 bp, Rattus norvegicus
aggatgcagctcgtcagcgccttct

SEQ ID NO: 585626 - DNA, 25 bp, Rattus norvegicus
gccttgggcgataaggatgcagctc

SEQ ID NO: 585627 - DNA, 25 bp, Rattus norvegicus
agtgctgtcatccttcgtgtctgtg

SEQ ID NO: 585628 - DNA, 25 bp, Rattus norvegicus
gaaccaaaagtgctgtcatccttcg

SEQ ID NO: 585629 - DNA, 25 bp, Rattus norvegicus
agctagcgacctagaaccaaaagtg

SEQ ID NO: 585630 - DNA, 25 bp, Rattus norvegicus
agcatgggatccagatgtgggatcc

SEQ ID NO: 585631 - DNA, 25 bp, Rattus norvegicus
cggtacgtccataactcaagtcaga

SEQ ID NO: 585632 - DNA, 25 bp, Rattus norvegicus
ctcaagtcagagcatgggatccaga

SEQ ID NO: 585633 - DNA, 25 bp, Rattus norvegicus
cgctggtcccgctgtgcattttcct

SEQ ID NO: 585634 - DNA, 25 bp, Rattus norvegicus
gctcacacccagctatggcgaatca

SEQ ID NO: 585635 - DNA, 25 bp, Rattus norvegicus
ccttgctgacctttgggacaggaca

SEQ ID NO: 585636 - DNA, 25 bp, Rattus norvegicus
gtctccagaggaaaatcgcagcttt

SEQ ID NO: 585637 - DNA, 25 bp, Rattus norvegicus
tcttcgtaggcaacatctccaaaga

SEQ ID NO: 585638 - DNA, 25 bp, Rattus norvegicus
taaaggcttcttcgtaggcaacatc

SEQ ID NO: 585639 - DNA, 25 bp, Rattus norvegicus
gttccagaagagacagataaaggct

SEQ ID NO: 585640 - DNA, 25 bp, Rattus norvegicus
ccgatattcggttccagaagagaca

SEQ ID NO: 585641 - DNA, 25 bp, Rattus norvegicus
ttgggacaggacaaatccgatattc

SEQ ID NO: 585642 - DNA, 25 bp, Rattus norvegicus
attttcctggggaccttgctgacct

SEQ ID NO: 585643 - DNA, 25 bp, Rattus norvegicus
ccagctatggcgaatcagcttcagc

SEQ ID NO: 585644 - DNA, 25 bp, Rattus norvegicus
ggaacaacgctcacacccagctatg

SEQ ID NO: 585645 - DNA, 25 bp, Rattus norvegicus
ggcgcaagaccctcacggaacaacg

SEQ ID NO: 585646 - DNA, 25 bp, Rattus norvegicus
gaatcagcttcagcgcctggaccgc

SEQ ID NO: 585647 - DNA, 25 bp, Rattus norvegicus
agtgccacctcagaaaccctcggag

SEQ ID NO: 585648 - DNA, 25 bp, Rattus norvegicus
agagtttctgagcagagctaatccc

SEQ ID NO: 585649 - DNA, 25 bp, Rattus norvegicus
ttcagcgtctctgggtgctcagcct

SEQ ID NO: 585650 - DNA, 25 bp, Rattus norvegicus
accctcggggaggacagagtttctg

SEQ ID NO: 585651 - DNA, 25 bp, Rattus norvegicus
ccctcaaggtgcttggaggacgaga

SEQ ID NO: 585652 - DNA, 25 bp, Rattus norvegicus
gtggccactaccctcaaggtgcttg

SEQ ID NO: 585653 - DNA, 25 bp, Rattus norvegicus
agcgctcgtcagaaggggctccagt

SEQ ID NO: 585654 - DNA, 25 bp, Rattus norvegicus
gagcccgcgtggacctcgcagctgt

SEQ ID NO: 585655 - DNA, 25 bp, Rattus norvegicus
cctcagaaaccctcggaggagtgcg

SEQ ID NO: 585656 - DNA, 25 bp, Rattus norvegicus
gcggttatccggcagtgccacctca

SEQ ID NO: 585657 - DNA, 25 bp, Rattus norvegicus
ccctcgccctgactgcagcagacta

SEQ ID NO: 585658 - DNA, 25 bp, Rattus norvegicus
cgagaaatgggttcccacaccctcg

SEQ ID NO: 585659 - DNA, 25 bp, Rattus norvegicus
gttcatttaggaagaacgagaaatg

SEQ ID NO: 585660 - DNA, 25 bp, Rattus norvegicus
tgcggagggcactcagcgctcgtca

SEQ ID NO: 585661 - DNA, 25 bp, Rattus norvegicus
tgacttggatccctagtcctctgcg

SEQ ID NO: 585662 - DNA, 25 bp, Rattus norvegicus
cagctctcgctcctcttggcccacc

SEQ ID NO: 585663 - DNA, 25 bp, Rattus norvegicus
ttggcccaccctctccggcgcatgc

SEQ ID NO: 585664 - DNA, 25 bp, Rattus norvegicus
gccactttgcactagggtatccaga

SEQ ID NO: 585665 - DNA, 25 bp, Rattus norvegicus
gatccctagtcctctgcgcacattg

SEQ ID NO: 585666 - DNA, 25 bp, Rattus norvegicus
gcgcacattggcagacgcgcttata

SEQ ID NO: 585667 - DNA, 25 bp, Rattus norvegicus
cacattggcagacgcgcttatagca

SEQ ID NO: 585668 - DNA, 25 bp, Rattus norvegicus
ggcagacgcgcttatagcaagcaga

SEQ ID NO: 585669 - DNA, 25 bp, Rattus norvegicus
cgcgcttatagcaagcagacggcca

SEQ ID NO: 585670 - DNA, 25 bp, Rattus norvegicus
ttatagcaagcagacggccaggcgg

SEQ ID NO: 585671 - DNA, 25 bp, Rattus norvegicus
cgggctcaggagctggtcctagatt

SEQ ID NO: 585672 - DNA, 25 bp, Rattus norvegicus
ctttgcactagggtatccagagcgc

SEQ ID NO: 585673 - DNA, 25 bp, Rattus norvegicus
ggtcctagattgacttggatcccta

SEQ ID NO: 585674 - DNA, 25 bp, Rattus norvegicus
ggcgccactttgcactagggtatcc

SEQ ID NO: 585675 - DNA, 25 bp, Rattus norvegicus
gagatgagcctttgccgtctgaccc

SEQ ID NO: 585676 - DNA, 25 bp, Rattus norvegicus
gggagcttccattgctcaggtcagc

SEQ ID NO: 585677 - DNA, 25 bp, Rattus norvegicus
ctcagtgctctttcttttcgttgtg

SEQ ID NO: 585678 - DNA, 25 bp, Rattus norvegicus
gcgaccttgaacctaaatcactgtg

SEQ ID NO: 585679 - DNA, 25 bp, Rattus norvegicus
ttgaacctaaatcactgtggtccta

SEQ ID NO: 585680 - DNA, 25 bp, Rattus norvegicus
ctgtggtcctatgtgtctgtgaacc

SEQ ID NO: 585681 - DNA, 25 bp, Rattus norvegicus
ctcccagaactcagagatgagcctt

SEQ ID NO: 585682 - DNA, 25 bp, Rattus norvegicus
actcagagatgagcctttgccgtct

SEQ ID NO: 585683 - DNA, 25 bp, Rattus norvegicus
gtgattctggcaatcgcccttcgcc

SEQ ID NO: 585684 - DNA, 25 bp, Rattus norvegicus
cctccgggagcttccattgctcagg

SEQ ID NO: 585685 - DNA, 25 bp, Rattus norvegicus
tggccttggccttagtctcagtgct

SEQ ID NO: 585686 - DNA, 25 bp, Rattus norvegicus
tcttttcgttgtgattctggcaatc

SEQ ID NO: 585687 - DNA, 25 bp, Rattus norvegicus
catagccagcgaccttgaacctaaa

SEQ ID NO: 585688 - DNA, 25 bp, Rattus norvegicus
ggccttagtctcagtgctctttctt

SEQ ID NO: 585689 - DNA, 25 bp, Rattus norvegicus
cgccgctggaatgcgattccctctt

SEQ ID NO: 585690 - DNA, 25 bp, Rattus norvegicus
gtctccagaggtagggctcaacttt

SEQ ID NO: 585691 - DNA, 25 bp, Rattus norvegicus
tccagatatcgggaagaactctctt

SEQ ID NO: 585692 - DNA, 25 bp, Rattus norvegicus
accgaccgggacgaaggatccaatg

SEQ ID NO: 585693 - DNA, 25 bp, Rattus norvegicus
tcggtccgagtaccgcgtgaatgtg

SEQ ID NO: 585694 - DNA, 25 bp, Rattus norvegicus
tagatgcaaatgacaacgcgccagc

SEQ ID NO: 585695 - DNA, 25 bp, Rattus norvegicus
tccttgtgacggtcctagatgcaaa

SEQ ID NO: 585696 - DNA, 25 bp, Rattus norvegicus
acccagaattggtgctggagagctc

SEQ ID NO: 585697 - DNA, 25 bp, Rattus norvegicus
ccgaatgctcacttctcgctcgagg

SEQ ID NO: 585698 - DNA, 25 bp, Rattus norvegicus
cccacgcttgggatccagatatcgg

SEQ ID NO: 585699 - DNA, 25 bp, Rattus norvegicus
taaaaatgagtgaaaacgccgccgc

SEQ ID NO: 585700 - DNA, 25 bp, Rattus norvegicus
acgcaccctacttccgtgaaagtga

SEQ ID NO: 585701 - DNA, 25 bp, Rattus norvegicus
tggggtccatcaagtgtcagttaaa

SEQ ID NO: 585702 - DNA, 25 bp, Rattus norvegicus
tttcgctctaaaccctcgaagcggc

SEQ ID NO: 585703 - DNA, 25 bp, Rattus norvegicus
cactgtggcgatcgccgacagtatc

SEQ ID NO: 585704 - DNA, 25 bp, Rattus norvegicus
cactgtcacgctcactgtggcgatc

SEQ ID NO: 585705 - DNA, 25 bp, Rattus norvegicus
cgtagatggagtgcaagctttcttg

SEQ ID NO: 585706 - DNA, 25 bp, Rattus norvegicus
ctgaaacctcaggtctcacgctgta

SEQ ID NO: 585707 - DNA, 25 bp, Rattus norvegicus
tctcacgctgtatctggtggtggcc

SEQ ID NO: 585708 - DNA, 25 bp, Rattus norvegicus
agcggtctccatggtcttcctggtc

SEQ ID NO: 585709 - DNA, 25 bp, Rattus norvegicus
ctagaatctcctaccacctctgaaa

SEQ ID NO: 585710 - DNA, 25 bp, Rattus norvegicus
tcctggtctttgttctggtgctgct

SEQ ID NO: 585711 - DNA, 25 bp, Rattus norvegicus
cgtcctggcagatttggacaatcta

SEQ ID NO: 585712 - DNA, 25 bp, Rattus norvegicus
gacccggattggctgacgttgcagc

SEQ ID NO: 585713 - DNA, 25 bp, Rattus norvegicus
tgacgttgcagcctctcgttttgtg

SEQ ID NO: 585714 - DNA, 25 bp, Rattus norvegicus
ctctcgttttgtgggcgtagatgga

SEQ ID NO: 585715 - DNA, 25 bp, Rattus norvegicus
tattcgcacgaggtctcgctcactg

SEQ ID NO: 585716 - DNA, 25 bp, Rattus norvegicus
gctttcttgcagacctattcgcacg

SEQ ID NO: 585717 - DNA, 25 bp, Rattus norvegicus
ggagatcccggtcctgtggaagcaa

SEQ ID NO: 585718 - DNA, 25 bp, Rattus norvegicus
gagatcccggtcctgtggaagcaat

SEQ ID NO: 585719 - DNA, 25 bp, Rattus norvegicus
agatcccggtcctgtggaagcaatc

SEQ ID NO: 585720 - DNA, 25 bp, Rattus norvegicus
gatcccggtcctgtggaagcaatcg

SEQ ID NO: 585721 - DNA, 25 bp, Rattus norvegicus
ccggtcctgtggaagcaatcgcctt

SEQ ID NO: 585722 - DNA, 25 bp, Rattus norvegicus
cggtcctgtggaagcaatcgccttc

SEQ ID NO: 585723 - DNA, 25 bp, Rattus norvegicus
ggtcctgtggaagcaatcgccttcc

SEQ ID NO: 585724 - DNA, 25 bp, Rattus norvegicus
gtcctgtggaagcaatcgccttcca

SEQ ID NO: 585725 - DNA, 25 bp, Rattus norvegicus
tcctgtggaagcaatcgccttccaa

SEQ ID NO: 585726 - DNA, 25 bp, Rattus norvegicus
cctgtggaagcaatcgccttccaaa

SEQ ID NO: 585727 - DNA, 25 bp, Rattus norvegicus
ctgtggaagcaatcgccttccaaag

SEQ ID NO: 585728 - DNA, 25 bp, Rattus norvegicus
tgtggaagcaatcgccttccaaagg

SEQ ID NO: 585729 - DNA, 25 bp, Rattus norvegicus
tggaagcaatcgccttccaaaggcg

SEQ ID NO: 585730 - DNA, 25 bp, Rattus norvegicus
tggagatcccggtcctgtggaagca

SEQ ID NO: 585731 - DNA, 25 bp, Rattus norvegicus
ctaggcgatgcgatcactaagactg

SEQ ID NO: 585732 - DNA, 25 bp, Rattus norvegicus
taacttcgctcgtgaaggatcgtgc

SEQ ID NO: 585733 - DNA, 25 bp, Rattus norvegicus
gctcgtgaaggatcgtgctgaacta

SEQ ID NO: 585734 - DNA, 25 bp, Rattus norvegicus
gtgctgaactacgtggagatcccgg

SEQ ID NO: 585735 - DNA, 25 bp, Rattus norvegicus
ctgggagtcccagaaacttggaaag

SEQ ID NO: 585736 - DNA, 25 bp, Rattus norvegicus
cgatgcgatcactaagactgagggg

SEQ ID NO: 585737 - DNA, 25 bp, Rattus norvegicus
acttggaaagtaacttcgctcgtga

SEQ ID NO: 585738 - DNA, 25 bp, Rattus norvegicus
tccagactaggcgatgcgatcacta

SEQ ID NO: 585739 - DNA, 25 bp, Rattus norvegicus
gtttcattcccagcgcggtcctggg

SEQ ID NO: 585740 - DNA, 25 bp, Rattus norvegicus
tccagccgctccagactaggcgatg

SEQ ID NO: 585741 - DNA, 25 bp, Rattus norvegicus
atgacttccgagtttccagccgctc

SEQ ID NO: 585742 - DNA, 25 bp, Rattus norvegicus
gggctgaatgcgaaatgacttccga

SEQ ID NO: 585743 - DNA, 25 bp, Rattus norvegicus
tcctgggctgaatgcgaaatgactt

SEQ ID NO: 585744 - DNA, 25 bp, Rattus norvegicus
gcgccctgggagtcccagaaacttg

SEQ ID NO: 585745 - DNA, 25 bp, Rattus norvegicus
tgtccggagctagccgtaggttctt

SEQ ID NO: 585746 - DNA, 25 bp, Rattus norvegicus
gcgctaacccgctgaaagtttctct

SEQ ID NO: 585747 - DNA, 25 bp, Rattus norvegicus
tgccctcctgcactgtaactctgga

SEQ ID NO: 585748 - DNA, 25 bp, Rattus norvegicus
cccaccgcggaaatgaaattggaga

SEQ ID NO: 585749 - DNA, 25 bp, Rattus norvegicus
aatcagtctttgtatagggcgcgcg

SEQ ID NO: 585750 - DNA, 25 bp, Rattus norvegicus
atcacagtgctggacgcgaatgaca

SEQ ID NO: 585751 - DNA, 25 bp, Rattus norvegicus
ctgaccgcacttgatggaggaaccc

SEQ ID NO: 585752 - DNA, 25 bp, Rattus norvegicus
tcccgatgtgggaagcaactcttta

SEQ ID NO: 585753 - DNA, 25 bp, Rattus norvegicus
gagtactttgcgctccgcgtgcaga

SEQ ID NO: 585754 - DNA, 25 bp, Rattus norvegicus
tgagctgagccacaacgagtacttt

SEQ ID NO: 585755 - DNA, 25 bp, Rattus norvegicus
gaggcttccaccatcattcactatg

SEQ ID NO: 585756 - DNA, 25 bp, Rattus norvegicus
tgctagctgccttgaccgaggcttc

SEQ ID NO: 585757 - DNA, 25 bp, Rattus norvegicus
aacggtgggagttttgcttctgcta

SEQ ID NO: 585758 - DNA, 25 bp, Rattus norvegicus
tgttcgtcaacgatcgactggaccg

SEQ ID NO: 585759 - DNA, 25 bp, Rattus norvegicus
atttgttactgaccgcaatgacaac

SEQ ID NO: 585760 - DNA, 25 bp, Rattus norvegicus
tctttctcttggaacccggagcgga

SEQ ID NO: 585761 - DNA, 25 bp, Rattus norvegicus
cggaaactggtctcgtaggtcgcta

SEQ ID NO: 585762 - DNA, 25 bp, Rattus norvegicus
actggtctcgtaggtcgctatttca

SEQ ID NO: 585763 - DNA, 25 bp, Rattus norvegicus
ggtcgctatttcacaataaatcgtg

SEQ ID NO: 585764 - DNA, 25 bp, Rattus norvegicus
tcgtgacaatggaatcttgacaacc

SEQ ID NO: 585765 - DNA, 25 bp, Rattus norvegicus
tggaatcttgacaaccttagtaccc

SEQ ID NO: 585766 - DNA, 25 bp, Rattus norvegicus
tatgaggatcagagagagttccagc

SEQ ID NO: 585767 - DNA, 25 bp, Rattus norvegicus
agagttccagctaaccgctcatata

SEQ ID NO: 585768 - DNA, 25 bp, Rattus norvegicus
cgctcatataaacgacggaggtacc

SEQ ID NO: 585769 - DNA, 25 bp, Rattus norvegicus
ccggttttggccaccaacatcagcg

SEQ ID NO: 585770 - DNA, 25 bp, Rattus norvegicus
cgtgaacatatttgttactgaccgc

SEQ ID NO: 585771 - DNA, 25 bp, Rattus norvegicus
cccggcctggccagagttcagtgga

SEQ ID NO: 585772 - DNA, 25 bp, Rattus norvegicus
ggccaccaacatcagcgtgaacata

SEQ ID NO: 585773 - DNA, 25 bp, Rattus norvegicus
cgcgcctcatgaatatacaatggtg

SEQ ID NO: 585774 - DNA, 25 bp, Rattus norvegicus
ctaaccattcggacccacgtgtagg

SEQ ID NO: 585775 - DNA, 25 bp, Rattus norvegicus
tctgccaggccacagcggggagtac

SEQ ID NO: 585776 - DNA, 25 bp, Rattus norvegicus
cggacggctccatgtcctggttagc

SEQ ID NO: 585777 - DNA, 25 bp, Rattus norvegicus
catgtcctggttagcgccggccaga

SEQ ID NO: 585778 - DNA, 25 bp, Rattus norvegicus
cccgcctcattaacatgctgggctg

SEQ ID NO: 585779 - DNA, 25 bp, Rattus norvegicus
ctgcgcgcgcctcatgaatatacaa

SEQ ID NO: 585780 - DNA, 25 bp, Rattus norvegicus
aaatttcttatgtttgccgccgtcg

SEQ ID NO: 585781 - DNA, 25 bp, Rattus norvegicus
atacaatggtgacgcctcgctcccg

SEQ ID NO: 585782 - DNA, 25 bp, Rattus norvegicus
ggccactccgccaggctgaggagca

SEQ ID NO: 585783 - DNA, 25 bp, Rattus norvegicus
gggagggacactcacaaatttctta

SEQ ID NO: 585784 - DNA, 25 bp, Rattus norvegicus
cagcgaaggaagctccaaggtggcc

SEQ ID NO: 585785 - DNA, 25 bp, Rattus norvegicus
cagagcctgcggactgaacagcgaa

SEQ ID NO: 585786 - DNA, 25 bp, Rattus norvegicus
tcattaacatgctgggctgcgcgcg

SEQ ID NO: 585787 - DNA, 25 bp, Rattus norvegicus
taaaccgagccattccgtccagctg

SEQ ID NO: 585788 - DNA, 25 bp, Rattus norvegicus
acgcgagtaggcatttgggaaccca

SEQ ID NO: 585789 - DNA, 25 bp, Rattus norvegicus
ttcacacacgcgtaaggctcacata

SEQ ID NO: 585790 - DNA, 25 bp, Rattus norvegicus
tgcagtcacgcgcacatctcacttg

SEQ ID NO: 585791 - DNA, 25 bp, Rattus norvegicus
gactggtggccaaagcctctcctga

SEQ ID NO: 585792 - DNA, 25 bp, Rattus norvegicus
cagtcgtctgggtaatctgagggca

SEQ ID NO: 585793 - DNA, 25 bp, Rattus norvegicus
aggaacctcggaagatctggcaaca

SEQ ID NO: 585794 - DNA, 25 bp, Rattus norvegicus
agctgttaccctcaaacgggtcttg

SEQ ID NO: 585795 - DNA, 25 bp, Rattus norvegicus
gggcgagggtcatatcctcagtaaa

SEQ ID NO: 585796 - DNA, 25 bp, Rattus norvegicus
aatagccgcttctttcggggcgagg

SEQ ID NO: 585797 - DNA, 25 bp, Rattus norvegicus
tccgaggcttgagacttggaacctg

SEQ ID NO: 585798 - DNA, 25 bp, Rattus norvegicus
cctcattatgctgccctggtccggt

SEQ ID NO: 585799 - DNA, 25 bp, Rattus norvegicus
gcctcccaaggctaggctttggcca

SEQ ID NO: 585800 - DNA, 25 bp, Rattus norvegicus
ggggtcgtgatttctctctaggaac

SEQ ID NO: 585801 - DNA, 25 bp, Rattus norvegicus
ggctgcatcgcgattccaccaaagg

SEQ ID NO: 585802 - DNA, 25 bp, Rattus norvegicus
agcagaggaactgaacctgttattc

SEQ ID NO: 585803 - DNA, 25 bp, Rattus norvegicus
cgattccaccaaaggctgccagaca

SEQ ID NO: 585804 - DNA, 25 bp, Rattus norvegicus
ctgttattccctgctacaagtaccc

SEQ ID NO: 585805 - DNA, 25 bp, Rattus norvegicus
gaactgaacctgttattccctgcta

SEQ ID NO: 585806 - DNA, 25 bp, Rattus norvegicus
cacaggggcagcagaggaactgaac

SEQ ID NO: 585807 - DNA, 25 bp, Rattus norvegicus
ccgggcgcggaagaacacaggggca

SEQ ID NO: 585808 - DNA, 25 bp, Rattus norvegicus
acgctcgtcaagctgcgcgccgggc

SEQ ID NO: 585809 - DNA, 25 bp, Rattus norvegicus
gctccgcccacgctcgtcaagctgc

SEQ ID NO: 585810 - DNA, 25 bp, Rattus norvegicus
tctactccggaactcgaggaagccc

SEQ ID NO: 585811 - DNA, 25 bp, Rattus norvegicus
agacactctactccggaactcgagg

SEQ ID NO: 585812 - DNA, 25 bp, Rattus norvegicus
aggctgccagacactctactccgga

SEQ ID NO: 585813 - DNA, 25 bp, Rattus norvegicus
atcgcgattccaccaaaggctgcca

SEQ ID NO: 585814 - DNA, 25 bp, Rattus norvegicus
tgaacctgttattccctgctacaag

SEQ ID NO: 585815 - DNA, 25 bp, Rattus norvegicus
ctggtttcatttcgcagattgatta

SEQ ID NO: 585816 - DNA, 25 bp, Rattus norvegicus
acttttgtcccgcttcagaggcagg

SEQ ID NO: 585817 - DNA, 25 bp, Rattus norvegicus
tgtttctctcgcctgaaggactggt

SEQ ID NO: 585818 - DNA, 25 bp, Rattus norvegicus
cttttgtcccgcttcagaggcaggg

SEQ ID NO: 585819 - DNA, 25 bp, Rattus norvegicus
tgcggaggaacacggtctgtttctc

SEQ ID NO: 585820 - DNA, 25 bp, Rattus norvegicus
cggaggaacacggtctgtttctctc

SEQ ID NO: 585821 - DNA, 25 bp, Rattus norvegicus
ggaacacggtctgtttctctcgcct

SEQ ID NO: 585822 - DNA, 25 bp, Rattus norvegicus
ttctctcgcctgaaggactggtttc

SEQ ID NO: 585823 - DNA, 25 bp, Rattus norvegicus
tctcgcctgaaggactggtttcatt

SEQ ID NO: 585824 - DNA, 25 bp, Rattus norvegicus
tattgctgcatgtgtggatgtgcgc

SEQ ID NO: 585825 - DNA, 25 bp, Rattus norvegicus
cagattgattattgctgcatgtgtg

SEQ ID NO: 585826 - DNA, 25 bp, Rattus norvegicus
gtttcatttcgcagattgattattg

SEQ ID NO: 585827 - DNA, 25 bp, Rattus norvegicus
ggactggtttcatttcgcagattga

SEQ ID NO: 585828 - DNA, 25 bp, Rattus norvegicus
ttcgcagattgattattgctgcatg

SEQ ID NO: 585829 - DNA, 25 bp, Rattus norvegicus
ttgcgggcgatcaccatggaaacag

SEQ ID NO: 585830 - DNA, 25 bp, Rattus norvegicus
gcttgtcgctgctctcgctactgaa

SEQ ID NO: 585831 - DNA, 25 bp, Rattus norvegicus
gaaacagcagctcggccaatcagtg

SEQ ID NO: 585832 - DNA, 25 bp, Rattus norvegicus
cacgctgggacctcggcccacagcc

SEQ ID NO: 585833 - DNA, 25 bp, Rattus norvegicus
cacagcctggctcctcacgcggctc

SEQ ID NO: 585834 - DNA, 25 bp, Rattus norvegicus
attaacctgcttgtcgctgctctcg

SEQ ID NO: 585835 - DNA, 25 bp, Rattus norvegicus
cgctgctctcgctactgaatagggc

SEQ ID NO: 585836 - DNA, 25 bp, Rattus norvegicus
tctcgctactgaatagggcctgggg

SEQ ID NO: 585837 - DNA, 25 bp, Rattus norvegicus
gcgatcaccatggaaacagcagctc

SEQ ID NO: 585838 - DNA, 25 bp, Rattus norvegicus
tgcagcgggcagctcggtctctgaa

SEQ ID NO: 585839 - DNA, 25 bp, Rattus norvegicus
tcggtctctgaagcctcgtgctgcc

SEQ ID NO: 585840 - DNA, 25 bp, Rattus norvegicus
cggctgactcctgcctgacaggcgg

SEQ ID NO: 585841 - DNA, 25 bp, Rattus norvegicus
tgactcctgcctgacaggcggtccg

SEQ ID NO: 585842 - DNA, 25 bp, Rattus norvegicus
ggctcctgttttattaacctgcttg

SEQ ID NO: 585843 - DNA, 25 bp, Rattus norvegicus
agtccctgtgctcaactaatcccgg

SEQ ID NO: 585844 - DNA, 25 bp, Rattus norvegicus
cccagagtccgaggccctgaaagcg

SEQ ID NO: 585845 - DNA, 25 bp, Rattus norvegicus
gacccagagtccgaggccctgaaag

SEQ ID NO: 585846 - DNA, 25 bp, Rattus norvegicus
taatcccggtggctgggtggaccca

SEQ ID NO: 585847 - DNA, 25 bp, Rattus norvegicus
caactaatcccggtggctgggtgga

SEQ ID NO: 585848 - DNA, 25 bp, Rattus norvegicus
ccctgtgctcaactaatcccggtgg

SEQ ID NO: 585849 - DNA, 25 bp, Rattus norvegicus
tccaggattagtccctgtgctcaac

SEQ ID NO: 585850 - DNA, 25 bp, Rattus norvegicus
ggctcatccaggattagtccctgtg

SEQ ID NO: 585851 - DNA, 25 bp, Rattus norvegicus
caccgtggctcatccaggattagtc

SEQ ID NO: 585852 - DNA, 25 bp, Rattus norvegicus
ggtttacaccgtggctcatccagga

SEQ ID NO: 585853 - DNA, 25 bp, Rattus norvegicus
tccgggtttacaccgtggctcatcc

SEQ ID NO: 585854 - DNA, 25 bp, Rattus norvegicus
tcaatccgggtttacaccgtggctc

SEQ ID NO: 585855 - DNA, 25 bp, Rattus norvegicus
ggagcggaaacgagccgggataggc

SEQ ID NO: 585856 - DNA, 25 bp, Rattus norvegicus
tgtgctcaactaatcccggtggctg

SEQ ID NO: 585857 - DNA, 25 bp, Rattus norvegicus
atggtgacaccgacgtacgccgaac

SEQ ID NO: 585858 - DNA, 25 bp, Rattus norvegicus
gccggctacaacaccaaagagaatg

SEQ ID NO: 585859 - DNA, 25 bp, Rattus norvegicus
ccagagtcaatgtcctccgctgtca

SEQ ID NO: 585860 - DNA, 25 bp, Rattus norvegicus
cacctggctgactgtctcgccgaga

SEQ ID NO: 585861 - DNA, 25 bp, Rattus norvegicus
ttgccgccagcgatgctataggtca

SEQ ID NO: 585862 - DNA, 25 bp, Rattus norvegicus
aagagtccgtaagggttgccgccag

SEQ ID NO: 585863 - DNA, 25 bp, Rattus norvegicus
tggcacctgaatgtgatccaatctg

SEQ ID NO: 585864 - DNA, 25 bp, Rattus norvegicus
ccttctccagcgtgatggcacctga

SEQ ID NO: 585865 - DNA, 25 bp, Rattus norvegicus
ctgaccttcaccacaaggcggtgta

SEQ ID NO: 585866 - DNA, 25 bp, Rattus norvegicus
tctcgttgacgtaaaggtggaccaa

SEQ ID NO: 585867 - DNA, 25 bp, Rattus norvegicus
ccaggctatggacaaggagggtctc

SEQ ID NO: 585868 - DNA, 25 bp, Rattus norvegicus
caatgtcaatatccaggggcgtgtc

SEQ ID NO: 585869 - DNA, 25 bp, Rattus norvegicus
aggtcagctcggcattgataccaga

SEQ ID NO: 585870 - DNA, 25 bp, Rattus norvegicus
tgccacgttgcttggaacgctcata

SEQ ID NO: 585871 - DNA, 25 bp, Rattus norvegicus
tatcctggccaaggagtgggcaccc

SEQ ID NO: 585872 - DNA, 25 bp, Rattus norvegicus
tccggttgtgccgatatttacaata

SEQ ID NO: 585873 - DNA, 25 bp, Rattus norvegicus
gcaagacctgtgctgtatacctata

SEQ ID NO: 585874 - DNA, 25 bp, Rattus norvegicus
gcgcgctgcagagtgtaatgtgaca

SEQ ID NO: 585875 - DNA, 25 bp, Rattus norvegicus
tcccgattgaggtgacagggctctg

SEQ ID NO: 585876 - DNA, 25 bp, Rattus norvegicus
cgggaggtatgtctgtgctcacata

SEQ ID NO: 585877 - DNA, 25 bp, Rattus norvegicus
ctggcgaaccgaggcagttatattc

SEQ ID NO: 585878 - DNA, 25 bp, Rattus norvegicus
ttgttcccggaatacccagctggtc

SEQ ID NO: 585879 - DNA, 25 bp, Rattus norvegicus
cttcagcggtatgtgtagggaacta

SEQ ID NO: 585880 - DNA, 25 bp, Rattus norvegicus
actaggttcagcgttcatctggcga

SEQ ID NO: 585881 - DNA, 25 bp, Rattus norvegicus
tgtagctatctatggccacgggttg

SEQ ID NO: 585882 - DNA, 25 bp, Rattus norvegicus
gtgtccggcattgctcaatatcata

SEQ ID NO: 585883 - DNA, 25 bp, Rattus norvegicus
acccaggtagctcggagaaagcagc

SEQ ID NO: 585884 - DNA, 25 bp, Rattus norvegicus
atctagggccacacagctccagggt

SEQ ID NO: 585885 - DNA, 25 bp, Rattus norvegicus
ccagagcccggcctatgagtcatac

SEQ ID NO: 585886 - DNA, 25 bp, Rattus norvegicus
gctggccactctagctgtgtgtgcc

SEQ ID NO: 585887 - DNA, 25 bp, Rattus norvegicus
ccggagaatatcaccgctggccact

SEQ ID NO: 585888 - DNA, 25 bp, Rattus norvegicus
caagatgtctccgacgccggcgctt

SEQ ID NO: 585889 - DNA, 25 bp, Rattus norvegicus
ctatgagtcatacggctgagccaga

SEQ ID NO: 585890 - DNA, 25 bp, Rattus norvegicus
gacgtcatcactgtgagccgcagta

SEQ ID NO: 585891 - DNA, 25 bp, Rattus norvegicus
cgctccattctagtgtggtcccaga

SEQ ID NO: 585892 - DNA, 25 bp, Rattus norvegicus
agctgactgcgcgagacaccctaga

SEQ ID NO: 585893 - DNA, 25 bp, Rattus norvegicus
ctgccgagaaaaccagccttgtctg

SEQ ID NO: 585894 - DNA, 25 bp, Rattus norvegicus
agccgtcattcgtctgccgagaaaa

SEQ ID NO: 585895 - DNA, 25 bp, Rattus norvegicus
cggcgcttttcagtttgcccgaggc

SEQ ID NO: 585896 - DNA, 25 bp, Rattus norvegicus
cctgaaactgcaccaagccgtcatt

SEQ ID NO: 585897 - DNA, 25 bp, Rattus norvegicus
ctgagccagattgcaccggagaata

SEQ ID NO: 585898 - DNA, 25 bp, Rattus norvegicus
tgggcacgcgcaaccaagatgtctc

SEQ ID NO: 585899 - DNA, 25 bp, Rattus norvegicus
gctagctcattcatgacctgcagga

SEQ ID NO: 585900 - DNA, 25 bp, Rattus norvegicus
ccctgccacccgacccgggcagctc

SEQ ID NO: 585901 - DNA, 25 bp, Rattus norvegicus
gcacagctgtgacgaccgcgcgcgt

SEQ ID NO: 585902 - DNA, 25 bp, Rattus norvegicus
gctctagcgccctccgcactgcggt

SEQ ID NO: 585903 - DNA, 25 bp, Rattus norvegicus
cactgcggtcgcttcccaggcgggt

SEQ ID NO: 585904 - DNA, 25 bp, Rattus norvegicus
cttcccaggcgggtgaagcccaggc

SEQ ID NO: 585905 - DNA, 25 bp, Rattus norvegicus
gaagcccaggccagcgattctgtga

SEQ ID NO: 585906 - DNA, 25 bp, Rattus norvegicus
aggccagcgattctgtgacagcttc

SEQ ID NO: 585907 - DNA, 25 bp, Rattus norvegicus
cagcgattctgtgacagcttctcca

SEQ ID NO: 585908 - DNA, 25 bp, Rattus norvegicus
tctgtgacagcttctccaggcggtc

SEQ ID NO: 585909 - DNA, 25 bp, Rattus norvegicus
cgccggctagctcattcatgacctg

SEQ ID NO: 585910 - DNA, 25 bp, Rattus norvegicus
caggagccagggttaccaatagcgt

SEQ ID NO: 585911 - DNA, 25 bp, Rattus norvegicus
cagggttaccaatagcgtacggtcg

SEQ ID NO: 585912 - DNA, 25 bp, Rattus norvegicus
tgacagcttctccaggcggtcaacc

SEQ ID NO: 585913 - DNA, 25 bp, Rattus norvegicus
tcgcggctcctgcaatggcgataga

SEQ ID NO: 585914 - DNA, 25 bp, Rattus norvegicus
ctgctacgacatgtggcgcctgaca

SEQ ID NO: 585915 - DNA, 25 bp, Rattus norvegicus
tgcaagctctatggtgctgctacga

SEQ ID NO: 585916 - DNA, 25 bp, Rattus norvegicus
tcggacctcgatcccttggctgcaa

SEQ ID NO: 585917 - DNA, 25 bp, Rattus norvegicus
ccagcaggcgatggacttgtaacta

SEQ ID NO: 585918 - DNA, 25 bp, Rattus norvegicus
cttgtaactacagtgcgccgcgatc

SEQ ID NO: 585919 - DNA, 25 bp, Rattus norvegicus
cgatccgcgggaagaccgccatagc

SEQ ID NO: 585920 - DNA, 25 bp, Rattus norvegicus
tgcgcagtatcaactctggtccctg

SEQ ID NO: 585921 - DNA, 25 bp, Rattus norvegicus
agagcgtcatccttccggcagggct

SEQ ID NO: 585922 - DNA, 25 bp, Rattus norvegicus
cggcagggctccttgctaattggct

SEQ ID NO: 585923 - DNA, 25 bp, Rattus norvegicus
gctacttccttcctagagcgtcatc

SEQ ID NO: 585924 - DNA, 25 bp, Rattus norvegicus
gtagctctcacctagctagcgccaa

SEQ ID NO: 585925 - DNA, 25 bp, Rattus norvegicus
tagaggacaaaatctcggccctggc

SEQ ID NO: 585926 - DNA, 25 bp, Rattus norvegicus
cctggccctgcttcaagttcttgta

SEQ ID NO: 585927 - DNA, 25 bp, Rattus norvegicus
tgcttgggagtcgtacaaatacgtc

SEQ ID NO: 585928 - DNA, 25 bp, Rattus norvegicus
tgcctgatcctgtcgggtgttgctt

SEQ ID NO: 585929 - DNA, 25 bp, Rattus norvegicus
gggcctatagccctgcctgatcctg

SEQ ID NO: 585930 - DNA, 25 bp, Rattus norvegicus
gaacagttcctctacgccattgcta

SEQ ID NO: 585931 - DNA, 25 bp, Rattus norvegicus
gcacgcccggggaacagttcctcta

SEQ ID NO: 585932 - DNA, 25 bp, Rattus norvegicus
caaatacgtctgcatggcgattggc

SEQ ID NO: 585933 - DNA, 25 bp, Rattus norvegicus
gcggctcctgcagcgatggccacaa

SEQ ID NO: 585934 - DNA, 25 bp, Rattus norvegicus
gatggccacaacctgtagagggcgc

SEQ ID NO: 585935 - DNA, 25 bp, Rattus norvegicus
agccagatgcgctcacggcggctgc

SEQ ID NO: 585936 - DNA, 25 bp, Rattus norvegicus
agctgacagctctggagacggaaga

SEQ ID NO: 585937 - DNA, 25 bp, Rattus norvegicus
ttctcaggtggtgcccggtgactgc

SEQ ID NO: 585938 - DNA, 25 bp, Rattus norvegicus
gtcaagggcatactgcggaactttc

SEQ ID NO: 585939 - DNA, 25 bp, Rattus norvegicus
ctgcggaactttcgggcccggctca

SEQ ID NO: 585940 - DNA, 25 bp, Rattus norvegicus
tgctctgtggacactcggctccctg

SEQ ID NO: 585941 - DNA, 25 bp, Rattus norvegicus
ctgggtaccagcaggtgagcggccc

SEQ ID NO: 585942 - DNA, 25 bp, Rattus norvegicus
cggcctgcggcactgggtaccagca

SEQ ID NO: 585943 - DNA, 25 bp, Rattus norvegicus
ctgctgcgccatggctttggcgttg

SEQ ID NO: 585944 - DNA, 25 bp, Rattus norvegicus
cctgaggcctgctgcgccatggctt

SEQ ID NO: 585945 - DNA, 25 bp, Rattus norvegicus
cccgcgctcgttcagctctctcgct

SEQ ID NO: 585946 - DNA, 25 bp, Rattus norvegicus
gcggcacccgcgctcgttcagctct

SEQ ID NO: 585947 - DNA, 25 bp, Rattus norvegicus
gcgcgtacctctcggcctcccggcg

SEQ ID NO: 585948 - DNA, 25 bp, Rattus norvegicus
acgccgcggcgcgtacctctcggcc

SEQ ID NO: 585949 - DNA, 25 bp, Rattus norvegicus
cggccatccacacgccgcggcgcgt

SEQ ID NO: 585950 - DNA, 25 bp, Rattus norvegicus
agcgtccctgcgtcggcagcggcca

SEQ ID NO: 585951 - DNA, 25 bp, Rattus norvegicus
tgcctgcggagagcgtccctgcgtc

SEQ ID NO: 585952 - DNA, 25 bp, Rattus norvegicus
tcagtgcctgcggagagcgtccctg

SEQ ID NO: 585953 - DNA, 25 bp, Rattus norvegicus
cgctcagtgcctgcggagagcgtcc

SEQ ID NO: 585954 - DNA, 25 bp, Rattus norvegicus
cgcctcctacccaggggccgcggcg

SEQ ID NO: 585955 - DNA, 25 bp, Rattus norvegicus
tgtactgatccgtacctccctcgtg

SEQ ID NO: 585956 - DNA, 25 bp, Rattus norvegicus
tgatccgtacctccctcgtgcctgt

SEQ ID NO: 585957 - DNA, 25 bp, Rattus norvegicus
cctcgtgcctgttctcttcttcttt

SEQ ID NO: 585958 - DNA, 25 bp, Rattus norvegicus
gtgtactgatccgtacctccctcgt

SEQ ID NO: 585959 - DNA, 25 bp, Rattus norvegicus
gtgcctgttctcttcttcttttccc

SEQ ID NO: 585960 - DNA, 25 bp, Rattus norvegicus
cctgcctgtcgtgtactgatccgta

SEQ ID NO: 585961 - DNA, 25 bp, Rattus norvegicus
tcttcttcttttcccctcgtgcttg

SEQ ID NO: 585962 - DNA, 25 bp, Rattus norvegicus
tcgtgcctgttctcttcttcttttc

SEQ ID NO: 585963 - DNA, 25 bp, Rattus norvegicus
tgtcgtgtactgatccgtacctccc

SEQ ID NO: 585964 - DNA, 25 bp, Rattus norvegicus
tgcctgtcgtgtactgatccgtacc

SEQ ID NO: 585965 - DNA, 25 bp, Rattus norvegicus
ccctgcctgtcgtgtactgatccgt

SEQ ID NO: 585966 - DNA, 25 bp, Rattus norvegicus
gtggatgatggtggtcttctctgcc

SEQ ID NO: 585967 - DNA, 25 bp, Rattus norvegicus
gtcgtgtactgatccgtacctccct

SEQ ID NO: 585968 - DNA, 25 bp, Rattus norvegicus
cctgtcgtgtactgatccgtacctc

SEQ ID NO: 585969 - DNA, 25 bp, Rattus norvegicus
cggcagcgcagcgttgcgcggactc

SEQ ID NO: 585970 - DNA, 25 bp, Rattus norvegicus
ctccacccgcgcttccctgagcggc

SEQ ID NO: 585971 - DNA, 25 bp, Rattus norvegicus
acacacctgcgctgcggacaagggc

SEQ ID NO: 585972 - DNA, 25 bp, Rattus norvegicus
ggagacacacctgcgctgcggacaa

SEQ ID NO: 585973 - DNA, 25 bp, Rattus norvegicus
agtaacgcgcggtcgggagacacac

SEQ ID NO: 585974 - DNA, 25 bp, Rattus norvegicus
cgccgggagccggtgagtaacgcgc

SEQ ID NO: 585975 - DNA, 25 bp, Rattus norvegicus
agaggactcctggacactgggcctt

SEQ ID NO: 585976 - DNA, 25 bp, Rattus norvegicus
tttcgagaggactcctggacactgg

SEQ ID NO: 585977 - DNA, 25 bp, Rattus norvegicus
tgggtttcgagaggactcctggaca

SEQ ID NO: 585978 - DNA, 25 bp, Rattus norvegicus
ccacgttgtgggtttcgagaggact

SEQ ID NO: 585979 - DNA, 25 bp, Rattus norvegicus
cgaaccacgttgtgggtttcgagag

SEQ ID NO: 585980 - DNA, 25 bp, Rattus norvegicus
cccaagcgaggggagacgaaccacg

SEQ ID NO: 585981 - DNA, 25 bp, Rattus norvegicus
gactcctggacactgggccttgacc

SEQ ID NO: 585982 - DNA, 25 bp, Rattus norvegicus
taggcagcgcccggtctacggtgca

SEQ ID NO: 585983 - DNA, 25 bp, Rattus norvegicus
cgcgcatgcgctaggctcctttttt

SEQ ID NO: 585984 - DNA, 25 bp, Rattus norvegicus
gctgcagagtcacaagcatcgctcc

SEQ ID NO: 585985 - DNA, 25 bp, Rattus norvegicus
gcatcgctccacgtctgtgtaaatc

SEQ ID NO: 585986 - DNA, 25 bp, Rattus norvegicus
ggtcagtcgccgttgtactcacaga

SEQ ID NO: 585987 - DNA, 25 bp, Rattus norvegicus
agacgccaagtcagaggagccggta

SEQ ID NO: 585988 - DNA, 25 bp, Rattus norvegicus
gttgcaacccttgcctgggaaaatg

SEQ ID NO: 585989 - DNA, 25 bp, Rattus norvegicus
cttaacccgtgattgctggggccgg

SEQ ID NO: 585990 - DNA, 25 bp, Rattus norvegicus
cgcgccgctcgcgattctatgaatg

SEQ ID NO: 585991 - DNA, 25 bp, Rattus norvegicus
aaacggcagtgccaggctgtgaaca

SEQ ID NO: 585992 - DNA, 25 bp, Rattus norvegicus
tggacttactttgaggagctgcaga

SEQ ID NO: 585993 - DNA, 25 bp, Rattus norvegicus
agctacgtcgagcataggccgctga

SEQ ID NO: 585994 - DNA, 25 bp, Rattus norvegicus
acacgcacagggcttccagagtcgc

SEQ ID NO: 585995 - DNA, 25 bp, Rattus norvegicus
aagacccacgagagagctggcaccg

SEQ ID NO: 585996 - DNA, 25 bp, Rattus norvegicus
ccaaaggggatcgaaatagtgcacc

SEQ ID NO: 585997 - DNA, 25 bp, Rattus norvegicus
ctcaagagtgagtgtccggagcagc

SEQ ID NO: 585998 - DNA, 25 bp, Rattus norvegicus
gaccagcgtgcaaggcgcatccctt

SEQ ID NO: 585999 - DNA, 25 bp, Rattus norvegicus
tctcaagtcccacgaagcggagctg

SEQ ID NO: 586000 - DNA, 25 bp, Rattus norvegicus
gctggacaagaccaacaaattcatc

SEQ ID NO: 586001 - DNA, 25 bp, Rattus norvegicus
ttcggtgtctctcagcagtagtagc

SEQ ID NO: 586002 - DNA, 25 bp, Rattus norvegicus
aagtcgctcatcagcgcgctcaaga

SEQ ID NO: 586003 - DNA, 25 bp, Rattus norvegicus
gctttcatccttcctcgggcgtaga

SEQ ID NO: 586004 - DNA, 25 bp, Rattus norvegicus
tcgagcgaggcaagaaggaaacgta

SEQ ID NO: 586005 - DNA, 25 bp, Rattus norvegicus
ttggaggaatctggtcgcccagccc

SEQ ID NO: 586006 - DNA, 25 bp, Rattus norvegicus
cgacacaggtgtttctggcgtgagc

SEQ ID NO: 586007 - DNA, 25 bp, Rattus norvegicus
ggaaacccattttcacgcttccatg

SEQ ID NO: 586008 - DNA, 25 bp, Rattus norvegicus
tcttaaggggcgaatcgcttacctc

SEQ ID NO: 586009 - DNA, 25 bp, Rattus norvegicus
actcatcaaggacgggaagtcgctc

SEQ ID NO: 586010 - DNA, 25 bp, Rattus norvegicus
cgcttccatggtttggtattcttaa

SEQ ID NO: 586011 - DNA, 25 bp, Rattus norvegicus
ctcgagctcgcaaaatggaggaggc

SEQ ID NO: 586012 - DNA, 25 bp, Rattus norvegicus
gaacggtgcaacctgttggcgactg

SEQ ID NO: 586013 - DNA, 25 bp, Rattus norvegicus
tcccaccgcagccagataaacaagt

SEQ ID NO: 586014 - DNA, 25 bp, Rattus norvegicus
gcaaaagtttgccaagtccggccgc

SEQ ID NO: 586015 - DNA, 25 bp, Rattus norvegicus
cggcgactcgggctccaggcactga

SEQ ID NO: 586016 - DNA, 25 bp, Rattus norvegicus
gttggcgactgtcggcaactgcaag

SEQ ID NO: 586017 - DNA, 25 bp, Rattus norvegicus
cggcgtcttgttccacccacttaga

SEQ ID NO: 586018 - DNA, 25 bp, Rattus norvegicus
ccaggcactgactcgagctcgcaaa

SEQ ID NO: 586019 - DNA, 25 bp, Rattus norvegicus
ccaaggaacgagaaaaagtgcggca

SEQ ID NO: 586020 - DNA, 25 bp, Rattus norvegicus
aagtcacccgttcccggctgacaag

SEQ ID NO: 586021 - DNA, 25 bp, Rattus norvegicus
tagcgctgaaagtcacccgttcccg

SEQ ID NO: 586022 - DNA, 25 bp, Rattus norvegicus
ccagataaacaagtcggcgtgcgga

SEQ ID NO: 586023 - DNA, 25 bp, Rattus norvegicus
cacggagaaggaagtcaacagtcgc

SEQ ID NO: 586024 - DNA, 25 bp, Rattus norvegicus
ttgttccacccacttagaatccgtc

SEQ ID NO: 586025 - DNA, 25 bp, Rattus norvegicus
ctgacctcttggagatccctgattg

SEQ ID NO: 586026 - DNA, 25 bp, Rattus norvegicus
tcttggtaaagagcagtgacgccgc

SEQ ID NO: 586027 - DNA, 25 bp, Rattus norvegicus
tgacgccgcacggtcaccatcttgg

SEQ ID NO: 586028 - DNA, 25 bp, Rattus norvegicus
accatcttggcaaaggtgctctttg

SEQ ID NO: 586029 - DNA, 25 bp, Rattus norvegicus
tgctctttggcgtcaaacccgagtc

SEQ ID NO: 586030 - DNA, 25 bp, Rattus norvegicus
acccgagtcgttctttcttggatga

SEQ ID NO: 586031 - DNA, 25 bp, Rattus norvegicus
ttggatgaaaagcttaaaggctgcc

SEQ ID NO: 586032 - DNA, 25 bp, Rattus norvegicus
taaaggctgcccaatgtatcgtccg

SEQ ID NO: 586033 - DNA, 25 bp, Rattus norvegicus
atgtatcgtccgctttgcacgggga

SEQ ID NO: 586034 - DNA, 25 bp, Rattus norvegicus
tttgcacggggagaacgtgactgta

SEQ ID NO: 586035 - DNA, 25 bp, Rattus norvegicus
aacgtgactgtaagcgggctccttg

SEQ ID NO: 586036 - DNA, 25 bp, Rattus norvegicus
ggtctcctctgcctgacctcttgga

SEQ ID NO: 586037 - DNA, 25 bp, Rattus norvegicus
tccttgggcagagatgccgcacggt

SEQ ID NO: 586038 - DNA, 25 bp, Rattus norvegicus
gcacttcgactccaagggcggtctc

SEQ ID NO: 586039 - DNA, 25 bp, Rattus norvegicus
actcagttccagacccggcagtagc

SEQ ID NO: 586040 - DNA, 25 bp, Rattus norvegicus
aaccggtagccgatccgcacaactg

SEQ ID NO: 586041 - DNA, 25 bp, Rattus norvegicus
ggcccacgcagacagaaccggtagc

SEQ ID NO: 586042 - DNA, 25 bp, Rattus norvegicus
tacatatagaaactaggggcctcgc

SEQ ID NO: 586043 - DNA, 25 bp, Rattus norvegicus
gcgtaggcgccgttacacatacata

SEQ ID NO: 586044 - DNA, 25 bp, Rattus norvegicus
cttccggcaaccgtagagcagggga

SEQ ID NO: 586045 - DNA, 25 bp, Rattus norvegicus
tcctgtgacgaaccaatagggaaca

SEQ ID NO: 586046 - DNA, 25 bp, Rattus norvegicus
cgggacttacagatggtcgtcttga

SEQ ID NO: 586047 - DNA, 25 bp, Rattus norvegicus
ctccctaggaatgtgcgtgtttggc

SEQ ID NO: 586048 - DNA, 25 bp, Rattus norvegicus
tgcgcagtctggtttggttgaactc

SEQ ID NO: 586049 - DNA, 25 bp, Rattus norvegicus
caagcgtgttagctgtttttgcgca

SEQ ID NO: 586050 - DNA, 25 bp, Rattus norvegicus
tgtcacaagccgaggaactgtttcc

SEQ ID NO: 586051 - DNA, 25 bp, Rattus norvegicus
agccctgttgctacgtgtcacaagc

SEQ ID NO: 586052 - DNA, 25 bp, Rattus norvegicus
gggcaacatgagacccggacactca

SEQ ID NO: 586053 - DNA, 25 bp, Rattus norvegicus
gccgaggtatatgaagcagcttgcg

SEQ ID NO: 586054 - DNA, 25 bp, Rattus norvegicus
gccactggcgatgacgcagcagcac

SEQ ID NO: 586055 - DNA, 25 bp, Rattus norvegicus
ttcaaaccggccactggcgatgacg

SEQ ID NO: 586056 - DNA, 25 bp, Rattus norvegicus
gtgcgacaagcctcattcaaaccgg

SEQ ID NO: 586057 - DNA, 25 bp, Rattus norvegicus
agcagcacgctgttcgcccaggaag

SEQ ID NO: 586058 - DNA, 25 bp, Rattus norvegicus
atatgaagcagcttgcggagccggc

SEQ ID NO: 586059 - DNA, 25 bp, Rattus norvegicus
gcctgacaagggcagccgaggtata

SEQ ID NO: 586060 - DNA, 25 bp, Rattus norvegicus
tcaccagagtagagtggcatggcga

SEQ ID NO: 586061 - DNA, 25 bp, Rattus norvegicus
acggagctcaccagagtagagtggc

SEQ ID NO: 586062 - DNA, 25 bp, Rattus norvegicus
cctctgcaggctgggcctacgcgga

SEQ ID NO: 586063 - DNA, 25 bp, Rattus norvegicus
tccgcatttcccaccgtggcccatg

SEQ ID NO: 586064 - DNA, 25 bp, Rattus norvegicus
ggacaagcctctacgcctagctggg

SEQ ID NO: 586065 - DNA, 25 bp, Rattus norvegicus
ggagacacagcggacaagcctctac

SEQ ID NO: 586066 - DNA, 25 bp, Rattus norvegicus
ctccggtgcgacaagcctcattcaa

SEQ ID NO: 586067 - DNA, 25 bp, Rattus norvegicus
tcatccctgtgagcagccttcgagg

SEQ ID NO: 586068 - DNA, 25 bp, Rattus norvegicus
aagcaagcgaccacctgctcgaagg

SEQ ID NO: 586069 - DNA, 25 bp, Rattus norvegicus
tggtacctttcggaggaagcaagcg

SEQ ID NO: 586070 - DNA, 25 bp, Rattus norvegicus
ccaggtcagagggactggtaccttt

SEQ ID NO: 586071 - DNA, 25 bp, Rattus norvegicus
cagcgggcacacttcccaggtcaga

SEQ ID NO: 586072 - DNA, 25 bp, Rattus norvegicus
gggcacttcaggctctccgcagcgg

SEQ ID NO: 586073 - DNA, 25 bp, Rattus norvegicus
ggaacacctggtgcacgtccacggt

SEQ ID NO: 586074 - DNA, 25 bp, Rattus norvegicus
gtccggtcaccacgcgacgtaggcg

SEQ ID NO: 586075 - DNA, 25 bp, Rattus norvegicus
cctgaggattgggtccggtcaccac

SEQ ID NO: 586076 - DNA, 25 bp, Rattus norvegicus
ggactcggagggtgactctagaccc

SEQ ID NO: 586077 - DNA, 25 bp, Rattus norvegicus
ctgctcgaaggggtactggaacacc

SEQ ID NO: 586078 - DNA, 25 bp, Rattus norvegicus
tgagcagccttcgaggaaacccgcc

SEQ ID NO: 586079 - DNA, 25 bp, Rattus norvegicus
gtgatgccatgcacggcgcccttcg

SEQ ID NO: 586080 - DNA, 25 bp, Rattus norvegicus
ttgtcctgcacatcccgggagcagc

SEQ ID NO: 586081 - DNA, 25 bp, Rattus norvegicus
agaccgtgctcccagaccacagaga

SEQ ID NO: 586082 - DNA, 25 bp, Rattus norvegicus
cacggagatctgaagaccgtgctcc

SEQ ID NO: 586083 - DNA, 25 bp, Rattus norvegicus
gctcccagaccacggagatctgaag

SEQ ID NO: 586084 - DNA, 25 bp, Rattus norvegicus
cagagatctgaagaccgtgctccca

SEQ ID NO: 586085 - DNA, 25 bp, Rattus norvegicus
tgaagaccgtgctcccagaccacag

SEQ ID NO: 586086 - DNA, 25 bp, Rattus norvegicus
atctgaagaccgtgctcccagacca

SEQ ID NO: 586087 - DNA, 25 bp, Rattus norvegicus
cagaccacggagatctgaagaccgt

SEQ ID NO: 586088 - DNA, 25 bp, Rattus norvegicus
cacagagatctgaagaccgtgctcc

SEQ ID NO: 586089 - DNA, 25 bp, Rattus norvegicus
agacctcggagatctgaagaccgtg

SEQ ID NO: 586090 - DNA, 25 bp, Rattus norvegicus
agaccgtgctcccagaccacggaga

SEQ ID NO: 586091 - DNA, 25 bp, Rattus norvegicus
ccagaccacggagatctgaagaccg

SEQ ID NO: 586092 - DNA, 25 bp, Rattus norvegicus
tgaagaccgtgctcccagaccacgg

SEQ ID NO: 586093 - DNA, 25 bp, Rattus norvegicus
cccagaccacggagatctgaagacc

SEQ ID NO: 586094 - DNA, 25 bp, Rattus norvegicus
gaccgtgctcccagaccacggagat

SEQ ID NO: 586095 - DNA, 25 bp, Rattus norvegicus
gcaggaggactttgcaaacagtgtc

SEQ ID NO: 586096 - DNA, 25 bp, Rattus norvegicus
gcccgcctggtacaagtccacagtg

SEQ ID NO: 586097 - DNA, 25 bp, Rattus norvegicus
ggcttcccgagtacacacaccggga

SEQ ID NO: 586098 - DNA, 25 bp, Rattus norvegicus
ccttacgattggctttccgcgcgca

SEQ ID NO: 586099 - DNA, 25 bp, Rattus norvegicus
gcgcgactgtcgagggatttttaaa

SEQ ID NO: 586100 - DNA, 25 bp, Rattus norvegicus
tcctggctggccaagttactggagc

SEQ ID NO: 586101 - DNA, 25 bp, Rattus norvegicus
tgtggatgccctcaagtcctggctg

SEQ ID NO: 586102 - DNA, 25 bp, Rattus norvegicus
gctcatagaagatgtggatgccctc

SEQ ID NO: 586103 - DNA, 25 bp, Rattus norvegicus
ttccctgcaccatgctcatagaaga

SEQ ID NO: 586104 - DNA, 25 bp, Rattus norvegicus
gcccagggagtaggtgaagtctata

SEQ ID NO: 586105 - DNA, 25 bp, Rattus norvegicus
gctcttgggttagttcctgttaggc

SEQ ID NO: 586106 - DNA, 25 bp, Rattus norvegicus
ttggttaatcctcccgtcactcatc

SEQ ID NO: 586107 - DNA, 25 bp, Rattus norvegicus
gcagccctctatcgcctattggtta

SEQ ID NO: 586108 - DNA, 25 bp, Rattus norvegicus
aaacagtgtctaggagcccggtgtc

SEQ ID NO: 586109 - DNA, 25 bp, Rattus norvegicus
ccacttgcatcaggccatgggcatg

SEQ ID NO: 586110 - DNA, 25 bp, Rattus norvegicus
ctcagcgatgtggagtcagaccctc

SEQ ID NO: 586111 - DNA, 25 bp, Rattus norvegicus
atgagtcacccgcatgccgtagcac

SEQ ID NO: 586112 - DNA, 25 bp, Rattus norvegicus
acccgcatcatctaggcgccatggg

SEQ ID NO: 586113 - DNA, 25 bp, Rattus norvegicus
agggcgacttactggagcacatctc

SEQ ID NO: 586114 - DNA, 25 bp, Rattus norvegicus
gtggatatcgtctcccacggcaaga

SEQ ID NO: 586115 - DNA, 25 bp, Rattus norvegicus
cttgcagctgcagggtaatatattt

SEQ ID NO: 586116 - DNA, 25 bp, Rattus norvegicus
gaggctgcctccgtattaattttta

SEQ ID NO: 586117 - DNA, 25 bp, Rattus norvegicus
tgtcgcccagaacaatcgccgctgt

SEQ ID NO: 586118 - DNA, 25 bp, Rattus norvegicus
tgggcgcggctttagccaatcttaa

SEQ ID NO: 586119 - DNA, 25 bp, Rattus norvegicus
ggccatgaacgccaagcagcctttc

SEQ ID NO: 586120 - DNA, 25 bp, Rattus norvegicus
tgccatgcctgcgtgtctcagcgat

SEQ ID NO: 586121 - DNA, 25 bp, Rattus norvegicus
ccctgccagactcccgaagatgatg

SEQ ID NO: 586122 - DNA, 25 bp, Rattus norvegicus
ggcacattttttgacaggcactagc

SEQ ID NO: 586123 - DNA, 25 bp, Rattus norvegicus
gcaccagggcatgcgaagcagtgtt

SEQ ID NO: 586124 - DNA, 25 bp, Rattus norvegicus
gacggtgggctagaacgactcaaaa

SEQ ID NO: 586125 - DNA, 25 bp, Rattus norvegicus
tgggctagaacgactcaaaagcttg

SEQ ID NO: 586126 - DNA, 25 bp, Rattus norvegicus
ctcaaaagcttgcaagggcggtgct

SEQ ID NO: 586127 - DNA, 25 bp, Rattus norvegicus
ccggctcagcagtctcgggttctac

SEQ ID NO: 586128 - DNA, 25 bp, Rattus norvegicus
aaaagcttgcaagggcggtgctgac

SEQ ID NO: 586129 - DNA, 25 bp, Rattus norvegicus
gctgacgcggccagagaaaagctga

SEQ ID NO: 586130 - DNA, 25 bp, Rattus norvegicus
gaaaagctgagagacgcaccagggc

SEQ ID NO: 586131 - DNA, 25 bp, Rattus norvegicus
ctgagagacgcaccagggcatgcga

SEQ ID NO: 586132 - DNA, 25 bp, Rattus norvegicus
aagcagtgttgtgcctagaggggcc

SEQ ID NO: 586133 - DNA, 25 bp, Rattus norvegicus
cctagaggggccggaaccatcgtag

SEQ ID NO: 586134 - DNA, 25 bp, Rattus norvegicus
actgaggcctgaatggcgccggctc

SEQ ID NO: 586135 - DNA, 25 bp, Rattus norvegicus
cagtgaccaccgagacggtgggcta

SEQ ID NO: 586136 - DNA, 25 bp, Rattus norvegicus
aagggcgagcagtgaccaccgagac

SEQ ID NO: 586137 - DNA, 25 bp, Rattus norvegicus
agcctccggttcgatcgctactttc

SEQ ID NO: 586138 - DNA, 25 bp, Rattus norvegicus
gggcgaattagcctccggttcgatc

SEQ ID NO: 586139 - DNA, 25 bp, Rattus norvegicus
cctgggcggcagtcagaacccgcaa

SEQ ID NO: 586140 - DNA, 25 bp, Rattus norvegicus
agagacggcccagggccagatccct

SEQ ID NO: 586141 - DNA, 25 bp, Rattus norvegicus
ccggttcgatcgctactttccgatc

SEQ ID NO: 586142 - DNA, 25 bp, Rattus norvegicus
ctactttccgatcaggtcaggtttc

SEQ ID NO: 586143 - DNA, 25 bp, Rattus norvegicus
tccgatcaggtcaggtttccctccg

SEQ ID NO: 586144 - DNA, 25 bp, Rattus norvegicus
caacctccgagagacggtcggtggt

SEQ ID NO: 586145 - DNA, 25 bp, Rattus norvegicus
ctccgagagacggtcggtggtccct

SEQ ID NO: 586146 - DNA, 25 bp, Rattus norvegicus
tggtccctgtgcagtccgtctgcct

SEQ ID NO: 586147 - DNA, 25 bp, Rattus norvegicus
gtccgtctgcctcctcgctgttcct

SEQ ID NO: 586148 - DNA, 25 bp, Rattus norvegicus
cccgcaggcaccagccagagacggc

SEQ ID NO: 586149 - DNA, 25 bp, Rattus norvegicus
ccatactgccgcaacctccgagaga

SEQ ID NO: 586150 - DNA, 25 bp, Rattus norvegicus
gcggcagtcagaacccgcaagggcc

SEQ ID NO: 586151 - DNA, 25 bp, Rattus norvegicus
tttgtgaagattcgcagccctgacc

SEQ ID NO: 586152 - DNA, 25 bp, Rattus norvegicus
aagcctgcgacctcgtcctgttcta

SEQ ID NO: 586153 - DNA, 25 bp, Rattus norvegicus
aagtagctctgtccgggtcccaagc

SEQ ID NO: 586154 - DNA, 25 bp, Rattus norvegicus
tgaggccgtagaacgagcaaaggtt

SEQ ID NO: 586155 - DNA, 25 bp, Rattus norvegicus
tcccagtagtcgaggggacttctca

SEQ ID NO: 586156 - DNA, 25 bp, Rattus norvegicus
ggccagtctctcgtctgtcccagta

SEQ ID NO: 586157 - DNA, 25 bp, Rattus norvegicus
agttgcaggcgcttttcgcaggcca

SEQ ID NO: 586158 - DNA, 25 bp, Rattus norvegicus
ccggatcctcacagcacgggtttgg

SEQ ID NO: 586159 - DNA, 25 bp, Rattus norvegicus
cctgaccgtttgcagggccacgaaa

SEQ ID NO: 586160 - DNA, 25 bp, Rattus norvegicus
tccgattcgttttcttttgtgaaga

SEQ ID NO: 586161 - DNA, 25 bp, Rattus norvegicus
gggtgctaccttccctcacatctag

SEQ ID NO: 586162 - DNA, 25 bp, Rattus norvegicus
gattcctccggccaattgggaacgc

SEQ ID NO: 586163 - DNA, 25 bp, Rattus norvegicus
cagggccacgaaagccgcttctcta

SEQ ID NO: 586164 - DNA, 25 bp, Rattus norvegicus
cacatctagacgtgctggcgtccca

SEQ ID NO: 586165 - DNA, 25 bp, Rattus norvegicus
agcgacgacgcacaatcgcacagtc

SEQ ID NO: 586166 - DNA, 25 bp, Rattus norvegicus
cctgtttccagctcgccctcctggg

SEQ ID NO: 586167 - DNA, 25 bp, Rattus norvegicus
atccagtcctctgccagcgacgacg

SEQ ID NO: 586168 - DNA, 25 bp, Rattus norvegicus
ccagccacgccctcctgtttccagc

SEQ ID NO: 586169 - DNA, 25 bp, Rattus norvegicus
gcgactggcgctcatccaggcgact

SEQ ID NO: 586170 - DNA, 25 bp, Rattus norvegicus
ctcatccaggcgactggcagttcgc

SEQ ID NO: 586171 - DNA, 25 bp, Rattus norvegicus
ccaggcgactggcagttcgctccgg

SEQ ID NO: 586172 - DNA, 25 bp, Rattus norvegicus
ctggggacgcccctagcggacttct

SEQ ID NO: 586173 - DNA, 25 bp, Rattus norvegicus
tagcggacttctcggcgctctcctc

SEQ ID NO: 586174 - DNA, 25 bp, Rattus norvegicus
cgctctcctcctatcccgggacccg

SEQ ID NO: 586175 - DNA, 25 bp, Rattus norvegicus
cctttgcagcggcaggtgcctgagc

SEQ ID NO: 586176 - DNA, 25 bp, Rattus norvegicus
agcgagcagtcctgccagggccatt

SEQ ID NO: 586177 - DNA, 25 bp, Rattus norvegicus
ggccattccctcaaccgcgtcctga

SEQ ID NO: 586178 - DNA, 25 bp, Rattus norvegicus
cctcctggggcgctcatccagtcct

SEQ ID NO: 586179 - DNA, 25 bp, Rattus norvegicus
acccgatggggcacgccaatggcat

SEQ ID NO: 586180 - DNA, 25 bp, Rattus norvegicus
cggcaaggagccaccggcggactca

SEQ ID NO: 586181 - DNA, 25 bp, Rattus norvegicus
gctgcatcagtgtggcgccgtctgc

SEQ ID NO: 586182 - DNA, 25 bp, Rattus norvegicus
gggcacgccaatggcatccaagcca

SEQ ID NO: 586183 - DNA, 25 bp, Rattus norvegicus
gagccaccggcggactcaccgtgat

SEQ ID NO: 586184 - DNA, 25 bp, Rattus norvegicus
caccgtgatccgaggaatgttcttc

SEQ ID NO: 586185 - DNA, 25 bp, Rattus norvegicus
gaatgttcttcttgccctggtagga

SEQ ID NO: 586186 - DNA, 25 bp, Rattus norvegicus
tcttgccctggtaggacatggtggt

SEQ ID NO: 586187 - DNA, 25 bp, Rattus norvegicus
caggggatgcctgcctcgctgctgc

SEQ ID NO: 586188 - DNA, 25 bp, Rattus norvegicus
ccagatcaggtggagcgaatggtgc

SEQ ID NO: 586189 - DNA, 25 bp, Rattus norvegicus
ggcggctgccagagacaatagtaaa

SEQ ID NO: 586190 - DNA, 25 bp, Rattus norvegicus
tgccagagacaatagtaaatctccc

SEQ ID NO: 586191 - DNA, 25 bp, Rattus norvegicus
gactgaccgccgcactccagcaccc

SEQ ID NO: 586192 - DNA, 25 bp, Rattus norvegicus
gcaccctcctccactggcgttcacg

SEQ ID NO: 586193 - DNA, 25 bp, Rattus norvegicus
ccgtgggacctgatctgtggtgccc

SEQ ID NO: 586194 - DNA, 25 bp, Rattus norvegicus
cagggcatcaaaatccaatgtcttg

SEQ ID NO: 586195 - DNA, 25 bp, Rattus norvegicus
gctgtcccacactcagggcatcaaa

SEQ ID NO: 586196 - DNA, 25 bp, Rattus norvegicus
caatgtcttgctctcgaaggcgccc

SEQ ID NO: 586197 - DNA, 25 bp, Rattus norvegicus
aggcgccctccacgttgcagaacat

SEQ ID NO: 586198 - DNA, 25 bp, Rattus norvegicus
ccttcgcgccagaggcggcagtgct

SEQ ID NO: 586199 - DNA, 25 bp, Rattus norvegicus
caccgtacttctgccgtgggacctg

SEQ ID NO: 586200 - DNA, 25 bp, Rattus norvegicus
gggccaagtacacaggcaggtcgtc

SEQ ID NO: 586201 - DNA, 25 bp, Rattus norvegicus
ggtcgtcctcgtgggagctgtccca

SEQ ID NO: 586202 - DNA, 25 bp, Rattus norvegicus
gcccgaagccatggttcaagcgaca

SEQ ID NO: 586203 - DNA, 25 bp, Rattus norvegicus
atggttcaagcgacagcggctcaga

SEQ ID NO: 586204 - DNA, 25 bp, Rattus norvegicus
gcggctcagaggctttcttcttcag

SEQ ID NO: 586205 - DNA, 25 bp, Rattus norvegicus
ttcttcagaggctgaagagagcagc

SEQ ID NO: 586206 - DNA, 25 bp, Rattus norvegicus
gttgcagaacatgccaccgtacttc

SEQ ID NO: 586207 - DNA, 25 bp, Rattus norvegicus
caaacgtctcattggcgaatcgcgc

SEQ ID NO: 586208 - DNA, 25 bp, Rattus norvegicus
ggccttgattctctattcccgggta

SEQ ID NO: 586209 - DNA, 25 bp, Rattus norvegicus
ggcagcgtcctggatgatctctgca

SEQ ID NO: 586210 - DNA, 25 bp, Rattus norvegicus
ggctctttatacgtcccgggtctca

SEQ ID NO: 586211 - DNA, 25 bp, Rattus norvegicus
tgcactcaatcaaaggcggcgggga

SEQ ID NO: 586212 - DNA, 25 bp, Rattus norvegicus
tctctgcaggtactagcggttcacc

SEQ ID NO: 586213 - DNA, 25 bp, Rattus norvegicus
ctattcccgggtatcgctttgcgtc

SEQ ID NO: 586214 - DNA, 25 bp, Rattus norvegicus
atggagaccaaacgcctggaaattc

SEQ ID NO: 586215 - DNA, 25 bp, Rattus norvegicus
tgctgcgggtcctcactatggagac

SEQ ID NO: 586216 - DNA, 25 bp, Rattus norvegicus
agctccttgcttctctacggtgccg

SEQ ID NO: 586217 - DNA, 25 bp, Rattus norvegicus
tacgagcagagggttccactgtccg

SEQ ID NO: 586218 - DNA, 25 bp, Rattus norvegicus
ttactttgggcctttcacgcagagg

SEQ ID NO: 586219 - DNA, 25 bp, Rattus norvegicus
ctgagcagcctgaagaccgattgga

SEQ ID NO: 586220 - DNA, 25 bp, Rattus norvegicus
tgttccgccttgctcttcagactcg

SEQ ID NO: 586221 - DNA, 25 bp, Rattus norvegicus
gaggggacctctgctctctagaccc

SEQ ID NO: 586222 - DNA, 25 bp, Rattus norvegicus
aatatgtccgccttcctgttcaaac

SEQ ID NO: 586223 - DNA, 25 bp, Rattus norvegicus
ctcccattttatccggtcgctgctg

SEQ ID NO: 586224 - DNA, 25 bp, Rattus norvegicus
tggtttccacagaacaggctcactc

SEQ ID NO: 586225 - DNA, 25 bp, Rattus norvegicus
ttatcctcggccaagagctggtttc

SEQ ID NO: 586226 - DNA, 25 bp, Rattus norvegicus
ggcccggtaagacgcactgatttat

SEQ ID NO: 586227 - DNA, 25 bp, Rattus norvegicus
cgctctaaggcgctagcggctgtct

SEQ ID NO: 586228 - DNA, 25 bp, Rattus norvegicus
agttcaaccaacttcctccgcggtg

SEQ ID NO: 586229 - DNA, 25 bp, Rattus norvegicus
ccgcagcggaaagcaagttcaacca

SEQ ID NO: 586230 - DNA, 25 bp, Rattus norvegicus
acgataccttcgtacccgcagcgga

SEQ ID NO: 586231 - DNA, 25 bp, Rattus norvegicus
tgctgctacttgtgacgataccttc

SEQ ID NO: 586232 - DNA, 25 bp, Rattus norvegicus
cccagtcgacatgatgctgctactt

SEQ ID NO: 586233 - DNA, 25 bp, Rattus norvegicus
cagcaggttgtcgattttttcaaac

SEQ ID NO: 586234 - DNA, 25 bp, Rattus norvegicus
gctgtctagccctgcatcccgggtt

SEQ ID NO: 586235 - DNA, 25 bp, Rattus norvegicus
gggcttactcccttccagcacattg

SEQ ID NO: 586236 - DNA, 25 bp, Rattus norvegicus
gcttaggctagatagcccgggctta

SEQ ID NO: 586237 - DNA, 25 bp, Rattus norvegicus
agctctggcacccaccgggagaagc

SEQ ID NO: 586238 - DNA, 25 bp, Rattus norvegicus
cccattacccggcaggcgggcagtt

SEQ ID NO: 586239 - DNA, 25 bp, Rattus norvegicus
tggaatctcaccagcgagccatagc

SEQ ID NO: 586240 - DNA, 25 bp, Rattus norvegicus
cacggaaagtctggctggaatctca

SEQ ID NO: 586241 - DNA, 25 bp, Rattus norvegicus
ttttcacccaggacagcagcgaggc

SEQ ID NO: 586242 - DNA, 25 bp, Rattus norvegicus
agatccggagccgagcagcacttca

SEQ ID NO: 586243 - DNA, 25 bp, Rattus norvegicus
cctgcacttttcagagccgggctcg

SEQ ID NO: 586244 - DNA, 25 bp, Rattus norvegicus
tttcaccgcaactccagaattcatg

SEQ ID NO: 586245 - DNA, 25 bp, Rattus norvegicus
ggaatcgtttccatatttcaccgca

SEQ ID NO: 586246 - DNA, 25 bp, Rattus norvegicus
acagtttcttacctcgctcagctca

SEQ ID NO: 586247 - DNA, 25 bp, Rattus norvegicus
cgagctccggacctcaacagtttct

SEQ ID NO: 586248 - DNA, 25 bp, Rattus norvegicus
tgcagtctagacagccattttcacc

SEQ ID NO: 586249 - DNA, 25 bp, Rattus norvegicus
ggagggtcgcttaccagctgatgaa

SEQ ID NO: 586250 - DNA, 25 bp, Rattus norvegicus
ttttaccgcaatcgcccaagtggca

SEQ ID NO: 586251 - DNA, 25 bp, Rattus norvegicus
tcgcttaccagctgatgaagccatc

SEQ ID NO: 586252 - DNA, 25 bp, Rattus norvegicus
gcacgtctggaagagccgccgcaga

SEQ ID NO: 586253 - DNA, 25 bp, Rattus norvegicus
agacgctcctcctcgtcggtgctgg

SEQ ID NO: 586254 - DNA, 25 bp, Rattus norvegicus
cctcctcgtcggtgctggacgtgtc

SEQ ID NO: 586255 - DNA, 25 bp, Rattus norvegicus
tggacgtgtcgctgctgctaccgtt

SEQ ID NO: 586256 - DNA, 25 bp, Rattus norvegicus
gcaagcgcttgcagccgccatcgcg

SEQ ID NO: 586257 - DNA, 25 bp, Rattus norvegicus
cccagggaggaacagcaggacctgc

SEQ ID NO: 586258 - DNA, 25 bp, Rattus norvegicus
gcaggacctgcactgctcacagctg

SEQ ID NO: 586259 - DNA, 25 bp, Rattus norvegicus
tgcactgctcacagctgcggacagc

SEQ ID NO: 586260 - DNA, 25 bp, Rattus norvegicus
tgaacctgcccgacgacggagcatg

SEQ ID NO: 586261 - DNA, 25 bp, Rattus norvegicus
ccgtcgctgtcgcacgtctggaaga

SEQ ID NO: 586262 - DNA, 25 bp, Rattus norvegicus
caggagcgacggattccacctttcc

SEQ ID NO: 586263 - DNA, 25 bp, Rattus norvegicus
gcgcttccgatacggtgaccagaga

SEQ ID NO: 586264 - DNA, 25 bp, Rattus norvegicus
aggaccgcattacagcctccaggga

SEQ ID NO: 586265 - DNA, 25 bp, Rattus norvegicus
ccagcatagtcagaggtcccgcgtt

SEQ ID NO: 586266 - DNA, 25 bp, Rattus norvegicus
gcggcgctcactcttgacgtcatca

SEQ ID NO: 586267 - DNA, 25 bp, Rattus norvegicus
gcacccaaggcttctctgggctgta

SEQ ID NO: 586268 - DNA, 25 bp, Rattus norvegicus
gtagtggtgccagcgctttcgcttt

SEQ ID NO: 586269 - DNA, 25 bp, Rattus norvegicus
gctttcgctttcaccgctactgtga

SEQ ID NO: 586270 - DNA, 25 bp, Rattus norvegicus
tactgtgagtgacgctttcccgcta

SEQ ID NO: 586271 - DNA, 25 bp, Rattus norvegicus
ctctcccggcgttgactttctagcg

SEQ ID NO: 586272 - DNA, 25 bp, Rattus norvegicus
gggccaaaggcctcaaagacattcg

SEQ ID NO: 586273 - DNA, 25 bp, Rattus norvegicus
tcgtatcgacgaggaggtgaagatc

SEQ ID NO: 586274 - DNA, 25 bp, Rattus norvegicus
gtgaagatcgctgtcaacattgctc

SEQ ID NO: 586275 - DNA, 25 bp, Rattus norvegicus
acattgctctggagcgcttccgata

SEQ ID NO: 586276 - DNA, 25 bp, Rattus norvegicus
cctgatgggcagaggaacccagagc

SEQ ID NO: 586277 - DNA, 25 bp, Rattus norvegicus
tccgggctgaagcagaagctgaagc

SEQ ID NO: 586278 - DNA, 25 bp, Rattus norvegicus
gctgtaacctgagcggccgcctgac

SEQ ID NO: 586279 - DNA, 25 bp, Rattus norvegicus
ggccttcaccgtgagcgaagccata

SEQ ID NO: 586280 - DNA, 25 bp, Rattus norvegicus
cgctcgagggcccttgataggaccc

SEQ ID NO: 586281 - DNA, 25 bp, Rattus norvegicus
cccatcacctgatgatacgaggagc

SEQ ID NO: 586282 - DNA, 25 bp, Rattus norvegicus
aaccgcgggatgtcagctgtaacct

SEQ ID NO: 586283 - DNA, 25 bp, Rattus norvegicus
tccgggcctttaactgaacccatca

SEQ ID NO: 586284 - DNA, 25 bp, Rattus norvegicus
gcagccagaggacacgccatcgcgt

SEQ ID NO: 586285 - DNA, 25 bp, Rattus norvegicus
ccttaccgcggtagtgcgcctgaaa

SEQ ID NO: 586286 - DNA, 25 bp, Rattus norvegicus
ctccttgcccagtagataggccttc

SEQ ID NO: 586287 - DNA, 25 bp, Rattus norvegicus
gcgaagccataaccgcagactaggt

SEQ ID NO: 586288 - DNA, 25 bp, Rattus norvegicus
gcagactaggtacggaggaaacagc

SEQ ID NO: 586289 - DNA, 25 bp, Rattus norvegicus
gagagcccagcttttataggatacg

SEQ ID NO: 586290 - DNA, 25 bp, Rattus norvegicus
tgatacgaggagcaagcgaaccgcg

SEQ ID NO: 586291 - DNA, 25 bp, Rattus norvegicus
cccttcaccgaaatagccatgagca

SEQ ID NO: 586292 - DNA, 25 bp, Rattus norvegicus
ccggggcagccagctcaatgtgagc

SEQ ID NO: 586293 - DNA, 25 bp, Rattus norvegicus
gcctggtctccctgcagctttaaca

SEQ ID NO: 586294 - DNA, 25 bp, Rattus norvegicus
acaacctggcgctctacggaactgg

SEQ ID NO: 586295 - DNA, 25 bp, Rattus norvegicus
tctaagccggagcacaacaattcta

SEQ ID NO: 586296 - DNA, 25 bp, Rattus norvegicus
cccagagatcgtggtgtctaagccg

SEQ ID NO: 586297 - DNA, 25 bp, Rattus norvegicus
cgagatggactcagaggctcagccc

SEQ ID NO: 586298 - DNA, 25 bp, Rattus norvegicus
cgccggaacctgcacgagatggact

SEQ ID NO: 586299 - DNA, 25 bp, Rattus norvegicus
caatgtgagcgagctgacgccgtcc

SEQ ID NO: 586300 - DNA, 25 bp, Rattus norvegicus
gtagcagcccatgcctccggtgcaa

SEQ ID NO: 586301 - DNA, 25 bp, Rattus norvegicus
acagagccaggacaaaccgtgcgcg

SEQ ID NO: 586302 - DNA, 25 bp, Rattus norvegicus
cattgcagttccagcgcggcttctt

SEQ ID NO: 586303 - DNA, 25 bp, Rattus norvegicus
gcagctttaacaggtctgacatgga

SEQ ID NO: 586304 - DNA, 25 bp, Rattus norvegicus
gtcatgcgtccgctcagcaacttga

SEQ ID NO: 586305 - DNA, 25 bp, Rattus norvegicus
caccgcgatccggaagcagttggcg

SEQ ID NO: 586306 - DNA, 25 bp, Rattus norvegicus
gcaggaaatccagccgttctccttc

SEQ ID NO: 586307 - DNA, 25 bp, Rattus norvegicus
ggtcccgcaggaaatccagccgttc

SEQ ID NO: 586308 - DNA, 25 bp, Rattus norvegicus
aagaaccgcacgtgtcggtcccgca

SEQ ID NO: 586309 - DNA, 25 bp, Rattus norvegicus
cagcgctggaagaaccgcacgtgtc

SEQ ID NO: 586310 - DNA, 25 bp, Rattus norvegicus
cgctccggcaagacctggaggcagc

SEQ ID NO: 586311 - DNA, 25 bp, Rattus norvegicus
aagaataccgctccggcaagacctg

SEQ ID NO: 586312 - DNA, 25 bp, Rattus norvegicus
tggtctccagcgaagaataccgctc

SEQ ID NO: 586313 - DNA, 25 bp, Rattus norvegicus
acctgctggtctccagcgaagaata

SEQ ID NO: 586314 - DNA, 25 bp, Rattus norvegicus
cgccgcagcgactaattacctgctg

SEQ ID NO: 586315 - DNA, 25 bp, Rattus norvegicus
ttaaggcccggcagcagtgcaaccc

SEQ ID NO: 586316 - DNA, 25 bp, Rattus norvegicus
ctaggacaagtcagggatcgcggtt

SEQ ID NO: 586317 - DNA, 25 bp, Rattus norvegicus
gacccggaggcctaggacaagtcag

SEQ ID NO: 586318 - DNA, 25 bp, Rattus norvegicus
ggccgccatgctgtcccggaaacga

SEQ ID NO: 586319 - DNA, 25 bp, Rattus norvegicus
cacagagttaaaggcggggcttgga

SEQ ID NO: 586320 - DNA, 25 bp, Rattus norvegicus
ctttccggggcgtggctactgagga

SEQ ID NO: 586321 - DNA, 25 bp, Rattus norvegicus
cccgcgcccgtacgcgggatcagct

SEQ ID NO: 586322 - DNA, 25 bp, Rattus norvegicus
gcgggatcagctcccgtggtcgtcc

SEQ ID NO: 586323 - DNA, 25 bp, Rattus norvegicus
ggccggggagcacagagttaaaggc

SEQ ID NO: 586324 - DNA, 25 bp, Rattus norvegicus
ctactgaggactccgttgggagcac

SEQ ID NO: 586325 - DNA, 25 bp, Rattus norvegicus
actaggcggagcacgcctagcccta

SEQ ID NO: 586326 - DNA, 25 bp, Rattus norvegicus
taactgctggaccactaggcggagc

SEQ ID NO: 586327 - DNA, 25 bp, Rattus norvegicus
ggttcctaactgctggaccactagg

SEQ ID NO: 586328 - DNA, 25 bp, Rattus norvegicus
acggttcctaactgctggaccacta

SEQ ID NO: 586329 - DNA, 25 bp, Rattus norvegicus
cgcacggttcctaactgctggacca

SEQ ID NO: 586330 - DNA, 25 bp, Rattus norvegicus
ccgcgcacggttcctaactgctgga

SEQ ID NO: 586331 - DNA, 25 bp, Rattus norvegicus
tcagctcccgtggtcgtcctcccac

SEQ ID NO: 586332 - DNA, 25 bp, Rattus norvegicus
ctgaggactccgttgggagcacaag

SEQ ID NO: 586333 - DNA, 25 bp, Rattus norvegicus
cctttgaacttgaggtccgtgggtg

SEQ ID NO: 586334 - DNA, 25 bp, Rattus norvegicus
tgaaggggcctttgaacttgaggtc

SEQ ID NO: 586335 - DNA, 25 bp, Rattus norvegicus
taagatgcgccgtggctaccgcggt

SEQ ID NO: 586336 - DNA, 25 bp, Rattus norvegicus
cgcagtttaagatgcgccgtggcta

SEQ ID NO: 586337 - DNA, 25 bp, Rattus norvegicus
cgacgggttgcgcagtttaagatgc

SEQ ID NO: 586338 - DNA, 25 bp, Rattus norvegicus
gaagcacactttcctcgtcgacggg

SEQ ID NO: 586339 - DNA, 25 bp, Rattus norvegicus
tcacaaccgccgtggccacgcgcga

SEQ ID NO: 586340 - DNA, 25 bp, Rattus norvegicus
ttcaccttgaagcacactttcctcg

SEQ ID NO: 586341 - DNA, 25 bp, Rattus norvegicus
ggctggtgctcttcaccttgaagca

SEQ ID NO: 586342 - DNA, 25 bp, Rattus norvegicus
tagcgccgagggctggtgctcttca

SEQ ID NO: 586343 - DNA, 25 bp, Rattus norvegicus
cgatgacgccgctgttgggccgcac

SEQ ID NO: 586344 - DNA, 25 bp, Rattus norvegicus
actgtgcagcctggctcgatgacgc

SEQ ID NO: 586345 - DNA, 25 bp, Rattus norvegicus
gcgaccgtcactgtgcagcctggct

SEQ ID NO: 586346 - DNA, 25 bp, Rattus norvegicus
acactttcctcgtcgacgggttgcg

SEQ ID NO: 586347 - DNA, 25 bp, Rattus norvegicus
gccaagtagaatgcgcctgcgtgac

SEQ ID NO: 586348 - DNA, 25 bp, Rattus norvegicus
cacgctaagacctcgccggaaaggc

SEQ ID NO: 586349 - DNA, 25 bp, Rattus norvegicus
tttcttcccttcaaactatgcgagg

SEQ ID NO: 586350 - DNA, 25 bp, Rattus norvegicus
ctatgcgaggcgctcaggaaatccg

SEQ ID NO: 586351 - DNA, 25 bp, Rattus norvegicus
cacaggaatgaatccggccgcgctg

SEQ ID NO: 586352 - DNA, 25 bp, Rattus norvegicus
ggccggacaagccagttcactgctt

SEQ ID NO: 586353 - DNA, 25 bp, Rattus norvegicus
tgcttcacattactgacgccgcagc

SEQ ID NO: 586354 - DNA, 25 bp, Rattus norvegicus
accttgcgcgcgctccagaaagatg

SEQ ID NO: 586355 - DNA, 25 bp, Rattus norvegicus
cgctccagaaagatgcgcctgcgta

SEQ ID NO: 586356 - DNA, 25 bp, Rattus norvegicus
aaatgcgcctgcgtgctacggaaag

SEQ ID NO: 586357 - DNA, 25 bp, Rattus norvegicus
agggctacccaaaagacgcgcatgc

SEQ ID NO: 586358 - DNA, 25 bp, Rattus norvegicus
aactctcggcctgctcacgctaaga

SEQ ID NO: 586359 - DNA, 25 bp, Rattus norvegicus
agaggcgggccatcccacatggaga

SEQ ID NO: 586360 - DNA, 25 bp, Rattus norvegicus
gcatcctgaaagtctggggcgccta

SEQ ID NO: 586361 - DNA, 25 bp, Rattus norvegicus
cccactgagcctgcagagtccagga

SEQ ID NO: 586362 - DNA, 25 bp, Rattus norvegicus
ttcgccttcggaagtcgtgctctgc

SEQ ID NO: 586363 - DNA, 25 bp, Rattus norvegicus
ccctcagggcggtggacttcgcctt

SEQ ID NO: 586364 - DNA, 25 bp, Rattus norvegicus
tccaggactggccatggagccctca

SEQ ID NO: 586365 - DNA, 25 bp, Rattus norvegicus
actgagcgagcccttgttgacaagc

SEQ ID NO: 586366 - DNA, 25 bp, Rattus norvegicus
agcggcttgccacagaactttgaaa

SEQ ID NO: 586367 - DNA, 25 bp, Rattus norvegicus
ctttgaaagttaggatgttactgtc

SEQ ID NO: 586368 - DNA, 25 bp, Rattus norvegicus
tgtcgtagatcgtgtcccaaaggca

SEQ ID NO: 586369 - DNA, 25 bp, Rattus norvegicus
gtcccaaaggcagtgtggctccgca

SEQ ID NO: 586370 - DNA, 25 bp, Rattus norvegicus
tggtcttgctctcccactgagcgag

SEQ ID NO: 586371 - DNA, 25 bp, Rattus norvegicus
gccacgaggctctttggtcttgctc

SEQ ID NO: 586372 - DNA, 25 bp, Rattus norvegicus
caacttacctgggaagcggtgctgc

SEQ ID NO: 586373 - DNA, 25 bp, Rattus norvegicus
cactgcgggcagaccagggctgcac

SEQ ID NO: 586374 - DNA, 25 bp, Rattus norvegicus
gcagacaccgcggacactgcgggca

SEQ ID NO: 586375 - DNA, 25 bp, Rattus norvegicus
cccggtgacccggatgtgaaatccg

SEQ ID NO: 586376 - DNA, 25 bp, Rattus norvegicus
agacgcaatgaggtacccgagccgc

SEQ ID NO: 586377 - DNA, 25 bp, Rattus norvegicus
cgcaggcttccggaaagacgcaatg

SEQ ID NO: 586378 - DNA, 25 bp, Rattus norvegicus
cgacgaggaaccagcgcaggcttcc

SEQ ID NO: 586379 - DNA, 25 bp, Rattus norvegicus
ttagtgaagcgtgcgacgaggaacc

SEQ ID NO: 586380 - DNA, 25 bp, Rattus norvegicus
ctcggacccggcagtagcagtagca

SEQ ID NO: 586381 - DNA, 25 bp, Rattus norvegicus
agtctgcaactccaacggcctgcgg

SEQ ID NO: 586382 - DNA, 25 bp, Rattus norvegicus
aagaggcctcgctgaccggaagtac

SEQ ID NO: 586383 - DNA, 25 bp, Rattus norvegicus
cccgagccgctctaggaaaacctga

SEQ ID NO: 586384 - DNA, 25 bp, Rattus norvegicus
cagtagagcaagcagtctgcaactc

SEQ ID NO: 586385 - DNA, 25 bp, Rattus norvegicus
ctaccggcccgcgagccttagtgaa

SEQ ID NO: 586386 - DNA, 25 bp, Rattus norvegicus
cagtagcagtagcaacagtagagca

SEQ ID NO: 586387 - DNA, 25 bp, Rattus norvegicus
cggaagtacggcgagatctaacgga

SEQ ID NO: 586388 - DNA, 25 bp, Rattus norvegicus
cagtggtaggagacccggcaaacca

SEQ ID NO: 586389 - DNA, 25 bp, Rattus norvegicus
gcattcgctggggtccacgccaaat

SEQ ID NO: 586390 - DNA, 25 bp, Rattus norvegicus
ggccgcggactttcttctggaggaa

SEQ ID NO: 586391 - DNA, 25 bp, Rattus norvegicus
gggctgtggagaccaccctggccct

SEQ ID NO: 586392 - DNA, 25 bp, Rattus norvegicus
ggggtccacgccaaatgtcacttcg

SEQ ID NO: 586393 - DNA, 25 bp, Rattus norvegicus
caggtgagctacttgtggggactca

SEQ ID NO: 586394 - DNA, 25 bp, Rattus norvegicus
tgtcacttcgtcacacgcgcgtctt

SEQ ID NO: 586395 - DNA, 25 bp, Rattus norvegicus
gctggacaccttgcctgcacagggc

SEQ ID NO: 586396 - DNA, 25 bp, Rattus norvegicus
tcttctggaggaactgactcgtgcg

SEQ ID NO: 586397 - DNA, 25 bp, Rattus norvegicus
ggcgcctgtaccagcgggaaacaaa

SEQ ID NO: 586398 - DNA, 25 bp, Rattus norvegicus
acccggtctccgttgctgcctttgt

SEQ ID NO: 586399 - DNA, 25 bp, Rattus norvegicus
ccgagcgccggacggacagcaagaa

SEQ ID NO: 586400 - DNA, 25 bp, Rattus norvegicus
cttgggaaagttgagagtagccaga

SEQ ID NO: 586401 - DNA, 25 bp, Rattus norvegicus
ctaagcagagcgcagcacgaagccg

SEQ ID NO: 586402 - DNA, 25 bp, Rattus norvegicus
agtagccagatgtggtcaggcattc

SEQ ID NO: 586403 - DNA, 25 bp, Rattus norvegicus
ggcttcaggctatacaaaccgcaca

SEQ ID NO: 586404 - DNA, 25 bp, Rattus norvegicus
cgcgtctcttcagtccagctgcgga

SEQ ID NO: 586405 - DNA, 25 bp, Rattus norvegicus
ctgggacgcgtctcttcagtccagc

SEQ ID NO: 586406 - DNA, 25 bp, Rattus norvegicus
gcttcagcagctcggtccgttccat

SEQ ID NO: 586407 - DNA, 25 bp, Rattus norvegicus
tgcaagattcggatgaggtcggcca

SEQ ID NO: 586408 - DNA, 25 bp, Rattus norvegicus
ccggcgaagagctcatgcaagattc

SEQ ID NO: 586409 - DNA, 25 bp, Rattus norvegicus
gcaggattgctctcgtaggcttcca

SEQ ID NO: 586410 - DNA, 25 bp, Rattus norvegicus
tacaaagcccactcggcaggattgc

SEQ ID NO: 586411 - DNA, 25 bp, Rattus norvegicus
gatcgaatttggcatacaaagccca

SEQ ID NO: 586412 - DNA, 25 bp, Rattus norvegicus
cgctcacctgtattgatcgaatttg

SEQ ID NO: 586413 - DNA, 25 bp, Rattus norvegicus
agcccgagcacgctcacctgtattg

SEQ ID NO: 586414 - DNA, 25 bp, Rattus norvegicus
caacggaggggacctagcccgagca

SEQ ID NO: 586415 - DNA, 25 bp, Rattus norvegicus
gtttcgcgagagacagagagctaaa

SEQ ID NO: 586416 - DNA, 25 bp, Rattus norvegicus
gagagctaaaaacctgagagctgtg

SEQ ID NO: 586417 - DNA, 25 bp, Rattus norvegicus
aggttgtctccggtggactgatttc

SEQ ID NO: 586418 - DNA, 25 bp, Rattus norvegicus
tctgttggaaacacgatagttaccg

SEQ ID NO: 586419 - DNA, 25 bp, Rattus norvegicus
atcttgcttgctgagcgtcgacggc

SEQ ID NO: 586420 - DNA, 25 bp, Rattus norvegicus
gttggaccttgctacacgaagcgtc

SEQ ID NO: 586421 - DNA, 25 bp, Rattus norvegicus
tgggagccggattaacagtgaattt

SEQ ID NO: 586422 - DNA, 25 bp, Rattus norvegicus
tgggatgtctagagagcagtccata

SEQ ID NO: 586423 - DNA, 25 bp, Rattus norvegicus
tctgaagggcttccgtgacgaatct

SEQ ID NO: 586424 - DNA, 25 bp, Rattus norvegicus
cgtgacgaatctctgtgagcaacca

SEQ ID NO: 586425 - DNA, 25 bp, Rattus norvegicus
tgagcaaccatatgaccacgtaccc

SEQ ID NO: 586426 - DNA, 25 bp, Rattus norvegicus
agcggcaacaagctcccggaggcga

SEQ ID NO: 586427 - DNA, 25 bp, Rattus norvegicus
gttctaccagccctatgtgagtatg

SEQ ID NO: 586428 - DNA, 25 bp, Rattus norvegicus
tctgggtcttctgccatcttgcttg

SEQ ID NO: 586429 - DNA, 25 bp, Rattus norvegicus
gactgatttctgtcgtccgcggaca

SEQ ID NO: 586430 - DNA, 25 bp, Rattus norvegicus
tcttcaacaaccacgggaagccgcg

SEQ ID NO: 586431 - DNA, 25 bp, Rattus norvegicus
cccgccctgcccgtagcggtctctc

SEQ ID NO: 586432 - DNA, 25 bp, Rattus norvegicus
cgccgggatcccaggagctggcctc

SEQ ID NO: 586433 - DNA, 25 bp, Rattus norvegicus
tcccggtgctccagcggcgatcgag

SEQ ID NO: 586434 - DNA, 25 bp, Rattus norvegicus
cccggtgctccagcggcgatcgagt

SEQ ID NO: 586435 - DNA, 25 bp, Rattus norvegicus
cgatcgagtgatgcggggcccttta

SEQ ID NO: 586436 - DNA, 25 bp, Rattus norvegicus
ggccgcggctcttgccgccttgccc

SEQ ID NO: 586437 - DNA, 25 bp, Rattus norvegicus
caaccctgctctgcccgggcccagc

SEQ ID NO: 586438 - DNA, 25 bp, Rattus norvegicus
agcctcagatcgaggccgccagcgc

SEQ ID NO: 586439 - DNA, 25 bp, Rattus norvegicus
tgcccgtagcggtctctcccgggcc

SEQ ID NO: 586440 - DNA, 25 bp, Rattus norvegicus
cgcccttcgcccgtcgactcggcgg

SEQ ID NO: 586441 - DNA, 25 bp, Rattus norvegicus
cgcgcccgcccttcgcccgtcgact

SEQ ID NO: 586442 - DNA, 25 bp, Rattus norvegicus
gagtgatgcggggccctttaaatcc

SEQ ID NO: 586443 - DNA, 25 bp, Rattus norvegicus
tcgcccgtcgactcggcggcggtcc

SEQ ID NO: 586444 - DNA, 25 bp, Rattus norvegicus
cgggcccagcctcagatcgaggccg

SEQ ID NO: 586445 - DNA, 25 bp, Rattus norvegicus
gattggctggattctgcacagctga

SEQ ID NO: 586446 - DNA, 25 bp, Rattus norvegicus
aagtcgcaaacctgccgggcggcaa

SEQ ID NO: 586447 - DNA, 25 bp, Rattus norvegicus
cggagggtcttgttggggctcagag

SEQ ID NO: 586448 - DNA, 25 bp, Rattus norvegicus
cccagagccccaggtagcggtcagg

SEQ ID NO: 586449 - DNA, 25 bp, Rattus norvegicus
gagcttcaagaatggcggcgtccgc

SEQ ID NO: 586450 - DNA, 25 bp, Rattus norvegicus
agcggtcaggctgagcgcccagcca

SEQ ID NO: 586451 - DNA, 25 bp, Rattus norvegicus
ttctgcacagctgacagtcgcgcgg

SEQ ID NO: 586452 - DNA, 25 bp, Rattus norvegicus
gccgtgattggctggattctgcaca

SEQ ID NO: 586453 - DNA, 25 bp, Rattus norvegicus
ggtttccgtcaggcgcgccgtgatt

SEQ ID NO: 586454 - DNA, 25 bp, Rattus norvegicus
cgggcggcaagacttggcccttccg

SEQ ID NO: 586455 - DNA, 25 bp, Rattus norvegicus
tgccgggcggcaagacttggccctt

SEQ ID NO: 586456 - DNA, 25 bp, Rattus norvegicus
gctggccaggctcacgagccggagc

SEQ ID NO: 586457 - DNA, 25 bp, Rattus norvegicus
agcggggttgctgccaccgcctgct

SEQ ID NO: 586458 - DNA, 25 bp, Rattus norvegicus
ctgcacagctgacagtcgcgcgggc

SEQ ID NO: 586459 - DNA, 25 bp, Rattus norvegicus
tccgctcagtcgttcggggtcagaa

SEQ ID NO: 586460 - DNA, 25 bp, Rattus norvegicus
tgcgcttggagccagaaactcgtga

SEQ ID NO: 586461 - DNA, 25 bp, Rattus norvegicus
gccagcgagctagagccagtgtcca

SEQ ID NO: 586462 - DNA, 25 bp, Rattus norvegicus
gaggtaccatcctccctccagtggg

SEQ ID NO: 586463 - DNA, 25 bp, Rattus norvegicus
agaatgaacacgctgagccctcgtc

SEQ ID NO: 586464 - DNA, 25 bp, Rattus norvegicus
agccctcgtctggttgtttccagga

SEQ ID NO: 586465 - DNA, 25 bp, Rattus norvegicus
gcgggagacctcagatcctgcttca

SEQ ID NO: 586466 - DNA, 25 bp, Rattus norvegicus
agtagcttctgtccgccacttgtgg

SEQ ID NO: 586467 - DNA, 25 bp, Rattus norvegicus
aagtgacactatccaccgagggtcg

SEQ ID NO: 586468 - DNA, 25 bp, Rattus norvegicus
tttccaggagtcttaagctatcaca

SEQ ID NO: 586469 - DNA, 25 bp, Rattus norvegicus
agtagcctggttctgtacagcccgc

SEQ ID NO: 586470 - DNA, 25 bp, Rattus norvegicus
tgacacacgcagtaccaggacagta

SEQ ID NO: 586471 - DNA, 25 bp, Rattus norvegicus
gggtccggtttctctccctgacaca

SEQ ID NO: 586472 - DNA, 25 bp, Rattus norvegicus
caggggctctgcactgtaaaaggga

SEQ ID NO: 586473 - DNA, 25 bp, Rattus norvegicus
agaaagggacaacgctcaggaggca

SEQ ID NO: 586474 - DNA, 25 bp, Rattus norvegicus
ctggggttcaggactgaaaagagct

SEQ ID NO: 586475 - DNA, 25 bp, Rattus norvegicus
ggtctctggggttcaggactgaaaa

SEQ ID NO: 586476 - DNA, 25 bp, Rattus norvegicus
ctgaaaagagctgaaggcaagactc

SEQ ID NO: 586477 - DNA, 25 bp, Rattus norvegicus
agctgaaggcaagactcggggctac

SEQ ID NO: 586478 - DNA, 25 bp, Rattus norvegicus
gaaggcaagactcggggctactccc

SEQ ID NO: 586479 - DNA, 25 bp, Rattus norvegicus
ccaagaaagggacaacgctcaggag

SEQ ID NO: 586480 - DNA, 25 bp, Rattus norvegicus
tgaggaagctcctgacatggagccc

SEQ ID NO: 586481 - DNA, 25 bp, Rattus norvegicus
gagaccgaatcaaacacaagcacta

SEQ ID NO: 586482 - DNA, 25 bp, Rattus norvegicus
cgaatcaaacacaagcactacaaag

SEQ ID NO: 586483 - DNA, 25 bp, Rattus norvegicus
caccccagcctggatccaggagatg

SEQ ID NO: 586484 - DNA, 25 bp, Rattus norvegicus
acgcgggtgaggaagctcctgacat

SEQ ID NO: 586485 - DNA, 25 bp, Rattus norvegicus
ctcctgacatggagcccggggtctc

SEQ ID NO: 586486 - DNA, 25 bp, Rattus norvegicus
agccgtgagaccgaatcaaacacaa

SEQ ID NO: 586487 - DNA, 25 bp, Rattus norvegicus
atctcgggcagtcggcaccgcggaa

SEQ ID NO: 586488 - DNA, 25 bp, Rattus norvegicus
ttgcgcagagcggactctcctccag

SEQ ID NO: 586489 - DNA, 25 bp, Rattus norvegicus
tggattgcgcagagcggactctcct

SEQ ID NO: 586490 - DNA, 25 bp, Rattus norvegicus
gactggattgcgcagagcggactct

SEQ ID NO: 586491 - DNA, 25 bp, Rattus norvegicus
caagtcccggactggattgcgcaga

SEQ ID NO: 586492 - DNA, 25 bp, Rattus norvegicus
gcggagccaagtcccggactggatt

SEQ ID NO: 586493 - DNA, 25 bp, Rattus norvegicus
tgtcactggagaggccgacgctccg

SEQ ID NO: 586494 - DNA, 25 bp, Rattus norvegicus
ctcctgtgtcactggagaggccgac

SEQ ID NO: 586495 - DNA, 25 bp, Rattus norvegicus
actactcctgtgtcactggagaggc

SEQ ID NO: 586496 - DNA, 25 bp, Rattus norvegicus
gctcactactcctgtgtcactggag

SEQ ID NO: 586497 - DNA, 25 bp, Rattus norvegicus
agcggagttggctgcagcctcaccc

SEQ ID NO: 586498 - DNA, 25 bp, Rattus norvegicus
tcggcaccgcggaaaagcgcctctg

SEQ ID NO: 586499 - DNA, 25 bp, Rattus norvegicus
cgcctccctgggctggcgtctcctc

SEQ ID NO: 586500 - DNA, 25 bp, Rattus norvegicus
gcctaggcagccgagtgcgtgggga

SEQ ID NO: 586501 - DNA, 25 bp, Rattus norvegicus
cgccacgagctgaggaaaggggtct

SEQ ID NO: 586502 - DNA, 25 bp, Rattus norvegicus
cctcagaggtgacgtgaggtcccgc

SEQ ID NO: 586503 - DNA, 25 bp, Rattus norvegicus
cacgtcacgtaaggggcaggcctca

SEQ ID NO: 586504 - DNA, 25 bp, Rattus norvegicus
aaaggggtctgcgtacgcacgtcac

SEQ ID NO: 586505 - DNA, 25 bp, Rattus norvegicus
tgttaagagtcaggccgtcgcattg

SEQ ID NO: 586506 - DNA, 25 bp, Rattus norvegicus
gctccatgggtggtgttaagagtca

SEQ ID NO: 586507 - DNA, 25 bp, Rattus norvegicus
ctcttcctgcggctccatgggtggt

SEQ ID NO: 586508 - DNA, 25 bp, Rattus norvegicus
gaggcgcagactccccgagcgttcg

SEQ ID NO: 586509 - DNA, 25 bp, Rattus norvegicus
tcggtaatccccaggcgccagaagg

SEQ ID NO: 586510 - DNA, 25 bp, Rattus norvegicus
cctcggaccgctcctcttcacccgg

SEQ ID NO: 586511 - DNA, 25 bp, Rattus norvegicus
cccacagcccgtctgcactcgtgct

SEQ ID NO: 586512 - DNA, 25 bp, Rattus norvegicus
ctgcgctccgcgtgctccaccggca

SEQ ID NO: 586513 - DNA, 25 bp, Rattus norvegicus
cctgcagcggctgcactccggcctg

SEQ ID NO: 586514 - DNA, 25 bp, Rattus norvegicus
tctgcgtacgcacgtcacgtaaggg

SEQ ID NO: 586515 - DNA, 25 bp, Rattus norvegicus
aatagcgtgtggacagctcggtccc

SEQ ID NO: 586516 - DNA, 25 bp, Rattus norvegicus
ggagctctaggtacgttcgggtctc

SEQ ID NO: 586517 - DNA, 25 bp, Rattus norvegicus
ctcgggattggctaactctcgacta

SEQ ID NO: 586518 - DNA, 25 bp, Rattus norvegicus
ctctcgactagaaaaggcgttgctg

SEQ ID NO: 586519 - DNA, 25 bp, Rattus norvegicus
gcgttgctgccctatgtactgccac

SEQ ID NO: 586520 - DNA, 25 bp, Rattus norvegicus
gccacccattctggagccttgaaga

SEQ ID NO: 586521 - DNA, 25 bp, Rattus norvegicus
tcgcgatattttggcgcaagggcca

SEQ ID NO: 586522 - DNA, 25 bp, Rattus norvegicus
cctgaattgcggtgacaggtgcaga

SEQ ID NO: 586523 - DNA, 25 bp, Rattus norvegicus
gcggacaccgagcttcacctgaatt

SEQ ID NO: 586524 - DNA, 25 bp, Rattus norvegicus
gccttgaagaaagtctcgcgatatt

SEQ ID NO: 586525 - DNA, 25 bp, Rattus norvegicus
gccatgaacctgcaccaggtgctga

SEQ ID NO: 586526 - DNA, 25 bp, Rattus norvegicus
cggcctccgctccagttagcgtgtt

SEQ ID NO: 586527 - DNA, 25 bp, Rattus norvegicus
tccagttagcgtgttttcgggctta

SEQ ID NO: 586528 - DNA, 25 bp, Rattus norvegicus
cgaccactgcttctcggtgggcagc

SEQ ID NO: 586529 - DNA, 25 bp, Rattus norvegicus
agtggtccagctccgaggaacagca

SEQ ID NO: 586530 - DNA, 25 bp, Rattus norvegicus
taatccacctcctagctccgccctg

SEQ ID NO: 586531 - DNA, 25 bp, Rattus norvegicus
ctagctccgccctggcacacaggct

SEQ ID NO: 586532 - DNA, 25 bp, Rattus norvegicus
gaggaacagcattgcgggaccgccc

SEQ ID NO: 586533 - DNA, 25 bp, Rattus norvegicus
agcattgcgggaccgccccgttctt

SEQ ID NO: 586534 - DNA, 25 bp, Rattus norvegicus
agagccgcgagtggtccagctccga

SEQ ID NO: 586535 - DNA, 25 bp, Rattus norvegicus
ggtccagctccgaggaacagcattg

SEQ ID NO: 586536 - DNA, 25 bp, Rattus norvegicus
tccagctccgaggaacagcattgcg

SEQ ID NO: 586537 - DNA, 25 bp, Rattus norvegicus
cagctccgaggaacagcattgcggg

SEQ ID NO: 586538 - DNA, 25 bp, Rattus norvegicus
ctccgaggaacagcattgcgggacc

SEQ ID NO: 586539 - DNA, 25 bp, Rattus norvegicus
cccgacctcctctctgcagtctggc

SEQ ID NO: 586540 - DNA, 25 bp, Rattus norvegicus
ggctcgagctccacttctcccgcgc

SEQ ID NO: 586541 - DNA, 25 bp, Rattus norvegicus
tcctctctgcagtctggctcttccc

SEQ ID NO: 586542 - DNA, 25 bp, Rattus norvegicus
ccgttcttcactcgtcccggcgccg

SEQ ID NO: 586543 - DNA, 25 bp, Rattus norvegicus
gaaggtacgccagccgctggactcc

SEQ ID NO: 586544 - DNA, 25 bp, Rattus norvegicus
attcgtcactcctgcggaactttcc

SEQ ID NO: 586545 - DNA, 25 bp, Rattus norvegicus
cccgggaggttctgatctcagaggc

SEQ ID NO: 586546 - DNA, 25 bp, Rattus norvegicus
ttctgatctcagaggcttcctccca

SEQ ID NO: 586547 - DNA, 25 bp, Rattus norvegicus
ccgcgcacatcacactggtctggga

SEQ ID NO: 586548 - DNA, 25 bp, Rattus norvegicus
agcccagggaaggtacgccagccgc

SEQ ID NO: 586549 - DNA, 25 bp, Rattus norvegicus
acatcacactggtctgggagcctcg

SEQ ID NO: 586550 - DNA, 25 bp, Rattus norvegicus
actggtctgggagcctcgcagcctc

SEQ ID NO: 586551 - DNA, 25 bp, Rattus norvegicus
cgcgcactccagagcacctttcctg

SEQ ID NO: 586552 - DNA, 25 bp, Rattus norvegicus
agcctcacgtccatgtccgtggcag

SEQ ID NO: 586553 - DNA, 25 bp, Rattus norvegicus
ccatgtccgtggcagtggtgcctgc

SEQ ID NO: 586554 - DNA, 25 bp, Rattus norvegicus
ccgacagcatgctctccgaggcgga

SEQ ID NO: 586555 - DNA, 25 bp, Rattus norvegicus
cgtgcgattcgtcactcctgcggaa

SEQ ID NO: 586556 - DNA, 25 bp, Rattus norvegicus
ccgccaagttcagcgcaggaatgta

SEQ ID NO: 586557 - DNA, 25 bp, Rattus norvegicus
tcgggtaaaggataatctggcgtcc

SEQ ID NO: 586558 - DNA, 25 bp, Rattus norvegicus
ctgacgcgcccagaagacgaagatg

SEQ ID NO: 586559 - DNA, 25 bp, Rattus norvegicus
cgcaattttcactcgggccgcgaca

SEQ ID NO: 586560 - DNA, 25 bp, Rattus norvegicus
cgcctctcccgtcagatgggagtta

SEQ ID NO: 586561 - DNA, 25 bp, Rattus norvegicus
gggtacccggagacactcagctgct

SEQ ID NO: 586562 - DNA, 25 bp, Rattus norvegicus
gggtgctcacgtaccttcctgctgc

SEQ ID NO: 586563 - DNA, 25 bp, Rattus norvegicus
tttgcaatcgccatagctgtgcgcc

SEQ ID NO: 586564 - DNA, 25 bp, Rattus norvegicus
tcagagcgcaggctgtttgcaatcg

SEQ ID NO: 586565 - DNA, 25 bp, Rattus norvegicus
atgaagaccaggagccgggatcacc

SEQ ID NO: 586566 - DNA, 25 bp, Rattus norvegicus
tcgttaaatggggaagccggacatc

SEQ ID NO: 586567 - DNA, 25 bp, Rattus norvegicus
cgagcctgcattatttcgttaaatg

SEQ ID NO: 586568 - DNA, 25 bp, Rattus norvegicus
cccggagccctcaaaggatctattt

SEQ ID NO: 586569 - DNA, 25 bp, Rattus norvegicus
atctggcgtccacactcagcgcagg

SEQ ID NO: 586570 - DNA, 25 bp, Rattus norvegicus
cactaactatgacagccggccagca

SEQ ID NO: 586571 - DNA, 25 bp, Rattus norvegicus
ttcgcctctgaggttcgacgggcgt

SEQ ID NO: 586572 - DNA, 25 bp, Rattus norvegicus
caggtcacttgtttgtgtcccgccc

SEQ ID NO: 586573 - DNA, 25 bp, Rattus norvegicus
caggcgcacttggaatcaccagcgc

SEQ ID NO: 586574 - DNA, 25 bp, Rattus norvegicus
acttggaatcaccagcgccagtttc

SEQ ID NO: 586575 - DNA, 25 bp, Rattus norvegicus
aatcaccagcgccagtttcccgaaa

SEQ ID NO: 586576 - DNA, 25 bp, Rattus norvegicus
ccgaaaccaccaggtcacttgtttg

SEQ ID NO: 586577 - DNA, 25 bp, Rattus norvegicus
aaccaccaggtcacttgtttgtgtc

SEQ ID NO: 586578 - DNA, 25 bp, Rattus norvegicus
tccgtgcccgtttcacagagcagta

SEQ ID NO: 586579 - DNA, 25 bp, Rattus norvegicus
gtgcccgtttcacagagcagtaccc

SEQ ID NO: 586580 - DNA, 25 bp, Rattus norvegicus
ccactgccagtgtgtgcgtggtgca

SEQ ID NO: 586581 - DNA, 25 bp, Rattus norvegicus
tgtgcgtggtgcaggatagactcat

SEQ ID NO: 586582 - DNA, 25 bp, Rattus norvegicus
tggtgcaggatagactcatggcttc

SEQ ID NO: 586583 - DNA, 25 bp, Rattus norvegicus
tgcaggatagactcatggcttcgcc

SEQ ID NO: 586584 - DNA, 25 bp, Rattus norvegicus
tagactcatggcttcgcctctgagg

SEQ ID NO: 586585 - DNA, 25 bp, Rattus norvegicus
ctccgtgtggcgctcagaactggcc

SEQ ID NO: 586586 - DNA, 25 bp, Rattus norvegicus
cagcgctcagcggccagaaaggtga

SEQ ID NO: 586587 - DNA, 25 bp, Rattus norvegicus
tgcctgcggttatcccatgccaggg

SEQ ID NO: 586588 - DNA, 25 bp, Rattus norvegicus
tcagaactggcctctgcctgcggtt

SEQ ID NO: 586589 - DNA, 25 bp, Rattus norvegicus
gcgagtggttaccagatccccgcct

SEQ ID NO: 586590 - DNA, 25 bp, Rattus norvegicus
aattccctggtcaggcctggcggag

SEQ ID NO: 586591 - DNA, 25 bp, Rattus norvegicus
acgaaattccctggtcaggcctggc

SEQ ID NO: 586592 - DNA, 25 bp, Rattus norvegicus
ggcataacgaaattccctggtcagg

SEQ ID NO: 586593 - DNA, 25 bp, Rattus norvegicus
gcttttggcataacgaaattccctg

SEQ ID NO: 586594 - DNA, 25 bp, Rattus norvegicus
cccacttgtttgcttttggcataac

SEQ ID NO: 586595 - DNA, 25 bp, Rattus norvegicus
cgggagcacctgagcctctcccatc

SEQ ID NO: 586596 - DNA, 25 bp, Rattus norvegicus
tggcctctgcctgcggttatcccat

SEQ ID NO: 586597 - DNA, 25 bp, Rattus norvegicus
cgctcaggcccgcaccgggagcacc

SEQ ID NO: 586598 - DNA, 25 bp, Rattus norvegicus
ctgcggttatcccatgccaggggcg

SEQ ID NO: 586599 - DNA, 25 bp, Rattus norvegicus
gcaccgcacagccacccgcggctgc

SEQ ID NO: 586600 - DNA, 25 bp, Rattus norvegicus
gctgcccgccgagcagtcgacatgt

SEQ ID NO: 586601 - DNA, 25 bp, Rattus norvegicus
tgtcagccaagtccaaggggaaccc

SEQ ID NO: 586602 - DNA, 25 bp, Rattus norvegicus
aagaatgtcagccaagtccaagggg

SEQ ID NO: 586603 - DNA, 25 bp, Rattus norvegicus
ttgctcgccccactgaagaatgtca

SEQ ID NO: 586604 - DNA, 25 bp, Rattus norvegicus
cctgtcctgacctggcttgctcgcc

SEQ ID NO: 586605 - DNA, 25 bp, Rattus norvegicus
ctcgctcgcctgtcctgacctggct

SEQ ID NO: 586606 - DNA, 25 bp, Rattus norvegicus
gagttgatggcagcaccacagtgcg

SEQ ID NO: 586607 - DNA, 25 bp, Rattus norvegicus
ccgagcagtcgacatgtggggagac

SEQ ID NO: 586608 - DNA, 25 bp, Rattus norvegicus
cgctgctcgcccgtctgcagctccg

SEQ ID NO: 586609 - DNA, 25 bp, Rattus norvegicus
agtgcctcgtctcggggagttgatg

SEQ ID NO: 586610 - DNA, 25 bp, Rattus norvegicus
atggcagcaccacagtgcggccgtc

SEQ ID NO: 586611 - DNA, 25 bp, Rattus norvegicus
tccgcgctgagtgcctcgtctcggg

SEQ ID NO: 586612 - DNA, 25 bp, Rattus norvegicus
ggccggagcagtgcccgggacccag

SEQ ID NO: 586613 - DNA, 25 bp, Rattus norvegicus
ttcgcccacaaactggaagtcgccg

SEQ ID NO: 586614 - DNA, 25 bp, Rattus norvegicus
tccgtccgcaatggctcagccgaga

SEQ ID NO: 586615 - DNA, 25 bp, Rattus norvegicus
tgtaattgccggtgctcacgtgctc

SEQ ID NO: 586616 - DNA, 25 bp, Rattus norvegicus
tctacgcagccgtggtgtaattgcc

SEQ ID NO: 586617 - DNA, 25 bp, Rattus norvegicus
cactgccggaaaatccctacgtttg

SEQ ID NO: 586618 - DNA, 25 bp, Rattus norvegicus
gaagtcgccgttcgcacttccggca

SEQ ID NO: 586619 - DNA, 25 bp, Rattus norvegicus
gctcaattttggctgttcgcccaca

SEQ ID NO: 586620 - DNA, 25 bp, Rattus norvegicus
ccaaggaaacgctcaattttggctg

SEQ ID NO: 586621 - DNA, 25 bp, Rattus norvegicus
cgcactagcttggtttccaaggaaa

SEQ ID NO: 586622 - DNA, 25 bp, Rattus norvegicus
cttcagcgcgcactagcttggtttc

SEQ ID NO: 586623 - DNA, 25 bp, Rattus norvegicus
gccgagacctctgaacctcaataac

SEQ ID NO: 586624 - DNA, 25 bp, Rattus norvegicus
agaccgtgggatgtggcctcttctc

SEQ ID NO: 586625 - DNA, 25 bp, Rattus norvegicus
acccggtggagaccggatccacgcg

SEQ ID NO: 586626 - DNA, 25 bp, Rattus norvegicus
caataacgaggtgagcacgcgggtc

SEQ ID NO: 586627 - DNA, 25 bp, Rattus norvegicus
cgtcggagtacttgtagggattgta

SEQ ID NO: 586628 - DNA, 25 bp, Rattus norvegicus
cctttcccagtcctggaaggcgacg

SEQ ID NO: 586629 - DNA, 25 bp, Rattus norvegicus
tcccattggattgtctggcgccagg

SEQ ID NO: 586630 - DNA, 25 bp, Rattus norvegicus
ccggtgccatatccaggtcggtgcc

SEQ ID NO: 586631 - DNA, 25 bp, Rattus norvegicus
accggggtctctcataagtgtcata

SEQ ID NO: 586632 - DNA, 25 bp, Rattus norvegicus
gaccgccacgtctagacagcactga

SEQ ID NO: 586633 - DNA, 25 bp, Rattus norvegicus
gtcgcccaccatgcgatctacgtgg

SEQ ID NO: 586634 - DNA, 25 bp, Rattus norvegicus
tcagattactgagctgcggaggctg

SEQ ID NO: 586635 - DNA, 25 bp, Rattus norvegicus
ccaacttggaaccagtggcgggctg

SEQ ID NO: 586636 - DNA, 25 bp, Rattus norvegicus
gcggttgtcacgcagcagcagaatg

SEQ ID NO: 586637 - DNA, 25 bp, Rattus norvegicus
atcccgcgaaggagggagacctctt

SEQ ID NO: 586638 - DNA, 25 bp, Rattus norvegicus
aaacgcatgatgctcccggctcgtc

SEQ ID NO: 586639 - DNA, 25 bp, Rattus norvegicus
tgtcccagaaagagcacggtccagg

SEQ ID NO: 586640 - DNA, 25 bp, Rattus norvegicus
cgtactggaagtaaccggtgccata

SEQ ID NO: 586641 - DNA, 25 bp, Rattus norvegicus
caataacaaacgtgaaggggatgcc

SEQ ID NO: 586642 - DNA, 25 bp, Rattus norvegicus
ctgcagagagccacaagaggggatc

SEQ ID NO: 586643 - DNA, 25 bp, Rattus norvegicus
aacgcgcgaggtaagcagaagcagc

SEQ ID NO: 586644 - DNA, 25 bp, Rattus norvegicus
cagcaggttcgctggtccgggatac

SEQ ID NO: 586645 - DNA, 25 bp, Rattus norvegicus
gtggtcgcgtccctgatctcaacgt

SEQ ID NO: 586646 - DNA, 25 bp, Rattus norvegicus
gtgcaactttgcaccgggcgacacc

SEQ ID NO: 586647 - DNA, 25 bp, Rattus norvegicus
aagaggggatcgctgtggtaaccca

SEQ ID NO: 586648 - DNA, 25 bp, Rattus norvegicus
ctgtggtaacccaggcagcttcacc

SEQ ID NO: 586649 - DNA, 25 bp, Rattus norvegicus
ttttcattggcccttgcgctagctg

SEQ ID NO: 586650 - DNA, 25 bp, Rattus norvegicus
ttctgcttgctgctacctcggatcg

SEQ ID NO: 586651 - DNA, 25 bp, Rattus norvegicus
caaaggcttggtgatagctacacta

SEQ ID NO: 586652 - DNA, 25 bp, Rattus norvegicus
atgccgggtggtgtcgctacccgaa

SEQ ID NO: 586653 - DNA, 25 bp, Rattus norvegicus
gctgtccggcgtcccgggattatcc

SEQ ID NO: 586654 - DNA, 25 bp, Rattus norvegicus
ctgtgccgaggctcctaagagctcc

SEQ ID NO: 586655 - DNA, 25 bp, Rattus norvegicus
ccttgcgtgctcacgtgacaggtcc

SEQ ID NO: 586656 - DNA, 25 bp, Rattus norvegicus
agcccaccgactttgaggagctgga

SEQ ID NO: 586657 - DNA, 25 bp, Rattus norvegicus
ggagaggacctgttcaccagcactg

SEQ ID NO: 586658 - DNA, 25 bp, Rattus norvegicus
accagcactgtctccacacttgagg

SEQ ID NO: 586659 - DNA, 25 bp, Rattus norvegicus
tctccacacttgaggtgagacagcc

SEQ ID NO: 586660 - DNA, 25 bp, Rattus norvegicus
aggccaggtccggtgacacctgtga

SEQ ID NO: 586661 - DNA, 25 bp, Rattus norvegicus
gtgacacctgtgacgccggctgcac

SEQ ID NO: 586662 - DNA, 25 bp, Rattus norvegicus
tgcacctcaggtgcctgtcaagggg

SEQ ID NO: 586663 - DNA, 25 bp, Rattus norvegicus
cgacctcatctccaaggggccagga

SEQ ID NO: 586664 - DNA, 25 bp, Rattus norvegicus
aacctagcggtgcttgcgggctctc

SEQ ID NO: 586665 - DNA, 25 bp, Rattus norvegicus
tgggagacgtgaagcccaccgactt

SEQ ID NO: 586666 - DNA, 25 bp, Rattus norvegicus
gggctctcgggccttccgagtcatt

SEQ ID NO: 586667 - DNA, 25 bp, Rattus norvegicus
agggaacctcctccgctgggagacg

SEQ ID NO: 586668 - DNA, 25 bp, Rattus norvegicus
ctcttgcagacgtccaggctagcga

SEQ ID NO: 586669 - DNA, 25 bp, Rattus norvegicus
aacgaaagcagaagcaagctgggca

SEQ ID NO: 586670 - DNA, 25 bp, Rattus norvegicus
acagcgatctggagcgcggctacac

SEQ ID NO: 586671 - DNA, 25 bp, Rattus norvegicus
ctttcgccacgaggacagcgatctg

SEQ ID NO: 586672 - DNA, 25 bp, Rattus norvegicus
tcgcctcccagtctggggtggcgtt

SEQ ID NO: 586673 - DNA, 25 bp, Rattus norvegicus
aagctgggcagcatctcgaagcgca

SEQ ID NO: 586674 - DNA, 25 bp, Rattus norvegicus
ccgctgcggccatggaggtctacat

SEQ ID NO: 586675 - DNA, 25 bp, Rattus norvegicus
cacgctttgccggtcagaacgaaag

SEQ ID NO: 586676 - DNA, 25 bp, Rattus norvegicus
cccggtgaaagttggcacgctttgc

SEQ ID NO: 586677 - DNA, 25 bp, Rattus norvegicus
cttagcttgaaaggggcgcatcaca

SEQ ID NO: 586678 - DNA, 25 bp, Rattus norvegicus
tccatacgcaggctgagaaggctta

SEQ ID NO: 586679 - DNA, 25 bp, Rattus norvegicus
accttgaggctgtgcggttccatac

SEQ ID NO: 586680 - DNA, 25 bp, Rattus norvegicus
tggaggtctacatcccgtcctttcg

SEQ ID NO: 586681 - DNA, 25 bp, Rattus norvegicus
cgcactggccaccttgaggctgtgc

SEQ ID NO: 586682 - DNA, 25 bp, Rattus norvegicus
aagcgcagtcgtttttcaccctccg

SEQ ID NO: 586683 - DNA, 25 bp, Rattus norvegicus
ggacgcgctcctcccaagttcaaag

SEQ ID NO: 586684 - DNA, 25 bp, Rattus norvegicus
tggtcacccatgtgcccgagtgttt

SEQ ID NO: 586685 - DNA, 25 bp, Rattus norvegicus
cagctccctgcagttccagtcagta

SEQ ID NO: 586686 - DNA, 25 bp, Rattus norvegicus
gtcccagccagactcaaatctcagt

SEQ ID NO: 586687 - DNA, 25 bp, Rattus norvegicus
aaagcgagagttagtccagtagccc

SEQ ID NO: 586688 - DNA, 25 bp, Rattus norvegicus
caccagcccggatgacaagtccaga

SEQ ID NO: 586689 - DNA, 25 bp, Rattus norvegicus
ttctagaagaaaggccctgcgggca

SEQ ID NO: 586690 - DNA, 25 bp, Rattus norvegicus
ccggccaagccaaggaagtactcca

SEQ ID NO: 586691 - DNA, 25 bp, Rattus norvegicus
gtcaccaagggacctcgctttcgga

SEQ ID NO: 586692 - DNA, 25 bp, Rattus norvegicus
cccggctcatggtgcacgatggaac

SEQ ID NO: 586693 - DNA, 25 bp, Rattus norvegicus
ctctagtagggagagtggtagatcc

SEQ ID NO: 586694 - DNA, 25 bp, Rattus norvegicus
gctggatcaccttgtccgtcaccaa

SEQ ID NO: 586695 - DNA, 25 bp, Rattus norvegicus
agaagttgctgtagccgctggatca

SEQ ID NO: 586696 - DNA, 25 bp, Rattus norvegicus
ggcgcaaccttaagctcccggactg

SEQ ID NO: 586697 - DNA, 25 bp, Rattus norvegicus
ttatgttagcgattgcttggcgggc

SEQ ID NO: 586698 - DNA, 25 bp, Rattus norvegicus
gctcccaacttttctctccggagga

SEQ ID NO: 586699 - DNA, 25 bp, Rattus norvegicus
ggcacccaacagcattccaggaaaa

SEQ ID NO: 586700 - DNA, 25 bp, Rattus norvegicus
aggactgggtcgatgcgcctcccgc

SEQ ID NO: 586701 - DNA, 25 bp, Rattus norvegicus
tttagagaccctggctcccaagctc

SEQ ID NO: 586702 - DNA, 25 bp, Rattus norvegicus
ctccagcttcgttcaggctgcgggc

SEQ ID NO: 586703 - DNA, 25 bp, Rattus norvegicus
gggtttcacgtcagcgcacagcgtg

SEQ ID NO: 586704 - DNA, 25 bp, Rattus norvegicus
ctctccggaggatttatgttagcga

SEQ ID NO: 586705 - DNA, 25 bp, Rattus norvegicus
ggcgagtcaactctggcacccaaca

SEQ ID NO: 586706 - DNA, 25 bp, Rattus norvegicus
ctcgacctgggccaggccggatcgt

SEQ ID NO: 586707 - DNA, 25 bp, Rattus norvegicus
tccaggaaaatctgaacccggctga

SEQ ID NO: 586708 - DNA, 25 bp, Rattus norvegicus
cccggctgaaaagcaaactcgctgt

SEQ ID NO: 586709 - DNA, 25 bp, Rattus norvegicus
aaactcgctgtgaggactgggtcga

SEQ ID NO: 586710 - DNA, 25 bp, Rattus norvegicus
caggccggatcgttctttagagacc

SEQ ID NO: 586711 - DNA, 25 bp, Rattus norvegicus
ttcaccggttgcgaagcggcaccgt

SEQ ID NO: 586712 - DNA, 25 bp, Rattus norvegicus
agacgtcctgcctggagttgtgccg

SEQ ID NO: 586713 - DNA, 25 bp, Rattus norvegicus
aagtggacccagcttacctgcagca

SEQ ID NO: 586714 - DNA, 25 bp, Rattus norvegicus
aagcggcaccgtgtgctcgcagcca

SEQ ID NO: 586715 - DNA, 25 bp, Rattus norvegicus
cgcgcctaggcttcggagtaaactt

SEQ ID NO: 586716 - DNA, 25 bp, Rattus norvegicus
agctcgaggcgtcggacatgctgaa

SEQ ID NO: 586717 - DNA, 25 bp, Rattus norvegicus
cggctcggccttcctcaaagtggac

SEQ ID NO: 586718 - DNA, 25 bp, Rattus norvegicus
ttacctgcagcactggcagcaactc

SEQ ID NO: 586719 - DNA, 25 bp, Rattus norvegicus
gcagcaactcttcccgcatggagga

SEQ ID NO: 586720 - DNA, 25 bp, Rattus norvegicus
gtggcgtcccacgtttccgctgcag

SEQ ID NO: 586721 - DNA, 25 bp, Rattus norvegicus
cgccgaggagctggactattacctg

SEQ ID NO: 586722 - DNA, 25 bp, Rattus norvegicus
ggcagcagcgcatggaaatcatccc

SEQ ID NO: 586723 - DNA, 25 bp, Rattus norvegicus
gttgtgccggaaagcgccggctctt

SEQ ID NO: 586724 - DNA, 25 bp, Rattus norvegicus
ctattacctgtatgggcagcagcgc

SEQ ID NO: 586725 - DNA, 25 bp, Rattus norvegicus
ccctccggtcttacaggaatgaagt

SEQ ID NO: 586726 - DNA, 25 bp, Rattus norvegicus
aataacgacgccgatttgcaagacg

SEQ ID NO: 586727 - DNA, 25 bp, Rattus norvegicus
gttctcgtcgcgcatccgcaggtct

SEQ ID NO: 586728 - DNA, 25 bp, Rattus norvegicus
tccggccattcatactcctagtctg

SEQ ID NO: 586729 - DNA, 25 bp, Rattus norvegicus
cctagtctgtgggtctttggagcct

SEQ ID NO: 586730 - DNA, 25 bp, Rattus norvegicus
ctttggagcctgaattccgtggaca

SEQ ID NO: 586731 - DNA, 25 bp, Rattus norvegicus
ttccgtggacagttggactagaagg

SEQ ID NO: 586732 - DNA, 25 bp, Rattus norvegicus
agactgcgccgctaggatgaagctc

SEQ ID NO: 586733 - DNA, 25 bp, Rattus norvegicus
tcgtcgcccagaaccctgggcaagg

SEQ ID NO: 586734 - DNA, 25 bp, Rattus norvegicus
gtggccaagccgtctctgtccactt

SEQ ID NO: 586735 - DNA, 25 bp, Rattus norvegicus
cggagcagtggtccctccgttttcg

SEQ ID NO: 586736 - DNA, 25 bp, Rattus norvegicus
gcacttgcagtgacgaggatttaga

SEQ ID NO: 586737 - DNA, 25 bp, Rattus norvegicus
gtccacttctcatccggcgacttaa

SEQ ID NO: 586738 - DNA, 25 bp, Rattus norvegicus
agtaggatggttttatctgcaaata

SEQ ID NO: 586739 - DNA, 25 bp, Rattus norvegicus
atctgccgcacctgctggctaagga

SEQ ID NO: 586740 - DNA, 25 bp, Rattus norvegicus
tcatcgtggtgctgatcgccgaggc

SEQ ID NO: 586741 - DNA, 25 bp, Rattus norvegicus
agactcggtcatcgtggtgctgatc

SEQ ID NO: 586742 - DNA, 25 bp, Rattus norvegicus
gcaggagaaggaagactcggtcatc

SEQ ID NO: 586743 - DNA, 25 bp, Rattus norvegicus
ctgagcccgcaggagaaggaagact

SEQ ID NO: 586744 - DNA, 25 bp, Rattus norvegicus
gctcatctcggagctgagcccgcag

SEQ ID NO: 586745 - DNA, 25 bp, Rattus norvegicus
ttgcactcgctcatctcggagctga

SEQ ID NO: 586746 - DNA, 25 bp, Rattus norvegicus
gcactcgtacttgactgacacattg

SEQ ID NO: 586747 - DNA, 25 bp, Rattus norvegicus
ctggctaaggaaagcagtctgcagc

SEQ ID NO: 586748 - DNA, 25 bp, Rattus norvegicus
gtctcgcacaggcacgtacttcatc

SEQ ID NO: 586749 - DNA, 25 bp, Rattus norvegicus
actgaagccgtggaacgtctcgcac

SEQ ID NO: 586750 - DNA, 25 bp, Rattus norvegicus
ggcgcgaggtgcactcgtacttgac

SEQ ID NO: 586751 - DNA, 25 bp, Rattus norvegicus
cagtgtccgtggtgatgggcattcc

SEQ ID NO: 586752 - DNA, 25 bp, Rattus norvegicus
cttgactgacacattgcactcgctc

SEQ ID NO: 586753 - DNA, 25 bp, Rattus norvegicus
tggatacgacgatgagcagctggtc

SEQ ID NO: 586754 - DNA, 25 bp, Rattus norvegicus
ccgactcgatgaaggctgctccgct

SEQ ID NO: 586755 - DNA, 25 bp, Rattus norvegicus
tgctaagccgctattcaaacgcccg

SEQ ID NO: 586756 - DNA, 25 bp, Rattus norvegicus
gatagaacgcccatcagccggcttc

SEQ ID NO: 586757 - DNA, 25 bp, Rattus norvegicus
ttccaagagccctgggaaaacacga

SEQ ID NO: 586758 - DNA, 25 bp, Rattus norvegicus
gccctgggaaaacacgacagcatta

SEQ ID NO: 586759 - DNA, 25 bp, Rattus norvegicus
aacacgacagcattagcccgcagcg

SEQ ID NO: 586760 - DNA, 25 bp, Rattus norvegicus
ccgcctgctggtcgcatgcggaaag

SEQ ID NO: 586761 - DNA, 25 bp, Rattus norvegicus
tgcggaaaggcaggagacttgaacc

SEQ ID NO: 586762 - DNA, 25 bp, Rattus norvegicus
ggagacttgaaccatcactatcctc

SEQ ID NO: 586763 - DNA, 25 bp, Rattus norvegicus
gctgcgcaagcgcaccgtagctcta

SEQ ID NO: 586764 - DNA, 25 bp, Rattus norvegicus
agcgcaccgtagctctaaacgcttc

SEQ ID NO: 586765 - DNA, 25 bp, Rattus norvegicus
cgctcaccttcgaggatggatacga

SEQ ID NO: 586766 - DNA, 25 bp, Rattus norvegicus
gcggtcgaggatagaacgcccatca

SEQ ID NO: 586767 - DNA, 25 bp, Rattus norvegicus
gaccatcgagcgcggcttccggcgt

SEQ ID NO: 586768 - DNA, 25 bp, Rattus norvegicus
cgaggaagccgccaagaagaaaaga

SEQ ID NO: 586769 - DNA, 25 bp, Rattus norvegicus
gaacctccagcacggccgaggaagc

SEQ ID NO: 586770 - DNA, 25 bp, Rattus norvegicus
agggaacctccagcacggccgagga

SEQ ID NO: 586771 - DNA, 25 bp, Rattus norvegicus
aagagggaacctccagcacggccga

SEQ ID NO: 586772 - DNA, 25 bp, Rattus norvegicus
acctggatccagacgacagggaaga

SEQ ID NO: 586773 - DNA, 25 bp, Rattus norvegicus
tggcgacctggatccagacgacagg

SEQ ID NO: 586774 - DNA, 25 bp, Rattus norvegicus
ctgaatggcgacctggatccagacg

SEQ ID NO: 586775 - DNA, 25 bp, Rattus norvegicus
acctgaatggcgacctggatccaga

SEQ ID NO: 586776 - DNA, 25 bp, Rattus norvegicus
ggccacctgaatggcgacctggatc

SEQ ID NO: 586777 - DNA, 25 bp, Rattus norvegicus
aagaggcatcgtctttcgggggcca

SEQ ID NO: 586778 - DNA, 25 bp, Rattus norvegicus
aacatggcgggcgtggaagaggcat

SEQ ID NO: 586779 - DNA, 25 bp, Rattus norvegicus
aggaagccgccaagaagaaaagacg

SEQ ID NO: 586780 - DNA, 25 bp, Rattus norvegicus
gtgggtgaagaaggagcgggccctc

SEQ ID NO: 586781 - DNA, 25 bp, Rattus norvegicus
cccaaaactgaagattcacggtaca

SEQ ID NO: 586782 - DNA, 25 bp, Rattus norvegicus
aagattcacggtacacacacgtccg

SEQ ID NO: 586783 - DNA, 25 bp, Rattus norvegicus
aaacacagccgcatcgacaggaccg

SEQ ID NO: 586784 - DNA, 25 bp, Rattus norvegicus
ctcggaaaacacagccgcatcgaca

SEQ ID NO: 586785 - DNA, 25 bp, Rattus norvegicus
gtttatcaaacagtgccctcggaaa

SEQ ID NO: 586786 - DNA, 25 bp, Rattus norvegicus
gggcaaagcttatctaagtttatca

SEQ ID NO: 586787 - DNA, 25 bp, Rattus norvegicus
gtgtgcagtgggcaaagcttatcta

SEQ ID NO: 586788 - DNA, 25 bp, Rattus norvegicus
caaatgtgtgcggtcagtgtgcagt

SEQ ID NO: 586789 - DNA, 25 bp, Rattus norvegicus
taatgaagtgcaaatgtgtgcggtc

SEQ ID NO: 586790 - DNA, 25 bp, Rattus norvegicus
gcgtcctcgaaagcttaatgaagtg

SEQ ID NO: 586791 - DNA, 25 bp, Rattus norvegicus
ggtcggcgtcctcgaaagcttaatg

SEQ ID NO: 586792 - DNA, 25 bp, Rattus norvegicus
aagaaccaagctgaggtcggcgtcc

SEQ ID NO: 586793 - DNA, 25 bp, Rattus norvegicus
acagagcggagggaagaaccaagct

SEQ ID NO: 586794 - DNA, 25 bp, Rattus norvegicus
ttcccacggcggcaaacagagcgga

SEQ ID NO: 586795 - DNA, 25 bp, Rattus norvegicus
tggccttcacagtctgcacgcagag

SEQ ID NO: 586796 - DNA, 25 bp, Rattus norvegicus
caccgcacgcttctgggcggtacta

SEQ ID NO: 586797 - DNA, 25 bp, Rattus norvegicus
ccactgcttctgaaatccgctcttt

SEQ ID NO: 586798 - DNA, 25 bp, Rattus norvegicus
agggaactgagccacccactgcttc

SEQ ID NO: 586799 - DNA, 25 bp, Rattus norvegicus
cgtccggatctactactctgggtga

SEQ ID NO: 586800 - DNA, 25 bp, Rattus norvegicus
taccgcagggcagtcgggaaataca

SEQ ID NO: 586801 - DNA, 25 bp, Rattus norvegicus
gggcgagccagacgcaacataacga

SEQ ID NO: 586802 - DNA, 25 bp, Rattus norvegicus
gcgggaaagtttgctggccttcaca

SEQ ID NO: 586803 - DNA, 25 bp, Rattus norvegicus
ataagggcggcaggcctactccaaa

SEQ ID NO: 586804 - DNA, 25 bp, Rattus norvegicus
gacccaggtcttgcagccaggcata

SEQ ID NO: 586805 - DNA, 25 bp, Rattus norvegicus
cacgccctcgttatcttcgcggaga

SEQ ID NO: 586806 - DNA, 25 bp, Rattus norvegicus
catggctacagttttccgggactcc

SEQ ID NO: 586807 - DNA, 25 bp, Rattus norvegicus
gcctcccgggtaaaccatggctaca

SEQ ID NO: 586808 - DNA, 25 bp, Rattus norvegicus
taacgagctcgcacgctagaagccc

SEQ ID NO: 586809 - DNA, 25 bp, Rattus norvegicus
gcgccaccaggaagaacggagcttg

SEQ ID NO: 586810 - DNA, 25 bp, Rattus norvegicus
gctttacctaaaccgctggagtgca

SEQ ID NO: 586811 - DNA, 25 bp, Rattus norvegicus
tggagtgcacggaactcgcctccca

SEQ ID NO: 586812 - DNA, 25 bp, Rattus norvegicus
aacaggcgagcatccctctctggcg

SEQ ID NO: 586813 - DNA, 25 bp, Rattus norvegicus
gaaggcctcacggtatcccggaaca

SEQ ID NO: 586814 - DNA, 25 bp, Rattus norvegicus
ctcggattccgacatgacggtcgtc

SEQ ID NO: 586815 - DNA, 25 bp, Rattus norvegicus
gcgatatggaagagggacagctttc

SEQ ID NO: 586816 - DNA, 25 bp, Rattus norvegicus
gctcccgaagcggtgctttacctaa

SEQ ID NO: 586817 - DNA, 25 bp, Rattus norvegicus
gttttatgatggtgacgctcgcccg

SEQ ID NO: 586818 - DNA, 25 bp, Rattus norvegicus
ctcccagcggtgagttttatgatgg

SEQ ID NO: 586819 - DNA, 25 bp, Rattus norvegicus
agccggaaggcctgcttagagcatc

SEQ ID NO: 586820 - DNA, 25 bp, Rattus norvegicus
taggcctctgcaaatggcggtgagc

SEQ ID NO: 586821 - DNA, 25 bp, Rattus norvegicus
cagcctcgagatgcaccgagtggga

SEQ ID NO: 586822 - DNA, 25 bp, Rattus norvegicus
agggacagctttccgactcggattc

SEQ ID NO: 586823 - DNA, 25 bp, Rattus norvegicus
cgcttcgctctttgtgcggtagccc

SEQ ID NO: 586824 - DNA, 25 bp, Rattus norvegicus
gcccgagaggaaacaaaagtgctac

SEQ ID NO: 586825 - DNA, 25 bp, Rattus norvegicus
gcacccgtttcggtctccaggctgt

SEQ ID NO: 586826 - DNA, 25 bp, Rattus norvegicus
tgtacactcacaaagggcgtctggc

SEQ ID NO: 586827 - DNA, 25 bp, Rattus norvegicus
cggcctgtggtttgtaccttagatc

SEQ ID NO: 586828 - DNA, 25 bp, Rattus norvegicus
accgtctggcggtgtatattgacaa

SEQ ID NO: 586829 - DNA, 25 bp, Rattus norvegicus
caccgggctcaaggctctctacgag

SEQ ID NO: 586830 - DNA, 25 bp, Rattus norvegicus
ctctctacgagaccgagctggccga

SEQ ID NO: 586831 - DNA, 25 bp, Rattus norvegicus
aagttcaaggccgagcacgaccagc

SEQ ID NO: 586832 - DNA, 25 bp, Rattus norvegicus
tcaagtgagtacgagttggaccgtc

SEQ ID NO: 586833 - DNA, 25 bp, Rattus norvegicus
ctgaacaggggtgccttgaagaatg

SEQ ID NO: 586834 - DNA, 25 bp, Rattus norvegicus
cttggcgatcatttctaggtggctg

SEQ ID NO: 586835 - DNA, 25 bp, Rattus norvegicus
ctacagatcgagctgggcaagttca

SEQ ID NO: 586836 - DNA, 25 bp, Rattus norvegicus
cgcgtttgcgagtgagcgtgtacac

SEQ ID NO: 586837 - DNA, 25 bp, Rattus norvegicus
cgctcagcgaatgaggcggaacacc

SEQ ID NO: 586838 - DNA, 25 bp, Rattus norvegicus
cgggtccctccagttctcagtcgga

SEQ ID NO: 586839 - DNA, 25 bp, Rattus norvegicus
aggaaccactcgcagccatctagga

SEQ ID NO: 586840 - DNA, 25 bp, Rattus norvegicus
ccatctaggaactgctgtgcgcgca

SEQ ID NO: 586841 - DNA, 25 bp, Rattus norvegicus
gggtggcaaccaccaacgccaagtc

SEQ ID NO: 586842 - DNA, 25 bp, Rattus norvegicus
tcggttccgacgcatagtcacgttc

SEQ ID NO: 586843 - DNA, 25 bp, Rattus norvegicus
cccggacgctgacagagagtaagtg

SEQ ID NO: 586844 - DNA, 25 bp, Rattus norvegicus
gctgcagatcctcagtcccaagttg

SEQ ID NO: 586845 - DNA, 25 bp, Rattus norvegicus
gcccagagcgcgctgacaatatacg

SEQ ID NO: 586846 - DNA, 25 bp, Rattus norvegicus
ctggcggaggccatagccaatagtc

SEQ ID NO: 586847 - DNA, 25 bp, Rattus norvegicus
aatagtcagggcaccaggatccttg

SEQ ID NO: 586848 - DNA, 25 bp, Rattus norvegicus
tactcggtgtccaatcgcttgctgg

SEQ ID NO: 586849 - DNA, 25 bp, Rattus norvegicus
agacgctctagctgcccgcaagttg

SEQ ID NO: 586850 - DNA, 25 bp, Rattus norvegicus
cgcattggctttactgggcacctga

SEQ ID NO: 586851 - DNA, 25 bp, Rattus norvegicus
ttccgcccgccgcacttccgctgcg

SEQ ID NO: 586852 - DNA, 25 bp, Rattus norvegicus
aacacccgggcacttggagtgctca

SEQ ID NO: 586853 - DNA, 25 bp, Rattus norvegicus
cccagtggctcagggatttatagct

SEQ ID NO: 586854 - DNA, 25 bp, Rattus norvegicus
agcgccggcgccattacccacctca

SEQ ID NO: 586855 - DNA, 25 bp, Rattus norvegicus
gcacttggagtgctcaccgtagcgc

SEQ ID NO: 586856 - DNA, 25 bp, Rattus norvegicus
ctcagcctcaggcagtcaagccgcc

SEQ ID NO: 586857 - DNA, 25 bp, Rattus norvegicus
gacgagctaacacccgggcacttgg

SEQ ID NO: 586858 - DNA, 25 bp, Rattus norvegicus
cgggacgagctaacacccgggcact

SEQ ID NO: 586859 - DNA, 25 bp, Rattus norvegicus
ggaagtctacatcggcgccgcactg

SEQ ID NO: 586860 - DNA, 25 bp, Rattus norvegicus
tgcaatggaagtctacatcggcgcc

SEQ ID NO: 586861 - DNA, 25 bp, Rattus norvegicus
cccgctaactgcaatggaagtctac

SEQ ID NO: 586862 - DNA, 25 bp, Rattus norvegicus
tatagctcccggcttaattaaatcc

SEQ ID NO: 586863 - DNA, 25 bp, Rattus norvegicus
cagggatttatagctcccggcttaa

SEQ ID NO: 586864 - DNA, 25 bp, Rattus norvegicus
ttggagtgctcaccgtagcgccggc

SEQ ID NO: 586865 - DNA, 25 bp, Rattus norvegicus
ccgatctgcgtgtgcagcttccgcg

SEQ ID NO: 586866 - DNA, 25 bp, Rattus norvegicus
ggggtccctcctagcatcgctcgga

SEQ ID NO: 586867 - DNA, 25 bp, Rattus norvegicus
cactggtccggacagcggggtccct

SEQ ID NO: 586868 - DNA, 25 bp, Rattus norvegicus
tccgcgcaggcgctgacttggagca

SEQ ID NO: 586869 - DNA, 25 bp, Rattus norvegicus
gcagcttccgcgcaggcgctgactt

SEQ ID NO: 586870 - DNA, 25 bp, Rattus norvegicus
tcctcgtccaccgtaagccggatcc

SEQ ID NO: 586871 - DNA, 25 bp, Rattus norvegicus
tcaggtcttcctcgtccaccgtaag

SEQ ID NO: 586872 - DNA, 25 bp, Rattus norvegicus
gcgggacacacgctcctcaggtctt

SEQ ID NO: 586873 - DNA, 25 bp, Rattus norvegicus
atcttggcgcgggacacacgctcct

SEQ ID NO: 586874 - DNA, 25 bp, Rattus norvegicus
ctgcagacgtggcacagactgccca

SEQ ID NO: 586875 - DNA, 25 bp, Rattus norvegicus
gcggaaagctttgatcactgtcccg

SEQ ID NO: 586876 - DNA, 25 bp, Rattus norvegicus
gattcccgggagtgtccagcgccgc

SEQ ID NO: 586877 - DNA, 25 bp, Rattus norvegicus
ctttgatcactgtcccgctgggagg

SEQ ID NO: 586878 - DNA, 25 bp, Rattus norvegicus
tgcccggcctgcagacgtggcacag

SEQ ID NO: 586879 - DNA, 25 bp, Rattus norvegicus
cgagccgcgctgtacgcagcgtcca

SEQ ID NO: 586880 - DNA, 25 bp, Rattus norvegicus
tgaacttcgtggacccggctgcctc

SEQ ID NO: 586881 - DNA, 25 bp, Rattus norvegicus
aaaagaagcgagaggagtccacagg

SEQ ID NO: 586882 - DNA, 25 bp, Rattus norvegicus
aggcagcggcgctgcgactctctct

SEQ ID NO: 586883 - DNA, 25 bp, Rattus norvegicus
ccaagtactgcgagtttagaactta

SEQ ID NO: 586884 - DNA, 25 bp, Rattus norvegicus
gcacggccgtactctccggtcgaga

SEQ ID NO: 586885 - DNA, 25 bp, Rattus norvegicus
ctccggtcgagaggatgctaccgct

SEQ ID NO: 586886 - DNA, 25 bp, Rattus norvegicus
ctggcgatgggctgggcaaacctct

SEQ ID NO: 586887 - DNA, 25 bp, Rattus norvegicus
ggctgggcaaacctctggggcccac

SEQ ID NO: 586888 - DNA, 25 bp, Rattus norvegicus
cagccagagccgcttccaggtggac

SEQ ID NO: 586889 - DNA, 25 bp, Rattus norvegicus
agagccgcttccaggtggacccggt

SEQ ID NO: 586890 - DNA, 25 bp, Rattus norvegicus
ccaagggccgcttccgcgtgaactt

SEQ ID NO: 586891 - DNA, 25 bp, Rattus norvegicus
cgcttccgcgtgaacttcgtggacc

SEQ ID NO: 586892 - DNA, 25 bp, Rattus norvegicus
aggagtccacagggtccgtgcagcc

SEQ ID NO: 586893 - DNA, 25 bp, Rattus norvegicus
gctggcctggggttcaccgctggcc

SEQ ID NO: 586894 - DNA, 25 bp, Rattus norvegicus
gccaggccattagaagagctttttc

SEQ ID NO: 586895 - DNA, 25 bp, Rattus norvegicus
tgagccaggccattagaagagcttt

SEQ ID NO: 586896 - DNA, 25 bp, Rattus norvegicus
catgagccaggccattagaagagct

SEQ ID NO: 586897 - DNA, 25 bp, Rattus norvegicus
cggccagtggtcatgagccaggcca

SEQ ID NO: 586898 - DNA, 25 bp, Rattus norvegicus
cccggccagtggtcatgagccaggc

SEQ ID NO: 586899 - DNA, 25 bp, Rattus norvegicus
tgccgcccaaaaagaactgaaccga

SEQ ID NO: 586900 - DNA, 25 bp, Rattus norvegicus
gctgccgcccaaaaagaactgaacc

SEQ ID NO: 586901 - DNA, 25 bp, Rattus norvegicus
tgctgccgcccaaaaagaactgaac

SEQ ID NO: 586902 - DNA, 25 bp, Rattus norvegicus
cctgctgccgcccaaaaagaactga

SEQ ID NO: 586903 - DNA, 25 bp, Rattus norvegicus
cactgtgcctgagggccggcctgct

SEQ ID NO: 586904 - DNA, 25 bp, Rattus norvegicus
cacactgtgcctgagggccggcctg

SEQ ID NO: 586905 - DNA, 25 bp, Rattus norvegicus
cagaagctggtgctgctcctgcccg

SEQ ID NO: 586906 - DNA, 25 bp, Rattus norvegicus
ccaggccattagaagagctttttct

SEQ ID NO: 586907 - DNA, 25 bp, Rattus norvegicus
ccttcccgaagtactgcagctgtgc

SEQ ID NO: 586908 - DNA, 25 bp, Rattus norvegicus
tggagcacggcttggcctcagccaa

SEQ ID NO: 586909 - DNA, 25 bp, Rattus norvegicus
ggcggtcgtaaaccagcaaccagtg

SEQ ID NO: 586910 - DNA, 25 bp, Rattus norvegicus
cccggagactgacgcacagaattca

SEQ ID NO: 586911 - DNA, 25 bp, Rattus norvegicus
acaatcacaacagtcccaagctgcg

SEQ ID NO: 586912 - DNA, 25 bp, Rattus norvegicus
cgctcagtcgcatcccgggagaaaa

SEQ ID NO: 586913 - DNA, 25 bp, Rattus norvegicus
aaggcgaactgagtccgggtgccct

SEQ ID NO: 586914 - DNA, 25 bp, Rattus norvegicus
ggctcaccttggcaatgctgctcag

SEQ ID NO: 586915 - DNA, 25 bp, Rattus norvegicus
ctcaggtagtagcaggcataggcga

SEQ ID NO: 586916 - DNA, 25 bp, Rattus norvegicus
ataggcgacgctgaagcccaggatc

SEQ ID NO: 586917 - DNA, 25 bp, Rattus norvegicus
aagcccaggatcagcgacaagccca

SEQ ID NO: 586918 - DNA, 25 bp, Rattus norvegicus
cgaagaaacccacgcgaacctggtg

SEQ ID NO: 586919 - DNA, 25 bp, Rattus norvegicus
acgtagagcgccagctcccgggaca

SEQ ID NO: 586920 - DNA, 25 bp, Rattus norvegicus
cgcgaacctggtgctccacgtagag

SEQ ID NO: 586921 - DNA, 25 bp, Rattus norvegicus
actcccttggcttgcggtgtcctgt

SEQ ID NO: 586922 - DNA, 25 bp, Rattus norvegicus
cgcagcggtccacacgtggagcgca

SEQ ID NO: 586923 - DNA, 25 bp, Rattus norvegicus
gcaggctagcgaacaaaagtcaccc

SEQ ID NO: 586924 - DNA, 25 bp, Rattus norvegicus
aagtcaccaaaggaagcaggctagc

SEQ ID NO: 586925 - DNA, 25 bp, Rattus norvegicus
caaagaaagcggacctcacaaggga

SEQ ID NO: 586926 - DNA, 25 bp, Rattus norvegicus
cagccgcggcataaagttacaaaga

SEQ ID NO: 586927 - DNA, 25 bp, Rattus norvegicus
ttacaaaagtaaccggagcagccgc

SEQ ID NO: 586928 - DNA, 25 bp, Rattus norvegicus
tagcgggacgcagcgtcagctcctg

SEQ ID NO: 586929 - DNA, 25 bp, Rattus norvegicus
ttcgtcagctcgcaggactcccttg

SEQ ID NO: 586930 - DNA, 25 bp, Rattus norvegicus
gtcagggtctgaccacccttcgtca

SEQ ID NO: 586931 - DNA, 25 bp, Rattus norvegicus
ggagagcactgtccgagaccaaatc

SEQ ID NO: 586932 - DNA, 25 bp, Rattus norvegicus
gggctggagacacaaccgccgccgt

SEQ ID NO: 586933 - DNA, 25 bp, Rattus norvegicus
acgcaacccagccacacgaagtagg

SEQ ID NO: 586934 - DNA, 25 bp, Rattus norvegicus
agcgacttcaggaccgccagcgggt

SEQ ID NO: 586935 - DNA, 25 bp, Rattus norvegicus
ctgtcgtatcaggtcaggccagccg

SEQ ID NO: 586936 - DNA, 25 bp, Rattus norvegicus
cctgcgactgctgtcctgtcgtatc

SEQ ID NO: 586937 - DNA, 25 bp, Rattus norvegicus
cgcggatcggaagatggtaatttgc

SEQ ID NO: 586938 - DNA, 25 bp, Rattus norvegicus
gctcttctgcttctctgtgttcgcg

SEQ ID NO: 586939 - DNA, 25 bp, Rattus norvegicus
cttattttcacggacggtgcagatc

SEQ ID NO: 586940 - DNA, 25 bp, Rattus norvegicus
ggcggtcacccttgctcttattttc

SEQ ID NO: 586941 - DNA, 25 bp, Rattus norvegicus
agtacgtggacctgcccaagggctt

SEQ ID NO: 586942 - DNA, 25 bp, Rattus norvegicus
tctggtcctctgaggaggcctgcga

SEQ ID NO: 586943 - DNA, 25 bp, Rattus norvegicus
aaattcgtggtgcagctcttcgccg

SEQ ID NO: 586944 - DNA, 25 bp, Rattus norvegicus
gctcgacatgcaccgcaaattcgtg

SEQ ID NO: 586945 - DNA, 25 bp, Rattus norvegicus
tgtacggcgaccagctcgacatgca

SEQ ID NO: 586946 - DNA, 25 bp, Rattus norvegicus
agaagttcctgagcctgtacggcga

SEQ ID NO: 586947 - DNA, 25 bp, Rattus norvegicus
ctacgacgtgctcatccagaagttc

SEQ ID NO: 586948 - DNA, 25 bp, Rattus norvegicus
ggtaatttgcagcttggtctggtcc

SEQ ID NO: 586949 - DNA, 25 bp, Rattus norvegicus
cgcgtcttctagagcttcagggcct

SEQ ID NO: 586950 - DNA, 25 bp, Rattus norvegicus
cccgcgtcttctagagcttcagggc

SEQ ID NO: 586951 - DNA, 25 bp, Rattus norvegicus
cgacgaggacgacggcgttggtggc

SEQ ID NO: 586952 - DNA, 25 bp, Rattus norvegicus
ccgcgtcttctagagcttcagggcc

SEQ ID NO: 586953 - DNA, 25 bp, Rattus norvegicus
gcgtcttctagagcttcagggcctg

SEQ ID NO: 586954 - DNA, 25 bp, Rattus norvegicus
cgtcttctagagcttcagggcctgg

SEQ ID NO: 586955 - DNA, 25 bp, Rattus norvegicus
gtcttctagagcttcagggcctggc

SEQ ID NO: 586956 - DNA, 25 bp, Rattus norvegicus
gcctggcttggctttcgaggcctcg

SEQ ID NO: 586957 - DNA, 25 bp, Rattus norvegicus
ctggcttggctttcgaggcctcgtc

SEQ ID NO: 586958 - DNA, 25 bp, Rattus norvegicus
ggcttggctttcgaggcctcgtcgt

SEQ ID NO: 586959 - DNA, 25 bp, Rattus norvegicus
cttggctttcgaggcctcgtcgtcc

SEQ ID NO: 586960 - DNA, 25 bp, Rattus norvegicus
tgtgaggttgagtggcctgagctta

SEQ ID NO: 586961 - DNA, 25 bp, Rattus norvegicus
tggcctgagcttagggcgcggagag

SEQ ID NO: 586962 - DNA, 25 bp, Rattus norvegicus
gcgcggagagctcggggcgacgagg

SEQ ID NO: 586963 - DNA, 25 bp, Rattus norvegicus
ctcgaggaatgggaagtcgtgtttc

SEQ ID NO: 586964 - DNA, 25 bp, Rattus norvegicus
tctgggagtcacacagcttgccctc

SEQ ID NO: 586965 - DNA, 25 bp, Rattus norvegicus
gcctgactcgcatctgctgctgctg

SEQ ID NO: 586966 - DNA, 25 bp, Rattus norvegicus
taccagctaggcttcctgtcgcatg

SEQ ID NO: 586967 - DNA, 25 bp, Rattus norvegicus
gggaccatctcaggtacgttctaga

SEQ ID NO: 586968 - DNA, 25 bp, Rattus norvegicus
ctctcggacttagccagtgcggatc

SEQ ID NO: 586969 - DNA, 25 bp, Rattus norvegicus
gcgcgcttctcttggccttatttta

SEQ ID NO: 586970 - DNA, 25 bp, Rattus norvegicus
tctgttaaaagatccaccagctgtg

SEQ ID NO: 586971 - DNA, 25 bp, Rattus norvegicus
cgtgccatgtgttactttgagatta

SEQ ID NO: 586972 - DNA, 25 bp, Rattus norvegicus
gagttctcacccgtttcagttagta

SEQ ID NO: 586973 - DNA, 25 bp, Rattus norvegicus
gactcatcacctaattcgccgggga

SEQ ID NO: 586974 - DNA, 25 bp, Rattus norvegicus
ttgcaggagtttcaggagctagacc

SEQ ID NO: 586975 - DNA, 25 bp, Rattus norvegicus
gcaggagtggcactgccgaacttta

SEQ ID NO: 586976 - DNA, 25 bp, Rattus norvegicus
cgtgcaagcgcctgatatctgtatg

SEQ ID NO: 586977 - DNA, 25 bp, Rattus norvegicus
agctgctacgatggcggtgcgctcc

SEQ ID NO: 586978 - DNA, 25 bp, Rattus norvegicus
acgcctggcagccacgacacgggtg

SEQ ID NO: 586979 - DNA, 25 bp, Rattus norvegicus
cgacacgggtggctcctccttcggg

SEQ ID NO: 586980 - DNA, 25 bp, Rattus norvegicus
tgccgaagtttcactcccgaccctc

SEQ ID NO: 586981 - DNA, 25 bp, Rattus norvegicus
gggcgacagccagcctagggaaccc

SEQ ID NO: 586982 - DNA, 25 bp, Rattus norvegicus
tccgtgctctgagctgctacgatgg

SEQ ID NO: 586983 - DNA, 25 bp, Rattus norvegicus
gacacaagcccgaaggtgcgacggc

SEQ ID NO: 586984 - DNA, 25 bp, Rattus norvegicus
tggtcctgggtttcaccgccgcgtc

SEQ ID NO: 586985 - DNA, 25 bp, Rattus norvegicus
aggcgacgcggctccagtctctgct

SEQ ID NO: 586986 - DNA, 25 bp, Rattus norvegicus
agtctctgctcctactacggtcgct

SEQ ID NO: 586987 - DNA, 25 bp, Rattus norvegicus
cccggaggtcccagtttgaggagca

SEQ ID NO: 586988 - DNA, 25 bp, Rattus norvegicus
cagccggctccgttgccgcagagga

SEQ ID NO: 586989 - DNA, 25 bp, Rattus norvegicus
ccgaccgaggagtagccagaacggc

SEQ ID NO: 586990 - DNA, 25 bp, Rattus norvegicus
agccagcctagggaacccgcgacag

SEQ ID NO: 586991 - DNA, 25 bp, Rattus norvegicus
ggtgctcatcccagtcactgcggct

SEQ ID NO: 586992 - DNA, 25 bp, Rattus norvegicus
cgcaaagtcccgctggatcggctta

SEQ ID NO: 586993 - DNA, 25 bp, Rattus norvegicus
cactgcggctggcaggaagttccgc

SEQ ID NO: 586994 - DNA, 25 bp, Rattus norvegicus
tgtcacacgaggtaactgggccgtc

SEQ ID NO: 586995 - DNA, 25 bp, Rattus norvegicus
tcgatcgctggaatgtgtgtcacac

SEQ ID NO: 586996 - DNA, 25 bp, Rattus norvegicus
ctactgcagtgagcttcgatcgctg

SEQ ID NO: 586997 - DNA, 25 bp, Rattus norvegicus
agctctacttctgccgctactgcag

SEQ ID NO: 586998 - DNA, 25 bp, Rattus norvegicus
gcgggttctctatctcgtccaagga

SEQ ID NO: 586999 - DNA, 25 bp, Rattus norvegicus
ccaagatggcgtccttgctgcagtc

SEQ ID NO: 587000 - DNA, 25 bp, Rattus norvegicus
gaaacgccggactgtgtcacgtgac

SEQ ID NO: 587001 - DNA, 25 bp, Rattus norvegicus
cgtcaatgtctacgtaaaagacgtg

SEQ ID NO: 587002 - DNA, 25 bp, Rattus norvegicus
gatcggcttagcttacgtcaatgtc

SEQ ID NO: 587003 - DNA, 25 bp, Rattus norvegicus
cgcacgcgcacttagatcgcaaagt

SEQ ID NO: 587004 - DNA, 25 bp, Rattus norvegicus
gtgggacccaaaaccgaggagcgca

SEQ ID NO: 587005 - DNA, 25 bp, Rattus norvegicus
cctttttcttcctgccggaagtgca

SEQ ID NO: 587006 - DNA, 25 bp, Rattus norvegicus
tctttagaggcaaggacgaacagta

SEQ ID NO: 587007 - DNA, 25 bp, Rattus norvegicus
cgaacagtagagctccgcataagcc

SEQ ID NO: 587008 - DNA, 25 bp, Rattus norvegicus
cacgccgtcctaggcgcgcagatta

SEQ ID NO: 587009 - DNA, 25 bp, Rattus norvegicus
gcagattatacgtagctcggcgcta

SEQ ID NO: 587010 - DNA, 25 bp, Rattus norvegicus
tcggtctctcgagtcggaagccaga

SEQ ID NO: 587011 - DNA, 25 bp, Rattus norvegicus
cccgggactcccgatatggcgactt

SEQ ID NO: 587012 - DNA, 25 bp, Rattus norvegicus
atggcgacttctctgggttccaaca

SEQ ID NO: 587013 - DNA, 25 bp, Rattus norvegicus
tgggttccaacacttacaacaggca

SEQ ID NO: 587014 - DNA, 25 bp, Rattus norvegicus
acaacaggcagaactgggaggacgc

SEQ ID NO: 587015 - DNA, 25 bp, Rattus norvegicus
tcggccagaaccgagctgcggccta

SEQ ID NO: 587016 - DNA, 25 bp, Rattus norvegicus
gccggaagtgcagacagcgtccctt

SEQ ID NO: 587017 - DNA, 25 bp, Rattus norvegicus
tagccacgcgtttggaccctactgg

SEQ ID NO: 587018 - DNA, 25 bp, Rattus norvegicus
tactgggtctttattctttagaggc

SEQ ID NO: 587019 - DNA, 25 bp, Rattus norvegicus
tcacccagccgtctaggctgctagg

SEQ ID NO: 587020 - DNA, 25 bp, Rattus norvegicus
actccggggactagtgcaggacgaa

SEQ ID NO: 587021 - DNA, 25 bp, Rattus norvegicus
atcgagagacacgtcggagtctgtg

SEQ ID NO: 587022 - DNA, 25 bp, Rattus norvegicus
gcccagagtcctcagaatcgagaga

SEQ ID NO: 587023 - DNA, 25 bp, Rattus norvegicus
cgggcgacttaagcccagagtcctc

SEQ ID NO: 587024 - DNA, 25 bp, Rattus norvegicus
tgtagcctagaatgccgggcgactt

SEQ ID NO: 587025 - DNA, 25 bp, Rattus norvegicus
cccgaggacagatgttgtagcctag

SEQ ID NO: 587026 - DNA, 25 bp, Rattus norvegicus
ttgagcctcaggctgccattccagc

SEQ ID NO: 587027 - DNA, 25 bp, Rattus norvegicus
gagactaccgcgcttgagcctcagg

SEQ ID NO: 587028 - DNA, 25 bp, Rattus norvegicus
aactttaggtggtgcaagaggcctc

SEQ ID NO: 587029 - DNA, 25 bp, Rattus norvegicus
agctccgcggaaattgcccgccggg

SEQ ID NO: 587030 - DNA, 25 bp, Rattus norvegicus
gccgcgttgatgatgttgcgtgcca

SEQ ID NO: 587031 - DNA, 25 bp, Rattus norvegicus
actagtgcaggacgaaggcccaacg

SEQ ID NO: 587032 - DNA, 25 bp, Rattus norvegicus
ttgcgtgccagaagcgcctgcagct

SEQ ID NO: 587033 - DNA, 25 bp, Rattus norvegicus
ttgaggagaaagacacgacagctgg

SEQ ID NO: 587034 - DNA, 25 bp, Rattus norvegicus
tcttgcggccggatttcccggagcg

SEQ ID NO: 587035 - DNA, 25 bp, Rattus norvegicus
ctcctgggtcttgcggccggatttc

SEQ ID NO: 587036 - DNA, 25 bp, Rattus norvegicus
gcccacgtcggttcacgctcaggct

SEQ ID NO: 587037 - DNA, 25 bp, Rattus norvegicus
agctaggactggtgcccatgagtga

SEQ ID NO: 587038 - DNA, 25 bp, Rattus norvegicus
aggactggtgcccatgagtgagcct

SEQ ID NO: 587039 - DNA, 25 bp, Rattus norvegicus
cccaacaacgacgagcttgaggaga

SEQ ID NO: 587040 - DNA, 25 bp, Rattus norvegicus
caacgacgagcttgaggagaaagac

SEQ ID NO: 587041 - DNA, 25 bp, Rattus norvegicus
tagagctaggactggtgcccatgag

SEQ ID NO: 587042 - DNA, 25 bp, Rattus norvegicus
ggtgcccacacagcccgggaaggta

SEQ ID NO: 587043 - DNA, 25 bp, Rattus norvegicus
cacacagcccgggaaggtagcaccc

SEQ ID NO: 587044 - DNA, 25 bp, Rattus norvegicus
aaagacacgacagctggtgcccaca

SEQ ID NO: 587045 - DNA, 25 bp, Rattus norvegicus
gacacgacagctggtgcccacacag

SEQ ID NO: 587046 - DNA, 25 bp, Rattus norvegicus
cgagcttgaggagaaagacacgaca

SEQ ID NO: 587047 - DNA, 25 bp, Rattus norvegicus
tagccaatgaatgcgggcaaacgtg

SEQ ID NO: 587048 - DNA, 25 bp, Rattus norvegicus
tcgaaccaataagcgtagagcactg

SEQ ID NO: 587049 - DNA, 25 bp, Rattus norvegicus
tgacccggccctgagcatctcgtgg

SEQ ID NO: 587050 - DNA, 25 bp, Rattus norvegicus
cgtagagcactgagctagccaatga

SEQ ID NO: 587051 - DNA, 25 bp, Rattus norvegicus
aagcgagttgctggccagttcttga

SEQ ID NO: 587052 - DNA, 25 bp, Rattus norvegicus
agcgcggcgcaccaagcgagttgct

SEQ ID NO: 587053 - DNA, 25 bp, Rattus norvegicus
ccggcctcaattctgagtgcggagg

SEQ ID NO: 587054 - DNA, 25 bp, Rattus norvegicus
gggacccggcctcaattctgagtgc

SEQ ID NO: 587055 - DNA, 25 bp, Rattus norvegicus
cgtgcgactgaccaatgagcgaaga

SEQ ID NO: 587056 - DNA, 25 bp, Rattus norvegicus
gggcaaacgtgcgactgaccaatga

SEQ ID NO: 587057 - DNA, 25 bp, Rattus norvegicus
cccgaacagctcgaaccaataagcg

SEQ ID NO: 587058 - DNA, 25 bp, Rattus norvegicus
tcaaggagcgtcttccgaggccgcc

SEQ ID NO: 587059 - DNA, 25 bp, Rattus norvegicus
ccaatgagcgaagagcctctgggta

SEQ ID NO: 587060 - DNA, 25 bp, Rattus norvegicus
gtgtggtccgcatcccgatcccggg

SEQ ID NO: 587061 - DNA, 25 bp, Rattus norvegicus
agcggattcctactttctcctcggg

SEQ ID NO: 587062 - DNA, 25 bp, Rattus norvegicus
tctacgcacctcactttcgactgcc

SEQ ID NO: 587063 - DNA, 25 bp, Rattus norvegicus
gggtcctctctacgcacctcacttt

SEQ ID NO: 587064 - DNA, 25 bp, Rattus norvegicus
cgaagcggattcctactttctcctc

SEQ ID NO: 587065 - DNA, 25 bp, Rattus norvegicus
ctcgaagcggattcctactttctcc

SEQ ID NO: 587066 - DNA, 25 bp, Rattus norvegicus
cctcgaagcggattcctactttctc

SEQ ID NO: 587067 - DNA, 25 bp, Rattus norvegicus
tacctcgaagcggattcctactttc

SEQ ID NO: 587068 - DNA, 25 bp, Rattus norvegicus
ccttacctcgaagcggattcctact

SEQ ID NO: 587069 - DNA, 25 bp, Rattus norvegicus
gccttacctcgaagcggattcctac

SEQ ID NO: 587070 - DNA, 25 bp, Rattus norvegicus
ggccttacctcgaagcggattccta

SEQ ID NO: 587071 - DNA, 25 bp, Rattus norvegicus
gaggccttacctcgaagcggattcc

SEQ ID NO: 587072 - DNA, 25 bp, Rattus norvegicus
ggaggccttacctcgaagcggattc

SEQ ID NO: 587073 - DNA, 25 bp, Rattus norvegicus
ctactttctcctcgggtcctctcta

SEQ ID NO: 587074 - DNA, 25 bp, Rattus norvegicus
aagcggattcctactttctcctcgg

SEQ ID NO: 587075 - DNA, 25 bp, Rattus norvegicus
acctggctacgtccatgcgtgagcc

SEQ ID NO: 587076 - DNA, 25 bp, Rattus norvegicus
gccctaagcgaggtcctagccgcta

SEQ ID NO: 587077 - DNA, 25 bp, Rattus norvegicus
tggctcacctggctacgtccatgcg

SEQ ID NO: 587078 - DNA, 25 bp, Rattus norvegicus
ccgctagaggctgaaggggacccaa

SEQ ID NO: 587079 - DNA, 25 bp, Rattus norvegicus
taagcgaggtcctagccgctagagg

SEQ ID NO: 587080 - DNA, 25 bp, Rattus norvegicus
ggcaccgctctcctgccgagcgctc

SEQ ID NO: 587081 - DNA, 25 bp, Rattus norvegicus
tcagcgccctaagcgaggtcctagc

SEQ ID NO: 587082 - DNA, 25 bp, Rattus norvegicus
actcagcgccctaagcgaggtccta

SEQ ID NO: 587083 - DNA, 25 bp, Rattus norvegicus
gctcacctggctacgtccatgcgtg

SEQ ID NO: 587084 - DNA, 25 bp, Rattus norvegicus
cttggctcacctggctacgtccatg

SEQ ID NO: 587085 - DNA, 25 bp, Rattus norvegicus
caagggcgaggctcactgggcgccc

SEQ ID NO: 587086 - DNA, 25 bp, Rattus norvegicus
cagctgcgcaggtggcaagggcgag

SEQ ID NO: 587087 - DNA, 25 bp, Rattus norvegicus
cacctcctctggggcggtgcgagca

SEQ ID NO: 587088 - DNA, 25 bp, Rattus norvegicus
aggtcctagccgctagaggctgaag

SEQ ID NO: 587089 - DNA, 25 bp, Rattus norvegicus
gggacaacggcacggccgccaacta

SEQ ID NO: 587090 - DNA, 25 bp, Rattus norvegicus
tttcccaccctgttgtcgctgagga

SEQ ID NO: 587091 - DNA, 25 bp, Rattus norvegicus
ttgtcgctgaggagcacctcgcagt

SEQ ID NO: 587092 - DNA, 25 bp, Rattus norvegicus
tcgcagtccctcacgaggcgccgct

SEQ ID NO: 587093 - DNA, 25 bp, Rattus norvegicus
tacccggatgtggagccgctctcgc

SEQ ID NO: 587094 - DNA, 25 bp, Rattus norvegicus
ttgctggcggccgtcgctgtagccc

SEQ ID NO: 587095 - DNA, 25 bp, Rattus norvegicus
tcctcgggcgaacctccagtcagtg

SEQ ID NO: 587096 - DNA, 25 bp, Rattus norvegicus
aacctccagtcagtgtgggagccgc

SEQ ID NO: 587097 - DNA, 25 bp, Rattus norvegicus
tgtccgggccccaatgagtaactcc

SEQ ID NO: 587098 - DNA, 25 bp, Rattus norvegicus
gagtaactcccgcaacaaccgagtg

SEQ ID NO: 587099 - DNA, 25 bp, Rattus norvegicus
cccgcaacaaccgagtgatggtgga

SEQ ID NO: 587100 - DNA, 25 bp, Rattus norvegicus
cactgtgcggagcttcgagagcccg

SEQ ID NO: 587101 - DNA, 25 bp, Rattus norvegicus
cgcttagggatccgtttccttctct

SEQ ID NO: 587102 - DNA, 25 bp, Rattus norvegicus
ccatgtaggcactgtgcggagcttc

SEQ ID NO: 587103 - DNA, 25 bp, Rattus norvegicus
ggccagtcttgcactgagtgatttc

SEQ ID NO: 587104 - DNA, 25 bp, Rattus norvegicus
cgttggaaaccgtgatagagacttc

SEQ ID NO: 587105 - DNA, 25 bp, Rattus norvegicus
tcagaggtacacttccacttccggg

SEQ ID NO: 587106 - DNA, 25 bp, Rattus norvegicus
tctctctttccggtggaggagtctg

SEQ ID NO: 587107 - DNA, 25 bp, Rattus norvegicus
gtaggaggcccagaccttgagaatc

SEQ ID NO: 587108 - DNA, 25 bp, Rattus norvegicus
ccttgagaatcgtgaggcatccttt

SEQ ID NO: 587109 - DNA, 25 bp, Rattus norvegicus
aataggccatcttccttacgggcgg

SEQ ID NO: 587110 - DNA, 25 bp, Rattus norvegicus
cctcgttcctctcgtgaaaagtacg

SEQ ID NO: 587111 - DNA, 25 bp, Rattus norvegicus
accgctctccgtgacctcagaggta

SEQ ID NO: 587112 - DNA, 25 bp, Rattus norvegicus
gccgcctgtaccctgttaagttata

SEQ ID NO: 587113 - DNA, 25 bp, Rattus norvegicus
aggatgtgtaccgatcccttctgta

SEQ ID NO: 587114 - DNA, 25 bp, Rattus norvegicus
ggcatcctttggttagggctctctg

SEQ ID NO: 587115 - DNA, 25 bp, Rattus norvegicus
gtgtccgctccgtgagttctcatag

SEQ ID NO: 587116 - DNA, 25 bp, Rattus norvegicus
gttctcataggcagatccggtcaca

SEQ ID NO: 587117 - DNA, 25 bp, Rattus norvegicus
agctgcgctagtcggatcagtttcc

SEQ ID NO: 587118 - DNA, 25 bp, Rattus norvegicus
ccgggcgggaattacaaagctgcgc

SEQ ID NO: 587119 - DNA, 25 bp, Rattus norvegicus
gcccactgcacccatggggaaactg

SEQ ID NO: 587120 - DNA, 25 bp, Rattus norvegicus
aataaggggaagcagctcccgccgc

SEQ ID NO: 587121 - DNA, 25 bp, Rattus norvegicus
tgcttgcaacagatgatggtaaata

SEQ ID NO: 587122 - DNA, 25 bp, Rattus norvegicus
gcggacgtagcctgcttgcaacaga

SEQ ID NO: 587123 - DNA, 25 bp, Rattus norvegicus
gtctgacgcttacctggccgctctg

SEQ ID NO: 587124 - DNA, 25 bp, Rattus norvegicus
ttgatcttgcactgggccgtctgac

SEQ ID NO: 587125 - DNA, 25 bp, Rattus norvegicus
cgggctactggctcccttgatcttg

SEQ ID NO: 587126 - DNA, 25 bp, Rattus norvegicus
tggccgacatctctgactcgcgctg

SEQ ID NO: 587127 - DNA, 25 bp, Rattus norvegicus
gtttaatgttcctcctgctccctgg

SEQ ID NO: 587128 - DNA, 25 bp, Rattus norvegicus
tcgcacggagtagagcagagtttaa

SEQ ID NO: 587129 - DNA, 25 bp, Rattus norvegicus
gatccggccaggctattcacgtgca

SEQ ID NO: 587130 - DNA, 25 bp, Rattus norvegicus
tggcctcggccatgccagagatccg

SEQ ID NO: 587131 - DNA, 25 bp, Rattus norvegicus
gggctctcactgcatccaggcgagc

SEQ ID NO: 587132 - DNA, 25 bp, Rattus norvegicus
gactcgggctggcccgtcatagttg

SEQ ID NO: 587133 - DNA, 25 bp, Rattus norvegicus
gcctgaccttcccggagcgccctgc

SEQ ID NO: 587134 - DNA, 25 bp, Rattus norvegicus
agcgccctgctgcagggcctcggat

SEQ ID NO: 587135 - DNA, 25 bp, Rattus norvegicus
tgctgcagggcctcggatcctggac

SEQ ID NO: 587136 - DNA, 25 bp, Rattus norvegicus
cagggcctcggatcctggacgagac

SEQ ID NO: 587137 - DNA, 25 bp, Rattus norvegicus
ggggctctcactgcatccaggcgag

SEQ ID NO: 587138 - DNA, 25 bp, Rattus norvegicus
ggctctcactgcatccaggcgagcg

SEQ ID NO: 587139 - DNA, 25 bp, Rattus norvegicus
ctctcactgcatccaggcgagcggg

SEQ ID NO: 587140 - DNA, 25 bp, Rattus norvegicus
tctcactgcatccaggcgagcgggt

SEQ ID NO: 587141 - DNA, 25 bp, Rattus norvegicus
ctagcgcggccggctctaggtcctg

SEQ ID NO: 587142 - DNA, 25 bp, Rattus norvegicus
ggccggctctaggtcctgggagccc

SEQ ID NO: 587143 - DNA, 25 bp, Rattus norvegicus
ctcactgcatccaggcgagcgggtg

SEQ ID NO: 587144 - DNA, 25 bp, Rattus norvegicus
gggcctcggatcctggacgagaccc

SEQ ID NO: 587145 - DNA, 25 bp, Rattus norvegicus
cccgcacgcagagctgcggattgga

SEQ ID NO: 587146 - DNA, 25 bp, Rattus norvegicus
gggtgcgtgacagacaccatcggcc

SEQ ID NO: 587147 - DNA, 25 bp, Rattus norvegicus
atccgatgacggacagacggttgca

SEQ ID NO: 587148 - DNA, 25 bp, Rattus norvegicus
ccagacagatccgatgacggacaga

SEQ ID NO: 587149 - DNA, 25 bp, Rattus norvegicus
gacacccagacagatccgatgacgg

SEQ ID NO: 587150 - DNA, 25 bp, Rattus norvegicus
gctgaggagacacccagacagatcc

SEQ ID NO: 587151 - DNA, 25 bp, Rattus norvegicus
tgcgcagcgcccaaggctgaggaga

SEQ ID NO: 587152 - DNA, 25 bp, Rattus norvegicus
gggtgctgcgaatgccctgcctctc

SEQ ID NO: 587153 - DNA, 25 bp, Rattus norvegicus
actggtcctatctctgcgcctttgc

SEQ ID NO: 587154 - DNA, 25 bp, Rattus norvegicus
ggcgccgagcactggtcctatctct

SEQ ID NO: 587155 - DNA, 25 bp, Rattus norvegicus
gcgtgacagacaccatcggccgcag

SEQ ID NO: 587156 - DNA, 25 bp, Rattus norvegicus
agtcagccagccaagcgggcgccga

SEQ ID NO: 587157 - DNA, 25 bp, Rattus norvegicus
gtgcttgcaagagcgcagtcagcca

SEQ ID NO: 587158 - DNA, 25 bp, Rattus norvegicus
atgccctgcctctccctgcgcagcg

SEQ ID NO: 587159 - DNA, 25 bp, Rattus norvegicus
ggcccggaccataggcagctgccca

SEQ ID NO: 587160 - DNA, 25 bp, Rattus norvegicus
ccgcctgcagctgccacgttgcgcc

SEQ ID NO: 587161 - DNA, 25 bp, Rattus norvegicus
taggcagctgcccagtcgtccttgg

SEQ ID NO: 587162 - DNA, 25 bp, Rattus norvegicus
cgggcactgggctaaagtccggagg

SEQ ID NO: 587163 - DNA, 25 bp, Rattus norvegicus
cgccaggatgccaggaccaggaccg

SEQ ID NO: 587164 - DNA, 25 bp, Rattus norvegicus
ggactgcgccaggatgccaggacca

SEQ ID NO: 587165 - DNA, 25 bp, Rattus norvegicus
cctttgcactcctggcgaggacggt

SEQ ID NO: 587166 - DNA, 25 bp, Rattus norvegicus
tccgcctttgcactcctggcgagga

SEQ ID NO: 587167 - DNA, 25 bp, Rattus norvegicus
ttcgtagggcgtccgcctttgcact

SEQ ID NO: 587168 - DNA, 25 bp, Rattus norvegicus
catccattcgtagggcgtccgcctt

SEQ ID NO: 587169 - DNA, 25 bp, Rattus norvegicus
acgttgcgccgcatccattcgtagg

SEQ ID NO: 587170 - DNA, 25 bp, Rattus norvegicus
gccgcatccattcgtagggcgtccg

SEQ ID NO: 587171 - DNA, 25 bp, Rattus norvegicus
actcctggcgaggacggtgctcccg

SEQ ID NO: 587172 - DNA, 25 bp, Rattus norvegicus
cccagtcgtccttgggcgcagggaa

SEQ ID NO: 587173 - DNA, 25 bp, Rattus norvegicus
ttcaaaaggagacaaattgccgccc

SEQ ID NO: 587174 - DNA, 25 bp, Rattus norvegicus
aggagacaaattgccgccctaagcg

SEQ ID NO: 587175 - DNA, 25 bp, Rattus norvegicus
aaattgccgccctaagcgggaggtg

SEQ ID NO: 587176 - DNA, 25 bp, Rattus norvegicus
ccctaagcgggaggtggatgggcca

SEQ ID NO: 587177 - DNA, 25 bp, Rattus norvegicus
cctgggtgatggtccaggcacagct

SEQ ID NO: 587178 - DNA, 25 bp, Rattus norvegicus
atggtccaggcacagcttcgtgttc

SEQ ID NO: 587179 - DNA, 25 bp, Rattus norvegicus
gtccaggcacagcttcgtgttccga

SEQ ID NO: 587180 - DNA, 25 bp, Rattus norvegicus
caggcacagcttcgtgttccgactc

SEQ ID NO: 587181 - DNA, 25 bp, Rattus norvegicus
gcacagcttcgtgttccgactcttc

SEQ ID NO: 587182 - DNA, 25 bp, Rattus norvegicus
gcttcgtgttccgactcttccttcg

SEQ ID NO: 587183 - DNA, 25 bp, Rattus norvegicus
tcgtgttccgactcttccttcggtg

SEQ ID NO: 587184 - DNA, 25 bp, Rattus norvegicus
tgttccgactcttccttcggtggtc

SEQ ID NO: 587185 - DNA, 25 bp, Rattus norvegicus
tccgactcttccttcggtggtcgcg

SEQ ID NO: 587186 - DNA, 25 bp, Rattus norvegicus
ggttcaaaaggagacaaattgccgc

SEQ ID NO: 587187 - DNA, 25 bp, Rattus norvegicus
ggaccgaaggttcgcgaacaggctc

SEQ ID NO: 587188 - DNA, 25 bp, Rattus norvegicus
tggcacgggacaaacagaagctgga

SEQ ID NO: 587189 - DNA, 25 bp, Rattus norvegicus
tttgagcctagagggccggacttac

SEQ ID NO: 587190 - DNA, 25 bp, Rattus norvegicus
cggctccaagcgtgacagtggtaaa

SEQ ID NO: 587191 - DNA, 25 bp, Rattus norvegicus
aggcggactgcttccggccaaactt

SEQ ID NO: 587192 - DNA, 25 bp, Rattus norvegicus
cccgagttaggtagcaagggcacac

SEQ ID NO: 587193 - DNA, 25 bp, Rattus norvegicus
aagggcacacgagtctacgcggcac

SEQ ID NO: 587194 - DNA, 25 bp, Rattus norvegicus
aggagcttgcgagcctcacggctca

SEQ ID NO: 587195 - DNA, 25 bp, Rattus norvegicus
tgattgcgtgcgaccctcgcgcaag

SEQ ID NO: 587196 - DNA, 25 bp, Rattus norvegicus
agcggcgacagcacaccactgatcg

SEQ ID NO: 587197 - DNA, 25 bp, Rattus norvegicus
gggtcctctgttggaacccattgga

SEQ ID NO: 587198 - DNA, 25 bp, Rattus norvegicus
accactgatcgccagggagacccgt

SEQ ID NO: 587199 - DNA, 25 bp, Rattus norvegicus
acccattggaggtttaggagctgga

SEQ ID NO: 587200 - DNA, 25 bp, Rattus norvegicus
gcaagcgcaaccgacgggtcctctg

SEQ ID NO: 587201 - DNA, 25 bp, Rattus norvegicus
ttaatgctccagtccgccagacacg

SEQ ID NO: 587202 - DNA, 25 bp, Rattus norvegicus
gacacatcaggtccgaggcggcccg

SEQ ID NO: 587203 - DNA, 25 bp, Rattus norvegicus
gccaccgcaggtctgccaggtcagt

SEQ ID NO: 587204 - DNA, 25 bp, Rattus norvegicus
caggtcagtccctgccgggttttgt

SEQ ID NO: 587205 - DNA, 25 bp, Rattus norvegicus
tgcagacgcactgctgaccgcagag

SEQ ID NO: 587206 - DNA, 25 bp, Rattus norvegicus
tgagtcttcagtggatcccgcgatc

SEQ ID NO: 587207 - DNA, 25 bp, Rattus norvegicus
acggcacgtcctccggcaagacttg

SEQ ID NO: 587208 - DNA, 25 bp, Rattus norvegicus
gccgccgcacgggtacaggcagtct

SEQ ID NO: 587209 - DNA, 25 bp, Rattus norvegicus
gcagcagctagccatggtcaccgta

SEQ ID NO: 587210 - DNA, 25 bp, Rattus norvegicus
tcgaccgcttgcttcttcgtgattg

SEQ ID NO: 587211 - DNA, 25 bp, Rattus norvegicus
ttcttcgtgattggctgtcctgggc

SEQ ID NO: 587212 - DNA, 25 bp, Rattus norvegicus
gggctacaagccaagtctgagtctt

SEQ ID NO: 587213 - DNA, 25 bp, Rattus norvegicus
tggatcccgcgatctactgcgtgga

SEQ ID NO: 587214 - DNA, 25 bp, Rattus norvegicus
ttttgtctcggctgcagacgcactg

SEQ ID NO: 587215 - DNA, 25 bp, Rattus norvegicus
gacagagccggatggacacgcactt

SEQ ID NO: 587216 - DNA, 25 bp, Rattus norvegicus
cggtgctgctctaagaaccacgacc

SEQ ID NO: 587217 - DNA, 25 bp, Rattus norvegicus
ccgggtcttctttgcgcagtgtcaa

SEQ ID NO: 587218 - DNA, 25 bp, Rattus norvegicus
ccaatcagaatcaggggcgggtcta

SEQ ID NO: 587219 - DNA, 25 bp, Rattus norvegicus
ttcctgaggcggataccatttctcc

SEQ ID NO: 587220 - DNA, 25 bp, Rattus norvegicus
agcctagacactacgagcgagcatg

SEQ ID NO: 587221 - DNA, 25 bp, Rattus norvegicus
ccgcgagacactggcttggaaagcc

SEQ ID NO: 587222 - DNA, 25 bp, Rattus norvegicus
aatgtccgctaatggaggcgccggc

SEQ ID NO: 587223 - DNA, 25 bp, Rattus norvegicus
gacaactccaggtcgtgctactgca

SEQ ID NO: 587224 - DNA, 25 bp, Rattus norvegicus
cggtccttcgtgtaaatgtccgcta

SEQ ID NO: 587225 - DNA, 25 bp, Rattus norvegicus
ccctaggttagtcggaccaggcatc

SEQ ID NO: 587226 - DNA, 25 bp, Rattus norvegicus
acacgcacttggtagggtggacaca

SEQ ID NO: 587227 - DNA, 25 bp, Rattus norvegicus
taacacgaagaaggccggacaactc

SEQ ID NO: 587228 - DNA, 25 bp, Rattus norvegicus
acacagtccaaggaagatgggcgta

SEQ ID NO: 587229 - DNA, 25 bp, Rattus norvegicus
ttagaccggctctcttgggctacga

SEQ ID NO: 587230 - DNA, 25 bp, Rattus norvegicus
tacccttagagtcgcgtccaggagc

SEQ ID NO: 587231 - DNA, 25 bp, Rattus norvegicus
cctgcagtgttttcccggaagtccg

SEQ ID NO: 587232 - DNA, 25 bp, Rattus norvegicus
gcccgagttacctgtgctgtgcgga

SEQ ID NO: 587233 - DNA, 25 bp, Rattus norvegicus
cgcgtatccctggaagtagcggagc

SEQ ID NO: 587234 - DNA, 25 bp, Rattus norvegicus
agccgcgcgaacaggtagaacagtc

SEQ ID NO: 587235 - DNA, 25 bp, Rattus norvegicus
acaggtagaacagtccgcacagggc

SEQ ID NO: 587236 - DNA, 25 bp, Rattus norvegicus
cgatatcccgcaccttcgtggaaga

SEQ ID NO: 587237 - DNA, 25 bp, Rattus norvegicus
ttcgtggaagaagatgccggcgacc

SEQ ID NO: 587238 - DNA, 25 bp, Rattus norvegicus
agcggaaagtactcgctgcaattta

SEQ ID NO: 587239 - DNA, 25 bp, Rattus norvegicus
tcgctgcaatttaccctgcgtgggg

SEQ ID NO: 587240 - DNA, 25 bp, Rattus norvegicus
tcggaagacgcgctcgaactcggga

SEQ ID NO: 587241 - DNA, 25 bp, Rattus norvegicus
gcggcgacacgtggaaagttcttcg

SEQ ID NO: 587242 - DNA, 25 bp, Rattus norvegicus
cgctcgcgtacaggggatccagcct

SEQ ID NO: 587243 - DNA, 25 bp, Rattus norvegicus
ctttaggcttgcaacaggcatgggc

SEQ ID NO: 587244 - DNA, 25 bp, Rattus norvegicus
acctgccagaggaatcgtagtaccc

SEQ ID NO: 587245 - DNA, 25 bp, Rattus norvegicus
gaccctggctggattctacctgcca

SEQ ID NO: 587246 - DNA, 25 bp, Rattus norvegicus
cgaggacgcgcctacaaaacccaga

SEQ ID NO: 587247 - DNA, 25 bp, Rattus norvegicus
cccgccacaagtgcacgtgaaagta

SEQ ID NO: 587248 - DNA, 25 bp, Rattus norvegicus
ggactccagggctatcgatcatctc

SEQ ID NO: 587249 - DNA, 25 bp, Rattus norvegicus
tacggggtacccgatgctggagaac

SEQ ID NO: 587250 - DNA, 25 bp, Rattus norvegicus
ggaagacgcaatctccgcccgcatg

SEQ ID NO: 587251 - DNA, 25 bp, Rattus norvegicus
gccttgctctttcctagcgggtctc

SEQ ID NO: 587252 - DNA, 25 bp, Rattus norvegicus
tgaggctcccagtctcagccagagc

SEQ ID NO: 587253 - DNA, 25 bp, Rattus norvegicus
ttttagtctccaagaccgcagcttc

SEQ ID NO: 587254 - DNA, 25 bp, Rattus norvegicus
ggcacaaacgcttccacaccaggta

SEQ ID NO: 587255 - DNA, 25 bp, Rattus norvegicus
tccctcccagtgttatgcaaaacgg

SEQ ID NO: 587256 - DNA, 25 bp, Rattus norvegicus
cactcctgtcatgcgcttgtagccg

SEQ ID NO: 587257 - DNA, 25 bp, Rattus norvegicus
cagttgccactctaagcctaggttg

SEQ ID NO: 587258 - DNA, 25 bp, Rattus norvegicus
tggcgacatcctgtcgccaggctgg

SEQ ID NO: 587259 - DNA, 25 bp, Rattus norvegicus
gcacctcatctgtccagcagctgtt

SEQ ID NO: 587260 - DNA, 25 bp, Rattus norvegicus
ggatgccctccggtgtcactcgcac

SEQ ID NO: 587261 - DNA, 25 bp, Rattus norvegicus
ggctccggctgcgagtgcagctcct

SEQ ID NO: 587262 - DNA, 25 bp, Rattus norvegicus
gagtgcagctcctctgtctgctgtg

SEQ ID NO: 587263 - DNA, 25 bp, Rattus norvegicus
agctcctctgtctgctgtgcacgcg

SEQ ID NO: 587264 - DNA, 25 bp, Rattus norvegicus
ccgcctttgtcagttgccactctaa

SEQ ID NO: 587265 - DNA, 25 bp, Rattus norvegicus
agtcgagggcgttcccagaccgcgc

SEQ ID NO: 587266 - DNA, 25 bp, Rattus norvegicus
gccactctaagcctaggttgttttc

SEQ ID NO: 587267 - DNA, 25 bp, Rattus norvegicus
ctaggttgttttcggcgcgcgctcc

SEQ ID NO: 587268 - DNA, 25 bp, Rattus norvegicus
cctgagtcacccagcagtcgagggc

SEQ ID NO: 587269 - DNA, 25 bp, Rattus norvegicus
acccagcagtcgagggcgttcccag

SEQ ID NO: 587270 - DNA, 25 bp, Rattus norvegicus
tgtctgctgtgcacgcgcagagcgc

SEQ ID NO: 587271 - DNA, 25 bp, Rattus norvegicus
cgtgatgacctttgaacctcgagaa

SEQ ID NO: 587272 - DNA, 25 bp, Rattus norvegicus
ggggttaacacacggcacgtgctcg

SEQ ID NO: 587273 - DNA, 25 bp, Rattus norvegicus
gaggggttaacacacggcacgtgct

SEQ ID NO: 587274 - DNA, 25 bp, Rattus norvegicus
aatcaacatgcgatgcacacagggg

SEQ ID NO: 587275 - DNA, 25 bp, Rattus norvegicus
cggttatcaatcaacatgcgatgca

SEQ ID NO: 587276 - DNA, 25 bp, Rattus norvegicus
cgcggttatcaatcaacatgcgatg

SEQ ID NO: 587277 - DNA, 25 bp, Rattus norvegicus
tggacgcggttatcaatcaacatgc

SEQ ID NO: 587278 - DNA, 25 bp, Rattus norvegicus
tggtggacgcggttatcaatcaaca

SEQ ID NO: 587279 - DNA, 25 bp, Rattus norvegicus
ggatcacaacgcagatggtggacgc

SEQ ID NO: 587280 - DNA, 25 bp, Rattus norvegicus
cacaggggatcacaacgcagatggt

SEQ ID NO: 587281 - DNA, 25 bp, Rattus norvegicus
agaacacaggggatcacaacgcaga

SEQ ID NO: 587282 - DNA, 25 bp, Rattus norvegicus
ctcgagaagaacacaggggatcaca

SEQ ID NO: 587283 - DNA, 25 bp, Rattus norvegicus
tttgaacctcgagaagaacacaggg

SEQ ID NO: 587284 - DNA, 25 bp, Rattus norvegicus
tgacctttgaacctcgagaagaaca

SEQ ID NO: 587285 - DNA, 25 bp, Rattus norvegicus
tggcgcagcttgtcaccaacatggc

SEQ ID NO: 587286 - DNA, 25 bp, Rattus norvegicus
agctccgccgccgtttggtgaatgt

SEQ ID NO: 587287 - DNA, 25 bp, Rattus norvegicus
tggatcatgacgtcgtgccgcagct

SEQ ID NO: 587288 - DNA, 25 bp, Rattus norvegicus
tggtgaatgttgtgtttcggctcgc

SEQ ID NO: 587289 - DNA, 25 bp, Rattus norvegicus
cttagggcggtctggaactgccagt

SEQ ID NO: 587290 - DNA, 25 bp, Rattus norvegicus
cgccgccgtttggtgaatgttgtgt

SEQ ID NO: 587291 - DNA, 25 bp, Rattus norvegicus
tgtcaccaacatggcgctgggcagc

SEQ ID NO: 587292 - DNA, 25 bp, Rattus norvegicus
agcttgtcaccaacatggcgctggg

SEQ ID NO: 587293 - DNA, 25 bp, Rattus norvegicus
agctccttggcgcagcttgtcacca

SEQ ID NO: 587294 - DNA, 25 bp, Rattus norvegicus
aactggtggatcatgacgtcgtgcc

SEQ ID NO: 587295 - DNA, 25 bp, Rattus norvegicus
cacgaactggtggatcatgacgtcg

SEQ ID NO: 587296 - DNA, 25 bp, Rattus norvegicus
gccacgcaacccacggccagcacga

SEQ ID NO: 587297 - DNA, 25 bp, Rattus norvegicus
cgcctggtcggccacgcaacccacg

SEQ ID NO: 587298 - DNA, 25 bp, Rattus norvegicus
cgccgtttggtgaatgttgtgtttc

SEQ ID NO: 587299 - DNA, 25 bp, Rattus norvegicus
gcgatcaacatcaccaatggcgagg

SEQ ID NO: 587300 - DNA, 25 bp, Rattus norvegicus
cggggacatttatctagcgatcaac

SEQ ID NO: 587301 - DNA, 25 bp, Rattus norvegicus
ctcgcctgacgcatagcaagacact

SEQ ID NO: 587302 - DNA, 25 bp, Rattus norvegicus
atcggatctggttccttcggggaca

SEQ ID NO: 587303 - DNA, 25 bp, Rattus norvegicus
tatcgtcggtgggaaatacaaactg

SEQ ID NO: 587304 - DNA, 25 bp, Rattus norvegicus
cagcggctccaaggccgaatttatc

SEQ ID NO: 587305 - DNA, 25 bp, Rattus norvegicus
ggaggcttccatcctcttccagagg

SEQ ID NO: 587306 - DNA, 25 bp, Rattus norvegicus
ctcctcagatctgccgggtggaaca

SEQ ID NO: 587307 - DNA, 25 bp, Rattus norvegicus
agccttggttttaggttgcctgccg

SEQ ID NO: 587308 - DNA, 25 bp, Rattus norvegicus
ttgcgccctgaaacgccaacaaagc

SEQ ID NO: 587309 - DNA, 25 bp, Rattus norvegicus
cccaaatagcaagtggccgagcttc

SEQ ID NO: 587310 - DNA, 25 bp, Rattus norvegicus
gctggagtaacaagatggcggcatc

SEQ ID NO: 587311 - DNA, 25 bp, Rattus norvegicus
tgccctcggggtccaaagtgattaa

SEQ ID NO: 587312 - DNA, 25 bp, Rattus norvegicus
atggcgaggtaatcacccggttctg

SEQ ID NO: 587313 - DNA, 25 bp, Rattus norvegicus
cctctagcggttggcgctcgactgt

SEQ ID NO: 587314 - DNA, 25 bp, Rattus norvegicus
agcctctagcggttggcgctcgact

SEQ ID NO: 587315 - DNA, 25 bp, Rattus norvegicus
gatcagcctctagcggttggcgctc

SEQ ID NO: 587316 - DNA, 25 bp, Rattus norvegicus
tgcggatcagcctctagcggttggc

SEQ ID NO: 587317 - DNA, 25 bp, Rattus norvegicus
cgctgcggatcagcctctagcggtt

SEQ ID NO: 587318 - DNA, 25 bp, Rattus norvegicus
agcacgctgcggatcagcctctagc

SEQ ID NO: 587319 - DNA, 25 bp, Rattus norvegicus
aggcagcacgctgcggatcagcctc

SEQ ID NO: 587320 - DNA, 25 bp, Rattus norvegicus
gtgaccaggcagcacgctgcggatc

SEQ ID NO: 587321 - DNA, 25 bp, Rattus norvegicus
gcggcggtgagaagtgtggccagca

SEQ ID NO: 587322 - DNA, 25 bp, Rattus norvegicus
caccgcatccttcccgcaccgattt

SEQ ID NO: 587323 - DNA, 25 bp, Rattus norvegicus
aagtgtggccagcacggcgagcagc

SEQ ID NO: 587324 - DNA, 25 bp, Rattus norvegicus
ctcttcccgcccgtcctcagtgagc

SEQ ID NO: 587325 - DNA, 25 bp, Rattus norvegicus
tcccgcccgtcctcagtgagcaccc

SEQ ID NO: 587326 - DNA, 25 bp, Rattus norvegicus
ggtcacctgcgaaccctcttcccgc

SEQ ID NO: 587327 - DNA, 25 bp, Rattus norvegicus
ctcgagccaagtggagagtcgcgct

SEQ ID NO: 587328 - DNA, 25 bp, Rattus norvegicus
tgcttgtgccaagaggctcgtagta

SEQ ID NO: 587329 - DNA, 25 bp, Rattus norvegicus
acgcgccgccatgttccagattaga

SEQ ID NO: 587330 - DNA, 25 bp, Rattus norvegicus
aaaagcgcgcctatgggcctcagcc

SEQ ID NO: 587331 - DNA, 25 bp, Rattus norvegicus
gtggatcctcacctcatcctcgaga

SEQ ID NO: 587332 - DNA, 25 bp, Rattus norvegicus
ctcgtagtaggtgcgaggttcactg

SEQ ID NO: 587333 - DNA, 25 bp, Rattus norvegicus
tcatagtcatgtggatgcttgtgcc

SEQ ID NO: 587334 - DNA, 25 bp, Rattus norvegicus
cctcgtagttcatctagtcatagtc

SEQ ID NO: 587335 - DNA, 25 bp, Rattus norvegicus
ctgcttttccggtcaggtcgctacc

SEQ ID NO: 587336 - DNA, 25 bp, Rattus norvegicus
gtgcgctaccctgcttttccggtca

SEQ ID NO: 587337 - DNA, 25 bp, Rattus norvegicus
ggacttccggtttcctgtgcgctac

SEQ ID NO: 587338 - DNA, 25 bp, Rattus norvegicus
gagtcgcgctctgaaaaaccacgcc

SEQ ID NO: 587339 - DNA, 25 bp, Rattus norvegicus
gttccagattagagcgccgacaatg

SEQ ID NO: 587340 - DNA, 25 bp, Rattus norvegicus
ttcactgtgagctaagtggatcctc

SEQ ID NO: 587341 - DNA, 25 bp, Rattus norvegicus
cggatcctggagcactcagcccaga

SEQ ID NO: 587342 - DNA, 25 bp, Rattus norvegicus
ctagcagggacagcctcacagctca

SEQ ID NO: 587343 - DNA, 25 bp, Rattus norvegicus
gtccgccaagccctagcgccacctc

SEQ ID NO: 587344 - DNA, 25 bp, Rattus norvegicus
tcacacgcttgggttcggtgcctac

SEQ ID NO: 587345 - DNA, 25 bp, Rattus norvegicus
ctcacagctcacacgcttgggttcg

SEQ ID NO: 587346 - DNA, 25 bp, Rattus norvegicus
cgccctcctgctgggctagcaggga

SEQ ID NO: 587347 - DNA, 25 bp, Rattus norvegicus
ccgcactggccaacgccacgccctg

SEQ ID NO: 587348 - DNA, 25 bp, Rattus norvegicus
ggaatagacccgagcacgcctcgcc

SEQ ID NO: 587349 - DNA, 25 bp, Rattus norvegicus
tgcgcgctcccggaatagacccgag

SEQ ID NO: 587350 - DNA, 25 bp, Rattus norvegicus
cctgcgatctcccaggcctcccttc

SEQ ID NO: 587351 - DNA, 25 bp, Rattus norvegicus
gagcactcagcccagagcgcagcgg

SEQ ID NO: 587352 - DNA, 25 bp, Rattus norvegicus
tctcagtcctatccggcctgcgatc

SEQ ID NO: 587353 - DNA, 25 bp, Rattus norvegicus
cccagacaggatgctcgcaggacgc

SEQ ID NO: 587354 - DNA, 25 bp, Rattus norvegicus
catggctccggcacggatcctggag

SEQ ID NO: 587355 - DNA, 25 bp, Rattus norvegicus
gaaacctgagagctcgccatccatg

SEQ ID NO: 587356 - DNA, 25 bp, Rattus norvegicus
tggctcatgaatcccgctggtcgtc

SEQ ID NO: 587357 - DNA, 25 bp, Rattus norvegicus
tggcagcgccggctcgtgcgcaccc

SEQ ID NO: 587358 - DNA, 25 bp, Rattus norvegicus
cccgcgttatcccagccggcaggct

SEQ ID NO: 587359 - DNA, 25 bp, Rattus norvegicus
ccacctcttgtccagttttgggagc

SEQ ID NO: 587360 - DNA, 25 bp, Rattus norvegicus
ctcttgtccagttttgggagccaga

SEQ ID NO: 587361 - DNA, 25 bp, Rattus norvegicus
ccctgcaagtggctcatgaatcccg

SEQ ID NO: 587362 - DNA, 25 bp, Rattus norvegicus
aagtggctcatgaatcccgctggtc

SEQ ID NO: 587363 - DNA, 25 bp, Rattus norvegicus
cgagccaggcgaaacctgagagctc

SEQ ID NO: 587364 - DNA, 25 bp, Rattus norvegicus
ctgagagctcgccatccatgatgtg

SEQ ID NO: 587365 - DNA, 25 bp, Rattus norvegicus
gctcgccatccatgatgtgggctcg

SEQ ID NO: 587366 - DNA, 25 bp, Rattus norvegicus
catccatgatgtgggctcgcagctt

SEQ ID NO: 587367 - DNA, 25 bp, Rattus norvegicus
tgccacctgctggacgcgccggcgc

SEQ ID NO: 587368 - DNA, 25 bp, Rattus norvegicus
atgccagggcgagccaggcgaaacc

SEQ ID NO: 587369 - DNA, 25 bp, Rattus norvegicus
ctcggcttccattgggtgccagcaa

SEQ ID NO: 587370 - DNA, 25 bp, Rattus norvegicus
gcttcattcagagaccgtaggtggc

SEQ ID NO: 587371 - DNA, 25 bp, Rattus norvegicus
ggcggactcctggaagcttcattca

SEQ ID NO: 587372 - DNA, 25 bp, Rattus norvegicus
agcgcaccggctttcagtgcccaga

SEQ ID NO: 587373 - DNA, 25 bp, Rattus norvegicus
gctgtcattcccgtgtggctccatg

SEQ ID NO: 587374 - DNA, 25 bp, Rattus norvegicus
gaacttggcaatggctgtgatgacc

SEQ ID NO: 587375 - DNA, 25 bp, Rattus norvegicus
acgttgccaaacacgatggccagga

SEQ ID NO: 587376 - DNA, 25 bp, Rattus norvegicus
ccgttcctgagtgatgtcgtggcct

SEQ ID NO: 587377 - DNA, 25 bp, Rattus norvegicus
tgcacactgagctcgtgggtgctcc

SEQ ID NO: 587378 - DNA, 25 bp, Rattus norvegicus
tgccagcaagaagtcgctgtcattc

SEQ ID NO: 587379 - DNA, 25 bp, Rattus norvegicus
ctgtgatgaccagcacgttgccaaa

SEQ ID NO: 587380 - DNA, 25 bp, Rattus norvegicus
accgacatgaggatggccatgccca

SEQ ID NO: 587381 - DNA, 25 bp, Rattus norvegicus
ggtttgtagtcgctcgaacttggca

SEQ ID NO: 587382 - DNA, 25 bp, Rattus norvegicus
atggccaggacgataaccgacatga

SEQ ID NO: 587383 - DNA, 25 bp, Rattus norvegicus
ttctcgaagatgacaagcgccctgc

SEQ ID NO: 587384 - DNA, 25 bp, Rattus norvegicus
ggaacctatccaagaggagccacgt

SEQ ID NO: 587385 - DNA, 25 bp, Rattus norvegicus
cgggctcagcgtagcagagtgtact

SEQ ID NO: 587386 - DNA, 25 bp, Rattus norvegicus
cgggtatttaaactgaacactcagg

SEQ ID NO: 587387 - DNA, 25 bp, Rattus norvegicus
cacgtcaggaatcttcgggtattta

SEQ ID NO: 587388 - DNA, 25 bp, Rattus norvegicus
tgatggacccgagctatagccaatc

SEQ ID NO: 587389 - DNA, 25 bp, Rattus norvegicus
ggcgaactctgcgtcactgctgatg

SEQ ID NO: 587390 - DNA, 25 bp, Rattus norvegicus
cgccgccatcttaaaattgttttcg

SEQ ID NO: 587391 - DNA, 25 bp, Rattus norvegicus
tcaggcttcggcctgtccgctatac

SEQ ID NO: 587392 - DNA, 25 bp, Rattus norvegicus
ctggcacttcgggttcctccgcttt

SEQ ID NO: 587393 - DNA, 25 bp, Rattus norvegicus
agacacagcctcgtagcgggcctca

SEQ ID NO: 587394 - DNA, 25 bp, Rattus norvegicus
agctccaggcgctcgggagacacag

SEQ ID NO: 587395 - DNA, 25 bp, Rattus norvegicus
caaaggtatgctggcgttcgagctc

SEQ ID NO: 587396 - DNA, 25 bp, Rattus norvegicus
ctcccaggacccagactaagaaatg

SEQ ID NO: 587397 - DNA, 25 bp, Rattus norvegicus
tccaccttcgcgacagcctcccagg

SEQ ID NO: 587398 - DNA, 25 bp, Rattus norvegicus
gtcttccgaagaagtgtcatcgggg

SEQ ID NO: 587399 - DNA, 25 bp, Rattus norvegicus
ggagaatcgcgacaaactcttcctg

SEQ ID NO: 587400 - DNA, 25 bp, Rattus norvegicus
gccgcggctcacttacgccggccct

SEQ ID NO: 587401 - DNA, 25 bp, Rattus norvegicus
cgccggccctccgtctgtttttgtg

SEQ ID NO: 587402 - DNA, 25 bp, Rattus norvegicus
gccctccgtctgtttttgtggttga

SEQ ID NO: 587403 - DNA, 25 bp, Rattus norvegicus
agagggacggagaatcgcgacaaac

SEQ ID NO: 587404 - DNA, 25 bp, Rattus norvegicus
aatcgcgacaaactcttcctgcggc

SEQ ID NO: 587405 - DNA, 25 bp, Rattus norvegicus
cccacctccgcagagcttccgcttc

SEQ ID NO: 587406 - DNA, 25 bp, Rattus norvegicus
ttccgctgcctctagagtcttccga

SEQ ID NO: 587407 - DNA, 25 bp, Rattus norvegicus
cgctgcctctagagtcttccgaaga

SEQ ID NO: 587408 - DNA, 25 bp, Rattus norvegicus
tagagtcttccgaagaagtgtcatc

SEQ ID NO: 587409 - DNA, 25 bp, Rattus norvegicus
ccacaaccgcgcacctccaccttcg

SEQ ID NO: 587410 - DNA, 25 bp, Rattus norvegicus
tgcctctagagtcttccgaagaagt

SEQ ID NO: 587411 - DNA, 25 bp, Rattus norvegicus
actcttcgcgtcagcaagcggccga

SEQ ID NO: 587412 - DNA, 25 bp, Rattus norvegicus
ctaggctgtttcactcttcgcgtca

SEQ ID NO: 587413 - DNA, 25 bp, Rattus norvegicus
gtaattaaccgacaacaccagcttg

SEQ ID NO: 587414 - DNA, 25 bp, Rattus norvegicus
caccagcttgagcacctccaggtta

SEQ ID NO: 587415 - DNA, 25 bp, Rattus norvegicus
ggttagctccgcatcactgcgcttg

SEQ ID NO: 587416 - DNA, 25 bp, Rattus norvegicus
tccgggccagctttgccataagaaa

SEQ ID NO: 587417 - DNA, 25 bp, Rattus norvegicus
gccgacgctctaggtgttttgctga

SEQ ID NO: 587418 - DNA, 25 bp, Rattus norvegicus
ggctggagcatctagccaaggcaga

SEQ ID NO: 587419 - DNA, 25 bp, Rattus norvegicus
gttttgctgagctctaggctgtttc

SEQ ID NO: 587420 - DNA, 25 bp, Rattus norvegicus
cgaggcaatggcagcccagaagata

SEQ ID NO: 587421 - DNA, 25 bp, Rattus norvegicus
agaagtagtacgtcgagtcgccgcc

SEQ ID NO: 587422 - DNA, 25 bp, Rattus norvegicus
ctgcagtcgatcgtgccagcctgcg

SEQ ID NO: 587423 - DNA, 25 bp, Rattus norvegicus
cctgcgccgcgtcatttgctgcaga

SEQ ID NO: 587424 - DNA, 25 bp, Rattus norvegicus
cggtgccttgccttttgggtcaatc

SEQ ID NO: 587425 - DNA, 25 bp, Rattus norvegicus
aaactttgcaagctctcactcccga

SEQ ID NO: 587426 - DNA, 25 bp, Rattus norvegicus
taggcagccacctagccaggcgtcg

SEQ ID NO: 587427 - DNA, 25 bp, Rattus norvegicus
cccatgaagtgtggaatcggaatcc

SEQ ID NO: 587428 - DNA, 25 bp, Rattus norvegicus
aatcggaatccaacggcggctgctc

SEQ ID NO: 587429 - DNA, 25 bp, Rattus norvegicus
aagctgtcctctgcccgctctggaa

SEQ ID NO: 587430 - DNA, 25 bp, Rattus norvegicus
tggcccagagtttctagcggaaccc

SEQ ID NO: 587431 - DNA, 25 bp, Rattus norvegicus
ggttccgatgccctcacggactatg

SEQ ID NO: 587432 - DNA, 25 bp, Rattus norvegicus
atagaaaggcggctcctagcagcga

SEQ ID NO: 587433 - DNA, 25 bp, Rattus norvegicus
ctcacggactatggagctcccggtg

SEQ ID NO: 587434 - DNA, 25 bp, Rattus norvegicus
gctcccggtgagctaaagaccgcca

SEQ ID NO: 587435 - DNA, 25 bp, Rattus norvegicus
gagtccagtgctccctgcgaggaac

SEQ ID NO: 587436 - DNA, 25 bp, Rattus norvegicus
ccaccgcgactttggtgagcaaaga

SEQ ID NO: 587437 - DNA, 25 bp, Rattus norvegicus
agaaagcccaagaaccctgcagttg

SEQ ID NO: 587438 - DNA, 25 bp, Rattus norvegicus
cggcgtgtcccagggccaatagaaa

SEQ ID NO: 587439 - DNA, 25 bp, Rattus norvegicus
cagccaccgcgctgagggagtctcg

SEQ ID NO: 587440 - DNA, 25 bp, Rattus norvegicus
aatctggatcgctcccgaccggctt

SEQ ID NO: 587441 - DNA, 25 bp, Rattus norvegicus
accatccttacagagagcccggcag

SEQ ID NO: 587442 - DNA, 25 bp, Rattus norvegicus
cttaagacgaaagcccgagagaggc

SEQ ID NO: 587443 - DNA, 25 bp, Rattus norvegicus
gtcctcccggtgctgcgagtgccga

SEQ ID NO: 587444 - DNA, 25 bp, Rattus norvegicus
gggcaaggcgcgcaacacccagcag

SEQ ID NO: 587445 - DNA, 25 bp, Rattus norvegicus
ccggctggaaatctggatcgctccc

SEQ ID NO: 587446 - DNA, 25 bp, Rattus norvegicus
acgtcatttccacgtcttccgtttg

SEQ ID NO: 587447 - DNA, 25 bp, Rattus norvegicus
acgtcttccgtttgcgtgccgacct

SEQ ID NO: 587448 - DNA, 25 bp, Rattus norvegicus
gtgccgacctgaggcttgcacgacc

SEQ ID NO: 587449 - DNA, 25 bp, Rattus norvegicus
ttgcacgacccgaacggcgcaggcg

SEQ ID NO: 587450 - DNA, 25 bp, Rattus norvegicus
cgcaggcgcagactgtagattccgc

SEQ ID NO: 587451 - DNA, 25 bp, Rattus norvegicus
ggaacggcgaccacgacgtgtcctc

SEQ ID NO: 587452 - DNA, 25 bp, Rattus norvegicus
cggcccttgcgtgtttgacgtcatt

SEQ ID NO: 587453 - DNA, 25 bp, Rattus norvegicus
taagtcacgtaaacagcgcgcggac

SEQ ID NO: 587454 - DNA, 25 bp, Rattus norvegicus
gccctgaagcccgaggccgggcaaa

SEQ ID NO: 587455 - DNA, 25 bp, Rattus norvegicus
ccgggcaaaaagagaaccaacactg

SEQ ID NO: 587456 - DNA, 25 bp, Rattus norvegicus
aacactgagaattggggcgaccttc

SEQ ID NO: 587457 - DNA, 25 bp, Rattus norvegicus
aattggggcgaccttcgctcttccg

SEQ ID NO: 587458 - DNA, 25 bp, Rattus norvegicus
tagcccacctctgcgctgagctggt

SEQ ID NO: 587459 - DNA, 25 bp, Rattus norvegicus
ggtcaccagaggctgcaagcgcacg

SEQ ID NO: 587460 - DNA, 25 bp, Rattus norvegicus
aaacagcgcgcggacagggatgcca

SEQ ID NO: 587461 - DNA, 25 bp, Rattus norvegicus
tgcattagccctgaagcccgaggcc

SEQ ID NO: 587462 - DNA, 25 bp, Rattus norvegicus
cgccgcgtaagaagtacattaagtc

SEQ ID NO: 587463 - DNA, 25 bp, Rattus norvegicus
acctctgcgctgagctggtggctgc

SEQ ID NO: 587464 - DNA, 25 bp, Rattus norvegicus
cgctgcgacttaccgccgcgtaaga

SEQ ID NO: 587465 - DNA, 25 bp, Rattus norvegicus
cccgggaccagtgcattagccctga

SEQ ID NO: 587466 - DNA, 25 bp, Rattus norvegicus
cagggatgccacctcagtgacctta

SEQ ID NO: 587467 - DNA, 25 bp, Rattus norvegicus
tcagctgatttactgcagcggcggc

SEQ ID NO: 587468 - DNA, 25 bp, Rattus norvegicus
cgccttctttacctcctctgcgggg

SEQ ID NO: 587469 - DNA, 25 bp, Rattus norvegicus
ggaattgcccggctggtcctcctca

SEQ ID NO: 587470 - DNA, 25 bp, Rattus norvegicus
ggctgcacctgcttggggtccctcg

SEQ ID NO: 587471 - DNA, 25 bp, Rattus norvegicus
gctgagaagctgagcggtttccacc

SEQ ID NO: 587472 - DNA, 25 bp, Rattus norvegicus
aagctgagcggtttccacctcgcct

SEQ ID NO: 587473 - DNA, 25 bp, Rattus norvegicus
gtggctccttgcaaccaggcagggt

SEQ ID NO: 587474 - DNA, 25 bp, Rattus norvegicus
cctcgcctcgcttttgcgacatttg

SEQ ID NO: 587475 - DNA, 25 bp, Rattus norvegicus
ttgcgacatttgcagcgacgtcacg

SEQ ID NO: 587476 - DNA, 25 bp, Rattus norvegicus
tttgcagcgacgtcacgacagttga

SEQ ID NO: 587477 - DNA, 25 bp, Rattus norvegicus
gtcacgacagttgaggccggtgtca

SEQ ID NO: 587478 - DNA, 25 bp, Rattus norvegicus
ccggtgtcagccgatttacggcagt

SEQ ID NO: 587479 - DNA, 25 bp, Rattus norvegicus
ccggtgtcagctgatttactgcagc

SEQ ID NO: 587480 - DNA, 25 bp, Rattus norvegicus
tttacggcagttgaggccggtgtca

SEQ ID NO: 587481 - DNA, 25 bp, Rattus norvegicus
aaagcctttgtcctaatcgatgtga

SEQ ID NO: 587482 - DNA, 25 bp, Rattus norvegicus
gcctagcccggaatgagaaattgca

SEQ ID NO: 587483 - DNA, 25 bp, Rattus norvegicus
tgcgcaggtttattctcttgaagcc

SEQ ID NO: 587484 - DNA, 25 bp, Rattus norvegicus
aatggcccgagtcgccagtatacta

SEQ ID NO: 587485 - DNA, 25 bp, Rattus norvegicus
ctcctcggtaactgcgtggtccttt

SEQ ID NO: 587486 - DNA, 25 bp, Rattus norvegicus
tggccgctcaatggaccgatttccc

SEQ ID NO: 587487 - DNA, 25 bp, Rattus norvegicus
agtatactagggctggtcatgctca

SEQ ID NO: 587488 - DNA, 25 bp, Rattus norvegicus
agaagagtgtttgggctcctcggta

SEQ ID NO: 587489 - DNA, 25 bp, Rattus norvegicus
gtggccctgctgattttatcgctta

SEQ ID NO: 587490 - DNA, 25 bp, Rattus norvegicus
atcgcttatcagctacgtgtccctg

SEQ ID NO: 587491 - DNA, 25 bp, Rattus norvegicus
gtccctgaaaaaggagaacatcttc

SEQ ID NO: 587492 - DNA, 25 bp, Rattus norvegicus
tgtacatgttccacgcgggattccg

SEQ ID NO: 587493 - DNA, 25 bp, Rattus norvegicus
cctgcgggaaacaagccttctgctg

SEQ ID NO: 587494 - DNA, 25 bp, Rattus norvegicus
cctctgcgactcaattgcctgggtc

SEQ ID NO: 587495 - DNA, 25 bp, Rattus norvegicus
aaacgctatgtccttggggccaaca

SEQ ID NO: 587496 - DNA, 25 bp, Rattus norvegicus
tgaaggtcttcggagctcagtttcc

SEQ ID NO: 587497 - DNA, 25 bp, Rattus norvegicus
cgggcgttccgcgaagcaaacgcta

SEQ ID NO: 587498 - DNA, 25 bp, Rattus norvegicus
cctccaattcgcagggtggccgatt

SEQ ID NO: 587499 - DNA, 25 bp, Rattus norvegicus
gttcccaggacaagtccggctacta

SEQ ID NO: 587500 - DNA, 25 bp, Rattus norvegicus
ttgcaagcaaaacgattcagaattc

SEQ ID NO: 587501 - DNA, 25 bp, Rattus norvegicus
cgcggccgccagtgttgatttcaaa

SEQ ID NO: 587502 - DNA, 25 bp, Rattus norvegicus
gtccggctactaggttgaccacagc

SEQ ID NO: 587503 - DNA, 25 bp, Rattus norvegicus
ctcagcccgggatctgaaggtcttc

SEQ ID NO: 587504 - DNA, 25 bp, Rattus norvegicus
gagctcagtttccttctccgcagtc

SEQ ID NO: 587505 - DNA, 25 bp, Rattus norvegicus
tctccgcagtcctaccaattaagtc

SEQ ID NO: 587506 - DNA, 25 bp, Rattus norvegicus
taccaattaagtccggccggagagc

SEQ ID NO: 587507 - DNA, 25 bp, Rattus norvegicus
ccggagagctctctggttcccagga

SEQ ID NO: 587508 - DNA, 25 bp, Rattus norvegicus
taaggtgacatcgagacagttttgc

SEQ ID NO: 587509 - DNA, 25 bp, Rattus norvegicus
ccgtgcattagaacacattagcgcc

SEQ ID NO: 587510 - DNA, 25 bp, Rattus norvegicus
cggaaaattaccgtgcattagaaca

SEQ ID NO: 587511 - DNA, 25 bp, Rattus norvegicus
tgcacataccaatctcggaaaatta

SEQ ID NO: 587512 - DNA, 25 bp, Rattus norvegicus
ctctcccatagattatgcacatacc

SEQ ID NO: 587513 - DNA, 25 bp, Rattus norvegicus
ggcgttcgagttattctctcccata

SEQ ID NO: 587514 - DNA, 25 bp, Rattus norvegicus
cagtccaggcgttcgagttattctc

SEQ ID NO: 587515 - DNA, 25 bp, Rattus norvegicus
cagctctcaaacagtccaggcgttc

SEQ ID NO: 587516 - DNA, 25 bp, Rattus norvegicus
gtcagtgtaaaccttccgccgccgc

SEQ ID NO: 587517 - DNA, 25 bp, Rattus norvegicus
cgcctgcattttaaaagctagcctg

SEQ ID NO: 587518 - DNA, 25 bp, Rattus norvegicus
gcattttaaaagctagcctgctagc

SEQ ID NO: 587519 - DNA, 25 bp, Rattus norvegicus
tagcctgctagctccctgcgagcga

SEQ ID NO: 587520 - DNA, 25 bp, Rattus norvegicus
tccctgcgagcgactctcgggaagt

SEQ ID NO: 587521 - DNA, 25 bp, Rattus norvegicus
actctcgggaagtggctagctagga

SEQ ID NO: 587522 - DNA, 25 bp, Rattus norvegicus
ttagaacacattagcgcctgcattt

SEQ ID NO: 587523 - DNA, 25 bp, Rattus norvegicus
cacagagggttctatgccggtctca

SEQ ID NO: 587524 - DNA, 25 bp, Rattus norvegicus
gcggccatgatgtctcacctcaatg

SEQ ID NO: 587525 - DNA, 25 bp, Rattus norvegicus
tgagcaacacctgtcccgaggcctg

SEQ ID NO: 587526 - DNA, 25 bp, Rattus norvegicus
tccgccgggccatgacaaaatgctc

SEQ ID NO: 587527 - DNA, 25 bp, Rattus norvegicus
gcagagcctgcccaactatggtccg

SEQ ID NO: 587528 - DNA, 25 bp, Rattus norvegicus
ggtggccttcacaatgctcagcaga

SEQ ID NO: 587529 - DNA, 25 bp, Rattus norvegicus
cagagcctgtctccgttggctgcca

SEQ ID NO: 587530 - DNA, 25 bp, Rattus norvegicus
tgcctagtatgagccagagcctgtc

SEQ ID NO: 587531 - DNA, 25 bp, Rattus norvegicus
agcccttacaaggagatgcctagta

SEQ ID NO: 587532 - DNA, 25 bp, Rattus norvegicus
tggcagcttcactctcatgcgggac

SEQ ID NO: 587533 - DNA, 25 bp, Rattus norvegicus
catcagcgtctgtccggcaacgtca

SEQ ID NO: 587534 - DNA, 25 bp, Rattus norvegicus
cgccaggcatgggtatgagcaacac

SEQ ID NO: 587535 - DNA, 25 bp, Rattus norvegicus
tacaccacgccatgagtatgtcctg

SEQ ID NO: 587536 - DNA, 25 bp, Rattus norvegicus
catggtcaccagtatggcctcgatc

SEQ ID NO: 587537 - DNA, 25 bp, Rattus norvegicus
aactaagaggcctcggctaccgccg

SEQ ID NO: 587538 - DNA, 25 bp, Rattus norvegicus
ggaccctcagccgtcgagattcctg

SEQ ID NO: 587539 - DNA, 25 bp, Rattus norvegicus
tatgaggaaagaaggcggccgtcac

SEQ ID NO: 587540 - DNA, 25 bp, Rattus norvegicus
ttgctgattgggtatgaggaaagaa

SEQ ID NO: 587541 - DNA, 25 bp, Rattus norvegicus
ccgcagaactaagaggcctcggcta

SEQ ID NO: 587542 - DNA, 25 bp, Rattus norvegicus
ccctcgttcctgagtggctacaaca

SEQ ID NO: 587543 - DNA, 25 bp, Rattus norvegicus
tggctacaacaaacgtcaactcccg

SEQ ID NO: 587544 - DNA, 25 bp, Rattus norvegicus
tcccgtccctttgcgcaagatctga

SEQ ID NO: 587545 - DNA, 25 bp, Rattus norvegicus
cgcaagatctgagaatctattggta

SEQ ID NO: 587546 - DNA, 25 bp, Rattus norvegicus
ctattggtagatacggccatcgctc

SEQ ID NO: 587547 - DNA, 25 bp, Rattus norvegicus
tacggccatcgctcaaagctctttc

SEQ ID NO: 587548 - DNA, 25 bp, Rattus norvegicus
ccctagggctattcttcgtggagcg

SEQ ID NO: 587549 - DNA, 25 bp, Rattus norvegicus
ttcgtggagcgtgatgattggacaa

SEQ ID NO: 587550 - DNA, 25 bp, Rattus norvegicus
cgaccgtcacgtgccgcagaactaa

SEQ ID NO: 587551 - DNA, 25 bp, Rattus norvegicus
ggttacattgttccggagcgggcac

SEQ ID NO: 587552 - DNA, 25 bp, Rattus norvegicus
ctgaaacctccggtatgggcggtga

SEQ ID NO: 587553 - DNA, 25 bp, Rattus norvegicus
tgcggctgacacagtttcgagcttt

SEQ ID NO: 587554 - DNA, 25 bp, Rattus norvegicus
cggtgagtgcaaaagcgaaagacgc

SEQ ID NO: 587555 - DNA, 25 bp, Rattus norvegicus
gtcaacgcgcgggttacattgttcc

SEQ ID NO: 587556 - DNA, 25 bp, Rattus norvegicus
taggaacactgaaacctccggtatg

SEQ ID NO: 587557 - DNA, 25 bp, Rattus norvegicus
gagcgggcacggctctctgtgcctc

SEQ ID NO: 587558 - DNA, 25 bp, Rattus norvegicus
ccgagaggcgaggtacagccctcta

SEQ ID NO: 587559 - DNA, 25 bp, Rattus norvegicus
ggtacagccctctattgttctagga

SEQ ID NO: 587560 - DNA, 25 bp, Rattus norvegicus
gccctctattgttctaggaacactg

SEQ ID NO: 587561 - DNA, 25 bp, Rattus norvegicus
tcccagagtgctacgactgctctgc

SEQ ID NO: 587562 - DNA, 25 bp, Rattus norvegicus
cgactcccagagtgctacgactgct

SEQ ID NO: 587563 - DNA, 25 bp, Rattus norvegicus
gcagacagacccgactcccagagtg

SEQ ID NO: 587564 - DNA, 25 bp, Rattus norvegicus
ttcgagcttttgtgcagacagaccc

SEQ ID NO: 587565 - DNA, 25 bp, Rattus norvegicus
accggtgttcttgccgtgtcaagtc

SEQ ID NO: 587566 - DNA, 25 bp, Rattus norvegicus
tgctttttagatgacgcgggagaca

SEQ ID NO: 587567 - DNA, 25 bp, Rattus norvegicus
cacaccggtgcagaacagactgatc

SEQ ID NO: 587568 - DNA, 25 bp, Rattus norvegicus
actgatctgttagcttgctggctga

SEQ ID NO: 587569 - DNA, 25 bp, Rattus norvegicus
tgcattcatacgtgcgcatctcctg

SEQ ID NO: 587570 - DNA, 25 bp, Rattus norvegicus
acgccttccgaacagagattgagac

SEQ ID NO: 587571 - DNA, 25 bp, Rattus norvegicus
gcggcgcatttatttttattccaag

SEQ ID NO: 587572 - DNA, 25 bp, Rattus norvegicus
tgctggcaacaataacgtaaacgtg

SEQ ID NO: 587573 - DNA, 25 bp, Rattus norvegicus
cgtgtggacccagatttcattgatc

SEQ ID NO: 587574 - DNA, 25 bp, Rattus norvegicus
atctggaacctgatccggcgcgttt

SEQ ID NO: 587575 - DNA, 25 bp, Rattus norvegicus
cctcagcggatgtggtcagatcatt

SEQ ID NO: 587576 - DNA, 25 bp, Rattus norvegicus
ccgcgccgtacaggtgctttttaga

SEQ ID NO: 587577 - DNA, 25 bp, Rattus norvegicus
agccgttggagccagctacattttc

SEQ ID NO: 587578 - DNA, 25 bp, Rattus norvegicus
gatccgagtcaggaggccaaaccca

SEQ ID NO: 587579 - DNA, 25 bp, Rattus norvegicus
ggagccaactgaaggtccgccctcg

SEQ ID NO: 587580 - DNA, 25 bp, Rattus norvegicus
ggaacgccgacctggcagcgctcta

SEQ ID NO: 587581 - DNA, 25 bp, Rattus norvegicus
cctaatcagtgtggctagcacagtc

SEQ ID NO: 587582 - DNA, 25 bp, Rattus norvegicus
gcggcctccctgacgctcctcacgt

SEQ ID NO: 587583 - DNA, 25 bp, Rattus norvegicus
cccagcgcctaatcagtgtggctag

SEQ ID NO: 587584 - DNA, 25 bp, Rattus norvegicus
agggatcctctaccgcggcgctcag

SEQ ID NO: 587585 - DNA, 25 bp, Rattus norvegicus
gggacagccagggatcctctaccgc

SEQ ID NO: 587586 - DNA, 25 bp, Rattus norvegicus
gccgaaagcatttccgggacagcca

SEQ ID NO: 587587 - DNA, 25 bp, Rattus norvegicus
ttggcgccggccgaaagcatttccg

SEQ ID NO: 587588 - DNA, 25 bp, Rattus norvegicus
tcgcggaacagagcgcccgcagccc

SEQ ID NO: 587589 - DNA, 25 bp, Rattus norvegicus
caacttacgcggctcgcggaacaga

SEQ ID NO: 587590 - DNA, 25 bp, Rattus norvegicus
gaacacagacgcaacccaacttacg

SEQ ID NO: 587591 - DNA, 25 bp, Rattus norvegicus
gacgctcctcacgttcccgaacaca

SEQ ID NO: 587592 - DNA, 25 bp, Rattus norvegicus
agtgtggctagcacagtcctcggca

SEQ ID NO: 587593 - DNA, 25 bp, Rattus norvegicus
gctgcgctagcgctgcatggcacac

SEQ ID NO: 587594 - DNA, 25 bp, Rattus norvegicus
ggggacctgaactgcttcggtaaga

SEQ ID NO: 587595 - DNA, 25 bp, Rattus norvegicus
tgtcctttgccaaccgtggaccatg

SEQ ID NO: 587596 - DNA, 25 bp, Rattus norvegicus
ctcgtccaagttcgggagtcccagg

SEQ ID NO: 587597 - DNA, 25 bp, Rattus norvegicus
caccgcaccgcagatgcgtagaatc

SEQ ID NO: 587598 - DNA, 25 bp, Rattus norvegicus
gatgcgtagaatccactagcccgtg

SEQ ID NO: 587599 - DNA, 25 bp, Rattus norvegicus
cctggctggttaggtcctagaggtc

SEQ ID NO: 587600 - DNA, 25 bp, Rattus norvegicus
ccgaccggacaaactggtttctctg

SEQ ID NO: 587601 - DNA, 25 bp, Rattus norvegicus
ttgtacgtagccctgctccagtgcg

SEQ ID NO: 587602 - DNA, 25 bp, Rattus norvegicus
gtgaccgatctttgtctcctctgtg

SEQ ID NO: 587603 - DNA, 25 bp, Rattus norvegicus
ctgtgaccctgccttttcggccgta

SEQ ID NO: 587604 - DNA, 25 bp, Rattus norvegicus
tttcccgcccactgttgtcggcttg

SEQ ID NO: 587605 - DNA, 25 bp, Rattus norvegicus
gaagcctgtccagttggccgcgact

SEQ ID NO: 587606 - DNA, 25 bp, Rattus norvegicus
cccgtggatcactcaaggcagccaa

SEQ ID NO: 587607 - DNA, 25 bp, Rattus norvegicus
ctaaggagcctagtggtgtcttccc

SEQ ID NO: 587608 - DNA, 25 bp, Rattus norvegicus
gggagcctatctacggactttcgga

SEQ ID NO: 587609 - DNA, 25 bp, Rattus norvegicus
ctttcggaagaggaggtgagttcct

SEQ ID NO: 587610 - DNA, 25 bp, Rattus norvegicus
gactacgggtgatcccgagcggtcc

SEQ ID NO: 587611 - DNA, 25 bp, Rattus norvegicus
gggtggcttggtcctccctcttcac

SEQ ID NO: 587612 - DNA, 25 bp, Rattus norvegicus
gggtccctttcctctgcaagctgtc

SEQ ID NO: 587613 - DNA, 25 bp, Rattus norvegicus
tgggcaacttttctggactacgctc

SEQ ID NO: 587614 - DNA, 25 bp, Rattus norvegicus
tggactacgctcctgcaacccggag

SEQ ID NO: 587615 - DNA, 25 bp, Rattus norvegicus
acccggagtccgtgacgtgtgtcac

SEQ ID NO: 587616 - DNA, 25 bp, Rattus norvegicus
ttcagcccgtcgcagcgtctaggac

SEQ ID NO: 587617 - DNA, 25 bp, Rattus norvegicus
atcccggcaagagtgagggacaccg

SEQ ID NO: 587618 - DNA, 25 bp, Rattus norvegicus
cagatgtgtgcagatcccggcaaga

SEQ ID NO: 587619 - DNA, 25 bp, Rattus norvegicus
ctaatgggcgctccgtagcagatgt

SEQ ID NO: 587620 - DNA, 25 bp, Rattus norvegicus
ccgggacttttcttgctaatgggcg

SEQ ID NO: 587621 - DNA, 25 bp, Rattus norvegicus
agtccaatcaggagcgcaggctgca

SEQ ID NO: 587622 - DNA, 25 bp, Rattus norvegicus
tcacacacgtcgttcgcccgaggtt

SEQ ID NO: 587623 - DNA, 25 bp, Rattus norvegicus
gcggccgttcttcacacacgtcgtt

SEQ ID NO: 587624 - DNA, 25 bp, Rattus norvegicus
ttccggcagagcagtaagaggcgcc

SEQ ID NO: 587625 - DNA, 25 bp, Rattus norvegicus
ctcggtgagtccaatcaggagcgca

SEQ ID NO: 587626 - DNA, 25 bp, Rattus norvegicus
accagcagcgactagcagaccctgg

SEQ ID NO: 587627 - DNA, 25 bp, Rattus norvegicus
caggctgcagttttccggcagagca

SEQ ID NO: 587628 - DNA, 25 bp, Rattus norvegicus
gcagttttccggcagagcagtaaga

SEQ ID NO: 587629 - DNA, 25 bp, Rattus norvegicus
cctccgactctctccgcgtcccgga

SEQ ID NO: 587630 - DNA, 25 bp, Rattus norvegicus
tagcagaccctggactctcggtctc

SEQ ID NO: 587631 - DNA, 25 bp, Rattus norvegicus
agcgactagcagaccctggactctc

SEQ ID NO: 587632 - DNA, 25 bp, Rattus norvegicus
gcagagcagtaagaggcgcctcctc

SEQ ID NO: 587633 - DNA, 25 bp, Rattus norvegicus
ctctctcccttttattcaccagcag

SEQ ID NO: 587634 - DNA, 25 bp, Rattus norvegicus
gtttgtttagggctcggtgagtcca

SEQ ID NO: 587635 - DNA, 25 bp, Rattus norvegicus
tctccggtggacactcctggaagct

SEQ ID NO: 587636 - DNA, 25 bp, Rattus norvegicus
ctcaagtgctgatgtgcgccaggta

SEQ ID NO: 587637 - DNA, 25 bp, Rattus norvegicus
gtcccttcagcatgttccagacgct

SEQ ID NO: 587638 - DNA, 25 bp, Rattus norvegicus
gaggactttttcatggcattccaga

SEQ ID NO: 587639 - DNA, 25 bp, Rattus norvegicus
tctctgctcagatcggctcatcgga

SEQ ID NO: 587640 - DNA, 25 bp, Rattus norvegicus
aaaggccgcagacggtgccacagac

SEQ ID NO: 587641 - DNA, 25 bp, Rattus norvegicus
tgaagatctccctgcagcgaaaggc

SEQ ID NO: 587642 - DNA, 25 bp, Rattus norvegicus
ctcgtagctcctccatgaagatctc

SEQ ID NO: 587643 - DNA, 25 bp, Rattus norvegicus
gcattccagacgctgccacggagaa

SEQ ID NO: 587644 - DNA, 25 bp, Rattus norvegicus
cggtttcattttggctctggccgca

SEQ ID NO: 587645 - DNA, 25 bp, Rattus norvegicus
tggcccatcggcttcggtttcattt

SEQ ID NO: 587646 - DNA, 25 bp, Rattus norvegicus
ggaccctggtcaatggcacttgtga

SEQ ID NO: 587647 - DNA, 25 bp, Rattus norvegicus
gcgcatccaacacagagcctcaagt

SEQ ID NO: 587648 - DNA, 25 bp, Rattus norvegicus
caagcgcagctcatccatgttcatc

SEQ ID NO: 587649 - DNA, 25 bp, Rattus norvegicus
ctagtgacgactgcagaacgggaga

SEQ ID NO: 587650 - DNA, 25 bp, Rattus norvegicus
gagtgcttagacaggctggcgctca

SEQ ID NO: 587651 - DNA, 25 bp, Rattus norvegicus
cctgacgcccggctgtggtcttgtg

SEQ ID NO: 587652 - DNA, 25 bp, Rattus norvegicus
tagacgtggagctagtgacgactgc

SEQ ID NO: 587653 - DNA, 25 bp, Rattus norvegicus
aggcgaagccaaaacaatagtcatc

SEQ ID NO: 587654 - DNA, 25 bp, Rattus norvegicus
caatagtcatctagacgtggagcta

SEQ ID NO: 587655 - DNA, 25 bp, Rattus norvegicus
tggtggaggcgaagccaaaacaata

SEQ ID NO: 587656 - DNA, 25 bp, Rattus norvegicus
ccaccgtctgttttatgccttcata

SEQ ID NO: 587657 - DNA, 25 bp, Rattus norvegicus
cgtctgaaacgttccaccgtctgtt

SEQ ID NO: 587658 - DNA, 25 bp, Rattus norvegicus
tgtgttccgtctgaaacgttccacc

SEQ ID NO: 587659 - DNA, 25 bp, Rattus norvegicus
cttggcgagcagattacacccgggg

SEQ ID NO: 587660 - DNA, 25 bp, Rattus norvegicus
ctgtggtcttgtgttccgtctgaaa

SEQ ID NO: 587661 - DNA, 25 bp, Rattus norvegicus
gaggcttggcgagcagattacaccc

SEQ ID NO: 587662 - DNA, 25 bp, Rattus norvegicus
ccttcatagaagtggtggaggcgaa

SEQ ID NO: 587663 - DNA, 25 bp, Rattus norvegicus
tcacgaaggccacgcagtctctcga

SEQ ID NO: 587664 - DNA, 25 bp, Rattus norvegicus
cagccgtcgccatgttgatgcccaa

SEQ ID NO: 587665 - DNA, 25 bp, Rattus norvegicus
catccagagacgggcaggcctcggc

SEQ ID NO: 587666 - DNA, 25 bp, Rattus norvegicus
gccatccagagacgggcaggcctcg

SEQ ID NO: 587667 - DNA, 25 bp, Rattus norvegicus
agccatccagagacgggcaggcctc

SEQ ID NO: 587668 - DNA, 25 bp, Rattus norvegicus
cgcagccatccagagacgggcaggc

SEQ ID NO: 587669 - DNA, 25 bp, Rattus norvegicus
gcagccgtcgccatgttgatgccca

SEQ ID NO: 587670 - DNA, 25 bp, Rattus norvegicus
gccgcagccatccagagacgggcag

SEQ ID NO: 587671 - DNA, 25 bp, Rattus norvegicus
tgcgccgcagccatccagagacggg

SEQ ID NO: 587672 - DNA, 25 bp, Rattus norvegicus
ttgcgccgcagccatccagagacgg

SEQ ID NO: 587673 - DNA, 25 bp, Rattus norvegicus
cgaaggccacgcagtctctcgagtc

SEQ ID NO: 587674 - DNA, 25 bp, Rattus norvegicus
acgaaggccacgcagtctctcgagt

SEQ ID NO: 587675 - DNA, 25 bp, Rattus norvegicus
agccgtcgccatgttgatgcccaag

SEQ ID NO: 587676 - DNA, 25 bp, Rattus norvegicus
gtcacgaaggccacgcagtctctcg

SEQ ID NO: 587677 - DNA, 25 bp, Rattus norvegicus
ctcggcccaaaggtccagagggtga

SEQ ID NO: 587678 - DNA, 25 bp, Rattus norvegicus
ggtacctcacgaatgagggcatcca

SEQ ID NO: 587679 - DNA, 25 bp, Rattus norvegicus
tacctccggagatcgtgcccgccac

SEQ ID NO: 587680 - DNA, 25 bp, Rattus norvegicus
gccatctatgaactcctttttaagg

SEQ ID NO: 587681 - DNA, 25 bp, Rattus norvegicus
gattacctgcacctacctccggaga

SEQ ID NO: 587682 - DNA, 25 bp, Rattus norvegicus
ttctactggtacctcacgaatgagg

SEQ ID NO: 587683 - DNA, 25 bp, Rattus norvegicus
agacatttctactggtacctcacga

SEQ ID NO: 587684 - DNA, 25 bp, Rattus norvegicus
cttggagacatttctactggtacct

SEQ ID NO: 587685 - DNA, 25 bp, Rattus norvegicus
ggagcagtttgcttggagacatttc

SEQ ID NO: 587686 - DNA, 25 bp, Rattus norvegicus
aaacaccccgagctggcagacaaga

SEQ ID NO: 587687 - DNA, 25 bp, Rattus norvegicus
aaaaagacgtccacatgcccaaaca

SEQ ID NO: 587688 - DNA, 25 bp, Rattus norvegicus
ggttgccaaaaaagacgtccacatg

SEQ ID NO: 587689 - DNA, 25 bp, Rattus norvegicus
ggtgatggttgccaaaaaagacgtc

SEQ ID NO: 587690 - DNA, 25 bp, Rattus norvegicus
caggcctcggcccaaaggtccagag

SEQ ID NO: 587691 - DNA, 25 bp, Rattus norvegicus
cgagaagctcctacgccgcaggctt

SEQ ID NO: 587692 - DNA, 25 bp, Rattus norvegicus
actcccaggactgcgagaggcaagc

SEQ ID NO: 587693 - DNA, 25 bp, Rattus norvegicus
tgcttcttcctgtgagggcctcgct

SEQ ID NO: 587694 - DNA, 25 bp, Rattus norvegicus
tgggcttctcaagggaacctgtctc

SEQ ID NO: 587695 - DNA, 25 bp, Rattus norvegicus
cctccttgccactggagaagagcca

SEQ ID NO: 587696 - DNA, 25 bp, Rattus norvegicus
ctgcttgctctaatgaacgggccca

SEQ ID NO: 587697 - DNA, 25 bp, Rattus norvegicus
tcactacaggtgaaactgcttgctc

SEQ ID NO: 587698 - DNA, 25 bp, Rattus norvegicus
cttcctagctgtggtagtccctcca

SEQ ID NO: 587699 - DNA, 25 bp, Rattus norvegicus
ggccaccggcgtaaccatgtcgctg

SEQ ID NO: 587700 - DNA, 25 bp, Rattus norvegicus
gcccacagtccaaagttaagccctg

SEQ ID NO: 587701 - DNA, 25 bp, Rattus norvegicus
tgtgcggtaagcatcctcccacggt

SEQ ID NO: 587702 - DNA, 25 bp, Rattus norvegicus
tgctccgtggtaaggagtcacgcga

SEQ ID NO: 587703 - DNA, 25 bp, Rattus norvegicus
agtcacgcgaaacctacgtgggctc

SEQ ID NO: 587704 - DNA, 25 bp, Rattus norvegicus
tgaccgcgtcttcgggaccttcgac

SEQ ID NO: 587705 - DNA, 25 bp, Rattus norvegicus
ctcatggacatgctgaccgagacta

SEQ ID NO: 587706 - DNA, 25 bp, Rattus norvegicus
agctgtacctaaagcagggctgcgc

SEQ ID NO: 587707 - DNA, 25 bp, Rattus norvegicus
gtcgcggtgatgcaataaagctgta

SEQ ID NO: 587708 - DNA, 25 bp, Rattus norvegicus
cgtacttatagtccagccgcgcgct

SEQ ID NO: 587709 - DNA, 25 bp, Rattus norvegicus
agaaagattcacaagcacgagggcg

SEQ ID NO: 587710 - DNA, 25 bp, Rattus norvegicus
gtgacacagataagtggagacccga

SEQ ID NO: 587711 - DNA, 25 bp, Rattus norvegicus
gcgcgcatgcaactgctggagaaga

SEQ ID NO: 587712 - DNA, 25 bp, Rattus norvegicus
gctgctggaagagaacaactacctg

SEQ ID NO: 587713 - DNA, 25 bp, Rattus norvegicus
agccgatcaagagccaggtgctgct

SEQ ID NO: 587714 - DNA, 25 bp, Rattus norvegicus
ctggaagccacaagggcagccgatc

SEQ ID NO: 587715 - DNA, 25 bp, Rattus norvegicus
gcactagactgagcgacgaggcctt

SEQ ID NO: 587716 - DNA, 25 bp, Rattus norvegicus
tgaggcaattctgggccgaccactt

SEQ ID NO: 587717 - DNA, 25 bp, Rattus norvegicus
ctgcagcaagaactgctcatggaca

SEQ ID NO: 587718 - DNA, 25 bp, Rattus norvegicus
gcgcgctcctggaagagaaagattc

SEQ ID NO: 587719 - DNA, 25 bp, Rattus norvegicus
cgctcgcactgcagcgggcgcagca

SEQ ID NO: 587720 - DNA, 25 bp, Rattus norvegicus
gcggagcagaggtcgcccgagccac

SEQ ID NO: 587721 - DNA, 25 bp, Rattus norvegicus
cacggcccggacacccgggcttgag

SEQ ID NO: 587722 - DNA, 25 bp, Rattus norvegicus
cgggcttgagcgctacggaggcccg

SEQ ID NO: 587723 - DNA, 25 bp, Rattus norvegicus
cgtagcatggaagcggccgccgctc

SEQ ID NO: 587724 - DNA, 25 bp, Rattus norvegicus
ccaccaccagcaccttcgggccggg

SEQ ID NO: 587725 - DNA, 25 bp, Rattus norvegicus
acagccggccttcgcgcccagccag

SEQ ID NO: 587726 - DNA, 25 bp, Rattus norvegicus
cctgagcccgcagccttccacccgg

SEQ ID NO: 587727 - DNA, 25 bp, Rattus norvegicus
gccgcgctcccttttgttcgctcgc

SEQ ID NO: 587728 - DNA, 25 bp, Rattus norvegicus
ccgggctccgctctcgcacacagac

SEQ ID NO: 587729 - DNA, 25 bp, Rattus norvegicus
cgcgacacgcccgtagcatggaagc

SEQ ID NO: 587730 - DNA, 25 bp, Rattus norvegicus
cagggctggtgttgctaggccccac

SEQ ID NO: 587731 - DNA, 25 bp, Rattus norvegicus
acacgcccgtagcatggaagcggcc

SEQ ID NO: 587732 - DNA, 25 bp, Rattus norvegicus
accagctccagagggggccacgtga

SEQ ID NO: 587733 - DNA, 25 bp, Rattus norvegicus
ggctttcggtcagtatgtcgttcgc

SEQ ID NO: 587734 - DNA, 25 bp, Rattus norvegicus
ccatctgcaggtcggtgcacttcca

SEQ ID NO: 587735 - DNA, 25 bp, Rattus norvegicus
cgaatcccttaatgccgtgttggcc

SEQ ID NO: 587736 - DNA, 25 bp, Rattus norvegicus
caggtcggtgcacttccagagccac

SEQ ID NO: 587737 - DNA, 25 bp, Rattus norvegicus
gagccacgtcaccaagaactgcctg

SEQ ID NO: 587738 - DNA, 25 bp, Rattus norvegicus
gaactgcctgcactacacacggaga

SEQ ID NO: 587739 - DNA, 25 bp, Rattus norvegicus
cactacacacggagagttggctttc

SEQ ID NO: 587740 - DNA, 25 bp, Rattus norvegicus
aaccgcgctgcggtttgacgggcct

SEQ ID NO: 587741 - DNA, 25 bp, Rattus norvegicus
tgcacacgtgtccttctcagggtta

SEQ ID NO: 587742 - DNA, 25 bp, Rattus norvegicus
tctcagggttacctggtggtcctcc

SEQ ID NO: 587743 - DNA, 25 bp, Rattus norvegicus
ctccgggaacctagcccatcggtag

SEQ ID NO: 587744 - DNA, 25 bp, Rattus norvegicus
agcccatcggtagtcgagttgatcc

SEQ ID NO: 587745 - DNA, 25 bp, Rattus norvegicus
gagttgatccgctcgaatcccttaa

SEQ ID NO: 587746 - DNA, 25 bp, Rattus norvegicus
tgtcgttcgctgataaccgcgctgc

SEQ ID NO: 587747 - DNA, 25 bp, Rattus norvegicus
ggaagatgaacaaacgacaggtaac

SEQ ID NO: 587748 - DNA, 25 bp, Rattus norvegicus
agactatggtcacgtgccacaagga

SEQ ID NO: 587749 - DNA, 25 bp, Rattus norvegicus
ctatggtcacgtgccacaaggatgc

SEQ ID NO: 587750 - DNA, 25 bp, Rattus norvegicus
tcacgtgccacaaggatgcgggctg

SEQ ID NO: 587751 - DNA, 25 bp, Rattus norvegicus
tgctccgcagccgagtgtgacagac

SEQ ID NO: 587752 - DNA, 25 bp, Rattus norvegicus
tccgcagccgagtgtgacagaccga

SEQ ID NO: 587753 - DNA, 25 bp, Rattus norvegicus
ccgagtgtgacagaccgagccggcc

SEQ ID NO: 587754 - DNA, 25 bp, Rattus norvegicus
cagagaccccgccatggttcgtgcg

SEQ ID NO: 587755 - DNA, 25 bp, Rattus norvegicus
gcaagactatggtcacgtgccacaa

SEQ ID NO: 587756 - DNA, 25 bp, Rattus norvegicus
acttgaggaagatgaacaaacgaca

SEQ ID NO: 587757 - DNA, 25 bp, Rattus norvegicus
caaacgacaggtaactgaggctctg

SEQ ID NO: 587758 - DNA, 25 bp, Rattus norvegicus
acgacaggtaactgaggctctggtg

SEQ ID NO: 587759 - DNA, 25 bp, Rattus norvegicus
cgcgtccagtgcaccgggacccgca

SEQ ID NO: 587760 - DNA, 25 bp, Rattus norvegicus
ctttggggacttgaggaagatgaac

SEQ ID NO: 587761 - DNA, 25 bp, Rattus norvegicus
gtcactgctctgtcgggacaacgca

SEQ ID NO: 587762 - DNA, 25 bp, Rattus norvegicus
gctcgctatagggagacgtcagtgt

SEQ ID NO: 587763 - DNA, 25 bp, Rattus norvegicus
ctatagggagacgtcagtgtgctca

SEQ ID NO: 587764 - DNA, 25 bp, Rattus norvegicus
ctcccgcgcaggcttgctttatata

SEQ ID NO: 587765 - DNA, 25 bp, Rattus norvegicus
gcgcaggcttgctttatataaagtc

SEQ ID NO: 587766 - DNA, 25 bp, Rattus norvegicus
tatataaagtccggggccgcgtgga

SEQ ID NO: 587767 - DNA, 25 bp, Rattus norvegicus
gaactgtcctcctgtcactgctctg

SEQ ID NO: 587768 - DNA, 25 bp, Rattus norvegicus
actctcagcctagtggagcgctctg

SEQ ID NO: 587769 - DNA, 25 bp, Rattus norvegicus
tagtggagcgctctgagggcttccc

SEQ ID NO: 587770 - DNA, 25 bp, Rattus norvegicus
gctctcgctcttgctgttggctctg

SEQ ID NO: 587771 - DNA, 25 bp, Rattus norvegicus
ttggctctggtcctctgccaggctc

SEQ ID NO: 587772 - DNA, 25 bp, Rattus norvegicus
cagtcctggccaagatgtatccgcg

SEQ ID NO: 587773 - DNA, 25 bp, Rattus norvegicus
agtggcagagctcctgagaactgtc

SEQ ID NO: 587774 - DNA, 25 bp, Rattus norvegicus
gtcgggacaacgcactctcagccta

SEQ ID NO: 587775 - DNA, 25 bp, Rattus norvegicus
tctttcagccaattcgtcgggagcg

SEQ ID NO: 587776 - DNA, 25 bp, Rattus norvegicus
cagagcgatgggaccgtgccctttt

SEQ ID NO: 587777 - DNA, 25 bp, Rattus norvegicus
atacagctttaaggggccgcatctg

SEQ ID NO: 587778 - DNA, 25 bp, Rattus norvegicus
cgtttcgagtacaaatacagcttta

SEQ ID NO: 587779 - DNA, 25 bp, Rattus norvegicus
cacaccgccgtttcgagtacaaata

SEQ ID NO: 587780 - DNA, 25 bp, Rattus norvegicus
ccaattcgtcgggagcgacggcatg

SEQ ID NO: 587781 - DNA, 25 bp, Rattus norvegicus
tgctgctgtctttcagccaattcgt

SEQ ID NO: 587782 - DNA, 25 bp, Rattus norvegicus
tggagcgcagtcgttcttctgcgcc

SEQ ID NO: 587783 - DNA, 25 bp, Rattus norvegicus
caggctggagcgcagtcgttcttct

SEQ ID NO: 587784 - DNA, 25 bp, Rattus norvegicus
ctctgcgtcccagaatccaagatgg

SEQ ID NO: 587785 - DNA, 25 bp, Rattus norvegicus
agtgagcgccctgttggccatccgc

SEQ ID NO: 587786 - DNA, 25 bp, Rattus norvegicus
tgggctccaccaatcagtgagcgcc

SEQ ID NO: 587787 - DNA, 25 bp, Rattus norvegicus
ggtctcctgggctccaccaatcagt

SEQ ID NO: 587788 - DNA, 25 bp, Rattus norvegicus
aggccgagttgccacaccgccgttt

SEQ ID NO: 587789 - DNA, 25 bp, Rattus norvegicus
ccacgtatcaactgcacgagctgga

SEQ ID NO: 587790 - DNA, 25 bp, Rattus norvegicus
cctagagccgtagagaggccgcttc

SEQ ID NO: 587791 - DNA, 25 bp, Rattus norvegicus
gagcacgtcgcgtttgcacagcatc

SEQ ID NO: 587792 - DNA, 25 bp, Rattus norvegicus
ttgcacagcatcgaagccatcctgg

SEQ ID NO: 587793 - DNA, 25 bp, Rattus norvegicus
cgggatcctagacacctttcctgca

SEQ ID NO: 587794 - DNA, 25 bp, Rattus norvegicus
caaggctgcaaaacccttggggcgc

SEQ ID NO: 587795 - DNA, 25 bp, Rattus norvegicus
tgccctacttgaggttagagaaatc

SEQ ID NO: 587796 - DNA, 25 bp, Rattus norvegicus
gtcactaaccgcttggggcctctct

SEQ ID NO: 587797 - DNA, 25 bp, Rattus norvegicus
cctgctatcccaaggagcaaggaga

SEQ ID NO: 587798 - DNA, 25 bp, Rattus norvegicus
acgagctggaacgtgcctttgagaa

SEQ ID NO: 587799 - DNA, 25 bp, Rattus norvegicus
cgtgcctttgagaagtcccactacc

SEQ ID NO: 587800 - DNA, 25 bp, Rattus norvegicus
ccgacgtgtacagccgcgaagagtt

SEQ ID NO: 587801 - DNA, 25 bp, Rattus norvegicus
tcgactcggcgctgagtgtcactaa

SEQ ID NO: 587802 - DNA, 25 bp, Rattus norvegicus
ttggggcctctctgtcccagctact

SEQ ID NO: 587803 - DNA, 25 bp, Rattus norvegicus
acgccggtgctccacagtttacaga

SEQ ID NO: 587804 - DNA, 25 bp, Rattus norvegicus
tggccagcgggacccttcgaaacgc

SEQ ID NO: 587805 - DNA, 25 bp, Rattus norvegicus
ggcagccagctctccggtctaaaaa

SEQ ID NO: 587806 - DNA, 25 bp, Rattus norvegicus
caggccgctgaacgggacgtaccac

SEQ ID NO: 587807 - DNA, 25 bp, Rattus norvegicus
gaggacctgttgctcttcactgacc

SEQ ID NO: 587808 - DNA, 25 bp, Rattus norvegicus
gtacagctcgctgtccgcagccagg

SEQ ID NO: 587809 - DNA, 25 bp, Rattus norvegicus
cggtctaaaaaacaccacacgcgtg

SEQ ID NO: 587810 - DNA, 25 bp, Rattus norvegicus
ggaaatgtaccagacgctcgccgct

SEQ ID NO: 587811 - DNA, 25 bp, Rattus norvegicus
gccgagcagccggaggaaatgtacc

SEQ ID NO: 587812 - DNA, 25 bp, Rattus norvegicus
ttcactgacctcgatcaggccgcga

SEQ ID NO: 587813 - DNA, 25 bp, Rattus norvegicus
ccctgtcgacttgggaggacctgtt

SEQ ID NO: 587814 - DNA, 25 bp, Rattus norvegicus
caggacgccgcagctcgacactgag

SEQ ID NO: 587815 - DNA, 25 bp, Rattus norvegicus
cgaccgccagcaagctgctgtggtc

SEQ ID NO: 587816 - DNA, 25 bp, Rattus norvegicus
ggcggcttcgtacactccgcagctg

SEQ ID NO: 587817 - DNA, 25 bp, Rattus norvegicus
gagacgccaggagaaactagaagtg

SEQ ID NO: 587818 - DNA, 25 bp, Rattus norvegicus
ccgcgctgcgcctgaaggccaaaga

SEQ ID NO: 587819 - DNA, 25 bp, Rattus norvegicus
gagttgctgcgagccctgtgtgcac

SEQ ID NO: 587820 - DNA, 25 bp, Rattus norvegicus
aagccctctagaggcgctgcggagt

SEQ ID NO: 587821 - DNA, 25 bp, Rattus norvegicus
ccggtggtcgcactttctttgctaa

SEQ ID NO: 587822 - DNA, 25 bp, Rattus norvegicus
ggaagccctggcaagccctctagag

SEQ ID NO: 587823 - DNA, 25 bp, Rattus norvegicus
tttgctaaccctgctgcaagccggc

SEQ ID NO: 587824 - DNA, 25 bp, Rattus norvegicus
aaagagcacatccaggccatcggga

SEQ ID NO: 587825 - DNA, 25 bp, Rattus norvegicus
cttcggggacaagttctcgctggaa

SEQ ID NO: 587826 - DNA, 25 bp, Rattus norvegicus
actagaagtgtcgtccatgaagctg

SEQ ID NO: 587827 - DNA, 25 bp, Rattus norvegicus
accgtcgggccaagtggagacgcca

SEQ ID NO: 587828 - DNA, 25 bp, Rattus norvegicus
tgcctgaaggcgtctgcggcttctt

SEQ ID NO: 587829 - DNA, 25 bp, Rattus norvegicus
gaggcgtacccacgcaacagcagca

SEQ ID NO: 587830 - DNA, 25 bp, Rattus norvegicus
cagcgctgcagagcctgccaggttt

SEQ ID NO: 587831 - DNA, 25 bp, Rattus norvegicus
tcccgcaagagatggaagtcacctg

SEQ ID NO: 587832 - DNA, 25 bp, Rattus norvegicus
gcgtctagacgcaaaggctgctact

SEQ ID NO: 587833 - DNA, 25 bp, Rattus norvegicus
accatcggggaagctcgccggcttc

SEQ ID NO: 587834 - DNA, 25 bp, Rattus norvegicus
tacgctctgggctctgcgtctagac

SEQ ID NO: 587835 - DNA, 25 bp, Rattus norvegicus
tgtcccagcgccaggagtagcagca

SEQ ID NO: 587836 - DNA, 25 bp, Rattus norvegicus
gttcctctcggaaggtccacgtgtg

SEQ ID NO: 587837 - DNA, 25 bp, Rattus norvegicus
ggacctgtggatccgccacctgaga

SEQ ID NO: 587838 - DNA, 25 bp, Rattus norvegicus
tcagcgaactgggacctgtggatcc

SEQ ID NO: 587839 - DNA, 25 bp, Rattus norvegicus
acaggacagagggtatccggcttcc

SEQ ID NO: 587840 - DNA, 25 bp, Rattus norvegicus
tggaagtcacctgaaacagctcacc

SEQ ID NO: 587841 - DNA, 25 bp, Rattus norvegicus
cgaaagttcacatcaagcgcggcgg

SEQ ID NO: 587842 - DNA, 25 bp, Rattus norvegicus
gggcgatcccactaccaagcgacaa

SEQ ID NO: 587843 - DNA, 25 bp, Rattus norvegicus
aaaggctgctactggtccctggtcc

SEQ ID NO: 587844 - DNA, 25 bp, Rattus norvegicus
ctccgccagtggctcagcgaactgg

SEQ ID NO: 587845 - DNA, 25 bp, Rattus norvegicus
cccagagtccagattggggatctaa

SEQ ID NO: 587846 - DNA, 25 bp, Rattus norvegicus
ggcgtctcgagaccagctttacttc

SEQ ID NO: 587847 - DNA, 25 bp, Rattus norvegicus
tatctagcagttcggcccgcggaca

SEQ ID NO: 587848 - DNA, 25 bp, Rattus norvegicus
acccaacgcgggcaggtatctagca

SEQ ID NO: 587849 - DNA, 25 bp, Rattus norvegicus
tcggaacgcgccattgaacccaacg

SEQ ID NO: 587850 - DNA, 25 bp, Rattus norvegicus
cgcgcctgtatgttcgggccaaatc

SEQ ID NO: 587851 - DNA, 25 bp, Rattus norvegicus
gcgtttctgagatgcccgggagaaa

SEQ ID NO: 587852 - DNA, 25 bp, Rattus norvegicus
ccagggttgctgctgctttaccgaa

SEQ ID NO: 587853 - DNA, 25 bp, Rattus norvegicus
gggagcccgatctgagaagattcca

SEQ ID NO: 587854 - DNA, 25 bp, Rattus norvegicus
cccataaaacccgagagccggcttg

SEQ ID NO: 587855 - DNA, 25 bp, Rattus norvegicus
atactcgggaccgttcagcccttcg

SEQ ID NO: 587856 - DNA, 25 bp, Rattus norvegicus
ggcgaggtgtcgtcatattacgtca

SEQ ID NO: 587857 - DNA, 25 bp, Rattus norvegicus
gctttaccgaagctccgtgcgcctg

SEQ ID NO: 587858 - DNA, 25 bp, Rattus norvegicus
tacgtcatattaccagggaagtccc

SEQ ID NO: 587859 - DNA, 25 bp, Rattus norvegicus
ccacggacgcctattttggtgacga

SEQ ID NO: 587860 - DNA, 25 bp, Rattus norvegicus
tgcatgcttgagtctccggggtcaa

SEQ ID NO: 587861 - DNA, 25 bp, Rattus norvegicus
tccttgtctccaccatggctgtagg

SEQ ID NO: 587862 - DNA, 25 bp, Rattus norvegicus
attgcttgtcgctgaacttaggtta

SEQ ID NO: 587863 - DNA, 25 bp, Rattus norvegicus
gtttgctaccagagccctccacgga

SEQ ID NO: 587864 - DNA, 25 bp, Rattus norvegicus
gcgcaggcgctctcctatcattttt

SEQ ID NO: 587865 - DNA, 25 bp, Rattus norvegicus
agggctttatttaggctgcgcaggc

SEQ ID NO: 587866 - DNA, 25 bp, Rattus norvegicus
ggagcccaaacgcatgcgtgtaata

SEQ ID NO: 587867 - DNA, 25 bp, Rattus norvegicus
cagacgcatgcgctttaagtaaaac

SEQ ID NO: 587868 - DNA, 25 bp, Rattus norvegicus
ccctgctgggagctgattatcgcca

SEQ ID NO: 587869 - DNA, 25 bp, Rattus norvegicus
ccctgtaaacctgaactctggatta

SEQ ID NO: 587870 - DNA, 25 bp, Rattus norvegicus
gctgcggattaagggtagaacaacc

SEQ ID NO: 587871 - DNA, 25 bp, Rattus norvegicus
ttctagggagaaagggcatggcttc

SEQ ID NO: 587872 - DNA, 25 bp, Rattus norvegicus
ccgcgccgcttctattgtgtgagat

SEQ ID NO: 587873 - DNA, 25 bp, Rattus norvegicus
ccgaaggccagtagctcaccgatta

SEQ ID NO: 587874 - DNA, 25 bp, Rattus norvegicus
tttacggtaacaggagctgatgcgc

SEQ ID NO: 587875 - DNA, 25 bp, Rattus norvegicus
acgttcggaggatgcacaatggccc

SEQ ID NO: 587876 - DNA, 25 bp, Rattus norvegicus
tcgatgggcctgtgctacagcctac

SEQ ID NO: 587877 - DNA, 25 bp, Rattus norvegicus
aggtcgccagtcgagctgcagaacc

SEQ ID NO: 587878 - DNA, 25 bp, Rattus norvegicus
atcgaccgcatgctgcgcgaacaga

SEQ ID NO: 587879 - DNA, 25 bp, Rattus norvegicus
gctcctgctcttgggtaggtctgca

SEQ ID NO: 587880 - DNA, 25 bp, Rattus norvegicus
ggcgtggacactacccacagaatga

SEQ ID NO: 587881 - DNA, 25 bp, Rattus norvegicus
tcgccagaacgctcctgggtgattt

SEQ ID NO: 587882 - DNA, 25 bp, Rattus norvegicus
ttccatgccttgtgaccgaaggcca

SEQ ID NO: 587883 - DNA, 25 bp, Rattus norvegicus
atgagcctctctgggaaatttccgc

SEQ ID NO: 587884 - DNA, 25 bp, Rattus norvegicus
gaaatttccgcccttgatccattga

SEQ ID NO: 587885 - DNA, 25 bp, Rattus norvegicus
gatccattgatttccgcagcgtgaa

SEQ ID NO: 587886 - DNA, 25 bp, Rattus norvegicus
gggtgatttcgctctcttccatgcc

SEQ ID NO: 587887 - DNA, 25 bp, Rattus norvegicus
ggaccctgcttttggttgcgcacca

SEQ ID NO: 587888 - DNA, 25 bp, Rattus norvegicus
ccagggcgaacgaactactgcgaga

SEQ ID NO: 587889 - DNA, 25 bp, Rattus norvegicus
agttgcagaaagagcgcctggctta

SEQ ID NO: 587890 - DNA, 25 bp, Rattus norvegicus
gccgggaggccaacaaaaagatcga

SEQ ID NO: 587891 - DNA, 25 bp, Rattus norvegicus
tttgggcaacagcagcaagaccgcg

SEQ ID NO: 587892 - DNA, 25 bp, Rattus norvegicus
cttcctacttgcctgatcggagtgc

SEQ ID NO: 587893 - DNA, 25 bp, Rattus norvegicus
cctgcctttaaggagcgtttccctg

SEQ ID NO: 587894 - DNA, 25 bp, Rattus norvegicus
ctgtgcttagccactacgaggggca

SEQ ID NO: 587895 - DNA, 25 bp, Rattus norvegicus
ggtacgaactctggcccttggtgct

SEQ ID NO: 587896 - DNA, 25 bp, Rattus norvegicus
tcgccttgttgggactctttggtac

SEQ ID NO: 587897 - DNA, 25 bp, Rattus norvegicus
caaagcaacgagtcggcccacagtc

SEQ ID NO: 587898 - DNA, 25 bp, Rattus norvegicus
ggcgcgcacatcagacagcaaagca

SEQ ID NO: 587899 - DNA, 25 bp, Rattus norvegicus
actcatcaggttagggaaacgctcc

SEQ ID NO: 587900 - DNA, 25 bp, Rattus norvegicus
gacctggccgtctctttcagtatca

SEQ ID NO: 587901 - DNA, 25 bp, Rattus norvegicus
tgggcaaagtgaccaagtccatggc

SEQ ID NO: 587902 - DNA, 25 bp, Rattus norvegicus
ccgcagcgcagagtttgacgtcact

SEQ ID NO: 587903 - DNA, 25 bp, Rattus norvegicus
cctggacgtccagactcagcaaatg

SEQ ID NO: 587904 - DNA, 25 bp, Rattus norvegicus
gcccgccttcgggatcaagtctgac

SEQ ID NO: 587905 - DNA, 25 bp, Rattus norvegicus
atgaactgtcccagagattggcccg

SEQ ID NO: 587906 - DNA, 25 bp, Rattus norvegicus
aacgagcgtagcttcggctgagcaa

SEQ ID NO: 587907 - DNA, 25 bp, Rattus norvegicus
cgggcctcgatctcaacatggagct

SEQ ID NO: 587908 - DNA, 25 bp, Rattus norvegicus
gatgagcagcacgacgacgttgacc

SEQ ID NO: 587909 - DNA, 25 bp, Rattus norvegicus
tcgatggacgcgacgttgaaaacta

SEQ ID NO: 587910 - DNA, 25 bp, Rattus norvegicus
gccgaaaatgccatccgccagaaga

SEQ ID NO: 587911 - DNA, 25 bp, Rattus norvegicus
ttcgcggccaaagaactgaacagga

SEQ ID NO: 587912 - DNA, 25 bp, Rattus norvegicus
cccgcgaccttgtccaacatggaga

SEQ ID NO: 587913 - DNA, 25 bp, Rattus norvegicus
gtctgcgccgcatagcgtagataca

SEQ ID NO: 587914 - DNA, 25 bp, Rattus norvegicus
tgaccgccgaacgagtccgagattt

SEQ ID NO: 587915 - DNA, 25 bp, Rattus norvegicus
cgcccggtgtcgtggaactgcagct

SEQ ID NO: 587916 - DNA, 25 bp, Rattus norvegicus
cagcttctcgggaatcagtccagga

SEQ ID NO: 587917 - DNA, 25 bp, Rattus norvegicus
tgcggccaaagtcccaaccgcggtg

SEQ ID NO: 587918 - DNA, 25 bp, Rattus norvegicus
agaagtcgctgctacacagggcggc

SEQ ID NO: 587919 - DNA, 25 bp, Rattus norvegicus
gcgcctccgagaagtcgctgctaca

SEQ ID NO: 587920 - DNA, 25 bp, Rattus norvegicus
gctcgcgagagccatcctccgggga

SEQ ID NO: 587921 - DNA, 25 bp, Rattus norvegicus
aagatggaaacctacgcggggctgc

SEQ ID NO: 587922 - DNA, 25 bp, Rattus norvegicus
actgcagctgcaggaagatccgccg

SEQ ID NO: 587923 - DNA, 25 bp, Rattus norvegicus
atcatctgagaaacccggagccctc

SEQ ID NO: 587924 - DNA, 25 bp, Rattus norvegicus
gagcccgggtgtcaatcatctgaga

SEQ ID NO: 587925 - DNA, 25 bp, Rattus norvegicus
catgaaggacctcggctggagctgc

SEQ ID NO: 587926 - DNA, 25 bp, Rattus norvegicus
ctcgatggcggccatgaaggacctc

SEQ ID NO: 587927 - DNA, 25 bp, Rattus norvegicus
cgtggaagcaaacactcgggaagcc

SEQ ID NO: 587928 - DNA, 25 bp, Rattus norvegicus
tgggaagagcagacgcaaataaaga

SEQ ID NO: 587929 - DNA, 25 bp, Rattus norvegicus
ctccaaggaacaccctagatgggcg

SEQ ID NO: 587930 - DNA, 25 bp, Rattus norvegicus
ctcagagctccaaggaacaccctag

SEQ ID NO: 587931 - DNA, 25 bp, Rattus norvegicus
ggtggcagcgtccagcccctcagag

SEQ ID NO: 587932 - DNA, 25 bp, Rattus norvegicus
cgttgcgtgcgggacaagtgagtgc

SEQ ID NO: 587933 - DNA, 25 bp, Rattus norvegicus
acgagtgcttcgaggtggccgtgca

SEQ ID NO: 587934 - DNA, 25 bp, Rattus norvegicus
cggccaccagttcgggagccgggag

SEQ ID NO: 587935 - DNA, 25 bp, Rattus norvegicus
cacgatgaagccgaacagcgaggaa

SEQ ID NO: 587936 - DNA, 25 bp, Rattus norvegicus
cgaaaccacgatgaagccgaacagc

SEQ ID NO: 587937 - DNA, 25 bp, Rattus norvegicus
gggcccggcgaaaccacgatgaagc

SEQ ID NO: 587938 - DNA, 25 bp, Rattus norvegicus
cacgcggaacagagcagagggtggc

SEQ ID NO: 587939 - DNA, 25 bp, Rattus norvegicus
agccggccgcagcacgcggaacaga

SEQ ID NO: 587940 - DNA, 25 bp, Rattus norvegicus
accgtgcggagcctccggtgctggc

SEQ ID NO: 587941 - DNA, 25 bp, Rattus norvegicus
gagctccaaggaacaccctagatgg

SEQ ID NO: 587942 - DNA, 25 bp, Rattus norvegicus
aaggaacaccctagatgggcggcgt

SEQ ID NO: 587943 - DNA, 25 bp, Rattus norvegicus
tgggacccgaggacccacaccaatg

SEQ ID NO: 587944 - DNA, 25 bp, Rattus norvegicus
cggaactactcgctgctcgcagaag

SEQ ID NO: 587945 - DNA, 25 bp, Rattus norvegicus
ctgctcgcagaagcgcagcctgtcg

SEQ ID NO: 587946 - DNA, 25 bp, Rattus norvegicus
gcctgtcgccaagatctgggctcga

SEQ ID NO: 587947 - DNA, 25 bp, Rattus norvegicus
cggacagggcagtgatttaagaggc

SEQ ID NO: 587948 - DNA, 25 bp, Rattus norvegicus
ctcgatcgggtcaagtcatcgcggg

SEQ ID NO: 587949 - DNA, 25 bp, Rattus norvegicus
cccaggcgtgggagccggaactact

SEQ ID NO: 587950 - DNA, 25 bp, Rattus norvegicus
gggactacgcgggagccctcatcag

SEQ ID NO: 587951 - DNA, 25 bp, Rattus norvegicus
ccacaccaatggagaccgccaggga

SEQ ID NO: 587952 - DNA, 25 bp, Rattus norvegicus
aatggagaccgccagggactacgcg

SEQ ID NO: 587953 - DNA, 25 bp, Rattus norvegicus
ctgcgcgcggtcacccttctttccg

SEQ ID NO: 587954 - DNA, 25 bp, Rattus norvegicus
atcaggcgagtgctgcccgtgtacc

SEQ ID NO: 587955 - DNA, 25 bp, Rattus norvegicus
gagccctcatcaggcgagtgctgcc

SEQ ID NO: 587956 - DNA, 25 bp, Rattus norvegicus
ccaagatctgggctcgatcgggtca

SEQ ID NO: 587957 - DNA, 25 bp, Rattus norvegicus
ctggagaggatcagcgtctactaca

SEQ ID NO: 587958 - DNA, 25 bp, Rattus norvegicus
ccggtcccagccgtgtgttctagag

SEQ ID NO: 587959 - DNA, 25 bp, Rattus norvegicus
tcagggttccgacccaggactctga

SEQ ID NO: 587960 - DNA, 25 bp, Rattus norvegicus
cctcgcaagttttgggaagtgatca

SEQ ID NO: 587961 - DNA, 25 bp, Rattus norvegicus
caatgagtcatcctgtgagtcgcgc

SEQ ID NO: 587962 - DNA, 25 bp, Rattus norvegicus
accgtgcgcactcctgggagagcaa

SEQ ID NO: 587963 - DNA, 25 bp, Rattus norvegicus
ttagtgtcgccgctttcggaggacc

SEQ ID NO: 587964 - DNA, 25 bp, Rattus norvegicus
tccacccacgggtgggcagttagtg

SEQ ID NO: 587965 - DNA, 25 bp, Rattus norvegicus
cagatcggtaccaaggtgggtcccg

SEQ ID NO: 587966 - DNA, 25 bp, Rattus norvegicus
agtcacgcctcagtcgggagagcca

SEQ ID NO: 587967 - DNA, 25 bp, Rattus norvegicus
acagccagctgccattggaggggaa

SEQ ID NO: 587968 - DNA, 25 bp, Rattus norvegicus
ggatccgcccgctagcctttgggag

SEQ ID NO: 587969 - DNA, 25 bp, Rattus norvegicus
cagacccggagatccggcccagaga

SEQ ID NO: 587970 - DNA, 25 bp, Rattus norvegicus
caggctccgggtctgactctctcta

SEQ ID NO: 587971 - DNA, 25 bp, Rattus norvegicus
cctttgcactgcacagagatcagct

SEQ ID NO: 587972 - DNA, 25 bp, Rattus norvegicus
tttcacagggcgacaccatcgggcc

SEQ ID NO: 587973 - DNA, 25 bp, Rattus norvegicus
tgtctttgcggagctccgccgggaa

SEQ ID NO: 587974 - DNA, 25 bp, Rattus norvegicus
tcctctggtgcggtatgtctggata

SEQ ID NO: 587975 - DNA, 25 bp, Rattus norvegicus
tctggataaacatcattagcctggg

SEQ ID NO: 587976 - DNA, 25 bp, Rattus norvegicus
attagcctggggctgtagaccgact

SEQ ID NO: 587977 - DNA, 25 bp, Rattus norvegicus
gccgtctacagggtcggctccggct

SEQ ID NO: 587978 - DNA, 25 bp, Rattus norvegicus
cctgtccgttttctttcattgattc

SEQ ID NO: 587979 - DNA, 25 bp, Rattus norvegicus
actagagggagtcctcagccaccgg

SEQ ID NO: 587980 - DNA, 25 bp, Rattus norvegicus
ctcatttggagacaagagtgggctt

SEQ ID NO: 587981 - DNA, 25 bp, Rattus norvegicus
gcttgggacctatccctgcatttta

SEQ ID NO: 587982 - DNA, 25 bp, Rattus norvegicus
cctccggtgaaacccaatgttcaga

SEQ ID NO: 587983 - DNA, 25 bp, Rattus norvegicus
gttcagacttctgtgactttcacag

SEQ ID NO: 587984 - DNA, 25 bp, Rattus norvegicus
agaccgactttgctaattgtgcttc

SEQ ID NO: 587985 - DNA, 25 bp, Rattus norvegicus
tcaggagaaataccacccacgggga

SEQ ID NO: 587986 - DNA, 25 bp, Rattus norvegicus
ccacggcagcgagtagcaaagcaga

SEQ ID NO: 587987 - DNA, 25 bp, Rattus norvegicus
cggtgcagtccactcgactgtcctt

SEQ ID NO: 587988 - DNA, 25 bp, Rattus norvegicus
cgactgtccttttccagtggcacga

SEQ ID NO: 587989 - DNA, 25 bp, Rattus norvegicus
ccaggagactcaggccgtcacgcgt

SEQ ID NO: 587990 - DNA, 25 bp, Rattus norvegicus
gccaacgagaccacggcagcgagta

SEQ ID NO: 587991 - DNA, 25 bp, Rattus norvegicus
gtgcggacgtcgacgtgccctccag

SEQ ID NO: 587992 - DNA, 25 bp, Rattus norvegicus
caaagcagaggcgtgaccttcccgg

SEQ ID NO: 587993 - DNA, 25 bp, Rattus norvegicus
cacccacggggaccaggagactcag

SEQ ID NO: 587994 - DNA, 25 bp, Rattus norvegicus
ggtgaccttgacacctgcgccctag

SEQ ID NO: 587995 - DNA, 25 bp, Rattus norvegicus
acgcgggactcaccgtacggaggca

SEQ ID NO: 587996 - DNA, 25 bp, Rattus norvegicus
aaagccggcggtcggcaaccctcag

SEQ ID NO: 587997 - DNA, 25 bp, Rattus norvegicus
ctcagcttccgcaacttatccggga

SEQ ID NO: 587998 - DNA, 25 bp, Rattus norvegicus
tccagtggcacgaaagccaacgaga

SEQ ID NO: 587999 - DNA, 25 bp, Rattus norvegicus
atgaagatctggagctcggagcacg

SEQ ID NO: 588000 - DNA, 25 bp, Rattus norvegicus
gggccgtgatttggacagcgtcaaa

SEQ ID NO: 588001 - DNA, 25 bp, Rattus norvegicus
ttccctatttttagccgccgcagtc

SEQ ID NO: 588002 - DNA, 25 bp, Rattus norvegicus
gcacgtgttcgggtgagccatccga

SEQ ID NO: 588003 - DNA, 25 bp, Rattus norvegicus
aaatgcgcggacgtggccatagccg

SEQ ID NO: 588004 - DNA, 25 bp, Rattus norvegicus
ccggtttgtaccgactgcgagctgc

SEQ ID NO: 588005 - DNA, 25 bp, Rattus norvegicus
gtcgcgatccatccggagtagggca

SEQ ID NO: 588006 - DNA, 25 bp, Rattus norvegicus
tgtcacccacggtgccctaggggct

SEQ ID NO: 588007 - DNA, 25 bp, Rattus norvegicus
cccgagaaatctagacatgaggaag

SEQ ID NO: 588008 - DNA, 25 bp, Rattus norvegicus
tttggtcctgaatacgttgtgcaca

SEQ ID NO: 588009 - DNA, 25 bp, Rattus norvegicus
ttgtgcacacggacgcctctaagcc

SEQ ID NO: 588010 - DNA, 25 bp, Rattus norvegicus
caccagggagactgcgaactgcctc

SEQ ID NO: 588011 - DNA, 25 bp, Rattus norvegicus
tgcgcactcgcgaatgtccctgcgg

SEQ ID NO: 588012 - DNA, 25 bp, Rattus norvegicus
cgtcaaagaacccagagctgcggtt

SEQ ID NO: 588013 - DNA, 25 bp, Rattus norvegicus
cttgtgctgcttcctgctgccgctt

SEQ ID NO: 588014 - DNA, 25 bp, Rattus norvegicus
ggactctaggcctgcttggagccca

SEQ ID NO: 588015 - DNA, 25 bp, Rattus norvegicus
tgcggttcttaaacgcaggtgatcc

SEQ ID NO: 588016 - DNA, 25 bp, Rattus norvegicus
cctgggcttgcttttcttgtataac

SEQ ID NO: 588017 - DNA, 25 bp, Rattus norvegicus
catgttggccggtcacgtgacctgc

SEQ ID NO: 588018 - DNA, 25 bp, Rattus norvegicus
gcggctgttctgaggttcacaaaga

SEQ ID NO: 588019 - DNA, 25 bp, Rattus norvegicus
gcttctcccgctgggtcacactaat

SEQ ID NO: 588020 - DNA, 25 bp, Rattus norvegicus
tggctccggtccacgatctcgaact

SEQ ID NO: 588021 - DNA, 25 bp, Rattus norvegicus
cgggtcaagtttctacagcggtgca

SEQ ID NO: 588022 - DNA, 25 bp, Rattus norvegicus
agagctctttgtccggcgggtcaag

SEQ ID NO: 588023 - DNA, 25 bp, Rattus norvegicus
gacacagcaccgcagagctctttgt

SEQ ID NO: 588024 - DNA, 25 bp, Rattus norvegicus
ggtcacactaattgcagagccctgc

SEQ ID NO: 588025 - DNA, 25 bp, Rattus norvegicus
acgtgacctgccactggcctgggtc

SEQ ID NO: 588026 - DNA, 25 bp, Rattus norvegicus
ccagccgggagtacttggaagttag

SEQ ID NO: 588027 - DNA, 25 bp, Rattus norvegicus
tcctgcaggcgtctggccgcgaagt

SEQ ID NO: 588028 - DNA, 25 bp, Rattus norvegicus
ccctcccgatgtgagtgacgcgcgg

SEQ ID NO: 588029 - DNA, 25 bp, Rattus norvegicus
tagcacggcgatggcgtccactagc

SEQ ID NO: 588030 - DNA, 25 bp, Rattus norvegicus
tgaccagcacgcagccggccggtag

SEQ ID NO: 588031 - DNA, 25 bp, Rattus norvegicus
tggagcatcgtctctacgagccgcc

SEQ ID NO: 588032 - DNA, 25 bp, Rattus norvegicus
ctcagcgctggagcatcgtctctac

SEQ ID NO: 588033 - DNA, 25 bp, Rattus norvegicus
ggatctcttccaagctcagcgcgtc

SEQ ID NO: 588034 - DNA, 25 bp, Rattus norvegicus
gttgtagagccgcaggatctcttcc

SEQ ID NO: 588035 - DNA, 25 bp, Rattus norvegicus
ggagccgcagcactggaagcacacg

SEQ ID NO: 588036 - DNA, 25 bp, Rattus norvegicus
tccagacgcggatctgcgcggccga

SEQ ID NO: 588037 - DNA, 25 bp, Rattus norvegicus
ggacacgcacagagcctcccgggaa

SEQ ID NO: 588038 - DNA, 25 bp, Rattus norvegicus
tggccgcgaagtcgctgtcacccgt

SEQ ID NO: 588039 - DNA, 25 bp, Rattus norvegicus
ccgagccgtggtcctgcaggcgtct

SEQ ID NO: 588040 - DNA, 25 bp, Rattus norvegicus
gtaaacagccgaggccggcggacac

SEQ ID NO: 588041 - DNA, 25 bp, Rattus norvegicus
tctggcctcggactacttgtacatg

SEQ ID NO: 588042 - DNA, 25 bp, Rattus norvegicus
tacttcagcttacggccagcagtcg

SEQ ID NO: 588043 - DNA, 25 bp, Rattus norvegicus
ataggtatcctagctgtcccggaca

SEQ ID NO: 588044 - DNA, 25 bp, Rattus norvegicus
cgatcgggcttccaggcgtaaagaa

SEQ ID NO: 588045 - DNA, 25 bp, Rattus norvegicus
catgaacatctggaaagcgcccgga

SEQ ID NO: 588046 - DNA, 25 bp, Rattus norvegicus
gggtcacacgcccaaccgaagcttg

SEQ ID NO: 588047 - DNA, 25 bp, Rattus norvegicus
cagtcatgttcgttccctgcgggga

SEQ ID NO: 588048 - DNA, 25 bp, Rattus norvegicus
gcggcgccacaactaactgtcttca

SEQ ID NO: 588049 - DNA, 25 bp, Rattus norvegicus
actgtcttcaaaccgggcggactga

SEQ ID NO: 588050 - DNA, 25 bp, Rattus norvegicus
ttcgagcctcgttcagcactgagcg

SEQ ID NO: 588051 - DNA, 25 bp, Rattus norvegicus
gcgagttccgccttctatcctaagg

SEQ ID NO: 588052 - DNA, 25 bp, Rattus norvegicus
aacgcgttccttgtcagtcattgga

SEQ ID NO: 588053 - DNA, 25 bp, Rattus norvegicus
gctgcttcagctcagaggctttctc

SEQ ID NO: 588054 - DNA, 25 bp, Rattus norvegicus
ggagcgccctgtctcccataactta

SEQ ID NO: 588055 - DNA, 25 bp, Rattus norvegicus
gtggcgccgccttcagaaccaacag

SEQ ID NO: 588056 - DNA, 25 bp, Rattus norvegicus
agctcctgactctgcttgccacagg

SEQ ID NO: 588057 - DNA, 25 bp, Rattus norvegicus
aaagtacctggagcgtcggacgtca

SEQ ID NO: 588058 - DNA, 25 bp, Rattus norvegicus
gcggaaccaccacagcggacaggct

SEQ ID NO: 588059 - DNA, 25 bp, Rattus norvegicus
aactcccgctcgatggtagccgaca

SEQ ID NO: 588060 - DNA, 25 bp, Rattus norvegicus
tgccagcgacactgagcatccagtt

SEQ ID NO: 588061 - DNA, 25 bp, Rattus norvegicus
ctcaccaagtataacggctgccagc

SEQ ID NO: 588062 - DNA, 25 bp, Rattus norvegicus
gcgcggacctgagactcaccaagta

SEQ ID NO: 588063 - DNA, 25 bp, Rattus norvegicus
ttcccgtctaaagcctcacagaggt

SEQ ID NO: 588064 - DNA, 25 bp, Rattus norvegicus
agtcagcagaccagaggctgtccca

SEQ ID NO: 588065 - DNA, 25 bp, Rattus norvegicus
aacaaaaacgcggtcagtcagcaga

SEQ ID NO: 588066 - DNA, 25 bp, Rattus norvegicus
atgagatcccgcttcgctttcgctg

SEQ ID NO: 588067 - DNA, 25 bp, Rattus norvegicus
cccaggataccgcaagagaccgaga

SEQ ID NO: 588068 - DNA, 25 bp, Rattus norvegicus
agctcggatcctccgaagaccggga

SEQ ID NO: 588069 - DNA, 25 bp, Rattus norvegicus
gggacatctctactcgctatgtgta

SEQ ID NO: 588070 - DNA, 25 bp, Rattus norvegicus
ccgatcacgtgtttacggaggcaca

SEQ ID NO: 588071 - DNA, 25 bp, Rattus norvegicus
tagtctaacgcgtttggccttctcg

SEQ ID NO: 588072 - DNA, 25 bp, Rattus norvegicus
ccgtggctggaacaaggtttggaca

SEQ ID NO: 588073 - DNA, 25 bp, Rattus norvegicus
aaggtttggacacaggctccgcctg

SEQ ID NO: 588074 - DNA, 25 bp, Rattus norvegicus
cggccatgtttgtggcgcgcagcat

SEQ ID NO: 588075 - DNA, 25 bp, Rattus norvegicus
tcgcggcggaccacaaggacctcat

SEQ ID NO: 588076 - DNA, 25 bp, Rattus norvegicus
atgtgtctttcgacttccacgggcg

SEQ ID NO: 588077 - DNA, 25 bp, Rattus norvegicus
atggccacctgttccagcgaccaga

SEQ ID NO: 588078 - DNA, 25 bp, Rattus norvegicus
tccagcgaccagagcgtcaaggtgc

SEQ ID NO: 588079 - DNA, 25 bp, Rattus norvegicus
aggcggcacagaagggactaactct

SEQ ID NO: 588080 - DNA, 25 bp, Rattus norvegicus
ggacctcatccacgatgtgtctttc

SEQ ID NO: 588081 - DNA, 25 bp, Rattus norvegicus
tgcgagacacaaagccgcggacgcc

SEQ ID NO: 588082 - DNA, 25 bp, Rattus norvegicus
ctaactctgaccgaggcgtgcgaga

SEQ ID NO: 588083 - DNA, 25 bp, Rattus norvegicus
cggacgttttcctagcgctcgtgag

SEQ ID NO: 588084 - DNA, 25 bp, Rattus norvegicus
ggaacggccgcatccttgtttcctc

SEQ ID NO: 588085 - DNA, 25 bp, Rattus norvegicus
ctgggctttggaacggccgcatcct

SEQ ID NO: 588086 - DNA, 25 bp, Rattus norvegicus
tgagatcaagcgtccgcgcgtggcc

SEQ ID NO: 588087 - DNA, 25 bp, Rattus norvegicus
tctgtgagatcaagcgtccgcgcgt

SEQ ID NO: 588088 - DNA, 25 bp, Rattus norvegicus
ctggtctgtgagatcaagcgtccgc

SEQ ID NO: 588089 - DNA, 25 bp, Rattus norvegicus
cttgtttcctccggtccggctagcg

SEQ ID NO: 588090 - DNA, 25 bp, Rattus norvegicus
tttcctagcgctcgtgagtggcgga

SEQ ID NO: 588091 - DNA, 25 bp, Rattus norvegicus
tttagcggacgttttcctagcgctc

SEQ ID NO: 588092 - DNA, 25 bp, Rattus norvegicus
cttcctacaggagggaggcctcgcg

SEQ ID NO: 588093 - DNA, 25 bp, Rattus norvegicus
tcgcttcctacaggagggaggcctc

SEQ ID NO: 588094 - DNA, 25 bp, Rattus norvegicus
acgccctcgcttcctacaggaggga

SEQ ID NO: 588095 - DNA, 25 bp, Rattus norvegicus
tcgagcttagcccaatccgggtcgg

SEQ ID NO: 588096 - DNA, 25 bp, Rattus norvegicus
gagagggcaaggctgtggcttctag

SEQ ID NO: 588097 - DNA, 25 bp, Rattus norvegicus
gagacgtcccacatcctgagaggta

SEQ ID NO: 588098 - DNA, 25 bp, Rattus norvegicus
gactcgtaattcgaaggccagactc

SEQ ID NO: 588099 - DNA, 25 bp, Rattus norvegicus
tacgagtcccaaggttcctagcgcg

SEQ ID NO: 588100 - DNA, 25 bp, Rattus norvegicus
ctctagccctgcgagcaagcacgga

SEQ ID NO: 588101 - DNA, 25 bp, Rattus norvegicus
ggcctagcgtttgctggagtcctgt

SEQ ID NO: 588102 - DNA, 25 bp, Rattus norvegicus
ttcctccgcgttggaactacgagtc

SEQ ID NO: 588103 - DNA, 25 bp, Rattus norvegicus
ctaacgcccagtgcggtaggaatcc

SEQ ID NO: 588104 - DNA, 25 bp, Rattus norvegicus
tgccttgttacgtcacttccgggga

SEQ ID NO: 588105 - DNA, 25 bp, Rattus norvegicus
atccacgattctgtttgcggaaacg

SEQ ID NO: 588106 - DNA, 25 bp, Rattus norvegicus
gacgttcggtctacctttgctctta

SEQ ID NO: 588107 - DNA, 25 bp, Rattus norvegicus
tcccacgaagcaaggaccgaaggta

SEQ ID NO: 588108 - DNA, 25 bp, Rattus norvegicus
ttcaccgccggcgtgtatgtctgac

SEQ ID NO: 588109 - DNA, 25 bp, Rattus norvegicus
ggaaaggccagaacgccgaacgcta

SEQ ID NO: 588110 - DNA, 25 bp, Rattus norvegicus
gtcgccctgctgaggcagctcctaa

SEQ ID NO: 588111 - DNA, 25 bp, Rattus norvegicus
cgagacgcatacatcagtgcggcaa

SEQ ID NO: 588112 - DNA, 25 bp, Rattus norvegicus
gacagcgtgatgatcacccgtgccc

SEQ ID NO: 588113 - DNA, 25 bp, Rattus norvegicus
ccgtgtcgcacggtgactagatctg

SEQ ID NO: 588114 - DNA, 25 bp, Rattus norvegicus
agacagcacccaaggccgggaacca

SEQ ID NO: 588115 - DNA, 25 bp, Rattus norvegicus
gcgccttctgacctacgggaaacga

SEQ ID NO: 588116 - DNA, 25 bp, Rattus norvegicus
atgctcggaagagcgcggatagtca

SEQ ID NO: 588117 - DNA, 25 bp, Rattus norvegicus
tgcggcaaaatttcgtggagactct

SEQ ID NO: 588118 - DNA, 25 bp, Rattus norvegicus
tcggggtttgaacatcggagactta

SEQ ID NO: 588119 - DNA, 25 bp, Rattus norvegicus
ggtcctaacaaacccgagacgcata

SEQ ID NO: 588120 - DNA, 25 bp, Rattus norvegicus
catcggagacttaacggtcctaaca

SEQ ID NO: 588121 - DNA, 25 bp, Rattus norvegicus
cacagtcaccgtggccgaggcgatc

SEQ ID NO: 588122 - DNA, 25 bp, Rattus norvegicus
cagagaagacacagccaagcgcagg

SEQ ID NO: 588123 - DNA, 25 bp, Rattus norvegicus
cggatagtcaggcttctgcagagaa

SEQ ID NO: 588124 - DNA, 25 bp, Rattus norvegicus
acgggaaacgaaagctcagctcgga

SEQ ID NO: 588125 - DNA, 25 bp, Rattus norvegicus
tctctaggcgccgtgtttaccactc

SEQ ID NO: 588126 - DNA, 25 bp, Rattus norvegicus
agcgccttctctttataagccgcag

SEQ ID NO: 588127 - DNA, 25 bp, Rattus norvegicus
ttgagtcggagatcaaggccagaca

SEQ ID NO: 588128 - DNA, 25 bp, Rattus norvegicus
cgcgctctgggagaaacgacctgag

SEQ ID NO: 588129 - DNA, 25 bp, Rattus norvegicus
acctgagacccacccgcctgcggga

SEQ ID NO: 588130 - DNA, 25 bp, Rattus norvegicus
ttctctttataagccgcagtgcccg

SEQ ID NO: 588131 - DNA, 25 bp, Rattus norvegicus
tttaccactctatggtcgcgcgctc

SEQ ID NO: 588132 - DNA, 25 bp, Rattus norvegicus
atcttggcggcctctctaggcgccg

SEQ ID NO: 588133 - DNA, 25 bp, Rattus norvegicus
gaacaacacttttgagtcggagatc

SEQ ID NO: 588134 - DNA, 25 bp, Rattus norvegicus
tcacacagcgggaacaacacttttg

SEQ ID NO: 588135 - DNA, 25 bp, Rattus norvegicus
aggcgccgtgtttaccactctatgg

SEQ ID NO: 588136 - DNA, 25 bp, Rattus norvegicus
tcccggcgagttctttcacacagcg

SEQ ID NO: 588137 - DNA, 25 bp, Rattus norvegicus
ccagtcattgtctggtggagcagcc

SEQ ID NO: 588138 - DNA, 25 bp, Rattus norvegicus
aggcgtggcttagcgcgccgccatc

SEQ ID NO: 588139 - DNA, 25 bp, Rattus norvegicus
gctgtgagtaaaaggactctccttc

SEQ ID NO: 588140 - DNA, 25 bp, Rattus norvegicus
gtgcagggtccaagcagctacttcc

SEQ ID NO: 588141 - DNA, 25 bp, Rattus norvegicus
cagctacttccggttggacgccgcg

SEQ ID NO: 588142 - DNA, 25 bp, Rattus norvegicus
tgctgtggatacacggaaaaggatc

SEQ ID NO: 588143 - DNA, 25 bp, Rattus norvegicus
cactcggcgagaagtgggcagtaac

SEQ ID NO: 588144 - DNA, 25 bp, Rattus norvegicus
ggacggatcccgaagactctgaagg

SEQ ID NO: 588145 - DNA, 25 bp, Rattus norvegicus
ccgggctcacgttccaagcagtcta

SEQ ID NO: 588146 - DNA, 25 bp, Rattus norvegicus
cagcgcgctcttttcgcgtagcgtt

SEQ ID NO: 588147 - DNA, 25 bp, Rattus norvegicus
tcgcgtagcgtttgaagtgtcttcc

SEQ ID NO: 588148 - DNA, 25 bp, Rattus norvegicus
gaagtgtcttccgtctgacccggga

SEQ ID NO: 588149 - DNA, 25 bp, Rattus norvegicus
tgcattttgcttgtgagagggacgc

SEQ ID NO: 588150 - DNA, 25 bp, Rattus norvegicus
ctgaatgtcctgtgcgtttcccttg

SEQ ID NO: 588151 - DNA, 25 bp, Rattus norvegicus
ttcccttgtgtggtgtgacagtcta

SEQ ID NO: 588152 - DNA, 25 bp, Rattus norvegicus
cagtctagttttaccgagcgtcttc

SEQ ID NO: 588153 - DNA, 25 bp, Rattus norvegicus
tgctgaacttgcaattccgtgcgcc

SEQ ID NO: 588154 - DNA, 25 bp, Rattus norvegicus
ggatagacatgaccgccgcctgggc

SEQ ID NO: 588155 - DNA, 25 bp, Rattus norvegicus
gatcttggctgtgtgtctgcggatc

SEQ ID NO: 588156 - DNA, 25 bp, Rattus norvegicus
tgttaagagtcagggatcttggctg

SEQ ID NO: 588157 - DNA, 25 bp, Rattus norvegicus
cctcccgggagaagagagttggtgt

SEQ ID NO: 588158 - DNA, 25 bp, Rattus norvegicus
attccgtgcgcctcgccgtgttccc

SEQ ID NO: 588159 - DNA, 25 bp, Rattus norvegicus
ttgcaattccgtgcgcctcgccgtg

SEQ ID NO: 588160 - DNA, 25 bp, Rattus norvegicus
atcttggctgtgtgtctgcggatcg

SEQ ID NO: 588161 - DNA, 25 bp, Rattus norvegicus
ctgaacttgcaattccgtgcgcctc

SEQ ID NO: 588162 - DNA, 25 bp, Rattus norvegicus
tttgctgaacttgcaattccgtgcg

SEQ ID NO: 588163 - DNA, 25 bp, Rattus norvegicus
tctttgctgaacttgcaattccgtg

SEQ ID NO: 588164 - DNA, 25 bp, Rattus norvegicus
catttctttgctgaacttgcaattc

SEQ ID NO: 588165 - DNA, 25 bp, Rattus norvegicus
cacccatttctttgctgaacttgca

SEQ ID NO: 588166 - DNA, 25 bp, Rattus norvegicus
gaacttgcaattccgtgcgcctcgc

SEQ ID NO: 588167 - DNA, 25 bp, Rattus norvegicus
ccggagattagtgggaccctgctcc

SEQ ID NO: 588168 - DNA, 25 bp, Rattus norvegicus
tctcttcaactgaggcatggggctg

SEQ ID NO: 588169 - DNA, 25 bp, Rattus norvegicus
gcatggtgaaatgtcccttctcttc

SEQ ID NO: 588170 - DNA, 25 bp, Rattus norvegicus
ccttcctggaggctgcatggtgaaa

SEQ ID NO: 588171 - DNA, 25 bp, Rattus norvegicus
ttccggactggtggtcctgtcaacg

SEQ ID NO: 588172 - DNA, 25 bp, Rattus norvegicus
tgcgaatccactggggcagctcttt

SEQ ID NO: 588173 - DNA, 25 bp, Rattus norvegicus
cgccctttagggtaactgccaggtg

SEQ ID NO: 588174 - DNA, 25 bp, Rattus norvegicus
tcactaaggagcgagggcactctga

SEQ ID NO: 588175 - DNA, 25 bp, Rattus norvegicus
acgtggaataatttctgaggagccc

SEQ ID NO: 588176 - DNA, 25 bp, Rattus norvegicus
ccgaggcgacttgggcaaactctgt

SEQ ID NO: 588177 - DNA, 25 bp, Rattus norvegicus
ccatcccagggtttaggtgtacgag

SEQ ID NO: 588178 - DNA, 25 bp, Rattus norvegicus
gcacttgccgctctcaggatgcaga

SEQ ID NO: 588179 - DNA, 25 bp, Rattus norvegicus
gctcggtcgacagcatctgaggctc

SEQ ID NO: 588180 - DNA, 25 bp, Rattus norvegicus
ctccggaggccaatagtgaggacac

SEQ ID NO: 588181 - DNA, 25 bp, Rattus norvegicus
tctagtcttctcgagctccggggac

SEQ ID NO: 588182 - DNA, 25 bp, Rattus norvegicus
gggcccactctagtcttctcgagct

SEQ ID NO: 588183 - DNA, 25 bp, Rattus norvegicus
ggggacccgccagcaagccagcaac

SEQ ID NO: 588184 - DNA, 25 bp, Rattus norvegicus
gccagcaagccagcaaccaaggcgc

SEQ ID NO: 588185 - DNA, 25 bp, Rattus norvegicus
tagtcttctcgagctccggggaccc

SEQ ID NO: 588186 - DNA, 25 bp, Rattus norvegicus
tcggggcccactctagtcttctcga

SEQ ID NO: 588187 - DNA, 25 bp, Rattus norvegicus
tggtatcaggtttcggggcccactc

SEQ ID NO: 588188 - DNA, 25 bp, Rattus norvegicus
cgctggtatcaggtttcggggccca

SEQ ID NO: 588189 - DNA, 25 bp, Rattus norvegicus
gcattccagcctacagccggccttc

SEQ ID NO: 588190 - DNA, 25 bp, Rattus norvegicus
gtggaaccgcattccagcctacagc

SEQ ID NO: 588191 - DNA, 25 bp, Rattus norvegicus
gggtggaaccgcattccagcctaca

SEQ ID NO: 588192 - DNA, 25 bp, Rattus norvegicus
gagtgggtggaaccgcattccagcc

SEQ ID NO: 588193 - DNA, 25 bp, Rattus norvegicus
cacccggagtgggtggaaccgcatt

SEQ ID NO: 588194 - DNA, 25 bp, Rattus norvegicus
actctagtcttctcgagctccgggg

SEQ ID NO: 588195 - DNA, 25 bp, Rattus norvegicus
cccgcgaagagttcagaggtcaaag

SEQ ID NO: 588196 - DNA, 25 bp, Rattus norvegicus
gcccaggaagtggagcacgactctt

SEQ ID NO: 588197 - DNA, 25 bp, Rattus norvegicus
acgactcttggaaaccgctgctctg

SEQ ID NO: 588198 - DNA, 25 bp, Rattus norvegicus
ccgctgctctggtttatcctgcaaa

SEQ ID NO: 588199 - DNA, 25 bp, Rattus norvegicus
cgggtccggaacactgatcttggca

SEQ ID NO: 588200 - DNA, 25 bp, Rattus norvegicus
tgtgcttggggacacagacatggcc

SEQ ID NO: 588201 - DNA, 25 bp, Rattus norvegicus
atggccttgggttaagaccttcatc

SEQ ID NO: 588202 - DNA, 25 bp, Rattus norvegicus
cccgcagtggatgctgagtgacaac

SEQ ID NO: 588203 - DNA, 25 bp, Rattus norvegicus
cagtgccctccttgggaagatcttc

SEQ ID NO: 588204 - DNA, 25 bp, Rattus norvegicus
gccgatggctcaccgggacactttt

SEQ ID NO: 588205 - DNA, 25 bp, Rattus norvegicus
gcacagttccagactctcggcggga

SEQ ID NO: 588206 - DNA, 25 bp, Rattus norvegicus
gagacgcccgcgatcgctttcaaac

SEQ ID NO: 588207 - DNA, 25 bp, Rattus norvegicus
gctttcaaaccgacccaacatggcg

SEQ ID NO: 588208 - DNA, 25 bp, Rattus norvegicus
ccgcacggcgcatgtgtagtaccag

SEQ ID NO: 588209 - DNA, 25 bp, Rattus norvegicus
ccgagggctccatggcacgagaaaa

SEQ ID NO: 588210 - DNA, 25 bp, Rattus norvegicus
tcctaggaaaccacggcccagcctc

SEQ ID NO: 588211 - DNA, 25 bp, Rattus norvegicus
tgcacggtctcctaggaaaccacgg

SEQ ID NO: 588212 - DNA, 25 bp, Rattus norvegicus
agctgctgcacggtctcctaggaaa

SEQ ID NO: 588213 - DNA, 25 bp, Rattus norvegicus
ttcccttcgggccaaccgcagcgca

SEQ ID NO: 588214 - DNA, 25 bp, Rattus norvegicus
ttcttcctccgcagggccgccttcc

SEQ ID NO: 588215 - DNA, 25 bp, Rattus norvegicus
cagtgcccgcactctccaggcccga

SEQ ID NO: 588216 - DNA, 25 bp, Rattus norvegicus
gctccatggcacgagaaaagtcttc

SEQ ID NO: 588217 - DNA, 25 bp, Rattus norvegicus
cgagtccgagggctccatggcacga

SEQ ID NO: 588218 - DNA, 25 bp, Rattus norvegicus
ttcccgccatcacccggagggcgcg

SEQ ID NO: 588219 - DNA, 25 bp, Rattus norvegicus
cgggcacccgcccttcacatccttc

SEQ ID NO: 588220 - DNA, 25 bp, Rattus norvegicus
ggaccagaaggccgcgacccaacga

SEQ ID NO: 588221 - DNA, 25 bp, Rattus norvegicus
tctccaggcccgagcgggaccagaa

SEQ ID NO: 588222 - DNA, 25 bp, Rattus norvegicus
tggcacgagaaaagtcttcttcctc

SEQ ID NO: 588223 - DNA, 25 bp, Rattus norvegicus
gcgctggcggcgactccgccataga

SEQ ID NO: 588224 - DNA, 25 bp, Rattus norvegicus
tgcctcgagcttggaggacctaaga

SEQ ID NO: 588225 - DNA, 25 bp, Rattus norvegicus
ctggcggcgactccgccatagagca

SEQ ID NO: 588226 - DNA, 25 bp, Rattus norvegicus
ggcggagacaacatggccgtgcctc

SEQ ID NO: 588227 - DNA, 25 bp, Rattus norvegicus
acaacatggccgtgcctcgagcttg

SEQ ID NO: 588228 - DNA, 25 bp, Rattus norvegicus
cgtgcctcgagcttggaggacctaa

SEQ ID NO: 588229 - DNA, 25 bp, Rattus norvegicus
gctctatgatgcttgcgcgcgtccc

SEQ ID NO: 588230 - DNA, 25 bp, Rattus norvegicus
caggtggacaaaggggcgtggctca

SEQ ID NO: 588231 - DNA, 25 bp, Rattus norvegicus
cagggcagcgcgctcgctccgtccc

SEQ ID NO: 588232 - DNA, 25 bp, Rattus norvegicus
tcggttacggaagaagcgcagagcc

SEQ ID NO: 588233 - DNA, 25 bp, Rattus norvegicus
ccgctctatgatgcttgcgcgcgtc

SEQ ID NO: 588234 - DNA, 25 bp, Rattus norvegicus
gcgcgcccgctctatgatgcttgcg

SEQ ID NO: 588235 - DNA, 25 bp, Rattus norvegicus
tgtgcgcgcccgctctatgatgctt

SEQ ID NO: 588236 - DNA, 25 bp, Rattus norvegicus
ctcgagcttggaggacctaagaggc

SEQ ID NO: 588237 - DNA, 25 bp, Rattus norvegicus
tccaggactggctcgttctcgtcac

SEQ ID NO: 588238 - DNA, 25 bp, Rattus norvegicus
ggctcgttctcgtcacccaatcaga

SEQ ID NO: 588239 - DNA, 25 bp, Rattus norvegicus
tcgtcacccaatcagaacggtctgg

SEQ ID NO: 588240 - DNA, 25 bp, Rattus norvegicus
caatcagaacggtctggggcgcaga

SEQ ID NO: 588241 - DNA, 25 bp, Rattus norvegicus
ggcgggctcccggagattaaaagca

SEQ ID NO: 588242 - DNA, 25 bp, Rattus norvegicus
cccggagattaaaagcagccaatca

SEQ ID NO: 588243 - DNA, 25 bp, Rattus norvegicus
agagcgcgccggcttcattcggaga

SEQ ID NO: 588244 - DNA, 25 bp, Rattus norvegicus
ggggctggttaaggccatgaaacaa

SEQ ID NO: 588245 - DNA, 25 bp, Rattus norvegicus
ggccatgaaacaaaagaaaccctga

SEQ ID NO: 588246 - DNA, 25 bp, Rattus norvegicus
aagaaaccctgagaggggagccgct

SEQ ID NO: 588247 - DNA, 25 bp, Rattus norvegicus
acctagttacctacctcggctctgt

SEQ ID NO: 588248 - DNA, 25 bp, Rattus norvegicus
accggctgctgctgagggaacgcct

SEQ ID NO: 588249 - DNA, 25 bp, Rattus norvegicus
cctcccagacccagccgatacccgg

SEQ ID NO: 588250 - DNA, 25 bp, Rattus norvegicus
aaggagccggcttccaggactggct

SEQ ID NO: 588251 - DNA, 25 bp, Rattus norvegicus
atcctgtctgtaaagagcgcgggcc

SEQ ID NO: 588252 - DNA, 25 bp, Rattus norvegicus
tcgggatcctgtctgtaaagagcgc

SEQ ID NO: 588253 - DNA, 25 bp, Rattus norvegicus
taggcagacatcctgcgctttttgc

SEQ ID NO: 588254 - DNA, 25 bp, Rattus norvegicus
atggcgacgcccagtggtgactgcg

SEQ ID NO: 588255 - DNA, 25 bp, Rattus norvegicus
tttttgcgggacaatggcgacgccc

SEQ ID NO: 588256 - DNA, 25 bp, Rattus norvegicus
cctgcgctttttgcgggacaatggc

SEQ ID NO: 588257 - DNA, 25 bp, Rattus norvegicus
gaaggagacgccataggcagacatc

SEQ ID NO: 588258 - DNA, 25 bp, Rattus norvegicus
ctgctgggcttcctcggggagccct

SEQ ID NO: 588259 - DNA, 25 bp, Rattus norvegicus
agcatgagctgcagcgagcataggc

SEQ ID NO: 588260 - DNA, 25 bp, Rattus norvegicus
ccgcccggagcatgagctgcagcga

SEQ ID NO: 588261 - DNA, 25 bp, Rattus norvegicus
cagccgccttgttttctgcaccgcg

SEQ ID NO: 588262 - DNA, 25 bp, Rattus norvegicus
gagacctatctctgcagaactcccg

SEQ ID NO: 588263 - DNA, 25 bp, Rattus norvegicus
gacatttccgagacctatctctgca

SEQ ID NO: 588264 - DNA, 25 bp, Rattus norvegicus
acatcctgcgctttttgcgggacaa

SEQ ID NO: 588265 - DNA, 25 bp, Rattus norvegicus
cgcgtcctcgctgtcgggcgctccc

SEQ ID NO: 588266 - DNA, 25 bp, Rattus norvegicus
actcttcggtctccggaacgcgctg

SEQ ID NO: 588267 - DNA, 25 bp, Rattus norvegicus
cggcgaggccgctctaggcgccgga

SEQ ID NO: 588268 - DNA, 25 bp, Rattus norvegicus
tggcgacgcgcagccggaagtgcgc

SEQ ID NO: 588269 - DNA, 25 bp, Rattus norvegicus
agcagtgcgcgagtggcgacgcgca

SEQ ID NO: 588270 - DNA, 25 bp, Rattus norvegicus
ccgcgggcctgtgagctccgaggaa

SEQ ID NO: 588271 - DNA, 25 bp, Rattus norvegicus
cccggcctgtggtcaccgcgagccc

SEQ ID NO: 588272 - DNA, 25 bp, Rattus norvegicus
tcacttcggagctgcgtgggccgaa

SEQ ID NO: 588273 - DNA, 25 bp, Rattus norvegicus
cagctcccggtcaaggctgcaggcg

SEQ ID NO: 588274 - DNA, 25 bp, Rattus norvegicus
ctccggaacgcgctggctgcagtgc

SEQ ID NO: 588275 - DNA, 25 bp, Rattus norvegicus
gcgctcctcagtttccaggctgcca

SEQ ID NO: 588276 - DNA, 25 bp, Rattus norvegicus
ccgaagactgagtggcccggcctgt

SEQ ID NO: 588277 - DNA, 25 bp, Rattus norvegicus
aggctgccagctcccggtcaaggct

SEQ ID NO: 588278 - DNA, 25 bp, Rattus norvegicus
gtcaaggctgcaggcggatgacacc

SEQ ID NO: 588279 - DNA, 25 bp, Rattus norvegicus
cgcggcgctatagccagagatgctc

SEQ ID NO: 588280 - DNA, 25 bp, Rattus norvegicus
ttcacgcgagaagatgttgtgcgca

SEQ ID NO: 588281 - DNA, 25 bp, Rattus norvegicus
ctgtcagtgccaggtccgcagagtc

SEQ ID NO: 588282 - DNA, 25 bp, Rattus norvegicus
agggtggcttatccctgtcagtgcc

SEQ ID NO: 588283 - DNA, 25 bp, Rattus norvegicus
taataccctgctccatggggacgcg

SEQ ID NO: 588284 - DNA, 25 bp, Rattus norvegicus
taactattctgaggccgcgtgcacc

SEQ ID NO: 588285 - DNA, 25 bp, Rattus norvegicus
ggttcctgggtgttaactattctga

SEQ ID NO: 588286 - DNA, 25 bp, Rattus norvegicus
cgagccaatgagaagctggaagctg

SEQ ID NO: 588287 - DNA, 25 bp, Rattus norvegicus
ccggtgctggcctaacggacaggca

SEQ ID NO: 588288 - DNA, 25 bp, Rattus norvegicus
cccacacgcgcagaggtagcggaga

SEQ ID NO: 588289 - DNA, 25 bp, Rattus norvegicus
tatagccagagatgctcggccctgg

SEQ ID NO: 588290 - DNA, 25 bp, Rattus norvegicus
cgtgccaggtagtgcagcaagcaga

SEQ ID NO: 588291 - DNA, 25 bp, Rattus norvegicus
taacggacaggcacgcgagccaatg

SEQ ID NO: 588292 - DNA, 25 bp, Rattus norvegicus
gagcttctggcagccggcgccagct

SEQ ID NO: 588293 - DNA, 25 bp, Rattus norvegicus
tacctgcaagcgtgcaaaagaaggc

SEQ ID NO: 588294 - DNA, 25 bp, Rattus norvegicus
ccacagcagcttgtccaggtaggac

SEQ ID NO: 588295 - DNA, 25 bp, Rattus norvegicus
ccttgcgtgggtccacctgaacatc

SEQ ID NO: 588296 - DNA, 25 bp, Rattus norvegicus
ggtcaggccgccattccagatctga

SEQ ID NO: 588297 - DNA, 25 bp, Rattus norvegicus
tcgctcgcgtcctgacagcggtcag

SEQ ID NO: 588298 - DNA, 25 bp, Rattus norvegicus
ctccgccagcggagtagagccagca

SEQ ID NO: 588299 - DNA, 25 bp, Rattus norvegicus
gctcggagctgctctgtgagtcctt

SEQ ID NO: 588300 - DNA, 25 bp, Rattus norvegicus
ctccaggaagcgctcggagctgctc

SEQ ID NO: 588301 - DNA, 25 bp, Rattus norvegicus
tggacgagtgcgactgctccaggaa

SEQ ID NO: 588302 - DNA, 25 bp, Rattus norvegicus
tcaaaggcgcgctccatggacgagt

SEQ ID NO: 588303 - DNA, 25 bp, Rattus norvegicus
cccactttgtagtcgcaggaccgtc

SEQ ID NO: 588304 - DNA, 25 bp, Rattus norvegicus
acaggctcacgggatacctgcaagc

SEQ ID NO: 588305 - DNA, 25 bp, Rattus norvegicus
ttccagatctgacgacaggctcacg

SEQ ID NO: 588306 - DNA, 25 bp, Rattus norvegicus
aggaccgtccatagtcggcctcaaa

SEQ ID NO: 588307 - DNA, 25 bp, Rattus norvegicus
gaacctctccgtaagccgcgcatgg

SEQ ID NO: 588308 - DNA, 25 bp, Rattus norvegicus
cctcaactcgttcactcagggaatc

SEQ ID NO: 588309 - DNA, 25 bp, Rattus norvegicus
cgcacttataaatacggaccgcccg

SEQ ID NO: 588310 - DNA, 25 bp, Rattus norvegicus
aacatttctctggacggacggccgc

SEQ ID NO: 588311 - DNA, 25 bp, Rattus norvegicus
tgcaacgcgttctcagcaccgggca

SEQ ID NO: 588312 - DNA, 25 bp, Rattus norvegicus
actggtgctcagctgcagttgcctg

SEQ ID NO: 588313 - DNA, 25 bp, Rattus norvegicus
cccggagcaagagctcggttcagcc

SEQ ID NO: 588314 - DNA, 25 bp, Rattus norvegicus
ggaggacgatgccttcaccaacgtg

SEQ ID NO: 588315 - DNA, 25 bp, Rattus norvegicus
cttctgattagataccgggctcctg

SEQ ID NO: 588316 - DNA, 25 bp, Rattus norvegicus
cactaccgccttggagcagctgcag

SEQ ID NO: 588317 - DNA, 25 bp, Rattus norvegicus
ccagctttgctgtgtccggatcaca

SEQ ID NO: 588318 - DNA, 25 bp, Rattus norvegicus
gtgagtatcatggacaccacgcacg

SEQ ID NO: 588319 - DNA, 25 bp, Rattus norvegicus
cgcagaactactgcgctttggagca

SEQ ID NO: 588320 - DNA, 25 bp, Rattus norvegicus
tctccaggcagaactcgcagaacta

SEQ ID NO: 588321 - DNA, 25 bp, Rattus norvegicus
gacgcgctcttctggcacaatcaca

SEQ ID NO: 588322 - DNA, 25 bp, Rattus norvegicus
gcgctcttctggcacaatcacaatc

SEQ ID NO: 588323 - DNA, 25 bp, Rattus norvegicus
cagacgcgctcttctggcacaatca

SEQ ID NO: 588324 - DNA, 25 bp, Rattus norvegicus
cgaggatgtcgaccccagacgcgct

SEQ ID NO: 588325 - DNA, 25 bp, Rattus norvegicus
cgagcggtcacgaggatgtcgaccc

SEQ ID NO: 588326 - DNA, 25 bp, Rattus norvegicus
tcagtacgagcggtcacgaggatgt

SEQ ID NO: 588327 - DNA, 25 bp, Rattus norvegicus
ctctcagtacgagcggtcacgagga

SEQ ID NO: 588328 - DNA, 25 bp, Rattus norvegicus
cccactcacggacgccggcgctcgc

SEQ ID NO: 588329 - DNA, 25 bp, Rattus norvegicus
ctagaggttgcagagcagccgccag

SEQ ID NO: 588330 - DNA, 25 bp, Rattus norvegicus
cccgagctagaggttgcagagcagc

SEQ ID NO: 588331 - DNA, 25 bp, Rattus norvegicus
cctgttggagggtccccgagctaga

SEQ ID NO: 588332 - DNA, 25 bp, Rattus norvegicus
gcagtctgggctcagccgcgctccg

SEQ ID NO: 588333 - DNA, 25 bp, Rattus norvegicus
ttccgccgctctcagtacgagcggt

SEQ ID NO: 588334 - DNA, 25 bp, Rattus norvegicus
tctggcacaatcacaatcacctcgg

SEQ ID NO: 588335 - DNA, 25 bp, Rattus norvegicus
aaggtcgtacccgtagacactggcg

SEQ ID NO: 588336 - DNA, 25 bp, Rattus norvegicus
tgatctctcggagcgcgtgcttcat

SEQ ID NO: 588337 - DNA, 25 bp, Rattus norvegicus
cgcgtgcttcatgcttcgtgcgtca

SEQ ID NO: 588338 - DNA, 25 bp, Rattus norvegicus
ttcatgcttcgtgcgtcactcagca

SEQ ID NO: 588339 - DNA, 25 bp, Rattus norvegicus
tcactcagcacaatcttcttcacgg

SEQ ID NO: 588340 - DNA, 25 bp, Rattus norvegicus
ttcttcacggctaccttccggcaag

SEQ ID NO: 588341 - DNA, 25 bp, Rattus norvegicus
ttccggcaagccctgctgtccgtag

SEQ ID NO: 588342 - DNA, 25 bp, Rattus norvegicus
aagccctgctgtccgtagccgacag

SEQ ID NO: 588343 - DNA, 25 bp, Rattus norvegicus
actttgacgatgttgtcgtggtcca

SEQ ID NO: 588344 - DNA, 25 bp, Rattus norvegicus
ccaggcgccggatgattttgatctc

SEQ ID NO: 588345 - DNA, 25 bp, Rattus norvegicus
gtagccgacagcaccagcccgttga

SEQ ID NO: 588346 - DNA, 25 bp, Rattus norvegicus
gttggaagtcagtgaagcgcccacc

SEQ ID NO: 588347 - DNA, 25 bp, Rattus norvegicus
gtgaagcgcccaccaaggtcgtacc

SEQ ID NO: 588348 - DNA, 25 bp, Rattus norvegicus
tgattttgatctctcggagcgcgtg

SEQ ID NO: 588349 - DNA, 25 bp, Rattus norvegicus
gcgaggctaacccttgaacagagaa

SEQ ID NO: 588350 - DNA, 25 bp, Rattus norvegicus
aagtcccggtccttgcagttcccag

SEQ ID NO: 588351 - DNA, 25 bp, Rattus norvegicus
ccatccgggtttctcaaaggaatcg

SEQ ID NO: 588352 - DNA, 25 bp, Rattus norvegicus
cgctgggcttccgattcttttctga

SEQ ID NO: 588353 - DNA, 25 bp, Rattus norvegicus
ttttctgatggagatcaagccggcc

SEQ ID NO: 588354 - DNA, 25 bp, Rattus norvegicus
tcgggactgagcagtgatgtcagcc

SEQ ID NO: 588355 - DNA, 25 bp, Rattus norvegicus
aaccgttgcgggctcagtgcagtcc

SEQ ID NO: 588356 - DNA, 25 bp, Rattus norvegicus
cagcgaggggaaacagctaggtcct

SEQ ID NO: 588357 - DNA, 25 bp, Rattus norvegicus
cagggccaccgacccacagaagagg

SEQ ID NO: 588358 - DNA, 25 bp, Rattus norvegicus
ggagaggctaacagggaacagaacc

SEQ ID NO: 588359 - DNA, 25 bp, Rattus norvegicus
tagcacacacccacggaagagctca

SEQ ID NO: 588360 - DNA, 25 bp, Rattus norvegicus
tccgaaagtcgcgagttgggtgtct

SEQ ID NO: 588361 - DNA, 25 bp, Rattus norvegicus
tccaaatctgaactcgagaaccgcc

SEQ ID NO: 588362 - DNA, 25 bp, Rattus norvegicus
agggagccactcaccgaggcagacg

SEQ ID NO: 588363 - DNA, 25 bp, Rattus norvegicus
cggcttccgagccagcgacctcgcg

SEQ ID NO: 588364 - DNA, 25 bp, Rattus norvegicus
gagtctggagcgaagagcctgcact

SEQ ID NO: 588365 - DNA, 25 bp, Rattus norvegicus
actgagtgcaccagactacgaccga

SEQ ID NO: 588366 - DNA, 25 bp, Rattus norvegicus
gcaccagactacgaccgaaacgtta

SEQ ID NO: 588367 - DNA, 25 bp, Rattus norvegicus
cgaaacgttataccgtgacaccagc

SEQ ID NO: 588368 - DNA, 25 bp, Rattus norvegicus
ttataccgtgacaccagctcccaga

SEQ ID NO: 588369 - DNA, 25 bp, Rattus norvegicus
gtgacaccagctcccagagccaaaa

SEQ ID NO: 588370 - DNA, 25 bp, Rattus norvegicus
tcccagagccaaaattcaaactgtc

SEQ ID NO: 588371 - DNA, 25 bp, Rattus norvegicus
aggcgcagaagcgtccgcccaacgg

SEQ ID NO: 588372 - DNA, 25 bp, Rattus norvegicus
aacggcgcagactccgctagcgcaa

SEQ ID NO: 588373 - DNA, 25 bp, Rattus norvegicus
ctccgctagcgcaagtcaaagtctg

SEQ ID NO: 588374 - DNA, 25 bp, Rattus norvegicus
ctagcgcaagtcaaagtctgggcgg

SEQ ID NO: 588375 - DNA, 25 bp, Rattus norvegicus
acctactgagcgatgcctcctcggg

SEQ ID NO: 588376 - DNA, 25 bp, Rattus norvegicus
gctggggactgagtgcaccagacta

SEQ ID NO: 588377 - DNA, 25 bp, Rattus norvegicus
cgtgatccggaagctactgtttgtt

SEQ ID NO: 588378 - DNA, 25 bp, Rattus norvegicus
cgacctatttgtttgccgctaagcg

SEQ ID NO: 588379 - DNA, 25 bp, Rattus norvegicus
cgaggctctagatgggcgacctatt

SEQ ID NO: 588380 - DNA, 25 bp, Rattus norvegicus
cgacaaggagacattcgaggctcta

SEQ ID NO: 588381 - DNA, 25 bp, Rattus norvegicus
cgctgtcttacggactggatggtca

SEQ ID NO: 588382 - DNA, 25 bp, Rattus norvegicus
gcgcagccatacttcccggaacgta

SEQ ID NO: 588383 - DNA, 25 bp, Rattus norvegicus
gacccgaactgtaggcgcagccata

SEQ ID NO: 588384 - DNA, 25 bp, Rattus norvegicus
gccaccgtacggacttgactgacaa

SEQ ID NO: 588385 - DNA, 25 bp, Rattus norvegicus
aatgcggccatattgccctctggcg

SEQ ID NO: 588386 - DNA, 25 bp, Rattus norvegicus
tgcgtcccaacgtcgaagcaaatgc

SEQ ID NO: 588387 - DNA, 25 bp, Rattus norvegicus
gacgctaatcagctgacgacatctg

SEQ ID NO: 588388 - DNA, 25 bp, Rattus norvegicus
ggagcccgcctgatgacgctaatca

SEQ ID NO: 588389 - DNA, 25 bp, Rattus norvegicus
ggttggcaaccgctgcctattggca

SEQ ID NO: 588390 - DNA, 25 bp, Rattus norvegicus
ttgttgcctaggaacgcacggagcc

SEQ ID NO: 588391 - DNA, 25 bp, Rattus norvegicus
aggcgctgcaggttcccgacaaacc

SEQ ID NO: 588392 - DNA, 25 bp, Rattus norvegicus
caccggcctagagccgaggaagctg

SEQ ID NO: 588393 - DNA, 25 bp, Rattus norvegicus
ttcccatgggtccaccggcctagag

SEQ ID NO: 588394 - DNA, 25 bp, Rattus norvegicus
tcgcgcaagcgggatccttcccatg

SEQ ID NO: 588395 - DNA, 25 bp, Rattus norvegicus
ctactgttttggaagaggctgcggt

SEQ ID NO: 588396 - DNA, 25 bp, Rattus norvegicus
cgcagaggcgacaactactgttttg

SEQ ID NO: 588397 - DNA, 25 bp, Rattus norvegicus
cacacaggtgctggtcctagtcgga

SEQ ID NO: 588398 - DNA, 25 bp, Rattus norvegicus
cgcaggcgcacagtcaagagagacc

SEQ ID NO: 588399 - DNA, 25 bp, Rattus norvegicus
caaaggcaagcattgggtttccggt

SEQ ID NO: 588400 - DNA, 25 bp, Rattus norvegicus
cgtgacaaggctgcacacacaggtg

SEQ ID NO: 588401 - DNA, 25 bp, Rattus norvegicus
ggcacgcgtgacaaggctgcacaca

SEQ ID NO: 588402 - DNA, 25 bp, Rattus norvegicus
tgaaaccgcaatacgcaggcgcgga

SEQ ID NO: 588403 - DNA, 25 bp, Rattus norvegicus
cctggtgtcaagctggtgagatagc

SEQ ID NO: 588404 - DNA, 25 bp, Rattus norvegicus
gggactaaccaaccgccgcagaggc

SEQ ID NO: 588405 - DNA, 25 bp, Rattus norvegicus
tcggcgccagaacgtctcacagata

SEQ ID NO: 588406 - DNA, 25 bp, Rattus norvegicus
ctctgcagagggaagtacacagctg

SEQ ID NO: 588407 - DNA, 25 bp, Rattus norvegicus
tccctgtgctggcaggttatttaga

SEQ ID NO: 588408 - DNA, 25 bp, Rattus norvegicus
ccacacttggcatttccggggtgaa

SEQ ID NO: 588409 - DNA, 25 bp, Rattus norvegicus
aggctgccgtttcttgctgggagaa

SEQ ID NO: 588410 - DNA, 25 bp, Rattus norvegicus
caagaatctacagtgccggagcgtg

SEQ ID NO: 588411 - DNA, 25 bp, Rattus norvegicus
agtcgtcagtgcacagtctgtcggc

SEQ ID NO: 588412 - DNA, 25 bp, Rattus norvegicus
ctcacagataagatccggaagggca

SEQ ID NO: 588413 - DNA, 25 bp, Rattus norvegicus
atcctcggctgtgcagctctgcaga

SEQ ID NO: 588414 - DNA, 25 bp, Rattus norvegicus
agccctgtgcaaagaccgttccgtc

SEQ ID NO: 588415 - DNA, 25 bp, Rattus norvegicus
gttccgtctgcacacaacatcaaga

SEQ ID NO: 588416 - DNA, 25 bp, Rattus norvegicus
catcaagatggacggtgtgttactc

SEQ ID NO: 588417 - DNA, 25 bp, Rattus norvegicus
tgacagcctcgtggcggaatccgat

SEQ ID NO: 588418 - DNA, 25 bp, Rattus norvegicus
cgtgttcagccatcccgtcagtatg

SEQ ID NO: 588419 - DNA, 25 bp, Rattus norvegicus
aggtcattcctctcccagggctgtg

SEQ ID NO: 588420 - DNA, 25 bp, Rattus norvegicus
gaagcttggtctcagccacgcgaga

SEQ ID NO: 588421 - DNA, 25 bp, Rattus norvegicus
gatgcacacggaaaccagaagcttg

SEQ ID NO: 588422 - DNA, 25 bp, Rattus norvegicus
gcggtatcagaaacccgaggtggtc

SEQ ID NO: 588423 - DNA, 25 bp, Rattus norvegicus
ttactcaactctgcgggaagccaag

SEQ ID NO: 588424 - DNA, 25 bp, Rattus norvegicus
cactgtcgcggtggtgaattcttac

SEQ ID NO: 588425 - DNA, 25 bp, Rattus norvegicus
accagagttggctttgctcctgacc

SEQ ID NO: 588426 - DNA, 25 bp, Rattus norvegicus
cagcagtttctgtgcagtttccaac

SEQ ID NO: 588427 - DNA, 25 bp, Rattus norvegicus
tttgcattaaggagaaacaccgcgg

SEQ ID NO: 588428 - DNA, 25 bp, Rattus norvegicus
tcggcttctgggctctacgaacagg

SEQ ID NO: 588429 - DNA, 25 bp, Rattus norvegicus
cccgtggaataactgagcttcgtca

SEQ ID NO: 588430 - DNA, 25 bp, Rattus norvegicus
tgaagctgtgagagacccgtggaat

SEQ ID NO: 588431 - DNA, 25 bp, Rattus norvegicus
ggcgccgcccacactattaaggctg

SEQ ID NO: 588432 - DNA, 25 bp, Rattus norvegicus
ggaaagcacggtcgccagcagtttc

SEQ ID NO: 588433 - DNA, 25 bp, Rattus norvegicus
gccagggcaagtggcctccgagacc

SEQ ID NO: 588434 - DNA, 25 bp, Rattus norvegicus
gctcttctccgaaaggccagggcaa

SEQ ID NO: 588435 - DNA, 25 bp, Rattus norvegicus
ccgagcaggaaaaccgggtctcgca

SEQ ID NO: 588436 - DNA, 25 bp, Rattus norvegicus
cgaggaggagaacacagacaatgca

SEQ ID NO: 588437 - DNA, 25 bp, Rattus norvegicus
acagacaatgcagtggggaaggatt

SEQ ID NO: 588438 - DNA, 25 bp, Rattus norvegicus
ttcgttgggatgtagaagcactgac

SEQ ID NO: 588439 - DNA, 25 bp, Rattus norvegicus
aagcactgacgaagggtccgcagga

SEQ ID NO: 588440 - DNA, 25 bp, Rattus norvegicus
taaatgcacattacctcgcagcgac

SEQ ID NO: 588441 - DNA, 25 bp, Rattus norvegicus
cgcagcctccaggacggcttgctaa

SEQ ID NO: 588442 - DNA, 25 bp, Rattus norvegicus
cgtaaggttgtgagacttcccgccg

SEQ ID NO: 588443 - DNA, 25 bp, Rattus norvegicus
tcccgccgggaagcaacaatagagg

SEQ ID NO: 588444 - DNA, 25 bp, Rattus norvegicus
tagaggctccagaagccgagcagga

SEQ ID NO: 588445 - DNA, 25 bp, Rattus norvegicus
gcccagcgcagaaaagaagtgagaa

SEQ ID NO: 588446 - DNA, 25 bp, Rattus norvegicus
ggcttgctaacggatgctcttctcc

SEQ ID NO: 588447 - DNA, 25 bp, Rattus norvegicus
cgcgaactccaggagaggtactttt

SEQ ID NO: 588448 - DNA, 25 bp, Rattus norvegicus
aactagcgacactgcggtcccgctg

SEQ ID NO: 588449 - DNA, 25 bp, Rattus norvegicus
ccgcagggataaactagcgacactg

SEQ ID NO: 588450 - DNA, 25 bp, Rattus norvegicus
tggacgcccgcagggataaactagc

SEQ ID NO: 588451 - DNA, 25 bp, Rattus norvegicus
gtttgaatgaaagtaccacacaccc

SEQ ID NO: 588452 - DNA, 25 bp, Rattus norvegicus
tcactgacgcccgaaccgagaactc

SEQ ID NO: 588453 - DNA, 25 bp, Rattus norvegicus
tgattggtcacaccttcactgacgc

SEQ ID NO: 588454 - DNA, 25 bp, Rattus norvegicus
cgtctcgggactctgattggtcaca

SEQ ID NO: 588455 - DNA, 25 bp, Rattus norvegicus
ttgcataatttattcccgtctcggg

SEQ ID NO: 588456 - DNA, 25 bp, Rattus norvegicus
tctagtcatctgacccatcgccaga

SEQ ID NO: 588457 - DNA, 25 bp, Rattus norvegicus
ctgtcacaccgcgaactccaggaga

SEQ ID NO: 588458 - DNA, 25 bp, Rattus norvegicus
gacctgcagtgaagccgggactcgc

SEQ ID NO: 588459 - DNA, 25 bp, Rattus norvegicus
tgtcctcgcccggacctgcagtgaa

SEQ ID NO: 588460 - DNA, 25 bp, Rattus norvegicus
ccatcgccagatggatatttgcata

SEQ ID NO: 588461 - DNA, 25 bp, Rattus norvegicus
gctcagtgctgtcccttgggctgct

SEQ ID NO: 588462 - DNA, 25 bp, Rattus norvegicus
ctactcctcggatctcgttccttgg

SEQ ID NO: 588463 - DNA, 25 bp, Rattus norvegicus
tcgttccttgggcaggaagtctcgc

SEQ ID NO: 588464 - DNA, 25 bp, Rattus norvegicus
agtctcgcgagaggtcgaggtctca

SEQ ID NO: 588465 - DNA, 25 bp, Rattus norvegicus
cgaggtctcatgaattctcccagta

SEQ ID NO: 588466 - DNA, 25 bp, Rattus norvegicus
tgaattctcccagtagccttcgcgc

SEQ ID NO: 588467 - DNA, 25 bp, Rattus norvegicus
cttcctcttcctgttagcggccaga

SEQ ID NO: 588468 - DNA, 25 bp, Rattus norvegicus
ccagaggtgagtgttactcggcgtc

SEQ ID NO: 588469 - DNA, 25 bp, Rattus norvegicus
cgccatctcggccttgggagcgctg

SEQ ID NO: 588470 - DNA, 25 bp, Rattus norvegicus
tcccggcatctgagctcgaagggcc

SEQ ID NO: 588471 - DNA, 25 bp, Rattus norvegicus
tcgaagggccatgggtcctcatcac

SEQ ID NO: 588472 - DNA, 25 bp, Rattus norvegicus
ggtcctcatcacaagcggccgtgct

SEQ ID NO: 588473 - DNA, 25 bp, Rattus norvegicus
gctcggatcagaccgggacgcccga

SEQ ID NO: 588474 - DNA, 25 bp, Rattus norvegicus
gacgcccgaggcttggcttctgcgt

SEQ ID NO: 588475 - DNA, 25 bp, Rattus norvegicus
tgacgctgggcggactattcccagt

SEQ ID NO: 588476 - DNA, 25 bp, Rattus norvegicus
aacgtcttgcgcctgtttgcggtga

SEQ ID NO: 588477 - DNA, 25 bp, Rattus norvegicus
actattcccagtgcacgcgcgggga

SEQ ID NO: 588478 - DNA, 25 bp, Rattus norvegicus
gcaccggctggaagcgatgctctac

SEQ ID NO: 588479 - DNA, 25 bp, Rattus norvegicus
tgctctacgcgctggaccgcgtcaa

SEQ ID NO: 588480 - DNA, 25 bp, Rattus norvegicus
tcggctagctccgtgtccatcatgg

SEQ ID NO: 588481 - DNA, 25 bp, Rattus norvegicus
ggctgctcgacacctgctcgcggga

SEQ ID NO: 588482 - DNA, 25 bp, Rattus norvegicus
cgcgggacacctacgctttggagca

SEQ ID NO: 588483 - DNA, 25 bp, Rattus norvegicus
acctacgctttggagcaggcgctga

SEQ ID NO: 588484 - DNA, 25 bp, Rattus norvegicus
gctgagcttcgtgcaggcgctcatc

SEQ ID NO: 588485 - DNA, 25 bp, Rattus norvegicus
ttcgtgcaggcgctcatccgaggcc

SEQ ID NO: 588486 - DNA, 25 bp, Rattus norvegicus
cgacgaggccagtgtgcgctgccct

SEQ ID NO: 588487 - DNA, 25 bp, Rattus norvegicus
gtccatcatggtggccaacgtcttg

SEQ ID NO: 588488 - DNA, 25 bp, Rattus norvegicus
gcgtcaacgctgacccggagctgct

SEQ ID NO: 588489 - DNA, 25 bp, Rattus norvegicus
accttgttggtgaggtgagaagcca

SEQ ID NO: 588490 - DNA, 25 bp, Rattus norvegicus
gcccgtccgctcaccttgttggtga

SEQ ID NO: 588491 - DNA, 25 bp, Rattus norvegicus
tgagaagccaggtaacaggtgcaaa

SEQ ID NO: 588492 - DNA, 25 bp, Rattus norvegicus
gccaggtaacaggtgcaaaaggtga

SEQ ID NO: 588493 - DNA, 25 bp, Rattus norvegicus
ggtaacaggtgcaaaaggtgaagcc

SEQ ID NO: 588494 - DNA, 25 bp, Rattus norvegicus
agcagggaccgcctcaagttcatca

SEQ ID NO: 588495 - DNA, 25 bp, Rattus norvegicus
gggaccgcctcaagttcatcagtca

SEQ ID NO: 588496 - DNA, 25 bp, Rattus norvegicus
gttcatcagtcagctctcccggctt

SEQ ID NO: 588497 - DNA, 25 bp, Rattus norvegicus
tgccacgaggctccgctccaccaat

SEQ ID NO: 588498 - DNA, 25 bp, Rattus norvegicus
gctccaccaatcagcgggccgctcg

SEQ ID NO: 588499 - DNA, 25 bp, Rattus norvegicus
ttaaaggggctacgtccgcaagagc

SEQ ID NO: 588500 - DNA, 25 bp, Rattus norvegicus
ggctacgtccgcaagagctccacgt

SEQ ID NO: 588501 - DNA, 25 bp, Rattus norvegicus
gcctcaagttcatcagtcagctctc

SEQ ID NO: 588502 - DNA, 25 bp, Rattus norvegicus
cggctcgcagcccacgcgcagtcac

SEQ ID NO: 588503 - DNA, 25 bp, Rattus norvegicus
cggacattgccctgggcgtcttggt

SEQ ID NO: 588504 - DNA, 25 bp, Rattus norvegicus
gcctcccggaagtgcggacattgcc

SEQ ID NO: 588505 - DNA, 25 bp, Rattus norvegicus
acctgcaattggctgctggcagccc

SEQ ID NO: 588506 - DNA, 25 bp, Rattus norvegicus
tgtcttgacctgcaattggctgctg

SEQ ID NO: 588507 - DNA, 25 bp, Rattus norvegicus
acgtgtatggctttgtcagtgtctt

SEQ ID NO: 588508 - DNA, 25 bp, Rattus norvegicus
ttgtcagcggcttgacgtccccaga

SEQ ID NO: 588509 - DNA, 25 bp, Rattus norvegicus
tgcgccccttggctgacgtgtatgg

SEQ ID NO: 588510 - DNA, 25 bp, Rattus norvegicus
cgtcatcattacgttctgtgcgccc

SEQ ID NO: 588511 - DNA, 25 bp, Rattus norvegicus
tgagctctgtgaacgtcatcattac

SEQ ID NO: 588512 - DNA, 25 bp, Rattus norvegicus
ctccggaagtgtcatgagctctgtg

SEQ ID NO: 588513 - DNA, 25 bp, Rattus norvegicus
aggcgctgactacagcgcagctccg

SEQ ID NO: 588514 - DNA, 25 bp, Rattus norvegicus
gttatcaggcgctgactacagcgca

SEQ ID NO: 588515 - DNA, 25 bp, Rattus norvegicus
tggctttgtcagtgtcttgacctgc

SEQ ID NO: 588516 - DNA, 25 bp, Rattus norvegicus
agtgactctcgcagcggttgtcagc

SEQ ID NO: 588517 - DNA, 25 bp, Rattus norvegicus
ggaggcctaagccagcgtgcacacc

SEQ ID NO: 588518 - DNA, 25 bp, Rattus norvegicus
ccgtagtgtgttgcgtgtctgacat

SEQ ID NO: 588519 - DNA, 25 bp, Rattus norvegicus
caggagccgctgagctacggaacca

SEQ ID NO: 588520 - DNA, 25 bp, Rattus norvegicus
tcttctcacttcagctcttgcgtct

SEQ ID NO: 588521 - DNA, 25 bp, Rattus norvegicus
tggcgcgcgcttagccgttcggtcc

SEQ ID NO: 588522 - DNA, 25 bp, Rattus norvegicus
atttcccagaagcatgcgcgctcgg

SEQ ID NO: 588523 - DNA, 25 bp, Rattus norvegicus
acagccgaggttggctggacaaatg

SEQ ID NO: 588524 - DNA, 25 bp, Rattus norvegicus
tacggaaccatggaggcctaagcca

SEQ ID NO: 588525 - DNA, 25 bp, Rattus norvegicus
gcgccgctgacacaggtgggcttcc

SEQ ID NO: 588526 - DNA, 25 bp, Rattus norvegicus
ccgggtgtgcagaaccaagtgaatt

SEQ ID NO: 588527 - DNA, 25 bp, Rattus norvegicus
tgaattggacccttggccatcccgc

SEQ ID NO: 588528 - DNA, 25 bp, Rattus norvegicus
ggaatggctggagcttccggacact

SEQ ID NO: 588529 - DNA, 25 bp, Rattus norvegicus
tggagcttccggacactcgggacag

SEQ ID NO: 588530 - DNA, 25 bp, Rattus norvegicus
atggaacgccggaaggactacattt

SEQ ID NO: 588531 - DNA, 25 bp, Rattus norvegicus
gcgcagagctaacctgatcttcctg

SEQ ID NO: 588532 - DNA, 25 bp, Rattus norvegicus
agacgcgcagagctaacctgatctc

SEQ ID NO: 588533 - DNA, 25 bp, Rattus norvegicus
gttaacgtaaggacagttccctgca

SEQ ID NO: 588534 - DNA, 25 bp, Rattus norvegicus
agacgcgcagagctaacctgatctt

SEQ ID NO: 588535 - DNA, 25 bp, Rattus norvegicus
gcagagctaacctgatcttcccgta

SEQ ID NO: 588536 - DNA, 25 bp, Rattus norvegicus
cctgatcttcccgtaacagttaacg

SEQ ID NO: 588537 - DNA, 25 bp, Rattus norvegicus
acggtaacgacagttcctacagacg

SEQ ID NO: 588538 - DNA, 25 bp, Rattus norvegicus
cagttaacgtaaggacagttccctg

SEQ ID NO: 588539 - DNA, 25 bp, Rattus norvegicus
acgcgcagagctaacctgatcttcc

SEQ ID NO: 588540 - DNA, 25 bp, Rattus norvegicus
cctgcagacgcgcagagctaacctg

SEQ ID NO: 588541 - DNA, 25 bp, Rattus norvegicus
acctgatcttcctgtaccagttaac

SEQ ID NO: 588542 - DNA, 25 bp, Rattus norvegicus
acagacgcgcagagctaacctgatc

SEQ ID NO: 588543 - DNA, 25 bp, Rattus norvegicus
ctgtaccagttaacggtaacgacag

SEQ ID NO: 588544 - DNA, 25 bp, Rattus norvegicus
gctaacctgatcttcccgtaccagt

SEQ ID NO: 588545 - DNA, 25 bp, Rattus norvegicus
ctcattgttccgcagccggggaaac

SEQ ID NO: 588546 - DNA, 25 bp, Rattus norvegicus
tcattaaggtttacaggtccgccgc

SEQ ID NO: 588547 - DNA, 25 bp, Rattus norvegicus
agacggctcacggacggtccctagt

SEQ ID NO: 588548 - DNA, 25 bp, Rattus norvegicus
cccagtgtgtctggcttggtgcctg

SEQ ID NO: 588549 - DNA, 25 bp, Rattus norvegicus
ttggtgcctggcaccgcgattcaga

SEQ ID NO: 588550 - DNA, 25 bp, Rattus norvegicus
gggttcctgagagcatctcccagtg

SEQ ID NO: 588551 - DNA, 25 bp, Rattus norvegicus
gggaactctcctggcacctgcctga

SEQ ID NO: 588552 - DNA, 25 bp, Rattus norvegicus
agcggcgcagacaggcaagattgca

SEQ ID NO: 588553 - DNA, 25 bp, Rattus norvegicus
aatggcctcattgttccgcagccgg

SEQ ID NO: 588554 - DNA, 25 bp, Rattus norvegicus
gaatgaataacgacacaatggcctc

SEQ ID NO: 588555 - DNA, 25 bp, Rattus norvegicus
tgggctctcaggaatgaataacgac

SEQ ID NO: 588556 - DNA, 25 bp, Rattus norvegicus
gctctcttgtgtgaatgggctctca

SEQ ID NO: 588557 - DNA, 25 bp, Rattus norvegicus
gcaagattgcagtcattaaggttta

SEQ ID NO: 588558 - DNA, 25 bp, Rattus norvegicus
ccagcctgcgaagggatgcagccct

SEQ ID NO: 588559 - DNA, 25 bp, Rattus norvegicus
gaaatttgtgcaatgagagcgtaga

SEQ ID NO: 588560 - DNA, 25 bp, Rattus norvegicus
gagccctgggcacattcgctcgctg

SEQ ID NO: 588561 - DNA, 25 bp, Rattus norvegicus
ctcggcgcacagaggatcttgtccc

SEQ ID NO: 588562 - DNA, 25 bp, Rattus norvegicus
cggagagctgcctgagacgcagcca

SEQ ID NO: 588563 - DNA, 25 bp, Rattus norvegicus
ccaacatcttgttctactttgtaaa

SEQ ID NO: 588564 - DNA, 25 bp, Rattus norvegicus
gcgcaggaggaaagaccagagactc

SEQ ID NO: 588565 - DNA, 25 bp, Rattus norvegicus
cccagatacgcaagattgaagcagc

SEQ ID NO: 588566 - DNA, 25 bp, Rattus norvegicus
ttgaagcagcctaaccagacctttc

SEQ ID NO: 588567 - DNA, 25 bp, Rattus norvegicus
cagacctttctgtggattaaaagaa

SEQ ID NO: 588568 - DNA, 25 bp, Rattus norvegicus
aaaggggatgtaactcgtggatacg

SEQ ID NO: 588569 - DNA, 25 bp, Rattus norvegicus
ggccagcagcttatgcgagcagccc

SEQ ID NO: 588570 - DNA, 25 bp, Rattus norvegicus
tgatgtggtaaaagataactctttg

SEQ ID NO: 588571 - DNA, 25 bp, Rattus norvegicus
tcccgggcgcgacgaagagagtctc

SEQ ID NO: 588572 - DNA, 25 bp, Rattus norvegicus
agagactctaaaacacccagatacg

SEQ ID NO: 588573 - DNA, 25 bp, Rattus norvegicus
tgcggtacccactagacccagagga

SEQ ID NO: 588574 - DNA, 25 bp, Rattus norvegicus
ccattactccgaggccacaggaatg

SEQ ID NO: 588575 - DNA, 25 bp, Rattus norvegicus
cccgcaagtcgaggtgactaaaaga

SEQ ID NO: 588576 - DNA, 25 bp, Rattus norvegicus
ggacacccggctgactaaagcacta

SEQ ID NO: 588577 - DNA, 25 bp, Rattus norvegicus
gacaagggatgctcacctcggggtt

SEQ ID NO: 588578 - DNA, 25 bp, Rattus norvegicus
tacactgcgcggctcccaacgagag

SEQ ID NO: 588579 - DNA, 25 bp, Rattus norvegicus
ggaacccggcaccagacatcggcta

SEQ ID NO: 588580 - DNA, 25 bp, Rattus norvegicus
gaaaggaatcttgctcgcgagcttc

SEQ ID NO: 588581 - DNA, 25 bp, Rattus norvegicus
agcaactgctcgttgcagcaaacga

SEQ ID NO: 588582 - DNA, 25 bp, Rattus norvegicus
cgcgtggacacacactcgcgggttc

SEQ ID NO: 588583 - DNA, 25 bp, Rattus norvegicus
tgcctgtctagacgagagccattca

SEQ ID NO: 588584 - DNA, 25 bp, Rattus norvegicus
cggcagaatcaccacggcgtagaac

SEQ ID NO: 588585 - DNA, 25 bp, Rattus norvegicus
tcggtcattcttaaagccggcagaa

SEQ ID NO: 588586 - DNA, 25 bp, Rattus norvegicus
tctataatcgagagcacgtcacgta

SEQ ID NO: 588587 - DNA, 25 bp, Rattus norvegicus
agactctgacagcagcgcggccaag

SEQ ID NO: 588588 - DNA, 25 bp, Rattus norvegicus
gtgacggtgttttattacttgggca

SEQ ID NO: 588589 - DNA, 25 bp, Rattus norvegicus
attacttgggcacccgaaccttgcg

SEQ ID NO: 588590 - DNA, 25 bp, Rattus norvegicus
gaaccttgcgctgtcttttcttgga

SEQ ID NO: 588591 - DNA, 25 bp, Rattus norvegicus
ttttcttggacattgagaaaggggc

SEQ ID NO: 588592 - DNA, 25 bp, Rattus norvegicus
cattttgggcagtgacggtgtttta

SEQ ID NO: 588593 - DNA, 25 bp, Rattus norvegicus
gagaggcgaccgcacacatccgggc

SEQ ID NO: 588594 - DNA, 25 bp, Rattus norvegicus
ctgtcaggggtctgcttctgcacct

SEQ ID NO: 588595 - DNA, 25 bp, Rattus norvegicus
tgcttctgcacctcggctgcctagg

SEQ ID NO: 588596 - DNA, 25 bp, Rattus norvegicus
gcggcagccatgcaaccaaaggagg

SEQ ID NO: 588597 - DNA, 25 bp, Rattus norvegicus
agcctctcggcagccacaggtggtt

SEQ ID NO: 588598 - DNA, 25 bp, Rattus norvegicus
agtttttgctgtacttctgccggga

SEQ ID NO: 588599 - DNA, 25 bp, Rattus norvegicus
ccacaggtggttcctgccaaaagtt

SEQ ID NO: 588600 - DNA, 25 bp, Rattus norvegicus
aaggtggaggggatcccgcacttct

SEQ ID NO: 588601 - DNA, 25 bp, Rattus norvegicus
cgggccctgcatcctcggctctccc

SEQ ID NO: 588602 - DNA, 25 bp, Rattus norvegicus
agcacgtccgggactggacagatcc

SEQ ID NO: 588603 - DNA, 25 bp, Rattus norvegicus
gactggacagatccgggccctgcat

SEQ ID NO: 588604 - DNA, 25 bp, Rattus norvegicus
cgtggtaagactgcagaggagagtc

SEQ ID NO: 588605 - DNA, 25 bp, Rattus norvegicus
gggtcaacatagatcccgcgttcca

SEQ ID NO: 588606 - DNA, 25 bp, Rattus norvegicus
cggctctcccgggtcaacatagatc

SEQ ID NO: 588607 - DNA, 25 bp, Rattus norvegicus
actgcagaggagagtctggagaccg

SEQ ID NO: 588608 - DNA, 25 bp, Rattus norvegicus
ccgctgaggccgctggcaggttccc

SEQ ID NO: 588609 - DNA, 25 bp, Rattus norvegicus
tgcgctggccttgcccgctgaggcc

SEQ ID NO: 588610 - DNA, 25 bp, Rattus norvegicus
cgttccagggctgcgctggccttgc

SEQ ID NO: 588611 - DNA, 25 bp, Rattus norvegicus
agatcccgcgttccagggctgcgct

SEQ ID NO: 588612 - DNA, 25 bp, Rattus norvegicus
catagatcccgcgttccagggctgc

SEQ ID NO: 588613 - DNA, 25 bp, Rattus norvegicus
gtcaacatagatcccgcgttccagg

SEQ ID NO: 588614 - DNA, 25 bp, Rattus norvegicus
gcagaagcacgtccgggactggaca

SEQ ID NO: 588615 - DNA, 25 bp, Rattus norvegicus
gtggttcctgctgcctctgcctggc

SEQ ID NO: 588616 - DNA, 25 bp, Rattus norvegicus
aatgacaacctctccctggctgcgg

SEQ ID NO: 588617 - DNA, 25 bp, Rattus norvegicus
ctctccctggctgcggcaggctccc

SEQ ID NO: 588618 - DNA, 25 bp, Rattus norvegicus
caggctcccggagcagcgctgccgt

SEQ ID NO: 588619 - DNA, 25 bp, Rattus norvegicus
tgccgtgtggacgcccagcctcgga

SEQ ID NO: 588620 - DNA, 25 bp, Rattus norvegicus
cccagcctcggaccctggcggcgct

SEQ ID NO: 588621 - DNA, 25 bp, Rattus norvegicus
gctcaggacacagcccgggcacgag

SEQ ID NO: 588622 - DNA, 25 bp, Rattus norvegicus
agcccgggcacgagcacgacgtccc

SEQ ID NO: 588623 - DNA, 25 bp, Rattus norvegicus
tagggaggtgatccgggctccgtcc

SEQ ID NO: 588624 - DNA, 25 bp, Rattus norvegicus
cctccggcgcagagtggttcctgct

SEQ ID NO: 588625 - DNA, 25 bp, Rattus norvegicus
cgcagagtggttcctgctgcctctg

SEQ ID NO: 588626 - DNA, 25 bp, Rattus norvegicus
ctctgcctggcaccgcggctgaatc

SEQ ID NO: 588627 - DNA, 25 bp, Rattus norvegicus
gcccagcgcgaatcaatgacaacct

SEQ ID NO: 588628 - DNA, 25 bp, Rattus norvegicus
gcgaatcaatgacaacctctccctg

SEQ ID NO: 588629 - DNA, 25 bp, Rattus norvegicus
tgagcagcacacctgcgactctacg

SEQ ID NO: 588630 - DNA, 25 bp, Rattus norvegicus
gcaggtagaactgccgagcattcgg

SEQ ID NO: 588631 - DNA, 25 bp, Rattus norvegicus
agggaccgagccagggtctccgtca

SEQ ID NO: 588632 - DNA, 25 bp, Rattus norvegicus
tctccgtcagggtgtcctgaggcct

SEQ ID NO: 588633 - DNA, 25 bp, Rattus norvegicus
tggcgccggcatgagcagcacacct

SEQ ID NO: 588634 - DNA, 25 bp, Rattus norvegicus
gcttggcaccagagcccggggatcc

SEQ ID NO: 588635 - DNA, 25 bp, Rattus norvegicus
gatcccagtgggaacgcctctgcct

SEQ ID NO: 588636 - DNA, 25 bp, Rattus norvegicus
ctcaccagtcactgaagaaaccaga

SEQ ID NO: 588637 - DNA, 25 bp, Rattus norvegicus
ccgcactgggcacgcgggactacat

SEQ ID NO: 588638 - DNA, 25 bp, Rattus norvegicus
ggctgctcaggcaggtagaactgcc

SEQ ID NO: 588639 - DNA, 25 bp, Rattus norvegicus
cgtcgccagggcttccaattgcgca

SEQ ID NO: 588640 - DNA, 25 bp, Rattus norvegicus
tcacagcgcgtaccgagcgagggct

SEQ ID NO: 588641 - DNA, 25 bp, Rattus norvegicus
acatttcccacaaggccatgaggcg

SEQ ID NO: 588642 - DNA, 25 bp, Rattus norvegicus
gtctctcacgcgttcacagcgcgta

SEQ ID NO: 588643 - DNA, 25 bp, Rattus norvegicus
gaggatacagccgagctgcagagac

SEQ ID NO: 588644 - DNA, 25 bp, Rattus norvegicus
aacgagagcaaaggccactgccgtg

SEQ ID NO: 588645 - DNA, 25 bp, Rattus norvegicus
cgtgccaaagtaggagaacgagagc

SEQ ID NO: 588646 - DNA, 25 bp, Rattus norvegicus
cagccgagctgcagagacgctattc

SEQ ID NO: 588647 - DNA, 25 bp, Rattus norvegicus
gaaaagtggccagccggaggataca

SEQ ID NO: 588648 - DNA, 25 bp, Rattus norvegicus
agagaatacgatgagactcccggtc

SEQ ID NO: 588649 - DNA, 25 bp, Rattus norvegicus
ctgcggtgacaaaagagagaatacg

SEQ ID NO: 588650 - DNA, 25 bp, Rattus norvegicus
ctgttggagattactgcggtgacaa

SEQ ID NO: 588651 - DNA, 25 bp, Rattus norvegicus
ggtcctccaagaaaacaaaatgctg

SEQ ID NO: 588652 - DNA, 25 bp, Rattus norvegicus
cggggtagctacaggtcctccaaga

SEQ ID NO: 588653 - DNA, 25 bp, Rattus norvegicus
gcgtccgcgggaaacaaagcggctc

SEQ ID NO: 588654 - DNA, 25 bp, Rattus norvegicus
tgcgcactgcgtccgcgggaaacaa

SEQ ID NO: 588655 - DNA, 25 bp, Rattus norvegicus
acaaaatgctgttggagattactgc

SEQ ID NO: 588656 - DNA, 25 bp, Rattus norvegicus
cagagacgctattcgtgccaaagta

SEQ ID NO: 588657 - DNA, 25 bp, Rattus norvegicus
cctcccgggttaggagcagccaatc

SEQ ID NO: 588658 - DNA, 25 bp, Rattus norvegicus
gcttctcctcgaattcggtccagtt

SEQ ID NO: 588659 - DNA, 25 bp, Rattus norvegicus
ggctcgagcattcggaggccacact

SEQ ID NO: 588660 - DNA, 25 bp, Rattus norvegicus
cactggttgggttcatgagattcgg

SEQ ID NO: 588661 - DNA, 25 bp, Rattus norvegicus
ggaagtcaaacccacgtctgccgtg

SEQ ID NO: 588662 - DNA, 25 bp, Rattus norvegicus
tgccaggactgggtcaacaccaacc

SEQ ID NO: 588663 - DNA, 25 bp, Rattus norvegicus
ctggtcggagtgtcttcacctgaac

SEQ ID NO: 588664 - DNA, 25 bp, Rattus norvegicus
ccgcagcagcttggggacccagtaa

SEQ ID NO: 588665 - DNA, 25 bp, Rattus norvegicus
tgagccagctcacgccaaatgcttg

SEQ ID NO: 588666 - DNA, 25 bp, Rattus norvegicus
caaatgcttgtctccgaagccagga

SEQ ID NO: 588667 - DNA, 25 bp, Rattus norvegicus
cttctccatttgttcctggacagga

SEQ ID NO: 588668 - DNA, 25 bp, Rattus norvegicus
agccagacgtactttgagccggagg

SEQ ID NO: 588669 - DNA, 25 bp, Rattus norvegicus
ccgactggatctgcgtcttgtcttc

SEQ ID NO: 588670 - DNA, 25 bp, Rattus norvegicus
ggctccgttgtcgtctctgccttct

SEQ ID NO: 588671 - DNA, 25 bp, Rattus norvegicus
cctgcagctcgcgagcgctgagcga

SEQ ID NO: 588672 - DNA, 25 bp, Rattus norvegicus
ctcggccggcgtgcctcacgcctaa

SEQ ID NO: 588673 - DNA, 25 bp, Rattus norvegicus
ggcctccttccgtccctgccgtgct

SEQ ID NO: 588674 - DNA, 25 bp, Rattus norvegicus
agcgacgtttcccttccgattccag

SEQ ID NO: 588675 - DNA, 25 bp, Rattus norvegicus
agcgagcgacgtttcccttccgatt

SEQ ID NO: 588676 - DNA, 25 bp, Rattus norvegicus
aaccaatcagcgagcgacgtttccc

SEQ ID NO: 588677 - DNA, 25 bp, Rattus norvegicus
tcgcctcacgctcgacggggaaggc

SEQ ID NO: 588678 - DNA, 25 bp, Rattus norvegicus
aactcaagcgcaaccgcgggcgtgc

SEQ ID NO: 588679 - DNA, 25 bp, Rattus norvegicus
ggacacgaactcaagcgcaaccgcg

SEQ ID NO: 588680 - DNA, 25 bp, Rattus norvegicus
gagcgcgccggacacgaactcaagc

SEQ ID NO: 588681 - DNA, 25 bp, Rattus norvegicus
cggccttccgcgatcctcccggagc

SEQ ID NO: 588682 - DNA, 25 bp, Rattus norvegicus
cgcggcgctccacccagaggcgcca

SEQ ID NO: 588683 - DNA, 25 bp, Rattus norvegicus
ccattccggcctcacgacggaggtg

SEQ ID NO: 588684 - DNA, 25 bp, Rattus norvegicus
ggcgtgccacccaacccggcctcgc

SEQ ID NO: 588685 - DNA, 25 bp, Rattus norvegicus
atggcggctctctgatgcctgggta

SEQ ID NO: 588686 - DNA, 25 bp, Rattus norvegicus
cgcagacgccttataaattacattt

SEQ ID NO: 588687 - DNA, 25 bp, Rattus norvegicus
ggtgataaattccagtccgcagacg

SEQ ID NO: 588688 - DNA, 25 bp, Rattus norvegicus
cggcgagcggatccggtgataaatt

SEQ ID NO: 588689 - DNA, 25 bp, Rattus norvegicus
ctacatatcaattgagcggcggcga

SEQ ID NO: 588690 - DNA, 25 bp, Rattus norvegicus
ggtgttgtttgaaaccaactacata

SEQ ID NO: 588691 - DNA, 25 bp, Rattus norvegicus
cagatatatccaagcgtaaaatcta

SEQ ID NO: 588692 - DNA, 25 bp, Rattus norvegicus
aatggcgagttaaacagatatatcc

SEQ ID NO: 588693 - DNA, 25 bp, Rattus norvegicus
cgctgtgatgatggcggctctctga

SEQ ID NO: 588694 - DNA, 25 bp, Rattus norvegicus
tttctccagagtgactggtttgtgc

SEQ ID NO: 588695 - DNA, 25 bp, Rattus norvegicus
tgactggtttgtgctgtcatcagcc

SEQ ID NO: 588696 - DNA, 25 bp, Rattus norvegicus
ccagtccgcagacgccttataaatt

SEQ ID NO: 588697 - DNA, 25 bp, Rattus norvegicus
tgtgctgtcatcagccgttgttttg

SEQ ID NO: 588698 - DNA, 25 bp, Rattus norvegicus
cagccgttgttttggtaaatggcga

SEQ ID NO: 588699 - DNA, 25 bp, Rattus norvegicus
aacaggcgcgatccgcgactgacca

SEQ ID NO: 588700 - DNA, 25 bp, Rattus norvegicus
agttcgtgcactcgcttccagaagc

SEQ ID NO: 588701 - DNA, 25 bp, Rattus norvegicus
gctaagcaccagactgtcctccggg

SEQ ID NO: 588702 - DNA, 25 bp, Rattus norvegicus
gagaggaaatccagttcgtgcactc

SEQ ID NO: 588703 - DNA, 25 bp, Rattus norvegicus
agccgaccctcttctcctggacaag

SEQ ID NO: 588704 - DNA, 25 bp, Rattus norvegicus
gcgggacctttaccctcggcagaga

SEQ ID NO: 588705 - DNA, 25 bp, Rattus norvegicus
tggagcatcctagctaagcaccaga

SEQ ID NO: 588706 - DNA, 25 bp, Rattus norvegicus
gcgggtaggccgaaattcaagacac

SEQ ID NO: 588707 - DNA, 25 bp, Rattus norvegicus
agtctgaacccgcaacatttcttgc

SEQ ID NO: 588708 - DNA, 25 bp, Rattus norvegicus
gggtgcccagtctgaacccgcaaca

SEQ ID NO: 588709 - DNA, 25 bp, Rattus norvegicus
ccagaagcagcagtaactcggacta

SEQ ID NO: 588710 - DNA, 25 bp, Rattus norvegicus
gcagcagtaactcggactagggaag

SEQ ID NO: 588711 - DNA, 25 bp, Rattus norvegicus
cgtccgggcttgaacaggcgcgatc

SEQ ID NO: 588712 - DNA, 25 bp, Rattus norvegicus
atccgcgactgaccagagctcgggg

SEQ ID NO: 588713 - DNA, 25 bp, Rattus norvegicus
gcggtcgccactggagacagagcca

SEQ ID NO: 588714 - DNA, 25 bp, Rattus norvegicus
cgaggagtaccagcccgccagctgg

SEQ ID NO: 588715 - DNA, 25 bp, Rattus norvegicus
gagctgaaaggcactccaggaattt

SEQ ID NO: 588716 - DNA, 25 bp, Rattus norvegicus
atcccgagctgaaaggcactccagg

SEQ ID NO: 588717 - DNA, 25 bp, Rattus norvegicus
tgaaaatcccgagctgaaaggcact

SEQ ID NO: 588718 - DNA, 25 bp, Rattus norvegicus
tctgaaaatcccgagctgaaaggca

SEQ ID NO: 588719 - DNA, 25 bp, Rattus norvegicus
cccttctgaaaatcccgagctgaaa

SEQ ID NO: 588720 - DNA, 25 bp, Rattus norvegicus
gcggacaggtaagtggcctcttcct

SEQ ID NO: 588721 - DNA, 25 bp, Rattus norvegicus
gaccgagcgctgagtgccgaagacc

SEQ ID NO: 588722 - DNA, 25 bp, Rattus norvegicus
gcagcggcggatcccgcgcgagaga

SEQ ID NO: 588723 - DNA, 25 bp, Rattus norvegicus
ctcgcagagaggagcacgggctgca

SEQ ID NO: 588724 - DNA, 25 bp, Rattus norvegicus
ccagctggctcgcagagaggagcac

SEQ ID NO: 588725 - DNA, 25 bp, Rattus norvegicus
ctgaaaggcactccaggaatttccg

SEQ ID NO: 588726 - DNA, 25 bp, Rattus norvegicus
ccgagcgctgagtgccgaagaccgc

SEQ ID NO: 588727 - DNA, 25 bp, Rattus norvegicus
tggattcgaggacccgcttggatgc

SEQ ID NO: 588728 - DNA, 25 bp, Rattus norvegicus
gcttggatgcttcgcctccgagcgc

SEQ ID NO: 588729 - DNA, 25 bp, Rattus norvegicus
gtgacgtcaccctgcccgctgggtg

SEQ ID NO: 588730 - DNA, 25 bp, Rattus norvegicus
cctccatcggacacgagttcagaga

SEQ ID NO: 588731 - DNA, 25 bp, Rattus norvegicus
ttcagagacagagaaaggcgctgtc

SEQ ID NO: 588732 - DNA, 25 bp, Rattus norvegicus
aggcgctgtcagactcgctccactt

SEQ ID NO: 588733 - DNA, 25 bp, Rattus norvegicus
cgcacccacactttctgcggtggtg

SEQ ID NO: 588734 - DNA, 25 bp, Rattus norvegicus
cactttctgcggtggtgggaacacc

SEQ ID NO: 588735 - DNA, 25 bp, Rattus norvegicus
ccctgccggggttcgagcgccatta

SEQ ID NO: 588736 - DNA, 25 bp, Rattus norvegicus
cgccattagcttgcgccagtaccgg

SEQ ID NO: 588737 - DNA, 25 bp, Rattus norvegicus
cagtaccgggatcttcgctcagctc

SEQ ID NO: 588738 - DNA, 25 bp, Rattus norvegicus
gatcttcgctcagctcgcctgagtc

SEQ ID NO: 588739 - DNA, 25 bp, Rattus norvegicus
gccctcggaagatgggccgtcagcc

SEQ ID NO: 588740 - DNA, 25 bp, Rattus norvegicus
agtcccgcccgctggattcgaggac

SEQ ID NO: 588741 - DNA, 25 bp, Rattus norvegicus
tatcctcccttctgcatgttctggc

SEQ ID NO: 588742 - DNA, 25 bp, Rattus norvegicus
cggacgccaagtacacgcagccaga

SEQ ID NO: 588743 - DNA, 25 bp, Rattus norvegicus
cgcagccagacgcagccaactttaa

SEQ ID NO: 588744 - DNA, 25 bp, Rattus norvegicus
cgccatctcaagctcacagacaaga

SEQ ID NO: 588745 - DNA, 25 bp, Rattus norvegicus
agccctcaggacgagctagtcttcg

SEQ ID NO: 588746 - DNA, 25 bp, Rattus norvegicus
tagtcttcgcctgggaggacgtcaa

SEQ ID NO: 588747 - DNA, 25 bp, Rattus norvegicus
ccatgttcaacggtggcagccgcaa

SEQ ID NO: 588748 - DNA, 25 bp, Rattus norvegicus
acccactcagttcagtcaaggctgc

SEQ ID NO: 588749 - DNA, 25 bp, Rattus norvegicus
acgacgatgacgattcccttcagga

SEQ ID NO: 588750 - DNA, 25 bp, Rattus norvegicus
gtgtagctactgcaacatgtacttc

SEQ ID NO: 588751 - DNA, 25 bp, Rattus norvegicus
cagtcatcccagtgcccagcaaggg

SEQ ID NO: 588752 - DNA, 25 bp, Rattus norvegicus
cgtgctacagaagttcccgggctgc

SEQ ID NO: 588753 - DNA, 25 bp, Rattus norvegicus
cggccttcggcttgtgccacaagaa

SEQ ID NO: 588754 - DNA, 25 bp, Rattus norvegicus
gggccgcaaggacgccttctatcct

SEQ ID NO: 588755 - DNA, 25 bp, Rattus norvegicus
cccccatctctggccccacagaaag

SEQ ID NO: 588756 - DNA, 25 bp, Rattus norvegicus
caggaggatgggaagctgggggacc

SEQ ID NO: 588757 - DNA, 25 bp, Rattus norvegicus
ccccatctctggccccacagaaagc

SEQ ID NO: 588758 - DNA, 25 bp, Rattus norvegicus
gcccccatctctggccccacagaaa

SEQ ID NO: 588759 - DNA, 25 bp, Rattus norvegicus
catctctggccccacagaaagcaag

SEQ ID NO: 588760 - DNA, 25 bp, Rattus norvegicus
cgcccccatctctggccccacagaa

SEQ ID NO: 588761 - DNA, 25 bp, Rattus norvegicus
ccgcccccatctctggccccacaga

SEQ ID NO: 588762 - DNA, 25 bp, Rattus norvegicus
gctgctacaggaggatgggaagctg

SEQ ID NO: 588763 - DNA, 25 bp, Rattus norvegicus
ctgctacaggaggatgggaagctgg

SEQ ID NO: 588764 - DNA, 25 bp, Rattus norvegicus
tgctacaggaggatgggaagctggg

SEQ ID NO: 588765 - DNA, 25 bp, Rattus norvegicus
gctacaggaggatgggaagctgggg

SEQ ID NO: 588766 - DNA, 25 bp, Rattus norvegicus
ctacaggaggatgggaagctggggg

SEQ ID NO: 588767 - DNA, 25 bp, Rattus norvegicus
tacaggaggatgggaagctggggga

SEQ ID NO: 588768 - DNA, 25 bp, Rattus norvegicus
acaggaggatgggaagctgggggac

SEQ ID NO: 588769 - DNA, 25 bp, Rattus norvegicus
ctccagggccgagggctgtcggaga

SEQ ID NO: 588770 - DNA, 25 bp, Rattus norvegicus
gtccttctcggagactccctggttg

SEQ ID NO: 588771 - DNA, 25 bp, Rattus norvegicus
ccttctcggagactccctggttggc

SEQ ID NO: 588772 - DNA, 25 bp, Rattus norvegicus
agactccctggttggcggtggccgg

SEQ ID NO: 588773 - DNA, 25 bp, Rattus norvegicus
ttctcggagactccctggttggcgg

SEQ ID NO: 588774 - DNA, 25 bp, Rattus norvegicus
ggagcggtcgggaccgcacgacgcc

SEQ ID NO: 588775 - DNA, 25 bp, Rattus norvegicus
aactcctccaggctgctacaggagg

SEQ ID NO: 588776 - DNA, 25 bp, Rattus norvegicus
agcgctgaactcctccaggctgcta

SEQ ID NO: 588777 - DNA, 25 bp, Rattus norvegicus
tgaactcctccaggctgctacagga

SEQ ID NO: 588778 - DNA, 25 bp, Rattus norvegicus
gctgaactcctccaggctgctacag

SEQ ID NO: 588779 - DNA, 25 bp, Rattus norvegicus
tctagcgctgaactcctccaggctg

SEQ ID NO: 588780 - DNA, 25 bp, Rattus norvegicus
gggtgctttccctctagcgctgaac

SEQ ID NO: 588781 - DNA, 25 bp, Rattus norvegicus
tcgggaccgcacgacgcccgccgtg

SEQ ID NO: 588782 - DNA, 25 bp, Rattus norvegicus
gtgctttccctctagcgctgaactc

SEQ ID NO: 588783 - DNA, 25 bp, Rattus norvegicus
cctgctgtgcgtgaatgccatcgcc

SEQ ID NO: 588784 - DNA, 25 bp, Rattus norvegicus
agcgcttcctcaagaacagtgagtg

SEQ ID NO: 588785 - DNA, 25 bp, Rattus norvegicus
tcggtgtccgggaaaaagtcagtca

SEQ ID NO: 588786 - DNA, 25 bp, Rattus norvegicus
tcaagaacagtgagtgcccgggctg

SEQ ID NO: 588787 - DNA, 25 bp, Rattus norvegicus
aatgccatcgccgtgctgcacgagg

SEQ ID NO: 588788 - DNA, 25 bp, Rattus norvegicus
tccgggaaaaagtcagtcaggcctg

SEQ ID NO: 588789 - DNA, 25 bp, Rattus norvegicus
cggccctgctgtgcgtgaatgccat

SEQ ID NO: 588790 - DNA, 25 bp, Rattus norvegicus
gtactccctgatgcaggcggccctg

SEQ ID NO: 588791 - DNA, 25 bp, Rattus norvegicus
ttacgttgtactccctgatgcaggc

SEQ ID NO: 588792 - DNA, 25 bp, Rattus norvegicus
atggcctttacgttgtactccctga

SEQ ID NO: 588793 - DNA, 25 bp, Rattus norvegicus
cagtttgaagtaactatggccttta

SEQ ID NO: 588794 - DNA, 25 bp, Rattus norvegicus
gcctgggaacagtttgaagtaacta

SEQ ID NO: 588795 - DNA, 25 bp, Rattus norvegicus
gtgctgcacgaggagcgcttcctca

SEQ ID NO: 588796 - DNA, 25 bp, Rattus norvegicus
gtcagtcaggcctgggaacagtttg

SEQ ID NO: 588797 - DNA, 25 bp, Rattus norvegicus
tgaaaccggcatttctagagcttgg

SEQ ID NO: 588798 - DNA, 25 bp, Rattus norvegicus
ttcgaagacattggcgcaagagttc

SEQ ID NO: 588799 - DNA, 25 bp, Rattus norvegicus
tcccgcccagtcttattgttctttc

SEQ ID NO: 588800 - DNA, 25 bp, Rattus norvegicus
ctttccattggtcagatttcttgtc

SEQ ID NO: 588801 - DNA, 25 bp, Rattus norvegicus
gttcccaggagaaggcgaatgattg

SEQ ID NO: 588802 - DNA, 25 bp, Rattus norvegicus
ccattttattgaggcgaaccgaatc

SEQ ID NO: 588803 - DNA, 25 bp, Rattus norvegicus
aaccgaatctctcaaggcggccgcg

SEQ ID NO: 588804 - DNA, 25 bp, Rattus norvegicus
agcggtttccttagtggctttgtga

SEQ ID NO: 588805 - DNA, 25 bp, Rattus norvegicus
ccggttcgtttccagtgtgtcagta

SEQ ID NO: 588806 - DNA, 25 bp, Rattus norvegicus
tcagtaggcaagacaccggagagcg

SEQ ID NO: 588807 - DNA, 25 bp, Rattus norvegicus
gcgtcccaggcagatagagacctta

SEQ ID NO: 588808 - DNA, 25 bp, Rattus norvegicus
gcgcgctcaccttggctactgctgt

SEQ ID NO: 588809 - DNA, 25 bp, Rattus norvegicus
gctcccattggaagatgaaaccggc

SEQ ID NO: 588810 - DNA, 25 bp, Rattus norvegicus
atgattggttggttgctgttcccgc

SEQ ID NO: 588811 - DNA, 25 bp, Rattus norvegicus
ccttttatggcctgagtgtgagtgc

SEQ ID NO: 588812 - DNA, 25 bp, Rattus norvegicus
cctcgacttccttttatggcctgag

SEQ ID NO: 588813 - DNA, 25 bp, Rattus norvegicus
cggcctggcatgaggccaactctgc

SEQ ID NO: 588814 - DNA, 25 bp, Rattus norvegicus
ggcctggcatgaggccaactctgcc

SEQ ID NO: 588815 - DNA, 25 bp, Rattus norvegicus
tgcctcgacttccttttatggcctg

SEQ ID NO: 588816 - DNA, 25 bp, Rattus norvegicus
gcctcgacttccttttatggcctga

SEQ ID NO: 588817 - DNA, 25 bp, Rattus norvegicus
ccggcctggcatgaggccaactctg

SEQ ID NO: 588818 - DNA, 25 bp, Rattus norvegicus
ctcgacttccttttatggcctgagt

SEQ ID NO: 588819 - DNA, 25 bp, Rattus norvegicus
ttttatggcctgagtgtgagtgcat

SEQ ID NO: 588820 - DNA, 25 bp, Rattus norvegicus
tcgacttccttttatggcctgagtg

SEQ ID NO: 588821 - DNA, 25 bp, Rattus norvegicus
cgacttccttttatggcctgagtgt

SEQ ID NO: 588822 - DNA, 25 bp, Rattus norvegicus
tccttttatggcctgagtgtgagtg

SEQ ID NO: 588823 - DNA, 25 bp, Rattus norvegicus
cttttatggcctgagtgtgagtgca

SEQ ID NO: 588824 - DNA, 25 bp, Rattus norvegicus
gacttccttttatggcctgagtgtg

SEQ ID NO: 588825 - DNA, 25 bp, Rattus norvegicus
cctttccagaggacaacggggctgc

SEQ ID NO: 588826 - DNA, 25 bp, Rattus norvegicus
aggcaacgtttgagcgatggcgctt

SEQ ID NO: 588827 - DNA, 25 bp, Rattus norvegicus
gagcgatggcgctttgttacagaga

SEQ ID NO: 588828 - DNA, 25 bp, Rattus norvegicus
gagatctatactgaccaacagcaga

SEQ ID NO: 588829 - DNA, 25 bp, Rattus norvegicus
tccacagctccggaggcacatcgga

SEQ ID NO: 588830 - DNA, 25 bp, Rattus norvegicus
aggcacatcggagacctggacgctg

SEQ ID NO: 588831 - DNA, 25 bp, Rattus norvegicus
aacagcagaagcatccacagctccg

SEQ ID NO: 588832 - DNA, 25 bp, Rattus norvegicus
aacgcctgcgcttgcttagagaatc

SEQ ID NO: 588833 - DNA, 25 bp, Rattus norvegicus
cgcttgcttagagaatcgcacttca

SEQ ID NO: 588834 - DNA, 25 bp, Rattus norvegicus
agaatcgcacttcacgggccgggcc

SEQ ID NO: 588835 - DNA, 25 bp, Rattus norvegicus
tgtggtgaccgaccctctgcggcgt

SEQ ID NO: 588836 - DNA, 25 bp, Rattus norvegicus
gtgcgcacgcgcagactgttctccc

SEQ ID NO: 588837 - DNA, 25 bp, Rattus norvegicus
ttggggaaacgcctgcgcttgctta

SEQ ID NO: 588838 - DNA, 25 bp, Rattus norvegicus
tggcgctttgttacagagatctata

SEQ ID NO: 588839 - DNA, 25 bp, Rattus norvegicus
actgggctcagcagggacaggccac

SEQ ID NO: 588840 - DNA, 25 bp, Rattus norvegicus
agaacgccacagttccggtaagagc

SEQ ID NO: 588841 - DNA, 25 bp, Rattus norvegicus
tccaagtccggggagaacgccacag

SEQ ID NO: 588842 - DNA, 25 bp, Rattus norvegicus
gacaggccaccaccggaagcgcgtg

SEQ ID NO: 588843 - DNA, 25 bp, Rattus norvegicus
aacgccacagttccggtaagagcct

SEQ ID NO: 588844 - DNA, 25 bp, Rattus norvegicus
gccacagttccggtaagagcctcag

SEQ ID NO: 588845 - DNA, 25 bp, Rattus norvegicus
cacagttccggtaagagcctcagta

SEQ ID NO: 588846 - DNA, 25 bp, Rattus norvegicus
cagttccggtaagagcctcagtagc

SEQ ID NO: 588847 - DNA, 25 bp, Rattus norvegicus
agagcctcagtagcagcctgcgctc

SEQ ID NO: 588848 - DNA, 25 bp, Rattus norvegicus
cctgcgctccggtgcagggaacagg

SEQ ID NO: 588849 - DNA, 25 bp, Rattus norvegicus
gagcaggggcaggaagcgacgagca

SEQ ID NO: 588850 - DNA, 25 bp, Rattus norvegicus
gaagcgacgagcaggactgggctca

SEQ ID NO: 588851 - DNA, 25 bp, Rattus norvegicus
cagggacaggccaccaccggaagcg

SEQ ID NO: 588852 - DNA, 25 bp, Rattus norvegicus
gctcgggcggaagaccgcgcgcggt

SEQ ID NO: 588853 - DNA, 25 bp, Rattus norvegicus
cggttaactgcgtgttcttcgacga

SEQ ID NO: 588854 - DNA, 25 bp, Rattus norvegicus
tgtcaccacccgtaagcaaattaga

SEQ ID NO: 588855 - DNA, 25 bp, Rattus norvegicus
cgacccggttcttggactgcatctt

SEQ ID NO: 588856 - DNA, 25 bp, Rattus norvegicus
actgcatcttctacggacgagctcc

SEQ ID NO: 588857 - DNA, 25 bp, Rattus norvegicus
cccagccatgggcagcgaggactac

SEQ ID NO: 588858 - DNA, 25 bp, Rattus norvegicus
gtaggcgacgcagaatgtcaccacc

SEQ ID NO: 588859 - DNA, 25 bp, Rattus norvegicus
ccagtgcagttcgagaaggcgaacc

SEQ ID NO: 588860 - DNA, 25 bp, Rattus norvegicus
catgtcctgtttgttcggatgaatc

SEQ ID NO: 588861 - DNA, 25 bp, Rattus norvegicus
cttcgacgaggccaacaagcaggtg

SEQ ID NO: 588862 - DNA, 25 bp, Rattus norvegicus
agacgccggagtgtctctgcaccgg

SEQ ID NO: 588863 - DNA, 25 bp, Rattus norvegicus
ttgtaccagagctgagacgcgagtg

SEQ ID NO: 588864 - DNA, 25 bp, Rattus norvegicus
cgagctggctttcagacggtcagtc

SEQ ID NO: 588865 - DNA, 25 bp, Rattus norvegicus
ctggcctgcggtcttaaaattcgtc

SEQ ID NO: 588866 - DNA, 25 bp, Rattus norvegicus
cgaggactactacctggagctgtgc

SEQ ID NO: 588867 - DNA, 25 bp, Rattus norvegicus
tctccctcagcgtggggagaagcgc

SEQ ID NO: 588868 - DNA, 25 bp, Rattus norvegicus
ctgtgtgaaagaccgaccgccttcg

SEQ ID NO: 588869 - DNA, 25 bp, Rattus norvegicus
gcgctttctccctcagcgtggggag

SEQ ID NO: 588870 - DNA, 25 bp, Rattus norvegicus
ccgccttcggaaacgcgaagttgtg

SEQ ID NO: 588871 - DNA, 25 bp, Rattus norvegicus
cccgctgtggtctaggcaggtctgt

SEQ ID NO: 588872 - DNA, 25 bp, Rattus norvegicus
tggtctaggcaggtctgtcacgaga

SEQ ID NO: 588873 - DNA, 25 bp, Rattus norvegicus
tctaggcaggtctgtcacgagatga

SEQ ID NO: 588874 - DNA, 25 bp, Rattus norvegicus
gcaggtctgtcacgagatgaggccc

SEQ ID NO: 588875 - DNA, 25 bp, Rattus norvegicus
tgtcacgagatgaggccccttcttc

SEQ ID NO: 588876 - DNA, 25 bp, Rattus norvegicus
cccggagcactgtgtgaaagaccga

SEQ ID NO: 588877 - DNA, 25 bp, Rattus norvegicus
gagaagcgcggtcttttgggaacac

SEQ ID NO: 588878 - DNA, 25 bp, Rattus norvegicus
agcactgtgtgaaagaccgaccgcc

SEQ ID NO: 588879 - DNA, 25 bp, Rattus norvegicus
cccttcttcccaccagcgctttctc

SEQ ID NO: 588880 - DNA, 25 bp, Rattus norvegicus
tgtgaaagaccgaccgccttcggaa

SEQ ID NO: 588881 - DNA, 25 bp, Rattus norvegicus
tgcaaatgctcgtctcgccgaggtt

SEQ ID NO: 588882 - DNA, 25 bp, Rattus norvegicus
gacggctgaccctgaatttctgctc

SEQ ID NO: 588883 - DNA, 25 bp, Rattus norvegicus
tcagccagagttgggagtcaaggcc

SEQ ID NO: 588884 - DNA, 25 bp, Rattus norvegicus
gggacagtctctcagtccattagca

SEQ ID NO: 588885 - DNA, 25 bp, Rattus norvegicus
cagtccattagcatgcaggggccgc

SEQ ID NO: 588886 - DNA, 25 bp, Rattus norvegicus
gaccttgctccgctttcaccgagga

SEQ ID NO: 588887 - DNA, 25 bp, Rattus norvegicus
gccacgccgtggcagttcgcctaag

SEQ ID NO: 588888 - DNA, 25 bp, Rattus norvegicus
gcggtgactcagtgacctgcgcacc

SEQ ID NO: 588889 - DNA, 25 bp, Rattus norvegicus
gctctgcggtctgcgctcctctgaa

SEQ ID NO: 588890 - DNA, 25 bp, Rattus norvegicus
catgattccaacctggccctttacg

SEQ ID NO: 588891 - DNA, 25 bp, Rattus norvegicus
cccattggtcgtcacctcggcggga

SEQ ID NO: 588892 - DNA, 25 bp, Rattus norvegicus
ccagaagccgcagcacgagagggca

SEQ ID NO: 588893 - DNA, 25 bp, Rattus norvegicus
cgcgactgcgcccacgggaaacttt

SEQ ID NO: 588894 - DNA, 25 bp, Rattus norvegicus
ccgaggattctccagcagcgcacga

SEQ ID NO: 588895 - DNA, 25 bp, Rattus norvegicus
cacgcaccactactatgacaatgtc

SEQ ID NO: 588896 - DNA, 25 bp, Rattus norvegicus
tgctgcagaggtacgagaacgcctc

SEQ ID NO: 588897 - DNA, 25 bp, Rattus norvegicus
ggagatcttcaccttcctgcgcatg

SEQ ID NO: 588898 - DNA, 25 bp, Rattus norvegicus
ggctttcatgctatgccctcggaga

SEQ ID NO: 588899 - DNA, 25 bp, Rattus norvegicus
tgacaatgtcaagcccaagcccggc

SEQ ID NO: 588900 - DNA, 25 bp, Rattus norvegicus
tgcacctgttcggtttctgggcctt

SEQ ID NO: 588901 - DNA, 25 bp, Rattus norvegicus
tacctgagcagcgtgtcgcgctact

SEQ ID NO: 588902 - DNA, 25 bp, Rattus norvegicus
tggacgacttccagtcgcggcagcc

SEQ ID NO: 588903 - DNA, 25 bp, Rattus norvegicus
cggcccttcttcagcgtgctgcaga

SEQ ID NO: 588904 - DNA, 25 bp, Rattus norvegicus
agtcaagtacatgctggacgacttc

SEQ ID NO: 588905 - DNA, 25 bp, Rattus norvegicus
ccctcgtgtccttccgagtcaagta

SEQ ID NO: 588906 - DNA, 25 bp, Rattus norvegicus
acaatgtgcgcaacaccctcgtgtc

SEQ ID NO: 588907 - DNA, 25 bp, Rattus norvegicus
agctctgcgaggaggtgcacctgtt

SEQ ID NO: 588908 - DNA, 25 bp, Rattus norvegicus
gctgccggccttctacaatgtgcgc

SEQ ID NO: 588909 - DNA, 25 bp, Rattus norvegicus
aacactggaagcacgagatagccga

SEQ ID NO: 588910 - DNA, 25 bp, Rattus norvegicus
cacaggctggcgcacgtgcgagcct

SEQ ID NO: 588911 - DNA, 25 bp, Rattus norvegicus
ctcccggacatgtggaggcgcgttc

SEQ ID NO: 588912 - DNA, 25 bp, Rattus norvegicus
accacgggagacgtgctcccggaca

SEQ ID NO: 588913 - DNA, 25 bp, Rattus norvegicus
tgcacacggagcgtgcacaccacgg

SEQ ID NO: 588914 - DNA, 25 bp, Rattus norvegicus
cttgcacacacacgcgggcggcgtg

SEQ ID NO: 588915 - DNA, 25 bp, Rattus norvegicus
agatagccgacgtggaccaggacca

SEQ ID NO: 588916 - DNA, 25 bp, Rattus norvegicus
gtttcgcccagacccaaacactgga

SEQ ID NO: 588917 - DNA, 25 bp, Rattus norvegicus
aagcgatacctctgtttcgcccaga

SEQ ID NO: 588918 - DNA, 25 bp, Rattus norvegicus
tacgcgctcggaaagaagcagaccc

SEQ ID NO: 588919 - DNA, 25 bp, Rattus norvegicus
agcgagtgcacacgacccaaaggtc

SEQ ID NO: 588920 - DNA, 25 bp, Rattus norvegicus
tgggcaccgcacacaggtcactcgg

SEQ ID NO: 588921 - DNA, 25 bp, Rattus norvegicus
gtcactcggggacgtgcgcacacag

SEQ ID NO: 588922 - DNA, 25 bp, Rattus norvegicus
atcctggctcctcgcgcagcggtgg

SEQ ID NO: 588923 - DNA, 25 bp, Rattus norvegicus
agccgacccacagtcgcggaagcgg

SEQ ID NO: 588924 - DNA, 25 bp, Rattus norvegicus
gcaggacactgtcgggagacccacg

SEQ ID NO: 588925 - DNA, 25 bp, Rattus norvegicus
actgtcgggagacccacgcacctag

SEQ ID NO: 588926 - DNA, 25 bp, Rattus norvegicus
ttctgggcatcagccgacccacagt

SEQ ID NO: 588927 - DNA, 25 bp, Rattus norvegicus
ggaagccctttctcgctccttcaag

SEQ ID NO: 588928 - DNA, 25 bp, Rattus norvegicus
ctccttcaaggccaccgcgggaggg

SEQ ID NO: 588929 - DNA, 25 bp, Rattus norvegicus
gtgagtgcctgcctccgttaccgag

SEQ ID NO: 588930 - DNA, 25 bp, Rattus norvegicus
ctgcctccgttaccgagctggagga

SEQ ID NO: 588931 - DNA, 25 bp, Rattus norvegicus
gccgggctccgcaaagttgctccaa

SEQ ID NO: 588932 - DNA, 25 bp, Rattus norvegicus
agttgctccaacacaactctgcggc

SEQ ID NO: 588933 - DNA, 25 bp, Rattus norvegicus
ccaacacaactctgcggcctgaggg

SEQ ID NO: 588934 - DNA, 25 bp, Rattus norvegicus
tgaggggctgcggtcccttcagccc

SEQ ID NO: 588935 - DNA, 25 bp, Rattus norvegicus
ccttcagcccgctgcccactcggtg

SEQ ID NO: 588936 - DNA, 25 bp, Rattus norvegicus
acgcacctagattctgggcatcagc

SEQ ID NO: 588937 - DNA, 25 bp, Rattus norvegicus
cgggacaaaaaacagccgcagtggg

SEQ ID NO: 588938 - DNA, 25 bp, Rattus norvegicus
gaccgcaccgtggaatcgggacaaa

SEQ ID NO: 588939 - DNA, 25 bp, Rattus norvegicus
ccagcctgaagcgaggagctccata

SEQ ID NO: 588940 - DNA, 25 bp, Rattus norvegicus
aagcgaggagctccatagagcggct

SEQ ID NO: 588941 - DNA, 25 bp, Rattus norvegicus
ccacaggggagtccgggcctgcaat

SEQ ID NO: 588942 - DNA, 25 bp, Rattus norvegicus
ctgcaatgggcctcggtcacgaccg

SEQ ID NO: 588943 - DNA, 25 bp, Rattus norvegicus
aatccgccagcctgaagcgaggagc

SEQ ID NO: 588944 - DNA, 25 bp, Rattus norvegicus
gtcacctgtgatgctttctcctcca

SEQ ID NO: 588945 - DNA, 25 bp, Rattus norvegicus
gacccagctccagatgtcacctgtg

SEQ ID NO: 588946 - DNA, 25 bp, Rattus norvegicus
gctaagtggggtcccgacccagctc

SEQ ID NO: 588947 - DNA, 25 bp, Rattus norvegicus
agatgcgtggctcccagagagctaa

SEQ ID NO: 588948 - DNA, 25 bp, Rattus norvegicus
aaacagccgcagtgggtgaccagca

SEQ ID NO: 588949 - DNA, 25 bp, Rattus norvegicus
cggtcacgaccgcaccgtggaatcg

SEQ ID NO: 588950 - DNA, 25 bp, Rattus norvegicus
gtgaccagcagatgcgtggctccca

SEQ ID NO: 588951 - DNA, 25 bp, Rattus norvegicus
ctcaggtctctgcggatcggagcgc

SEQ ID NO: 588952 - DNA, 25 bp, Rattus norvegicus
tgggccggctgccttgaccttcctt

SEQ ID NO: 588953 - DNA, 25 bp, Rattus norvegicus
cgcgctcggccattttgtgccagtc

SEQ ID NO: 588954 - DNA, 25 bp, Rattus norvegicus
cattttgtgccagtcgtccggaggc

SEQ ID NO: 588955 - DNA, 25 bp, Rattus norvegicus
cgtggatccgtgacctcggcgttgc

SEQ ID NO: 588956 - DNA, 25 bp, Rattus norvegicus
ctgcggctgcagaagatctctccaa

SEQ ID NO: 588957 - DNA, 25 bp, Rattus norvegicus
ggctgcagaagatctctccaagaag

SEQ ID NO: 588958 - DNA, 25 bp, Rattus norvegicus
gaagctgcaaggatgctgtccgtgc

SEQ ID NO: 588959 - DNA, 25 bp, Rattus norvegicus
gatgctgtccgtgcgcatcgccgcg

SEQ ID NO: 588960 - DNA, 25 bp, Rattus norvegicus
cttccttcgcgctcggccattttgt

SEQ ID NO: 588961 - DNA, 25 bp, Rattus norvegicus
aggggctcttttgcaggccttcggt

SEQ ID NO: 588962 - DNA, 25 bp, Rattus norvegicus
caaaggggctcttttgcaggccttc

SEQ ID NO: 588963 - DNA, 25 bp, Rattus norvegicus
ttgcaccgtggctgccaggcagcgc

SEQ ID NO: 588964 - DNA, 25 bp, Rattus norvegicus
gacggcgccatcttgcaccgtggct

SEQ ID NO: 588965 - DNA, 25 bp, Rattus norvegicus
tagccgcgtgaactgtctcgcccga

SEQ ID NO: 588966 - DNA, 25 bp, Rattus norvegicus
ctccggatgcgcacaacttctggtt

SEQ ID NO: 588967 - DNA, 25 bp, Rattus norvegicus
caacttctggttggggcatccctgg

SEQ ID NO: 588968 - DNA, 25 bp, Rattus norvegicus
cagcctgcgcggagacaagggtaca

SEQ ID NO: 588969 - DNA, 25 bp, Rattus norvegicus
caagggtacacggtcagagcggctc

SEQ ID NO: 588970 - DNA, 25 bp, Rattus norvegicus
gagcggctcggtcccagcaggacca

SEQ ID NO: 588971 - DNA, 25 bp, Rattus norvegicus
tcctgcgctagctcaccgtggggcg

SEQ ID NO: 588972 - DNA, 25 bp, Rattus norvegicus
atgctgcagctcttgcccgggctgc

SEQ ID NO: 588973 - DNA, 25 bp, Rattus norvegicus
cgggctgcgctcaccggaatctcag

SEQ ID NO: 588974 - DNA, 25 bp, Rattus norvegicus
tcaccggaatctcaggggcgtgctt

SEQ ID NO: 588975 - DNA, 25 bp, Rattus norvegicus
aatctcaggggcgtgcttccgcctt

SEQ ID NO: 588976 - DNA, 25 bp, Rattus norvegicus
gtgcttccgccttgcgggtccaatc

SEQ ID NO: 588977 - DNA, 25 bp, Rattus norvegicus
tctgacactctagccgcgtgaactg

SEQ ID NO: 588978 - DNA, 25 bp, Rattus norvegicus
gccttgcgggtccaatctgacactc

SEQ ID NO: 588979 - DNA, 25 bp, Rattus norvegicus
gcgtctcttaaggtttctattgatc

SEQ ID NO: 588980 - DNA, 25 bp, Rattus norvegicus
gcgtgtgacctgagagctgattctg

SEQ ID NO: 588981 - DNA, 25 bp, Rattus norvegicus
ctgaagcccaaaaggaggagagttc

SEQ ID NO: 588982 - DNA, 25 bp, Rattus norvegicus
ctcgttctcacgcttgaaaactgaa

SEQ ID NO: 588983 - DNA, 25 bp, Rattus norvegicus
cccgggctgtgcctctatcctaaga

SEQ ID NO: 588984 - DNA, 25 bp, Rattus norvegicus
cttctgggtaagtcagagtggcgca

SEQ ID NO: 588985 - DNA, 25 bp, Rattus norvegicus
ttcgctgttcaaggggaacttctgg

SEQ ID NO: 588986 - DNA, 25 bp, Rattus norvegicus
atcagcaccgtaggcgacgttttaa

SEQ ID NO: 588987 - DNA, 25 bp, Rattus norvegicus
tctgaatttctaggtcgagaggtcc

SEQ ID NO: 588988 - DNA, 25 bp, Rattus norvegicus
aactccgaagttgcgccggaccttg

SEQ ID NO: 588989 - DNA, 25 bp, Rattus norvegicus
gaccttggccctgacagtcggagct

SEQ ID NO: 588990 - DNA, 25 bp, Rattus norvegicus
agtcggagctctcctctcgatccgg

SEQ ID NO: 588991 - DNA, 25 bp, Rattus norvegicus
taatcggcagtttagacccgcagtc

SEQ ID NO: 588992 - DNA, 25 bp, Rattus norvegicus
tgcgtgcgcaccattccttgtagca

SEQ ID NO: 588993 - DNA, 25 bp, Rattus norvegicus
gtggagtgtttgtcacgtgacattc

SEQ ID NO: 588994 - DNA, 25 bp, Rattus norvegicus
tcccttgcccaagtggtggagtgtt

SEQ ID NO: 588995 - DNA, 25 bp, Rattus norvegicus
ccagccgccgagcttcagtttacgg

SEQ ID NO: 588996 - DNA, 25 bp, Rattus norvegicus
cagtttacggttcacagggcgtggc

SEQ ID NO: 588997 - DNA, 25 bp, Rattus norvegicus
ggcggagcctttcgcgcacaagtag

SEQ ID NO: 588998 - DNA, 25 bp, Rattus norvegicus
gcgcacaagtagtcccttactagtt

SEQ ID NO: 588999 - DNA, 25 bp, Rattus norvegicus
ttactagtttgtcccaagttgcagc

SEQ ID NO: 589000 - DNA, 25 bp, Rattus norvegicus
cttgcgtgaattgcaggagtttgac

SEQ ID NO: 589001 - DNA, 25 bp, Rattus norvegicus
aagttgcagcccgtaccggctcctg

SEQ ID NO: 589002 - DNA, 25 bp, Rattus norvegicus
cgtgacattcaggaggccggaactg

SEQ ID NO: 589003 - DNA, 25 bp, Rattus norvegicus
tttgacagaaacagaccgcgacgtc

SEQ ID NO: 589004 - DNA, 25 bp, Rattus norvegicus
ggatgctgtcgctcccttgcgagcc

SEQ ID NO: 589005 - DNA, 25 bp, Rattus norvegicus
ttcgggctgtcaggatcgcttggct

SEQ ID NO: 589006 - DNA, 25 bp, Rattus norvegicus
gccagccggaccaaaggcaaggtga

SEQ ID NO: 589007 - DNA, 25 bp, Rattus norvegicus
gccttaccagtcacgtgcagccgga

SEQ ID NO: 589008 - DNA, 25 bp, Rattus norvegicus
agaagtagcgtctgctgtccgccag

SEQ ID NO: 589009 - DNA, 25 bp, Rattus norvegicus
tggcgactctcatagcgatcgtggg

SEQ ID NO: 589010 - DNA, 25 bp, Rattus norvegicus
tactatcgcccacgggacaggaatg

SEQ ID NO: 589011 - DNA, 25 bp, Rattus norvegicus
ctgggacctgagttctgcatttcta

SEQ ID NO: 589012 - DNA, 25 bp, Rattus norvegicus
tctgcgagcatctgggcaccactca

SEQ ID NO: 589013 - DNA, 25 bp, Rattus norvegicus
gccttccttggccaactgccggtgt

SEQ ID NO: 589014 - DNA, 25 bp, Rattus norvegicus
gggctcactgagatttggcaaacta

SEQ ID NO: 589015 - DNA, 25 bp, Rattus norvegicus
ttctccgtgtgtaaaatggtgatca

SEQ ID NO: 589016 - DNA, 25 bp, Rattus norvegicus
gcagcgatggccttagcaagctatt

SEQ ID NO: 589017 - DNA, 25 bp, Rattus norvegicus
atgcctgggtcctattgcagcgatg

SEQ ID NO: 589018 - DNA, 25 bp, Rattus norvegicus
ggcagcactgagatgttgacgatcc

SEQ ID NO: 589019 - DNA, 25 bp, Rattus norvegicus
tcctgcaacccttacggtctttaga

SEQ ID NO: 589020 - DNA, 25 bp, Rattus norvegicus
cggtgaactccacacggcagaagta

SEQ ID NO: 589021 - DNA, 25 bp, Rattus norvegicus
gctgtacttctcagccgagggccca

SEQ ID NO: 589022 - DNA, 25 bp, Rattus norvegicus
ccgggcacagtgtgagttgccatgc

SEQ ID NO: 589023 - DNA, 25 bp, Rattus norvegicus
cgggagaggccagaaatgcatgcca

SEQ ID NO: 589024 - DNA, 25 bp, Rattus norvegicus
atgccaagtccttgtgcacggggcc

SEQ ID NO: 589025 - DNA, 25 bp, Rattus norvegicus
cgcggacctgaacgcaccatatgtg

SEQ ID NO: 589026 - DNA, 25 bp, Rattus norvegicus
gcaccatatgtgtctctcaccagag

SEQ ID NO: 589027 - DNA, 25 bp, Rattus norvegicus
ctcaccagagacgagggagtggctt

SEQ ID NO: 589028 - DNA, 25 bp, Rattus norvegicus
gagtggctttgatttcatttccgta

SEQ ID NO: 589029 - DNA, 25 bp, Rattus norvegicus
atctgggtaatttccggacactcgc

SEQ ID NO: 589030 - DNA, 25 bp, Rattus norvegicus
tgatatcccgggaattgcacacaca

SEQ ID NO: 589031 - DNA, 25 bp, Rattus norvegicus
ggttgcctccgcgtgaattccgcga

SEQ ID NO: 589032 - DNA, 25 bp, Rattus norvegicus
ccgtgcacctgtgaacgcagagcga

SEQ ID NO: 589033 - DNA, 25 bp, Rattus norvegicus
agactctggcccgaacagcttacgc

SEQ ID NO: 589034 - DNA, 25 bp, Rattus norvegicus
tccggacactcgcacttatgatatc

SEQ ID NO: 589035 - DNA, 25 bp, Rattus norvegicus
tacagctctcggtacggctcgcagt

SEQ ID NO: 589036 - DNA, 25 bp, Rattus norvegicus
cagagaaggcgacctccagagcttc

SEQ ID NO: 589037 - DNA, 25 bp, Rattus norvegicus
cgggaagtagttccgctcttttgtg

SEQ ID NO: 589038 - DNA, 25 bp, Rattus norvegicus
attagagcgcatagctgggccgatc

SEQ ID NO: 589039 - DNA, 25 bp, Rattus norvegicus
tgggccgatccctttggcgagccac

SEQ ID NO: 589040 - DNA, 25 bp, Rattus norvegicus
ggtacggctcgcagtgcaccgcgac

SEQ ID NO: 589041 - DNA, 25 bp, Rattus norvegicus
agagcttcaccggaagaccaacttc

SEQ ID NO: 589042 - DNA, 25 bp, Rattus norvegicus
tttggcgagccacgtctgccagcgc

SEQ ID NO: 589043 - DNA, 25 bp, Rattus norvegicus
cgtggacagacataggagcagagaa

SEQ ID NO: 589044 - DNA, 25 bp, Rattus norvegicus
gggcgtgtcttagatgcaggtatta

SEQ ID NO: 589045 - DNA, 25 bp, Rattus norvegicus
caaagccaagcaggcaggcgacctc

SEQ ID NO: 589046 - DNA, 25 bp, Rattus norvegicus
tttgtgccgcgctgttcctgcgcac

SEQ ID NO: 589047 - DNA, 25 bp, Rattus norvegicus
ttccgctcttttgtgccgcgctgtt

SEQ ID NO: 589048 - DNA, 25 bp, Rattus norvegicus
gggtctttggaagccgctcacctgc

SEQ ID NO: 589049 - DNA, 25 bp, Rattus norvegicus
ccagtagctccagcgagtcggagtc

SEQ ID NO: 589050 - DNA, 25 bp, Rattus norvegicus
tagatttcggtcaattgaagggatc

SEQ ID NO: 589051 - DNA, 25 bp, Rattus norvegicus
gatctgggttcttgccggaggggaa

SEQ ID NO: 589052 - DNA, 25 bp, Rattus norvegicus
ccctgggtagatttcggtcaattga

SEQ ID NO: 589053 - DNA, 25 bp, Rattus norvegicus
acgacctctctgtccctccaccgcc

SEQ ID NO: 589054 - DNA, 25 bp, Rattus norvegicus
cccaaggaggcgcagccagtgagcg

SEQ ID NO: 589055 - DNA, 25 bp, Rattus norvegicus
tcgcggcccagtagctccagcgagt

SEQ ID NO: 589056 - DNA, 25 bp, Rattus norvegicus
ggcgcgagagcccacactgctcgcc

SEQ ID NO: 589057 - DNA, 25 bp, Rattus norvegicus
tagctccagcgagtcggagtctgcc

SEQ ID NO: 589058 - DNA, 25 bp, Rattus norvegicus
gctccagcgagtcggagtctgccgc

SEQ ID NO: 589059 - DNA, 25 bp, Rattus norvegicus
agtctgccgcggagactgtgcggcc

SEQ ID NO: 589060 - DNA, 25 bp, Rattus norvegicus
gagtcccggagtcctactgaaagga

SEQ ID NO: 589061 - DNA, 25 bp, Rattus norvegicus
agtgagcggccgacgacctctctgt

SEQ ID NO: 589062 - DNA, 25 bp, Rattus norvegicus
cggtcaattgaagggatctgggttc

SEQ ID NO: 589063 - DNA, 25 bp, Rattus norvegicus
ttggaactggagactgctgggattc

SEQ ID NO: 589064 - DNA, 25 bp, Rattus norvegicus
ctatgcgaacacaaagcccggcggc

SEQ ID NO: 589065 - DNA, 25 bp, Rattus norvegicus
ctttggagcttaggcgctgcatgcc

SEQ ID NO: 589066 - DNA, 25 bp, Rattus norvegicus
ccggagtcgacaactttggagctta

SEQ ID NO: 589067 - DNA, 25 bp, Rattus norvegicus
actcgctcccgtggcaaatgaatgg

SEQ ID NO: 589068 - DNA, 25 bp, Rattus norvegicus
ctgcagcgcagtggaagtcaagagc

SEQ ID NO: 589069 - DNA, 25 bp, Rattus norvegicus
agaccctacgcttctacgactgcag

SEQ ID NO: 589070 - DNA, 25 bp, Rattus norvegicus
ccggagttttcataagtctcagacc

SEQ ID NO: 589071 - DNA, 25 bp, Rattus norvegicus
ctaagtggggccgaaatcatgaacc

SEQ ID NO: 589072 - DNA, 25 bp, Rattus norvegicus
gtctccacggagactctctctgagg

SEQ ID NO: 589073 - DNA, 25 bp, Rattus norvegicus
taggctctgaaccagctccacgaga

SEQ ID NO: 589074 - DNA, 25 bp, Rattus norvegicus
gagagctgctcttttgttccacgaa

SEQ ID NO: 589075 - DNA, 25 bp, Rattus norvegicus
ttgttccacgaactagagtcgaccc

SEQ ID NO: 589076 - DNA, 25 bp, Rattus norvegicus
tgggacagtccgtgtaggctctgaa

SEQ ID NO: 589077 - DNA, 25 bp, Rattus norvegicus
gcaggcactctgtcgaggaagaaga

SEQ ID NO: 589078 - DNA, 25 bp, Rattus norvegicus
aggtaccagggatcttcatttcccg

SEQ ID NO: 589079 - DNA, 25 bp, Rattus norvegicus
tggcaccagcgtgcgagtgacaccc

SEQ ID NO: 589080 - DNA, 25 bp, Rattus norvegicus
ttctacatccgagatggcaccagcg

SEQ ID NO: 589081 - DNA, 25 bp, Rattus norvegicus
ggctttaccggcacggctgtgagaa

SEQ ID NO: 589082 - DNA, 25 bp, Rattus norvegicus
accgccgcgtgaggctttaccggca

SEQ ID NO: 589083 - DNA, 25 bp, Rattus norvegicus
agctcaacatcagcatgccgcacga

SEQ ID NO: 589084 - DNA, 25 bp, Rattus norvegicus
ctggtgctcttctgcctctgagtga

SEQ ID NO: 589085 - DNA, 25 bp, Rattus norvegicus
ctgtttcagaggaggcagaccatta

SEQ ID NO: 589086 - DNA, 25 bp, Rattus norvegicus
tctgagtgacgcacctctcacttta

SEQ ID NO: 589087 - DNA, 25 bp, Rattus norvegicus
ctcactttacgctctctggactgtt

SEQ ID NO: 589088 - DNA, 25 bp, Rattus norvegicus
ttacagcttcggagcaggcactctg

SEQ ID NO: 589089 - DNA, 25 bp, Rattus norvegicus
ttcatttcccgaatggtgcccggcg

SEQ ID NO: 589090 - DNA, 25 bp, Rattus norvegicus
gcccggtgtcctccatcattgacgt

SEQ ID NO: 589091 - DNA, 25 bp, Rattus norvegicus
acgttgccttatttgcatgccgacg

SEQ ID NO: 589092 - DNA, 25 bp, Rattus norvegicus
caggaagtgacgttgccttatttgc

SEQ ID NO: 589093 - DNA, 25 bp, Rattus norvegicus
tgcctcaggaagtgacgttgcctta

SEQ ID NO: 589094 - DNA, 25 bp, Rattus norvegicus
tcagctgcctcaggaagtgacgttg

SEQ ID NO: 589095 - DNA, 25 bp, Rattus norvegicus
atggcgctcagctgcctcaggaagt

SEQ ID NO: 589096 - DNA, 25 bp, Rattus norvegicus
gagaagatggcgctcagctgcctca

SEQ ID NO: 589097 - DNA, 25 bp, Rattus norvegicus
ccgagccgcgcactagaatgtccgg

SEQ ID NO: 589098 - DNA, 25 bp, Rattus norvegicus
ccgcgcactagaatgtccgggattc

SEQ ID NO: 589099 - DNA, 25 bp, Rattus norvegicus
gcactagaatgtccgggattccgaa

SEQ ID NO: 589100 - DNA, 25 bp, Rattus norvegicus
aatgtccgggattccgaaggcaccg

SEQ ID NO: 589101 - DNA, 25 bp, Rattus norvegicus
attccgaaggcaccgtggtagcgac

SEQ ID NO: 589102 - DNA, 25 bp, Rattus norvegicus
cgccgtcgcaacaccgccgcgtcct

SEQ ID NO: 589103 - DNA, 25 bp, Rattus norvegicus
gcgtcctccgcctacgcggcgggac

SEQ ID NO: 589104 - DNA, 25 bp, Rattus norvegicus
gaaagagaagatggcgctcagctgc

SEQ ID NO: 589105 - DNA, 25 bp, Rattus norvegicus
cgcggcgcgaagttatgactgttgt

SEQ ID NO: 589106 - DNA, 25 bp, Rattus norvegicus
ccaaagacgagacccggcagcagga

SEQ ID NO: 589107 - DNA, 25 bp, Rattus norvegicus
gtaagccctagatgaccaaagacga

SEQ ID NO: 589108 - DNA, 25 bp, Rattus norvegicus
tggacagacgggagagtaagcccta

SEQ ID NO: 589109 - DNA, 25 bp, Rattus norvegicus
agctcgattatgcactggacagacg

SEQ ID NO: 589110 - DNA, 25 bp, Rattus norvegicus
ggggcccgcaagctcgattatgcac

SEQ ID NO: 589111 - DNA, 25 bp, Rattus norvegicus
cgacgctggcccacatgcctgggag

SEQ ID NO: 589112 - DNA, 25 bp, Rattus norvegicus
tcttgcttccgcaggaggtgaccga

SEQ ID NO: 589113 - DNA, 25 bp, Rattus norvegicus
agcaagttcttgcttccgcaggagg

SEQ ID NO: 589114 - DNA, 25 bp, Rattus norvegicus
cgaagcaaatttcttgagcaagttc

SEQ ID NO: 589115 - DNA, 25 bp, Rattus norvegicus
cctggttttcgaagcaaatttcttg

SEQ ID NO: 589116 - DNA, 25 bp, Rattus norvegicus
cctgatcggtgcatacctggttttc

SEQ ID NO: 589117 - DNA, 25 bp, Rattus norvegicus
cagaggaccctgatcggtgcatacc

SEQ ID NO: 589118 - DNA, 25 bp, Rattus norvegicus
accaggcgaccaggcccgcagagga

SEQ ID NO: 589119 - DNA, 25 bp, Rattus norvegicus
ggctcacgctggagtcgccacaggc

SEQ ID NO: 589120 - DNA, 25 bp, Rattus norvegicus
ctccgtgtcctccagcctggctgct

SEQ ID NO: 589121 - DNA, 25 bp, Rattus norvegicus
cgccacgcctcatgaaggctcagag

SEQ ID NO: 589122 - DNA, 25 bp, Rattus norvegicus
tgaaggctcagagccgccacgcatg

SEQ ID NO: 589123 - DNA, 25 bp, Rattus norvegicus
tcagagccgccacgcatggagactt

SEQ ID NO: 589124 - DNA, 25 bp, Rattus norvegicus
ccgccacgcatggagacttagcctg

SEQ ID NO: 589125 - DNA, 25 bp, Rattus norvegicus
cacgcatggagacttagcctgggga

SEQ ID NO: 589126 - DNA, 25 bp, Rattus norvegicus
cttagcctggggagctaacccagaa

SEQ ID NO: 589127 - DNA, 25 bp, Rattus norvegicus
gctaacccagaacagcgaatcgcgc

SEQ ID NO: 589128 - DNA, 25 bp, Rattus norvegicus
ggaaggtatgaggatcgctgacgcc

SEQ ID NO: 589129 - DNA, 25 bp, Rattus norvegicus
tggagtcgccacaggcctccgtgtc

SEQ ID NO: 589130 - DNA, 25 bp, Rattus norvegicus
agaacagcgaatcgcgccacataca

SEQ ID NO: 589131 - DNA, 25 bp, Rattus norvegicus
accccgaggccagatgaagctcaca

SEQ ID NO: 589132 - DNA, 25 bp, Rattus norvegicus
gggagctaacccagaacagcgaatc

SEQ ID NO: 589133 - DNA, 25 bp, Rattus norvegicus
cacccataggtagttcgcggcgtcc

SEQ ID NO: 589134 - DNA, 25 bp, Rattus norvegicus
gcgcaagcgcgttcaagatgtcgta

SEQ ID NO: 589135 - DNA, 25 bp, Rattus norvegicus
aagatgtcgtacatgcttccgcatc

SEQ ID NO: 589136 - DNA, 25 bp, Rattus norvegicus
tgcttccgcatctgcacaatggctg

SEQ ID NO: 589137 - DNA, 25 bp, Rattus norvegicus
tgcacaatggctggcaggtagacca

SEQ ID NO: 589138 - DNA, 25 bp, Rattus norvegicus
gggtcgcgacctcagctctttacac

SEQ ID NO: 589139 - DNA, 25 bp, Rattus norvegicus
gcaggtagaccaggccattctttcg

SEQ ID NO: 589140 - DNA, 25 bp, Rattus norvegicus
cgagccgaggccctgtatggccttc

SEQ ID NO: 589141 - DNA, 25 bp, Rattus norvegicus
ctcacacgaggttagaggtcgtcta

SEQ ID NO: 589142 - DNA, 25 bp, Rattus norvegicus
agaggtcgtctaatgtggcccagtg

SEQ ID NO: 589143 - DNA, 25 bp, Rattus norvegicus
gcctgcgcagtaacgctgaaaaagc

SEQ ID NO: 589144 - DNA, 25 bp, Rattus norvegicus
aacaggaggtggagcgcgtcctccc

SEQ ID NO: 589145 - DNA, 25 bp, Rattus norvegicus
cgtggtcgtcattcgcttcggacac

SEQ ID NO: 589146 - DNA, 25 bp, Rattus norvegicus
cattctttcggaggaggaccgcgtg

SEQ ID NO: 589147 - DNA, 25 bp, Rattus norvegicus
gccagtatgaacatccgccgggctc

SEQ ID NO: 589148 - DNA, 25 bp, Rattus norvegicus
ttctaccacggcctctcgtggcctc

SEQ ID NO: 589149 - DNA, 25 bp, Rattus norvegicus
tatgaacatccgccgggctcggccg

SEQ ID NO: 589150 - DNA, 25 bp, Rattus norvegicus
cagtatgaacatccgccgggctcgg

SEQ ID NO: 589151 - DNA, 25 bp, Rattus norvegicus
tgtccctcatggacacatcacctca

SEQ ID NO: 589152 - DNA, 25 bp, Rattus norvegicus
ccagtatgaacatccgccgggctcg

SEQ ID NO: 589153 - DNA, 25 bp, Rattus norvegicus
ggctcggccggacgacctgatgaac

SEQ ID NO: 589154 - DNA, 25 bp, Rattus norvegicus
acggcctctcgtggcctcagctctc

SEQ ID NO: 589155 - DNA, 25 bp, Rattus norvegicus
tcatggacacatcacctcactggcc

SEQ ID NO: 589156 - DNA, 25 bp, Rattus norvegicus
cctcactggccgtgaaacgctccca

SEQ ID NO: 589157 - DNA, 25 bp, Rattus norvegicus
actggccgtgaaacgctcccaccgg

SEQ ID NO: 589158 - DNA, 25 bp, Rattus norvegicus
ctcggccggacgacctgatgaacat

SEQ ID NO: 589159 - DNA, 25 bp, Rattus norvegicus
gctcggccggacgacctgatgaaca

SEQ ID NO: 589160 - DNA, 25 bp, Rattus norvegicus
tcggccggacgacctgatgaacatg

SEQ ID NO: 589161 - DNA, 25 bp, Rattus norvegicus
cgaccttggtcctcggagccctagg

SEQ ID NO: 589162 - DNA, 25 bp, Rattus norvegicus
tggccacggctaaaaccggagagcg

SEQ ID NO: 589163 - DNA, 25 bp, Rattus norvegicus
gcgctttgggctggccacggctaaa

SEQ ID NO: 589164 - DNA, 25 bp, Rattus norvegicus
accaggcagatgtcgcgctttgggc

SEQ ID NO: 589165 - DNA, 25 bp, Rattus norvegicus
cttaagtggaccaggcagatgtcgc

SEQ ID NO: 589166 - DNA, 25 bp, Rattus norvegicus
ctgggtcttaagtggaccaggcaga

SEQ ID NO: 589167 - DNA, 25 bp, Rattus norvegicus
cagcctaacagtttggggtcctggg

SEQ ID NO: 589168 - DNA, 25 bp, Rattus norvegicus
tccacaccagcctaacagtttgggg

SEQ ID NO: 589169 - DNA, 25 bp, Rattus norvegicus
ggcgtccgggcgtccatccacacca

SEQ ID NO: 589170 - DNA, 25 bp, Rattus norvegicus
tagggcacgcgtcactcaccgcgtt

SEQ ID NO: 589171 - DNA, 25 bp, Rattus norvegicus
caagccggcgaccttggtcctcgga

SEQ ID NO: 589172 - DNA, 25 bp, Rattus norvegicus
caataccctaaagccaagccggcga

SEQ ID NO: 589173 - DNA, 25 bp, Rattus norvegicus
caggtgcggaccagaccagcagccg

SEQ ID NO: 589174 - DNA, 25 bp, Rattus norvegicus
gtcactcaccgcgttctgcagcaag

SEQ ID NO: 589175 - DNA, 25 bp, Rattus norvegicus
ccctggagtgggagtgacctccatt

SEQ ID NO: 589176 - DNA, 25 bp, Rattus norvegicus
ctccctagctttcctgggagctgga

SEQ ID NO: 589177 - DNA, 25 bp, Rattus norvegicus
cggagaacctgaggacttgggatcc

SEQ ID NO: 589178 - DNA, 25 bp, Rattus norvegicus
tttggttgctcttcgctatcaggcg

SEQ ID NO: 589179 - DNA, 25 bp, Rattus norvegicus
acgcggattcagctcactttggttg

SEQ ID NO: 589180 - DNA, 25 bp, Rattus norvegicus
tgacctccattgtgacgccacgggg

SEQ ID NO: 589181 - DNA, 25 bp, Rattus norvegicus
ggacaggtcctagctctgcttggaa

SEQ ID NO: 589182 - DNA, 25 bp, Rattus norvegicus
aacagaaatgagtgcgggccacctc

SEQ ID NO: 589183 - DNA, 25 bp, Rattus norvegicus
tgggacactcagcagaacagaaatg

SEQ ID NO: 589184 - DNA, 25 bp, Rattus norvegicus
ggtttttcctaatctgggacactca

SEQ ID NO: 589185 - DNA, 25 bp, Rattus norvegicus
tggtcacttggcctgaaagcgcctc

SEQ ID NO: 589186 - DNA, 25 bp, Rattus norvegicus
cgctcgctagagacaggttcacgtg

SEQ ID NO: 589187 - DNA, 25 bp, Rattus norvegicus
taaggcgtctactctgtgccctgcg

SEQ ID NO: 589188 - DNA, 25 bp, Rattus norvegicus
cttcctctggctgggactgagggac

SEQ ID NO: 589189 - DNA, 25 bp, Rattus norvegicus
tgtgacgtcatctaggaagccttgc

SEQ ID NO: 589190 - DNA, 25 bp, Rattus norvegicus
ggaagctcggctcccgtgaagctga

SEQ ID NO: 589191 - DNA, 25 bp, Rattus norvegicus
cgtgaagctgaactcgcaactcgcc

SEQ ID NO: 589192 - DNA, 25 bp, Rattus norvegicus
cgttcgcctgggcagctttcatttc

SEQ ID NO: 589193 - DNA, 25 bp, Rattus norvegicus
catttcgccgaatggccattatcta

SEQ ID NO: 589194 - DNA, 25 bp, Rattus norvegicus
tggccattatctacaacggatagta

SEQ ID NO: 589195 - DNA, 25 bp, Rattus norvegicus
cggatagtagcattttcccacgtcg

SEQ ID NO: 589196 - DNA, 25 bp, Rattus norvegicus
ccgctccttcgcaggtgggtgtgac

SEQ ID NO: 589197 - DNA, 25 bp, Rattus norvegicus
tcgccgctcctgtggcaaagcatag

SEQ ID NO: 589198 - DNA, 25 bp, Rattus norvegicus
tggcaaagcatagtcatgatcctta

SEQ ID NO: 589199 - DNA, 25 bp, Rattus norvegicus
gatccttacgatgctactgatgctg

SEQ ID NO: 589200 - DNA, 25 bp, Rattus norvegicus
ctgatgctgaagctgtgcaccgagg

SEQ ID NO: 589201 - DNA, 25 bp, Rattus norvegicus
agctgaacgtcaagcgccgctcctt

SEQ ID NO: 589202 - DNA, 25 bp, Rattus norvegicus
cgtggccaacgagctgaacgtcaag

SEQ ID NO: 589203 - DNA, 25 bp, Rattus norvegicus
acccaataggggtagagacgaggct

SEQ ID NO: 589204 - DNA, 25 bp, Rattus norvegicus
cggtgccatcctgtggggaaaagaa

SEQ ID NO: 589205 - DNA, 25 bp, Rattus norvegicus
tgtaacaggggtccagtcacacatc

SEQ ID NO: 589206 - DNA, 25 bp, Rattus norvegicus
gtcacacatctacgcactcggaaca

SEQ ID NO: 589207 - DNA, 25 bp, Rattus norvegicus
tgcgagcggcatcacggtcagctcc

SEQ ID NO: 589208 - DNA, 25 bp, Rattus norvegicus
cgcactcggaacaccagatctctga

SEQ ID NO: 589209 - DNA, 25 bp, Rattus norvegicus
gcgttcgtgcctgggcgacctcaca

SEQ ID NO: 589210 - DNA, 25 bp, Rattus norvegicus
gtccgaaagatccactctccagctg

SEQ ID NO: 589211 - DNA, 25 bp, Rattus norvegicus
ctccagctgatctgcgtacccaata

SEQ ID NO: 589212 - DNA, 25 bp, Rattus norvegicus
ctgtctactcacgttgcgagcggca

SEQ ID NO: 589213 - DNA, 25 bp, Rattus norvegicus
atgcgatccacagcggcgcggtgcc

SEQ ID NO: 589214 - DNA, 25 bp, Rattus norvegicus
tgacccatctgggatgcgatccaca

SEQ ID NO: 589215 - DNA, 25 bp, Rattus norvegicus
acctcgctgtgacccatctgggatg

SEQ ID NO: 589216 - DNA, 25 bp, Rattus norvegicus
acaccagatctctgagtccgaaaga

SEQ ID NO: 589217 - DNA, 25 bp, Rattus norvegicus
agctcgcgctcagccaggtgcacga

SEQ ID NO: 589218 - DNA, 25 bp, Rattus norvegicus
tgtcctcccgcaggaccggttcagg

SEQ ID NO: 589219 - DNA, 25 bp, Rattus norvegicus
ccttgagctccgagtaggagcgcga

SEQ ID NO: 589220 - DNA, 25 bp, Rattus norvegicus
agatgactgcccaccagtagctggc

SEQ ID NO: 589221 - DNA, 25 bp, Rattus norvegicus
gcgaagagcgccatggccacgcaga

SEQ ID NO: 589222 - DNA, 25 bp, Rattus norvegicus
gcgttccagcatcttgctgcccgtg

SEQ ID NO: 589223 - DNA, 25 bp, Rattus norvegicus
gtcccgcgagcagcgacacgtagaa

SEQ ID NO: 589224 - DNA, 25 bp, Rattus norvegicus
aaggcgcacttgctctcggcttgca

SEQ ID NO: 589225 - DNA, 25 bp, Rattus norvegicus
agcgcagcaggaactcgaaggagaa

SEQ ID NO: 589226 - DNA, 25 bp, Rattus norvegicus
acgcacactgtctccaacacgaaga

SEQ ID NO: 589227 - DNA, 25 bp, Rattus norvegicus
aacacgaagaggttgcggcacttgg

SEQ ID NO: 589228 - DNA, 25 bp, Rattus norvegicus
ggcacttggtggagcactcgcccta

SEQ ID NO: 589229 - DNA, 25 bp, Rattus norvegicus
tcgccctagggaggaaaggaacatc

SEQ ID NO: 589230 - DNA, 25 bp, Rattus norvegicus
ctgcgtggcaccatgtctccatagc

SEQ ID NO: 589231 - DNA, 25 bp, Rattus norvegicus
ctcctcctcgcgacggcgcagacgg

SEQ ID NO: 589232 - DNA, 25 bp, Rattus norvegicus
cggctcacgtcgtagtcgtcacaca

SEQ ID NO: 589233 - DNA, 25 bp, Rattus norvegicus
cgggagccgggccatggccccatat

SEQ ID NO: 589234 - DNA, 25 bp, Rattus norvegicus
acgttgattatgacgtggcgcgccc

SEQ ID NO: 589235 - DNA, 25 bp, Rattus norvegicus
cctgcagcccccgacgttgattatg

SEQ ID NO: 589236 - DNA, 25 bp, Rattus norvegicus
cgcagcccaggccagacgcaccctg

SEQ ID NO: 589237 - DNA, 25 bp, Rattus norvegicus
tagtcgtcacacacgcgcagcagct

SEQ ID NO: 589238 - DNA, 25 bp, Rattus norvegicus
agaagaactcgtcgcggctcacgtc

SEQ ID NO: 589239 - DNA, 25 bp, Rattus norvegicus
aagcgcacgggctgcggtcgaagaa

SEQ ID NO: 589240 - DNA, 25 bp, Rattus norvegicus
cagcagcgccacgatggcgcggaaa

SEQ ID NO: 589241 - DNA, 25 bp, Rattus norvegicus
agcagcctcagcttgccggcgcgca

SEQ ID NO: 589242 - DNA, 25 bp, Rattus norvegicus
aggccagctcgtcccggaaggccag

SEQ ID NO: 589243 - DNA, 25 bp, Rattus norvegicus
ctccagccgcgcctcgtcgatgccc

SEQ ID NO: 589244 - DNA, 25 bp, Rattus norvegicus
ccagtaggccagctcgtcccggaag

SEQ ID NO: 589245 - DNA, 25 bp, Rattus norvegicus
ggcagccgccagaagctccatgaaa

SEQ ID NO: 589246 - DNA, 25 bp, Rattus norvegicus
ttggacgatcatcctcgggcgcata

SEQ ID NO: 589247 - DNA, 25 bp, Rattus norvegicus
ataggaagcagctcaccgtccgcgc

SEQ ID NO: 589248 - DNA, 25 bp, Rattus norvegicus
cactgtccggaccagacgttgctgt

SEQ ID NO: 589249 - DNA, 25 bp, Rattus norvegicus
tttgcagaattcgaacgcgggagcc

SEQ ID NO: 589250 - DNA, 25 bp, Rattus norvegicus
acccgcaaccctgagaggttacaga

SEQ ID NO: 589251 - DNA, 25 bp, Rattus norvegicus
tgcaaccagaaagggaaccagagcc

SEQ ID NO: 589252 - DNA, 25 bp, Rattus norvegicus
agagcccactgctcagagtccggca

SEQ ID NO: 589253 - DNA, 25 bp, Rattus norvegicus
tccggtagaaccgacgcggccagac

SEQ ID NO: 589254 - DNA, 25 bp, Rattus norvegicus
gaactgagctgcgttcccgccagtg

SEQ ID NO: 589255 - DNA, 25 bp, Rattus norvegicus
acaggtgtctactctccgctcggac

SEQ ID NO: 589256 - DNA, 25 bp, Rattus norvegicus
tgcacagacctctttcgcagctacg

SEQ ID NO: 589257 - DNA, 25 bp, Rattus norvegicus
acttgggtcacgcaatgtaaattca

SEQ ID NO: 589258 - DNA, 25 bp, Rattus norvegicus
ggtgcgcacagccttcaagccctgt

SEQ ID NO: 589259 - DNA, 25 bp, Rattus norvegicus
tgcgaatgctggacttaacgagacc

SEQ ID NO: 589260 - DNA, 25 bp, Rattus norvegicus
actgcggcttcgtacactgccagca

SEQ ID NO: 589261 - DNA, 25 bp, Rattus norvegicus
actgcgtgcgctcaagataaggata

SEQ ID NO: 589262 - DNA, 25 bp, Rattus norvegicus
gccagtccgtggtatggagactaca

SEQ ID NO: 589263 - DNA, 25 bp, Rattus norvegicus
cgcggaccgctgtcacaagactttt

SEQ ID NO: 589264 - DNA, 25 bp, Rattus norvegicus
ccagttccggcatacagtgcgtgtc

SEQ ID NO: 589265 - DNA, 25 bp, Rattus norvegicus
taacgagaccgagttccagcgcagg

SEQ ID NO: 589266 - DNA, 25 bp, Rattus norvegicus
cgcggaccgctgtattggatagtac

SEQ ID NO: 589267 - DNA, 25 bp, Rattus norvegicus
atcctcccgtcaagcactgcgaatg

SEQ ID NO: 589268 - DNA, 25 bp, Rattus norvegicus
gaaactataggtctccctccgcaga

SEQ ID NO: 589269 - DNA, 25 bp, Rattus norvegicus
gcggcctagactcgatccttcttta

SEQ ID NO: 589270 - DNA, 25 bp, Rattus norvegicus
gcactgcgaggttttcatggagaaa

SEQ ID NO: 589271 - DNA, 25 bp, Rattus norvegicus
tgcgagttccaaccacaggagtctt

SEQ ID NO: 589272 - DNA, 25 bp, Rattus norvegicus
cgtgtctatggcaactcccgtcgta

SEQ ID NO: 589273 - DNA, 25 bp, Rattus norvegicus
gtgcgatgagcgtcccgctttaaga

SEQ ID NO: 589274 - DNA, 25 bp, Rattus norvegicus
tgcggtttcgcctctctagtcaagg

SEQ ID NO: 589275 - DNA, 25 bp, Rattus norvegicus
cagtgtcgctcagctaggtgtctga

SEQ ID NO: 589276 - DNA, 25 bp, Rattus norvegicus
tggcgacatttctcggccaaaaggc

SEQ ID NO: 589277 - DNA, 25 bp, Rattus norvegicus
ccattttgtcggtgtttgtcgcagc

SEQ ID NO: 589278 - DNA, 25 bp, Rattus norvegicus
gctggatccacctgaggaggttgta

SEQ ID NO: 589279 - DNA, 25 bp, Rattus norvegicus
tgcgcagccgcagtatgaatgataa

SEQ ID NO: 589280 - DNA, 25 bp, Rattus norvegicus
agaactcgtcctacaggcgccttgg

SEQ ID NO: 589281 - DNA, 25 bp, Rattus norvegicus
aacctcgacttgacaggctgacaga

SEQ ID NO: 589282 - DNA, 25 bp, Rattus norvegicus
aggcgatcttccaggttcacccaag

SEQ ID NO: 589283 - DNA, 25 bp, Rattus norvegicus
gagcccgacacgtgccgtagattta

SEQ ID NO: 589284 - DNA, 25 bp, Rattus norvegicus
cgtggcaacgcccagcaaaactctt

SEQ ID NO: 589285 - DNA, 25 bp, Rattus norvegicus
atcgcaggaaccagcagggagaccc

SEQ ID NO: 589286 - DNA, 25 bp, Rattus norvegicus
aaggtcagaggttggccctacccag

SEQ ID NO: 589287 - DNA, 25 bp, Rattus norvegicus
cgccacggggcttgctatttttgga

SEQ ID NO: 589288 - DNA, 25 bp, Rattus norvegicus
cgcagacagcagtgtggaaactcca

SEQ ID NO: 589289 - DNA, 25 bp, Rattus norvegicus
aatgtggcccgagcttctgtttttc

SEQ ID NO: 589290 - DNA, 25 bp, Rattus norvegicus
tctcggcctccacttatttttatct

SEQ ID NO: 589291 - DNA, 25 bp, Rattus norvegicus
ctcgactttcattaaaaagcgggcg

SEQ ID NO: 589292 - DNA, 25 bp, Rattus norvegicus
ttcgggaagcagtcaaagtagcaca

SEQ ID NO: 589293 - DNA, 25 bp, Rattus norvegicus
ttttctcaaagttgcttcgggaagc

SEQ ID NO: 589294 - DNA, 25 bp, Rattus norvegicus
tttagcctgaaaactccggagcacg

SEQ ID NO: 589295 - DNA, 25 bp, Rattus norvegicus
agcctgcttccctatttagcctgaa

SEQ ID NO: 589296 - DNA, 25 bp, Rattus norvegicus
tttcctaccgtaggtagcctgcttc

SEQ ID NO: 589297 - DNA, 25 bp, Rattus norvegicus
cagccgttaagacggaatgattttc

SEQ ID NO: 589298 - DNA, 25 bp, Rattus norvegicus
tgctgctgctacacgggactgtcag

SEQ ID NO: 589299 - DNA, 25 bp, Rattus norvegicus
gacagcggaaggacgagtgacaaca

SEQ ID NO: 589300 - DNA, 25 bp, Rattus norvegicus
atcataataagccaccgccacgggg

SEQ ID NO: 589301 - DNA, 25 bp, Rattus norvegicus
tggccgctgccaggcaagcgcaaca

SEQ ID NO: 589302 - DNA, 25 bp, Rattus norvegicus
ttttaaataaactccgcgcgcgagc

SEQ ID NO: 589303 - DNA, 25 bp, Rattus norvegicus
gtgggacttggtctcccttaggata

SEQ ID NO: 589304 - DNA, 25 bp, Rattus norvegicus
gggtttacataaacaagcggctcgc

SEQ ID NO: 589305 - DNA, 25 bp, Rattus norvegicus
caacctaggcgcagttggccgctgc

SEQ ID NO: 589306 - DNA, 25 bp, Rattus norvegicus
aagcgcaacagcctaggccgggccg

SEQ ID NO: 589307 - DNA, 25 bp, Rattus norvegicus
atcgaagtcgaactccgggtcctgc

SEQ ID NO: 589308 - DNA, 25 bp, Rattus norvegicus
cgaactcgaagaggaaatcgaagtc

SEQ ID NO: 589309 - DNA, 25 bp, Rattus norvegicus
ccgccgctctgatcgaactcgaaga

SEQ ID NO: 589310 - DNA, 25 bp, Rattus norvegicus
aacttggtccgcgtcgctcctggct

SEQ ID NO: 589311 - DNA, 25 bp, Rattus norvegicus
aggtccaagtcctgcgccggacaca

SEQ ID NO: 589312 - DNA, 25 bp, Rattus norvegicus
cccggactacgaggtccaagtcctg

SEQ ID NO: 589313 - DNA, 25 bp, Rattus norvegicus
ggctctcagaaagggcggcttccga

SEQ ID NO: 589314 - DNA, 25 bp, Rattus norvegicus
ttggtctcccttaggataccgccgc

SEQ ID NO: 589315 - DNA, 25 bp, Rattus norvegicus
gactggaaagctggtacttggcatc

SEQ ID NO: 589316 - DNA, 25 bp, Rattus norvegicus
cgggctctgccttctgcctttttaa

SEQ ID NO: 589317 - DNA, 25 bp, Rattus norvegicus
tcactctgacgcagggccgggctct

SEQ ID NO: 589318 - DNA, 25 bp, Rattus norvegicus
tctcggtctcactctgacgcagggc

SEQ ID NO: 589319 - DNA, 25 bp, Rattus norvegicus
ggagcctctcggtctcactctgacg

SEQ ID NO: 589320 - DNA, 25 bp, Rattus norvegicus
tgtcgcccagttcggagcctctcgg

SEQ ID NO: 589321 - DNA, 25 bp, Rattus norvegicus
cgcgaggcgactctgtcgcccagtt

SEQ ID NO: 589322 - DNA, 25 bp, Rattus norvegicus
tggtacttggcatccacgcggcggt

SEQ ID NO: 589323 - DNA, 25 bp, Rattus norvegicus
tctgcctttttaaagctggaaaaca

SEQ ID NO: 589324 - DNA, 25 bp, Rattus norvegicus
aaagtttctccgctcccgcagactg

SEQ ID NO: 589325 - DNA, 25 bp, Rattus norvegicus
ttcacagtgtgtgccacgctgtccg

SEQ ID NO: 589326 - DNA, 25 bp, Rattus norvegicus
ggggacacccttcacagtgtgtgcc

SEQ ID NO: 589327 - DNA, 25 bp, Rattus norvegicus
ggcttaccttcctcggccgccttca

SEQ ID NO: 589328 - DNA, 25 bp, Rattus norvegicus
ctcccgagtccgacctctccttcgc

SEQ ID NO: 589329 - DNA, 25 bp, Rattus norvegicus
tcgggctcaagcctggtccagcggc

SEQ ID NO: 589330 - DNA, 25 bp, Rattus norvegicus
gtttccctctgtttaatgccgttgc

SEQ ID NO: 589331 - DNA, 25 bp, Rattus norvegicus
ttccctctgtttaatgccgttgccg

SEQ ID NO: 589332 - DNA, 25 bp, Rattus norvegicus
cctctgtttaatgccgttgccggga

SEQ ID NO: 589333 - DNA, 25 bp, Rattus norvegicus
ctgtttaatgccgttgccgggacca

SEQ ID NO: 589334 - DNA, 25 bp, Rattus norvegicus
tgtttaatgccgttgccgggaccac

SEQ ID NO: 589335 - DNA, 25 bp, Rattus norvegicus
ccgggaccacggtggccgcacgcca

SEQ ID NO: 589336 - DNA, 25 bp, Rattus norvegicus
ggccgcacgccaggcgcagggagtt

SEQ ID NO: 589337 - DNA, 25 bp, Rattus norvegicus
ccaggcgcagggagttccggaggca

SEQ ID NO: 589338 - DNA, 25 bp, Rattus norvegicus
aggccctgcggccacctcgggctca

SEQ ID NO: 589339 - DNA, 25 bp, Rattus norvegicus
caagcctggtccagcggccgcgctc

SEQ ID NO: 589340 - DNA, 25 bp, Rattus norvegicus
ggccgcgctccctgcgcgtccctac

SEQ ID NO: 589341 - DNA, 25 bp, Rattus norvegicus
tgcgcgtccctaccgccttctttcc

SEQ ID NO: 589342 - DNA, 25 bp, Rattus norvegicus
cagcggcgcaggagtgcagccagct

SEQ ID NO: 589343 - DNA, 25 bp, Rattus norvegicus
ggctctatggctccgtgcggactac

SEQ ID NO: 589344 - DNA, 25 bp, Rattus norvegicus
tcaactcggcgtaatctcggagccg

SEQ ID NO: 589345 - DNA, 25 bp, Rattus norvegicus
gcggcgtctccgaattcctgggcgc

SEQ ID NO: 589346 - DNA, 25 bp, Rattus norvegicus
ctatcctcaactcggcgtaatctcg

SEQ ID NO: 589347 - DNA, 25 bp, Rattus norvegicus
agaggaatctggtccgccatgctcc

SEQ ID NO: 589348 - DNA, 25 bp, Rattus norvegicus
cacggggtacagaggaatctggtcc

SEQ ID NO: 589349 - DNA, 25 bp, Rattus norvegicus
tgtagtaggccgcacgtctgtggct

SEQ ID NO: 589350 - DNA, 25 bp, Rattus norvegicus
cccaacggcgctgtagtaggccgca

SEQ ID NO: 589351 - DNA, 25 bp, Rattus norvegicus
cagggaagaccctcagcgccgggaa

SEQ ID NO: 589352 - DNA, 25 bp, Rattus norvegicus
gctggcagggaagaccctcagcgcc

SEQ ID NO: 589353 - DNA, 25 bp, Rattus norvegicus
ctatggctccgtgcggactacgggc

SEQ ID NO: 589354 - DNA, 25 bp, Rattus norvegicus
ctccgaattcctgggcgcggctcgg

SEQ ID NO: 589355 - DNA, 25 bp, Rattus norvegicus
gcccgaggccctgggctcaggaatc

SEQ ID NO: 589356 - DNA, 25 bp, Rattus norvegicus
gcccgggcccaacggcgctgtagta

SEQ ID NO: 589357 - DNA, 25 bp, Rattus norvegicus
gggttcgaataatcgggacgacaca

SEQ ID NO: 589358 - DNA, 25 bp, Rattus norvegicus
ggagcctacagtaagatcgcgcttg

SEQ ID NO: 589359 - DNA, 25 bp, Rattus norvegicus
gcgccctgaccaatgctacgaggca

SEQ ID NO: 589360 - DNA, 25 bp, Rattus norvegicus
ggattatactgccagacactcggta

SEQ ID NO: 589361 - DNA, 25 bp, Rattus norvegicus
tcaaggttatgacggattatactgc

SEQ ID NO: 589362 - DNA, 25 bp, Rattus norvegicus
cggacttaggaaatgtcaaggttat

SEQ ID NO: 589363 - DNA, 25 bp, Rattus norvegicus
caatgaatcacggacttaggaaatg

SEQ ID NO: 589364 - DNA, 25 bp, Rattus norvegicus
gcactcgagaagacaatgaatcacg

SEQ ID NO: 589365 - DNA, 25 bp, Rattus norvegicus
tcagcaaaagagatcggggttcgaa

SEQ ID NO: 589366 - DNA, 25 bp, Rattus norvegicus
taatcgggacgacacaccgtgtttg

SEQ ID NO: 589367 - DNA, 25 bp, Rattus norvegicus
taagatcgcgcttgcgcaatgcgca

SEQ ID NO: 589368 - DNA, 25 bp, Rattus norvegicus
cccgtattgtgtatgagagagacag

SEQ ID NO: 589369 - DNA, 25 bp, Rattus norvegicus
cacaccgtgtttgcactcgagaaga

SEQ ID NO: 589370 - DNA, 25 bp, Rattus norvegicus
gtatcccagtctcatccgcgccctg

SEQ ID NO: 589371 - DNA, 25 bp, Rattus norvegicus
gaagactctacacaccaatgccacg

SEQ ID NO: 589372 - DNA, 25 bp, Rattus norvegicus
gctctacagacagcttccacgcaga

SEQ ID NO: 589373 - DNA, 25 bp, Rattus norvegicus
gactcagcgtccagaagactctaca

SEQ ID NO: 589374 - DNA, 25 bp, Rattus norvegicus
gagttctctagactcagcgtccaga

SEQ ID NO: 589375 - DNA, 25 bp, Rattus norvegicus
cggcttccacgtacagagttctcta

SEQ ID NO: 589376 - DNA, 25 bp, Rattus norvegicus
tcctcagacggcttccacgtacaga

SEQ ID NO: 589377 - DNA, 25 bp, Rattus norvegicus
tgacatcctgcacatgtccgcggcg

SEQ ID NO: 589378 - DNA, 25 bp, Rattus norvegicus
gctgtgccgctcaccttgaatgaca

SEQ ID NO: 589379 - DNA, 25 bp, Rattus norvegicus
ctcggaaagccgcagcgaagcgcgc

SEQ ID NO: 589380 - DNA, 25 bp, Rattus norvegicus
gacctggcggaaagctcggaaagcc

SEQ ID NO: 589381 - DNA, 25 bp, Rattus norvegicus
gggctcacacgacctggcggaaagc

SEQ ID NO: 589382 - DNA, 25 bp, Rattus norvegicus
ttactaaggcgacagtcccggccgc

SEQ ID NO: 589383 - DNA, 25 bp, Rattus norvegicus
gccgcggcctgttactaaggcgaca

SEQ ID NO: 589384 - DNA, 25 bp, Rattus norvegicus
gggcacacagaacagcccggagctc

SEQ ID NO: 589385 - DNA, 25 bp, Rattus norvegicus
tcagagctagctctggctcacgaga

SEQ ID NO: 589386 - DNA, 25 bp, Rattus norvegicus
tccgtgccgctcaagctgaaaactt

SEQ ID NO: 589387 - DNA, 25 bp, Rattus norvegicus
gctctcgcaattagcggccgcgctg

SEQ ID NO: 589388 - DNA, 25 bp, Rattus norvegicus
actccggcggcctatgcaaatgagg

SEQ ID NO: 589389 - DNA, 25 bp, Rattus norvegicus
gctggtgaataatgcatggccatta

SEQ ID NO: 589390 - DNA, 25 bp, Rattus norvegicus
ggctgagcaattaggctggtgaata

SEQ ID NO: 589391 - DNA, 25 bp, Rattus norvegicus
cttgcgccgagacatgctgctagcg

SEQ ID NO: 589392 - DNA, 25 bp, Rattus norvegicus
gcggtagctcctcgtccgacttgag

SEQ ID NO: 589393 - DNA, 25 bp, Rattus norvegicus
tggctcacgagaacaggggaacttt

SEQ ID NO: 589394 - DNA, 25 bp, Rattus norvegicus
cccaagtatgagtagcggagccaag

SEQ ID NO: 589395 - DNA, 25 bp, Rattus norvegicus
ctgaaaactttggtggcgtccgcgc

SEQ ID NO: 589396 - DNA, 25 bp, Rattus norvegicus
tcccgcgcgcttcgagggagtacca

SEQ ID NO: 589397 - DNA, 25 bp, Rattus norvegicus
agaactctgggccaccctgaggtcc

SEQ ID NO: 589398 - DNA, 25 bp, Rattus norvegicus
cagccgactcggatccgtcctggag

SEQ ID NO: 589399 - DNA, 25 bp, Rattus norvegicus
tctccacgccgatgccgaagagcgg

SEQ ID NO: 589400 - DNA, 25 bp, Rattus norvegicus
gccgtgaatgcacaatggccacata

SEQ ID NO: 589401 - DNA, 25 bp, Rattus norvegicus
atccacagacatcgcggccagggtg

SEQ ID NO: 589402 - DNA, 25 bp, Rattus norvegicus
tataaacttgcagatgaaggcgccc

SEQ ID NO: 589403 - DNA, 25 bp, Rattus norvegicus
accaccagcgtgatgaagttctcca

SEQ ID NO: 589404 - DNA, 25 bp, Rattus norvegicus
aggttcaccggagccagttccatca

SEQ ID NO: 589405 - DNA, 25 bp, Rattus norvegicus
ttgtgccagccagggaaagccagct

SEQ ID NO: 589406 - DNA, 25 bp, Rattus norvegicus
ccggcaagacagcagaggacagtga

SEQ ID NO: 589407 - DNA, 25 bp, Rattus norvegicus
tgtgcctgatctcgctatcctcttc

SEQ ID NO: 589408 - DNA, 25 bp, Rattus norvegicus
cggcaggctccagagaacagaggta

SEQ ID NO: 589409 - DNA, 25 bp, Rattus norvegicus
ctaggcgactcccattgctggcagt

SEQ ID NO: 589410 - DNA, 25 bp, Rattus norvegicus
ggcgggactcttccgcagctacctg

SEQ ID NO: 589411 - DNA, 25 bp, Rattus norvegicus
tacctgcaggcggagaatcttctgc

SEQ ID NO: 589412 - DNA, 25 bp, Rattus norvegicus
acggtgatcaccaggctgttgccca

SEQ ID NO: 589413 - DNA, 25 bp, Rattus norvegicus
cacttggcgtccgatccgcaggcag

SEQ ID NO: 589414 - DNA, 25 bp, Rattus norvegicus
ctttttctgggccaggagcgcctgg

SEQ ID NO: 589415 - DNA, 25 bp, Rattus norvegicus
ggctcaggccgccagagtctcgcga

SEQ ID NO: 589416 - DNA, 25 bp, Rattus norvegicus
ccagtggcgtgcagttacctgcttc

SEQ ID NO: 589417 - DNA, 25 bp, Rattus norvegicus
agcgcctgggtcacacctgaccaga

SEQ ID NO: 589418 - DNA, 25 bp, Rattus norvegicus
tgaagacagcagaaatctatttccc

SEQ ID NO: 589419 - DNA, 25 bp, Rattus norvegicus
cccgtgaagacagcagaaatctatt

SEQ ID NO: 589420 - DNA, 25 bp, Rattus norvegicus
aagtgatcattagctgggacgcgtg

SEQ ID NO: 589421 - DNA, 25 bp, Rattus norvegicus
gcagcaccggtaagtgatcattagc

SEQ ID NO: 589422 - DNA, 25 bp, Rattus norvegicus
ccgcaggcagcaccggtaagtgatc

SEQ ID NO: 589423 - DNA, 25 bp, Rattus norvegicus
gaacgcagtactcgtgccccagcga

SEQ ID NO: 589424 - DNA, 25 bp, Rattus norvegicus
tgcgcgccagcgaggacgagcctct

SEQ ID NO: 589425 - DNA, 25 bp, Rattus norvegicus
tgcagttacctgcttccaggcaggg

SEQ ID NO: 589426 - DNA, 25 bp, Rattus norvegicus
gtcacacctgaccagaggtgcaggt

SEQ ID NO: 589427 - DNA, 25 bp, Rattus norvegicus
ttcgactgaggtgtgcgctcaaaca

SEQ ID NO: 589428 - DNA, 25 bp, Rattus norvegicus
tatttgcatagaaggaactgcccgc

SEQ ID NO: 589429 - DNA, 25 bp, Rattus norvegicus
tgtcccatgttcacgatggggtgta

SEQ ID NO: 589430 - DNA, 25 bp, Rattus norvegicus
ggcagcgtgatcgtcaccttcagga

SEQ ID NO: 589431 - DNA, 25 bp, Rattus norvegicus
tcaccttcaggagcggggcttcacc

SEQ ID NO: 589432 - DNA, 25 bp, Rattus norvegicus
aagggtcctactgtccggcttctgt

SEQ ID NO: 589433 - DNA, 25 bp, Rattus norvegicus
cttctgtgccgggacttgcatctgt

SEQ ID NO: 589434 - DNA, 25 bp, Rattus norvegicus
ttgcatctgtaggacaaacaaccca

SEQ ID NO: 589435 - DNA, 25 bp, Rattus norvegicus
cgctggagatactaatgaggctctt

SEQ ID NO: 589436 - DNA, 25 bp, Rattus norvegicus
agtaacagtcctgagcgcggcgttt

SEQ ID NO: 589437 - DNA, 25 bp, Rattus norvegicus
tcgcctgttctcagcgctggagata

SEQ ID NO: 589438 - DNA, 25 bp, Rattus norvegicus
ttttctggcggggtctatttgcata

SEQ ID NO: 589439 - DNA, 25 bp, Rattus norvegicus
gaaagaccttggagtaacagtcctg

SEQ ID NO: 589440 - DNA, 25 bp, Rattus norvegicus
cgaaacgcacctggagcgcctgcta

SEQ ID NO: 589441 - DNA, 25 bp, Rattus norvegicus
tggttttgagggcactgagtaccgc

SEQ ID NO: 589442 - DNA, 25 bp, Rattus norvegicus
gtaacttgatctcctggtcctgaga

SEQ ID NO: 589443 - DNA, 25 bp, Rattus norvegicus
gcctggcccgatcttcccgcggtaa

SEQ ID NO: 589444 - DNA, 25 bp, Rattus norvegicus
gatcttcccgcggtaacttgatctc

SEQ ID NO: 589445 - DNA, 25 bp, Rattus norvegicus
cttcccgcggtaacttgatctcctg

SEQ ID NO: 589446 - DNA, 25 bp, Rattus norvegicus
cccgcggtaacttgatctcctggtc

SEQ ID NO: 589447 - DNA, 25 bp, Rattus norvegicus
cggtaacttgatctcctggtcctga

SEQ ID NO: 589448 - DNA, 25 bp, Rattus norvegicus
tgatctcctggtcctgagaaagcgc

SEQ ID NO: 589449 - DNA, 25 bp, Rattus norvegicus
tctcctggtcctgagaaagcgcggg

SEQ ID NO: 589450 - DNA, 25 bp, Rattus norvegicus
tcctgagaaagcgcggggtcccagt

SEQ ID NO: 589451 - DNA, 25 bp, Rattus norvegicus
gttatgatttgttgtaaactctggt

SEQ ID NO: 589452 - DNA, 25 bp, Rattus norvegicus
ctctggttttgagggcactgagtac

SEQ ID NO: 589453 - DNA, 25 bp, Rattus norvegicus
gagggcactgagtaccgcgcgaccc

SEQ ID NO: 589454 - DNA, 25 bp, Rattus norvegicus
taaactctggttttgagggcactga

SEQ ID NO: 589455 - DNA, 25 bp, Rattus norvegicus
tacaccggaagagcgggcactccct

SEQ ID NO: 589456 - DNA, 25 bp, Rattus norvegicus
gacgacgacgcagagcgggcgacat

SEQ ID NO: 589457 - DNA, 25 bp, Rattus norvegicus
acttaaggggacgacgacgcagagc

SEQ ID NO: 589458 - DNA, 25 bp, Rattus norvegicus
gaaagacatggagggaggggactta

SEQ ID NO: 589459 - DNA, 25 bp, Rattus norvegicus
caggcggaaggaacagaaagacatg

SEQ ID NO: 589460 - DNA, 25 bp, Rattus norvegicus
gcaggcggaaggaacagaaagacat

SEQ ID NO: 589461 - DNA, 25 bp, Rattus norvegicus
tgcctagaacgaccgaggcgggcag

SEQ ID NO: 589462 - DNA, 25 bp, Rattus norvegicus
cctgtgcctagaacgaccgaggcgg

SEQ ID NO: 589463 - DNA, 25 bp, Rattus norvegicus
ggcctgtgcctagaacgaccgaggc

SEQ ID NO: 589464 - DNA, 25 bp, Rattus norvegicus
cctggggcctgtgcctagaacgacc

SEQ ID NO: 589465 - DNA, 25 bp, Rattus norvegicus
ggatacaccggaagagcgggcactc

SEQ ID NO: 589466 - DNA, 25 bp, Rattus norvegicus
tcggtccctgctggatcggggtccc

SEQ ID NO: 589467 - DNA, 25 bp, Rattus norvegicus
cctcggtccctgctggatcggggtc

SEQ ID NO: 589468 - DNA, 25 bp, Rattus norvegicus
tggggcctgtgcctagaacgaccga

SEQ ID NO: 589469 - DNA, 25 bp, Rattus norvegicus
agcagcaccatcctcttacttaaga

SEQ ID NO: 589470 - DNA, 25 bp, Rattus norvegicus
tagacagagccgctgcgcataggta

SEQ ID NO: 589471 - DNA, 25 bp, Rattus norvegicus
ctttattcaataagatgggagggcc

SEQ ID NO: 589472 - DNA, 25 bp, Rattus norvegicus
catgacggttggtgggcccaagaaa

SEQ ID NO: 589473 - DNA, 25 bp, Rattus norvegicus
cacgttcaaggttcgtaacatacgg

SEQ ID NO: 589474 - DNA, 25 bp, Rattus norvegicus
ggccacgttcaaggttcgtaacata

SEQ ID NO: 589475 - DNA, 25 bp, Rattus norvegicus
ggacttacacggctgccgacatcaa

SEQ ID NO: 589476 - DNA, 25 bp, Rattus norvegicus
agagccgctgcgcataggtacggtc

SEQ ID NO: 589477 - DNA, 25 bp, Rattus norvegicus
taagatctctcttcacgctttggcc

SEQ ID NO: 589478 - DNA, 25 bp, Rattus norvegicus
ttaagacggacaaatagacagagcc

SEQ ID NO: 589479 - DNA, 25 bp, Rattus norvegicus
cacggagagcagcaccatcctctta

SEQ ID NO: 589480 - DNA, 25 bp, Rattus norvegicus
acggctgccgacatcaaagcacgga

SEQ ID NO: 589481 - DNA, 25 bp, Rattus norvegicus
tcaaagcacggagagcagcaccatc

SEQ ID NO: 589482 - DNA, 25 bp, Rattus norvegicus
cacgctttggccacgttcaaggttc

SEQ ID NO: 589483 - DNA, 25 bp, Rattus norvegicus
tgggtctgagtcatcgtgagcctcc

SEQ ID NO: 589484 - DNA, 25 bp, Rattus norvegicus
ctgcggcaacctgagaccttaagct

SEQ ID NO: 589485 - DNA, 25 bp, Rattus norvegicus
acggtcctgttcttcccgaagcatg

SEQ ID NO: 589486 - DNA, 25 bp, Rattus norvegicus
agactcgctcccgtgaagttcaggg

SEQ ID NO: 589487 - DNA, 25 bp, Rattus norvegicus
tgaacaccgtttggtctgggcttga

SEQ ID NO: 589488 - DNA, 25 bp, Rattus norvegicus
accttaagctgaggggcgaccacta

SEQ ID NO: 589489 - DNA, 25 bp, Rattus norvegicus
ccgacgtcgtgattcagggctatta

SEQ ID NO: 589490 - DNA, 25 bp, Rattus norvegicus
gtgagcctccagactttctccgcag

SEQ ID NO: 589491 - DNA, 25 bp, Rattus norvegicus
tctccgcagtgtggcagaactttgt

SEQ ID NO: 589492 - DNA, 25 bp, Rattus norvegicus
gcgtttcctacagggcagaccattc

SEQ ID NO: 589493 - DNA, 25 bp, Rattus norvegicus
tcggcttcaccttcagatgcgcggg

SEQ ID NO: 589494 - DNA, 25 bp, Rattus norvegicus
tcgggacccactacgtgcgcaagac

SEQ ID NO: 589495 - DNA, 25 bp, Rattus norvegicus
gctggacaagcatcccaagcacgtc

SEQ ID NO: 589496 - DNA, 25 bp, Rattus norvegicus
tgcgcgcgtaaacagcctccaggag

SEQ ID NO: 589497 - DNA, 25 bp, Rattus norvegicus
cagatgtgtgctgtagacgtggaca

SEQ ID NO: 589498 - DNA, 25 bp, Rattus norvegicus
cttttatccaagtctgtccagctag

SEQ ID NO: 589499 - DNA, 25 bp, Rattus norvegicus
acgcgcccgtgtgtcggcccagagt

SEQ ID NO: 589500 - DNA, 25 bp, Rattus norvegicus
ggctctgtcggccaatccgcagcag

SEQ ID NO: 589501 - DNA, 25 bp, Rattus norvegicus
aagtctgtccagctagatgcgcacg

SEQ ID NO: 589502 - DNA, 25 bp, Rattus norvegicus
ccagagtcgggccagaggcgcgcat

SEQ ID NO: 589503 - DNA, 25 bp, Rattus norvegicus
gctcccgcatttgcacagatgtgtg

SEQ ID NO: 589504 - DNA, 25 bp, Rattus norvegicus
tgctgtagacgtggacacgctttta

SEQ ID NO: 589505 - DNA, 25 bp, Rattus norvegicus
gtggacacgcttttatccaagtctg

SEQ ID NO: 589506 - DNA, 25 bp, Rattus norvegicus
cgcgcacgctcgaccacgcgcccgt

SEQ ID NO: 589507 - DNA, 25 bp, Rattus norvegicus
agctttctctatcccggaggtaatt

SEQ ID NO: 589508 - DNA, 25 bp, Rattus norvegicus
gcagcagctttctctatcccggagg

SEQ ID NO: 589509 - DNA, 25 bp, Rattus norvegicus
ggccaatccgcagcagctttctcta

SEQ ID NO: 589510 - DNA, 25 bp, Rattus norvegicus
cgcaggctcccgcatttgcacagat

SEQ ID NO: 589511 - DNA, 25 bp, Rattus norvegicus
gcagtgtctgcatgcaccgaggtca

SEQ ID NO: 589512 - DNA, 25 bp, Rattus norvegicus
cgtgtacctcctcctacgcgggccg

SEQ ID NO: 589513 - DNA, 25 bp, Rattus norvegicus
cggccctctctccaatctctgcaag

SEQ ID NO: 589514 - DNA, 25 bp, Rattus norvegicus
taggtggtgtcagcccgtgtacctc

SEQ ID NO: 589515 - DNA, 25 bp, Rattus norvegicus
cttggttactaggtggtgtcagccc

SEQ ID NO: 589516 - DNA, 25 bp, Rattus norvegicus
ccgagatttccaacttggttactag

SEQ ID NO: 589517 - DNA, 25 bp, Rattus norvegicus
tgtctgcatgcaccgaggtcacctc

SEQ ID NO: 589518 - DNA, 25 bp, Rattus norvegicus
acaccggctctgcagtgtctgcatg

SEQ ID NO: 589519 - DNA, 25 bp, Rattus norvegicus
gtccacaccggctctgcagtgtctg

SEQ ID NO: 589520 - DNA, 25 bp, Rattus norvegicus
ttggaaggcccagtgtccacaccgg

SEQ ID NO: 589521 - DNA, 25 bp, Rattus norvegicus
ccgaccttggaaggcccagtgtcca

SEQ ID NO: 589522 - DNA, 25 bp, Rattus norvegicus
caccgaccttggaaggcccagtgtc

SEQ ID NO: 589523 - DNA, 25 bp, Rattus norvegicus
tccaacttggttactaggtggtgtc

SEQ ID NO: 589524 - DNA, 25 bp, Rattus norvegicus
catgcaccgaggtcacctcgagggt

SEQ ID NO: 589525 - DNA, 25 bp, Rattus norvegicus
tcgcaccgtaacaaaggctggggtc

SEQ ID NO: 589526 - DNA, 25 bp, Rattus norvegicus
cggggcaccacctgcccgccctaga

SEQ ID NO: 589527 - DNA, 25 bp, Rattus norvegicus
ctgcccgccctagagcgtggcgtgc

SEQ ID NO: 589528 - DNA, 25 bp, Rattus norvegicus
cccgtcatgtggaacggacgtcaca

SEQ ID NO: 589529 - DNA, 25 bp, Rattus norvegicus
tcatgtggaacggacgtcacacgcc

SEQ ID NO: 589530 - DNA, 25 bp, Rattus norvegicus
tgtggaacggacgtcacacgcctgc

SEQ ID NO: 589531 - DNA, 25 bp, Rattus norvegicus
gaacggacgtcacacgcctgcactg

SEQ ID NO: 589532 - DNA, 25 bp, Rattus norvegicus
acggacgtcacacgcctgcactgta

SEQ ID NO: 589533 - DNA, 25 bp, Rattus norvegicus
cacgcctgcactgtaacccaagaag

SEQ ID NO: 589534 - DNA, 25 bp, Rattus norvegicus
gcctgcactgtaacccaagaagtga

SEQ ID NO: 589535 - DNA, 25 bp, Rattus norvegicus
ctgtaacccaagaagtgaaagagac

SEQ ID NO: 589536 - DNA, 25 bp, Rattus norvegicus
gaagtgaaagagacggggacccgca

SEQ ID NO: 589537 - DNA, 25 bp, Rattus norvegicus
agcccaacttcgcaccgtaacaaag

SEQ ID NO: 589538 - DNA, 25 bp, Rattus norvegicus
aacttcgcaccgtaacaaaggctgg

SEQ ID NO: 589539 - DNA, 25 bp, Rattus norvegicus
gagtcggatcagcttttcaaacaat

SEQ ID NO: 589540 - DNA, 25 bp, Rattus norvegicus
ttcaaacaatacaggtgacccgggc

SEQ ID NO: 589541 - DNA, 25 bp, Rattus norvegicus
tcagtagcagcggaccaggagttct

SEQ ID NO: 589542 - DNA, 25 bp, Rattus norvegicus
caggagttctctgaccctgagtcaa

SEQ ID NO: 589543 - DNA, 25 bp, Rattus norvegicus
ccagtgcgtccgaggtccatcctat

SEQ ID NO: 589544 - DNA, 25 bp, Rattus norvegicus
atcctatctcggagggttgggcatt

SEQ ID NO: 589545 - DNA, 25 bp, Rattus norvegicus
agctccggacgcctggatcgaagcg

SEQ ID NO: 589546 - DNA, 25 bp, Rattus norvegicus
cgggcgcagacacccgaaacggctg

SEQ ID NO: 589547 - DNA, 25 bp, Rattus norvegicus
cgcgagccggctgctgagtaatccc

SEQ ID NO: 589548 - DNA, 25 bp, Rattus norvegicus
gctcccggcaagtcggacagggctc

SEQ ID NO: 589549 - DNA, 25 bp, Rattus norvegicus
ccctggctggcatcaacatgcttct

SEQ ID NO: 589550 - DNA, 25 bp, Rattus norvegicus
atgcttctcaacaacggcttcaggg

SEQ ID NO: 589551 - DNA, 25 bp, Rattus norvegicus
aacaacggcttcagggagtcggatc

SEQ ID NO: 589552 - DNA, 25 bp, Rattus norvegicus
gcacaccgggtggtcacctcgtgac

SEQ ID NO: 589553 - DNA, 25 bp, Rattus norvegicus
cgccggcaggccaggtaattggttt

SEQ ID NO: 589554 - DNA, 25 bp, Rattus norvegicus
aaacttcactttgttctgtcggagg

SEQ ID NO: 589555 - DNA, 25 bp, Rattus norvegicus
acttcactttgttctgtcggaggtg

SEQ ID NO: 589556 - DNA, 25 bp, Rattus norvegicus
ttcactttgttctgtcggaggtggg

SEQ ID NO: 589557 - DNA, 25 bp, Rattus norvegicus
cactttgttctgtcggaggtgggtt

SEQ ID NO: 589558 - DNA, 25 bp, Rattus norvegicus
ggggcggttatgtaagtctccacac

SEQ ID NO: 589559 - DNA, 25 bp, Rattus norvegicus
ggcggttatgtaagtctccacacct

SEQ ID NO: 589560 - DNA, 25 bp, Rattus norvegicus
cggttatgtaagtctccacacctga

SEQ ID NO: 589561 - DNA, 25 bp, Rattus norvegicus
tatgtaagtctccacacctgagtcg

SEQ ID NO: 589562 - DNA, 25 bp, Rattus norvegicus
tgtaagtctccacacctgagtcggg

SEQ ID NO: 589563 - DNA, 25 bp, Rattus norvegicus
taagtctccacacctgagtcgggcc

SEQ ID NO: 589564 - DNA, 25 bp, Rattus norvegicus
ctgagtcgggccctgcttctccggg

SEQ ID NO: 589565 - DNA, 25 bp, Rattus norvegicus
tgggtacggagtgctggcggctccc

SEQ ID NO: 589566 - DNA, 25 bp, Rattus norvegicus
ttaaacttcactttgttctgtcgga

SEQ ID NO: 589567 - DNA, 25 bp, Rattus norvegicus
actcccgtgtgcaccgccgcgcacg

SEQ ID NO: 589568 - DNA, 25 bp, Rattus norvegicus
gtgcggcaagatcttccgcacctac

SEQ ID NO: 589569 - DNA, 25 bp, Rattus norvegicus
ttcactcagcgagggtgattcggcg

SEQ ID NO: 589570 - DNA, 25 bp, Rattus norvegicus
ccaggggaagtcctctgagtgcttc

SEQ ID NO: 589571 - DNA, 25 bp, Rattus norvegicus
tgcggttcactcagcgagggtgatt

SEQ ID NO: 589572 - DNA, 25 bp, Rattus norvegicus
agtacgtgcccgctgcggttcactc

SEQ ID NO: 589573 - DNA, 25 bp, Rattus norvegicus
gccaccactggccaggggaagtcct

SEQ ID NO: 589574 - DNA, 25 bp, Rattus norvegicus
cgcacgccgtgacagggatcctgaa

SEQ ID NO: 589575 - DNA, 25 bp, Rattus norvegicus
gatggtgctccactcccgtgtgcac

SEQ ID NO: 589576 - DNA, 25 bp, Rattus norvegicus
accagatggtgctccactcccgtgt

SEQ ID NO: 589577 - DNA, 25 bp, Rattus norvegicus
cttccgcacctaccaccagatggtg

SEQ ID NO: 589578 - DNA, 25 bp, Rattus norvegicus
cttcgagtgcggcaagatcttccgc

SEQ ID NO: 589579 - DNA, 25 bp, Rattus norvegicus
cctctgagtgcttcgagtgcggcaa

SEQ ID NO: 589580 - DNA, 25 bp, Rattus norvegicus
cacgccgtgacagggatcctgaagg

SEQ ID NO: 589581 - DNA, 25 bp, Rattus norvegicus
ttattccaacgcctgggatgggagc

SEQ ID NO: 589582 - DNA, 25 bp, Rattus norvegicus
gccgcctctctcaacgtacgagaag

SEQ ID NO: 589583 - DNA, 25 bp, Rattus norvegicus
aaggcgtgtatagcgccggtcccga

SEQ ID NO: 589584 - DNA, 25 bp, Rattus norvegicus
aaggccgccactctggacctgagac

SEQ ID NO: 589585 - DNA, 25 bp, Rattus norvegicus
gtacgagaagcgaccgagaactacc

SEQ ID NO: 589586 - DNA, 25 bp, Rattus norvegicus
gcccgcagttgcttgaattattcca

SEQ ID NO: 589587 - DNA, 25 bp, Rattus norvegicus
ccacaagcggtcatgcccgcagttg

SEQ ID NO: 589588 - DNA, 25 bp, Rattus norvegicus
ccgcccatgatgacgtgaaccacaa

SEQ ID NO: 589589 - DNA, 25 bp, Rattus norvegicus
agcgcagagtatccgcccatgatga

SEQ ID NO: 589590 - DNA, 25 bp, Rattus norvegicus
tacgaccctggatcagcgcagagta

SEQ ID NO: 589591 - DNA, 25 bp, Rattus norvegicus
cacattcttgggagagaaacctcgg

SEQ ID NO: 589592 - DNA, 25 bp, Rattus norvegicus
acccggcgatctggggacacattct

SEQ ID NO: 589593 - DNA, 25 bp, Rattus norvegicus
atagtttagagtcccgctccacccg

SEQ ID NO: 589594 - DNA, 25 bp, Rattus norvegicus
ctgagacgtcggctgctcaggtatc

SEQ ID NO: 589595 - DNA, 25 bp, Rattus norvegicus
tgggcatcagtgtcagtgtacggaa

SEQ ID NO: 589596 - DNA, 25 bp, Rattus norvegicus
tgggcatcagtgtcagtgtatggaa

SEQ ID NO: 589597 - DNA, 25 bp, Rattus norvegicus
catcagggtcggtgtacggaaggct

SEQ ID NO: 589598 - DNA, 25 bp, Rattus norvegicus
gcatcagggttggtgtacggaaggc

SEQ ID NO: 589599 - DNA, 25 bp, Rattus norvegicus
gtatggaaggctggtttgggcatca

SEQ ID NO: 589600 - DNA, 25 bp, Rattus norvegicus
atcagtgtcagtgtacggaaggctg

SEQ ID NO: 589601 - DNA, 25 bp, Rattus norvegicus
tgggcatcagtgtcggtgtacggaa

SEQ ID NO: 589602 - DNA, 25 bp, Rattus norvegicus
gggcatcagtgtcggtgtacggaag

SEQ ID NO: 589603 - DNA, 25 bp, Rattus norvegicus
gcatcagtgtcggtgtacggaaggc

SEQ ID NO: 589604 - DNA, 25 bp, Rattus norvegicus
catcagtgtcggtgtacggaaggct

SEQ ID NO: 589605 - DNA, 25 bp, Rattus norvegicus
catcagggttggtgtacggaaggct

SEQ ID NO: 589606 - DNA, 25 bp, Rattus norvegicus
gcatcagtgtcagtgtacggaaggc

SEQ ID NO: 589607 - DNA, 25 bp, Rattus norvegicus
catcagtgtcagtgtacggaaggct

SEQ ID NO: 589608 - DNA, 25 bp, Rattus norvegicus
catcagtgtcagtgtatggaaggct

SEQ ID NO: 589609 - DNA, 25 bp, Rattus norvegicus
agcgccgctccaccttccaaacagt

SEQ ID NO: 589610 - DNA, 25 bp, Rattus norvegicus
agctctctcattgtgcgccagcgag

SEQ ID NO: 589611 - DNA, 25 bp, Rattus norvegicus
tcattgtgcgccagcgaggccgacc

SEQ ID NO: 589612 - DNA, 25 bp, Rattus norvegicus
cagcgaggccgaccggctgtccttt

SEQ ID NO: 589613 - DNA, 25 bp, Rattus norvegicus
cccgcacttagtctaggaggaagaa

SEQ ID NO: 589614 - DNA, 25 bp, Rattus norvegicus
ctaggaggaagaaagcaaacaagac

SEQ ID NO: 589615 - DNA, 25 bp, Rattus norvegicus
ggagtgaagcccctgtacatacatg

SEQ ID NO: 589616 - DNA, 25 bp, Rattus norvegicus
ctgtacatacatgcgccgggggaga

SEQ ID NO: 589617 - DNA, 25 bp, Rattus norvegicus
tcaaacagtgtcacccgccggagcg

SEQ ID NO: 589618 - DNA, 25 bp, Rattus norvegicus
ggccgccaggatcgccgcttcttcc

SEQ ID NO: 589619 - DNA, 25 bp, Rattus norvegicus
cgggtcgcagctctctcattgtgcg

SEQ ID NO: 589620 - DNA, 25 bp, Rattus norvegicus
agtctccgcgcgcaactttctcggc

SEQ ID NO: 589621 - DNA, 25 bp, Rattus norvegicus
agcaaacaagacaggagtgaagccc

SEQ ID NO: 589622 - DNA, 25 bp, Rattus norvegicus
ccaaacagtcacagatcaaacagtg

SEQ ID NO: 589623 - DNA, 25 bp, Rattus norvegicus
gccgccttgtcgctcagggacgctt

SEQ ID NO: 589624 - DNA, 25 bp, Rattus norvegicus
gggtgcaccgtgcactgagcgccct

SEQ ID NO: 589625 - DNA, 25 bp, Rattus norvegicus
cccggtggaggaatcaaatcccatc

SEQ ID NO: 589626 - DNA, 25 bp, Rattus norvegicus
caccttgcaaggaagtgaatgcttc

SEQ ID NO: 589627 - DNA, 25 bp, Rattus norvegicus
ggcgctggccctttagcttggcgcc

SEQ ID NO: 589628 - DNA, 25 bp, Rattus norvegicus
cggctgagccctaacttccacgagg

SEQ ID NO: 589629 - DNA, 25 bp, Rattus norvegicus
atcaaatcccatcgcagagcgtgcg

SEQ ID NO: 589630 - DNA, 25 bp, Rattus norvegicus
gagatcctaggccagtgtgagccga

SEQ ID NO: 589631 - DNA, 25 bp, Rattus norvegicus
gagccgagcggattcaaaccaaaac

SEQ ID NO: 589632 - DNA, 25 bp, Rattus norvegicus
aaaagattaaaggagcagcggctgc

SEQ ID NO: 589633 - DNA, 25 bp, Rattus norvegicus
cccgagccatcgtggacatgtcgta

SEQ ID NO: 589634 - DNA, 25 bp, Rattus norvegicus
tgtcgtacgcccgtcacttcctgga

SEQ ID NO: 589635 - DNA, 25 bp, Rattus norvegicus
actatgcagaagctggtggtaaccc

SEQ ID NO: 589636 - DNA, 25 bp, Rattus norvegicus
ggggttgattcgtaccaccttgcaa

SEQ ID NO: 589637 - DNA, 25 bp, Rattus norvegicus
aagccagtccctcggagcggacgcg

SEQ ID NO: 589638 - DNA, 25 bp, Rattus norvegicus
cgtggagactctgagcaaggttgtc

SEQ ID NO: 589639 - DNA, 25 bp, Rattus norvegicus
accagcatggcgtaacggaagaagc

SEQ ID NO: 589640 - DNA, 25 bp, Rattus norvegicus
tgctcctgaggacgcagaggtaagt

SEQ ID NO: 589641 - DNA, 25 bp, Rattus norvegicus
caaggttgtcaacgcgccaggcaag

SEQ ID NO: 589642 - DNA, 25 bp, Rattus norvegicus
acgaagaggagaacggccagatctc

SEQ ID NO: 589643 - DNA, 25 bp, Rattus norvegicus
gaagcgtgttccctcgggacgaaga

SEQ ID NO: 589644 - DNA, 25 bp, Rattus norvegicus
gcgctacggtttcggaagcgtgttc

SEQ ID NO: 589645 - DNA, 25 bp, Rattus norvegicus
acggattgcacagaagcggacggcc

SEQ ID NO: 589646 - DNA, 25 bp, Rattus norvegicus
gtcatggctccctgtcaccagcatg

SEQ ID NO: 589647 - DNA, 25 bp, Rattus norvegicus
cagtggcgtagaacaggaacctccc

SEQ ID NO: 589648 - DNA, 25 bp, Rattus norvegicus
tgtcgatcaccgcagcggccagagt

SEQ ID NO: 589649 - DNA, 25 bp, Rattus norvegicus
tgccaggctgcccagtgtcgatcac

SEQ ID NO: 589650 - DNA, 25 bp, Rattus norvegicus
ggcaagggcaaacccgtgcccgaga

SEQ ID NO: 589651 - DNA, 25 bp, Rattus norvegicus
gctggatggagcacggaacaccata

SEQ ID NO: 589652 - DNA, 25 bp, Rattus norvegicus
agatgctgttttggctcactgacgg

SEQ ID NO: 589653 - DNA, 25 bp, Rattus norvegicus
cggaaagcctagagagtcaatctgt

SEQ ID NO: 589654 - DNA, 25 bp, Rattus norvegicus
aagttccaccctccctgctggaagg

SEQ ID NO: 589655 - DNA, 25 bp, Rattus norvegicus
cggctctgcgtgtcgatttgttttc

SEQ ID NO: 589656 - DNA, 25 bp, Rattus norvegicus
ctctgtttttcctcgaatggccggc

SEQ ID NO: 589657 - DNA, 25 bp, Rattus norvegicus
cgccggagaataactcacctgtttg

SEQ ID NO: 589658 - DNA, 25 bp, Rattus norvegicus
cacctgtttgtcgtggaaatcgctc

SEQ ID NO: 589659 - DNA, 25 bp, Rattus norvegicus
gtggaaatcgctcctgctcggccct

SEQ ID NO: 589660 - DNA, 25 bp, Rattus norvegicus
gctcaccgtcttccctctgggagga

SEQ ID NO: 589661 - DNA, 25 bp, Rattus norvegicus
gggacttcctgtctctccgttgagc

SEQ ID NO: 589662 - DNA, 25 bp, Rattus norvegicus
agtcgccttcccgaggatgctcagt

SEQ ID NO: 589663 - DNA, 25 bp, Rattus norvegicus
ttgccttggctaaagacctaaattc

SEQ ID NO: 589664 - DNA, 25 bp, Rattus norvegicus
tcccagggcgactacgctggatgga

SEQ ID NO: 589665 - DNA, 25 bp, Rattus norvegicus
tgtccttactgttttaagttcagtg

SEQ ID NO: 589666 - DNA, 25 bp, Rattus norvegicus
tgcccgggtgaatgtccttactgtt

SEQ ID NO: 589667 - DNA, 25 bp, Rattus norvegicus
cttacagccattgtggagggaaaga

SEQ ID NO: 589668 - DNA, 25 bp, Rattus norvegicus
caccgcttcttacagccattgtgga

SEQ ID NO: 589669 - DNA, 25 bp, Rattus norvegicus
tgacgggcttctacaccgcttctta

SEQ ID NO: 589670 - DNA, 25 bp, Rattus norvegicus
atacttgctcgctaacaacttccgg

SEQ ID NO: 589671 - DNA, 25 bp, Rattus norvegicus
aagttcagtgtcacggcagctgcca

SEQ ID NO: 589672 - DNA, 25 bp, Rattus norvegicus
gcgtgctcctatggcctgcctctga

SEQ ID NO: 589673 - DNA, 25 bp, Rattus norvegicus
aagtgcaaccgcgtgctcctatggc

SEQ ID NO: 589674 - DNA, 25 bp, Rattus norvegicus
tagtctgaagtgcaaccgcgtgctc

SEQ ID NO: 589675 - DNA, 25 bp, Rattus norvegicus
aacttccggtatcatgtcgggcacg

SEQ ID NO: 589676 - DNA, 25 bp, Rattus norvegicus
acgtctcggtagtctgaagtgcaac

SEQ ID NO: 589677 - DNA, 25 bp, Rattus norvegicus
tgctcgctaacaacttccggtatca

SEQ ID NO: 589678 - DNA, 25 bp, Rattus norvegicus
gctttcgcacgtctcggtagtctga

SEQ ID NO: 589679 - DNA, 25 bp, Rattus norvegicus
ggatggctgggacagacagcccatc

SEQ ID NO: 589680 - DNA, 25 bp, Rattus norvegicus
ccactagccaatgtccagaggtctg

SEQ ID NO: 589681 - DNA, 25 bp, Rattus norvegicus
gtctagtgtagagcgctgactccgc

SEQ ID NO: 589682 - DNA, 25 bp, Rattus norvegicus
gcccttttgccgaaggtctagtgta

SEQ ID NO: 589683 - DNA, 25 bp, Rattus norvegicus
cgggctatccctgctccatagaagc

SEQ ID NO: 589684 - DNA, 25 bp, Rattus norvegicus
caatgccaggtctcctcgggctatc

SEQ ID NO: 589685 - DNA, 25 bp, Rattus norvegicus
ctcggttggcgcaccctttcaggac

SEQ ID NO: 589686 - DNA, 25 bp, Rattus norvegicus
atcgctgggctctgcacctattcca

SEQ ID NO: 589687 - DNA, 25 bp, Rattus norvegicus
agaccagggagactcaggcatcgct

SEQ ID NO: 589688 - DNA, 25 bp, Rattus norvegicus
cgcacttccaagcagaccagggaga

SEQ ID NO: 589689 - DNA, 25 bp, Rattus norvegicus
ctgcattagagatcggggaactcca

SEQ ID NO: 589690 - DNA, 25 bp, Rattus norvegicus
cctgggctgactgcattagagatcg

SEQ ID NO: 589691 - DNA, 25 bp, Rattus norvegicus
cgcttccggagatcggtcgatccta

SEQ ID NO: 589692 - DNA, 25 bp, Rattus norvegicus
tcctgggctaaggtcgctggaatcg

SEQ ID NO: 589693 - DNA, 25 bp, Rattus norvegicus
cagtgctgggactcttacgcggcgc

SEQ ID NO: 589694 - DNA, 25 bp, Rattus norvegicus
cttctcaaggtcctcggtgtccaca

SEQ ID NO: 589695 - DNA, 25 bp, Rattus norvegicus
ttacgcggcgccctaggccagtttc

SEQ ID NO: 589696 - DNA, 25 bp, Rattus norvegicus
cctgcgatgctacaacgtcgtagcg

SEQ ID NO: 589697 - DNA, 25 bp, Rattus norvegicus
catcctggcggcgctggtaggtccc

SEQ ID NO: 589698 - DNA, 25 bp, Rattus norvegicus
ccgcattgcccagtgccgcgcgtcc

SEQ ID NO: 589699 - DNA, 25 bp, Rattus norvegicus
ctgggactcttacgcggcgccctag

SEQ ID NO: 589700 - DNA, 25 bp, Rattus norvegicus
cgctcctcgccttcgccgcgtggac

SEQ ID NO: 589701 - DNA, 25 bp, Rattus norvegicus
cgcgctgctgctccgcgcacacccg

SEQ ID NO: 589702 - DNA, 25 bp, Rattus norvegicus
gagcgtcctctcagagcgctgcacg

SEQ ID NO: 589703 - DNA, 25 bp, Rattus norvegicus
ctctcagagcgctgcacggacgaga

SEQ ID NO: 589704 - DNA, 25 bp, Rattus norvegicus
tcagagcgctgcacggacgagaaga

SEQ ID NO: 589705 - DNA, 25 bp, Rattus norvegicus
ggtgtccacaccacctgcgatgcta

SEQ ID NO: 589706 - DNA, 25 bp, Rattus norvegicus
ccacctgcgatgctacaacgtcgta

SEQ ID NO: 589707 - DNA, 25 bp, Rattus norvegicus
agaagaaggttctcgagcacacgtt

SEQ ID NO: 589708 - DNA, 25 bp, Rattus norvegicus
agcccgttctcagagaagaaggttc

SEQ ID NO: 589709 - DNA, 25 bp, Rattus norvegicus
gcccgttctcagagaagaaggttct

SEQ ID NO: 589710 - DNA, 25 bp, Rattus norvegicus
cccgttctcagagaagaaggttctc

SEQ ID NO: 589711 - DNA, 25 bp, Rattus norvegicus
ccgttctcagagaagaaggttctcg

SEQ ID NO: 589712 - DNA, 25 bp, Rattus norvegicus
cgttctcagagaagaaggttctcga

SEQ ID NO: 589713 - DNA, 25 bp, Rattus norvegicus
ttctcagagaagaaggttctcgagc

SEQ ID NO: 589714 - DNA, 25 bp, Rattus norvegicus
tctcagagaagaaggttctcgagca

SEQ ID NO: 589715 - DNA, 25 bp, Rattus norvegicus
ctcagagaagaaggttctcgagcac

SEQ ID NO: 589716 - DNA, 25 bp, Rattus norvegicus
tcagagaagaaggttctcgagcaca

SEQ ID NO: 589717 - DNA, 25 bp, Rattus norvegicus
cagagaagaaggttctcgagcacac

SEQ ID NO: 589718 - DNA, 25 bp, Rattus norvegicus
gagaagaaggttctcgagcacacgt

SEQ ID NO: 589719 - DNA, 25 bp, Rattus norvegicus
gaagaaggttctcgagcacacgttg

SEQ ID NO: 589720 - DNA, 25 bp, Rattus norvegicus
agagaagaaggttctcgagcacacg

SEQ ID NO: 589721 - DNA, 25 bp, Rattus norvegicus
gcacttgtaattccctttaatgagc

SEQ ID NO: 589722 - DNA, 25 bp, Rattus norvegicus
ctctcccggtcggatgttgtgatcc

SEQ ID NO: 589723 - DNA, 25 bp, Rattus norvegicus
cgagcacacgttgcacttgtaattc

SEQ ID NO: 589724 - DNA, 25 bp, Rattus norvegicus
cacgttgcacttgtaattcccttta

SEQ ID NO: 589725 - DNA, 25 bp, Rattus norvegicus
gccttcttcttcacgatggcactct

SEQ ID NO: 589726 - DNA, 25 bp, Rattus norvegicus
atggcactctctcccggtcggatgt

SEQ ID NO: 589727 - DNA, 25 bp, Rattus norvegicus
cccggtcggatgttgtgatcccgga

SEQ ID NO: 589728 - DNA, 25 bp, Rattus norvegicus
gtggttctgcagcagagtctccatg

SEQ ID NO: 589729 - DNA, 25 bp, Rattus norvegicus
cagcagagtctccatggtgtaggcc

SEQ ID NO: 589730 - DNA, 25 bp, Rattus norvegicus
agagtctccatggtgtaggccgccc

SEQ ID NO: 589731 - DNA, 25 bp, Rattus norvegicus
ccgcagatgtcgcagccatacatgg

SEQ ID NO: 589732 - DNA, 25 bp, Rattus norvegicus
agccatacatgggttcggagctgtc

SEQ ID NO: 589733 - DNA, 25 bp, Rattus norvegicus
ggttcggagctgtccacgtcctcct

SEQ ID NO: 589734 - DNA, 25 bp, Rattus norvegicus
cctttaatgagctccgccttcttct

SEQ ID NO: 589735 - DNA, 25 bp, Rattus norvegicus
ctggaagtttcggcctccaggctct

SEQ ID NO: 589736 - DNA, 25 bp, Rattus norvegicus
gtcgctcctccagaaggtacctttg

SEQ ID NO: 589737 - DNA, 25 bp, Rattus norvegicus
ggtacctttgggtctccatggcgac

SEQ ID NO: 589738 - DNA, 25 bp, Rattus norvegicus
gggcttctctgtcgctcctccagaa

SEQ ID NO: 589739 - DNA, 25 bp, Rattus norvegicus
ggctctgcgagggtcccttcatggt

SEQ ID NO: 589740 - DNA, 25 bp, Rattus norvegicus
cagaaggtacctttgggtctccatg

SEQ ID NO: 589741 - DNA, 25 bp, Rattus norvegicus
cagtgctgggcttctctgtcgctcc

SEQ ID NO: 589742 - DNA, 25 bp, Rattus norvegicus
tcccttcatggtgggggcactacct

SEQ ID NO: 589743 - DNA, 25 bp, Rattus norvegicus
tcgaagagcaaaggaggtgttcaca

SEQ ID NO: 589744 - DNA, 25 bp, Rattus norvegicus
caacgacgttcgaagagcaaaggag

SEQ ID NO: 589745 - DNA, 25 bp, Rattus norvegicus
gattgtcccgaacaacgacgttcga

SEQ ID NO: 589746 - DNA, 25 bp, Rattus norvegicus
gaggtgttcacagagaaacccagtc

SEQ ID NO: 589747 - DNA, 25 bp, Rattus norvegicus
cgtcagaatgactggggcgtgggaa

SEQ ID NO: 589748 - DNA, 25 bp, Rattus norvegicus
tcggatgctgaggcctggaagtttc

SEQ ID NO: 589749 - DNA, 25 bp, Rattus norvegicus
ctggcactttattggctgctgctgc

SEQ ID NO: 589750 - DNA, 25 bp, Rattus norvegicus
ctgtagcctaagcaccgcgcgagca

SEQ ID NO: 589751 - DNA, 25 bp, Rattus norvegicus
tgtcctcattttagaacgcgcgcga

SEQ ID NO: 589752 - DNA, 25 bp, Rattus norvegicus
ctcctcgttcttgctggcgttgatc

SEQ ID NO: 589753 - DNA, 25 bp, Rattus norvegicus
gctcctgcaacgagcggcgacgaca

SEQ ID NO: 589754 - DNA, 25 bp, Rattus norvegicus
gccgccgtacgctatcgagaaggaa

SEQ ID NO: 589755 - DNA, 25 bp, Rattus norvegicus
cgagaaggaagacctcagctccgtc

SEQ ID NO: 589756 - DNA, 25 bp, Rattus norvegicus
ccgcctgacaatgccaactcgtgga

SEQ ID NO: 589757 - DNA, 25 bp, Rattus norvegicus
aactcgtggagctctttataatgcc

SEQ ID NO: 589758 - DNA, 25 bp, Rattus norvegicus
gggcaccacctcgtaacaacgaatg

SEQ ID NO: 589759 - DNA, 25 bp, Rattus norvegicus
caacgaatgctttcattggctaagg

SEQ ID NO: 589760 - DNA, 25 bp, Rattus norvegicus
agcagcccgggtcggcctcaaagtc

SEQ ID NO: 589761 - DNA, 25 bp, Rattus norvegicus
cactcaccattgtcctggcacttta

SEQ ID NO: 589762 - DNA, 25 bp, Rattus norvegicus
ttggctaaggtgaaccgccactcac

SEQ ID NO: 589763 - DNA, 25 bp, Rattus norvegicus
tggatgagaccggtgactgaacaag

SEQ ID NO: 589764 - DNA, 25 bp, Rattus norvegicus
gcagcccgacgagccgatgacggac

SEQ ID NO: 589765 - DNA, 25 bp, Rattus norvegicus
ttcctgccttcaatgcctcagcaga

SEQ ID NO: 589766 - DNA, 25 bp, Rattus norvegicus
gccttcaatgcctcagcagaagacc

SEQ ID NO: 589767 - DNA, 25 bp, Rattus norvegicus
ctgcggctggacatcctccgggcga

SEQ ID NO: 589768 - DNA, 25 bp, Rattus norvegicus
gacgctgctcggacccggtgctagt

SEQ ID NO: 589769 - DNA, 25 bp, Rattus norvegicus
gtgactgaacaagtccctgcctctg

SEQ ID NO: 589770 - DNA, 25 bp, Rattus norvegicus
ctgcccagtcgttgccgtcgatcgg

SEQ ID NO: 589771 - DNA, 25 bp, Rattus norvegicus
tcgttgccgtcgatcgggaccggtc

SEQ ID NO: 589772 - DNA, 25 bp, Rattus norvegicus
ccaccttgcgccttctgcctctcac

SEQ ID NO: 589773 - DNA, 25 bp, Rattus norvegicus
cccagatcaggtccgggcttcgggc

SEQ ID NO: 589774 - DNA, 25 bp, Rattus norvegicus
cgccgcgtcctcctgacagctgcgg

SEQ ID NO: 589775 - DNA, 25 bp, Rattus norvegicus
gcaaacgagggcgagagccagccaa

SEQ ID NO: 589776 - DNA, 25 bp, Rattus norvegicus
gctggacatcctccgggcgacgctg

SEQ ID NO: 589777 - DNA, 25 bp, Rattus norvegicus
gaagcaagtaggttccaggcaccgc

SEQ ID NO: 589778 - DNA, 25 bp, Rattus norvegicus
ccgagcgggaagcaagtaggttcca

SEQ ID NO: 589779 - DNA, 25 bp, Rattus norvegicus
ggtcgtgctccgaagtgtcctcctc

SEQ ID NO: 589780 - DNA, 25 bp, Rattus norvegicus
aagaagggtcgtgctccgaagtgtc

SEQ ID NO: 589781 - DNA, 25 bp, Rattus norvegicus
cggagcagttattggccaggcgctg

SEQ ID NO: 589782 - DNA, 25 bp, Rattus norvegicus
agcagcgctcggtgttgggcgccct

SEQ ID NO: 589783 - DNA, 25 bp, Rattus norvegicus
gcaagtaggttccaggcaccgccgt

SEQ ID NO: 589784 - DNA, 25 bp, Rattus norvegicus
gacccggaagagtcaagctgcgcgc

SEQ ID NO: 589785 - DNA, 25 bp, Rattus norvegicus
ggctcctagcctcgctgcggctcta

SEQ ID NO: 589786 - DNA, 25 bp, Rattus norvegicus
ttagtgcggctcctagcctcgctgc

SEQ ID NO: 589787 - DNA, 25 bp, Rattus norvegicus
aagagtcaagctgcgcgccttagtg

SEQ ID NO: 589788 - DNA, 25 bp, Rattus norvegicus
ctgcgcgccttagtgcggctcctag

SEQ ID NO: 589789 - DNA, 25 bp, Rattus norvegicus
taggttccaggcaccgccgtgcgcg

SEQ ID NO: 589790 - DNA, 25 bp, Rattus norvegicus
cggctctaagccgagcgggaagcaa

SEQ ID NO: 589791 - DNA, 25 bp, Rattus norvegicus
tatctgtgcgctcaggcagtgccaa

SEQ ID NO: 589792 - DNA, 25 bp, Rattus norvegicus
ttcgaccaggtcagccgctaaacgg

SEQ ID NO: 589793 - DNA, 25 bp, Rattus norvegicus
ctcagaacgacacggagcccatcgt

SEQ ID NO: 589794 - DNA, 25 bp, Rattus norvegicus
caagtgcctggtagtgtgcgattcc

SEQ ID NO: 589795 - DNA, 25 bp, Rattus norvegicus
tggtagtgtgcgattccagtccatc

SEQ ID NO: 589796 - DNA, 25 bp, Rattus norvegicus
tgagcaaccgtaccatgaccatcta

SEQ ID NO: 589797 - DNA, 25 bp, Rattus norvegicus
ttccctgggcatatctgtgcgctca

SEQ ID NO: 589798 - DNA, 25 bp, Rattus norvegicus
caggcagtgccaaggtggccttctc

SEQ ID NO: 589799 - DNA, 25 bp, Rattus norvegicus
aggtggccttctccgctactcggag

SEQ ID NO: 589800 - DNA, 25 bp, Rattus norvegicus
gagccttcagagatgagcaaccgta

SEQ ID NO: 589801 - DNA, 25 bp, Rattus norvegicus
cctgctgcccggtaaaggctcagaa

SEQ ID NO: 589802 - DNA, 25 bp, Rattus norvegicus
tgagccggccgactttggctccagc

SEQ ID NO: 589803 - DNA, 25 bp, Rattus norvegicus
ggcccacccgccgataagtgaaaga

SEQ ID NO: 589804 - DNA, 25 bp, Rattus norvegicus
gcgctgtcacttcttccctgggcat

SEQ ID NO: 589805 - DNA, 25 bp, Rattus norvegicus
ctgttcctttcagacgagtttccgg

SEQ ID NO: 589806 - DNA, 25 bp, Rattus norvegicus
ctctgtggcgcgaccgtttaattct

SEQ ID NO: 589807 - DNA, 25 bp, Rattus norvegicus
gtagacatcgtggaacctctgttcc

SEQ ID NO: 589808 - DNA, 25 bp, Rattus norvegicus
ccgtttaattctccggcggcgacag

SEQ ID NO: 589809 - DNA, 25 bp, Rattus norvegicus
ctcatcaggaagctcggtaactgtc

SEQ ID NO: 589810 - DNA, 25 bp, Rattus norvegicus
taactgtctgtgttgcccagggtcc

SEQ ID NO: 589811 - DNA, 25 bp, Rattus norvegicus
gagccctcgcgtcttggcttggtag

SEQ ID NO: 589812 - DNA, 25 bp, Rattus norvegicus
tcttggcttggtagtgctgggtttc

SEQ ID NO: 589813 - DNA, 25 bp, Rattus norvegicus
ctagtccctgcttgcgcaacgttgc

SEQ ID NO: 589814 - DNA, 25 bp, Rattus norvegicus
tgcttgcgcaacgttgcccgctgac

SEQ ID NO: 589815 - DNA, 25 bp, Rattus norvegicus
gcccgctgaccttgctcacattgta

SEQ ID NO: 589816 - DNA, 25 bp, Rattus norvegicus
ttgtataatcctcggccgcatccag

SEQ ID NO: 589817 - DNA, 25 bp, Rattus norvegicus
tatgaacgaactctgtggcgcgacc

SEQ ID NO: 589818 - DNA, 25 bp, Rattus norvegicus
tccggaggatattaattatgaacga

SEQ ID NO: 589819 - DNA, 25 bp, Rattus norvegicus
ctcgcgacccgtcgtcaccttcgcc

SEQ ID NO: 589820 - DNA, 25 bp, Rattus norvegicus
ccggaactgctcagcagcaccagca

SEQ ID NO: 589821 - DNA, 25 bp, Rattus norvegicus
cgccacacacggaggcaggggatcc

SEQ ID NO: 589822 - DNA, 25 bp, Rattus norvegicus
gggtcgatagctgggccgccacaca

SEQ ID NO: 589823 - DNA, 25 bp, Rattus norvegicus
agcagtcgcgccgccgctgatttct

SEQ ID NO: 589824 - DNA, 25 bp, Rattus norvegicus
gagcttcctgctgcggattttcacg

SEQ ID NO: 589825 - DNA, 25 bp, Rattus norvegicus
cacgtatccctgcttgactatgtcg

SEQ ID NO: 589826 - DNA, 25 bp, Rattus norvegicus
ccctgcttgactatgtcgttaaagt

SEQ ID NO: 589827 - DNA, 25 bp, Rattus norvegicus
tcgttaaagttggaggccatggcca

SEQ ID NO: 589828 - DNA, 25 bp, Rattus norvegicus
gggctcctctgctgggcgatccgct

SEQ ID NO: 589829 - DNA, 25 bp, Rattus norvegicus
ccggagtcgacaaccgctgtccgcc

SEQ ID NO: 589830 - DNA, 25 bp, Rattus norvegicus
gtccacgcaggtctcgcatccagcc

SEQ ID NO: 589831 - DNA, 25 bp, Rattus norvegicus
tgctgcggattttcacgtatccctg

SEQ ID NO: 589832 - DNA, 25 bp, Rattus norvegicus
tggccacaagcggagcacagcgacc

SEQ ID NO: 589833 - DNA, 25 bp, Rattus norvegicus
aggtcgtccacggaggtgaactgct

SEQ ID NO: 589834 - DNA, 25 bp, Rattus norvegicus
gaggtgaactgcttgtcgcagctct

SEQ ID NO: 589835 - DNA, 25 bp, Rattus norvegicus
cggaggtgaactgcttgtcgcagct

SEQ ID NO: 589836 - DNA, 25 bp, Rattus norvegicus
acggaggtgaactgcttgtcgcagc

SEQ ID NO: 589837 - DNA, 25 bp, Rattus norvegicus
cacggaggtgaactgcttgtcgcag

SEQ ID NO: 589838 - DNA, 25 bp, Rattus norvegicus
ccacggaggtgaactgcttgtcgca

SEQ ID NO: 589839 - DNA, 25 bp, Rattus norvegicus
tccacggaggtgaactgcttgtcgc

SEQ ID NO: 589840 - DNA, 25 bp, Rattus norvegicus
gtccacggaggtgaactgcttgtcg

SEQ ID NO: 589841 - DNA, 25 bp, Rattus norvegicus
cgtccacggaggtgaactgcttgtc

SEQ ID NO: 589842 - DNA, 25 bp, Rattus norvegicus
ggtcgtccacggaggtgaactgctt

SEQ ID NO: 589843 - DNA, 25 bp, Rattus norvegicus
ggtgaactgcttgtcgcagctctcg

SEQ ID NO: 589844 - DNA, 25 bp, Rattus norvegicus
aggtgaactgcttgtcgcagctctc

SEQ ID NO: 589845 - DNA, 25 bp, Rattus norvegicus
tcgtccacggaggtgaactgcttgt

SEQ ID NO: 589846 - DNA, 25 bp, Rattus norvegicus
ggaggtgaactgcttgtcgcagctc

SEQ ID NO: 589847 - DNA, 25 bp, Rattus norvegicus
acctcctggcacagcgtgcagcgga

SEQ ID NO: 589848 - DNA, 25 bp, Rattus norvegicus
tggacaccttcgagtcgaacacctc

SEQ ID NO: 589849 - DNA, 25 bp, Rattus norvegicus
actttcttctcgttactgtgcttca

SEQ ID NO: 589850 - DNA, 25 bp, Rattus norvegicus
ctggatggacaccttcgagtcgaac

SEQ ID NO: 589851 - DNA, 25 bp, Rattus norvegicus
gcttcacggccaggtgcagctggat

SEQ ID NO: 589852 - DNA, 25 bp, Rattus norvegicus
gcagcggtacactttcttctcgtta

SEQ ID NO: 589853 - DNA, 25 bp, Rattus norvegicus
ggacgtgcagcggtacactttcttc

SEQ ID NO: 589854 - DNA, 25 bp, Rattus norvegicus
ttgcaggacgtgcagcggtacactt

SEQ ID NO: 589855 - DNA, 25 bp, Rattus norvegicus
agtcccagttgcaggacgtgcagcg

SEQ ID NO: 589856 - DNA, 25 bp, Rattus norvegicus
gtcggtctcgttgcggaagtcccag

SEQ ID NO: 589857 - DNA, 25 bp, Rattus norvegicus
tgcagctggatggacaccttcgagt

SEQ ID NO: 589858 - DNA, 25 bp, Rattus norvegicus
tgcagctgcaggtcggtctcgttgc

SEQ ID NO: 589859 - DNA, 25 bp, Rattus norvegicus
gcaggtgcttctggaggtcgtccac

SEQ ID NO: 589860 - DNA, 25 bp, Rattus norvegicus
gcacagcgtgcagcggaagaacacg

SEQ ID NO: 589861 - DNA, 25 bp, Rattus norvegicus
cgcgagaccagcagaagccaggcaa

SEQ ID NO: 589862 - DNA, 25 bp, Rattus norvegicus
aacttcctctgctacggggactcca

SEQ ID NO: 589863 - DNA, 25 bp, Rattus norvegicus
catttggggatcctcctcccggctt

SEQ ID NO: 589864 - DNA, 25 bp, Rattus norvegicus
ttttctcatccactttctaccgctg

SEQ ID NO: 589865 - DNA, 25 bp, Rattus norvegicus
gcccagacggagatcgccaacaaga

SEQ ID NO: 589866 - DNA, 25 bp, Rattus norvegicus
cagaaactttttcttccagcccaga

SEQ ID NO: 589867 - DNA, 25 bp, Rattus norvegicus
tgccgcatgagtttctgcatattta

SEQ ID NO: 589868 - DNA, 25 bp, Rattus norvegicus
ccaggcaagaccagcggaacccgaa

SEQ ID NO: 589869 - DNA, 25 bp, Rattus norvegicus
gttcagttgtttacgtcggccgcga

SEQ ID NO: 589870 - DNA, 25 bp, Rattus norvegicus
gcagcccaagtgcacccggttcagt

SEQ ID NO: 589871 - DNA, 25 bp, Rattus norvegicus
acaagggcggtcaactttctgggca

SEQ ID NO: 589872 - DNA, 25 bp, Rattus norvegicus
gccgccgcaagccaactaagtgtac

SEQ ID NO: 589873 - DNA, 25 bp, Rattus norvegicus
cagccaccggatcgataacttcagt

SEQ ID NO: 589874 - DNA, 25 bp, Rattus norvegicus
agggacttctccctcctgtccatga

SEQ ID NO: 589875 - DNA, 25 bp, Rattus norvegicus
tgcgcgctcaggcacatctatctgc

SEQ ID NO: 589876 - DNA, 25 bp, Rattus norvegicus
cgctcaggaaatggtcccgccacga

SEQ ID NO: 589877 - DNA, 25 bp, Rattus norvegicus
tatctgcggcagaccggaacagacc

SEQ ID NO: 589878 - DNA, 25 bp, Rattus norvegicus
cgagccattgcggaaggttcccaag

SEQ ID NO: 589879 - DNA, 25 bp, Rattus norvegicus
tgagagggcctcaactccgaggagt

SEQ ID NO: 589880 - DNA, 25 bp, Rattus norvegicus
tctgcgttccggcttccgcgactag

SEQ ID NO: 589881 - DNA, 25 bp, Rattus norvegicus
caggccgcagcccagaggaaaagag

SEQ ID NO: 589882 - DNA, 25 bp, Rattus norvegicus
ccaccgggccggcagagaaatccgg

SEQ ID NO: 589883 - DNA, 25 bp, Rattus norvegicus
cgctgtcacaggaaacacggggccc

SEQ ID NO: 589884 - DNA, 25 bp, Rattus norvegicus
cagctcaccttctggatggcggcgg

SEQ ID NO: 589885 - DNA, 25 bp, Rattus norvegicus
ggctgcgaacgccacagacatattg

SEQ ID NO: 589886 - DNA, 25 bp, Rattus norvegicus
ggctgcagctcccagaaaagtattt

SEQ ID NO: 589887 - DNA, 25 bp, Rattus norvegicus
tttgagaagctcactgtcgccggtg

SEQ ID NO: 589888 - DNA, 25 bp, Rattus norvegicus
acagtcgggactcaggagcgcctac

SEQ ID NO: 589889 - DNA, 25 bp, Rattus norvegicus
agcgccgtctctcggctttctgttt

SEQ ID NO: 589890 - DNA, 25 bp, Rattus norvegicus
cttcatagcgactctaaagcaggtg

SEQ ID NO: 589891 - DNA, 25 bp, Rattus norvegicus
ttagaaatatgcaggagctcccagc

SEQ ID NO: 589892 - DNA, 25 bp, Rattus norvegicus
cattcgcagaattaccgcatgcacg

SEQ ID NO: 589893 - DNA, 25 bp, Rattus norvegicus
cacaagctcacggtggaggaccctg

SEQ ID NO: 589894 - DNA, 25 bp, Rattus norvegicus
cgtagagtatataactcgcttcata

SEQ ID NO: 589895 - DNA, 25 bp, Rattus norvegicus
tggagtgccagagccacaagctcac

SEQ ID NO: 589896 - DNA, 25 bp, Rattus norvegicus
gcgactctaaagcaggtgagcttta

SEQ ID NO: 589897 - DNA, 25 bp, Rattus norvegicus
gagctttagctcgtagcgccgtctc

SEQ ID NO: 589898 - DNA, 25 bp, Rattus norvegicus
cgccatcattggtcctgtcttagaa

SEQ ID NO: 589899 - DNA, 25 bp, Rattus norvegicus
gctcccagcacttagtcacggagtg

SEQ ID NO: 589900 - DNA, 25 bp, Rattus norvegicus
acttagtcacggagtgcctcggctc

SEQ ID NO: 589901 - DNA, 25 bp, Rattus norvegicus
cctcggctccgtattcattcgcaga

SEQ ID NO: 589902 - DNA, 25 bp, Rattus norvegicus
gaggaccctgtcaccgtagagtata

SEQ ID NO: 589903 - DNA, 25 bp, Rattus norvegicus
gacgctgcagcatcgcggagcacac

SEQ ID NO: 589904 - DNA, 25 bp, Rattus norvegicus
cggggagctctaactctgcgcttcc

SEQ ID NO: 589905 - DNA, 25 bp, Rattus norvegicus
tttatatagccacgcggagcccttg

SEQ ID NO: 589906 - DNA, 25 bp, Rattus norvegicus
ggcttccctgaagtccgaccttctg

SEQ ID NO: 589907 - DNA, 25 bp, Rattus norvegicus
ccgaccttctgattggtcagcaaga

SEQ ID NO: 589908 - DNA, 25 bp, Rattus norvegicus
aggaatcgcgctagtgacgtcacga

SEQ ID NO: 589909 - DNA, 25 bp, Rattus norvegicus
gtagctcagactccaccagaatctg

SEQ ID NO: 589910 - DNA, 25 bp, Rattus norvegicus
aatctgaggcgcaggttcccggaaa

SEQ ID NO: 589911 - DNA, 25 bp, Rattus norvegicus
cccggaaagtcatcacgtgcgagcc

SEQ ID NO: 589912 - DNA, 25 bp, Rattus norvegicus
gcagcactagctgacccgcgacagg

SEQ ID NO: 589913 - DNA, 25 bp, Rattus norvegicus
gcctctcctaggatgttacacatta

SEQ ID NO: 589914 - DNA, 25 bp, Rattus norvegicus
accgattctggacaaggtggaattc

SEQ ID NO: 589915 - DNA, 25 bp, Rattus norvegicus
ctcgagactacaggagcagcggcgc

SEQ ID NO: 589916 - DNA, 25 bp, Rattus norvegicus
cgcggctccgccagccatgtttata

SEQ ID NO: 589917 - DNA, 25 bp, Rattus norvegicus
ataacccggaagtgatctaggaggc

SEQ ID NO: 589918 - DNA, 25 bp, Rattus norvegicus
cctgactgagttgtgattgctaaga

SEQ ID NO: 589919 - DNA, 25 bp, Rattus norvegicus
gccgtaaagcagaagcagattcgtc

SEQ ID NO: 589920 - DNA, 25 bp, Rattus norvegicus
acgcttctctctttgtagccgtaaa

SEQ ID NO: 589921 - DNA, 25 bp, Rattus norvegicus
ttgacgagatctctgctcacgcttc

SEQ ID NO: 589922 - DNA, 25 bp, Rattus norvegicus
ctttacaaatgcatcaagaagggtg

SEQ ID NO: 589923 - DNA, 25 bp, Rattus norvegicus
ccgcctgacgcgcaagctttacaaa

SEQ ID NO: 589924 - DNA, 25 bp, Rattus norvegicus
ataaaggtggttcccgaggaatctg

SEQ ID NO: 589925 - DNA, 25 bp, Rattus norvegicus
gtggttcctctatgccctgactgag

SEQ ID NO: 589926 - DNA, 25 bp, Rattus norvegicus
cggaaatccaaatcccgagcctgga

SEQ ID NO: 589927 - DNA, 25 bp, Rattus norvegicus
tcgtttcccaattggtcacagggta

SEQ ID NO: 589928 - DNA, 25 bp, Rattus norvegicus
ctacttagagattggtcggtgcgga

SEQ ID NO: 589929 - DNA, 25 bp, Rattus norvegicus
cacagggtagggctgcttcataacc

SEQ ID NO: 589930 - DNA, 25 bp, Rattus norvegicus
gaagagctgctggtcaacctgaacc

SEQ ID NO: 589931 - DNA, 25 bp, Rattus norvegicus
ccggatcctggaaccgctgctaaaa

SEQ ID NO: 589932 - DNA, 25 bp, Rattus norvegicus
gaacgcacgaccttggccggatcct

SEQ ID NO: 589933 - DNA, 25 bp, Rattus norvegicus
tctcctcaaagacgagtccagcctg

SEQ ID NO: 589934 - DNA, 25 bp, Rattus norvegicus
gggagtaccaagaggacacgacttc

SEQ ID NO: 589935 - DNA, 25 bp, Rattus norvegicus
taaggcgtctttcgtgtactggagc

SEQ ID NO: 589936 - DNA, 25 bp, Rattus norvegicus
ttccgtgaggcgtctttcgtgtact

SEQ ID NO: 589937 - DNA, 25 bp, Rattus norvegicus
cccgcctttgagataatagagtccg

SEQ ID NO: 589938 - DNA, 25 bp, Rattus norvegicus
tatggacgtaaacagggaacttgcg

SEQ ID NO: 589939 - DNA, 25 bp, Rattus norvegicus
cctgtgttcgtttctacgctgttta

SEQ ID NO: 589940 - DNA, 25 bp, Rattus norvegicus
tcgaccacttgataatgtgcgcttg

SEQ ID NO: 589941 - DNA, 25 bp, Rattus norvegicus
taatggctgtttccggtccctatgg

SEQ ID NO: 589942 - DNA, 25 bp, Rattus norvegicus
tccctatgggcgtgttcaagcgtgt

SEQ ID NO: 589943 - DNA, 25 bp, Rattus norvegicus
gtccgtgtcacctttgtcgatttta

SEQ ID NO: 589944 - DNA, 25 bp, Rattus norvegicus
tggcggaaccgaagaactcgaacta

SEQ ID NO: 589945 - DNA, 25 bp, Rattus norvegicus
taatgaccttcagctaccgggaggc

SEQ ID NO: 589946 - DNA, 25 bp, Rattus norvegicus
cgttatctgcacctcctggatctcg

SEQ ID NO: 589947 - DNA, 25 bp, Rattus norvegicus
cgagtcctctggctccaggggctct

SEQ ID NO: 589948 - DNA, 25 bp, Rattus norvegicus
tgccgcccgcgctggtgttacagtc

SEQ ID NO: 589949 - DNA, 25 bp, Rattus norvegicus
gctgccaggcattctcgccatattg

SEQ ID NO: 589950 - DNA, 25 bp, Rattus norvegicus
cgctgagagcttttgtgtttaatga

SEQ ID NO: 589951 - DNA, 25 bp, Rattus norvegicus
gggcggtgtcgcttcactaggtaat

SEQ ID NO: 589952 - DNA, 25 bp, Rattus norvegicus
gcaaagccgggctcttaaaggagcc

SEQ ID NO: 589953 - DNA, 25 bp, Rattus norvegicus
aggagccgcgctccaattgtcattc

SEQ ID NO: 589954 - DNA, 25 bp, Rattus norvegicus
attgtcattccggagcgcctcacgg

SEQ ID NO: 589955 - DNA, 25 bp, Rattus norvegicus
attgtggccaggagccggtaaaaga

SEQ ID NO: 589956 - DNA, 25 bp, Rattus norvegicus
cagccggaccttcttccttctttag

SEQ ID NO: 589957 - DNA, 25 bp, Rattus norvegicus
cttcactaggtaatgccggaggagc

SEQ ID NO: 589958 - DNA, 25 bp, Rattus norvegicus
ggcgcatgcgctatattggaccgca

SEQ ID NO: 589959 - DNA, 25 bp, Rattus norvegicus
agccggcccgcgaagcagtttcggt

SEQ ID NO: 589960 - DNA, 25 bp, Rattus norvegicus
cacctcactttggaagcagttcacc

SEQ ID NO: 589961 - DNA, 25 bp, Rattus norvegicus
gttcaggcactccacctcactttgg

SEQ ID NO: 589962 - DNA, 25 bp, Rattus norvegicus
aagttgctgcgtgccaggagcccga

SEQ ID NO: 589963 - DNA, 25 bp, Rattus norvegicus
atcgctaggaagttgctgcgtgcca

SEQ ID NO: 589964 - DNA, 25 bp, Rattus norvegicus
agcccgggatcgctaggaagttgct

SEQ ID NO: 589965 - DNA, 25 bp, Rattus norvegicus
atcagcccgggatcgctaggaagtt

SEQ ID NO: 589966 - DNA, 25 bp, Rattus norvegicus
aaaggcgatcccgatcagcccggga

SEQ ID NO: 589967 - DNA, 25 bp, Rattus norvegicus
gggcacaaaggcgatcccgatcagc

SEQ ID NO: 589968 - DNA, 25 bp, Rattus norvegicus
tgctggagggcacaaaggcgatccc

SEQ ID NO: 589969 - DNA, 25 bp, Rattus norvegicus
gacagcttaagtgctggagggcaca

SEQ ID NO: 589970 - DNA, 25 bp, Rattus norvegicus
tatttccacgacagcttaagtgctg

SEQ ID NO: 589971 - DNA, 25 bp, Rattus norvegicus
ggaagcagttcaccacaacgcgtca

SEQ ID NO: 589972 - DNA, 25 bp, Rattus norvegicus
gaaaaattatttccacgacagctta

SEQ ID NO: 589973 - DNA, 25 bp, Rattus norvegicus
ccgcggcgatgagctccgagacgca

SEQ ID NO: 589974 - DNA, 25 bp, Rattus norvegicus
ctggcacatgcgtaaaagcgagttg

SEQ ID NO: 589975 - DNA, 25 bp, Rattus norvegicus
cctggcacatgcgtaaaagcgagtt

SEQ ID NO: 589976 - DNA, 25 bp, Rattus norvegicus
atgcctggcacatgcgtaaaagcga

SEQ ID NO: 589977 - DNA, 25 bp, Rattus norvegicus
ccatgcctggcacatgcgtaaaagc

SEQ ID NO: 589978 - DNA, 25 bp, Rattus norvegicus
cccatgcctggcacatgcgtaaaag

SEQ ID NO: 589979 - DNA, 25 bp, Rattus norvegicus
agccgcagccggtgcgagcggatcc

SEQ ID NO: 589980 - DNA, 25 bp, Rattus norvegicus
ccaggaagaaaaccgaggagccgca

SEQ ID NO: 589981 - DNA, 25 bp, Rattus norvegicus
ctccgagacgcagcacccggccgcg

SEQ ID NO: 589982 - DNA, 25 bp, Rattus norvegicus
ctccgggaagaatggacgcgcgcgg

SEQ ID NO: 589983 - DNA, 25 bp, Rattus norvegicus
ggcacatgcgtaaaagcgagttgcg

SEQ ID NO: 589984 - DNA, 25 bp, Rattus norvegicus
ggaagaaaaccgaggagccgcagcc

SEQ ID NO: 589985 - DNA, 25 bp, Rattus norvegicus
ggcccgggttctcgccgcctctgct

SEQ ID NO: 589986 - DNA, 25 bp, Rattus norvegicus
ctgccaggaagaaaaccgaggagcc

SEQ ID NO: 589987 - DNA, 25 bp, Rattus norvegicus
agcactaagggatcaggtcagcgtc

SEQ ID NO: 589988 - DNA, 25 bp, Rattus norvegicus
agagatgcgcccaccgcgctgatca

SEQ ID NO: 589989 - DNA, 25 bp, Rattus norvegicus
cgcgctgatcagaggcgcccggact

SEQ ID NO: 589990 - DNA, 25 bp, Rattus norvegicus
ccggactctgggtaccgcgcatccc

SEQ ID NO: 589991 - DNA, 25 bp, Rattus norvegicus
agtgcagttacctccgcatccgtcc

SEQ ID NO: 589992 - DNA, 25 bp, Rattus norvegicus
atccgtccctggagctgtgcaggta

SEQ ID NO: 589993 - DNA, 25 bp, Rattus norvegicus
gcaggtaccactccggcagagcaga

SEQ ID NO: 589994 - DNA, 25 bp, Rattus norvegicus
tccagggcaaactctccggaacctg

SEQ ID NO: 589995 - DNA, 25 bp, Rattus norvegicus
gcctggtgcgggatcagagcactaa

SEQ ID NO: 589996 - DNA, 25 bp, Rattus norvegicus
atcaggtcagcgtcggacccgcacg

SEQ ID NO: 589997 - DNA, 25 bp, Rattus norvegicus
gcacgccgccaagccggaccggcta

SEQ ID NO: 589998 - DNA, 25 bp, Rattus norvegicus
ccctggagctgtgcaggtaccactc

SEQ ID NO: 589999 - DNA, 25 bp, Rattus norvegicus
cagggcaaactctccggaacctgtc

SEQ ID NO: 590000 - DNA, 25 bp, Rattus norvegicus
ccactccggcagagcagactgggga

SEQ ID NO: 590001 - DNA, 25 bp, Rattus norvegicus
tggaggcaagtcctgtaactaagac

SEQ ID NO: 590002 - DNA, 25 bp, Rattus norvegicus
cgccggactcgcaccaggagtaata

SEQ ID NO: 590003 - DNA, 25 bp, Rattus norvegicus
tccaaaggccagaaggcaactctga

SEQ ID NO: 590004 - DNA, 25 bp, Rattus norvegicus
tgaagacaataggacaccggcgccc

SEQ ID NO: 590005 - DNA, 25 bp, Rattus norvegicus
acaccagagtgagaatcctagtaca

SEQ ID NO: 590006 - DNA, 25 bp, Rattus norvegicus
acctaggagttcttctgcctcattc

SEQ ID NO: 590007 - DNA, 25 bp, Rattus norvegicus
ctcattcttctgctgcttggggaca

SEQ ID NO: 590008 - DNA, 25 bp, Rattus norvegicus
gggacatccctcgagctcgccttga

SEQ ID NO: 590009 - DNA, 25 bp, Rattus norvegicus
gaccctgtgaccgaggctcgccaaa

SEQ ID NO: 590010 - DNA, 25 bp, Rattus norvegicus
cccgagcttcatgcccgtgcagttt

SEQ ID NO: 590011 - DNA, 25 bp, Rattus norvegicus
cgggacctccgcttacctgaagcaa

SEQ ID NO: 590012 - DNA, 25 bp, Rattus norvegicus
ccgccaatgagagcgagctggtaac

SEQ ID NO: 590013 - DNA, 25 bp, Rattus norvegicus
ctggtaacaaatagcgggcctcgga

SEQ ID NO: 590014 - DNA, 25 bp, Rattus norvegicus
gcaactctgagctgggatgaagaca

SEQ ID NO: 590015 - DNA, 25 bp, Rattus norvegicus
catggctaactcaagggacaggtca

SEQ ID NO: 590016 - DNA, 25 bp, Rattus norvegicus
ttttggctgggcgtccgcgatccgc

SEQ ID NO: 590017 - DNA, 25 bp, Rattus norvegicus
gcctattacagctcgctcgcagcta

SEQ ID NO: 590018 - DNA, 25 bp, Rattus norvegicus
tggtgtccgggtcgctcggcttcct

SEQ ID NO: 590019 - DNA, 25 bp, Rattus norvegicus
tcaccgccaacaactgctgcagttt

SEQ ID NO: 590020 - DNA, 25 bp, Rattus norvegicus
tgctgcagtttaaggtgacctgaga

SEQ ID NO: 590021 - DNA, 25 bp, Rattus norvegicus
tgacctgagacctagtgatccgacc

SEQ ID NO: 590022 - DNA, 25 bp, Rattus norvegicus
ctagtgatccgacccgggccagtcg

SEQ ID NO: 590023 - DNA, 25 bp, Rattus norvegicus
tccgtgagttggtcccggtgctcac

SEQ ID NO: 590024 - DNA, 25 bp, Rattus norvegicus
cgctgccgccatggctaactcaagg

SEQ ID NO: 590025 - DNA, 25 bp, Rattus norvegicus
taactcaagggacaggtcaccgccc

SEQ ID NO: 590026 - DNA, 25 bp, Rattus norvegicus
cgcacaggcacttttctcgcgcttg

SEQ ID NO: 590027 - DNA, 25 bp, Rattus norvegicus
ttctcgcgcttgtctgatgctcccg

SEQ ID NO: 590028 - DNA, 25 bp, Rattus norvegicus
ctcaccgcgagggtcaacaggtgtc

SEQ ID NO: 590029 - DNA, 25 bp, Rattus norvegicus
accctactgctgctgttgcagctgc

SEQ ID NO: 590030 - DNA, 25 bp, Rattus norvegicus
ccgcagtgggacagcgcagggccca

SEQ ID NO: 590031 - DNA, 25 bp, Rattus norvegicus
agaaggcaccgctgtccccgcagtg

SEQ ID NO: 590032 - DNA, 25 bp, Rattus norvegicus
tggtaagtgcagtgacccccgcgcc

SEQ ID NO: 590033 - DNA, 25 bp, Rattus norvegicus
gggcccaacatagggcgggcgagca

SEQ ID NO: 590034 - DNA, 25 bp, Rattus norvegicus
cggtgcaccctactgctgctgttgc

SEQ ID NO: 590035 - DNA, 25 bp, Rattus norvegicus
gagcggccggtgcaccctactgctg

SEQ ID NO: 590036 - DNA, 25 bp, Rattus norvegicus
ggactctggcaaggcccggcggcaa

SEQ ID NO: 590037 - DNA, 25 bp, Rattus norvegicus
tgacccggccacacctggaaccgca

SEQ ID NO: 590038 - DNA, 25 bp, Rattus norvegicus
ggctaccctttctgacccggccaca

SEQ ID NO: 590039 - DNA, 25 bp, Rattus norvegicus
ctcctccatccagactgcggcccgg

SEQ ID NO: 590040 - DNA, 25 bp, Rattus norvegicus
tgcctcgcacctcctggcagagcga

SEQ ID NO: 590041 - DNA, 25 bp, Rattus norvegicus
gagggcgggaactgcctcgcacctc

SEQ ID NO: 590042 - DNA, 25 bp, Rattus norvegicus
gccctagccaagaaggcaccgctgt

SEQ ID NO: 590043 - DNA, 25 bp, Rattus norvegicus
tatgacaactacgtcggtttgggcc

SEQ ID NO: 590044 - DNA, 25 bp, Rattus norvegicus
gcgatcgccctcatgattctggctc

SEQ ID NO: 590045 - DNA, 25 bp, Rattus norvegicus
gattctggctctcctgcttctgctg

SEQ ID NO: 590046 - DNA, 25 bp, Rattus norvegicus
tcctgcttctgctgcgtaagtcttc

SEQ ID NO: 590047 - DNA, 25 bp, Rattus norvegicus
tcttcaaagcctgtattcccagtgc

SEQ ID NO: 590048 - DNA, 25 bp, Rattus norvegicus
tattcccagtgccttgacgagttta

SEQ ID NO: 590049 - DNA, 25 bp, Rattus norvegicus
gccttgacgagtttactaggtcttc

SEQ ID NO: 590050 - DNA, 25 bp, Rattus norvegicus
ctaggtcttcagaaaggacttgcca

SEQ ID NO: 590051 - DNA, 25 bp, Rattus norvegicus
aaaggacttgccacagccgtgcgcc

SEQ ID NO: 590052 - DNA, 25 bp, Rattus norvegicus
tgcgccgtgtgcttataaggttgtt

SEQ ID NO: 590053 - DNA, 25 bp, Rattus norvegicus
tgtggctgcgctgtatgacaactac

SEQ ID NO: 590054 - DNA, 25 bp, Rattus norvegicus
tccaatccaagcgtgattcgcgcgc

SEQ ID NO: 590055 - DNA, 25 bp, Rattus norvegicus
tgattcgcgcgctcaactcattgcg

SEQ ID NO: 590056 - DNA, 25 bp, Rattus norvegicus
tacaaacgtttattccaatccaagc

SEQ ID NO: 590057 - DNA, 25 bp, Rattus norvegicus
cgttctcaggaagatgatccacgtc

SEQ ID NO: 590058 - DNA, 25 bp, Rattus norvegicus
ccacgttaaagagcatggcacgatt

SEQ ID NO: 590059 - DNA, 25 bp, Rattus norvegicus
tgtgtgccggtctccacagaacaga

SEQ ID NO: 590060 - DNA, 25 bp, Rattus norvegicus
tcagactcggtcacgtgaggctttc

SEQ ID NO: 590061 - DNA, 25 bp, Rattus norvegicus
cgtgaggctttcctttcgcttctta

SEQ ID NO: 590062 - DNA, 25 bp, Rattus norvegicus
ccacttaggatcgagagggacgagc

SEQ ID NO: 590063 - DNA, 25 bp, Rattus norvegicus
tgctgcaagcacacgccacttagga

SEQ ID NO: 590064 - DNA, 25 bp, Rattus norvegicus
catggcctctttgaaacccacgtta

SEQ ID NO: 590065 - DNA, 25 bp, Rattus norvegicus
cgtcgtggaagatcacacagtccca

SEQ ID NO: 590066 - DNA, 25 bp, Rattus norvegicus
cccgcatccgtaatagttccgatcg

SEQ ID NO: 590067 - DNA, 25 bp, Rattus norvegicus
ttcgctgcaaagtgccgcggcatct

SEQ ID NO: 590068 - DNA, 25 bp, Rattus norvegicus
gggacgagctactcacatgtacatg

SEQ ID NO: 590069 - DNA, 25 bp, Rattus norvegicus
acatgtacttgtccagcttcgctgc

SEQ ID NO: 590070 - DNA, 25 bp, Rattus norvegicus
agtcccaggctctgtccttcatggc

SEQ ID NO: 590071 - DNA, 25 bp, Rattus norvegicus
cctcgcccgcggctttgcatggaat

SEQ ID NO: 590072 - DNA, 25 bp, Rattus norvegicus
atccctgcgattcggagcaatcctc

SEQ ID NO: 590073 - DNA, 25 bp, Rattus norvegicus
gttcgcccgagttaggcggcagtca

SEQ ID NO: 590074 - DNA, 25 bp, Rattus norvegicus
ccgaatgaatcgttcgcccgagtta

SEQ ID NO: 590075 - DNA, 25 bp, Rattus norvegicus
cccgcggctttgcatggaatgccga

SEQ ID NO: 590076 - DNA, 25 bp, Rattus norvegicus
cgccgctgtcatcggaaccggaagg

SEQ ID NO: 590077 - DNA, 25 bp, Rattus norvegicus
gctgtcacctagtcttgcagcccag

SEQ ID NO: 590078 - DNA, 25 bp, Rattus norvegicus
gctcacaggctgtcacctagtcttg

SEQ ID NO: 590079 - DNA, 25 bp, Rattus norvegicus
ccggtacccggagctcacaggctgt

SEQ ID NO: 590080 - DNA, 25 bp, Rattus norvegicus
atttctccaggctttggtcggggcg

SEQ ID NO: 590081 - DNA, 25 bp, Rattus norvegicus
ggccgacaatttctccaggctttgg

SEQ ID NO: 590082 - DNA, 25 bp, Rattus norvegicus
gagggtgtggccgacaatttctcca

SEQ ID NO: 590083 - DNA, 25 bp, Rattus norvegicus
agtccgggcgactccaccagccctt

SEQ ID NO: 590084 - DNA, 25 bp, Rattus norvegicus
gcatggaatgccgaatgaatcgttc

SEQ ID NO: 590085 - DNA, 25 bp, Rattus norvegicus
ccttcaaactgacagcgcgggctgc

SEQ ID NO: 590086 - DNA, 25 bp, Rattus norvegicus
gtgaggagaactgcctcacgtcgcc

SEQ ID NO: 590087 - DNA, 25 bp, Rattus norvegicus
tgtcacgtcgccgtgaggagaactg

SEQ ID NO: 590088 - DNA, 25 bp, Rattus norvegicus
cggggcggtgaatgcatacattcga

SEQ ID NO: 590089 - DNA, 25 bp, Rattus norvegicus
gtgcacgaatgcatttacagccttc

SEQ ID NO: 590090 - DNA, 25 bp, Rattus norvegicus
agcgcatgcgcacacactctgtctg

SEQ ID NO: 590091 - DNA, 25 bp, Rattus norvegicus
tcgaatgcctccactttgaaccagg

SEQ ID NO: 590092 - DNA, 25 bp, Rattus norvegicus
ggagcgcatgcgcacacactctgtc

SEQ ID NO: 590093 - DNA, 25 bp, Rattus norvegicus
gctcagtcactgtcacgtcgccgtg

SEQ ID NO: 590094 - DNA, 25 bp, Rattus norvegicus
tttacagccttcaaactgacagcgc

SEQ ID NO: 590095 - DNA, 25 bp, Rattus norvegicus
ccaaatgctcagtcactgtcacgtc

SEQ ID NO: 590096 - DNA, 25 bp, Rattus norvegicus
gtgaatgcatacattcgaatgcctc

SEQ ID NO: 590097 - DNA, 25 bp, Rattus norvegicus
aggcacatgcctgtccccaaatgct

SEQ ID NO: 590098 - DNA, 25 bp, Rattus norvegicus
ctctgtctgtgcacgaatgcattta

SEQ ID NO: 590099 - DNA, 25 bp, Rattus norvegicus
ccgtggagttgccatgggactatgt

SEQ ID NO: 590100 - DNA, 25 bp, Rattus norvegicus
tacctgggcgccgtggagttgccat

SEQ ID NO: 590101 - DNA, 25 bp, Rattus norvegicus
ccggaagtactacctgggcgccgtg

SEQ ID NO: 590102 - DNA, 25 bp, Rattus norvegicus
ctgctcctgcgccacccggaagtac

SEQ ID NO: 590103 - DNA, 25 bp, Rattus norvegicus
tgcgcgacccgctcgggaattttta

SEQ ID NO: 590104 - DNA, 25 bp, Rattus norvegicus
gctcagtttccggtccctctcttcc

SEQ ID NO: 590105 - DNA, 25 bp, Rattus norvegicus
agctccttgcccttcccgtcccagt

SEQ ID NO: 590106 - DNA, 25 bp, Rattus norvegicus
atttgaaccccgcaggccgttgccg

SEQ ID NO: 590107 - DNA, 25 bp, Rattus norvegicus
tcaacggatgtgaggatttgaaccc

SEQ ID NO: 590108 - DNA, 25 bp, Rattus norvegicus
tgtaaggattcgctcaacggatgtg

SEQ ID NO: 590109 - DNA, 25 bp, Rattus norvegicus
ccagcggatgtaaggattcgctcaa

SEQ ID NO: 590110 - DNA, 25 bp, Rattus norvegicus
acaaggccagcggatgtaaggattc

SEQ ID NO: 590111 - DNA, 25 bp, Rattus norvegicus
agcgcagcgactccaggtaactgtc

SEQ ID NO: 590112 - DNA, 25 bp, Rattus norvegicus
gtgcccagcgcagcgactccaggta

SEQ ID NO: 590113 - DNA, 25 bp, Rattus norvegicus
ttcctctgccctaccagcagctccg

SEQ ID NO: 590114 - DNA, 25 bp, Rattus norvegicus
tgtgcctccgcgagcgctgccagtg

SEQ ID NO: 590115 - DNA, 25 bp, Rattus norvegicus
ttggagacccgcatcatccgcttga

SEQ ID NO: 590116 - DNA, 25 bp, Rattus norvegicus
gtccaagaggcgagtccccgcgatc

SEQ ID NO: 590117 - DNA, 25 bp, Rattus norvegicus
aaggagaaatggatgcaatgaatgg

SEQ ID NO: 590118 - DNA, 25 bp, Rattus norvegicus
tatgggaagaagaaccgagccggga

SEQ ID NO: 590119 - DNA, 25 bp, Rattus norvegicus
cttccatgaatgtaccgggtgggta

SEQ ID NO: 590120 - DNA, 25 bp, Rattus norvegicus
caggccctaaacttccatgaatgta

SEQ ID NO: 590121 - DNA, 25 bp, Rattus norvegicus
aggccagactccgagccacggtcca

SEQ ID NO: 590122 - DNA, 25 bp, Rattus norvegicus
ttgagcgcagacatcttcctctgcc

SEQ ID NO: 590123 - DNA, 25 bp, Rattus norvegicus
tccgcttgagcgcagacatcttcct

SEQ ID NO: 590124 - DNA, 25 bp, Rattus norvegicus
atcagggagcgattggagacccgca

SEQ ID NO: 590125 - DNA, 25 bp, Rattus norvegicus
cgctgccagtgcgaggctctaacgt

SEQ ID NO: 590126 - DNA, 25 bp, Rattus norvegicus
acggtccaggccctaaacttccatg

SEQ ID NO: 590127 - DNA, 25 bp, Rattus norvegicus
cccagccggccaaggcaaccgcatt

SEQ ID NO: 590128 - DNA, 25 bp, Rattus norvegicus
aggaaacagatgacagacacgcggc

SEQ ID NO: 590129 - DNA, 25 bp, Rattus norvegicus
cccagaggacgaaggaaacagatga

SEQ ID NO: 590130 - DNA, 25 bp, Rattus norvegicus
cagatgacagacacgcggcgatctc

SEQ ID NO: 590131 - DNA, 25 bp, Rattus norvegicus
cagacacgcggcgatctcggactgc

SEQ ID NO: 590132 - DNA, 25 bp, Rattus norvegicus
ggcgatctcggactgcggacaccca

SEQ ID NO: 590133 - DNA, 25 bp, Rattus norvegicus
cacccacgaggacaatcccggcagc

SEQ ID NO: 590134 - DNA, 25 bp, Rattus norvegicus
gacaatcccggcagccctgtgcgcc

SEQ ID NO: 590135 - DNA, 25 bp, Rattus norvegicus
cccgcccgtgcacaactcgccaggc

SEQ ID NO: 590136 - DNA, 25 bp, Rattus norvegicus
gggagaagaggaaccaagagcccta

SEQ ID NO: 590137 - DNA, 25 bp, Rattus norvegicus
ccgcggatcctgattggtcctgtta

SEQ ID NO: 590138 - DNA, 25 bp, Rattus norvegicus
cggatcctgattggtcctgttactc

SEQ ID NO: 590139 - DNA, 25 bp, Rattus norvegicus
ctgattggtcctgttactccgcgcc

SEQ ID NO: 590140 - DNA, 25 bp, Rattus norvegicus
tggtcctgttactccgcgccagcat

SEQ ID NO: 590141 - DNA, 25 bp, Rattus norvegicus
gctttgcatcccaccctggcaggtg

SEQ ID NO: 590142 - DNA, 25 bp, Rattus norvegicus
atactgtgacgagtggattccctga

SEQ ID NO: 590143 - DNA, 25 bp, Rattus norvegicus
ggcagtactattcccggcaggccct

SEQ ID NO: 590144 - DNA, 25 bp, Rattus norvegicus
ctacggcaaagccttggtcactgtc

SEQ ID NO: 590145 - DNA, 25 bp, Rattus norvegicus
acgcctcacgtgactgtgtcaaaga

SEQ ID NO: 590146 - DNA, 25 bp, Rattus norvegicus
tcagcgctctccgaggctttgcatc

SEQ ID NO: 590147 - DNA, 25 bp, Rattus norvegicus
gatgagctcctgcaccgactgcacg

SEQ ID NO: 590148 - DNA, 25 bp, Rattus norvegicus
tgagccgctcggcttcgtcactgca

SEQ ID NO: 590149 - DNA, 25 bp, Rattus norvegicus
ggacaccacgtaccttcggaagtga

SEQ ID NO: 590150 - DNA, 25 bp, Rattus norvegicus
ccacaacttggtttcagcctggtga

SEQ ID NO: 590151 - DNA, 25 bp, Rattus norvegicus
tcaggagcgcgctgtcttgacagac

SEQ ID NO: 590152 - DNA, 25 bp, Rattus norvegicus
gttcgtccaaggaagaaagcgccta

SEQ ID NO: 590153 - DNA, 25 bp, Rattus norvegicus
tgtgtcggggctcaagtttatcttc

SEQ ID NO: 590154 - DNA, 25 bp, Rattus norvegicus
ctgtccgacaggaaccgccatgttg

SEQ ID NO: 590155 - DNA, 25 bp, Rattus norvegicus
gatggctcgggcttcctcatcgact

SEQ ID NO: 590156 - DNA, 25 bp, Rattus norvegicus
gaccacagtaagtccacgctgaccg

SEQ ID NO: 590157 - DNA, 25 bp, Rattus norvegicus
acagtaagtccacgctgaccgactc

SEQ ID NO: 590158 - DNA, 25 bp, Rattus norvegicus
cgctgaccgactcccttgtgtgcaa

SEQ ID NO: 590159 - DNA, 25 bp, Rattus norvegicus
tgaccgactcccttgtgtgcaaggc

SEQ ID NO: 590160 - DNA, 25 bp, Rattus norvegicus
ctcccttgtgtgcaaggccggcatc

SEQ ID NO: 590161 - DNA, 25 bp, Rattus norvegicus
aaggccggcatcatcgcctctggtc

SEQ ID NO: 590162 - DNA, 25 bp, Rattus norvegicus
agcaggagcgctgcattgcgttcta

SEQ ID NO: 590163 - DNA, 25 bp, Rattus norvegicus
gagcgctgcattgcgttctatgagc

SEQ ID NO: 590164 - DNA, 25 bp, Rattus norvegicus
gcattgcgttctatgagctctccga

SEQ ID NO: 590165 - DNA, 25 bp, Rattus norvegicus
cgttctatgagctctccgagaatga

SEQ ID NO: 590166 - DNA, 25 bp, Rattus norvegicus
tggctcgggcttcctcatcgactct

SEQ ID NO: 590167 - DNA, 25 bp, Rattus norvegicus
gtcatcgctcacgtggaccacagta

SEQ ID NO: 590168 - DNA, 25 bp, Rattus norvegicus
tcgctcacgtggaccacagtaagtc

SEQ ID NO: 590169 - DNA, 25 bp, Rattus norvegicus
agcttgctgagctacagcgcagcga

SEQ ID NO: 590170 - DNA, 25 bp, Rattus norvegicus
ttgcggaactcggagtgcggactcc

SEQ ID NO: 590171 - DNA, 25 bp, Rattus norvegicus
ctgcagtgctcggtcgctcgcggaa

SEQ ID NO: 590172 - DNA, 25 bp, Rattus norvegicus
cgctcgcggaagagcgtttgtaagc

SEQ ID NO: 590173 - DNA, 25 bp, Rattus norvegicus
gctcccggcagcttgctgagctaca

SEQ ID NO: 590174 - DNA, 25 bp, Rattus norvegicus
ggaactcttgcggaactcggagtgc

SEQ ID NO: 590175 - DNA, 25 bp, Rattus norvegicus
agctacagcgcagcgatgggctccc

SEQ ID NO: 590176 - DNA, 25 bp, Rattus norvegicus
atgggctccctgctgagcagcgaca

SEQ ID NO: 590177 - DNA, 25 bp, Rattus norvegicus
tccgcccggcggactctggagcgta

SEQ ID NO: 590178 - DNA, 25 bp, Rattus norvegicus
agctgcccatcacctccttcgactg

SEQ ID NO: 590179 - DNA, 25 bp, Rattus norvegicus
ctccgtgtgcctggaggtgctacac

SEQ ID NO: 590180 - DNA, 25 bp, Rattus norvegicus
acccgctgtggccacgtgtgagtgt

SEQ ID NO: 590181 - DNA, 25 bp, Rattus norvegicus
gggcgggacaacagaaccaccagca

SEQ ID NO: 590182 - DNA, 25 bp, Rattus norvegicus
gggacctcgagcttctgcagtgctc

SEQ ID NO: 590183 - DNA, 25 bp, Rattus norvegicus
gaccatcgctctgcggcctagacgg

SEQ ID NO: 590184 - DNA, 25 bp, Rattus norvegicus
ctcgccaggcctgagaggaatcaca

SEQ ID NO: 590185 - DNA, 25 bp, Rattus norvegicus
ccagtctgtcaggaggtgctcaaga

SEQ ID NO: 590186 - DNA, 25 bp, Rattus norvegicus
gcttcacggtgcatcacgagcctca

SEQ ID NO: 590187 - DNA, 25 bp, Rattus norvegicus
actgataccagaagacggcgcggga

SEQ ID NO: 590188 - DNA, 25 bp, Rattus norvegicus
tcagggcatctgaggtgagaccaac

SEQ ID NO: 590189 - DNA, 25 bp, Rattus norvegicus
cccgaaagcgcctgtgagagcgaca

SEQ ID NO: 590190 - DNA, 25 bp, Rattus norvegicus
cgccgttgatagacgcttcgccgta

SEQ ID NO: 590191 - DNA, 25 bp, Rattus norvegicus
tgtcagcacgtgtgagtagacgccc

SEQ ID NO: 590192 - DNA, 25 bp, Rattus norvegicus
cttcgccgtagccaatgagtgcgtc

SEQ ID NO: 590193 - DNA, 25 bp, Rattus norvegicus
gacctgctcatgctgctgccttgtc

SEQ ID NO: 590194 - DNA, 25 bp, Rattus norvegicus
gagctttcggcggacacgtcctaca

SEQ ID NO: 590195 - DNA, 25 bp, Rattus norvegicus
cgtcctacacggaagatgatttcta

SEQ ID NO: 590196 - DNA, 25 bp, Rattus norvegicus
tcactggggcctagttccatgaggc

SEQ ID NO: 590197 - DNA, 25 bp, Rattus norvegicus
cgggtccgaagaacgccatagcagc

SEQ ID NO: 590198 - DNA, 25 bp, Rattus norvegicus
agcataggctccacctcctcaagga

SEQ ID NO: 590199 - DNA, 25 bp, Rattus norvegicus
aggctccgccttcgcacatttactg

SEQ ID NO: 590200 - DNA, 25 bp, Rattus norvegicus
cagtaggctcggctttccacatatc

SEQ ID NO: 590201 - DNA, 25 bp, Rattus norvegicus
ggctctgcttccctggaactcgggc

SEQ ID NO: 590202 - DNA, 25 bp, Rattus norvegicus
gaggcctggcctctttaactcggtc

SEQ ID NO: 590203 - DNA, 25 bp, Rattus norvegicus
actgggctccacttcacatccttga

SEQ ID NO: 590204 - DNA, 25 bp, Rattus norvegicus
agcctccgcctcgagcacagtgtga

SEQ ID NO: 590205 - DNA, 25 bp, Rattus norvegicus
gcttcagcagccacaccgaggcatg

SEQ ID NO: 590206 - DNA, 25 bp, Rattus norvegicus
ttcacatccttgaggctgcagccca

SEQ ID NO: 590207 - DNA, 25 bp, Rattus norvegicus
acatttactggctaggcgctctgtc

SEQ ID NO: 590208 - DNA, 25 bp, Rattus norvegicus
agcgctcccggcactgactaatcaa

SEQ ID NO: 590209 - DNA, 25 bp, Rattus norvegicus
tcaacaaggtgcaagggacgcctgc

SEQ ID NO: 590210 - DNA, 25 bp, Rattus norvegicus
accagcaggtcgagcggcatagcca

SEQ ID NO: 590211 - DNA, 25 bp, Rattus norvegicus
tactgcatgcgggtctcacggtcgt

SEQ ID NO: 590212 - DNA, 25 bp, Rattus norvegicus
gggtctcacggtcgtgctccagcca

SEQ ID NO: 590213 - DNA, 25 bp, Rattus norvegicus
ggtcgtgctccagccacagcacgga

SEQ ID NO: 590214 - DNA, 25 bp, Rattus norvegicus
agccacagcacggacatctggaaaa

SEQ ID NO: 590215 - DNA, 25 bp, Rattus norvegicus
agcgagtccagcagggcacgcatct

SEQ ID NO: 590216 - DNA, 25 bp, Rattus norvegicus
cggacatctggaaaagtgccagctc

SEQ ID NO: 590217 - DNA, 25 bp, Rattus norvegicus
tggaaaagtgccagctccgactcca

SEQ ID NO: 590218 - DNA, 25 bp, Rattus norvegicus
aaagtgccagctccgactccacggg

SEQ ID NO: 590219 - DNA, 25 bp, Rattus norvegicus
ggcgcgtactgcatgcgggtctcac

SEQ ID NO: 590220 - DNA, 25 bp, Rattus norvegicus
aaagcgaaggcgcttcatgaggtcg

SEQ ID NO: 590221 - DNA, 25 bp, Rattus norvegicus
atgaaatccaccgactggacccgct

SEQ ID NO: 590222 - DNA, 25 bp, Rattus norvegicus
gggtcggtgcgcatgaaatccaccg

SEQ ID NO: 590223 - DNA, 25 bp, Rattus norvegicus
gtgcgcatgaaatccaccgactgga

SEQ ID NO: 590224 - DNA, 25 bp, Rattus norvegicus
cgcttcatgaggtcgggcgcgtact

SEQ ID NO: 590225 - DNA, 25 bp, Rattus norvegicus
cgctgctagctgagcacggtgcagt

SEQ ID NO: 590226 - DNA, 25 bp, Rattus norvegicus
gtgaggcctgcttagagctagtgca

SEQ ID NO: 590227 - DNA, 25 bp, Rattus norvegicus
gagatcagactcctgcgccaagggc

SEQ ID NO: 590228 - DNA, 25 bp, Rattus norvegicus
gatccgggcgatgctccacggaaaa

SEQ ID NO: 590229 - DNA, 25 bp, Rattus norvegicus
tgctccacggaaaacgcatttactg

SEQ ID NO: 590230 - DNA, 25 bp, Rattus norvegicus
catttactggtcagcctcgtgagcg

SEQ ID NO: 590231 - DNA, 25 bp, Rattus norvegicus
ctcgtgagcgggaacagaggacacc

SEQ ID NO: 590232 - DNA, 25 bp, Rattus norvegicus
gggtatccgagaacgacctccgcga

SEQ ID NO: 590233 - DNA, 25 bp, Rattus norvegicus
ccacttaccatgctggcgccgtgga

SEQ ID NO: 590234 - DNA, 25 bp, Rattus norvegicus
ccagttcggtctcgaacctttctcg

SEQ ID NO: 590235 - DNA, 25 bp, Rattus norvegicus
tttctcgtcccaggctcttcgggca

SEQ ID NO: 590236 - DNA, 25 bp, Rattus norvegicus
gcgaaggacgcactaggcgacactc

SEQ ID NO: 590237 - DNA, 25 bp, Rattus norvegicus
actaggcgacactcgtcggctggcc

SEQ ID NO: 590238 - DNA, 25 bp, Rattus norvegicus
gctcgcgtgcagaagctccgcagac

SEQ ID NO: 590239 - DNA, 25 bp, Rattus norvegicus
gctttgctttttcttagttggccca

SEQ ID NO: 590240 - DNA, 25 bp, Rattus norvegicus
gtgacacctcgtgggctcgagtcca

SEQ ID NO: 590241 - DNA, 25 bp, Rattus norvegicus
tcaactggtgctggaagctttgctt

SEQ ID NO: 590242 - DNA, 25 bp, Rattus norvegicus
cggcggttccaggtcaactggtgct

SEQ ID NO: 590243 - DNA, 25 bp, Rattus norvegicus
cccagagctcagaggcgaccgacgg

SEQ ID NO: 590244 - DNA, 25 bp, Rattus norvegicus
cccagctggatgaacggaaaggccg

SEQ ID NO: 590245 - DNA, 25 bp, Rattus norvegicus
gctcgagtccatgcccagctggatg

SEQ ID NO: 590246 - DNA, 25 bp, Rattus norvegicus
tgcgggtgagcgattcttagctctc

SEQ ID NO: 590247 - DNA, 25 bp, Rattus norvegicus
cttagctctctaaaagctggggaca

SEQ ID NO: 590248 - DNA, 25 bp, Rattus norvegicus
gctggggacaccttcgattatccga

SEQ ID NO: 590249 - DNA, 25 bp, Rattus norvegicus
ggaggagataaagccctttcttctc

SEQ ID NO: 590250 - DNA, 25 bp, Rattus norvegicus
ggacccgctcagtggactcggcaga

SEQ ID NO: 590251 - DNA, 25 bp, Rattus norvegicus
gcgggagctgtccttatcaattcta

SEQ ID NO: 590252 - DNA, 25 bp, Rattus norvegicus
gcttcgcaaactgttggcttccctc

SEQ ID NO: 590253 - DNA, 25 bp, Rattus norvegicus
ctccgggaacagtccgggtgtctgt

SEQ ID NO: 590254 - DNA, 25 bp, Rattus norvegicus
agcatgttttgtgtggacccggttc

SEQ ID NO: 590255 - DNA, 25 bp, Rattus norvegicus
gaggacactgtgagagcatgttttg

SEQ ID NO: 590256 - DNA, 25 bp, Rattus norvegicus
gtcgtgtgcattccgtgagaggaca

SEQ ID NO: 590257 - DNA, 25 bp, Rattus norvegicus
tccgactcggacttagaaggcgtgt

SEQ ID NO: 590258 - DNA, 25 bp, Rattus norvegicus
tgcatgcaccgtgtgtgtccgactc

SEQ ID NO: 590259 - DNA, 25 bp, Rattus norvegicus
tgtgtgtcccgcgtttgtgagttca

SEQ ID NO: 590260 - DNA, 25 bp, Rattus norvegicus
ttcatcaataactccgggaacagtc

SEQ ID NO: 590261 - DNA, 25 bp, Rattus norvegicus
ttgtgtggcaattaccactccctcc

SEQ ID NO: 590262 - DNA, 25 bp, Rattus norvegicus
tcccgagacctttgtgtggcaatta

SEQ ID NO: 590263 - DNA, 25 bp, Rattus norvegicus
accggtgaatctctcagcgtttggc

SEQ ID NO: 590264 - DNA, 25 bp, Rattus norvegicus
gggacacttcttctcgggacttggc

SEQ ID NO: 590265 - DNA, 25 bp, Rattus norvegicus
cggctctttgttattccgcgggagt

SEQ ID NO: 590266 - DNA, 25 bp, Rattus norvegicus
agttcagatctttcacacgtgcatg

SEQ ID NO: 590267 - DNA, 25 bp, Rattus norvegicus
ctcaggacaaccctggtctggggcc

SEQ ID NO: 590268 - DNA, 25 bp, Rattus norvegicus
ggcggtccgcacgtcattctcacag

SEQ ID NO: 590269 - DNA, 25 bp, Rattus norvegicus
aaatttgctgacagaaaatctgccc

SEQ ID NO: 590270 - DNA, 25 bp, Rattus norvegicus
gcgcggcatacgacgaccacagcag

SEQ ID NO: 590271 - DNA, 25 bp, Rattus norvegicus
cgaccctgtgggcactcaggacaac

SEQ ID NO: 590272 - DNA, 25 bp, Rattus norvegicus
accggatgacgtaaatttgctgaca

SEQ ID NO: 590273 - DNA, 25 bp, Rattus norvegicus
tgcgcattgcgcaaccggatgacgt

SEQ ID NO: 590274 - DNA, 25 bp, Rattus norvegicus
aacggattagggtgcgcattgcgca

SEQ ID NO: 590275 - DNA, 25 bp, Rattus norvegicus
gcgaggctttgattaacggattagg

SEQ ID NO: 590276 - DNA, 25 bp, Rattus norvegicus
gtcctcagagcgaggctttgattaa

SEQ ID NO: 590277 - DNA, 25 bp, Rattus norvegicus
ttagattctcactgcgccaccggtc

SEQ ID NO: 590278 - DNA, 25 bp, Rattus norvegicus
ccgccaatctgagtcacgtgttaga

SEQ ID NO: 590279 - DNA, 25 bp, Rattus norvegicus
tggcgaaccgccaatctgagtcacg

SEQ ID NO: 590280 - DNA, 25 bp, Rattus norvegicus
cggccgagaaggacgacgacaaagt

SEQ ID NO: 590281 - DNA, 25 bp, Rattus norvegicus
agtcctgaaactggcggtacatgtc

SEQ ID NO: 590282 - DNA, 25 bp, Rattus norvegicus
gcccagctggaaacccttcgatttg

SEQ ID NO: 590283 - DNA, 25 bp, Rattus norvegicus
gtacatgtcgcgctcgctctccatg

SEQ ID NO: 590284 - DNA, 25 bp, Rattus norvegicus
tcaccgtcttggtcttgcctgagtc

SEQ ID NO: 590285 - DNA, 25 bp, Rattus norvegicus
gagctggacaatccgctcgtatttc

SEQ ID NO: 590286 - DNA, 25 bp, Rattus norvegicus
gagcttgactctgagccgttgagga

SEQ ID NO: 590287 - DNA, 25 bp, Rattus norvegicus
gctctgcaggttcgctattccttta

SEQ ID NO: 590288 - DNA, 25 bp, Rattus norvegicus
tccgggctgctccagcagacaaata

SEQ ID NO: 590289 - DNA, 25 bp, Rattus norvegicus
atcagagcgtgtgcctgagcttcca

SEQ ID NO: 590290 - DNA, 25 bp, Rattus norvegicus
tcaccctgggctcatgaaatacgca

SEQ ID NO: 590291 - DNA, 25 bp, Rattus norvegicus
gccaacgaggagacacagtaaccta

SEQ ID NO: 590292 - DNA, 25 bp, Rattus norvegicus
gacccgcacgaagagcacttgcttg

SEQ ID NO: 590293 - DNA, 25 bp, Rattus norvegicus
ccacattcgggctttgtgccaacga

SEQ ID NO: 590294 - DNA, 25 bp, Rattus norvegicus
gcccgacacggtgaagactagcttc

SEQ ID NO: 590295 - DNA, 25 bp, Rattus norvegicus
tcggcttaaccagccggatggccct

SEQ ID NO: 590296 - DNA, 25 bp, Rattus norvegicus
agctcggactgacagcccgggcgct

SEQ ID NO: 590297 - DNA, 25 bp, Rattus norvegicus
aaccaggggagttccagtcctgcta

SEQ ID NO: 590298 - DNA, 25 bp, Rattus norvegicus
tagctgcagccgctcctctttactg

SEQ ID NO: 590299 - DNA, 25 bp, Rattus norvegicus
cgggtcgcagggatcggcttaacca

SEQ ID NO: 590300 - DNA, 25 bp, Rattus norvegicus
atggccctcgccgtgttcctgaggg

SEQ ID NO: 590301 - DNA, 25 bp, Rattus norvegicus
tgttcctgaggggtccgagcccacc

SEQ ID NO: 590302 - DNA, 25 bp, Rattus norvegicus
gagttccagtcctgctagctgcagc

SEQ ID NO: 590303 - DNA, 25 bp, Rattus norvegicus
ctcgctgcggtctcctcggcgaaag

SEQ ID NO: 590304 - DNA, 25 bp, Rattus norvegicus
agtgggaacccggctcactcctctg

SEQ ID NO: 590305 - DNA, 25 bp, Rattus norvegicus
ggtcccggagctctcgggctgctca

SEQ ID NO: 590306 - DNA, 25 bp, Rattus norvegicus
tgctcagtggctcctgcgcggccag

SEQ ID NO: 590307 - DNA, 25 bp, Rattus norvegicus
tgcgcgtctcttggaaggtctcgcg

SEQ ID NO: 590308 - DNA, 25 bp, Rattus norvegicus
tctttactgcactccctgccgaggc

SEQ ID NO: 590309 - DNA, 25 bp, Rattus norvegicus
ctgttccgtcgggatctgccctcgg

SEQ ID NO: 590310 - DNA, 25 bp, Rattus norvegicus
gactggggcgccctagcaagggcag

SEQ ID NO: 590311 - DNA, 25 bp, Rattus norvegicus
aggcgccgggcaaagtctggagccg

SEQ ID NO: 590312 - DNA, 25 bp, Rattus norvegicus
cactcgcggggttcccacctgtgtg

SEQ ID NO: 590313 - DNA, 25 bp, Rattus norvegicus
gggttcccacctgtgtgcccgcgcc

SEQ ID NO: 590314 - DNA, 25 bp, Rattus norvegicus
tgcgcgtggcaggtggattcccccc

SEQ ID NO: 590315 - DNA, 25 bp, Rattus norvegicus
cccacgcgaagcaggggctgcccac

SEQ ID NO: 590316 - DNA, 25 bp, Rattus norvegicus
ccggctccgtgggatgagctgttcc

SEQ ID NO: 590317 - DNA, 25 bp, Rattus norvegicus
atgagctgttccgtcgggatctgcc

SEQ ID NO: 590318 - DNA, 25 bp, Rattus norvegicus
tctgccctcggggtcgctgtcgtcg

SEQ ID NO: 590319 - DNA, 25 bp, Rattus norvegicus
cccgccggggataggactgaggctg

SEQ ID NO: 590320 - DNA, 25 bp, Rattus norvegicus
ttgaccgggaaacccgcgcgagctg

SEQ ID NO: 590321 - DNA, 25 bp, Rattus norvegicus
aaacccgcgcgagctggtctctccc

SEQ ID NO: 590322 - DNA, 25 bp, Rattus norvegicus
gctccgtgggatgagctgttccgtc

SEQ ID NO: 590323 - DNA, 25 bp, Rattus norvegicus
ctcgccacggccctcctcaacgggg

SEQ ID NO: 590324 - DNA, 25 bp, Rattus norvegicus
caggatgaggcctaccaggtacagg

SEQ ID NO: 590325 - DNA, 25 bp, Rattus norvegicus
aagctgcaggatgaggcctaccagg

SEQ ID NO: 590326 - DNA, 25 bp, Rattus norvegicus
ctgcagatggaggagtacctgaagc

SEQ ID NO: 590327 - DNA, 25 bp, Rattus norvegicus
tgcggcagctggagaacgagctgca

SEQ ID NO: 590328 - DNA, 25 bp, Rattus norvegicus
tacgagaacgagtctgtgcggcagc

SEQ ID NO: 590329 - DNA, 25 bp, Rattus norvegicus
tggcaactacgagaacgagtctgtg

SEQ ID NO: 590330 - DNA, 25 bp, Rattus norvegicus
caaccggaggatggcaactacgaga

SEQ ID NO: 590331 - DNA, 25 bp, Rattus norvegicus
acccgcaaccggaggatggcaacta

SEQ ID NO: 590332 - DNA, 25 bp, Rattus norvegicus
agacggagatccttacccgcaaccg

SEQ ID NO: 590333 - DNA, 25 bp, Rattus norvegicus
cagggtcccggaagacggagatcct

SEQ ID NO: 590334 - DNA, 25 bp, Rattus norvegicus
caaacgcctcttgtgtttttcccag

SEQ ID NO: 590335 - DNA, 25 bp, Rattus norvegicus
gaggagtacctgaagcagaagctgc

SEQ ID NO: 590336 - DNA, 25 bp, Rattus norvegicus
ctaccaggtacaggaggccgcggca

SEQ ID NO: 590337 - DNA, 25 bp, Rattus norvegicus
attcaaagctgtacaaccctggcgc

SEQ ID NO: 590338 - DNA, 25 bp, Rattus norvegicus
caggccaggcgttggccgcgcctct

SEQ ID NO: 590339 - DNA, 25 bp, Rattus norvegicus
tcaaagctgtacaaccctggcgcgc

SEQ ID NO: 590340 - DNA, 25 bp, Rattus norvegicus
ggtgagtcaagtacattcaaagctg

SEQ ID NO: 590341 - DNA, 25 bp, Rattus norvegicus
agcaggtgagtcaagtacattcaaa

SEQ ID NO: 590342 - DNA, 25 bp, Rattus norvegicus
ccggagcaggtgagtcaagtacatt

SEQ ID NO: 590343 - DNA, 25 bp, Rattus norvegicus
cgacaacgccggagcaggtgagtca

SEQ ID NO: 590344 - DNA, 25 bp, Rattus norvegicus
aaagcccccagctgtcagcagaaga

SEQ ID NO: 590345 - DNA, 25 bp, Rattus norvegicus
acgacgagtcacgtgagtctgtgga

SEQ ID NO: 590346 - DNA, 25 bp, Rattus norvegicus
tggcagacgacgagtcacgtgagtc

SEQ ID NO: 590347 - DNA, 25 bp, Rattus norvegicus
ctctgacggtggcagacgacgagtc

SEQ ID NO: 590348 - DNA, 25 bp, Rattus norvegicus
gctctccggagtggactctgacggt

SEQ ID NO: 590349 - DNA, 25 bp, Rattus norvegicus
cagacaccctttgccctgggtccgt

SEQ ID NO: 590350 - DNA, 25 bp, Rattus norvegicus
ggccggctgagtgggtggagaaaac

SEQ ID NO: 590351 - DNA, 25 bp, Rattus norvegicus
gcactcacctcgctccgcacgttac

SEQ ID NO: 590352 - DNA, 25 bp, Rattus norvegicus
ccaccgtgctcgagcgccggaagtg

SEQ ID NO: 590353 - DNA, 25 bp, Rattus norvegicus
gccggaaagccaccgtgctcgagcg

SEQ ID NO: 590354 - DNA, 25 bp, Rattus norvegicus
gcacgttacctgcacagccctggga

SEQ ID NO: 590355 - DNA, 25 bp, Rattus norvegicus
aaggcatcgaagctgcaccctcgca

SEQ ID NO: 590356 - DNA, 25 bp, Rattus norvegicus
acctggaaggcatcgaagctgcacc

SEQ ID NO: 590357 - DNA, 25 bp, Rattus norvegicus
aagaatgtacaggaggattgcgccc

SEQ ID NO: 590358 - DNA, 25 bp, Rattus norvegicus
tggcctaggcacagctccaggctct

SEQ ID NO: 590359 - DNA, 25 bp, Rattus norvegicus
gaatctgcgaagtggcctaggcaca

SEQ ID NO: 590360 - DNA, 25 bp, Rattus norvegicus
acccgcgaatctgcgaagtggccta

SEQ ID NO: 590361 - DNA, 25 bp, Rattus norvegicus
cagaggaataagcaacccgcgaatc

SEQ ID NO: 590362 - DNA, 25 bp, Rattus norvegicus
gcacccgcagaggaataagcaaccc

SEQ ID NO: 590363 - DNA, 25 bp, Rattus norvegicus
ccatcagagggacctggaaggcatc

SEQ ID NO: 590364 - DNA, 25 bp, Rattus norvegicus
acagccctgggaagccggaaagcca

SEQ ID NO: 590365 - DNA, 25 bp, Rattus norvegicus
cacgccatgaccctcgtctccgctc

SEQ ID NO: 590366 - DNA, 25 bp, Rattus norvegicus
cctcgcacccctgcgccgtccggct

SEQ ID NO: 590367 - DNA, 25 bp, Rattus norvegicus
gcctggcaccgggatcgatcgcagc

SEQ ID NO: 590368 - DNA, 25 bp, Rattus norvegicus
ctcgcgaaggaggttttacaatcaa

SEQ ID NO: 590369 - DNA, 25 bp, Rattus norvegicus
actcgcgaaggaggttttacaatca

SEQ ID NO: 590370 - DNA, 25 bp, Rattus norvegicus
tggcaccgggatcgatcgcagcgca

SEQ ID NO: 590371 - DNA, 25 bp, Rattus norvegicus
gaggttttacaatcaaagatgggaa

SEQ ID NO: 590372 - DNA, 25 bp, Rattus norvegicus
agatgggaaaatcggagaaaatcgc

SEQ ID NO: 590373 - DNA, 25 bp, Rattus norvegicus
cgcgaaggaggttttacaatcaaag

SEQ ID NO: 590374 - DNA, 25 bp, Rattus norvegicus
gcgaaggaggttttacaatcaaaga

SEQ ID NO: 590375 - DNA, 25 bp, Rattus norvegicus
aggaggttttacaatcaaagatggg

SEQ ID NO: 590376 - DNA, 25 bp, Rattus norvegicus
tcgcgaaggaggttttacaatcaaa

SEQ ID NO: 590377 - DNA, 25 bp, Rattus norvegicus
ttacaatcaaagatgggaaaatcgg

SEQ ID NO: 590378 - DNA, 25 bp, Rattus norvegicus
gaaggaggttttacaatcaaagatg

SEQ ID NO: 590379 - DNA, 25 bp, Rattus norvegicus
cgcttctctgaggacggttatcgca

SEQ ID NO: 590380 - DNA, 25 bp, Rattus norvegicus
aggtgccgtcctatctcagctataa

SEQ ID NO: 590381 - DNA, 25 bp, Rattus norvegicus
gcacatccttcctgctggcgggctt

SEQ ID NO: 590382 - DNA, 25 bp, Rattus norvegicus
tcgtgtacctgttcatcggcacatc

SEQ ID NO: 590383 - DNA, 25 bp, Rattus norvegicus
cttcgtgggcctcaacagcctggac

SEQ ID NO: 590384 - DNA, 25 bp, Rattus norvegicus
gaggccaattcgcagtacttccacc

SEQ ID NO: 590385 - DNA, 25 bp, Rattus norvegicus
ctataagtttctgggtgagcgcgat

SEQ ID NO: 590386 - DNA, 25 bp, Rattus norvegicus
tgtccggttgctacaccatggtgtc

SEQ ID NO: 590387 - DNA, 25 bp, Rattus norvegicus
ctatttagtggacatgcagcgattc

SEQ ID NO: 590388 - DNA, 25 bp, Rattus norvegicus
ctgtgctgcgcttctactttcttca

SEQ ID NO: 590389 - DNA, 25 bp, Rattus norvegicus
tgcccgtctctggatcctcacatgg

SEQ ID NO: 590390 - DNA, 25 bp, Rattus norvegicus
ctcgcaggaggagactcgttttgcc

SEQ ID NO: 590391 - DNA, 25 bp, Rattus norvegicus
gtcagtggcctacattgcgggcttc

SEQ ID NO: 590392 - DNA, 25 bp, Rattus norvegicus
gacggctccatgttcttctcgcagg

SEQ ID NO: 590393 - DNA, 25 bp, Rattus norvegicus
ggctcagcctgatgtcctctacctg

SEQ ID NO: 590394 - DNA, 25 bp, Rattus norvegicus
gcgatccaggcatccaggacgctga

SEQ ID NO: 590395 - DNA, 25 bp, Rattus norvegicus
ttcagactctggatggggtcctgtc

SEQ ID NO: 590396 - DNA, 25 bp, Rattus norvegicus
aggctaccagacttgctcgcgaagg

SEQ ID NO: 590397 - DNA, 25 bp, Rattus norvegicus
tcgctgcaatctttggggctgaagc

SEQ ID NO: 590398 - DNA, 25 bp, Rattus norvegicus
aagaaccggctttgcgcgaagaatc

SEQ ID NO: 590399 - DNA, 25 bp, Rattus norvegicus
acctggatctctgaagccgggcttt

SEQ ID NO: 590400 - DNA, 25 bp, Rattus norvegicus
tcagccgccggagtttcggaaagtc

SEQ ID NO: 590401 - DNA, 25 bp, Rattus norvegicus
aatcgacttagcatctccgagaggc

SEQ ID NO: 590402 - DNA, 25 bp, Rattus norvegicus
cgcgtcgcggcccttaatcgactta

SEQ ID NO: 590403 - DNA, 25 bp, Rattus norvegicus
ctccgtagaaagcttcgggttcctg

SEQ ID NO: 590404 - DNA, 25 bp, Rattus norvegicus
caggcgctctttcctgccggttttc

SEQ ID NO: 590405 - DNA, 25 bp, Rattus norvegicus
tcgtgaaggtaagagcggaccgacc

SEQ ID NO: 590406 - DNA, 25 bp, Rattus norvegicus
ggctttggagacagagggacaactc

SEQ ID NO: 590407 - DNA, 25 bp, Rattus norvegicus
cagggcatctcggacagccgcgcat

SEQ ID NO: 590408 - DNA, 25 bp, Rattus norvegicus
gcccaacgaatagtcgagactgctc

SEQ ID NO: 590409 - DNA, 25 bp, Rattus norvegicus
cgagactgctcactgagcatgcgta

SEQ ID NO: 590410 - DNA, 25 bp, Rattus norvegicus
cgcctctcaggaaagaccgagcagc

SEQ ID NO: 590411 - DNA, 25 bp, Rattus norvegicus
cgctgcggtcttgactcacagagtg

SEQ ID NO: 590412 - DNA, 25 bp, Rattus norvegicus
tcacagagtgacagaagactgagcg

SEQ ID NO: 590413 - DNA, 25 bp, Rattus norvegicus
ctgagcgtgctcagtaacacgtcaa

SEQ ID NO: 590414 - DNA, 25 bp, Rattus norvegicus
ttggatcagggcatctcggacagcc

SEQ ID NO: 590415 - DNA, 25 bp, Rattus norvegicus
gccgcgcatgcgcaatgcgttgcca

SEQ ID NO: 590416 - DNA, 25 bp, Rattus norvegicus
aatgcgttgccagtctaggctgtgc

SEQ ID NO: 590417 - DNA, 25 bp, Rattus norvegicus
ccagtctaggctgtgcgaagggctt

SEQ ID NO: 590418 - DNA, 25 bp, Rattus norvegicus
cgaagggctttgtccaccattttgg

SEQ ID NO: 590419 - DNA, 25 bp, Rattus norvegicus
accattttgggtcaaggccgtcgtg

SEQ ID NO: 590420 - DNA, 25 bp, Rattus norvegicus
tgctcagtaacacgtcaagcccgta

SEQ ID NO: 590421 - DNA, 25 bp, Rattus norvegicus
gttctgaaaacgtgccatgatcgtg

SEQ ID NO: 590422 - DNA, 25 bp, Rattus norvegicus
gcaccgtcgctgtacaatacgtgta

SEQ ID NO: 590423 - DNA, 25 bp, Rattus norvegicus
ggccttgcgcctctcactgagtgac

SEQ ID NO: 590424 - DNA, 25 bp, Rattus norvegicus
tactccagagttctgaaacgttctg

SEQ ID NO: 590425 - DNA, 25 bp, Rattus norvegicus
ggagccctctggagtaactagctta

SEQ ID NO: 590426 - DNA, 25 bp, Rattus norvegicus
cagtttcacaagtgcccggtgctcc

SEQ ID NO: 590427 - DNA, 25 bp, Rattus norvegicus
attcaccaggaagggctgcagaagc

SEQ ID NO: 590428 - DNA, 25 bp, Rattus norvegicus
ggcttgagcgtctcccagaatcctc

SEQ ID NO: 590429 - DNA, 25 bp, Rattus norvegicus
gactgttgctctctgttccacttta

SEQ ID NO: 590430 - DNA, 25 bp, Rattus norvegicus
cgcgagccgctagagcctcgaaata

SEQ ID NO: 590431 - DNA, 25 bp, Rattus norvegicus
cttttatgcgcacgcccggaatgct

SEQ ID NO: 590432 - DNA, 25 bp, Rattus norvegicus
ccatgatcgtgtcaggcaccgtcgc

SEQ ID NO: 590433 - DNA, 25 bp, Rattus norvegicus
aatggccgcattgaggctgcgcttg

SEQ ID NO: 590434 - DNA, 25 bp, Rattus norvegicus
aggtgccgcttgatgacaatggccg

SEQ ID NO: 590435 - DNA, 25 bp, Rattus norvegicus
ctcggtcgtgcatccagtcgccggg

SEQ ID NO: 590436 - DNA, 25 bp, Rattus norvegicus
gctttacttgctgccgccgtctttg

SEQ ID NO: 590437 - DNA, 25 bp, Rattus norvegicus
agtcgccgggctcgacggaaccact

SEQ ID NO: 590438 - DNA, 25 bp, Rattus norvegicus
ccacaggtggctccgcatcaggcgt

SEQ ID NO: 590439 - DNA, 25 bp, Rattus norvegicus
gtctttgtccgcacacaggtgggca

SEQ ID NO: 590440 - DNA, 25 bp, Rattus norvegicus
gacggcgccttcgttttcagcagcc

SEQ ID NO: 590441 - DNA, 25 bp, Rattus norvegicus
ttcgttttcagcagcccgcgaccgg

SEQ ID NO: 590442 - DNA, 25 bp, Rattus norvegicus
tggacaaccggatcctgcgcctctg

SEQ ID NO: 590443 - DNA, 25 bp, Rattus norvegicus
aggaagcgaccgcacggcggaacca

SEQ ID NO: 590444 - DNA, 25 bp, Rattus norvegicus
ggccgagctcgtcctgccaggactg

SEQ ID NO: 590445 - DNA, 25 bp, Rattus norvegicus
ccgtgctgacggatactccgggcga

SEQ ID NO: 590446 - DNA, 25 bp, Rattus norvegicus
gctgcatgaggcacagcgggaacta

SEQ ID NO: 590447 - DNA, 25 bp, Rattus norvegicus
tcccggaggctttacttgctgccgc

SEQ ID NO: 590448 - DNA, 25 bp, Rattus norvegicus
acagcgggaactagcgcgccgagcc

SEQ ID NO: 590449 - DNA, 25 bp, Rattus norvegicus
gcttgccaggatcgcgttcgaacca

SEQ ID NO: 590450 - DNA, 25 bp, Rattus norvegicus
tcgccacagtccagccgacgtaatt

SEQ ID NO: 590451 - DNA, 25 bp, Rattus norvegicus
actgcccggtttactagagtgacta

SEQ ID NO: 590452 - DNA, 25 bp, Rattus norvegicus
cgggatccttctaccctcggactga

SEQ ID NO: 590453 - DNA, 25 bp, Rattus norvegicus
tacctggtttgcattcggacccgaa

SEQ ID NO: 590454 - DNA, 25 bp, Rattus norvegicus
ccaggattgcactaggacccgggct

SEQ ID NO: 590455 - DNA, 25 bp, Rattus norvegicus
ccgggcttgagcttccttgattgca

SEQ ID NO: 590456 - DNA, 25 bp, Rattus norvegicus
tttcgctcggcagcaaagaagtccg

SEQ ID NO: 590457 - DNA, 25 bp, Rattus norvegicus
tcagcaaggcgacccaaccaagtta

SEQ ID NO: 590458 - DNA, 25 bp, Rattus norvegicus
catttcatttaaggggagctgccga

SEQ ID NO: 590459 - DNA, 25 bp, Rattus norvegicus
tgccgagactctgtacgctgaccta

SEQ ID NO: 590460 - DNA, 25 bp, Rattus norvegicus
gggtgctctccgttgcttctcttta

SEQ ID NO: 590461 - DNA, 25 bp, Rattus norvegicus
cctcccgatcgagagaaggtttcgc

SEQ ID NO: 590462 - DNA, 25 bp, Rattus norvegicus
cagcctcttggtagaaggacctttc

SEQ ID NO: 590463 - DNA, 25 bp, Rattus norvegicus
cacacttcacggacaacgtttactg

SEQ ID NO: 590464 - DNA, 25 bp, Rattus norvegicus
gtcacccgtgcacacatcatcggtg

SEQ ID NO: 590465 - DNA, 25 bp, Rattus norvegicus
cacccgtgcacacatcatcggtgta

SEQ ID NO: 590466 - DNA, 25 bp, Rattus norvegicus
cccgtgcacacatcatcggtgtacg

SEQ ID NO: 590467 - DNA, 25 bp, Rattus norvegicus
tgcacacatcatcggtgtacgcgtc

SEQ ID NO: 590468 - DNA, 25 bp, Rattus norvegicus
acacatcatcggtgtacgcgtcacc

SEQ ID NO: 590469 - DNA, 25 bp, Rattus norvegicus
acatcatcggtgtacgcgtcaccca

SEQ ID NO: 590470 - DNA, 25 bp, Rattus norvegicus
atcatcggtgtacgcgtcacccatg

SEQ ID NO: 590471 - DNA, 25 bp, Rattus norvegicus
tcggtgtacgcgtcacccatgtaca

SEQ ID NO: 590472 - DNA, 25 bp, Rattus norvegicus
gtacgcgtcacccatgtacacactt

SEQ ID NO: 590473 - DNA, 25 bp, Rattus norvegicus
gtcacccatgtacacacttcacgga

SEQ ID NO: 590474 - DNA, 25 bp, Rattus norvegicus
tgtacacacttcacggacaacgttt

SEQ ID NO: 590475 - DNA, 25 bp, Rattus norvegicus
ccatgtacacacttcacggacaacg

SEQ ID NO: 590476 - DNA, 25 bp, Rattus norvegicus
cacttcacggacaacgtttactgtt

SEQ ID NO: 590477 - DNA, 25 bp, Rattus norvegicus
gcccgtccgatctctctgttttctg

SEQ ID NO: 590478 - DNA, 25 bp, Rattus norvegicus
ctggccacccgggtgacttggattt

SEQ ID NO: 590479 - DNA, 25 bp, Rattus norvegicus
cacccgggtgacttggatttgagtc

SEQ ID NO: 590480 - DNA, 25 bp, Rattus norvegicus
tctgtccgcagaacggacacccagg

SEQ ID NO: 590481 - DNA, 25 bp, Rattus norvegicus
ctttaatttctgtccgcagaacgga

SEQ ID NO: 590482 - DNA, 25 bp, Rattus norvegicus
gagatctttaatttctgtccgcaga

SEQ ID NO: 590483 - DNA, 25 bp, Rattus norvegicus
cgtccgatctctctgttttctgaga

SEQ ID NO: 590484 - DNA, 25 bp, Rattus norvegicus
ttcgcttcctttcatgcgcgggcgc

SEQ ID NO: 590485 - DNA, 25 bp, Rattus norvegicus
gagcctcttcgcttcctttcatgcg

SEQ ID NO: 590486 - DNA, 25 bp, Rattus norvegicus
gggcacgagcctcttcgcttccttt

SEQ ID NO: 590487 - DNA, 25 bp, Rattus norvegicus
cagggcgacgggcacgagcctcttc

SEQ ID NO: 590488 - DNA, 25 bp, Rattus norvegicus
cttggatttgagtcgtgcacagggc

SEQ ID NO: 590489 - DNA, 25 bp, Rattus norvegicus
gcagaacggacacccaggcacacat

SEQ ID NO: 590490 - DNA, 25 bp, Rattus norvegicus
tctctctgttttctgagatctttaa

SEQ ID NO: 590491 - DNA, 25 bp, Rattus norvegicus
tcttttgcaggtgggcctacagttc

SEQ ID NO: 590492 - DNA, 25 bp, Rattus norvegicus
cgaatgcgtgtttccggagggaatt

SEQ ID NO: 590493 - DNA, 25 bp, Rattus norvegicus
ggcagaggcctaggatggttacact

SEQ ID NO: 590494 - DNA, 25 bp, Rattus norvegicus
tggttacactgagaaagccgacttc

SEQ ID NO: 590495 - DNA, 25 bp, Rattus norvegicus
gacttccggcgtggcgttcaatcgc

SEQ ID NO: 590496 - DNA, 25 bp, Rattus norvegicus
ttcaatcgcagcgtttgggcgactg

SEQ ID NO: 590497 - DNA, 25 bp, Rattus norvegicus
ttgggcgactgtgctctggagcaat

SEQ ID NO: 590498 - DNA, 25 bp, Rattus norvegicus
ggagcaatgcggcagaagtattata

SEQ ID NO: 590499 - DNA, 25 bp, Rattus norvegicus
agtattatattgaagcggctgctcg

SEQ ID NO: 590500 - DNA, 25 bp, Rattus norvegicus
acacacggtaggagaacgccgcctg

SEQ ID NO: 590501 - DNA, 25 bp, Rattus norvegicus
ctcacgcccttttctcttttgcagg

SEQ ID NO: 590502 - DNA, 25 bp, Rattus norvegicus
tgggcctacagttcgacacacggta

SEQ ID NO: 590503 - DNA, 25 bp, Rattus norvegicus
gaccggaactcctgtgtcgcgaatg

SEQ ID NO: 590504 - DNA, 25 bp, Rattus norvegicus
caggcccgctacctcctgtaagagg

SEQ ID NO: 590505 - DNA, 25 bp, Rattus norvegicus
gagttgctcaactcggacagcttct

SEQ ID NO: 590506 - DNA, 25 bp, Rattus norvegicus
tggatagaatcaccaggaacctggg

SEQ ID NO: 590507 - DNA, 25 bp, Rattus norvegicus
gcaccaggagcacgactcgacagtc

SEQ ID NO: 590508 - DNA, 25 bp, Rattus norvegicus
ctcgacagtactagcaagccgtggc

SEQ ID NO: 590509 - DNA, 25 bp, Rattus norvegicus
tcagatgaacgaagaggcgaacacc

SEQ ID NO: 590510 - DNA, 25 bp, Rattus norvegicus
cggctctgtgggacgcatcatcaga

SEQ ID NO: 590511 - DNA, 25 bp, Rattus norvegicus
atctagcaagatggcgcccagccgg

SEQ ID NO: 590512 - DNA, 25 bp, Rattus norvegicus
agtgacgtcacacatcgggccctgc

SEQ ID NO: 590513 - DNA, 25 bp, Rattus norvegicus
tcaggaagcctgctcaaggggagtt

SEQ ID NO: 590514 - DNA, 25 bp, Rattus norvegicus
agctaggcacctggggaaagactga

SEQ ID NO: 590515 - DNA, 25 bp, Rattus norvegicus
gcccgggctgaactcaggaagcctg

SEQ ID NO: 590516 - DNA, 25 bp, Rattus norvegicus
gggaccgctcacctttgcgtagctc

SEQ ID NO: 590517 - DNA, 25 bp, Rattus norvegicus
tccgaggctggtcgcaatctagcaa

SEQ ID NO: 590518 - DNA, 25 bp, Rattus norvegicus
gaaggcggacatccctccaaaacca

SEQ ID NO: 590519 - DNA, 25 bp, Rattus norvegicus
ttcggcacatcctgctccgttgttc

SEQ ID NO: 590520 - DNA, 25 bp, Rattus norvegicus
ctcgaggagctttgagttggaattc

SEQ ID NO: 590521 - DNA, 25 bp, Rattus norvegicus
ttatgtgttttgctgcccgaaccgg

SEQ ID NO: 590522 - DNA, 25 bp, Rattus norvegicus
agcacccggtctatatggatccagc

SEQ ID NO: 590523 - DNA, 25 bp, Rattus norvegicus
cgttgttctctatgaccctcaggta

SEQ ID NO: 590524 - DNA, 25 bp, Rattus norvegicus
tttccgcggctagctagagtagttc

SEQ ID NO: 590525 - DNA, 25 bp, Rattus norvegicus
acatacagtggtcaggcctggctca

SEQ ID NO: 590526 - DNA, 25 bp, Rattus norvegicus
ttcgagagcgccctacatacagtgg

SEQ ID NO: 590527 - DNA, 25 bp, Rattus norvegicus
ccgcttttccgcgtgttctcagacg

SEQ ID NO: 590528 - DNA, 25 bp, Rattus norvegicus
ggtctgctaagaccgatccgctttt

SEQ ID NO: 590529 - DNA, 25 bp, Rattus norvegicus
ctccaagcaggacaatcggtaatta

SEQ ID NO: 590530 - DNA, 25 bp, Rattus norvegicus
cggcagaatcatgagcccggctacc

SEQ ID NO: 590531 - DNA, 25 bp, Rattus norvegicus
tgcagtcttgcggaactcacctttc

SEQ ID NO: 590532 - DNA, 25 bp, Rattus norvegicus
caaacctctaggatgcgcgcgtacg

SEQ ID NO: 590533 - DNA, 25 bp, Rattus norvegicus
gagatggactcctcgggaatcgaaa

SEQ ID NO: 590534 - DNA, 25 bp, Rattus norvegicus
ggcggtctagatcccgtagacttca

SEQ ID NO: 590535 - DNA, 25 bp, Rattus norvegicus
accgagttctgtcccaggtgggcaa

SEQ ID NO: 590536 - DNA, 25 bp, Rattus norvegicus
ggccgcaccgaagtgaaagctttca

SEQ ID NO: 590537 - DNA, 25 bp, Rattus norvegicus
gctttcagtgagtctgcgagctgca

SEQ ID NO: 590538 - DNA, 25 bp, Rattus norvegicus
gggacccgagtcacccagggctcag

SEQ ID NO: 590539 - DNA, 25 bp, Rattus norvegicus
cagggctcagcactggcgaaatcgc

SEQ ID NO: 590540 - DNA, 25 bp, Rattus norvegicus
gtagacttcagacgcgatccatggc

SEQ ID NO: 590541 - DNA, 25 bp, Rattus norvegicus
gaccaggagtttggccgcctagcag

SEQ ID NO: 590542 - DNA, 25 bp, Rattus norvegicus
gccgcctagcaggtgagcgactgac

SEQ ID NO: 590543 - DNA, 25 bp, Rattus norvegicus
acgcagggacactcagggctggaac

SEQ ID NO: 590544 - DNA, 25 bp, Rattus norvegicus
gggacgcactttgtacttgatttta

SEQ ID NO: 590545 - DNA, 25 bp, Rattus norvegicus
attgtgagcgcctgctcggtgtccc

SEQ ID NO: 590546 - DNA, 25 bp, Rattus norvegicus
gttgtatcacttgggacgcactttg

SEQ ID NO: 590547 - DNA, 25 bp, Rattus norvegicus
tgcatcatggccacgctggcttgtc

SEQ ID NO: 590548 - DNA, 25 bp, Rattus norvegicus
ccactgaggcttaggcaaaggggcc

SEQ ID NO: 590549 - DNA, 25 bp, Rattus norvegicus
gacgacaccgatcctttcaacagca

SEQ ID NO: 590550 - DNA, 25 bp, Rattus norvegicus
ttcacattccgcgaggacctggctc

SEQ ID NO: 590551 - DNA, 25 bp, Rattus norvegicus
cgcgcccaagggcatatgccactga

SEQ ID NO: 590552 - DNA, 25 bp, Rattus norvegicus
gtcagaagctctgttgggcctccct

SEQ ID NO: 590553 - DNA, 25 bp, Rattus norvegicus
tcgcgtgcagttcttggacgacacc

SEQ ID NO: 590554 - DNA, 25 bp, Rattus norvegicus
ccggttttcttgaagagagccctga

SEQ ID NO: 590555 - DNA, 25 bp, Rattus norvegicus
ggcctctccgttagctcggcctggt

SEQ ID NO: 590556 - DNA, 25 bp, Rattus norvegicus
tgcattaggatctccgtggcctctc

SEQ ID NO: 590557 - DNA, 25 bp, Rattus norvegicus
cccagtgcagatcttagggcgagcg

SEQ ID NO: 590558 - DNA, 25 bp, Rattus norvegicus
agaagctagcgcacgactctctgtg

SEQ ID NO: 590559 - DNA, 25 bp, Rattus norvegicus
gggccaggagcacccagaagctagc

SEQ ID NO: 590560 - DNA, 25 bp, Rattus norvegicus
agccctgaaagatgccggggtcaga

SEQ ID NO: 590561 - DNA, 25 bp, Rattus norvegicus
tctgcaggtgttccatccataaaca

SEQ ID NO: 590562 - DNA, 25 bp, Rattus norvegicus
tgttccatccataaacaagcgtcgg

SEQ ID NO: 590563 - DNA, 25 bp, Rattus norvegicus
cagctcactctgcaggtgttccatc

SEQ ID NO: 590564 - DNA, 25 bp, Rattus norvegicus
aggaaatcagctcactctgcaggtg

SEQ ID NO: 590565 - DNA, 25 bp, Rattus norvegicus
cgcgcatcaggaaatcagctcactc

SEQ ID NO: 590566 - DNA, 25 bp, Rattus norvegicus
tgcttctggcgggctgagcctccag

SEQ ID NO: 590567 - DNA, 25 bp, Rattus norvegicus
tagcgtcttggcttggcccgtgctt

SEQ ID NO: 590568 - DNA, 25 bp, Rattus norvegicus
ttaactttcagatacaaatacttgg

SEQ ID NO: 590569 - DNA, 25 bp, Rattus norvegicus
acaaatacttggagcacttggcagc

SEQ ID NO: 590570 - DNA, 25 bp, Rattus norvegicus
atacttggagcacttggcagccgag

SEQ ID NO: 590571 - DNA, 25 bp, Rattus norvegicus
acttggcagccgaggcgcacgagaa

SEQ ID NO: 590572 - DNA, 25 bp, Rattus norvegicus
cgccctgcgcgcatcaggaaatcag

SEQ ID NO: 590573 - DNA, 25 bp, Rattus norvegicus
cgcacgagaaggagcagagaagccg

SEQ ID NO: 590574 - DNA, 25 bp, Rattus norvegicus
ataaacaagcgtcggccacggggct

SEQ ID NO: 590575 - DNA, 25 bp, Rattus norvegicus
cttttagagtcgatcgggtgggata

SEQ ID NO: 590576 - DNA, 25 bp, Rattus norvegicus
tcaccttcttgacagaccggggatc

SEQ ID NO: 590577 - DNA, 25 bp, Rattus norvegicus
ccggcatggagaacgtcaccttctt

SEQ ID NO: 590578 - DNA, 25 bp, Rattus norvegicus
ccggaagtagcctgtgtcaccacta

SEQ ID NO: 590579 - DNA, 25 bp, Rattus norvegicus
gaggaccgtgcacagactcgcctgc

SEQ ID NO: 590580 - DNA, 25 bp, Rattus norvegicus
gatgtcatcatcttccgctggtggc

SEQ ID NO: 590581 - DNA, 25 bp, Rattus norvegicus
atggcgtctcggtctcttcagcccg

SEQ ID NO: 590582 - DNA, 25 bp, Rattus norvegicus
gcgccgatcctaagagctccaacag

SEQ ID NO: 590583 - DNA, 25 bp, Rattus norvegicus
gatctcagggtaggacagagccgtc

SEQ ID NO: 590584 - DNA, 25 bp, Rattus norvegicus
cactcaccgttggtgtagggagacc

SEQ ID NO: 590585 - DNA, 25 bp, Rattus norvegicus
cgtcaaagtcgaggcatggcgtctc

SEQ ID NO: 590586 - DNA, 25 bp, Rattus norvegicus
aggattacctgaaacgaccgatgtc

SEQ ID NO: 590587 - DNA, 25 bp, Rattus norvegicus
cgggctcctcttccgggaatctttg

SEQ ID NO: 590588 - DNA, 25 bp, Rattus norvegicus
tgggataggagaaaccgggctcctc

SEQ ID NO: 590589 - DNA, 25 bp, Rattus norvegicus
cgccgcgcccgccatcttgaaacaa

SEQ ID NO: 590590 - DNA, 25 bp, Rattus norvegicus
gccgcaccttgagaagttgaccctg

SEQ ID NO: 590591 - DNA, 25 bp, Rattus norvegicus
aagccggcagcaagccgcaccttga

SEQ ID NO: 590592 - DNA, 25 bp, Rattus norvegicus
aagacgcgtgccatggaggagacac

SEQ ID NO: 590593 - DNA, 25 bp, Rattus norvegicus
ccctcaggcgctgaaaactacaact

SEQ ID NO: 590594 - DNA, 25 bp, Rattus norvegicus
gcggagccctcaggcgctgaaaact

SEQ ID NO: 590595 - DNA, 25 bp, Rattus norvegicus
ggcggaaccgctgctgccaaagccg

SEQ ID NO: 590596 - DNA, 25 bp, Rattus norvegicus
tacagtcgcggctccagaacgcgga

SEQ ID NO: 590597 - DNA, 25 bp, Rattus norvegicus
agaagttgaccctgggcgtaactcg

SEQ ID NO: 590598 - DNA, 25 bp, Rattus norvegicus
atcttgaaacaaccgccactcgagg

SEQ ID NO: 590599 - DNA, 25 bp, Rattus norvegicus
aaccgccactcgaggcgtcgagtcg

SEQ ID NO: 590600 - DNA, 25 bp, Rattus norvegicus
cccagcctgaagtggaaaggcccat

SEQ ID NO: 590601 - DNA, 25 bp, Rattus norvegicus
gcgagtcgggcacccagcctgaagt

SEQ ID NO: 590602 - DNA, 25 bp, Rattus norvegicus
tctctggcccacacaaagcctcgcg

SEQ ID NO: 590603 - DNA, 25 bp, Rattus norvegicus
ctgagaaggcgacgggtccatccaa

SEQ ID NO: 590604 - DNA, 25 bp, Rattus norvegicus
cagctgcaccttgagcctcttcatg

SEQ ID NO: 590605 - DNA, 25 bp, Rattus norvegicus
gtctttgggccgcttcagctgcacc

SEQ ID NO: 590606 - DNA, 25 bp, Rattus norvegicus
ctcagtacgggcgattggcgtcttt

SEQ ID NO: 590607 - DNA, 25 bp, Rattus norvegicus
ccgccggcgctcagtacgggcgatt

SEQ ID NO: 590608 - DNA, 25 bp, Rattus norvegicus
cgccgcccatggttacctgtgcgag

SEQ ID NO: 590609 - DNA, 25 bp, Rattus norvegicus
ttgagcctcttcatgcctatctgga

SEQ ID NO: 590610 - DNA, 25 bp, Rattus norvegicus
ttcatgcctatctggaagccgttca

SEQ ID NO: 590611 - DNA, 25 bp, Rattus norvegicus
aagcctggcgagacacgagggacca

SEQ ID NO: 590612 - DNA, 25 bp, Rattus norvegicus
gctcacgaagcctggcgagacacga

SEQ ID NO: 590613 - DNA, 25 bp, Rattus norvegicus
ccgggttgtcgaagctcacgaagcc

SEQ ID NO: 590614 - DNA, 25 bp, Rattus norvegicus
ccgttcatggcctggatggcggtct

SEQ ID NO: 590615 - DNA, 25 bp, Rattus norvegicus
ctggaagccgttcatggcctggatg

SEQ ID NO: 590616 - DNA, 25 bp, Rattus norvegicus
ttacctgtgcgagtcctggtctccc

SEQ ID NO: 590617 - DNA, 25 bp, Rattus norvegicus
caggatagtgcactcctcgatgttc

SEQ ID NO: 590618 - DNA, 25 bp, Rattus norvegicus
cttctagaacaaaattaggagatgc

SEQ ID NO: 590619 - DNA, 25 bp, Rattus norvegicus
attaggagatgcttacccgggccag

SEQ ID NO: 590620 - DNA, 25 bp, Rattus norvegicus
ccgcgcaggatagtgcactcctcga

SEQ ID NO: 590621 - DNA, 25 bp, Rattus norvegicus
gatagtgcactcctcgatgttcccg

SEQ ID NO: 590622 - DNA, 25 bp, Rattus norvegicus
gtgcactcctcgatgttcccgaagg

SEQ ID NO: 590623 - DNA, 25 bp, Rattus norvegicus
agccgcccgcaaaagggcgaggccg

SEQ ID NO: 590624 - DNA, 25 bp, Rattus norvegicus
tcctcgatgttcccgaaggcctcga

SEQ ID NO: 590625 - DNA, 25 bp, Rattus norvegicus
gaagaggcggcgcacgtcgtcctca

SEQ ID NO: 590626 - DNA, 25 bp, Rattus norvegicus
cgtcgtcctcagattgttgcttgtt

SEQ ID NO: 590627 - DNA, 25 bp, Rattus norvegicus
ctcagattgttgcttgttgagcata

SEQ ID NO: 590628 - DNA, 25 bp, Rattus norvegicus
ttgttgagcatacccacgaagagtt

SEQ ID NO: 590629 - DNA, 25 bp, Rattus norvegicus
gttgagcatacccacgaagagtttt

SEQ ID NO: 590630 - DNA, 25 bp, Rattus norvegicus
tccggcccgcgcaggatagtgcact

SEQ ID NO: 590631 - DNA, 25 bp, Rattus norvegicus
tgaccctgcaggaaccacgggcttc

SEQ ID NO: 590632 - DNA, 25 bp, Rattus norvegicus
taaacggagcagagactgcggcttg

SEQ ID NO: 590633 - DNA, 25 bp, Rattus norvegicus
gacaactggcgcgttcctccgggca

SEQ ID NO: 590634 - DNA, 25 bp, Rattus norvegicus
ctgcaggaaccacgggcttccgtct

SEQ ID NO: 590635 - DNA, 25 bp, Rattus norvegicus
tctgctaacggcctggcctgtgggt

SEQ ID NO: 590636 - DNA, 25 bp, Rattus norvegicus
actgctctgctaacggcctggcctg

SEQ ID NO: 590637 - DNA, 25 bp, Rattus norvegicus
tgaagcgggatgctgacttgccgcc

SEQ ID NO: 590638 - DNA, 25 bp, Rattus norvegicus
agactgcggcttgggtgtgtgaagc

SEQ ID NO: 590639 - DNA, 25 bp, Rattus norvegicus
gaggcttccacataaacggagcaga

SEQ ID NO: 590640 - DNA, 25 bp, Rattus norvegicus
ggggaggcttccacataaacggagc

SEQ ID NO: 590641 - DNA, 25 bp, Rattus norvegicus
gcagatgcttctcgcaggcagggca

SEQ ID NO: 590642 - DNA, 25 bp, Rattus norvegicus
ggaccggcggcagatgcttctcgca

SEQ ID NO: 590643 - DNA, 25 bp, Rattus norvegicus
gttcctccgggcagcgctgggctct

SEQ ID NO: 590644 - DNA, 25 bp, Rattus norvegicus
tccacataaacggagcagagactgc

SEQ ID NO: 590645 - DNA, 25 bp, Rattus norvegicus
ttggtgagaacacgggacacacata

SEQ ID NO: 590646 - DNA, 25 bp, Rattus norvegicus
gccctggccgcatcggcagcaaata

SEQ ID NO: 590647 - DNA, 25 bp, Rattus norvegicus
gggcatacaacatccaccctcatgg

SEQ ID NO: 590648 - DNA, 25 bp, Rattus norvegicus
tgtgttcaagaaccgagcgagccgg

SEQ ID NO: 590649 - DNA, 25 bp, Rattus norvegicus
tcgccatctcgcttgcactttcaga

SEQ ID NO: 590650 - DNA, 25 bp, Rattus norvegicus
acacgggacacatggggtccacgcc

SEQ ID NO: 590651 - DNA, 25 bp, Rattus norvegicus
gggacacacatagggtcgtctcagt

SEQ ID NO: 590652 - DNA, 25 bp, Rattus norvegicus
caccctcatgggatccgtgacgttg

SEQ ID NO: 590653 - DNA, 25 bp, Rattus norvegicus
cggagactcactgttggtgagaaca

SEQ ID NO: 590654 - DNA, 25 bp, Rattus norvegicus
cggacggcacctttcacacgcgtga

SEQ ID NO: 590655 - DNA, 25 bp, Rattus norvegicus
gaaagtcaggttcgtggcctacacg

SEQ ID NO: 590656 - DNA, 25 bp, Rattus norvegicus
cggcagcaaatataagaaagtcagg

SEQ ID NO: 590657 - DNA, 25 bp, Rattus norvegicus
cctagggccactgctctacggggag

SEQ ID NO: 590658 - DNA, 25 bp, Rattus norvegicus
tcgtctcagtgtgggtgagaacacg

SEQ ID NO: 590659 - DNA, 25 bp, Rattus norvegicus
tccctgtggattattcggctctccg

SEQ ID NO: 590660 - DNA, 25 bp, Rattus norvegicus
caatttgcgggccacgttgcatcgc

SEQ ID NO: 590661 - DNA, 25 bp, Rattus norvegicus
ccgccgctgcgtgcagtttgctgca

SEQ ID NO: 590662 - DNA, 25 bp, Rattus norvegicus
agtttgctgcacgttaaattcatta

SEQ ID NO: 590663 - DNA, 25 bp, Rattus norvegicus
ttcattattttaacaggtcagtgcc

SEQ ID NO: 590664 - DNA, 25 bp, Rattus norvegicus
tattttaacaggtcagtgcctctga

SEQ ID NO: 590665 - DNA, 25 bp, Rattus norvegicus
tccggaaaagcgataccggcgactc

SEQ ID NO: 590666 - DNA, 25 bp, Rattus norvegicus
ccggcgactcgcagagactttaatc

SEQ ID NO: 590667 - DNA, 25 bp, Rattus norvegicus
ccgctgcttctttaatccctgtgga

SEQ ID NO: 590668 - DNA, 25 bp, Rattus norvegicus
agcaccgctgcttctttaatccctg

SEQ ID NO: 590669 - DNA, 25 bp, Rattus norvegicus
gacgtggaaaacaatttgcgggcca

SEQ ID NO: 590670 - DNA, 25 bp, Rattus norvegicus
atttgtgggagatgagcaccgctgc

SEQ ID NO: 590671 - DNA, 25 bp, Rattus norvegicus
tgcctctgacagatattcatttgtg

SEQ ID NO: 590672 - DNA, 25 bp, Rattus norvegicus
ttcggctctccggaaaagcgatacc

SEQ ID NO: 590673 - DNA, 25 bp, Rattus norvegicus
ataaaccgcggtgatctcactggcg

SEQ ID NO: 590674 - DNA, 25 bp, Rattus norvegicus
cgctgactcacgctcgcagtaggtg

SEQ ID NO: 590675 - DNA, 25 bp, Rattus norvegicus
gctctgggccttcagcgctgactca

SEQ ID NO: 590676 - DNA, 25 bp, Rattus norvegicus
gtcttctgctcgtgcagcgcgctct

SEQ ID NO: 590677 - DNA, 25 bp, Rattus norvegicus
cgacgggcgcatccgagctcggtac

SEQ ID NO: 590678 - DNA, 25 bp, Rattus norvegicus
ggctcccggtcactgccaagattct

SEQ ID NO: 590679 - DNA, 25 bp, Rattus norvegicus
ggccgtgtgagcttttgccgcgccc

SEQ ID NO: 590680 - DNA, 25 bp, Rattus norvegicus
agcatctgaggcatcgccggacagt

SEQ ID NO: 590681 - DNA, 25 bp, Rattus norvegicus
tgcgggatcccagcggggccctact

SEQ ID NO: 590682 - DNA, 25 bp, Rattus norvegicus
ctggctccttaaataaaccgcggtg

SEQ ID NO: 590683 - DNA, 25 bp, Rattus norvegicus
cgatagtttatcaaagacgagggct

SEQ ID NO: 590684 - DNA, 25 bp, Rattus norvegicus
gggccaaggcgcgatagtttatcaa

SEQ ID NO: 590685 - DNA, 25 bp, Rattus norvegicus
gcgcagaagctataaaccagggcca

SEQ ID NO: 590686 - DNA, 25 bp, Rattus norvegicus
ggccctactggatgctcccgggagc

SEQ ID NO: 590687 - DNA, 25 bp, Rattus norvegicus
gcgttgtcagcctgtccgtttgcta

SEQ ID NO: 590688 - DNA, 25 bp, Rattus norvegicus
ggctgctgcctagcccgttggtact

SEQ ID NO: 590689 - DNA, 25 bp, Rattus norvegicus
aatccgttcatatgcccggcgctgc

SEQ ID NO: 590690 - DNA, 25 bp, Rattus norvegicus
cgggctgtggcttaatccgttcata

SEQ ID NO: 590691 - DNA, 25 bp, Rattus norvegicus
cttcataggaatggtcgacgggttc

SEQ ID NO: 590692 - DNA, 25 bp, Rattus norvegicus
gatggcatcgtggtccttcatagga

SEQ ID NO: 590693 - DNA, 25 bp, Rattus norvegicus
ggggatctgcccaatgaacagcttg

SEQ ID NO: 590694 - DNA, 25 bp, Rattus norvegicus
gaggtccttctcatccaggtttcgg

SEQ ID NO: 590695 - DNA, 25 bp, Rattus norvegicus
ccgaactcttcgaagaggggcttga

SEQ ID NO: 590696 - DNA, 25 bp, Rattus norvegicus
gctctcacctttgtgcatgcctgtg

SEQ ID NO: 590697 - DNA, 25 bp, Rattus norvegicus
tgtgaacctgtccttcagaaccgta

SEQ ID NO: 590698 - DNA, 25 bp, Rattus norvegicus
cttcagaaccgtaagctcgtagatc

SEQ ID NO: 590699 - DNA, 25 bp, Rattus norvegicus
gctcgtagatcttgccgaactcttc

SEQ ID NO: 590700 - DNA, 25 bp, Rattus norvegicus
gcttgcatcggctgttcgcctcaaa

SEQ ID NO: 590701 - DNA, 25 bp, Rattus norvegicus
tgcccagatcgctcagcgcggaatc

SEQ ID NO: 590702 - DNA, 25 bp, Rattus norvegicus
gcgctaccggatccagaggtgcgaa

SEQ ID NO: 590703 - DNA, 25 bp, Rattus norvegicus
agcctggcgaagcttgtgctgccct

SEQ ID NO: 590704 - DNA, 25 bp, Rattus norvegicus
attcactgtcaaagagatgaagccc

SEQ ID NO: 590705 - DNA, 25 bp, Rattus norvegicus
ctgtggcaaattggaaattcctttt

SEQ ID NO: 590706 - DNA, 25 bp, Rattus norvegicus
gacttttccggtccggagagcggca

SEQ ID NO: 590707 - DNA, 25 bp, Rattus norvegicus
gagggaatgtttcagtcccggacga

SEQ ID NO: 590708 - DNA, 25 bp, Rattus norvegicus
tagaattcggcttggttctccgccc

SEQ ID NO: 590709 - DNA, 25 bp, Rattus norvegicus
tggcaggctcaagagcggtcccgcc

SEQ ID NO: 590710 - DNA, 25 bp, Rattus norvegicus
cgaatagtggtagtgaacttggcta

SEQ ID NO: 590711 - DNA, 25 bp, Rattus norvegicus
ccgattttcattctcagcgtgttta

SEQ ID NO: 590712 - DNA, 25 bp, Rattus norvegicus
atcctctccgacgtttgcctttcta

SEQ ID NO: 590713 - DNA, 25 bp, Rattus norvegicus
taggcttcagaaacccggccaatta

SEQ ID NO: 590714 - DNA, 25 bp, Rattus norvegicus
ctagagcctcagctgcgcgcgagag

SEQ ID NO: 590715 - DNA, 25 bp, Rattus norvegicus
gcttccgacatgtgggtcagcttcc

SEQ ID NO: 590716 - DNA, 25 bp, Rattus norvegicus
tccgtcacgtgggtcagcttccgac

SEQ ID NO: 590717 - DNA, 25 bp, Rattus norvegicus
acgtaggtctgcttccgtcacgtgg

SEQ ID NO: 590718 - DNA, 25 bp, Rattus norvegicus
tgcttccgtcacgtaggtctgcttc

SEQ ID NO: 590719 - DNA, 25 bp, Rattus norvegicus
tccgacatgtgggtctgcttccgtc

SEQ ID NO: 590720 - DNA, 25 bp, Rattus norvegicus
gtcacgtgggtcagcttccgacatg

SEQ ID NO: 590721 - DNA, 25 bp, Rattus norvegicus
acatgtgggtctgcttccgtcacgt

SEQ ID NO: 590722 - DNA, 25 bp, Rattus norvegicus
agcttccgacatgtgggtctgcttc

SEQ ID NO: 590723 - DNA, 25 bp, Rattus norvegicus
cgtcacgtgggtcagcttccgacat

SEQ ID NO: 590724 - DNA, 25 bp, Rattus norvegicus
catgtgggtcagcttccgtcacgtg

SEQ ID NO: 590725 - DNA, 25 bp, Rattus norvegicus
tccgacatgtgggtcagcttccgtc

SEQ ID NO: 590726 - DNA, 25 bp, Rattus norvegicus
tcacgtgggtcagcttccgacatgt

SEQ ID NO: 590727 - DNA, 25 bp, Rattus norvegicus
ctgcttccgtcacgtgggtcagctt

SEQ ID NO: 590728 - DNA, 25 bp, Rattus norvegicus
gtcacgtaggtctgcttccgtcacg

SEQ ID NO: 590729 - DNA, 25 bp, Rattus norvegicus
gacatgcccagaggaatgctcaagc

SEQ ID NO: 590730 - DNA, 25 bp, Rattus norvegicus
cagaggtgcagaggcctcgcggcta

SEQ ID NO: 590731 - DNA, 25 bp, Rattus norvegicus
gctccaatgatctgcagctcagagg

SEQ ID NO: 590732 - DNA, 25 bp, Rattus norvegicus
tgtcgctacacccaacgcgactggg

SEQ ID NO: 590733 - DNA, 25 bp, Rattus norvegicus
ccgctccgcgctcttctgtcgctac

SEQ ID NO: 590734 - DNA, 25 bp, Rattus norvegicus
acggccgcctaccatcctgccctcg

SEQ ID NO: 590735 - DNA, 25 bp, Rattus norvegicus
ggccggccgactgacaggcgactcc

SEQ ID NO: 590736 - DNA, 25 bp, Rattus norvegicus
tgcccagaggaatgctcaagcagcc

SEQ ID NO: 590737 - DNA, 25 bp, Rattus norvegicus
gagcgtcttctacaagatcaccacc

SEQ ID NO: 590738 - DNA, 25 bp, Rattus norvegicus
acaagatcaccacccagcagacatg

SEQ ID NO: 590739 - DNA, 25 bp, Rattus norvegicus
gagaccgagcgtcttctacaagatc

SEQ ID NO: 590740 - DNA, 25 bp, Rattus norvegicus
ctacctgaacgcgtggagaccgagc

SEQ ID NO: 590741 - DNA, 25 bp, Rattus norvegicus
gaatgctcaagcagccgacggccgc

SEQ ID NO: 590742 - DNA, 25 bp, Rattus norvegicus
aacgcgtggagaccgagcgtcttct

SEQ ID NO: 590743 - DNA, 25 bp, Rattus norvegicus
cggaagtcactgctagaacccggaa

SEQ ID NO: 590744 - DNA, 25 bp, Rattus norvegicus
gtgttgtcacccagtggcccagttc

SEQ ID NO: 590745 - DNA, 25 bp, Rattus norvegicus
ctcccttcagggcagaggacgaaag

SEQ ID NO: 590746 - DNA, 25 bp, Rattus norvegicus
gtgtgcaagaaccaaggcgggcctt

SEQ ID NO: 590747 - DNA, 25 bp, Rattus norvegicus
gcacaccgtacgaagggcttttctc

SEQ ID NO: 590748 - DNA, 25 bp, Rattus norvegicus
cacaaatcgcgtgcggaggaggctc

SEQ ID NO: 590749 - DNA, 25 bp, Rattus norvegicus
ttccgtccctgaaccgaaggagcgc

SEQ ID NO: 590750 - DNA, 25 bp, Rattus norvegicus
cgccgcggatgcatctcgaacgggc

SEQ ID NO: 590751 - DNA, 25 bp, Rattus norvegicus
gactgacaaccggaagtcactgcta

SEQ ID NO: 590752 - DNA, 25 bp, Rattus norvegicus
acccggaagtcctaggcacacgtga

SEQ ID NO: 590753 - DNA, 25 bp, Rattus norvegicus
acgtgactccacctataggcgcttc

SEQ ID NO: 590754 - DNA, 25 bp, Rattus norvegicus
taggcgcttcttcccaaattggttg

SEQ ID NO: 590755 - DNA, 25 bp, Rattus norvegicus
ccaaattggttgctagggagacgcg

SEQ ID NO: 590756 - DNA, 25 bp, Rattus norvegicus
gccgctgcacgtctggagactgaca

SEQ ID NO: 590757 - DNA, 25 bp, Rattus norvegicus
gagactggcgtcttattggctgaca

SEQ ID NO: 590758 - DNA, 25 bp, Rattus norvegicus
tacagtgatgcacccagcgtctggc

SEQ ID NO: 590759 - DNA, 25 bp, Rattus norvegicus
gaattgcgttccctctgtgcctgca

SEQ ID NO: 590760 - DNA, 25 bp, Rattus norvegicus
cagctgcggattggtgctgtataca

SEQ ID NO: 590761 - DNA, 25 bp, Rattus norvegicus
attggcccagccaagaagtttaggc

SEQ ID NO: 590762 - DNA, 25 bp, Rattus norvegicus
ccttcttgccagagatcgcctatct

SEQ ID NO: 590763 - DNA, 25 bp, Rattus norvegicus
cttctggagcagtttaaagtgactc

SEQ ID NO: 590764 - DNA, 25 bp, Rattus norvegicus
ctttagcaagctaggcagagcggtt

SEQ ID NO: 590765 - DNA, 25 bp, Rattus norvegicus
cggtccttattccagctctttagca

SEQ ID NO: 590766 - DNA, 25 bp, Rattus norvegicus
cgtcacagctcttgcggtccttatt

SEQ ID NO: 590767 - DNA, 25 bp, Rattus norvegicus
cggtgctcgtccctggaaaaggaca

SEQ ID NO: 590768 - DNA, 25 bp, Rattus norvegicus
gttgcagccagtaagcgaaagtctc

SEQ ID NO: 590769 - DNA, 25 bp, Rattus norvegicus
tcgtcctgttctcttcaggcgagga

SEQ ID NO: 590770 - DNA, 25 bp, Rattus norvegicus
tcgtggcggccacatataaaaaggg

SEQ ID NO: 590771 - DNA, 25 bp, Rattus norvegicus
ggaatctctatggttctcgccgact

SEQ ID NO: 590772 - DNA, 25 bp, Rattus norvegicus
ccgaaatgggagatcctcacctgta

SEQ ID NO: 590773 - DNA, 25 bp, Rattus norvegicus
cctcacctgtaaggggagcccagta

SEQ ID NO: 590774 - DNA, 25 bp, Rattus norvegicus
ggagcccagtaggtttcaggtcttc

SEQ ID NO: 590775 - DNA, 25 bp, Rattus norvegicus
tcccggagagactcactgccatatg

SEQ ID NO: 590776 - DNA, 25 bp, Rattus norvegicus
gcggtactcccagagcttcggaatc

SEQ ID NO: 590777 - DNA, 25 bp, Rattus norvegicus
ctcgccgactcgctagaggacgttt

SEQ ID NO: 590778 - DNA, 25 bp, Rattus norvegicus
gtttggtccactggaggactcccta

SEQ ID NO: 590779 - DNA, 25 bp, Rattus norvegicus
gctccggggatacctctagttctcc

SEQ ID NO: 590780 - DNA, 25 bp, Rattus norvegicus
ccttgggactctgcttttctcggta

SEQ ID NO: 590781 - DNA, 25 bp, Rattus norvegicus
gctttctcttgccaggccttctcga

SEQ ID NO: 590782 - DNA, 25 bp, Rattus norvegicus
cttctcgaggcctgttcagttccga

SEQ ID NO: 590783 - DNA, 25 bp, Rattus norvegicus
cagttccgaggcagacagtaccctg

SEQ ID NO: 590784 - DNA, 25 bp, Rattus norvegicus
atatgcgtgagactcggcctccaca

SEQ ID NO: 590785 - DNA, 25 bp, Rattus norvegicus
aagagcccgtccgtgcggcttccgt

SEQ ID NO: 590786 - DNA, 25 bp, Rattus norvegicus
ttagaagagcccgtccgtgcggctt

SEQ ID NO: 590787 - DNA, 25 bp, Rattus norvegicus
tggaagcgatcctcgagctggcgac

SEQ ID NO: 590788 - DNA, 25 bp, Rattus norvegicus
tgtctgtggcagtgcgcagggcgat

SEQ ID NO: 590789 - DNA, 25 bp, Rattus norvegicus
tttccttagaagagcccgtccgtgc

SEQ ID NO: 590790 - DNA, 25 bp, Rattus norvegicus
ttccgtctccggcagtgtctgtggc

SEQ ID NO: 590791 - DNA, 25 bp, Rattus norvegicus
gaccggaagccgctagactgcgccc

SEQ ID NO: 590792 - DNA, 25 bp, Rattus norvegicus
ctgacctaccgtcgtccgcccgctt

SEQ ID NO: 590793 - DNA, 25 bp, Rattus norvegicus
agggtgcctgacctaccgtcgtccg

SEQ ID NO: 590794 - DNA, 25 bp, Rattus norvegicus
tagtgtgatagcagggtgcctgacc

SEQ ID NO: 590795 - DNA, 25 bp, Rattus norvegicus
cctagtgtgatagcagggtgcctga

SEQ ID NO: 590796 - DNA, 25 bp, Rattus norvegicus
gtctcgcgggtttcccctagtgtga

SEQ ID NO: 590797 - DNA, 25 bp, Rattus norvegicus
tcgcgggcagtctcgcgggtttccc

SEQ ID NO: 590798 - DNA, 25 bp, Rattus norvegicus
cgtctccggcagtgtctgtggcagt

SEQ ID NO: 590799 - DNA, 25 bp, Rattus norvegicus
gacgccgtgaggcaacctaggccca

SEQ ID NO: 590800 - DNA, 25 bp, Rattus norvegicus
ggtcctagcgttaagatagccacca

SEQ ID NO: 590801 - DNA, 25 bp, Rattus norvegicus
gccaccaagacgtactcaaatgttt

SEQ ID NO: 590802 - DNA, 25 bp, Rattus norvegicus
ctcaaatgtttaggcgccgatgtcc

SEQ ID NO: 590803 - DNA, 25 bp, Rattus norvegicus
cacctgcgcgcatgctctatttgag

SEQ ID NO: 590804 - DNA, 25 bp, Rattus norvegicus
agccctacggtagacctgcggcaga

SEQ ID NO: 590805 - DNA, 25 bp, Rattus norvegicus
cgtgatgacgcacgggcgtacgctc

SEQ ID NO: 590806 - DNA, 25 bp, Rattus norvegicus
atggcggctgcatctttgaaggaga

SEQ ID NO: 590807 - DNA, 25 bp, Rattus norvegicus
gagagacattccctacggcgccgaa

SEQ ID NO: 590808 - DNA, 25 bp, Rattus norvegicus
tcgcggttaggagctcttcccggcc

SEQ ID NO: 590809 - DNA, 25 bp, Rattus norvegicus
gtaagtccgccgtggaacctgtgag

SEQ ID NO: 590810 - DNA, 25 bp, Rattus norvegicus
gcgggaaagagaaggacagacctct

SEQ ID NO: 590811 - DNA, 25 bp, Rattus norvegicus
ggtcccatcggaggaactctgcgga

SEQ ID NO: 590812 - DNA, 25 bp, Rattus norvegicus
cggccgcagagacgcaaagttcgga

SEQ ID NO: 590813 - DNA, 25 bp, Rattus norvegicus
gcagccgcaggttccgcaacgcgga

SEQ ID NO: 590814 - DNA, 25 bp, Rattus norvegicus
tggtggctcaggaccctccggccgc

SEQ ID NO: 590815 - DNA, 25 bp, Rattus norvegicus
tgctcgtgctattgctgctgctgct

SEQ ID NO: 590816 - DNA, 25 bp, Rattus norvegicus
cgcgatcttcaccaccgctgctcgt

SEQ ID NO: 590817 - DNA, 25 bp, Rattus norvegicus
ctgggctgggcaccgcgatcttcac

SEQ ID NO: 590818 - DNA, 25 bp, Rattus norvegicus
ggagcacaagcaggagaaccagcgc

SEQ ID NO: 590819 - DNA, 25 bp, Rattus norvegicus
atccggagcacaagcaggagaacca

SEQ ID NO: 590820 - DNA, 25 bp, Rattus norvegicus
tgccatccggagcacaagcaggaga

SEQ ID NO: 590821 - DNA, 25 bp, Rattus norvegicus
tcctgctccgtggtgccatccggag

SEQ ID NO: 590822 - DNA, 25 bp, Rattus norvegicus
cgcgcagagagtggcagcctcctgc

SEQ ID NO: 590823 - DNA, 25 bp, Rattus norvegicus
gcctactcctgaggctgctcgggcg

SEQ ID NO: 590824 - DNA, 25 bp, Rattus norvegicus
agggcgccgcctactcctgaggctg

SEQ ID NO: 590825 - DNA, 25 bp, Rattus norvegicus
acgcgtcggcctcagcgcgtggaca

SEQ ID NO: 590826 - DNA, 25 bp, Rattus norvegicus
ctgctgaggatgtcgccctgctgga

SEQ ID NO: 590827 - DNA, 25 bp, Rattus norvegicus
cctcgaacccttcgccggcctcacg

SEQ ID NO: 590828 - DNA, 25 bp, Rattus norvegicus
cgcctggccgcctactcacacagcg

SEQ ID NO: 590829 - DNA, 25 bp, Rattus norvegicus
atgaaaaaattcatccgctacctga

SEQ ID NO: 590830 - DNA, 25 bp, Rattus norvegicus
ttcatccgctacctgaagctgcgca

SEQ ID NO: 590831 - DNA, 25 bp, Rattus norvegicus
tccgctacctgaagctgcgcaggca

SEQ ID NO: 590832 - DNA, 25 bp, Rattus norvegicus
ctacctgaagctgcgcaggcagagc

SEQ ID NO: 590833 - DNA, 25 bp, Rattus norvegicus
tgaggtggacttcaacctcgaaccc

SEQ ID NO: 590834 - DNA, 25 bp, Rattus norvegicus
cgcgaggagtacataaagcggaagc

SEQ ID NO: 590835 - DNA, 25 bp, Rattus norvegicus
ggcctcacgcccgagtacatggaaa

SEQ ID NO: 590836 - DNA, 25 bp, Rattus norvegicus
ctcacgcccgagtacatggaaatga

SEQ ID NO: 590837 - DNA, 25 bp, Rattus norvegicus
cgcccgagtacatggaaatgagtga

SEQ ID NO: 590838 - DNA, 25 bp, Rattus norvegicus
gaaatgagtgagtggtatcccggcc

SEQ ID NO: 590839 - DNA, 25 bp, Rattus norvegicus
tacataaagcggaagcagcgctatg

SEQ ID NO: 590840 - DNA, 25 bp, Rattus norvegicus
gcagcgctatgaggtggacttcaac

SEQ ID NO: 590841 - DNA, 25 bp, Rattus norvegicus
cccggccactttcgagcagtgtgaa

SEQ ID NO: 590842 - DNA, 25 bp, Rattus norvegicus
gtctgggatgtcctcagcctaagca

SEQ ID NO: 590843 - DNA, 25 bp, Rattus norvegicus
ccgcacaactttgcggggacgcagg

SEQ ID NO: 590844 - DNA, 25 bp, Rattus norvegicus
cgcatgctttggcagacgtggcacc

SEQ ID NO: 590845 - DNA, 25 bp, Rattus norvegicus
cgcctctcctagcttggtgcgcatg

SEQ ID NO: 590846 - DNA, 25 bp, Rattus norvegicus
gcgggaacacttgctggttggaccc

SEQ ID NO: 590847 - DNA, 25 bp, Rattus norvegicus
tgcctttcacttgcgccgcgggaac

SEQ ID NO: 590848 - DNA, 25 bp, Rattus norvegicus
gggtcgccacctccaggagttctgc

SEQ ID NO: 590849 - DNA, 25 bp, Rattus norvegicus
ttcgagcagtgtgaagccttggatc

SEQ ID NO: 590850 - DNA, 25 bp, Rattus norvegicus
gccttggatctttaaacgtgtctgc

SEQ ID NO: 590851 - DNA, 25 bp, Rattus norvegicus
tgtctgcgtttcttccacgagatgg

SEQ ID NO: 590852 - DNA, 25 bp, Rattus norvegicus
ggggactgtaaagctactcgctaag

SEQ ID NO: 590853 - DNA, 25 bp, Rattus norvegicus
actcgctaaggaggttgtcagacgc

SEQ ID NO: 590854 - DNA, 25 bp, Rattus norvegicus
ctgaggagtcggtggaactagctcc

SEQ ID NO: 590855 - DNA, 25 bp, Rattus norvegicus
agaaccgcgggagacccttcagatg

SEQ ID NO: 590856 - DNA, 25 bp, Rattus norvegicus
tcttcgatatccgtcgctgctgggc

SEQ ID NO: 590857 - DNA, 25 bp, Rattus norvegicus
ccacaacaggatcacacggctaaga

SEQ ID NO: 590858 - DNA, 25 bp, Rattus norvegicus
cggcgggctcctagagaatgctaac

SEQ ID NO: 590859 - DNA, 25 bp, Rattus norvegicus
aagtgccggacagcatcgatgcccg

SEQ ID NO: 590860 - DNA, 25 bp, Rattus norvegicus
ccttcagatgccctggccaaagcta

SEQ ID NO: 590861 - DNA, 25 bp, Rattus norvegicus
cgatgcccgggagatcttcgatatc

SEQ ID NO: 590862 - DNA, 25 bp, Rattus norvegicus
agtgatgtgcaacacgctggtggaa

SEQ ID NO: 590863 - DNA, 25 bp, Rattus norvegicus
gccgtaggagcggaagtacacacca

SEQ ID NO: 590864 - DNA, 25 bp, Rattus norvegicus
gccttcttctcgttcccaggaagtg

SEQ ID NO: 590865 - DNA, 25 bp, Rattus norvegicus
cgcttctagcggactacccgctgga

SEQ ID NO: 590866 - DNA, 25 bp, Rattus norvegicus
tgcacgacaaacacaacgcttctag

SEQ ID NO: 590867 - DNA, 25 bp, Rattus norvegicus
gcctttggagtagcctgcacgacaa

SEQ ID NO: 590868 - DNA, 25 bp, Rattus norvegicus
agctaccagcattttcccgcctttg

SEQ ID NO: 590869 - DNA, 25 bp, Rattus norvegicus
agcgcgaccgtcgtcgaggcagcac

SEQ ID NO: 590870 - DNA, 25 bp, Rattus norvegicus
tgccggtggacgagcgagaccttca

SEQ ID NO: 590871 - DNA, 25 bp, Rattus norvegicus
catgccggtggacgagcgagacctt

SEQ ID NO: 590872 - DNA, 25 bp, Rattus norvegicus
cactgcaccgcaggagcatgccggt

SEQ ID NO: 590873 - DNA, 25 bp, Rattus norvegicus
gagcgagaccttcaggcggcgctaa

SEQ ID NO: 590874 - DNA, 25 bp, Rattus norvegicus
tgaccctgaatggaggcagcggagc

SEQ ID NO: 590875 - DNA, 25 bp, Rattus norvegicus
acgatgaccctgaatggaggcagcg

SEQ ID NO: 590876 - DNA, 25 bp, Rattus norvegicus
gcgagaccttcaggcggcgctaacc

SEQ ID NO: 590877 - DNA, 25 bp, Rattus norvegicus
ccgacacgatgaccctgaatggagg

SEQ ID NO: 590878 - DNA, 25 bp, Rattus norvegicus
actgcaccgcaggagcatgccggtg

SEQ ID NO: 590879 - DNA, 25 bp, Rattus norvegicus
gtccgacacgatgaccctgaatgga

SEQ ID NO: 590880 - DNA, 25 bp, Rattus norvegicus
gcgtccgacacgatgaccctgaatg

SEQ ID NO: 590881 - DNA, 25 bp, Rattus norvegicus
cacgatgaccctgaatggaggcagc

SEQ ID NO: 590882 - DNA, 25 bp, Rattus norvegicus
tcgtcgaggcagcaccccatggggc

SEQ ID NO: 590883 - DNA, 25 bp, Rattus norvegicus
ttgcgttctctggagtcgcaggtga

SEQ ID NO: 590884 - DNA, 25 bp, Rattus norvegicus
agcgctttgcacagccggctcagag

SEQ ID NO: 590885 - DNA, 25 bp, Rattus norvegicus
gtttaggctgtacactcacccggag

SEQ ID NO: 590886 - DNA, 25 bp, Rattus norvegicus
ggccctggcagccatagcgctttgc

SEQ ID NO: 590887 - DNA, 25 bp, Rattus norvegicus
ggactgtcactagcgaggcacccgc

SEQ ID NO: 590888 - DNA, 25 bp, Rattus norvegicus
ggccagggaattgcggactgtcact

SEQ ID NO: 590889 - DNA, 25 bp, Rattus norvegicus
acagccggctcagagcgtgtaggac

SEQ ID NO: 590890 - DNA, 25 bp, Rattus norvegicus
caggtgagtggcagtgctctcgtct

SEQ ID NO: 590891 - DNA, 25 bp, Rattus norvegicus
ccggaaggccactgtttaggctgta

SEQ ID NO: 590892 - DNA, 25 bp, Rattus norvegicus
acagctgtggccctccggaaggcca

SEQ ID NO: 590893 - DNA, 25 bp, Rattus norvegicus
tgcgagggacgacaactccggccac

SEQ ID NO: 590894 - DNA, 25 bp, Rattus norvegicus
tccttcgcgaatggggagcctgttg

SEQ ID NO: 590895 - DNA, 25 bp, Rattus norvegicus
ctcacccggagtgtcttatctctgg

SEQ ID NO: 590896 - DNA, 25 bp, Rattus norvegicus
ttatctctggtccttcgcgaatggg

SEQ ID NO: 590897 - DNA, 25 bp, Rattus norvegicus
tcggactccgagtaggctctggttt

SEQ ID NO: 590898 - DNA, 25 bp, Rattus norvegicus
ttgaggtgcgagctagtcctccagc

SEQ ID NO: 590899 - DNA, 25 bp, Rattus norvegicus
agcgattggcggcactttgatagtg

SEQ ID NO: 590900 - DNA, 25 bp, Rattus norvegicus
tcctccggtgccttctcagagagct

SEQ ID NO: 590901 - DNA, 25 bp, Rattus norvegicus
tgggattcctagagtggggtcctcc

SEQ ID NO: 590902 - DNA, 25 bp, Rattus norvegicus
acaagatcgctctctgtgggattcc

SEQ ID NO: 590903 - DNA, 25 bp, Rattus norvegicus
ccgtgatgtctctagggaaagtcga

SEQ ID NO: 590904 - DNA, 25 bp, Rattus norvegicus
agactgctcccgtgatgtctctagg

SEQ ID NO: 590905 - DNA, 25 bp, Rattus norvegicus
agggtcaatgctaactttgagaatc

SEQ ID NO: 590906 - DNA, 25 bp, Rattus norvegicus
ctacgagcggctcggactccgagta

SEQ ID NO: 590907 - DNA, 25 bp, Rattus norvegicus
ctctggtttggactggagtaagctt

SEQ ID NO: 590908 - DNA, 25 bp, Rattus norvegicus
ccttcctaagcttccagcggtgcag

SEQ ID NO: 590909 - DNA, 25 bp, Rattus norvegicus
ggagtaagctttccagggtcaatgc

SEQ ID NO: 590910 - DNA, 25 bp, Rattus norvegicus
tgagaatcaaaccttaccggaaagc

SEQ ID NO: 590911 - DNA, 25 bp, Rattus norvegicus
cggctccacggaggccagctgggca

SEQ ID NO: 590912 - DNA, 25 bp, Rattus norvegicus
ccgacttggcggggattgcgaatct

SEQ ID NO: 590913 - DNA, 25 bp, Rattus norvegicus
gattgcgaatctgggctgtagcatg

SEQ ID NO: 590914 - DNA, 25 bp, Rattus norvegicus
aatctgggctgtagcatgaggaaga

SEQ ID NO: 590915 - DNA, 25 bp, Rattus norvegicus
aggctccttggttggcctccggcct

SEQ ID NO: 590916 - DNA, 25 bp, Rattus norvegicus
ttgcggtctccggtgccctcctggt

SEQ ID NO: 590917 - DNA, 25 bp, Rattus norvegicus
cggctgctgtgagcgcccctcggaa

SEQ ID NO: 590918 - DNA, 25 bp, Rattus norvegicus
cggagagagagcaagcccagcgccc

SEQ ID NO: 590919 - DNA, 25 bp, Rattus norvegicus
ggagcctcgccaggagttcattgtc

SEQ ID NO: 590920 - DNA, 25 bp, Rattus norvegicus
cctcgccaggagttcattgtctgtg

SEQ ID NO: 590921 - DNA, 25 bp, Rattus norvegicus
cacccaggctgtcttccgtcctgac

SEQ ID NO: 590922 - DNA, 25 bp, Rattus norvegicus
ttcattgtctgtgccgcgccggcgg

SEQ ID NO: 590923 - DNA, 25 bp, Rattus norvegicus
caggagttcattgtctgtgccgcgc

SEQ ID NO: 590924 - DNA, 25 bp, Rattus norvegicus
ccctcctggtcactcggggacgcgg

SEQ ID NO: 590925 - DNA, 25 bp, Rattus norvegicus
cgacgcagtaactcagggcctgggc

SEQ ID NO: 590926 - DNA, 25 bp, Rattus norvegicus
tctgcttcgtgacccgcgaaagcct

SEQ ID NO: 590927 - DNA, 25 bp, Rattus norvegicus
gcgaaagcctggtggccttgggaac

SEQ ID NO: 590928 - DNA, 25 bp, Rattus norvegicus
ctcctgcccatggaggcggtcctgg

SEQ ID NO: 590929 - DNA, 25 bp, Rattus norvegicus
tgggactcctttgaggcgccgtcct

SEQ ID NO: 590930 - DNA, 25 bp, Rattus norvegicus
ctttgaggcgccgtcctgggaacgc

SEQ ID NO: 590931 - DNA, 25 bp, Rattus norvegicus
ggctccatggctgcgacgcagtaac

SEQ ID NO: 590932 - DNA, 25 bp, Rattus norvegicus
ctgcgacgcagtaactcagggcctg

SEQ ID NO: 590933 - DNA, 25 bp, Rattus norvegicus
tcagggcctgggcttggcacaaagc

SEQ ID NO: 590934 - DNA, 25 bp, Rattus norvegicus
cctgggcttggcacaaagcggccgc

SEQ ID NO: 590935 - DNA, 25 bp, Rattus norvegicus
ctccggggccctttctgcttcgtga

SEQ ID NO: 590936 - DNA, 25 bp, Rattus norvegicus
gcgccctcagtcctcggagacccag

SEQ ID NO: 590937 - DNA, 25 bp, Rattus norvegicus
tccatggctgcgacgcagtaactca

SEQ ID NO: 590938 - DNA, 25 bp, Rattus norvegicus
cctttctgcttcgtgacccgcgaaa

SEQ ID NO: 590939 - DNA, 25 bp, Rattus norvegicus
tgcagccgcctcttcaaacacaaga

SEQ ID NO: 590940 - DNA, 25 bp, Rattus norvegicus
tgccgtacccttgccagttctgcga

SEQ ID NO: 590941 - DNA, 25 bp, Rattus norvegicus
cagttctgcgacaagtccttcatcc

SEQ ID NO: 590942 - DNA, 25 bp, Rattus norvegicus
tccttcatccgcctgagctacttga

SEQ ID NO: 590943 - DNA, 25 bp, Rattus norvegicus
agctacttgaagaggcatgaacaga

SEQ ID NO: 590944 - DNA, 25 bp, Rattus norvegicus
atgatcggcgatggttgtgaccttg

SEQ ID NO: 590945 - DNA, 25 bp, Rattus norvegicus
agctgccgttcaagtgcaccttctg

SEQ ID NO: 590946 - DNA, 25 bp, Rattus norvegicus
ttcaaacacaagaggagccgggacc

SEQ ID NO: 590947 - DNA, 25 bp, Rattus norvegicus
cgggaccggcacatcaagctgcaca

SEQ ID NO: 590948 - DNA, 25 bp, Rattus norvegicus
cacaggcgacaagaagtaccactgc

SEQ ID NO: 590949 - DNA, 25 bp, Rattus norvegicus
agtaccactgccacgagtgcgaggc

SEQ ID NO: 590950 - DNA, 25 bp, Rattus norvegicus
aagccgttcaagtgcagcgtgtgca

SEQ ID NO: 590951 - DNA, 25 bp, Rattus norvegicus
tcacccacgcagatgatcggcgatg

SEQ ID NO: 590952 - DNA, 25 bp, Rattus norvegicus
tgaacagatccacagcgacaagctg

SEQ ID NO: 590953 - DNA, 25 bp, Rattus norvegicus
gggatcataacatccggcccggaga

SEQ ID NO: 590954 - DNA, 25 bp, Rattus norvegicus
gcactacatgtgtcccatctgtggc

SEQ ID NO: 590955 - DNA, 25 bp, Rattus norvegicus
tgccaagcactacatgtgtcccatc

SEQ ID NO: 590956 - DNA, 25 bp, Rattus norvegicus
gggccctgccaagcactacatgtgt

SEQ ID NO: 590957 - DNA, 25 bp, Rattus norvegicus
tctcggagaacgggctccgggaaca

SEQ ID NO: 590958 - DNA, 25 bp, Rattus norvegicus
ctcggactttcttctcggagaacgg

SEQ ID NO: 590959 - DNA, 25 bp, Rattus norvegicus
tgtgctctcggactttcttctcgga

SEQ ID NO: 590960 - DNA, 25 bp, Rattus norvegicus
gtgtaacgtgtgctctcggactttc

SEQ ID NO: 590961 - DNA, 25 bp, Rattus norvegicus
aaagggcagccacaagtgtaacgtg

SEQ ID NO: 590962 - DNA, 25 bp, Rattus norvegicus
aggcagagttcataaagggcagcca

SEQ ID NO: 590963 - DNA, 25 bp, Rattus norvegicus
cgcaagaaggcagagttcataaagg

SEQ ID NO: 590964 - DNA, 25 bp, Rattus norvegicus
ccggagaggacgatggctcacgcaa

SEQ ID NO: 590965 - DNA, 25 bp, Rattus norvegicus
gactccgggatcataacatccggcc

SEQ ID NO: 590966 - DNA, 25 bp, Rattus norvegicus
ggacgatggctcacgcaagaaggca

SEQ ID NO: 590967 - DNA, 25 bp, Rattus norvegicus
gatgagttcctcaggcgcactgtca

SEQ ID NO: 590968 - DNA, 25 bp, Rattus norvegicus
aagctcgtacacagcccgacatttc

SEQ ID NO: 590969 - DNA, 25 bp, Rattus norvegicus
tcatgacatcgaatagagctaactg

SEQ ID NO: 590970 - DNA, 25 bp, Rattus norvegicus
ccgctccacgagatgagttcctcag

SEQ ID NO: 590971 - DNA, 25 bp, Rattus norvegicus
tcaggcgcactgtcaaaagagaacg

SEQ ID NO: 590972 - DNA, 25 bp, Rattus norvegicus
gtcaaaagagaacgctcacgaagtt

SEQ ID NO: 590973 - DNA, 25 bp, Rattus norvegicus
agttgtgcctgttctcttcccgctc

SEQ ID NO: 590974 - DNA, 25 bp, Rattus norvegicus
ttcccgctcctcttcaagtggattg

SEQ ID NO: 590975 - DNA, 25 bp, Rattus norvegicus
cgctcctcttcaagtggattgaaca

SEQ ID NO: 590976 - DNA, 25 bp, Rattus norvegicus
ctccaattccgtgtgtcatgacatc

SEQ ID NO: 590977 - DNA, 25 bp, Rattus norvegicus
tggattgaacactgggaaaattctc

SEQ ID NO: 590978 - DNA, 25 bp, Rattus norvegicus
cgctcacgaagttgtgcctgttctc

SEQ ID NO: 590979 - DNA, 25 bp, Rattus norvegicus
tttccgaaagtccaccaagctcgta

SEQ ID NO: 590980 - DNA, 25 bp, Rattus norvegicus
atagagctaactgctcacgtttccc

SEQ ID NO: 590981 - DNA, 25 bp, Rattus norvegicus
acctctccgcagaaggcttgccgga

SEQ ID NO: 590982 - DNA, 25 bp, Rattus norvegicus
gttggcagcaacaggaaccgatccc

SEQ ID NO: 590983 - DNA, 25 bp, Rattus norvegicus
ttacagtgaacccaggttggcagca

SEQ ID NO: 590984 - DNA, 25 bp, Rattus norvegicus
catcccttaggaacgacccgaatgg

SEQ ID NO: 590985 - DNA, 25 bp, Rattus norvegicus
agaggcagcctgcaagccatcagag

SEQ ID NO: 590986 - DNA, 25 bp, Rattus norvegicus
cgagcacttcgcattttgttttgta

SEQ ID NO: 590987 - DNA, 25 bp, Rattus norvegicus
cgtgtctcctttcttcgcctttgca

SEQ ID NO: 590988 - DNA, 25 bp, Rattus norvegicus
tcagagtttccttctcgccattgga

SEQ ID NO: 590989 - DNA, 25 bp, Rattus norvegicus
gggacaggcatgctcgccattcttt

SEQ ID NO: 590990 - DNA, 25 bp, Rattus norvegicus
cgcctttgcagaaccacacgatgag

SEQ ID NO: 590991 - DNA, 25 bp, Rattus norvegicus
gccagcacgcacagtgagggacctc

SEQ ID NO: 590992 - DNA, 25 bp, Rattus norvegicus
agggacctcgcgacaggacacctct

SEQ ID NO: 590993 - DNA, 25 bp, Rattus norvegicus
tgcacatctgcggtttcctcctgcg

SEQ ID NO: 590994 - DNA, 25 bp, Rattus norvegicus
tttgtaatgatcgagccgctttctg

SEQ ID NO: 590995 - DNA, 25 bp, Rattus norvegicus
tacagctccggatttatccgagccc

SEQ ID NO: 590996 - DNA, 25 bp, Rattus norvegicus
tttatggcggtgacaaggctgccag

SEQ ID NO: 590997 - DNA, 25 bp, Rattus norvegicus
gtaatgaggtttatggcggtgacaa

SEQ ID NO: 590998 - DNA, 25 bp, Rattus norvegicus
aatcagcggcgaagccggctgctgc

SEQ ID NO: 590999 - DNA, 25 bp, Rattus norvegicus
aagagcttttcacgccgagtgggaa

SEQ ID NO: 591000 - DNA, 25 bp, Rattus norvegicus
gtttaagagcttttcacgccgagtg

SEQ ID NO: 591001 - DNA, 25 bp, Rattus norvegicus
gcgtagggctaaattagtcactgcc

SEQ ID NO: 591002 - DNA, 25 bp, Rattus norvegicus
taccaacagaagatgtgatttgacg

SEQ ID NO: 591003 - DNA, 25 bp, Rattus norvegicus
gtcgcaaagcttcctaaagtggctc

SEQ ID NO: 591004 - DNA, 25 bp, Rattus norvegicus
cagcccaggtgagccctcagtaagt

SEQ ID NO: 591005 - DNA, 25 bp, Rattus norvegicus
gggcgctctacagctccggatttat

SEQ ID NO: 591006 - DNA, 25 bp, Rattus norvegicus
ggccaggatgcactggccgcctgca

SEQ ID NO: 591007 - DNA, 25 bp, Rattus norvegicus
ttcctaaagtggctcggtctggctc

SEQ ID NO: 591008 - DNA, 25 bp, Rattus norvegicus
tgagccctcagtaagtaccaacaga

SEQ ID NO: 591009 - DNA, 25 bp, Rattus norvegicus
actccggatttgtcccgtctgggcg

SEQ ID NO: 591010 - DNA, 25 bp, Rattus norvegicus
atttgtcccgtctgggcggcaccgc

SEQ ID NO: 591011 - DNA, 25 bp, Rattus norvegicus
cctcagttcccggactccggatttg

SEQ ID NO: 591012 - DNA, 25 bp, Rattus norvegicus
ggagcaccctgctgaactagctccg

SEQ ID NO: 591013 - DNA, 25 bp, Rattus norvegicus
tagcctgtacactgacccggagacc

SEQ ID NO: 591014 - DNA, 25 bp, Rattus norvegicus
cctttaatcacatgtagcctgtaca

SEQ ID NO: 591015 - DNA, 25 bp, Rattus norvegicus
cgaggatctcctttaatcacatgta

SEQ ID NO: 591016 - DNA, 25 bp, Rattus norvegicus
gcctagcaccgcgaggatctccttt

SEQ ID NO: 591017 - DNA, 25 bp, Rattus norvegicus
gcaccgagcctagcaccgcgaggat

SEQ ID NO: 591018 - DNA, 25 bp, Rattus norvegicus
gatgacgtcgggctcactcaggccc

SEQ ID NO: 591019 - DNA, 25 bp, Rattus norvegicus
tctgaacaagggcaggatgacgtcg

SEQ ID NO: 591020 - DNA, 25 bp, Rattus norvegicus
tgtagttctgaacaagggcaggatg

SEQ ID NO: 591021 - DNA, 25 bp, Rattus norvegicus
gcaccgcgaggatctcctttaatca

SEQ ID NO: 591022 - DNA, 25 bp, Rattus norvegicus
gcccatccgcgtccgctgctgctag

SEQ ID NO: 591023 - DNA, 25 bp, Rattus norvegicus
cacgctcgctttctaggctcaacaa

SEQ ID NO: 591024 - DNA, 25 bp, Rattus norvegicus
gctgtccaaggttcctgaaagcatc

SEQ ID NO: 591025 - DNA, 25 bp, Rattus norvegicus
ggaataatattcgtggcggcagccc

SEQ ID NO: 591026 - DNA, 25 bp, Rattus norvegicus
gccaaggtggctttctctgccatca

SEQ ID NO: 591027 - DNA, 25 bp, Rattus norvegicus
catgagccgtccgagatgagtaatc

SEQ ID NO: 591028 - DNA, 25 bp, Rattus norvegicus
gagtttcccgttttcttgcagcatc

SEQ ID NO: 591029 - DNA, 25 bp, Rattus norvegicus
tgggatatactctccaggggctctg

SEQ ID NO: 591030 - DNA, 25 bp, Rattus norvegicus
tgaacatcgggaacaactttgactc

SEQ ID NO: 591031 - DNA, 25 bp, Rattus norvegicus
tttgactcagaacgcagcactttca

SEQ ID NO: 591032 - DNA, 25 bp, Rattus norvegicus
ccgcgcaaaggcatctacagtttta

SEQ ID NO: 591033 - DNA, 25 bp, Rattus norvegicus
ctacatggttctttggcttgcactg

SEQ ID NO: 591034 - DNA, 25 bp, Rattus norvegicus
ctcacagacagctagggcctttata

SEQ ID NO: 591035 - DNA, 25 bp, Rattus norvegicus
tttatacggtctctgccacgctcgc

SEQ ID NO: 591036 - DNA, 25 bp, Rattus norvegicus
ccacgtggtgaaagtctacaacaga

SEQ ID NO: 591037 - DNA, 25 bp, Rattus norvegicus
gcccaggccttcttggctggctttt

SEQ ID NO: 591038 - DNA, 25 bp, Rattus norvegicus
agaagacgtcctccgtggtggcttc

SEQ ID NO: 591039 - DNA, 25 bp, Rattus norvegicus
aagacgtcctccgtggtggcttcct

SEQ ID NO: 591040 - DNA, 25 bp, Rattus norvegicus
gtcctccgtggtggcttcctcgcgg

SEQ ID NO: 591041 - DNA, 25 bp, Rattus norvegicus
gcttcctcgcgggtggtccttgcgt

SEQ ID NO: 591042 - DNA, 25 bp, Rattus norvegicus
tgcccttgccgtcctgggcccaggc

SEQ ID NO: 591043 - DNA, 25 bp, Rattus norvegicus
aaatgagaagacgtcctccgtggtg

SEQ ID NO: 591044 - DNA, 25 bp, Rattus norvegicus
ggccttcttggctggcttttctgga

SEQ ID NO: 591045 - DNA, 25 bp, Rattus norvegicus
tcttggctggcttttctggagtggt

SEQ ID NO: 591046 - DNA, 25 bp, Rattus norvegicus
agtggtccgtgcactgggcccatcc

SEQ ID NO: 591047 - DNA, 25 bp, Rattus norvegicus
tggtccgtgcactgggcccatcctg

SEQ ID NO: 591048 - DNA, 25 bp, Rattus norvegicus
tggtttcttcttggcaggcaggcga

SEQ ID NO: 591049 - DNA, 25 bp, Rattus norvegicus
agtgcggcctcgggccttcctggca

SEQ ID NO: 591050 - DNA, 25 bp, Rattus norvegicus
gtggtccttgcgtgcccttgccgtc

SEQ ID NO: 591051 - DNA, 25 bp, Rattus norvegicus
ttcgtccagaagttttgattgtacc

SEQ ID NO: 591052 - DNA, 25 bp, Rattus norvegicus
ggctcccgaagcaccttacactttg

SEQ ID NO: 591053 - DNA, 25 bp, Rattus norvegicus
ttacactttgtaccagcgcctctga

SEQ ID NO: 591054 - DNA, 25 bp, Rattus norvegicus
taccagcgcctctgaacctgaggtc

SEQ ID NO: 591055 - DNA, 25 bp, Rattus norvegicus
tgcgctcattcgtaggattttaaag

SEQ ID NO: 591056 - DNA, 25 bp, Rattus norvegicus
agccaagggtccaggactgagatcc

SEQ ID NO: 591057 - DNA, 25 bp, Rattus norvegicus
gttttgattgtaccgaaacataatg

SEQ ID NO: 591058 - DNA, 25 bp, Rattus norvegicus
agcaaaattgaaataaacgacttcg

SEQ ID NO: 591059 - DNA, 25 bp, Rattus norvegicus
cttcgttttaagtctggaaagctga

SEQ ID NO: 591060 - DNA, 25 bp, Rattus norvegicus
ttaagtctggaaagctgaccctgtg

SEQ ID NO: 591061 - DNA, 25 bp, Rattus norvegicus
ccctgtgttgaacgcgggtgatgca

SEQ ID NO: 591062 - DNA, 25 bp, Rattus norvegicus
acgcgggtgatgcaacgccagaagc

SEQ ID NO: 591063 - DNA, 25 bp, Rattus norvegicus
gtccaggactgagatccgcgacccg

SEQ ID NO: 591064 - DNA, 25 bp, Rattus norvegicus
gcggccagacttgcgattgcgctca

SEQ ID NO: 591065 - DNA, 25 bp, Rattus norvegicus
aagtggtagacctgcctctgagctc

SEQ ID NO: 591066 - DNA, 25 bp, Rattus norvegicus
tgagctctgcccaatgagatccgtc

SEQ ID NO: 591067 - DNA, 25 bp, Rattus norvegicus
ggaaattctcgcctcctgcccagag

SEQ ID NO: 591068 - DNA, 25 bp, Rattus norvegicus
ctagcactgataactcgccgagccg

SEQ ID NO: 591069 - DNA, 25 bp, Rattus norvegicus
cacacctggtggatgagggatgcta

SEQ ID NO: 591070 - DNA, 25 bp, Rattus norvegicus
ttaggaattcccacgcgccctcaga

SEQ ID NO: 591071 - DNA, 25 bp, Rattus norvegicus
cggagcccgacctgagtaagtacta

SEQ ID NO: 591072 - DNA, 25 bp, Rattus norvegicus
gagcgctcggcccagaattagtgga

SEQ ID NO: 591073 - DNA, 25 bp, Rattus norvegicus
cactttaggcagagacctgagcgtc

SEQ ID NO: 591074 - DNA, 25 bp, Rattus norvegicus
gcgtcaacacgcgagccgtactttt

SEQ ID NO: 591075 - DNA, 25 bp, Rattus norvegicus
tccacagctcggagaggcatgaacg

SEQ ID NO: 591076 - DNA, 25 bp, Rattus norvegicus
catgaacgcgatccggaggagacta

SEQ ID NO: 591077 - DNA, 25 bp, Rattus norvegicus
gatccgtggacattagccgctctcg

SEQ ID NO: 591078 - DNA, 25 bp, Rattus norvegicus
ctcgtgagcgaccagcgaaaagttg

SEQ ID NO: 591079 - DNA, 25 bp, Rattus norvegicus
agctgagtgtctaaatcggccgggc

SEQ ID NO: 591080 - DNA, 25 bp, Rattus norvegicus
ggtctcttcgatccctggcgtcaga

SEQ ID NO: 591081 - DNA, 25 bp, Rattus norvegicus
gaggtctccgcggtctcttcgatcc

SEQ ID NO: 591082 - DNA, 25 bp, Rattus norvegicus
ggcggagcatgtcccggcttcctgc

SEQ ID NO: 591083 - DNA, 25 bp, Rattus norvegicus
gagtgtctaaatcggccgggcccgc

SEQ ID NO: 591084 - DNA, 25 bp, Rattus norvegicus
ccctggcgtcagatcgatggcctgc

SEQ ID NO: 591085 - DNA, 25 bp, Rattus norvegicus
ctcggcgcaattagagctgagtgtc

SEQ ID NO: 591086 - DNA, 25 bp, Rattus norvegicus
agaagcacatcctctcggcgcgggt

SEQ ID NO: 591087 - DNA, 25 bp, Rattus norvegicus
gcctggcgacagagaagcacatcct

SEQ ID NO: 591088 - DNA, 25 bp, Rattus norvegicus
agcaattgggcctggcgacagagaa

SEQ ID NO: 591089 - DNA, 25 bp, Rattus norvegicus
ccgataagtgagagcaattgggcct

SEQ ID NO: 591090 - DNA, 25 bp, Rattus norvegicus
gaggccaagcactgcgcctggcttc

SEQ ID NO: 591091 - DNA, 25 bp, Rattus norvegicus
ccgggctggcgaaacccgataagtg

SEQ ID NO: 591092 - DNA, 25 bp, Rattus norvegicus
atggcctgcgcggttgtgtgcttcc

SEQ ID NO: 591093 - DNA, 25 bp, Rattus norvegicus
cgtagtatgttcgtcccgggagcct

SEQ ID NO: 591094 - DNA, 25 bp, Rattus norvegicus
acgcttgcccacaatcaatatggtg

SEQ ID NO: 591095 - DNA, 25 bp, Rattus norvegicus
caatatggtgacagcgtgtggcgtc

SEQ ID NO: 591096 - DNA, 25 bp, Rattus norvegicus
ctgcagttgctaagctgcggcggcc

SEQ ID NO: 591097 - DNA, 25 bp, Rattus norvegicus
tagtgctggatgagttcacggcgcc

SEQ ID NO: 591098 - DNA, 25 bp, Rattus norvegicus
tgcctgcgcgcatctggctgcagct

SEQ ID NO: 591099 - DNA, 25 bp, Rattus norvegicus
acagcgccaaggtgagtccagcctg

SEQ ID NO: 591100 - DNA, 25 bp, Rattus norvegicus
ccgcctgtcccttggatgtgcgcaa

SEQ ID NO: 591101 - DNA, 25 bp, Rattus norvegicus
cctatttgtaaagggcgctgcgaga

SEQ ID NO: 591102 - DNA, 25 bp, Rattus norvegicus
gctgcgagagcatctcccttactgg

SEQ ID NO: 591103 - DNA, 25 bp, Rattus norvegicus
tcccttactggtagtccctctcgaa

SEQ ID NO: 591104 - DNA, 25 bp, Rattus norvegicus
gtccctctcgaagtgcgcagaatta

SEQ ID NO: 591105 - DNA, 25 bp, Rattus norvegicus
cgcagaattagagcgatcaggcctc

SEQ ID NO: 591106 - DNA, 25 bp, Rattus norvegicus
ggagcctcggtgtccctatttgtaa

SEQ ID NO: 591107 - DNA, 25 bp, Rattus norvegicus
cggccgccgcagtgtgtggtactta

SEQ ID NO: 591108 - DNA, 25 bp, Rattus norvegicus
gcctttaagcctaagccttgctccg

SEQ ID NO: 591109 - DNA, 25 bp, Rattus norvegicus
cccagcttcctttgcgggatagttc

SEQ ID NO: 591110 - DNA, 25 bp, Rattus norvegicus
tgggccgctccagcctttaagccta

SEQ ID NO: 591111 - DNA, 25 bp, Rattus norvegicus
tcccttgtttatgtcgccacgagcg

SEQ ID NO: 591112 - DNA, 25 bp, Rattus norvegicus
tgcggggaagaacgcagcctcctcc

SEQ ID NO: 591113 - DNA, 25 bp, Rattus norvegicus
cgccctcgctcagtctttgttgtgc

SEQ ID NO: 591114 - DNA, 25 bp, Rattus norvegicus
caccgcgggaaccagtagcgcggta

SEQ ID NO: 591115 - DNA, 25 bp, Rattus norvegicus
tccggtaaccgaagcgtctcgacgc

SEQ ID NO: 591116 - DNA, 25 bp, Rattus norvegicus
atgctcggggtgcagctccggtaac

SEQ ID NO: 591117 - DNA, 25 bp, Rattus norvegicus
tcaattccataggaagggcccgaga

SEQ ID NO: 591118 - DNA, 25 bp, Rattus norvegicus
ggccggcgcaaaaccaagtcaattc

SEQ ID NO: 591119 - DNA, 25 bp, Rattus norvegicus
acgctcccagatgcaacttagtgtg

SEQ ID NO: 591120 - DNA, 25 bp, Rattus norvegicus
cgcgcctttattgtgcggggaagaa

SEQ ID NO: 591121 - DNA, 25 bp, Rattus norvegicus
agccaggcagcaacacactctcatg

SEQ ID NO: 591122 - DNA, 25 bp, Rattus norvegicus
gcgtcactcccacttttcacgttga

SEQ ID NO: 591123 - DNA, 25 bp, Rattus norvegicus
cacgttgaggagactgagacacagc

SEQ ID NO: 591124 - DNA, 25 bp, Rattus norvegicus
agacacagctatgctcacgggccgc

SEQ ID NO: 591125 - DNA, 25 bp, Rattus norvegicus
actcctaggatggtgctctgcaacg

SEQ ID NO: 591126 - DNA, 25 bp, Rattus norvegicus
ctgcaacgacgtgcccttgagcaaa

SEQ ID NO: 591127 - DNA, 25 bp, Rattus norvegicus
ggtcactagcgaaaagcgtcactcc

SEQ ID NO: 591128 - DNA, 25 bp, Rattus norvegicus
acggctccgcaccagctgcaagtta

SEQ ID NO: 591129 - DNA, 25 bp, Rattus norvegicus
ggccgtgtccacacttgtgcgcata

SEQ ID NO: 591130 - DNA, 25 bp, Rattus norvegicus
actctcatgggtcaacagcagcgga

SEQ ID NO: 591131 - DNA, 25 bp, Rattus norvegicus
ggaggacatggccacgccgttaaca

SEQ ID NO: 591132 - DNA, 25 bp, Rattus norvegicus
tcaggaggactccagctaccaactc

SEQ ID NO: 591133 - DNA, 25 bp, Rattus norvegicus
gcgcaccacagctgtaacactacgg

SEQ ID NO: 591134 - DNA, 25 bp, Rattus norvegicus
tcccgggctcaaactctgacgcttt

SEQ ID NO: 591135 - DNA, 25 bp, Rattus norvegicus
cgctgctgttcttgggactcgcgct

SEQ ID NO: 591136 - DNA, 25 bp, Rattus norvegicus
aacagacggacctcttcgtgctgcg

SEQ ID NO: 591137 - DNA, 25 bp, Rattus norvegicus
ggtgacctcaactccgacaaacaga

SEQ ID NO: 591138 - DNA, 25 bp, Rattus norvegicus
tgctccggcacaggctctacacaat

SEQ ID NO: 591139 - DNA, 25 bp, Rattus norvegicus
gtgctttgcggctgccgtcaagcgc

SEQ ID NO: 591140 - DNA, 25 bp, Rattus norvegicus
tcttttctcggtcggccggttgcac

SEQ ID NO: 591141 - DNA, 25 bp, Rattus norvegicus
tgagaatacaacgaggggctgcccg

SEQ ID NO: 591142 - DNA, 25 bp, Rattus norvegicus
cccagggcagcgtgagaatacaacg

SEQ ID NO: 591143 - DNA, 25 bp, Rattus norvegicus
tctctgggtcgtcggagaaacagcc

SEQ ID NO: 591144 - DNA, 25 bp, Rattus norvegicus
gcagacgtcgccctaactccttggt

SEQ ID NO: 591145 - DNA, 25 bp, Rattus norvegicus
tgagctctctcaggcagacgtcgcc

SEQ ID NO: 591146 - DNA, 25 bp, Rattus norvegicus
agccagccggaagtgagctctctca

SEQ ID NO: 591147 - DNA, 25 bp, Rattus norvegicus
cgacactgtcgggaggcaagccagc

SEQ ID NO: 591148 - DNA, 25 bp, Rattus norvegicus
tctacacaatgtcacggccgagctc

SEQ ID NO: 591149 - DNA, 25 bp, Rattus norvegicus
atcagcgaggctgagcagacgtttt

SEQ ID NO: 591150 - DNA, 25 bp, Rattus norvegicus
caactgagctcgagttgctccgagc

SEQ ID NO: 591151 - DNA, 25 bp, Rattus norvegicus
gttttcaagcaactgagctcgagtt

SEQ ID NO: 591152 - DNA, 25 bp, Rattus norvegicus
gacgttttcaagcaactgagctcga

SEQ ID NO: 591153 - DNA, 25 bp, Rattus norvegicus
agcagacgttttcaagcaactgagc

SEQ ID NO: 591154 - DNA, 25 bp, Rattus norvegicus
ctgagcagacgttttcaagcaactg

SEQ ID NO: 591155 - DNA, 25 bp, Rattus norvegicus
cgaggctgagcagacgttttcaagc

SEQ ID NO: 591156 - DNA, 25 bp, Rattus norvegicus
actgagctcgagttgctccgagcgg

SEQ ID NO: 591157 - DNA, 25 bp, Rattus norvegicus
caccgccggctttcctcagcgcgcc

SEQ ID NO: 591158 - DNA, 25 bp, Rattus norvegicus
cacttcaagggagcccgccgcagga

SEQ ID NO: 591159 - DNA, 25 bp, Rattus norvegicus
cccggcgcgcgccacttcaagggag

SEQ ID NO: 591160 - DNA, 25 bp, Rattus norvegicus
cgctcgctgcttaaatgagccgggg

SEQ ID NO: 591161 - DNA, 25 bp, Rattus norvegicus
ccgaggcttcgagaagaccccggca

SEQ ID NO: 591162 - DNA, 25 bp, Rattus norvegicus
gctgcgctcgctgcttaaatgagcc

SEQ ID NO: 591163 - DNA, 25 bp, Rattus norvegicus
aagctactcagaggccaagtctccg

SEQ ID NO: 591164 - DNA, 25 bp, Rattus norvegicus
aatcctgctgccttgtgggtcctgt

SEQ ID NO: 591165 - DNA, 25 bp, Rattus norvegicus
cgacagcaccgagctcctaaagcta

SEQ ID NO: 591166 - DNA, 25 bp, Rattus norvegicus
cccggttgccgcctcggaaagtgat

SEQ ID NO: 591167 - DNA, 25 bp, Rattus norvegicus
cgagctcctaaagctactcagaggc

SEQ ID NO: 591168 - DNA, 25 bp, Rattus norvegicus
gtagcggccggcgaaccgacagcac

SEQ ID NO: 591169 - DNA, 25 bp, Rattus norvegicus
tcgccgaatcctgctgccttgtggg

SEQ ID NO: 591170 - DNA, 25 bp, Rattus norvegicus
cgccttcccgggatcgccgaatcct

SEQ ID NO: 591171 - DNA, 25 bp, Rattus norvegicus
aggctgcggcaccactgcgggctcc

SEQ ID NO: 591172 - DNA, 25 bp, Rattus norvegicus
gacgcccgtgggtcccacctgctgc

SEQ ID NO: 591173 - DNA, 25 bp, Rattus norvegicus
agtgattgcacaccgaccacaaagc

SEQ ID NO: 591174 - DNA, 25 bp, Rattus norvegicus
ggaaagtgattgcacaccgaccaca

SEQ ID NO: 591175 - DNA, 25 bp, Rattus norvegicus
tgccgcctcggaaagtgattgcaca

SEQ ID NO: 591176 - DNA, 25 bp, Rattus norvegicus
gaaccgacagcaccgagctcctaaa

SEQ ID NO: 591177 - DNA, 25 bp, Rattus norvegicus
ggccttgtggcaacgtcatggcgct

SEQ ID NO: 591178 - DNA, 25 bp, Rattus norvegicus
cgtcatggcgctgcgccgggtcaaa

SEQ ID NO: 591179 - DNA, 25 bp, Rattus norvegicus
aagctgtacgacatcctgggcgtcc

SEQ ID NO: 591180 - DNA, 25 bp, Rattus norvegicus
aacgagctgaagaaggtactggagc

SEQ ID NO: 591181 - DNA, 25 bp, Rattus norvegicus
tcggctctggctgaccttgggcctc

SEQ ID NO: 591182 - DNA, 25 bp, Rattus norvegicus
gtaccaccctaggaggattccacgc

SEQ ID NO: 591183 - DNA, 25 bp, Rattus norvegicus
aggaggattccacgccggcttcttt

SEQ ID NO: 591184 - DNA, 25 bp, Rattus norvegicus
gcctcagccgcagcgagagttcctt

SEQ ID NO: 591185 - DNA, 25 bp, Rattus norvegicus
agccgcagcgagagttccttacgaa

SEQ ID NO: 591186 - DNA, 25 bp, Rattus norvegicus
ccatggcgaacgtggccgacacgaa

SEQ ID NO: 591187 - DNA, 25 bp, Rattus norvegicus
tcgcctacgggcgtcaggaaaggac

SEQ ID NO: 591188 - DNA, 25 bp, Rattus norvegicus
ggccgacacgaagctgtacgacatc

SEQ ID NO: 591189 - DNA, 25 bp, Rattus norvegicus
agttccttacgaacgccgtcatccg

SEQ ID NO: 591190 - DNA, 25 bp, Rattus norvegicus
ccggcgccagcgagaacgagctgaa

SEQ ID NO: 591191 - DNA, 25 bp, Rattus norvegicus
cttcccagttgtttggctccggcga

SEQ ID NO: 591192 - DNA, 25 bp, Rattus norvegicus
ggcgctttgccgcagtcattaataa

SEQ ID NO: 591193 - DNA, 25 bp, Rattus norvegicus
ggagtagccacttttttctaattca

SEQ ID NO: 591194 - DNA, 25 bp, Rattus norvegicus
gacttccttgtgatctctttagagg

SEQ ID NO: 591195 - DNA, 25 bp, Rattus norvegicus
atagcctccaactgcgatggccgcg

SEQ ID NO: 591196 - DNA, 25 bp, Rattus norvegicus
tgggcgcaaagtaactccatggacg

SEQ ID NO: 591197 - DNA, 25 bp, Rattus norvegicus
tcagccctccagtccagagctggtg

SEQ ID NO: 591198 - DNA, 25 bp, Rattus norvegicus
cctgctgggaagatggtcagccctc

SEQ ID NO: 591199 - DNA, 25 bp, Rattus norvegicus
gctggctcttaccttgctccgcggt

SEQ ID NO: 591200 - DNA, 25 bp, Rattus norvegicus
gagcactggcagatctgttgaaaaa

SEQ ID NO: 591201 - DNA, 25 bp, Rattus norvegicus
ccgcgctggcttcctagaacaggca

SEQ ID NO: 591202 - DNA, 25 bp, Rattus norvegicus
ggctgaccaacatgcgcaatctctc

SEQ ID NO: 591203 - DNA, 25 bp, Rattus norvegicus
ttaataaagaaggtcgccaggctca

SEQ ID NO: 591204 - DNA, 25 bp, Rattus norvegicus
gtactctttaaaacacggctgacca

SEQ ID NO: 591205 - DNA, 25 bp, Rattus norvegicus
tcggctgcagcgctgctgtgactac

SEQ ID NO: 591206 - DNA, 25 bp, Rattus norvegicus
cttcacctgcgggttcatggactcc

SEQ ID NO: 591207 - DNA, 25 bp, Rattus norvegicus
gctacgctctggtcgcaccttgagc

SEQ ID NO: 591208 - DNA, 25 bp, Rattus norvegicus
gatctcgccggccttgagcacgatg

SEQ ID NO: 591209 - DNA, 25 bp, Rattus norvegicus
ctgcatcgcgaatcttccgaggtta

SEQ ID NO: 591210 - DNA, 25 bp, Rattus norvegicus
gagagcaagacatcgcgtacagccc

SEQ ID NO: 591211 - DNA, 25 bp, Rattus norvegicus
atgtggacaccagtcctccagcagc

SEQ ID NO: 591212 - DNA, 25 bp, Rattus norvegicus
agctccggggctggatttccatccc

SEQ ID NO: 591213 - DNA, 25 bp, Rattus norvegicus
agcaccaaaacgctacaccgctagg

SEQ ID NO: 591214 - DNA, 25 bp, Rattus norvegicus
ctacaccgctaggttgccgggtctg

SEQ ID NO: 591215 - DNA, 25 bp, Rattus norvegicus
ccgggtctgtgcctaatgtgcgtat

SEQ ID NO: 591216 - DNA, 25 bp, Rattus norvegicus
tgtgcgtatgcaacgtgcctctctc

SEQ ID NO: 591217 - DNA, 25 bp, Rattus norvegicus
caccgcgccgtttatggtgagcctg

SEQ ID NO: 591218 - DNA, 25 bp, Rattus norvegicus
ttcatggactccagggtgaggatgc

SEQ ID NO: 591219 - DNA, 25 bp, Rattus norvegicus
tcggcccacctgtgcgttggttggt

SEQ ID NO: 591220 - DNA, 25 bp, Rattus norvegicus
agccaaggcgctgcttccacagctg

SEQ ID NO: 591221 - DNA, 25 bp, Rattus norvegicus
tgcttccacagctgctcaggagggg

SEQ ID NO: 591222 - DNA, 25 bp, Rattus norvegicus
ggagcatgtctgcaactcgagccaa

SEQ ID NO: 591223 - DNA, 25 bp, Rattus norvegicus
gtctgcaactcgagccaagaaagtg

SEQ ID NO: 591224 - DNA, 25 bp, Rattus norvegicus
ccaagaaagtgaagatggccaccaa

SEQ ID NO: 591225 - DNA, 25 bp, Rattus norvegicus
tggccaccaaatcgtgcccggagtg

SEQ ID NO: 591226 - DNA, 25 bp, Rattus norvegicus
aatcgtgcccggagtgcgaccaaca

SEQ ID NO: 591227 - DNA, 25 bp, Rattus norvegicus
ccctgcggtccctgatggctttgtt

SEQ ID NO: 591228 - DNA, 25 bp, Rattus norvegicus
tccctgatggctttgttcgcggtcg

SEQ ID NO: 591229 - DNA, 25 bp, Rattus norvegicus
cagcggagccaaggcgctgcttcca

SEQ ID NO: 591230 - DNA, 25 bp, Rattus norvegicus
ctcaggaggggagcatgtctgcaac

SEQ ID NO: 591231 - DNA, 25 bp, Rattus norvegicus
cgagcgagcggtccaccgccttgga

SEQ ID NO: 591232 - DNA, 25 bp, Rattus norvegicus
gtggagtctcgttggagccacgccc

SEQ ID NO: 591233 - DNA, 25 bp, Rattus norvegicus
agtgtccttgcgagtttccatgatc

SEQ ID NO: 591234 - DNA, 25 bp, Rattus norvegicus
tcacaggtttcgtaggcgttgatta

SEQ ID NO: 591235 - DNA, 25 bp, Rattus norvegicus
tggccgagggaaatgtgaccacatg

SEQ ID NO: 591236 - DNA, 25 bp, Rattus norvegicus
aaatctggcggtgctgtgtagaagc

SEQ ID NO: 591237 - DNA, 25 bp, Rattus norvegicus
gggccatcctctcgccgattggcta

SEQ ID NO: 591238 - DNA, 25 bp, Rattus norvegicus
tccaagatgcggactcagcacagtg

SEQ ID NO: 591239 - DNA, 25 bp, Rattus norvegicus
attgtgactctcgactgcacccgga

SEQ ID NO: 591240 - DNA, 25 bp, Rattus norvegicus
cctttcctgcatcgctggacagaga

SEQ ID NO: 591241 - DNA, 25 bp, Rattus norvegicus
tggaccctgggaaacctgcacccta

SEQ ID NO: 591242 - DNA, 25 bp, Rattus norvegicus
tccgcgctcacaagcttcacaggtt

SEQ ID NO: 591243 - DNA, 25 bp, Rattus norvegicus
tgtcttcaccttttaggagcccgcg

SEQ ID NO: 591244 - DNA, 25 bp, Rattus norvegicus
ccacgcccagggaagtcactgtctt

SEQ ID NO: 591245 - DNA, 25 bp, Rattus norvegicus
ccatgatctccgtggaggtgtcgtc

SEQ ID NO: 591246 - DNA, 25 bp, Rattus norvegicus
gatccggcttgcatccgtgaccttg

SEQ ID NO: 591247 - DNA, 25 bp, Rattus norvegicus
tgggccaatcgaaacgcctctaccg

SEQ ID NO: 591248 - DNA, 25 bp, Rattus norvegicus
acgcgagactttatgtgggccaatc

SEQ ID NO: 591249 - DNA, 25 bp, Rattus norvegicus
gtccatagctcgctgctacgctgta

SEQ ID NO: 591250 - DNA, 25 bp, Rattus norvegicus
cggtcataaggttctatcgctgctc

SEQ ID NO: 591251 - DNA, 25 bp, Rattus norvegicus
gcccagacgtagtggacggtcataa

SEQ ID NO: 591252 - DNA, 25 bp, Rattus norvegicus
gcacacgatgatgcgctggcccaga

SEQ ID NO: 591253 - DNA, 25 bp, Rattus norvegicus
tcctggtctttcttctacgcatgtg

SEQ ID NO: 591254 - DNA, 25 bp, Rattus norvegicus
cgcgtccagattggttgcgacaaga

SEQ ID NO: 591255 - DNA, 25 bp, Rattus norvegicus
cgcgcgcagactgtcagagggataa

SEQ ID NO: 591256 - DNA, 25 bp, Rattus norvegicus
tccattgatggacgaaatgcgcgcc

SEQ ID NO: 591257 - DNA, 25 bp, Rattus norvegicus
gtgccttacaagatccgactccatt

SEQ ID NO: 591258 - DNA, 25 bp, Rattus norvegicus
tcagggccgtttccctacatgcacg

SEQ ID NO: 591259 - DNA, 25 bp, Rattus norvegicus
tttggaggactcagggccacagtca

SEQ ID NO: 591260 - DNA, 25 bp, Rattus norvegicus
taggtttcgatcgagacccgtcttg

SEQ ID NO: 591261 - DNA, 25 bp, Rattus norvegicus
gtacagtggccacggctacgaagtg

SEQ ID NO: 591262 - DNA, 25 bp, Rattus norvegicus
gtcctgtaaccgctgcctactgttc

SEQ ID NO: 591263 - DNA, 25 bp, Rattus norvegicus
gagctgccgcggaaacaattgaaga

SEQ ID NO: 591264 - DNA, 25 bp, Rattus norvegicus
caattgaagacactggactgcggac

SEQ ID NO: 591265 - DNA, 25 bp, Rattus norvegicus
tgcgagccgtgcgatttaatggtaa

SEQ ID NO: 591266 - DNA, 25 bp, Rattus norvegicus
cgatttaatggtaagcgactccgcc

SEQ ID NO: 591267 - DNA, 25 bp, Rattus norvegicus
agcgactccgccttcatcttgggca

SEQ ID NO: 591268 - DNA, 25 bp, Rattus norvegicus
cctactgttcccagtggatggcaac

SEQ ID NO: 591269 - DNA, 25 bp, Rattus norvegicus
tggatggcaactactgcctgacgtg

SEQ ID NO: 591270 - DNA, 25 bp, Rattus norvegicus
cctgacgtgcggcagcgataaaacc

SEQ ID NO: 591271 - DNA, 25 bp, Rattus norvegicus
agcgataaaaccctaaagctgtgga

SEQ ID NO: 591272 - DNA, 25 bp, Rattus norvegicus
acgctgctgcggacgtacagtggcc

SEQ ID NO: 591273 - DNA, 25 bp, Rattus norvegicus
cggctacgaagtgctcgatgcggcc

SEQ ID NO: 591274 - DNA, 25 bp, Rattus norvegicus
ctaaagctgtggaacccgctgcgtg

SEQ ID NO: 591275 - DNA, 25 bp, Rattus norvegicus
tgaagtcgtaaccttggacctgggc

SEQ ID NO: 591276 - DNA, 25 bp, Rattus norvegicus
tccagaagcgcgtggtaatctaccc

SEQ ID NO: 591277 - DNA, 25 bp, Rattus norvegicus
tgcttgagcacagcggccagcgccg

SEQ ID NO: 591278 - DNA, 25 bp, Rattus norvegicus
actagttaaccaggactccgcctct

SEQ ID NO: 591279 - DNA, 25 bp, Rattus norvegicus
cggcgcctcaccatggcgttgactt

SEQ ID NO: 591280 - DNA, 25 bp, Rattus norvegicus
accatggcgttgacttgctgcaccg

SEQ ID NO: 591281 - DNA, 25 bp, Rattus norvegicus
tggtgccgtaggcttccagaagcgc

SEQ ID NO: 591282 - DNA, 25 bp, Rattus norvegicus
gcggaacactagttaaccaggactc

SEQ ID NO: 591283 - DNA, 25 bp, Rattus norvegicus
caacgctgagctgtgcttgagcaca

SEQ ID NO: 591284 - DNA, 25 bp, Rattus norvegicus
tcggccgttctctggtcacagcagt

SEQ ID NO: 591285 - DNA, 25 bp, Rattus norvegicus
tcacagcagtctcggtgccctggaa

SEQ ID NO: 591286 - DNA, 25 bp, Rattus norvegicus
cttggtccgccggagcccaggaaat

SEQ ID NO: 591287 - DNA, 25 bp, Rattus norvegicus
ccggagcccaggaaatgcgactcgg

SEQ ID NO: 591288 - DNA, 25 bp, Rattus norvegicus
accgcgcgcccgaagttggtggcct

SEQ ID NO: 591289 - DNA, 25 bp, Rattus norvegicus
tcacgcacgaggttgtgcagcgctt

SEQ ID NO: 591290 - DNA, 25 bp, Rattus norvegicus
gcgtgctacataggcctcagcttga

SEQ ID NO: 591291 - DNA, 25 bp, Rattus norvegicus
ctccaggtgactcgatcacgcacga

SEQ ID NO: 591292 - DNA, 25 bp, Rattus norvegicus
gccggtactttggaggcatcctttc

SEQ ID NO: 591293 - DNA, 25 bp, Rattus norvegicus
cgcgcatccaggtaggcacagatct

SEQ ID NO: 591294 - DNA, 25 bp, Rattus norvegicus
cacgcacggcaggacatgaagcacg

SEQ ID NO: 591295 - DNA, 25 bp, Rattus norvegicus
gtttcctaggcagcgcgagatcact

SEQ ID NO: 591296 - DNA, 25 bp, Rattus norvegicus
aacatggactgcagtgacgagcgcc

SEQ ID NO: 591297 - DNA, 25 bp, Rattus norvegicus
atcctttcgctctggcatgcccagg

SEQ ID NO: 591298 - DNA, 25 bp, Rattus norvegicus
agggccgcgtcttgtttcctaggca

SEQ ID NO: 591299 - DNA, 25 bp, Rattus norvegicus
aggattcccacactgccctgaggga

SEQ ID NO: 591300 - DNA, 25 bp, Rattus norvegicus
gggtccgactcgtcctcacaagagc

SEQ ID NO: 591301 - DNA, 25 bp, Rattus norvegicus
cggcgcaggttagatgacgtcagaa

SEQ ID NO: 591302 - DNA, 25 bp, Rattus norvegicus
acgtcagaaaccacccgccagatta

SEQ ID NO: 591303 - DNA, 25 bp, Rattus norvegicus
aagccctctggccttaagtctgacg

SEQ ID NO: 591304 - DNA, 25 bp, Rattus norvegicus
tcagatctggccaagcctctctagc

SEQ ID NO: 591305 - DNA, 25 bp, Rattus norvegicus
tgaatgagagccagtcaaaaccgcc

SEQ ID NO: 591306 - DNA, 25 bp, Rattus norvegicus
gcaatcccgataagtctccaatgtc

SEQ ID NO: 591307 - DNA, 25 bp, Rattus norvegicus
ggctcagtccacgaggattcccttc

SEQ ID NO: 591308 - DNA, 25 bp, Rattus norvegicus
ggcccagtgactctccttaaccaga

SEQ ID NO: 591309 - DNA, 25 bp, Rattus norvegicus
ctttctgacctagacgcggcccagt

SEQ ID NO: 591310 - DNA, 25 bp, Rattus norvegicus
tacaagctcagtagacgccacatgc

SEQ ID NO: 591311 - DNA, 25 bp, Rattus norvegicus
ttctaggtccctaagcgcccagatc

SEQ ID NO: 591312 - DNA, 25 bp, Rattus norvegicus
tcgcagtcagactcagcaaagccct

SEQ ID NO: 591313 - DNA, 25 bp, Rattus norvegicus
gcagcttcccttaaagagtcccgca

SEQ ID NO: 591314 - DNA, 25 bp, Rattus norvegicus
tgctgacggatctctggcagttccc

SEQ ID NO: 591315 - DNA, 25 bp, Rattus norvegicus
cctcctagattcctgagctcttcta

SEQ ID NO: 591316 - DNA, 25 bp, Rattus norvegicus
ccagcggtctttcaggtgaaggctc

SEQ ID NO: 591317 - DNA, 25 bp, Rattus norvegicus
ccaacgcaatttcccggttctcagg

SEQ ID NO: 591318 - DNA, 25 bp, Rattus norvegicus
gaggactgccttggatctgacgccc

SEQ ID NO: 591319 - DNA, 25 bp, Rattus norvegicus
aggacttcgggaaaggctctcacac

SEQ ID NO: 591320 - DNA, 25 bp, Rattus norvegicus
ccagatgccgcgcaaaggacttcgg

SEQ ID NO: 591321 - DNA, 25 bp, Rattus norvegicus
gcagccattttgtggccagatgccg

SEQ ID NO: 591322 - DNA, 25 bp, Rattus norvegicus
gtctccctcgggcagccattttgtg

SEQ ID NO: 591323 - DNA, 25 bp, Rattus norvegicus
aaaggctctcacaccgcgcgcttgg

SEQ ID NO: 591324 - DNA, 25 bp, Rattus norvegicus
aacgaccgggatcgtccaggcagcc

SEQ ID NO: 591325 - DNA, 25 bp, Rattus norvegicus
tcaagattctcagcaaacgaccggg

SEQ ID NO: 591326 - DNA, 25 bp, Rattus norvegicus
cgtccggaatccaggctcaagattc

SEQ ID NO: 591327 - DNA, 25 bp, Rattus norvegicus
atacacctctcgtccggaatccagg

SEQ ID NO: 591328 - DNA, 25 bp, Rattus norvegicus
agagattcccattcccgcccagata

SEQ ID NO: 591329 - DNA, 25 bp, Rattus norvegicus
tcaggtcccgcgagtaacatctaga

SEQ ID NO: 591330 - DNA, 25 bp, Rattus norvegicus
tcccgcgagtaacatctagagattc

SEQ ID NO: 591331 - DNA, 25 bp, Rattus norvegicus
ccacgcttagcaatatcatcgagca

SEQ ID NO: 591332 - DNA, 25 bp, Rattus norvegicus
tcccgatcccggtaaagcgagctaa

SEQ ID NO: 591333 - DNA, 25 bp, Rattus norvegicus
tggctctacggggttgtttctctcc

SEQ ID NO: 591334 - DNA, 25 bp, Rattus norvegicus
aagcagaagagttcgaggatgcacc

SEQ ID NO: 591335 - DNA, 25 bp, Rattus norvegicus
tggagccactggaacccacgcttag

SEQ ID NO: 591336 - DNA, 25 bp, Rattus norvegicus
attagtcacgtgagccgggtccaag

SEQ ID NO: 591337 - DNA, 25 bp, Rattus norvegicus
tcatcgagcagcgtagccttaagtg

SEQ ID NO: 591338 - DNA, 25 bp, Rattus norvegicus
tagccttaagtggatcttcgtcggg

SEQ ID NO: 591339 - DNA, 25 bp, Rattus norvegicus
gcaaaggaggcgttggtaagaccac

SEQ ID NO: 591340 - DNA, 25 bp, Rattus norvegicus
cgttggtaagaccacctgcaggtaa

SEQ ID NO: 591341 - DNA, 25 bp, Rattus norvegicus
cacctgcaggtaaggagactctagc

SEQ ID NO: 591342 - DNA, 25 bp, Rattus norvegicus
agactctagcggagccaagaggacg

SEQ ID NO: 591343 - DNA, 25 bp, Rattus norvegicus
agcgagctaaccatggctctacggg

SEQ ID NO: 591344 - DNA, 25 bp, Rattus norvegicus
aggatgcacctgacgtggagccact

SEQ ID NO: 591345 - DNA, 25 bp, Rattus norvegicus
cctactcggagagcgagaagcaatg

SEQ ID NO: 591346 - DNA, 25 bp, Rattus norvegicus
gtgggtcgcactaggcctccgagcc

SEQ ID NO: 591347 - DNA, 25 bp, Rattus norvegicus
ccacgagggcgctccaggtaggtcc

SEQ ID NO: 591348 - DNA, 25 bp, Rattus norvegicus
aggtaggtccaccagagcactcgca

SEQ ID NO: 591349 - DNA, 25 bp, Rattus norvegicus
agagcactcgcactcagtcacggtc

SEQ ID NO: 591350 - DNA, 25 bp, Rattus norvegicus
agtcacggtcgctctagccttgcgg

SEQ ID NO: 591351 - DNA, 25 bp, Rattus norvegicus
tccgcggtggagaagctagtttccg

SEQ ID NO: 591352 - DNA, 25 bp, Rattus norvegicus
agaagctagtttccggcgtgcggca

SEQ ID NO: 591353 - DNA, 25 bp, Rattus norvegicus
aggctgccgacttcgccgagcagtt

SEQ ID NO: 591354 - DNA, 25 bp, Rattus norvegicus
gagcagttccgttcctactcggaga

SEQ ID NO: 591355 - DNA, 25 bp, Rattus norvegicus
agaagcaatggaaagcgcgcatgga

SEQ ID NO: 591356 - DNA, 25 bp, Rattus norvegicus
aaagcgcgcatggagtttatcctgc

SEQ ID NO: 591357 - DNA, 25 bp, Rattus norvegicus
ggagtttatcctgcgccacctgcct

SEQ ID NO: 591358 - DNA, 25 bp, Rattus norvegicus
ttcgccgagcagttccgttcctact

SEQ ID NO: 591359 - DNA, 25 bp, Rattus norvegicus
cgacgacgacttcgagaccaacttt

SEQ ID NO: 591360 - DNA, 25 bp, Rattus norvegicus
gatcacgcaccgtgagggctctacc

SEQ ID NO: 591361 - DNA, 25 bp, Rattus norvegicus
attgaccgcaacttccaggtcagcg

SEQ ID NO: 591362 - DNA, 25 bp, Rattus norvegicus
caggtcagcgtctccagttttctaa

SEQ ID NO: 591363 - DNA, 25 bp, Rattus norvegicus
tccagttttctaagatgatcccaga

SEQ ID NO: 591364 - DNA, 25 bp, Rattus norvegicus
ctaaacgcccgtcactctttgatca

SEQ ID NO: 591365 - DNA, 25 bp, Rattus norvegicus
cgtcactctttgatcacgcaccgtg

SEQ ID NO: 591366 - DNA, 25 bp, Rattus norvegicus
ctagcggtagatgagatgtatgacg

SEQ ID NO: 591367 - DNA, 25 bp, Rattus norvegicus
gatgtatgacgacttggccatgttg

SEQ ID NO: 591368 - DNA, 25 bp, Rattus norvegicus
tggccatgttggaaaaagatctata

SEQ ID NO: 591369 - DNA, 25 bp, Rattus norvegicus
ctatactgggatgcagcggaagctc

SEQ ID NO: 591370 - DNA, 25 bp, Rattus norvegicus
gcagcggaagctcgagcgccctaca

SEQ ID NO: 591371 - DNA, 25 bp, Rattus norvegicus
gagaccaactttcttattgaccgca

SEQ ID NO: 591372 - DNA, 25 bp, Rattus norvegicus
ccaggtgtccatgctagcggtagat

SEQ ID NO: 591373 - DNA, 25 bp, Rattus norvegicus
gagcctcccgcatgtcctgagccgc

SEQ ID NO: 591374 - DNA, 25 bp, Rattus norvegicus
cgcctgtcactcttgcggcgaaaga

SEQ ID NO: 591375 - DNA, 25 bp, Rattus norvegicus
ctcttgcggcgaaagaacagctgcg

SEQ ID NO: 591376 - DNA, 25 bp, Rattus norvegicus
gcggcgaaagaacagctgcgtgtcc

SEQ ID NO: 591377 - DNA, 25 bp, Rattus norvegicus
aagaacagctgcgtgtccgaggcct

SEQ ID NO: 591378 - DNA, 25 bp, Rattus norvegicus
aggcctccaccgcagccagctgcag

SEQ ID NO: 591379 - DNA, 25 bp, Rattus norvegicus
ttgagtgcggttgtggcgatccatt

SEQ ID NO: 591380 - DNA, 25 bp, Rattus norvegicus
ctgcgggaacctgagctggagcctc

SEQ ID NO: 591381 - DNA, 25 bp, Rattus norvegicus
cctgaaccttttaccgctgtgtcga

SEQ ID NO: 591382 - DNA, 25 bp, Rattus norvegicus
cgctgtgtcgattcccgggcctcgg

SEQ ID NO: 591383 - DNA, 25 bp, Rattus norvegicus
gttgtggcgatccattgctcgaccc

SEQ ID NO: 591384 - DNA, 25 bp, Rattus norvegicus
ccttttaccgctgtgtcgattcccg

SEQ ID NO: 591385 - DNA, 25 bp, Rattus norvegicus
aactcctgaaccttttaccgctgtg

SEQ ID NO: 591386 - DNA, 25 bp, Rattus norvegicus
tttaccgctgtgtcgattcccgggc

SEQ ID NO: 591387 - DNA, 25 bp, Rattus norvegicus
ggtccgccaccagcgagcgcccgaa

SEQ ID NO: 591388 - DNA, 25 bp, Rattus norvegicus
atactcatggctccggatcgaattc

SEQ ID NO: 591389 - DNA, 25 bp, Rattus norvegicus
agcgagcgcccgaagcccagacctc

SEQ ID NO: 591390 - DNA, 25 bp, Rattus norvegicus
tctcttccaattgcaagcgcttgcc

SEQ ID NO: 591391 - DNA, 25 bp, Rattus norvegicus
gctctgcctagagcgccgccctgct

SEQ ID NO: 591392 - DNA, 25 bp, Rattus norvegicus
ccagacacgtgatctcttccaattg

SEQ ID NO: 591393 - DNA, 25 bp, Rattus norvegicus
cgtgatctcttccaattgcaagcgc

SEQ ID NO: 591394 - DNA, 25 bp, Rattus norvegicus
agctcggccttgtccatactcatgg

SEQ ID NO: 591395 - DNA, 25 bp, Rattus norvegicus
ttgtccatactcatggctccggatc

SEQ ID NO: 591396 - DNA, 25 bp, Rattus norvegicus
gacctacccaggtgagcagagaccc

SEQ ID NO: 591397 - DNA, 25 bp, Rattus norvegicus
gcagagacccgcatagctcggcctt

SEQ ID NO: 591398 - DNA, 25 bp, Rattus norvegicus
gagacccgcatagctcggccttgtc

SEQ ID NO: 591399 - DNA, 25 bp, Rattus norvegicus
gcatagctcggccttgtccatactc

SEQ ID NO: 591400 - DNA, 25 bp, Rattus norvegicus
tccgacctacccaggtgagcagaga

SEQ ID NO: 591401 - DNA, 25 bp, Rattus norvegicus
cagggatcactggaagcctttccca

SEQ ID NO: 591402 - DNA, 25 bp, Rattus norvegicus
gcctttcccagagcgtcgggactca

SEQ ID NO: 591403 - DNA, 25 bp, Rattus norvegicus
aggagtttcctgtgtccagcgctgc

SEQ ID NO: 591404 - DNA, 25 bp, Rattus norvegicus
cacctcgaaggcagatggatgtctt

SEQ ID NO: 591405 - DNA, 25 bp, Rattus norvegicus
atggatgtcttcgagtcccaaatcg

SEQ ID NO: 591406 - DNA, 25 bp, Rattus norvegicus
cgaagttcccaacgtctacccattg

SEQ ID NO: 591407 - DNA, 25 bp, Rattus norvegicus
cggcaattggcttgagcccgcaaaa

SEQ ID NO: 591408 - DNA, 25 bp, Rattus norvegicus
agcccgcaaaataggagtctggatt

SEQ ID NO: 591409 - DNA, 25 bp, Rattus norvegicus
agttgctagcaggagccctggtttc

SEQ ID NO: 591410 - DNA, 25 bp, Rattus norvegicus
gccctggtttcttcctcgacttctg

SEQ ID NO: 591411 - DNA, 25 bp, Rattus norvegicus
ttaaatccgcgggtatccgtcagcg

SEQ ID NO: 591412 - DNA, 25 bp, Rattus norvegicus
tcgggcgccattttgtcgagaaaca

SEQ ID NO: 591413 - DNA, 25 bp, Rattus norvegicus
cccttagggctgatgagcggcaatt

SEQ ID NO: 591414 - DNA, 25 bp, Rattus norvegicus
agttgcagccgactcgtagcgcttt

SEQ ID NO: 591415 - DNA, 25 bp, Rattus norvegicus
tcgttcgtgacgtgagacacgaagg

SEQ ID NO: 591416 - DNA, 25 bp, Rattus norvegicus
cgtgacgtgagacacgaaggagttc

SEQ ID NO: 591417 - DNA, 25 bp, Rattus norvegicus
tgacgtgagacacgaaggagttcgc

SEQ ID NO: 591418 - DNA, 25 bp, Rattus norvegicus
cgtgagacacgaaggagttcgctgc

SEQ ID NO: 591419 - DNA, 25 bp, Rattus norvegicus
tgagacacgaaggagttcgctgcgt

SEQ ID NO: 591420 - DNA, 25 bp, Rattus norvegicus
agacacgaaggagttcgctgcgtgc

SEQ ID NO: 591421 - DNA, 25 bp, Rattus norvegicus
acacgaaggagttcgctgcgtgcgt

SEQ ID NO: 591422 - DNA, 25 bp, Rattus norvegicus
ggtagtactgcggaacgagagactt

SEQ ID NO: 591423 - DNA, 25 bp, Rattus norvegicus
tagtactgcggaacgagagactttg

SEQ ID NO: 591424 - DNA, 25 bp, Rattus norvegicus
gtactgcggaacgagagactttgga

SEQ ID NO: 591425 - DNA, 25 bp, Rattus norvegicus
tactgcggaacgagagactttggag

SEQ ID NO: 591426 - DNA, 25 bp, Rattus norvegicus
cgtcgttcgtgacgtgagacacgaa

SEQ ID NO: 591427 - DNA, 25 bp, Rattus norvegicus
cgtgcgtcgttcgtgacgtgagaca

SEQ ID NO: 591428 - DNA, 25 bp, Rattus norvegicus
tgcgtcgttcgtgacgtgagacacg

SEQ ID NO: 591429 - DNA, 25 bp, Rattus norvegicus
tctgcaccctctggaggttccggga

SEQ ID NO: 591430 - DNA, 25 bp, Rattus norvegicus
gtcgcggcgcttccgcctttaaaga

SEQ ID NO: 591431 - DNA, 25 bp, Rattus norvegicus
ggaagaccaggagcgcatcaaagtg

SEQ ID NO: 591432 - DNA, 25 bp, Rattus norvegicus
gctgtcaagtactgccggcctccta

SEQ ID NO: 591433 - DNA, 25 bp, Rattus norvegicus
gcctcctacgggagcaagtggcgca

SEQ ID NO: 591434 - DNA, 25 bp, Rattus norvegicus
gcgcagctcaagcagaaggtcatga

SEQ ID NO: 591435 - DNA, 25 bp, Rattus norvegicus
ccacgtcagcaacggctgccagttg

SEQ ID NO: 591436 - DNA, 25 bp, Rattus norvegicus
ctgccagttgctgctaggggtcaag

SEQ ID NO: 591437 - DNA, 25 bp, Rattus norvegicus
aagggacacgccttctgagagcctc

SEQ ID NO: 591438 - DNA, 25 bp, Rattus norvegicus
gggcgcagctcacacactggactct

SEQ ID NO: 591439 - DNA, 25 bp, Rattus norvegicus
gtccttccacctcgaggtttacatg

SEQ ID NO: 591440 - DNA, 25 bp, Rattus norvegicus
tggtactcagcctgtggggatacta

SEQ ID NO: 591441 - DNA, 25 bp, Rattus norvegicus
tgcggacggttttgtcaaagccctg

SEQ ID NO: 591442 - DNA, 25 bp, Rattus norvegicus
gccctggacgacctgcacaagatga

SEQ ID NO: 591443 - DNA, 25 bp, Rattus norvegicus
agccttttatgcgtggcccaaacca

SEQ ID NO: 591444 - DNA, 25 bp, Rattus norvegicus
gacagtaccgcggtcgcatccattg

SEQ ID NO: 591445 - DNA, 25 bp, Rattus norvegicus
cggtcgcatccattgcggctgcaga

SEQ ID NO: 591446 - DNA, 25 bp, Rattus norvegicus
agacgcggcccggtccacaagcttg

SEQ ID NO: 591447 - DNA, 25 bp, Rattus norvegicus
cggtccacaagcttgcccaagggtt

SEQ ID NO: 591448 - DNA, 25 bp, Rattus norvegicus
cacaagcttgcccaagggttggatg

SEQ ID NO: 591449 - DNA, 25 bp, Rattus norvegicus
tgtccttagggacgccgggattgtc

SEQ ID NO: 591450 - DNA, 25 bp, Rattus norvegicus
attgtctgtgctgtgggttccgcgc

SEQ ID NO: 591451 - DNA, 25 bp, Rattus norvegicus
caagagccggacacgcggacgacca

SEQ ID NO: 591452 - DNA, 25 bp, Rattus norvegicus
gcggacgaccagacacgagcagaga

SEQ ID NO: 591453 - DNA, 25 bp, Rattus norvegicus
gacaggaaagagatctcagaaccga

SEQ ID NO: 591454 - DNA, 25 bp, Rattus norvegicus
ctaggcccgggagccttttatgcgt

SEQ ID NO: 591455 - DNA, 25 bp, Rattus norvegicus
ccaaaccacagcaggcagggcgcgg

SEQ ID NO: 591456 - DNA, 25 bp, Rattus norvegicus
agaaccgagagagccctaggcccgg

SEQ ID NO: 591457 - DNA, 25 bp, Rattus norvegicus
tgtgcctcaaggagccgtgcgtcct

SEQ ID NO: 591458 - DNA, 25 bp, Rattus norvegicus
tgtacctgccgtgtgcctcaaggag

SEQ ID NO: 591459 - DNA, 25 bp, Rattus norvegicus
ctgagttctcctgtacctgccgtgt

SEQ ID NO: 591460 - DNA, 25 bp, Rattus norvegicus
gagggacaatacaggccgttgtcgc

SEQ ID NO: 591461 - DNA, 25 bp, Rattus norvegicus
ccgttgtcgcctgagttctcctgta

SEQ ID NO: 591462 - DNA, 25 bp, Rattus norvegicus
cgacagcagcgcgtgcgtaagcgtc

SEQ ID NO: 591463 - DNA, 25 bp, Rattus norvegicus
aagcgtccacgccagagagcgcgta

SEQ ID NO: 591464 - DNA, 25 bp, Rattus norvegicus
cctgcgagccgattggtcagcatca

SEQ ID NO: 591465 - DNA, 25 bp, Rattus norvegicus
gtcagcatcaagagccgctgctgta

SEQ ID NO: 591466 - DNA, 25 bp, Rattus norvegicus
cgctgctgtattcgcggaaaacgcg

SEQ ID NO: 591467 - DNA, 25 bp, Rattus norvegicus
ggaaaacgcgcgctggcatctgcgc

SEQ ID NO: 591468 - DNA, 25 bp, Rattus norvegicus
tctgcgcctgcagtactgttttcta

SEQ ID NO: 591469 - DNA, 25 bp, Rattus norvegicus
ttctacggttgttggctgttgcaga

SEQ ID NO: 591470 - DNA, 25 bp, Rattus norvegicus
ctcagcgaactggagagggacaata

SEQ ID NO: 591471 - DNA, 25 bp, Rattus norvegicus
attctggcctgatccgccgccggag

SEQ ID NO: 591472 - DNA, 25 bp, Rattus norvegicus
catggacgattctggcctgatccgc

SEQ ID NO: 591473 - DNA, 25 bp, Rattus norvegicus
gccgccatggacgattctggcctga

SEQ ID NO: 591474 - DNA, 25 bp, Rattus norvegicus
ggaggggctgcatcctagcgcgccc

SEQ ID NO: 591475 - DNA, 25 bp, Rattus norvegicus
atcgccgccgccatggacgattctg

SEQ ID NO: 591476 - DNA, 25 bp, Rattus norvegicus
tccgcgagtcctggcagcgcggacc

SEQ ID NO: 591477 - DNA, 25 bp, Rattus norvegicus
tcgcccgggtatcccggaggctgct

SEQ ID NO: 591478 - DNA, 25 bp, Rattus norvegicus
aggctgcaggtacgccgcagcccgg

SEQ ID NO: 591479 - DNA, 25 bp, Rattus norvegicus
ctcgaccgaagagtgcggtgtccgc

SEQ ID NO: 591480 - DNA, 25 bp, Rattus norvegicus
cagaggatgctctcgaccgaagagt

SEQ ID NO: 591481 - DNA, 25 bp, Rattus norvegicus
cttcgtactgccagaggatgctctc

SEQ ID NO: 591482 - DNA, 25 bp, Rattus norvegicus
agaacttgcgccagggtcgccagtg

SEQ ID NO: 591483 - DNA, 25 bp, Rattus norvegicus
acgcaggagaacttgcgccagggtc

SEQ ID NO: 591484 - DNA, 25 bp, Rattus norvegicus
ggccgagcagaacgcaggagaactt

SEQ ID NO: 591485 - DNA, 25 bp, Rattus norvegicus
gcgggactttgtctctgacgcaaga

SEQ ID NO: 591486 - DNA, 25 bp, Rattus norvegicus
cgggtccatccgctgtccgtgaaaa

SEQ ID NO: 591487 - DNA, 25 bp, Rattus norvegicus
gctgcggcaaagctaaagtactaca

SEQ ID NO: 591488 - DNA, 25 bp, Rattus norvegicus
tccgctgtccgtgaaaacgctggta

SEQ ID NO: 591489 - DNA, 25 bp, Rattus norvegicus
tccgtgaaaacgctggtactgggcg

SEQ ID NO: 591490 - DNA, 25 bp, Rattus norvegicus
ctgcacggggtgtgtcctggtcctt

SEQ ID NO: 591491 - DNA, 25 bp, Rattus norvegicus
ctggtccttggaaccggcgccgaat

SEQ ID NO: 591492 - DNA, 25 bp, Rattus norvegicus
actttgtctctgacgcaagactccg

SEQ ID NO: 591493 - DNA, 25 bp, Rattus norvegicus
ttggctcaacgccacgcgggacttt

SEQ ID NO: 591494 - DNA, 25 bp, Rattus norvegicus
ggagcctaggcttctcgacgtcttc

SEQ ID NO: 591495 - DNA, 25 bp, Rattus norvegicus
aaaggagtatgagtcttgagtacgg

SEQ ID NO: 591496 - DNA, 25 bp, Rattus norvegicus
actacagcggctaagcgggtccatc

SEQ ID NO: 591497 - DNA, 25 bp, Rattus norvegicus
ggcttctcgacgtcttcctcgcggt

SEQ ID NO: 591498 - DNA, 25 bp, Rattus norvegicus
ggcgccgaatcccattggctcaacg

SEQ ID NO: 591499 - DNA, 25 bp, Rattus norvegicus
tgacgccatcagaacaagtcacgtg

SEQ ID NO: 591500 - DNA, 25 bp, Rattus norvegicus
tgggatgacgtcaggtcacgtgacc

SEQ ID NO: 591501 - DNA, 25 bp, Rattus norvegicus
cgccctacagtccatagcttcggga

SEQ ID NO: 591502 - DNA, 25 bp, Rattus norvegicus
aaccacgtgtgcctgtgacgccatc

SEQ ID NO: 591503 - DNA, 25 bp, Rattus norvegicus
accgctagcggcgttgtcaacaatc

SEQ ID NO: 591504 - DNA, 25 bp, Rattus norvegicus
tgcatccggagcctgagatttcggg

SEQ ID NO: 591505 - DNA, 25 bp, Rattus norvegicus
gtcgctagtttcaagttcggccgga

SEQ ID NO: 591506 - DNA, 25 bp, Rattus norvegicus
ggcttcttggctgtgaggaactatg

SEQ ID NO: 591507 - DNA, 25 bp, Rattus norvegicus
tccgccagtaccaccgctgggagga

SEQ ID NO: 591508 - DNA, 25 bp, Rattus norvegicus
tgaaatcccgcatgagcctcctacg

SEQ ID NO: 591509 - DNA, 25 bp, Rattus norvegicus
ccttaccgcttgaaatcccgcatga

SEQ ID NO: 591510 - DNA, 25 bp, Rattus norvegicus
tattgggctaagacgagggccctta

SEQ ID NO: 591511 - DNA, 25 bp, Rattus norvegicus
agcttcgggaagaggccgtcatatt

SEQ ID NO: 591512 - DNA, 25 bp, Rattus norvegicus
ggagcgaagtatctagaaccacgtg

SEQ ID NO: 591513 - DNA, 25 bp, Rattus norvegicus
accgcggacagtgcgggtcgtccta

SEQ ID NO: 591514 - DNA, 25 bp, Rattus norvegicus
gtttgcggcgcctttgtttgcggac

SEQ ID NO: 591515 - DNA, 25 bp, Rattus norvegicus
ggacctccgggtgaagacaccctgc

SEQ ID NO: 591516 - DNA, 25 bp, Rattus norvegicus
cagctgcgccagaggtgtccgcgct

SEQ ID NO: 591517 - DNA, 25 bp, Rattus norvegicus
cgactggccgcagtagcagggccct

SEQ ID NO: 591518 - DNA, 25 bp, Rattus norvegicus
ccgggatgctgctagctgtccagct

SEQ ID NO: 591519 - DNA, 25 bp, Rattus norvegicus
tgaagacaccctgccggctgctgcg

SEQ ID NO: 591520 - DNA, 25 bp, Rattus norvegicus
tttcgccgcaccaagaggtagaccc

SEQ ID NO: 591521 - DNA, 25 bp, Rattus norvegicus
ggcagcatgtttcgccgcaccaaga

SEQ ID NO: 591522 - DNA, 25 bp, Rattus norvegicus
tttccaatttctcgatgccctcctt

SEQ ID NO: 591523 - DNA, 25 bp, Rattus norvegicus
gaccgcgctttccaatttctcgatg

SEQ ID NO: 591524 - DNA, 25 bp, Rattus norvegicus
gccgccgggtcatgtctgactctct

SEQ ID NO: 591525 - DNA, 25 bp, Rattus norvegicus
tttgtttgcggacgctgtgggctca

SEQ ID NO: 591526 - DNA, 25 bp, Rattus norvegicus
gtctgactctctctggaccgcgctt

SEQ ID NO: 591527 - DNA, 25 bp, Rattus norvegicus
gcgcctacgaacctgacagcgtgct

SEQ ID NO: 591528 - DNA, 25 bp, Rattus norvegicus
tcgggttcctacaccggccaagagc

SEQ ID NO: 591529 - DNA, 25 bp, Rattus norvegicus
ctcctcctacgacaacgaaatcgtg

SEQ ID NO: 591530 - DNA, 25 bp, Rattus norvegicus
accatgtgtacaaggagcggttccc

SEQ ID NO: 591531 - DNA, 25 bp, Rattus norvegicus
agcggttcccgaaggtgagacaagc

SEQ ID NO: 591532 - DNA, 25 bp, Rattus norvegicus
gcgcagactccggtgaccacaactt

SEQ ID NO: 591533 - DNA, 25 bp, Rattus norvegicus
ggtgaccacaacttcccagagcttt

SEQ ID NO: 591534 - DNA, 25 bp, Rattus norvegicus
agagctttgcatccctgtaccgctg

SEQ ID NO: 591535 - DNA, 25 bp, Rattus norvegicus
caggccaccgcgcagatggaagaga

SEQ ID NO: 591536 - DNA, 25 bp, Rattus norvegicus
gcttcatccaccaccagatcattga

SEQ ID NO: 591537 - DNA, 25 bp, Rattus norvegicus
accaagtcccgcgatgggctcatca

SEQ ID NO: 591538 - DNA, 25 bp, Rattus norvegicus
tgggctcatcaccacggtctatttc

SEQ ID NO: 591539 - DNA, 25 bp, Rattus norvegicus
tggcccgagactgccttaccaagtc

SEQ ID NO: 591540 - DNA, 25 bp, Rattus norvegicus
tgctgcaggacgtgagtgccaatta

SEQ ID NO: 591541 - DNA, 25 bp, Rattus norvegicus
acccgtttgtggtcggcatgttctg

SEQ ID NO: 591542 - DNA, 25 bp, Rattus norvegicus
gcaccgggacacacggcagcgcttt

SEQ ID NO: 591543 - DNA, 25 bp, Rattus norvegicus
tgttctgctcctttgagacccggcg

SEQ ID NO: 591544 - DNA, 25 bp, Rattus norvegicus
cgctttgccatgaagaagatcaaca

SEQ ID NO: 591545 - DNA, 25 bp, Rattus norvegicus
gaagaagatcaacaaacagaacttg

SEQ ID NO: 591546 - DNA, 25 bp, Rattus norvegicus
cagaacttgatccttcgcaaccaga

SEQ ID NO: 591547 - DNA, 25 bp, Rattus norvegicus
atccttcgcaaccagatccagcagg

SEQ ID NO: 591548 - DNA, 25 bp, Rattus norvegicus
caggcgttcgtggagcgtgacatcc

SEQ ID NO: 591549 - DNA, 25 bp, Rattus norvegicus
cacgtttgccgagaacccgtttgtg

SEQ ID NO: 591550 - DNA, 25 bp, Rattus norvegicus
gtcggcatgttctgctcctttgaga

SEQ ID NO: 591551 - DNA, 25 bp, Rattus norvegicus
aggtgatggccggtcctcgctctct

SEQ ID NO: 591552 - DNA, 25 bp, Rattus norvegicus
cagggctgtctacctggtgcggcac

SEQ ID NO: 591553 - DNA, 25 bp, Rattus norvegicus
gtgacatcctcacgtttgccgagaa

SEQ ID NO: 591554 - DNA, 25 bp, Rattus norvegicus
cggcagcgctttgccatgaagaaga

SEQ ID NO: 591555 - DNA, 25 bp, Rattus norvegicus
tgaaccggtctttgtcgtccagcga

SEQ ID NO: 591556 - DNA, 25 bp, Rattus norvegicus
agcgacagtcttcctggttcgccca

SEQ ID NO: 591557 - DNA, 25 bp, Rattus norvegicus
ccgttgctacccgatggtgtccaga

SEQ ID NO: 591558 - DNA, 25 bp, Rattus norvegicus
tgcatagcctcgctgagtccgatgg

SEQ ID NO: 591559 - DNA, 25 bp, Rattus norvegicus
tgggtcaccctgatttccgaaagga

SEQ ID NO: 591560 - DNA, 25 bp, Rattus norvegicus
acacagtctggaagtgggtcaccct

SEQ ID NO: 591561 - DNA, 25 bp, Rattus norvegicus
gggagcattgcgcaaacacagtctg

SEQ ID NO: 591562 - DNA, 25 bp, Rattus norvegicus
tgggcagctcccataccacgcagag

SEQ ID NO: 591563 - DNA, 25 bp, Rattus norvegicus
gcgcgctgtaaatcggctggcaaca

SEQ ID NO: 591564 - DNA, 25 bp, Rattus norvegicus
cgccagtatcgttcagcgcgctgta

SEQ ID NO: 591565 - DNA, 25 bp, Rattus norvegicus
tctgcacgggctgtcaccgaaacta

SEQ ID NO: 591566 - DNA, 25 bp, Rattus norvegicus
tctgcaggtgcctcgtcacagagta

SEQ ID NO: 591567 - DNA, 25 bp, Rattus norvegicus
tgtccagagacctatggcgtcaggc

SEQ ID NO: 591568 - DNA, 25 bp, Rattus norvegicus
caccgaggtgctcagaatgtttgca

SEQ ID NO: 591569 - DNA, 25 bp, Rattus norvegicus
cgacctcaccggctggttctgtgct

SEQ ID NO: 591570 - DNA, 25 bp, Rattus norvegicus
gaagacagcgggtgaacgtccaagc

SEQ ID NO: 591571 - DNA, 25 bp, Rattus norvegicus
gtgaacgtccaagcgcgactccctt

SEQ ID NO: 591572 - DNA, 25 bp, Rattus norvegicus
tcacctcgctcgagcaggtcgctga

SEQ ID NO: 591573 - DNA, 25 bp, Rattus norvegicus
gaccgcggcactgcgaacagcagct

SEQ ID NO: 591574 - DNA, 25 bp, Rattus norvegicus
ggctcaccagcaccttgggactcag

SEQ ID NO: 591575 - DNA, 25 bp, Rattus norvegicus
cactcgcgtgcaccagcgcaggaag

SEQ ID NO: 591576 - DNA, 25 bp, Rattus norvegicus
aggaagccggccactgcgtcactct

SEQ ID NO: 591577 - DNA, 25 bp, Rattus norvegicus
cggagctcggtgtcccttctaaacg

SEQ ID NO: 591578 - DNA, 25 bp, Rattus norvegicus
gtcccttctaaacggctccagcttg

SEQ ID NO: 591579 - DNA, 25 bp, Rattus norvegicus
aacggctccagcttgggaatcgcgc

SEQ ID NO: 591580 - DNA, 25 bp, Rattus norvegicus
tgtgctgtctgcacccgagttctgg

SEQ ID NO: 591581 - DNA, 25 bp, Rattus norvegicus
tgcagctcgtggagcagcgccagca

SEQ ID NO: 591582 - DNA, 25 bp, Rattus norvegicus
cgcctcgctctagggaagacagcgg

SEQ ID NO: 591583 - DNA, 25 bp, Rattus norvegicus
cacggatgcccacgcagtctgcgag

SEQ ID NO: 591584 - DNA, 25 bp, Rattus norvegicus
agctcagctccggataggcttcacc

SEQ ID NO: 591585 - DNA, 25 bp, Rattus norvegicus
agctcctgcttttggcgagctcagc

SEQ ID NO: 591586 - DNA, 25 bp, Rattus norvegicus
ctgaagttgtcccagcagcgaaccc

SEQ ID NO: 591587 - DNA, 25 bp, Rattus norvegicus
cggggcttcctctgaagttgtccca

SEQ ID NO: 591588 - DNA, 25 bp, Rattus norvegicus
gggtcacgagcttcagaccaacttc

SEQ ID NO: 591589 - DNA, 25 bp, Rattus norvegicus
cgacagtaatgaactctgaaagacc

SEQ ID NO: 591590 - DNA, 25 bp, Rattus norvegicus
tcggtgctgccatgaagcgacagta

SEQ ID NO: 591591 - DNA, 25 bp, Rattus norvegicus
ccaacagcagcgagctcggtgctgc

SEQ ID NO: 591592 - DNA, 25 bp, Rattus norvegicus
ggcttcggcaggaacccacagcagc

SEQ ID NO: 591593 - DNA, 25 bp, Rattus norvegicus
cccatagcagctcagggcttcggca

SEQ ID NO: 591594 - DNA, 25 bp, Rattus norvegicus
gggacattcttgcaaccacttgctc

SEQ ID NO: 591595 - DNA, 25 bp, Rattus norvegicus
cggataggcttcacccacggacgcg

SEQ ID NO: 591596 - DNA, 25 bp, Rattus norvegicus
acgcagtctgcgagggacattcttg

SEQ ID NO: 591597 - DNA, 25 bp, Rattus norvegicus
agaccgctcgcgattcggagaatgc

SEQ ID NO: 591598 - DNA, 25 bp, Rattus norvegicus
tttgctccgtttccggttccagatc

SEQ ID NO: 591599 - DNA, 25 bp, Rattus norvegicus
cagccctgtccttaccggtgtgcgt

SEQ ID NO: 591600 - DNA, 25 bp, Rattus norvegicus
cttggtgtagctcttcccgcatcct

SEQ ID NO: 591601 - DNA, 25 bp, Rattus norvegicus
tgccgcctgcctcttttgtgccaga

SEQ ID NO: 591602 - DNA, 25 bp, Rattus norvegicus
gagttctgtgcccaccgcaccaggt

SEQ ID NO: 591603 - DNA, 25 bp, Rattus norvegicus
cgcaccaggtcccagacaattcaaa

SEQ ID NO: 591604 - DNA, 25 bp, Rattus norvegicus
ggtatcccgacagcagcccataggg

SEQ ID NO: 591605 - DNA, 25 bp, Rattus norvegicus
tgggccacccgcataagcgctcaga

SEQ ID NO: 591606 - DNA, 25 bp, Rattus norvegicus
agatccggatcccacgcacaggtca

SEQ ID NO: 591607 - DNA, 25 bp, Rattus norvegicus
tctccgggagggtcctctgatttca

SEQ ID NO: 591608 - DNA, 25 bp, Rattus norvegicus
cagactcacgtgaaaggacggttcc

SEQ ID NO: 591609 - DNA, 25 bp, Rattus norvegicus
ggcccaaatcctgtgtctcctcaga

SEQ ID NO: 591610 - DNA, 25 bp, Rattus norvegicus
cgagcccacgaaagagctggaaatg

SEQ ID NO: 591611 - DNA, 25 bp, Rattus norvegicus
aagcagttaggcctgtcactcctca

SEQ ID NO: 591612 - DNA, 25 bp, Rattus norvegicus
agggcagacctcgtggaataaacca

SEQ ID NO: 591613 - DNA, 25 bp, Rattus norvegicus
cacgtgctgaatgaaccgcgctctg

SEQ ID NO: 591614 - DNA, 25 bp, Rattus norvegicus
acacgggaaaccagcgcctcacgta

SEQ ID NO: 591615 - DNA, 25 bp, Rattus norvegicus
agcatgtgtgggaagtctcgtatcc

SEQ ID NO: 591616 - DNA, 25 bp, Rattus norvegicus
gcggcgctaaccctgaggaacagtc

SEQ ID NO: 591617 - DNA, 25 bp, Rattus norvegicus
cccggagtccaggaaaagcagttag

SEQ ID NO: 591618 - DNA, 25 bp, Rattus norvegicus
tctacctgcgtgttgggtaacctca

SEQ ID NO: 591619 - DNA, 25 bp, Rattus norvegicus
gcgccactgagctaggtgtctcctc

SEQ ID NO: 591620 - DNA, 25 bp, Rattus norvegicus
ctcgtggttctcattctgctgatgc

SEQ ID NO: 591621 - DNA, 25 bp, Rattus norvegicus
cacagtgagttgtcttcgcccggct

SEQ ID NO: 591622 - DNA, 25 bp, Rattus norvegicus
cgctaagaccttcccgccgattgta

SEQ ID NO: 591623 - DNA, 25 bp, Rattus norvegicus
cccagcgcttcgttagtcaggaaac

SEQ ID NO: 591624 - DNA, 25 bp, Rattus norvegicus
tctccacaatcgctggcggttcctg

SEQ ID NO: 591625 - DNA, 25 bp, Rattus norvegicus
cgccatggctatccctagcgcattt

SEQ ID NO: 591626 - DNA, 25 bp, Rattus norvegicus
atactcacttcacccagagcctgga

SEQ ID NO: 591627 - DNA, 25 bp, Rattus norvegicus
gagcctggaggctcttcacagcgcc

SEQ ID NO: 591628 - DNA, 25 bp, Rattus norvegicus
accactgcctggtgctccacgccca

SEQ ID NO: 591629 - DNA, 25 bp, Rattus norvegicus
acgcccagctgcgtagccaactccg

SEQ ID NO: 591630 - DNA, 25 bp, Rattus norvegicus
tgtccaggccgccatcagctacctc

SEQ ID NO: 591631 - DNA, 25 bp, Rattus norvegicus
ggtggagcatgcgtcgccattttta

SEQ ID NO: 591632 - DNA, 25 bp, Rattus norvegicus
ctatccctagcgcatttaacgtgtg

SEQ ID NO: 591633 - DNA, 25 bp, Rattus norvegicus
catttaacgtgtgtaggccgccgga

SEQ ID NO: 591634 - DNA, 25 bp, Rattus norvegicus
atgtggcataagtacgggcgatttg

SEQ ID NO: 591635 - DNA, 25 bp, Rattus norvegicus
cagcaactgctccaagacgggatta

SEQ ID NO: 591636 - DNA, 25 bp, Rattus norvegicus
gcgtcgccatttttaatgtggcata

SEQ ID NO: 591637 - DNA, 25 bp, Rattus norvegicus
aagacgggattatccgccatggcta

SEQ ID NO: 591638 - DNA, 25 bp, Rattus norvegicus
aggtcggccagcagcacgcgccata

SEQ ID NO: 591639 - DNA, 25 bp, Rattus norvegicus
gaaatcagccatctgggatcccagc

SEQ ID NO: 591640 - DNA, 25 bp, Rattus norvegicus
gttaacacccggtactgctcgcgcg

SEQ ID NO: 591641 - DNA, 25 bp, Rattus norvegicus
cgcgcggattctttaaacgacttca

SEQ ID NO: 591642 - DNA, 25 bp, Rattus norvegicus
tacaacgcgtggtcgaccctgattg

SEQ ID NO: 591643 - DNA, 25 bp, Rattus norvegicus
gcgttccgagccacagcctaacttg

SEQ ID NO: 591644 - DNA, 25 bp, Rattus norvegicus
tgctgaggcgactaggacgcaatga

SEQ ID NO: 591645 - DNA, 25 bp, Rattus norvegicus
gagccgctgcttgaagatcgtttta

SEQ ID NO: 591646 - DNA, 25 bp, Rattus norvegicus
gcagaccctgccatctatttcaaag

SEQ ID NO: 591647 - DNA, 25 bp, Rattus norvegicus
tgcctcgtcgtgtgtaaagtaatta

SEQ ID NO: 591648 - DNA, 25 bp, Rattus norvegicus
ttaccgttcagagggccaacactgt

SEQ ID NO: 591649 - DNA, 25 bp, Rattus norvegicus
tgtagctcctgacagacgttggtta

SEQ ID NO: 591650 - DNA, 25 bp, Rattus norvegicus
tgaagccgatcgaggtgtcaagttc

SEQ ID NO: 591651 - DNA, 25 bp, Rattus norvegicus
ggacagctgtaggtctaaaccagtc

SEQ ID NO: 591652 - DNA, 25 bp, Rattus norvegicus
cttcatggcgagcaagggactctca

SEQ ID NO: 591653 - DNA, 25 bp, Rattus norvegicus
ttgcgtactgtgctccgaacgcctc

SEQ ID NO: 591654 - DNA, 25 bp, Rattus norvegicus
tgctgcatctatcttccgcttcgtg

SEQ ID NO: 591655 - DNA, 25 bp, Rattus norvegicus
ctatcttccgcttcgtgtcactttc

SEQ ID NO: 591656 - DNA, 25 bp, Rattus norvegicus
cgcttcgtgtcactttcccttccgg

SEQ ID NO: 591657 - DNA, 25 bp, Rattus norvegicus
ccagtcttgcgtactgtgctccgaa

SEQ ID NO: 591658 - DNA, 25 bp, Rattus norvegicus
tactgtgctccgaacgcctcaggtc

SEQ ID NO: 591659 - DNA, 25 bp, Rattus norvegicus
acccggttgccagggcatccggctg

SEQ ID NO: 591660 - DNA, 25 bp, Rattus norvegicus
ttgccagggcatccggctgcccgga

SEQ ID NO: 591661 - DNA, 25 bp, Rattus norvegicus
gtgtcccgcgtccggctgggacttc

SEQ ID NO: 591662 - DNA, 25 bp, Rattus norvegicus
gctgggacttccacgcagccgggcc

SEQ ID NO: 591663 - DNA, 25 bp, Rattus norvegicus
cggcgattctcaggacgaggtccac

SEQ ID NO: 591664 - DNA, 25 bp, Rattus norvegicus
attctcaggacgaggtccacagcgc

SEQ ID NO: 591665 - DNA, 25 bp, Rattus norvegicus
ctcaggacgaggtccacagcgcggc

SEQ ID NO: 591666 - DNA, 25 bp, Rattus norvegicus
cccagcgatttccagtcttgcgtac

SEQ ID NO: 591667 - DNA, 25 bp, Rattus norvegicus
tgtaaaggtgtagccgcgcatgctc

SEQ ID NO: 591668 - DNA, 25 bp, Rattus norvegicus
cagaccttcaagatccgcatggaac

SEQ ID NO: 591669 - DNA, 25 bp, Rattus norvegicus
taaaacgttgcagcagcagaccttc

SEQ ID NO: 591670 - DNA, 25 bp, Rattus norvegicus
tcacacttaaaacgttgcagcagca

SEQ ID NO: 591671 - DNA, 25 bp, Rattus norvegicus
tggccgtcaccatcacacttaaaac

SEQ ID NO: 591672 - DNA, 25 bp, Rattus norvegicus
aggatcccggggctgccgcattgct

SEQ ID NO: 591673 - DNA, 25 bp, Rattus norvegicus
agttgcatgttgtgcgaggatcccg

SEQ ID NO: 591674 - DNA, 25 bp, Rattus norvegicus
ggcgcagcacacttgccccggaagt

SEQ ID NO: 591675 - DNA, 25 bp, Rattus norvegicus
agggtgtcacggtcgctgacgatcc

SEQ ID NO: 591676 - DNA, 25 bp, Rattus norvegicus
tttgcgcatgtctaatgtaaaggtg

SEQ ID NO: 591677 - DNA, 25 bp, Rattus norvegicus
ctgttcccgggccagttccagggag

SEQ ID NO: 591678 - DNA, 25 bp, Rattus norvegicus
cgcatggaacctgatgagacggtgc

SEQ ID NO: 591679 - DNA, 25 bp, Rattus norvegicus
tcacggtcgctgacgatccgcgggc

SEQ ID NO: 591680 - DNA, 25 bp, Rattus norvegicus
ttcaagatccgcatggaacctgatg

SEQ ID NO: 591681 - DNA, 25 bp, Rattus norvegicus
gcccgaactgcttggccgcataacg

SEQ ID NO: 591682 - DNA, 25 bp, Rattus norvegicus
tgccgccatcttggctgtgggtcct

SEQ ID NO: 591683 - DNA, 25 bp, Rattus norvegicus
cctcaggaggtagcggctccgcgtc

SEQ ID NO: 591684 - DNA, 25 bp, Rattus norvegicus
gtcacagtgagcctcaggaggtagc

SEQ ID NO: 591685 - DNA, 25 bp, Rattus norvegicus
ctgggacccagagtcacagtgagcc

SEQ ID NO: 591686 - DNA, 25 bp, Rattus norvegicus
ggggtcatcaggttctcccgatctg

SEQ ID NO: 591687 - DNA, 25 bp, Rattus norvegicus
ataacgcggcgttagctgccatcgc

SEQ ID NO: 591688 - DNA, 25 bp, Rattus norvegicus
cacagctgctctgaggaaggccaca

SEQ ID NO: 591689 - DNA, 25 bp, Rattus norvegicus
tccaactcgcacagctgctctgagg

SEQ ID NO: 591690 - DNA, 25 bp, Rattus norvegicus
cttgggtaccattctcgctcctcgg

SEQ ID NO: 591691 - DNA, 25 bp, Rattus norvegicus
gtcgctaagcttgggtaccattctc

SEQ ID NO: 591692 - DNA, 25 bp, Rattus norvegicus
gactcttgcatggtcgctaagcttg

SEQ ID NO: 591693 - DNA, 25 bp, Rattus norvegicus
tgcacgcgcagcgactcttgcatgg

SEQ ID NO: 591694 - DNA, 25 bp, Rattus norvegicus
gttagctgccatcgcggggtcatca

SEQ ID NO: 591695 - DNA, 25 bp, Rattus norvegicus
ctaggaggacctcgctgaccatcgt

SEQ ID NO: 591696 - DNA, 25 bp, Rattus norvegicus
gccgatctgcttggtgggacagcaa

SEQ ID NO: 591697 - DNA, 25 bp, Rattus norvegicus
tcttttttgcttccaggccgccgga

SEQ ID NO: 591698 - DNA, 25 bp, Rattus norvegicus
cctccgatttgtagggagcattggc

SEQ ID NO: 591699 - DNA, 25 bp, Rattus norvegicus
cctaagaggttcagaagccggagtc

SEQ ID NO: 591700 - DNA, 25 bp, Rattus norvegicus
tttctccgccggagtccagcttacg

SEQ ID NO: 591701 - DNA, 25 bp, Rattus norvegicus
gtccagggctgctttgcctcagttt

SEQ ID NO: 591702 - DNA, 25 bp, Rattus norvegicus
acagggccatttacaccggctaagc

SEQ ID NO: 591703 - DNA, 25 bp, Rattus norvegicus
ggccaaggcggactttgcgcacaga

SEQ ID NO: 591704 - DNA, 25 bp, Rattus norvegicus
cgcaagcactcagacagggccattt

SEQ ID NO: 591705 - DNA, 25 bp, Rattus norvegicus
cgaagggaactagtgtcaaagactc

SEQ ID NO: 591706 - DNA, 25 bp, Rattus norvegicus
gtgagtcttgcggacacctacctcg

SEQ ID NO: 591707 - DNA, 25 bp, Rattus norvegicus
cactgtcctagttgcatcgccgatc

SEQ ID NO: 591708 - DNA, 25 bp, Rattus norvegicus
tcaagaccgaacagtgcacagcgtg

SEQ ID NO: 591709 - DNA, 25 bp, Rattus norvegicus
ctgctgcctcacgtccgagccttct

SEQ ID NO: 591710 - DNA, 25 bp, Rattus norvegicus
ttcatcgaggcgctgctgcctcacg

SEQ ID NO: 591711 - DNA, 25 bp, Rattus norvegicus
ccgagccttctcctacacctggttc

SEQ ID NO: 591712 - DNA, 25 bp, Rattus norvegicus
tgctgggcgagaagcctgagatcaa

SEQ ID NO: 591713 - DNA, 25 bp, Rattus norvegicus
ctgagatcaagcagaagtgggcatc

SEQ ID NO: 591714 - DNA, 25 bp, Rattus norvegicus
atcaagcagaagtgggcatcccggc

SEQ ID NO: 591715 - DNA, 25 bp, Rattus norvegicus
gcatcccggctgttggccaagctgc

SEQ ID NO: 591716 - DNA, 25 bp, Rattus norvegicus
cgagttccgcgaggactttgtgcta

SEQ ID NO: 591717 - DNA, 25 bp, Rattus norvegicus
ttccgcgaggactttgtgctaacca

SEQ ID NO: 591718 - DNA, 25 bp, Rattus norvegicus
tttgtgctaaccatcacgggcaaga

SEQ ID NO: 591719 - DNA, 25 bp, Rattus norvegicus
tgctaaccatcacgggcaagaagcc

SEQ ID NO: 591720 - DNA, 25 bp, Rattus norvegicus
ccagaagggcaagatccggcggatt

SEQ ID NO: 591721 - DNA, 25 bp, Rattus norvegicus
aagatccggcggattgactgcctgc

SEQ ID NO: 591722 - DNA, 25 bp, Rattus norvegicus
cttgccgcctgcaggatgagttcca

SEQ ID NO: 591723 - DNA, 25 bp, Rattus norvegicus
taaacagggtcagagctaagagcta

SEQ ID NO: 591724 - DNA, 25 bp, Rattus norvegicus
caaggtgcccggcgaggtaccctcg

SEQ ID NO: 591725 - DNA, 25 bp, Rattus norvegicus
aatgatttttcagttcggttggcta

SEQ ID NO: 591726 - DNA, 25 bp, Rattus norvegicus
gctctctgtgtggaagttgagcgaa

SEQ ID NO: 591727 - DNA, 25 bp, Rattus norvegicus
tcggttggctaaacagggtcagagc

SEQ ID NO: 591728 - DNA, 25 bp, Rattus norvegicus
tgtggaagttgagcgaagccctccc

SEQ ID NO: 591729 - DNA, 25 bp, Rattus norvegicus
gcgaatggccgctagcagggagctc

SEQ ID NO: 591730 - DNA, 25 bp, Rattus norvegicus
ctaagagctagcgaaagagggtccc

SEQ ID NO: 591731 - DNA, 25 bp, Rattus norvegicus
agctagcgaaagagggtccctgccc

SEQ ID NO: 591732 - DNA, 25 bp, Rattus norvegicus
tagcgaaagagggtccctgcccggc

SEQ ID NO: 591733 - DNA, 25 bp, Rattus norvegicus
tgcgcctcttcggtccgtcgaggac

SEQ ID NO: 591734 - DNA, 25 bp, Rattus norvegicus
cctcttcggtccgtcgaggacagtg

SEQ ID NO: 591735 - DNA, 25 bp, Rattus norvegicus
cagttcggttggctaaacagggtca

SEQ ID NO: 591736 - DNA, 25 bp, Rattus norvegicus
cgcggtcaaagtgcaatgatttttc

SEQ ID NO: 591737 - DNA, 25 bp, Rattus norvegicus
gcaagccacggtacctgtcagcagt

SEQ ID NO: 591738 - DNA, 25 bp, Rattus norvegicus
cagacttcgggctttgtttgggctc

SEQ ID NO: 591739 - DNA, 25 bp, Rattus norvegicus
tgcggagcgccagagacgcagactt

SEQ ID NO: 591740 - DNA, 25 bp, Rattus norvegicus
ggttcccatctctttgcactgcgtt

SEQ ID NO: 591741 - DNA, 25 bp, Rattus norvegicus
aggcctggcccagacgcaatctgca

SEQ ID NO: 591742 - DNA, 25 bp, Rattus norvegicus
ctctgctggaagacccacaggcctg

SEQ ID NO: 591743 - DNA, 25 bp, Rattus norvegicus
cgtcccgcttgttggctggacgcta

SEQ ID NO: 591744 - DNA, 25 bp, Rattus norvegicus
tggctgcgcctagaggagatcccaa

SEQ ID NO: 591745 - DNA, 25 bp, Rattus norvegicus
aaaatccaccaatggcacagccgcg

SEQ ID NO: 591746 - DNA, 25 bp, Rattus norvegicus
tcagcagttggagcctgtgtcccag

SEQ ID NO: 591747 - DNA, 25 bp, Rattus norvegicus
ccggagcccgctccaaattggagag

SEQ ID NO: 591748 - DNA, 25 bp, Rattus norvegicus
ctcatctgggaacgcgcacccgaga

SEQ ID NO: 591749 - DNA, 25 bp, Rattus norvegicus
cgtgcctcaggtttcgctcatctgg

SEQ ID NO: 591750 - DNA, 25 bp, Rattus norvegicus
agcaccttcatctcggcgtcggagg

SEQ ID NO: 591751 - DNA, 25 bp, Rattus norvegicus
tccagccatgctgacaggtcgattt

SEQ ID NO: 591752 - DNA, 25 bp, Rattus norvegicus
aatcgagagccctaggggcacccta

SEQ ID NO: 591753 - DNA, 25 bp, Rattus norvegicus
cccagcagaggtcaatgccaacgaa

SEQ ID NO: 591754 - DNA, 25 bp, Rattus norvegicus
acaggtcgatttgcccaggcccgcg

SEQ ID NO: 591755 - DNA, 25 bp, Rattus norvegicus
ggtcaatgccaacgaacaaacgtcc

SEQ ID NO: 591756 - DNA, 25 bp, Rattus norvegicus
ttcgatgctccaggacaggtccagc

SEQ ID NO: 591757 - DNA, 25 bp, Rattus norvegicus
tccctccgggaggttcgatgctcca

SEQ ID NO: 591758 - DNA, 25 bp, Rattus norvegicus
ctcagcaagttggtagtttcctccc

SEQ ID NO: 591759 - DNA, 25 bp, Rattus norvegicus
gcgcgctcagcaagttggtagtttc

SEQ ID NO: 591760 - DNA, 25 bp, Rattus norvegicus
ccagcattaatcaggagcgcgctca

SEQ ID NO: 591761 - DNA, 25 bp, Rattus norvegicus
ttgaccctcaccagcattaatcagg

SEQ ID NO: 591762 - DNA, 25 bp, Rattus norvegicus
ctttgagccagacgccaacttgacc

SEQ ID NO: 591763 - DNA, 25 bp, Rattus norvegicus
cgagcgcccttctttgagccagacg

SEQ ID NO: 591764 - DNA, 25 bp, Rattus norvegicus
ggtggctcagacgacccaccgtttc

SEQ ID NO: 591765 - DNA, 25 bp, Rattus norvegicus
caggaagccgatgtacttcatggcc

SEQ ID NO: 591766 - DNA, 25 bp, Rattus norvegicus
gccgttaacgtgctgctgccgccag

SEQ ID NO: 591767 - DNA, 25 bp, Rattus norvegicus
tgagctccgcgaaggcgccgttaac

SEQ ID NO: 591768 - DNA, 25 bp, Rattus norvegicus
gttcttgctcagcttccggtcgggc

SEQ ID NO: 591769 - DNA, 25 bp, Rattus norvegicus
aggcgcagcacctcgttcttgctca

SEQ ID NO: 591770 - DNA, 25 bp, Rattus norvegicus
gtacttcatggccaggcgcagcacc

SEQ ID NO: 591771 - DNA, 25 bp, Rattus norvegicus
cagcagccgcaccaggaagccgatg

SEQ ID NO: 591772 - DNA, 25 bp, Rattus norvegicus
aacacagccgcttggtctcgcagca

SEQ ID NO: 591773 - DNA, 25 bp, Rattus norvegicus
ccggaggccaacacagccgcttggt

SEQ ID NO: 591774 - DNA, 25 bp, Rattus norvegicus
gggtcgcactgacccatttgggtcg

SEQ ID NO: 591775 - DNA, 25 bp, Rattus norvegicus
ctccatcttgatgggtcgcactgac

SEQ ID NO: 591776 - DNA, 25 bp, Rattus norvegicus
cgctcgcggctgttggtgaacactc

SEQ ID NO: 591777 - DNA, 25 bp, Rattus norvegicus
acctcaggactcagggccgtctgct

SEQ ID NO: 591778 - DNA, 25 bp, Rattus norvegicus
tcagggccgtctgctccatcttgat

SEQ ID NO: 591779 - DNA, 25 bp, Rattus norvegicus
ccggttgaactcctgcaccgggttg

SEQ ID NO: 591780 - DNA, 25 bp, Rattus norvegicus
ttgctcacgttaggtcccggttgaa

SEQ ID NO: 591781 - DNA, 25 bp, Rattus norvegicus
tgctcacgttaggtcccggttgaac

SEQ ID NO: 591782 - DNA, 25 bp, Rattus norvegicus
gttaggtcccggttgaactcctgca

SEQ ID NO: 591783 - DNA, 25 bp, Rattus norvegicus
ttaggtcccggttgaactcctgcac

SEQ ID NO: 591784 - DNA, 25 bp, Rattus norvegicus
taggtcccggttgaactcctgcacc

SEQ ID NO: 591785 - DNA, 25 bp, Rattus norvegicus
ccttgctcacgttaggtcccggttg

SEQ ID NO: 591786 - DNA, 25 bp, Rattus norvegicus
cggttgaactcctgcaccgggttgt

SEQ ID NO: 591787 - DNA, 25 bp, Rattus norvegicus
gttgaactcctgcaccgggttgtag

SEQ ID NO: 591788 - DNA, 25 bp, Rattus norvegicus
ttgaactcctgcaccgggttgtaga

SEQ ID NO: 591789 - DNA, 25 bp, Rattus norvegicus
ctgcaccgggttgtagaaaacctcg

SEQ ID NO: 591790 - DNA, 25 bp, Rattus norvegicus
tgaactcctgcaccgggttgtagaa

SEQ ID NO: 591791 - DNA, 25 bp, Rattus norvegicus
cttgctcacgttaggtcccggttga

SEQ ID NO: 591792 - DNA, 25 bp, Rattus norvegicus
aggtcccggttgaactcctgcaccg

SEQ ID NO: 591793 - DNA, 25 bp, Rattus norvegicus
cacaggatcgtcctcgcgagggaca

SEQ ID NO: 591794 - DNA, 25 bp, Rattus norvegicus
ggaaggagattctggcggcgccctc

SEQ ID NO: 591795 - DNA, 25 bp, Rattus norvegicus
atcgtcctcgcgagggacatccgcg

SEQ ID NO: 591796 - DNA, 25 bp, Rattus norvegicus
cggcttagccacaggatcgtcctcg

SEQ ID NO: 591797 - DNA, 25 bp, Rattus norvegicus
ctgagctctacagaggctgcgggcc

SEQ ID NO: 591798 - DNA, 25 bp, Rattus norvegicus
tccatgaactgagctctacagaggc

SEQ ID NO: 591799 - DNA, 25 bp, Rattus norvegicus
cttccgttccatgaactgagctcta

SEQ ID NO: 591800 - DNA, 25 bp, Rattus norvegicus
ctgggccttccgttccatgaactga

SEQ ID NO: 591801 - DNA, 25 bp, Rattus norvegicus
ccgttctccatcgttggtggtgagg

SEQ ID NO: 591802 - DNA, 25 bp, Rattus norvegicus
tgtgccgttctccatcgttggtggt

SEQ ID NO: 591803 - DNA, 25 bp, Rattus norvegicus
tcacaggaccgtgtgccgttctcca

SEQ ID NO: 591804 - DNA, 25 bp, Rattus norvegicus
gctcttcacaggaccgtgtgccgtt

SEQ ID NO: 591805 - DNA, 25 bp, Rattus norvegicus
gtgggcgctcttcacaggaccgtgt

SEQ ID NO: 591806 - DNA, 25 bp, Rattus norvegicus
gcgccctcggtgacagtcgcgaccg

SEQ ID NO: 591807 - DNA, 25 bp, Rattus norvegicus
ggcgaccaagaacaagattcttcta

SEQ ID NO: 591808 - DNA, 25 bp, Rattus norvegicus
ttcggctcacaggatccaaggagtc

SEQ ID NO: 591809 - DNA, 25 bp, Rattus norvegicus
agtcgcagtgcacgcctctcgcatt

SEQ ID NO: 591810 - DNA, 25 bp, Rattus norvegicus
aagcttctgccttcggctcacagga

SEQ ID NO: 591811 - DNA, 25 bp, Rattus norvegicus
cggacaagcttctgccttcggctca

SEQ ID NO: 591812 - DNA, 25 bp, Rattus norvegicus
gatccaaggagtcgcagtgcacgcc

SEQ ID NO: 591813 - DNA, 25 bp, Rattus norvegicus
attcttctaggaaaggaagcgcgga

SEQ ID NO: 591814 - DNA, 25 bp, Rattus norvegicus
cagtgggcgaccaagaacaagattc

SEQ ID NO: 591815 - DNA, 25 bp, Rattus norvegicus
cgcaacctacagtgggcgaccaaga

SEQ ID NO: 591816 - DNA, 25 bp, Rattus norvegicus
gctgaccaattagagacgcaaccta

SEQ ID NO: 591817 - DNA, 25 bp, Rattus norvegicus
tcacgtgacaatagctgaccaatta

SEQ ID NO: 591818 - DNA, 25 bp, Rattus norvegicus
acgcctctcgcattagggcctggga

SEQ ID NO: 591819 - DNA, 25 bp, Rattus norvegicus
gggccggtcacgtgacaatagctga

SEQ ID NO: 591820 - DNA, 25 bp, Rattus norvegicus
cgcattagggcctgggagccgccat

SEQ ID NO: 591821 - DNA, 25 bp, Rattus norvegicus
cttcctttggcagtcagcttcgctg

SEQ ID NO: 591822 - DNA, 25 bp, Rattus norvegicus
gccattacagaaagccgagtcccga

SEQ ID NO: 591823 - DNA, 25 bp, Rattus norvegicus
gcactccggcttgcttcatggagcg

SEQ ID NO: 591824 - DNA, 25 bp, Rattus norvegicus
aaaggcattgcgcttgcactccggc

SEQ ID NO: 591825 - DNA, 25 bp, Rattus norvegicus
ccggactcctggaataaaggcattg

SEQ ID NO: 591826 - DNA, 25 bp, Rattus norvegicus
ctggcagtactttgcgcccgggaac

SEQ ID NO: 591827 - DNA, 25 bp, Rattus norvegicus
cccggccaaggactggcagtacttt

SEQ ID NO: 591828 - DNA, 25 bp, Rattus norvegicus
tcgaatctagcagaccggcgcccgg

SEQ ID NO: 591829 - DNA, 25 bp, Rattus norvegicus
caacatggcggcacggagaccagac

SEQ ID NO: 591830 - DNA, 25 bp, Rattus norvegicus
tctgcccgggccttcctattaggag

SEQ ID NO: 591831 - DNA, 25 bp, Rattus norvegicus
ctctgcgagaaggtgagctgctcta

SEQ ID NO: 591832 - DNA, 25 bp, Rattus norvegicus
agtcccaggtcaagagcctctgcga

SEQ ID NO: 591833 - DNA, 25 bp, Rattus norvegicus
tgcaagcagctctccgagtcccagg

SEQ ID NO: 591834 - DNA, 25 bp, Rattus norvegicus
cggcatcatggacgagaagttgttc

SEQ ID NO: 591835 - DNA, 25 bp, Rattus norvegicus
cgcagctaagcttgcctaaggggcg

SEQ ID NO: 591836 - DNA, 25 bp, Rattus norvegicus
gaggccgtttcctccctgccggcag

SEQ ID NO: 591837 - DNA, 25 bp, Rattus norvegicus
gcggcctggcccacaatgaatggcc

SEQ ID NO: 591838 - DNA, 25 bp, Rattus norvegicus
ggcccacaatgaatggccgccgcgg

SEQ ID NO: 591839 - DNA, 25 bp, Rattus norvegicus
ccacagcgcaggtgagatggcccgc

SEQ ID NO: 591840 - DNA, 25 bp, Rattus norvegicus
gcggcccgaggacatccgaggttcc

SEQ ID NO: 591841 - DNA, 25 bp, Rattus norvegicus
ccctgctgggaacgagaagccgagc

SEQ ID NO: 591842 - DNA, 25 bp, Rattus norvegicus
tctgctggcggcctacagcgtccag

SEQ ID NO: 591843 - DNA, 25 bp, Rattus norvegicus
ctcgcgggacttgaaggccgcccga

SEQ ID NO: 591844 - DNA, 25 bp, Rattus norvegicus
ggtcgcgggatccttgaagtcgcag

SEQ ID NO: 591845 - DNA, 25 bp, Rattus norvegicus
cgaggacatccgaggttccggccga

SEQ ID NO: 591846 - DNA, 25 bp, Rattus norvegicus
gaagcgcagctaagcttgcctaagg

SEQ ID NO: 591847 - DNA, 25 bp, Rattus norvegicus
gtcagatatctgctggcggcctaca

SEQ ID NO: 591848 - DNA, 25 bp, Rattus norvegicus
agggtgagatggtcagatatctgct

SEQ ID NO: 591849 - DNA, 25 bp, Rattus norvegicus
cagggagacccatacacccggacgg

SEQ ID NO: 591850 - DNA, 25 bp, Rattus norvegicus
tcccactgaggcgtcccaggctatt

SEQ ID NO: 591851 - DNA, 25 bp, Rattus norvegicus
gtcccaggctattcggcagctcatt

SEQ ID NO: 591852 - DNA, 25 bp, Rattus norvegicus
tattcggcagctcattggcggtcca

SEQ ID NO: 591853 - DNA, 25 bp, Rattus norvegicus
ggcggtccagccgagctctttcgaa

SEQ ID NO: 591854 - DNA, 25 bp, Rattus norvegicus
ctctttcgaagagccacagagtctc

SEQ ID NO: 591855 - DNA, 25 bp, Rattus norvegicus
cagagtctccctgcaggagttcgca

SEQ ID NO: 591856 - DNA, 25 bp, Rattus norvegicus
aggagttcgcaccagcgctggcgca

SEQ ID NO: 591857 - DNA, 25 bp, Rattus norvegicus
ctttctgcacctcgctgcgggagca

SEQ ID NO: 591858 - DNA, 25 bp, Rattus norvegicus
aaccgaggtccagacacgccaacat

SEQ ID NO: 591859 - DNA, 25 bp, Rattus norvegicus
aaactgcctgtcacccagtggccta

SEQ ID NO: 591860 - DNA, 25 bp, Rattus norvegicus
ggctcgaggcaaaggtcccaaacca

SEQ ID NO: 591861 - DNA, 25 bp, Rattus norvegicus
ccttggcactgacgagcggcgagac

SEQ ID NO: 591862 - DNA, 25 bp, Rattus norvegicus
gtggcctacaccttggcactgacga

SEQ ID NO: 591863 - DNA, 25 bp, Rattus norvegicus
gcccaaataacagacgcgaactacc

SEQ ID NO: 591864 - DNA, 25 bp, Rattus norvegicus
cgcgaactaccggagacggcatttc

SEQ ID NO: 591865 - DNA, 25 bp, Rattus norvegicus
gagacggcatttcggctccagatgg

SEQ ID NO: 591866 - DNA, 25 bp, Rattus norvegicus
gctccagatggagggaagcaccaga

SEQ ID NO: 591867 - DNA, 25 bp, Rattus norvegicus
atggagggaagcaccagaaattgga

SEQ ID NO: 591868 - DNA, 25 bp, Rattus norvegicus
gccgccagacgtcattacaaccaaa

SEQ ID NO: 591869 - DNA, 25 bp, Rattus norvegicus
ggaagcccgctcctcgggctaagaa

SEQ ID NO: 591870 - DNA, 25 bp, Rattus norvegicus
gtcgtgcactctgcccaaataacag

SEQ ID NO: 591871 - DNA, 25 bp, Rattus norvegicus
ggctaagaaagtcagcccttgttct

SEQ ID NO: 591872 - DNA, 25 bp, Rattus norvegicus
ccttgttcttatatgggcatccgga

SEQ ID NO: 591873 - DNA, 25 bp, Rattus norvegicus
ttatatgggcatccggaagtgggtt

SEQ ID NO: 591874 - DNA, 25 bp, Rattus norvegicus
caaatttagccagggaagtcggtcg

SEQ ID NO: 591875 - DNA, 25 bp, Rattus norvegicus
gtcattacaaccaaatttagccagg

SEQ ID NO: 591876 - DNA, 25 bp, Rattus norvegicus
ccagaaattggagaggtgtggtcca

SEQ ID NO: 591877 - DNA, 25 bp, Rattus norvegicus
cgcgagaacccgaagctgcaatgga

SEQ ID NO: 591878 - DNA, 25 bp, Rattus norvegicus
accgtggtggccttctgaggattac

SEQ ID NO: 591879 - DNA, 25 bp, Rattus norvegicus
cccggccgacaatatgctcaacgtg

SEQ ID NO: 591880 - DNA, 25 bp, Rattus norvegicus
aaaggcgcttctccagtctcttgaa

SEQ ID NO: 591881 - DNA, 25 bp, Rattus norvegicus
ctggtaccaagcaagaaggcccgtc

SEQ ID NO: 591882 - DNA, 25 bp, Rattus norvegicus
cgggagctctacctctcagccaagg

SEQ ID NO: 591883 - DNA, 25 bp, Rattus norvegicus
ctgcagctgtccctcgttatgcgca

SEQ ID NO: 591884 - DNA, 25 bp, Rattus norvegicus
ggaagatgtaccactctcgcatgca

SEQ ID NO: 591885 - DNA, 25 bp, Rattus norvegicus
cagtcgtcgaacaagcatggaagta

SEQ ID NO: 591886 - DNA, 25 bp, Rattus norvegicus
cggcttaactctacacagtcgtcga

SEQ ID NO: 591887 - DNA, 25 bp, Rattus norvegicus
gcagcaacgccggtcttaatccatt

SEQ ID NO: 591888 - DNA, 25 bp, Rattus norvegicus
cctgcaactgtaagtgagtcgtcta

SEQ ID NO: 591889 - DNA, 25 bp, Rattus norvegicus
gccggaacgtctaacagagtacctg

SEQ ID NO: 591890 - DNA, 25 bp, Rattus norvegicus
ggaggtctccaatcgcctgcagctt

SEQ ID NO: 591891 - DNA, 25 bp, Rattus norvegicus
ccaaagtctcgagaatgggctctgt

SEQ ID NO: 591892 - DNA, 25 bp, Rattus norvegicus
tcgagaatgggctctgttgcagcgc

SEQ ID NO: 591893 - DNA, 25 bp, Rattus norvegicus
acttgactccgcgaggaaaccagtc

SEQ ID NO: 591894 - DNA, 25 bp, Rattus norvegicus
ctccgcgaggaaaccagtcagaggc

SEQ ID NO: 591895 - DNA, 25 bp, Rattus norvegicus
ttccggagctcgctagcctagcaga

SEQ ID NO: 591896 - DNA, 25 bp, Rattus norvegicus
tcgctagcctagcagaccaactcta

SEQ ID NO: 591897 - DNA, 25 bp, Rattus norvegicus
cagaccaactctaggggggccgatt

SEQ ID NO: 591898 - DNA, 25 bp, Rattus norvegicus
ggggccgattacgtcaatcagagac

SEQ ID NO: 591899 - DNA, 25 bp, Rattus norvegicus
ttacgtcaatcagagacaggccgga

SEQ ID NO: 591900 - DNA, 25 bp, Rattus norvegicus
agacaggccggagcgtgcaaacctc

SEQ ID NO: 591901 - DNA, 25 bp, Rattus norvegicus
tgcgtgcggtaacctgcttcttctg

SEQ ID NO: 591902 - DNA, 25 bp, Rattus norvegicus
gcttcttctgggaactcctagcctc

SEQ ID NO: 591903 - DNA, 25 bp, Rattus norvegicus
ttctgggaactcctagcctctgcct

SEQ ID NO: 591904 - DNA, 25 bp, Rattus norvegicus
tctgcctccgctagggcccggggat

SEQ ID NO: 591905 - DNA, 25 bp, Rattus norvegicus
cccgcgtagtaaccattgggcagcc

SEQ ID NO: 591906 - DNA, 25 bp, Rattus norvegicus
cgcagtccgcggtgcgcgaagtcct

SEQ ID NO: 591907 - DNA, 25 bp, Rattus norvegicus
taaccattgggcagcctgcggccgt

SEQ ID NO: 591908 - DNA, 25 bp, Rattus norvegicus
gcccgcaagaactcccgtgggtctg

SEQ ID NO: 591909 - DNA, 25 bp, Rattus norvegicus
tcgctctcgctgtacgcgtcgtgcg

SEQ ID NO: 591910 - DNA, 25 bp, Rattus norvegicus
ggcggcttagcaccagtcgtcctcg

SEQ ID NO: 591911 - DNA, 25 bp, Rattus norvegicus
ttatcatttgcggtgcgcccgcacc

SEQ ID NO: 591912 - DNA, 25 bp, Rattus norvegicus
attgtttatcatttgcggtgcgccc

SEQ ID NO: 591913 - DNA, 25 bp, Rattus norvegicus
aactcatcaatagaagctatttttg

SEQ ID NO: 591914 - DNA, 25 bp, Rattus norvegicus
ttcaatcgagatgataaaactcatc

SEQ ID NO: 591915 - DNA, 25 bp, Rattus norvegicus
cgggaaaacgaaagattcaatcgag

SEQ ID NO: 591916 - DNA, 25 bp, Rattus norvegicus
gcagccacctcggtttcgttcaccg

SEQ ID NO: 591917 - DNA, 25 bp, Rattus norvegicus
gtgcagccgtccctccggctcgcag

SEQ ID NO: 591918 - DNA, 25 bp, Rattus norvegicus
aactcccgtgggtctgagaagtgtg

SEQ ID NO: 591919 - DNA, 25 bp, Rattus norvegicus
aggagggctggccacctcagcgaac

SEQ ID NO: 591920 - DNA, 25 bp, Rattus norvegicus
cgcgaagccaatgactttggaaagt

SEQ ID NO: 591921 - DNA, 25 bp, Rattus norvegicus
accactccgagtgctgtgcatcttc

SEQ ID NO: 591922 - DNA, 25 bp, Rattus norvegicus
gctcgcctcacctgtgggagcggat

SEQ ID NO: 591923 - DNA, 25 bp, Rattus norvegicus
atgggcgtctcgacgcgcaccggca

SEQ ID NO: 591924 - DNA, 25 bp, Rattus norvegicus
ctgtgacattacgatgtcgtccaaa

SEQ ID NO: 591925 - DNA, 25 bp, Rattus norvegicus
gaagttctcctcaggtcccagagcg

SEQ ID NO: 591926 - DNA, 25 bp, Rattus norvegicus
tggcttcaaactcgttttcccgcgc

SEQ ID NO: 591927 - DNA, 25 bp, Rattus norvegicus
aatacgcctccgacatggcagctcg

SEQ ID NO: 591928 - DNA, 25 bp, Rattus norvegicus
taaaatcggtgacgggagaccactc

SEQ ID NO: 591929 - DNA, 25 bp, Rattus norvegicus
tcagcgaacccgctggcttcaaact

SEQ ID NO: 591930 - DNA, 25 bp, Rattus norvegicus
accggcagcttctcctgtgacatta

SEQ ID NO: 591931 - DNA, 25 bp, Rattus norvegicus
gagcgccggactccaccgggaaata

SEQ ID NO: 591932 - DNA, 25 bp, Rattus norvegicus
gtcgtccaaagacaggaagttctcc

SEQ ID NO: 591933 - DNA, 25 bp, Rattus norvegicus
tccgcaggacacgagtcgcagggaa

SEQ ID NO: 591934 - DNA, 25 bp, Rattus norvegicus
tgggcttccactgacggaactactg

SEQ ID NO: 591935 - DNA, 25 bp, Rattus norvegicus
ggaactactgccctacacgaaaatc

SEQ ID NO: 591936 - DNA, 25 bp, Rattus norvegicus
gcaaagataccacggaccaaccagg

SEQ ID NO: 591937 - DNA, 25 bp, Rattus norvegicus
cggaccaaccaggagcacacgggga

SEQ ID NO: 591938 - DNA, 25 bp, Rattus norvegicus
gggcgggcaaaccaacacaacagtg

SEQ ID NO: 591939 - DNA, 25 bp, Rattus norvegicus
aggagagaaacgagaaacgagcttc

SEQ ID NO: 591940 - DNA, 25 bp, Rattus norvegicus
cgagcttcgtaagtttccgaagtca

SEQ ID NO: 591941 - DNA, 25 bp, Rattus norvegicus
actcacaggcgtccgcaggacacga

SEQ ID NO: 591942 - DNA, 25 bp, Rattus norvegicus
gaaaagcaagagtggcgggctaccc

SEQ ID NO: 591943 - DNA, 25 bp, Rattus norvegicus
gcttctggtcaatctgggcctgcca

SEQ ID NO: 591944 - DNA, 25 bp, Rattus norvegicus
tgccacacgcacctgtctgtgtgtc

SEQ ID NO: 591945 - DNA, 25 bp, Rattus norvegicus
tgtggccgatgcttccggtccttgg

SEQ ID NO: 591946 - DNA, 25 bp, Rattus norvegicus
gtttccgaagtcactcacaggcgtc

SEQ ID NO: 591947 - DNA, 25 bp, Rattus norvegicus
agccgcagcattccatcctcagaag

SEQ ID NO: 591948 - DNA, 25 bp, Rattus norvegicus
tcatagctccgtgggaagtgactgt

SEQ ID NO: 591949 - DNA, 25 bp, Rattus norvegicus
gactcattcatagctccgtgggaag

SEQ ID NO: 591950 - DNA, 25 bp, Rattus norvegicus
ggaatctcgagactcattcatagct

SEQ ID NO: 591951 - DNA, 25 bp, Rattus norvegicus
cgggcacatgcagacggaatctcga

SEQ ID NO: 591952 - DNA, 25 bp, Rattus norvegicus
ctgctccgcccagaacgggcagatg

SEQ ID NO: 591953 - DNA, 25 bp, Rattus norvegicus
agagcggtacaaacgggcacatgca

SEQ ID NO: 591954 - DNA, 25 bp, Rattus norvegicus
cgaggcctacacagagcggtacaaa

SEQ ID NO: 591955 - DNA, 25 bp, Rattus norvegicus
ccagaacgggcagatgataggcacc

SEQ ID NO: 591956 - DNA, 25 bp, Rattus norvegicus
tgataggcacccagccgcagcattc

SEQ ID NO: 591957 - DNA, 25 bp, Rattus norvegicus
ttccatcctcagaagcggcaggcac

SEQ ID NO: 591958 - DNA, 25 bp, Rattus norvegicus
ccctggtggacatgcagcgaggcct

SEQ ID NO: 591959 - DNA, 25 bp, Rattus norvegicus
cctcgaggtggggtccacggccaca

SEQ ID NO: 591960 - DNA, 25 bp, Rattus norvegicus
ggacatgcagcgaggcctacacaga

SEQ ID NO: 591961 - DNA, 25 bp, Rattus norvegicus
agcatgatgttgtgccacgcttccc

SEQ ID NO: 591962 - DNA, 25 bp, Rattus norvegicus
ggcttcccgctgaggcaggacagca

SEQ ID NO: 591963 - DNA, 25 bp, Rattus norvegicus
tcgtgtgcagactcaccagaaatga

SEQ ID NO: 591964 - DNA, 25 bp, Rattus norvegicus
caccagaaatgagcaaaggaagatg

SEQ ID NO: 591965 - DNA, 25 bp, Rattus norvegicus
tgagcaaaggaagatgaacgagaca

SEQ ID NO: 591966 - DNA, 25 bp, Rattus norvegicus
tgaacgagacaaagtaaaaataggc

SEQ ID NO: 591967 - DNA, 25 bp, Rattus norvegicus
taggcgaactcgttgccacactctg

SEQ ID NO: 591968 - DNA, 25 bp, Rattus norvegicus
cacactctggtttttggatcccgga

SEQ ID NO: 591969 - DNA, 25 bp, Rattus norvegicus
tttggatcccggagttcttgtcgca

SEQ ID NO: 591970 - DNA, 25 bp, Rattus norvegicus
agttcttgtcgcatggcttcccgct

SEQ ID NO: 591971 - DNA, 25 bp, Rattus norvegicus
caggacagcatgatgttgtgccacg

SEQ ID NO: 591972 - DNA, 25 bp, Rattus norvegicus
ctgtggcgctcctgaggatacgcat

SEQ ID NO: 591973 - DNA, 25 bp, Rattus norvegicus
agacatggccctcctcgtgtgcaga

SEQ ID NO: 591974 - DNA, 25 bp, Rattus norvegicus
tgaggatacgcatcgtcagtgaccc

SEQ ID NO: 591975 - DNA, 25 bp, Rattus norvegicus
gggtccaggcgctgtcactttagct

SEQ ID NO: 591976 - DNA, 25 bp, Rattus norvegicus
ggatttctctgcctcgattgccatc

SEQ ID NO: 591977 - DNA, 25 bp, Rattus norvegicus
gccctgatttaaggcggtggcccgc

SEQ ID NO: 591978 - DNA, 25 bp, Rattus norvegicus
gtcctcgcctcctgtcgattatcag

SEQ ID NO: 591979 - DNA, 25 bp, Rattus norvegicus
cacggccttcactggccctgattta

SEQ ID NO: 591980 - DNA, 25 bp, Rattus norvegicus
tgacagtgattctgacacggccttc

SEQ ID NO: 591981 - DNA, 25 bp, Rattus norvegicus
ttgccatcagccctaaggaaggtgt

SEQ ID NO: 591982 - DNA, 25 bp, Rattus norvegicus
tggcagccagcatagacccacatga

SEQ ID NO: 591983 - DNA, 25 bp, Rattus norvegicus
ccacatgagggctgcaggtgcattt

SEQ ID NO: 591984 - DNA, 25 bp, Rattus norvegicus
agatatcagctttttgccgcaatgg

SEQ ID NO: 591985 - DNA, 25 bp, Rattus norvegicus
cgcaccatcggctctgcgcaaaaga

SEQ ID NO: 591986 - DNA, 25 bp, Rattus norvegicus
gtatctatgagtgctggggtccgca

SEQ ID NO: 591987 - DNA, 25 bp, Rattus norvegicus
acgagggcgaatgcgtgtatctatg

SEQ ID NO: 591988 - DNA, 25 bp, Rattus norvegicus
ggttctagaaaagatgaccgccttc

SEQ ID NO: 591989 - DNA, 25 bp, Rattus norvegicus
gagtcaggccttctagggccgccca

SEQ ID NO: 591990 - DNA, 25 bp, Rattus norvegicus
acaggcttgttgctccgcgctccag

SEQ ID NO: 591991 - DNA, 25 bp, Rattus norvegicus
ggccggctgtgtgacgtcacgaact

SEQ ID NO: 591992 - DNA, 25 bp, Rattus norvegicus
ctcctataaaagctgacgccgcgcg

SEQ ID NO: 591993 - DNA, 25 bp, Rattus norvegicus
agtggccttgttctcgagacttcta

SEQ ID NO: 591994 - DNA, 25 bp, Rattus norvegicus
gacttctattcggttgtgaactctg

SEQ ID NO: 591995 - DNA, 25 bp, Rattus norvegicus
gtgaactctgttcggcagcctcagg

SEQ ID NO: 591996 - DNA, 25 bp, Rattus norvegicus
agcctcaggcctgcggtcttgagac

SEQ ID NO: 591997 - DNA, 25 bp, Rattus norvegicus
gctcgctgctgtatccagctctgtg

SEQ ID NO: 591998 - DNA, 25 bp, Rattus norvegicus
gtcttgagaccgagcacggtgagta

SEQ ID NO: 591999 - DNA, 25 bp, Rattus norvegicus
aacgcggctgcaaggcctaggcttc

SEQ ID NO: 592000 - DNA, 25 bp, Rattus norvegicus
agctctgtggcaggcctgctctttt

SEQ ID NO: 592001 - DNA, 25 bp, Rattus norvegicus
gcctgctcttttgcgggcgacgtca

SEQ ID NO: 592002 - DNA, 25 bp, Rattus norvegicus
cctgccttagcgacaggcttgttgc

SEQ ID NO: 592003 - DNA, 25 bp, Rattus norvegicus
caggttctgcttgcgcatctcgctg

SEQ ID NO: 592004 - DNA, 25 bp, Rattus norvegicus
gcctcgcggctagccagcaggttct

SEQ ID NO: 592005 - DNA, 25 bp, Rattus norvegicus
aagtgcgtcttcacgtccggccgca

SEQ ID NO: 592006 - DNA, 25 bp, Rattus norvegicus
agcggccggtccaagtgcgtcttca

SEQ ID NO: 592007 - DNA, 25 bp, Rattus norvegicus
ttacggttctcctgcgggtccacca

SEQ ID NO: 592008 - DNA, 25 bp, Rattus norvegicus
cgcacggctcttgttggtgttgttg

SEQ ID NO: 592009 - DNA, 25 bp, Rattus norvegicus
tttggcgcagcgcttctggcgcacg

SEQ ID NO: 592010 - DNA, 25 bp, Rattus norvegicus
atacgggccctctcgtccaggggcg

SEQ ID NO: 592011 - DNA, 25 bp, Rattus norvegicus
gttgcggctcgctctcgcggccata

SEQ ID NO: 592012 - DNA, 25 bp, Rattus norvegicus
tcaggatccgcgtcccagggtacgt

SEQ ID NO: 592013 - DNA, 25 bp, Rattus norvegicus
tgtctgcgctccctgtcatcgtggg

SEQ ID NO: 592014 - DNA, 25 bp, Rattus norvegicus
cgctccggtctgtcgtccggttcgt

SEQ ID NO: 592015 - DNA, 25 bp, Rattus norvegicus
ccgtgtcggtgtcgccgcttgcgct

SEQ ID NO: 592016 - DNA, 25 bp, Rattus norvegicus
tgcgcatctcgctggtgcgctgctc

SEQ ID NO: 592017 - DNA, 25 bp, Rattus norvegicus
catcttgctaaaggcgtgggctcgg

SEQ ID NO: 592018 - DNA, 25 bp, Rattus norvegicus
gttttgctgactttcttagacctgg

SEQ ID NO: 592019 - DNA, 25 bp, Rattus norvegicus
tgcggcagagcctggcagcatccca

SEQ ID NO: 592020 - DNA, 25 bp, Rattus norvegicus
tgcagcagcgcagtcttgaaaattc

SEQ ID NO: 592021 - DNA, 25 bp, Rattus norvegicus
gatctgttttcctcctgattcagca

SEQ ID NO: 592022 - DNA, 25 bp, Rattus norvegicus
cgactagcttcaaattcctccgagg

SEQ ID NO: 592023 - DNA, 25 bp, Rattus norvegicus
gaaaattcctgaaaacgctgcagcc

SEQ ID NO: 592024 - DNA, 25 bp, Rattus norvegicus
aataaccggggacgcgatccaggcg

SEQ ID NO: 592025 - DNA, 25 bp, Rattus norvegicus
aggatttgtccgtctgttttgctga

SEQ ID NO: 592026 - DNA, 25 bp, Rattus norvegicus
ccaaaaccaggtctttgctatagga

SEQ ID NO: 592027 - DNA, 25 bp, Rattus norvegicus
gctcggcccattagtaagaaaaata

SEQ ID NO: 592028 - DNA, 25 bp, Rattus norvegicus
tcctggtcagcttggcatcttgcta

SEQ ID NO: 592029 - DNA, 25 bp, Rattus norvegicus
ctccctgggacgcagcgactagctt

SEQ ID NO: 592030 - DNA, 25 bp, Rattus norvegicus
cgcgaagtctaagcgaaggacgtcc

SEQ ID NO: 592031 - DNA, 25 bp, Rattus norvegicus
gttttcggccaatggcgcctctagg

SEQ ID NO: 592032 - DNA, 25 bp, Rattus norvegicus
cttggcctgccacgggagacctgcg

SEQ ID NO: 592033 - DNA, 25 bp, Rattus norvegicus
ggcgatccgcgggttccaggctccg

SEQ ID NO: 592034 - DNA, 25 bp, Rattus norvegicus
ttccaggctccgggtgtgcttccgg

SEQ ID NO: 592035 - DNA, 25 bp, Rattus norvegicus
ccgggctggtggaggcgtgacgtca

SEQ ID NO: 592036 - DNA, 25 bp, Rattus norvegicus
cgtgacgtcaggaagagggcaggta

SEQ ID NO: 592037 - DNA, 25 bp, Rattus norvegicus
gtgcggaccggtccgcgacggcgac

SEQ ID NO: 592038 - DNA, 25 bp, Rattus norvegicus
tgccacgggagacctgcggcctcga

SEQ ID NO: 592039 - DNA, 25 bp, Rattus norvegicus
agacctgcggcctcgagcgggttcc

SEQ ID NO: 592040 - DNA, 25 bp, Rattus norvegicus
gagcgggttcccaggacccagccgc

SEQ ID NO: 592041 - DNA, 25 bp, Rattus norvegicus
cagccgccgttttcggccaatggcg

SEQ ID NO: 592042 - DNA, 25 bp, Rattus norvegicus
ttttcggccaatggcgcctctaggc

SEQ ID NO: 592043 - DNA, 25 bp, Rattus norvegicus
ccgttttcggccaatggcgcctcta

SEQ ID NO: 592044 - DNA, 25 bp, Rattus norvegicus
agccgccgttttcggccaatggcgc

SEQ ID NO: 592045 - DNA, 25 bp, Rattus norvegicus
tgcgagaccagctgagcctccttgt

SEQ ID NO: 592046 - DNA, 25 bp, Rattus norvegicus
cggaactagagggtgctactgaaga

SEQ ID NO: 592047 - DNA, 25 bp, Rattus norvegicus
cccgcaacctgtgcgggattctgtg

SEQ ID NO: 592048 - DNA, 25 bp, Rattus norvegicus
gaagacgctgatcacgggactacta

SEQ ID NO: 592049 - DNA, 25 bp, Rattus norvegicus
tgctactgaagagaccgtgcgggaa

SEQ ID NO: 592050 - DNA, 25 bp, Rattus norvegicus
atctgactcacatggcggcccgaga

SEQ ID NO: 592051 - DNA, 25 bp, Rattus norvegicus
tggccctgtacggtaggcaacatga

SEQ ID NO: 592052 - DNA, 25 bp, Rattus norvegicus
tgggttgcctcagcctggctgtaga

SEQ ID NO: 592053 - DNA, 25 bp, Rattus norvegicus
ccagggaagcgatccgcgccatgaa

SEQ ID NO: 592054 - DNA, 25 bp, Rattus norvegicus
actatgagacgctgagctccgtgca

SEQ ID NO: 592055 - DNA, 25 bp, Rattus norvegicus
ctgccggagcactgccactatgaga

SEQ ID NO: 592056 - DNA, 25 bp, Rattus norvegicus
ggcaacatgagactggaagcgatcc

SEQ ID NO: 592057 - DNA, 25 bp, Rattus norvegicus
gcagatcctcgaccagctgcagctg

SEQ ID NO: 592058 - DNA, 25 bp, Rattus norvegicus
gaagcgatccgctactcgccgggct

SEQ ID NO: 592059 - DNA, 25 bp, Rattus norvegicus
cagaaacctaaaagcaaggcggcgg

SEQ ID NO: 592060 - DNA, 25 bp, Rattus norvegicus
ttccggctttcggtggaacatggcg

SEQ ID NO: 592061 - DNA, 25 bp, Rattus norvegicus
gcctcttccggctttcggtggaaca

SEQ ID NO: 592062 - DNA, 25 bp, Rattus norvegicus
tggaacatggcgcagggacaacgca

SEQ ID NO: 592063 - DNA, 25 bp, Rattus norvegicus
catggcgcagggacaacgcaagttc

SEQ ID NO: 592064 - DNA, 25 bp, Rattus norvegicus
gcgcagggacaacgcaagttccagg

SEQ ID NO: 592065 - DNA, 25 bp, Rattus norvegicus
ggacaacgcaagttccaggcgcaga

SEQ ID NO: 592066 - DNA, 25 bp, Rattus norvegicus
ttccaggcgcagaaacctaaaagca

SEQ ID NO: 592067 - DNA, 25 bp, Rattus norvegicus
gagagaggacgacgaactccgggag

SEQ ID NO: 592068 - DNA, 25 bp, Rattus norvegicus
ggtccaggctcaccggctggtgcct

SEQ ID NO: 592069 - DNA, 25 bp, Rattus norvegicus
ccaggtcgagtcatcgctcccaaga

SEQ ID NO: 592070 - DNA, 25 bp, Rattus norvegicus
tcgagtcatcgctcccaagaaggcg

SEQ ID NO: 592071 - DNA, 25 bp, Rattus norvegicus
gtcatcgctcccaagaaggcgcgcg

SEQ ID NO: 592072 - DNA, 25 bp, Rattus norvegicus
acgcaagttccaggcgcagaaacct

SEQ ID NO: 592073 - DNA, 25 bp, Rattus norvegicus
cctccgtaaacaaagcggtgtgtag

SEQ ID NO: 592074 - DNA, 25 bp, Rattus norvegicus
agccgttgctggacctcagcgccaa

SEQ ID NO: 592075 - DNA, 25 bp, Rattus norvegicus
cggcttcattgttgtgaagagtctt

SEQ ID NO: 592076 - DNA, 25 bp, Rattus norvegicus
cagcggctgctaagacggcttcatt

SEQ ID NO: 592077 - DNA, 25 bp, Rattus norvegicus
ggcgggtctgcaaagacagccaata

SEQ ID NO: 592078 - DNA, 25 bp, Rattus norvegicus
cagcttcttgaaggcgggtctgcaa

SEQ ID NO: 592079 - DNA, 25 bp, Rattus norvegicus
ttgtcaaatgaacagcagcttcttg

SEQ ID NO: 592080 - DNA, 25 bp, Rattus norvegicus
acggccgtggaagttgtcaaatgaa

SEQ ID NO: 592081 - DNA, 25 bp, Rattus norvegicus
ttggatggcaccgaaaagacggccg

SEQ ID NO: 592082 - DNA, 25 bp, Rattus norvegicus
ccttgcggcctcttattggatggca

SEQ ID NO: 592083 - DNA, 25 bp, Rattus norvegicus
cccgtgatggacagcgactctcctt

SEQ ID NO: 592084 - DNA, 25 bp, Rattus norvegicus
gtcccttcgctttgattggctcata

SEQ ID NO: 592085 - DNA, 25 bp, Rattus norvegicus
gttgtgaatgaacgtgagaccgccc

SEQ ID NO: 592086 - DNA, 25 bp, Rattus norvegicus
cctcacaaggccgtgctgtggggtc

SEQ ID NO: 592087 - DNA, 25 bp, Rattus norvegicus
tcgggccccgcaagtctacctgctg

SEQ ID NO: 592088 - DNA, 25 bp, Rattus norvegicus
tgctgtcgcccgtagccagatccag

SEQ ID NO: 592089 - DNA, 25 bp, Rattus norvegicus
ctgtcgcccgtagccagatccagtt

SEQ ID NO: 592090 - DNA, 25 bp, Rattus norvegicus
gtcgcccgtagccagatccagttct

SEQ ID NO: 592091 - DNA, 25 bp, Rattus norvegicus
gccggccggcccagatcgcctttaa

SEQ ID NO: 592092 - DNA, 25 bp, Rattus norvegicus
cgcccgtagccagatccagttcttg

SEQ ID NO: 592093 - DNA, 25 bp, Rattus norvegicus
cgccaccgtcatgtgcccccgaggc

SEQ ID NO: 592094 - DNA, 25 bp, Rattus norvegicus
ccgtagccagatccagttcttgcct

SEQ ID NO: 592095 - DNA, 25 bp, Rattus norvegicus
cgggaaagttgtcgccgcctgcgcc

SEQ ID NO: 592096 - DNA, 25 bp, Rattus norvegicus
ccgcgcgggaaagttgtcgccgcct

SEQ ID NO: 592097 - DNA, 25 bp, Rattus norvegicus
gatccagttcttgcctcccgggcca

SEQ ID NO: 592098 - DNA, 25 bp, Rattus norvegicus
gtagccagatccagttcttgcctcc

SEQ ID NO: 592099 - DNA, 25 bp, Rattus norvegicus
gcccgtagccagatccagttcttgc

SEQ ID NO: 592100 - DNA, 25 bp, Rattus norvegicus
ctgcgcgcgggcgagacgacgccgg

SEQ ID NO: 592101 - DNA, 25 bp, Rattus norvegicus
tcctaccgtccaaaaacgatcattg

SEQ ID NO: 592102 - DNA, 25 bp, Rattus norvegicus
attgcggcaagctcccgtgaactga

SEQ ID NO: 592103 - DNA, 25 bp, Rattus norvegicus
aatggttgaactgcaggacccagga

SEQ ID NO: 592104 - DNA, 25 bp, Rattus norvegicus
tccaaaaacgatcattgcggcaagc

SEQ ID NO: 592105 - DNA, 25 bp, Rattus norvegicus
caggcgacggtatgttttttccatc

SEQ ID NO: 592106 - DNA, 25 bp, Rattus norvegicus
ctcccgtgaactgaatggttgaact

SEQ ID NO: 592107 - DNA, 25 bp, Rattus norvegicus
gcagggtttccagcctcgcaccaag

SEQ ID NO: 592108 - DNA, 25 bp, Rattus norvegicus
attcttcgccgctgacagatgggca

SEQ ID NO: 592109 - DNA, 25 bp, Rattus norvegicus
tcgcttgcagcgtcatttattcttc

SEQ ID NO: 592110 - DNA, 25 bp, Rattus norvegicus
cgtgagcaggcctcttcgcttgcag

SEQ ID NO: 592111 - DNA, 25 bp, Rattus norvegicus
taacaacttgagtaggatttgcggc

SEQ ID NO: 592112 - DNA, 25 bp, Rattus norvegicus
tttccatcttcgttgctcgcccaga

SEQ ID NO: 592113 - DNA, 25 bp, Rattus norvegicus
acattgtaagcaggcgacggtatgt

SEQ ID NO: 592114 - DNA, 25 bp, Rattus norvegicus
cgcccagagctttggtaacaacttg

SEQ ID NO: 592115 - DNA, 25 bp, Rattus norvegicus
agcaggcaacaaccggagcagggac

SEQ ID NO: 592116 - DNA, 25 bp, Rattus norvegicus
gtccggacaagggaactgagcgagc

SEQ ID NO: 592117 - DNA, 25 bp, Rattus norvegicus
acgtcagtggggttgctatggcaac

SEQ ID NO: 592118 - DNA, 25 bp, Rattus norvegicus
caaataaaattactgcgggcgagca

SEQ ID NO: 592119 - DNA, 25 bp, Rattus norvegicus
cgagcaaagtttcctggagtcggct

SEQ ID NO: 592120 - DNA, 25 bp, Rattus norvegicus
aaagtttcctggagtcggctgcgga

SEQ ID NO: 592121 - DNA, 25 bp, Rattus norvegicus
actagggataatccgtttctcactc

SEQ ID NO: 592122 - DNA, 25 bp, Rattus norvegicus
ccggagctggggatccctgtcccag

SEQ ID NO: 592123 - DNA, 25 bp, Rattus norvegicus
gctcccacgcgtgcacttcctgtcg

SEQ ID NO: 592124 - DNA, 25 bp, Rattus norvegicus
aggaggtaaatcaagcgagcaggca

SEQ ID NO: 592125 - DNA, 25 bp, Rattus norvegicus
caagcgagcaggcaacaaccggagc

SEQ ID NO: 592126 - DNA, 25 bp, Rattus norvegicus
catcacccacggacttaaaaactag

SEQ ID NO: 592127 - DNA, 25 bp, Rattus norvegicus
gataatccgtttctcactcccgggc

SEQ ID NO: 592128 - DNA, 25 bp, Rattus norvegicus
agtcggctgcggagtaaacaatggc

SEQ ID NO: 592129 - DNA, 25 bp, Rattus norvegicus
gtggatcccaccctccaaaagtggc

SEQ ID NO: 592130 - DNA, 25 bp, Rattus norvegicus
ctagctttaaagcaaccgggcgcct

SEQ ID NO: 592131 - DNA, 25 bp, Rattus norvegicus
tgctcctgccgtcgcctggagggct

SEQ ID NO: 592132 - DNA, 25 bp, Rattus norvegicus
gcacggaccgcgtctgcccggtgat

SEQ ID NO: 592133 - DNA, 25 bp, Rattus norvegicus
cgaggcctccattgttcccggccgt

SEQ ID NO: 592134 - DNA, 25 bp, Rattus norvegicus
ctttgtgcgcgcgtgctcctgccgt

SEQ ID NO: 592135 - DNA, 25 bp, Rattus norvegicus
tctgtggcccgcgtgcctttgtgcg

SEQ ID NO: 592136 - DNA, 25 bp, Rattus norvegicus
gtgtccctacgtgtgtggccgccac

SEQ ID NO: 592137 - DNA, 25 bp, Rattus norvegicus
cgctcccaggtgtccctacgtgtgt

SEQ ID NO: 592138 - DNA, 25 bp, Rattus norvegicus
ccgatcactctgctgaggagcccta

SEQ ID NO: 592139 - DNA, 25 bp, Rattus norvegicus
tgaggagccctagctttaaagcaac

SEQ ID NO: 592140 - DNA, 25 bp, Rattus norvegicus
tggccgcagaaaggaaagatggccc

SEQ ID NO: 592141 - DNA, 25 bp, Rattus norvegicus
actctgctgaggagccctagcttta

SEQ ID NO: 592142 - DNA, 25 bp, Rattus norvegicus
acaaggtttgccgagtggatcccac

SEQ ID NO: 592143 - DNA, 25 bp, Rattus norvegicus
aacatcaaaggcaccgcgggcagcg

SEQ ID NO: 592144 - DNA, 25 bp, Rattus norvegicus
gcgcaaaactcaccgtcctctaggg

SEQ ID NO: 592145 - DNA, 25 bp, Rattus norvegicus
ggcgggtcggaacatcaaaggcacc

SEQ ID NO: 592146 - DNA, 25 bp, Rattus norvegicus
aaggccaagagctcgtccggcgcgc

SEQ ID NO: 592147 - DNA, 25 bp, Rattus norvegicus
tcgccttcgtcttggaaggccaaga

SEQ ID NO: 592148 - DNA, 25 bp, Rattus norvegicus
ttatcgtcctgttcctcgccttcgt

SEQ ID NO: 592149 - DNA, 25 bp, Rattus norvegicus
cggcgctgtcgcgattcttatcgtc

SEQ ID NO: 592150 - DNA, 25 bp, Rattus norvegicus
tcaccagtgaggacttgagctccgc

SEQ ID NO: 592151 - DNA, 25 bp, Rattus norvegicus
gcgccttcagactcattcaccagtg

SEQ ID NO: 592152 - DNA, 25 bp, Rattus norvegicus
gcgggtccgcaggataccaactacg

SEQ ID NO: 592153 - DNA, 25 bp, Rattus norvegicus
tccagagatgggacccacgagggcc

SEQ ID NO: 592154 - DNA, 25 bp, Rattus norvegicus
agtctctgcgaagtgtgctctcgtc

SEQ ID NO: 592155 - DNA, 25 bp, Rattus norvegicus
ggagcgcacgctgactccgcctgag

SEQ ID NO: 592156 - DNA, 25 bp, Rattus norvegicus
tctggaagtttgtccgagaaaagtc

SEQ ID NO: 592157 - DNA, 25 bp, Rattus norvegicus
cacgcactgactgccgggaaatgta

SEQ ID NO: 592158 - DNA, 25 bp, Rattus norvegicus
gccctcaggacgtcacattgccgcg

SEQ ID NO: 592159 - DNA, 25 bp, Rattus norvegicus
gccgtacgcatgctccttctctccg

SEQ ID NO: 592160 - DNA, 25 bp, Rattus norvegicus
aggcgcatgcgcgttcacgcactga

SEQ ID NO: 592161 - DNA, 25 bp, Rattus norvegicus
aatgtagtttagttgcagagtgccc

SEQ ID NO: 592162 - DNA, 25 bp, Rattus norvegicus
ttgcagagtgcccaagaatccagtg

SEQ ID NO: 592163 - DNA, 25 bp, Rattus norvegicus
tgcccaagaatccagtggccgcgct

SEQ ID NO: 592164 - DNA, 25 bp, Rattus norvegicus
agtggccgcgctcccgaaggccaag

SEQ ID NO: 592165 - DNA, 25 bp, Rattus norvegicus
ctcccgaaggccaaggcggaagctg

SEQ ID NO: 592166 - DNA, 25 bp, Rattus norvegicus
tgggcggccaaaagtcgagaatccc

SEQ ID NO: 592167 - DNA, 25 bp, Rattus norvegicus
tcgagaatcccaggggccggtcgca

SEQ ID NO: 592168 - DNA, 25 bp, Rattus norvegicus
aactcggggctcaggcacagcgcga

SEQ ID NO: 592169 - DNA, 25 bp, Rattus norvegicus
agcgcgagctctgagacgcgacttc

SEQ ID NO: 592170 - DNA, 25 bp, Rattus norvegicus
cgctccacttcatgctaggcgcatg

SEQ ID NO: 592171 - DNA, 25 bp, Rattus norvegicus
ggggcatcaccagggcctgcaaatg

SEQ ID NO: 592172 - DNA, 25 bp, Rattus norvegicus
gcacctagcgcagccacgcggttgt

SEQ ID NO: 592173 - DNA, 25 bp, Rattus norvegicus
gccaggttgagttcggtcaaggctc

SEQ ID NO: 592174 - DNA, 25 bp, Rattus norvegicus
ctggttaccggccaggtccaagctg

SEQ ID NO: 592175 - DNA, 25 bp, Rattus norvegicus
tcaggcagccggctcaactggttac

SEQ ID NO: 592176 - DNA, 25 bp, Rattus norvegicus
acgcaaactggcaggcaggccctca

SEQ ID NO: 592177 - DNA, 25 bp, Rattus norvegicus
tgcagtctcagtgaacgcaaactgg

SEQ ID NO: 592178 - DNA, 25 bp, Rattus norvegicus
ccgcaattggttgcgttgcagtctc

SEQ ID NO: 592179 - DNA, 25 bp, Rattus norvegicus
tgctctggctccagggtccgcaatt

SEQ ID NO: 592180 - DNA, 25 bp, Rattus norvegicus
cgcagcttattcagcccagcgagct

SEQ ID NO: 592181 - DNA, 25 bp, Rattus norvegicus
ttgtgtgccaagttcagctcccgca

SEQ ID NO: 592182 - DNA, 25 bp, Rattus norvegicus
gttcaatgtcgcctacgcggagccg

SEQ ID NO: 592183 - DNA, 25 bp, Rattus norvegicus
tgccaagcgccaggttcaatgtcgc

SEQ ID NO: 592184 - DNA, 25 bp, Rattus norvegicus
ccagcctgttgccatagaggtgcaa

SEQ ID NO: 592185 - DNA, 25 bp, Rattus norvegicus
gaagagaccaggaatgccggctgtc

SEQ ID NO: 592186 - DNA, 25 bp, Rattus norvegicus
cccagctcgaaatcggagcggaaca

SEQ ID NO: 592187 - DNA, 25 bp, Rattus norvegicus
gcgcccagctcgaaatcggagcgga

SEQ ID NO: 592188 - DNA, 25 bp, Rattus norvegicus
tggcgcccagctcgaaatcggagcg

SEQ ID NO: 592189 - DNA, 25 bp, Rattus norvegicus
aatggcgcccagctcgaaatcggag

SEQ ID NO: 592190 - DNA, 25 bp, Rattus norvegicus
ctgagggaccggttgctccggaagt

SEQ ID NO: 592191 - DNA, 25 bp, Rattus norvegicus
aaaggccaatcagaaagtggcaggg

SEQ ID NO: 592192 - DNA, 25 bp, Rattus norvegicus
aggagaaaaggccaatcagaaagtg

SEQ ID NO: 592193 - DNA, 25 bp, Rattus norvegicus
cagtaaggagaaaaggccaatcaga

SEQ ID NO: 592194 - DNA, 25 bp, Rattus norvegicus
caaccggccggccgcagtaaggaga

SEQ ID NO: 592195 - DNA, 25 bp, Rattus norvegicus
gctgtcacccaaccggccggccgca

SEQ ID NO: 592196 - DNA, 25 bp, Rattus norvegicus
aggaatgccggctgtcacccaaccg

SEQ ID NO: 592197 - DNA, 25 bp, Rattus norvegicus
agctcgaaatcggagcggaacagcg

SEQ ID NO: 592198 - DNA, 25 bp, Rattus norvegicus
gagaccaggaatgccggctgtcacc

SEQ ID NO: 592199 - DNA, 25 bp, Rattus norvegicus
cctgtgccaagtggttgagcgatgt

SEQ ID NO: 592200 - DNA, 25 bp, Rattus norvegicus
tgttctgcagcactgcgcgcgctgc

SEQ ID NO: 592201 - DNA, 25 bp, Rattus norvegicus
catctggttgatctgggcagtgttc

SEQ ID NO: 592202 - DNA, 25 bp, Rattus norvegicus
ggtcgcttagcatctggttgatctg

SEQ ID NO: 592203 - DNA, 25 bp, Rattus norvegicus
cactcgattgaggtcgcttagcatc

SEQ ID NO: 592204 - DNA, 25 bp, Rattus norvegicus
ttgcgaagtccactcgattgaggtc

SEQ ID NO: 592205 - DNA, 25 bp, Rattus norvegicus
tgctcacctggacatttgcgaagtc

SEQ ID NO: 592206 - DNA, 25 bp, Rattus norvegicus
cccaatggtgctcacctggacattt

SEQ ID NO: 592207 - DNA, 25 bp, Rattus norvegicus
tcccatcgctccctcctgtcccagc

SEQ ID NO: 592208 - DNA, 25 bp, Rattus norvegicus
agccgctcagccgtctctcccatcg

SEQ ID NO: 592209 - DNA, 25 bp, Rattus norvegicus
gacacacccacgaggcctgctcctg

SEQ ID NO: 592210 - DNA, 25 bp, Rattus norvegicus
accacacggtcctcgcagcgacaca

SEQ ID NO: 592211 - DNA, 25 bp, Rattus norvegicus
tgtagcgccgcagcgtctgtgcgaa

SEQ ID NO: 592212 - DNA, 25 bp, Rattus norvegicus
ctgcctgtgccaagtggttgagcga

SEQ ID NO: 592213 - DNA, 25 bp, Rattus norvegicus
gctgtggctcgaagaccaccctctg

SEQ ID NO: 592214 - DNA, 25 bp, Rattus norvegicus
tccacacccggctcgtaatggggcg

SEQ ID NO: 592215 - DNA, 25 bp, Rattus norvegicus
catagcggctcgctgggccagacgc

SEQ ID NO: 592216 - DNA, 25 bp, Rattus norvegicus
tgtccgccaccacctactttgaggg

SEQ ID NO: 592217 - DNA, 25 bp, Rattus norvegicus
cacctactttgagggcggtgccgaa

SEQ ID NO: 592218 - DNA, 25 bp, Rattus norvegicus
actttgagggcggtgccgaacacta

SEQ ID NO: 592219 - DNA, 25 bp, Rattus norvegicus
ccgaacactagcacctggggcattc

SEQ ID NO: 592220 - DNA, 25 bp, Rattus norvegicus
tagcacctggggcattctgtggatc

SEQ ID NO: 592221 - DNA, 25 bp, Rattus norvegicus
tgctcgctgcctagctgcaaggcct

SEQ ID NO: 592222 - DNA, 25 bp, Rattus norvegicus
tctgtggatcctgaccctcaggtca

SEQ ID NO: 592223 - DNA, 25 bp, Rattus norvegicus
agaccaccctctgctgcggcaggag

SEQ ID NO: 592224 - DNA, 25 bp, Rattus norvegicus
ctgctgctcgctgcctagctgcaag

SEQ ID NO: 592225 - DNA, 25 bp, Rattus norvegicus
acacccggctcgtaatggggcggct

SEQ ID NO: 592226 - DNA, 25 bp, Rattus norvegicus
ggcattctgtggatcctgaccctca

SEQ ID NO: 592227 - DNA, 25 bp, Rattus norvegicus
aatcggctctctggttggactaacg

SEQ ID NO: 592228 - DNA, 25 bp, Rattus norvegicus
aaggaacgttgcgactctgtgctgc

SEQ ID NO: 592229 - DNA, 25 bp, Rattus norvegicus
gttcgctcctacgtaccgctgaaaa

SEQ ID NO: 592230 - DNA, 25 bp, Rattus norvegicus
cgcgctgtcattggtctagcctcca

SEQ ID NO: 592231 - DNA, 25 bp, Rattus norvegicus
gtccaaaagtttgtcgcgctctctt

SEQ ID NO: 592232 - DNA, 25 bp, Rattus norvegicus
ccctagatggcaagcgaagcccgtc

SEQ ID NO: 592233 - DNA, 25 bp, Rattus norvegicus
cggacgtccgtcagagaaagctaaa

SEQ ID NO: 592234 - DNA, 25 bp, Rattus norvegicus
cgattcctcagttcggacgtccgtc

SEQ ID NO: 592235 - DNA, 25 bp, Rattus norvegicus
tgcttccggcatgctattggctacc

SEQ ID NO: 592236 - DNA, 25 bp, Rattus norvegicus
ggggcaactgttgctacccacccta

SEQ ID NO: 592237 - DNA, 25 bp, Rattus norvegicus
ccgcacttgtgtccgcggaaggctt

SEQ ID NO: 592238 - DNA, 25 bp, Rattus norvegicus
ggttacctcggcttctccgcacttg

SEQ ID NO: 592239 - DNA, 25 bp, Rattus norvegicus
ccctcaggactgtactcaagcgaca

SEQ ID NO: 592240 - DNA, 25 bp, Rattus norvegicus
gcgctctcttgcacaggtccatggt

SEQ ID NO: 592241 - DNA, 25 bp, Rattus norvegicus
cccatggtgagcagcttcgttgtac

SEQ ID NO: 592242 - DNA, 25 bp, Rattus norvegicus
ggagcttctactgccgctgctacca

SEQ ID NO: 592243 - DNA, 25 bp, Rattus norvegicus
acgcctcaagccgttggagcttcta

SEQ ID NO: 592244 - DNA, 25 bp, Rattus norvegicus
ctggctccgggttgcacgcctcaag

SEQ ID NO: 592245 - DNA, 25 bp, Rattus norvegicus
tccctgagagtcatgagctggctcc

SEQ ID NO: 592246 - DNA, 25 bp, Rattus norvegicus
ttcccgcaggttgtaagacccaggc

SEQ ID NO: 592247 - DNA, 25 bp, Rattus norvegicus
ttcagacccgagaacttgaccacgg

SEQ ID NO: 592248 - DNA, 25 bp, Rattus norvegicus
agcttcgttgtaccctgcagttgta

SEQ ID NO: 592249 - DNA, 25 bp, Rattus norvegicus
acgcgtccacggtccgacaagttca

SEQ ID NO: 592250 - DNA, 25 bp, Rattus norvegicus
acgtgctaggccctgcgctctggta

SEQ ID NO: 592251 - DNA, 25 bp, Rattus norvegicus
tctgtgccgtcccagcacgtgctag

SEQ ID NO: 592252 - DNA, 25 bp, Rattus norvegicus
aaaggggcccaggactccctctgtg

SEQ ID NO: 592253 - DNA, 25 bp, Rattus norvegicus
gactgggcgacaacaggatgtagca

SEQ ID NO: 592254 - DNA, 25 bp, Rattus norvegicus
cggtgtcacttgtccctgagagtca

SEQ ID NO: 592255 - DNA, 25 bp, Rattus norvegicus
gatgctgcggaagccaggcccacgc

SEQ ID NO: 592256 - DNA, 25 bp, Rattus norvegicus
cctgatgctgcggaagccaggccca

SEQ ID NO: 592257 - DNA, 25 bp, Rattus norvegicus
cttgagccgctccacgcggaatttc

SEQ ID NO: 592258 - DNA, 25 bp, Rattus norvegicus
tgagccgctccacgcggaatttctc

SEQ ID NO: 592259 - DNA, 25 bp, Rattus norvegicus
gctccacgcggaatttctcctcctc

SEQ ID NO: 592260 - DNA, 25 bp, Rattus norvegicus
cctccagctcgcgacgcgcggcgcc

SEQ ID NO: 592261 - DNA, 25 bp, Rattus norvegicus
gcggcgccgatctcctcctgcagcc

SEQ ID NO: 592262 - DNA, 25 bp, Rattus norvegicus
tgcgcacacaggaccaagagctgcg

SEQ ID NO: 592263 - DNA, 25 bp, Rattus norvegicus
gcccaatggtggtccgcagatgggg

SEQ ID NO: 592264 - DNA, 25 bp, Rattus norvegicus
cacacaggaccaagagctgcgggcg

SEQ ID NO: 592265 - DNA, 25 bp, Rattus norvegicus
ggccgcagagcgctgactcagcagc

SEQ ID NO: 592266 - DNA, 25 bp, Rattus norvegicus
cgcgccctgatgctgcggaagccag

SEQ ID NO: 592267 - DNA, 25 bp, Rattus norvegicus
gctgactcagcagcgaaaggggcgg

SEQ ID NO: 592268 - DNA, 25 bp, Rattus norvegicus
accttgagccgctccacgcggaatt

SEQ ID NO: 592269 - DNA, 25 bp, Rattus norvegicus
tccgcgtagacgtgagtggtctgca

SEQ ID NO: 592270 - DNA, 25 bp, Rattus norvegicus
ctcagacatctttcagcctgtggtg

SEQ ID NO: 592271 - DNA, 25 bp, Rattus norvegicus
tcagtgatcgcgctgtccgagtcct

SEQ ID NO: 592272 - DNA, 25 bp, Rattus norvegicus
tcctccgtctgggagtcagtgatcg

SEQ ID NO: 592273 - DNA, 25 bp, Rattus norvegicus
cgcacagttggatgactggcagctc

SEQ ID NO: 592274 - DNA, 25 bp, Rattus norvegicus
tgatacaggtacctgagctcctcca

SEQ ID NO: 592275 - DNA, 25 bp, Rattus norvegicus
gccgcagaggcccatgatacaggta

SEQ ID NO: 592276 - DNA, 25 bp, Rattus norvegicus
caaagctacattcgaggccgcagag

SEQ ID NO: 592277 - DNA, 25 bp, Rattus norvegicus
cgtgagtggtctgcaaagctacatt

SEQ ID NO: 592278 - DNA, 25 bp, Rattus norvegicus
gtcttcagtaagatgtccggcttca

SEQ ID NO: 592279 - DNA, 25 bp, Rattus norvegicus
cggcttcactttggccgcgaccttg

SEQ ID NO: 592280 - DNA, 25 bp, Rattus norvegicus
tgcctagacaactgaacgccgcttg

SEQ ID NO: 592281 - DNA, 25 bp, Rattus norvegicus
tgtggtgctctgtgagtcttcagta

SEQ ID NO: 592282 - DNA, 25 bp, Rattus norvegicus
gcgaccttgcagagcgttgcctaga

SEQ ID NO: 592283 - DNA, 25 bp, Rattus norvegicus
agagcagccaagcactgacaggcgg

SEQ ID NO: 592284 - DNA, 25 bp, Rattus norvegicus
tctcaggatgaattatttaccagcc

SEQ ID NO: 592285 - DNA, 25 bp, Rattus norvegicus
cgctatcaacttctcaggatgaatt

SEQ ID NO: 592286 - DNA, 25 bp, Rattus norvegicus
ggagcgctatcaacttctcaggatg

SEQ ID NO: 592287 - DNA, 25 bp, Rattus norvegicus
gctggggagcgctatcaacttctca

SEQ ID NO: 592288 - DNA, 25 bp, Rattus norvegicus
cagtgctggggagcgctatcaactt

SEQ ID NO: 592289 - DNA, 25 bp, Rattus norvegicus
ggctgcctcccagttctcacgcacg

SEQ ID NO: 592290 - DNA, 25 bp, Rattus norvegicus
ggagagcagccaagcactgacaggc

SEQ ID NO: 592291 - DNA, 25 bp, Rattus norvegicus
tctcacgcacgcagctcagccacgc

SEQ ID NO: 592292 - DNA, 25 bp, Rattus norvegicus
gaattatttaccagcctccggcctc

SEQ ID NO: 592293 - DNA, 25 bp, Rattus norvegicus
gatgaattatttaccagcctccggc

SEQ ID NO: 592294 - DNA, 25 bp, Rattus norvegicus
cctccacgctgcactcggctgcctc

SEQ ID NO: 592295 - DNA, 25 bp, Rattus norvegicus
agccacgccggatgctccagcaggt

SEQ ID NO: 592296 - DNA, 25 bp, Rattus norvegicus
ccacgccggatgctccagcaggtgg

SEQ ID NO: 592297 - DNA, 25 bp, Rattus norvegicus
ctcgatctttcagagcgcctgcatt

SEQ ID NO: 592298 - DNA, 25 bp, Rattus norvegicus
gactccgggcgaccctattcgctga

SEQ ID NO: 592299 - DNA, 25 bp, Rattus norvegicus
cggcatggatctggtagagaccctc

SEQ ID NO: 592300 - DNA, 25 bp, Rattus norvegicus
aggctgcgcaggagccacaagactc

SEQ ID NO: 592301 - DNA, 25 bp, Rattus norvegicus
ctgcatttggaagcgaggggctatc

SEQ ID NO: 592302 - DNA, 25 bp, Rattus norvegicus
cggagggagagatcctagctcgatc

SEQ ID NO: 592303 - DNA, 25 bp, Rattus norvegicus
gcacatgatcacagagccgcagatg

SEQ ID NO: 592304 - DNA, 25 bp, Rattus norvegicus
cttttacgcgcggtcgcacatgatc

SEQ ID NO: 592305 - DNA, 25 bp, Rattus norvegicus
gtgccaaagtgcacgcaggctttta

SEQ ID NO: 592306 - DNA, 25 bp, Rattus norvegicus
tggctccaacagtgacccgcgtgtc

SEQ ID NO: 592307 - DNA, 25 bp, Rattus norvegicus
ctcaaatgcttccagcagcctggtg

SEQ ID NO: 592308 - DNA, 25 bp, Rattus norvegicus
gccactgctcactgtgccggaaact

SEQ ID NO: 592309 - DNA, 25 bp, Rattus norvegicus
attcgctgaggtccttaggccactg

SEQ ID NO: 592310 - DNA, 25 bp, Rattus norvegicus
ctctggctctagatccggtcggcat

SEQ ID NO: 592311 - DNA, 25 bp, Rattus norvegicus
aaatccgccgtagctgcgagcgcga

SEQ ID NO: 592312 - DNA, 25 bp, Rattus norvegicus
ggagacgcccatccagcgcgaaatc

SEQ ID NO: 592313 - DNA, 25 bp, Rattus norvegicus
tggcatccaaaccagcgcctgcgga

SEQ ID NO: 592314 - DNA, 25 bp, Rattus norvegicus
gttttccaccgaggcccgtggcatc

SEQ ID NO: 592315 - DNA, 25 bp, Rattus norvegicus
cgggacatcgaacgcgaggctcaca

SEQ ID NO: 592316 - DNA, 25 bp, Rattus norvegicus
gctggatgaactcaagcgcttcttt

SEQ ID NO: 592317 - DNA, 25 bp, Rattus norvegicus
agggcattgtgtcctacctatctgg

SEQ ID NO: 592318 - DNA, 25 bp, Rattus norvegicus
atctgggcatcttaatccggctctg

SEQ ID NO: 592319 - DNA, 25 bp, Rattus norvegicus
tccggctctgagaactgaaattgtc

SEQ ID NO: 592320 - DNA, 25 bp, Rattus norvegicus
gtgcgcctaactccgaacatccatg

SEQ ID NO: 592321 - DNA, 25 bp, Rattus norvegicus
gagtcctgggatcgcctgaaactta

SEQ ID NO: 592322 - DNA, 25 bp, Rattus norvegicus
taaagctacgtgttccgggagccgc

SEQ ID NO: 592323 - DNA, 25 bp, Rattus norvegicus
ctggcacttggataacggaggtact

SEQ ID NO: 592324 - DNA, 25 bp, Rattus norvegicus
cagaggcctccaggtgtgttttcca

SEQ ID NO: 592325 - DNA, 25 bp, Rattus norvegicus
ctggggctccagctctgttgaaccc

SEQ ID NO: 592326 - DNA, 25 bp, Rattus norvegicus
gaggtgggagcttccatcatggact

SEQ ID NO: 592327 - DNA, 25 bp, Rattus norvegicus
cggcgaccacgaggggtctccataa

SEQ ID NO: 592328 - DNA, 25 bp, Rattus norvegicus
accacgaggggtctccataaggctg

SEQ ID NO: 592329 - DNA, 25 bp, Rattus norvegicus
gtctccataaggctgcggcccgggt

SEQ ID NO: 592330 - DNA, 25 bp, Rattus norvegicus
ccaattcctccgagggcggtgcttc

SEQ ID NO: 592331 - DNA, 25 bp, Rattus norvegicus
ccaggactccgcagccatccacgtc

SEQ ID NO: 592332 - DNA, 25 bp, Rattus norvegicus
catccacgtccacagcaggctcctc

SEQ ID NO: 592333 - DNA, 25 bp, Rattus norvegicus
tctcagcccagcctcgacgtctctg

SEQ ID NO: 592334 - DNA, 25 bp, Rattus norvegicus
gggatttcgcctcttttgaatttca

SEQ ID NO: 592335 - DNA, 25 bp, Rattus norvegicus
tttgaatttcagcacgcggagggcg

SEQ ID NO: 592336 - DNA, 25 bp, Rattus norvegicus
tgccaagggcggagcccacaccagc

SEQ ID NO: 592337 - DNA, 25 bp, Rattus norvegicus
accagccttgtggttgcggcgcaca

SEQ ID NO: 592338 - DNA, 25 bp, Rattus norvegicus
ttccatcatggactgtgctcgctgg

SEQ ID NO: 592339 - DNA, 25 bp, Rattus norvegicus
ccgcagatcaggtcactgaccaaga

SEQ ID NO: 592340 - DNA, 25 bp, Rattus norvegicus
ggtagcgcacgacttcccgcaggct

SEQ ID NO: 592341 - DNA, 25 bp, Rattus norvegicus
ggcctcgcgccgcttcctcttccag

SEQ ID NO: 592342 - DNA, 25 bp, Rattus norvegicus
ggaaactgaggctcccgcagatcag

SEQ ID NO: 592343 - DNA, 25 bp, Rattus norvegicus
actgaccaagaccaccgcgttcgga

SEQ ID NO: 592344 - DNA, 25 bp, Rattus norvegicus
aggctcccgcagatcaggtcactga

SEQ ID NO: 592345 - DNA, 25 bp, Rattus norvegicus
cgtgccaggttctgggttaataaag

SEQ ID NO: 592346 - DNA, 25 bp, Rattus norvegicus
ctgggttaataaagccctcaatagc

SEQ ID NO: 592347 - DNA, 25 bp, Rattus norvegicus
gccctcaatagccaagtcttactaa

SEQ ID NO: 592348 - DNA, 25 bp, Rattus norvegicus
gtcttactaaactcgctcaactacc

SEQ ID NO: 592349 - DNA, 25 bp, Rattus norvegicus
cccaggggtcgctactgtcagcaat

SEQ ID NO: 592350 - DNA, 25 bp, Rattus norvegicus
cgctactgtcagcaatccgcgttta

SEQ ID NO: 592351 - DNA, 25 bp, Rattus norvegicus
tccgcgtttacagccgaggaaactg

SEQ ID NO: 592352 - DNA, 25 bp, Rattus norvegicus
agaccaccgcgttcggagtccacgg

SEQ ID NO: 592353 - DNA, 25 bp, Rattus norvegicus
tgctaatcctatttggccgaaccgg

SEQ ID NO: 592354 - DNA, 25 bp, Rattus norvegicus
ggccgccctccagccattgggcgcg

SEQ ID NO: 592355 - DNA, 25 bp, Rattus norvegicus
attgggcgcgggacccagacgtcct

SEQ ID NO: 592356 - DNA, 25 bp, Rattus norvegicus
acccagacgtcctcggcgcccagcc

SEQ ID NO: 592357 - DNA, 25 bp, Rattus norvegicus
tctccacgcctctccgcgcgcagcg

SEQ ID NO: 592358 - DNA, 25 bp, Rattus norvegicus
cagcgctctcgggaccgcacttacc

SEQ ID NO: 592359 - DNA, 25 bp, Rattus norvegicus
gcacttaccgggaactagccgcgtc

SEQ ID NO: 592360 - DNA, 25 bp, Rattus norvegicus
taccgggaactagccgcgtcgcggc

SEQ ID NO: 592361 - DNA, 25 bp, Rattus norvegicus
tcgctcctgggagccgcggagacct

SEQ ID NO: 592362 - DNA, 25 bp, Rattus norvegicus
tgggagccgcggagacctcactagc

SEQ ID NO: 592363 - DNA, 25 bp, Rattus norvegicus
gagacctcactagcggccctgcctc

SEQ ID NO: 592364 - DNA, 25 bp, Rattus norvegicus
tgcctcgcctacacgaggactccgg

SEQ ID NO: 592365 - DNA, 25 bp, Rattus norvegicus
cttcgactctgctaatcctatttgg

SEQ ID NO: 592366 - DNA, 25 bp, Rattus norvegicus
ttctccttcgactctgctaatccta

SEQ ID NO: 592367 - DNA, 25 bp, Rattus norvegicus
gctggctcccggtcctcggctgccc

SEQ ID NO: 592368 - DNA, 25 bp, Rattus norvegicus
cctgctctagcagtgacggagcaac

SEQ ID NO: 592369 - DNA, 25 bp, Rattus norvegicus
tgccgctgcaagctcgctccgtcct

SEQ ID NO: 592370 - DNA, 25 bp, Rattus norvegicus
ctgaagggcggggtgcaaccggcct

SEQ ID NO: 592371 - DNA, 25 bp, Rattus norvegicus
taccggacagccgtcctgaagggcg

SEQ ID NO: 592372 - DNA, 25 bp, Rattus norvegicus
cagtaccggacagccgtcctgaagg

SEQ ID NO: 592373 - DNA, 25 bp, Rattus norvegicus
aacgagcggcggcaactgccccagt

SEQ ID NO: 592374 - DNA, 25 bp, Rattus norvegicus
accgcttacgggtgaggctcggcgc

SEQ ID NO: 592375 - DNA, 25 bp, Rattus norvegicus
ctctagcagtgacggagcaacgagc

SEQ ID NO: 592376 - DNA, 25 bp, Rattus norvegicus
ctcctgctctagcagtgacggagca

SEQ ID NO: 592377 - DNA, 25 bp, Rattus norvegicus
cggagcacctcctgctctagcagtg

SEQ ID NO: 592378 - DNA, 25 bp, Rattus norvegicus
tcgcgctcacgcacccggagcacct

SEQ ID NO: 592379 - DNA, 25 bp, Rattus norvegicus
cccgtagatgctgcgccgctgcagc

SEQ ID NO: 592380 - DNA, 25 bp, Rattus norvegicus
agcacctcctgctctagcagtgacg

SEQ ID NO: 592381 - DNA, 25 bp, Rattus norvegicus
gcgccgttcggcgtcattcataagg

SEQ ID NO: 592382 - DNA, 25 bp, Rattus norvegicus
cttccattggttcaggcctccctga

SEQ ID NO: 592383 - DNA, 25 bp, Rattus norvegicus
cgcgccaccataggctcctggatga

SEQ ID NO: 592384 - DNA, 25 bp, Rattus norvegicus
tgagtgacgcgagttgcagactctc

SEQ ID NO: 592385 - DNA, 25 bp, Rattus norvegicus
ttgcagactctcgtccattcacggg

SEQ ID NO: 592386 - DNA, 25 bp, Rattus norvegicus
ccattcacgggcttgtgaggccgca

SEQ ID NO: 592387 - DNA, 25 bp, Rattus norvegicus
ccatgtgattggtcaaaaagcccga

SEQ ID NO: 592388 - DNA, 25 bp, Rattus norvegicus
tcgccctgagaagccgtcgattggc

SEQ ID NO: 592389 - DNA, 25 bp, Rattus norvegicus
gttgacgccacagcgagccggcgca

SEQ ID NO: 592390 - DNA, 25 bp, Rattus norvegicus
gcagtccaccttccattggttcagg

SEQ ID NO: 592391 - DNA, 25 bp, Rattus norvegicus
ctgacactgggcagccgtgacccaa

SEQ ID NO: 592392 - DNA, 25 bp, Rattus norvegicus
agccgtgacccaagcagctccgggt

SEQ ID NO: 592393 - DNA, 25 bp, Rattus norvegicus
ccgctttggtttgctcgcgacacaa

SEQ ID NO: 592394 - DNA, 25 bp, Rattus norvegicus
ctacgggccagaggttgacgccaca

SEQ ID NO: 592395 - DNA, 25 bp, Rattus norvegicus
ctcttagcttcgtaaaggtctatcg

SEQ ID NO: 592396 - DNA, 25 bp, Rattus norvegicus
cgcctggaccaacagaccaatcaga

SEQ ID NO: 592397 - DNA, 25 bp, Rattus norvegicus
gggaaccaatccctagagtctccga

SEQ ID NO: 592398 - DNA, 25 bp, Rattus norvegicus
actcgaatagcttgtacgggtgggc

SEQ ID NO: 592399 - DNA, 25 bp, Rattus norvegicus
gcgcggaacttctcttgtccaatcc

SEQ ID NO: 592400 - DNA, 25 bp, Rattus norvegicus
tcccaagggttaccgcaccagcatg

SEQ ID NO: 592401 - DNA, 25 bp, Rattus norvegicus
gcttttccggtagacgcacctcaca

SEQ ID NO: 592402 - DNA, 25 bp, Rattus norvegicus
gagagcagcgccaccaacggccgaa

SEQ ID NO: 592403 - DNA, 25 bp, Rattus norvegicus
ctacaggaggcggaacgataatctc

SEQ ID NO: 592404 - DNA, 25 bp, Rattus norvegicus
agagacgctccctcttcacggtcta

SEQ ID NO: 592405 - DNA, 25 bp, Rattus norvegicus
agccaatcgccgctaaggatctatg

SEQ ID NO: 592406 - DNA, 25 bp, Rattus norvegicus
gtggcgcgcgactctcactaaaacg

SEQ ID NO: 592407 - DNA, 25 bp, Rattus norvegicus
cgtaagcgcgctcccttcaaatagc

SEQ ID NO: 592408 - DNA, 25 bp, Rattus norvegicus
ctaaggatctatgacggcgcgagcc

SEQ ID NO: 592409 - DNA, 25 bp, Rattus norvegicus
gcaaaacctggcctggactcaccgt

SEQ ID NO: 592410 - DNA, 25 bp, Rattus norvegicus
cggcacgtgtgtgcccaggcgactt

SEQ ID NO: 592411 - DNA, 25 bp, Rattus norvegicus
cgcggggcaccagcaatgacaagcc

SEQ ID NO: 592412 - DNA, 25 bp, Rattus norvegicus
ggcaccagcaatgacaagccgcctg

SEQ ID NO: 592413 - DNA, 25 bp, Rattus norvegicus
gagggcaagcgcaaaacctggcctg

SEQ ID NO: 592414 - DNA, 25 bp, Rattus norvegicus
ctacgcagctagaagcaggcgcggc

SEQ ID NO: 592415 - DNA, 25 bp, Rattus norvegicus
tggactcaccgtccaggactagcct

SEQ ID NO: 592416 - DNA, 25 bp, Rattus norvegicus
ggaaacctggcctggagttccactc

SEQ ID NO: 592417 - DNA, 25 bp, Rattus norvegicus
aagaaaaggcggatcgcggcgctcc

SEQ ID NO: 592418 - DNA, 25 bp, Rattus norvegicus
cgagggaggactccgtgtcccttct

SEQ ID NO: 592419 - DNA, 25 bp, Rattus norvegicus
agagggagtcgacgcgctagatccc

SEQ ID NO: 592420 - DNA, 25 bp, Rattus norvegicus
gaaaaaccggaacggattctgcagc

SEQ ID NO: 592421 - DNA, 25 bp, Rattus norvegicus
agccgtgctgtgcagaaaggcgcct

SEQ ID NO: 592422 - DNA, 25 bp, Rattus norvegicus
ggaacggattctgcagccgtgctgt

SEQ ID NO: 592423 - DNA, 25 bp, Rattus norvegicus
aaagcagccaagaggggcgctgtcc

SEQ ID NO: 592424 - DNA, 25 bp, Rattus norvegicus
gggcgctgtcctaattccggcacac

SEQ ID NO: 592425 - DNA, 25 bp, Rattus norvegicus
gctgtcctaattccggcacacctag

SEQ ID NO: 592426 - DNA, 25 bp, Rattus norvegicus
tcctaattccggcacacctagcggg

SEQ ID NO: 592427 - DNA, 25 bp, Rattus norvegicus
cctaattccggcacacctagcgggg

SEQ ID NO: 592428 - DNA, 25 bp, Rattus norvegicus
gtcgaacgctgaaagggacgcggct

SEQ ID NO: 592429 - DNA, 25 bp, Rattus norvegicus
ggacccgccgtctgcgcttcaaatg

SEQ ID NO: 592430 - DNA, 25 bp, Rattus norvegicus
ccgccgtctgcgcttcaaatgcaaa

SEQ ID NO: 592431 - DNA, 25 bp, Rattus norvegicus
gccgtctgcgcttcaaatgcaaaat

SEQ ID NO: 592432 - DNA, 25 bp, Rattus norvegicus
gtctgcgcttcaaatgcaaaatccg

SEQ ID NO: 592433 - DNA, 25 bp, Rattus norvegicus
cttcaaatgcaaaatccgagcgggg

SEQ ID NO: 592434 - DNA, 25 bp, Rattus norvegicus
ccgccctgggggatgaaagcagcca

SEQ ID NO: 592435 - DNA, 25 bp, Rattus norvegicus
ccaagaggggcgctgtcctaattcc

SEQ ID NO: 592436 - DNA, 25 bp, Rattus norvegicus
tgcgcttcaaatgcaaaatccgagc

SEQ ID NO: 592437 - DNA, 25 bp, Rattus norvegicus
ccggcctctcctgtccgcccggcct

SEQ ID NO: 592438 - DNA, 25 bp, Rattus norvegicus
gggtgggcaggcagactaccactct

SEQ ID NO: 592439 - DNA, 25 bp, Rattus norvegicus
ggcaggcagactaccactctgcttg

SEQ ID NO: 592440 - DNA, 25 bp, Rattus norvegicus
agactaccactctgcttggcgggtg

SEQ ID NO: 592441 - DNA, 25 bp, Rattus norvegicus
taccactctgcttggcgggtggcga

SEQ ID NO: 592442 - DNA, 25 bp, Rattus norvegicus
gtctacgccgaggtgaacagcctga

SEQ ID NO: 592443 - DNA, 25 bp, Rattus norvegicus
tacgccgaggtgaacagcctgagga

SEQ ID NO: 592444 - DNA, 25 bp, Rattus norvegicus
caagggctcctaaggggtgacctgc

SEQ ID NO: 592445 - DNA, 25 bp, Rattus norvegicus
aacagcctgaggagccgcgagtact

SEQ ID NO: 592446 - DNA, 25 bp, Rattus norvegicus
gagccgcgagtactgggactacgaa

SEQ ID NO: 592447 - DNA, 25 bp, Rattus norvegicus
cgcgaaccgcaccttgccggccgct

SEQ ID NO: 592448 - DNA, 25 bp, Rattus norvegicus
ctaaaagcggcgctagtcgagggca

SEQ ID NO: 592449 - DNA, 25 bp, Rattus norvegicus
gctagtcgagggcaagggctcctaa

SEQ ID NO: 592450 - DNA, 25 bp, Rattus norvegicus
cgagtactgggactacgaagcccac

SEQ ID NO: 592451 - DNA, 25 bp, Rattus norvegicus
cgcagatctggcgttggctcgaaag

SEQ ID NO: 592452 - DNA, 25 bp, Rattus norvegicus
ccaggcccataacgcaggggcgcga

SEQ ID NO: 592453 - DNA, 25 bp, Rattus norvegicus
gaagtgctcgctctccgcccgggaa

SEQ ID NO: 592454 - DNA, 25 bp, Rattus norvegicus
cctgcaagtggaccacggggtccgc

SEQ ID NO: 592455 - DNA, 25 bp, Rattus norvegicus
catgagcagtaacagcgggcgctcc

SEQ ID NO: 592456 - DNA, 25 bp, Rattus norvegicus
ggcggctctagaacctgctggctcc

SEQ ID NO: 592457 - DNA, 25 bp, Rattus norvegicus
cccagagtgcgggaggaaccgcaca

SEQ ID NO: 592458 - DNA, 25 bp, Rattus norvegicus
cgggaggaaccgcacataaatctgc

SEQ ID NO: 592459 - DNA, 25 bp, Rattus norvegicus
cgagctcccgtgcactgcgcatgag

SEQ ID NO: 592460 - DNA, 25 bp, Rattus norvegicus
gccgtaatgatggtagtgctaatga

SEQ ID NO: 592461 - DNA, 25 bp, Rattus norvegicus
aatgatggtagtgctaatgagaccc

SEQ ID NO: 592462 - DNA, 25 bp, Rattus norvegicus
tccaaccctgcaagtggaccacggg

SEQ ID NO: 592463 - DNA, 25 bp, Rattus norvegicus
cgcacataaatctgccgtaatgatg

SEQ ID NO: 592464 - DNA, 25 bp, Rattus norvegicus
tggtgtttggagaagtgctcgctct

SEQ ID NO: 592465 - DNA, 25 bp, Rattus norvegicus
agctctctgtcaacccagacgctgt

SEQ ID NO: 592466 - DNA, 25 bp, Rattus norvegicus
tctgtcaacccagacgctgtccgtt

SEQ ID NO: 592467 - DNA, 25 bp, Rattus norvegicus
gacgctgtccgttccgcgccaccat

SEQ ID NO: 592468 - DNA, 25 bp, Rattus norvegicus
accatgaggggcgtcagctgtcacc

SEQ ID NO: 592469 - DNA, 25 bp, Rattus norvegicus
gtcagctgtcacctcctgctcggtg

SEQ ID NO: 592470 - DNA, 25 bp, Rattus norvegicus
tgtcacctcctgctcggtgagacct

SEQ ID NO: 592471 - DNA, 25 bp, Rattus norvegicus
acctcctgctcggtgagacctcggg

SEQ ID NO: 592472 - DNA, 25 bp, Rattus norvegicus
ctgttactttccagcggggaggaca

SEQ ID NO: 592473 - DNA, 25 bp, Rattus norvegicus
ctttccagcggggaggacagttccg

SEQ ID NO: 592474 - DNA, 25 bp, Rattus norvegicus
tgcataaaggcccagcccagccgcc

SEQ ID NO: 592475 - DNA, 25 bp, Rattus norvegicus
cccacgcccgctgcataaaggccca

SEQ ID NO: 592476 - DNA, 25 bp, Rattus norvegicus
ccagtcgggagtagcgtttgttcca

SEQ ID NO: 592477 - DNA, 25 bp, Rattus norvegicus
aggggcagggacaggcaaagcccgc

SEQ ID NO: 592478 - DNA, 25 bp, Rattus norvegicus
ggcactttcctgttactttccagcg

SEQ ID NO: 592479 - DNA, 25 bp, Rattus norvegicus
caacggccgccgtctccagtggggt

SEQ ID NO: 592480 - DNA, 25 bp, Rattus norvegicus
ggcatctgcccagaaagcctgggtc

SEQ ID NO: 592481 - DNA, 25 bp, Rattus norvegicus
ttcgcctccgcgagctgcgaagaga

SEQ ID NO: 592482 - DNA, 25 bp, Rattus norvegicus
tgaatggcctaagggccgccacacc

SEQ ID NO: 592483 - DNA, 25 bp, Rattus norvegicus
cttcggagtctggaggtgaatctcc

SEQ ID NO: 592484 - DNA, 25 bp, Rattus norvegicus
acgacacccggtgaatggcctaagg

SEQ ID NO: 592485 - DNA, 25 bp, Rattus norvegicus
cgcgaccgaaaacgcagcctggagc

SEQ ID NO: 592486 - DNA, 25 bp, Rattus norvegicus
cacagtacacatgcgggcctccgag

SEQ ID NO: 592487 - DNA, 25 bp, Rattus norvegicus
gatcccggaagccaacgcactaacg

SEQ ID NO: 592488 - DNA, 25 bp, Rattus norvegicus
ggaagccaacgcactaacggccggc

SEQ ID NO: 592489 - DNA, 25 bp, Rattus norvegicus
cctggcgcatgcttactggaaccca

SEQ ID NO: 592490 - DNA, 25 bp, Rattus norvegicus
atgcttactggaacccaacggccgc

SEQ ID NO: 592491 - DNA, 25 bp, Rattus norvegicus
tctccagtggggtgcctaaccgtcc

SEQ ID NO: 592492 - DNA, 25 bp, Rattus norvegicus
ccggctttccgcttcggagtctgga

SEQ ID NO: 592493 - DNA, 25 bp, Rattus norvegicus
gacgccgtgcaggtaggctacccgc

SEQ ID NO: 592494 - DNA, 25 bp, Rattus norvegicus
cacgggtagaatccgagacgaggtc

SEQ ID NO: 592495 - DNA, 25 bp, Rattus norvegicus
ctactctgggtcctcagcgttcggt

SEQ ID NO: 592496 - DNA, 25 bp, Rattus norvegicus
ggccgctcaggcctgttcagagtcc

SEQ ID NO: 592497 - DNA, 25 bp, Rattus norvegicus
cctacgctatgaggagcgcttgcca

SEQ ID NO: 592498 - DNA, 25 bp, Rattus norvegicus
ggaaggtctgggctccgcgcttccc

SEQ ID NO: 592499 - DNA, 25 bp, Rattus norvegicus
ctgttcgggattctaccactgcatc

SEQ ID NO: 592500 - DNA, 25 bp, Rattus norvegicus
agacgtctttacgatggtcttgacg

SEQ ID NO: 592501 - DNA, 25 bp, Rattus norvegicus
tccgcctgcagacgtctttacgatg

SEQ ID NO: 592502 - DNA, 25 bp, Rattus norvegicus
cctggagcaggtgcctggcaccctg

SEQ ID NO: 592503 - DNA, 25 bp, Rattus norvegicus
ggcaggtgccgcttcacctggagca

SEQ ID NO: 592504 - DNA, 25 bp, Rattus norvegicus
ccacttcggtgtccgaggccagctg

SEQ ID NO: 592505 - DNA, 25 bp, Rattus norvegicus
cctcagcgttcggtttctggcaggt

SEQ ID NO: 592506 - DNA, 25 bp, Rattus norvegicus
cttgccacgcagcacagcgaacaga

SEQ ID NO: 592507 - DNA, 25 bp, Rattus norvegicus
acatggcctgctaggtcgatggcaa

SEQ ID NO: 592508 - DNA, 25 bp, Rattus norvegicus
gttggacacagcacccagcgtcatg

SEQ ID NO: 592509 - DNA, 25 bp, Rattus norvegicus
cagtatacaggcgaagcaccaaggc

SEQ ID NO: 592510 - DNA, 25 bp, Rattus norvegicus
gggcgcacgtcctgcagtatacagg

SEQ ID NO: 592511 - DNA, 25 bp, Rattus norvegicus
gaagaccatgcagccgcccaggaaa

SEQ ID NO: 592512 - DNA, 25 bp, Rattus norvegicus
cagcgtcatggagaagataggcagc

SEQ ID NO: 592513 - DNA, 25 bp, Rattus norvegicus
ggccatgccacagccaagcaaaagt

SEQ ID NO: 592514 - DNA, 25 bp, Rattus norvegicus
tgtagctcgtagtgacccacgtgca

SEQ ID NO: 592515 - DNA, 25 bp, Rattus norvegicus
aagtgccagggtactgtagctcgta

SEQ ID NO: 592516 - DNA, 25 bp, Rattus norvegicus
cccaaggctaatgaaacaccaagtg

SEQ ID NO: 592517 - DNA, 25 bp, Rattus norvegicus
ttacacactagtgcggcaaggagcg

SEQ ID NO: 592518 - DNA, 25 bp, Rattus norvegicus
aggccgctgagcgtattacacacta

SEQ ID NO: 592519 - DNA, 25 bp, Rattus norvegicus
cgggacctgcgttctctcggaaacg

SEQ ID NO: 592520 - DNA, 25 bp, Rattus norvegicus
tgggcacaggccaaagaagaccatg

SEQ ID NO: 592521 - DNA, 25 bp, Rattus norvegicus
tgttatccggacctgggtggtctcc

SEQ ID NO: 592522 - DNA, 25 bp, Rattus norvegicus
ccgagctctgtacccaggaaagcgc

SEQ ID NO: 592523 - DNA, 25 bp, Rattus norvegicus
tttggaggaccgagctctgtaccca

SEQ ID NO: 592524 - DNA, 25 bp, Rattus norvegicus
ctctaaatgacggagggctgaacca

SEQ ID NO: 592525 - DNA, 25 bp, Rattus norvegicus
ggtccaaccttactcgctctaaatg

SEQ ID NO: 592526 - DNA, 25 bp, Rattus norvegicus
cccatcgtgcgagcagtggtccaac

SEQ ID NO: 592527 - DNA, 25 bp, Rattus norvegicus
cggaacgctctggagggatccctcc

SEQ ID NO: 592528 - DNA, 25 bp, Rattus norvegicus
tcatgtccaatgagcgcctccggtc

SEQ ID NO: 592529 - DNA, 25 bp, Rattus norvegicus
accaccaacagggagcgtccaggga

SEQ ID NO: 592530 - DNA, 25 bp, Rattus norvegicus
agctgttgttactgttatccggacc

SEQ ID NO: 592531 - DNA, 25 bp, Rattus norvegicus
gggaggcatcaaactagtacagctg

SEQ ID NO: 592532 - DNA, 25 bp, Rattus norvegicus
cgtaagtgccggacgaggaaacgct

SEQ ID NO: 592533 - DNA, 25 bp, Rattus norvegicus
gctgtgcaccgtaagtgccggacga

SEQ ID NO: 592534 - DNA, 25 bp, Rattus norvegicus
cggccgtgcacactcatgtccaatg

SEQ ID NO: 592535 - DNA, 25 bp, Rattus norvegicus
gcccagcgtctggtagtagtccttg

SEQ ID NO: 592536 - DNA, 25 bp, Rattus norvegicus
ttcctcgcctgtcaaacggcgggtc

SEQ ID NO: 592537 - DNA, 25 bp, Rattus norvegicus
gcccgcttgatctcgtcgtcggacg

SEQ ID NO: 592538 - DNA, 25 bp, Rattus norvegicus
gctccttgttcttgtccgggtggta

SEQ ID NO: 592539 - DNA, 25 bp, Rattus norvegicus
ggcgatctccttgaacttctcctcg

SEQ ID NO: 592540 - DNA, 25 bp, Rattus norvegicus
cggtcgaaaatctcgcgcttgcgcg

SEQ ID NO: 592541 - DNA, 25 bp, Rattus norvegicus
ccttcctctccatagcggtcgaaaa

SEQ ID NO: 592542 - DNA, 25 bp, Rattus norvegicus
gtccggcggaagcttccagatcccg

SEQ ID NO: 592543 - DNA, 25 bp, Rattus norvegicus
tctgaggccgccgattagagagaag

SEQ ID NO: 592544 - DNA, 25 bp, Rattus norvegicus
tgcggcagacgtgctagaagcttct

SEQ ID NO: 592545 - DNA, 25 bp, Rattus norvegicus
gcaattttcattcccatcgcgaccg

SEQ ID NO: 592546 - DNA, 25 bp, Rattus norvegicus
gggaatcgacacttgggcaattttc

SEQ ID NO: 592547 - DNA, 25 bp, Rattus norvegicus
ggactctatatacccgtccggcgga

SEQ ID NO: 592548 - DNA, 25 bp, Rattus norvegicus
tagaagcttctgtgctagcggcgca

SEQ ID NO: 592549 - DNA, 25 bp, Rattus norvegicus
acctcacgctgattggcagaaggga

SEQ ID NO: 592550 - DNA, 25 bp, Rattus norvegicus
cgcgagcagtgggtgcacctcacgc

SEQ ID NO: 592551 - DNA, 25 bp, Rattus norvegicus
agctgattggtcagtcgtgtggcgc

SEQ ID NO: 592552 - DNA, 25 bp, Rattus norvegicus
ggtcccctgcgctccttgaatctgg

SEQ ID NO: 592553 - DNA, 25 bp, Rattus norvegicus
tcttgcctgccaagacacggagggg

SEQ ID NO: 592554 - DNA, 25 bp, Rattus norvegicus
gccgagttttaatcttgcctgccaa

SEQ ID NO: 592555 - DNA, 25 bp, Rattus norvegicus
gttggtggccgagttttaatcttgc

SEQ ID NO: 592556 - DNA, 25 bp, Rattus norvegicus
tgattggttggtggccgagttttaa

SEQ ID NO: 592557 - DNA, 25 bp, Rattus norvegicus
ccttttgattggttggtggccgagt

SEQ ID NO: 592558 - DNA, 25 bp, Rattus norvegicus
cgccaaggctcccttttgattggtt

SEQ ID NO: 592559 - DNA, 25 bp, Rattus norvegicus
ccgcgccaaggctcccttttgattg

SEQ ID NO: 592560 - DNA, 25 bp, Rattus norvegicus
gtgcacctcacgctgattggcagaa

SEQ ID NO: 592561 - DNA, 25 bp, Rattus norvegicus
ttggcagaagggacgcacgcataga

SEQ ID NO: 592562 - DNA, 25 bp, Rattus norvegicus
cacgctgattggcagaagggacgca

SEQ ID NO: 592563 - DNA, 25 bp, Rattus norvegicus
ggcatcttctcagggtcaggctcca

SEQ ID NO: 592564 - DNA, 25 bp, Rattus norvegicus
ttccgggtcatctagcccgcagcgg

SEQ ID NO: 592565 - DNA, 25 bp, Rattus norvegicus
cttgcgctccggaagaccgtagttc

SEQ ID NO: 592566 - DNA, 25 bp, Rattus norvegicus
tagagacgaacggtggaagacttcc

SEQ ID NO: 592567 - DNA, 25 bp, Rattus norvegicus
cgctgtgtccaggacgaagtgcacc

SEQ ID NO: 592568 - DNA, 25 bp, Rattus norvegicus
ccttcagtgacttccgggtcatcta

SEQ ID NO: 592569 - DNA, 25 bp, Rattus norvegicus
ctttctttagcagccggggtcacct

SEQ ID NO: 592570 - DNA, 25 bp, Rattus norvegicus
ggctactctgccctacctttcttta

SEQ ID NO: 592571 - DNA, 25 bp, Rattus norvegicus
atcccacagatagcgccgggtcagg

SEQ ID NO: 592572 - DNA, 25 bp, Rattus norvegicus
ttcggcgggaagctgggcatcttct

SEQ ID NO: 592573 - DNA, 25 bp, Rattus norvegicus
ctctgcagccgagttccgcgggatc

SEQ ID NO: 592574 - DNA, 25 bp, Rattus norvegicus
tgtcttgtcccagccttttctcagg

SEQ ID NO: 592575 - DNA, 25 bp, Rattus norvegicus
agtgcaccggggcagtctcgtcttc

SEQ ID NO: 592576 - DNA, 25 bp, Rattus norvegicus
ggaagacttcctggcccgctggcac

SEQ ID NO: 592577 - DNA, 25 bp, Rattus norvegicus
gcctctttctttggcgcgtcttctc

SEQ ID NO: 592578 - DNA, 25 bp, Rattus norvegicus
gccgggagacctccgagtccctgag

SEQ ID NO: 592579 - DNA, 25 bp, Rattus norvegicus
aaacgcaaggtgaggcgacccaggc

SEQ ID NO: 592580 - DNA, 25 bp, Rattus norvegicus
tcccggcgcctcaaacgcaaggtga

SEQ ID NO: 592581 - DNA, 25 bp, Rattus norvegicus
aaggattggtgggagtccgcctcct

SEQ ID NO: 592582 - DNA, 25 bp, Rattus norvegicus
tgcgcaggcgtgcaatctcgagtaa

SEQ ID NO: 592583 - DNA, 25 bp, Rattus norvegicus
cggtgctctgccaagggctagtcgc

SEQ ID NO: 592584 - DNA, 25 bp, Rattus norvegicus
cctgattgggcgtcaatgccctttt

SEQ ID NO: 592585 - DNA, 25 bp, Rattus norvegicus
tcttctgcgtcgtgattggttgctg

SEQ ID NO: 592586 - DNA, 25 bp, Rattus norvegicus
agatctgcagcgagagcctctttct

SEQ ID NO: 592587 - DNA, 25 bp, Rattus norvegicus
ggaagagcctgacgttgccgaacag

SEQ ID NO: 592588 - DNA, 25 bp, Rattus norvegicus
ggttgctgcctttttaggacacgcc

SEQ ID NO: 592589 - DNA, 25 bp, Rattus norvegicus
aggacacgcccaacacgcctgattg

SEQ ID NO: 592590 - DNA, 25 bp, Rattus norvegicus
gcgcgtcttctcttctgcgtcgtga

SEQ ID NO: 592591 - DNA, 25 bp, Rattus norvegicus
tgacgtcacttcacagaacctagca

SEQ ID NO: 592592 - DNA, 25 bp, Rattus norvegicus
ggctgcacgagagaagctgtcgccc

SEQ ID NO: 592593 - DNA, 25 bp, Rattus norvegicus
acgtagcagcttcgggagtgcgctt

SEQ ID NO: 592594 - DNA, 25 bp, Rattus norvegicus
actcacggtggttcccactggccga

SEQ ID NO: 592595 - DNA, 25 bp, Rattus norvegicus
acggggaccaagtgccgccgactca

SEQ ID NO: 592596 - DNA, 25 bp, Rattus norvegicus
ctaacctttccggttcaggaatgcg

SEQ ID NO: 592597 - DNA, 25 bp, Rattus norvegicus
cgcgatctctggtgctggcgttgct

SEQ ID NO: 592598 - DNA, 25 bp, Rattus norvegicus
tgccgcctccttgggcagaatgagc

SEQ ID NO: 592599 - DNA, 25 bp, Rattus norvegicus
agtccgttatggctgccgcctcctt

SEQ ID NO: 592600 - DNA, 25 bp, Rattus norvegicus
aacctagcaacagcgcaggctccgg

SEQ ID NO: 592601 - DNA, 25 bp, Rattus norvegicus
tcggacgcgtctctgacgtcacttc

SEQ ID NO: 592602 - DNA, 25 bp, Rattus norvegicus
catcacgtcgggacgtagcagcttc

SEQ ID NO: 592603 - DNA, 25 bp, Rattus norvegicus
ccggttcaggaatgcgacgtcatca

SEQ ID NO: 592604 - DNA, 25 bp, Rattus norvegicus
gccggtcctgtgctatggtaatgga

SEQ ID NO: 592605 - DNA, 25 bp, Rattus norvegicus
tcagatacgcctgcgcagggacagc

SEQ ID NO: 592606 - DNA, 25 bp, Rattus norvegicus
gcagcactgcatcacaacgtccagg

SEQ ID NO: 592607 - DNA, 25 bp, Rattus norvegicus
aacgtccaggcactgttcgagggtg

SEQ ID NO: 592608 - DNA, 25 bp, Rattus norvegicus
gttgtgcgtcagatacgcctgcgca

SEQ ID NO: 592609 - DNA, 25 bp, Rattus norvegicus
cagggacagcaaagaggataatgct

SEQ ID NO: 592610 - DNA, 25 bp, Rattus norvegicus
ggataatgctcgtcgacaagctggc

SEQ ID NO: 592611 - DNA, 25 bp, Rattus norvegicus
tcgacaagctggcactcgacgacgg

SEQ ID NO: 592612 - DNA, 25 bp, Rattus norvegicus
ccttggcaagaaggccaaacgcttt

SEQ ID NO: 592613 - DNA, 25 bp, Rattus norvegicus
caaacgctttctgggccgcatagta

SEQ ID NO: 592614 - DNA, 25 bp, Rattus norvegicus
gggccgcatagtagctcgcaacagc

SEQ ID NO: 592615 - DNA, 25 bp, Rattus norvegicus
tcgcaacagccgcaagatggccttt

SEQ ID NO: 592616 - DNA, 25 bp, Rattus norvegicus
gttcatcgagacctccgcagcactg

SEQ ID NO: 592617 - DNA, 25 bp, Rattus norvegicus
ctcgacgacgggagagccttggcaa

SEQ ID NO: 592618 - DNA, 25 bp, Rattus norvegicus
cactgttcgagggtgttgtgcgtca

SEQ ID NO: 592619 - DNA, 25 bp, Rattus norvegicus
cggctggcgagatgttcaagaacac

SEQ ID NO: 592620 - DNA, 25 bp, Rattus norvegicus
tgacaccacgcaggcactgtaaaca

SEQ ID NO: 592621 - DNA, 25 bp, Rattus norvegicus
cactgtaaacacgtgcggtaacttc

SEQ ID NO: 592622 - DNA, 25 bp, Rattus norvegicus
cacgtgcggtaacttcttacgtctc

SEQ ID NO: 592623 - DNA, 25 bp, Rattus norvegicus
cttacgtctccttccgctgttctga

SEQ ID NO: 592624 - DNA, 25 bp, Rattus norvegicus
ctgttctgaagcaagtctcggctgc

SEQ ID NO: 592625 - DNA, 25 bp, Rattus norvegicus
cttggcaaccgagttccgctccgga

SEQ ID NO: 592626 - DNA, 25 bp, Rattus norvegicus
aaccgctctttctgcggtaggactg

SEQ ID NO: 592627 - DNA, 25 bp, Rattus norvegicus
gtgtgttcaccgaggcttgcggatc

SEQ ID NO: 592628 - DNA, 25 bp, Rattus norvegicus
ctctctttcgccgttcggttccgat

SEQ ID NO: 592629 - DNA, 25 bp, Rattus norvegicus
caagaacacgttccagagcggcttc

SEQ ID NO: 592630 - DNA, 25 bp, Rattus norvegicus
atcctctacagcatcggcagcaagc

SEQ ID NO: 592631 - DNA, 25 bp, Rattus norvegicus
ctgcagatctgggacaaaaaggtga

SEQ ID NO: 592632 - DNA, 25 bp, Rattus norvegicus
tcagtgtccttccttcggaccggcg

SEQ ID NO: 592633 - DNA, 25 bp, Rattus norvegicus
cagctcaggtgtccgactggccgct

SEQ ID NO: 592634 - DNA, 25 bp, Rattus norvegicus
cgcgcccaggggaaaatgcggtcct

SEQ ID NO: 592635 - DNA, 25 bp, Rattus norvegicus
gggcacctggatccgatttctcacc

SEQ ID NO: 592636 - DNA, 25 bp, Rattus norvegicus
ccgcggtctacacacctgtcctgcg

SEQ ID NO: 592637 - DNA, 25 bp, Rattus norvegicus
cagcagcgactgctaactgcgcgtg

SEQ ID NO: 592638 - DNA, 25 bp, Rattus norvegicus
gctcaaccgccgctcgggacccagc

SEQ ID NO: 592639 - DNA, 25 bp, Rattus norvegicus
ggaaaatgcggtcctcccaacgtca

SEQ ID NO: 592640 - DNA, 25 bp, Rattus norvegicus
ggtcctcccaacgtcagtctctgga

SEQ ID NO: 592641 - DNA, 25 bp, Rattus norvegicus
caacgtcagtctctggagctcaagc

SEQ ID NO: 592642 - DNA, 25 bp, Rattus norvegicus
tcagtctctggagctcaagctgaca

SEQ ID NO: 592643 - DNA, 25 bp, Rattus norvegicus
tcaagctgacagatttgcagacggc

SEQ ID NO: 592644 - DNA, 25 bp, Rattus norvegicus
cagatttgcagacggctcggttctt

SEQ ID NO: 592645 - DNA, 25 bp, Rattus norvegicus
cagacggctcggttcttcgtgtcgc

SEQ ID NO: 592646 - DNA, 25 bp, Rattus norvegicus
aggtgtccgactggccgctactcgg

SEQ ID NO: 592647 - DNA, 25 bp, Rattus norvegicus
agcctcgcagtcttcccgcggatag

SEQ ID NO: 592648 - DNA, 25 bp, Rattus norvegicus
tgagcaaagtttcaggccgcttcca

SEQ ID NO: 592649 - DNA, 25 bp, Rattus norvegicus
ggagtctccgaaagctctgagcaaa

SEQ ID NO: 592650 - DNA, 25 bp, Rattus norvegicus
ccctgcggggatttcgaatttgaca

SEQ ID NO: 592651 - DNA, 25 bp, Rattus norvegicus
ttcttccgcaccagtgataggctga

SEQ ID NO: 592652 - DNA, 25 bp, Rattus norvegicus
cgagccaatccgaagacgacgaaga

SEQ ID NO: 592653 - DNA, 25 bp, Rattus norvegicus
agcgctccgcgtagagcgtcgtttc

SEQ ID NO: 592654 - DNA, 25 bp, Rattus norvegicus
gccgcttccatagggaccacgtagg

SEQ ID NO: 592655 - DNA, 25 bp, Rattus norvegicus
ctagttcttccgcttctgtgaggtg

SEQ ID NO: 592656 - DNA, 25 bp, Rattus norvegicus
agttctgccgccttggtcccgacaa

SEQ ID NO: 592657 - DNA, 25 bp, Rattus norvegicus
agcgccgaagggatgactcatttta

SEQ ID NO: 592658 - DNA, 25 bp, Rattus norvegicus
taaagaccctgatctgcgcgtcccg

SEQ ID NO: 592659 - DNA, 25 bp, Rattus norvegicus
tcgaatttgacagctccctcggccg

SEQ ID NO: 592660 - DNA, 25 bp, Rattus norvegicus
gtcgtttccgttgccggtgtttgca

SEQ ID NO: 592661 - DNA, 25 bp, Rattus norvegicus
tggcccttccttcgttgcagaatga

SEQ ID NO: 592662 - DNA, 25 bp, Rattus norvegicus
cctgcgtgtgtcgtgtgtattcaag

SEQ ID NO: 592663 - DNA, 25 bp, Rattus norvegicus
attcaaggttgacgctcgacgggac

SEQ ID NO: 592664 - DNA, 25 bp, Rattus norvegicus
cccatcccagcgtggaggaagctgc

SEQ ID NO: 592665 - DNA, 25 bp, Rattus norvegicus
cgaatgaatgacgacagcgcggctc

SEQ ID NO: 592666 - DNA, 25 bp, Rattus norvegicus
cccagccggagatcactgctcgtga

SEQ ID NO: 592667 - DNA, 25 bp, Rattus norvegicus
ggtgatctccagtagcccagccgga

SEQ ID NO: 592668 - DNA, 25 bp, Rattus norvegicus
agcttgtgcgggaatcagagccctc

SEQ ID NO: 592669 - DNA, 25 bp, Rattus norvegicus
ttgggaccgagcaagtagcatcctc

SEQ ID NO: 592670 - DNA, 25 bp, Rattus norvegicus
ccgcgatggccttcagcagactgcg

SEQ ID NO: 592671 - DNA, 25 bp, Rattus norvegicus
gcagtcgcacaaaggggcccagaca

SEQ ID NO: 592672 - DNA, 25 bp, Rattus norvegicus
atccacagcgcgttggccagcagca

SEQ ID NO: 592673 - DNA, 25 bp, Rattus norvegicus
gggttggctctctcagtgatccaca

SEQ ID NO: 592674 - DNA, 25 bp, Rattus norvegicus
gctccaggttttagacccggctcta

SEQ ID NO: 592675 - DNA, 25 bp, Rattus norvegicus
ggactcggccagtatgtaatagtga

SEQ ID NO: 592676 - DNA, 25 bp, Rattus norvegicus
cggggactcgcagtgagtaatattg

SEQ ID NO: 592677 - DNA, 25 bp, Rattus norvegicus
gcggggactcgcagtgtgtaataat

SEQ ID NO: 592678 - DNA, 25 bp, Rattus norvegicus
cggggactcggccagtatgtaatag

SEQ ID NO: 592679 - DNA, 25 bp, Rattus norvegicus
cgcagtgtgtaatagtgaggcagcc

SEQ ID NO: 592680 - DNA, 25 bp, Rattus norvegicus
actcgcagtgtgtaatagtgaggca

SEQ ID NO: 592681 - DNA, 25 bp, Rattus norvegicus
ggactcggccagtgtgtaatagtga

SEQ ID NO: 592682 - DNA, 25 bp, Rattus norvegicus
gcggggactcgcagtgagtaatatt

SEQ ID NO: 592683 - DNA, 25 bp, Rattus norvegicus
ccgggactcggcagtgtgtaatagt

SEQ ID NO: 592684 - DNA, 25 bp, Rattus norvegicus
ctcggccagtgtgtaatagtgaggc

SEQ ID NO: 592685 - DNA, 25 bp, Rattus norvegicus
ctcggcagtgtgtaatagtgaggca

SEQ ID NO: 592686 - DNA, 25 bp, Rattus norvegicus
tcgcagtgtgtaatagtgaggcagc

SEQ ID NO: 592687 - DNA, 25 bp, Rattus norvegicus
cggggactcgcagtgtgtaataata

SEQ ID NO: 592688 - DNA, 25 bp, Rattus norvegicus
tcgcagtgagtaatagtgaggcagc

SEQ ID NO: 592689 - DNA, 25 bp, Rattus norvegicus
gttggaacccacgttgaagatgacc

SEQ ID NO: 592690 - DNA, 25 bp, Rattus norvegicus
cgctcttctctgtgtgcagctcggc

SEQ ID NO: 592691 - DNA, 25 bp, Rattus norvegicus
tcgtggaccgaactggccatgacca

SEQ ID NO: 592692 - DNA, 25 bp, Rattus norvegicus
ctgcagaaacgcgttccggatctta

SEQ ID NO: 592693 - DNA, 25 bp, Rattus norvegicus
tcgggctccgtataggtgatgttca

SEQ ID NO: 592694 - DNA, 25 bp, Rattus norvegicus
atggtctcgttggtgttggaaccca

SEQ ID NO: 592695 - DNA, 25 bp, Rattus norvegicus
tcacgaaggcggtgtaccattcctc

SEQ ID NO: 592696 - DNA, 25 bp, Rattus norvegicus
ttctccgccacggtgaagtccaggc

SEQ ID NO: 592697 - DNA, 25 bp, Rattus norvegicus
gcagccatgttgagagagccagact

SEQ ID NO: 592698 - DNA, 25 bp, Rattus norvegicus
cggcacgcttggatgagagacattg

SEQ ID NO: 592699 - DNA, 25 bp, Rattus norvegicus
gactgccaggcgtcctgcttctttg

SEQ ID NO: 592700 - DNA, 25 bp, Rattus norvegicus
cctgcgtcgccttctctcatagagg

SEQ ID NO: 592701 - DNA, 25 bp, Rattus norvegicus
atcggtcccactgcagtcacggtgg

SEQ ID NO: 592702 - DNA, 25 bp, Rattus norvegicus
atccctgtaggtgcagttgcccttg

SEQ ID NO: 592703 - DNA, 25 bp, Rattus norvegicus
aaacgggctgtgtctgccattccgg

SEQ ID NO: 592704 - DNA, 25 bp, Rattus norvegicus
gcgcttcttctcttcctagcaagtc

SEQ ID NO: 592705 - DNA, 25 bp, Rattus norvegicus
tcgcctctgcgtcctcggccactga

SEQ ID NO: 592706 - DNA, 25 bp, Rattus norvegicus
ctagcaagtccacttccgggaaggc

SEQ ID NO: 592707 - DNA, 25 bp, Rattus norvegicus
gatatccggtctctcgcccactgtt

SEQ ID NO: 592708 - DNA, 25 bp, Rattus norvegicus
ctctgacgttgcaggatatccggtc

SEQ ID NO: 592709 - DNA, 25 bp, Rattus norvegicus
caaccttggtgctctgacgttgcag

SEQ ID NO: 592710 - DNA, 25 bp, Rattus norvegicus
tacgtgtgcaaccttggtgctctga

SEQ ID NO: 592711 - DNA, 25 bp, Rattus norvegicus
ggactcttccggttacgtgtgcaac

SEQ ID NO: 592712 - DNA, 25 bp, Rattus norvegicus
acgcgctggactcttccggttacgt

SEQ ID NO: 592713 - DNA, 25 bp, Rattus norvegicus
ctcgcccactgttggaaacgggctg

SEQ ID NO: 592714 - DNA, 25 bp, Rattus norvegicus
tccacttccgggaaggcgagctctc

SEQ ID NO: 592715 - DNA, 25 bp, Rattus norvegicus
aacgctggcgcttcttctcttccta

SEQ ID NO: 592716 - DNA, 25 bp, Rattus norvegicus
tactcgcaacgctggcgcttcttct

SEQ ID NO: 592717 - DNA, 25 bp, Rattus norvegicus
agacctgctgctgcttggcttcaag

SEQ ID NO: 592718 - DNA, 25 bp, Rattus norvegicus
agtggcgacgatggacaagattctg

SEQ ID NO: 592719 - DNA, 25 bp, Rattus norvegicus
ccctcaagcggatgattgtgcggaa

SEQ ID NO: 592720 - DNA, 25 bp, Rattus norvegicus
tgacgacccgcctcatcctggaggg

SEQ ID NO: 592721 - DNA, 25 bp, Rattus norvegicus
tgggccttcccactcgataaatgtg

SEQ ID NO: 592722 - DNA, 25 bp, Rattus norvegicus
cgaggccatgtttgacctgacgacc

SEQ ID NO: 592723 - DNA, 25 bp, Rattus norvegicus
ctctccttggcagatcgaggtactc

SEQ ID NO: 592724 - DNA, 25 bp, Rattus norvegicus
tactctggttgacagcgcctcctga

SEQ ID NO: 592725 - DNA, 25 bp, Rattus norvegicus
tgccggtatttctgcttccgggtta

SEQ ID NO: 592726 - DNA, 25 bp, Rattus norvegicus
gaacttcacttcctatttgccggta

SEQ ID NO: 592727 - DNA, 25 bp, Rattus norvegicus
cctatctgctgtgcctcggaacttc

SEQ ID NO: 592728 - DNA, 25 bp, Rattus norvegicus
gcccgcaggaaatgtgtcgaatgta

SEQ ID NO: 592729 - DNA, 25 bp, Rattus norvegicus
agtccgccagtgacgttcctcatcg

SEQ ID NO: 592730 - DNA, 25 bp, Rattus norvegicus
cctgactcaaccgagggcggctttt

SEQ ID NO: 592731 - DNA, 25 bp, Rattus norvegicus
agcgtgcatctccagtcctccttgc

SEQ ID NO: 592732 - DNA, 25 bp, Rattus norvegicus
ggtgcagaagcagcgtgcatctcca

SEQ ID NO: 592733 - DNA, 25 bp, Rattus norvegicus
gccacagtcaatgcgagcgcgcagc

SEQ ID NO: 592734 - DNA, 25 bp, Rattus norvegicus
gcagaagcagcgtgcatctccagtc

SEQ ID NO: 592735 - DNA, 25 bp, Rattus norvegicus
ttgccacagtcaatgcgagcgcgca

SEQ ID NO: 592736 - DNA, 25 bp, Rattus norvegicus
tccttgccacagtcaatgcgagcgc

SEQ ID NO: 592737 - DNA, 25 bp, Rattus norvegicus
attcgtgtgatgctcgcagaagcgc

SEQ ID NO: 592738 - DNA, 25 bp, Rattus norvegicus
agtcctccttgccacagtcaatgcg

SEQ ID NO: 592739 - DNA, 25 bp, Rattus norvegicus
gaagcagcgtgcatctccagtcctc

SEQ ID NO: 592740 - DNA, 25 bp, Rattus norvegicus
gccggacgcacagcagagctcttgg

SEQ ID NO: 592741 - DNA, 25 bp, Rattus norvegicus
ctcttggatcgtgggtgcagaagca

SEQ ID NO: 592742 - DNA, 25 bp, Rattus norvegicus
tcgtgtgatgctcgcagaagcgctg

SEQ ID NO: 592743 - DNA, 25 bp, Rattus norvegicus
agccggacgcacagcagagctcttg

SEQ ID NO: 592744 - DNA, 25 bp, Rattus norvegicus
cagcccgtggcgagcgaccgcgact

SEQ ID NO: 592745 - DNA, 25 bp, Rattus norvegicus
ggcgccacgcagaactgctctggtt

SEQ ID NO: 592746 - DNA, 25 bp, Rattus norvegicus
tcccggcggcagaaatagggcagcc

SEQ ID NO: 592747 - DNA, 25 bp, Rattus norvegicus
gctggagcttggactgtctctagca

SEQ ID NO: 592748 - DNA, 25 bp, Rattus norvegicus
ggaccagccgacagccggagacgac

SEQ ID NO: 592749 - DNA, 25 bp, Rattus norvegicus
cgccttaggtaagcgggtcgcagct

SEQ ID NO: 592750 - DNA, 25 bp, Rattus norvegicus
ggtgtctgagtcgtgccaccaccgc

SEQ ID NO: 592751 - DNA, 25 bp, Rattus norvegicus
tgcgggcgttcgctgatcctcactg

SEQ ID NO: 592752 - DNA, 25 bp, Rattus norvegicus
cccacgcctggagagccaagtttgc

SEQ ID NO: 592753 - DNA, 25 bp, Rattus norvegicus
agagccaagtttgcgcgcctggtca

SEQ ID NO: 592754 - DNA, 25 bp, Rattus norvegicus
gccaccctggatgcgctaggattgg

SEQ ID NO: 592755 - DNA, 25 bp, Rattus norvegicus
tgctctacacctgccgcgggtctga

SEQ ID NO: 592756 - DNA, 25 bp, Rattus norvegicus
aacggagcgatccttatgggcgcgc

SEQ ID NO: 592757 - DNA, 25 bp, Rattus norvegicus
tgctctggttgagcccgaagctcgc

SEQ ID NO: 592758 - DNA, 25 bp, Rattus norvegicus
tacatggggtttgacactcggggat

SEQ ID NO: 592759 - DNA, 25 bp, Rattus norvegicus
gaatctgcgacgtcctctgggctgc

SEQ ID NO: 592760 - DNA, 25 bp, Rattus norvegicus
agagaggttcgatcgccagcacagg

SEQ ID NO: 592761 - DNA, 25 bp, Rattus norvegicus
gttcctcttcggtccgcggatctgc

SEQ ID NO: 592762 - DNA, 25 bp, Rattus norvegicus
tgcactgaaagaaggccggagagac

SEQ ID NO: 592763 - DNA, 25 bp, Rattus norvegicus
ggagcgcgtccgctgtgtccaccaa

SEQ ID NO: 592764 - DNA, 25 bp, Rattus norvegicus
tttccaggcgcccttttccgagcag

SEQ ID NO: 592765 - DNA, 25 bp, Rattus norvegicus
cccgaactctgtaggcggctcggga

SEQ ID NO: 592766 - DNA, 25 bp, Rattus norvegicus
gcagaagctagaggcgaccgatcgt

SEQ ID NO: 592767 - DNA, 25 bp, Rattus norvegicus
tcagagaaagtctgggcagaagcta

SEQ ID NO: 592768 - DNA, 25 bp, Rattus norvegicus
aagcgctccggaggagtttcagaga

SEQ ID NO: 592769 - DNA, 25 bp, Rattus norvegicus
tttgctcgggatggctccgcaagtc

SEQ ID NO: 592770 - DNA, 25 bp, Rattus norvegicus
cccttgttgttttggctggaagcgc

SEQ ID NO: 592771 - DNA, 25 bp, Rattus norvegicus
tcccggctccctgttcgggcagagt

SEQ ID NO: 592772 - DNA, 25 bp, Rattus norvegicus
ccctctcagtgtgaaagcgccagcg

SEQ ID NO: 592773 - DNA, 25 bp, Rattus norvegicus
ctaggaggaacaggcgcatgcgccc

SEQ ID NO: 592774 - DNA, 25 bp, Rattus norvegicus
gaagagccagctcgcgtcacacgaa

SEQ ID NO: 592775 - DNA, 25 bp, Rattus norvegicus
ctactccggtagaggagaaggcgcc

SEQ ID NO: 592776 - DNA, 25 bp, Rattus norvegicus
gccgggagacctctgagtacctttc

SEQ ID NO: 592777 - DNA, 25 bp, Rattus norvegicus
tgattcccgccgtgaggtaaacgcc

SEQ ID NO: 592778 - DNA, 25 bp, Rattus norvegicus
acgcagccggaacatgtcgtccacg

SEQ ID NO: 592779 - DNA, 25 bp, Rattus norvegicus
aacatgtcgtccacggctgagcctc

SEQ ID NO: 592780 - DNA, 25 bp, Rattus norvegicus
agctagcctagccagatcgcggatc

SEQ ID NO: 592781 - DNA, 25 bp, Rattus norvegicus
tcgcggatcgctcttacgaaacaca

SEQ ID NO: 592782 - DNA, 25 bp, Rattus norvegicus
acgaaacacatgttcctgattactg

SEQ ID NO: 592783 - DNA, 25 bp, Rattus norvegicus
cctgattactgtggccgaagggacc

SEQ ID NO: 592784 - DNA, 25 bp, Rattus norvegicus
agggacccgtttcctctatcgctag

SEQ ID NO: 592785 - DNA, 25 bp, Rattus norvegicus
ctggttggttggagaagataatcta

SEQ ID NO: 592786 - DNA, 25 bp, Rattus norvegicus
gtcacacgaaggagcgaacgcgcaa

SEQ ID NO: 592787 - DNA, 25 bp, Rattus norvegicus
agcaacaacagcaaggggaccaaca

SEQ ID NO: 592788 - DNA, 25 bp, Rattus norvegicus
atgaagtcccgcaggatggatttgg

SEQ ID NO: 592789 - DNA, 25 bp, Rattus norvegicus
acgtgctcctggcagcccatgaagt

SEQ ID NO: 592790 - DNA, 25 bp, Rattus norvegicus
gacgagccacatcgggccatcgcga

SEQ ID NO: 592791 - DNA, 25 bp, Rattus norvegicus
aggggaccaacaccatcaccacgtt

SEQ ID NO: 592792 - DNA, 25 bp, Rattus norvegicus
ggccatcgcgatcggggctccacgt

SEQ ID NO: 592793 - DNA, 25 bp, Rattus norvegicus
gccaggcccagtatgcagagcaaca

SEQ ID NO: 592794 - DNA, 25 bp, Rattus norvegicus
tgcaccagagcgaaagccaggccca

SEQ ID NO: 592795 - DNA, 25 bp, Rattus norvegicus
gggtgcgcccttgcgctgcatctgc

SEQ ID NO: 592796 - DNA, 25 bp, Rattus norvegicus
agcgcttgcagtagagcagcatgcg

SEQ ID NO: 592797 - DNA, 25 bp, Rattus norvegicus
tggccgggttccatccgcaggcgct

SEQ ID NO: 592798 - DNA, 25 bp, Rattus norvegicus
tgcgggtgccacgtgatcacaccca

SEQ ID NO: 592799 - DNA, 25 bp, Rattus norvegicus
actcctgcagcgagcgcttgcagta

SEQ ID NO: 592800 - DNA, 25 bp, Rattus norvegicus
tgctgtcatcctctgtctcaggctc

SEQ ID NO: 592801 - DNA, 25 bp, Rattus norvegicus
ggatgtccagcactgtcacctcgca

SEQ ID NO: 592802 - DNA, 25 bp, Rattus norvegicus
gtggaattccctgcctcgtagcgca

SEQ ID NO: 592803 - DNA, 25 bp, Rattus norvegicus
aattccctgcctcgtagcgcagctg

SEQ ID NO: 592804 - DNA, 25 bp, Rattus norvegicus
cgcagctgcagctgtatccgggttc

SEQ ID NO: 592805 - DNA, 25 bp, Rattus norvegicus
gctgcagctgtatccgggttcttgt

SEQ ID NO: 592806 - DNA, 25 bp, Rattus norvegicus
tgggcgagccgaagtgaatgtattt

SEQ ID NO: 592807 - DNA, 25 bp, Rattus norvegicus
tgaatgtatttgacctggcgggccc

SEQ ID NO: 592808 - DNA, 25 bp, Rattus norvegicus
ctccttggagccgtgggatgtccag

SEQ ID NO: 592809 - DNA, 25 bp, Rattus norvegicus
cactggtcgcctggctgcacttgaa

SEQ ID NO: 592810 - DNA, 25 bp, Rattus norvegicus
gctgcacttgaatcatcagatcccg

SEQ ID NO: 592811 - DNA, 25 bp, Rattus norvegicus
ttgaatcatcagatcccgcagtggg

SEQ ID NO: 592812 - DNA, 25 bp, Rattus norvegicus
agatcccgcagtgggtcgagccaaa

SEQ ID NO: 592813 - DNA, 25 bp, Rattus norvegicus
cgcagtgggtcgagccaaaccgagc

SEQ ID NO: 592814 - DNA, 25 bp, Rattus norvegicus
cccgaaatcacagggaaattggcgc

SEQ ID NO: 592815 - DNA, 25 bp, Rattus norvegicus
ctcacgagtgtagctgctgaccgtc

SEQ ID NO: 592816 - DNA, 25 bp, Rattus norvegicus
cccaggttatcttgggatggtggac

SEQ ID NO: 592817 - DNA, 25 bp, Rattus norvegicus
gctcatttgagggtcctgctcgcca

SEQ ID NO: 592818 - DNA, 25 bp, Rattus norvegicus
agaacccgaggacgccatttgtctc

SEQ ID NO: 592819 - DNA, 25 bp, Rattus norvegicus
gccatttgtctcttcgttcaagctg

SEQ ID NO: 592820 - DNA, 25 bp, Rattus norvegicus
tcaagctgactctgtagagcttccc

SEQ ID NO: 592821 - DNA, 25 bp, Rattus norvegicus
cacccacggagctctgctcatttga

SEQ ID NO: 592822 - DNA, 25 bp, Rattus norvegicus
tatgtatcggggcatcactgaaacc

SEQ ID NO: 592823 - DNA, 25 bp, Rattus norvegicus
tggttgctgcctcggtgttagctat

SEQ ID NO: 592824 - DNA, 25 bp, Rattus norvegicus
cggtgttagctatggcgcccaagaa

SEQ ID NO: 592825 - DNA, 25 bp, Rattus norvegicus
atggcgcccaagaaagaggcgtgaa

SEQ ID NO: 592826 - DNA, 25 bp, Rattus norvegicus
aggcgtgaagtcataggctgagatc

SEQ ID NO: 592827 - DNA, 25 bp, Rattus norvegicus
gctgagatcacgaggctcacgagtg

SEQ ID NO: 592828 - DNA, 25 bp, Rattus norvegicus
tgctcgccacgcttcctatgtatcg

SEQ ID NO: 592829 - DNA, 25 bp, Rattus norvegicus
ctgggcccacgcaagcgcttgctcc

SEQ ID NO: 592830 - DNA, 25 bp, Rattus norvegicus
gaagccaggcaacgatccctccgtt

SEQ ID NO: 592831 - DNA, 25 bp, Rattus norvegicus
gcccactgactgagtacatcacttc

SEQ ID NO: 592832 - DNA, 25 bp, Rattus norvegicus
ctgagtacatcacttccccggctga

SEQ ID NO: 592833 - DNA, 25 bp, Rattus norvegicus
ggcagcaacgtactttcgtcccagg

SEQ ID NO: 592834 - DNA, 25 bp, Rattus norvegicus
ggctccagcccactgactgagtaca

SEQ ID NO: 592835 - DNA, 25 bp, Rattus norvegicus
ttctactcacaccatctgggagcct

SEQ ID NO: 592836 - DNA, 25 bp, Rattus norvegicus
acgtactttcgtcccaggctgggca

SEQ ID NO: 592837 - DNA, 25 bp, Rattus norvegicus
ccttgaatggcagcaacgtactttc

SEQ ID NO: 592838 - DNA, 25 bp, Rattus norvegicus
ggtcgccttgaatggcagcaacgta

SEQ ID NO: 592839 - DNA, 25 bp, Rattus norvegicus
agcccggtcgccttgaatggcagca

SEQ ID NO: 592840 - DNA, 25 bp, Rattus norvegicus
agcctcagcccggtcgccttgaatg

SEQ ID NO: 592841 - DNA, 25 bp, Rattus norvegicus
tactcacaccatctgggagcctcag

SEQ ID NO: 592842 - DNA, 25 bp, Rattus norvegicus
cacggtggcgttccaggttccgagc

SEQ ID NO: 592843 - DNA, 25 bp, Rattus norvegicus
tttggctactgcacggcccattgga

SEQ ID NO: 592844 - DNA, 25 bp, Rattus norvegicus
cattggaaggggaccgttgtctcca

SEQ ID NO: 592845 - DNA, 25 bp, Rattus norvegicus
acatctgggactgccggagcattcc

SEQ ID NO: 592846 - DNA, 25 bp, Rattus norvegicus
accggctccagctgcacatctggga

SEQ ID NO: 592847 - DNA, 25 bp, Rattus norvegicus
gcgtccgtagttaggcctcaatagc

SEQ ID NO: 592848 - DNA, 25 bp, Rattus norvegicus
ggctgccaccttgggaagactatta

SEQ ID NO: 592849 - DNA, 25 bp, Rattus norvegicus
caattccggttctcagggtcccagc

SEQ ID NO: 592850 - DNA, 25 bp, Rattus norvegicus
tgctcagtggttctaggttccctca

SEQ ID NO: 592851 - DNA, 25 bp, Rattus norvegicus
ccctcagttaattggcgtcgcagca

SEQ ID NO: 592852 - DNA, 25 bp, Rattus norvegicus
ctacgctctcatgccttgcgcgagg

SEQ ID NO: 592853 - DNA, 25 bp, Rattus norvegicus
agacctgacggctagccctgctttg

SEQ ID NO: 592854 - DNA, 25 bp, Rattus norvegicus
gaggactcatctgcgcccgctaaca

SEQ ID NO: 592855 - DNA, 25 bp, Rattus norvegicus
acacgctgtgtgctaagacctgacg

SEQ ID NO: 592856 - DNA, 25 bp, Rattus norvegicus
gaagagccgcgatcttacacacctg

SEQ ID NO: 592857 - DNA, 25 bp, Rattus norvegicus
cgtccttggcgaccaatttccgata

SEQ ID NO: 592858 - DNA, 25 bp, Rattus norvegicus
gcggcgccgaacctagaactgcctt

SEQ ID NO: 592859 - DNA, 25 bp, Rattus norvegicus
tacaaatccctacaacgctagcggc

SEQ ID NO: 592860 - DNA, 25 bp, Rattus norvegicus
agcctagtgcatggccatccgcacg

SEQ ID NO: 592861 - DNA, 25 bp, Rattus norvegicus
gacagctgcctccatgttgccggtc

SEQ ID NO: 592862 - DNA, 25 bp, Rattus norvegicus
cttgcgcagataggcgtccatgggc

SEQ ID NO: 592863 - DNA, 25 bp, Rattus norvegicus
ccgatacaatcccagcttgcgcaga

SEQ ID NO: 592864 - DNA, 25 bp, Rattus norvegicus
cggaacaagcacgacccgtccttgg

SEQ ID NO: 592865 - DNA, 25 bp, Rattus norvegicus
gtgcgccactgtctcacggactaca

SEQ ID NO: 592866 - DNA, 25 bp, Rattus norvegicus
cccacgccgagaacggaggagacca

SEQ ID NO: 592867 - DNA, 25 bp, Rattus norvegicus
acctcgcagcctagaatttgttttc

SEQ ID NO: 592868 - DNA, 25 bp, Rattus norvegicus
tttcgctttcagcactcggcgcaga

SEQ ID NO: 592869 - DNA, 25 bp, Rattus norvegicus
gtagtttaagcagcggcaggacgtc

SEQ ID NO: 592870 - DNA, 25 bp, Rattus norvegicus
tcccgaccggtgtgaggcgagaaaa

SEQ ID NO: 592871 - DNA, 25 bp, Rattus norvegicus
cgagcgtacccgagccgactcgaga

SEQ ID NO: 592872 - DNA, 25 bp, Rattus norvegicus
gccgagccggtaaagccgagcgtac

SEQ ID NO: 592873 - DNA, 25 bp, Rattus norvegicus
ttgcctcactgcagcgttccgagcg

SEQ ID NO: 592874 - DNA, 25 bp, Rattus norvegicus
actcgagagggacttgtcctgtgcc

SEQ ID NO: 592875 - DNA, 25 bp, Rattus norvegicus
gcaccgggacaaggaccagctccag

SEQ ID NO: 592876 - DNA, 25 bp, Rattus norvegicus
ctgaagggaatctgggacgagctcc

SEQ ID NO: 592877 - DNA, 25 bp, Rattus norvegicus
atgatggcgtctcgcagccgcgaac

SEQ ID NO: 592878 - DNA, 25 bp, Rattus norvegicus
ccacactgcctgatttggggatcga

SEQ ID NO: 592879 - DNA, 25 bp, Rattus norvegicus
cggcggagttccctctgatttattc

SEQ ID NO: 592880 - DNA, 25 bp, Rattus norvegicus
tctgatttattcaaaggtctggccg

SEQ ID NO: 592881 - DNA, 25 bp, Rattus norvegicus
tttaccggattcgattgcctcactg

SEQ ID NO: 592882 - DNA, 25 bp, Rattus norvegicus
ggaacaactgctctcgtccagactg

SEQ ID NO: 592883 - DNA, 25 bp, Rattus norvegicus
tgacgccagcgcgaccagatcaatc

SEQ ID NO: 592884 - DNA, 25 bp, Rattus norvegicus
tccagactgtctttgttagtgtttc

SEQ ID NO: 592885 - DNA, 25 bp, Rattus norvegicus
agcctaagccaggacgcattccaga

SEQ ID NO: 592886 - DNA, 25 bp, Rattus norvegicus
taagccaggacgcattccagagagc

SEQ ID NO: 592887 - DNA, 25 bp, Rattus norvegicus
cgcggaaagagagggcatggcaccg

SEQ ID NO: 592888 - DNA, 25 bp, Rattus norvegicus
ggcgtcacgttacgcctgcgtgctg

SEQ ID NO: 592889 - DNA, 25 bp, Rattus norvegicus
cgccgcgagacaggccttccttcag

SEQ ID NO: 592890 - DNA, 25 bp, Rattus norvegicus
gccgagcccacagcggcctccacca

SEQ ID NO: 592891 - DNA, 25 bp, Rattus norvegicus
agagcaaaagccgagcccacagcgg

SEQ ID NO: 592892 - DNA, 25 bp, Rattus norvegicus
ccaggacgcattccagagagcaaaa

SEQ ID NO: 592893 - DNA, 25 bp, Rattus norvegicus
ccgagacagcctaagccaggacgca

SEQ ID NO: 592894 - DNA, 25 bp, Rattus norvegicus
aaggggcggtgctttactgcgcggc

SEQ ID NO: 592895 - DNA, 25 bp, Rattus norvegicus
cacgttacgcctgcgtgctgccgga

SEQ ID NO: 592896 - DNA, 25 bp, Rattus norvegicus
gacagcctaagccaggacgcattcc

SEQ ID NO: 592897 - DNA, 25 bp, Rattus norvegicus
cagggccgagacagcctaagccagg

SEQ ID NO: 592898 - DNA, 25 bp, Rattus norvegicus
cagagagcaaaagccgagcccacag

SEQ ID NO: 592899 - DNA, 25 bp, Rattus norvegicus
gcagctctgaaagcccaggtctatg

SEQ ID NO: 592900 - DNA, 25 bp, Rattus norvegicus
tgcgccgcccatccagaagtaagga

SEQ ID NO: 592901 - DNA, 25 bp, Rattus norvegicus
aagttgtcaactgagcctgcgcgga

SEQ ID NO: 592902 - DNA, 25 bp, Rattus norvegicus
gtattgcgtcacatcctagcacagg

SEQ ID NO: 592903 - DNA, 25 bp, Rattus norvegicus
gaggctcctcccgtttgacaaagta

SEQ ID NO: 592904 - DNA, 25 bp, Rattus norvegicus
tcagacgcttttcctcctgaggctc

SEQ ID NO: 592905 - DNA, 25 bp, Rattus norvegicus
tattctcgcgagatcccagctcaga

SEQ ID NO: 592906 - DNA, 25 bp, Rattus norvegicus
ggccacagcgacatagcagctctga

SEQ ID NO: 592907 - DNA, 25 bp, Rattus norvegicus
gagcggtccatcctacggtctcagg

SEQ ID NO: 592908 - DNA, 25 bp, Rattus norvegicus
caaagccttcgtttggaccgcgcga

SEQ ID NO: 592909 - DNA, 25 bp, Rattus norvegicus
ctcgaaggctctcgttgcgacagga

SEQ ID NO: 592910 - DNA, 25 bp, Rattus norvegicus
ttagcgatcgtctcaatgccgccgg

SEQ ID NO: 592911 - DNA, 25 bp, Rattus norvegicus
accgtccacgaggatgcttgggtcc

SEQ ID NO: 592912 - DNA, 25 bp, Rattus norvegicus
tgcagcggtcgctatactcattagc

SEQ ID NO: 592913 - DNA, 25 bp, Rattus norvegicus
cagccgcctgcgagtgattttatgt

SEQ ID NO: 592914 - DNA, 25 bp, Rattus norvegicus
cctagccctgtgagtcgactccttg

SEQ ID NO: 592915 - DNA, 25 bp, Rattus norvegicus
aaaattttcctacactcgcagccgc

SEQ ID NO: 592916 - DNA, 25 bp, Rattus norvegicus
tgagtcgactccttgcataccggga

SEQ ID NO: 592917 - DNA, 25 bp, Rattus norvegicus
tcctcagaacctctagcgggcaggc

SEQ ID NO: 592918 - DNA, 25 bp, Rattus norvegicus
aactgctgcgagttttctgtgaatc

SEQ ID NO: 592919 - DNA, 25 bp, Rattus norvegicus
ccacgcgcgtccgagcaagagggaa

SEQ ID NO: 592920 - DNA, 25 bp, Rattus norvegicus
ggaatgtttgcggagcagactgccc

SEQ ID NO: 592921 - DNA, 25 bp, Rattus norvegicus
gctcacatacaaccgagacaccata

SEQ ID NO: 592922 - DNA, 25 bp, Rattus norvegicus
tccgtgaacttcaggtgaccgacca

SEQ ID NO: 592923 - DNA, 25 bp, Rattus norvegicus
gttttgcaggatcgggctccgagca

SEQ ID NO: 592924 - DNA, 25 bp, Rattus norvegicus
ggtgaccgaccacgtcggcctgaca

SEQ ID NO: 592925 - DNA, 25 bp, Rattus norvegicus
ttctgtgaatcgcagcgcggagcct

SEQ ID NO: 592926 - DNA, 25 bp, Rattus norvegicus
aagaaaggactgcaccggggcattt

SEQ ID NO: 592927 - DNA, 25 bp, Rattus norvegicus
gcgccgaagtctcgcgccacggtaa

SEQ ID NO: 592928 - DNA, 25 bp, Rattus norvegicus
cttggctacggcaacccgccgggat

SEQ ID NO: 592929 - DNA, 25 bp, Rattus norvegicus
cccgccgggatcaaaaagactctat

SEQ ID NO: 592930 - DNA, 25 bp, Rattus norvegicus
ttacagcgggatccggagccctcac

SEQ ID NO: 592931 - DNA, 25 bp, Rattus norvegicus
agctcaccttacagcgggatccgga

SEQ ID NO: 592932 - DNA, 25 bp, Rattus norvegicus
gggccgcaagctcaccttacagcgg

SEQ ID NO: 592933 - DNA, 25 bp, Rattus norvegicus
tggcccggacgagcgagcgcctact

SEQ ID NO: 592934 - DNA, 25 bp, Rattus norvegicus
tcagcgtcctccttggctacggcaa

SEQ ID NO: 592935 - DNA, 25 bp, Rattus norvegicus
gccacggtaacctcgggcgctcagt

SEQ ID NO: 592936 - DNA, 25 bp, Rattus norvegicus
gctagccagcttgcgtctgagaacc

SEQ ID NO: 592937 - DNA, 25 bp, Rattus norvegicus
ttccgtcgcgcacggattcgcgagt

SEQ ID NO: 592938 - DNA, 25 bp, Rattus norvegicus
cgcgtttacgacgttccgtcgcgca

SEQ ID NO: 592939 - DNA, 25 bp, Rattus norvegicus
aaaagactctatcgcgctagccagc

SEQ ID NO: 592940 - DNA, 25 bp, Rattus norvegicus
ggcgctcagtccaaccggcgcgaag

SEQ ID NO: 592941 - DNA, 25 bp, Rattus norvegicus
agcagacttcctggacggtaggccc

SEQ ID NO: 592942 - DNA, 25 bp, Rattus norvegicus
catgcgcgcatcctcggggcattac

SEQ ID NO: 592943 - DNA, 25 bp, Rattus norvegicus
gtgaacgtctctcgctcgactctga

SEQ ID NO: 592944 - DNA, 25 bp, Rattus norvegicus
aggcatgcctcgcagtgaacgtctc

SEQ ID NO: 592945 - DNA, 25 bp, Rattus norvegicus
taaatctacagtgacggaggcccga

SEQ ID NO: 592946 - DNA, 25 bp, Rattus norvegicus
gcctcattatggtgtcgctgcagta

SEQ ID NO: 592947 - DNA, 25 bp, Rattus norvegicus
tgcggtgcacacatgaccaagcttg

SEQ ID NO: 592948 - DNA, 25 bp, Rattus norvegicus
ttgcactaacaggacccgctgcggt

SEQ ID NO: 592949 - DNA, 25 bp, Rattus norvegicus
ggagacgagtcacgggttgcactaa

SEQ ID NO: 592950 - DNA, 25 bp, Rattus norvegicus
gcagggcacgtagaacggagacaca

SEQ ID NO: 592951 - DNA, 25 bp, Rattus norvegicus
atccagtgacgggaaagcctcgctg

SEQ ID NO: 592952 - DNA, 25 bp, Rattus norvegicus
tcggtccctccagacatgcagcaga

SEQ ID NO: 592953 - DNA, 25 bp, Rattus norvegicus
tccagcagcctcatatttgttaggg

SEQ ID NO: 592954 - DNA, 25 bp, Rattus norvegicus
actctgagcccgagagacgcgagac

SEQ ID NO: 592955 - DNA, 25 bp, Rattus norvegicus
gaatcgcgcgggctaaatgactaga

SEQ ID NO: 592956 - DNA, 25 bp, Rattus norvegicus
tgctctctctgtccatgcccaggtt

SEQ ID NO: 592957 - DNA, 25 bp, Rattus norvegicus
ctttgtctggctcagcgatccggcc

SEQ ID NO: 592958 - DNA, 25 bp, Rattus norvegicus
agcaagcccaactccagagcctttg

SEQ ID NO: 592959 - DNA, 25 bp, Rattus norvegicus
ctgcaaattcccaaaccgggtgaga

SEQ ID NO: 592960 - DNA, 25 bp, Rattus norvegicus
tggaaaacttgcgacgctccctggc

SEQ ID NO: 592961 - DNA, 25 bp, Rattus norvegicus
cgcgttctcgcacgcggctggaaaa

SEQ ID NO: 592962 - DNA, 25 bp, Rattus norvegicus
cggcgtatacttcggcgtcttcaga

SEQ ID NO: 592963 - DNA, 25 bp, Rattus norvegicus
tgtggttcgttctacatccctcggg

SEQ ID NO: 592964 - DNA, 25 bp, Rattus norvegicus
cagagactcaagctagggtgggtca

SEQ ID NO: 592965 - DNA, 25 bp, Rattus norvegicus
ttccctctggtgactccactagctg

SEQ ID NO: 592966 - DNA, 25 bp, Rattus norvegicus
cccaggcagtccagaagcaccagta

SEQ ID NO: 592967 - DNA, 25 bp, Rattus norvegicus
gaggcgctcagcagagctctgacca

SEQ ID NO: 592968 - DNA, 25 bp, Rattus norvegicus
gggttcttacctcagcggcgtatac

SEQ ID NO: 592969 - DNA, 25 bp, Rattus norvegicus
tgctgactcccggagggctctcctt

SEQ ID NO: 592970 - DNA, 25 bp, Rattus norvegicus
cggtttcctgctcgccgctaccgcc

SEQ ID NO: 592971 - DNA, 25 bp, Rattus norvegicus
ggagggctctcctttccacgcttgc

SEQ ID NO: 592972 - DNA, 25 bp, Rattus norvegicus
ctttccacgcttgccctccactttg

SEQ ID NO: 592973 - DNA, 25 bp, Rattus norvegicus
tccactttgtttttgtcctagagcg

SEQ ID NO: 592974 - DNA, 25 bp, Rattus norvegicus
gtttttgtcctagagcgtgccagtg

SEQ ID NO: 592975 - DNA, 25 bp, Rattus norvegicus
gtcctagagcgtgccagtgcctctt

SEQ ID NO: 592976 - DNA, 25 bp, Rattus norvegicus
ttgtctgcacctagtgtcttccgcg

SEQ ID NO: 592977 - DNA, 25 bp, Rattus norvegicus
gcctcctctcgcacctgctggcctt

SEQ ID NO: 592978 - DNA, 25 bp, Rattus norvegicus
acggcctgcacctgctccggatcac

SEQ ID NO: 592979 - DNA, 25 bp, Rattus norvegicus
accagccacccgcaggtcctcaccg

SEQ ID NO: 592980 - DNA, 25 bp, Rattus norvegicus
gtcctcaccgttgtctgcacctagt

SEQ ID NO: 592981 - DNA, 25 bp, Rattus norvegicus
accgttgtctgcacctagtgtcttc

SEQ ID NO: 592982 - DNA, 25 bp, Rattus norvegicus
gcgtgccagtgcctcttaggcctgc

SEQ ID NO: 592983 - DNA, 25 bp, Rattus norvegicus
gcaagcaggcgttcagcatgcctca

SEQ ID NO: 592984 - DNA, 25 bp, Rattus norvegicus
tgatgtccctgaatagcaagcaggc

SEQ ID NO: 592985 - DNA, 25 bp, Rattus norvegicus
cgccgcgcaaggaaagatgatgatg

SEQ ID NO: 592986 - DNA, 25 bp, Rattus norvegicus
accagagtgagccagcgacgagcgc

SEQ ID NO: 592987 - DNA, 25 bp, Rattus norvegicus
tacttctccggagggtcggtagctg

SEQ ID NO: 592988 - DNA, 25 bp, Rattus norvegicus
aactttgccgtgttgttccctctgc

SEQ ID NO: 592989 - DNA, 25 bp, Rattus norvegicus
gcagacccagcaggcgacacagaag

SEQ ID NO: 592990 - DNA, 25 bp, Rattus norvegicus
gcgggaagaggggactataactcca

SEQ ID NO: 592991 - DNA, 25 bp, Rattus norvegicus
gctgaggtctgaagccagcgccacc

SEQ ID NO: 592992 - DNA, 25 bp, Rattus norvegicus
taactccacggcctcgacgagctgg

SEQ ID NO: 592993 - DNA, 25 bp, Rattus norvegicus
gttcagcatgcctcatgccggcagc

SEQ ID NO: 592994 - DNA, 25 bp, Rattus norvegicus
tggccgctgagcacaactttgccgt

SEQ ID NO: 592995 - DNA, 25 bp, Rattus norvegicus
gccacccggagcagggcaacagctt

SEQ ID NO: 592996 - DNA, 25 bp, Rattus norvegicus
ggcaacagcttgagcagacccagca

SEQ ID NO: 592997 - DNA, 25 bp, Rattus norvegicus
gcttccggagagagcgcgcacaatt

SEQ ID NO: 592998 - DNA, 25 bp, Rattus norvegicus
tgctgagcgtaatgtgtgccttcta

SEQ ID NO: 592999 - DNA, 25 bp, Rattus norvegicus
gtgccttctacttacaattgcagag

SEQ ID NO: 593000 - DNA, 25 bp, Rattus norvegicus
ttgcagagcaatatattcggcggtc

SEQ ID NO: 593001 - DNA, 25 bp, Rattus norvegicus
gccgtggacatcgtctcccagagta

SEQ ID NO: 593002 - DNA, 25 bp, Rattus norvegicus
ccacatcaggctctggagggcgagc

SEQ ID NO: 593003 - DNA, 25 bp, Rattus norvegicus
gcgcacaattccctgctgagcgtaa

SEQ ID NO: 593004 - DNA, 25 bp, Rattus norvegicus
acggtggtgtccactccggctcacg

SEQ ID NO: 593005 - DNA, 25 bp, Rattus norvegicus
ctgccctcgcacatgggctgcatga

SEQ ID NO: 593006 - DNA, 25 bp, Rattus norvegicus
gcatgagcgacgtggatgcagaccc

SEQ ID NO: 593007 - DNA, 25 bp, Rattus norvegicus
ggtttgagtccctcacgctgtcgca

SEQ ID NO: 593008 - DNA, 25 bp, Rattus norvegicus
gaagcagagaaatcccaccgcgaga

SEQ ID NO: 593009 - DNA, 25 bp, Rattus norvegicus
gcgagaagctcaccaagcccgagct

SEQ ID NO: 593010 - DNA, 25 bp, Rattus norvegicus
ccgagctcttcaatggcgcggagaa

SEQ ID NO: 593011 - DNA, 25 bp, Rattus norvegicus
cctttccttctgagaaccagggctg

SEQ ID NO: 593012 - DNA, 25 bp, Rattus norvegicus
ttcctccagccgagactgggctgca

SEQ ID NO: 593013 - DNA, 25 bp, Rattus norvegicus
caggctgagcgagatctcctctaga

SEQ ID NO: 593014 - DNA, 25 bp, Rattus norvegicus
accatcgcaggagcttgcaggctga

SEQ ID NO: 593015 - DNA, 25 bp, Rattus norvegicus
gccgtcctgggaagtttcctccagc

SEQ ID NO: 593016 - DNA, 25 bp, Rattus norvegicus
cggacctggcgctgtctgcgtccga

SEQ ID NO: 593017 - DNA, 25 bp, Rattus norvegicus
ctctaaggtcggtgcaagcctttcc

SEQ ID NO: 593018 - DNA, 25 bp, Rattus norvegicus
tcctctagagaagccgggccgtcct

SEQ ID NO: 593019 - DNA, 25 bp, Rattus norvegicus
gcagcgccggcgaaacacagcagcg

SEQ ID NO: 593020 - DNA, 25 bp, Rattus norvegicus
cgaaacacagcagcggggcctggca

SEQ ID NO: 593021 - DNA, 25 bp, Rattus norvegicus
gcgcccagtgtgaggcgctttcctg

SEQ ID NO: 593022 - DNA, 25 bp, Rattus norvegicus
gggtggacaccagacacgacgattg

SEQ ID NO: 593023 - DNA, 25 bp, Rattus norvegicus
agacacgacgattgagctttgactc

SEQ ID NO: 593024 - DNA, 25 bp, Rattus norvegicus
tctgcgtccgaggagctctaaggtc

SEQ ID NO: 593025 - DNA, 25 bp, Rattus norvegicus
tgtacagctacagtggagattccga

SEQ ID NO: 593026 - DNA, 25 bp, Rattus norvegicus
ccagcttgaagccacgccaatcatt

SEQ ID NO: 593027 - DNA, 25 bp, Rattus norvegicus
ttgcgggacaaggttagcccagccc

SEQ ID NO: 593028 - DNA, 25 bp, Rattus norvegicus
tcataaagctttgcgttgcgggaca

SEQ ID NO: 593029 - DNA, 25 bp, Rattus norvegicus
ctcctccgtagctgaccaatcataa

SEQ ID NO: 593030 - DNA, 25 bp, Rattus norvegicus
gccaatcattttcagtgggcatgta

SEQ ID NO: 593031 - DNA, 25 bp, Rattus norvegicus
gggcggaaactagcctgccatagca

SEQ ID NO: 593032 - DNA, 25 bp, Rattus norvegicus
ggtagggtaccagtctcaggtcaga

SEQ ID NO: 593033 - DNA, 25 bp, Rattus norvegicus
gggccatgatgcagccaagactctg

SEQ ID NO: 593034 - DNA, 25 bp, Rattus norvegicus
aagactctgggcgacttccagttga

SEQ ID NO: 593035 - DNA, 25 bp, Rattus norvegicus
ggaagtgctcttacatctgttaata

SEQ ID NO: 593036 - DNA, 25 bp, Rattus norvegicus
acgcggctccaacggctggtaaatc

SEQ ID NO: 593037 - DNA, 25 bp, Rattus norvegicus
tccctatagggcgactgacgaaaag

SEQ ID NO: 593038 - DNA, 25 bp, Rattus norvegicus
cggctacaccggctgcatgcggttt

SEQ ID NO: 593039 - DNA, 25 bp, Rattus norvegicus
ctcagcgctctgcaaggactgtgcc

SEQ ID NO: 593040 - DNA, 25 bp, Rattus norvegicus
cgaagtcctggtcgcccagacagtg

SEQ ID NO: 593041 - DNA, 25 bp, Rattus norvegicus
agctgcgcacgcatcctgcggcggt

SEQ ID NO: 593042 - DNA, 25 bp, Rattus norvegicus
cggtgcgttgtgatgacgtcacgct

SEQ ID NO: 593043 - DNA, 25 bp, Rattus norvegicus
ggtcgcccagacagtgctcagcgct

SEQ ID NO: 593044 - DNA, 25 bp, Rattus norvegicus
tgcaaggactgtgccaccagccggt

SEQ ID NO: 593045 - DNA, 25 bp, Rattus norvegicus
acctgggcctcgagttcggcatggc

SEQ ID NO: 593046 - DNA, 25 bp, Rattus norvegicus
tcgagttcggcatggctgagtctct

SEQ ID NO: 593047 - DNA, 25 bp, Rattus norvegicus
tgagtctctgctcagaagcccacga

SEQ ID NO: 593048 - DNA, 25 bp, Rattus norvegicus
tcagaagcccacgaaaaaggacgcc

SEQ ID NO: 593049 - DNA, 25 bp, Rattus norvegicus
gtccggaaagagtctccacacctcg

SEQ ID NO: 593050 - DNA, 25 bp, Rattus norvegicus
ctagacccgtcgcagcaacaggacg

SEQ ID NO: 593051 - DNA, 25 bp, Rattus norvegicus
gcagcaacaggacgcgaaaaggagt

SEQ ID NO: 593052 - DNA, 25 bp, Rattus norvegicus
taggcagtcccgaagtcctggtcgc

SEQ ID NO: 593053 - DNA, 25 bp, Rattus norvegicus
cctcagtcagccgtccggggctcgg

SEQ ID NO: 593054 - DNA, 25 bp, Rattus norvegicus
cagtggacgacgtgctgcggacatc

SEQ ID NO: 593055 - DNA, 25 bp, Rattus norvegicus
cactgcgtcagtcccagtcccggct

SEQ ID NO: 593056 - DNA, 25 bp, Rattus norvegicus
ggaaccatggcgtccgccgtgtgaa

SEQ ID NO: 593057 - DNA, 25 bp, Rattus norvegicus
gtccgccgtgtgaagtgcgccgcct

SEQ ID NO: 593058 - DNA, 25 bp, Rattus norvegicus
ccttgccctaggcagccggtcgccg

SEQ ID NO: 593059 - DNA, 25 bp, Rattus norvegicus
gcccgaatgcgcgtccggtgaaggt

SEQ ID NO: 593060 - DNA, 25 bp, Rattus norvegicus
tgagaagccgcctgactgactgact

SEQ ID NO: 593061 - DNA, 25 bp, Rattus norvegicus
atgggccgcggccactgcgtcagtc

SEQ ID NO: 593062 - DNA, 25 bp, Rattus norvegicus
ctggtcacgtgacgctcgcagcagc

SEQ ID NO: 593063 - DNA, 25 bp, Rattus norvegicus
gcggcctggtcacgtgacgctcgca

SEQ ID NO: 593064 - DNA, 25 bp, Rattus norvegicus
cccacagcgcctccctagcgggctg

SEQ ID NO: 593065 - DNA, 25 bp, Rattus norvegicus
tgctgcggacatccacgtcaccctt

SEQ ID NO: 593066 - DNA, 25 bp, Rattus norvegicus
actgacgtctgactgaggcgcggcc

SEQ ID NO: 593067 - DNA, 25 bp, Rattus norvegicus
ataggcgattccatagggcataagc

SEQ ID NO: 593068 - DNA, 25 bp, Rattus norvegicus
cccacatgaaaaggccaggcatata

SEQ ID NO: 593069 - DNA, 25 bp, Rattus norvegicus
tcacctggacctagcgagccgagat

SEQ ID NO: 593070 - DNA, 25 bp, Rattus norvegicus
agggcacagactaggttctccaccg

SEQ ID NO: 593071 - DNA, 25 bp, Rattus norvegicus
cagggtggataggattgcataaatc

SEQ ID NO: 593072 - DNA, 25 bp, Rattus norvegicus
ctggatcagcagacatcagcacttc

SEQ ID NO: 593073 - DNA, 25 bp, Rattus norvegicus
cagcacttcctgcacgagcatgaga

SEQ ID NO: 593074 - DNA, 25 bp, Rattus norvegicus
catagatgtgatccaagccgtcgtc

SEQ ID NO: 593075 - DNA, 25 bp, Rattus norvegicus
aagccgtcgtccttgaatgctgccg

SEQ ID NO: 593076 - DNA, 25 bp, Rattus norvegicus
accgctgtagtcatggggctgcagc

SEQ ID NO: 593077 - DNA, 25 bp, Rattus norvegicus
ggagctcgagaggaccaacaagttc

SEQ ID NO: 593078 - DNA, 25 bp, Rattus norvegicus
gctcatcaaagacggcaagaacctt

SEQ ID NO: 593079 - DNA, 25 bp, Rattus norvegicus
agcgtcttccctgccgagtaggatg

SEQ ID NO: 593080 - DNA, 25 bp, Rattus norvegicus
gctgccaccaaaagtaagcggggtc

SEQ ID NO: 593081 - DNA, 25 bp, Rattus norvegicus
tccggcccgtagaacttgcagcctt

SEQ ID NO: 593082 - DNA, 25 bp, Rattus norvegicus
cactggcacccccccgcgaacgatc

SEQ ID NO: 593083 - DNA, 25 bp, Rattus norvegicus
ccactggcacccccccgcgaacgat

SEQ ID NO: 593084 - DNA, 25 bp, Rattus norvegicus
gccactggcacccccccgcgaacga

SEQ ID NO: 593085 - DNA, 25 bp, Rattus norvegicus
gtcgccactggcacccccccgcgaa

SEQ ID NO: 593086 - DNA, 25 bp, Rattus norvegicus
tgtcgccactggcacccccccgcga

SEQ ID NO: 593087 - DNA, 25 bp, Rattus norvegicus
gttgtcgccactggcacccccccgc

SEQ ID NO: 593088 - DNA, 25 bp, Rattus norvegicus
gccatcgtaacgcctcagttcggca

SEQ ID NO: 593089 - DNA, 25 bp, Rattus norvegicus
acgccatcgtaacgcctcagttcgg

SEQ ID NO: 593090 - DNA, 25 bp, Rattus norvegicus
gacgccatcgtaacgcctcagttcg

SEQ ID NO: 593091 - DNA, 25 bp, Rattus norvegicus
ggacgccatcgtaacgcctcagttc

SEQ ID NO: 593092 - DNA, 25 bp, Rattus norvegicus
tggacgccatcgtaacgcctcagtt

SEQ ID NO: 593093 - DNA, 25 bp, Rattus norvegicus
ctggacgccatcgtaacgcctcagt

SEQ ID NO: 593094 - DNA, 25 bp, Rattus norvegicus
actggcacccccccgcgaacgatct

SEQ ID NO: 593095 - DNA, 25 bp, Rattus norvegicus
aacgatcttgtagagcaggaagatg

SEQ ID NO: 593096 - DNA, 25 bp, Rattus norvegicus
ggcgccagtcgccaccacatcctcg

SEQ ID NO: 593097 - DNA, 25 bp, Rattus norvegicus
tgatggccataagaatgcgcgggtc

SEQ ID NO: 593098 - DNA, 25 bp, Rattus norvegicus
tggccataagaatgcgcgggtcctg

SEQ ID NO: 593099 - DNA, 25 bp, Rattus norvegicus
agttcggcaggggtgaagtcacgcg

SEQ ID NO: 593100 - DNA, 25 bp, Rattus norvegicus
aagtcacgcggcttgaggcggggca

SEQ ID NO: 593101 - DNA, 25 bp, Rattus norvegicus
cccgcgaacgatcttgtagagcagg

SEQ ID NO: 593102 - DNA, 25 bp, Rattus norvegicus
cgcgaacgatcttgtagagcaggaa

SEQ ID NO: 593103 - DNA, 25 bp, Rattus norvegicus
cgaacgatcttgtagagcaggaaga

SEQ ID NO: 593104 - DNA, 25 bp, Rattus norvegicus
caaggagcagcaggttgagaggcga

SEQ ID NO: 593105 - DNA, 25 bp, Rattus norvegicus
tgagaggcgacgtgaaaatctcttg

SEQ ID NO: 593106 - DNA, 25 bp, Rattus norvegicus
ggcgacgtgaaaatctcttgaagca

SEQ ID NO: 593107 - DNA, 25 bp, Rattus norvegicus
gacgtgaaaatctcttgaagcagcc

SEQ ID NO: 593108 - DNA, 25 bp, Rattus norvegicus
ggttgagaggcgacgtgaaaatctc

SEQ ID NO: 593109 - DNA, 25 bp, Rattus norvegicus
ggtgacttgcactggcttcctctga

SEQ ID NO: 593110 - DNA, 25 bp, Rattus norvegicus
ttcctctgagcagcctgaagttggc

SEQ ID NO: 593111 - DNA, 25 bp, Rattus norvegicus
cgccggagcgatttccattggccaa

SEQ ID NO: 593112 - DNA, 25 bp, Rattus norvegicus
aaacaaggctccacgctgtgcgggc

SEQ ID NO: 593113 - DNA, 25 bp, Rattus norvegicus
taggagcgcttctcattgggcaatc

SEQ ID NO: 593114 - DNA, 25 bp, Rattus norvegicus
aggcgggcgacatgactgatacaaa

SEQ ID NO: 593115 - DNA, 25 bp, Rattus norvegicus
gcctggactccgcagcttccttaaa

SEQ ID NO: 593116 - DNA, 25 bp, Rattus norvegicus
cgtgttctcctagttcccggaggtg

SEQ ID NO: 593117 - DNA, 25 bp, Rattus norvegicus
acccgcggtggaccacaggcaatct

SEQ ID NO: 593118 - DNA, 25 bp, Rattus norvegicus
agcagcctagatggtgtgccctcgc

SEQ ID NO: 593119 - DNA, 25 bp, Rattus norvegicus
tcagagttacctccctgccgagcag

SEQ ID NO: 593120 - DNA, 25 bp, Rattus norvegicus
tgccgagcagccgtaatctccgcgg

SEQ ID NO: 593121 - DNA, 25 bp, Rattus norvegicus
cgtctacctgttgcagcgcttgcca

SEQ ID NO: 593122 - DNA, 25 bp, Rattus norvegicus
agaaagttcaggtcgctgtcccgcc

SEQ ID NO: 593123 - DNA, 25 bp, Rattus norvegicus
gtcgaagctccttgcaaaatctagg

SEQ ID NO: 593124 - DNA, 25 bp, Rattus norvegicus
agtcgctgcactcaccttttctagg

SEQ ID NO: 593125 - DNA, 25 bp, Rattus norvegicus
gccgctaccagcaagtccaatactg

SEQ ID NO: 593126 - DNA, 25 bp, Rattus norvegicus
gtccaatactggctgatcggcaatg

SEQ ID NO: 593127 - DNA, 25 bp, Rattus norvegicus
agaggatagcaatcccggcagtcgc

SEQ ID NO: 593128 - DNA, 25 bp, Rattus norvegicus
cctactgacggtgggtagagtaata

SEQ ID NO: 593129 - DNA, 25 bp, Rattus norvegicus
gcgacagtgcagataccctgttgga

SEQ ID NO: 593130 - DNA, 25 bp, Rattus norvegicus
agcccaccagtcgagcggtaagacc

SEQ ID NO: 593131 - DNA, 25 bp, Rattus norvegicus
cagctccggcgatagagagtggtta

SEQ ID NO: 593132 - DNA, 25 bp, Rattus norvegicus
gggtcacaccctcactagcagtatg

SEQ ID NO: 593133 - DNA, 25 bp, Rattus norvegicus
cagtatgaggcagtccagcggtcct

SEQ ID NO: 593134 - DNA, 25 bp, Rattus norvegicus
cgaggggaaacggaactccagtgca

SEQ ID NO: 593135 - DNA, 25 bp, Rattus norvegicus
ccgacactgtcggtgcaaagtgaca

SEQ ID NO: 593136 - DNA, 25 bp, Rattus norvegicus
ctggttttgccctgagtcgaagctc

SEQ ID NO: 593137 - DNA, 25 bp, Rattus norvegicus
gattcgtcggttccggctgccacaa

SEQ ID NO: 593138 - DNA, 25 bp, Rattus norvegicus
tggggccgaacctagagtagctcca

SEQ ID NO: 593139 - DNA, 25 bp, Rattus norvegicus
cccagccgatctgtagcgtggactg

SEQ ID NO: 593140 - DNA, 25 bp, Rattus norvegicus
ctgcgcccaccgcttgtgcggtaaa

SEQ ID NO: 593141 - DNA, 25 bp, Rattus norvegicus
cagtgtctcagtgcgggttccacag

SEQ ID NO: 593142 - DNA, 25 bp, Rattus norvegicus
gttccacaggactgcgggtccactt

SEQ ID NO: 593143 - DNA, 25 bp, Rattus norvegicus
gggtccacttgccagacttgcaaaa

SEQ ID NO: 593144 - DNA, 25 bp, Rattus norvegicus
caaaaagttggagtcgcaggatccc

SEQ ID NO: 593145 - DNA, 25 bp, Rattus norvegicus
ggatccctcctgagagcgagctgaa

SEQ ID NO: 593146 - DNA, 25 bp, Rattus norvegicus
cgcacgtcagctgcagaagaccgga

SEQ ID NO: 593147 - DNA, 25 bp, Rattus norvegicus
tggaacggctcctccgctactggag

SEQ ID NO: 593148 - DNA, 25 bp, Rattus norvegicus
agaaagcagctggtctccgcttgcc

SEQ ID NO: 593149 - DNA, 25 bp, Rattus norvegicus
ctagcccggtccacggacaatctga

SEQ ID NO: 593150 - DNA, 25 bp, Rattus norvegicus
ggacaatctgatccggcgctccgag

SEQ ID NO: 593151 - DNA, 25 bp, Rattus norvegicus
tctcgccaactgcagtgatggatcc

SEQ ID NO: 593152 - DNA, 25 bp, Rattus norvegicus
gctccggggacgagccatctggcct

SEQ ID NO: 593153 - DNA, 25 bp, Rattus norvegicus
agcgccagctgcctggttgctccgg

SEQ ID NO: 593154 - DNA, 25 bp, Rattus norvegicus
agagcgggtctcagccttctccgca

SEQ ID NO: 593155 - DNA, 25 bp, Rattus norvegicus
tgaacaaaatgatttagacgcgccg

SEQ ID NO: 593156 - DNA, 25 bp, Rattus norvegicus
gctggtggctgaacaaaatgattta

SEQ ID NO: 593157 - DNA, 25 bp, Rattus norvegicus
cgacaggctggtggctgaacaaaat

SEQ ID NO: 593158 - DNA, 25 bp, Rattus norvegicus
aacttgcagcgacaggctggtggct

SEQ ID NO: 593159 - DNA, 25 bp, Rattus norvegicus
agcccgagcggacatctgggcgcct

SEQ ID NO: 593160 - DNA, 25 bp, Rattus norvegicus
tgtccagagcccgagcggacatctg

SEQ ID NO: 593161 - DNA, 25 bp, Rattus norvegicus
tcccgttgctggctcctgtccagag

SEQ ID NO: 593162 - DNA, 25 bp, Rattus norvegicus
tggcctctcgccaactgcagtgatg

SEQ ID NO: 593163 - DNA, 25 bp, Rattus norvegicus
ggggacgagccatctggcctctcgc

SEQ ID NO: 593164 - DNA, 25 bp, Rattus norvegicus
actgcagtgatggatcccgttgctg

SEQ ID NO: 593165 - DNA, 25 bp, Rattus norvegicus
agaggttatcgtctaggctgcgacc

SEQ ID NO: 593166 - DNA, 25 bp, Rattus norvegicus
ctcggctttcggagcggagctcaaa

SEQ ID NO: 593167 - DNA, 25 bp, Rattus norvegicus
acagactctgcttgcccttatcgga

SEQ ID NO: 593168 - DNA, 25 bp, Rattus norvegicus
cttgcagattaagtacacgggcttc

SEQ ID NO: 593169 - DNA, 25 bp, Rattus norvegicus
cgagggtaatctcgccggagcagca

SEQ ID NO: 593170 - DNA, 25 bp, Rattus norvegicus
agttcttcaggaagctgagccgcga

SEQ ID NO: 593171 - DNA, 25 bp, Rattus norvegicus
cggaccagaggagcaagttcgagaa

SEQ ID NO: 593172 - DNA, 25 bp, Rattus norvegicus
actcctgattttgggccgtctctgc

SEQ ID NO: 593173 - DNA, 25 bp, Rattus norvegicus
ccgccgcggatttgactcctgattt

SEQ ID NO: 593174 - DNA, 25 bp, Rattus norvegicus
atggtttgcgttttccagtgccggc

SEQ ID NO: 593175 - DNA, 25 bp, Rattus norvegicus
gtccggattcgaaaggcaagaggca

SEQ ID NO: 593176 - DNA, 25 bp, Rattus norvegicus
gcaggctcacttcctagtccggatt

SEQ ID NO: 593177 - DNA, 25 bp, Rattus norvegicus
gccagacacgcttccagaacgcttg

SEQ ID NO: 593178 - DNA, 25 bp, Rattus norvegicus
gggcgggctcctgaaacaaagagaa

SEQ ID NO: 593179 - DNA, 25 bp, Rattus norvegicus
gtcagcagctgcgtgctctcctcag

SEQ ID NO: 593180 - DNA, 25 bp, Rattus norvegicus
ttgttgtgttagtgctgccgtcgcc

SEQ ID NO: 593181 - DNA, 25 bp, Rattus norvegicus
acgagagcggccagtcagcagctgc

SEQ ID NO: 593182 - DNA, 25 bp, Rattus norvegicus
cagcctctcctaccggggctgctgc

SEQ ID NO: 593183 - DNA, 25 bp, Rattus norvegicus
caggcgctgctgttgctacagcctc

SEQ ID NO: 593184 - DNA, 25 bp, Rattus norvegicus
cggcgcttttgctgcagttgctcca

SEQ ID NO: 593185 - DNA, 25 bp, Rattus norvegicus
agtctggcctccgacccagagtttg

SEQ ID NO: 593186 - DNA, 25 bp, Rattus norvegicus
ttagctccgcctttgccacgcttta

SEQ ID NO: 593187 - DNA, 25 bp, Rattus norvegicus
cgcctctgtgatttagctccgcctt

SEQ ID NO: 593188 - DNA, 25 bp, Rattus norvegicus
agagtttgcgcgtgcgcgactccgc

SEQ ID NO: 593189 - DNA, 25 bp, Rattus norvegicus
ggcctccgacccagagtttgcgcgt

SEQ ID NO: 593190 - DNA, 25 bp, Rattus norvegicus
tcaggccgggtcctgtctgcgctgc

SEQ ID NO: 593191 - DNA, 25 bp, Rattus norvegicus
ttacggcccggcacggcgcttttgc

SEQ ID NO: 593192 - DNA, 25 bp, Rattus norvegicus
aagtgtgttgttgtgttagtgctgc

SEQ ID NO: 593193 - DNA, 25 bp, Rattus norvegicus
gatacctgcggaagtcaaaggggtc

SEQ ID NO: 593194 - DNA, 25 bp, Rattus norvegicus
gcgtaagccacgcatcccggcaaag

SEQ ID NO: 593195 - DNA, 25 bp, Rattus norvegicus
tcgcgctgcgcatagagcaggagtc

SEQ ID NO: 593196 - DNA, 25 bp, Rattus norvegicus
tccttggcgcgcagatacctgcgga

SEQ ID NO: 593197 - DNA, 25 bp, Rattus norvegicus
aagcgccgttggtccttggcgcgca

SEQ ID NO: 593198 - DNA, 25 bp, Rattus norvegicus
ttagtagcggaaagcgccgttggtc

SEQ ID NO: 593199 - DNA, 25 bp, Rattus norvegicus
gcggctggttaattagtagcggaaa

SEQ ID NO: 593200 - DNA, 25 bp, Rattus norvegicus
ctgcgatgagcaagtcgagcgagcc

SEQ ID NO: 593201 - DNA, 25 bp, Rattus norvegicus
gcggccacagacttgactgcgatga

SEQ ID NO: 593202 - DNA, 25 bp, Rattus norvegicus
gccgctcgaagtcggcggccacaga

SEQ ID NO: 593203 - DNA, 25 bp, Rattus norvegicus
cctaataagaacactcggcgcacga

SEQ ID NO: 593204 - DNA, 25 bp, Rattus norvegicus
taggcacgcctaataagaacactcg

SEQ ID NO: 593205 - DNA, 25 bp, Rattus norvegicus
cagatgcgccgtcgctgtggcattt

SEQ ID NO: 593206 - DNA, 25 bp, Rattus norvegicus
cggcgctgagcaacagcgtaagcca

SEQ ID NO: 593207 - DNA, 25 bp, Rattus norvegicus
ttgcaaccgcactgcttcctgggca

SEQ ID NO: 593208 - DNA, 25 bp, Rattus norvegicus
gctcatactcataggccagcgagtc

SEQ ID NO: 593209 - DNA, 25 bp, Rattus norvegicus
aggatccctcagtgctcgacagcta

SEQ ID NO: 593210 - DNA, 25 bp, Rattus norvegicus
tcttgcagattcagtggccggttca

SEQ ID NO: 593211 - DNA, 25 bp, Rattus norvegicus
cgcttctgctggtgaacctcaccta

SEQ ID NO: 593212 - DNA, 25 bp, Rattus norvegicus
gtggagtcacacgtcagtttgcaga

SEQ ID NO: 593213 - DNA, 25 bp, Rattus norvegicus
agctccgcgagttcttcgtccctga

SEQ ID NO: 593214 - DNA, 25 bp, Rattus norvegicus
ccagcaccttctgggctaagatgta

SEQ ID NO: 593215 - DNA, 25 bp, Rattus norvegicus
tcgtcggtcagccaactgtccagct

SEQ ID NO: 593216 - DNA, 25 bp, Rattus norvegicus
ccctcggcttgtatgaaacggcgca

SEQ ID NO: 593217 - DNA, 25 bp, Rattus norvegicus
ccggctcagatctacctgctggtga

SEQ ID NO: 593218 - DNA, 25 bp, Rattus norvegicus
ttcaaacagcgctcttcgtcggtca

SEQ ID NO: 593219 - DNA, 25 bp, Rattus norvegicus
ttcgaacctgctggagctacctgtg

SEQ ID NO: 593220 - DNA, 25 bp, Rattus norvegicus
ctgctagactagtgagctcgttctc

SEQ ID NO: 593221 - DNA, 25 bp, Rattus norvegicus
gcaaaaagaaatgcgagttgacctc

SEQ ID NO: 593222 - DNA, 25 bp, Rattus norvegicus
cgttggggatgcctttgctgaaata

SEQ ID NO: 593223 - DNA, 25 bp, Rattus norvegicus
cgggagctaccatttttcttctatc

SEQ ID NO: 593224 - DNA, 25 bp, Rattus norvegicus
tcgtgaagtcatttccgggagctac

SEQ ID NO: 593225 - DNA, 25 bp, Rattus norvegicus
tccatgtctgtcgaagatgttggta

SEQ ID NO: 593226 - DNA, 25 bp, Rattus norvegicus
cgcgctgctcaaagggcgacaagct

SEQ ID NO: 593227 - DNA, 25 bp, Rattus norvegicus
gcgacaagctgtaggagatcacatg

SEQ ID NO: 593228 - DNA, 25 bp, Rattus norvegicus
gatcacatgccgtatccgcgtcagg

SEQ ID NO: 593229 - DNA, 25 bp, Rattus norvegicus
tatccgcgtcaggttcccaaactcg

SEQ ID NO: 593230 - DNA, 25 bp, Rattus norvegicus
ccctgaggacagaagataggtgcgt

SEQ ID NO: 593231 - DNA, 25 bp, Rattus norvegicus
cgtggctcagtctcgcaaaaaactc

SEQ ID NO: 593232 - DNA, 25 bp, Rattus norvegicus
tgagcccggctttgcacgtcacttc

SEQ ID NO: 593233 - DNA, 25 bp, Rattus norvegicus
gccgaccctggagatcgtgaagtca

SEQ ID NO: 593234 - DNA, 25 bp, Rattus norvegicus
atacgataagaactccatgtctgtc

SEQ ID NO: 593235 - DNA, 25 bp, Rattus norvegicus
accgcgcggttctcactctcgggaa

SEQ ID NO: 593236 - DNA, 25 bp, Rattus norvegicus
gccgccactggctggccagcaattg

SEQ ID NO: 593237 - DNA, 25 bp, Rattus norvegicus
tggccagcaattgcgcgtgtcacta

SEQ ID NO: 593238 - DNA, 25 bp, Rattus norvegicus
tgcgcgtgtcactaccgcgcggttc

SEQ ID NO: 593239 - DNA, 25 bp, Rattus norvegicus
cggttctcactctcgggaagctaga

SEQ ID NO: 593240 - DNA, 25 bp, Rattus norvegicus
cactctcgggaagctagatctctcg

SEQ ID NO: 593241 - DNA, 25 bp, Rattus norvegicus
tctcgggaagctagatctctcgctt

SEQ ID NO: 593242 - DNA, 25 bp, Rattus norvegicus
tctcgctttgctcgggctgcaccaa

SEQ ID NO: 593243 - DNA, 25 bp, Rattus norvegicus
gctcgggctgcaccaaggttgccca

SEQ ID NO: 593244 - DNA, 25 bp, Rattus norvegicus
tgcaccaaggttgcccacccactct

SEQ ID NO: 593245 - DNA, 25 bp, Rattus norvegicus
tctccgcactaacctggccgccaca

SEQ ID NO: 593246 - DNA, 25 bp, Rattus norvegicus
acactcgcctggctccactgctcgc

SEQ ID NO: 593247 - DNA, 25 bp, Rattus norvegicus
tgaacgggcgagtcctcccgcgcgt

SEQ ID NO: 593248 - DNA, 25 bp, Rattus norvegicus
cagcaattgcgcgtgtcactaccgc

SEQ ID NO: 593249 - DNA, 25 bp, Rattus norvegicus
agcgcgccactacgccgaaactttg

SEQ ID NO: 593250 - DNA, 25 bp, Rattus norvegicus
tgcactagtgaacagcgtacagccc

SEQ ID NO: 593251 - DNA, 25 bp, Rattus norvegicus
gcccgcctctgtgcttaggctattg

SEQ ID NO: 593252 - DNA, 25 bp, Rattus norvegicus
gcccttggactgcaccttgctagta

SEQ ID NO: 593253 - DNA, 25 bp, Rattus norvegicus
tcgcgtgccgcgttagaattgctag

SEQ ID NO: 593254 - DNA, 25 bp, Rattus norvegicus
tgaagcctgggcgacactaacttgc

SEQ ID NO: 593255 - DNA, 25 bp, Rattus norvegicus
acactgatgcggtgattgggcaatc

SEQ ID NO: 593256 - DNA, 25 bp, Rattus norvegicus
gtgcttccagatgaggccgtgtctc

SEQ ID NO: 593257 - DNA, 25 bp, Rattus norvegicus
cgggcttgagagagatacactgctt

SEQ ID NO: 593258 - DNA, 25 bp, Rattus norvegicus
tacactgcttctgcgtggtgagacc

SEQ ID NO: 593259 - DNA, 25 bp, Rattus norvegicus
agaccctctgtactggatgccttcc

SEQ ID NO: 593260 - DNA, 25 bp, Rattus norvegicus
gagctccgcagtcttttcctggaca

SEQ ID NO: 593261 - DNA, 25 bp, Rattus norvegicus
gcgcctgcgcagctatacgctcaaa

SEQ ID NO: 593262 - DNA, 25 bp, Rattus norvegicus
ctaacttgctatcatcccgggctga

SEQ ID NO: 593263 - DNA, 25 bp, Rattus norvegicus
tggtaggcgacccaggcaccgacca

SEQ ID NO: 593264 - DNA, 25 bp, Rattus norvegicus
ggctcgcccacccacacacctacgt

SEQ ID NO: 593265 - DNA, 25 bp, Rattus norvegicus
cccgcctctagggttcgcacgcggc

SEQ ID NO: 593266 - DNA, 25 bp, Rattus norvegicus
gcagcactttcacggctttgacaag

SEQ ID NO: 593267 - DNA, 25 bp, Rattus norvegicus
acggctttgacaagcccgcagcggc

SEQ ID NO: 593268 - DNA, 25 bp, Rattus norvegicus
ccggccgagactgcgccatgcagga

SEQ ID NO: 593269 - DNA, 25 bp, Rattus norvegicus
agactgcgccatgcaggaagcgcca

SEQ ID NO: 593270 - DNA, 25 bp, Rattus norvegicus
tgcaggaagcgccagctgcgctgcc

SEQ ID NO: 593271 - DNA, 25 bp, Rattus norvegicus
ggtacctgccttcctcggcaagcta

SEQ ID NO: 593272 - DNA, 25 bp, Rattus norvegicus
cctcggcaagctatgggcgctggta

SEQ ID NO: 593273 - DNA, 25 bp, Rattus norvegicus
acacctacgtttcagccagtccttt

SEQ ID NO: 593274 - DNA, 25 bp, Rattus norvegicus
ggcaccgaccacctcatccgctgga

SEQ ID NO: 593275 - DNA, 25 bp, Rattus norvegicus
ccttcctcggcaagctatgggcgct

SEQ ID NO: 593276 - DNA, 25 bp, Rattus norvegicus
ggcaaacgcagcactttcacggctt

SEQ ID NO: 593277 - DNA, 25 bp, Rattus norvegicus
tcctcagatggttttcggaaggtgg

SEQ ID NO: 593278 - DNA, 25 bp, Rattus norvegicus
cgtaagtgatcagagccgcttcgcc

SEQ ID NO: 593279 - DNA, 25 bp, Rattus norvegicus
ttctcggtagagtggcaccagcttc

SEQ ID NO: 593280 - DNA, 25 bp, Rattus norvegicus
accagcttcctcgtaagtgatcaga

SEQ ID NO: 593281 - DNA, 25 bp, Rattus norvegicus
atggttgtcgttcgttctcggtaga

SEQ ID NO: 593282 - DNA, 25 bp, Rattus norvegicus
tttcaagcacagcaatatggcgagc

SEQ ID NO: 593283 - DNA, 25 bp, Rattus norvegicus
tcagcatccgagcttcgtgcgaggc

SEQ ID NO: 593284 - DNA, 25 bp, Rattus norvegicus
tgaccacgttgagtttcagcatccg

SEQ ID NO: 593285 - DNA, 25 bp, Rattus norvegicus
catcgagcaaggtggcctgctaaga

SEQ ID NO: 593286 - DNA, 25 bp, Rattus norvegicus
gaggatggagcgactcacactcaca

SEQ ID NO: 593287 - DNA, 25 bp, Rattus norvegicus
tgagtccctttgaccagcggggagc

SEQ ID NO: 593288 - DNA, 25 bp, Rattus norvegicus
cgtcaactcaacatgtgtgagtccc

SEQ ID NO: 593289 - DNA, 25 bp, Rattus norvegicus
atggcgagctttgttcgtcaactca

SEQ ID NO: 593290 - DNA, 25 bp, Rattus norvegicus
gctaagaccagagcgtgaccacgtt

SEQ ID NO: 593291 - DNA, 25 bp, Rattus norvegicus
tccaggccctgaacacgtgggaaca

SEQ ID NO: 593292 - DNA, 25 bp, Rattus norvegicus
tcgggaaattgttgcctcaggcctg

SEQ ID NO: 593293 - DNA, 25 bp, Rattus norvegicus
tggacacgcctgtctccaccgtagg

SEQ ID NO: 593294 - DNA, 25 bp, Rattus norvegicus
tcgctgcaggaatatcaccaccatc

SEQ ID NO: 593295 - DNA, 25 bp, Rattus norvegicus
gcctgacgatgctctcgggacacgt

SEQ ID NO: 593296 - DNA, 25 bp, Rattus norvegicus
cagacgtgcggtaaacgtggcttta

SEQ ID NO: 593297 - DNA, 25 bp, Rattus norvegicus
tcagccaggattaggtgtaccaccg

SEQ ID NO: 593298 - DNA, 25 bp, Rattus norvegicus
atttactgagtactccacgggagcc

SEQ ID NO: 593299 - DNA, 25 bp, Rattus norvegicus
tccgggcttctaaagtgactagaga

SEQ ID NO: 593300 - DNA, 25 bp, Rattus norvegicus
tggatccggtctggtcctagacttc

SEQ ID NO: 593301 - DNA, 25 bp, Rattus norvegicus
ggtcggaattcactgcctctatagg

SEQ ID NO: 593302 - DNA, 25 bp, Rattus norvegicus
cttaaactcactgtgggcggagcca

SEQ ID NO: 593303 - DNA, 25 bp, Rattus norvegicus
ccaccgtagggcgtgcttaaactca

SEQ ID NO: 593304 - DNA, 25 bp, Rattus norvegicus
cctcgtacctcacgtcgggaaattg

SEQ ID NO: 593305 - DNA, 25 bp, Rattus norvegicus
ctctcttcaagtgcccggtgtgcca

SEQ ID NO: 593306 - DNA, 25 bp, Rattus norvegicus
tttaagtacgcttcagacctgcagc

SEQ ID NO: 593307 - DNA, 25 bp, Rattus norvegicus
tgtccagactgcgagaagcgcttta

SEQ ID NO: 593308 - DNA, 25 bp, Rattus norvegicus
cccgggagaagccactcaagtgtcc

SEQ ID NO: 593309 - DNA, 25 bp, Rattus norvegicus
caccctgtgtgagcgccgctttttt

SEQ ID NO: 593310 - DNA, 25 bp, Rattus norvegicus
gaagcctctgcgttgcaccctgtgt

SEQ ID NO: 593311 - DNA, 25 bp, Rattus norvegicus
agccctttaaatgcggcctgtgtga

SEQ ID NO: 593312 - DNA, 25 bp, Rattus norvegicus
cgcacagtgcagagaggcccttcaa

SEQ ID NO: 593313 - DNA, 25 bp, Rattus norvegicus
tgtgcgagctgcatttcaaagagtc

SEQ ID NO: 593314 - DNA, 25 bp, Rattus norvegicus
tgcagaagcaccagctgtctcactg

SEQ ID NO: 593315 - DNA, 25 bp, Rattus norvegicus
gcaccacctgttccgctgcaatgtg

SEQ ID NO: 593316 - DNA, 25 bp, Rattus norvegicus
atgtacgcgcattccggtgagcacc

SEQ ID NO: 593317 - DNA, 25 bp, Rattus norvegicus
ggccctacaagtgtgctgtctgtga

SEQ ID NO: 593318 - DNA, 25 bp, Rattus norvegicus
cccgtgtgtaacaaggcctacaagc

SEQ ID NO: 593319 - DNA, 25 bp, Rattus norvegicus
ccaaggacggcgtgcttgacctcaa

SEQ ID NO: 593320 - DNA, 25 bp, Rattus norvegicus
gcctggaccagtagcgggaaccagc

SEQ ID NO: 593321 - DNA, 25 bp, Rattus norvegicus
gagatggtggaccaggcctggacca

SEQ ID NO: 593322 - DNA, 25 bp, Rattus norvegicus
cggcgtgcttgacctcaagttggtg

SEQ ID NO: 593323 - DNA, 25 bp, Rattus norvegicus
cttctgcaggaagccaaggacggcg

SEQ ID NO: 593324 - DNA, 25 bp, Rattus norvegicus
agttcgtgtcgcttctgcaggaagc

SEQ ID NO: 593325 - DNA, 25 bp, Rattus norvegicus
gaagagtctgggacttctcaccacc

SEQ ID NO: 593326 - DNA, 25 bp, Rattus norvegicus
cgggtactccaagccggcacgagaa

SEQ ID NO: 593327 - DNA, 25 bp, Rattus norvegicus
cggcgactaggaacggaagcggaag

SEQ ID NO: 593328 - DNA, 25 bp, Rattus norvegicus
gatagctccggtggcccggcgacta

SEQ ID NO: 593329 - DNA, 25 bp, Rattus norvegicus
gcagcaatgatagctccggtggccc

SEQ ID NO: 593330 - DNA, 25 bp, Rattus norvegicus
gacggaagcggaagcagcaatgata

SEQ ID NO: 593331 - DNA, 25 bp, Rattus norvegicus
tctgggacttctcaccaccaagttc

SEQ ID NO: 593332 - DNA, 25 bp, Rattus norvegicus
ttgacctcaagttggtgcggaccgg

SEQ ID NO: 593333 - DNA, 25 bp, Rattus norvegicus
agcggcagtgcaggactaaaccaga

SEQ ID NO: 593334 - DNA, 25 bp, Rattus norvegicus
gggcgctatccaatggaccgtgcta

SEQ ID NO: 593335 - DNA, 25 bp, Rattus norvegicus
cggcaaagctttcccggtgttgtga

SEQ ID NO: 593336 - DNA, 25 bp, Rattus norvegicus
ggctgggtatttgcttcgcaccatg

SEQ ID NO: 593337 - DNA, 25 bp, Rattus norvegicus
tactcgcccttgtttcggtggctgg

SEQ ID NO: 593338 - DNA, 25 bp, Rattus norvegicus
ctgcagttccagttactcgcccttg

SEQ ID NO: 593339 - DNA, 25 bp, Rattus norvegicus
gccgatgtggtgtctactgactgca

SEQ ID NO: 593340 - DNA, 25 bp, Rattus norvegicus
cctgacgagtttggtctgtaccgga

SEQ ID NO: 593341 - DNA, 25 bp, Rattus norvegicus
gaatccacttccgtccagaatcctg

SEQ ID NO: 593342 - DNA, 25 bp, Rattus norvegicus
aatgtagtcctaccgtctcaggggc

SEQ ID NO: 593343 - DNA, 25 bp, Rattus norvegicus
cccacgcaaggatttctgggaaatg

SEQ ID NO: 593344 - DNA, 25 bp, Rattus norvegicus
aggcctgaaggaccacttcctctca

SEQ ID NO: 593345 - DNA, 25 bp, Rattus norvegicus
gggcgagctgtcagatagcctctcc

SEQ ID NO: 593346 - DNA, 25 bp, Rattus norvegicus
cagaactagcgttagagccgagggc

SEQ ID NO: 593347 - DNA, 25 bp, Rattus norvegicus
ttccgggaagttggcacaagcgaaa

SEQ ID NO: 593348 - DNA, 25 bp, Rattus norvegicus
tccactgctaggagggcgggaaaac

SEQ ID NO: 593349 - DNA, 25 bp, Rattus norvegicus
tgatcccgttagttccactgctagg

SEQ ID NO: 593350 - DNA, 25 bp, Rattus norvegicus
actcagagacctggtgatcccgtta

SEQ ID NO: 593351 - DNA, 25 bp, Rattus norvegicus
gtgcttgggccagccactcagagac

SEQ ID NO: 593352 - DNA, 25 bp, Rattus norvegicus
gtaccggcccgctaaggtctatctc

SEQ ID NO: 593353 - DNA, 25 bp, Rattus norvegicus
tgcaacttcaactggactaactttg

SEQ ID NO: 593354 - DNA, 25 bp, Rattus norvegicus
tgtgtccctgcaatgctgcaacttc

SEQ ID NO: 593355 - DNA, 25 bp, Rattus norvegicus
tcacagtcaccactgatactgggtc

SEQ ID NO: 593356 - DNA, 25 bp, Rattus norvegicus
gtgtcttccaggtactgcactctca

SEQ ID NO: 593357 - DNA, 25 bp, Rattus norvegicus
gtctatctcctagaagcgctgccca

SEQ ID NO: 593358 - DNA, 25 bp, Rattus norvegicus
caagcgaaagggtcggtgtcttcca

SEQ ID NO: 593359 - DNA, 25 bp, Rattus norvegicus
ctcaccttgagaggcgctcccagga

SEQ ID NO: 593360 - DNA, 25 bp, Rattus norvegicus
actttagatttgataccggcgaggc

SEQ ID NO: 593361 - DNA, 25 bp, Rattus norvegicus
aatttccggagatgaggctaaccta

SEQ ID NO: 593362 - DNA, 25 bp, Rattus norvegicus
gttttctcagcgtgaagccgggacc

SEQ ID NO: 593363 - DNA, 25 bp, Rattus norvegicus
ttctgcagtagccacgcttgtatcg

SEQ ID NO: 593364 - DNA, 25 bp, Rattus norvegicus
cttgtatcggctttctgagacccta

SEQ ID NO: 593365 - DNA, 25 bp, Rattus norvegicus
agaccctagtccttgctgctccagg

SEQ ID NO: 593366 - DNA, 25 bp, Rattus norvegicus
tattagaaggcagcagcgcaccgcc

SEQ ID NO: 593367 - DNA, 25 bp, Rattus norvegicus
ctgaatcccgaggagaggcggttta

SEQ ID NO: 593368 - DNA, 25 bp, Rattus norvegicus
ggaggggatcccaactgctagaatc

SEQ ID NO: 593369 - DNA, 25 bp, Rattus norvegicus
ctgctagaatcctgggcagggtctc

SEQ ID NO: 593370 - DNA, 25 bp, Rattus norvegicus
tgcccggaggacagcaagatgctgc

SEQ ID NO: 593371 - DNA, 25 bp, Rattus norvegicus
tcgcactgcttcttctgcccgggtt

SEQ ID NO: 593372 - DNA, 25 bp, Rattus norvegicus
cgttaggtgagcctccaggcttggc

SEQ ID NO: 593373 - DNA, 25 bp, Rattus norvegicus
aggcggtttaggagagcatactcga

SEQ ID NO: 593374 - DNA, 25 bp, Rattus norvegicus
agtgggtttcaagactcgaagggca

SEQ ID NO: 593375 - DNA, 25 bp, Rattus norvegicus
cccagctgtggcagggactcagcgt

SEQ ID NO: 593376 - DNA, 25 bp, Rattus norvegicus
cgtctcgggctggagccacaggtac

SEQ ID NO: 593377 - DNA, 25 bp, Rattus norvegicus
tgcagtggttagaggtccaggaccc

SEQ ID NO: 593378 - DNA, 25 bp, Rattus norvegicus
cgggactgggaccacgtacagaatc

SEQ ID NO: 593379 - DNA, 25 bp, Rattus norvegicus
acagaatcacaagaggaaggggcgc

SEQ ID NO: 593380 - DNA, 25 bp, Rattus norvegicus
atgtcactgggtgatcgccggaacc

SEQ ID NO: 593381 - DNA, 25 bp, Rattus norvegicus
ggactcagcgtacgcagtgccgtcc

SEQ ID NO: 593382 - DNA, 25 bp, Rattus norvegicus
ccacaggtacgacgcagcgggaccg

SEQ ID NO: 593383 - DNA, 25 bp, Rattus norvegicus
gggcacacagcacgcggtccacaga

SEQ ID NO: 593384 - DNA, 25 bp, Rattus norvegicus
ccacagatccgcttcccaggaggga

SEQ ID NO: 593385 - DNA, 25 bp, Rattus norvegicus
gtagcagcctgaccgtccttctgtc

SEQ ID NO: 593386 - DNA, 25 bp, Rattus norvegicus
gggcttgagttctctgcagtggtta

SEQ ID NO: 593387 - DNA, 25 bp, Rattus norvegicus
agtccagacaggctgcgccagtgga

SEQ ID NO: 593388 - DNA, 25 bp, Rattus norvegicus
ttctgtctggacctttcgaccggga

SEQ ID NO: 593389 - DNA, 25 bp, Rattus norvegicus
agcacgggtacaggcacctagggca

SEQ ID NO: 593390 - DNA, 25 bp, Rattus norvegicus
ttgcggcccttcgagccaccagaag

SEQ ID NO: 593391 - DNA, 25 bp, Rattus norvegicus
cgcccttggattctgggcggcctcg

SEQ ID NO: 593392 - DNA, 25 bp, Rattus norvegicus
gtgattcggtcctccagaccctaga

SEQ ID NO: 593393 - DNA, 25 bp, Rattus norvegicus
ccttccggacgagcctgtgattcgg

SEQ ID NO: 593394 - DNA, 25 bp, Rattus norvegicus
tgcatcctcctgctgtcagagcggc

SEQ ID NO: 593395 - DNA, 25 bp, Rattus norvegicus
aaggcgctgagcataggagaccacc

SEQ ID NO: 593396 - DNA, 25 bp, Rattus norvegicus
gagggcccgccaagtctccaaggcg

SEQ ID NO: 593397 - DNA, 25 bp, Rattus norvegicus
ccaccagaaggtggcgcccttggat

SEQ ID NO: 593398 - DNA, 25 bp, Rattus norvegicus
tcgcggtatccatcgttgaggctgt

SEQ ID NO: 593399 - DNA, 25 bp, Rattus norvegicus
gctgtggtgcgtttgttcttcgtta

SEQ ID NO: 593400 - DNA, 25 bp, Rattus norvegicus
agggctctgtagtcttctggcttca

SEQ ID NO: 593401 - DNA, 25 bp, Rattus norvegicus
tcttcgttagttcgagggctctgta

SEQ ID NO: 593402 - DNA, 25 bp, Rattus norvegicus
agagttccctacagcgcgtcccagg

SEQ ID NO: 593403 - DNA, 25 bp, Rattus norvegicus
cttagagaaccaaagcccgcggcca

SEQ ID NO: 593404 - DNA, 25 bp, Rattus norvegicus
cggacaggctcgtgactggtcctct

SEQ ID NO: 593405 - DNA, 25 bp, Rattus norvegicus
gacaggctcgtgactggtcctctaa

SEQ ID NO: 593406 - DNA, 25 bp, Rattus norvegicus
caggctcgtgactggtcctctaacg

SEQ ID NO: 593407 - DNA, 25 bp, Rattus norvegicus
ggctcgtgactggtcctctaacggc

SEQ ID NO: 593408 - DNA, 25 bp, Rattus norvegicus
cgtgactggtcctctaacggccctt

SEQ ID NO: 593409 - DNA, 25 bp, Rattus norvegicus
ctggtcctctaacggcccttagaga

SEQ ID NO: 593410 - DNA, 25 bp, Rattus norvegicus
cgctgaccctcgagcagccgggtag

SEQ ID NO: 593411 - DNA, 25 bp, Rattus norvegicus
tagagaaccaaagcccgcggccagt

SEQ ID NO: 593412 - DNA, 25 bp, Rattus norvegicus
accaaagcccgcggccagtgagagg

SEQ ID NO: 593413 - DNA, 25 bp, Rattus norvegicus
agcgaatggcggagcaatgggatct

SEQ ID NO: 593414 - DNA, 25 bp, Rattus norvegicus
gatctggacgaggagtgcctccgcc

SEQ ID NO: 593415 - DNA, 25 bp, Rattus norvegicus
tggacgaggagtgcctccgccgcct

SEQ ID NO: 593416 - DNA, 25 bp, Rattus norvegicus
gactggtcctctaacggcccttaga

SEQ ID NO: 593417 - DNA, 25 bp, Rattus norvegicus
gctgtgcagccttgccaggccaagg

SEQ ID NO: 593418 - DNA, 25 bp, Rattus norvegicus
agcctgccaaggtcagccagcggct

SEQ ID NO: 593419 - DNA, 25 bp, Rattus norvegicus
ggtcaaaccgcgctgcgtcacttcg

SEQ ID NO: 593420 - DNA, 25 bp, Rattus norvegicus
cgccttagttcggacccgctggctg

SEQ ID NO: 593421 - DNA, 25 bp, Rattus norvegicus
catcctggacggaggttgggcctca

SEQ ID NO: 593422 - DNA, 25 bp, Rattus norvegicus
ggaacgcagctccatcctggacgga

SEQ ID NO: 593423 - DNA, 25 bp, Rattus norvegicus
ccagggcggctgcacttcagactgt

SEQ ID NO: 593424 - DNA, 25 bp, Rattus norvegicus
tggcaacagcgcgaactacggcgcc

SEQ ID NO: 593425 - DNA, 25 bp, Rattus norvegicus
gcgccagatgcagcctgccaaggtc

SEQ ID NO: 593426 - DNA, 25 bp, Rattus norvegicus
ctcggaggtgagaaacgccacagcc

SEQ ID NO: 593427 - DNA, 25 bp, Rattus norvegicus
gaaacccatcaggaggccgacacgg

SEQ ID NO: 593428 - DNA, 25 bp, Rattus norvegicus
tccaccgggtcggtgaaacccatca

SEQ ID NO: 593429 - DNA, 25 bp, Rattus norvegicus
agttcggacccgctggctgtgcagc

SEQ ID NO: 593430 - DNA, 25 bp, Rattus norvegicus
ttcagactgtctgggcagagtcagt

SEQ ID NO: 593431 - DNA, 25 bp, Rattus norvegicus
ctgagatagaagtggaggaaagccc

SEQ ID NO: 593432 - DNA, 25 bp, Rattus norvegicus
cgcggtgctcatcaccggtgagtgt

SEQ ID NO: 593433 - DNA, 25 bp, Rattus norvegicus
ggctccgcctcgtgcagcaacttgg

SEQ ID NO: 593434 - DNA, 25 bp, Rattus norvegicus
cagcaacttggggactttgttccgg

SEQ ID NO: 593435 - DNA, 25 bp, Rattus norvegicus
tcgaaagcggatctagccaaggggc

SEQ ID NO: 593436 - DNA, 25 bp, Rattus norvegicus
ccagggcgctttataagctgggtcc

SEQ ID NO: 593437 - DNA, 25 bp, Rattus norvegicus
tttataagctgggtccgagggccca

SEQ ID NO: 593438 - DNA, 25 bp, Rattus norvegicus
gggcccagcaaagaaagcgagtatc

SEQ ID NO: 593439 - DNA, 25 bp, Rattus norvegicus
gtgttcctctgcactccgtgtcctg

SEQ ID NO: 593440 - DNA, 25 bp, Rattus norvegicus
cccgaagtcatggagcgctggcctt

SEQ ID NO: 593441 - DNA, 25 bp, Rattus norvegicus
agctgctgcgctcagacctgcgtct

SEQ ID NO: 593442 - DNA, 25 bp, Rattus norvegicus
tctcgactggctgtgccagcgcctg

SEQ ID NO: 593443 - DNA, 25 bp, Rattus norvegicus
ctggatcgcgttgtcccgcctagcg

SEQ ID NO: 593444 - DNA, 25 bp, Rattus norvegicus
tccggcttcttcgaaagcggatcta

SEQ ID NO: 593445 - DNA, 25 bp, Rattus norvegicus
caggctgtcaagtgcgtcaggtgac

SEQ ID NO: 593446 - DNA, 25 bp, Rattus norvegicus
aatggggctggctcttaaatgtatc

SEQ ID NO: 593447 - DNA, 25 bp, Rattus norvegicus
cacgttgaaataaagctccgggaag

SEQ ID NO: 593448 - DNA, 25 bp, Rattus norvegicus
gcgcactagagaaaggtgagccttc

SEQ ID NO: 593449 - DNA, 25 bp, Rattus norvegicus
cgcgcatgcgttcctctggagtgac

SEQ ID NO: 593450 - DNA, 25 bp, Rattus norvegicus
ttaaatgtatccagcttccgggccc

SEQ ID NO: 593451 - DNA, 25 bp, Rattus norvegicus
gggcggcctacattcgggcctttca

SEQ ID NO: 593452 - DNA, 25 bp, Rattus norvegicus
atctcacgtgaccacaatggggctg

SEQ ID NO: 593453 - DNA, 25 bp, Rattus norvegicus
agcgtctcgcactgcaccaggttga

SEQ ID NO: 593454 - DNA, 25 bp, Rattus norvegicus
aggtagtccgcctggctgagcaccc

SEQ ID NO: 593455 - DNA, 25 bp, Rattus norvegicus
gcactaatccctccaagtagccatt

SEQ ID NO: 593456 - DNA, 25 bp, Rattus norvegicus
gtcaggtgacgcactgcatctcacg

SEQ ID NO: 593457 - DNA, 25 bp, Rattus norvegicus
agctccgggaagaacgacatggctg

SEQ ID NO: 593458 - DNA, 25 bp, Rattus norvegicus
agtagccattgtccacgttgaaata

SEQ ID NO: 593459 - DNA, 25 bp, Rattus norvegicus
cacctgcgttcgtaagggagtaagg

SEQ ID NO: 593460 - DNA, 25 bp, Rattus norvegicus
aggttcaggaaactctcgaatcccg

SEQ ID NO: 593461 - DNA, 25 bp, Rattus norvegicus
ggagtaaggttcaggaaactctcga

SEQ ID NO: 593462 - DNA, 25 bp, Rattus norvegicus
tggatctagcacctgcgttcgtaag

SEQ ID NO: 593463 - DNA, 25 bp, Rattus norvegicus
ttctgtggatctagcacctgcgttc

SEQ ID NO: 593464 - DNA, 25 bp, Rattus norvegicus
ctcgcggttctgtggatctagcacc

SEQ ID NO: 593465 - DNA, 25 bp, Rattus norvegicus
acgagactcgcggttctgtggatct

SEQ ID NO: 593466 - DNA, 25 bp, Rattus norvegicus
cagcgacgcggagaacgagactcgc

SEQ ID NO: 593467 - DNA, 25 bp, Rattus norvegicus
gcagccttacacagcgacgcggaga

SEQ ID NO: 593468 - DNA, 25 bp, Rattus norvegicus
agcaggactcgtgcagccttacaca

SEQ ID NO: 593469 - DNA, 25 bp, Rattus norvegicus
cccaagcaggactcgtgcagcctta

SEQ ID NO: 593470 - DNA, 25 bp, Rattus norvegicus
tgttgtcccaagcaggactcgtgca

SEQ ID NO: 593471 - DNA, 25 bp, Rattus norvegicus
agcaaggtacctgttgtcccaagca

SEQ ID NO: 593472 - DNA, 25 bp, Rattus norvegicus
cgcagcaaggtacctgttgtcccaa

SEQ ID NO: 593473 - DNA, 25 bp, Rattus norvegicus
tctgccgatttacgtaactacccgc

SEQ ID NO: 593474 - DNA, 25 bp, Rattus norvegicus
ccagaagaaccaatacgggcttttg

SEQ ID NO: 593475 - DNA, 25 bp, Rattus norvegicus
aatccgcgagctaaacccgatgtcg

SEQ ID NO: 593476 - DNA, 25 bp, Rattus norvegicus
ttatgtttaaaaaatccgcgagcta

SEQ ID NO: 593477 - DNA, 25 bp, Rattus norvegicus
cttcatttcctggaacccggttatg

SEQ ID NO: 593478 - DNA, 25 bp, Rattus norvegicus
cagtctggctgggatttttccgtcc

SEQ ID NO: 593479 - DNA, 25 bp, Rattus norvegicus
ccaatacgggcttttgcgttcttag

SEQ ID NO: 593480 - DNA, 25 bp, Rattus norvegicus
cgccttcctttggaattgaccaatg

SEQ ID NO: 593481 - DNA, 25 bp, Rattus norvegicus
attgaccaatggaagcaagcgcttc

SEQ ID NO: 593482 - DNA, 25 bp, Rattus norvegicus
cttaggtcccagaagaaccaatacg

SEQ ID NO: 593483 - DNA, 25 bp, Rattus norvegicus
gcgcttctgccgatttacgtaacta

SEQ ID NO: 593484 - DNA, 25 bp, Rattus norvegicus
ccgactcagactaatcacgagaaag

SEQ ID NO: 593485 - DNA, 25 bp, Rattus norvegicus
cgagaaagaagtgcttacggacctc

SEQ ID NO: 593486 - DNA, 25 bp, Rattus norvegicus
aagcaagcgcttctgccgatttacg

SEQ ID NO: 593487 - DNA, 25 bp, Rattus norvegicus
tctcgcgacccggatcgcgctgtgt

SEQ ID NO: 593488 - DNA, 25 bp, Rattus norvegicus
agacgtttatctgggcctgagattg

SEQ ID NO: 593489 - DNA, 25 bp, Rattus norvegicus
gcctgagacgtttatctgggcctga

SEQ ID NO: 593490 - DNA, 25 bp, Rattus norvegicus
gagggcgagcctgagacgtttatct

SEQ ID NO: 593491 - DNA, 25 bp, Rattus norvegicus
acccggatcgcgctgtgtctttttt

SEQ ID NO: 593492 - DNA, 25 bp, Rattus norvegicus
cctgagattggccttatccccgagc

SEQ ID NO: 593493 - DNA, 25 bp, Rattus norvegicus
gcggtggatcccgtgcttcctgcac

SEQ ID NO: 593494 - DNA, 25 bp, Rattus norvegicus
ccagcgcagccatgtgagtgtccgc

SEQ ID NO: 593495 - DNA, 25 bp, Rattus norvegicus
gacagcgcgaggtccttgcagccca

SEQ ID NO: 593496 - DNA, 25 bp, Rattus norvegicus
agagtaccgacagcgcgaggtcctt

SEQ ID NO: 593497 - DNA, 25 bp, Rattus norvegicus
cggcaacgccgagagtaccgacagc

SEQ ID NO: 593498 - DNA, 25 bp, Rattus norvegicus
agcaggcccggcaacgccgagagta

SEQ ID NO: 593499 - DNA, 25 bp, Rattus norvegicus
gagaacgcagcttcgccccacaaaa

SEQ ID NO: 593500 - DNA, 25 bp, Rattus norvegicus
cgggtctcgcctcacccggttctcg

SEQ ID NO: 593501 - DNA, 25 bp, Rattus norvegicus
gaaacctgggccagagccgctggca

SEQ ID NO: 593502 - DNA, 25 bp, Rattus norvegicus
ggcacagtgggtgaccgagagtcgg

SEQ ID NO: 593503 - DNA, 25 bp, Rattus norvegicus
gctggtaccaaaaagccccgagcta

SEQ ID NO: 593504 - DNA, 25 bp, Rattus norvegicus
tggagcccaactgggctggtaccaa

SEQ ID NO: 593505 - DNA, 25 bp, Rattus norvegicus
cttggagcccaactgggctggtacc

SEQ ID NO: 593506 - DNA, 25 bp, Rattus norvegicus
agcttggagcccaactgggctggta

SEQ ID NO: 593507 - DNA, 25 bp, Rattus norvegicus
aacctgggccagagccgctggcagt

SEQ ID NO: 593508 - DNA, 25 bp, Rattus norvegicus
agccagaaacctgggccagagccgc

SEQ ID NO: 593509 - DNA, 25 bp, Rattus norvegicus
gcagccagaaacctgggccagagcc

SEQ ID NO: 593510 - DNA, 25 bp, Rattus norvegicus
agagcagccagaaacctgggccaga

SEQ ID NO: 593511 - DNA, 25 bp, Rattus norvegicus
tcgagagcagccagaaacctgggcc

SEQ ID NO: 593512 - DNA, 25 bp, Rattus norvegicus
cccatcccggcgggctgagtcagga

SEQ ID NO: 593513 - DNA, 25 bp, Rattus norvegicus
tccgggagaccagtcccgccccatc

SEQ ID NO: 593514 - DNA, 25 bp, Rattus norvegicus
agccgctggcagtgagcttggagcc

SEQ ID NO: 593515 - DNA, 25 bp, Rattus norvegicus
gactgccaagactggaacccactgg

SEQ ID NO: 593516 - DNA, 25 bp, Rattus norvegicus
cccgggtcagtaggagccagtcctt

SEQ ID NO: 593517 - DNA, 25 bp, Rattus norvegicus
ttcccagctgtgatgagggtcctca

SEQ ID NO: 593518 - DNA, 25 bp, Rattus norvegicus
gagcccgcacctccgcaggaagtag

SEQ ID NO: 593519 - DNA, 25 bp, Rattus norvegicus
cctgcagaggccacgctgagtccga

SEQ ID NO: 593520 - DNA, 25 bp, Rattus norvegicus
tgccctgtcattagcgcggggccaa

SEQ ID NO: 593521 - DNA, 25 bp, Rattus norvegicus
gccaatgaggctgagactgccaaga

SEQ ID NO: 593522 - DNA, 25 bp, Rattus norvegicus
agccctgggacccagtcacgggaag

SEQ ID NO: 593523 - DNA, 25 bp, Rattus norvegicus
attccatgatgtccctgtcggtgcg

SEQ ID NO: 593524 - DNA, 25 bp, Rattus norvegicus
ggaaaacgggcgcttccgctcattc

SEQ ID NO: 593525 - DNA, 25 bp, Rattus norvegicus
ggagccagtccttcgcaggcgtcct

SEQ ID NO: 593526 - DNA, 25 bp, Rattus norvegicus
aggcgtcctcggcagccaagagcgc

SEQ ID NO: 593527 - DNA, 25 bp, Rattus norvegicus
aacccactggggcagctgtacctgg

SEQ ID NO: 593528 - DNA, 25 bp, Rattus norvegicus
agacccgattggtgctggacacaca

SEQ ID NO: 593529 - DNA, 25 bp, Rattus norvegicus
aacctgaggcgctgacgccgtcaca

SEQ ID NO: 593530 - DNA, 25 bp, Rattus norvegicus
gacgccattgcgcacgcgcgagcta

SEQ ID NO: 593531 - DNA, 25 bp, Rattus norvegicus
cagggccaaccgtgctctgagacgg

SEQ ID NO: 593532 - DNA, 25 bp, Rattus norvegicus
tccgcagccgccaaaccaaaaaata

SEQ ID NO: 593533 - DNA, 25 bp, Rattus norvegicus
gcacacggctggctgctagccctag

SEQ ID NO: 593534 - DNA, 25 bp, Rattus norvegicus
ctgttcagtacactgcagcacacgg

SEQ ID NO: 593535 - DNA, 25 bp, Rattus norvegicus
cctttgtcctacaccctgttcagta

SEQ ID NO: 593536 - DNA, 25 bp, Rattus norvegicus
aggaagctccctgaccagtgacgcg

SEQ ID NO: 593537 - DNA, 25 bp, Rattus norvegicus
actggcacagcagagctagaggacg

SEQ ID NO: 593538 - DNA, 25 bp, Rattus norvegicus
ccacgcttcgatcgaggtgaggcta

SEQ ID NO: 593539 - DNA, 25 bp, Rattus norvegicus
aaccagtgcccggtgcctgatacgt

SEQ ID NO: 593540 - DNA, 25 bp, Rattus norvegicus
tctgcgcctctgtttgcggaaacca

SEQ ID NO: 593541 - DNA, 25 bp, Rattus norvegicus
cctttaatctgaagcggagggagaa

SEQ ID NO: 593542 - DNA, 25 bp, Rattus norvegicus
ctagaggacgtgagcgaagaactgt

SEQ ID NO: 593543 - DNA, 25 bp, Rattus norvegicus
agctctttctccacggcgtctggtg

SEQ ID NO: 593544 - DNA, 25 bp, Rattus norvegicus
gagcggctcccttacctagactggg

SEQ ID NO: 593545 - DNA, 25 bp, Rattus norvegicus
cctatctcgaaagacgccgtacctt

SEQ ID NO: 593546 - DNA, 25 bp, Rattus norvegicus
taccttcaatgacccagggacctgg

SEQ ID NO: 593547 - DNA, 25 bp, Rattus norvegicus
acgcgggaccactaagcagacaaga

SEQ ID NO: 593548 - DNA, 25 bp, Rattus norvegicus
ggctgaagctacaacacgcaccgca

SEQ ID NO: 593549 - DNA, 25 bp, Rattus norvegicus
cttccagcgaaaggagctccgcatg

SEQ ID NO: 593550 - DNA, 25 bp, Rattus norvegicus
tcggagccaggcaaattacatcgtg

SEQ ID NO: 593551 - DNA, 25 bp, Rattus norvegicus
gagggcttgagagaggcttattcca

SEQ ID NO: 593552 - DNA, 25 bp, Rattus norvegicus
gcttattccacgcaggagttgcagc

SEQ ID NO: 593553 - DNA, 25 bp, Rattus norvegicus
agactcagtccctaagctcaacgga

SEQ ID NO: 593554 - DNA, 25 bp, Rattus norvegicus
gctgaactcccggtccgcgaatctt

SEQ ID NO: 593555 - DNA, 25 bp, Rattus norvegicus
cgcgaatcttgccagtgcccataga

SEQ ID NO: 593556 - DNA, 25 bp, Rattus norvegicus
tccaaagggctgcaggagactcagt

SEQ ID NO: 593557 - DNA, 25 bp, Rattus norvegicus
ctgcttttgaaagttggcgcccggg

SEQ ID NO: 593558 - DNA, 25 bp, Rattus norvegicus
acgccatcgcgcctgcttttgaaag

SEQ ID NO: 593559 - DNA, 25 bp, Rattus norvegicus
agcgccgacgcaggcgcattgcact

SEQ ID NO: 593560 - DNA, 25 bp, Rattus norvegicus
cgcttagccaggtcccggaaccgtg

SEQ ID NO: 593561 - DNA, 25 bp, Rattus norvegicus
tcgcctaggggttctggaccctctg

SEQ ID NO: 593562 - DNA, 25 bp, Rattus norvegicus
acggttgacgcgcttgcttcgccta

SEQ ID NO: 593563 - DNA, 25 bp, Rattus norvegicus
taacgaggctggacttctgaggcac

SEQ ID NO: 593564 - DNA, 25 bp, Rattus norvegicus
ttgtctctaccctcgaggccggctt

SEQ ID NO: 593565 - DNA, 25 bp, Rattus norvegicus
tcctcccaacatggtaggcctctgg

SEQ ID NO: 593566 - DNA, 25 bp, Rattus norvegicus
ccgcctctaggtgtcacgatggggc

SEQ ID NO: 593567 - DNA, 25 bp, Rattus norvegicus
gacagcagtagccagtgcaggcacg

SEQ ID NO: 593568 - DNA, 25 bp, Rattus norvegicus
cgattaaaccgtgcgcggagctgct

SEQ ID NO: 593569 - DNA, 25 bp, Rattus norvegicus
tccgagcctgtggagcgattaaacc

SEQ ID NO: 593570 - DNA, 25 bp, Rattus norvegicus
gccattttgtgtccgagcctgtgga

SEQ ID NO: 593571 - DNA, 25 bp, Rattus norvegicus
cttctggtgcttttgcctcaggtgc

SEQ ID NO: 593572 - DNA, 25 bp, Rattus norvegicus
ggccctctgcctcgcatggacctgc

SEQ ID NO: 593573 - DNA, 25 bp, Rattus norvegicus
gggccgtctgcacgcggctctccaa

SEQ ID NO: 593574 - DNA, 25 bp, Rattus norvegicus
tgctgaggaagcagaacgggacccc

SEQ ID NO: 593575 - DNA, 25 bp, Rattus norvegicus
gtgcttttgcctcaggtgctgctga

SEQ ID NO: 593576 - DNA, 25 bp, Rattus norvegicus
ctacgccatccgacccgagcccgac

SEQ ID NO: 593577 - DNA, 25 bp, Rattus norvegicus
atggacctgccacccgccgggcaac

SEQ ID NO: 593578 - DNA, 25 bp, Rattus norvegicus
ctctgttctcttctggtgcttttgc

SEQ ID NO: 593579 - DNA, 25 bp, Rattus norvegicus
tcgacgctctgttctcttctggtgc

SEQ ID NO: 593580 - DNA, 25 bp, Rattus norvegicus
tgggttcgacgctctgttctcttct

SEQ ID NO: 593581 - DNA, 25 bp, Rattus norvegicus
acctccctgggttcgacgctctgtt

SEQ ID NO: 593582 - DNA, 25 bp, Rattus norvegicus
gccgcccgccctagcgcctccgcca

SEQ ID NO: 593583 - DNA, 25 bp, Rattus norvegicus
gctgcacagagtcgcgcgcactcgg

SEQ ID NO: 593584 - DNA, 25 bp, Rattus norvegicus
catgcttggcggctgcacagagtcg

SEQ ID NO: 593585 - DNA, 25 bp, Rattus norvegicus
agaacagaggaagccctctctacct

SEQ ID NO: 593586 - DNA, 25 bp, Rattus norvegicus
gctcgaaccatagcgtaatgacgta

SEQ ID NO: 593587 - DNA, 25 bp, Rattus norvegicus
tgacgtaagaacagaggaagccctc

SEQ ID NO: 593588 - DNA, 25 bp, Rattus norvegicus
tctctacctccgtctccgtttccta

SEQ ID NO: 593589 - DNA, 25 bp, Rattus norvegicus
cgtagactccgcgtttcttggtgtc

SEQ ID NO: 593590 - DNA, 25 bp, Rattus norvegicus
tagactccgcgtttcttggtgtcgc

SEQ ID NO: 593591 - DNA, 25 bp, Rattus norvegicus
cttggtgtcgcgtcccccttgacgt

SEQ ID NO: 593592 - DNA, 25 bp, Rattus norvegicus
gcgtcccccttgacgtcatggtttg

SEQ ID NO: 593593 - DNA, 25 bp, Rattus norvegicus
gccaggctgtgcacctgcgcctcgg

SEQ ID NO: 593594 - DNA, 25 bp, Rattus norvegicus
aggccctgcaatggccaggccgcag

SEQ ID NO: 593595 - DNA, 25 bp, Rattus norvegicus
ctgcaatggccaggccgcagaggac

SEQ ID NO: 593596 - DNA, 25 bp, Rattus norvegicus
tccggcgcgcagtccggatagcatc

SEQ ID NO: 593597 - DNA, 25 bp, Rattus norvegicus
gcgcgcagtccggatagcatcgtcg

SEQ ID NO: 593598 - DNA, 25 bp, Rattus norvegicus
cgaaccatagcgtaatgacgtaaga

SEQ ID NO: 593599 - DNA, 25 bp, Rattus norvegicus
gggacgggccctcgcacatgatcct

SEQ ID NO: 593600 - DNA, 25 bp, Rattus norvegicus
tccaggcctgatgcgagggccacga

SEQ ID NO: 593601 - DNA, 25 bp, Rattus norvegicus
tccaggtcgcgacctgaagtcagca

SEQ ID NO: 593602 - DNA, 25 bp, Rattus norvegicus
agcaggtccagcttcaacgcgtttc

SEQ ID NO: 593603 - DNA, 25 bp, Rattus norvegicus
acgcgtttccttccaggcgtccttg

SEQ ID NO: 593604 - DNA, 25 bp, Rattus norvegicus
caagacgcggtggaaagccgtgctc

SEQ ID NO: 593605 - DNA, 25 bp, Rattus norvegicus
cgcgactagcacacggccctgaggg

SEQ ID NO: 593606 - DNA, 25 bp, Rattus norvegicus
gatcctaccgtagccctgcaactgt

SEQ ID NO: 593607 - DNA, 25 bp, Rattus norvegicus
ctgcaactgtgcatcaggacctgtt

SEQ ID NO: 593608 - DNA, 25 bp, Rattus norvegicus
tcaggacctgttgcgctgtgcaaat

SEQ ID NO: 593609 - DNA, 25 bp, Rattus norvegicus
ctctaatccctgtcgggtgtttcca

SEQ ID NO: 593610 - DNA, 25 bp, Rattus norvegicus
gctcgtttcctaagctcagcccgta

SEQ ID NO: 593611 - DNA, 25 bp, Rattus norvegicus
acgctctaggatctctcgggctcca

SEQ ID NO: 593612 - DNA, 25 bp, Rattus norvegicus
tccttgggctgaagagcaagacgcg

SEQ ID NO: 593613 - DNA, 25 bp, Rattus norvegicus
gcgtatactcgcttccaacctcagg

SEQ ID NO: 593614 - DNA, 25 bp, Rattus norvegicus
cagcttcagacgctctcggattttc

SEQ ID NO: 593615 - DNA, 25 bp, Rattus norvegicus
ctgctatggttcttccagcttcaga

SEQ ID NO: 593616 - DNA, 25 bp, Rattus norvegicus
acccgcagggagtatattgctgcta

SEQ ID NO: 593617 - DNA, 25 bp, Rattus norvegicus
agctgcgcatgcttgcgcctcgtgg

SEQ ID NO: 593618 - DNA, 25 bp, Rattus norvegicus
ccaggatagagagctgcgcatgctt

SEQ ID NO: 593619 - DNA, 25 bp, Rattus norvegicus
aggaggacagcgcatgctctgtgac

SEQ ID NO: 593620 - DNA, 25 bp, Rattus norvegicus
cacgccgcctggtttctaaggaaca

SEQ ID NO: 593621 - DNA, 25 bp, Rattus norvegicus
agagcaccgataccgggaacacgcc

SEQ ID NO: 593622 - DNA, 25 bp, Rattus norvegicus
cgcaccggaatccagagcaccgata

SEQ ID NO: 593623 - DNA, 25 bp, Rattus norvegicus
tccgtctgccctgaggaaggataga

SEQ ID NO: 593624 - DNA, 25 bp, Rattus norvegicus
ccatggatccggacgggtttccgag

SEQ ID NO: 593625 - DNA, 25 bp, Rattus norvegicus
ggcatgatggcattgcccgcccaga

SEQ ID NO: 593626 - DNA, 25 bp, Rattus norvegicus
agtcgcacgcgaaaccatggatccg

SEQ ID NO: 593627 - DNA, 25 bp, Rattus norvegicus
agatccgccatgttcaggatcccac

SEQ ID NO: 593628 - DNA, 25 bp, Rattus norvegicus
gtctgagtgctctggcgtcgtctcg

SEQ ID NO: 593629 - DNA, 25 bp, Rattus norvegicus
cgtcgtctcggagtgtgcgaatccg

SEQ ID NO: 593630 - DNA, 25 bp, Rattus norvegicus
ggagtgtgcgaatccgctgtatcca

SEQ ID NO: 593631 - DNA, 25 bp, Rattus norvegicus
gctgtatccagcacgtgccgcaaga

SEQ ID NO: 593632 - DNA, 25 bp, Rattus norvegicus
tgccgcaagagcgtacgtatggtcg

SEQ ID NO: 593633 - DNA, 25 bp, Rattus norvegicus
tcctaactgttctagctgcagcaag

SEQ ID NO: 593634 - DNA, 25 bp, Rattus norvegicus
tctagctgcagcaagcaccgcattc

SEQ ID NO: 593635 - DNA, 25 bp, Rattus norvegicus
tcccgccgcctcttttgagtgaagt

SEQ ID NO: 593636 - DNA, 25 bp, Rattus norvegicus
ccgcctcttttgagtgaagtctcgc

SEQ ID NO: 593637 - DNA, 25 bp, Rattus norvegicus
gaagtctcgcgatgctaccacatgg

SEQ ID NO: 593638 - DNA, 25 bp, Rattus norvegicus
actgtagtccgacagctggggagcc

SEQ ID NO: 593639 - DNA, 25 bp, Rattus norvegicus
ggactactgagatccgccatgttca

SEQ ID NO: 593640 - DNA, 25 bp, Rattus norvegicus
ccgtcgggactactgagatccgcca

SEQ ID NO: 593641 - DNA, 25 bp, Rattus norvegicus
gcggccgcaccaaaacgttcttctg

SEQ ID NO: 593642 - DNA, 25 bp, Rattus norvegicus
cgtctctgcagcgttcacttccagg

SEQ ID NO: 593643 - DNA, 25 bp, Rattus norvegicus
ctctggctcaagaacgtgtcccgtg

SEQ ID NO: 593644 - DNA, 25 bp, Rattus norvegicus
aggcgctgcacttctacacgtttcc

SEQ ID NO: 593645 - DNA, 25 bp, Rattus norvegicus
cgtaccgggctgctacaacaactca

SEQ ID NO: 593646 - DNA, 25 bp, Rattus norvegicus
tgcctggctttacgtgctgcgtacc

SEQ ID NO: 593647 - DNA, 25 bp, Rattus norvegicus
gggcggcaatagtgagagacctcta

SEQ ID NO: 593648 - DNA, 25 bp, Rattus norvegicus
gcggtccgcaagcatattctgggca

SEQ ID NO: 593649 - DNA, 25 bp, Rattus norvegicus
gcgtagtcctcctttccaggcggtc

SEQ ID NO: 593650 - DNA, 25 bp, Rattus norvegicus
cgccttggacgagctttatctggaa

SEQ ID NO: 593651 - DNA, 25 bp, Rattus norvegicus
gtagtccgtgcgacaacgttccatt

SEQ ID NO: 593652 - DNA, 25 bp, Rattus norvegicus
tgtgttagacacagagcgcttgcgc

SEQ ID NO: 593653 - DNA, 25 bp, Rattus norvegicus
ctctgaacaggatatcgcggtgccc

SEQ ID NO: 593654 - DNA, 25 bp, Rattus norvegicus
ctgatgcagcatggaacttgtagtc

SEQ ID NO: 593655 - DNA, 25 bp, Rattus norvegicus
aactttgcagcgagggacaggagcc

SEQ ID NO: 593656 - DNA, 25 bp, Rattus norvegicus
gctgccaatggaaaccaagcggtgg

SEQ ID NO: 593657 - DNA, 25 bp, Rattus norvegicus
agacccgttgcgctgccaatggaaa

SEQ ID NO: 593658 - DNA, 25 bp, Rattus norvegicus
ggctttacgcctagacccgttgcgc

SEQ ID NO: 593659 - DNA, 25 bp, Rattus norvegicus
ctggccaatcagagaagggctttac

SEQ ID NO: 593660 - DNA, 25 bp, Rattus norvegicus
cagcccgtctccatccgggtggaag

SEQ ID NO: 593661 - DNA, 25 bp, Rattus norvegicus
tctcacgcgagggaagaactttgca

SEQ ID NO: 593662 - DNA, 25 bp, Rattus norvegicus
tgaagtcccggagcctctcacgcga

SEQ ID NO: 593663 - DNA, 25 bp, Rattus norvegicus
tcatcgcggccgaggactcgctgaa

SEQ ID NO: 593664 - DNA, 25 bp, Rattus norvegicus
agcaacagctcggacgtccggaatc

SEQ ID NO: 593665 - DNA, 25 bp, Rattus norvegicus
gaaagtcgaggttgcggatcctgcc

SEQ ID NO: 593666 - DNA, 25 bp, Rattus norvegicus
ctcatagcccgtggttggcgggaaa

SEQ ID NO: 593667 - DNA, 25 bp, Rattus norvegicus
gtgggtccgtagtgcccactcctgt

SEQ ID NO: 593668 - DNA, 25 bp, Rattus norvegicus
cccaacgtggtcaccatggcgagtg

SEQ ID NO: 593669 - DNA, 25 bp, Rattus norvegicus
ccgcctaccgcggattgtctgtggc

SEQ ID NO: 593670 - DNA, 25 bp, Rattus norvegicus
gggaaatgtcgttctagccaagttc

SEQ ID NO: 593671 - DNA, 25 bp, Rattus norvegicus
cgagcaatggctgcgcctccgcgaa

SEQ ID NO: 593672 - DNA, 25 bp, Rattus norvegicus
tggctgatggccaggtctttttctc

SEQ ID NO: 593673 - DNA, 25 bp, Rattus norvegicus
aagatccggggatgggcaacgccac

SEQ ID NO: 593674 - DNA, 25 bp, Rattus norvegicus
ttgctcgaatcctgcaacctctgca

SEQ ID NO: 593675 - DNA, 25 bp, Rattus norvegicus
gtggccttccctggcttgctcgaat

SEQ ID NO: 593676 - DNA, 25 bp, Rattus norvegicus
cgatcaggatagctctcaggggccc

SEQ ID NO: 593677 - DNA, 25 bp, Rattus norvegicus
cttgtccggacgatcaggatagctc

SEQ ID NO: 593678 - DNA, 25 bp, Rattus norvegicus
gccaggtctttttctcttgtccgga

SEQ ID NO: 593679 - DNA, 25 bp, Rattus norvegicus
aatgctgagagcctgacggacgcct

SEQ ID NO: 593680 - DNA, 25 bp, Rattus norvegicus
aaggagcatattgggactacgtttc

SEQ ID NO: 593681 - DNA, 25 bp, Rattus norvegicus
tccgcgaacggcattctgggaaatg

SEQ ID NO: 593682 - DNA, 25 bp, Rattus norvegicus
ttcactaacgctcataaggagcata

SEQ ID NO: 593683 - DNA, 25 bp, Rattus norvegicus
gctcttagcgaagtggcggacgtat

SEQ ID NO: 593684 - DNA, 25 bp, Rattus norvegicus
tagaggaactaacgtccggcgagca

SEQ ID NO: 593685 - DNA, 25 bp, Rattus norvegicus
atcgacattgaggacgccacgcagc

SEQ ID NO: 593686 - DNA, 25 bp, Rattus norvegicus
agcaggactctcgtggctgggccca

SEQ ID NO: 593687 - DNA, 25 bp, Rattus norvegicus
ctgcgggacatcctcaaactggacc

SEQ ID NO: 593688 - DNA, 25 bp, Rattus norvegicus
cggacgtatggcgtggatctgaacc

SEQ ID NO: 593689 - DNA, 25 bp, Rattus norvegicus
cctcctgcgcgagcatcgacattga

SEQ ID NO: 593690 - DNA, 25 bp, Rattus norvegicus
aggttttgtgtagtgctctgtcgtc

SEQ ID NO: 593691 - DNA, 25 bp, Rattus norvegicus
tgctctgtcgtctcctgctctctaa

SEQ ID NO: 593692 - DNA, 25 bp, Rattus norvegicus
cctgctctctaacggggtcgtggct

SEQ ID NO: 593693 - DNA, 25 bp, Rattus norvegicus
tggctgggcgaaattggacactttt

SEQ ID NO: 593694 - DNA, 25 bp, Rattus norvegicus
tggatctgaaccgttttcgggtgcc

SEQ ID NO: 593695 - DNA, 25 bp, Rattus norvegicus
tggacactttttggaggtagaggaa

SEQ ID NO: 593696 - DNA, 25 bp, Rattus norvegicus
gacgccacgcagcatctgcgggaca

SEQ ID NO: 593697 - DNA, 25 bp, Rattus norvegicus
gcagtcgcctgacccgtgtgaacct

SEQ ID NO: 593698 - DNA, 25 bp, Rattus norvegicus
cgcagactggactcgacacaacgga

SEQ ID NO: 593699 - DNA, 25 bp, Rattus norvegicus
gacacaacggagctctggaggctgc

SEQ ID NO: 593700 - DNA, 25 bp, Rattus norvegicus
agctggaacggttccgccggttcat

SEQ ID NO: 593701 - DNA, 25 bp, Rattus norvegicus
gttccgccggttcatgactgatcta

SEQ ID NO: 593702 - DNA, 25 bp, Rattus norvegicus
ttcatgactgatctagagcgcgtgc

SEQ ID NO: 593703 - DNA, 25 bp, Rattus norvegicus
tctagagcgcgtgcttggtcttcta

SEQ ID NO: 593704 - DNA, 25 bp, Rattus norvegicus
ctactgctgctaggcagtcgcctga

SEQ ID NO: 593705 - DNA, 25 bp, Rattus norvegicus
tggactcgacacaacggagctctgg

SEQ ID NO: 593706 - DNA, 25 bp, Rattus norvegicus
acccgtgtgaacctcgccttggcta

SEQ ID NO: 593707 - DNA, 25 bp, Rattus norvegicus
tgtgaacctcgccttggctagggcg

SEQ ID NO: 593708 - DNA, 25 bp, Rattus norvegicus
cgtgcttggtcttctactgctgcta

SEQ ID NO: 593709 - DNA, 25 bp, Rattus norvegicus
gctgcagtgagccaagcctgcactc

SEQ ID NO: 593710 - DNA, 25 bp, Rattus norvegicus
ctagggcgggctcagacagcgaccc

SEQ ID NO: 593711 - DNA, 25 bp, Rattus norvegicus
tgccgagccgcaaataaacctatcc

SEQ ID NO: 593712 - DNA, 25 bp, Rattus norvegicus
caaggccctgtaggggccatcgatc

SEQ ID NO: 593713 - DNA, 25 bp, Rattus norvegicus
gatctaaccttgtgtgcggcgccta

SEQ ID NO: 593714 - DNA, 25 bp, Rattus norvegicus
gcgcgggtcaggttgatctaacctt

SEQ ID NO: 593715 - DNA, 25 bp, Rattus norvegicus
acttggtcagctgcctgtctgttgc

SEQ ID NO: 593716 - DNA, 25 bp, Rattus norvegicus
cgcgttaggtccgatggacttggtc

SEQ ID NO: 593717 - DNA, 25 bp, Rattus norvegicus
ctcgaaacctcctgccgcgttaggt

SEQ ID NO: 593718 - DNA, 25 bp, Rattus norvegicus
gtctccgggcatggcctcgaaacct

SEQ ID NO: 593719 - DNA, 25 bp, Rattus norvegicus
ctgagccgccgagactccgaagagc

SEQ ID NO: 593720 - DNA, 25 bp, Rattus norvegicus
agtaatgacgccaccacgctgacgc

SEQ ID NO: 593721 - DNA, 25 bp, Rattus norvegicus
caagtttgttttggcgtcaggcgcg

SEQ ID NO: 593722 - DNA, 25 bp, Rattus norvegicus
cttgcgacagaacgccaaggccctg

SEQ ID NO: 593723 - DNA, 25 bp, Rattus norvegicus
caaagacattgattggcaggcactc

SEQ ID NO: 593724 - DNA, 25 bp, Rattus norvegicus
cccgtggcagcccaagtttgttttg

SEQ ID NO: 593725 - DNA, 25 bp, Rattus norvegicus
acctgaggcgagttcggcaccagcc

SEQ ID NO: 593726 - DNA, 25 bp, Rattus norvegicus
cggcaccagccagagtgaggcagtc

SEQ ID NO: 593727 - DNA, 25 bp, Rattus norvegicus
ccagagtgaggcagtccgctagccg

SEQ ID NO: 593728 - DNA, 25 bp, Rattus norvegicus
tccctaggcggccacgtctgcaagc

SEQ ID NO: 593729 - DNA, 25 bp, Rattus norvegicus
aaggactcgtcggtctgagcgcgct

SEQ ID NO: 593730 - DNA, 25 bp, Rattus norvegicus
agaaaagtggagtcccgcatggacg

SEQ ID NO: 593731 - DNA, 25 bp, Rattus norvegicus
agtggagtcccgcatggacgtctgc

SEQ ID NO: 593732 - DNA, 25 bp, Rattus norvegicus
ggcgcaccctcaccatccgagtctt

SEQ ID NO: 593733 - DNA, 25 bp, Rattus norvegicus
ccctcgaggttgtcatagtcgccgc

SEQ ID NO: 593734 - DNA, 25 bp, Rattus norvegicus
aggttgtcatagtcgccgcgtcgcg

SEQ ID NO: 593735 - DNA, 25 bp, Rattus norvegicus
cggcaccacggtgaagtgaggcatc

SEQ ID NO: 593736 - DNA, 25 bp, Rattus norvegicus
accacggtgaagtgaggcatcgcgc

SEQ ID NO: 593737 - DNA, 25 bp, Rattus norvegicus
cggaccaaaaggactcgtcggtctg

SEQ ID NO: 593738 - DNA, 25 bp, Rattus norvegicus
gcgcgcgagtctcgtgtagacgccc

SEQ ID NO: 593739 - DNA, 25 bp, Rattus norvegicus
cactatgttccgtcgaggttccaga

SEQ ID NO: 593740 - DNA, 25 bp, Rattus norvegicus
ctgcacggaggttggctgaacaatt

SEQ ID NO: 593741 - DNA, 25 bp, Rattus norvegicus
ggttccagaagcaaccggactgcta

SEQ ID NO: 593742 - DNA, 25 bp, Rattus norvegicus
gtcggaaccgcgcaacactatgttc

SEQ ID NO: 593743 - DNA, 25 bp, Rattus norvegicus
cagagcccgcggaatgcgcacaaca

SEQ ID NO: 593744 - DNA, 25 bp, Rattus norvegicus
accaggagtggaccaggttgcacta

SEQ ID NO: 593745 - DNA, 25 bp, Rattus norvegicus
aactctggccgctttgccgagacca

SEQ ID NO: 593746 - DNA, 25 bp, Rattus norvegicus
gctgcactcgctctatggaaaaatg

SEQ ID NO: 593747 - DNA, 25 bp, Rattus norvegicus
tagacccaggtccacgaagttgccc

SEQ ID NO: 593748 - DNA, 25 bp, Rattus norvegicus
cagccttctgaagcgcgagcagtac

SEQ ID NO: 593749 - DNA, 25 bp, Rattus norvegicus
aacaatttcggggacagccttctga

SEQ ID NO: 593750 - DNA, 25 bp, Rattus norvegicus
ccgctaccggtttcagcagcgcaaa

SEQ ID NO: 593751 - DNA, 25 bp, Rattus norvegicus
aaaatggtcctgacgcgatcgccga

SEQ ID NO: 593752 - DNA, 25 bp, Rattus norvegicus
cgtcacgtacgcgactgtagtctga

SEQ ID NO: 593753 - DNA, 25 bp, Rattus norvegicus
gcgcccacgacgagctcgactttaa

SEQ ID NO: 593754 - DNA, 25 bp, Rattus norvegicus
tagtcggaacggaacacttggcctc

SEQ ID NO: 593755 - DNA, 25 bp, Rattus norvegicus
cgctcggccagctttctagtcggaa

SEQ ID NO: 593756 - DNA, 25 bp, Rattus norvegicus
tggctcttaggcaccctcgactggc

SEQ ID NO: 593757 - DNA, 25 bp, Rattus norvegicus
aaagtttgcagtggagccgcgacct

SEQ ID NO: 593758 - DNA, 25 bp, Rattus norvegicus
gggccacgccgatgactactgcaaa

SEQ ID NO: 593759 - DNA, 25 bp, Rattus norvegicus
ctactgcaaactgtggcgcccacga

SEQ ID NO: 593760 - DNA, 25 bp, Rattus norvegicus
ctgcaagcgaactagtagggaactc

SEQ ID NO: 593761 - DNA, 25 bp, Rattus norvegicus
ccgaaaggccactggccagcggact

SEQ ID NO: 593762 - DNA, 25 bp, Rattus norvegicus
cccgcccgaaaagtttgcagtggag

SEQ ID NO: 593763 - DNA, 25 bp, Rattus norvegicus
tcttcggcgaggacggggcaccaac

SEQ ID NO: 593764 - DNA, 25 bp, Rattus norvegicus
gtgtcccaggtctcgcggcctgcag

SEQ ID NO: 593765 - DNA, 25 bp, Rattus norvegicus
gcgacgtagaagtgacttggctgca

SEQ ID NO: 593766 - DNA, 25 bp, Rattus norvegicus
tcgactttaaactcgtcttcggcga

SEQ ID NO: 593767 - DNA, 25 bp, Rattus norvegicus
accaagtgatctaccgccaaaccta

SEQ ID NO: 593768 - DNA, 25 bp, Rattus norvegicus
gaccctatttctgaggcgtcctctg

SEQ ID NO: 593769 - DNA, 25 bp, Rattus norvegicus
ggtggattcctcagccgctattgtc

SEQ ID NO: 593770 - DNA, 25 bp, Rattus norvegicus
gtcctactgtccctgccagtgggtc

SEQ ID NO: 593771 - DNA, 25 bp, Rattus norvegicus
gtaaggaacggcctagcacacgtcc

SEQ ID NO: 593772 - DNA, 25 bp, Rattus norvegicus
cgcggtagtcgctcaaaagtttcaa

SEQ ID NO: 593773 - DNA, 25 bp, Rattus norvegicus
attaagtcggtctcgtcggagccta

SEQ ID NO: 593774 - DNA, 25 bp, Rattus norvegicus
ggggtaatccaatgagacactgtgc

SEQ ID NO: 593775 - DNA, 25 bp, Rattus norvegicus
gtaccgaccgacagcagacagacga

SEQ ID NO: 593776 - DNA, 25 bp, Rattus norvegicus
tcggcgcgaactagcgacttgtgta

SEQ ID NO: 593777 - DNA, 25 bp, Rattus norvegicus
tgcagcaccttatccagagactccg

SEQ ID NO: 593778 - DNA, 25 bp, Rattus norvegicus
ggtagtgtccctgccacaccgcagt

SEQ ID NO: 593779 - DNA, 25 bp, Rattus norvegicus
accacttgccaaactaggaggatta

SEQ ID NO: 593780 - DNA, 25 bp, Rattus norvegicus
gctattgtcaactcccgcagcagga

SEQ ID NO: 593781 - DNA, 25 bp, Rattus norvegicus
atccagctccggagtggcctcctgt

SEQ ID NO: 593782 - DNA, 25 bp, Rattus norvegicus
tgcatttgtcgcgagatccagctcc

SEQ ID NO: 593783 - DNA, 25 bp, Rattus norvegicus
gttcccttttcttctactaatgatg

SEQ ID NO: 593784 - DNA, 25 bp, Rattus norvegicus
atgatgctggcagacctagcgctcc

SEQ ID NO: 593785 - DNA, 25 bp, Rattus norvegicus
catggatcgccatctctgcatttgt

SEQ ID NO: 593786 - DNA, 25 bp, Rattus norvegicus
aagcaacgtcttggacctgcggcca

SEQ ID NO: 593787 - DNA, 25 bp, Rattus norvegicus
gatccttaagcaaagcaacgtcttg

SEQ ID NO: 593788 - DNA, 25 bp, Rattus norvegicus
ccggcctaggcacgatccttaagca

SEQ ID NO: 593789 - DNA, 25 bp, Rattus norvegicus
agccttagcaaaaggcggatcctta

SEQ ID NO: 593790 - DNA, 25 bp, Rattus norvegicus
agttacaattggtagagccttagca

SEQ ID NO: 593791 - DNA, 25 bp, Rattus norvegicus
cgttcgtagcggagagttacaattg

SEQ ID NO: 593792 - DNA, 25 bp, Rattus norvegicus
tggacctgcggccacagtctcatgc

SEQ ID NO: 593793 - DNA, 25 bp, Rattus norvegicus
gatcgatgcgttcggcgcgcagcac

SEQ ID NO: 593794 - DNA, 25 bp, Rattus norvegicus
gtctcatgccatggatcgccatctc

SEQ ID NO: 593795 - DNA, 25 bp, Rattus norvegicus
atccctgagtggacggtggtgtgag

SEQ ID NO: 593796 - DNA, 25 bp, Rattus norvegicus
gagcgtggatccctgagtggacggt

SEQ ID NO: 593797 - DNA, 25 bp, Rattus norvegicus
cggctgagaggaggacgccgggagc

SEQ ID NO: 593798 - DNA, 25 bp, Rattus norvegicus
tctgcgtcccgcgtgctggatggcg

SEQ ID NO: 593799 - DNA, 25 bp, Rattus norvegicus
gccacgaggaggttactggcggggc

SEQ ID NO: 593800 - DNA, 25 bp, Rattus norvegicus
gccgaacgctctgcgggtctgcgtc

SEQ ID NO: 593801 - DNA, 25 bp, Rattus norvegicus
gtgtgaggaagacgcaggcgcgcgc

SEQ ID NO: 593802 - DNA, 25 bp, Rattus norvegicus
ggccacctagcgtacggccgaacgc

SEQ ID NO: 593803 - DNA, 25 bp, Rattus norvegicus
gcagctcggggccacgaggaggtta

SEQ ID NO: 593804 - DNA, 25 bp, Rattus norvegicus
ggcgcgaccgagcatcctggcagct

SEQ ID NO: 593805 - DNA, 25 bp, Rattus norvegicus
gacggcgcgaccgagcatcctggca

SEQ ID NO: 593806 - DNA, 25 bp, Rattus norvegicus
tagcgtacggccgaacgctctgcgg

SEQ ID NO: 593807 - DNA, 25 bp, Rattus norvegicus
cgtacggccgaacgctctgcgggtc

SEQ ID NO: 593808 - DNA, 25 bp, Rattus norvegicus
acggccgaacgctctgcgggtctgc

SEQ ID NO: 593809 - DNA, 25 bp, Rattus norvegicus
cggtggcaaccaattggaagacatt

SEQ ID NO: 593810 - DNA, 25 bp, Rattus norvegicus
tacctgagatcgcacggtggcaacc

SEQ ID NO: 593811 - DNA, 25 bp, Rattus norvegicus
tcgcttccacaaaaaagagtctatc

SEQ ID NO: 593812 - DNA, 25 bp, Rattus norvegicus
atggacagcgttcaaagatcgcttc

SEQ ID NO: 593813 - DNA, 25 bp, Rattus norvegicus
ggctcctcctgaggggcgacagaaa

SEQ ID NO: 593814 - DNA, 25 bp, Rattus norvegicus
cacaagctgctggattggctcctcc

SEQ ID NO: 593815 - DNA, 25 bp, Rattus norvegicus
ctcgcgaaccgaggcacgaagatcg

SEQ ID NO: 593816 - DNA, 25 bp, Rattus norvegicus
gactactctgtagcggccctcttta

SEQ ID NO: 593817 - DNA, 25 bp, Rattus norvegicus
tctctggagcagacgactcgacttc

SEQ ID NO: 593818 - DNA, 25 bp, Rattus norvegicus
tccggaggcgtttacaggccagcac

SEQ ID NO: 593819 - DNA, 25 bp, Rattus norvegicus
tccatagcggcaatcgcggagtact

SEQ ID NO: 593820 - DNA, 25 bp, Rattus norvegicus
atatccagttccgtagagggccgtg

SEQ ID NO: 593821 - DNA, 25 bp, Rattus norvegicus
gtgaggcaaaatggccgcggaattt

SEQ ID NO: 593822 - DNA, 25 bp, Rattus norvegicus
ctgaccctctggtgtctctggagca

SEQ ID NO: 593823 - DNA, 25 bp, Rattus norvegicus
cacgctcaccaaggagttggcgggc

SEQ ID NO: 593824 - DNA, 25 bp, Rattus norvegicus
agcgcctggacacgctcaccaagga

SEQ ID NO: 593825 - DNA, 25 bp, Rattus norvegicus
caaggtgcgcgctgagcgcaaccgt

SEQ ID NO: 593826 - DNA, 25 bp, Rattus norvegicus
actgcacggcgaactggcgcgagaa

SEQ ID NO: 593827 - DNA, 25 bp, Rattus norvegicus
aaaacaatgcgctggtggtcggact

SEQ ID NO: 593828 - DNA, 25 bp, Rattus norvegicus
cttgcagatggagaaaacaatgcgc

SEQ ID NO: 593829 - DNA, 25 bp, Rattus norvegicus
cgcccgagccttgcagatggagaaa

SEQ ID NO: 593830 - DNA, 25 bp, Rattus norvegicus
cacactacccttgactgcgcccgca

SEQ ID NO: 593831 - DNA, 25 bp, Rattus norvegicus
gcctagcggcactccatcacccgga

SEQ ID NO: 593832 - DNA, 25 bp, Rattus norvegicus
agagcagcctgcttaccatcctggg

SEQ ID NO: 593833 - DNA, 25 bp, Rattus norvegicus
agcctcactatgagccacggcccga

SEQ ID NO: 593834 - DNA, 25 bp, Rattus norvegicus
caagttcgcacccagggccagccca

SEQ ID NO: 593835 - DNA, 25 bp, Rattus norvegicus
tccttgagcctagccgcaagttcgc

SEQ ID NO: 593836 - DNA, 25 bp, Rattus norvegicus
gcgtcgtccttgagcctagccgcaa

SEQ ID NO: 593837 - DNA, 25 bp, Rattus norvegicus
ctttgtcctcccgtggatgcctggg

SEQ ID NO: 593838 - DNA, 25 bp, Rattus norvegicus
cacgttttcgtggaagctacccgtg

SEQ ID NO: 593839 - DNA, 25 bp, Rattus norvegicus
gggattttccatcccggctcgcgcg

SEQ ID NO: 593840 - DNA, 25 bp, Rattus norvegicus
cagagcgcgaaagccgggcacctga

SEQ ID NO: 593841 - DNA, 25 bp, Rattus norvegicus
ggcacctgagagcagccgctgcacg

SEQ ID NO: 593842 - DNA, 25 bp, Rattus norvegicus
agatcccggcgtccagatctggagc

SEQ ID NO: 593843 - DNA, 25 bp, Rattus norvegicus
gctcggcatgcagcggagcatccct

SEQ ID NO: 593844 - DNA, 25 bp, Rattus norvegicus
tccgcgaacgcggaggacgtcgcct

SEQ ID NO: 593845 - DNA, 25 bp, Rattus norvegicus
gagagggagaccactcggtcctttc

SEQ ID NO: 593846 - DNA, 25 bp, Rattus norvegicus
cctcaggtgcccatctagactctta

SEQ ID NO: 593847 - DNA, 25 bp, Rattus norvegicus
tctagactcttagccgcggtgctgg

SEQ ID NO: 593848 - DNA, 25 bp, Rattus norvegicus
gctggagctctaattcccggggtgt

SEQ ID NO: 593849 - DNA, 25 bp, Rattus norvegicus
ggagcatccctccaggatccgcgaa

SEQ ID NO: 593850 - DNA, 25 bp, Rattus norvegicus
gagcgagcacgctttgtctctctcc

SEQ ID NO: 593851 - DNA, 25 bp, Rattus norvegicus
gatgggcacctcctccatgtccgga

SEQ ID NO: 593852 - DNA, 25 bp, Rattus norvegicus
cacggccacgttgttgacgaacttc

SEQ ID NO: 593853 - DNA, 25 bp, Rattus norvegicus
gagtcctcgggctgttctcccaatg

SEQ ID NO: 593854 - DNA, 25 bp, Rattus norvegicus
tatctcagatggtgcggacgagtcc

SEQ ID NO: 593855 - DNA, 25 bp, Rattus norvegicus
tgatggagcctcaaccagggtgacc

SEQ ID NO: 593856 - DNA, 25 bp, Rattus norvegicus
gacgaacttcttgaagcggtcccta

SEQ ID NO: 593857 - DNA, 25 bp, Rattus norvegicus
ctcggacgctacctccaaggactga

SEQ ID NO: 593858 - DNA, 25 bp, Rattus norvegicus
ggcgactctgtgctcgacaggacca

SEQ ID NO: 593859 - DNA, 25 bp, Rattus norvegicus
ccagcgtccagtagcggcttgaagc

SEQ ID NO: 593860 - DNA, 25 bp, Rattus norvegicus
gtcccaggtgaagtcccagaccgga

SEQ ID NO: 593861 - DNA, 25 bp, Rattus norvegicus
ggtctcagaggtgtgctgtatctca

SEQ ID NO: 593862 - DNA, 25 bp, Rattus norvegicus
agcccgtgtagctggtggctccaac

SEQ ID NO: 593863 - DNA, 25 bp, Rattus norvegicus
caccggcagcatgcaaggcttcttc

SEQ ID NO: 593864 - DNA, 25 bp, Rattus norvegicus
tagctctggattctcgggttccctg

SEQ ID NO: 593865 - DNA, 25 bp, Rattus norvegicus
ccaatggagacgcaggatccgccca

SEQ ID NO: 593866 - DNA, 25 bp, Rattus norvegicus
gacctcaggcactgggccacgaaga

SEQ ID NO: 593867 - DNA, 25 bp, Rattus norvegicus
aggttgctccgacctcaggcactgg

SEQ ID NO: 593868 - DNA, 25 bp, Rattus norvegicus
caaaacccagccgaggttgctccga

SEQ ID NO: 593869 - DNA, 25 bp, Rattus norvegicus
ccacctcagacggtgctcacgaggg

SEQ ID NO: 593870 - DNA, 25 bp, Rattus norvegicus
gggcttcccagaggcttctctcaca

SEQ ID NO: 593871 - DNA, 25 bp, Rattus norvegicus
aggcttctctcacagcggcgagggt

SEQ ID NO: 593872 - DNA, 25 bp, Rattus norvegicus
gcgagctgccctagccaatggagac

SEQ ID NO: 593873 - DNA, 25 bp, Rattus norvegicus
cgaagaggcccgcagtcagtcctca

SEQ ID NO: 593874 - DNA, 25 bp, Rattus norvegicus
gactcagcacctggagcggcgaaca

SEQ ID NO: 593875 - DNA, 25 bp, Rattus norvegicus
ctccacggacagatggtgttaagtg

SEQ ID NO: 593876 - DNA, 25 bp, Rattus norvegicus
gcggcgaggacacgtcccatcaact

SEQ ID NO: 593877 - DNA, 25 bp, Rattus norvegicus
aaaagcgagtcctatagcacccacc

SEQ ID NO: 593878 - DNA, 25 bp, Rattus norvegicus
gcagtcagtcctcaagctccacgga

SEQ ID NO: 593879 - DNA, 25 bp, Rattus norvegicus
acaagaaactgcagcgggcgctaga

SEQ ID NO: 593880 - DNA, 25 bp, Rattus norvegicus
gaatcgtagtttctgggcccgcaga

SEQ ID NO: 593881 - DNA, 25 bp, Rattus norvegicus
cgaggatcagtgtgcgcagtcgcac

SEQ ID NO: 593882 - DNA, 25 bp, Rattus norvegicus
gcagtcgcacttgtggctctgcgcc

SEQ ID NO: 593883 - DNA, 25 bp, Rattus norvegicus
cattgtccggccctgttgttgcaga

SEQ ID NO: 593884 - DNA, 25 bp, Rattus norvegicus
cggccctgttgttgcagagctgcac

SEQ ID NO: 593885 - DNA, 25 bp, Rattus norvegicus
ctgcaccgccgagaacaagaaactg

SEQ ID NO: 593886 - DNA, 25 bp, Rattus norvegicus
cggacctgaggtcgcggattccgaa

SEQ ID NO: 593887 - DNA, 25 bp, Rattus norvegicus
ctttcatttggccttggggagagcc

SEQ ID NO: 593888 - DNA, 25 bp, Rattus norvegicus
cccggagccagatttcgagtgccgt

SEQ ID NO: 593889 - DNA, 25 bp, Rattus norvegicus
agccagatttcgagtgccgtgggta

SEQ ID NO: 593890 - DNA, 25 bp, Rattus norvegicus
actgtcccgaagctgtggggccttt

SEQ ID NO: 593891 - DNA, 25 bp, Rattus norvegicus
aagctgtggggcctttcatttggcc

SEQ ID NO: 593892 - DNA, 25 bp, Rattus norvegicus
ttgcagagctgcaccgccgagaaca

SEQ ID NO: 593893 - DNA, 25 bp, Rattus norvegicus
agaaggcagcgtccgggcccaggct

SEQ ID NO: 593894 - DNA, 25 bp, Rattus norvegicus
taatggtttcgcctggctccgggcc

SEQ ID NO: 593895 - DNA, 25 bp, Rattus norvegicus
taactgtctgcctaatggtttcgcc

SEQ ID NO: 593896 - DNA, 25 bp, Rattus norvegicus
cccgaggagctgagtatcattttct

SEQ ID NO: 593897 - DNA, 25 bp, Rattus norvegicus
agtatcattttctccgctctgctcg

SEQ ID NO: 593898 - DNA, 25 bp, Rattus norvegicus
cgccggaatgctgagtgccctggaa

SEQ ID NO: 593899 - DNA, 25 bp, Rattus norvegicus
gaggcggaaatgagcgcgctccaca

SEQ ID NO: 593900 - DNA, 25 bp, Rattus norvegicus
cacagctctccagtcgagtgtttac

SEQ ID NO: 593901 - DNA, 25 bp, Rattus norvegicus
ctccagtcgagtgtttacttaatta

SEQ ID NO: 593902 - DNA, 25 bp, Rattus norvegicus
tgtttacttaattagggcctgtatc

SEQ ID NO: 593903 - DNA, 25 bp, Rattus norvegicus
aattagggcctgtatcctgaggctc

SEQ ID NO: 593904 - DNA, 25 bp, Rattus norvegicus
cctgtatcctgaggctcgtttgtgt

SEQ ID NO: 593905 - DNA, 25 bp, Rattus norvegicus
gctcgtttgtgtttaactgtctgcc

SEQ ID NO: 593906 - DNA, 25 bp, Rattus norvegicus
tctgcctaatggtttcgcctggctc

SEQ ID NO: 593907 - DNA, 25 bp, Rattus norvegicus
cgggaccctgtgacgtttgaccaat

SEQ ID NO: 593908 - DNA, 25 bp, Rattus norvegicus
ttagcggaacgcttggctaccgtcg

SEQ ID NO: 593909 - DNA, 25 bp, Rattus norvegicus
gcaccgggagcttagcggaacgctt

SEQ ID NO: 593910 - DNA, 25 bp, Rattus norvegicus
tgctcaaagctgcaccgggagctta

SEQ ID NO: 593911 - DNA, 25 bp, Rattus norvegicus
agccgcgttgctcaaagctgcaccg

SEQ ID NO: 593912 - DNA, 25 bp, Rattus norvegicus
gggctctagcgagccgcgttgctca

SEQ ID NO: 593913 - DNA, 25 bp, Rattus norvegicus
ccctgtgacgtttgaccaatcagca

SEQ ID NO: 593914 - DNA, 25 bp, Rattus norvegicus
tgacgtttgaccaatcagcagctac

SEQ ID NO: 593915 - DNA, 25 bp, Rattus norvegicus
agctggtctggactccacctgcgag

SEQ ID NO: 593916 - DNA, 25 bp, Rattus norvegicus
ttcggcaagctggtctggactccac

SEQ ID NO: 593917 - DNA, 25 bp, Rattus norvegicus
agcgacttcggcaagctggtctgga

SEQ ID NO: 593918 - DNA, 25 bp, Rattus norvegicus
agcttcgggagcgacttcggcaagc

SEQ ID NO: 593919 - DNA, 25 bp, Rattus norvegicus
cctttaggagcttcgggagcgactt

SEQ ID NO: 593920 - DNA, 25 bp, Rattus norvegicus
acctggcctcctcccgcgggctcta

SEQ ID NO: 593921 - DNA, 25 bp, Rattus norvegicus
cgcctctcgcttaggttcccaggtg

SEQ ID NO: 593922 - DNA, 25 bp, Rattus norvegicus
agcagggtccctgtttgagacggac

SEQ ID NO: 593923 - DNA, 25 bp, Rattus norvegicus
cccgagttgagcagggtccctgttt

SEQ ID NO: 593924 - DNA, 25 bp, Rattus norvegicus
agctcagtgtttgctcggcgtttgc

SEQ ID NO: 593925 - DNA, 25 bp, Rattus norvegicus
ccgcggcgcactactgagttctcaa

SEQ ID NO: 593926 - DNA, 25 bp, Rattus norvegicus
ccagatcgccctggaggctacgctg

SEQ ID NO: 593927 - DNA, 25 bp, Rattus norvegicus
tgagttctcaagaacttctgctaga

SEQ ID NO: 593928 - DNA, 25 bp, Rattus norvegicus
gaccgcacccgagctcagtgtttgc

SEQ ID NO: 593929 - DNA, 25 bp, Rattus norvegicus
ctctgcttggctcactggtgtggga

SEQ ID NO: 593930 - DNA, 25 bp, Rattus norvegicus
ctgctcctgctgcaggtatgtggag

SEQ ID NO: 593931 - DNA, 25 bp, Rattus norvegicus
tatgtggagggtcccacgacccgct

SEQ ID NO: 593932 - DNA, 25 bp, Rattus norvegicus
tttttgccttctgtggttccacttc

SEQ ID NO: 593933 - DNA, 25 bp, Rattus norvegicus
cttcttccaagaaagttgggctcca

SEQ ID NO: 593934 - DNA, 25 bp, Rattus norvegicus
ttctgctagacttcagcccggccta

SEQ ID NO: 593935 - DNA, 25 bp, Rattus norvegicus
ttggagcagattctggaagcgctga

SEQ ID NO: 593936 - DNA, 25 bp, Rattus norvegicus
cactcaggccctcccgggaactcca

SEQ ID NO: 593937 - DNA, 25 bp, Rattus norvegicus
cccgggaggtgagaggatgaatctc

SEQ ID NO: 593938 - DNA, 25 bp, Rattus norvegicus
gacatgtggtttggagcagattctg

SEQ ID NO: 593939 - DNA, 25 bp, Rattus norvegicus
aatcatggcggcctccgttcaggcg

SEQ ID NO: 593940 - DNA, 25 bp, Rattus norvegicus
ggctagctccactccaatcatggcg

SEQ ID NO: 593941 - DNA, 25 bp, Rattus norvegicus
agcgtatcgcaagtggctagctcca

SEQ ID NO: 593942 - DNA, 25 bp, Rattus norvegicus
tgtctgagcgtatcgcaagtggcta

SEQ ID NO: 593943 - DNA, 25 bp, Rattus norvegicus
gctggtccactgtagtgtctgagcg

SEQ ID NO: 593944 - DNA, 25 bp, Rattus norvegicus
cgcgctggtccactgtagtgtctga

SEQ ID NO: 593945 - DNA, 25 bp, Rattus norvegicus
acgcctcccgccacatccaaaatgg

SEQ ID NO: 593946 - DNA, 25 bp, Rattus norvegicus
tccatcagagggcacgcctcccgcc

SEQ ID NO: 593947 - DNA, 25 bp, Rattus norvegicus
ggaactccatcccactcccgggagc

SEQ ID NO: 593948 - DNA, 25 bp, Rattus norvegicus
gctgccaccgcatgttccactcagg

SEQ ID NO: 593949 - DNA, 25 bp, Rattus norvegicus
ccggcgatcgtcagtcggagcgccc

SEQ ID NO: 593950 - DNA, 25 bp, Rattus norvegicus
cagaggctgcgactctccagacgga

SEQ ID NO: 593951 - DNA, 25 bp, Rattus norvegicus
acaggactgcttcgcgggcacctct

SEQ ID NO: 593952 - DNA, 25 bp, Rattus norvegicus
cggtacaggactgcttcgcgggcac

SEQ ID NO: 593953 - DNA, 25 bp, Rattus norvegicus
cgggcggcacggtgagcgcatccaa

SEQ ID NO: 593954 - DNA, 25 bp, Rattus norvegicus
cgcgatatttaaggcggctcggctg

SEQ ID NO: 593955 - DNA, 25 bp, Rattus norvegicus
ctttcccggcgggtcgcgcgcgata

SEQ ID NO: 593956 - DNA, 25 bp, Rattus norvegicus
actttccctgccctggtgccggagg

SEQ ID NO: 593957 - DNA, 25 bp, Rattus norvegicus
tcccactcttgccaactttccctgc

SEQ ID NO: 593958 - DNA, 25 bp, Rattus norvegicus
gctccgggagccctcccactcttgc

SEQ ID NO: 593959 - DNA, 25 bp, Rattus norvegicus
agcgccagccggtggccaggaaccg

SEQ ID NO: 593960 - DNA, 25 bp, Rattus norvegicus
cagacggaggggctacgtccacgac

SEQ ID NO: 593961 - DNA, 25 bp, Rattus norvegicus
tcgcgcgcgatatttaaggcggctc

SEQ ID NO: 593962 - DNA, 25 bp, Rattus norvegicus
actctccagacggaggggctacgtc

SEQ ID NO: 593963 - DNA, 25 bp, Rattus norvegicus
atccaagcgaactcaagcggggtga

SEQ ID NO: 593964 - DNA, 25 bp, Rattus norvegicus
gagcgtggcgagagcttccgtatct

SEQ ID NO: 593965 - DNA, 25 bp, Rattus norvegicus
cgagagcttccgtatctgccttgga

SEQ ID NO: 593966 - DNA, 25 bp, Rattus norvegicus
tatctgccttggacctgaccggaca

SEQ ID NO: 593967 - DNA, 25 bp, Rattus norvegicus
cggacagcctctggaactgcaccga

SEQ ID NO: 593968 - DNA, 25 bp, Rattus norvegicus
cagcctctggaactgcaccgaggcg

SEQ ID NO: 593969 - DNA, 25 bp, Rattus norvegicus
gttgctgggctagccacggcacctc

SEQ ID NO: 593970 - DNA, 25 bp, Rattus norvegicus
gtgtggctgtatggccttagccatc

SEQ ID NO: 593971 - DNA, 25 bp, Rattus norvegicus
gcttccgtatctgccttggacctga

SEQ ID NO: 593972 - DNA, 25 bp, Rattus norvegicus
ggccttagccatccaagcgaactca

SEQ ID NO: 593973 - DNA, 25 bp, Rattus norvegicus
cttaccggctgagtcgtgggagacc

SEQ ID NO: 593974 - DNA, 25 bp, Rattus norvegicus
gttccttaccggctgagtcgtggga

SEQ ID NO: 593975 - DNA, 25 bp, Rattus norvegicus
ccttcccagaacgaggcgggcagta

SEQ ID NO: 593976 - DNA, 25 bp, Rattus norvegicus
tgccttggacctgaccggacagcct

SEQ ID NO: 593977 - DNA, 25 bp, Rattus norvegicus
gcgagcattgcctgcgcacttccgg

SEQ ID NO: 593978 - DNA, 25 bp, Rattus norvegicus
tccgctcgccattcttctccgggag

SEQ ID NO: 593979 - DNA, 25 bp, Rattus norvegicus
gctgcctgacctgcaatggcggccg

SEQ ID NO: 593980 - DNA, 25 bp, Rattus norvegicus
cgcctagtacttccgggacggagct

SEQ ID NO: 593981 - DNA, 25 bp, Rattus norvegicus
cttccgggacggagctatagagtgc

SEQ ID NO: 593982 - DNA, 25 bp, Rattus norvegicus
tagctgaaacagtgagttcggaagg

SEQ ID NO: 593983 - DNA, 25 bp, Rattus norvegicus
cccgcggaccttgttagatgctcgg

SEQ ID NO: 593984 - DNA, 25 bp, Rattus norvegicus
ttgttagatgctcggttctgaggcc

SEQ ID NO: 593985 - DNA, 25 bp, Rattus norvegicus
ttctgaggccgagtggaagctaact

SEQ ID NO: 593986 - DNA, 25 bp, Rattus norvegicus
tggaagctaactccgtgaacctggg

SEQ ID NO: 593987 - DNA, 25 bp, Rattus norvegicus
aactccgtgaacctgggagagagca

SEQ ID NO: 593988 - DNA, 25 bp, Rattus norvegicus
agagagcaggactggcggacacctc

SEQ ID NO: 593989 - DNA, 25 bp, Rattus norvegicus
tggcggacacctcgcgctcttcagt

SEQ ID NO: 593990 - DNA, 25 bp, Rattus norvegicus
gcctagctggccgatctttcgcgct

SEQ ID NO: 593991 - DNA, 25 bp, Rattus norvegicus
gacgacgacagaacgccagtgccct

SEQ ID NO: 593992 - DNA, 25 bp, Rattus norvegicus
ccctggactgtgacctgagggccag

SEQ ID NO: 593993 - DNA, 25 bp, Rattus norvegicus
actgtgacctgagggccagccaggc

SEQ ID NO: 593994 - DNA, 25 bp, Rattus norvegicus
caggccgcccttttcgagaagaaca

SEQ ID NO: 593995 - DNA, 25 bp, Rattus norvegicus
cgcccttttcgagaagaacaaggtg

SEQ ID NO: 593996 - DNA, 25 bp, Rattus norvegicus
tcgagaagaacaaggtgggacgggc

SEQ ID NO: 593997 - DNA, 25 bp, Rattus norvegicus
cgacagaacgccagtgccctggact

SEQ ID NO: 593998 - DNA, 25 bp, Rattus norvegicus
cgcagacgacgacagaacgccagtg

SEQ ID NO: 593999 - DNA, 25 bp, Rattus norvegicus
ctggcccgcagacgacgacagaacg

SEQ ID NO: 594000 - DNA, 25 bp, Rattus norvegicus
aacaagaagctgcgtgcgcaggttg

SEQ ID NO: 594001 - DNA, 25 bp, Rattus norvegicus
ggcctggaacgggagaacaagaagc

SEQ ID NO: 594002 - DNA, 25 bp, Rattus norvegicus
gctcgctgttgcagatggaaaggct

SEQ ID NO: 594003 - DNA, 25 bp, Rattus norvegicus
cagaacgccagtgccctggactgtg

SEQ ID NO: 594004 - DNA, 25 bp, Rattus norvegicus
ctccaggcggagaatgcagccgagt

SEQ ID NO: 594005 - DNA, 25 bp, Rattus norvegicus
ccgggtctcccagacgtggcaattc

SEQ ID NO: 594006 - DNA, 25 bp, Rattus norvegicus
tggcggccaccgacctggaacgcat

SEQ ID NO: 594007 - DNA, 25 bp, Rattus norvegicus
accgacctggaacgcatctcggtga

SEQ ID NO: 594008 - DNA, 25 bp, Rattus norvegicus
cctggaacgcatctcggtgaggcct

SEQ ID NO: 594009 - DNA, 25 bp, Rattus norvegicus
gcttcgcgcgacgtaagctcctttt

SEQ ID NO: 594010 - DNA, 25 bp, Rattus norvegicus
tcgcgcgacgtaagctccttttgcg

SEQ ID NO: 594011 - DNA, 25 bp, Rattus norvegicus
tgcgcagctcgccatggcggccacc

SEQ ID NO: 594012 - DNA, 25 bp, Rattus norvegicus
ggtctcccagacgtggcaattcgcc

SEQ ID NO: 594013 - DNA, 25 bp, Rattus norvegicus
gtcccagcagcactcgcagctagta

SEQ ID NO: 594014 - DNA, 25 bp, Rattus norvegicus
agtacctcctgccaagccgcggaga

SEQ ID NO: 594015 - DNA, 25 bp, Rattus norvegicus
cgccaaggggagtttccaggaagtg

SEQ ID NO: 594016 - DNA, 25 bp, Rattus norvegicus
ccaggaagtggccatattggatcca

SEQ ID NO: 594017 - DNA, 25 bp, Rattus norvegicus
agtggccatattggatccattcagc

SEQ ID NO: 594018 - DNA, 25 bp, Rattus norvegicus
attggatccattcagccgcagccgc

SEQ ID NO: 594019 - DNA, 25 bp, Rattus norvegicus
ccaccaaagcgggactggtggagct

SEQ ID NO: 594020 - DNA, 25 bp, Rattus norvegicus
tcgccagcgcgcactttgtttctgc

SEQ ID NO: 594021 - DNA, 25 bp, Rattus norvegicus
acgaccaggccgtgcaggcgctgaa

SEQ ID NO: 594022 - DNA, 25 bp, Rattus norvegicus
gtgaacggcaccgacctgcgccagg

SEQ ID NO: 594023 - DNA, 25 bp, Rattus norvegicus
gacgccatcctgtcggtgaacggca

SEQ ID NO: 594024 - DNA, 25 bp, Rattus norvegicus
ctgcggctaggcgacgccatcctgt

SEQ ID NO: 594025 - DNA, 25 bp, Rattus norvegicus
ccaagatcttcccagggctggcggc

SEQ ID NO: 594026 - DNA, 25 bp, Rattus norvegicus
cggatgccgatcctcatctccaaga

SEQ ID NO: 594027 - DNA, 25 bp, Rattus norvegicus
catcagcatcaagggcggccgagag

SEQ ID NO: 594028 - DNA, 25 bp, Rattus norvegicus
gccgaactcagtggcgagagcctga

SEQ ID NO: 594029 - DNA, 25 bp, Rattus norvegicus
cctcatgaataatgaatcgccgggg

SEQ ID NO: 594030 - DNA, 25 bp, Rattus norvegicus
gtgggcgtgaccctcatgaataatg

SEQ ID NO: 594031 - DNA, 25 bp, Rattus norvegicus
cggccgagagaaccggatgccgatc

SEQ ID NO: 594032 - DNA, 25 bp, Rattus norvegicus
agcgccgaggctgcctgactggaat

SEQ ID NO: 594033 - DNA, 25 bp, Rattus norvegicus
aatgacaacgtcaaccctccaggta

SEQ ID NO: 594034 - DNA, 25 bp, Rattus norvegicus
tcattcatttcctccgccgtgcagg

SEQ ID NO: 594035 - DNA, 25 bp, Rattus norvegicus
ttgttggccgcacccttcgctaggc

SEQ ID NO: 594036 - DNA, 25 bp, Rattus norvegicus
tcacccaggttcttctagcctttgg

SEQ ID NO: 594037 - DNA, 25 bp, Rattus norvegicus
cccatcttggaggagtgatgcctgc

SEQ ID NO: 594038 - DNA, 25 bp, Rattus norvegicus
gagagtcgacctgccaggctcctga

SEQ ID NO: 594039 - DNA, 25 bp, Rattus norvegicus
aggctcctgagcagcggacctacca

SEQ ID NO: 594040 - DNA, 25 bp, Rattus norvegicus
ggcggacccaggatatgaaatgaca

SEQ ID NO: 594041 - DNA, 25 bp, Rattus norvegicus
accctccaggtacttgggtgcggcg

SEQ ID NO: 594042 - DNA, 25 bp, Rattus norvegicus
cccaagtcgcgcagccgaggctgaa

SEQ ID NO: 594043 - DNA, 25 bp, Rattus norvegicus
cgaggctgaactgccgccttgcagc

SEQ ID NO: 594044 - DNA, 25 bp, Rattus norvegicus
tctgggagcggcgttcactcgctcc

SEQ ID NO: 594045 - DNA, 25 bp, Rattus norvegicus
ggcctcggcccaagatgaaccggcg

SEQ ID NO: 594046 - DNA, 25 bp, Rattus norvegicus
ggtttcgcggccagctacccttcat

SEQ ID NO: 594047 - DNA, 25 bp, Rattus norvegicus
tggcgacagtcgttcggttttatta

SEQ ID NO: 594048 - DNA, 25 bp, Rattus norvegicus
cgggaactcgagcaccagcacttgc

SEQ ID NO: 594049 - DNA, 25 bp, Rattus norvegicus
ggcactcccagttgaggcgcactca

SEQ ID NO: 594050 - DNA, 25 bp, Rattus norvegicus
cctacctggcacacgcgtgtatatg

SEQ ID NO: 594051 - DNA, 25 bp, Rattus norvegicus
ggcgcctcaagtaccgccagtagga

SEQ ID NO: 594052 - DNA, 25 bp, Rattus norvegicus
tagactggccgatgagctgcaactc

SEQ ID NO: 594053 - DNA, 25 bp, Rattus norvegicus
ctcagagtgacccacgctggcaaca

SEQ ID NO: 594054 - DNA, 25 bp, Rattus norvegicus
cgccatggtgcaggaaaacgccgca

SEQ ID NO: 594055 - DNA, 25 bp, Rattus norvegicus
ggaagcgtagttcccgcataacttc

SEQ ID NO: 594056 - DNA, 25 bp, Rattus norvegicus
agggtcgctgaagcaataggctcca

SEQ ID NO: 594057 - DNA, 25 bp, Rattus norvegicus
tgcctatggctcctcactcggtggc

SEQ ID NO: 594058 - DNA, 25 bp, Rattus norvegicus
agctctcaagttccacaggtctctg

SEQ ID NO: 594059 - DNA, 25 bp, Rattus norvegicus
cacggaagagcctgtccgggaactc

SEQ ID NO: 594060 - DNA, 25 bp, Rattus norvegicus
gaaagggttccatctgacgcagctc

SEQ ID NO: 594061 - DNA, 25 bp, Rattus norvegicus
ccgcaccgcgaatgaacgtcttgta

SEQ ID NO: 594062 - DNA, 25 bp, Rattus norvegicus
tctccaaagagacggtgtatgcgct

SEQ ID NO: 594063 - DNA, 25 bp, Rattus norvegicus
ggtttctcacctagccgactttctg

SEQ ID NO: 594064 - DNA, 25 bp, Rattus norvegicus
aacgtcttgtaattggcgaaggcca

SEQ ID NO: 594065 - DNA, 25 bp, Rattus norvegicus
ttctcacgccattgggcctcaggga

SEQ ID NO: 594066 - DNA, 25 bp, Rattus norvegicus
gcgacgccaggagtccttcatcttc

SEQ ID NO: 594067 - DNA, 25 bp, Rattus norvegicus
gagcagctgccatctttccacgaca

SEQ ID NO: 594068 - DNA, 25 bp, Rattus norvegicus
gggaaacatttcctgtctctatggt

SEQ ID NO: 594069 - DNA, 25 bp, Rattus norvegicus
tggcgctagcgcaaagaacacgtaa

SEQ ID NO: 594070 - DNA, 25 bp, Rattus norvegicus
cacgctttggtgtacccaggaagta

SEQ ID NO: 594071 - DNA, 25 bp, Rattus norvegicus
ctagtgggaaaatgaggcctttgac

SEQ ID NO: 594072 - DNA, 25 bp, Rattus norvegicus
gagacccgcgtaatgtttgagaaga

SEQ ID NO: 594073 - DNA, 25 bp, Rattus norvegicus
agggacgcctccacgtctccaaaga

SEQ ID NO: 594074 - DNA, 25 bp, Rattus norvegicus
aattaggctagagaggcacgctttg

SEQ ID NO: 594075 - DNA, 25 bp, Rattus norvegicus
tgatgtcccggatctgcctgaagtc

SEQ ID NO: 594076 - DNA, 25 bp, Rattus norvegicus
tcaccctgcatgatgtcccggatct

SEQ ID NO: 594077 - DNA, 25 bp, Rattus norvegicus
cgcagccatgataccgacgagtttc

SEQ ID NO: 594078 - DNA, 25 bp, Rattus norvegicus
tcccgcagccatgataccgacgagt

SEQ ID NO: 594079 - DNA, 25 bp, Rattus norvegicus
tgacgccatcgggtcacgcacaacg

SEQ ID NO: 594080 - DNA, 25 bp, Rattus norvegicus
cgtttccttggctgtgacgccatcg

SEQ ID NO: 594081 - DNA, 25 bp, Rattus norvegicus
tcccgccatcgtgttcgaccgccga

SEQ ID NO: 594082 - DNA, 25 bp, Rattus norvegicus
acttgagcacccagcggttgaccgc

SEQ ID NO: 594083 - DNA, 25 bp, Rattus norvegicus
gtagaacttgagcacccagcggttg

SEQ ID NO: 594084 - DNA, 25 bp, Rattus norvegicus
ctcgtggaagtagaacttgagcacc

SEQ ID NO: 594085 - DNA, 25 bp, Rattus norvegicus
gcagcgcctcgtggaagtagaactt

SEQ ID NO: 594086 - DNA, 25 bp, Rattus norvegicus
tctgcctgaagtcccggtaccggct

SEQ ID NO: 594087 - DNA, 25 bp, Rattus norvegicus
cggatctgcctgaagtcccggtacc

SEQ ID NO: 594088 - DNA, 25 bp, Rattus norvegicus
tgataccgacgagtttccaagccgc

SEQ ID NO: 594089 - DNA, 25 bp, Rattus norvegicus
agggactcggatccaatggcgaccc

SEQ ID NO: 594090 - DNA, 25 bp, Rattus norvegicus
gatatcacccgcttcctcagcgagg

SEQ ID NO: 594091 - DNA, 25 bp, Rattus norvegicus
tccacgggcgagtctacgatatcac

SEQ ID NO: 594092 - DNA, 25 bp, Rattus norvegicus
gatggtgatccacgggcgagtctac

SEQ ID NO: 594093 - DNA, 25 bp, Rattus norvegicus
cgaagcgaaataccgcggaggagac

SEQ ID NO: 594094 - DNA, 25 bp, Rattus norvegicus
ccgtcacctactaccggctggagga

SEQ ID NO: 594095 - DNA, 25 bp, Rattus norvegicus
gcaggaatggccagggctccgaccc

SEQ ID NO: 594096 - DNA, 25 bp, Rattus norvegicus
cggccgagagggactcggatccaat

SEQ ID NO: 594097 - DNA, 25 bp, Rattus norvegicus
gcagaatcccagatagcggccgaga

SEQ ID NO: 594098 - DNA, 25 bp, Rattus norvegicus
agttagccgcagaatcccagatagc

SEQ ID NO: 594099 - DNA, 25 bp, Rattus norvegicus
gcgagtctacgatatcacccgcttc

SEQ ID NO: 594100 - DNA, 25 bp, Rattus norvegicus
gacaaggaccaagcgcgggcccggc

SEQ ID NO: 594101 - DNA, 25 bp, Rattus norvegicus
cgcttcctcagcgaggtgcgggcct

SEQ ID NO: 594102 - DNA, 25 bp, Rattus norvegicus
cgtgaaggaagttagccgcagaatc

SEQ ID NO: 594103 - DNA, 25 bp, Rattus norvegicus
acttcatctcattgctcagcgcgga

SEQ ID NO: 594104 - DNA, 25 bp, Rattus norvegicus
ggctcagattcctgtcagcggcggc

SEQ ID NO: 594105 - DNA, 25 bp, Rattus norvegicus
tgcagacatctaggtcccgagggtc

SEQ ID NO: 594106 - DNA, 25 bp, Rattus norvegicus
ccgagggtctgtgtcctcctaagta

SEQ ID NO: 594107 - DNA, 25 bp, Rattus norvegicus
gtcctcctaagtacagcacggtgta

SEQ ID NO: 594108 - DNA, 25 bp, Rattus norvegicus
tggaatcgcccaagtccctgtactc

SEQ ID NO: 594109 - DNA, 25 bp, Rattus norvegicus
agcgaagcccttgttgatgctgttc

SEQ ID NO: 594110 - DNA, 25 bp, Rattus norvegicus
ccctgtactcgcgaggtgagtcaga

SEQ ID NO: 594111 - DNA, 25 bp, Rattus norvegicus
ctggactcaccgagagtcagttttc

SEQ ID NO: 594112 - DNA, 25 bp, Rattus norvegicus
gtcagttttccactccacagagctg

SEQ ID NO: 594113 - DNA, 25 bp, Rattus norvegicus
acagagctgttctccactccgaagc

SEQ ID NO: 594114 - DNA, 25 bp, Rattus norvegicus
agctgcgatgccctcggacttcatc

SEQ ID NO: 594115 - DNA, 25 bp, Rattus norvegicus
cagcgcggacctagacctggaatcg

SEQ ID NO: 594116 - DNA, 25 bp, Rattus norvegicus
ccaccaggtcgtggcaaaaatcttt

SEQ ID NO: 594117 - DNA, 25 bp, Rattus norvegicus
tgccaaggacagaccgcgcatgcgt

SEQ ID NO: 594118 - DNA, 25 bp, Rattus norvegicus
aggctgcgccaggacactcacctag

SEQ ID NO: 594119 - DNA, 25 bp, Rattus norvegicus
acctagcctcacgtactccgggaag

SEQ ID NO: 594120 - DNA, 25 bp, Rattus norvegicus
gaaccgcagctcgtagggcagcact

SEQ ID NO: 594121 - DNA, 25 bp, Rattus norvegicus
tggccttgtcgcgaatctctctcac

SEQ ID NO: 594122 - DNA, 25 bp, Rattus norvegicus
tcccggatggtgtagatgttttttc

SEQ ID NO: 594123 - DNA, 25 bp, Rattus norvegicus
tgtcctgtggacagaccggcctagt

SEQ ID NO: 594124 - DNA, 25 bp, Rattus norvegicus
cggcctagttatcccactcgcttga

SEQ ID NO: 594125 - DNA, 25 bp, Rattus norvegicus
cgtggcggaatctctagtacctgta

SEQ ID NO: 594126 - DNA, 25 bp, Rattus norvegicus
agtacctgtagaggcgcatccctca

SEQ ID NO: 594127 - DNA, 25 bp, Rattus norvegicus
caacgtgctccacaggcgccatgtt

SEQ ID NO: 594128 - DNA, 25 bp, Rattus norvegicus
gcttgcgctgttccctaggtttgca

SEQ ID NO: 594129 - DNA, 25 bp, Rattus norvegicus
ctcccggactggagaggaacagctg

SEQ ID NO: 594130 - DNA, 25 bp, Rattus norvegicus
tccctcaagaaagctccggcgtcag

SEQ ID NO: 594131 - DNA, 25 bp, Rattus norvegicus
tcggccggggagactcgcatgctcc

SEQ ID NO: 594132 - DNA, 25 bp, Rattus norvegicus
tcttccgggtcaggtgaccgcgcgc

SEQ ID NO: 594133 - DNA, 25 bp, Rattus norvegicus
acttcggccggggagactcgcatgc

SEQ ID NO: 594134 - DNA, 25 bp, Rattus norvegicus
tcgcccgttgctggcgtttccggaa

SEQ ID NO: 594135 - DNA, 25 bp, Rattus norvegicus
ggagtcgcccgttgctggcgtttcc

SEQ ID NO: 594136 - DNA, 25 bp, Rattus norvegicus
gcccacgtgacccggtctgagtgcg

SEQ ID NO: 594137 - DNA, 25 bp, Rattus norvegicus
cggccagcctcttccgggtcaggtg

SEQ ID NO: 594138 - DNA, 25 bp, Rattus norvegicus
gctctaggtggtccgcacctgcgcg

SEQ ID NO: 594139 - DNA, 25 bp, Rattus norvegicus
cggctctaggtggtccgcacctgcg

SEQ ID NO: 594140 - DNA, 25 bp, Rattus norvegicus
caaatgctcacagcccggctctagg

SEQ ID NO: 594141 - DNA, 25 bp, Rattus norvegicus
ggtcaaatgctcacagcccggctct

SEQ ID NO: 594142 - DNA, 25 bp, Rattus norvegicus
gccctcaccgggtcaaatgctcaca

SEQ ID NO: 594143 - DNA, 25 bp, Rattus norvegicus
ctccgaggaggggtgtcccgactcg

SEQ ID NO: 594144 - DNA, 25 bp, Rattus norvegicus
agcctcttccgggtcaggtgaccgc

SEQ ID NO: 594145 - DNA, 25 bp, Rattus norvegicus
ggtttgaccgccaccgcacagtcga

SEQ ID NO: 594146 - DNA, 25 bp, Rattus norvegicus
cgttctggtaaaaggcgcggccaag

SEQ ID NO: 594147 - DNA, 25 bp, Rattus norvegicus
gccaaggcgggtagaatcgtcccga

SEQ ID NO: 594148 - DNA, 25 bp, Rattus norvegicus
gaatcgtcccgattccgggcactca

SEQ ID NO: 594149 - DNA, 25 bp, Rattus norvegicus
ttccgggcactcaacaggcgggcca

SEQ ID NO: 594150 - DNA, 25 bp, Rattus norvegicus
cgaggctgtcaatgggttccgagca

SEQ ID NO: 594151 - DNA, 25 bp, Rattus norvegicus
tcccgggccgctgagtttatgcccg

SEQ ID NO: 594152 - DNA, 25 bp, Rattus norvegicus
gccacccgctcaccggttgaaatga

SEQ ID NO: 594153 - DNA, 25 bp, Rattus norvegicus
cgctcaccggttgaaatgatccacc

SEQ ID NO: 594154 - DNA, 25 bp, Rattus norvegicus
gcgcccagccgttctggtaaaaggc

SEQ ID NO: 594155 - DNA, 25 bp, Rattus norvegicus
ggcaaccgcagcgttacaggccgct

SEQ ID NO: 594156 - DNA, 25 bp, Rattus norvegicus
gaaatgatccaccacactgagcagc

SEQ ID NO: 594157 - DNA, 25 bp, Rattus norvegicus
ggggtggaccaccactttctgcacc

SEQ ID NO: 594158 - DNA, 25 bp, Rattus norvegicus
gcaaacaccggcaaccgcagcgtta

SEQ ID NO: 594159 - DNA, 25 bp, Rattus norvegicus
cctctttaggagtcgggacaggccg

SEQ ID NO: 594160 - DNA, 25 bp, Rattus norvegicus
gccctctttaggagtcgggacaggc

SEQ ID NO: 594161 - DNA, 25 bp, Rattus norvegicus
tctgccctctttaggagtcgggaca

SEQ ID NO: 594162 - DNA, 25 bp, Rattus norvegicus
acaggggagcggtctgccctcttta

SEQ ID NO: 594163 - DNA, 25 bp, Rattus norvegicus
gcgcgcccagggactgcggtgatgg

SEQ ID NO: 594164 - DNA, 25 bp, Rattus norvegicus
agcccgccactgtgtccagacgccc

SEQ ID NO: 594165 - DNA, 25 bp, Rattus norvegicus
ctggatcagcggcttttgactcatg

SEQ ID NO: 594166 - DNA, 25 bp, Rattus norvegicus
ggatcagcggcttttgactcatggg

SEQ ID NO: 594167 - DNA, 25 bp, Rattus norvegicus
atcagcggcttttgactcatgggca

SEQ ID NO: 594168 - DNA, 25 bp, Rattus norvegicus
cagcggcttttgactcatgggcagg

SEQ ID NO: 594169 - DNA, 25 bp, Rattus norvegicus
cttttgactcatgggcagggaggcg

SEQ ID NO: 594170 - DNA, 25 bp, Rattus norvegicus
agtgccagcccggagcttcaaaaca

SEQ ID NO: 594171 - DNA, 25 bp, Rattus norvegicus
agcttcaaaacagccggcgcctcgc

SEQ ID NO: 594172 - DNA, 25 bp, Rattus norvegicus
gcctcacgcgcagcccgccactgtg

SEQ ID NO: 594173 - DNA, 25 bp, Rattus norvegicus
gagggtcgcttacctattatgggca

SEQ ID NO: 594174 - DNA, 25 bp, Rattus norvegicus
acccgggcgcttccggctagacgtg

SEQ ID NO: 594175 - DNA, 25 bp, Rattus norvegicus
gcctgcgcgaccaccagtttgtcgg

SEQ ID NO: 594176 - DNA, 25 bp, Rattus norvegicus
gtacggcatcacgaccggctgcctg

SEQ ID NO: 594177 - DNA, 25 bp, Rattus norvegicus
ccgtgatccgcacggttggctggtt

SEQ ID NO: 594178 - DNA, 25 bp, Rattus norvegicus
ttctcttcagtgagttccgtgatcc

SEQ ID NO: 594179 - DNA, 25 bp, Rattus norvegicus
tctcgataatgaacttgacgttctc

SEQ ID NO: 594180 - DNA, 25 bp, Rattus norvegicus
cgccaggtccgtgttctcgataatg

SEQ ID NO: 594181 - DNA, 25 bp, Rattus norvegicus
tggaattggccaccctacaggagga

SEQ ID NO: 594182 - DNA, 25 bp, Rattus norvegicus
tgaagaccctccgaatggaattggc

SEQ ID NO: 594183 - DNA, 25 bp, Rattus norvegicus
gcgcagtgccacctgctgaccggag

SEQ ID NO: 594184 - DNA, 25 bp, Rattus norvegicus
gggcacctctgcgatgaagaccctc

SEQ ID NO: 594185 - DNA, 25 bp, Rattus norvegicus
ggcgtgcacctcctcagtgttctca

SEQ ID NO: 594186 - DNA, 25 bp, Rattus norvegicus
tgccgagcaaggcacgcaccgaggc

SEQ ID NO: 594187 - DNA, 25 bp, Rattus norvegicus
gtacccgcagaggagagtaccctca

SEQ ID NO: 594188 - DNA, 25 bp, Rattus norvegicus
agtatccgcagagggtacccgcaga

SEQ ID NO: 594189 - DNA, 25 bp, Rattus norvegicus
tacccgcagaggagagtaccctcag

SEQ ID NO: 594190 - DNA, 25 bp, Rattus norvegicus
gtaccctcagaggagagtacccgca

SEQ ID NO: 594191 - DNA, 25 bp, Rattus norvegicus
agagtacccgcagagagtatccgca

SEQ ID NO: 594192 - DNA, 25 bp, Rattus norvegicus
cgcagagagtatccgcagagggtac

SEQ ID NO: 594193 - DNA, 25 bp, Rattus norvegicus
agagtatccgcagagggtacccgca

SEQ ID NO: 594194 - DNA, 25 bp, Rattus norvegicus
atccgcagagggtacccgcagagga

SEQ ID NO: 594195 - DNA, 25 bp, Rattus norvegicus
acccgcagagggtacccgcagagga

SEQ ID NO: 594196 - DNA, 25 bp, Rattus norvegicus
ggagagtaccctcagaggagagtac

SEQ ID NO: 594197 - DNA, 25 bp, Rattus norvegicus
agtacccgcagagggtacccgcaga

SEQ ID NO: 594198 - DNA, 25 bp, Rattus norvegicus
gtacccgcagaggagggtacccgca

SEQ ID NO: 594199 - DNA, 25 bp, Rattus norvegicus
agtacccgcagagagtacccgcaga

SEQ ID NO: 594200 - DNA, 25 bp, Rattus norvegicus
acccgcagaggagggtacccgcaga

SEQ ID NO: 594201 - DNA, 25 bp, Rattus norvegicus
cagcgtgcgccgctatcctagttgg

SEQ ID NO: 594202 - DNA, 25 bp, Rattus norvegicus
gggttctggtcgctgaagtaaacaa

SEQ ID NO: 594203 - DNA, 25 bp, Rattus norvegicus
ggaagcccttccctgaagactgtaa

SEQ ID NO: 594204 - DNA, 25 bp, Rattus norvegicus
agggtcggcgcaaatccacccgctt

SEQ ID NO: 594205 - DNA, 25 bp, Rattus norvegicus
tactgcagcgttcccagacttcggg

SEQ ID NO: 594206 - DNA, 25 bp, Rattus norvegicus
atgagcggttcttcctactgcagcg

SEQ ID NO: 594207 - DNA, 25 bp, Rattus norvegicus
gctaaagtgtcgttatgagcggttc

SEQ ID NO: 594208 - DNA, 25 bp, Rattus norvegicus
aacctttagcattcaagtgtcgggg

SEQ ID NO: 594209 - DNA, 25 bp, Rattus norvegicus
aagactgtaagtctaacctttagca

SEQ ID NO: 594210 - DNA, 25 bp, Rattus norvegicus
tatcctagttggcaggaagcccttc

SEQ ID NO: 594211 - DNA, 25 bp, Rattus norvegicus
ccacggatggtgtggtccacggcct

SEQ ID NO: 594212 - DNA, 25 bp, Rattus norvegicus
ctatcgcattgaccgcacctggagg

SEQ ID NO: 594213 - DNA, 25 bp, Rattus norvegicus
aacacccggagcctatcgcattgac

SEQ ID NO: 594214 - DNA, 25 bp, Rattus norvegicus
tcgctgaagtaaacaaacacccgga

SEQ ID NO: 594215 - DNA, 25 bp, Rattus norvegicus
gggtcagtgccctgccctgtgccga

SEQ ID NO: 594216 - DNA, 25 bp, Rattus norvegicus
ggtgcgtcctattctggccacgaga

SEQ ID NO: 594217 - DNA, 25 bp, Rattus norvegicus
tctggccacgagaaactggcgtcga

SEQ ID NO: 594218 - DNA, 25 bp, Rattus norvegicus
ctggcgtcgagtgtcactaatactc

SEQ ID NO: 594219 - DNA, 25 bp, Rattus norvegicus
gagtgtcactaatactcactgagcc

SEQ ID NO: 594220 - DNA, 25 bp, Rattus norvegicus
tcactgagccctagcatgtaactgg

SEQ ID NO: 594221 - DNA, 25 bp, Rattus norvegicus
cctagcatgtaactggcaggcggcg

SEQ ID NO: 594222 - DNA, 25 bp, Rattus norvegicus
gggtgccttgcctctgcccattttt

SEQ ID NO: 594223 - DNA, 25 bp, Rattus norvegicus
tgccctgtgccgagcctgaaggccg

SEQ ID NO: 594224 - DNA, 25 bp, Rattus norvegicus
ggccgcccagaggagaatatggcta

SEQ ID NO: 594225 - DNA, 25 bp, Rattus norvegicus
tagctagagccaaattcctggtgcc

SEQ ID NO: 594226 - DNA, 25 bp, Rattus norvegicus
cccgagccagttgcgtcctggatct

SEQ ID NO: 594227 - DNA, 25 bp, Rattus norvegicus
ttgcgtcctggatctctcgagagac

SEQ ID NO: 594228 - DNA, 25 bp, Rattus norvegicus
ctcgagagacctcgcggggtgcctt

SEQ ID NO: 594229 - DNA, 25 bp, Rattus norvegicus
cgactgtagatgtcaggctttgccc

SEQ ID NO: 594230 - DNA, 25 bp, Rattus norvegicus
gcgcccagcgcgactgtagatgtca

SEQ ID NO: 594231 - DNA, 25 bp, Rattus norvegicus
ttctgtgtgtttgtgcgtctatgtc

SEQ ID NO: 594232 - DNA, 25 bp, Rattus norvegicus
agctccggccctgcttctgtgtgtt

SEQ ID NO: 594233 - DNA, 25 bp, Rattus norvegicus
ctcccgaggtgtacggaggctttgt

SEQ ID NO: 594234 - DNA, 25 bp, Rattus norvegicus
cgctgccactggaatctcccgttgt

SEQ ID NO: 594235 - DNA, 25 bp, Rattus norvegicus
gcctcgcgggaacacggctttgttc

SEQ ID NO: 594236 - DNA, 25 bp, Rattus norvegicus
gtaagttcggggctccgctgccact

SEQ ID NO: 594237 - DNA, 25 bp, Rattus norvegicus
ttacataaagcgattccgggcgggc

SEQ ID NO: 594238 - DNA, 25 bp, Rattus norvegicus
ctgcgagttgagcttcatttacata

SEQ ID NO: 594239 - DNA, 25 bp, Rattus norvegicus
gtgcgcgctgcaaactgcgagttga

SEQ ID NO: 594240 - DNA, 25 bp, Rattus norvegicus
ccgctttgttgctgtgtaatgtgga

SEQ ID NO: 594241 - DNA, 25 bp, Rattus norvegicus
tgcggggctgtgagtttcaaattaa

SEQ ID NO: 594242 - DNA, 25 bp, Rattus norvegicus
cctttgacttttgatgagcggtgcg

SEQ ID NO: 594243 - DNA, 25 bp, Rattus norvegicus
ggggaaatcgtctaccagccagatg

SEQ ID NO: 594244 - DNA, 25 bp, Rattus norvegicus
aacgagtgctcagcctccttttcca

SEQ ID NO: 594245 - DNA, 25 bp, Rattus norvegicus
ttgttgagagcttgagccagctggc

SEQ ID NO: 594246 - DNA, 25 bp, Rattus norvegicus
tggcggacagcagcacctccgctgg

SEQ ID NO: 594247 - DNA, 25 bp, Rattus norvegicus
ctgcaacgagtgctcagcctccttt

SEQ ID NO: 594248 - DNA, 25 bp, Rattus norvegicus
ttttccagcctccagacctacatgg

SEQ ID NO: 594249 - DNA, 25 bp, Rattus norvegicus
tccagacctacatggagcaccactg

SEQ ID NO: 594250 - DNA, 25 bp, Rattus norvegicus
ccctgcgagaggagagcgccagcga

SEQ ID NO: 594251 - DNA, 25 bp, Rattus norvegicus
cctggccggggaaatcgtctaccag

SEQ ID NO: 594252 - DNA, 25 bp, Rattus norvegicus
tacattgttgagagcttgagccagc

SEQ ID NO: 594253 - DNA, 25 bp, Rattus norvegicus
aaatcgtctaccagccagatggctc

SEQ ID NO: 594254 - DNA, 25 bp, Rattus norvegicus
cagatggctccgcatacattgttga

SEQ ID NO: 594255 - DNA, 25 bp, Rattus norvegicus
aggaggtcagctgcaacgagtgctc

SEQ ID NO: 594256 - DNA, 25 bp, Rattus norvegicus
ctccgcatacattgttgagagcttg

SEQ ID NO: 594257 - DNA, 25 bp, Rattus norvegicus
cagtgcgcggtctgcaacaagttca

SEQ ID NO: 594258 - DNA, 25 bp, Rattus norvegicus
tgcaacaagttcacgacggacaacc

SEQ ID NO: 594259 - DNA, 25 bp, Rattus norvegicus
acgacggacaacctggacatgctgg

SEQ ID NO: 594260 - DNA, 25 bp, Rattus norvegicus
tgcacatgaacgtggagcgcagcct

SEQ ID NO: 594261 - DNA, 25 bp, Rattus norvegicus
gaacgtggagcgcagcctctcagag

SEQ ID NO: 594262 - DNA, 25 bp, Rattus norvegicus
acgacccatcgctgaagctctttca

SEQ ID NO: 594263 - DNA, 25 bp, Rattus norvegicus
cgaggctgacctctgactgtcttcc

SEQ ID NO: 594264 - DNA, 25 bp, Rattus norvegicus
ctctaccttccctacagtgggcggt

SEQ ID NO: 594265 - DNA, 25 bp, Rattus norvegicus
tctgtaccgcggctgcgaggctgac

SEQ ID NO: 594266 - DNA, 25 bp, Rattus norvegicus
gctgatgaacctgggcgagagcttc

SEQ ID NO: 594267 - DNA, 25 bp, Rattus norvegicus
cctctcagaggacgagtggaaggcc

SEQ ID NO: 594268 - DNA, 25 bp, Rattus norvegicus
cttccctacagtgggcggtgagatc

SEQ ID NO: 594269 - DNA, 25 bp, Rattus norvegicus
gagagcttcatccagaccaacgacc

SEQ ID NO: 594270 - DNA, 25 bp, Rattus norvegicus
ggcgagagcttcatccagaccaacg

SEQ ID NO: 594271 - DNA, 25 bp, Rattus norvegicus
ccaagctggacaatgacgactgttc

SEQ ID NO: 594272 - DNA, 25 bp, Rattus norvegicus
gtaccgtggactacagtgagacctc

SEQ ID NO: 594273 - DNA, 25 bp, Rattus norvegicus
ccgagtatgaagaccggctgtcgtc

SEQ ID NO: 594274 - DNA, 25 bp, Rattus norvegicus
ggggttgaccaaagcagccatgatg

SEQ ID NO: 594275 - DNA, 25 bp, Rattus norvegicus
ttctgcaccgaacgaggggttgacc

SEQ ID NO: 594276 - DNA, 25 bp, Rattus norvegicus
tgcaatcacagacaccacaacgggg

SEQ ID NO: 594277 - DNA, 25 bp, Rattus norvegicus
tctcgcctgtgagcaaaaccatgga

SEQ ID NO: 594278 - DNA, 25 bp, Rattus norvegicus
gccggctacaacctgactctgtctg

SEQ ID NO: 594279 - DNA, 25 bp, Rattus norvegicus
cagggcgctcttcaaggccaagaca

SEQ ID NO: 594280 - DNA, 25 bp, Rattus norvegicus
aggcccacaggagatgccctttttg

SEQ ID NO: 594281 - DNA, 25 bp, Rattus norvegicus
tggtttcagaacacccgagctcggg

SEQ ID NO: 594282 - DNA, 25 bp, Rattus norvegicus
acccgactcgaaagatgctggatca

SEQ ID NO: 594283 - DNA, 25 bp, Rattus norvegicus
aagtacctgctggactcgaacccga

SEQ ID NO: 594284 - DNA, 25 bp, Rattus norvegicus
gccacggggatagcgaacgaaacca

SEQ ID NO: 594285 - DNA, 25 bp, Rattus norvegicus
cgagtcggccttgcacaaacacaga

SEQ ID NO: 594286 - DNA, 25 bp, Rattus norvegicus
cctccaggaagtcttggccgccagt

SEQ ID NO: 594287 - DNA, 25 bp, Rattus norvegicus
tcacgagagcagcaagaaacgccaa

SEQ ID NO: 594288 - DNA, 25 bp, Rattus norvegicus
ttcggaggagtctgacacggatctc

SEQ ID NO: 594289 - DNA, 25 bp, Rattus norvegicus
tgccaacagacgactattcggagga

SEQ ID NO: 594290 - DNA, 25 bp, Rattus norvegicus
ggttcagccctcgatgccaacagac

SEQ ID NO: 594291 - DNA, 25 bp, Rattus norvegicus
acggttacctcaagttcatgcagca

SEQ ID NO: 594292 - DNA, 25 bp, Rattus norvegicus
ggatctcagccaaaagtccgacgga

SEQ ID NO: 594293 - DNA, 25 bp, Rattus norvegicus
agtctgccgctcactcaaacgacag

SEQ ID NO: 594294 - DNA, 25 bp, Rattus norvegicus
tagtttattacctcactctgcctgc

SEQ ID NO: 594295 - DNA, 25 bp, Rattus norvegicus
cgccaaagagcaccctagtttatta

SEQ ID NO: 594296 - DNA, 25 bp, Rattus norvegicus
aacacagaacaatcacgagagcagc

SEQ ID NO: 594297 - DNA, 25 bp, Rattus norvegicus
tgagtcagcatctcgagtcggcctt

SEQ ID NO: 594298 - DNA, 25 bp, Rattus norvegicus
tcatgcagcacctcaggggttcagc

SEQ ID NO: 594299 - DNA, 25 bp, Rattus norvegicus
agtatcccaggcacgcagacccgtc

SEQ ID NO: 594300 - DNA, 25 bp, Rattus norvegicus
cagtatcccaggcacgcagacccgt

SEQ ID NO: 594301 - DNA, 25 bp, Rattus norvegicus
catggcgctcacacagtatcccagg

SEQ ID NO: 594302 - DNA, 25 bp, Rattus norvegicus
tcacacagtatcccaggcacgcaga

SEQ ID NO: 594303 - DNA, 25 bp, Rattus norvegicus
acccgtcatggcgctcacacagtat

SEQ ID NO: 594304 - DNA, 25 bp, Rattus norvegicus
agacccgtcatggcgctcacacagt

SEQ ID NO: 594305 - DNA, 25 bp, Rattus norvegicus
tcatggcgctcacacagtatcccag

SEQ ID NO: 594306 - DNA, 25 bp, Rattus norvegicus
gtcatggcgctcacacagtatccca

SEQ ID NO: 594307 - DNA, 25 bp, Rattus norvegicus
tggcgctcacacagtatcccaggca

SEQ ID NO: 594308 - DNA, 25 bp, Rattus norvegicus
caggcacgcagacccgtcatggcgc

SEQ ID NO: 594309 - DNA, 25 bp, Rattus norvegicus
gcagacccgtcatggcgctcacaca

SEQ ID NO: 594310 - DNA, 25 bp, Rattus norvegicus
tcccaggcacgcagacccgtcatgg

SEQ ID NO: 594311 - DNA, 25 bp, Rattus norvegicus
gtcatggcgctcacacagtctccca

SEQ ID NO: 594312 - DNA, 25 bp, Rattus norvegicus
cccaggcacacagacccgtcatggc

SEQ ID NO: 594313 - DNA, 25 bp, Rattus norvegicus
cccgtaggtgtctttgtgcgaataa

SEQ ID NO: 594314 - DNA, 25 bp, Rattus norvegicus
tgatacagaatgtaacccgtaggtg

SEQ ID NO: 594315 - DNA, 25 bp, Rattus norvegicus
cgagcggacaccttagcttatgata

SEQ ID NO: 594316 - DNA, 25 bp, Rattus norvegicus
tataaactgttattccgagcggaca

SEQ ID NO: 594317 - DNA, 25 bp, Rattus norvegicus
agaaaaagcacctcgcggccagcag

SEQ ID NO: 594318 - DNA, 25 bp, Rattus norvegicus
cctgcgcagccggacagaaaaagca

SEQ ID NO: 594319 - DNA, 25 bp, Rattus norvegicus
cgcggccgttgccatagaagcgcaa

SEQ ID NO: 594320 - DNA, 25 bp, Rattus norvegicus
attggcggaccaccagacgcggcca

SEQ ID NO: 594321 - DNA, 25 bp, Rattus norvegicus
aaacccggtgttgttggactgcatc

SEQ ID NO: 594322 - DNA, 25 bp, Rattus norvegicus
gtctccagagcgctaaggtgtttcg

SEQ ID NO: 594323 - DNA, 25 bp, Rattus norvegicus
tgcggtttgtgagccgtagtctcca

SEQ ID NO: 594324 - DNA, 25 bp, Rattus norvegicus
actttgagaagtcgagggcacccta

SEQ ID NO: 594325 - DNA, 25 bp, Rattus norvegicus
ttgcgcaagcgtactttgagaagtc

SEQ ID NO: 594326 - DNA, 25 bp, Rattus norvegicus
tccatggagatggacgcggaaaccc

SEQ ID NO: 594327 - DNA, 25 bp, Rattus norvegicus
ccaatcgcgcttgccgtaagaatta

SEQ ID NO: 594328 - DNA, 25 bp, Rattus norvegicus
tctacgtccgtgtttctcacttccg

SEQ ID NO: 594329 - DNA, 25 bp, Rattus norvegicus
cgcggtggcacgttctttttctacg

SEQ ID NO: 594330 - DNA, 25 bp, Rattus norvegicus
taccggacttttgactgggacgcgc

SEQ ID NO: 594331 - DNA, 25 bp, Rattus norvegicus
tgcaaagtggaagggaactaaaata

SEQ ID NO: 594332 - DNA, 25 bp, Rattus norvegicus
gcagatgcaaagtggaagggaacta

SEQ ID NO: 594333 - DNA, 25 bp, Rattus norvegicus
ataacttccggtcgggcagatgcaa

SEQ ID NO: 594334 - DNA, 25 bp, Rattus norvegicus
gaaatgacataacttccggtcgggc

SEQ ID NO: 594335 - DNA, 25 bp, Rattus norvegicus
ctaagggcggaaatgacataacttc

SEQ ID NO: 594336 - DNA, 25 bp, Rattus norvegicus
gccatatttactaagggcggaaatg

SEQ ID NO: 594337 - DNA, 25 bp, Rattus norvegicus
tgaggtcggccatatttactaaggg

SEQ ID NO: 594338 - DNA, 25 bp, Rattus norvegicus
agagggcaaaatgaggtcggccata

SEQ ID NO: 594339 - DNA, 25 bp, Rattus norvegicus
gcgcttgccgtaagaattaacaccc

SEQ ID NO: 594340 - DNA, 25 bp, Rattus norvegicus
ccgcctctgccctgtgggtgtacga

SEQ ID NO: 594341 - DNA, 25 bp, Rattus norvegicus
ctgagggactcgtaaaccaggctaa

SEQ ID NO: 594342 - DNA, 25 bp, Rattus norvegicus
gggtgaccatgaccgggaaccagct

SEQ ID NO: 594343 - DNA, 25 bp, Rattus norvegicus
cccatcacctgagggactcgtaaac

SEQ ID NO: 594344 - DNA, 25 bp, Rattus norvegicus
actcctccaccagtgcgcgggccca

SEQ ID NO: 594345 - DNA, 25 bp, Rattus norvegicus
gactcgtaaaccaggctaaggaaga

SEQ ID NO: 594346 - DNA, 25 bp, Rattus norvegicus
ggctaaggaagacggtccgtccgca

SEQ ID NO: 594347 - DNA, 25 bp, Rattus norvegicus
agtatcctcgtcctctcctcaccag

SEQ ID NO: 594348 - DNA, 25 bp, Rattus norvegicus
agctcgcgccgctgacactgggcga

SEQ ID NO: 594349 - DNA, 25 bp, Rattus norvegicus
gccgctgacactgggcgaatcctct

SEQ ID NO: 594350 - DNA, 25 bp, Rattus norvegicus
tgggcgaatcctctcagctcaggtc

SEQ ID NO: 594351 - DNA, 25 bp, Rattus norvegicus
cgaatcctctcagctcaggtcctga

SEQ ID NO: 594352 - DNA, 25 bp, Rattus norvegicus
ctcaggtcctgagcacagttccgcg

SEQ ID NO: 594353 - DNA, 25 bp, Rattus norvegicus
ctgagcacagttccgcgattgctgc

SEQ ID NO: 594354 - DNA, 25 bp, Rattus norvegicus
gaccatgaccgggaaccagctcgtc

SEQ ID NO: 594355 - DNA, 25 bp, Rattus norvegicus
tctttccgcgtgaaacccggagctg

SEQ ID NO: 594356 - DNA, 25 bp, Rattus norvegicus
cttggtacgcctgggaaagtcagtg

SEQ ID NO: 594357 - DNA, 25 bp, Rattus norvegicus
aacggccctctttgaagccttctcg

SEQ ID NO: 594358 - DNA, 25 bp, Rattus norvegicus
gtctcgagcacctgaccgggcttaa

SEQ ID NO: 594359 - DNA, 25 bp, Rattus norvegicus
ccggtgtctaccgagcgtgttttca

SEQ ID NO: 594360 - DNA, 25 bp, Rattus norvegicus
gcggaggacaccagacactgctgcc

SEQ ID NO: 594361 - DNA, 25 bp, Rattus norvegicus
ttggaacgagaagccggtgtctacc

SEQ ID NO: 594362 - DNA, 25 bp, Rattus norvegicus
tctaggactcagacgctgtgcggca

SEQ ID NO: 594363 - DNA, 25 bp, Rattus norvegicus
gaattgcgtcgactctctaggactc

SEQ ID NO: 594364 - DNA, 25 bp, Rattus norvegicus
gtcacgccgtgagcagaattgcgtc

SEQ ID NO: 594365 - DNA, 25 bp, Rattus norvegicus
ccatcttggagatgggcacgcacgc

SEQ ID NO: 594366 - DNA, 25 bp, Rattus norvegicus
tcgggaccgccggtttactcatagc

SEQ ID NO: 594367 - DNA, 25 bp, Rattus norvegicus
gtctgccgcctctttccgcgtgaaa

SEQ ID NO: 594368 - DNA, 25 bp, Rattus norvegicus
tgcggcatcttctcgcgagagattg

SEQ ID NO: 594369 - DNA, 25 bp, Rattus norvegicus
agggttgaacgcatgcgctctgccg

SEQ ID NO: 594370 - DNA, 25 bp, Rattus norvegicus
cctatctcccaagcccgcaagccgg

SEQ ID NO: 594371 - DNA, 25 bp, Rattus norvegicus
tgaacgcatgcgctctgccgagagc

SEQ ID NO: 594372 - DNA, 25 bp, Rattus norvegicus
tgcgctctgccgagagctaagctcc

SEQ ID NO: 594373 - DNA, 25 bp, Rattus norvegicus
tctgccgagagctaagctccgtggc

SEQ ID NO: 594374 - DNA, 25 bp, Rattus norvegicus
actctcagctgtctccacgccatgc

SEQ ID NO: 594375 - DNA, 25 bp, Rattus norvegicus
acgccatgcttcttctaccactaag

SEQ ID NO: 594376 - DNA, 25 bp, Rattus norvegicus
atgcttcttctaccactaagctcgc

SEQ ID NO: 594377 - DNA, 25 bp, Rattus norvegicus
gcctccgcctgcattccattggaaa

SEQ ID NO: 594378 - DNA, 25 bp, Rattus norvegicus
ccattggaaaactgggcttcggctc

SEQ ID NO: 594379 - DNA, 25 bp, Rattus norvegicus
gaaaactgggcttcggctccaccta

SEQ ID NO: 594380 - DNA, 25 bp, Rattus norvegicus
ggcttcggctccacctatctcccaa

SEQ ID NO: 594381 - DNA, 25 bp, Rattus norvegicus
ctcgatgttgattggagggttgaac

SEQ ID NO: 594382 - DNA, 25 bp, Rattus norvegicus
ccgcgccggactcactctcagctgt

SEQ ID NO: 594383 - DNA, 25 bp, Rattus norvegicus
gtgcccagtacccttgttccagatt

SEQ ID NO: 594384 - DNA, 25 bp, Rattus norvegicus
ttgtgacacctgacatctagcagtg

SEQ ID NO: 594385 - DNA, 25 bp, Rattus norvegicus
cggaggcgtggaacttaacttgtga

SEQ ID NO: 594386 - DNA, 25 bp, Rattus norvegicus
ctaacggagattggctgtgcgcaca

SEQ ID NO: 594387 - DNA, 25 bp, Rattus norvegicus
gccacgccctacctaacggagattg

SEQ ID NO: 594388 - DNA, 25 bp, Rattus norvegicus
agcagatttccgattagccgttctg

SEQ ID NO: 594389 - DNA, 25 bp, Rattus norvegicus
gcacagatgacttgaccttaaggtc

SEQ ID NO: 594390 - DNA, 25 bp, Rattus norvegicus
ccttgcaatttacctggggcgcggc

SEQ ID NO: 594391 - DNA, 25 bp, Rattus norvegicus
ttcccggctgacaacggcacagatg

SEQ ID NO: 594392 - DNA, 25 bp, Rattus norvegicus
gacaaggcctttctgagggtcccga

SEQ ID NO: 594393 - DNA, 25 bp, Rattus norvegicus
gccggtcattcgatcctgggtctac

SEQ ID NO: 594394 - DNA, 25 bp, Rattus norvegicus
ggcttctgtctaccgatactgatcc

SEQ ID NO: 594395 - DNA, 25 bp, Rattus norvegicus
agatttagcgctgtggagcccattc

SEQ ID NO: 594396 - DNA, 25 bp, Rattus norvegicus
taaggtcctaacaccggctggagtc

SEQ ID NO: 594397 - DNA, 25 bp, Rattus norvegicus
ttcgatgttgggagaggaaaccagc

SEQ ID NO: 594398 - DNA, 25 bp, Rattus norvegicus
atgtgggttttgtggctcaattcga

SEQ ID NO: 594399 - DNA, 25 bp, Rattus norvegicus
aaaccagcggggagttgacagctca

SEQ ID NO: 594400 - DNA, 25 bp, Rattus norvegicus
gctcagtggagctacgggttctaaa

SEQ ID NO: 594401 - DNA, 25 bp, Rattus norvegicus
ggatagatagctcggaaagctcctg

SEQ ID NO: 594402 - DNA, 25 bp, Rattus norvegicus
aaagctcctggatgctcagctgcgc

SEQ ID NO: 594403 - DNA, 25 bp, Rattus norvegicus
aacgcccgcgattggatgcttccta

SEQ ID NO: 594404 - DNA, 25 bp, Rattus norvegicus
cgccttttgtctgctcgctcctggg

SEQ ID NO: 594405 - DNA, 25 bp, Rattus norvegicus
cactcgctgcgagagcgcgaacagc

SEQ ID NO: 594406 - DNA, 25 bp, Rattus norvegicus
gtccgtctgtctaccgttggctttg

SEQ ID NO: 594407 - DNA, 25 bp, Rattus norvegicus
accgttggctttgtctgtctaccgc

SEQ ID NO: 594408 - DNA, 25 bp, Rattus norvegicus
attgtcccgcgatctgtccgtccgg

SEQ ID NO: 594409 - DNA, 25 bp, Rattus norvegicus
cgggagccagcagctcgcttagctc

SEQ ID NO: 594410 - DNA, 25 bp, Rattus norvegicus
tggatgcttcctaagtcccgccttc

SEQ ID NO: 594411 - DNA, 25 bp, Rattus norvegicus
tcggcagaacgaacccttggaagta

SEQ ID NO: 594412 - DNA, 25 bp, Rattus norvegicus
cccttggaagtaagactgcaacgac

SEQ ID NO: 594413 - DNA, 25 bp, Rattus norvegicus
ctgcaacgacttgaacgagaacgca

SEQ ID NO: 594414 - DNA, 25 bp, Rattus norvegicus
cgagaacgcacagccaagaagagtc

SEQ ID NO: 594415 - DNA, 25 bp, Rattus norvegicus
aagagtcggcgagacaatgagaccc

SEQ ID NO: 594416 - DNA, 25 bp, Rattus norvegicus
agacgcatgagggatcgtgaagcca

SEQ ID NO: 594417 - DNA, 25 bp, Rattus norvegicus
tcgtgaagccaagcgcctgcagcgc

SEQ ID NO: 594418 - DNA, 25 bp, Rattus norvegicus
agcggcaggcccgactcattcgaga

SEQ ID NO: 594419 - DNA, 25 bp, Rattus norvegicus
ctcgcaggctacagagagaccgtga

SEQ ID NO: 594420 - DNA, 25 bp, Rattus norvegicus
ccatgaggctcaagcgggccaatga

SEQ ID NO: 594421 - DNA, 25 bp, Rattus norvegicus
caagtgggccctccgtcggcagaac

SEQ ID NO: 594422 - DNA, 25 bp, Rattus norvegicus
gagacagatgaacagcgagctcgca

SEQ ID NO: 594423 - DNA, 25 bp, Rattus norvegicus
ctgcagcgcatgcaagagacagatg

SEQ ID NO: 594424 - DNA, 25 bp, Rattus norvegicus
agaccgtgaggccatgaggctcaag

SEQ ID NO: 594425 - DNA, 25 bp, Rattus norvegicus
agagctccgaaccaggcctgcttga

SEQ ID NO: 594426 - DNA, 25 bp, Rattus norvegicus
ccgctggcgacgcttccttgtttgg

SEQ ID NO: 594427 - DNA, 25 bp, Rattus norvegicus
cgccctgagaactcggacatcctgg

SEQ ID NO: 594428 - DNA, 25 bp, Rattus norvegicus
tgagaactcggacatcctggcccgc

SEQ ID NO: 594429 - DNA, 25 bp, Rattus norvegicus
acaccgccggggcatcagggcctga

SEQ ID NO: 594430 - DNA, 25 bp, Rattus norvegicus
catcagggcctgaggccgctttctg

SEQ ID NO: 594431 - DNA, 25 bp, Rattus norvegicus
ccaggcgggaaagcagcatctacag

SEQ ID NO: 594432 - DNA, 25 bp, Rattus norvegicus
agcagcatctacagggccaggcacg

SEQ ID NO: 594433 - DNA, 25 bp, Rattus norvegicus
ggggcccttccactagagctccgaa

SEQ ID NO: 594434 - DNA, 25 bp, Rattus norvegicus
tgcttgacctcaggccagcccagag

SEQ ID NO: 594435 - DNA, 25 bp, Rattus norvegicus
cccggagatggcgttaagcgcatcc

SEQ ID NO: 594436 - DNA, 25 bp, Rattus norvegicus
agaaatgacgtcactcgaaccaggg

SEQ ID NO: 594437 - DNA, 25 bp, Rattus norvegicus
acgtcactcgaaccagggagcgccg

SEQ ID NO: 594438 - DNA, 25 bp, Rattus norvegicus
tacagggccaggcacggcctctttc

SEQ ID NO: 594439 - DNA, 25 bp, Rattus norvegicus
gagcactccggtggcaggtggagca

SEQ ID NO: 594440 - DNA, 25 bp, Rattus norvegicus
ggagcactccggtggcaggtggagt

SEQ ID NO: 594441 - DNA, 25 bp, Rattus norvegicus
caggcggagcactcgtgtggcaggc

SEQ ID NO: 594442 - DNA, 25 bp, Rattus norvegicus
aggcggagcactcgtgtggcaggcg

SEQ ID NO: 594443 - DNA, 25 bp, Rattus norvegicus
cactcgtgtggcaggcggagcactc

SEQ ID NO: 594444 - DNA, 25 bp, Rattus norvegicus
tggcaggtggagtactcgggtggca

SEQ ID NO: 594445 - DNA, 25 bp, Rattus norvegicus
gcactcgtgtggcaggcggagcact

SEQ ID NO: 594446 - DNA, 25 bp, Rattus norvegicus
aggcggagcactccggtggcaggtg

SEQ ID NO: 594447 - DNA, 25 bp, Rattus norvegicus
caggcggagcactccggtggcaggt

SEQ ID NO: 594448 - DNA, 25 bp, Rattus norvegicus
actcgtgtggcaggcggagcactcg

SEQ ID NO: 594449 - DNA, 25 bp, Rattus norvegicus
cactccggtggcaggtggagcactc

SEQ ID NO: 594450 - DNA, 25 bp, Rattus norvegicus
tggcaggcggagcactccggtggca

SEQ ID NO: 594451 - DNA, 25 bp, Rattus norvegicus
caggtggagtactcgggtggcaggc

SEQ ID NO: 594452 - DNA, 25 bp, Rattus norvegicus
ggagcactcgtgtggcaggcggagc

SEQ ID NO: 594453 - DNA, 25 bp, Rattus norvegicus
gaggagcgacgtcttctcgagaagc

SEQ ID NO: 594454 - DNA, 25 bp, Rattus norvegicus
tcggcaaatagtcctcagcagggtc

SEQ ID NO: 594455 - DNA, 25 bp, Rattus norvegicus
tagggccggacctttctagctcaga

SEQ ID NO: 594456 - DNA, 25 bp, Rattus norvegicus
tagctcagactcctcgcagcggtga

SEQ ID NO: 594457 - DNA, 25 bp, Rattus norvegicus
gccgcgtctagcgtcatcagtgaca

SEQ ID NO: 594458 - DNA, 25 bp, Rattus norvegicus
ttagaaactccctcctcgcctggga

SEQ ID NO: 594459 - DNA, 25 bp, Rattus norvegicus
agctgctggtttcattcgaggtttc

SEQ ID NO: 594460 - DNA, 25 bp, Rattus norvegicus
tccactgcagctgcgagcgtttgac

SEQ ID NO: 594461 - DNA, 25 bp, Rattus norvegicus
tgagccacgtatcagcgttcttgtg

SEQ ID NO: 594462 - DNA, 25 bp, Rattus norvegicus
agcgtttgactggaaacctcctgtc

SEQ ID NO: 594463 - DNA, 25 bp, Rattus norvegicus
ctcggaagcttcagaaccggagctc

SEQ ID NO: 594464 - DNA, 25 bp, Rattus norvegicus
ggcctccttgaacccattgacttta

SEQ ID NO: 594465 - DNA, 25 bp, Rattus norvegicus
cgagctgctatcctcctttgaaagc

SEQ ID NO: 594466 - DNA, 25 bp, Rattus norvegicus
gcggaaccaaagtgcgttgactctg

SEQ ID NO: 594467 - DNA, 25 bp, Rattus norvegicus
atggggtcgataagaggacgcccgc

SEQ ID NO: 594468 - DNA, 25 bp, Rattus norvegicus
cgatggcccgcagagataggggcgc

SEQ ID NO: 594469 - DNA, 25 bp, Rattus norvegicus
cttatgtaacgggagatggggtcga

SEQ ID NO: 594470 - DNA, 25 bp, Rattus norvegicus
ctcctccgtggtctccgggaaggcg

SEQ ID NO: 594471 - DNA, 25 bp, Rattus norvegicus
gggaagcggccaccactccgcttgc

SEQ ID NO: 594472 - DNA, 25 bp, Rattus norvegicus
cactccgcttgcaaaacgggaccgt

SEQ ID NO: 594473 - DNA, 25 bp, Rattus norvegicus
tctgttgaacatcgcgcgcctgcac

SEQ ID NO: 594474 - DNA, 25 bp, Rattus norvegicus
ctggaccgctggatcagtgtcccaa

SEQ ID NO: 594475 - DNA, 25 bp, Rattus norvegicus
ctggatcagtgtcccaagcgccttt

SEQ ID NO: 594476 - DNA, 25 bp, Rattus norvegicus
atcagtgtcccaagcgcctttgcgc

SEQ ID NO: 594477 - DNA, 25 bp, Rattus norvegicus
gcgcctttgcgctctgttgaacatc

SEQ ID NO: 594478 - DNA, 25 bp, Rattus norvegicus
cgctctgttgaacatcgcgcgcctg

SEQ ID NO: 594479 - DNA, 25 bp, Rattus norvegicus
gtcccggctggaccgctggatcagt

SEQ ID NO: 594480 - DNA, 25 bp, Rattus norvegicus
agataggggcgcggccttatgtaac

SEQ ID NO: 594481 - DNA, 25 bp, Rattus norvegicus
gagcgtctctgtaaagccttggccg

SEQ ID NO: 594482 - DNA, 25 bp, Rattus norvegicus
cgcgccggccgagcgtctctgtaaa

SEQ ID NO: 594483 - DNA, 25 bp, Rattus norvegicus
ttcgggtcctaaaggtgagtcggca

SEQ ID NO: 594484 - DNA, 25 bp, Rattus norvegicus
cgccttcgcctagctgcccgaggca

SEQ ID NO: 594485 - DNA, 25 bp, Rattus norvegicus
accgccgtcgtttcgctgggcctag

SEQ ID NO: 594486 - DNA, 25 bp, Rattus norvegicus
agtacgcagggttcggcggacacct

SEQ ID NO: 594487 - DNA, 25 bp, Rattus norvegicus
tcggcggacacctgaagacatcacc

SEQ ID NO: 594488 - DNA, 25 bp, Rattus norvegicus
tgccctcgggactggctaccgagtt

SEQ ID NO: 594489 - DNA, 25 bp, Rattus norvegicus
taccgagttccgaaccggctctcag

SEQ ID NO: 594490 - DNA, 25 bp, Rattus norvegicus
cggctctcagctccaagacgcgaca

SEQ ID NO: 594491 - DNA, 25 bp, Rattus norvegicus
acgcgacacccggagcttcccgctt

SEQ ID NO: 594492 - DNA, 25 bp, Rattus norvegicus
cccgaggatctgctgcctgagaacc

SEQ ID NO: 594493 - DNA, 25 bp, Rattus norvegicus
tctgctgcctgagaacccgctgggc

SEQ ID NO: 594494 - DNA, 25 bp, Rattus norvegicus
tgaaggaggcagagcgtcttagtta

SEQ ID NO: 594495 - DNA, 25 bp, Rattus norvegicus
aaccaaccacaagtttcccaggcag

SEQ ID NO: 594496 - DNA, 25 bp, Rattus norvegicus
gcccggaaacgatcggagggcaaca

SEQ ID NO: 594497 - DNA, 25 bp, Rattus norvegicus
agtgtttttcatggcccgattcctg

SEQ ID NO: 594498 - DNA, 25 bp, Rattus norvegicus
cgcgcacggctttggcgggacttct

SEQ ID NO: 594499 - DNA, 25 bp, Rattus norvegicus
agtcccggctgtgtcccaactgggt

SEQ ID NO: 594500 - DNA, 25 bp, Rattus norvegicus
ttctcccgggctctttgttcggctg

SEQ ID NO: 594501 - DNA, 25 bp, Rattus norvegicus
gtcaccgttcctctccctgtgcctg

SEQ ID NO: 594502 - DNA, 25 bp, Rattus norvegicus
gttcggctgcgcgatgacccgcgtc

SEQ ID NO: 594503 - DNA, 25 bp, Rattus norvegicus
tccctgtgtctgtcctggcgcggtt

SEQ ID NO: 594504 - DNA, 25 bp, Rattus norvegicus
cgcggttctcggtcggttctatgtt

SEQ ID NO: 594505 - DNA, 25 bp, Rattus norvegicus
tctcggtcggttctatgttcccggc

SEQ ID NO: 594506 - DNA, 25 bp, Rattus norvegicus
ctctttgttcggctgcgcgatgacc

SEQ ID NO: 594507 - DNA, 25 bp, Rattus norvegicus
gatcggagggcaacaaccaaccaca

SEQ ID NO: 594508 - DNA, 25 bp, Rattus norvegicus
tctctcggacgggtccggggctcac

SEQ ID NO: 594509 - DNA, 25 bp, Rattus norvegicus
ctcggtgcccacagcggtgacgctt

SEQ ID NO: 594510 - DNA, 25 bp, Rattus norvegicus
ctcgcggcccaccacgtctcggtgc

SEQ ID NO: 594511 - DNA, 25 bp, Rattus norvegicus
ggtcagcacgcagggtccctcgcag

SEQ ID NO: 594512 - DNA, 25 bp, Rattus norvegicus
gaagcggctcgaggtgacatcgcaa

SEQ ID NO: 594513 - DNA, 25 bp, Rattus norvegicus
tcgaggtgacatcgcaagtccattg

SEQ ID NO: 594514 - DNA, 25 bp, Rattus norvegicus
gtgacatcgcaagtccattgacccg

SEQ ID NO: 594515 - DNA, 25 bp, Rattus norvegicus
cttgagtggcaactaccgtcaggcc

SEQ ID NO: 594516 - DNA, 25 bp, Rattus norvegicus
ttcgcggtgtcctggcggtcagcac

SEQ ID NO: 594517 - DNA, 25 bp, Rattus norvegicus
accgtcaggcccacagagcttagca

SEQ ID NO: 594518 - DNA, 25 bp, Rattus norvegicus
tcacttcacagagggtgactgcgtg

SEQ ID NO: 594519 - DNA, 25 bp, Rattus norvegicus
cggtgacgcttgagtggcaactacc

SEQ ID NO: 594520 - DNA, 25 bp, Rattus norvegicus
cacagagcttagcaggtggcggatc

SEQ ID NO: 594521 - DNA, 25 bp, Rattus norvegicus
cgagagggagggcaatactcctaga

SEQ ID NO: 594522 - DNA, 25 bp, Rattus norvegicus
gactcgttgcggttcgcggtgtcct

SEQ ID NO: 594523 - DNA, 25 bp, Rattus norvegicus
gttgccagggaaccagttgcactcc

SEQ ID NO: 594524 - DNA, 25 bp, Rattus norvegicus
gggaaccagttgcactccagcgctg

SEQ ID NO: 594525 - DNA, 25 bp, Rattus norvegicus
ttcctcccaggttgccagggaacca

SEQ ID NO: 594526 - DNA, 25 bp, Rattus norvegicus
aggctggattcctcccaggttgcca

SEQ ID NO: 594527 - DNA, 25 bp, Rattus norvegicus
tgtagctgaggctggattcctccca

SEQ ID NO: 594528 - DNA, 25 bp, Rattus norvegicus
ttatagtgggctggcagcctccgcc

SEQ ID NO: 594529 - DNA, 25 bp, Rattus norvegicus
tgctttttatagtgggctggcagcc

SEQ ID NO: 594530 - DNA, 25 bp, Rattus norvegicus
gccgatagcctggttgctttttata

SEQ ID NO: 594531 - DNA, 25 bp, Rattus norvegicus
ctcgccgatagcctggttgcttttt

SEQ ID NO: 594532 - DNA, 25 bp, Rattus norvegicus
agctcggagtagtcgctcgccgata

SEQ ID NO: 594533 - DNA, 25 bp, Rattus norvegicus
agcagtgtcgcagctcggagtagtc

SEQ ID NO: 594534 - DNA, 25 bp, Rattus norvegicus
ccaggagactgagcagtgtcgcagc

SEQ ID NO: 594535 - DNA, 25 bp, Rattus norvegicus
cagcagccacgcgagctgtgaggga

SEQ ID NO: 594536 - DNA, 25 bp, Rattus norvegicus
accagttgcactccagcgctgggct

SEQ ID NO: 594537 - DNA, 25 bp, Rattus norvegicus
ggactgctcggatgcctgtttgagc

SEQ ID NO: 594538 - DNA, 25 bp, Rattus norvegicus
ctcggtgagtgacagtcccgggtta

SEQ ID NO: 594539 - DNA, 25 bp, Rattus norvegicus
aacgcgcgggatagctcggcctcct

SEQ ID NO: 594540 - DNA, 25 bp, Rattus norvegicus
cccgacttctcggtgagtgacagtc

SEQ ID NO: 594541 - DNA, 25 bp, Rattus norvegicus
tttgagctatggctgtcccgggttc

SEQ ID NO: 594542 - DNA, 25 bp, Rattus norvegicus
tgcctgtttgagctatggctgtccc

SEQ ID NO: 594543 - DNA, 25 bp, Rattus norvegicus
tggaggaatgcggacccgacttctc

SEQ ID NO: 594544 - DNA, 25 bp, Rattus norvegicus
gcgtgtaccgtgctactgctccagc

SEQ ID NO: 594545 - DNA, 25 bp, Rattus norvegicus
tgaggaccgcgtgtaccgtgctact

SEQ ID NO: 594546 - DNA, 25 bp, Rattus norvegicus
cctcctccttgtcggtgactcgggt

SEQ ID NO: 594547 - DNA, 25 bp, Rattus norvegicus
gtccgggcaatcgtctaagcgctcc

SEQ ID NO: 594548 - DNA, 25 bp, Rattus norvegicus
cctggaggaggctctggctccagtt

SEQ ID NO: 594549 - DNA, 25 bp, Rattus norvegicus
ggctgtcggcatcttgcagccgatg

SEQ ID NO: 594550 - DNA, 25 bp, Rattus norvegicus
tagctcggcctcctggaaggcgcct

SEQ ID NO: 594551 - DNA, 25 bp, Rattus norvegicus
ttcgccaagaacttttcctactgta

SEQ ID NO: 594552 - DNA, 25 bp, Rattus norvegicus
atgccgtgtctgagctcttcgccaa

SEQ ID NO: 594553 - DNA, 25 bp, Rattus norvegicus
agcccagacgctctcaatgccgtgt

SEQ ID NO: 594554 - DNA, 25 bp, Rattus norvegicus
caggaagcgtccagctcagcagcca

SEQ ID NO: 594555 - DNA, 25 bp, Rattus norvegicus
tggcagttaccagctcccgccgaga

SEQ ID NO: 594556 - DNA, 25 bp, Rattus norvegicus
cagatcatcgcccacgtgagaaagg

SEQ ID NO: 594557 - DNA, 25 bp, Rattus norvegicus
cctactgtaagccactcgatcacga

SEQ ID NO: 594558 - DNA, 25 bp, Rattus norvegicus
gccttcaccaacagggcggggcaga

SEQ ID NO: 594559 - DNA, 25 bp, Rattus norvegicus
acctcctgtgcgataaggagctgga

SEQ ID NO: 594560 - DNA, 25 bp, Rattus norvegicus
tgaacgcagtgaaaaacctcctgtg

SEQ ID NO: 594561 - DNA, 25 bp, Rattus norvegicus
cttgacttgaagaactccctgaacg

SEQ ID NO: 594562 - DNA, 25 bp, Rattus norvegicus
cgagcacgtcgagttccaagctttc

SEQ ID NO: 594563 - DNA, 25 bp, Rattus norvegicus
cgagagcttcacctgcgagcacgtc

SEQ ID NO: 594564 - DNA, 25 bp, Rattus norvegicus
tcgatcacgagtggcagttaccagc

SEQ ID NO: 594565 - DNA, 25 bp, Rattus norvegicus
gtgcctgcgccatcacgtgatctga

SEQ ID NO: 594566 - DNA, 25 bp, Rattus norvegicus
tgatctgagtaacatggccgcggcc

SEQ ID NO: 594567 - DNA, 25 bp, Rattus norvegicus
ggcccagtgagcgttgccggttcct

SEQ ID NO: 594568 - DNA, 25 bp, Rattus norvegicus
ccctgggcggcgtagcccatgagca

SEQ ID NO: 594569 - DNA, 25 bp, Rattus norvegicus
cagcctcgggctaaggtgtctcgag

SEQ ID NO: 594570 - DNA, 25 bp, Rattus norvegicus
gcgcagcgcgagctgccaccatgaa

SEQ ID NO: 594571 - DNA, 25 bp, Rattus norvegicus
actcccaacatcgtaagggccctga

SEQ ID NO: 594572 - DNA, 25 bp, Rattus norvegicus
ccggagaaggattttgcgccactca

SEQ ID NO: 594573 - DNA, 25 bp, Rattus norvegicus
gggccctgaatgataaactctacga

SEQ ID NO: 594574 - DNA, 25 bp, Rattus norvegicus
actctacgaaaagcggaaggtagca

SEQ ID NO: 594575 - DNA, 25 bp, Rattus norvegicus
agcagcgctggagatcgagaagtaa

SEQ ID NO: 594576 - DNA, 25 bp, Rattus norvegicus
cgagaagtaagagctactgggaccc

SEQ ID NO: 594577 - DNA, 25 bp, Rattus norvegicus
atgccgctcctagcggctcttctgg

SEQ ID NO: 594578 - DNA, 25 bp, Rattus norvegicus
gctgccaccatgaacccggagaagg

SEQ ID NO: 594579 - DNA, 25 bp, Rattus norvegicus
ccaggcgggctccaagcacgggtct

SEQ ID NO: 594580 - DNA, 25 bp, Rattus norvegicus
cccagcatggagacggcagagaagg

SEQ ID NO: 594581 - DNA, 25 bp, Rattus norvegicus
cttccaggccatcgtcaacgacatg

SEQ ID NO: 594582 - DNA, 25 bp, Rattus norvegicus
tccaggccatcgtcaacgacatgaa

SEQ ID NO: 594583 - DNA, 25 bp, Rattus norvegicus
ggccatcgtcaacgacatgaaggta

SEQ ID NO: 594584 - DNA, 25 bp, Rattus norvegicus
cggcagagaaggagtgtggcgccct

SEQ ID NO: 594585 - DNA, 25 bp, Rattus norvegicus
cgacatgaaggtaccccaggcgggc

SEQ ID NO: 594586 - DNA, 25 bp, Rattus norvegicus
ctccaagcacgggtctcctctgagg

SEQ ID NO: 594587 - DNA, 25 bp, Rattus norvegicus
caagcacgggtctcctctgagggac

SEQ ID NO: 594588 - DNA, 25 bp, Rattus norvegicus
cacgggtctcctctgagggacgtgt

SEQ ID NO: 594589 - DNA, 25 bp, Rattus norvegicus
ggcagtagtgtcctgctacggccgt

SEQ ID NO: 594590 - DNA, 25 bp, Rattus norvegicus
agtagtgtcctgctacggccgtgca

SEQ ID NO: 594591 - DNA, 25 bp, Rattus norvegicus
agtgtcctgctacggccgtgcagcg

SEQ ID NO: 594592 - DNA, 25 bp, Rattus norvegicus
catcgtcaacgacatgaaggtaccc

SEQ ID NO: 594593 - DNA, 25 bp, Rattus norvegicus
agctgtgtacgaacgactctgcggc

SEQ ID NO: 594594 - DNA, 25 bp, Rattus norvegicus
cccggaagcgccgagtgggcaccaa

SEQ ID NO: 594595 - DNA, 25 bp, Rattus norvegicus
accaagatggcggatgtggaatccc

SEQ ID NO: 594596 - DNA, 25 bp, Rattus norvegicus
ctccgaagttgtcaggagcgcctcc

SEQ ID NO: 594597 - DNA, 25 bp, Rattus norvegicus
gaagttgtcaggagcgcctccacca

SEQ ID NO: 594598 - DNA, 25 bp, Rattus norvegicus
aggagcgcctccaccacctgagggg

SEQ ID NO: 594599 - DNA, 25 bp, Rattus norvegicus
gggaggaggtcactgctccgaaatc

SEQ ID NO: 594600 - DNA, 25 bp, Rattus norvegicus
gaggtcactgctccgaaatctccac

SEQ ID NO: 594601 - DNA, 25 bp, Rattus norvegicus
gaaatctccaccgagctcattcgct

SEQ ID NO: 594602 - DNA, 25 bp, Rattus norvegicus
cgagctcattcgctctctgacagag

SEQ ID NO: 594603 - DNA, 25 bp, Rattus norvegicus
attcgctctctgacagagctgcagg

SEQ ID NO: 594604 - DNA, 25 bp, Rattus norvegicus
tctctgacagagctgcaggagctgg

SEQ ID NO: 594605 - DNA, 25 bp, Rattus norvegicus
gctggaagctgtgtacgaacgactc

SEQ ID NO: 594606 - DNA, 25 bp, Rattus norvegicus
caggagctggaagctgtgtacgaac

SEQ ID NO: 594607 - DNA, 25 bp, Rattus norvegicus
gacccacttacctgcgtccgcccag

SEQ ID NO: 594608 - DNA, 25 bp, Rattus norvegicus
gttctcaaacttacacggagcgctc

SEQ ID NO: 594609 - DNA, 25 bp, Rattus norvegicus
agagctcgcagagccggctctttaa

SEQ ID NO: 594610 - DNA, 25 bp, Rattus norvegicus
gccggctctttaacgtgactgcgca

SEQ ID NO: 594611 - DNA, 25 bp, Rattus norvegicus
tctttaacgtgactgcgcatgccgc

SEQ ID NO: 594612 - DNA, 25 bp, Rattus norvegicus
gtgactgcgcatgccgcgcagcgca

SEQ ID NO: 594613 - DNA, 25 bp, Rattus norvegicus
cgcagcgcaccctgggaaatgcagt

SEQ ID NO: 594614 - DNA, 25 bp, Rattus norvegicus
gggaaatgcagttcattcgatcttg

SEQ ID NO: 594615 - DNA, 25 bp, Rattus norvegicus
gcagttcattcgatcttgctccaga

SEQ ID NO: 594616 - DNA, 25 bp, Rattus norvegicus
tcgatcttgctccagagtccgtaga

SEQ ID NO: 594617 - DNA, 25 bp, Rattus norvegicus
ggtaacgacagagatccgggagacc

SEQ ID NO: 594618 - DNA, 25 bp, Rattus norvegicus
tccagagtccgtagaacccgcatgc

SEQ ID NO: 594619 - DNA, 25 bp, Rattus norvegicus
gagtccgtagaacccgcatgcagcc

SEQ ID NO: 594620 - DNA, 25 bp, Rattus norvegicus
gcagccccgccttactgaagggaaa

SEQ ID NO: 594621 - DNA, 25 bp, Rattus norvegicus
gacaccctaaacatcttctggggcc

SEQ ID NO: 594622 - DNA, 25 bp, Rattus norvegicus
aggcgacaccctaaacatcttctgg

SEQ ID NO: 594623 - DNA, 25 bp, Rattus norvegicus
cccacgcacacacaaggcgacaccc

SEQ ID NO: 594624 - DNA, 25 bp, Rattus norvegicus
attgggtcaggccagctgaggtccc

SEQ ID NO: 594625 - DNA, 25 bp, Rattus norvegicus
ttccgagagattgggtcaggccagc

SEQ ID NO: 594626 - DNA, 25 bp, Rattus norvegicus
cattccgagagattgggtcaggcca

SEQ ID NO: 594627 - DNA, 25 bp, Rattus norvegicus
ttccgacattccgagagattgggtc

SEQ ID NO: 594628 - DNA, 25 bp, Rattus norvegicus
gagcgcaagcgtgggcttccgacat

SEQ ID NO: 594629 - DNA, 25 bp, Rattus norvegicus
ctttccccgggaagtggatgaagtg

SEQ ID NO: 594630 - DNA, 25 bp, Rattus norvegicus
ttctggggccctcgactcaggactt

SEQ ID NO: 594631 - DNA, 25 bp, Rattus norvegicus
caagcgtgggcttccgacattccga

SEQ ID NO: 594632 - DNA, 25 bp, Rattus norvegicus
tgggcttccgacattccgagagatt

SEQ ID NO: 594633 - DNA, 25 bp, Rattus norvegicus
tggggccctcgactcaggacttacc

SEQ ID NO: 594634 - DNA, 25 bp, Rattus norvegicus
cctcgactcaggacttaccgtcttc

SEQ ID NO: 594635 - DNA, 25 bp, Rattus norvegicus
ccagcgggtccagcgcaataacttc

SEQ ID NO: 594636 - DNA, 25 bp, Rattus norvegicus
cctacccttttctgtgcgggcagcg

SEQ ID NO: 594637 - DNA, 25 bp, Rattus norvegicus
gggtccagcgcaataacttccctcg

SEQ ID NO: 594638 - DNA, 25 bp, Rattus norvegicus
gggtccgattgccttggcctctatc

SEQ ID NO: 594639 - DNA, 25 bp, Rattus norvegicus
gcggcagctttctgcacgggtggag

SEQ ID NO: 594640 - DNA, 25 bp, Rattus norvegicus
cggcgcccagcgcagactgaggtgc

SEQ ID NO: 594641 - DNA, 25 bp, Rattus norvegicus
agagccgagaagctaacgggtccgg

SEQ ID NO: 594642 - DNA, 25 bp, Rattus norvegicus
acccttttctgtgcgggcagcgggc

SEQ ID NO: 594643 - DNA, 25 bp, Rattus norvegicus
gatccagcgggtccagcgcaataac

SEQ ID NO: 594644 - DNA, 25 bp, Rattus norvegicus
gcgggtccagcgcaataacttccct

SEQ ID NO: 594645 - DNA, 25 bp, Rattus norvegicus
gtccagcgcaataacttccctcggg

SEQ ID NO: 594646 - DNA, 25 bp, Rattus norvegicus
agcgcaataacttccctcgggtctg

SEQ ID NO: 594647 - DNA, 25 bp, Rattus norvegicus
gcaataacttccctcgggtctgggc

SEQ ID NO: 594648 - DNA, 25 bp, Rattus norvegicus
gagcggcaagcatggcccgcgcggc

SEQ ID NO: 594649 - DNA, 25 bp, Rattus norvegicus
agctcactgcgggttttcttcgctc

SEQ ID NO: 594650 - DNA, 25 bp, Rattus norvegicus
tcgctctaggagcaaatcagcacta

SEQ ID NO: 594651 - DNA, 25 bp, Rattus norvegicus
atcgcccgcagcagactccagtgtg

SEQ ID NO: 594652 - DNA, 25 bp, Rattus norvegicus
gctggaaactgggtcctcctcagtc

SEQ ID NO: 594653 - DNA, 25 bp, Rattus norvegicus
gccaggccactgaccgacttgacag

SEQ ID NO: 594654 - DNA, 25 bp, Rattus norvegicus
gttgagtcccaacccgcgccaagtg

SEQ ID NO: 594655 - DNA, 25 bp, Rattus norvegicus
gcgccaagtgccactagtgcggagc

SEQ ID NO: 594656 - DNA, 25 bp, Rattus norvegicus
cactagtgcggagcggaaaaagacc

SEQ ID NO: 594657 - DNA, 25 bp, Rattus norvegicus
cggaaaaagacctgcgcgaagttga

SEQ ID NO: 594658 - DNA, 25 bp, Rattus norvegicus
gcgaagttgacgtcagttccggccc

SEQ ID NO: 594659 - DNA, 25 bp, Rattus norvegicus
ggcgctccgcccagaggaacataag

SEQ ID NO: 594660 - DNA, 25 bp, Rattus norvegicus
gcccagaggaacataagcgtgctta

SEQ ID NO: 594661 - DNA, 25 bp, Rattus norvegicus
ccaaactcggataagcagctcactg

SEQ ID NO: 594662 - DNA, 25 bp, Rattus norvegicus
cagcactaagtgatcgcccgcagca

SEQ ID NO: 594663 - DNA, 25 bp, Rattus norvegicus
gcccaagaatccgtggccatggtcc

SEQ ID NO: 594664 - DNA, 25 bp, Rattus norvegicus
tgtcgtcagagtcgcgtcagctctg

SEQ ID NO: 594665 - DNA, 25 bp, Rattus norvegicus
aacggcgcgccacggtgtcgtcaga

SEQ ID NO: 594666 - DNA, 25 bp, Rattus norvegicus
ctcagaagaccggaaacggcgcgcc

SEQ ID NO: 594667 - DNA, 25 bp, Rattus norvegicus
ctcgtccactgctagggcccaagaa

SEQ ID NO: 594668 - DNA, 25 bp, Rattus norvegicus
attcaccgccgctcagaagaccgga

SEQ ID NO: 594669 - DNA, 25 bp, Rattus norvegicus
gggaaatcattcaccgccgctcaga

SEQ ID NO: 594670 - DNA, 25 bp, Rattus norvegicus
gtgtcagagaggtccagcaccgccc

SEQ ID NO: 594671 - DNA, 25 bp, Rattus norvegicus
caaccgcggactcaggtgggtgtca

SEQ ID NO: 594672 - DNA, 25 bp, Rattus norvegicus
cttgggcggtgcaaccgcggactca

SEQ ID NO: 594673 - DNA, 25 bp, Rattus norvegicus
gtttgcccgcttgggcggtgcaacc

SEQ ID NO: 594674 - DNA, 25 bp, Rattus norvegicus
ctgctagggcccaagaatccgtggc

SEQ ID NO: 594675 - DNA, 25 bp, Rattus norvegicus
gcagcgctggcaggtttgcccgctt

SEQ ID NO: 594676 - DNA, 25 bp, Rattus norvegicus
ggatccagcgccactaccgtcttct

SEQ ID NO: 594677 - DNA, 25 bp, Rattus norvegicus
ccttcggagccttgaaagtggtgta

SEQ ID NO: 594678 - DNA, 25 bp, Rattus norvegicus
ggcgtgagaatggaccaataatatt

SEQ ID NO: 594679 - DNA, 25 bp, Rattus norvegicus
atattagtggatggcaaggcgtagc

SEQ ID NO: 594680 - DNA, 25 bp, Rattus norvegicus
aaggcgtagcgggtcacttttcatc

SEQ ID NO: 594681 - DNA, 25 bp, Rattus norvegicus
ggtcacttttcatcagagcgctctg

SEQ ID NO: 594682 - DNA, 25 bp, Rattus norvegicus
cgcatctgagggagcaggtaactgc

SEQ ID NO: 594683 - DNA, 25 bp, Rattus norvegicus
accctggggagaaaagcgagccctg

SEQ ID NO: 594684 - DNA, 25 bp, Rattus norvegicus
gcgagccctgagagctctacgagaa

SEQ ID NO: 594685 - DNA, 25 bp, Rattus norvegicus
gggacccaggctccgcaggagcaca

SEQ ID NO: 594686 - DNA, 25 bp, Rattus norvegicus
ccgcaggagcacaatctcgagagta

SEQ ID NO: 594687 - DNA, 25 bp, Rattus norvegicus
gtagcttttgctattccttcggagc

SEQ ID NO: 594688 - DNA, 25 bp, Rattus norvegicus
gacttgcggaggaccaagaccttga

SEQ ID NO: 594689 - DNA, 25 bp, Rattus norvegicus
gcttgttagctcattcgcgctccga

SEQ ID NO: 594690 - DNA, 25 bp, Rattus norvegicus
gcgctccgaatgattggcgtgagaa

SEQ ID NO: 594691 - DNA, 25 bp, Rattus norvegicus
ggccactgccagtttgcgtagatgc

SEQ ID NO: 594692 - DNA, 25 bp, Rattus norvegicus
aagcggctgcacatggccactgcca

SEQ ID NO: 594693 - DNA, 25 bp, Rattus norvegicus
aatgtctccaagaagggagatgcac

SEQ ID NO: 594694 - DNA, 25 bp, Rattus norvegicus
ggtggaagtcgcctcagaaatgtct

SEQ ID NO: 594695 - DNA, 25 bp, Rattus norvegicus
aggccggtggaagtcgcctcagaaa

SEQ ID NO: 594696 - DNA, 25 bp, Rattus norvegicus
cacatggccactgccagtttgcgta

SEQ ID NO: 594697 - DNA, 25 bp, Rattus norvegicus
ggaagtccgtaggtccgcagcggct

SEQ ID NO: 594698 - DNA, 25 bp, Rattus norvegicus
acagccttgcaaggaagttggggaa

SEQ ID NO: 594699 - DNA, 25 bp, Rattus norvegicus
tcccacagccttgcaaggaagttgg

SEQ ID NO: 594700 - DNA, 25 bp, Rattus norvegicus
tgctcccacagccttgcaaggaagt

SEQ ID NO: 594701 - DNA, 25 bp, Rattus norvegicus
acaggaagagcgtaaaagtggacga

SEQ ID NO: 594702 - DNA, 25 bp, Rattus norvegicus
cccacaggaagagcgtaaaagtgga

SEQ ID NO: 594703 - DNA, 25 bp, Rattus norvegicus
gctgcacatggccactgccagtttg

SEQ ID NO: 594704 - DNA, 25 bp, Rattus norvegicus
cactgccagtttgcgtagatgcggc

SEQ ID NO: 594705 - DNA, 25 bp, Rattus norvegicus
ggtcgcttgctctgcgatttccgtc

SEQ ID NO: 594706 - DNA, 25 bp, Rattus norvegicus
aagtagctcgtacgccggtagccgc

SEQ ID NO: 594707 - DNA, 25 bp, Rattus norvegicus
cgcgggcgcgtatctttaagcgagc

SEQ ID NO: 594708 - DNA, 25 bp, Rattus norvegicus
taagggctcagcctacctggaagcg

SEQ ID NO: 594709 - DNA, 25 bp, Rattus norvegicus
gcttaggacgctaccctcgtgctca

SEQ ID NO: 594710 - DNA, 25 bp, Rattus norvegicus
tcgtgctcaactcgaggtgtccgcg

SEQ ID NO: 594711 - DNA, 25 bp, Rattus norvegicus
gaggagcattctgaggccggcctca

SEQ ID NO: 594712 - DNA, 25 bp, Rattus norvegicus
tcatgcccgtgctcaatcaggtggc

SEQ ID NO: 594713 - DNA, 25 bp, Rattus norvegicus
gccagactgagagttggaccgatgc

SEQ ID NO: 594714 - DNA, 25 bp, Rattus norvegicus
tctacccggtgttgcagcagtgctt

SEQ ID NO: 594715 - DNA, 25 bp, Rattus norvegicus
cccgccctgattggaaaacttgagc

SEQ ID NO: 594716 - DNA, 25 bp, Rattus norvegicus
aaaacttgagcgacgaggatgcgga

SEQ ID NO: 594717 - DNA, 25 bp, Rattus norvegicus
cggaggactgctatcgcccttttct

SEQ ID NO: 594718 - DNA, 25 bp, Rattus norvegicus
cgaagaagacgagacgcccgctgct

SEQ ID NO: 594719 - DNA, 25 bp, Rattus norvegicus
gctctggctcggctctgatgcccag

SEQ ID NO: 594720 - DNA, 25 bp, Rattus norvegicus
ggcgagacccaaacaagcccacgtg

SEQ ID NO: 594721 - DNA, 25 bp, Rattus norvegicus
cgcaagccgccaactaggcagagga

SEQ ID NO: 594722 - DNA, 25 bp, Rattus norvegicus
cggcagcagcttcccgcacgcaagc

SEQ ID NO: 594723 - DNA, 25 bp, Rattus norvegicus
agcgaccaccggcagagacctggct

SEQ ID NO: 594724 - DNA, 25 bp, Rattus norvegicus
cacaccgggtcgaggctctggctcg

SEQ ID NO: 594725 - DNA, 25 bp, Rattus norvegicus
ggctctgatgcccaggctctacacg

SEQ ID NO: 594726 - DNA, 25 bp, Rattus norvegicus
atgcccaggctctacacggaaacgg

SEQ ID NO: 594727 - DNA, 25 bp, Rattus norvegicus
ggcctggcggcagacgatcacccga

SEQ ID NO: 594728 - DNA, 25 bp, Rattus norvegicus
ggacagagaacagcgaccaccggca

SEQ ID NO: 594729 - DNA, 25 bp, Rattus norvegicus
aagttctgccaaagcccagcacgga

SEQ ID NO: 594730 - DNA, 25 bp, Rattus norvegicus
taagcgacgcgcagggacagagaac

SEQ ID NO: 594731 - DNA, 25 bp, Rattus norvegicus
cccagcacggaaaggccttaagcga

SEQ ID NO: 594732 - DNA, 25 bp, Rattus norvegicus
acggaaaggccttaagcgacgcgca

SEQ ID NO: 594733 - DNA, 25 bp, Rattus norvegicus
cgggtccggcgccagaattcagcca

SEQ ID NO: 594734 - DNA, 25 bp, Rattus norvegicus
ggcctcgggaaccggtgtctgccac

SEQ ID NO: 594735 - DNA, 25 bp, Rattus norvegicus
cgcatctctgcaggtggaaaggttt

SEQ ID NO: 594736 - DNA, 25 bp, Rattus norvegicus
gtctctgaggcggtgccacgggtcc

SEQ ID NO: 594737 - DNA, 25 bp, Rattus norvegicus
ccggcgccagaattcagccagcgga

SEQ ID NO: 594738 - DNA, 25 bp, Rattus norvegicus
cgccagaattcagccagcggagctg

SEQ ID NO: 594739 - DNA, 25 bp, Rattus norvegicus
cagaattcagccagcggagctgtga

SEQ ID NO: 594740 - DNA, 25 bp, Rattus norvegicus
gggctcgcacctgctgtcacggtca

SEQ ID NO: 594741 - DNA, 25 bp, Rattus norvegicus
ccacctcgaaacgtgcggtttggct

SEQ ID NO: 594742 - DNA, 25 bp, Rattus norvegicus
gcacctgctgtcacggtcagctgtc

SEQ ID NO: 594743 - DNA, 25 bp, Rattus norvegicus
ggtcagctgtcaccgcatctctgca

SEQ ID NO: 594744 - DNA, 25 bp, Rattus norvegicus
acctcgaaacgtgcggtttggctgc

SEQ ID NO: 594745 - DNA, 25 bp, Rattus norvegicus
ctgtcaccgcatctctgcaggtgga

SEQ ID NO: 594746 - DNA, 25 bp, Rattus norvegicus
ccgcatctctgcaggtggaaaggtt

SEQ ID NO: 594747 - DNA, 25 bp, Rattus norvegicus
ccgtgtagagcctgggcatcagagc

SEQ ID NO: 594748 - DNA, 25 bp, Rattus norvegicus
cctcctctgcctagttggcggcttg

SEQ ID NO: 594749 - DNA, 25 bp, Rattus norvegicus
gtcgcttaaggcctttccgtgctgg

SEQ ID NO: 594750 - DNA, 25 bp, Rattus norvegicus
ccgtttccgtgtagagcctgggcat

SEQ ID NO: 594751 - DNA, 25 bp, Rattus norvegicus
cgtgctgggctttggcagaacttgt

SEQ ID NO: 594752 - DNA, 25 bp, Rattus norvegicus
ggcatcagagccgagccagagcctc

SEQ ID NO: 594753 - DNA, 25 bp, Rattus norvegicus
cgagccagagcctcgacccggtgtg

SEQ ID NO: 594754 - DNA, 25 bp, Rattus norvegicus
cgggtgatcgtctgccgccaggcct

SEQ ID NO: 594755 - DNA, 25 bp, Rattus norvegicus
agccaggtctctgccggtggtcgct

SEQ ID NO: 594756 - DNA, 25 bp, Rattus norvegicus
tctctgccggtggtcgctgttctct

SEQ ID NO: 594757 - DNA, 25 bp, Rattus norvegicus
gtcgctgttctctgtccctgcgcgt

SEQ ID NO: 594758 - DNA, 25 bp, Rattus norvegicus
ttctctgtccctgcgcgtcgcttaa

SEQ ID NO: 594759 - DNA, 25 bp, Rattus norvegicus
acgtgggcttgtttgggtctcgcca

SEQ ID NO: 594760 - DNA, 25 bp, Rattus norvegicus
taaggcctttccgtgctgggctttg

SEQ ID NO: 594761 - DNA, 25 bp, Rattus norvegicus
aagacaggagcgcaaacagaaacac

SEQ ID NO: 594762 - DNA, 25 bp, Rattus norvegicus
cttgctcgaatgcaccggggagtga

SEQ ID NO: 594763 - DNA, 25 bp, Rattus norvegicus
tgggatccgcttgctcgaatgcacc

SEQ ID NO: 594764 - DNA, 25 bp, Rattus norvegicus
cgacaaggagcgaaataagggactg

SEQ ID NO: 594765 - DNA, 25 bp, Rattus norvegicus
gaacaccgcgacaaggagcgaaata

SEQ ID NO: 594766 - DNA, 25 bp, Rattus norvegicus
ctgatcccagaacaccgcgacaagg

SEQ ID NO: 594767 - DNA, 25 bp, Rattus norvegicus
tactgaggccgtgagccgaggtcct

SEQ ID NO: 594768 - DNA, 25 bp, Rattus norvegicus
ttcgcctactgaggccgtgagccga

SEQ ID NO: 594769 - DNA, 25 bp, Rattus norvegicus
acagaaacacgctccttaggccttc

SEQ ID NO: 594770 - DNA, 25 bp, Rattus norvegicus
gcatcacacaaaagacaggagcgca

SEQ ID NO: 594771 - DNA, 25 bp, Rattus norvegicus
taaactggttttcggcgaggagcca

SEQ ID NO: 594772 - DNA, 25 bp, Rattus norvegicus
tccttaggccttcgcctactgaggc

SEQ ID NO: 594773 - DNA, 25 bp, Rattus norvegicus
gccactctgcatagagcatcacaca

SEQ ID NO: 594774 - DNA, 25 bp, Rattus norvegicus
ggcgaggagccactctgcatagagc

SEQ ID NO: 594775 - DNA, 25 bp, Rattus norvegicus
ggacatgtttgcaccacgcttctta

SEQ ID NO: 594776 - DNA, 25 bp, Rattus norvegicus
gcagattcccgcctcagttgacctg

SEQ ID NO: 594777 - DNA, 25 bp, Rattus norvegicus
agcagcagcaagctcgcagattccc

SEQ ID NO: 594778 - DNA, 25 bp, Rattus norvegicus
cccaaaagaaacgaagccagccagc

SEQ ID NO: 594779 - DNA, 25 bp, Rattus norvegicus
ggttcaggaccgcacacccaaaaga

SEQ ID NO: 594780 - DNA, 25 bp, Rattus norvegicus
acacttccggtaccgcgggcttctg

SEQ ID NO: 594781 - DNA, 25 bp, Rattus norvegicus
tccggcggcgagaacacttccggta

SEQ ID NO: 594782 - DNA, 25 bp, Rattus norvegicus
gaaagttccgaacccgagctgcgag

SEQ ID NO: 594783 - DNA, 25 bp, Rattus norvegicus
ctgccagggaccagtttaacctcga

SEQ ID NO: 594784 - DNA, 25 bp, Rattus norvegicus
ggagtcctaatgtacggagcaggtc

SEQ ID NO: 594785 - DNA, 25 bp, Rattus norvegicus
gcacgcccagaatgctcatcttttc

SEQ ID NO: 594786 - DNA, 25 bp, Rattus norvegicus
acgcttcttatctcactgccaggga

SEQ ID NO: 594787 - DNA, 25 bp, Rattus norvegicus
tttaacctcgaagcggaagctgggc

SEQ ID NO: 594788 - DNA, 25 bp, Rattus norvegicus
gctcatcttttcgatccgggacatg

SEQ ID NO: 594789 - DNA, 25 bp, Rattus norvegicus
atgaagggcccacgccctataccgg

SEQ ID NO: 594790 - DNA, 25 bp, Rattus norvegicus
gtaggggcaccgtggtacaaatctc

SEQ ID NO: 594791 - DNA, 25 bp, Rattus norvegicus
cgtggtacaaatctctcgattgtcg

SEQ ID NO: 594792 - DNA, 25 bp, Rattus norvegicus
caccgtggtacaaatctctcgattg

SEQ ID NO: 594793 - DNA, 25 bp, Rattus norvegicus
aggggcaccgtggtacaaatctctc

SEQ ID NO: 594794 - DNA, 25 bp, Rattus norvegicus
tgctggggctgcttagaaaacccgg

SEQ ID NO: 594795 - DNA, 25 bp, Rattus norvegicus
aactgctggggctgcttagaaaacc

SEQ ID NO: 594796 - DNA, 25 bp, Rattus norvegicus
ccttcccggaggaactgctggggct

SEQ ID NO: 594797 - DNA, 25 bp, Rattus norvegicus
ctttccttcccggaggaactgctgg

SEQ ID NO: 594798 - DNA, 25 bp, Rattus norvegicus
cctataccgggctggcgggaaagtg

SEQ ID NO: 594799 - DNA, 25 bp, Rattus norvegicus
tgaaaaacggggatgcgctatgaag

SEQ ID NO: 594800 - DNA, 25 bp, Rattus norvegicus
atgcgctatgaagggcccacgccct

SEQ ID NO: 594801 - DNA, 25 bp, Rattus norvegicus
ggatgcgctatgaagggcccacgcc

SEQ ID NO: 594802 - DNA, 25 bp, Rattus norvegicus
gggcaccgtggtacaaatctctcga

SEQ ID NO: 594803 - DNA, 25 bp, Rattus norvegicus
tcggtgcaagccgaatgccgcctca

SEQ ID NO: 594804 - DNA, 25 bp, Rattus norvegicus
gaaggcgcctccagcaattggtaga

SEQ ID NO: 594805 - DNA, 25 bp, Rattus norvegicus
cttgatactttactgggcgagaacc

SEQ ID NO: 594806 - DNA, 25 bp, Rattus norvegicus
agtagtgacgccctcattggccagc

SEQ ID NO: 594807 - DNA, 25 bp, Rattus norvegicus
ggtcgccgccactgaagtagtgacg

SEQ ID NO: 594808 - DNA, 25 bp, Rattus norvegicus
cacggacggcgaccaatatcttctc

SEQ ID NO: 594809 - DNA, 25 bp, Rattus norvegicus
tattggtcaaccaacacggacggcg

SEQ ID NO: 594810 - DNA, 25 bp, Rattus norvegicus
cggcttagcgagctcctattggtca

SEQ ID NO: 594811 - DNA, 25 bp, Rattus norvegicus
taccgcgcacagtgagcaactcttc

SEQ ID NO: 594812 - DNA, 25 bp, Rattus norvegicus
aaggagaccgccgagttcccagagc

SEQ ID NO: 594813 - DNA, 25 bp, Rattus norvegicus
ctactccgtacagggccagcaatcg

SEQ ID NO: 594814 - DNA, 25 bp, Rattus norvegicus
cgcgcgagaagcaattggagaacta

SEQ ID NO: 594815 - DNA, 25 bp, Rattus norvegicus
tggtagaaacccgagtctgccctct

SEQ ID NO: 594816 - DNA, 25 bp, Rattus norvegicus
agcctacttcactgggccgcgcgag

SEQ ID NO: 594817 - DNA, 25 bp, Rattus norvegicus
gtcggcactgatgtcctggccagcc

SEQ ID NO: 594818 - DNA, 25 bp, Rattus norvegicus
tcgcagttcgcccacatagtactgc

SEQ ID NO: 594819 - DNA, 25 bp, Rattus norvegicus
tgctcatttgcatgccgtgctctca

SEQ ID NO: 594820 - DNA, 25 bp, Rattus norvegicus
atgccgtgctctcattggccactcg

SEQ ID NO: 594821 - DNA, 25 bp, Rattus norvegicus
atagtactgctccagccagcggcga

SEQ ID NO: 594822 - DNA, 25 bp, Rattus norvegicus
cggcgagcgttgtccgagtgtttat

SEQ ID NO: 594823 - DNA, 25 bp, Rattus norvegicus
gttcgcccacatagtactgctccag

SEQ ID NO: 594824 - DNA, 25 bp, Rattus norvegicus
gtggcccatccaggtcggcactgat

SEQ ID NO: 594825 - DNA, 25 bp, Rattus norvegicus
gatgatgccgcacgaagccggtgag

SEQ ID NO: 594826 - DNA, 25 bp, Rattus norvegicus
gatctcggagcccggcagtctgctc

SEQ ID NO: 594827 - DNA, 25 bp, Rattus norvegicus
cagcgcgcctctaacatctcgggag

SEQ ID NO: 594828 - DNA, 25 bp, Rattus norvegicus
ctaacatctcgggagccggggcagc

SEQ ID NO: 594829 - DNA, 25 bp, Rattus norvegicus
cgcacctgctcatttgcatgccgtg

SEQ ID NO: 594830 - DNA, 25 bp, Rattus norvegicus
ccgagtgtttatgaggtggcccatc

SEQ ID NO: 594831 - DNA, 25 bp, Rattus norvegicus
agctcacctgagagtcccgaaactc

SEQ ID NO: 594832 - DNA, 25 bp, Rattus norvegicus
cctgagtttagagagcagacgccgc

SEQ ID NO: 594833 - DNA, 25 bp, Rattus norvegicus
gttacccagtaagagcctgagttta

SEQ ID NO: 594834 - DNA, 25 bp, Rattus norvegicus
ggtcagcgtcagttacccagtaaga

SEQ ID NO: 594835 - DNA, 25 bp, Rattus norvegicus
tgtagtcaaatgtcaggtcagcgtc

SEQ ID NO: 594836 - DNA, 25 bp, Rattus norvegicus
gccgtgagctctgccgggaattgta

SEQ ID NO: 594837 - DNA, 25 bp, Rattus norvegicus
gtcatcagtacgagtcacccgggca

SEQ ID NO: 594838 - DNA, 25 bp, Rattus norvegicus
ccgatgatagatcccgcctcttctg

SEQ ID NO: 594839 - DNA, 25 bp, Rattus norvegicus
caacgcattggctactccgatgata

SEQ ID NO: 594840 - DNA, 25 bp, Rattus norvegicus
cctttcacttgaccgcaacgcattg

SEQ ID NO: 594841 - DNA, 25 bp, Rattus norvegicus
agccagctaataaatccggccacgc

SEQ ID NO: 594842 - DNA, 25 bp, Rattus norvegicus
tctcacaagcccgaccgtggggtgc

SEQ ID NO: 594843 - DNA, 25 bp, Rattus norvegicus
gcgcatgctcagacggctccattta

SEQ ID NO: 594844 - DNA, 25 bp, Rattus norvegicus
caagacccgagactccctaggttag

SEQ ID NO: 594845 - DNA, 25 bp, Rattus norvegicus
cggcttggacagtttgaaattctta

SEQ ID NO: 594846 - DNA, 25 bp, Rattus norvegicus
ctctcatggtctcaacggcggcgag

SEQ ID NO: 594847 - DNA, 25 bp, Rattus norvegicus
ctgtggcgcgaaggcgcccgcttct

SEQ ID NO: 594848 - DNA, 25 bp, Rattus norvegicus
gaccgcgcgtctttcggacctatag

SEQ ID NO: 594849 - DNA, 25 bp, Rattus norvegicus
acatgcattcggcttggacagtttg

SEQ ID NO: 594850 - DNA, 25 bp, Rattus norvegicus
ccacctatgcccacggcaatggtta

SEQ ID NO: 594851 - DNA, 25 bp, Rattus norvegicus
gctctccacccgcttctgagtggtg

SEQ ID NO: 594852 - DNA, 25 bp, Rattus norvegicus
gggtctctaccgatgacagcgccgt

SEQ ID NO: 594853 - DNA, 25 bp, Rattus norvegicus
cactttgggcactaccggacgggcg

SEQ ID NO: 594854 - DNA, 25 bp, Rattus norvegicus
cagtcgctcggtcagctcggtggca

SEQ ID NO: 594855 - DNA, 25 bp, Rattus norvegicus
gaggggtgccctttagcctctacac

SEQ ID NO: 594856 - DNA, 25 bp, Rattus norvegicus
gggtccacgtcggactccacctatg

SEQ ID NO: 594857 - DNA, 25 bp, Rattus norvegicus
tcggacctatagaagaacatgcatt

SEQ ID NO: 594858 - DNA, 25 bp, Rattus norvegicus
cggcaatggttaccaagagaccggc

SEQ ID NO: 594859 - DNA, 25 bp, Rattus norvegicus
tctgtctagggatccgctgtcgcag

SEQ ID NO: 594860 - DNA, 25 bp, Rattus norvegicus
tggaggggacctacacaccctactc

SEQ ID NO: 594861 - DNA, 25 bp, Rattus norvegicus
gactcctatggaggggacctacaca

SEQ ID NO: 594862 - DNA, 25 bp, Rattus norvegicus
gcgagcacagcatgactcctatgga

SEQ ID NO: 594863 - DNA, 25 bp, Rattus norvegicus
gcttcgcgcacctgtaggttctgtc

SEQ ID NO: 594864 - DNA, 25 bp, Rattus norvegicus
ccgggacgcacacttccgagatcgt

SEQ ID NO: 594865 - DNA, 25 bp, Rattus norvegicus
tcccgagcgtcgtaggctcgcgatc

SEQ ID NO: 594866 - DNA, 25 bp, Rattus norvegicus
ctcgcgatcgctatggcggagttcc

SEQ ID NO: 594867 - DNA, 25 bp, Rattus norvegicus
aaccttgcaccctgggacggtcgtg

SEQ ID NO: 594868 - DNA, 25 bp, Rattus norvegicus
tccgagatcgtctggaaccttgcac

SEQ ID NO: 594869 - DNA, 25 bp, Rattus norvegicus
gttcccgtcgaaagtgagcaccagg

SEQ ID NO: 594870 - DNA, 25 bp, Rattus norvegicus
atctgtgtctgcgatgcgaccggac

SEQ ID NO: 594871 - DNA, 25 bp, Rattus norvegicus
gtgtgacagccctgcgagcacagca

SEQ ID NO: 594872 - DNA, 25 bp, Rattus norvegicus
accggacctgggctttgtgcgctcc

SEQ ID NO: 594873 - DNA, 25 bp, Rattus norvegicus
ctcatgatggcttagtgggctcctg

SEQ ID NO: 594874 - DNA, 25 bp, Rattus norvegicus
cgagctctggtgagtcggttcctaa

SEQ ID NO: 594875 - DNA, 25 bp, Rattus norvegicus
cctccaggtatgtatgcaaggccgg

SEQ ID NO: 594876 - DNA, 25 bp, Rattus norvegicus
tccacaatctgcacgcttgcgcaaa

SEQ ID NO: 594877 - DNA, 25 bp, Rattus norvegicus
gcttgcgcaaaagccctagtggttg

SEQ ID NO: 594878 - DNA, 25 bp, Rattus norvegicus
acctacagtcgcgagtgggtgacag

SEQ ID NO: 594879 - DNA, 25 bp, Rattus norvegicus
tttgtcaggagacgcaccactgctg

SEQ ID NO: 594880 - DNA, 25 bp, Rattus norvegicus
aggctccagcctccctttgtcagga

SEQ ID NO: 594881 - DNA, 25 bp, Rattus norvegicus
cggaattatcacgtccatcccgtta

SEQ ID NO: 594882 - DNA, 25 bp, Rattus norvegicus
agtcggttcctaagggctgctcccg

SEQ ID NO: 594883 - DNA, 25 bp, Rattus norvegicus
cgcttgacccttcaggagggtttga

SEQ ID NO: 594884 - DNA, 25 bp, Rattus norvegicus
ttcgtggtggtgcttagtgtttcca

SEQ ID NO: 594885 - DNA, 25 bp, Rattus norvegicus
ccagttatattgtcgcggaattatc

SEQ ID NO: 594886 - DNA, 25 bp, Rattus norvegicus
tgggctcctggaacctccttggttc

SEQ ID NO: 594887 - DNA, 25 bp, Rattus norvegicus
cgccggtttgcagccctcagcaaat

SEQ ID NO: 594888 - DNA, 25 bp, Rattus norvegicus
gcagccctcagcaaatctcggtttc

SEQ ID NO: 594889 - DNA, 25 bp, Rattus norvegicus
accctgctagcgaaggtcctctgaa

SEQ ID NO: 594890 - DNA, 25 bp, Rattus norvegicus
ggctactgcgggttgcggacatccc

SEQ ID NO: 594891 - DNA, 25 bp, Rattus norvegicus
cctatgcaaatacaccgaggtgggc

SEQ ID NO: 594892 - DNA, 25 bp, Rattus norvegicus
ttcatggtgctccacggccagaggc

SEQ ID NO: 594893 - DNA, 25 bp, Rattus norvegicus
acactcaccaggtacttcatggtgc

SEQ ID NO: 594894 - DNA, 25 bp, Rattus norvegicus
acgtgccgagctgcccggtaactct

SEQ ID NO: 594895 - DNA, 25 bp, Rattus norvegicus
gggactcgtttacgtgccgagctgc

SEQ ID NO: 594896 - DNA, 25 bp, Rattus norvegicus
ggcgtcacgctagctccgtgagctg

SEQ ID NO: 594897 - DNA, 25 bp, Rattus norvegicus
agtctcaggcaacccggacccaagg

SEQ ID NO: 594898 - DNA, 25 bp, Rattus norvegicus
ctgcataccgcctcgggctgagtct

SEQ ID NO: 594899 - DNA, 25 bp, Rattus norvegicus
ctcggtttctcagtccctctgcata

SEQ ID NO: 594900 - DNA, 25 bp, Rattus norvegicus
aggtcctctgaagacgccactcagc

SEQ ID NO: 594901 - DNA, 25 bp, Rattus norvegicus
aaagccgtgtcagagatgccggtta

SEQ ID NO: 594902 - DNA, 25 bp, Rattus norvegicus
tggaaaagccgtgtcagagatgccg

SEQ ID NO: 594903 - DNA, 25 bp, Rattus norvegicus
agatgccggttatggggcggtgccc

SEQ ID NO: 594904 - DNA, 25 bp, Rattus norvegicus
cacctcggcttgaaaagaacctccg

SEQ ID NO: 594905 - DNA, 25 bp, Rattus norvegicus
tcggcttgaaaagaacctccggcga

SEQ ID NO: 594906 - DNA, 25 bp, Rattus norvegicus
gggagcagggtctcaggcggtcagc

SEQ ID NO: 594907 - DNA, 25 bp, Rattus norvegicus
aggcggtcagcactcaccggcacgg

SEQ ID NO: 594908 - DNA, 25 bp, Rattus norvegicus
ggtcagcactcaccggcacggtcat

SEQ ID NO: 594909 - DNA, 25 bp, Rattus norvegicus
agcactcaccggcacggtcatcttg

SEQ ID NO: 594910 - DNA, 25 bp, Rattus norvegicus
gcactcaccggcacggtcatcttgg

SEQ ID NO: 594911 - DNA, 25 bp, Rattus norvegicus
ggcacggtcatcttggccaccgctc

SEQ ID NO: 594912 - DNA, 25 bp, Rattus norvegicus
cccgtcctactcggctgtcctggag

SEQ ID NO: 594913 - DNA, 25 bp, Rattus norvegicus
gctggaaaagccgtgtcagagatgc

SEQ ID NO: 594914 - DNA, 25 bp, Rattus norvegicus
agccgtgtcagagatgccggttatg

SEQ ID NO: 594915 - DNA, 25 bp, Rattus norvegicus
cctcgtccgatgtggagaaatcttc

SEQ ID NO: 594916 - DNA, 25 bp, Rattus norvegicus
gttggtcgttctacactctccgggc

SEQ ID NO: 594917 - DNA, 25 bp, Rattus norvegicus
acacttccggctgttgcggttggtc

SEQ ID NO: 594918 - DNA, 25 bp, Rattus norvegicus
catgcgtagacggtgtcacgtgata

SEQ ID NO: 594919 - DNA, 25 bp, Rattus norvegicus
agcgaagctctagggcgagaccata

SEQ ID NO: 594920 - DNA, 25 bp, Rattus norvegicus
ttccatgctgctgtcacttggggcc

SEQ ID NO: 594921 - DNA, 25 bp, Rattus norvegicus
atggcacgtagtcctcatcctcgtc

SEQ ID NO: 594922 - DNA, 25 bp, Rattus norvegicus
gtgaagcgtgagaaccaccctcttt

SEQ ID NO: 594923 - DNA, 25 bp, Rattus norvegicus
tcctgaggaccggaactccagagcc

SEQ ID NO: 594924 - DNA, 25 bp, Rattus norvegicus
gtgcagaaccgacacacacgtgttc

SEQ ID NO: 594925 - DNA, 25 bp, Rattus norvegicus
cccaggagaacagctgtgcagaacc

SEQ ID NO: 594926 - DNA, 25 bp, Rattus norvegicus
cttcagggcgatagaccgtacgctc

SEQ ID NO: 594927 - DNA, 25 bp, Rattus norvegicus
gggtcggcttctagaacgcttcagg

SEQ ID NO: 594928 - DNA, 25 bp, Rattus norvegicus
gggcctgctaccaacacgactgcgg

SEQ ID NO: 594929 - DNA, 25 bp, Rattus norvegicus
ggacgagctctcactgtctgagcca

SEQ ID NO: 594930 - DNA, 25 bp, Rattus norvegicus
gctcgctgccttgactggctggacc

SEQ ID NO: 594931 - DNA, 25 bp, Rattus norvegicus
gtaggtttcgaacgcgcagtgttca

SEQ ID NO: 594932 - DNA, 25 bp, Rattus norvegicus
ttttggcggtcgcagcttgacgcct

SEQ ID NO: 594933 - DNA, 25 bp, Rattus norvegicus
cagcaaaggtaagcccgccggggct

SEQ ID NO: 594934 - DNA, 25 bp, Rattus norvegicus
tgtgactcgctcctgcagcaaaggt

SEQ ID NO: 594935 - DNA, 25 bp, Rattus norvegicus
tcattcccgggtaccctctgtgact

SEQ ID NO: 594936 - DNA, 25 bp, Rattus norvegicus
gtgcacgcatcgtgtacctacaccg

SEQ ID NO: 594937 - DNA, 25 bp, Rattus norvegicus
gggcatcattcgctccgtgcacgca

SEQ ID NO: 594938 - DNA, 25 bp, Rattus norvegicus
tgtctgagccaaaccgaaccgggcc

SEQ ID NO: 594939 - DNA, 25 bp, Rattus norvegicus
ttcgtcgaggtaggacgagctctca

SEQ ID NO: 594940 - DNA, 25 bp, Rattus norvegicus
agtgcgcactactccttcgtcgagg

SEQ ID NO: 594941 - DNA, 25 bp, Rattus norvegicus
tgtttagatttcttcgcggcgccgc

SEQ ID NO: 594942 - DNA, 25 bp, Rattus norvegicus
ggaacccagcatctcgggcatcatt

SEQ ID NO: 594943 - DNA, 25 bp, Rattus norvegicus
ccaagcctgggatacactgagcgca

SEQ ID NO: 594944 - DNA, 25 bp, Rattus norvegicus
cttgaaactgtccatgcctcgtggc

SEQ ID NO: 594945 - DNA, 25 bp, Rattus norvegicus
cccgagccatgggtgatgttgtaaa

SEQ ID NO: 594946 - DNA, 25 bp, Rattus norvegicus
ccaggcggtagcgatcttgcaagaa

SEQ ID NO: 594947 - DNA, 25 bp, Rattus norvegicus
ggcttgtgcaatgctacctctgcga

SEQ ID NO: 594948 - DNA, 25 bp, Rattus norvegicus
tggtacccaggacgatgccattgtc

SEQ ID NO: 594949 - DNA, 25 bp, Rattus norvegicus
gcgcacctccttgagcactacgtga

SEQ ID NO: 594950 - DNA, 25 bp, Rattus norvegicus
cgcgttgcacacagaggcttacaca

SEQ ID NO: 594951 - DNA, 25 bp, Rattus norvegicus
tgcccactggaagagatccgagata

SEQ ID NO: 594952 - DNA, 25 bp, Rattus norvegicus
ggtaggcatcgaacacgtccatgtc

SEQ ID NO: 594953 - DNA, 25 bp, Rattus norvegicus
cgtccatgtcgcataggaacactga

SEQ ID NO: 594954 - DNA, 25 bp, Rattus norvegicus
tgccaagctggctccatcaggtaga

SEQ ID NO: 594955 - DNA, 25 bp, Rattus norvegicus
agaggtcccgttgctcaagctccga

SEQ ID NO: 594956 - DNA, 25 bp, Rattus norvegicus
ctggacccggcgaatcttggcaaag

SEQ ID NO: 594957 - DNA, 25 bp, Rattus norvegicus
gggcgcatacaatgagcagctcagt

SEQ ID NO: 594958 - DNA, 25 bp, Rattus norvegicus
caacccggaccgtgtctggccacgc

SEQ ID NO: 594959 - DNA, 25 bp, Rattus norvegicus
agccagttggcctggagctcctcta

SEQ ID NO: 594960 - DNA, 25 bp, Rattus norvegicus
aagcagccagttggcctggagctcc

SEQ ID NO: 594961 - DNA, 25 bp, Rattus norvegicus
tcagtgagtggtggctctttgcctg

SEQ ID NO: 594962 - DNA, 25 bp, Rattus norvegicus
ctcagtgagtggtggctctttgcct

SEQ ID NO: 594963 - DNA, 25 bp, Rattus norvegicus
gcgcatacaatgagcagctcagtga

SEQ ID NO: 594964 - DNA, 25 bp, Rattus norvegicus
gcgcttctgtgctgctctgcgctgc

SEQ ID NO: 594965 - DNA, 25 bp, Rattus norvegicus
cggggcgcatacaatgagcagctca

SEQ ID NO: 594966 - DNA, 25 bp, Rattus norvegicus
cccggggcgcatacaatgagcagct

SEQ ID NO: 594967 - DNA, 25 bp, Rattus norvegicus
ccgcccggggcgcatacaatgagca

SEQ ID NO: 594968 - DNA, 25 bp, Rattus norvegicus
gctgcgcttctgtgctgctctgcgc

SEQ ID NO: 594969 - DNA, 25 bp, Rattus norvegicus
gcagctcagtgagtggtggctcttt

SEQ ID NO: 594970 - DNA, 25 bp, Rattus norvegicus
ctgccggctgcgcttctgtgctgct

SEQ ID NO: 594971 - DNA, 25 bp, Rattus norvegicus
tgagagaagagatggtacagcgcca

SEQ ID NO: 594972 - DNA, 25 bp, Rattus norvegicus
gaaccacgcaccgacacgagcggaa

SEQ ID NO: 594973 - DNA, 25 bp, Rattus norvegicus
acacgagcggaacgcgcaggtgaac

SEQ ID NO: 594974 - DNA, 25 bp, Rattus norvegicus
gagccaccagcagcacttggtgctg

SEQ ID NO: 594975 - DNA, 25 bp, Rattus norvegicus
gcacttggtgctggaagcgcacgtt

SEQ ID NO: 594976 - DNA, 25 bp, Rattus norvegicus
cgcacgttcggctgctcctcgtagt

SEQ ID NO: 594977 - DNA, 25 bp, Rattus norvegicus
gctcctcgtagttgctgcgcttcag

SEQ ID NO: 594978 - DNA, 25 bp, Rattus norvegicus
gggcgggaaccacgcaccgacacga

SEQ ID NO: 594979 - DNA, 25 bp, Rattus norvegicus
tgcgcttcagccaaaaccctgcggg

SEQ ID NO: 594980 - DNA, 25 bp, Rattus norvegicus
aaccctgcgggagacaaggcgtgtt

SEQ ID NO: 594981 - DNA, 25 bp, Rattus norvegicus
tccagacccaggcaggcttaccgtg

SEQ ID NO: 594982 - DNA, 25 bp, Rattus norvegicus
caggcttaccgtggctccggaaggc

SEQ ID NO: 594983 - DNA, 25 bp, Rattus norvegicus
ctccggaaggccaccagcaacgggg

SEQ ID NO: 594984 - DNA, 25 bp, Rattus norvegicus
aagagatggtacagcgccatgagcc

SEQ ID NO: 594985 - DNA, 25 bp, Rattus norvegicus
gtcagcctgatttacttctttccca

SEQ ID NO: 594986 - DNA, 25 bp, Rattus norvegicus
accctgctgtcacccttagtgtctt

SEQ ID NO: 594987 - DNA, 25 bp, Rattus norvegicus
ttctttcccagaacacagatgcgtg

SEQ ID NO: 594988 - DNA, 25 bp, Rattus norvegicus
ctgctggcagttcctgaggggatct

SEQ ID NO: 594989 - DNA, 25 bp, Rattus norvegicus
accactcgctgggtaagcgaggcag

SEQ ID NO: 594990 - DNA, 25 bp, Rattus norvegicus
tgccgagtagtcgtcgctgccgccg

SEQ ID NO: 594991 - DNA, 25 bp, Rattus norvegicus
ccttagtgtcttggagaggtgtcga

SEQ ID NO: 594992 - DNA, 25 bp, Rattus norvegicus
gctgtcacccttagtgtcttggaga

SEQ ID NO: 594993 - DNA, 25 bp, Rattus norvegicus
tgatgcatttaccaggcccgccgga

SEQ ID NO: 594994 - DNA, 25 bp, Rattus norvegicus
cccgggcggttgctaggctccagca

SEQ ID NO: 594995 - DNA, 25 bp, Rattus norvegicus
taggctccagcagccggaagtcccg

SEQ ID NO: 594996 - DNA, 25 bp, Rattus norvegicus
gaagtcccgcctgccgagtagtcgt

SEQ ID NO: 594997 - DNA, 25 bp, Rattus norvegicus
aggtggcgattgtcagcctgattta

SEQ ID NO: 594998 - DNA, 25 bp, Rattus norvegicus
tccgcggatcctgctggcagttcct

SEQ ID NO: 594999 - DNA, 25 bp, Rattus norvegicus
cactgacgcagacgatgtggccatc

SEQ ID NO: 595000 - DNA, 25 bp, Rattus norvegicus
cccagaagctcaaacggaaggcgga

SEQ ID NO: 595001 - DNA, 25 bp, Rattus norvegicus
catgtcgttttacgtgcggcccagc

SEQ ID NO: 595002 - DNA, 25 bp, Rattus norvegicus
ggctgtcaacgctcatcctgcacgg

SEQ ID NO: 595003 - DNA, 25 bp, Rattus norvegicus
cgggcgacttcatctccacgcagta

SEQ ID NO: 595004 - DNA, 25 bp, Rattus norvegicus
cgggcgcattgcctacactgacgca

SEQ ID NO: 595005 - DNA, 25 bp, Rattus norvegicus
tgtggccatcctaacctacgtaaag

SEQ ID NO: 595006 - DNA, 25 bp, Rattus norvegicus
ggaaaatgcccgttcgcccagctca

SEQ ID NO: 595007 - DNA, 25 bp, Rattus norvegicus
ccagctcagtcacaggcaatgcctt

SEQ ID NO: 595008 - DNA, 25 bp, Rattus norvegicus
agcactcctggcagtcgctcaagga

SEQ ID NO: 595009 - DNA, 25 bp, Rattus norvegicus
gtcgctcaaggaccgctacctcaag

SEQ ID NO: 595010 - DNA, 25 bp, Rattus norvegicus
tgcagggccaggagcacaagtacct

SEQ ID NO: 595011 - DNA, 25 bp, Rattus norvegicus
acaagtacctgctcgggaacgctcc

SEQ ID NO: 595012 - DNA, 25 bp, Rattus norvegicus
cagtacatcctagactgcgtggagc

SEQ ID NO: 595013 - DNA, 25 bp, Rattus norvegicus
tgagctgcagccagtcgttgttata

SEQ ID NO: 595014 - DNA, 25 bp, Rattus norvegicus
ggcacaccgcttccggagcggaatc

SEQ ID NO: 595015 - DNA, 25 bp, Rattus norvegicus
ggcatccgatcgttttttacgctgc

SEQ ID NO: 595016 - DNA, 25 bp, Rattus norvegicus
cgttttttacgctgcatcctagaga

SEQ ID NO: 595017 - DNA, 25 bp, Rattus norvegicus
gccagtcgttgttatagtcaaggta

SEQ ID NO: 595018 - DNA, 25 bp, Rattus norvegicus
ttgccacggtcgctctgagctgcag

SEQ ID NO: 595019 - DNA, 25 bp, Rattus norvegicus
tcttctgtgattgccacggtcgctc

SEQ ID NO: 595020 - DNA, 25 bp, Rattus norvegicus
tcagacgtcttctgtgattgccacg

SEQ ID NO: 595021 - DNA, 25 bp, Rattus norvegicus
cagagaaggttttgcgtcagacgtc

SEQ ID NO: 595022 - DNA, 25 bp, Rattus norvegicus
gcagcttcgcagagaaggttttgcg

SEQ ID NO: 595023 - DNA, 25 bp, Rattus norvegicus
caaacattggttgggcagcttcgca

SEQ ID NO: 595024 - DNA, 25 bp, Rattus norvegicus
gataacagacgggaagcaaaggaag

SEQ ID NO: 595025 - DNA, 25 bp, Rattus norvegicus
ctgcatcctagagataacagacggg

SEQ ID NO: 595026 - DNA, 25 bp, Rattus norvegicus
caaggtaaatgagcctgagagaccc

SEQ ID NO: 595027 - DNA, 25 bp, Rattus norvegicus
gcgggatttactcaccgcatcctgg

SEQ ID NO: 595028 - DNA, 25 bp, Rattus norvegicus
tcaaccgcatcaaggacccgcagaa

SEQ ID NO: 595029 - DNA, 25 bp, Rattus norvegicus
caaggacagcgcgaagctctcttcc

SEQ ID NO: 595030 - DNA, 25 bp, Rattus norvegicus
tggccacgtcacttacaaggacagc

SEQ ID NO: 595031 - DNA, 25 bp, Rattus norvegicus
tcggtgacatatgcccgcgggaaga

SEQ ID NO: 595032 - DNA, 25 bp, Rattus norvegicus
ggaagcgctggtaatcggtgacata

SEQ ID NO: 595033 - DNA, 25 bp, Rattus norvegicus
tttgctgacggccaagattgaggcc

SEQ ID NO: 595034 - DNA, 25 bp, Rattus norvegicus
cagctcaaggcctctggggtttgct

SEQ ID NO: 595035 - DNA, 25 bp, Rattus norvegicus
tcaggagtggctttatacaggcggt

SEQ ID NO: 595036 - DNA, 25 bp, Rattus norvegicus
cctagcgggtaactggatcaggagt

SEQ ID NO: 595037 - DNA, 25 bp, Rattus norvegicus
gtccatcgtagaggcgccgcagtct

SEQ ID NO: 595038 - DNA, 25 bp, Rattus norvegicus
ctcttcctctaaggcgtccatcgta

SEQ ID NO: 595039 - DNA, 25 bp, Rattus norvegicus
ttaacgccacacctatctgctggtg

SEQ ID NO: 595040 - DNA, 25 bp, Rattus norvegicus
tctgctggtgagtgtgaccacacgc

SEQ ID NO: 595041 - DNA, 25 bp, Rattus norvegicus
cccacggatggcaataggtatcaaa

SEQ ID NO: 595042 - DNA, 25 bp, Rattus norvegicus
ccggacgggaaagatttcagcgcaa

SEQ ID NO: 595043 - DNA, 25 bp, Rattus norvegicus
tctgtccgtatgaagaaagacgccg

SEQ ID NO: 595044 - DNA, 25 bp, Rattus norvegicus
caataggtatcaaaggcggtgcttg

SEQ ID NO: 595045 - DNA, 25 bp, Rattus norvegicus
gtgcataccgtaagtgtttcgttta

SEQ ID NO: 595046 - DNA, 25 bp, Rattus norvegicus
aggtgttcgggtgtgcataccgtaa

SEQ ID NO: 595047 - DNA, 25 bp, Rattus norvegicus
cgtgtactatagactccagccttca

SEQ ID NO: 595048 - DNA, 25 bp, Rattus norvegicus
ggtaccctgaaatcaactctgtccg

SEQ ID NO: 595049 - DNA, 25 bp, Rattus norvegicus
cgcggacagcgtcgtgtactataga

SEQ ID NO: 595050 - DNA, 25 bp, Rattus norvegicus
atcgcgatgcgcatcgaggtgttcg

SEQ ID NO: 595051 - DNA, 25 bp, Rattus norvegicus
gccttcaatcaaagccaggtttctg

SEQ ID NO: 595052 - DNA, 25 bp, Rattus norvegicus
ggtttctgcgcttcattcctctgga

SEQ ID NO: 595053 - DNA, 25 bp, Rattus norvegicus
tcctctggaatggaacccgaagggc

SEQ ID NO: 595054 - DNA, 25 bp, Rattus norvegicus
aacccgaagggcagaatcgcgatgc

SEQ ID NO: 595055 - DNA, 25 bp, Rattus norvegicus
aacgcagcttgtggcggccattggc

SEQ ID NO: 595056 - DNA, 25 bp, Rattus norvegicus
taccgctgtgaaaccggaagtgtcc

SEQ ID NO: 595057 - DNA, 25 bp, Rattus norvegicus
ggtcatgtttttgaatgtcgcgatc

SEQ ID NO: 595058 - DNA, 25 bp, Rattus norvegicus
agggtgcaagtgtttggtcatgttt

SEQ ID NO: 595059 - DNA, 25 bp, Rattus norvegicus
gagcgtcacccgtccgaaagtgtcg

SEQ ID NO: 595060 - DNA, 25 bp, Rattus norvegicus
aatgtctcgtgtttgcggaagccca

SEQ ID NO: 595061 - DNA, 25 bp, Rattus norvegicus
cccgggaggcatcgcttccggaagt

SEQ ID NO: 595062 - DNA, 25 bp, Rattus norvegicus
actccggggagtaaataccgctgtg

SEQ ID NO: 595063 - DNA, 25 bp, Rattus norvegicus
cgcgatctgtcgaaaaccgtagggg

SEQ ID NO: 595064 - DNA, 25 bp, Rattus norvegicus
tcgcgcggattccagagttccggaa

SEQ ID NO: 595065 - DNA, 25 bp, Rattus norvegicus
ctcttggtccaaggagtgggccgct

SEQ ID NO: 595066 - DNA, 25 bp, Rattus norvegicus
cggctcctggaagtgttgctgtcca

SEQ ID NO: 595067 - DNA, 25 bp, Rattus norvegicus
cttcaggcggtagctcttggtccaa

SEQ ID NO: 595068 - DNA, 25 bp, Rattus norvegicus
cgcgctatcttctcggtgagggaac

SEQ ID NO: 595069 - DNA, 25 bp, Rattus norvegicus
tgcgggatgccctgggcacactact

SEQ ID NO: 595070 - DNA, 25 bp, Rattus norvegicus
gcgtggcccgcatcttcgcacataa

SEQ ID NO: 595071 - DNA, 25 bp, Rattus norvegicus
gcatcttcgcacataagcagaacta

SEQ ID NO: 595072 - DNA, 25 bp, Rattus norvegicus
taagcagaactatgacctacgtcgc

SEQ ID NO: 595073 - DNA, 25 bp, Rattus norvegicus
tatgacctacgtcgcctgctggctg

SEQ ID NO: 595074 - DNA, 25 bp, Rattus norvegicus
tgctggctggctcagagcgtacact

SEQ ID NO: 595075 - DNA, 25 bp, Rattus norvegicus
agcgtacactggaccggctcctgga

SEQ ID NO: 595076 - DNA, 25 bp, Rattus norvegicus
tcctggacagtgtggagcaagaccc

SEQ ID NO: 595077 - DNA, 25 bp, Rattus norvegicus
cgtgcgctgtgtgcctctggcccgt

SEQ ID NO: 595078 - DNA, 25 bp, Rattus norvegicus
gggcacactactgcggcgctgtaca

SEQ ID NO: 595079 - DNA, 25 bp, Rattus norvegicus
cctggccttgtcagtgctggctgtt

SEQ ID NO: 595080 - DNA, 25 bp, Rattus norvegicus
tgttggcggtcgactgataacggca

SEQ ID NO: 595081 - DNA, 25 bp, Rattus norvegicus
cggcagcccaagagaggaatgtgct

SEQ ID NO: 595082 - DNA, 25 bp, Rattus norvegicus
tggagcaagacccaggcgccctgct

SEQ ID NO: 595083 - DNA, 25 bp, Rattus norvegicus
gggcagcagtgccaacggcagctcc

SEQ ID NO: 595084 - DNA, 25 bp, Rattus norvegicus
gcgggcaagcttccgccctcctctg

SEQ ID NO: 595085 - DNA, 25 bp, Rattus norvegicus
cattggcccgccgagggcaattcgc

SEQ ID NO: 595086 - DNA, 25 bp, Rattus norvegicus
ccgagggcaattcgcgagcaccatt

SEQ ID NO: 595087 - DNA, 25 bp, Rattus norvegicus
caattcgcgagcaccattggctaag

SEQ ID NO: 595088 - DNA, 25 bp, Rattus norvegicus
cattggctaagagtggacgtccgtc

SEQ ID NO: 595089 - DNA, 25 bp, Rattus norvegicus
tccggcccagacacgccaccctgca

SEQ ID NO: 595090 - DNA, 25 bp, Rattus norvegicus
cgtaccctacctcgctcggctctgg

SEQ ID NO: 595091 - DNA, 25 bp, Rattus norvegicus
tgttgaccgactcgcctcaggaggg

SEQ ID NO: 595092 - DNA, 25 bp, Rattus norvegicus
taagagtggacgtccgtcagagcta

SEQ ID NO: 595093 - DNA, 25 bp, Rattus norvegicus
gcacggctcaaccaagcctagagtg

SEQ ID NO: 595094 - DNA, 25 bp, Rattus norvegicus
atcccagcgagctcgagtccgcgcc

SEQ ID NO: 595095 - DNA, 25 bp, Rattus norvegicus
cgtggctgttgaccgactcgcctca

SEQ ID NO: 595096 - DNA, 25 bp, Rattus norvegicus
atgccgcttcccgtcctgccacggt

SEQ ID NO: 595097 - DNA, 25 bp, Rattus norvegicus
tgctgcggtgaagctccggaaacac

SEQ ID NO: 595098 - DNA, 25 bp, Rattus norvegicus
tgaagctccggaaacacaggcccgc

SEQ ID NO: 595099 - DNA, 25 bp, Rattus norvegicus
aggctgcggagttcccctgtccttc

SEQ ID NO: 595100 - DNA, 25 bp, Rattus norvegicus
ctcttcagagaagctataaaaagcg

SEQ ID NO: 595101 - DNA, 25 bp, Rattus norvegicus
gccagcagtgctgcggtgaagctcc

SEQ ID NO: 595102 - DNA, 25 bp, Rattus norvegicus
ctcacgagcccgcattcacagcgcc

SEQ ID NO: 595103 - DNA, 25 bp, Rattus norvegicus
cgcaccctgagcgaacgcggcccac

SEQ ID NO: 595104 - DNA, 25 bp, Rattus norvegicus
tagccgtcgtagctgccgctttgtt

SEQ ID NO: 595105 - DNA, 25 bp, Rattus norvegicus
cgtcgtagccgtcgtagctgccgct

SEQ ID NO: 595106 - DNA, 25 bp, Rattus norvegicus
cattaccggtcgtggccgtcgtagc

SEQ ID NO: 595107 - DNA, 25 bp, Rattus norvegicus
acaccattaccggtcgtggccgtcg

SEQ ID NO: 595108 - DNA, 25 bp, Rattus norvegicus
tccctgtgacccgtgtggacccgga

SEQ ID NO: 595109 - DNA, 25 bp, Rattus norvegicus
agcgtccggggttgcgcttacctct

SEQ ID NO: 595110 - DNA, 25 bp, Rattus norvegicus
ttgcgcttacctctcctgtgggcct

SEQ ID NO: 595111 - DNA, 25 bp, Rattus norvegicus
ccaccgaagcacagcagaggcagca

SEQ ID NO: 595112 - DNA, 25 bp, Rattus norvegicus
cgaatctgcagcacccgtggctagg

SEQ ID NO: 595113 - DNA, 25 bp, Rattus norvegicus
gcggagtacccacagagatcaaata

SEQ ID NO: 595114 - DNA, 25 bp, Rattus norvegicus
caaagagcgtgggatttctgggact

SEQ ID NO: 595115 - DNA, 25 bp, Rattus norvegicus
ttcgtccgagctcctgtgcggcaaa

SEQ ID NO: 595116 - DNA, 25 bp, Rattus norvegicus
ctagggagctctgacggtgatgctc

SEQ ID NO: 595117 - DNA, 25 bp, Rattus norvegicus
aggggctcccagagccgaatctgca

SEQ ID NO: 595118 - DNA, 25 bp, Rattus norvegicus
aggtcgctcacatggcagcactgga

SEQ ID NO: 595119 - DNA, 25 bp, Rattus norvegicus
caggtgcgagtcaccaaggtcgctc

SEQ ID NO: 595120 - DNA, 25 bp, Rattus norvegicus
aacaggagggcgcactccatggtca

SEQ ID NO: 595121 - DNA, 25 bp, Rattus norvegicus
gctggagcgcctgcaagaaagaaaa

SEQ ID NO: 595122 - DNA, 25 bp, Rattus norvegicus
tacgaaccatcatttaatccgctgc

SEQ ID NO: 595123 - DNA, 25 bp, Rattus norvegicus
ctgccgctgtcactggctaaggcga

SEQ ID NO: 595124 - DNA, 25 bp, Rattus norvegicus
atcagagtgattgtgtgcggctcgc

SEQ ID NO: 595125 - DNA, 25 bp, Rattus norvegicus
ctggtccagtatccacgactttttg

SEQ ID NO: 595126 - DNA, 25 bp, Rattus norvegicus
tcaagatccgcgtcaaagcctggtc

SEQ ID NO: 595127 - DNA, 25 bp, Rattus norvegicus
cagatgatcgagaaggagaccagca

SEQ ID NO: 595128 - DNA, 25 bp, Rattus norvegicus
caccgcctcggggatgcccaggaat

SEQ ID NO: 595129 - DNA, 25 bp, Rattus norvegicus
gcgggctcaacaagctgaggctctc

SEQ ID NO: 595130 - DNA, 25 bp, Rattus norvegicus
ggctctccagaaaggccatgccgga

SEQ ID NO: 595131 - DNA, 25 bp, Rattus norvegicus
tttttctctctttacgcgctgggcg

SEQ ID NO: 595132 - DNA, 25 bp, Rattus norvegicus
cggaggagaccgaacagatgatcga

SEQ ID NO: 595133 - DNA, 25 bp, Rattus norvegicus
acctcgcgcaccatggccaaggaag

SEQ ID NO: 595134 - DNA, 25 bp, Rattus norvegicus
ccacattcaacaggaggaacccgcg

SEQ ID NO: 595135 - DNA, 25 bp, Rattus norvegicus
ttgcactgaagagcatcccacattc

SEQ ID NO: 595136 - DNA, 25 bp, Rattus norvegicus
cgcggctcctctgaggattacggca

SEQ ID NO: 595137 - DNA, 25 bp, Rattus norvegicus
cacaggacggcgagctcaagatccg

SEQ ID NO: 595138 - DNA, 25 bp, Rattus norvegicus
ccgctcacagaggttgcagccattg

SEQ ID NO: 595139 - DNA, 25 bp, Rattus norvegicus
acacggacagtgaggatgagctgcc

SEQ ID NO: 595140 - DNA, 25 bp, Rattus norvegicus
ggtcaaggtccggtcacctggccac

SEQ ID NO: 595141 - DNA, 25 bp, Rattus norvegicus
agattgccagtctcctgtcccaggg

SEQ ID NO: 595142 - DNA, 25 bp, Rattus norvegicus
gcgggcacgcgcatccagattgcca

SEQ ID NO: 595143 - DNA, 25 bp, Rattus norvegicus
agcggcgttcctgagagccgtgtcc

SEQ ID NO: 595144 - DNA, 25 bp, Rattus norvegicus
ctacgccaagtaagcggcctggagc

SEQ ID NO: 595145 - DNA, 25 bp, Rattus norvegicus
aggagagaaccaccaaggacggctg

SEQ ID NO: 595146 - DNA, 25 bp, Rattus norvegicus
agctctgcgctatgcgggcctggat

SEQ ID NO: 595147 - DNA, 25 bp, Rattus norvegicus
tatctccagcatggcagctctgcgc

SEQ ID NO: 595148 - DNA, 25 bp, Rattus norvegicus
agcaggcggctacttctatctccag

SEQ ID NO: 595149 - DNA, 25 bp, Rattus norvegicus
gctgctcactgtgtggcactgcacc

SEQ ID NO: 595150 - DNA, 25 bp, Rattus norvegicus
gtcgccgcgaaaccaggaaactgga

SEQ ID NO: 595151 - DNA, 25 bp, Rattus norvegicus
ggaaactggattgcagctgcggacc

SEQ ID NO: 595152 - DNA, 25 bp, Rattus norvegicus
cggctgggtgtactacgccaagtaa

SEQ ID NO: 595153 - DNA, 25 bp, Rattus norvegicus
tttcggcgcagtgcgcacagtgcgc

SEQ ID NO: 595154 - DNA, 25 bp, Rattus norvegicus
cgcacgtgatcctggcctgtaggaa

SEQ ID NO: 595155 - DNA, 25 bp, Rattus norvegicus
ggccaagtccttcgccctccatggt

SEQ ID NO: 595156 - DNA, 25 bp, Rattus norvegicus
acagtgcgctgctcttggaacgaca

SEQ ID NO: 595157 - DNA, 25 bp, Rattus norvegicus
acacaccgcaggctgagtgcatgga

SEQ ID NO: 595158 - DNA, 25 bp, Rattus norvegicus
tcaaatccgtacacaccgcaggctg

SEQ ID NO: 595159 - DNA, 25 bp, Rattus norvegicus
cctggcctgtaggaacatgagcaga

SEQ ID NO: 595160 - DNA, 25 bp, Rattus norvegicus
agtgctcagatgcttagttcgctaa

SEQ ID NO: 595161 - DNA, 25 bp, Rattus norvegicus
ttctggaggaatgggtaagtgctca

SEQ ID NO: 595162 - DNA, 25 bp, Rattus norvegicus
gccgtgtcccgcattctggaggaat

SEQ ID NO: 595163 - DNA, 25 bp, Rattus norvegicus
agcagagccagcgaggccgtgtccc

SEQ ID NO: 595164 - DNA, 25 bp, Rattus norvegicus
tgtaggaacatgagcagagccagcg

SEQ ID NO: 595165 - DNA, 25 bp, Rattus norvegicus
agttcgctaactgtcaaatccgtac

SEQ ID NO: 595166 - DNA, 25 bp, Rattus norvegicus
cgctgctcttggaacgacatcttcg

SEQ ID NO: 595167 - DNA, 25 bp, Rattus norvegicus
tgaggcccaacttgcaagcgatgtg

SEQ ID NO: 595168 - DNA, 25 bp, Rattus norvegicus
tttgagatttatgaggcccaacttg

SEQ ID NO: 595169 - DNA, 25 bp, Rattus norvegicus
tgcgcttcgactgggtttgagattt

SEQ ID NO: 595170 - DNA, 25 bp, Rattus norvegicus
gaacatttcgtttcgtgcgcttcga

SEQ ID NO: 595171 - DNA, 25 bp, Rattus norvegicus
atctgcgccttctaagaacatttcg

SEQ ID NO: 595172 - DNA, 25 bp, Rattus norvegicus
tctcatttaatgtatctgcgccttc

SEQ ID NO: 595173 - DNA, 25 bp, Rattus norvegicus
gcccaacttgcaagcgatgtgcgcc

SEQ ID NO: 595174 - DNA, 25 bp, Rattus norvegicus
ggcgtcggtattgtttgcgtgatta

SEQ ID NO: 595175 - DNA, 25 bp, Rattus norvegicus
ggtgccgaagctctcatttaatgta

SEQ ID NO: 595176 - DNA, 25 bp, Rattus norvegicus
actttaagatcggagagaggcgtcg

SEQ ID NO: 595177 - DNA, 25 bp, Rattus norvegicus
aggggatactttaagatcggagaga

SEQ ID NO: 595178 - DNA, 25 bp, Rattus norvegicus
gcgagggtgctttccgagaaaagga

SEQ ID NO: 595179 - DNA, 25 bp, Rattus norvegicus
ccgtggtgccgaagctctcatttaa

SEQ ID NO: 595180 - DNA, 25 bp, Rattus norvegicus
gcgtgattaatgagtccgtggtgcc

SEQ ID NO: 595181 - DNA, 25 bp, Rattus norvegicus
gctcgtccgagaagcggtcgtcgaa

SEQ ID NO: 595182 - DNA, 25 bp, Rattus norvegicus
gcccgaaagctcgagcgtgcacaca

SEQ ID NO: 595183 - DNA, 25 bp, Rattus norvegicus
tgccagttctgaagccatcctcctg

SEQ ID NO: 595184 - DNA, 25 bp, Rattus norvegicus
ggtcggaattgttcattgccagttc

SEQ ID NO: 595185 - DNA, 25 bp, Rattus norvegicus
aacatattccatggccaggggactg

SEQ ID NO: 595186 - DNA, 25 bp, Rattus norvegicus
tcagatcgaagtcattaacatattc

SEQ ID NO: 595187 - DNA, 25 bp, Rattus norvegicus
atgcggtcggtctccaccggttcct

SEQ ID NO: 595188 - DNA, 25 bp, Rattus norvegicus
agacggccgcactggctgatgatgc

SEQ ID NO: 595189 - DNA, 25 bp, Rattus norvegicus
gtgcgccttctgttcgctgcccgag

SEQ ID NO: 595190 - DNA, 25 bp, Rattus norvegicus
gtagtagtcttccaggtgcgccttc

SEQ ID NO: 595191 - DNA, 25 bp, Rattus norvegicus
agccggtcatccagtagtagtcttc

SEQ ID NO: 595192 - DNA, 25 bp, Rattus norvegicus
ctcgactgcgtcctccgggctgaag

SEQ ID NO: 595193 - DNA, 25 bp, Rattus norvegicus
gcatagccatcgaagccaccctgga

SEQ ID NO: 595194 - DNA, 25 bp, Rattus norvegicus
tattgctgatgagcgcctcgactgc

SEQ ID NO: 595195 - DNA, 25 bp, Rattus norvegicus
tgctctcacgctgcagcgagcgatc

SEQ ID NO: 595196 - DNA, 25 bp, Rattus norvegicus
gcggtgcgcctgcagtgttattttt

SEQ ID NO: 595197 - DNA, 25 bp, Rattus norvegicus
gcgaagtttaatgcaccaagggaca

SEQ ID NO: 595198 - DNA, 25 bp, Rattus norvegicus
ctaaaagggcggctggaatccgatg

SEQ ID NO: 595199 - DNA, 25 bp, Rattus norvegicus
cttcagagtttgagagaggcctgcc

SEQ ID NO: 595200 - DNA, 25 bp, Rattus norvegicus
tccctccgcaagtgaggtgatcaga

SEQ ID NO: 595201 - DNA, 25 bp, Rattus norvegicus
gagcgatccgccaagaactccctgg

SEQ ID NO: 595202 - DNA, 25 bp, Rattus norvegicus
tggtcccgcaccctaacaaggtgta

SEQ ID NO: 595203 - DNA, 25 bp, Rattus norvegicus
aggtgtattcattcgtcttgcagtt

SEQ ID NO: 595204 - DNA, 25 bp, Rattus norvegicus
tcttgcagttttcgatctttgattc

SEQ ID NO: 595205 - DNA, 25 bp, Rattus norvegicus
ctctgcatccttcgtggccgttgag

SEQ ID NO: 595206 - DNA, 25 bp, Rattus norvegicus
gagccgagtgcctttcttccctgaa

SEQ ID NO: 595207 - DNA, 25 bp, Rattus norvegicus
ttcttccctgaatcggacgctccgg

SEQ ID NO: 595208 - DNA, 25 bp, Rattus norvegicus
ggggccaacttgactcaactctttg

SEQ ID NO: 595209 - DNA, 25 bp, Rattus norvegicus
ggtgaacggcccaatcagatctctc

SEQ ID NO: 595210 - DNA, 25 bp, Rattus norvegicus
tgactttcactagctccggggccca

SEQ ID NO: 595211 - DNA, 25 bp, Rattus norvegicus
cgactcctttgtgacaggtccaaga

SEQ ID NO: 595212 - DNA, 25 bp, Rattus norvegicus
ccaatcatcgttcaaggctcgtgtc

SEQ ID NO: 595213 - DNA, 25 bp, Rattus norvegicus
cgccaccctggaatgaactggttaa

SEQ ID NO: 595214 - DNA, 25 bp, Rattus norvegicus
aggaaccgctttcaggcgcctccag

SEQ ID NO: 595215 - DNA, 25 bp, Rattus norvegicus
cagatctctccatacggtctcgaag

SEQ ID NO: 595216 - DNA, 25 bp, Rattus norvegicus
ggtctcgaagcaccggatttccacg

SEQ ID NO: 595217 - DNA, 25 bp, Rattus norvegicus
agctgttgattggacgatgccgccg

SEQ ID NO: 595218 - DNA, 25 bp, Rattus norvegicus
aagtctgtttgcctcctttaagccg

SEQ ID NO: 595219 - DNA, 25 bp, Rattus norvegicus
agcggctgttctcttccctcacagg

SEQ ID NO: 595220 - DNA, 25 bp, Rattus norvegicus
cagccagagttaggattagggccca

SEQ ID NO: 595221 - DNA, 25 bp, Rattus norvegicus
tagggcccaggtttgtcttcagtcc

SEQ ID NO: 595222 - DNA, 25 bp, Rattus norvegicus
aaaccaggcttctcggccgaggaga

SEQ ID NO: 595223 - DNA, 25 bp, Rattus norvegicus
tcctgcttcttactacaggggtacc

SEQ ID NO: 595224 - DNA, 25 bp, Rattus norvegicus
gacgctgctgccactgggcgagtcc

SEQ ID NO: 595225 - DNA, 25 bp, Rattus norvegicus
cacccggaatgacctgcctgggctg

SEQ ID NO: 595226 - DNA, 25 bp, Rattus norvegicus
ccggaatgacctgcctgggctgcga

SEQ ID NO: 595227 - DNA, 25 bp, Rattus norvegicus
cggccagggcgcaggtatcaacctg

SEQ ID NO: 595228 - DNA, 25 bp, Rattus norvegicus
ggtatcaacctgcaggtctaaggca

SEQ ID NO: 595229 - DNA, 25 bp, Rattus norvegicus
ctcttcagtcctgcttcttactaca

SEQ ID NO: 595230 - DNA, 25 bp, Rattus norvegicus
ctcctcactgggcacaatcttagga

SEQ ID NO: 595231 - DNA, 25 bp, Rattus norvegicus
ctgggcacaatcttaggagaactgg

SEQ ID NO: 595232 - DNA, 25 bp, Rattus norvegicus
acaatcttaggagaactggtccctc

SEQ ID NO: 595233 - DNA, 25 bp, Rattus norvegicus
cttaggagaactggtccctcggagc

SEQ ID NO: 595234 - DNA, 25 bp, Rattus norvegicus
aggagaactggtccctcggagctga

SEQ ID NO: 595235 - DNA, 25 bp, Rattus norvegicus
gctgaggggcctttgcttccaggat

SEQ ID NO: 595236 - DNA, 25 bp, Rattus norvegicus
cctgcaggtctaaggcaagggagcc

SEQ ID NO: 595237 - DNA, 25 bp, Rattus norvegicus
agcgctcactgccaggaggagttca

SEQ ID NO: 595238 - DNA, 25 bp, Rattus norvegicus
ctaggttccgttccgactcggcatc

SEQ ID NO: 595239 - DNA, 25 bp, Rattus norvegicus
gctactggctcaagggctgctttac

SEQ ID NO: 595240 - DNA, 25 bp, Rattus norvegicus
cgatctcggcctaggagtgacacta

SEQ ID NO: 595241 - DNA, 25 bp, Rattus norvegicus
ggagccaggcctcagatctctacgg

SEQ ID NO: 595242 - DNA, 25 bp, Rattus norvegicus
gcttcagcgataccggttgggactc

SEQ ID NO: 595243 - DNA, 25 bp, Rattus norvegicus
cctgtccgtaagtagagcgactctg

SEQ ID NO: 595244 - DNA, 25 bp, Rattus norvegicus
tgcagtgccattccaccgaggctcg

SEQ ID NO: 595245 - DNA, 25 bp, Rattus norvegicus
ggagcccgcaactccctcaggagta

SEQ ID NO: 595246 - DNA, 25 bp, Rattus norvegicus
aggctgatggacacccgacactcac

SEQ ID NO: 595247 - DNA, 25 bp, Rattus norvegicus
tgggaagctgaagagccgcatcctc

SEQ ID NO: 595248 - DNA, 25 bp, Rattus norvegicus
caagtgagtgttcctagcaaaggtc

SEQ ID NO: 595249 - DNA, 25 bp, Rattus norvegicus
cgggcagacctcagcagtcactgtg

SEQ ID NO: 595250 - DNA, 25 bp, Rattus norvegicus
tggggatccagagcgttttccatcc

SEQ ID NO: 595251 - DNA, 25 bp, Rattus norvegicus
gacataccattgaagccattgggga

SEQ ID NO: 595252 - DNA, 25 bp, Rattus norvegicus
ggagccgagccaggactcagaactg

SEQ ID NO: 595253 - DNA, 25 bp, Rattus norvegicus
gaggctcgtgagttcccaccgacgc

SEQ ID NO: 595254 - DNA, 25 bp, Rattus norvegicus
tagctccgcccacactggaagactg

SEQ ID NO: 595255 - DNA, 25 bp, Rattus norvegicus
tcagaactggctgggcagtacgcaa

SEQ ID NO: 595256 - DNA, 25 bp, Rattus norvegicus
caccgccaaccttacatagggtctg

SEQ ID NO: 595257 - DNA, 25 bp, Rattus norvegicus
ggtcacctcgtcgtagtcccgcatg

SEQ ID NO: 595258 - DNA, 25 bp, Rattus norvegicus
cccgccaggaacacgatagacatac

SEQ ID NO: 595259 - DNA, 25 bp, Rattus norvegicus
tgtgaggcacaaggcaacggtgctc

SEQ ID NO: 595260 - DNA, 25 bp, Rattus norvegicus
cgcgctgctcaagttcacggtgtga

SEQ ID NO: 595261 - DNA, 25 bp, Rattus norvegicus
caacgggatactgtggttgcgccac

SEQ ID NO: 595262 - DNA, 25 bp, Rattus norvegicus
tccgtccttcgtctccaacgggata

SEQ ID NO: 595263 - DNA, 25 bp, Rattus norvegicus
cagctctgaggcacctgtcgtccgt

SEQ ID NO: 595264 - DNA, 25 bp, Rattus norvegicus
gggtgtggcttcattcgaccacgcc

SEQ ID NO: 595265 - DNA, 25 bp, Rattus norvegicus
ctgtttacccgggtgcggaggatga

SEQ ID NO: 595266 - DNA, 25 bp, Rattus norvegicus
agctgcctgtttacccgggtgcgga

SEQ ID NO: 595267 - DNA, 25 bp, Rattus norvegicus
caacgagctgcctgtttacccgggt

SEQ ID NO: 595268 - DNA, 25 bp, Rattus norvegicus
acacctcaacgagctgcctgtttac

SEQ ID NO: 595269 - DNA, 25 bp, Rattus norvegicus
acaacacctcaacgagctgcctgtt

SEQ ID NO: 595270 - DNA, 25 bp, Rattus norvegicus
cagcttctcggtggcgtgcccacaa

SEQ ID NO: 595271 - DNA, 25 bp, Rattus norvegicus
acgcacggagccagcagcttctcgg

SEQ ID NO: 595272 - DNA, 25 bp, Rattus norvegicus
cctgccacctgagcccgaccgagca

SEQ ID NO: 595273 - DNA, 25 bp, Rattus norvegicus
gggtttgcgcggtgccctgccacct

SEQ ID NO: 595274 - DNA, 25 bp, Rattus norvegicus
gccaccgactgcaggtgagcgggcc

SEQ ID NO: 595275 - DNA, 25 bp, Rattus norvegicus
cggatgctaatgagctcggaggccc

SEQ ID NO: 595276 - DNA, 25 bp, Rattus norvegicus
ccggccggatgctaatgagctcgga

SEQ ID NO: 595277 - DNA, 25 bp, Rattus norvegicus
acgtccggccggatgctaatgagct

SEQ ID NO: 595278 - DNA, 25 bp, Rattus norvegicus
cggaggatgagcgacaggtgatgcc

SEQ ID NO: 595279 - DNA, 25 bp, Rattus norvegicus
cccacgtgctgtcaggctcttcgag

SEQ ID NO: 595280 - DNA, 25 bp, Rattus norvegicus
agaaggttgcttccttccgcggctc

SEQ ID NO: 595281 - DNA, 25 bp, Rattus norvegicus
gctctgccgcccgtgaagtgtctag

SEQ ID NO: 595282 - DNA, 25 bp, Rattus norvegicus
acagccacttagacgctcctacggg

SEQ ID NO: 595283 - DNA, 25 bp, Rattus norvegicus
cgctagagccggactgttgccctag

SEQ ID NO: 595284 - DNA, 25 bp, Rattus norvegicus
ctgttgccctaggttacggccgcgt

SEQ ID NO: 595285 - DNA, 25 bp, Rattus norvegicus
gcagtcttgacggaagtgacgtaaa

SEQ ID NO: 595286 - DNA, 25 bp, Rattus norvegicus
tgacgtaaagcctcaacaaaacagc

SEQ ID NO: 595287 - DNA, 25 bp, Rattus norvegicus
aacagctcaagggaggaggctctct

SEQ ID NO: 595288 - DNA, 25 bp, Rattus norvegicus
ggactaaggagattcccgtcgcgca

SEQ ID NO: 595289 - DNA, 25 bp, Rattus norvegicus
cgcagttcgcggttgcttgctttac

SEQ ID NO: 595290 - DNA, 25 bp, Rattus norvegicus
ttgctgggtccctcctttgcctaaa

SEQ ID NO: 595291 - DNA, 25 bp, Rattus norvegicus
ctcttcgagggcttcgcaccgtcga

SEQ ID NO: 595292 - DNA, 25 bp, Rattus norvegicus
taaacgacgatttcgggcgactggc

SEQ ID NO: 595293 - DNA, 25 bp, Rattus norvegicus
ggcagggctatagctcgctctggcc

SEQ ID NO: 595294 - DNA, 25 bp, Rattus norvegicus
attccacttcggataggacaacgcg

SEQ ID NO: 595295 - DNA, 25 bp, Rattus norvegicus
ctctgattggacagcttgaagattc

SEQ ID NO: 595296 - DNA, 25 bp, Rattus norvegicus
ccaaggttccgagggtaactgcgct

SEQ ID NO: 595297 - DNA, 25 bp, Rattus norvegicus
catgatccaaggttccgagggtaac

SEQ ID NO: 595298 - DNA, 25 bp, Rattus norvegicus
ctcgcagcgacatgatccaaggttc

SEQ ID NO: 595299 - DNA, 25 bp, Rattus norvegicus
gcacactccttaccactcgcagcga

SEQ ID NO: 595300 - DNA, 25 bp, Rattus norvegicus
gatgcgcaggctgcaggccacagcc

SEQ ID NO: 595301 - DNA, 25 bp, Rattus norvegicus
agcaaagcagatccggtgcgcagcg

SEQ ID NO: 595302 - DNA, 25 bp, Rattus norvegicus
cttacccgagagcaaagcagatccg

SEQ ID NO: 595303 - DNA, 25 bp, Rattus norvegicus
gtgcctcgcacttacccgagagcaa

SEQ ID NO: 595304 - DNA, 25 bp, Rattus norvegicus
gcggtgaccacgtgcctcgcactta

SEQ ID NO: 595305 - DNA, 25 bp, Rattus norvegicus
ccagagtaagcggagcaccgaggcc

SEQ ID NO: 595306 - DNA, 25 bp, Rattus norvegicus
cagcttgaagattccacttcggata

SEQ ID NO: 595307 - DNA, 25 bp, Rattus norvegicus
ccgggatgtgcccaaaagctccaaa

SEQ ID NO: 595308 - DNA, 25 bp, Rattus norvegicus
ctctgcccgggaataatggacgtga

SEQ ID NO: 595309 - DNA, 25 bp, Rattus norvegicus
cgtgaacgtagcgaggcgtaactcc

SEQ ID NO: 595310 - DNA, 25 bp, Rattus norvegicus
ctcccgcgaaaggaataagtcttcg

SEQ ID NO: 595311 - DNA, 25 bp, Rattus norvegicus
actcgatcaccgaaactaggaattc

SEQ ID NO: 595312 - DNA, 25 bp, Rattus norvegicus
taggaattcgatcccgccgaaccgc

SEQ ID NO: 595313 - DNA, 25 bp, Rattus norvegicus
ttcccgcaccaagtctagaacgctg

SEQ ID NO: 595314 - DNA, 25 bp, Rattus norvegicus
caattccttaaaggcgccggccgca

SEQ ID NO: 595315 - DNA, 25 bp, Rattus norvegicus
aggcgcgttgttgaacttccagctc

SEQ ID NO: 595316 - DNA, 25 bp, Rattus norvegicus
ggagatcccggtgcagaagaacatc

SEQ ID NO: 595317 - DNA, 25 bp, Rattus norvegicus
atgcttctggcggactccacgctct

SEQ ID NO: 595318 - DNA, 25 bp, Rattus norvegicus
gcagaagtttacctccgactcaccg

SEQ ID NO: 595319 - DNA, 25 bp, Rattus norvegicus
aacacggtgtacaggccgtcctgga

SEQ ID NO: 595320 - DNA, 25 bp, Rattus norvegicus
tccagagcttcactcagtccgggcg

SEQ ID NO: 595321 - DNA, 25 bp, Rattus norvegicus
cgctgttgccgccattgacgtcaga

SEQ ID NO: 595322 - DNA, 25 bp, Rattus norvegicus
cagctttcagcccagccttgtacta

SEQ ID NO: 595323 - DNA, 25 bp, Rattus norvegicus
ctgttgccgccattgacgtcagagg

SEQ ID NO: 595324 - DNA, 25 bp, Rattus norvegicus
aggccgaagccgctgttgccgccat

SEQ ID NO: 595325 - DNA, 25 bp, Rattus norvegicus
tcgaacactacccacattccggggc

SEQ ID NO: 595326 - DNA, 25 bp, Rattus norvegicus
ctagggttcagctgtgcaccctcgg

SEQ ID NO: 595327 - DNA, 25 bp, Rattus norvegicus
agggctagggttcagctgtgcaccc

SEQ ID NO: 595328 - DNA, 25 bp, Rattus norvegicus
ttggtcatggacagactttatttcc

SEQ ID NO: 595329 - DNA, 25 bp, Rattus norvegicus
tcctcttggtcatggacagacttta

SEQ ID NO: 595330 - DNA, 25 bp, Rattus norvegicus
cggcatcctcttggtcatggacaga

SEQ ID NO: 595331 - DNA, 25 bp, Rattus norvegicus
gacagtcggcatcctcttggtcatg

SEQ ID NO: 595332 - DNA, 25 bp, Rattus norvegicus
ggaagtgacagtcggcatcctcttg

SEQ ID NO: 595333 - DNA, 25 bp, Rattus norvegicus
cagccttgtactaggaaggggaagt

SEQ ID NO: 595334 - DNA, 25 bp, Rattus norvegicus
tcagcccagccttgtactaggaagg

SEQ ID NO: 595335 - DNA, 25 bp, Rattus norvegicus
gaccgaggcgccctgctggttgtcc

SEQ ID NO: 595336 - DNA, 25 bp, Rattus norvegicus
cctccaaattcctgaggcgttggga

SEQ ID NO: 595337 - DNA, 25 bp, Rattus norvegicus
aattcctgaggcgttgggagccgca

SEQ ID NO: 595338 - DNA, 25 bp, Rattus norvegicus
tgggagccgcaccacctaacgctgg

SEQ ID NO: 595339 - DNA, 25 bp, Rattus norvegicus
taacgctggccgacaacagcttggc

SEQ ID NO: 595340 - DNA, 25 bp, Rattus norvegicus
tggccgacaacagcttggcatccgc

SEQ ID NO: 595341 - DNA, 25 bp, Rattus norvegicus
atccgccacggtgagtggccctgcg

SEQ ID NO: 595342 - DNA, 25 bp, Rattus norvegicus
tgcaggagggcgacattcaagtctg

SEQ ID NO: 595343 - DNA, 25 bp, Rattus norvegicus
gggcgacattcaagtctgtgtcatc

SEQ ID NO: 595344 - DNA, 25 bp, Rattus norvegicus
tcagcaagatcctcacctccaaatt

SEQ ID NO: 595345 - DNA, 25 bp, Rattus norvegicus
cattcaagtctgtgtcatccggcac

SEQ ID NO: 595346 - DNA, 25 bp, Rattus norvegicus
accctcggacctttctcagcaagat

SEQ ID NO: 595347 - DNA, 25 bp, Rattus norvegicus
cggacctttctcagcaagatcctca

SEQ ID NO: 595348 - DNA, 25 bp, Rattus norvegicus
aacagcttggcatccgccacggtga

SEQ ID NO: 595349 - DNA, 25 bp, Rattus norvegicus
ctgccagcagccgtgcgaccggaag

SEQ ID NO: 595350 - DNA, 25 bp, Rattus norvegicus
aagagatccggaacggctgccagca

SEQ ID NO: 595351 - DNA, 25 bp, Rattus norvegicus
cagcccggacctggtgtctcaggaa

SEQ ID NO: 595352 - DNA, 25 bp, Rattus norvegicus
tggtgtctcaggaagccacattgtc

SEQ ID NO: 595353 - DNA, 25 bp, Rattus norvegicus
gccacattgtctgagccacggctca

SEQ ID NO: 595354 - DNA, 25 bp, Rattus norvegicus
ctcaagtcggtggtcgtggcctcca

SEQ ID NO: 595355 - DNA, 25 bp, Rattus norvegicus
tggcctccagcgaggtccacgtaga

SEQ ID NO: 595356 - DNA, 25 bp, Rattus norvegicus
ggcgctgacagccagcacgggcaat

SEQ ID NO: 595357 - DNA, 25 bp, Rattus norvegicus
ggcaatgacagcgagcccaacctta

SEQ ID NO: 595358 - DNA, 25 bp, Rattus norvegicus
gcccaaccttattgactgtctcatg

SEQ ID NO: 595359 - DNA, 25 bp, Rattus norvegicus
ttgactgtctcatggtcagcccggc

SEQ ID NO: 595360 - DNA, 25 bp, Rattus norvegicus
gcgtgtggcaccatgagcatcgagc

SEQ ID NO: 595361 - DNA, 25 bp, Rattus norvegicus
aggtggagcgcaccagcactgccaa

SEQ ID NO: 595362 - DNA, 25 bp, Rattus norvegicus
cccagcctgaaagagatccggaacg

SEQ ID NO: 595363 - DNA, 25 bp, Rattus norvegicus
ggaagcctagagttggcaccgcgtc

SEQ ID NO: 595364 - DNA, 25 bp, Rattus norvegicus
aacctgccggtgtgcgggaagccta

SEQ ID NO: 595365 - DNA, 25 bp, Rattus norvegicus
gtggtaccgccaggtaagtgaccca

SEQ ID NO: 595366 - DNA, 25 bp, Rattus norvegicus
tgagcaagacgtgccctgccggact

SEQ ID NO: 595367 - DNA, 25 bp, Rattus norvegicus
tccaaagcagaagtaagagcgcggc

SEQ ID NO: 595368 - DNA, 25 bp, Rattus norvegicus
gcggccgcctccaaagcagaagtaa

SEQ ID NO: 595369 - DNA, 25 bp, Rattus norvegicus
atgctctgacagatcgggacccgcc

SEQ ID NO: 595370 - DNA, 25 bp, Rattus norvegicus
gcttgcgcttttgggatgctctgac

SEQ ID NO: 595371 - DNA, 25 bp, Rattus norvegicus
gtgcagtggccaactagggtttgaa

SEQ ID NO: 595372 - DNA, 25 bp, Rattus norvegicus
caactagggtttgaatgagagacgc

SEQ ID NO: 595373 - DNA, 25 bp, Rattus norvegicus
gtggccggagcgtccgccttcaact

SEQ ID NO: 595374 - DNA, 25 bp, Rattus norvegicus
gccttcaactctcgccactgtgagt

SEQ ID NO: 595375 - DNA, 25 bp, Rattus norvegicus
tcgccactgtgagtcctgcgcgagg

SEQ ID NO: 595376 - DNA, 25 bp, Rattus norvegicus
tggcgccacctctccagggtgtgca

SEQ ID NO: 595377 - DNA, 25 bp, Rattus norvegicus
ctctgcctactaccaagacagggta

SEQ ID NO: 595378 - DNA, 25 bp, Rattus norvegicus
gcagcaggacttgcctctctgccta

SEQ ID NO: 595379 - DNA, 25 bp, Rattus norvegicus
ggagctcgcagcaggacttgcctct

SEQ ID NO: 595380 - DNA, 25 bp, Rattus norvegicus
tcacgtggattcaaagtgccagccc

SEQ ID NO: 595381 - DNA, 25 bp, Rattus norvegicus
ccgctgccgagaaatcacgtggatt

SEQ ID NO: 595382 - DNA, 25 bp, Rattus norvegicus
aattcatagaacctgctgccgctgc

SEQ ID NO: 595383 - DNA, 25 bp, Rattus norvegicus
gctgttcgccaattcatagaacctg

SEQ ID NO: 595384 - DNA, 25 bp, Rattus norvegicus
acagagcgctgttcgccaattcata

SEQ ID NO: 595385 - DNA, 25 bp, Rattus norvegicus
ctgaaagtggccacagagcgctgtt

SEQ ID NO: 595386 - DNA, 25 bp, Rattus norvegicus
ctctgtgcgaaactgaaagtggcca

SEQ ID NO: 595387 - DNA, 25 bp, Rattus norvegicus
caccgcgctctgtgcgaaactgaaa

SEQ ID NO: 595388 - DNA, 25 bp, Rattus norvegicus
ttcacgggcttagctctggctccac

SEQ ID NO: 595389 - DNA, 25 bp, Rattus norvegicus
gcagggaattcacgggcttagctct

SEQ ID NO: 595390 - DNA, 25 bp, Rattus norvegicus
ccctacctgagcagggaattcacgg

SEQ ID NO: 595391 - DNA, 25 bp, Rattus norvegicus
aatgaggccgcttggcctgcggttc

SEQ ID NO: 595392 - DNA, 25 bp, Rattus norvegicus
ggcgcttctaccaaggcacggagac

SEQ ID NO: 595393 - DNA, 25 bp, Rattus norvegicus
tctaccaaggcacggagacgacacg

SEQ ID NO: 595394 - DNA, 25 bp, Rattus norvegicus
gaggaaccctggcagcacgcaggca

SEQ ID NO: 595395 - DNA, 25 bp, Rattus norvegicus
agcacgcaggcacccacggtctctg

SEQ ID NO: 595396 - DNA, 25 bp, Rattus norvegicus
gcgctgcgttttccagtccacaaag

SEQ ID NO: 595397 - DNA, 25 bp, Rattus norvegicus
tgcgttttccagtccacaaagaaca

SEQ ID NO: 595398 - DNA, 25 bp, Rattus norvegicus
acacacctcgtgagttccaaaacca

SEQ ID NO: 595399 - DNA, 25 bp, Rattus norvegicus
cgtgtgaaatgaggccgcttggcct

SEQ ID NO: 595400 - DNA, 25 bp, Rattus norvegicus
tacggagacctcgtctgaggtgcgt

SEQ ID NO: 595401 - DNA, 25 bp, Rattus norvegicus
tctctgcgctgcgttttccagtcca

SEQ ID NO: 595402 - DNA, 25 bp, Rattus norvegicus
ctcgtgagttccaaaaccaatttca

SEQ ID NO: 595403 - DNA, 25 bp, Rattus norvegicus
cagtccacaaagaacacacctcgtg

SEQ ID NO: 595404 - DNA, 25 bp, Rattus norvegicus
cccgttacggagacctcgtctgagg

SEQ ID NO: 595405 - DNA, 25 bp, Rattus norvegicus
gtgacccggcggtgcgttctgttct

SEQ ID NO: 595406 - DNA, 25 bp, Rattus norvegicus
tactaggccggaccgggcaggacac

SEQ ID NO: 595407 - DNA, 25 bp, Rattus norvegicus
tcttcctgccggtactactaggccg

SEQ ID NO: 595408 - DNA, 25 bp, Rattus norvegicus
tcagcggtctcttcctgccggtact

SEQ ID NO: 595409 - DNA, 25 bp, Rattus norvegicus
cctgtcgggtcaagctcccgggaag

SEQ ID NO: 595410 - DNA, 25 bp, Rattus norvegicus
ggggtcactcagtctcgctctcggc

SEQ ID NO: 595411 - DNA, 25 bp, Rattus norvegicus
acttggagagcctgtcgggtcaagc

SEQ ID NO: 595412 - DNA, 25 bp, Rattus norvegicus
aaacgccggctgctgcgcgtgtcca

SEQ ID NO: 595413 - DNA, 25 bp, Rattus norvegicus
ctcaagcaggcggagcttctgacga

SEQ ID NO: 595414 - DNA, 25 bp, Rattus norvegicus
tccagtggctcggagccaggcccag

SEQ ID NO: 595415 - DNA, 25 bp, Rattus norvegicus
ttcccgaaggctccagtggctcgga

SEQ ID NO: 595416 - DNA, 25 bp, Rattus norvegicus
tcgggccttcccgaaggctccagtg

SEQ ID NO: 595417 - DNA, 25 bp, Rattus norvegicus
gtgcaccgcatacgtgcagcgcgtg

SEQ ID NO: 595418 - DNA, 25 bp, Rattus norvegicus
ttctgcacccgcctgggttcctgtt

SEQ ID NO: 595419 - DNA, 25 bp, Rattus norvegicus
gcgatctcagccgagaattctttta

SEQ ID NO: 595420 - DNA, 25 bp, Rattus norvegicus
ttttgcggccaggaaacgcgctcgc

SEQ ID NO: 595421 - DNA, 25 bp, Rattus norvegicus
ttatatcgttcacacagcgaacctc

SEQ ID NO: 595422 - DNA, 25 bp, Rattus norvegicus
aacagctcagtgatccggagatgtc

SEQ ID NO: 595423 - DNA, 25 bp, Rattus norvegicus
ccagacagcgaacaaagggcttttg

SEQ ID NO: 595424 - DNA, 25 bp, Rattus norvegicus
gaacaaagggcttttgcggccagga

SEQ ID NO: 595425 - DNA, 25 bp, Rattus norvegicus
cggagatgtctgagaaagctcactc

SEQ ID NO: 595426 - DNA, 25 bp, Rattus norvegicus
gcgaacctccttggagacgctggta

SEQ ID NO: 595427 - DNA, 25 bp, Rattus norvegicus
agctcactcgcagaaccagacagcg

SEQ ID NO: 595428 - DNA, 25 bp, Rattus norvegicus
aggtctgccatcaggcgatctcagc

SEQ ID NO: 595429 - DNA, 25 bp, Rattus norvegicus
agaacggctcgacagaggtctgcca

SEQ ID NO: 595430 - DNA, 25 bp, Rattus norvegicus
ccttggagacgctggtaaacagctc

SEQ ID NO: 595431 - DNA, 25 bp, Rattus norvegicus
ttgagagaacggctcgacagaggtc

SEQ ID NO: 595432 - DNA, 25 bp, Rattus norvegicus
gccgagaattcttttatatcgttca

SEQ ID NO: 595433 - DNA, 25 bp, Rattus norvegicus
tcgtagatggcagctgtcaaccttt

SEQ ID NO: 595434 - DNA, 25 bp, Rattus norvegicus
cgactccgacactcacatactatga

SEQ ID NO: 595435 - DNA, 25 bp, Rattus norvegicus
tttcgtgggtatgtttccaaggcca

SEQ ID NO: 595436 - DNA, 25 bp, Rattus norvegicus
ttccaaggccattctgtcgtagatg

SEQ ID NO: 595437 - DNA, 25 bp, Rattus norvegicus
ggcccatgcaagcagaacgcgaacg

SEQ ID NO: 595438 - DNA, 25 bp, Rattus norvegicus
tgtcaacctttagccatttcgtgtg

SEQ ID NO: 595439 - DNA, 25 bp, Rattus norvegicus
agccatttcgtgtgacccgtcaggg

SEQ ID NO: 595440 - DNA, 25 bp, Rattus norvegicus
cccgtcagggtgaagaaaacctgca

SEQ ID NO: 595441 - DNA, 25 bp, Rattus norvegicus
agaaaacctgcagacttggcgctta

SEQ ID NO: 595442 - DNA, 25 bp, Rattus norvegicus
cttggcgcttagacgaatgcaatcg

SEQ ID NO: 595443 - DNA, 25 bp, Rattus norvegicus
cgcaatctacacagctaaacacacg

SEQ ID NO: 595444 - DNA, 25 bp, Rattus norvegicus
cccatgttgtgtgccagatgatacg

SEQ ID NO: 595445 - DNA, 25 bp, Rattus norvegicus
aatgcaatcgcaagcccatgttgtg

SEQ ID NO: 595446 - DNA, 25 bp, Rattus norvegicus
acgcgaacgaagctgctaagtaacg

SEQ ID NO: 595447 - DNA, 25 bp, Rattus norvegicus
ttctgcattcagatcgccctgcttg

SEQ ID NO: 595448 - DNA, 25 bp, Rattus norvegicus
atccgtcttgtaaagccattggtcc

SEQ ID NO: 595449 - DNA, 25 bp, Rattus norvegicus
aatgctttcgcgatgctgccgctga

SEQ ID NO: 595450 - DNA, 25 bp, Rattus norvegicus
tgccgctgatctatttgggaagttg

SEQ ID NO: 595451 - DNA, 25 bp, Rattus norvegicus
caaaggctggctcccacggaaaata

SEQ ID NO: 595452 - DNA, 25 bp, Rattus norvegicus
aggcgcttcttctagtcgggcaaga

SEQ ID NO: 595453 - DNA, 25 bp, Rattus norvegicus
cattggtcctggtcatcagccgcta

SEQ ID NO: 595454 - DNA, 25 bp, Rattus norvegicus
gggcttctgctaaccgccgcgcaga

SEQ ID NO: 595455 - DNA, 25 bp, Rattus norvegicus
cccggctagctcagatgcgaggtca

SEQ ID NO: 595456 - DNA, 25 bp, Rattus norvegicus
aggcgacatcctagctgacatcaag

SEQ ID NO: 595457 - DNA, 25 bp, Rattus norvegicus
gtaactttggttcgcctcctccaga

SEQ ID NO: 595458 - DNA, 25 bp, Rattus norvegicus
cagaggctcatgtatcggatatata

SEQ ID NO: 595459 - DNA, 25 bp, Rattus norvegicus
ggccagagctggcatcactgacttc

SEQ ID NO: 595460 - DNA, 25 bp, Rattus norvegicus
tgtgtgaatgcaaacgccgccaggc

SEQ ID NO: 595461 - DNA, 25 bp, Rattus norvegicus
tgacaaaccgcggagagtacaaagg

SEQ ID NO: 595462 - DNA, 25 bp, Rattus norvegicus
aaaatgaaggcgctgtcacctggcc

SEQ ID NO: 595463 - DNA, 25 bp, Rattus norvegicus
gaacccgagcggtgtgatgcaagca

SEQ ID NO: 595464 - DNA, 25 bp, Rattus norvegicus
cggtgtgatgcaagcagataatatt

SEQ ID NO: 595465 - DNA, 25 bp, Rattus norvegicus
gcagataatatttaacggacacaga

SEQ ID NO: 595466 - DNA, 25 bp, Rattus norvegicus
cggacacagaaggttaatgaaacgt

SEQ ID NO: 595467 - DNA, 25 bp, Rattus norvegicus
ttcgtagagtcattgacaaaccgcg

SEQ ID NO: 595468 - DNA, 25 bp, Rattus norvegicus
gtacaaagggaagagacgaaaatga

SEQ ID NO: 595469 - DNA, 25 bp, Rattus norvegicus
tgtcacctggcccttcggaaagtga

SEQ ID NO: 595470 - DNA, 25 bp, Rattus norvegicus
ccttcggaaagtgactccgctctga

SEQ ID NO: 595471 - DNA, 25 bp, Rattus norvegicus
aaagtgactccgctctgagaatgag

SEQ ID NO: 595472 - DNA, 25 bp, Rattus norvegicus
ctctgagaatgagtttgcagaaaca

SEQ ID NO: 595473 - DNA, 25 bp, Rattus norvegicus
agtttgcagaaacaggctcggaccc

SEQ ID NO: 595474 - DNA, 25 bp, Rattus norvegicus
gaaacgtttcgtagagtcattgaca

SEQ ID NO: 595475 - DNA, 25 bp, Rattus norvegicus
gacaacgctctcctgcggtacaaca

SEQ ID NO: 595476 - DNA, 25 bp, Rattus norvegicus
cgatcccgagaaaggagacattgtc

SEQ ID NO: 595477 - DNA, 25 bp, Rattus norvegicus
tgacaagccgtctcctaacatgttc

SEQ ID NO: 595478 - DNA, 25 bp, Rattus norvegicus
tcaccgtggtgtcacctgcgctgct

SEQ ID NO: 595479 - DNA, 25 bp, Rattus norvegicus
tgataaccgtctcctaccctttggc

SEQ ID NO: 595480 - DNA, 25 bp, Rattus norvegicus
aacatgttctacatcgatcccgaga

SEQ ID NO: 595481 - DNA, 25 bp, Rattus norvegicus
gtcagcagacgcctgacaagccgtc

SEQ ID NO: 595482 - DNA, 25 bp, Rattus norvegicus
tgcggtacaacatccgtcagcagac

SEQ ID NO: 595483 - DNA, 25 bp, Rattus norvegicus
aggagacattgtcaccgtggtgtca

SEQ ID NO: 595484 - DNA, 25 bp, Rattus norvegicus
agatgacccggccactgacaacgct

SEQ ID NO: 595485 - DNA, 25 bp, Rattus norvegicus
tgacagcgtttgatgcagatgaccc

SEQ ID NO: 595486 - DNA, 25 bp, Rattus norvegicus
cacggtgatgcggatgacagcgttt

SEQ ID NO: 595487 - DNA, 25 bp, Rattus norvegicus
gccctccttagggaccacggtgatg

SEQ ID NO: 595488 - DNA, 25 bp, Rattus norvegicus
tttgatgcagatgacccggccactg

SEQ ID NO: 595489 - DNA, 25 bp, Rattus norvegicus
gtctgcgccaagaaaccgaagtcta

SEQ ID NO: 595490 - DNA, 25 bp, Rattus norvegicus
catcaccttggtggtaagccgcatc

SEQ ID NO: 595491 - DNA, 25 bp, Rattus norvegicus
aggcccttgcggaaggcctcgcaca

SEQ ID NO: 595492 - DNA, 25 bp, Rattus norvegicus
tgacccgcagggacacggaaccgac

SEQ ID NO: 595493 - DNA, 25 bp, Rattus norvegicus
ggatactccgggtctgctttccgcc

SEQ ID NO: 595494 - DNA, 25 bp, Rattus norvegicus
gcatcctcacatgggcccggatact

SEQ ID NO: 595495 - DNA, 25 bp, Rattus norvegicus
cccaagacaatgcaggacatcacct

SEQ ID NO: 595496 - DNA, 25 bp, Rattus norvegicus
cgaagtctaggtgacggttccgaga

SEQ ID NO: 595497 - DNA, 25 bp, Rattus norvegicus
cccgtgactgttgtcgcgagaactg

SEQ ID NO: 595498 - DNA, 25 bp, Rattus norvegicus
tgcgtgacggaaactacaacaccca

SEQ ID NO: 595499 - DNA, 25 bp, Rattus norvegicus
tcctaggaccttccgatgcgtgacg

SEQ ID NO: 595500 - DNA, 25 bp, Rattus norvegicus
ggacgctctgaagcctcctaggacc

SEQ ID NO: 595501 - DNA, 25 bp, Rattus norvegicus
gcttatccgcagacaggacgctctg

SEQ ID NO: 595502 - DNA, 25 bp, Rattus norvegicus
ggttccgagacatcgccgccaagct

SEQ ID NO: 595503 - DNA, 25 bp, Rattus norvegicus
gtggcctcttccaccacatcagtaa

SEQ ID NO: 595504 - DNA, 25 bp, Rattus norvegicus
cagctgtttcgggttgtcatgagag

SEQ ID NO: 595505 - DNA, 25 bp, Rattus norvegicus
gacctaggctgtgcagcgggctcac

SEQ ID NO: 595506 - DNA, 25 bp, Rattus norvegicus
cgccatggacgagctgctacggcga

SEQ ID NO: 595507 - DNA, 25 bp, Rattus norvegicus
tgcgcggacttcgtgagcttttacg

SEQ ID NO: 595508 - DNA, 25 bp, Rattus norvegicus
ccctcaagctggtggaagggccgca

SEQ ID NO: 595509 - DNA, 25 bp, Rattus norvegicus
tcgtgccgcgataccgtggcctctt

SEQ ID NO: 595510 - DNA, 25 bp, Rattus norvegicus
gtggcttctcccgttagcagctgtt

SEQ ID NO: 595511 - DNA, 25 bp, Rattus norvegicus
acatcagtaagctggacggcggcgt

SEQ ID NO: 595512 - DNA, 25 bp, Rattus norvegicus
taccggaagccgaaagcggaagtgc

SEQ ID NO: 595513 - DNA, 25 bp, Rattus norvegicus
cttcctggtacagctgcgggccgat

SEQ ID NO: 595514 - DNA, 25 bp, Rattus norvegicus
cgattggccgatgccctcgtccgtt

SEQ ID NO: 595515 - DNA, 25 bp, Rattus norvegicus
ccgcctcgaccaatgggccggagag

SEQ ID NO: 595516 - DNA, 25 bp, Rattus norvegicus
cagaggaccggctacgctatgccct

SEQ ID NO: 595517 - DNA, 25 bp, Rattus norvegicus
tgtcatctccacatcccatagctgg

SEQ ID NO: 595518 - DNA, 25 bp, Rattus norvegicus
cagccgtcatcctggacgtgagtac

SEQ ID NO: 595519 - DNA, 25 bp, Rattus norvegicus
ctgggtgcctgtccgcacacgggac

SEQ ID NO: 595520 - DNA, 25 bp, Rattus norvegicus
agcacggctgggtgcctgtccgcac

SEQ ID NO: 595521 - DNA, 25 bp, Rattus norvegicus
cgccgggaccgtatgaccctcacct

SEQ ID NO: 595522 - DNA, 25 bp, Rattus norvegicus
cgttctcttcctccgctttcttgca

SEQ ID NO: 595523 - DNA, 25 bp, Rattus norvegicus
cccatcgcggctgaggcttgggtcc

SEQ ID NO: 595524 - DNA, 25 bp, Rattus norvegicus
ctgaggcttgggtccgcacccggac

SEQ ID NO: 595525 - DNA, 25 bp, Rattus norvegicus
ggacggaggaccctctcctcagtcg

SEQ ID NO: 595526 - DNA, 25 bp, Rattus norvegicus
gttcccgcttccactaattccatag

SEQ ID NO: 595527 - DNA, 25 bp, Rattus norvegicus
ttccactaattccatagcacgggcc

SEQ ID NO: 595528 - DNA, 25 bp, Rattus norvegicus
gtcgtaggtcctcctgaaacccgca

SEQ ID NO: 595529 - DNA, 25 bp, Rattus norvegicus
gtcatcctggacgtgagtacgcgcg

SEQ ID NO: 595530 - DNA, 25 bp, Rattus norvegicus
tgcatcctatctatggctgagaccc

SEQ ID NO: 595531 - DNA, 25 bp, Rattus norvegicus
cgacacttggtgtctttgggacacg

SEQ ID NO: 595532 - DNA, 25 bp, Rattus norvegicus
ccgtacgtctgtccgcttgcatttt

SEQ ID NO: 595533 - DNA, 25 bp, Rattus norvegicus
gcaggctctgcaaattgttccctca

SEQ ID NO: 595534 - DNA, 25 bp, Rattus norvegicus
ctgactcccagatcagcaggctctg

SEQ ID NO: 595535 - DNA, 25 bp, Rattus norvegicus
ggttgcgtcatcctgagtcccgaca

SEQ ID NO: 595536 - DNA, 25 bp, Rattus norvegicus
agatagcgctctctgtggctgccgt

SEQ ID NO: 595537 - DNA, 25 bp, Rattus norvegicus
acaggtgagctcaggcagcctttca

SEQ ID NO: 595538 - DNA, 25 bp, Rattus norvegicus
gggccttgaggcgactcacactcca

SEQ ID NO: 595539 - DNA, 25 bp, Rattus norvegicus
cactcagctccaagtcgcggtggcg

SEQ ID NO: 595540 - DNA, 25 bp, Rattus norvegicus
ccgtccattggctgagacagaggtc

SEQ ID NO: 595541 - DNA, 25 bp, Rattus norvegicus
ctcgactgcgctcagggatgccgaa

SEQ ID NO: 595542 - DNA, 25 bp, Rattus norvegicus
cccgtgccaggattccgcagatagc

SEQ ID NO: 595543 - DNA, 25 bp, Rattus norvegicus
ggtcagtgcccaacgtggcccaatc

SEQ ID NO: 595544 - DNA, 25 bp, Rattus norvegicus
cgctgattggggctcttcaccagca

SEQ ID NO: 595545 - DNA, 25 bp, Rattus norvegicus
acatgctgaccttcttcttggtgtc

SEQ ID NO: 595546 - DNA, 25 bp, Rattus norvegicus
agtcccagccgcactgcgaggactg

SEQ ID NO: 595547 - DNA, 25 bp, Rattus norvegicus
ctctggctgtttgccggtaagtccc

SEQ ID NO: 595548 - DNA, 25 bp, Rattus norvegicus
ccctctggctgtttgccggtaagtc

SEQ ID NO: 595549 - DNA, 25 bp, Rattus norvegicus
gttccctctggctgtttgccggtaa

SEQ ID NO: 595550 - DNA, 25 bp, Rattus norvegicus
gctgaccttcttcttggtgtcgggg

SEQ ID NO: 595551 - DNA, 25 bp, Rattus norvegicus
tttccgtgaggagcgcgcgctgagc

SEQ ID NO: 595552 - DNA, 25 bp, Rattus norvegicus
cccagccgcactgcgaggactggag

SEQ ID NO: 595553 - DNA, 25 bp, Rattus norvegicus
gttcggatgccgctgtctctgtgcc

SEQ ID NO: 595554 - DNA, 25 bp, Rattus norvegicus
ctcggcggttcggatgccgctgtct

SEQ ID NO: 595555 - DNA, 25 bp, Rattus norvegicus
tcccccagaacgttgcgtggcgggc

SEQ ID NO: 595556 - DNA, 25 bp, Rattus norvegicus
ccgatcgtgcggaggtaagggtcgt

SEQ ID NO: 595557 - DNA, 25 bp, Rattus norvegicus
ggactggagagtcgggtttccgtga

SEQ ID NO: 595558 - DNA, 25 bp, Rattus norvegicus
caccgacatgctgaccttcttcttg

SEQ ID NO: 595559 - DNA, 25 bp, Rattus norvegicus
aacacgcctcgggtatccattcggg

SEQ ID NO: 595560 - DNA, 25 bp, Rattus norvegicus
ctcgcgacatctatggccttggggc

SEQ ID NO: 595561 - DNA, 25 bp, Rattus norvegicus
agcagtatagagatctcgcgacatc

SEQ ID NO: 595562 - DNA, 25 bp, Rattus norvegicus
gcacccaggcgagaagcagtataga

SEQ ID NO: 595563 - DNA, 25 bp, Rattus norvegicus
ggggatgtttactcgcaaatctcgc

SEQ ID NO: 595564 - DNA, 25 bp, Rattus norvegicus
gcgccactcgaaaacgactacagta

SEQ ID NO: 595565 - DNA, 25 bp, Rattus norvegicus
gtccctgtgcgtgcagcaagcggct

SEQ ID NO: 595566 - DNA, 25 bp, Rattus norvegicus
caatttctggggaagcagctgcggt

SEQ ID NO: 595567 - DNA, 25 bp, Rattus norvegicus
ctgctccgggccaatttctggggaa

SEQ ID NO: 595568 - DNA, 25 bp, Rattus norvegicus
gctcgcgaacgcagagccctgcgga

SEQ ID NO: 595569 - DNA, 25 bp, Rattus norvegicus
tatgcacggacctgcaggcccattc

SEQ ID NO: 595570 - DNA, 25 bp, Rattus norvegicus
aatcccagccgcgttatgcacggac

SEQ ID NO: 595571 - DNA, 25 bp, Rattus norvegicus
gactacagtaaaggcaaatcccagc

SEQ ID NO: 595572 - DNA, 25 bp, Rattus norvegicus
aaatctcgcgagaccacgccgctga

SEQ ID NO: 595573 - DNA, 25 bp, Rattus norvegicus
acctgctcaggcagctaagggccgc

SEQ ID NO: 595574 - DNA, 25 bp, Rattus norvegicus
cggaaccaagagttcgcgcctacgg

SEQ ID NO: 595575 - DNA, 25 bp, Rattus norvegicus
agaacccaccgggctctgcaggatc

SEQ ID NO: 595576 - DNA, 25 bp, Rattus norvegicus
gcggccattctgcaccagtcctgaa

SEQ ID NO: 595577 - DNA, 25 bp, Rattus norvegicus
gggcatggcccagcgactccacaga

SEQ ID NO: 595578 - DNA, 25 bp, Rattus norvegicus
agaaaggaagattaagaggcaccga

SEQ ID NO: 595579 - DNA, 25 bp, Rattus norvegicus
atacctgcagcgagaggcgcggtct

SEQ ID NO: 595580 - DNA, 25 bp, Rattus norvegicus
tccgcaggcgatcacggcgacgcag

SEQ ID NO: 595581 - DNA, 25 bp, Rattus norvegicus
acgacgcggactgtagtactggagc

SEQ ID NO: 595582 - DNA, 25 bp, Rattus norvegicus
gttggacagccaacgacgcggactg

SEQ ID NO: 595583 - DNA, 25 bp, Rattus norvegicus
acgtgatccgcgcacgcgcctgggt

SEQ ID NO: 595584 - DNA, 25 bp, Rattus norvegicus
aggtccgctactcacgtgatccgcg

SEQ ID NO: 595585 - DNA, 25 bp, Rattus norvegicus
gccgcaggtccgctactcacgtgat

SEQ ID NO: 595586 - DNA, 25 bp, Rattus norvegicus
tgcaccagtcctgaatcctagaacc

SEQ ID NO: 595587 - DNA, 25 bp, Rattus norvegicus
acggggtcaagctctggagcagcca

SEQ ID NO: 595588 - DNA, 25 bp, Rattus norvegicus
gcagcatccatcacagcgcggcggt

SEQ ID NO: 595589 - DNA, 25 bp, Rattus norvegicus
ggtggcgggtacatcccattctttg

SEQ ID NO: 595590 - DNA, 25 bp, Rattus norvegicus
attctttgcgtctacgcagcgcggg

SEQ ID NO: 595591 - DNA, 25 bp, Rattus norvegicus
cggggagatacgcttcctcattggc

SEQ ID NO: 595592 - DNA, 25 bp, Rattus norvegicus
cctcattggctggtcgcagcatcca

SEQ ID NO: 595593 - DNA, 25 bp, Rattus norvegicus
tgtcctcgcgctgcacagttggcgg

SEQ ID NO: 595594 - DNA, 25 bp, Rattus norvegicus
tgattggtcatctccaggaagaggc

SEQ ID NO: 595595 - DNA, 25 bp, Rattus norvegicus
aagaggcggagttcgtagttagctc

SEQ ID NO: 595596 - DNA, 25 bp, Rattus norvegicus
cacgtgctccacgtataaaagagca

SEQ ID NO: 595597 - DNA, 25 bp, Rattus norvegicus
ctctggagcagccatggcgaatgtg

SEQ ID NO: 595598 - DNA, 25 bp, Rattus norvegicus
cgcaggagacctcgactggcagcgt

SEQ ID NO: 595599 - DNA, 25 bp, Rattus norvegicus
tggcagcgtcgctacagatcagccc

SEQ ID NO: 595600 - DNA, 25 bp, Rattus norvegicus
gtagttagctctgcgccacacacgt

SEQ ID NO: 595601 - DNA, 25 bp, Rattus norvegicus
gtgcccgcagaacacgcagcaccag

SEQ ID NO: 595602 - DNA, 25 bp, Rattus norvegicus
cggggactcatcagacaccgcgagc

SEQ ID NO: 595603 - DNA, 25 bp, Rattus norvegicus
tttctccaggtaggagctgccactc

SEQ ID NO: 595604 - DNA, 25 bp, Rattus norvegicus
tctccaggtaggagctgccactcgg

SEQ ID NO: 595605 - DNA, 25 bp, Rattus norvegicus
caggtaggagctgccactcggcctc

SEQ ID NO: 595606 - DNA, 25 bp, Rattus norvegicus
ggcctctcacctgcctccggggact

SEQ ID NO: 595607 - DNA, 25 bp, Rattus norvegicus
tccggggactcatcagacaccgcga

SEQ ID NO: 595608 - DNA, 25 bp, Rattus norvegicus
gggactcatcagacaccgcgagcga

SEQ ID NO: 595609 - DNA, 25 bp, Rattus norvegicus
cgacacgtagtatggggagatggct

SEQ ID NO: 595610 - DNA, 25 bp, Rattus norvegicus
ggagatggctagaatgtcgatgaca

SEQ ID NO: 595611 - DNA, 25 bp, Rattus norvegicus
atgtcgatgacattcaggggcccgc

SEQ ID NO: 595612 - DNA, 25 bp, Rattus norvegicus
tgtcgatgacattcaggggcccgcg

SEQ ID NO: 595613 - DNA, 25 bp, Rattus norvegicus
aggatgcgcagtgcccgcagaacac

SEQ ID NO: 595614 - DNA, 25 bp, Rattus norvegicus
accgcgagcgacacgtagtatgggg

SEQ ID NO: 595615 - DNA, 25 bp, Rattus norvegicus
aacggagaggcaagcgaagaccttc

SEQ ID NO: 595616 - DNA, 25 bp, Rattus norvegicus
cagggcgcacatctctcgcagaagc

SEQ ID NO: 595617 - DNA, 25 bp, Rattus norvegicus
tcctcccggaaggacagggcgcaca

SEQ ID NO: 595618 - DNA, 25 bp, Rattus norvegicus
gctccaggttggcttcctcgatgcc

SEQ ID NO: 595619 - DNA, 25 bp, Rattus norvegicus
agtttgcgtagacagcagcgctcca

SEQ ID NO: 595620 - DNA, 25 bp, Rattus norvegicus
cagcttcttcagcagtttgcgtaga

SEQ ID NO: 595621 - DNA, 25 bp, Rattus norvegicus
tcctccagcttcttcagcagtttgc

SEQ ID NO: 595622 - DNA, 25 bp, Rattus norvegicus
cctgcacttcggagtggcaggcctg

SEQ ID NO: 595623 - DNA, 25 bp, Rattus norvegicus
cgcgaagcctgcacttcggagtggc

SEQ ID NO: 595624 - DNA, 25 bp, Rattus norvegicus
atgctgcgggcccatcgcgaagcct

SEQ ID NO: 595625 - DNA, 25 bp, Rattus norvegicus
cagctggttcatgctgcgggcccat

SEQ ID NO: 595626 - DNA, 25 bp, Rattus norvegicus
catctcccgcagctggttcatgctg

SEQ ID NO: 595627 - DNA, 25 bp, Rattus norvegicus
ggcagccctgactgtgggtcctcca

SEQ ID NO: 595628 - DNA, 25 bp, Rattus norvegicus
gcaagcgaagaccttcccgggcagc

SEQ ID NO: 595629 - DNA, 25 bp, Rattus norvegicus
tcactgcggctgaccctgggagttc

SEQ ID NO: 595630 - DNA, 25 bp, Rattus norvegicus
aagcgggctgggactacgacctgcc

SEQ ID NO: 595631 - DNA, 25 bp, Rattus norvegicus
cgctagggccccagggaagcgggct

SEQ ID NO: 595632 - DNA, 25 bp, Rattus norvegicus
cgcgcagcaccagccgcggcctcgc

SEQ ID NO: 595633 - DNA, 25 bp, Rattus norvegicus
gaccaggtaggcagctccccggcaa

SEQ ID NO: 595634 - DNA, 25 bp, Rattus norvegicus
aggtaggcagctccccggcaacctg

SEQ ID NO: 595635 - DNA, 25 bp, Rattus norvegicus
acctggggaccaggtaggcagctcc

SEQ ID NO: 595636 - DNA, 25 bp, Rattus norvegicus
tacctggggaccaggtaggcagctc

SEQ ID NO: 595637 - DNA, 25 bp, Rattus norvegicus
agcttacctggggaccaggtaggca

SEQ ID NO: 595638 - DNA, 25 bp, Rattus norvegicus
agcgggctgggactacgacctgccc

SEQ ID NO: 595639 - DNA, 25 bp, Rattus norvegicus
cactgcggctgaccctgggagttcg

SEQ ID NO: 595640 - DNA, 25 bp, Rattus norvegicus
agtcactgcggctgaccctgggagt

SEQ ID NO: 595641 - DNA, 25 bp, Rattus norvegicus
ctgaccctgggagttcggggtcctg

SEQ ID NO: 595642 - DNA, 25 bp, Rattus norvegicus
cctggggaccaggtaggcagctccc

SEQ ID NO: 595643 - DNA, 25 bp, Rattus norvegicus
cttgtcgatcttcgtggccatggcc

SEQ ID NO: 595644 - DNA, 25 bp, Rattus norvegicus
cacgaagcaggtcggtactggcatc

SEQ ID NO: 595645 - DNA, 25 bp, Rattus norvegicus
gcggcgttgctcaccagatgaccga

SEQ ID NO: 595646 - DNA, 25 bp, Rattus norvegicus
gcactaagttgtacgccgcgcgaca

SEQ ID NO: 595647 - DNA, 25 bp, Rattus norvegicus
ccgcgaggacactgccggaaccagt

SEQ ID NO: 595648 - DNA, 25 bp, Rattus norvegicus
ccggaaccagtgaatgcgtccctga

SEQ ID NO: 595649 - DNA, 25 bp, Rattus norvegicus
gtggccgctcgcaattgcaagctaa

SEQ ID NO: 595650 - DNA, 25 bp, Rattus norvegicus
ttgcaagctaaggtcctcggagagg

SEQ ID NO: 595651 - DNA, 25 bp, Rattus norvegicus
cccgcggttactgcagagccggagc

SEQ ID NO: 595652 - DNA, 25 bp, Rattus norvegicus
cctctgttcccattggtcgcgcggg

SEQ ID NO: 595653 - DNA, 25 bp, Rattus norvegicus
agcgtcttgcacacccggtggccaa

SEQ ID NO: 595654 - DNA, 25 bp, Rattus norvegicus
ccagtctatgtggattgcgcaactc

SEQ ID NO: 595655 - DNA, 25 bp, Rattus norvegicus
tgaatgcgtccctgatccgctgcga

SEQ ID NO: 595656 - DNA, 25 bp, Rattus norvegicus
gacgagccgtcgtcccgcactaagt

SEQ ID NO: 595657 - DNA, 25 bp, Rattus norvegicus
cattgacacagtaggctcgcacttc

SEQ ID NO: 595658 - DNA, 25 bp, Rattus norvegicus
cagctaggcgccacagacgtggtcc

SEQ ID NO: 595659 - DNA, 25 bp, Rattus norvegicus
taaagcggcgctccgccttcacagg

SEQ ID NO: 595660 - DNA, 25 bp, Rattus norvegicus
ccctagccgccattgacacagtagg

SEQ ID NO: 595661 - DNA, 25 bp, Rattus norvegicus
gacacagtaggctcgcacttcctta

SEQ ID NO: 595662 - DNA, 25 bp, Rattus norvegicus
taggctcgcacttccttacagaggg

SEQ ID NO: 595663 - DNA, 25 bp, Rattus norvegicus
cttccttacagagggatggctgcgc

SEQ ID NO: 595664 - DNA, 25 bp, Rattus norvegicus
ccgcagcgtgcgctgctctggtagc

SEQ ID NO: 595665 - DNA, 25 bp, Rattus norvegicus
cgctgctctggtagcggctcgcaag

SEQ ID NO: 595666 - DNA, 25 bp, Rattus norvegicus
ctcagcgcctcagcaccttcggggc

SEQ ID NO: 595667 - DNA, 25 bp, Rattus norvegicus
ttcacctcacctgcttgcacgtagt

SEQ ID NO: 595668 - DNA, 25 bp, Rattus norvegicus
ctgcttgcacgtagtccaggacgca

SEQ ID NO: 595669 - DNA, 25 bp, Rattus norvegicus
gcacgtagtccaggacgcagctagg

SEQ ID NO: 595670 - DNA, 25 bp, Rattus norvegicus
gaggctccgccctttatcctgcaga

SEQ ID NO: 595671 - DNA, 25 bp, Rattus norvegicus
aacgctcctgcgttcggaggagtgc

SEQ ID NO: 595672 - DNA, 25 bp, Rattus norvegicus
ctggtggcagcttctcgagagacaa

SEQ ID NO: 595673 - DNA, 25 bp, Rattus norvegicus
agccaccactgcgttgccgtgctgg

SEQ ID NO: 595674 - DNA, 25 bp, Rattus norvegicus
tgaaggagacatccctaccggcccg

SEQ ID NO: 595675 - DNA, 25 bp, Rattus norvegicus
gacacctgctacctggacaccaaga

SEQ ID NO: 595676 - DNA, 25 bp, Rattus norvegicus
tcgcgtgctggagaacatccgcttc

SEQ ID NO: 595677 - DNA, 25 bp, Rattus norvegicus
ctggagctgagcgatgacacctgct

SEQ ID NO: 595678 - DNA, 25 bp, Rattus norvegicus
aggacatcctgctacagcgggtgaa

SEQ ID NO: 595679 - DNA, 25 bp, Rattus norvegicus
cgcggcctccaaccttctttatagg

SEQ ID NO: 595680 - DNA, 25 bp, Rattus norvegicus
tgaagctggccatgtgctcgctgct

SEQ ID NO: 595681 - DNA, 25 bp, Rattus norvegicus
tcctgcagacgaagcgaacgctcct

SEQ ID NO: 595682 - DNA, 25 bp, Rattus norvegicus
tggcccagccagtcctgcagacgaa

SEQ ID NO: 595683 - DNA, 25 bp, Rattus norvegicus
ggaggccatgcactaccacaacagc

SEQ ID NO: 595684 - DNA, 25 bp, Rattus norvegicus
cttgctcttcgtaggtggtgaggtc

SEQ ID NO: 595685 - DNA, 25 bp, Rattus norvegicus
cgcctcaggaattctgttgcaagga

SEQ ID NO: 595686 - DNA, 25 bp, Rattus norvegicus
tcctgagacccacttaggaggagtg

SEQ ID NO: 595687 - DNA, 25 bp, Rattus norvegicus
tctggagcgcttgctgcgctttctg

SEQ ID NO: 595688 - DNA, 25 bp, Rattus norvegicus
ggctgctttagagccggcgtctgtt

SEQ ID NO: 595689 - DNA, 25 bp, Rattus norvegicus
gacaccttttgcacggagtccgagc

SEQ ID NO: 595690 - DNA, 25 bp, Rattus norvegicus
ttgcaaggaaaactgggaaccactg

SEQ ID NO: 595691 - DNA, 25 bp, Rattus norvegicus
gaactgcctcgagagcgtccgagcc

SEQ ID NO: 595692 - DNA, 25 bp, Rattus norvegicus
aacctcattgagacgggccgccatg

SEQ ID NO: 595693 - DNA, 25 bp, Rattus norvegicus
gccggaggagctccgaacctcattg

SEQ ID NO: 595694 - DNA, 25 bp, Rattus norvegicus
cagcctccgcgcgttgtgagcggaa

SEQ ID NO: 595695 - DNA, 25 bp, Rattus norvegicus
ggtgcgtggccagttcaatcctcac

SEQ ID NO: 595696 - DNA, 25 bp, Rattus norvegicus
cgctccagaaggtaaaggatccgtg

SEQ ID NO: 595697 - DNA, 25 bp, Rattus norvegicus
agaagtcagcacgtggtgccgcttc

SEQ ID NO: 595698 - DNA, 25 bp, Rattus norvegicus
tgtctcgcccgggactgacaccttt

SEQ ID NO: 595699 - DNA, 25 bp, Rattus norvegicus
tgactgacccatgggccagccaatg

SEQ ID NO: 595700 - DNA, 25 bp, Rattus norvegicus
tgatgcggctcgtcgccagccaatc

SEQ ID NO: 595701 - DNA, 25 bp, Rattus norvegicus
atcgtgccgagcgaccttagtgtta

SEQ ID NO: 595702 - DNA, 25 bp, Rattus norvegicus
attggagctgtgcagttatcgtgcc

SEQ ID NO: 595703 - DNA, 25 bp, Rattus norvegicus
tcaggcttcttggaaactaaaattg

SEQ ID NO: 595704 - DNA, 25 bp, Rattus norvegicus
ttcggccaacctgcggagcactgag

SEQ ID NO: 595705 - DNA, 25 bp, Rattus norvegicus
tcggatggctttgtgcagactgccc

SEQ ID NO: 595706 - DNA, 25 bp, Rattus norvegicus
gagttgctgtctccctgtgatcggc

SEQ ID NO: 595707 - DNA, 25 bp, Rattus norvegicus
tgcccacttcgctcggttgtttacg

SEQ ID NO: 595708 - DNA, 25 bp, Rattus norvegicus
gcttttcagcaagcggagcgggtta

SEQ ID NO: 595709 - DNA, 25 bp, Rattus norvegicus
cccaccttgttccagaagcttttca

SEQ ID NO: 595710 - DNA, 25 bp, Rattus norvegicus
ccgctcagtttgctgccacgtgatg

SEQ ID NO: 595711 - DNA, 25 bp, Rattus norvegicus
ctgtcatatgactgaggcgcccatg

SEQ ID NO: 595712 - DNA, 25 bp, Rattus norvegicus
ccgtggccgtttgaagtgactaatt

SEQ ID NO: 595713 - DNA, 25 bp, Rattus norvegicus
cagccagccaccacaagaaaggaag

SEQ ID NO: 595714 - DNA, 25 bp, Rattus norvegicus
caagtgaactttatggagatccgca

SEQ ID NO: 595715 - DNA, 25 bp, Rattus norvegicus
ctcagaagagcctagtcacagcact

SEQ ID NO: 595716 - DNA, 25 bp, Rattus norvegicus
cgtggcgatagtgcaccagtaggaa

SEQ ID NO: 595717 - DNA, 25 bp, Rattus norvegicus
tacaagtaagtcaagggagctccgc

SEQ ID NO: 595718 - DNA, 25 bp, Rattus norvegicus
agatccgcaagagaacacagacgtg

SEQ ID NO: 595719 - DNA, 25 bp, Rattus norvegicus
cgttgcgccgccaagtgaactttat

SEQ ID NO: 595720 - DNA, 25 bp, Rattus norvegicus
ctgaggcggtcagctcccagaagcc

SEQ ID NO: 595721 - DNA, 25 bp, Rattus norvegicus
tcgagttaggctcggggttctgctt

SEQ ID NO: 595722 - DNA, 25 bp, Rattus norvegicus
acataggatggagttcgagttaggc

SEQ ID NO: 595723 - DNA, 25 bp, Rattus norvegicus
cgcgagcctcgtggctacgaacata

SEQ ID NO: 595724 - DNA, 25 bp, Rattus norvegicus
tcacagcactcggtgagctgtcgcc

SEQ ID NO: 595725 - DNA, 25 bp, Rattus norvegicus
accagtaggaaggaccacgctcaga

SEQ ID NO: 595726 - DNA, 25 bp, Rattus norvegicus
gcggagctgtcgctacaagtaagtc

SEQ ID NO: 595727 - DNA, 25 bp, Rattus norvegicus
cccaatcagcgctgactgtggactt

SEQ ID NO: 595728 - DNA, 25 bp, Rattus norvegicus
tgttgtcccgtccttcacttgagta

SEQ ID NO: 595729 - DNA, 25 bp, Rattus norvegicus
atcagcacgcgctgcccggtggtct

SEQ ID NO: 595730 - DNA, 25 bp, Rattus norvegicus
ttcacttgagtagtagaaccgggtg

SEQ ID NO: 595731 - DNA, 25 bp, Rattus norvegicus
acggcctgtccgagagtgcccagat

SEQ ID NO: 595732 - DNA, 25 bp, Rattus norvegicus
gtgcccagatcgttgcgcgcagaaa

SEQ ID NO: 595733 - DNA, 25 bp, Rattus norvegicus
gcgcgcagaaagcactcaatgaaaa

SEQ ID NO: 595734 - DNA, 25 bp, Rattus norvegicus
ctccttgcgcatcgtggtcctcaga

SEQ ID NO: 595735 - DNA, 25 bp, Rattus norvegicus
ctgcccaggttgaggccagagttcc

SEQ ID NO: 595736 - DNA, 25 bp, Rattus norvegicus
tggctcaggatgctccaagaggcta

SEQ ID NO: 595737 - DNA, 25 bp, Rattus norvegicus
ctccaagaggctactaggggccgcg

SEQ ID NO: 595738 - DNA, 25 bp, Rattus norvegicus
cagggtcccagagccgaagtttgct

SEQ ID NO: 595739 - DNA, 25 bp, Rattus norvegicus
cgaagtttgcttgcccagcgctgcc

SEQ ID NO: 595740 - DNA, 25 bp, Rattus norvegicus
tacttttatggtcacggctaggggc

SEQ ID NO: 595741 - DNA, 25 bp, Rattus norvegicus
gcgacgcatcatgcggcagcgctca

SEQ ID NO: 595742 - DNA, 25 bp, Rattus norvegicus
tgcgtcgccgttcgtaggcactcac

SEQ ID NO: 595743 - DNA, 25 bp, Rattus norvegicus
cgagggccatgctgcgtcgccgttc

SEQ ID NO: 595744 - DNA, 25 bp, Rattus norvegicus
actcagtacctacggggcgccgcga

SEQ ID NO: 595745 - DNA, 25 bp, Rattus norvegicus
caagacttctaaacggagttgcccg

SEQ ID NO: 595746 - DNA, 25 bp, Rattus norvegicus
ggaggcatcagcctttacggcaaga

SEQ ID NO: 595747 - DNA, 25 bp, Rattus norvegicus
aaactcggcagttcttggagaggag

SEQ ID NO: 595748 - DNA, 25 bp, Rattus norvegicus
ggcgatttcgtccaagaccgagctc

SEQ ID NO: 595749 - DNA, 25 bp, Rattus norvegicus
ctcgtgaggaggttacggcgatttc

SEQ ID NO: 595750 - DNA, 25 bp, Rattus norvegicus
ggtcaagacgctgcgcctgcgtcct

SEQ ID NO: 595751 - DNA, 25 bp, Rattus norvegicus
ctggaacagccaagcggaacgaccc

SEQ ID NO: 595752 - DNA, 25 bp, Rattus norvegicus
cccgacgcggagctggaacagccaa

SEQ ID NO: 595753 - DNA, 25 bp, Rattus norvegicus
cagccgaccagcagaagcgggagcc

SEQ ID NO: 595754 - DNA, 25 bp, Rattus norvegicus
cggatccgctcggttccgttcggct

SEQ ID NO: 595755 - DNA, 25 bp, Rattus norvegicus
gctaccttaggcaagaccaactttg

SEQ ID NO: 595756 - DNA, 25 bp, Rattus norvegicus
cagtcttgcactggtctgcgctctc

SEQ ID NO: 595757 - DNA, 25 bp, Rattus norvegicus
taggatttgggaagaccagtcttgc

SEQ ID NO: 595758 - DNA, 25 bp, Rattus norvegicus
tcgcgccttcaaaggccggtcggtc

SEQ ID NO: 595759 - DNA, 25 bp, Rattus norvegicus
acaccgaggccgcttctaggatttg

SEQ ID NO: 595760 - DNA, 25 bp, Rattus norvegicus
gtcgcacatcacgtgccgctaaagg

SEQ ID NO: 595761 - DNA, 25 bp, Rattus norvegicus
aactcgcacgtcacgcgggagagga

SEQ ID NO: 595762 - DNA, 25 bp, Rattus norvegicus
ctcccagtaaaagtgacagctcgtg

SEQ ID NO: 595763 - DNA, 25 bp, Rattus norvegicus
tggaactgttctggagggaacccgc

SEQ ID NO: 595764 - DNA, 25 bp, Rattus norvegicus
agaaagacccggctggtcgcacatc

SEQ ID NO: 595765 - DNA, 25 bp, Rattus norvegicus
caaaccactcctgcgcgcaaaaagg

SEQ ID NO: 595766 - DNA, 25 bp, Rattus norvegicus
cttcgctgggactctgctaccttag

SEQ ID NO: 595767 - DNA, 25 bp, Rattus norvegicus
aggcttggcggtccattaccgcaca

SEQ ID NO: 595768 - DNA, 25 bp, Rattus norvegicus
gccctggtcatcctctgctggaact

SEQ ID NO: 595769 - DNA, 25 bp, Rattus norvegicus
acgtgcagaagcaggagactccctc

SEQ ID NO: 595770 - DNA, 25 bp, Rattus norvegicus
cccaataagcgctgcgaggttcgca

SEQ ID NO: 595771 - DNA, 25 bp, Rattus norvegicus
ccgccttgtcaacggcaactctggg

SEQ ID NO: 595772 - DNA, 25 bp, Rattus norvegicus
aagcctgctacctctgcggggagga

SEQ ID NO: 595773 - DNA, 25 bp, Rattus norvegicus
cagagcttcgagctggccaacgtgc

SEQ ID NO: 595774 - DNA, 25 bp, Rattus norvegicus
ctcgtgtgtccctgctgcttctcgt

SEQ ID NO: 595775 - DNA, 25 bp, Rattus norvegicus
tgtcaccggcctcgcagcagcagat

SEQ ID NO: 595776 - DNA, 25 bp, Rattus norvegicus
tgttgctacgtctgtggctcagcgc

SEQ ID NO: 595777 - DNA, 25 bp, Rattus norvegicus
cgtgctaaggggcatccaggagccc

SEQ ID NO: 595778 - DNA, 25 bp, Rattus norvegicus
gatgcgcacgattccaccaagtctg

SEQ ID NO: 595779 - DNA, 25 bp, Rattus norvegicus
cccgcgagtggaacaccgaggacgc

SEQ ID NO: 595780 - DNA, 25 bp, Rattus norvegicus
tgtactggctcaagaggccgcacca

SEQ ID NO: 595781 - DNA, 25 bp, Rattus norvegicus
acgcccgtggacaagcgcgtgtact

SEQ ID NO: 595782 - DNA, 25 bp, Rattus norvegicus
ctcacgcaccagtggcagagcttcg

SEQ ID NO: 595783 - DNA, 25 bp, Rattus norvegicus
ctgttggaaacaggtctcttgaccc

SEQ ID NO: 595784 - DNA, 25 bp, Rattus norvegicus
gtgtccctagcccaagacttgtttg

SEQ ID NO: 595785 - DNA, 25 bp, Rattus norvegicus
ggacgctggttttgtttcattgctg

SEQ ID NO: 595786 - DNA, 25 bp, Rattus norvegicus
ccctcggtacttcttggctgtttgg

SEQ ID NO: 595787 - DNA, 25 bp, Rattus norvegicus
tttggacatttttgagcgccgtggc

SEQ ID NO: 595788 - DNA, 25 bp, Rattus norvegicus
ttcgtccctctctggccactatgga

SEQ ID NO: 595789 - DNA, 25 bp, Rattus norvegicus
gttctgaacgtgaaaccctgttgga

SEQ ID NO: 595790 - DNA, 25 bp, Rattus norvegicus
aggcagcctttgatcatcttggaga

SEQ ID NO: 595791 - DNA, 25 bp, Rattus norvegicus
tacctcactgtggatctgctctggc

SEQ ID NO: 595792 - DNA, 25 bp, Rattus norvegicus
aggctccggcccttccttggtcaat

SEQ ID NO: 595793 - DNA, 25 bp, Rattus norvegicus
gcgagattgctgttcgcacgtctta

SEQ ID NO: 595794 - DNA, 25 bp, Rattus norvegicus
tctcccattgacgaggcgaaatctg

SEQ ID NO: 595795 - DNA, 25 bp, Rattus norvegicus
gaccctcgcccttgacattcaaatg

SEQ ID NO: 595796 - DNA, 25 bp, Rattus norvegicus
cggggatcgctcttctgcctttatt

SEQ ID NO: 595797 - DNA, 25 bp, Rattus norvegicus
tcgggtgtttattgcgcctccagaa

SEQ ID NO: 595798 - DNA, 25 bp, Rattus norvegicus
aaggctcgcacggtttgaagacatg

SEQ ID NO: 595799 - DNA, 25 bp, Rattus norvegicus
ttgtcagaagagaaactcgggtgtt

SEQ ID NO: 595800 - DNA, 25 bp, Rattus norvegicus
aatccgctcggctattgtcagaaga

SEQ ID NO: 595801 - DNA, 25 bp, Rattus norvegicus
tattgcgcctccagaatgtcaaagg

SEQ ID NO: 595802 - DNA, 25 bp, Rattus norvegicus
ctccagaatgtcaaaggctcgcacg

SEQ ID NO: 595803 - DNA, 25 bp, Rattus norvegicus
cccgagcatatgtctacgaggccgg

SEQ ID NO: 595804 - DNA, 25 bp, Rattus norvegicus
gaatagcccgagcatatgtctacga

SEQ ID NO: 595805 - DNA, 25 bp, Rattus norvegicus
tggcagggaatagcccgagcatatg

SEQ ID NO: 595806 - DNA, 25 bp, Rattus norvegicus
aagacatgctggcagggaatagccc

SEQ ID NO: 595807 - DNA, 25 bp, Rattus norvegicus
tcgcacggtttgaagacatgctggc

SEQ ID NO: 595808 - DNA, 25 bp, Rattus norvegicus
atatgtctacgaggccggggcagct

SEQ ID NO: 595809 - DNA, 25 bp, Rattus norvegicus
ccagttaattaaatccgctcggcta

SEQ ID NO: 595810 - DNA, 25 bp, Rattus norvegicus
tcggctattgtcagaagagaaactc

SEQ ID NO: 595811 - DNA, 25 bp, Rattus norvegicus
aagcttctcgaacatgggctcttta

SEQ ID NO: 595812 - DNA, 25 bp, Rattus norvegicus
cgcctccgtggacttaagcttctcg

SEQ ID NO: 595813 - DNA, 25 bp, Rattus norvegicus
cccgggtgagataagcagttcagac

SEQ ID NO: 595814 - DNA, 25 bp, Rattus norvegicus
catgggctctttaaagaactcgacc

SEQ ID NO: 595815 - DNA, 25 bp, Rattus norvegicus
ccgtgtggccttcacaaaaatttct

SEQ ID NO: 595816 - DNA, 25 bp, Rattus norvegicus
ttgcaaaactttgggtcagaggctc

SEQ ID NO: 595817 - DNA, 25 bp, Rattus norvegicus
ttgcggtaatagatcaggcatcttg

SEQ ID NO: 595818 - DNA, 25 bp, Rattus norvegicus
tccactcagcacaaggaaagtcctc

SEQ ID NO: 595819 - DNA, 25 bp, Rattus norvegicus
ctcctgagcgctgggtttatccctc

SEQ ID NO: 595820 - DNA, 25 bp, Rattus norvegicus
aagccactcctctctactcttggga

SEQ ID NO: 595821 - DNA, 25 bp, Rattus norvegicus
tactcttgggagatgagtggcccgc

SEQ ID NO: 595822 - DNA, 25 bp, Rattus norvegicus
acagcagcaggtgtttcttggccca

SEQ ID NO: 595823 - DNA, 25 bp, Rattus norvegicus
gcagttcagacaaacccgggcgacg

SEQ ID NO: 595824 - DNA, 25 bp, Rattus norvegicus
ggccagcggcctatattgtgtagtc

SEQ ID NO: 595825 - DNA, 25 bp, Rattus norvegicus
ttggtcagagccgtatcgatgttgg

SEQ ID NO: 595826 - DNA, 25 bp, Rattus norvegicus
gctgcaggtgcagctctcgggactt

SEQ ID NO: 595827 - DNA, 25 bp, Rattus norvegicus
agatccgtgtgtcggcctgaggaca

SEQ ID NO: 595828 - DNA, 25 bp, Rattus norvegicus
aaggaagatccgtgtgtcggcctga

SEQ ID NO: 595829 - DNA, 25 bp, Rattus norvegicus
cgtcccaaaggaagatccgtgtgtc

SEQ ID NO: 595830 - DNA, 25 bp, Rattus norvegicus
aagccgtcccaaaggaagatccgtg

SEQ ID NO: 595831 - DNA, 25 bp, Rattus norvegicus
tgttggacaggttaagccgtcccaa

SEQ ID NO: 595832 - DNA, 25 bp, Rattus norvegicus
tcgatgttggacaggttaagccgtc

SEQ ID NO: 595833 - DNA, 25 bp, Rattus norvegicus
ggaatcgatctgtacgcttttggtc

SEQ ID NO: 595834 - DNA, 25 bp, Rattus norvegicus
cagagccgtatcgatgttggacagg

SEQ ID NO: 595835 - DNA, 25 bp, Rattus norvegicus
acgcttttggtcagagccgtatcga

SEQ ID NO: 595836 - DNA, 25 bp, Rattus norvegicus
aggtgcagctctcgggacttctttc

SEQ ID NO: 595837 - DNA, 25 bp, Rattus norvegicus
gccgtatcgatgttggacaggttaa

SEQ ID NO: 595838 - DNA, 25 bp, Rattus norvegicus
caagcagcaataaaaggaatcgatc

SEQ ID NO: 595839 - DNA, 25 bp, Rattus norvegicus
ggcagcgctacactcggagcggata

SEQ ID NO: 595840 - DNA, 25 bp, Rattus norvegicus
tgcctccgctgcacccgtcggctat

SEQ ID NO: 595841 - DNA, 25 bp, Rattus norvegicus
gtcggctatgcacctgcatctctct

SEQ ID NO: 595842 - DNA, 25 bp, Rattus norvegicus
ctgcatctctctggcgtacggtacc

SEQ ID NO: 595843 - DNA, 25 bp, Rattus norvegicus
tgagctctcacactcctccctggca

SEQ ID NO: 595844 - DNA, 25 bp, Rattus norvegicus
acactcggagcggatatccagcctc

SEQ ID NO: 595845 - DNA, 25 bp, Rattus norvegicus
cggagcggatatccagcctcagcgc

SEQ ID NO: 595846 - DNA, 25 bp, Rattus norvegicus
cagcctcagcgcagagaggtgagcc

SEQ ID NO: 595847 - DNA, 25 bp, Rattus norvegicus
agaggtgagccgtgtcttcagcaga

SEQ ID NO: 595848 - DNA, 25 bp, Rattus norvegicus
aggggagcacagtcgagcatgcttc

SEQ ID NO: 595849 - DNA, 25 bp, Rattus norvegicus
agcacagtcgagcatgcttcatgcc

SEQ ID NO: 595850 - DNA, 25 bp, Rattus norvegicus
gagcatgcttcatgccctcagcagg

SEQ ID NO: 595851 - DNA, 25 bp, Rattus norvegicus
cctcagcagggtcaggctcggtggt

SEQ ID NO: 595852 - DNA, 25 bp, Rattus norvegicus
ctggcgtacggtaccctcctgagct

SEQ ID NO: 595853 - DNA, 25 bp, Rattus norvegicus
acctctgcgctccacaaggccagta

SEQ ID NO: 595854 - DNA, 25 bp, Rattus norvegicus
cggtcctcagaagccctcagcgaga

SEQ ID NO: 595855 - DNA, 25 bp, Rattus norvegicus
ctcagaagccctcagcgagagctga

SEQ ID NO: 595856 - DNA, 25 bp, Rattus norvegicus
ggttgggccggagatagactaaatc

SEQ ID NO: 595857 - DNA, 25 bp, Rattus norvegicus
gagatagactaaatctccctccctc

SEQ ID NO: 595858 - DNA, 25 bp, Rattus norvegicus
tgacagcgcgaatataagagagccc

SEQ ID NO: 595859 - DNA, 25 bp, Rattus norvegicus
cgaatataagagagcccagccaatc

SEQ ID NO: 595860 - DNA, 25 bp, Rattus norvegicus
gtaaactgactgaaggagcgcctcc

SEQ ID NO: 595861 - DNA, 25 bp, Rattus norvegicus
tgaaggagcgcctccttcgcctgac

SEQ ID NO: 595862 - DNA, 25 bp, Rattus norvegicus
tccttcgcctgaccggagcttctgg

SEQ ID NO: 595863 - DNA, 25 bp, Rattus norvegicus
accggagcttctggcagcgcactca

SEQ ID NO: 595864 - DNA, 25 bp, Rattus norvegicus
tctggcagcgcactcagcggggcct

SEQ ID NO: 595865 - DNA, 25 bp, Rattus norvegicus
gggtgcacacctcaaccggtctccg

SEQ ID NO: 595866 - DNA, 25 bp, Rattus norvegicus
ggccgctacgccaactgcctctgag

SEQ ID NO: 595867 - DNA, 25 bp, Rattus norvegicus
gtccagactgaagttcgggatgata

SEQ ID NO: 595868 - DNA, 25 bp, Rattus norvegicus
tttcttcattggtctccggctctgc

SEQ ID NO: 595869 - DNA, 25 bp, Rattus norvegicus
cggagttacagctacttcactgatg

SEQ ID NO: 595870 - DNA, 25 bp, Rattus norvegicus
cctggttcagccctcaacggagtta

SEQ ID NO: 595871 - DNA, 25 bp, Rattus norvegicus
aagtgggctccacgcttcctgaatc

SEQ ID NO: 595872 - DNA, 25 bp, Rattus norvegicus
ggcctaccaatgctctctcctgaaa

SEQ ID NO: 595873 - DNA, 25 bp, Rattus norvegicus
tcgtaagtcagagcccagtgccata

SEQ ID NO: 595874 - DNA, 25 bp, Rattus norvegicus
atcccgcggattggttcgtaagtca

SEQ ID NO: 595875 - DNA, 25 bp, Rattus norvegicus
ctcagctagtacaatcccgcggatt

SEQ ID NO: 595876 - DNA, 25 bp, Rattus norvegicus
cgcagcctccaattctcagctagta

SEQ ID NO: 595877 - DNA, 25 bp, Rattus norvegicus
ctcggccgcgtccatgatgaagagt

SEQ ID NO: 595878 - DNA, 25 bp, Rattus norvegicus
cccgatcaggtagatcttgtccaga

SEQ ID NO: 595879 - DNA, 25 bp, Rattus norvegicus
tgatagttaccagctccttctcggc

SEQ ID NO: 595880 - DNA, 25 bp, Rattus norvegicus
gccctgcgtctgtccaatagaaatg

SEQ ID NO: 595881 - DNA, 25 bp, Rattus norvegicus
gcactcgttcctgccgtagtactac

SEQ ID NO: 595882 - DNA, 25 bp, Rattus norvegicus
tcagctctacgctgcttgcagtcac

SEQ ID NO: 595883 - DNA, 25 bp, Rattus norvegicus
gggcgtgtcttctgcgcccgccact

SEQ ID NO: 595884 - DNA, 25 bp, Rattus norvegicus
aagtttcccgctgggcgcagtctcc

SEQ ID NO: 595885 - DNA, 25 bp, Rattus norvegicus
gcaagtttcccgctgggcgcagtct

SEQ ID NO: 595886 - DNA, 25 bp, Rattus norvegicus
gagcgcaagtttcccgctgggcgca

SEQ ID NO: 595887 - DNA, 25 bp, Rattus norvegicus
gctgagcgcaagtttcccgctgggc

SEQ ID NO: 595888 - DNA, 25 bp, Rattus norvegicus
cgctcagctctacgctgcttgcagt

SEQ ID NO: 595889 - DNA, 25 bp, Rattus norvegicus
ctcgttcctgccgtagtactacggg

SEQ ID NO: 595890 - DNA, 25 bp, Rattus norvegicus
ggtgcactcgttcctgccgtagtac

SEQ ID NO: 595891 - DNA, 25 bp, Rattus norvegicus
tcgcagcgctggtgcactcgttcct

SEQ ID NO: 595892 - DNA, 25 bp, Rattus norvegicus
ctcttcgcagcgctggtgcactcgt

SEQ ID NO: 595893 - DNA, 25 bp, Rattus norvegicus
gatttgggctccgtgcgacggcccc

SEQ ID NO: 595894 - DNA, 25 bp, Rattus norvegicus
cggagctgagcgcaagtttcccgct

SEQ ID NO: 595895 - DNA, 25 bp, Rattus norvegicus
ttcgaaacacttggtggagggaagc

SEQ ID NO: 595896 - DNA, 25 bp, Rattus norvegicus
ccctaagcgaggcagctcatcaata

SEQ ID NO: 595897 - DNA, 25 bp, Rattus norvegicus
tcggcaacctgacaacccagtcggg

SEQ ID NO: 595898 - DNA, 25 bp, Rattus norvegicus
ccgatgtcagacacgcggccagagg

SEQ ID NO: 595899 - DNA, 25 bp, Rattus norvegicus
gaggccgagcagatcagcgaagtct

SEQ ID NO: 595900 - DNA, 25 bp, Rattus norvegicus
ggggccaaagggtctcccatcactc

SEQ ID NO: 595901 - DNA, 25 bp, Rattus norvegicus
actctggagtccctaccaccgtggg

SEQ ID NO: 595902 - DNA, 25 bp, Rattus norvegicus
taccaccgtggggtctacacaggct

SEQ ID NO: 595903 - DNA, 25 bp, Rattus norvegicus
tccggatccctatcttcctaggtct

SEQ ID NO: 595904 - DNA, 25 bp, Rattus norvegicus
taggtctccacgatcctaaggtccc

SEQ ID NO: 595905 - DNA, 25 bp, Rattus norvegicus
atcctaaggtccctcatcctgggtc

SEQ ID NO: 595906 - DNA, 25 bp, Rattus norvegicus
tggctccacctcctgtgcagagacg

SEQ ID NO: 595907 - DNA, 25 bp, Rattus norvegicus
tgtgcagagacgcagaggtaacgcc

SEQ ID NO: 595908 - DNA, 25 bp, Rattus norvegicus
agctgctttgatgtactgggcgccc

SEQ ID NO: 595909 - DNA, 25 bp, Rattus norvegicus
cgctagctagcgtctgccagaaagc

SEQ ID NO: 595910 - DNA, 25 bp, Rattus norvegicus
tgccgcaccgcgatctgaagctgat

SEQ ID NO: 595911 - DNA, 25 bp, Rattus norvegicus
ccacgaagagagtgtggttgcccgc

SEQ ID NO: 595912 - DNA, 25 bp, Rattus norvegicus
tgcacgctaagatgagctcccacca

SEQ ID NO: 595913 - DNA, 25 bp, Rattus norvegicus
acttgagcagctccgtgaccttggg

SEQ ID NO: 595914 - DNA, 25 bp, Rattus norvegicus
accgtcttgctcttccggtgcggga

SEQ ID NO: 595915 - DNA, 25 bp, Rattus norvegicus
ggggcttcttcgattcccgcgatgc

SEQ ID NO: 595916 - DNA, 25 bp, Rattus norvegicus
agtcctgacgtcacgctacggtttc

SEQ ID NO: 595917 - DNA, 25 bp, Rattus norvegicus
cgccggaaagcgtagtcgctagcta

SEQ ID NO: 595918 - DNA, 25 bp, Rattus norvegicus
gcgaccaacgcaccacagtacgaaa

SEQ ID NO: 595919 - DNA, 25 bp, Rattus norvegicus
tggtcagcttcacgccaggcatgct

SEQ ID NO: 595920 - DNA, 25 bp, Rattus norvegicus
gcaccatcttgcagtaggcctgggt

SEQ ID NO: 595921 - DNA, 25 bp, Rattus norvegicus
acttggcgccgtgtagcaccatctt

SEQ ID NO: 595922 - DNA, 25 bp, Rattus norvegicus
tctgccaccagaagcccgttgacgg

SEQ ID NO: 595923 - DNA, 25 bp, Rattus norvegicus
gatttctcggaaaggcgagcgcttc

SEQ ID NO: 595924 - DNA, 25 bp, Rattus norvegicus
aggtgacactcagggcgcctctgga

SEQ ID NO: 595925 - DNA, 25 bp, Rattus norvegicus
tccttgaccttaggcggacgctcca

SEQ ID NO: 595926 - DNA, 25 bp, Rattus norvegicus
accagcttccttgaccttaggcgga

SEQ ID NO: 595927 - DNA, 25 bp, Rattus norvegicus
cccgaggatgattcgagcaccacca

SEQ ID NO: 595928 - DNA, 25 bp, Rattus norvegicus
gacgcgcagaagtgatttctcggaa

SEQ ID NO: 595929 - DNA, 25 bp, Rattus norvegicus
tctgaaactccagcccgggcaggtg

SEQ ID NO: 595930 - DNA, 25 bp, Rattus norvegicus
gaccggcctttgctctgaaactcca

SEQ ID NO: 595931 - DNA, 25 bp, Rattus norvegicus
aggacgcaactctgggaccggcctt

SEQ ID NO: 595932 - DNA, 25 bp, Rattus norvegicus
cgccctgtctataaaagcaggcgca

SEQ ID NO: 595933 - DNA, 25 bp, Rattus norvegicus
ctccatccaggagagcggcctgcta

SEQ ID NO: 595934 - DNA, 25 bp, Rattus norvegicus
tgcgcaatttcaggttatcatcctc

SEQ ID NO: 595935 - DNA, 25 bp, Rattus norvegicus
ctggtttcccagatttcctgcgcaa

SEQ ID NO: 595936 - DNA, 25 bp, Rattus norvegicus
ctagtggctgtcgtccaggacgcaa

SEQ ID NO: 595937 - DNA, 25 bp, Rattus norvegicus
cggaagctgtttggacacctggagc

SEQ ID NO: 595938 - DNA, 25 bp, Rattus norvegicus
gacccggaagctgtttggacacctg

SEQ ID NO: 595939 - DNA, 25 bp, Rattus norvegicus
caggtgacccggaagctgtttggac

SEQ ID NO: 595940 - DNA, 25 bp, Rattus norvegicus
ccatccccagtgagcggcagaggca

SEQ ID NO: 595941 - DNA, 25 bp, Rattus norvegicus
ggcggcggacaccatccccagtgag

SEQ ID NO: 595942 - DNA, 25 bp, Rattus norvegicus
gacggcctggagcccgtgtgcttcc

SEQ ID NO: 595943 - DNA, 25 bp, Rattus norvegicus
gctgccgaagctgtatgggccggac

SEQ ID NO: 595944 - DNA, 25 bp, Rattus norvegicus
agcgcggcgtgctcctgcacagcaa

SEQ ID NO: 595945 - DNA, 25 bp, Rattus norvegicus
aagctgtttggacacctggagcgcg

SEQ ID NO: 595946 - DNA, 25 bp, Rattus norvegicus
aaccgcaagggtgtgttcgtgaagc

SEQ ID NO: 595947 - DNA, 25 bp, Rattus norvegicus
tcctgcacagcaaccgcaagggtgt

SEQ ID NO: 595948 - DNA, 25 bp, Rattus norvegicus
ttcgtgaagcggctgtgccagggcc

SEQ ID NO: 595949 - DNA, 25 bp, Rattus norvegicus
gtgctcctgcacagcaaccgcaagg

SEQ ID NO: 595950 - DNA, 25 bp, Rattus norvegicus
gccgcgtgttctgcagcggcaacgc

SEQ ID NO: 595951 - DNA, 25 bp, Rattus norvegicus
agctccagcagggagcaacgcgccg

SEQ ID NO: 595952 - DNA, 25 bp, Rattus norvegicus
gatgcgacggaacctgctgcagacc

SEQ ID NO: 595953 - DNA, 25 bp, Rattus norvegicus
cttctccagatggtgtcggtgtgca

SEQ ID NO: 595954 - DNA, 25 bp, Rattus norvegicus
gcagcgacgcgaagatctccactag

SEQ ID NO: 595955 - DNA, 25 bp, Rattus norvegicus
catggcgctgcagcctatttccagg

SEQ ID NO: 595956 - DNA, 25 bp, Rattus norvegicus
tgatgagttcgggtccggaaagcca

SEQ ID NO: 595957 - DNA, 25 bp, Rattus norvegicus
tcggggtccgtgtccgcctcactgt

SEQ ID NO: 595958 - DNA, 25 bp, Rattus norvegicus
gtgggcgcgccctctcttagggcca

SEQ ID NO: 595959 - DNA, 25 bp, Rattus norvegicus
tagggccacgcccttgcatggcgct

SEQ ID NO: 595960 - DNA, 25 bp, Rattus norvegicus
ccctaaaagagggttgatgagttcg

SEQ ID NO: 595961 - DNA, 25 bp, Rattus norvegicus
tccagctgctccctaaaagagggtt

SEQ ID NO: 595962 - DNA, 25 bp, Rattus norvegicus
accggaaatctaggtgtccagctgc

SEQ ID NO: 595963 - DNA, 25 bp, Rattus norvegicus
ctgctgcagacctgcgccaggctgg

SEQ ID NO: 595964 - DNA, 25 bp, Rattus norvegicus
tccactagcagctcgggaggcagct

SEQ ID NO: 595965 - DNA, 25 bp, Rattus norvegicus
acttgaagctgagagggaacgcaag

SEQ ID NO: 595966 - DNA, 25 bp, Rattus norvegicus
tctccgagtctgtgaaataaaaaca

SEQ ID NO: 595967 - DNA, 25 bp, Rattus norvegicus
aggctgggcactactgcgcatgttt

SEQ ID NO: 595968 - DNA, 25 bp, Rattus norvegicus
cggggtgtgtttactctccgagtct

SEQ ID NO: 595969 - DNA, 25 bp, Rattus norvegicus
aacgcaagggactggcggctgcatc

SEQ ID NO: 595970 - DNA, 25 bp, Rattus norvegicus
agcaacctcgacagctgcgggctag

SEQ ID NO: 595971 - DNA, 25 bp, Rattus norvegicus
ggccgtgaccgcatgctcctgcaat

SEQ ID NO: 595972 - DNA, 25 bp, Rattus norvegicus
caaatcaaaaacaaagccggccgtg

SEQ ID NO: 595973 - DNA, 25 bp, Rattus norvegicus
tctgtttacatcttggtctatcgca

SEQ ID NO: 595974 - DNA, 25 bp, Rattus norvegicus
tcacgcggaagaacgaggaacttga

SEQ ID NO: 595975 - DNA, 25 bp, Rattus norvegicus
tgacactcgctctgtttacatcttg

SEQ ID NO: 595976 - DNA, 25 bp, Rattus norvegicus
ataaaaacaaacaaggcgtcacgcg

SEQ ID NO: 595977 - DNA, 25 bp, Rattus norvegicus
gcgcatgtttccattccagagagtg

SEQ ID NO: 595978 - DNA, 25 bp, Rattus norvegicus
ttccattccagagagtgacactcgc

SEQ ID NO: 595979 - DNA, 25 bp, Rattus norvegicus
ctttcctgggaatgagcgtcggatt

SEQ ID NO: 595980 - DNA, 25 bp, Rattus norvegicus
ttccagcccgggctctttcctggga

SEQ ID NO: 595981 - DNA, 25 bp, Rattus norvegicus
ggggcctacgttctccatgttgagt

SEQ ID NO: 595982 - DNA, 25 bp, Rattus norvegicus
gcgttccggaatgcccaggttccag

SEQ ID NO: 595983 - DNA, 25 bp, Rattus norvegicus
gcgtcggattttaggagtcatcgta

SEQ ID NO: 595984 - DNA, 25 bp, Rattus norvegicus
gcttccggctctcggcgttccggaa

SEQ ID NO: 595985 - DNA, 25 bp, Rattus norvegicus
cccacgacatcttgagcaattcttg

SEQ ID NO: 595986 - DNA, 25 bp, Rattus norvegicus
ttgtttacttgttctgaagagcagg

SEQ ID NO: 595987 - DNA, 25 bp, Rattus norvegicus
tgacgcggagattgcctgcacagct

SEQ ID NO: 595988 - DNA, 25 bp, Rattus norvegicus
gcctgcacagctagccaatagtttc

SEQ ID NO: 595989 - DNA, 25 bp, Rattus norvegicus
gtttccaagacaacaaagccgactg

SEQ ID NO: 595990 - DNA, 25 bp, Rattus norvegicus
ttccaatcaaaaagaggcaggggcg

SEQ ID NO: 595991 - DNA, 25 bp, Rattus norvegicus
catgttgagtgtggcgctccgctct

SEQ ID NO: 595992 - DNA, 25 bp, Rattus norvegicus
tgtatggaccggacaacgccgaagc

SEQ ID NO: 595993 - DNA, 25 bp, Rattus norvegicus
tccttagtgggtcccaggtctgggc

SEQ ID NO: 595994 - DNA, 25 bp, Rattus norvegicus
cgtcggtcaccagtgagctcggcat

SEQ ID NO: 595995 - DNA, 25 bp, Rattus norvegicus
gtacgcatgcgggccgccgagcttc

SEQ ID NO: 595996 - DNA, 25 bp, Rattus norvegicus
agcgccggagcttcggtgcgcgccg

SEQ ID NO: 595997 - DNA, 25 bp, Rattus norvegicus
aagggtctccctggtggtgtcgtgc

SEQ ID NO: 595998 - DNA, 25 bp, Rattus norvegicus
cctggccgtcggtcaccagtgagct

SEQ ID NO: 595999 - DNA, 25 bp, Rattus norvegicus
gctcggcattccctgcgggactgga

SEQ ID NO: 596000 - DNA, 25 bp, Rattus norvegicus
attccctgcgggactggagacccga

SEQ ID NO: 596001 - DNA, 25 bp, Rattus norvegicus
ttccctgcgggactggagacccgac

SEQ ID NO: 596002 - DNA, 25 bp, Rattus norvegicus
cccactggcggaggacaccgcaggc

SEQ ID NO: 596003 - DNA, 25 bp, Rattus norvegicus
cgctcggctgtgtccttagtgggtc

SEQ ID NO: 596004 - DNA, 25 bp, Rattus norvegicus
tgtgtccttagtgggtcccaggtct

SEQ ID NO: 596005 - DNA, 25 bp, Rattus norvegicus
gtcccaggtctgggcgccctgcgat

SEQ ID NO: 596006 - DNA, 25 bp, Rattus norvegicus
gctgtgtccttagtgggtcccaggt

SEQ ID NO: 596007 - DNA, 25 bp, Rattus norvegicus
cgggcgttgcgaagacttgtttgct

SEQ ID NO: 596008 - DNA, 25 bp, Rattus norvegicus
gcgacgaaatccaagccgctcattc

SEQ ID NO: 596009 - DNA, 25 bp, Rattus norvegicus
cccgcttcttgaatggcagcctcga

SEQ ID NO: 596010 - DNA, 25 bp, Rattus norvegicus
cagctctgcccggtagtctattttt

SEQ ID NO: 596011 - DNA, 25 bp, Rattus norvegicus
tagtctatttttggcgacgccctcg

SEQ ID NO: 596012 - DNA, 25 bp, Rattus norvegicus
acgccctcgtagcatttccggaatc

SEQ ID NO: 596013 - DNA, 25 bp, Rattus norvegicus
tgcgaccgactctcgcgacgaaatc

SEQ ID NO: 596014 - DNA, 25 bp, Rattus norvegicus
cgcccaagtctttacgtcacggcta

SEQ ID NO: 596015 - DNA, 25 bp, Rattus norvegicus
cttgtttgcttgagtttggaccctg

SEQ ID NO: 596016 - DNA, 25 bp, Rattus norvegicus
gctgggtatgcggaaactacaatcc

SEQ ID NO: 596017 - DNA, 25 bp, Rattus norvegicus
tgatgagcacctttcctgccgcttc

SEQ ID NO: 596018 - DNA, 25 bp, Rattus norvegicus
ctcggcaggcactgaggaagaagcc

SEQ ID NO: 596019 - DNA, 25 bp, Rattus norvegicus
ctgcggacatgaactcgcccgtgga

SEQ ID NO: 596020 - DNA, 25 bp, Rattus norvegicus
tggaccctgcgacagttctcatttc

SEQ ID NO: 596021 - DNA, 25 bp, Rattus norvegicus
tgcacaagtccagcaggccgcacag

SEQ ID NO: 596022 - DNA, 25 bp, Rattus norvegicus
caactcgagcgggatgcacaagtcc

SEQ ID NO: 596023 - DNA, 25 bp, Rattus norvegicus
ggagaaccagcggtacacgccgtcc

SEQ ID NO: 596024 - DNA, 25 bp, Rattus norvegicus
gcacaggaactccacgcgctgcggt

SEQ ID NO: 596025 - DNA, 25 bp, Rattus norvegicus
acggcagttcggagaaccagcggta

SEQ ID NO: 596026 - DNA, 25 bp, Rattus norvegicus
cgaatggtagtccttgcgtgccaag

SEQ ID NO: 596027 - DNA, 25 bp, Rattus norvegicus
agtcgcgcagcgaatggtagtcctt

SEQ ID NO: 596028 - DNA, 25 bp, Rattus norvegicus
ttggccttaatctcggagtcgcgca

SEQ ID NO: 596029 - DNA, 25 bp, Rattus norvegicus
gtccgccggattgttggccttaatc

SEQ ID NO: 596030 - DNA, 25 bp, Rattus norvegicus
accacctcgtccgtcaggttggtga

SEQ ID NO: 596031 - DNA, 25 bp, Rattus norvegicus
agcgacaccaacagcttgctgcgca

SEQ ID NO: 596032 - DNA, 25 bp, Rattus norvegicus
tgagcgtgcggtacaacacgcccgc

SEQ ID NO: 596033 - DNA, 25 bp, Rattus norvegicus
agctgtagcccgtagttgtggatga

SEQ ID NO: 596034 - DNA, 25 bp, Rattus norvegicus
cacgagccgaggaagcgcaactcga

SEQ ID NO: 596035 - DNA, 25 bp, Rattus norvegicus
gcggcaacacgtaccaaggcacctg

SEQ ID NO: 596036 - DNA, 25 bp, Rattus norvegicus
acggagacctactcggatggaggta

SEQ ID NO: 596037 - DNA, 25 bp, Rattus norvegicus
agcaacggactgcaggatggctacg

SEQ ID NO: 596038 - DNA, 25 bp, Rattus norvegicus
tctaaaatgaacaatcgccgcgggc

SEQ ID NO: 596039 - DNA, 25 bp, Rattus norvegicus
acgcacggatttaaggggcgctacg

SEQ ID NO: 596040 - DNA, 25 bp, Rattus norvegicus
ggcgtctacacctggccaagcggca

SEQ ID NO: 596041 - DNA, 25 bp, Rattus norvegicus
tacgcagttcctgtccctttaaatc

SEQ ID NO: 596042 - DNA, 25 bp, Rattus norvegicus
acggagccaaatacgaagggacctg

SEQ ID NO: 596043 - DNA, 25 bp, Rattus norvegicus
taattttgacgatggagggtcctac

SEQ ID NO: 596044 - DNA, 25 bp, Rattus norvegicus
aggctccggcgcagctctaaaatga

SEQ ID NO: 596045 - DNA, 25 bp, Rattus norvegicus
tttttcaccgcttgcgggattcgca

SEQ ID NO: 596046 - DNA, 25 bp, Rattus norvegicus
cgggattcgcaaaccgcgttacatg

SEQ ID NO: 596047 - DNA, 25 bp, Rattus norvegicus
ccgcgttacatgcatgtccagtggg

SEQ ID NO: 596048 - DNA, 25 bp, Rattus norvegicus
agactccggtttgttgatcgccttg

SEQ ID NO: 596049 - DNA, 25 bp, Rattus norvegicus
cagtgaatccagctgggtgagaacc

SEQ ID NO: 596050 - DNA, 25 bp, Rattus norvegicus
tgagaaccaggggtctgcgcctacc

SEQ ID NO: 596051 - DNA, 25 bp, Rattus norvegicus
gttgtgtcccgaagtgcccttctcc

SEQ ID NO: 596052 - DNA, 25 bp, Rattus norvegicus
actccaatggggaaactctttcgtg

SEQ ID NO: 596053 - DNA, 25 bp, Rattus norvegicus
agcacggactttgcgcccggatcag

SEQ ID NO: 596054 - DNA, 25 bp, Rattus norvegicus
acgcgctcagctacccagtggttcg

SEQ ID NO: 596055 - DNA, 25 bp, Rattus norvegicus
ggtccttgcatacccgttgtgcgcg

SEQ ID NO: 596056 - DNA, 25 bp, Rattus norvegicus
ccagctccgaggaggtccttgcata

SEQ ID NO: 596057 - DNA, 25 bp, Rattus norvegicus
gcataccagtctgtaccgcagctcg

SEQ ID NO: 596058 - DNA, 25 bp, Rattus norvegicus
taccgcagctcggacactccaatgg

SEQ ID NO: 596059 - DNA, 25 bp, Rattus norvegicus
tctgaaaaacctggtcggacgcgcg

SEQ ID NO: 596060 - DNA, 25 bp, Rattus norvegicus
cctcgcttgctgctgtggagcagcc

SEQ ID NO: 596061 - DNA, 25 bp, Rattus norvegicus
cccaacagtggtggccggtcatgcc

SEQ ID NO: 596062 - DNA, 25 bp, Rattus norvegicus
tggagcagcctcttaaagtggcggc

SEQ ID NO: 596063 - DNA, 25 bp, Rattus norvegicus
cttggcagagccgagcgcactcttc

SEQ ID NO: 596064 - DNA, 25 bp, Rattus norvegicus
tgaatctggagcaacggtgtaagcg

SEQ ID NO: 596065 - DNA, 25 bp, Rattus norvegicus
tcagttggcggttgctccagcccgc

SEQ ID NO: 596066 - DNA, 25 bp, Rattus norvegicus
cagagccgagcgcactcttcgggcg

SEQ ID NO: 596067 - DNA, 25 bp, Rattus norvegicus
ccctttggtgccacaggcccgagta

SEQ ID NO: 596068 - DNA, 25 bp, Rattus norvegicus
gctcagtcacgagcgcagcgtcctt

SEQ ID NO: 596069 - DNA, 25 bp, Rattus norvegicus
ttgcactcagttggcggttgctcca

SEQ ID NO: 596070 - DNA, 25 bp, Rattus norvegicus
cgcaaagggtttgcactcagttggc

SEQ ID NO: 596071 - DNA, 25 bp, Rattus norvegicus
tccgggcgcaaagggtttgcactca

SEQ ID NO: 596072 - DNA, 25 bp, Rattus norvegicus
tctctttatagtcgttggacgggtc

SEQ ID NO: 596073 - DNA, 25 bp, Rattus norvegicus
gcggacagtctgctctctttatagt

SEQ ID NO: 596074 - DNA, 25 bp, Rattus norvegicus
cacgagcgcagcgtccttggcagag

SEQ ID NO: 596075 - DNA, 25 bp, Rattus norvegicus
gcaacggtgtaagcgacaagaaggc

SEQ ID NO: 596076 - DNA, 25 bp, Rattus norvegicus
tgaggcttagcggacagtctgctct

SEQ ID NO: 596077 - DNA, 25 bp, Rattus norvegicus
ccagcgctcggatgggctcaagtat

SEQ ID NO: 596078 - DNA, 25 bp, Rattus norvegicus
cactgcgtgccagcaagatccggga

SEQ ID NO: 596079 - DNA, 25 bp, Rattus norvegicus
gcccacagtgactcggagatcctga

SEQ ID NO: 596080 - DNA, 25 bp, Rattus norvegicus
tcgccaagcagaaagccgagatcgc

SEQ ID NO: 596081 - DNA, 25 bp, Rattus norvegicus
tccgcagcgagcacacgaacggtgc

SEQ ID NO: 596082 - DNA, 25 bp, Rattus norvegicus
catgggtacggatgtatgaccttcc

SEQ ID NO: 596083 - DNA, 25 bp, Rattus norvegicus
ctgaagctgcgcaagtctgagtcca

SEQ ID NO: 596084 - DNA, 25 bp, Rattus norvegicus
tccaagagcagcctggctagccagc

SEQ ID NO: 596085 - DNA, 25 bp, Rattus norvegicus
agcgcagcaagcagagctccttccg

SEQ ID NO: 596086 - DNA, 25 bp, Rattus norvegicus
accgtgagttccacggccagcgaca

SEQ ID NO: 596087 - DNA, 25 bp, Rattus norvegicus
ccaccatcagcctgggtgaggccga

SEQ ID NO: 596088 - DNA, 25 bp, Rattus norvegicus
gctggctgtcattgaggacgacatc

SEQ ID NO: 596089 - DNA, 25 bp, Rattus norvegicus
aaacgacaagcgctcgggctttggc

SEQ ID NO: 596090 - DNA, 25 bp, Rattus norvegicus
gacagagtgtcccttacggcatggc

SEQ ID NO: 596091 - DNA, 25 bp, Rattus norvegicus
cggcgcgctatatgaacgtcacttc

SEQ ID NO: 596092 - DNA, 25 bp, Rattus norvegicus
ctcgggcccgcgttagtatatatcc

SEQ ID NO: 596093 - DNA, 25 bp, Rattus norvegicus
caaccgactccaccagtacttaggg

SEQ ID NO: 596094 - DNA, 25 bp, Rattus norvegicus
tgtctccgttggagcaaccgactcc

SEQ ID NO: 596095 - DNA, 25 bp, Rattus norvegicus
tcctgtccgtttttctaatgtctcc

SEQ ID NO: 596096 - DNA, 25 bp, Rattus norvegicus
ccggccaaaaacgagcggcgcgcta

SEQ ID NO: 596097 - DNA, 25 bp, Rattus norvegicus
atgatgatgttctgtccggccaaaa

SEQ ID NO: 596098 - DNA, 25 bp, Rattus norvegicus
ttgcccatcgcgcaggttctgaagg

SEQ ID NO: 596099 - DNA, 25 bp, Rattus norvegicus
ttggacactttcttctccatcttgg

SEQ ID NO: 596100 - DNA, 25 bp, Rattus norvegicus
ttccgcgagcgcttggacactttct

SEQ ID NO: 596101 - DNA, 25 bp, Rattus norvegicus
aggcataggcctaccaccctgggac

SEQ ID NO: 596102 - DNA, 25 bp, Rattus norvegicus
agacccggtagagaaggcgaagcct

SEQ ID NO: 596103 - DNA, 25 bp, Rattus norvegicus
tctgaaggggtacctagaggcaacg

SEQ ID NO: 596104 - DNA, 25 bp, Rattus norvegicus
ctcggggctgcaaagagacccggta

SEQ ID NO: 596105 - DNA, 25 bp, Rattus norvegicus
ccttacaagtccctgtgtgtgtgca

SEQ ID NO: 596106 - DNA, 25 bp, Rattus norvegicus
cacgatggagaagacgccgcacaca

SEQ ID NO: 596107 - DNA, 25 bp, Rattus norvegicus
cgtcacgaagatgcccgaaccgatg

SEQ ID NO: 596108 - DNA, 25 bp, Rattus norvegicus
cccgaaccgatgatggtgcccacta

SEQ ID NO: 596109 - DNA, 25 bp, Rattus norvegicus
cagtgtgatattgcgctgcagggtc

SEQ ID NO: 596110 - DNA, 25 bp, Rattus norvegicus
gccgctctccgcgtatagagaaatg

SEQ ID NO: 596111 - DNA, 25 bp, Rattus norvegicus
gcgcggccttttattgctaccgtta

SEQ ID NO: 596112 - DNA, 25 bp, Rattus norvegicus
tggagcgtatgatgcggactgtatc

SEQ ID NO: 596113 - DNA, 25 bp, Rattus norvegicus
gcgagccgtagacctctagcatgta

SEQ ID NO: 596114 - DNA, 25 bp, Rattus norvegicus
tcacaagacctgactgctgtacgcg

SEQ ID NO: 596115 - DNA, 25 bp, Rattus norvegicus
ccagcgccacgatgtactgtgagga

SEQ ID NO: 596116 - DNA, 25 bp, Rattus norvegicus
gggccgaatgatgagcagctcgatc

SEQ ID NO: 596117 - DNA, 25 bp, Rattus norvegicus
tcgccgcctgactttgagatggtag

SEQ ID NO: 596118 - DNA, 25 bp, Rattus norvegicus
gtatcgcggcgtgtttcacaagacc

SEQ ID NO: 596119 - DNA, 25 bp, Rattus norvegicus
ggctgataactggtgctcgcttccc

SEQ ID NO: 596120 - DNA, 25 bp, Rattus norvegicus
catgttcactggagtccgtcggcga

SEQ ID NO: 596121 - DNA, 25 bp, Rattus norvegicus
cgaaagcgcgcgcaagaggcgccca

SEQ ID NO: 596122 - DNA, 25 bp, Rattus norvegicus
cccgagctcagggagcctgcgctga

SEQ ID NO: 596123 - DNA, 25 bp, Rattus norvegicus
tgctgcttctctcgcgaggacggac

SEQ ID NO: 596124 - DNA, 25 bp, Rattus norvegicus
acaaacaccacgagaattccgcagc

SEQ ID NO: 596125 - DNA, 25 bp, Rattus norvegicus
gggaggacaactgcgcatgttcact

SEQ ID NO: 596126 - DNA, 25 bp, Rattus norvegicus
ttccgcagcccacacggtaattgca

SEQ ID NO: 596127 - DNA, 25 bp, Rattus norvegicus
acacggtaattgcagctcccgcagc

SEQ ID NO: 596128 - DNA, 25 bp, Rattus norvegicus
agcgagagcgagatctccgtccgcc

SEQ ID NO: 596129 - DNA, 25 bp, Rattus norvegicus
gcccagtctgtcagtgcagggcctc

SEQ ID NO: 596130 - DNA, 25 bp, Rattus norvegicus
atctcccggcagttcttggcgctct

SEQ ID NO: 596131 - DNA, 25 bp, Rattus norvegicus
ctctgtttacatcggggctgataac

SEQ ID NO: 596132 - DNA, 25 bp, Rattus norvegicus
aggacggacgccattatcgcatctc

SEQ ID NO: 596133 - DNA, 25 bp, Rattus norvegicus
agagagtttcccaccaggccggcgt

SEQ ID NO: 596134 - DNA, 25 bp, Rattus norvegicus
accctgtactttggggcagctccgc

SEQ ID NO: 596135 - DNA, 25 bp, Rattus norvegicus
ccaacacctaggaaaagccgtgcta

SEQ ID NO: 596136 - DNA, 25 bp, Rattus norvegicus
gtatcgggattcaaccggacttcca

SEQ ID NO: 596137 - DNA, 25 bp, Rattus norvegicus
cagctccgctggagtagtccacgga

SEQ ID NO: 596138 - DNA, 25 bp, Rattus norvegicus
accggacttccagtggcggtccaga

SEQ ID NO: 596139 - DNA, 25 bp, Rattus norvegicus
cctgctagcagacttgagggtcgcc

SEQ ID NO: 596140 - DNA, 25 bp, Rattus norvegicus
gagccgttcgtctgctactccacag

SEQ ID NO: 596141 - DNA, 25 bp, Rattus norvegicus
cattcattgcgacttggagccgttc

SEQ ID NO: 596142 - DNA, 25 bp, Rattus norvegicus
ggtgacccggtagctcattcattgc

SEQ ID NO: 596143 - DNA, 25 bp, Rattus norvegicus
ccgttgcgaacgcagagcaagcgtc

SEQ ID NO: 596144 - DNA, 25 bp, Rattus norvegicus
gcaagcgtgtaacccaagccggggc

SEQ ID NO: 596145 - DNA, 25 bp, Rattus norvegicus
cgtggctaggtggatcccatgaaac

SEQ ID NO: 596146 - DNA, 25 bp, Rattus norvegicus
tccacggagttaagctaagcagacc

SEQ ID NO: 596147 - DNA, 25 bp, Rattus norvegicus
cccgcgtctcggcatgggcacccag

SEQ ID NO: 596148 - DNA, 25 bp, Rattus norvegicus
agcccggccacctcgcggcctgcac

SEQ ID NO: 596149 - DNA, 25 bp, Rattus norvegicus
cgccgagtgccaagcgcgccgtaat

SEQ ID NO: 596150 - DNA, 25 bp, Rattus norvegicus
tctaatctctgctggcgggcagggc

SEQ ID NO: 596151 - DNA, 25 bp, Rattus norvegicus
gtaatctaatctctgctggcgggca

SEQ ID NO: 596152 - DNA, 25 bp, Rattus norvegicus
gcgcgccgtaatctaatctctgctg

SEQ ID NO: 596153 - DNA, 25 bp, Rattus norvegicus
gccaagcgcgccgtaatctaatctc

SEQ ID NO: 596154 - DNA, 25 bp, Rattus norvegicus
gagtcaaactttgcccgcggtgccc

SEQ ID NO: 596155 - DNA, 25 bp, Rattus norvegicus
tcaagcgtgagtcaaactttgcccg

SEQ ID NO: 596156 - DNA, 25 bp, Rattus norvegicus
cccggcagatcaagcgtgagtcaaa

SEQ ID NO: 596157 - DNA, 25 bp, Rattus norvegicus
gtccaggaggaaacagagcaatccc

SEQ ID NO: 596158 - DNA, 25 bp, Rattus norvegicus
cgcacggcgccggagacatgtccag

SEQ ID NO: 596159 - DNA, 25 bp, Rattus norvegicus
ccgcatcagagatggtgcggcgata

SEQ ID NO: 596160 - DNA, 25 bp, Rattus norvegicus
cgccggagacatgtccaggaggaaa

SEQ ID NO: 596161 - DNA, 25 bp, Rattus norvegicus
tgctcaccaccgtagatgggatctc

SEQ ID NO: 596162 - DNA, 25 bp, Rattus norvegicus
ctgctaacgcggaattcccagggtt

SEQ ID NO: 596163 - DNA, 25 bp, Rattus norvegicus
gttgcccgaaatcaaccggcatggg

SEQ ID NO: 596164 - DNA, 25 bp, Rattus norvegicus
gcgacgtcagtgagccgctacctac

SEQ ID NO: 596165 - DNA, 25 bp, Rattus norvegicus
ggatctcccggtgcaacaacctgta

SEQ ID NO: 596166 - DNA, 25 bp, Rattus norvegicus
caacctgtaagagtcgccggagcga

SEQ ID NO: 596167 - DNA, 25 bp, Rattus norvegicus
actgcaaagcagtggccgggcttcc

SEQ ID NO: 596168 - DNA, 25 bp, Rattus norvegicus
cccatcgggaaggtgcaagctacag

SEQ ID NO: 596169 - DNA, 25 bp, Rattus norvegicus
gtggaaactggcctcacggagaatg

SEQ ID NO: 596170 - DNA, 25 bp, Rattus norvegicus
gaaccattgccggtcctcgcgtgag

SEQ ID NO: 596171 - DNA, 25 bp, Rattus norvegicus
aggacctcgcccagactggaaaatg

SEQ ID NO: 596172 - DNA, 25 bp, Rattus norvegicus
ccacaaactgtgtgtgcggctgcgc

SEQ ID NO: 596173 - DNA, 25 bp, Rattus norvegicus
atggggctgctcctcagctcgaaac

SEQ ID NO: 596174 - DNA, 25 bp, Rattus norvegicus
accttgctatctggatccggccata

SEQ ID NO: 596175 - DNA, 25 bp, Rattus norvegicus
tgcgcaaagatagatgtgccgtgcc

SEQ ID NO: 596176 - DNA, 25 bp, Rattus norvegicus
cctgggcagcaaacgagggaacaac

SEQ ID NO: 596177 - DNA, 25 bp, Rattus norvegicus
agagtccaacccacttcggtcagcg

SEQ ID NO: 596178 - DNA, 25 bp, Rattus norvegicus
cccgcactctgagatccaggacgga

SEQ ID NO: 596179 - DNA, 25 bp, Rattus norvegicus
ctgagccctctgtgcaactcgtggc

SEQ ID NO: 596180 - DNA, 25 bp, Rattus norvegicus
ctcccatagcagatctaaacgcgtt

SEQ ID NO: 596181 - DNA, 25 bp, Rattus norvegicus
ttgattgtcaccaagcggaggcgtc

SEQ ID NO: 596182 - DNA, 25 bp, Rattus norvegicus
ggctctctacccaaggccgtgcgtg

SEQ ID NO: 596183 - DNA, 25 bp, Rattus norvegicus
gtacgccttttgttctgcgcaaaga

SEQ ID NO: 596184 - DNA, 25 bp, Rattus norvegicus
tgccgtgccgataaggcttgcaacc

SEQ ID NO: 596185 - DNA, 25 bp, Rattus norvegicus
gccgcgatagcgcttccatttatta

SEQ ID NO: 596186 - DNA, 25 bp, Rattus norvegicus
cttgcccagtcgatgtaagctctga

SEQ ID NO: 596187 - DNA, 25 bp, Rattus norvegicus
cttgcaaccgatggcagccgcgata

SEQ ID NO: 596188 - DNA, 25 bp, Rattus norvegicus
ttgccaagagtgataagaggcctta

SEQ ID NO: 596189 - DNA, 25 bp, Rattus norvegicus
tgcagcaccacaggcttcggagatc

SEQ ID NO: 596190 - DNA, 25 bp, Rattus norvegicus
cacaatatgtgttcggtccggacgc

SEQ ID NO: 596191 - DNA, 25 bp, Rattus norvegicus
gtctgagttggtacacaaccggcta

SEQ ID NO: 596192 - DNA, 25 bp, Rattus norvegicus
cacaggcctcttcccggggactaag

SEQ ID NO: 596193 - DNA, 25 bp, Rattus norvegicus
gccacgtgctttgaatgcgagatca

SEQ ID NO: 596194 - DNA, 25 bp, Rattus norvegicus
tctatgtgcacaagcgtctctactg

SEQ ID NO: 596195 - DNA, 25 bp, Rattus norvegicus
tgcgcagacccaaagcagccacagg

SEQ ID NO: 596196 - DNA, 25 bp, Rattus norvegicus
cggtagacgatgcagaggacgatcc

SEQ ID NO: 596197 - DNA, 25 bp, Rattus norvegicus
cgaggcctgcaacatccggtttagc

SEQ ID NO: 596198 - DNA, 25 bp, Rattus norvegicus
tagccgccacgaaacctacactgtg

SEQ ID NO: 596199 - DNA, 25 bp, Rattus norvegicus
acactgtgcacaagcgctactactg

SEQ ID NO: 596200 - DNA, 25 bp, Rattus norvegicus
gccggcgtcgcaaactgtacgagct

SEQ ID NO: 596201 - DNA, 25 bp, Rattus norvegicus
gggacgctcttcctgccacaatatg

SEQ ID NO: 596202 - DNA, 25 bp, Rattus norvegicus
gatcctggccaagatgtctgagttg

SEQ ID NO: 596203 - DNA, 25 bp, Rattus norvegicus
aagacgttcagtgtgctaagttcgc

SEQ ID NO: 596204 - DNA, 25 bp, Rattus norvegicus
gctactgccgcctgtgcaacatcag

SEQ ID NO: 596205 - DNA, 25 bp, Rattus norvegicus
gcaacatcaggttcagcagtctgtc

SEQ ID NO: 596206 - DNA, 25 bp, Rattus norvegicus
ttcagcagtctgtccaccttcatcg

SEQ ID NO: 596207 - DNA, 25 bp, Rattus norvegicus
tgtccaccttcatcgcacacaagaa

SEQ ID NO: 596208 - DNA, 25 bp, Rattus norvegicus
tcatcgcacacaagaagtattactg

SEQ ID NO: 596209 - DNA, 25 bp, Rattus norvegicus
agtattactgctcttctcacgctgc

SEQ ID NO: 596210 - DNA, 25 bp, Rattus norvegicus
ctcacgctgccgagcacgtaaagtg

SEQ ID NO: 596211 - DNA, 25 bp, Rattus norvegicus
ctgccgagcacgtaaagtgagactg

SEQ ID NO: 596212 - DNA, 25 bp, Rattus norvegicus
aagtgagactgtggggccgcaccac

SEQ ID NO: 596213 - DNA, 25 bp, Rattus norvegicus
ccttgacacttaataaagacgttca

SEQ ID NO: 596214 - DNA, 25 bp, Rattus norvegicus
ttcagtgtgctaagttcgctggcgg

SEQ ID NO: 596215 - DNA, 25 bp, Rattus norvegicus
agaacacgccttctgaccaggccga

SEQ ID NO: 596216 - DNA, 25 bp, Rattus norvegicus
ccaggccgatcaaggcgctcggaca

SEQ ID NO: 596217 - DNA, 25 bp, Rattus norvegicus
gtggtgcgacactcccacacagcga

SEQ ID NO: 596218 - DNA, 25 bp, Rattus norvegicus
agcggcagcagacacgtagagtagc

SEQ ID NO: 596219 - DNA, 25 bp, Rattus norvegicus
caaaggcagcggcaagacaccagca

SEQ ID NO: 596220 - DNA, 25 bp, Rattus norvegicus
agacctcacatcaatttccgctgcg

SEQ ID NO: 596221 - DNA, 25 bp, Rattus norvegicus
agacaggcgttcgatggtcctggcc

SEQ ID NO: 596222 - DNA, 25 bp, Rattus norvegicus
ttccgctgcgacagggaagacaggc

SEQ ID NO: 596223 - DNA, 25 bp, Rattus norvegicus
ctgcgacgcatcagcacaatagtgc

SEQ ID NO: 596224 - DNA, 25 bp, Rattus norvegicus
cacggcgatatacagctgtctaaca

SEQ ID NO: 596225 - DNA, 25 bp, Rattus norvegicus
ccttctgcgagagcacggcgatata

SEQ ID NO: 596226 - DNA, 25 bp, Rattus norvegicus
ctgtctaacactgtagcgcaatatc

SEQ ID NO: 596227 - DNA, 25 bp, Rattus norvegicus
gcagagaggaatctcccaagacctc

SEQ ID NO: 596228 - DNA, 25 bp, Rattus norvegicus
tatagcttgccgattaccttctgcg

SEQ ID NO: 596229 - DNA, 25 bp, Rattus norvegicus
agcgcaatatctcgcagctctatag

SEQ ID NO: 596230 - DNA, 25 bp, Rattus norvegicus
tgcgaactgtcttccactcagctct

SEQ ID NO: 596231 - DNA, 25 bp, Rattus norvegicus
aggaaacctgctcacgtgccctggg

SEQ ID NO: 596232 - DNA, 25 bp, Rattus norvegicus
aaatggcccgcacatgcccgggagc

SEQ ID NO: 596233 - DNA, 25 bp, Rattus norvegicus
gctcaagggaaatggcccgcacatg

SEQ ID NO: 596234 - DNA, 25 bp, Rattus norvegicus
cacgcccttcttctggctcaaggga

SEQ ID NO: 596235 - DNA, 25 bp, Rattus norvegicus
ccagagtattgggtcgcgcgcaaaa

SEQ ID NO: 596236 - DNA, 25 bp, Rattus norvegicus
cgcgacctttatagcccagagtatt

SEQ ID NO: 596237 - DNA, 25 bp, Rattus norvegicus
agaagcacgcggagcgcgaccttta

SEQ ID NO: 596238 - DNA, 25 bp, Rattus norvegicus
cgtgggtacagagcctgcacacgcc

SEQ ID NO: 596239 - DNA, 25 bp, Rattus norvegicus
ggcagttggagatcaacgagagatc

SEQ ID NO: 596240 - DNA, 25 bp, Rattus norvegicus
cgaagtctgcaagcatccctccttt

SEQ ID NO: 596241 - DNA, 25 bp, Rattus norvegicus
gagcctgcgcacgacccgaagtctg

SEQ ID NO: 596242 - DNA, 25 bp, Rattus norvegicus
ccctccttttgcacgtgggtacaga

SEQ ID NO: 596243 - DNA, 25 bp, Rattus norvegicus
gctgagcgcaaagggtctgcgatcc

SEQ ID NO: 596244 - DNA, 25 bp, Rattus norvegicus
aacgagagatcgctgtagagttcta

SEQ ID NO: 596245 - DNA, 25 bp, Rattus norvegicus
gcctccagtcctcgcgctgaggtaa

SEQ ID NO: 596246 - DNA, 25 bp, Rattus norvegicus
gaaggtccacagactgcgcacgcgc

SEQ ID NO: 596247 - DNA, 25 bp, Rattus norvegicus
acgcgccgctaagagtcccgctaga

SEQ ID NO: 596248 - DNA, 25 bp, Rattus norvegicus
gtcgacctcagtgagcctgcgcagt

SEQ ID NO: 596249 - DNA, 25 bp, Rattus norvegicus
agcctgcgcagtaggggagacttca

SEQ ID NO: 596250 - DNA, 25 bp, Rattus norvegicus
tcgcggcctgatgacgtcgcacaat

SEQ ID NO: 596251 - DNA, 25 bp, Rattus norvegicus
tgttccgcccgcgtcgtgcctgaag

SEQ ID NO: 596252 - DNA, 25 bp, Rattus norvegicus
cctacaaaggggagcgaatcacgca

SEQ ID NO: 596253 - DNA, 25 bp, Rattus norvegicus
aaaggctgagggacgtcctgtccac

SEQ ID NO: 596254 - DNA, 25 bp, Rattus norvegicus
ggaggccggcttagactatcgaccg

SEQ ID NO: 596255 - DNA, 25 bp, Rattus norvegicus
gcgccgtggtctgccatagtgaagt

SEQ ID NO: 596256 - DNA, 25 bp, Rattus norvegicus
gaagttggttttcctgaagctgtca

SEQ ID NO: 596257 - DNA, 25 bp, Rattus norvegicus
gtggcacatgttcgccgcctacaaa

SEQ ID NO: 596258 - DNA, 25 bp, Rattus norvegicus
agccagagccagtgagaagcggaaa

SEQ ID NO: 596259 - DNA, 25 bp, Rattus norvegicus
ttcagcctatggacagaatcgaatg

SEQ ID NO: 596260 - DNA, 25 bp, Rattus norvegicus
accgtgaatccggagggatcctcga

SEQ ID NO: 596261 - DNA, 25 bp, Rattus norvegicus
tcagcttctcggctacacgcaaaga

SEQ ID NO: 596262 - DNA, 25 bp, Rattus norvegicus
cggggccatctgctgctgaaacagc

SEQ ID NO: 596263 - DNA, 25 bp, Rattus norvegicus
tctcgcactagcctcgcagactagg

SEQ ID NO: 596264 - DNA, 25 bp, Rattus norvegicus
cgccttatgtacagttggcatctgc

SEQ ID NO: 596265 - DNA, 25 bp, Rattus norvegicus
cggagcctctaagctcgtggctgca

SEQ ID NO: 596266 - DNA, 25 bp, Rattus norvegicus
gtctacagtctcacgcgctgccgta

SEQ ID NO: 596267 - DNA, 25 bp, Rattus norvegicus
ctggagtaccgagctacagagccca

SEQ ID NO: 596268 - DNA, 25 bp, Rattus norvegicus
aggcttttccgaggccatgacgaga

SEQ ID NO: 596269 - DNA, 25 bp, Rattus norvegicus
tgaccattaggtcctgaggcttttc

SEQ ID NO: 596270 - DNA, 25 bp, Rattus norvegicus
tttgataaccgcgatgttgaccggc

SEQ ID NO: 596271 - DNA, 25 bp, Rattus norvegicus
ctcgaatccgcagcccaaggtcgtg

SEQ ID NO: 596272 - DNA, 25 bp, Rattus norvegicus
ggagtgaatctacgcatgcgcctta

SEQ ID NO: 596273 - DNA, 25 bp, Rattus norvegicus
ttagcatagcgcaccacctcggcca

SEQ ID NO: 596274 - DNA, 25 bp, Rattus norvegicus
ggcattgtcccctcccgagagcagg

SEQ ID NO: 596275 - DNA, 25 bp, Rattus norvegicus
cgagagcaggcagagtctagagcct

SEQ ID NO: 596276 - DNA, 25 bp, Rattus norvegicus
cgggacaccgagtgtagcgtctggc

SEQ ID NO: 596277 - DNA, 25 bp, Rattus norvegicus
cagcgcagccggcaggtgcgagaag

SEQ ID NO: 596278 - DNA, 25 bp, Rattus norvegicus
gggtcaggctcattagcatagcgca

SEQ ID NO: 596279 - DNA, 25 bp, Rattus norvegicus
acctcggccaaccagcgcggagcac

SEQ ID NO: 596280 - DNA, 25 bp, Rattus norvegicus
cgcgaagccacgcccaggacaggtg

SEQ ID NO: 596281 - DNA, 25 bp, Rattus norvegicus
acccgccgcgtggtcggcggtgtct

SEQ ID NO: 596282 - DNA, 25 bp, Rattus norvegicus
tcggcggtgtctgccccacgggact

SEQ ID NO: 596283 - DNA, 25 bp, Rattus norvegicus
acgggactcggctggcccgcgtcat

SEQ ID NO: 596284 - DNA, 25 bp, Rattus norvegicus
ggctggcccgcgtcatggtcacgca

SEQ ID NO: 596285 - DNA, 25 bp, Rattus norvegicus
ccgcgtcatggtcacgcaccgaccc

SEQ ID NO: 596286 - DNA, 25 bp, Rattus norvegicus
cgagaagggtcaggctcattagcat

SEQ ID NO: 596287 - DNA, 25 bp, Rattus norvegicus
cggccgaggtaagagcttttcacca

SEQ ID NO: 596288 - DNA, 25 bp, Rattus norvegicus
gtgacgtcatctcgacgcgccggct

SEQ ID NO: 596289 - DNA, 25 bp, Rattus norvegicus
gcgcccgcttttcgtgacgtcatct

SEQ ID NO: 596290 - DNA, 25 bp, Rattus norvegicus
ttgcgtcactacagcgcccgctttt

SEQ ID NO: 596291 - DNA, 25 bp, Rattus norvegicus
agactggcgtcactgccgcgacggc

SEQ ID NO: 596292 - DNA, 25 bp, Rattus norvegicus
tatccaggccggcagactggcgtca

SEQ ID NO: 596293 - DNA, 25 bp, Rattus norvegicus
aagctgcggaacatcgccatgccgg

SEQ ID NO: 596294 - DNA, 25 bp, Rattus norvegicus
cggaggccaccaagctgcggaacat

SEQ ID NO: 596295 - DNA, 25 bp, Rattus norvegicus
gacagctgaactgagcctccaggcc

SEQ ID NO: 596296 - DNA, 25 bp, Rattus norvegicus
tccaggcagataggacagctgaact

SEQ ID NO: 596297 - DNA, 25 bp, Rattus norvegicus
gatggtacacctccaggcagatagg

SEQ ID NO: 596298 - DNA, 25 bp, Rattus norvegicus
ccgatggccactggccgatggtaca

SEQ ID NO: 596299 - DNA, 25 bp, Rattus norvegicus
ttcaccaccaggtccgggacagttc

SEQ ID NO: 596300 - DNA, 25 bp, Rattus norvegicus
cctccatgtgtcaggccggtgagga

SEQ ID NO: 596301 - DNA, 25 bp, Rattus norvegicus
gaaccgcgcgccatggcactcaggg

SEQ ID NO: 596302 - DNA, 25 bp, Rattus norvegicus
tcggaactcacggttgctcgcggag

SEQ ID NO: 596303 - DNA, 25 bp, Rattus norvegicus
ggactcggattaggggcaatacaga

SEQ ID NO: 596304 - DNA, 25 bp, Rattus norvegicus
ccctcgtggctagagcaactttcgc

SEQ ID NO: 596305 - DNA, 25 bp, Rattus norvegicus
gactcccaaggacctgatttccctg

SEQ ID NO: 596306 - DNA, 25 bp, Rattus norvegicus
ggcaatacagaatgactcccaagga

SEQ ID NO: 596307 - DNA, 25 bp, Rattus norvegicus
gcctgcgggcctttataagctcggc

SEQ ID NO: 596308 - DNA, 25 bp, Rattus norvegicus
gcgctcacgcctcaggaatgcgggc

SEQ ID NO: 596309 - DNA, 25 bp, Rattus norvegicus
tgggcctcgagtcccgcggaatctc

SEQ ID NO: 596310 - DNA, 25 bp, Rattus norvegicus
caggggtacacggatgcagtcttcc

SEQ ID NO: 596311 - DNA, 25 bp, Rattus norvegicus
tcacccgccaggagtgtgcagggta

SEQ ID NO: 596312 - DNA, 25 bp, Rattus norvegicus
cagggtagcaacagccagtagagcc

SEQ ID NO: 596313 - DNA, 25 bp, Rattus norvegicus
ctagtgccggtgagccggagacttt

SEQ ID NO: 596314 - DNA, 25 bp, Rattus norvegicus
gtctagcgcagtcactcgcacagtg

SEQ ID NO: 596315 - DNA, 25 bp, Rattus norvegicus
cgcgcgcgcacaacggttattaatg

SEQ ID NO: 596316 - DNA, 25 bp, Rattus norvegicus
cgggaagccatgtcttttaagggca

SEQ ID NO: 596317 - DNA, 25 bp, Rattus norvegicus
tggcttcggaacctgctcgttttta

SEQ ID NO: 596318 - DNA, 25 bp, Rattus norvegicus
tatctcttgtttaagggcgtgggtc

SEQ ID NO: 596319 - DNA, 25 bp, Rattus norvegicus
gcgtgggtcgtctcttaagtgtctt

SEQ ID NO: 596320 - DNA, 25 bp, Rattus norvegicus
ggcacagccggagacgctccgcata

SEQ ID NO: 596321 - DNA, 25 bp, Rattus norvegicus
cgctccgcatagcaaccaatcagaa

SEQ ID NO: 596322 - DNA, 25 bp, Rattus norvegicus
tatggacaggaagacggaagtaacc

SEQ ID NO: 596323 - DNA, 25 bp, Rattus norvegicus
aagccgcggagccaaattatggaca

SEQ ID NO: 596324 - DNA, 25 bp, Rattus norvegicus
tccaagtataaaaccgcgagaagcc

SEQ ID NO: 596325 - DNA, 25 bp, Rattus norvegicus
aggccagacgtttgctaagcaaatc

SEQ ID NO: 596326 - DNA, 25 bp, Rattus norvegicus
cccgcagaaggaaggccagacgttt

SEQ ID NO: 596327 - DNA, 25 bp, Rattus norvegicus
tgcagtatatccttcttagtccgcc

SEQ ID NO: 596328 - DNA, 25 bp, Rattus norvegicus
tttaagggcagagtctcttccgccg

SEQ ID NO: 596329 - DNA, 25 bp, Rattus norvegicus
ggtttgagacccttacgcgccacag

SEQ ID NO: 596330 - DNA, 25 bp, Rattus norvegicus
gccagtgcacaggagtcaaacagta

SEQ ID NO: 596331 - DNA, 25 bp, Rattus norvegicus
ttccgcgagccaagtcgacctgtct

SEQ ID NO: 596332 - DNA, 25 bp, Rattus norvegicus
gttaccgatttctatgcgtgccgtc

SEQ ID NO: 596333 - DNA, 25 bp, Rattus norvegicus
aagtagctttttggcgccatggcgc

SEQ ID NO: 596334 - DNA, 25 bp, Rattus norvegicus
cgcatgctccggagcgagcacattt

SEQ ID NO: 596335 - DNA, 25 bp, Rattus norvegicus
tcactcaatccaaagccgcagcggg

SEQ ID NO: 596336 - DNA, 25 bp, Rattus norvegicus
cgtgatcatctttttgctgggccaa

SEQ ID NO: 596337 - DNA, 25 bp, Rattus norvegicus
aagcgtctcccttcacgtgatcatc

SEQ ID NO: 596338 - DNA, 25 bp, Rattus norvegicus
tgactcagaccgagctactccgcta

SEQ ID NO: 596339 - DNA, 25 bp, Rattus norvegicus
ctcagcagttgcgtatgactcagac

SEQ ID NO: 596340 - DNA, 25 bp, Rattus norvegicus
gctcgcgaccagacactcagcagtt

SEQ ID NO: 596341 - DNA, 25 bp, Rattus norvegicus
gtcctgtgtactcatctcgcgctcg

SEQ ID NO: 596342 - DNA, 25 bp, Rattus norvegicus
ggctcccgttctgggtcactcaatc

SEQ ID NO: 596343 - DNA, 25 bp, Rattus norvegicus
cggatctttcaagaggggcgagata

SEQ ID NO: 596344 - DNA, 25 bp, Rattus norvegicus
acaaggacaggagagtgacccgcgt

SEQ ID NO: 596345 - DNA, 25 bp, Rattus norvegicus
gcctgcgatgtagtcgatcttgccg

SEQ ID NO: 596346 - DNA, 25 bp, Rattus norvegicus
gatgtagtcgatcttgccgccgtgc

SEQ ID NO: 596347 - DNA, 25 bp, Rattus norvegicus
agctcggaaggagtccggatctttc

SEQ ID NO: 596348 - DNA, 25 bp, Rattus norvegicus
tgagagtacggcgtcaacgcctcgc

SEQ ID NO: 596349 - DNA, 25 bp, Rattus norvegicus
gcacctgaacagcacgcccgggatg

SEQ ID NO: 596350 - DNA, 25 bp, Rattus norvegicus
gccaccagctgcaactcagattcgg

SEQ ID NO: 596351 - DNA, 25 bp, Rattus norvegicus
tcagattcggacatggccgcatgca

SEQ ID NO: 596352 - DNA, 25 bp, Rattus norvegicus
catggccgcatgcatgtaagaggaa

SEQ ID NO: 596353 - DNA, 25 bp, Rattus norvegicus
caggggcaagtcaatccgggaaaca

SEQ ID NO: 596354 - DNA, 25 bp, Rattus norvegicus
ctcctgggtccaaagagggcaagca

SEQ ID NO: 596355 - DNA, 25 bp, Rattus norvegicus
tatccctgggaacaaggacaggaga

SEQ ID NO: 596356 - DNA, 25 bp, Rattus norvegicus
aggggcgagatatccctgggaacaa

SEQ ID NO: 596357 - DNA, 25 bp, Rattus norvegicus
ctgcagccttccacccttcgctcta

SEQ ID NO: 596358 - DNA, 25 bp, Rattus norvegicus
cgccagcttgcaggcctcggccttc

SEQ ID NO: 596359 - DNA, 25 bp, Rattus norvegicus
ctcggccttcgggatttgagatcca

SEQ ID NO: 596360 - DNA, 25 bp, Rattus norvegicus
gatttgagatccaccgggaagcata

SEQ ID NO: 596361 - DNA, 25 bp, Rattus norvegicus
aagcatagccggtcgctgcagcctt

SEQ ID NO: 596362 - DNA, 25 bp, Rattus norvegicus
ttcgctctacgcgttcttttcacgg

SEQ ID NO: 596363 - DNA, 25 bp, Rattus norvegicus
cgcgttcttttcacggcctcagcta

SEQ ID NO: 596364 - DNA, 25 bp, Rattus norvegicus
cctcagctaccttccgcgtccgggt

SEQ ID NO: 596365 - DNA, 25 bp, Rattus norvegicus
cctagctgcccagcggtgctattta

SEQ ID NO: 596366 - DNA, 25 bp, Rattus norvegicus
gctgcccagcggtgctatttaagta

SEQ ID NO: 596367 - DNA, 25 bp, Rattus norvegicus
cccagcggtgctatttaagtataag

SEQ ID NO: 596368 - DNA, 25 bp, Rattus norvegicus
tatttaagtataagcctggcgcggc

SEQ ID NO: 596369 - DNA, 25 bp, Rattus norvegicus
ttaagtataagcctggcgcggctcg

SEQ ID NO: 596370 - DNA, 25 bp, Rattus norvegicus
accgggaagcatagccggtcgctgc

SEQ ID NO: 596371 - DNA, 25 bp, Rattus norvegicus
gccgttgctgaagccattgggcgta

SEQ ID NO: 596372 - DNA, 25 bp, Rattus norvegicus
tggctgggccgttgctgaagccatt

SEQ ID NO: 596373 - DNA, 25 bp, Rattus norvegicus
cgttcatcactgtaggagagcggtg

SEQ ID NO: 596374 - DNA, 25 bp, Rattus norvegicus
tgccgttcatcactgtaggagagcg

SEQ ID NO: 596375 - DNA, 25 bp, Rattus norvegicus
gctgccgttcatcactgtaggagag

SEQ ID NO: 596376 - DNA, 25 bp, Rattus norvegicus
ttgctgaagccattgggcgtagacg

SEQ ID NO: 596377 - DNA, 25 bp, Rattus norvegicus
gtgaggaaccgcttgagtttgctga

SEQ ID NO: 596378 - DNA, 25 bp, Rattus norvegicus
ccgatctcgggcgagatgtcgctgc

SEQ ID NO: 596379 - DNA, 25 bp, Rattus norvegicus
cgctgccaaactgctgcagggtggt

SEQ ID NO: 596380 - DNA, 25 bp, Rattus norvegicus
tgtcgctgccaaactgctgcagggt

SEQ ID NO: 596381 - DNA, 25 bp, Rattus norvegicus
cgagatgtcgctgccaaactgctgc

SEQ ID NO: 596382 - DNA, 25 bp, Rattus norvegicus
ctcgggcgagatgtcgctgccaaac

SEQ ID NO: 596383 - DNA, 25 bp, Rattus norvegicus
ccattgggcgtagacggggcaccgt

SEQ ID NO: 596384 - DNA, 25 bp, Rattus norvegicus
ggaaccgcttgagtttgctgagctg

SEQ ID NO: 596385 - DNA, 25 bp, Rattus norvegicus
cggcacttacggtctggagctccag

SEQ ID NO: 596386 - DNA, 25 bp, Rattus norvegicus
tcccagtgcgtagccagtgcgtgtg

SEQ ID NO: 596387 - DNA, 25 bp, Rattus norvegicus
gccgaggagtcccagtgcgtagcca

SEQ ID NO: 596388 - DNA, 25 bp, Rattus norvegicus
gatccgactcaggacgtagggaccc

SEQ ID NO: 596389 - DNA, 25 bp, Rattus norvegicus
gctatgggatccgactcaggacgta

SEQ ID NO: 596390 - DNA, 25 bp, Rattus norvegicus
tggacttggctatgggatccgactc

SEQ ID NO: 596391 - DNA, 25 bp, Rattus norvegicus
accgcctgggccatgccgagtgcgt

SEQ ID NO: 596392 - DNA, 25 bp, Rattus norvegicus
gggcgatccgcacgctgtcttctcg

SEQ ID NO: 596393 - DNA, 25 bp, Rattus norvegicus
cctccataacttgggggcgatccgc

SEQ ID NO: 596394 - DNA, 25 bp, Rattus norvegicus
tgggtcgccacctccataacttggg

SEQ ID NO: 596395 - DNA, 25 bp, Rattus norvegicus
cgaagtggcttttccttctcactgg

SEQ ID NO: 596396 - DNA, 25 bp, Rattus norvegicus
ctcccgaagtggcttttccttctca

SEQ ID NO: 596397 - DNA, 25 bp, Rattus norvegicus
tctggagctccagaggaccgtagct

SEQ ID NO: 596398 - DNA, 25 bp, Rattus norvegicus
agaggaccgtagctctctcgcaacc

SEQ ID NO: 596399 - DNA, 25 bp, Rattus norvegicus
ctctgtgcgtgtgcactgcggcagc

SEQ ID NO: 596400 - DNA, 25 bp, Rattus norvegicus
cactgcggcagctgtcccgagtccc

SEQ ID NO: 596401 - DNA, 25 bp, Rattus norvegicus
gcgagagactgtagcttagttcctc

SEQ ID NO: 596402 - DNA, 25 bp, Rattus norvegicus
gagactgtagcttagttcctccagg

SEQ ID NO: 596403 - DNA, 25 bp, Rattus norvegicus
ctgtagcttagttcctccaggcaag

SEQ ID NO: 596404 - DNA, 25 bp, Rattus norvegicus
agcttagttcctccaggcaagcgga

SEQ ID NO: 596405 - DNA, 25 bp, Rattus norvegicus
ttagttcctccaggcaagcggatgc

SEQ ID NO: 596406 - DNA, 25 bp, Rattus norvegicus
tcctccaggcaagcggatgcgctgc

SEQ ID NO: 596407 - DNA, 25 bp, Rattus norvegicus
gatgcgctgcgtagctagggcagca

SEQ ID NO: 596408 - DNA, 25 bp, Rattus norvegicus
tagctagggcagcaggtggcaaggc

SEQ ID NO: 596409 - DNA, 25 bp, Rattus norvegicus
ggcaaggcttttatagccccaggcg

SEQ ID NO: 596410 - DNA, 25 bp, Rattus norvegicus
cgctgagtgtaagaccgtaggaccg

SEQ ID NO: 596411 - DNA, 25 bp, Rattus norvegicus
cccgctgagtgtaagaccgtaggac

SEQ ID NO: 596412 - DNA, 25 bp, Rattus norvegicus
ggcgcgcaagcagcgacttggctcc

SEQ ID NO: 596413 - DNA, 25 bp, Rattus norvegicus
tttgttcatggggtctggcctcacg

SEQ ID NO: 596414 - DNA, 25 bp, Rattus norvegicus
gagttggcaccgacagaacccggcc

SEQ ID NO: 596415 - DNA, 25 bp, Rattus norvegicus
tctgagggagttggcaccgacagaa

SEQ ID NO: 596416 - DNA, 25 bp, Rattus norvegicus
ccacagtgcccgctctgagggagtt

SEQ ID NO: 596417 - DNA, 25 bp, Rattus norvegicus
gatggcaagcgtccatctttctcca

SEQ ID NO: 596418 - DNA, 25 bp, Rattus norvegicus
cagccgccggcgctcgagatggcaa

SEQ ID NO: 596419 - DNA, 25 bp, Rattus norvegicus
tccacggcagcgttgccaactgtct

SEQ ID NO: 596420 - DNA, 25 bp, Rattus norvegicus
ctggctttggctacatccgtccgtt

SEQ ID NO: 596421 - DNA, 25 bp, Rattus norvegicus
ccagcgatctgctgcgggttttgtt

SEQ ID NO: 596422 - DNA, 25 bp, Rattus norvegicus
gtcttctgcctcctaacatgggctg

SEQ ID NO: 596423 - DNA, 25 bp, Rattus norvegicus
ttggctacatccgtccgttcccagg

SEQ ID NO: 596424 - DNA, 25 bp, Rattus norvegicus
gttgccaactgtcttctgcctccta

SEQ ID NO: 596425 - DNA, 25 bp, Rattus norvegicus
acctgttccgcgctggctttggcta

SEQ ID NO: 596426 - DNA, 25 bp, Rattus norvegicus
tcctaacatgggctgccagcgatct

SEQ ID NO: 596427 - DNA, 25 bp, Rattus norvegicus
tcgcctgcggacatttttaggtgta

SEQ ID NO: 596428 - DNA, 25 bp, Rattus norvegicus
tgcggacatttttaggtgtaggact

SEQ ID NO: 596429 - DNA, 25 bp, Rattus norvegicus
cgacccacccacctggccgacctct

SEQ ID NO: 596430 - DNA, 25 bp, Rattus norvegicus
caggtgagggcgtagcagagaacaa

SEQ ID NO: 596431 - DNA, 25 bp, Rattus norvegicus
gaacgctcgactccggaacccatta

SEQ ID NO: 596432 - DNA, 25 bp, Rattus norvegicus
aatgagcaggaacgctcgactccgg

SEQ ID NO: 596433 - DNA, 25 bp, Rattus norvegicus
cacttttcgcctgcggacattttta

SEQ ID NO: 596434 - DNA, 25 bp, Rattus norvegicus
tcgactccggaacccattactcagg

SEQ ID NO: 596435 - DNA, 25 bp, Rattus norvegicus
cggaacccattactcaggctctgca

SEQ ID NO: 596436 - DNA, 25 bp, Rattus norvegicus
ccattactcaggctctgcatgcggg

SEQ ID NO: 596437 - DNA, 25 bp, Rattus norvegicus
tagaccgacggacacttttcgcctg

SEQ ID NO: 596438 - DNA, 25 bp, Rattus norvegicus
gacggacacttttcgcctgcggaca

SEQ ID NO: 596439 - DNA, 25 bp, Rattus norvegicus
tctgcatgcggggacatattagacc

SEQ ID NO: 596440 - DNA, 25 bp, Rattus norvegicus
gggacatattagaccgacggacact

SEQ ID NO: 596441 - DNA, 25 bp, Rattus norvegicus
aggtcctgttctctggctgaatttc

SEQ ID NO: 596442 - DNA, 25 bp, Rattus norvegicus
cgaggtcagccttctgcgagtctct

SEQ ID NO: 596443 - DNA, 25 bp, Rattus norvegicus
ttcatgaacacagttgacgggtttc

SEQ ID NO: 596444 - DNA, 25 bp, Rattus norvegicus
cgatggacgggctttgcgttttcat

SEQ ID NO: 596445 - DNA, 25 bp, Rattus norvegicus
atttcgttatttgtgcgcgatggac

SEQ ID NO: 596446 - DNA, 25 bp, Rattus norvegicus
tgcaggcgagcgtaccctgctgtct

SEQ ID NO: 596447 - DNA, 25 bp, Rattus norvegicus
tggctgaagtctcaaggtcctgttc

SEQ ID NO: 596448 - DNA, 25 bp, Rattus norvegicus
aggtaaggtaagtggctgaagtctc

SEQ ID NO: 596449 - DNA, 25 bp, Rattus norvegicus
cgccaggtttcctctgcgaggtaca

SEQ ID NO: 596450 - DNA, 25 bp, Rattus norvegicus
gtgctgtcaagctggtcttcaggtc

SEQ ID NO: 596451 - DNA, 25 bp, Rattus norvegicus
tcgagtccagaggtgactgccaggc

SEQ ID NO: 596452 - DNA, 25 bp, Rattus norvegicus
gctgagctgcctggtgatcctcgct

SEQ ID NO: 596453 - DNA, 25 bp, Rattus norvegicus
tgtccaggaagcgtggaggtcacaa

SEQ ID NO: 596454 - DNA, 25 bp, Rattus norvegicus
tgcgagtctctcactgatttcgtta

SEQ ID NO: 596455 - DNA, 25 bp, Rattus norvegicus
agcgcgtgtgagctttgagaaaaca

SEQ ID NO: 596456 - DNA, 25 bp, Rattus norvegicus
ggcctgacggcttccgtaacaggta

SEQ ID NO: 596457 - DNA, 25 bp, Rattus norvegicus
aagacgtcccgggaagattggcatc

SEQ ID NO: 596458 - DNA, 25 bp, Rattus norvegicus
ttggcatcggtgcataagcgacaca

SEQ ID NO: 596459 - DNA, 25 bp, Rattus norvegicus
cgacacaagcggaaaagcagctaga

SEQ ID NO: 596460 - DNA, 25 bp, Rattus norvegicus
attggctgccctccctgctaagagg

SEQ ID NO: 596461 - DNA, 25 bp, Rattus norvegicus
tacggggtacgacgattggccatac

SEQ ID NO: 596462 - DNA, 25 bp, Rattus norvegicus
ttggccatactcagtcccggaagtg

SEQ ID NO: 596463 - DNA, 25 bp, Rattus norvegicus
agatgtgctgtattggctggccttg

SEQ ID NO: 596464 - DNA, 25 bp, Rattus norvegicus
tcacgtcggagaggaaatgcgatgc

SEQ ID NO: 596465 - DNA, 25 bp, Rattus norvegicus
ctgtagccgacaggaggcccttgaa

SEQ ID NO: 596466 - DNA, 25 bp, Rattus norvegicus
cccttgaagtagcaaagagagctgg

SEQ ID NO: 596467 - DNA, 25 bp, Rattus norvegicus
caaggttgttgtcgaaggagccaga

SEQ ID NO: 596468 - DNA, 25 bp, Rattus norvegicus
cagggatcgcttacgtcacgtcgga

SEQ ID NO: 596469 - DNA, 25 bp, Rattus norvegicus
cgacacgccggcgttccctgaggag

SEQ ID NO: 596470 - DNA, 25 bp, Rattus norvegicus
tggccgtcgagaaaccggatcctgc

SEQ ID NO: 596471 - DNA, 25 bp, Rattus norvegicus
accacgcgggtgtcaatctggccgt

SEQ ID NO: 596472 - DNA, 25 bp, Rattus norvegicus
agtgcagacccatgggtgacgccca

SEQ ID NO: 596473 - DNA, 25 bp, Rattus norvegicus
gggcactgctaggtccttctgctcc

SEQ ID NO: 596474 - DNA, 25 bp, Rattus norvegicus
gcctgcgctcgggttacgcgttatc

SEQ ID NO: 596475 - DNA, 25 bp, Rattus norvegicus
ccggccaagatcattttcgaggacg

SEQ ID NO: 596476 - DNA, 25 bp, Rattus norvegicus
atccgcaaagaaatcccggccaaga

SEQ ID NO: 596477 - DNA, 25 bp, Rattus norvegicus
cggcaagatcatccgcaaagaaatc

SEQ ID NO: 596478 - DNA, 25 bp, Rattus norvegicus
ggtggcgacacgatcttcggcaaga

SEQ ID NO: 596479 - DNA, 25 bp, Rattus norvegicus
tgacgagattgccaaggctcaagtg

SEQ ID NO: 596480 - DNA, 25 bp, Rattus norvegicus
ccgcgatggctgacgagattgccaa

SEQ ID NO: 596481 - DNA, 25 bp, Rattus norvegicus
cattttcgaggacgatcgggtaggc

SEQ ID NO: 596482 - DNA, 25 bp, Rattus norvegicus
gttacgcgttatcggccgctcggcc

SEQ ID NO: 596483 - DNA, 25 bp, Rattus norvegicus
ccttctattcctagcgtgtgtgaga

SEQ ID NO: 596484 - DNA, 25 bp, Rattus norvegicus
tgtctccacgggaacccgcaggctg

SEQ ID NO: 596485 - DNA, 25 bp, Rattus norvegicus
gttgctagcgttagcgctgcgctcc

SEQ ID NO: 596486 - DNA, 25 bp, Rattus norvegicus
cgctccctgctgacaccggagttta

SEQ ID NO: 596487 - DNA, 25 bp, Rattus norvegicus
agccgctaaccttaccgagaccaga

SEQ ID NO: 596488 - DNA, 25 bp, Rattus norvegicus
gagaccagaaggttcgcaccgcgca

SEQ ID NO: 596489 - DNA, 25 bp, Rattus norvegicus
ggcgtcgcaagaagcgcccaacctt

SEQ ID NO: 596490 - DNA, 25 bp, Rattus norvegicus
tacgtagtccgtgggactccgattg

SEQ ID NO: 596491 - DNA, 25 bp, Rattus norvegicus
gctggaggccacacgcctcaggtaa

SEQ ID NO: 596492 - DNA, 25 bp, Rattus norvegicus
cggaccggatgtgcacctgcacctt

SEQ ID NO: 596493 - DNA, 25 bp, Rattus norvegicus
gcaccttcctcttcggcgagatgca

SEQ ID NO: 596494 - DNA, 25 bp, Rattus norvegicus
cgtgtgtgagagagacgccttgtac

SEQ ID NO: 596495 - DNA, 25 bp, Rattus norvegicus
gcatcgggtggtccttctattccta

SEQ ID NO: 596496 - DNA, 25 bp, Rattus norvegicus
acctgaggcagcgtctgcatcgggt

SEQ ID NO: 596497 - DNA, 25 bp, Rattus norvegicus
ctcctgtacaggaggtgagtctcta

SEQ ID NO: 596498 - DNA, 25 bp, Rattus norvegicus
cgcaagatccgcaggtgagcgtcgc

SEQ ID NO: 596499 - DNA, 25 bp, Rattus norvegicus
ccgaggcgacgacagcatggagcca

SEQ ID NO: 596500 - DNA, 25 bp, Rattus norvegicus
catctccgtggacccaaggaggcga

SEQ ID NO: 596501 - DNA, 25 bp, Rattus norvegicus
tttcacccggtgctgtgtctgggca

SEQ ID NO: 596502 - DNA, 25 bp, Rattus norvegicus
ggacggtgcttcgaggtgtttcacc

SEQ ID NO: 596503 - DNA, 25 bp, Rattus norvegicus
tacgagctttctcggcaaggctagc

SEQ ID NO: 596504 - DNA, 25 bp, Rattus norvegicus
gaacccttttccatctgactacgag

SEQ ID NO: 596505 - DNA, 25 bp, Rattus norvegicus
tctccggaatcgctgtactgtcttg

SEQ ID NO: 596506 - DNA, 25 bp, Rattus norvegicus
cgggctcggtggaatgatgacattc

SEQ ID NO: 596507 - DNA, 25 bp, Rattus norvegicus
cgtgttctccctgcagacgcaaggc

SEQ ID NO: 596508 - DNA, 25 bp, Rattus norvegicus
tcgcgtgacgtcatttccttcttca

SEQ ID NO: 596509 - DNA, 25 bp, Rattus norvegicus
ctccatccgctgtcatcggcgaaga

SEQ ID NO: 596510 - DNA, 25 bp, Rattus norvegicus
tttgcggtgcccgatcctttccgct

SEQ ID NO: 596511 - DNA, 25 bp, Rattus norvegicus
ctgctggatcgggatccgctgacca

SEQ ID NO: 596512 - DNA, 25 bp, Rattus norvegicus
gggatccgctgaccaagtcggaccc

SEQ ID NO: 596513 - DNA, 25 bp, Rattus norvegicus
atcgggatccgctgaccaagtcgga

SEQ ID NO: 596514 - DNA, 25 bp, Rattus norvegicus
ctgccggcacctgctggatcgggat

SEQ ID NO: 596515 - DNA, 25 bp, Rattus norvegicus
ctgagctgccggcacctgctggatc

SEQ ID NO: 596516 - DNA, 25 bp, Rattus norvegicus
ccctgcgcctcgaaggtggagctgc

SEQ ID NO: 596517 - DNA, 25 bp, Rattus norvegicus
tgcaccctgcgcctcgaaggtggag

SEQ ID NO: 596518 - DNA, 25 bp, Rattus norvegicus
ttcgagtgcggagcctgaagcatga

SEQ ID NO: 596519 - DNA, 25 bp, Rattus norvegicus
gcccaccggttcgagtgcggagcct

SEQ ID NO: 596520 - DNA, 25 bp, Rattus norvegicus
gccaccatttctccggcgcccaccg

SEQ ID NO: 596521 - DNA, 25 bp, Rattus norvegicus
tggtccggccaccatttctccggcg

SEQ ID NO: 596522 - DNA, 25 bp, Rattus norvegicus
gaagtgcggccacgcctggtccggc

SEQ ID NO: 596523 - DNA, 25 bp, Rattus norvegicus
agcctgaagcatgagcggcgactcg

SEQ ID NO: 596524 - DNA, 25 bp, Rattus norvegicus
cggccgcccgagacacgtgtgcccg

SEQ ID NO: 596525 - DNA, 25 bp, Rattus norvegicus
ctgaggcgcgatgtccacagaatcc

SEQ ID NO: 596526 - DNA, 25 bp, Rattus norvegicus
gatgtccacagaatcccgctccgaa

SEQ ID NO: 596527 - DNA, 25 bp, Rattus norvegicus
acccgaagtggatgacagcccctta

SEQ ID NO: 596528 - DNA, 25 bp, Rattus norvegicus
cttaccgtccatggccagtcggaca

SEQ ID NO: 596529 - DNA, 25 bp, Rattus norvegicus
ggagaccttccggactagctgtagc

SEQ ID NO: 596530 - DNA, 25 bp, Rattus norvegicus
tagctgtagccgtgaggacttccgg

SEQ ID NO: 596531 - DNA, 25 bp, Rattus norvegicus
ttgttactgtttccggtcgcgcggc

SEQ ID NO: 596532 - DNA, 25 bp, Rattus norvegicus
cgcggcctgctctcgcgagaagacg

SEQ ID NO: 596533 - DNA, 25 bp, Rattus norvegicus
ttctcgcgcggcacgcggttgccat

SEQ ID NO: 596534 - DNA, 25 bp, Rattus norvegicus
cgcggttgccatggtaatgagctcc

SEQ ID NO: 596535 - DNA, 25 bp, Rattus norvegicus
catggtaatgagctcccggagcgga

SEQ ID NO: 596536 - DNA, 25 bp, Rattus norvegicus
ggggtcacctatgggccagtcgaaa

SEQ ID NO: 596537 - DNA, 25 bp, Rattus norvegicus
tcctctgcgtcctcgggctgtaggt

SEQ ID NO: 596538 - DNA, 25 bp, Rattus norvegicus
gccagtcgaaaagcaaacccggaga

SEQ ID NO: 596539 - DNA, 25 bp, Rattus norvegicus
ttcaccgtgcctccagaacacaggg

SEQ ID NO: 596540 - DNA, 25 bp, Rattus norvegicus
aaatccgcagcccagaggccgggtg

SEQ ID NO: 596541 - DNA, 25 bp, Rattus norvegicus
tttgccgtggcgtgtgcagaaatcc

SEQ ID NO: 596542 - DNA, 25 bp, Rattus norvegicus
catcagtcgcagagtttgccgtggc

SEQ ID NO: 596543 - DNA, 25 bp, Rattus norvegicus
tcggaggaacatcagtcgcagagtt

SEQ ID NO: 596544 - DNA, 25 bp, Rattus norvegicus
aggttccggcgtcggaggaacatca

SEQ ID NO: 596545 - DNA, 25 bp, Rattus norvegicus
tgcctccagaacacagggtgcgacg

SEQ ID NO: 596546 - DNA, 25 bp, Rattus norvegicus
cgtgtgcagaaatccgcagcccaga

SEQ ID NO: 596547 - DNA, 25 bp, Rattus norvegicus
aaggtttcttcaccgtgcctccaga

SEQ ID NO: 596548 - DNA, 25 bp, Rattus norvegicus
tgtatccgtaaggaaggtttcttca

SEQ ID NO: 596549 - DNA, 25 bp, Rattus norvegicus
ccgactgaagtgtatccgtaaggaa

SEQ ID NO: 596550 - DNA, 25 bp, Rattus norvegicus
cagatccgactgaagtgtatccgta

SEQ ID NO: 596551 - DNA, 25 bp, Rattus norvegicus
gaagtacgttatgtgcctgcgccga

SEQ ID NO: 596552 - DNA, 25 bp, Rattus norvegicus
cgccgtgtcgcgttaaagtttgagg

SEQ ID NO: 596553 - DNA, 25 bp, Rattus norvegicus
ccagatcgcggagggctggcgccag

SEQ ID NO: 596554 - DNA, 25 bp, Rattus norvegicus
cagatcgcggagggctggcgccagg

SEQ ID NO: 596555 - DNA, 25 bp, Rattus norvegicus
agatcgcggagggctggcgccaggt

SEQ ID NO: 596556 - DNA, 25 bp, Rattus norvegicus
gaaggcgcgggccagatcgcggagg

SEQ ID NO: 596557 - DNA, 25 bp, Rattus norvegicus
ggccagatcgcggagggctggcgcc

SEQ ID NO: 596558 - DNA, 25 bp, Rattus norvegicus
gggccagatcgcggagggctggcgc

SEQ ID NO: 596559 - DNA, 25 bp, Rattus norvegicus
cgggccagatcgcggagggctggcg

SEQ ID NO: 596560 - DNA, 25 bp, Rattus norvegicus
gcgggccagatcgcggagggctggc

SEQ ID NO: 596561 - DNA, 25 bp, Rattus norvegicus
aaggcgcgggccagatcgcggaggg

SEQ ID NO: 596562 - DNA, 25 bp, Rattus norvegicus
cgcgggccagatcgcggagggctgg

SEQ ID NO: 596563 - DNA, 25 bp, Rattus norvegicus
gcgcgggccagatcgcggagggctg

SEQ ID NO: 596564 - DNA, 25 bp, Rattus norvegicus
ggcgcgggccagatcgcggagggct

SEQ ID NO: 596565 - DNA, 25 bp, Rattus norvegicus
aggcgcgggccagatcgcggagggc

SEQ ID NO: 596566 - DNA, 25 bp, Rattus norvegicus
gccagatcgcggagggctggcgcca

SEQ ID NO: 596567 - DNA, 25 bp, Rattus norvegicus
cccacaggccatcagtgaacagtgc

SEQ ID NO: 596568 - DNA, 25 bp, Rattus norvegicus
aggcacaggcgatagtcctccgaca

SEQ ID NO: 596569 - DNA, 25 bp, Rattus norvegicus
atagtcctccgacagcgagctgctg

SEQ ID NO: 596570 - DNA, 25 bp, Rattus norvegicus
agctcacgctccaggcacaggcgat

SEQ ID NO: 596571 - DNA, 25 bp, Rattus norvegicus
gcagcgagggatcgccacagacgcc

SEQ ID NO: 596572 - DNA, 25 bp, Rattus norvegicus
cgcgcagcgagggatcgccacagac

SEQ ID NO: 596573 - DNA, 25 bp, Rattus norvegicus
agtcctccaccagaatctgccagag

SEQ ID NO: 596574 - DNA, 25 bp, Rattus norvegicus
tgcccatcctgaccgagcgcgggac

SEQ ID NO: 596575 - DNA, 25 bp, Rattus norvegicus
ggtcgaagtcctccaccagaatctg

SEQ ID NO: 596576 - DNA, 25 bp, Rattus norvegicus
gtgcaggtcgaagtcctccaccaga

SEQ ID NO: 596577 - DNA, 25 bp, Rattus norvegicus
agtgccagcgcatcgtcctgaagcg

SEQ ID NO: 596578 - DNA, 25 bp, Rattus norvegicus
tgaacagtgccagcgcatcgtcctg

SEQ ID NO: 596579 - DNA, 25 bp, Rattus norvegicus
catcagtgaacagtgccagcgcatc

SEQ ID NO: 596580 - DNA, 25 bp, Rattus norvegicus
gacagcgagctgctgcccatcctga

SEQ ID NO: 596581 - DNA, 25 bp, Rattus norvegicus
gcaggagctagttgggacctacgta

SEQ ID NO: 596582 - DNA, 25 bp, Rattus norvegicus
aagctgccaaccttgcgcctgcgtg

SEQ ID NO: 596583 - DNA, 25 bp, Rattus norvegicus
tagctggcgccatcatgctgctgcc

SEQ ID NO: 596584 - DNA, 25 bp, Rattus norvegicus
gctgctgcctgtgttcaccctgaaa

SEQ ID NO: 596585 - DNA, 25 bp, Rattus norvegicus
gttcaccctgaaactgcgccacaaa

SEQ ID NO: 596586 - DNA, 25 bp, Rattus norvegicus
cgccactgcgcagtcgcaggagcta

SEQ ID NO: 596587 - DNA, 25 bp, Rattus norvegicus
gttccaaccaggcaagacgccactg

SEQ ID NO: 596588 - DNA, 25 bp, Rattus norvegicus
tgggacctacgtagctctgtagctg

SEQ ID NO: 596589 - DNA, 25 bp, Rattus norvegicus
gttccgggtgtatttacctcgcaca

SEQ ID NO: 596590 - DNA, 25 bp, Rattus norvegicus
tcgcacactttatccgctgctaggc

SEQ ID NO: 596591 - DNA, 25 bp, Rattus norvegicus
gctgctaggcaaccggcctgccaag

SEQ ID NO: 596592 - DNA, 25 bp, Rattus norvegicus
tagggcgctacgacgggactcaccc

SEQ ID NO: 596593 - DNA, 25 bp, Rattus norvegicus
ggccgccacccaagcgggcaaggta

SEQ ID NO: 596594 - DNA, 25 bp, Rattus norvegicus
ccgcatggtggccatagggcgctac

SEQ ID NO: 596595 - DNA, 25 bp, Rattus norvegicus
tgccgccctttcagcgaagtaggag

SEQ ID NO: 596596 - DNA, 25 bp, Rattus norvegicus
tgggtctatcctcgctcttccgcag

SEQ ID NO: 596597 - DNA, 25 bp, Rattus norvegicus
cgccctttcagcgaagtaggagggt

SEQ ID NO: 596598 - DNA, 25 bp, Rattus norvegicus
ggtgccgccctttcagcgaagtagg

SEQ ID NO: 596599 - DNA, 25 bp, Rattus norvegicus
gctggagtcgggtgccgccctttca

SEQ ID NO: 596600 - DNA, 25 bp, Rattus norvegicus
cccttggccttggttgtgacgttgg

SEQ ID NO: 596601 - DNA, 25 bp, Rattus norvegicus
atcctcgctcttccgcagagtgtca

SEQ ID NO: 596602 - DNA, 25 bp, Rattus norvegicus
ctccgcttgggcctgggtctatcct

SEQ ID NO: 596603 - DNA, 25 bp, Rattus norvegicus
tcccagagagctccgcttgggcctg

SEQ ID NO: 596604 - DNA, 25 bp, Rattus norvegicus
gctatcccagagagctccgcttggg

SEQ ID NO: 596605 - DNA, 25 bp, Rattus norvegicus
tgctagtcgccagctatcccagaga

SEQ ID NO: 596606 - DNA, 25 bp, Rattus norvegicus
ggtgctacctgctagtcgccagcta

SEQ ID NO: 596607 - DNA, 25 bp, Rattus norvegicus
cggcggtgctacctgctagtcgcca

SEQ ID NO: 596608 - DNA, 25 bp, Rattus norvegicus
gctcttccgcagagtgtcaagcccg

SEQ ID NO: 596609 - DNA, 25 bp, Rattus norvegicus
ttctgtcggacttactctgagtgtc

SEQ ID NO: 596610 - DNA, 25 bp, Rattus norvegicus
agtccgctctagcagaactcagtga

SEQ ID NO: 596611 - DNA, 25 bp, Rattus norvegicus
gctctcgacacagcagtggctactg

SEQ ID NO: 596612 - DNA, 25 bp, Rattus norvegicus
ccctaagaactctgggctctcgaca

SEQ ID NO: 596613 - DNA, 25 bp, Rattus norvegicus
tcgcaagttctgagcgaccctaaga

SEQ ID NO: 596614 - DNA, 25 bp, Rattus norvegicus
ggtgctcctcctttatgggccagtc

SEQ ID NO: 596615 - DNA, 25 bp, Rattus norvegicus
tgcgtcagttcgaggcagtttaccc

SEQ ID NO: 596616 - DNA, 25 bp, Rattus norvegicus
ctggtggaaagaacctcacgttttg

SEQ ID NO: 596617 - DNA, 25 bp, Rattus norvegicus
tcagtgagccgagccacacggaata

SEQ ID NO: 596618 - DNA, 25 bp, Rattus norvegicus
cgccgcgcagaactgggtttaccga

SEQ ID NO: 596619 - DNA, 25 bp, Rattus norvegicus
cgccggaagggacccagatacactt

SEQ ID NO: 596620 - DNA, 25 bp, Rattus norvegicus
cggccgcttcctgtctcctggaata

SEQ ID NO: 596621 - DNA, 25 bp, Rattus norvegicus
ttgaggttttctaagtgccacagcc

SEQ ID NO: 596622 - DNA, 25 bp, Rattus norvegicus
tcgttcaccaggctcagatctcggg

SEQ ID NO: 596623 - DNA, 25 bp, Rattus norvegicus
gctcggtccatgtttttcggaggac

SEQ ID NO: 596624 - DNA, 25 bp, Rattus norvegicus
acccggagaatggagggaccgcact

SEQ ID NO: 596625 - DNA, 25 bp, Rattus norvegicus
accgcactgggcactgattggggtc

SEQ ID NO: 596626 - DNA, 25 bp, Rattus norvegicus
cactgattggggtcggaaggtagtg

SEQ ID NO: 596627 - DNA, 25 bp, Rattus norvegicus
aggtagtggtggcaggacctaccca

SEQ ID NO: 596628 - DNA, 25 bp, Rattus norvegicus
tagtggtggcaggacctacccagca

SEQ ID NO: 596629 - DNA, 25 bp, Rattus norvegicus
cagctcggtccatgtttttcggagg

SEQ ID NO: 596630 - DNA, 25 bp, Rattus norvegicus
cccttgccggcgagcccggcatagc

SEQ ID NO: 596631 - DNA, 25 bp, Rattus norvegicus
gagcccggcatagcgtctggaacac

SEQ ID NO: 596632 - DNA, 25 bp, Rattus norvegicus
cgtctggaacactagctctgcagcc

SEQ ID NO: 596633 - DNA, 25 bp, Rattus norvegicus
tctggaacactagctctgcagcccg

SEQ ID NO: 596634 - DNA, 25 bp, Rattus norvegicus
gctgcctcccgattggcggcggcta

SEQ ID NO: 596635 - DNA, 25 bp, Rattus norvegicus
tcccgattggcggcggctaggttct

SEQ ID NO: 596636 - DNA, 25 bp, Rattus norvegicus
gtggtggcaggacctacccagcagc

SEQ ID NO: 596637 - DNA, 25 bp, Rattus norvegicus
agcaccgtcatcctcgaggctcaga

SEQ ID NO: 596638 - DNA, 25 bp, Rattus norvegicus
ggccagacgccagtaccgacggaaa

SEQ ID NO: 596639 - DNA, 25 bp, Rattus norvegicus
tgattcccgccgaactctgcttgca

SEQ ID NO: 596640 - DNA, 25 bp, Rattus norvegicus
gaacccggctaacctcggctgaggc

SEQ ID NO: 596641 - DNA, 25 bp, Rattus norvegicus
ctaaggcctccggactgacgagaga

SEQ ID NO: 596642 - DNA, 25 bp, Rattus norvegicus
ctggacaggttcctgcagcaccgtc

SEQ ID NO: 596643 - DNA, 25 bp, Rattus norvegicus
tgccgagttcctccgagcgagacac

SEQ ID NO: 596644 - DNA, 25 bp, Rattus norvegicus
tggccggaaattatcgagtgctacc

SEQ ID NO: 596645 - DNA, 25 bp, Rattus norvegicus
aggaagtgtctcttctcagccacgc

SEQ ID NO: 596646 - DNA, 25 bp, Rattus norvegicus
atcagccacgctaattgggccacgc

SEQ ID NO: 596647 - DNA, 25 bp, Rattus norvegicus
ggccacgcccaaagagcaaccggta

SEQ ID NO: 596648 - DNA, 25 bp, Rattus norvegicus
agggatcctgcagactcgcgttaca

SEQ ID NO: 596649 - DNA, 25 bp, Rattus norvegicus
atggcggagcctaagtctgactttg

SEQ ID NO: 596650 - DNA, 25 bp, Rattus norvegicus
tgttcgctttgcgacccaggcatgg

SEQ ID NO: 596651 - DNA, 25 bp, Rattus norvegicus
aagcccgttagcctagcagcagccg

SEQ ID NO: 596652 - DNA, 25 bp, Rattus norvegicus
gccctgcagcgactctgcacactca

SEQ ID NO: 596653 - DNA, 25 bp, Rattus norvegicus
cctcagggtgctgtcatccagcgca

SEQ ID NO: 596654 - DNA, 25 bp, Rattus norvegicus
cagggtgctgtcatccagcgcagca

SEQ ID NO: 596655 - DNA, 25 bp, Rattus norvegicus
tcccgggacacacccagccgtgaca

SEQ ID NO: 596656 - DNA, 25 bp, Rattus norvegicus
tggaaggccgcaccccagcaaggac

SEQ ID NO: 596657 - DNA, 25 bp, Rattus norvegicus
agcctggtgctcgtcccgggtctct

SEQ ID NO: 596658 - DNA, 25 bp, Rattus norvegicus
tcagccctggactccgtgccctgca

SEQ ID NO: 596659 - DNA, 25 bp, Rattus norvegicus
tgcacactcaccgctctggggaggc

SEQ ID NO: 596660 - DNA, 25 bp, Rattus norvegicus
aggcctcggatcagggcagacagat

SEQ ID NO: 596661 - DNA, 25 bp, Rattus norvegicus
ggcagacagatagacgcagctcgaa

SEQ ID NO: 596662 - DNA, 25 bp, Rattus norvegicus
tagacgcagctcgaagcccgttagc

SEQ ID NO: 596663 - DNA, 25 bp, Rattus norvegicus
ctcgaagcccgttagcctagcagca

SEQ ID NO: 596664 - DNA, 25 bp, Rattus norvegicus
tcttggaccacaccctccgcggggc

SEQ ID NO: 596665 - DNA, 25 bp, Rattus norvegicus
cgctgttatggagacccgccgcgcg

SEQ ID NO: 596666 - DNA, 25 bp, Rattus norvegicus
tcctcctgcgtagggacggctcggt

SEQ ID NO: 596667 - DNA, 25 bp, Rattus norvegicus
acatcctcctgcgtagggacggctc

SEQ ID NO: 596668 - DNA, 25 bp, Rattus norvegicus
cagacatcctcctgcgtagggacgg

SEQ ID NO: 596669 - DNA, 25 bp, Rattus norvegicus
gcatccgggacacggcagacatcct

SEQ ID NO: 596670 - DNA, 25 bp, Rattus norvegicus
cggcgcatccgggacacggcagaca

SEQ ID NO: 596671 - DNA, 25 bp, Rattus norvegicus
ggtgtacgagcagcccatcaacgag

SEQ ID NO: 596672 - DNA, 25 bp, Rattus norvegicus
ctgaaggtgtacgagcagcccatca

SEQ ID NO: 596673 - DNA, 25 bp, Rattus norvegicus
cggcgcagcagctcccgaacgcgcg

SEQ ID NO: 596674 - DNA, 25 bp, Rattus norvegicus
tgcgtcgccccgctgttatggagac

SEQ ID NO: 596675 - DNA, 25 bp, Rattus norvegicus
aatgacaaagcacacgggcggcgcg

SEQ ID NO: 596676 - DNA, 25 bp, Rattus norvegicus
cggaatgacaaagcacacgggcggc

SEQ ID NO: 596677 - DNA, 25 bp, Rattus norvegicus
cggggccggaatgacaaagcacacg

SEQ ID NO: 596678 - DNA, 25 bp, Rattus norvegicus
aagtgctgaaggtgtacgagcagcc

SEQ ID NO: 596679 - DNA, 25 bp, Rattus norvegicus
ctttgctcaggccatgcggctgtgt

SEQ ID NO: 596680 - DNA, 25 bp, Rattus norvegicus
ccgagctgtgcgcacctttgctcag

SEQ ID NO: 596681 - DNA, 25 bp, Rattus norvegicus
agcgactgtgaagacagcagctgcg

SEQ ID NO: 596682 - DNA, 25 bp, Rattus norvegicus
gccaacagcgactgtgaagacagca

SEQ ID NO: 596683 - DNA, 25 bp, Rattus norvegicus
tcatcgacctcatggccaacagcga

SEQ ID NO: 596684 - DNA, 25 bp, Rattus norvegicus
ctcagcccgcagctggagaggctca

SEQ ID NO: 596685 - DNA, 25 bp, Rattus norvegicus
ctgtgtgcctcacgcctgacggatc

SEQ ID NO: 596686 - DNA, 25 bp, Rattus norvegicus
gctggagaggctcatcgacctcatg

SEQ ID NO: 596687 - DNA, 25 bp, Rattus norvegicus
gagacgcttgagctccgtgccttct

SEQ ID NO: 596688 - DNA, 25 bp, Rattus norvegicus
cgcaggcccactaccaggcagtgtg

SEQ ID NO: 596689 - DNA, 25 bp, Rattus norvegicus
ctaccaggcagtgtgccgagctctc

SEQ ID NO: 596690 - DNA, 25 bp, Rattus norvegicus
aggcagtgtgccgagctctctttgt

SEQ ID NO: 596691 - DNA, 25 bp, Rattus norvegicus
gctctctttgtggagacgcttgagc

SEQ ID NO: 596692 - DNA, 25 bp, Rattus norvegicus
caggccatgcggctgtgtgcctcac

SEQ ID NO: 596693 - DNA, 25 bp, Rattus norvegicus
tcctccttgatgacgatgacgcaga

SEQ ID NO: 596694 - DNA, 25 bp, Rattus norvegicus
gcaacccatacacctcgaaagctga

SEQ ID NO: 596695 - DNA, 25 bp, Rattus norvegicus
aggggcaatacaggaccgtgacgtc

SEQ ID NO: 596696 - DNA, 25 bp, Rattus norvegicus
cccgatgtgacgtaggggcaataca

SEQ ID NO: 596697 - DNA, 25 bp, Rattus norvegicus
ctttgctgcagtatagggcgtgtct

SEQ ID NO: 596698 - DNA, 25 bp, Rattus norvegicus
ctcgaaagctgaagtgccgcactcc

SEQ ID NO: 596699 - DNA, 25 bp, Rattus norvegicus
ggctgagtgacaggactttgctgca

SEQ ID NO: 596700 - DNA, 25 bp, Rattus norvegicus
atgaggccgtgctgaattgcaagtc

SEQ ID NO: 596701 - DNA, 25 bp, Rattus norvegicus
tcgtccctctgcctacatctggttg

SEQ ID NO: 596702 - DNA, 25 bp, Rattus norvegicus
tgtcaacaaccggttcgagctggtg

SEQ ID NO: 596703 - DNA, 25 bp, Rattus norvegicus
ccctgcagtttgtcctccttgatga

SEQ ID NO: 596704 - DNA, 25 bp, Rattus norvegicus
tcgactctcgcgagaactccctggg

SEQ ID NO: 596705 - DNA, 25 bp, Rattus norvegicus
ctacatctggttgtcgggtcctatg

SEQ ID NO: 596706 - DNA, 25 bp, Rattus norvegicus
gcatgacgtcatgcgaaggggcata

SEQ ID NO: 596707 - DNA, 25 bp, Rattus norvegicus
cgtcactctgctttgcgctcaggtt

SEQ ID NO: 596708 - DNA, 25 bp, Rattus norvegicus
ctcacttgcgtcactctgctttgcg

SEQ ID NO: 596709 - DNA, 25 bp, Rattus norvegicus
ctagcggaacaaagggaagagccca

SEQ ID NO: 596710 - DNA, 25 bp, Rattus norvegicus
ctctaggagccgctagcggaacaaa

SEQ ID NO: 596711 - DNA, 25 bp, Rattus norvegicus
aaccagataggggccaaggtgagcc

SEQ ID NO: 596712 - DNA, 25 bp, Rattus norvegicus
gcattggcccacagcgcttacatca

SEQ ID NO: 596713 - DNA, 25 bp, Rattus norvegicus
ctagccgagtgaagtcagcatgagg

SEQ ID NO: 596714 - DNA, 25 bp, Rattus norvegicus
cgtctctagccgagtgaagtcagca

SEQ ID NO: 596715 - DNA, 25 bp, Rattus norvegicus
ctgcctcttcgtctctagccgagtg

SEQ ID NO: 596716 - DNA, 25 bp, Rattus norvegicus
cagtctcttataagagggcgcggcg

SEQ ID NO: 596717 - DNA, 25 bp, Rattus norvegicus
cagcgcttacatcagccagcgaggg

SEQ ID NO: 596718 - DNA, 25 bp, Rattus norvegicus
agagcctgccgcattgtgcggcgcc

SEQ ID NO: 596719 - DNA, 25 bp, Rattus norvegicus
tgatgctgcagagcctgccgcattg

SEQ ID NO: 596720 - DNA, 25 bp, Rattus norvegicus
ctctgctttgcgctcaggttgcagc

SEQ ID NO: 596721 - DNA, 25 bp, Rattus norvegicus
ggccgagagcaacatgaacgacctg

SEQ ID NO: 596722 - DNA, 25 bp, Rattus norvegicus
accgtcttccgtgggcgcatgtcca

SEQ ID NO: 596723 - DNA, 25 bp, Rattus norvegicus
tggtgtctgagtaccagcagtacca

SEQ ID NO: 596724 - DNA, 25 bp, Rattus norvegicus
ggcgcaaggccttcctccactggta

SEQ ID NO: 596725 - DNA, 25 bp, Rattus norvegicus
cagtttacggccatgttccggcgca

SEQ ID NO: 596726 - DNA, 25 bp, Rattus norvegicus
tgtcgtccaccttcatcggcaacag

SEQ ID NO: 596727 - DNA, 25 bp, Rattus norvegicus
cgagggctcaagatgtcgtccacct

SEQ ID NO: 596728 - DNA, 25 bp, Rattus norvegicus
caaggtagcggtgtgtgacatcccg

SEQ ID NO: 596729 - DNA, 25 bp, Rattus norvegicus
ccaacaacgtcaaggtagcggtgtg

SEQ ID NO: 596730 - DNA, 25 bp, Rattus norvegicus
cagtagttacttcgtggagtggatc

SEQ ID NO: 596731 - DNA, 25 bp, Rattus norvegicus
ctggccattcagagtaagaacagta

SEQ ID NO: 596732 - DNA, 25 bp, Rattus norvegicus
gtggatgagcagatgctggccattc

SEQ ID NO: 596733 - DNA, 25 bp, Rattus norvegicus
tgaccgtggccaccgtcttccgtgg

SEQ ID NO: 596734 - DNA, 25 bp, Rattus norvegicus
tgtatgaagatgacgacgaggagtc

SEQ ID NO: 596735 - DNA, 25 bp, Rattus norvegicus
cggtacaatgtagcggcagccaggt

SEQ ID NO: 596736 - DNA, 25 bp, Rattus norvegicus
tacagtgtaacagcggtggcgaact

SEQ ID NO: 596737 - DNA, 25 bp, Rattus norvegicus
aacagcggtggcgaactacagtgta

SEQ ID NO: 596738 - DNA, 25 bp, Rattus norvegicus
aactacagtgtagccagccggtccg

SEQ ID NO: 596739 - DNA, 25 bp, Rattus norvegicus
ccagccggtccggtacaatgtagcg

SEQ ID NO: 596740 - DNA, 25 bp, Rattus norvegicus
gcaattgccactggccggactccgg

SEQ ID NO: 596741 - DNA, 25 bp, Rattus norvegicus
caatgtagcggcagccaggtaagca

SEQ ID NO: 596742 - DNA, 25 bp, Rattus norvegicus
taagcagcggagctgtctccgcagg

SEQ ID NO: 596743 - DNA, 25 bp, Rattus norvegicus
agcggagctgtctccgcaggtgtcc

SEQ ID NO: 596744 - DNA, 25 bp, Rattus norvegicus
agggtccggatctcagcatgcaatt

SEQ ID NO: 596745 - DNA, 25 bp, Rattus norvegicus
ggatctcagcatgcaattgccactg

SEQ ID NO: 596746 - DNA, 25 bp, Rattus norvegicus
cagcatgcaattgccactggccgga

SEQ ID NO: 596747 - DNA, 25 bp, Rattus norvegicus
ggactccgggatccggcttctgccc

SEQ ID NO: 596748 - DNA, 25 bp, Rattus norvegicus
tgtagccagccggtccggtacaatg

SEQ ID NO: 596749 - DNA, 25 bp, Rattus norvegicus
aagtcccaaccaatgctgcggcctg

SEQ ID NO: 596750 - DNA, 25 bp, Rattus norvegicus
cggaggatctagtggtaccgatacc

SEQ ID NO: 596751 - DNA, 25 bp, Rattus norvegicus
gactccactagtgccgctgatcgca

SEQ ID NO: 596752 - DNA, 25 bp, Rattus norvegicus
ggcgcagctgctttcttgattcctg

SEQ ID NO: 596753 - DNA, 25 bp, Rattus norvegicus
tggcctggcctttcttcaagctgtg

SEQ ID NO: 596754 - DNA, 25 bp, Rattus norvegicus
gccgcgaaccgaacacctaaagaga

SEQ ID NO: 596755 - DNA, 25 bp, Rattus norvegicus
cccgtccaggatcttaggcagcaca

SEQ ID NO: 596756 - DNA, 25 bp, Rattus norvegicus
agcactgtgttcataggttccgggc

SEQ ID NO: 596757 - DNA, 25 bp, Rattus norvegicus
agccgaagcgacattcccgtccagg

SEQ ID NO: 596758 - DNA, 25 bp, Rattus norvegicus
cgcgggccatttgtcatcagccgaa

SEQ ID NO: 596759 - DNA, 25 bp, Rattus norvegicus
cctaggtgcctaggtcaagttggcc

SEQ ID NO: 596760 - DNA, 25 bp, Rattus norvegicus
aatacgtctacagtccctaggtgcc

SEQ ID NO: 596761 - DNA, 25 bp, Rattus norvegicus
ccactggtgtcgttgacaatgcaaa

SEQ ID NO: 596762 - DNA, 25 bp, Rattus norvegicus
ccctcaactagcgagaagtaggctc

SEQ ID NO: 596763 - DNA, 25 bp, Rattus norvegicus
ccctggagcgcaccattaacctgta

SEQ ID NO: 596764 - DNA, 25 bp, Rattus norvegicus
tcaggatttcttcagtgacagcgtc

SEQ ID NO: 596765 - DNA, 25 bp, Rattus norvegicus
gggacgtgcgctttctttctcagac

SEQ ID NO: 596766 - DNA, 25 bp, Rattus norvegicus
taacctgtaagtacggcgcagcctc

SEQ ID NO: 596767 - DNA, 25 bp, Rattus norvegicus
tccagtgtcggagctattcagcatg

SEQ ID NO: 596768 - DNA, 25 bp, Rattus norvegicus
ccgctttctacaggtctccagtgtc

SEQ ID NO: 596769 - DNA, 25 bp, Rattus norvegicus
ttaccatgactgaacggcgtccggc

SEQ ID NO: 596770 - DNA, 25 bp, Rattus norvegicus
cgctcctcttgctctcgactgttaa

SEQ ID NO: 596771 - DNA, 25 bp, Rattus norvegicus
tgccgccggagcgtattcacttccg

SEQ ID NO: 596772 - DNA, 25 bp, Rattus norvegicus
cacgctgccagcaattggtcaaatg

SEQ ID NO: 596773 - DNA, 25 bp, Rattus norvegicus
agatcaagatattgcgtcacgctgc

SEQ ID NO: 596774 - DNA, 25 bp, Rattus norvegicus
cgccgaggaagtcaggacgctactt

SEQ ID NO: 596775 - DNA, 25 bp, Rattus norvegicus
ttcccttcttcattggccgcgctgg

SEQ ID NO: 596776 - DNA, 25 bp, Rattus norvegicus
tctctcacgccggatgccgtgtttc

SEQ ID NO: 596777 - DNA, 25 bp, Rattus norvegicus
cgtgaacaagcgggtagcatcgccc

SEQ ID NO: 596778 - DNA, 25 bp, Rattus norvegicus
ggcttagaaggcatcagtgggtctc

SEQ ID NO: 596779 - DNA, 25 bp, Rattus norvegicus
tccatgcggccaatggggtccgcga

SEQ ID NO: 596780 - DNA, 25 bp, Rattus norvegicus
cctcgggagactccatgcggccaat

SEQ ID NO: 596781 - DNA, 25 bp, Rattus norvegicus
tcacctcccggacctgcgccctcgg

SEQ ID NO: 596782 - DNA, 25 bp, Rattus norvegicus
gctgcggtttgttgctaggttctgg

SEQ ID NO: 596783 - DNA, 25 bp, Rattus norvegicus
agaaggcatcagtgggtctccaggc

SEQ ID NO: 596784 - DNA, 25 bp, Rattus norvegicus
cagtccgtgtttgccgagccgggta

SEQ ID NO: 596785 - DNA, 25 bp, Rattus norvegicus
aagagacgcagtccgtgtttgccga

SEQ ID NO: 596786 - DNA, 25 bp, Rattus norvegicus
ctcgcaaagcaggaaaagagacgca

SEQ ID NO: 596787 - DNA, 25 bp, Rattus norvegicus
gcccggagctcgcaaagcaggaaaa

SEQ ID NO: 596788 - DNA, 25 bp, Rattus norvegicus
ttcctgagcccggagctcgcaaagc

SEQ ID NO: 596789 - DNA, 25 bp, Rattus norvegicus
ccttggagggcagtccgcttcctga

SEQ ID NO: 596790 - DNA, 25 bp, Rattus norvegicus
ctgacagggggctcaggacgcaacc

SEQ ID NO: 596791 - DNA, 25 bp, Rattus norvegicus
cctagaattgagaactgagcgcttc

SEQ ID NO: 596792 - DNA, 25 bp, Rattus norvegicus
ttcggatgcctagaattgagaactg

SEQ ID NO: 596793 - DNA, 25 bp, Rattus norvegicus
cgttgttagggacgcatccctggtt

SEQ ID NO: 596794 - DNA, 25 bp, Rattus norvegicus
ttagggacgcatccctggttgcccg

SEQ ID NO: 596795 - DNA, 25 bp, Rattus norvegicus
agagtctcgcgaggatttgagaacc

SEQ ID NO: 596796 - DNA, 25 bp, Rattus norvegicus
tctcgcgaggatttgagaaccagcg

SEQ ID NO: 596797 - DNA, 25 bp, Rattus norvegicus
tttgagaaccagcgcgggatcgagt

SEQ ID NO: 596798 - DNA, 25 bp, Rattus norvegicus
atcgagtcggagttgccaggagaca

SEQ ID NO: 596799 - DNA, 25 bp, Rattus norvegicus
tcctctgaccagtgcgggtcccgga

SEQ ID NO: 596800 - DNA, 25 bp, Rattus norvegicus
tagtggaggtgctgcactgctgcca

SEQ ID NO: 596801 - DNA, 25 bp, Rattus norvegicus
gtgctgcactgctgccatcatggtg

SEQ ID NO: 596802 - DNA, 25 bp, Rattus norvegicus
agcagcctgcggtttcggatgccta

SEQ ID NO: 596803 - DNA, 25 bp, Rattus norvegicus
cctgcggtttcggatgcctagaatt

SEQ ID NO: 596804 - DNA, 25 bp, Rattus norvegicus
agaactgagcgcttccgcgaggcta

SEQ ID NO: 596805 - DNA, 25 bp, Rattus norvegicus
gctgcgtatttactgccttgaactg

SEQ ID NO: 596806 - DNA, 25 bp, Rattus norvegicus
gtctaccttgctctcctgcaccctg

SEQ ID NO: 596807 - DNA, 25 bp, Rattus norvegicus
tgcgtatttactgccttgaactgga

SEQ ID NO: 596808 - DNA, 25 bp, Rattus norvegicus
taccttgctctcctgcaccctggtt

SEQ ID NO: 596809 - DNA, 25 bp, Rattus norvegicus
ttctgtctcactggtctaccttgct

SEQ ID NO: 596810 - DNA, 25 bp, Rattus norvegicus
tctgtctcactggtctaccttgctc

SEQ ID NO: 596811 - DNA, 25 bp, Rattus norvegicus
tctggtaattttgctggtaattgcg

SEQ ID NO: 596812 - DNA, 25 bp, Rattus norvegicus
cactggtctaccttgctctcctgca

SEQ ID NO: 596813 - DNA, 25 bp, Rattus norvegicus
ctgctgcgtatttactgccttgaac

SEQ ID NO: 596814 - DNA, 25 bp, Rattus norvegicus
attttgctggtaattgcgtggagga

SEQ ID NO: 596815 - DNA, 25 bp, Rattus norvegicus
ttacggtctgctgcgtatttactgc

SEQ ID NO: 596816 - DNA, 25 bp, Rattus norvegicus
gtctgctgcgtatttactgccttga

SEQ ID NO: 596817 - DNA, 25 bp, Rattus norvegicus
tgtctcactggtctaccttgctctc

SEQ ID NO: 596818 - DNA, 25 bp, Rattus norvegicus
cggtctgctgcgtatttactgcctt

SEQ ID NO: 596819 - DNA, 25 bp, Rattus norvegicus
tcggtccgtctatacccacgggaga

SEQ ID NO: 596820 - DNA, 25 bp, Rattus norvegicus
aggagcgcaactactttcagctgga

SEQ ID NO: 596821 - DNA, 25 bp, Rattus norvegicus
gcaactactttcagctggagcggga

SEQ ID NO: 596822 - DNA, 25 bp, Rattus norvegicus
aactactttcagctggagcgggaca

SEQ ID NO: 596823 - DNA, 25 bp, Rattus norvegicus
ctttcagctggagcgggacaaaatc

SEQ ID NO: 596824 - DNA, 25 bp, Rattus norvegicus
cagctggagcgggacaaaatccaca

SEQ ID NO: 596825 - DNA, 25 bp, Rattus norvegicus
ggacaaaatccacaccttctgggag

SEQ ID NO: 596826 - DNA, 25 bp, Rattus norvegicus
aatccacaccttctgggagatcacg

SEQ ID NO: 596827 - DNA, 25 bp, Rattus norvegicus
cacaccttctgggagatcacgcgga

SEQ ID NO: 596828 - DNA, 25 bp, Rattus norvegicus
ccttctgggagatcacgcggaggca

SEQ ID NO: 596829 - DNA, 25 bp, Rattus norvegicus
ggagaagaaggctgagctgcgcaac

SEQ ID NO: 596830 - DNA, 25 bp, Rattus norvegicus
aggagaggcaccaggtggagatcaa

SEQ ID NO: 596831 - DNA, 25 bp, Rattus norvegicus
agtggcgtcggtccgtctataccca

SEQ ID NO: 596832 - DNA, 25 bp, Rattus norvegicus
gcgggaggagcgcaactactttcag

SEQ ID NO: 596833 - DNA, 25 bp, Rattus norvegicus
gtccgagacttacggtaggacgcgc

SEQ ID NO: 596834 - DNA, 25 bp, Rattus norvegicus
ttcctctcgctctgcggagactgga

SEQ ID NO: 596835 - DNA, 25 bp, Rattus norvegicus
actcggttcctctcgctctgcggag

SEQ ID NO: 596836 - DNA, 25 bp, Rattus norvegicus
tctcgctctgcggagactggaggac

SEQ ID NO: 596837 - DNA, 25 bp, Rattus norvegicus
tctgcggagactggaggacgaaccc

SEQ ID NO: 596838 - DNA, 25 bp, Rattus norvegicus
gcaggatggcgcagaccgccatgtc

SEQ ID NO: 596839 - DNA, 25 bp, Rattus norvegicus
atcgagatgtcgtgcaaacctcgcg

SEQ ID NO: 596840 - DNA, 25 bp, Rattus norvegicus
ccgccatgtccgagacttacggtag

SEQ ID NO: 596841 - DNA, 25 bp, Rattus norvegicus
tcagggtgtccagagccggtgtcta

SEQ ID NO: 596842 - DNA, 25 bp, Rattus norvegicus
ccagagccggtgtctagactatcga

SEQ ID NO: 596843 - DNA, 25 bp, Rattus norvegicus
ccggtgtctagactatcgagatgtc

SEQ ID NO: 596844 - DNA, 25 bp, Rattus norvegicus
agactatcgagatgtcgtgcaaacc

SEQ ID NO: 596845 - DNA, 25 bp, Rattus norvegicus
cgtacccggctctccacactcggtt

SEQ ID NO: 596846 - DNA, 25 bp, Rattus norvegicus
cgcagaccgccatgtccgagactta

SEQ ID NO: 596847 - DNA, 25 bp, Rattus norvegicus
gcaggcccgtagttcaggtaatagc

SEQ ID NO: 596848 - DNA, 25 bp, Rattus norvegicus
cggttcccggtagcgcttcatatac

SEQ ID NO: 596849 - DNA, 25 bp, Rattus norvegicus
tatcaggagggattccaagcgacgc

SEQ ID NO: 596850 - DNA, 25 bp, Rattus norvegicus
cgaccgtgctaggtggactggtact

SEQ ID NO: 596851 - DNA, 25 bp, Rattus norvegicus
tccacccggtagaggtgaagactgc

SEQ ID NO: 596852 - DNA, 25 bp, Rattus norvegicus
tgaagactgccggactcaaggtggc

SEQ ID NO: 596853 - DNA, 25 bp, Rattus norvegicus
caggggatcttaggttccaggcacc

SEQ ID NO: 596854 - DNA, 25 bp, Rattus norvegicus
aggcaccctcctgggcgaggagtca

SEQ ID NO: 596855 - DNA, 25 bp, Rattus norvegicus
agtgtcctattctccgctctccgga

SEQ ID NO: 596856 - DNA, 25 bp, Rattus norvegicus
cgctctccggaagtcggcagagatc

SEQ ID NO: 596857 - DNA, 25 bp, Rattus norvegicus
gcagctaccgagtgaacagcgtttc

SEQ ID NO: 596858 - DNA, 25 bp, Rattus norvegicus
gtcctccaccaagatgtcgccgatg

SEQ ID NO: 596859 - DNA, 25 bp, Rattus norvegicus
ccgtacctggtagcactgtgtcctg

SEQ ID NO: 596860 - DNA, 25 bp, Rattus norvegicus
gtagcacggcgcgtattcgtcccaa

SEQ ID NO: 596861 - DNA, 25 bp, Rattus norvegicus
gccgccgatccacactgagtacttg

SEQ ID NO: 596862 - DNA, 25 bp, Rattus norvegicus
gcagactccatacctggtggcccgg

SEQ ID NO: 596863 - DNA, 25 bp, Rattus norvegicus
tcatgatgctgttgtaggtggtctc

SEQ ID NO: 596864 - DNA, 25 bp, Rattus norvegicus
ggtccttcctgatgtcgatgtcgca

SEQ ID NO: 596865 - DNA, 25 bp, Rattus norvegicus
cctgacatgacgttgttggcgtaca

SEQ ID NO: 596866 - DNA, 25 bp, Rattus norvegicus
ctccttctgcatgcggtcagcgata

SEQ ID NO: 596867 - DNA, 25 bp, Rattus norvegicus
atggggccaccctgcaaccatagca

SEQ ID NO: 596868 - DNA, 25 bp, Rattus norvegicus
aggcgcgtcatccaccttgatcttc

SEQ ID NO: 596869 - DNA, 25 bp, Rattus norvegicus
ggctcaccgataaaggaaggctgga

SEQ ID NO: 596870 - DNA, 25 bp, Rattus norvegicus
gcttggtgatccacatctgctggaa

SEQ ID NO: 596871 - DNA, 25 bp, Rattus norvegicus
cctcgtcgtactcctgcttggtgat

SEQ ID NO: 596872 - DNA, 25 bp, Rattus norvegicus
cgcctagaagcatttgcggtgcaca

SEQ ID NO: 596873 - DNA, 25 bp, Rattus norvegicus
gcacgatggtcgattgtcgtcctga

SEQ ID NO: 596874 - DNA, 25 bp, Rattus norvegicus
cttgatcttcatggtgctgggagcc

SEQ ID NO: 596875 - DNA, 25 bp, Rattus norvegicus
tcactaaagcactcgagtgaggctg

SEQ ID NO: 596876 - DNA, 25 bp, Rattus norvegicus
agcctgctgcgctcactaaagcact

SEQ ID NO: 596877 - DNA, 25 bp, Rattus norvegicus
tgctgcgctcactaaagcactcgaa

SEQ ID NO: 596878 - DNA, 25 bp, Rattus norvegicus
ggcgactgagcatggaacccgagcc

SEQ ID NO: 596879 - DNA, 25 bp, Rattus norvegicus
aggctgactgagcatggaacccgag

SEQ ID NO: 596880 - DNA, 25 bp, Rattus norvegicus
ctgctgcgctcactaaagcactcga

SEQ ID NO: 596881 - DNA, 25 bp, Rattus norvegicus
gctgactgagcatggaacccgagcc

SEQ ID NO: 596882 - DNA, 25 bp, Rattus norvegicus
cactaaagcactcgagtgaggctga

SEQ ID NO: 596883 - DNA, 25 bp, Rattus norvegicus
gagcctgctgcgctcactaaagcac

SEQ ID NO: 596884 - DNA, 25 bp, Rattus norvegicus
ctaaagcactcgagtgaggctgact

SEQ ID NO: 596885 - DNA, 25 bp, Rattus norvegicus
ggctgactgagcatggaacccgagc

SEQ ID NO: 596886 - DNA, 25 bp, Rattus norvegicus
aggcgactgagcatggaacccgagc

SEQ ID NO: 596887 - DNA, 25 bp, Rattus norvegicus
ctgcgctcactaaagcactcgaaga

SEQ ID NO: 596888 - DNA, 25 bp, Rattus norvegicus
cactcgaagagtgaggcgactgagc

SEQ ID NO: 596889 - DNA, 25 bp, Rattus norvegicus
cctggaaacatatctgcagagtgtg

SEQ ID NO: 596890 - DNA, 25 bp, Rattus norvegicus
gagggcccgattccgactagcggac

SEQ ID NO: 596891 - DNA, 25 bp, Rattus norvegicus
ggcgcctagagatgatgtaaagaca

SEQ ID NO: 596892 - DNA, 25 bp, Rattus norvegicus
ttctcaggctggagttgaccctctg

SEQ ID NO: 596893 - DNA, 25 bp, Rattus norvegicus
cgcacttacctagagctcactgagc

SEQ ID NO: 596894 - DNA, 25 bp, Rattus norvegicus
acaggcgagctaaccgcagatccca

SEQ ID NO: 596895 - DNA, 25 bp, Rattus norvegicus
aggaagctgcactcgcgggctaaaa

SEQ ID NO: 596896 - DNA, 25 bp, Rattus norvegicus
aagacagggcgctcaacaaatgggg

SEQ ID NO: 596897 - DNA, 25 bp, Rattus norvegicus
gtccgaactggaagcgctcatgtga

SEQ ID NO: 596898 - DNA, 25 bp, Rattus norvegicus
gacgtcacacccagcaccagtgggg

SEQ ID NO: 596899 - DNA, 25 bp, Rattus norvegicus
cggggcaagcgagtttgaatcctga

SEQ ID NO: 596900 - DNA, 25 bp, Rattus norvegicus
ttgaatcctgaaccttgtttcgcga

SEQ ID NO: 596901 - DNA, 25 bp, Rattus norvegicus
tgtttcgcgaagtggcatgagttcc

SEQ ID NO: 596902 - DNA, 25 bp, Rattus norvegicus
ctaccggcgagaacagcacaggcga

SEQ ID NO: 596903 - DNA, 25 bp, Rattus norvegicus
agggttcctacctgacagtctcccg

SEQ ID NO: 596904 - DNA, 25 bp, Rattus norvegicus
tacctctgccttggatacggtcggc

SEQ ID NO: 596905 - DNA, 25 bp, Rattus norvegicus
caaccatgtccgagaggagacggcc

SEQ ID NO: 596906 - DNA, 25 bp, Rattus norvegicus
gttcccaaggtctcgcacaccggtg

SEQ ID NO: 596907 - DNA, 25 bp, Rattus norvegicus
tcggctcgtggatcagagaggtcca

SEQ ID NO: 596908 - DNA, 25 bp, Rattus norvegicus
cacgcgcgtacgagcggagtccact

SEQ ID NO: 596909 - DNA, 25 bp, Rattus norvegicus
ggagtccactcagaagccaaccatg

SEQ ID NO: 596910 - DNA, 25 bp, Rattus norvegicus
gcaatgccttgtctaggctgcagtc

SEQ ID NO: 596911 - DNA, 25 bp, Rattus norvegicus
gagccgcacgcggaagctttttcgc

SEQ ID NO: 596912 - DNA, 25 bp, Rattus norvegicus
gccctccgcggcttgtgaacctggg

SEQ ID NO: 596913 - DNA, 25 bp, Rattus norvegicus
acctgggagcgtccgagccctttct

SEQ ID NO: 596914 - DNA, 25 bp, Rattus norvegicus
cgcggcactctggtcgcagattatg

SEQ ID NO: 596915 - DNA, 25 bp, Rattus norvegicus
cttgagacctttgggtacctctgcc

SEQ ID NO: 596916 - DNA, 25 bp, Rattus norvegicus
gcagattatggaccgcgcttgagac

SEQ ID NO: 596917 - DNA, 25 bp, Rattus norvegicus
ccgctgcccacttccgccgagcgcc

SEQ ID NO: 596918 - DNA, 25 bp, Rattus norvegicus
cgggacttcgcagagacgcgcgcgc

SEQ ID NO: 596919 - DNA, 25 bp, Rattus norvegicus
aggccgggacttcgcagagacgcgc

SEQ ID NO: 596920 - DNA, 25 bp, Rattus norvegicus
cgaggaggccgggacttcgcagaga

SEQ ID NO: 596921 - DNA, 25 bp, Rattus norvegicus
gccacgtgcggggtcgctctaaacc

SEQ ID NO: 596922 - DNA, 25 bp, Rattus norvegicus
tcgcacagttggctccgcgcgaggg

SEQ ID NO: 596923 - DNA, 25 bp, Rattus norvegicus
gctcgcacagttggctccgcgcgag

SEQ ID NO: 596924 - DNA, 25 bp, Rattus norvegicus
agctcgcacagttggctccgcgcga

SEQ ID NO: 596925 - DNA, 25 bp, Rattus norvegicus
gtgagctcgcacagttggctccgcg

SEQ ID NO: 596926 - DNA, 25 bp, Rattus norvegicus
cgagccgtccgtccgctgcccactt

SEQ ID NO: 596927 - DNA, 25 bp, Rattus norvegicus
agcgaacgagccgctcgcccgaggc

SEQ ID NO: 596928 - DNA, 25 bp, Rattus norvegicus
cgtgagctcgcacagttggctccgc

SEQ ID NO: 596929 - DNA, 25 bp, Rattus norvegicus
tgagctcgcacagttggctccgcgc

SEQ ID NO: 596930 - DNA, 25 bp, Rattus norvegicus
gtccgctgcccacttccgccgagcg

SEQ ID NO: 596931 - DNA, 25 bp, Rattus norvegicus
cggctgcgaagaacagccgaggcaa

SEQ ID NO: 596932 - DNA, 25 bp, Rattus norvegicus
ctgctgtcggacagcctgttcgtgt

SEQ ID NO: 596933 - DNA, 25 bp, Rattus norvegicus
tggcccagtacctgctgtcggacag

SEQ ID NO: 596934 - DNA, 25 bp, Rattus norvegicus
ttgctgggcaccatcgtcagcgcct

SEQ ID NO: 596935 - DNA, 25 bp, Rattus norvegicus
acttacacgggcctcagcggcctgg

SEQ ID NO: 596936 - DNA, 25 bp, Rattus norvegicus
tgctcttcctcgagcgcttcccgtg

SEQ ID NO: 596937 - DNA, 25 bp, Rattus norvegicus
tcttgtgcatttggggctgctgcgc

SEQ ID NO: 596938 - DNA, 25 bp, Rattus norvegicus
gccctaggtcgggtcttgtgcattt

SEQ ID NO: 596939 - DNA, 25 bp, Rattus norvegicus
cacaggcctgccgtcattgcccaca

SEQ ID NO: 596940 - DNA, 25 bp, Rattus norvegicus
ccatgtcacccattatccgcagggg

SEQ ID NO: 596941 - DNA, 25 bp, Rattus norvegicus
actgaggctagactggccctcgcgt

SEQ ID NO: 596942 - DNA, 25 bp, Rattus norvegicus
gggagccgccatgtcacccattatc

SEQ ID NO: 596943 - DNA, 25 bp, Rattus norvegicus
aaggtgtccggctgcgaagaacagc

SEQ ID NO: 596944 - DNA, 25 bp, Rattus norvegicus
ctagactggccctcgcgtggggctc

SEQ ID NO: 596945 - DNA, 25 bp, Rattus norvegicus
gcgtcttgcgcccagatcttgggga

SEQ ID NO: 596946 - DNA, 25 bp, Rattus norvegicus
tgggacccgcgatcctcgcgtcttg

SEQ ID NO: 596947 - DNA, 25 bp, Rattus norvegicus
ggatcattgtcacccgagacccggt

SEQ ID NO: 596948 - DNA, 25 bp, Rattus norvegicus
ctccgggatcttggggatcattgtc

SEQ ID NO: 596949 - DNA, 25 bp, Rattus norvegicus
acactccctgctccgggatcttggg

SEQ ID NO: 596950 - DNA, 25 bp, Rattus norvegicus
cgcccagatcttggggatctcggtc

SEQ ID NO: 596951 - DNA, 25 bp, Rattus norvegicus
tgggtgcagcgacttgcctcccgca

SEQ ID NO: 596952 - DNA, 25 bp, Rattus norvegicus
gcgggcaacaagaaccaggtaccgc

SEQ ID NO: 596953 - DNA, 25 bp, Rattus norvegicus
aacaagaaccaggtaccgccctgcg

SEQ ID NO: 596954 - DNA, 25 bp, Rattus norvegicus
accgccctgcgccaggatattgggg

SEQ ID NO: 596955 - DNA, 25 bp, Rattus norvegicus
gctgttatcgcgctggcgacactgt

SEQ ID NO: 596956 - DNA, 25 bp, Rattus norvegicus
atcgcgctggcgacactgtgctcca

SEQ ID NO: 596957 - DNA, 25 bp, Rattus norvegicus
gtgctccactccctgtgccgggatc

SEQ ID NO: 596958 - DNA, 25 bp, Rattus norvegicus
tgccgggatcgctgggacaaccctt

SEQ ID NO: 596959 - DNA, 25 bp, Rattus norvegicus
cggctgcgcgccttaaatgccggaa

SEQ ID NO: 596960 - DNA, 25 bp, Rattus norvegicus
tgttgtccatctgccgtccctctga

SEQ ID NO: 596961 - DNA, 25 bp, Rattus norvegicus
cgaggcagacctccgtgtgcgggct

SEQ ID NO: 596962 - DNA, 25 bp, Rattus norvegicus
tgcgggctcccggtaccttctccgc

SEQ ID NO: 596963 - DNA, 25 bp, Rattus norvegicus
ttctccgcgcgcttgccgcggctgt

SEQ ID NO: 596964 - DNA, 25 bp, Rattus norvegicus
gtgcctgcagcccatcctgattcgt

SEQ ID NO: 596965 - DNA, 25 bp, Rattus norvegicus
tgcagcccatcctgattcgtgcgtc

SEQ ID NO: 596966 - DNA, 25 bp, Rattus norvegicus
agcccatcctgattcgtgcgtcctg

SEQ ID NO: 596967 - DNA, 25 bp, Rattus norvegicus
catcctgattcgtgcgtcctgccgg

SEQ ID NO: 596968 - DNA, 25 bp, Rattus norvegicus
attcgtgcgtcctgccggctgtgac

SEQ ID NO: 596969 - DNA, 25 bp, Rattus norvegicus
gtgactctcaatcgcccggagctgc

SEQ ID NO: 596970 - DNA, 25 bp, Rattus norvegicus
tgcgcgccttaaatgccggaagagc

SEQ ID NO: 596971 - DNA, 25 bp, Rattus norvegicus
cgcgccttaaatgccggaagagcag

SEQ ID NO: 596972 - DNA, 25 bp, Rattus norvegicus
cggctgtgactctcaatcgcccgga

SEQ ID NO: 596973 - DNA, 25 bp, Rattus norvegicus
cagccgctgcccaatggagagcgcg

SEQ ID NO: 596974 - DNA, 25 bp, Rattus norvegicus
agcgtgcacgggctgcctccagtag

SEQ ID NO: 596975 - DNA, 25 bp, Rattus norvegicus
tgtgcaggctctcgtagcgtgcacg

SEQ ID NO: 596976 - DNA, 25 bp, Rattus norvegicus
catcgtccgagatgtgcaggctctc

SEQ ID NO: 596977 - DNA, 25 bp, Rattus norvegicus
gactcgccgaacacatcgtccgaga

SEQ ID NO: 596978 - DNA, 25 bp, Rattus norvegicus
ctgtagaaggggttcccgccgctgt

SEQ ID NO: 596979 - DNA, 25 bp, Rattus norvegicus
gctcgcgctcatcgtccgaggaggc

SEQ ID NO: 596980 - DNA, 25 bp, Rattus norvegicus
gcgggcgatccctcagcacggtgct

SEQ ID NO: 596981 - DNA, 25 bp, Rattus norvegicus
accaccggtgtcctcgaagcgcgga

SEQ ID NO: 596982 - DNA, 25 bp, Rattus norvegicus
tcagtagtggggagcaccgcccata

SEQ ID NO: 596983 - DNA, 25 bp, Rattus norvegicus
accgcccataggctcttagtggctc

SEQ ID NO: 596984 - DNA, 25 bp, Rattus norvegicus
cgtggtgctcctagcgctccgtgct

SEQ ID NO: 596985 - DNA, 25 bp, Rattus norvegicus
gagctgtccgcctagcggttctgaa

SEQ ID NO: 596986 - DNA, 25 bp, Rattus norvegicus
gcggttctgaaattcacgctgcgga

SEQ ID NO: 596987 - DNA, 25 bp, Rattus norvegicus
atacacacggttgctcggaaacatg

SEQ ID NO: 596988 - DNA, 25 bp, Rattus norvegicus
gctatgtccatacacacggttgctc

SEQ ID NO: 596989 - DNA, 25 bp, Rattus norvegicus
cactcattcggtcacagttagctga

SEQ ID NO: 596990 - DNA, 25 bp, Rattus norvegicus
acgcacacagggaaagagctatgtc

SEQ ID NO: 596991 - DNA, 25 bp, Rattus norvegicus
cagagcggatggacagaggaataaa

SEQ ID NO: 596992 - DNA, 25 bp, Rattus norvegicus
ggcggctcagaacctcggtgttcaa

SEQ ID NO: 596993 - DNA, 25 bp, Rattus norvegicus
cacagttagctgagtggggctgaca

SEQ ID NO: 596994 - DNA, 25 bp, Rattus norvegicus
cagaggaataaactcccacaacggc

SEQ ID NO: 596995 - DNA, 25 bp, Rattus norvegicus
tcggaaacatgacgctgagcgaaga

SEQ ID NO: 596996 - DNA, 25 bp, Rattus norvegicus
ctcccgtgggaacactcattcggtc

SEQ ID NO: 596997 - DNA, 25 bp, Rattus norvegicus
cggtgttcaatggtgcctcagtttc

SEQ ID NO: 596998 - DNA, 25 bp, Rattus norvegicus
cacctgagcagctcccgtgggaaca

SEQ ID NO: 596999 - DNA, 25 bp, Rattus norvegicus
cgtgaccagactcacctgagcagct

SEQ ID NO: 597000 - DNA, 25 bp, Rattus norvegicus
gtgcctcagtttcaccgtgaccaga

SEQ ID NO: 597001 - DNA, 25 bp, Rattus norvegicus
tcagatactgagaccctgcgattcc

SEQ ID NO: 597002 - DNA, 25 bp, Rattus norvegicus
tgaattcatgaaggtgagggcaccc

SEQ ID NO: 597003 - DNA, 25 bp, Rattus norvegicus
gagcgtcggactccagtgcgccgct

SEQ ID NO: 597004 - DNA, 25 bp, Rattus norvegicus
tcgattacccgaggcagtagcgctg

SEQ ID NO: 597005 - DNA, 25 bp, Rattus norvegicus
gtaccacgttcgattacccgaggca

SEQ ID NO: 597006 - DNA, 25 bp, Rattus norvegicus
tgcccgaagctgcagtaccacgttc

SEQ ID NO: 597007 - DNA, 25 bp, Rattus norvegicus
acgctcgtctattggctgccgctcg

SEQ ID NO: 597008 - DNA, 25 bp, Rattus norvegicus
gcccgcgacgctcgtctattggctg

SEQ ID NO: 597009 - DNA, 25 bp, Rattus norvegicus
acgcaggatgaacctgcccaccggg

SEQ ID NO: 597010 - DNA, 25 bp, Rattus norvegicus
gaccctgcgattcccggaggctcga

SEQ ID NO: 597011 - DNA, 25 bp, Rattus norvegicus
ctgtgcttcgataaggatgaattca

SEQ ID NO: 597012 - DNA, 25 bp, Rattus norvegicus
ggccggacacgctgtgcttcgataa

SEQ ID NO: 597013 - DNA, 25 bp, Rattus norvegicus
ccagcgcgatggagaaacgcaggat

SEQ ID NO: 597014 - DNA, 25 bp, Rattus norvegicus
gggcacccggcagatcagatactga

SEQ ID NO: 597015 - DNA, 25 bp, Rattus norvegicus
agccgcgcccactcgggcccgtact

SEQ ID NO: 597016 - DNA, 25 bp, Rattus norvegicus
cttctccttgtcctgcatgatcttc

SEQ ID NO: 597017 - DNA, 25 bp, Rattus norvegicus
tgcatgatcttcctagccattgggc

SEQ ID NO: 597018 - DNA, 25 bp, Rattus norvegicus
tagccattgggctcagcgaggagaa

SEQ ID NO: 597019 - DNA, 25 bp, Rattus norvegicus
ggttcccgctcatgacggccgagcg

SEQ ID NO: 597020 - DNA, 25 bp, Rattus norvegicus
ctcagcgaggagaagtaggtaaagc

SEQ ID NO: 597021 - DNA, 25 bp, Rattus norvegicus
atttcgtcctgctgcgcgggcggca

SEQ ID NO: 597022 - DNA, 25 bp, Rattus norvegicus
gtcgatgatttcgtcctgctgcgcg

SEQ ID NO: 597023 - DNA, 25 bp, Rattus norvegicus
caggcagcggtcgatgatttcgtcc

SEQ ID NO: 597024 - DNA, 25 bp, Rattus norvegicus
caccaggcagcggtcgatgatttcg

SEQ ID NO: 597025 - DNA, 25 bp, Rattus norvegicus
gtcgccgaagcgcaccagcttctgg

SEQ ID NO: 597026 - DNA, 25 bp, Rattus norvegicus
gaagtaggtaaagcgcttccgctcc

SEQ ID NO: 597027 - DNA, 25 bp, Rattus norvegicus
gcacccacctcgtcgccgaagcgca

SEQ ID NO: 597028 - DNA, 25 bp, Rattus norvegicus
gtacttctcccggatcttctccttg

SEQ ID NO: 597029 - DNA, 25 bp, Rattus norvegicus
aaacttcttcctgcacgtgccgaac

SEQ ID NO: 597030 - DNA, 25 bp, Rattus norvegicus
tggcactgatgacaaaggaaacttc

SEQ ID NO: 597031 - DNA, 25 bp, Rattus norvegicus
ggcactgatgacaaaggaaacttct

SEQ ID NO: 597032 - DNA, 25 bp, Rattus norvegicus
aggaaacttcttcctgcacgtgccg

SEQ ID NO: 597033 - DNA, 25 bp, Rattus norvegicus
ggaaacttcttcctgcacgtgccga

SEQ ID NO: 597034 - DNA, 25 bp, Rattus norvegicus
gaaacttcttcctgcacgtgccgaa

SEQ ID NO: 597035 - DNA, 25 bp, Rattus norvegicus
gaacctggctctcaaccatcctcgc

SEQ ID NO: 597036 - DNA, 25 bp, Rattus norvegicus
acgtgccgaacctggctctcaacca

SEQ ID NO: 597037 - DNA, 25 bp, Rattus norvegicus
tgcacgtgccgaacctggctctcaa

SEQ ID NO: 597038 - DNA, 25 bp, Rattus norvegicus
gcacgtgccgaacctggctctcaac

SEQ ID NO: 597039 - DNA, 25 bp, Rattus norvegicus
ttcttcctgcacgtgccgaacctgg

SEQ ID NO: 597040 - DNA, 25 bp, Rattus norvegicus
tgccgaacctggctctcaaccatcc

SEQ ID NO: 597041 - DNA, 25 bp, Rattus norvegicus
ggctctcaaccatcctcgctccttc

SEQ ID NO: 597042 - DNA, 25 bp, Rattus norvegicus
gctctcaaccatcctcgctccttcg

SEQ ID NO: 597043 - DNA, 25 bp, Rattus norvegicus
cccgtacaagcgctgcggttgtaga

SEQ ID NO: 597044 - DNA, 25 bp, Rattus norvegicus
gaagaccgccatggcgccacgtggc

SEQ ID NO: 597045 - DNA, 25 bp, Rattus norvegicus
ttaactccgggcgaagaccgccatg

SEQ ID NO: 597046 - DNA, 25 bp, Rattus norvegicus
cgctgcggttgtagatggccacaag

SEQ ID NO: 597047 - DNA, 25 bp, Rattus norvegicus
cccatctggtactggtcgggtccac

SEQ ID NO: 597048 - DNA, 25 bp, Rattus norvegicus
catctctggggctgctgtagagtcc

SEQ ID NO: 597049 - DNA, 25 bp, Rattus norvegicus
cccttaggcatctctggggctgctg

SEQ ID NO: 597050 - DNA, 25 bp, Rattus norvegicus
cgctttccgggacccttaggcatct

SEQ ID NO: 597051 - DNA, 25 bp, Rattus norvegicus
tgtcaaggcctttccgtttctcctc

SEQ ID NO: 597052 - DNA, 25 bp, Rattus norvegicus
tcctgtcaaggcctttccgtttctc

SEQ ID NO: 597053 - DNA, 25 bp, Rattus norvegicus
ccggagccctgtgggcacctgaagc

SEQ ID NO: 597054 - DNA, 25 bp, Rattus norvegicus
aatcgtcccggagccctgtgggcac

SEQ ID NO: 597055 - DNA, 25 bp, Rattus norvegicus
ctggtcgggtccacgaatcgtcccg

SEQ ID NO: 597056 - DNA, 25 bp, Rattus norvegicus
tagatggccacaaggggttaactcc

SEQ ID NO: 597057 - DNA, 25 bp, Rattus norvegicus
actgagctgactccgaggatgctga

SEQ ID NO: 597058 - DNA, 25 bp, Rattus norvegicus
gcccgactctgaggacgctgagcct

SEQ ID NO: 597059 - DNA, 25 bp, Rattus norvegicus
acgctgagcccgactctgaggacgc

SEQ ID NO: 597060 - DNA, 25 bp, Rattus norvegicus
gcctgactctgaggacgctgagccc

SEQ ID NO: 597061 - DNA, 25 bp, Rattus norvegicus
cctgactctgaggacgctgagcccg

SEQ ID NO: 597062 - DNA, 25 bp, Rattus norvegicus
cgactctgaggacgctgagcctgac

SEQ ID NO: 597063 - DNA, 25 bp, Rattus norvegicus
actctgaggacgctgggcctgactc

SEQ ID NO: 597064 - DNA, 25 bp, Rattus norvegicus
gactctgaggacactgagctgactc

SEQ ID NO: 597065 - DNA, 25 bp, Rattus norvegicus
gctgagcccgactctgaggacgctg

SEQ ID NO: 597066 - DNA, 25 bp, Rattus norvegicus
tgactctgaggacgctgagcccgac

SEQ ID NO: 597067 - DNA, 25 bp, Rattus norvegicus
actctgaggacgctgagcccgactc

SEQ ID NO: 597068 - DNA, 25 bp, Rattus norvegicus
ctgagcctgactctgaggacgctgg

SEQ ID NO: 597069 - DNA, 25 bp, Rattus norvegicus
ctgagcctgactctgaggacgctga

SEQ ID NO: 597070 - DNA, 25 bp, Rattus norvegicus
ctgagcccgactctgaggacgctgg

SEQ ID NO: 597071 - DNA, 25 bp, Rattus norvegicus
tgcacgacagcaggcatcctccagg

SEQ ID NO: 597072 - DNA, 25 bp, Rattus norvegicus
ctcgttagcctcaagcgctcattca

SEQ ID NO: 597073 - DNA, 25 bp, Rattus norvegicus
agtcgtagtccgcacctcgttagcc

SEQ ID NO: 597074 - DNA, 25 bp, Rattus norvegicus
cgcagtacccgctgggagtcgtagt

SEQ ID NO: 597075 - DNA, 25 bp, Rattus norvegicus
gcgctcattcagcacttggactaca

SEQ ID NO: 597076 - DNA, 25 bp, Rattus norvegicus
tgccggtgctgaagttcctgcttca

SEQ ID NO: 597077 - DNA, 25 bp, Rattus norvegicus
tcctctttcttgtatcgttgtatcg

SEQ ID NO: 597078 - DNA, 25 bp, Rattus norvegicus
cctgcttcagcaaggacagcggaga

SEQ ID NO: 597079 - DNA, 25 bp, Rattus norvegicus
ctgagtgtcctctccaaggccagtc

SEQ ID NO: 597080 - DNA, 25 bp, Rattus norvegicus
tcagcagccggaagtagaagcccta

SEQ ID NO: 597081 - DNA, 25 bp, Rattus norvegicus
ttgtatcgagtgcaaccgggaggcc

SEQ ID NO: 597082 - DNA, 25 bp, Rattus norvegicus
ccgggactacaaccacggagtgctc

SEQ ID NO: 597083 - DNA, 25 bp, Rattus norvegicus
agataaccatctgcgtgagcgcgcc

SEQ ID NO: 597084 - DNA, 25 bp, Rattus norvegicus
aggccagtccaagcgtcttccgtca

SEQ ID NO: 597085 - DNA, 25 bp, Rattus norvegicus
ccgtgccggtaatcggattcctggc

SEQ ID NO: 597086 - DNA, 25 bp, Rattus norvegicus
ctgagcaccgcttccgtgccggtaa

SEQ ID NO: 597087 - DNA, 25 bp, Rattus norvegicus
gtactgacttcacccggcctgagca

SEQ ID NO: 597088 - DNA, 25 bp, Rattus norvegicus
ccctcggttcagctcgtcctggatg

SEQ ID NO: 597089 - DNA, 25 bp, Rattus norvegicus
tcctggatgcgcgacttctgtgcgt

SEQ ID NO: 597090 - DNA, 25 bp, Rattus norvegicus
ttccagggaccagaggaaagtgtcc

SEQ ID NO: 597091 - DNA, 25 bp, Rattus norvegicus
ttctgtgcgtacagccgctccaggt

SEQ ID NO: 597092 - DNA, 25 bp, Rattus norvegicus
tggtccttaccatctccttgcgcaa

SEQ ID NO: 597093 - DNA, 25 bp, Rattus norvegicus
aggggcccggccacccatctgttgt

SEQ ID NO: 597094 - DNA, 25 bp, Rattus norvegicus
aagatgtccagccatgggaagcccg

SEQ ID NO: 597095 - DNA, 25 bp, Rattus norvegicus
aagcctgttctcctgggacccggca

SEQ ID NO: 597096 - DNA, 25 bp, Rattus norvegicus
gcagctctgcttaggtcccttggag

SEQ ID NO: 597097 - DNA, 25 bp, Rattus norvegicus
acaccgacctgcaggcgcacaggaa

SEQ ID NO: 597098 - DNA, 25 bp, Rattus norvegicus
agcagcccactcaggcttttgggta

SEQ ID NO: 597099 - DNA, 25 bp, Rattus norvegicus
gacgctgctcaatacgggcctgtga

SEQ ID NO: 597100 - DNA, 25 bp, Rattus norvegicus
tcacaatgtctgcttgccgtgcgcc

SEQ ID NO: 597101 - DNA, 25 bp, Rattus norvegicus
tcctgccctgttctcacaatgtctg

SEQ ID NO: 597102 - DNA, 25 bp, Rattus norvegicus
gcggatccctgttccgggagcccat

SEQ ID NO: 597103 - DNA, 25 bp, Rattus norvegicus
tcggagctttgaccatccttggctg

SEQ ID NO: 597104 - DNA, 25 bp, Rattus norvegicus
cagctgcgcttgtcttcggagcttt

SEQ ID NO: 597105 - DNA, 25 bp, Rattus norvegicus
tcctgactcaagagcgctgacatcg

SEQ ID NO: 597106 - DNA, 25 bp, Rattus norvegicus
ccaccctcgggtgaagacagcatgc

SEQ ID NO: 597107 - DNA, 25 bp, Rattus norvegicus
agggctgctggccaccttcatacgg

SEQ ID NO: 597108 - DNA, 25 bp, Rattus norvegicus
tgctgctgcctattcaccacctgga

SEQ ID NO: 597109 - DNA, 25 bp, Rattus norvegicus
ctggtccttcgtagagtggaggcac

SEQ ID NO: 597110 - DNA, 25 bp, Rattus norvegicus
cacagcagcgagtcactggtccttc

SEQ ID NO: 597111 - DNA, 25 bp, Rattus norvegicus
ccgcactggccaagagctggttagg

SEQ ID NO: 597112 - DNA, 25 bp, Rattus norvegicus
agcccggctcagtagccttgctggc

SEQ ID NO: 597113 - DNA, 25 bp, Rattus norvegicus
agcagtgcccgtggaggctgtgtgt

SEQ ID NO: 597114 - DNA, 25 bp, Rattus norvegicus
agtgcccgtggaggccgtgtgagca

SEQ ID NO: 597115 - DNA, 25 bp, Rattus norvegicus
agtgcctgtggaggctgtgtgagca

SEQ ID NO: 597116 - DNA, 25 bp, Rattus norvegicus
tgagcagtgcccgtggaggccgtgt

SEQ ID NO: 597117 - DNA, 25 bp, Rattus norvegicus
agtgcccgtggaggctgtgtgagca

SEQ ID NO: 597118 - DNA, 25 bp, Rattus norvegicus
tgcagtgcccgtggaggctgtgtgt

SEQ ID NO: 597119 - DNA, 25 bp, Rattus norvegicus
aggccgtgtgtgcagtgcccgtgga

SEQ ID NO: 597120 - DNA, 25 bp, Rattus norvegicus
agcagtgcccgtggaggctgtgtga

SEQ ID NO: 597121 - DNA, 25 bp, Rattus norvegicus
cagtgcccgtggaggctgtgtgagc

SEQ ID NO: 597122 - DNA, 25 bp, Rattus norvegicus
ctgtggaggccgtgtgagcagtgcc

SEQ ID NO: 597123 - DNA, 25 bp, Rattus norvegicus
tgagcagtgcccgtggaggctgtgt

SEQ ID NO: 597124 - DNA, 25 bp, Rattus norvegicus
cctgtggaggctgtgtgagcagtgc

SEQ ID NO: 597125 - DNA, 25 bp, Rattus norvegicus
cagtgcctgtggaggctgtgtgagc

SEQ ID NO: 597126 - DNA, 25 bp, Rattus norvegicus
tgtggaggccgtgtgtgcagtgcct

SEQ ID NO: 597127 - DNA, 25 bp, Rattus norvegicus
aggaccgtcgccatgcgtcgtgtac

SEQ ID NO: 597128 - DNA, 25 bp, Rattus norvegicus
gacccaggatctcagcgtgtaactc

SEQ ID NO: 597129 - DNA, 25 bp, Rattus norvegicus
gtccagattgtcctagaggggctcc

SEQ ID NO: 597130 - DNA, 25 bp, Rattus norvegicus
ccttcagcggctgatgggtccagat

SEQ ID NO: 597131 - DNA, 25 bp, Rattus norvegicus
cgcctcatctcgaagcgcgtgagtg

SEQ ID NO: 597132 - DNA, 25 bp, Rattus norvegicus
tgcctagaccgacctcgaggaccgt

SEQ ID NO: 597133 - DNA, 25 bp, Rattus norvegicus
tggctttaaaggcactggagagtcg

SEQ ID NO: 597134 - DNA, 25 bp, Rattus norvegicus
ttgcaatagggacctgctggcttta

SEQ ID NO: 597135 - DNA, 25 bp, Rattus norvegicus
ctgagcgcagccaggcattgcaata

SEQ ID NO: 597136 - DNA, 25 bp, Rattus norvegicus
gaaatcccgcctagggcctgcaatc

SEQ ID NO: 597137 - DNA, 25 bp, Rattus norvegicus
ccgcctctttcgcagagcctttttt

SEQ ID NO: 597138 - DNA, 25 bp, Rattus norvegicus
gcgctgagccctgtttctgcattct

SEQ ID NO: 597139 - DNA, 25 bp, Rattus norvegicus
acgcccagcaagttctgcctatctt

SEQ ID NO: 597140 - DNA, 25 bp, Rattus norvegicus
cctgatcctggagcaggccttcagc

SEQ ID NO: 597141 - DNA, 25 bp, Rattus norvegicus
tcggctctgccagccctagcagtgt

SEQ ID NO: 597142 - DNA, 25 bp, Rattus norvegicus
tccaggagcgcctccgaaccaggaa

SEQ ID NO: 597143 - DNA, 25 bp, Rattus norvegicus
ccgaaccaggaagctcagaggaatc

SEQ ID NO: 597144 - DNA, 25 bp, Rattus norvegicus
gaggaatccaactctcgctctgccg

SEQ ID NO: 597145 - DNA, 25 bp, Rattus norvegicus
cgctctgccgccattggaatcagca

SEQ ID NO: 597146 - DNA, 25 bp, Rattus norvegicus
accacagccgtgtagcagaccagtc

SEQ ID NO: 597147 - DNA, 25 bp, Rattus norvegicus
tcacccaggtcgtagagggtccgca

SEQ ID NO: 597148 - DNA, 25 bp, Rattus norvegicus
tcccaggagatacgctcacccaggt

SEQ ID NO: 597149 - DNA, 25 bp, Rattus norvegicus
cttccgatgcatctcgctgcctttg

SEQ ID NO: 597150 - DNA, 25 bp, Rattus norvegicus
caggaaatctcgtagcccgtggtcc

SEQ ID NO: 597151 - DNA, 25 bp, Rattus norvegicus
gtcggcatggctccaggaaatctcg

SEQ ID NO: 597152 - DNA, 25 bp, Rattus norvegicus
gccaagaagtaggtgaaaaggtctc

SEQ ID NO: 597153 - DNA, 25 bp, Rattus norvegicus
agccgcgccatggacgttcctagct

SEQ ID NO: 597154 - DNA, 25 bp, Rattus norvegicus
cagtgtgctcctctatgcggtaggc

SEQ ID NO: 597155 - DNA, 25 bp, Rattus norvegicus
cgcctgtgccaaagtcgagactctc

SEQ ID NO: 597156 - DNA, 25 bp, Rattus norvegicus
ccagcgggatgctctccagactgct

SEQ ID NO: 597157 - DNA, 25 bp, Rattus norvegicus
agactgctcttctgctccgtcagca

SEQ ID NO: 597158 - DNA, 25 bp, Rattus norvegicus
tggtacatctcgctctccaggtagg

SEQ ID NO: 597159 - DNA, 25 bp, Rattus norvegicus
gcgccgtctcgatgaactgccggta

SEQ ID NO: 597160 - DNA, 25 bp, Rattus norvegicus
actgccggtagttctggtagacgtt

SEQ ID NO: 597161 - DNA, 25 bp, Rattus norvegicus
tgcaggcgctcttcctgcagtttaa

SEQ ID NO: 597162 - DNA, 25 bp, Rattus norvegicus
tgctgcgacagttgcttcacgtaca

SEQ ID NO: 597163 - DNA, 25 bp, Rattus norvegicus
ggtctcgcgagatccgtacgcctca

SEQ ID NO: 597164 - DNA, 25 bp, Rattus norvegicus
agccaccttcggttaggcgttcgag

SEQ ID NO: 597165 - DNA, 25 bp, Rattus norvegicus
tcgggcacggaccagacttgacgtg

SEQ ID NO: 597166 - DNA, 25 bp, Rattus norvegicus
cgagcccagcgttcctaagtctgtg

SEQ ID NO: 597167 - DNA, 25 bp, Rattus norvegicus
gcggtctggagacaactggcttcct

SEQ ID NO: 597168 - DNA, 25 bp, Rattus norvegicus
ctggtagacgttgcgcttcaggttc

SEQ ID NO: 597169 - DNA, 25 bp, Rattus norvegicus
agtcgtccaccacgcagatgccgtg

SEQ ID NO: 597170 - DNA, 25 bp, Rattus norvegicus
acgatgtactccagcgccagcttca

SEQ ID NO: 597171 - DNA, 25 bp, Rattus norvegicus
gttcatgcacggcacgatgtactcc

SEQ ID NO: 597172 - DNA, 25 bp, Rattus norvegicus
cagatgccgtgcttgttcatgcacg

SEQ ID NO: 597173 - DNA, 25 bp, Rattus norvegicus
gtccaccacgcagatgccgtgcttg

SEQ ID NO: 597174 - DNA, 25 bp, Rattus norvegicus
cgctgggcacaagctagcgcgctcg

SEQ ID NO: 597175 - DNA, 25 bp, Rattus norvegicus
aggaagtcgtccaccacgcagatgc

SEQ ID NO: 597176 - DNA, 25 bp, Rattus norvegicus
ggtctccctgcccaggaagtcgtcc

SEQ ID NO: 597177 - DNA, 25 bp, Rattus norvegicus
gtccgtgaacttgccggtgtcgtgc

SEQ ID NO: 597178 - DNA, 25 bp, Rattus norvegicus
agttgcccgtccgtgaacttgccgg

SEQ ID NO: 597179 - DNA, 25 bp, Rattus norvegicus
aggtgatcttgtccccccggatgtc

SEQ ID NO: 597180 - DNA, 25 bp, Rattus norvegicus
gagcaggccgatggtctcgcagccg

SEQ ID NO: 597181 - DNA, 25 bp, Rattus norvegicus
cagccacttactttcgttcggccgt

SEQ ID NO: 597182 - DNA, 25 bp, Rattus norvegicus
acgcagatgccgtgcttgttcatgc

SEQ ID NO: 597183 - DNA, 25 bp, Rattus norvegicus
gcattagaatctacaatagtacctg

SEQ ID NO: 597184 - DNA, 25 bp, Rattus norvegicus
tgttgtcttgagacgcagcccggta

SEQ ID NO: 597185 - DNA, 25 bp, Rattus norvegicus
gcttttctgcggtccttaaactctg

SEQ ID NO: 597186 - DNA, 25 bp, Rattus norvegicus
tgcggtccttaaactctgagatttc

SEQ ID NO: 597187 - DNA, 25 bp, Rattus norvegicus
ctcctgggttaagtaaggtaatcag

SEQ ID NO: 597188 - DNA, 25 bp, Rattus norvegicus
cgccggtccggttctggctttgctt

SEQ ID NO: 597189 - DNA, 25 bp, Rattus norvegicus
ggtaatcagggctcggttccagatc

SEQ ID NO: 597190 - DNA, 25 bp, Rattus norvegicus
tcggttccagatcggcactcaggcc

SEQ ID NO: 597191 - DNA, 25 bp, Rattus norvegicus
cctgaagctctcaagagcgtagtcc

SEQ ID NO: 597192 - DNA, 25 bp, Rattus norvegicus
cgtagtccgtgaacgactctgcaca

SEQ ID NO: 597193 - DNA, 25 bp, Rattus norvegicus
ctctgcacacggagttaaaatctcg

SEQ ID NO: 597194 - DNA, 25 bp, Rattus norvegicus
agtacctgcagaattacgaggatta

SEQ ID NO: 597195 - DNA, 25 bp, Rattus norvegicus
cgaggattattacgggctttctttg

SEQ ID NO: 597196 - DNA, 25 bp, Rattus norvegicus
attacgggctttctttgttgtcttg

SEQ ID NO: 597197 - DNA, 25 bp, Rattus norvegicus
cgaccggcttcggagtgctcgcaac

SEQ ID NO: 597198 - DNA, 25 bp, Rattus norvegicus
cctgagagtcgccaagcctggtgaa

SEQ ID NO: 597199 - DNA, 25 bp, Rattus norvegicus
acaatgcttgcaccatatccggacc

SEQ ID NO: 597200 - DNA, 25 bp, Rattus norvegicus
ggtgtggactctcagccctacaatg

SEQ ID NO: 597201 - DNA, 25 bp, Rattus norvegicus
accaatgctcttcgggtgtggactc

SEQ ID NO: 597202 - DNA, 25 bp, Rattus norvegicus
tgagcgcgagccctgagcttacagg

SEQ ID NO: 597203 - DNA, 25 bp, Rattus norvegicus
acgcccattggccagtcggacaagc

SEQ ID NO: 597204 - DNA, 25 bp, Rattus norvegicus
tcaaatgaacgtgcgggcgctgccg

SEQ ID NO: 597205 - DNA, 25 bp, Rattus norvegicus
gggatactgcgaccaggctcaaatg

SEQ ID NO: 597206 - DNA, 25 bp, Rattus norvegicus
cgaaattgattcctcgggatactgc

SEQ ID NO: 597207 - DNA, 25 bp, Rattus norvegicus
gggacgcgcttgacgcaaaagtgca

SEQ ID NO: 597208 - DNA, 25 bp, Rattus norvegicus
aaagtgcaagccacagttgcgcggg

SEQ ID NO: 597209 - DNA, 25 bp, Rattus norvegicus
ggaacctgtgcccagagccagtcca

SEQ ID NO: 597210 - DNA, 25 bp, Rattus norvegicus
tctcggggagacgagccgaaattga

SEQ ID NO: 597211 - DNA, 25 bp, Rattus norvegicus
tgagccctgcgtgtatcacgggttc

SEQ ID NO: 597212 - DNA, 25 bp, Rattus norvegicus
ccgctcctgcttcctgctggtgggg

SEQ ID NO: 597213 - DNA, 25 bp, Rattus norvegicus
gccgagcggctcttctcactggagc

SEQ ID NO: 597214 - DNA, 25 bp, Rattus norvegicus
tctcactggagctgctcgtggactg

SEQ ID NO: 597215 - DNA, 25 bp, Rattus norvegicus
ggctggactcgccatgcttcgcgag

SEQ ID NO: 597216 - DNA, 25 bp, Rattus norvegicus
gcgtttcgtctgctggacttcccgc

SEQ ID NO: 597217 - DNA, 25 bp, Rattus norvegicus
atcaccttcggacgcggcaaagcct

SEQ ID NO: 597218 - DNA, 25 bp, Rattus norvegicus
cggcaaagcctgcttactgcgcctg

SEQ ID NO: 597219 - DNA, 25 bp, Rattus norvegicus
actcctgttgggagcttgcgacatc

SEQ ID NO: 597220 - DNA, 25 bp, Rattus norvegicus
ctcggtgggtcaacgaggtatattc

SEQ ID NO: 597221 - DNA, 25 bp, Rattus norvegicus
acgaggtatattcaccctgcgcggc

SEQ ID NO: 597222 - DNA, 25 bp, Rattus norvegicus
tatattcaccctgcgcggcccggag

SEQ ID NO: 597223 - DNA, 25 bp, Rattus norvegicus
ttctaccgcttgaccgacctgggac

SEQ ID NO: 597224 - DNA, 25 bp, Rattus norvegicus
ggaattggcgctcttctaccgcttg

SEQ ID NO: 597225 - DNA, 25 bp, Rattus norvegicus
cggcatgctgtacctgcacgaggag

SEQ ID NO: 597226 - DNA, 25 bp, Rattus norvegicus
gctcgcctgtgcacgtagacttcga

SEQ ID NO: 597227 - DNA, 25 bp, Rattus norvegicus
acctctgcctagtgctggagttcgc

SEQ ID NO: 597228 - DNA, 25 bp, Rattus norvegicus
cgcgtaagtccaagcaggtccagca

SEQ ID NO: 597229 - DNA, 25 bp, Rattus norvegicus
cttcggacaggtgtatcgcgccacc

SEQ ID NO: 597230 - DNA, 25 bp, Rattus norvegicus
gtgggccgcgctttatgattacgaa

SEQ ID NO: 597231 - DNA, 25 bp, Rattus norvegicus
ggtccactagcgacctctcaaatcg

SEQ ID NO: 597232 - DNA, 25 bp, Rattus norvegicus
gtggctgtcgcactcggtccactag

SEQ ID NO: 597233 - DNA, 25 bp, Rattus norvegicus
atacacgtcgctggagacccgggaa

SEQ ID NO: 597234 - DNA, 25 bp, Rattus norvegicus
ttagcttggaccgatgatacacgtc

SEQ ID NO: 597235 - DNA, 25 bp, Rattus norvegicus
ctgcacccttccctgttagcttgga

SEQ ID NO: 597236 - DNA, 25 bp, Rattus norvegicus
gcagtggtcgtaacctctgtagtcc

SEQ ID NO: 597237 - DNA, 25 bp, Rattus norvegicus
ccgcggggaagaactagccaaactg

SEQ ID NO: 597238 - DNA, 25 bp, Rattus norvegicus
acgttctagtcaactgggccgtgca

SEQ ID NO: 597239 - DNA, 25 bp, Rattus norvegicus
ctgcgcaagctgaagcggcgcttcc

SEQ ID NO: 597240 - DNA, 25 bp, Rattus norvegicus
ccgtggagctgccttatgaggacct

SEQ ID NO: 597241 - DNA, 25 bp, Rattus norvegicus
ccagcgaggtgacctcggagcacga

SEQ ID NO: 597242 - DNA, 25 bp, Rattus norvegicus
tccaccacaggtagggtcgctgctg

SEQ ID NO: 597243 - DNA, 25 bp, Rattus norvegicus
tcagcaacgcctcggggaattggaa

SEQ ID NO: 597244 - DNA, 25 bp, Rattus norvegicus
caattatggagtgtcggtgctcagc

SEQ ID NO: 597245 - DNA, 25 bp, Rattus norvegicus
ttcctggaggagcacgagtgcctgt

SEQ ID NO: 597246 - DNA, 25 bp, Rattus norvegicus
tgggctacctgctctacctggtgtt

SEQ ID NO: 597247 - DNA, 25 bp, Rattus norvegicus
gcgccgggaagatgctgcagtccct

SEQ ID NO: 597248 - DNA, 25 bp, Rattus norvegicus
gggtgagagctctccgcccgaccaa

SEQ ID NO: 597249 - DNA, 25 bp, Rattus norvegicus
tttgcacggaaccaggaaagggagc

SEQ ID NO: 597250 - DNA, 25 bp, Rattus norvegicus
ctggcctcttgtatttgcacggaac

SEQ ID NO: 597251 - DNA, 25 bp, Rattus norvegicus
ccgcgtgctggaggccagcaattat

SEQ ID NO: 597252 - DNA, 25 bp, Rattus norvegicus
ccgtggtcttctcgtccgtggagct

SEQ ID NO: 597253 - DNA, 25 bp, Rattus norvegicus
gtccagcgtgtcaccgtgcatgtca

SEQ ID NO: 597254 - DNA, 25 bp, Rattus norvegicus
tcacgtgtgagtacccgtggcaggc

SEQ ID NO: 597255 - DNA, 25 bp, Rattus norvegicus
cgtccatgccgttctgctgggattc

SEQ ID NO: 597256 - DNA, 25 bp, Rattus norvegicus
tgtcaccgtgcatgtcacccgcaga

SEQ ID NO: 597257 - DNA, 25 bp, Rattus norvegicus
ggtcctctacttccacatacgctgg

SEQ ID NO: 597258 - DNA, 25 bp, Rattus norvegicus
tccacatacgctggggcttctccaa

SEQ ID NO: 597259 - DNA, 25 bp, Rattus norvegicus
cttctccaagcaggtggtggccatc

SEQ ID NO: 597260 - DNA, 25 bp, Rattus norvegicus
ctgggattcgtcaccgtgtcctgct

SEQ ID NO: 597261 - DNA, 25 bp, Rattus norvegicus
ccgtgttctccgtgctggaggatga

SEQ ID NO: 597262 - DNA, 25 bp, Rattus norvegicus
aggatgactggaacttcctcgaatc

SEQ ID NO: 597263 - DNA, 25 bp, Rattus norvegicus
gtttcatctccctgagcaccatcgg

SEQ ID NO: 597264 - DNA, 25 bp, Rattus norvegicus
gttccaggggaaggctacaaccaga

SEQ ID NO: 597265 - DNA, 25 bp, Rattus norvegicus
gggagctgtacaagatcgggatcac

SEQ ID NO: 597266 - DNA, 25 bp, Rattus norvegicus
acaaccagaagttccgggagctgta

SEQ ID NO: 597267 - DNA, 25 bp, Rattus norvegicus
gagcagccatgggtcttcaccagtc

SEQ ID NO: 597268 - DNA, 25 bp, Rattus norvegicus
ggagactgtccgacatcagccctca

SEQ ID NO: 597269 - DNA, 25 bp, Rattus norvegicus
ggagagaccaagagactcacgtgtc

SEQ ID NO: 597270 - DNA, 25 bp, Rattus norvegicus
ggtcgcgttctgtggaggacctcac

SEQ ID NO: 597271 - DNA, 25 bp, Rattus norvegicus
cgaagccggagaagtttcagcagca

SEQ ID NO: 597272 - DNA, 25 bp, Rattus norvegicus
gctccggcagctcaagtacttggtg

SEQ ID NO: 597273 - DNA, 25 bp, Rattus norvegicus
tttcagcagcatttcgggccactca

SEQ ID NO: 597274 - DNA, 25 bp, Rattus norvegicus
atcctgcactgatgcgctcctggtg

SEQ ID NO: 597275 - DNA, 25 bp, Rattus norvegicus
cgcccagggccaagagcattgctgt

SEQ ID NO: 597276 - DNA, 25 bp, Rattus norvegicus
gcccatggggatccgagagtttccc

SEQ ID NO: 597277 - DNA, 25 bp, Rattus norvegicus
agctcgcagagcctggcatacacgg

SEQ ID NO: 597278 - DNA, 25 bp, Rattus norvegicus
gccctaaggttgcagagctcgcaga

SEQ ID NO: 597279 - DNA, 25 bp, Rattus norvegicus
acgtgtcaaaaccagaacgccagga

SEQ ID NO: 597280 - DNA, 25 bp, Rattus norvegicus
aggaggatctgaaatggtcgcgttc

SEQ ID NO: 597281 - DNA, 25 bp, Rattus norvegicus
gctccggttggtttaagttgttgca

SEQ ID NO: 597282 - DNA, 25 bp, Rattus norvegicus
caccggtttgtgagatttgcgacga

SEQ ID NO: 597283 - DNA, 25 bp, Rattus norvegicus
ccatggtcaccggtttgtgagattt

SEQ ID NO: 597284 - DNA, 25 bp, Rattus norvegicus
cttgctaggaggtccgggtcctcca

SEQ ID NO: 597285 - DNA, 25 bp, Rattus norvegicus
caccaatgctccttgctaggaggtc

SEQ ID NO: 597286 - DNA, 25 bp, Rattus norvegicus
gggtgtcaacaccaatgctccttgc

SEQ ID NO: 597287 - DNA, 25 bp, Rattus norvegicus
aagttgttgcaggagctggtgttaa

SEQ ID NO: 597288 - DNA, 25 bp, Rattus norvegicus
aaccgaggtcttgctgggctccggt

SEQ ID NO: 597289 - DNA, 25 bp, Rattus norvegicus
cgagttcatttggaaccgaggtctt

SEQ ID NO: 597290 - DNA, 25 bp, Rattus norvegicus
taggtccgaaggtgacgagttcatt

SEQ ID NO: 597291 - DNA, 25 bp, Rattus norvegicus
gccgctgtttagagctaggtccgaa

SEQ ID NO: 597292 - DNA, 25 bp, Rattus norvegicus
caccatcggccgctgtttagagcta

SEQ ID NO: 597293 - DNA, 25 bp, Rattus norvegicus
gctgcacaccatcggccgctgttta

SEQ ID NO: 597294 - DNA, 25 bp, Rattus norvegicus
gcaggcgaagcttgggtgtcaacac

SEQ ID NO: 597295 - DNA, 25 bp, Rattus norvegicus
gactgtgctccgaacactgtcgaga

SEQ ID NO: 597296 - DNA, 25 bp, Rattus norvegicus
tccgaacactgtcgagatcctccga

SEQ ID NO: 597297 - DNA, 25 bp, Rattus norvegicus
cctctccgagggtttccgaatatct

SEQ ID NO: 597298 - DNA, 25 bp, Rattus norvegicus
ctccgagggtttccgaatatcttcg

SEQ ID NO: 597299 - DNA, 25 bp, Rattus norvegicus
tatcttcggggcctttccgaagctg

SEQ ID NO: 597300 - DNA, 25 bp, Rattus norvegicus
ttcggggcctttccgaagctgccga

SEQ ID NO: 597301 - DNA, 25 bp, Rattus norvegicus
ggggcctttccgaagctgccgaagc

SEQ ID NO: 597302 - DNA, 25 bp, Rattus norvegicus
gaacactgtcgagatcctccgagcc

SEQ ID NO: 597303 - DNA, 25 bp, Rattus norvegicus
agcggagccgagcaacgccaagctc

SEQ ID NO: 597304 - DNA, 25 bp, Rattus norvegicus
ggagccgagcaacgccaagctcagc

SEQ ID NO: 597305 - DNA, 25 bp, Rattus norvegicus
ccatcgacttttccagcctcggctg

SEQ ID NO: 597306 - DNA, 25 bp, Rattus norvegicus
tgctccgaacactgtcgagatcctc

SEQ ID NO: 597307 - DNA, 25 bp, Rattus norvegicus
cgctcggccctctccgcttggaccc

SEQ ID NO: 597308 - DNA, 25 bp, Rattus norvegicus
ctgccgaagccgctcggccctctcc

SEQ ID NO: 597309 - DNA, 25 bp, Rattus norvegicus
gcgtctgtccctgacccggagggac

SEQ ID NO: 597310 - DNA, 25 bp, Rattus norvegicus
tacgtgacgttggagtttgcagcga

SEQ ID NO: 597311 - DNA, 25 bp, Rattus norvegicus
gagtgcacttgtacgtgacgttgga

SEQ ID NO: 597312 - DNA, 25 bp, Rattus norvegicus
cggcagcttcgggacgctgtccgca

SEQ ID NO: 597313 - DNA, 25 bp, Rattus norvegicus
gcggccaccgcagtgagtcgcgaca

SEQ ID NO: 597314 - DNA, 25 bp, Rattus norvegicus
caccgcagtgagtcgcgacaggagc

SEQ ID NO: 597315 - DNA, 25 bp, Rattus norvegicus
ccggctcaccatgaagaagcactcg

SEQ ID NO: 597316 - DNA, 25 bp, Rattus norvegicus
aagaagcactcggccagggtggccc

SEQ ID NO: 597317 - DNA, 25 bp, Rattus norvegicus
agcgcctgcaacagtccggtcctga

SEQ ID NO: 597318 - DNA, 25 bp, Rattus norvegicus
agtccggtcctgaccctcaccaaag

SEQ ID NO: 597319 - DNA, 25 bp, Rattus norvegicus
tcaccaaagtggaaggtaaacgcgc

SEQ ID NO: 597320 - DNA, 25 bp, Rattus norvegicus
tgtccgggcctgaggcgtctgtccc

SEQ ID NO: 597321 - DNA, 25 bp, Rattus norvegicus
cccggagggacacctggctgctagt

SEQ ID NO: 597322 - DNA, 25 bp, Rattus norvegicus
cttcgggacgctgtccgcagtgcag

SEQ ID NO: 597323 - DNA, 25 bp, Rattus norvegicus
cagcggttagctccgaccgatcgga

SEQ ID NO: 597324 - DNA, 25 bp, Rattus norvegicus
ctcacgttctcgaagcctgttcttg

SEQ ID NO: 597325 - DNA, 25 bp, Rattus norvegicus
cctgttcttgaagttggggtcactc

SEQ ID NO: 597326 - DNA, 25 bp, Rattus norvegicus
ggtcactccgccttttgcggtcaaa

SEQ ID NO: 597327 - DNA, 25 bp, Rattus norvegicus
cggtcaaagtagatgcagtacccta

SEQ ID NO: 597328 - DNA, 25 bp, Rattus norvegicus
agcactcggggacgcgcaagcctga

SEQ ID NO: 597329 - DNA, 25 bp, Rattus norvegicus
accatcttcgctcgactggggcgtg

SEQ ID NO: 597330 - DNA, 25 bp, Rattus norvegicus
aggggtttgtgcgtcatcccgcgcc

SEQ ID NO: 597331 - DNA, 25 bp, Rattus norvegicus
tgccgcctgtctgcagtccagacgg

SEQ ID NO: 597332 - DNA, 25 bp, Rattus norvegicus
ctgcagtccagacggaaaaggccga

SEQ ID NO: 597333 - DNA, 25 bp, Rattus norvegicus
aaaaggccgagtgtgaggacttccg

SEQ ID NO: 597334 - DNA, 25 bp, Rattus norvegicus
gcctggtgcgcacgcgcagataacc

SEQ ID NO: 597335 - DNA, 25 bp, Rattus norvegicus
cagataaccctgtctgcgcggcgga

SEQ ID NO: 597336 - DNA, 25 bp, Rattus norvegicus
taccctatgaagagggcaccgcaca

SEQ ID NO: 597337 - DNA, 25 bp, Rattus norvegicus
tcccactggttccaggttccggctg

SEQ ID NO: 597338 - DNA, 25 bp, Rattus norvegicus
acgagggtgttcactctagtccgcc

SEQ ID NO: 597339 - DNA, 25 bp, Rattus norvegicus
ctgggcgtttacgagggtgttcact

SEQ ID NO: 597340 - DNA, 25 bp, Rattus norvegicus
ctcggcctaatacaggcggagctga

SEQ ID NO: 597341 - DNA, 25 bp, Rattus norvegicus
aggagtcgtgctcggcctaatacag

SEQ ID NO: 597342 - DNA, 25 bp, Rattus norvegicus
ttcctctctgtgcagaccacggctg

SEQ ID NO: 597343 - DNA, 25 bp, Rattus norvegicus
tagggccggactcttccgctcatga

SEQ ID NO: 597344 - DNA, 25 bp, Rattus norvegicus
agccatgcttaaaactaatcttctg

SEQ ID NO: 597345 - DNA, 25 bp, Rattus norvegicus
tgcctccgggttccgactacttcta

SEQ ID NO: 597346 - DNA, 25 bp, Rattus norvegicus
ggatccggttagtcctgcgttccca

SEQ ID NO: 597347 - DNA, 25 bp, Rattus norvegicus
cttctggaacggaagtaatgagtcc

SEQ ID NO: 597348 - DNA, 25 bp, Rattus norvegicus
ctacttctattctagggccggactc

SEQ ID NO: 597349 - DNA, 25 bp, Rattus norvegicus
taatgagtccgtacttccgggatcc

SEQ ID NO: 597350 - DNA, 25 bp, Rattus norvegicus
tagtcctgcgttcccactggttcca

SEQ ID NO: 597351 - DNA, 25 bp, Rattus norvegicus
acttccggctccttgagccacggac

SEQ ID NO: 597352 - DNA, 25 bp, Rattus norvegicus
gagccacggacttccggctccttga

SEQ ID NO: 597353 - DNA, 25 bp, Rattus norvegicus
agccacggacttccggctccttgag

SEQ ID NO: 597354 - DNA, 25 bp, Rattus norvegicus
cttgagccacggacttccggctcct

SEQ ID NO: 597355 - DNA, 25 bp, Rattus norvegicus
tgagccacggacttccggctccttg

SEQ ID NO: 597356 - DNA, 25 bp, Rattus norvegicus
gacttccggctccttgagccacgga

SEQ ID NO: 597357 - DNA, 25 bp, Rattus norvegicus
ttccggctccttgagccacggactt

SEQ ID NO: 597358 - DNA, 25 bp, Rattus norvegicus
ggacttccggctccttgagccacgg

SEQ ID NO: 597359 - DNA, 25 bp, Rattus norvegicus
ttgagccacggacttccggctcctt

SEQ ID NO: 597360 - DNA, 25 bp, Rattus norvegicus
ggctccttgagccacggacttccgg

SEQ ID NO: 597361 - DNA, 25 bp, Rattus norvegicus
gctccttgagccacggacttccggc

SEQ ID NO: 597362 - DNA, 25 bp, Rattus norvegicus
acggacttccggctccttgagccac

SEQ ID NO: 597363 - DNA, 25 bp, Rattus norvegicus
cggacttccggctccttgagccacg

SEQ ID NO: 597364 - DNA, 25 bp, Rattus norvegicus
ccggctccttgagccacggacttcc

SEQ ID NO: 597365 - DNA, 25 bp, Rattus norvegicus
tcctagagcagcctacggcaagtgg

SEQ ID NO: 597366 - DNA, 25 bp, Rattus norvegicus
acactgtctgggtcttccgggctta

SEQ ID NO: 597367 - DNA, 25 bp, Rattus norvegicus
cgcggtctctggacactgtctgggt

SEQ ID NO: 597368 - DNA, 25 bp, Rattus norvegicus
cgcggccgtaaagttctcggcgctc

SEQ ID NO: 597369 - DNA, 25 bp, Rattus norvegicus
tcaatatggcgcttcctggagacgg

SEQ ID NO: 597370 - DNA, 25 bp, Rattus norvegicus
cgcggggatcaatatggcgcttcct

SEQ ID NO: 597371 - DNA, 25 bp, Rattus norvegicus
agcaggcggtgacccgctaccggaa

SEQ ID NO: 597372 - DNA, 25 bp, Rattus norvegicus
ggcgtcccggagtagacctcctaga

SEQ ID NO: 597373 - DNA, 25 bp, Rattus norvegicus
aggcccaagcacagcgccgcgggtt

SEQ ID NO: 597374 - DNA, 25 bp, Rattus norvegicus
tcgccgtgcggtgaaccgagcagcc

SEQ ID NO: 597375 - DNA, 25 bp, Rattus norvegicus
gagtcccgactaagcgctagcgcca

SEQ ID NO: 597376 - DNA, 25 bp, Rattus norvegicus
cggagatggccgcatgaaagttttc

SEQ ID NO: 597377 - DNA, 25 bp, Rattus norvegicus
aaagttttcagccttatccagcagg

SEQ ID NO: 597378 - DNA, 25 bp, Rattus norvegicus
caaagaaaggaagaggacctcgttg

SEQ ID NO: 597379 - DNA, 25 bp, Rattus norvegicus
agaagtggtaggttttagctgaccg

SEQ ID NO: 597380 - DNA, 25 bp, Rattus norvegicus
ctccggcggtgaattaccgcacttc

SEQ ID NO: 597381 - DNA, 25 bp, Rattus norvegicus
tccactccggcggtgaattaccgca

SEQ ID NO: 597382 - DNA, 25 bp, Rattus norvegicus
atcagctgtgggctccactccggcg

SEQ ID NO: 597383 - DNA, 25 bp, Rattus norvegicus
tcctttgccatcagctgtgggctcc

SEQ ID NO: 597384 - DNA, 25 bp, Rattus norvegicus
tgactcctttgccatcagctgtggg

SEQ ID NO: 597385 - DNA, 25 bp, Rattus norvegicus
atctgcgtttcctaaccaccgtgac

SEQ ID NO: 597386 - DNA, 25 bp, Rattus norvegicus
cgtaagaagtggtaggttttagctg

SEQ ID NO: 597387 - DNA, 25 bp, Rattus norvegicus
ggagttcttgttgatggcggtcctc

SEQ ID NO: 597388 - DNA, 25 bp, Rattus norvegicus
ggtagctatggagttcttgttgatg

SEQ ID NO: 597389 - DNA, 25 bp, Rattus norvegicus
gcatggccgccatacacagatcggg

SEQ ID NO: 597390 - DNA, 25 bp, Rattus norvegicus
accgtgactcctttgccatcagctg

SEQ ID NO: 597391 - DNA, 25 bp, Rattus norvegicus
ggtgaattaccgcacttccgttgta

SEQ ID NO: 597392 - DNA, 25 bp, Rattus norvegicus
attaccgcacttccgttgtagcgga

SEQ ID NO: 597393 - DNA, 25 bp, Rattus norvegicus
gcggctatcgcctagaccttgcctg

SEQ ID NO: 597394 - DNA, 25 bp, Rattus norvegicus
cagggccgaaaagaaggctggactc

SEQ ID NO: 597395 - DNA, 25 bp, Rattus norvegicus
ctctctacacaagggggtggctttg

SEQ ID NO: 597396 - DNA, 25 bp, Rattus norvegicus
tccagggctggctctctacacaagg

SEQ ID NO: 597397 - DNA, 25 bp, Rattus norvegicus
agtggcgactaacggaggcgctcca

SEQ ID NO: 597398 - DNA, 25 bp, Rattus norvegicus
ccaaagaggtagctagtggcgacta

SEQ ID NO: 597399 - DNA, 25 bp, Rattus norvegicus
cgaaaagaaggctggactctggagc

SEQ ID NO: 597400 - DNA, 25 bp, Rattus norvegicus
agggtcagagaaccaaagaggtagc

SEQ ID NO: 597401 - DNA, 25 bp, Rattus norvegicus
cccggtcttccataagggtcagaga

SEQ ID NO: 597402 - DNA, 25 bp, Rattus norvegicus
caggcgtttgactcccagccttctg

SEQ ID NO: 597403 - DNA, 25 bp, Rattus norvegicus
tcgactcaggcgtttgactcccagc

SEQ ID NO: 597404 - DNA, 25 bp, Rattus norvegicus
ccttccgctcgactcaggcgtttga

SEQ ID NO: 597405 - DNA, 25 bp, Rattus norvegicus
gcagagggccaacggcctcgcgact

SEQ ID NO: 597406 - DNA, 25 bp, Rattus norvegicus
ctagaccttgcctgcagagggccaa

SEQ ID NO: 597407 - DNA, 25 bp, Rattus norvegicus
tccgcagcggtaagtgacagccgga

SEQ ID NO: 597408 - DNA, 25 bp, Rattus norvegicus
caatcgtgctctcccgcggctgcct

SEQ ID NO: 597409 - DNA, 25 bp, Rattus norvegicus
ggttttcctccctcaatcgtgctct

SEQ ID NO: 597410 - DNA, 25 bp, Rattus norvegicus
gctgggttttcctccctcaatcgtg

SEQ ID NO: 597411 - DNA, 25 bp, Rattus norvegicus
gattgttaagattcccgtttgctgg

SEQ ID NO: 597412 - DNA, 25 bp, Rattus norvegicus
taagcggacttaagagcgttgtttc

SEQ ID NO: 597413 - DNA, 25 bp, Rattus norvegicus
gaggattttatggttcttaagcgga

SEQ ID NO: 597414 - DNA, 25 bp, Rattus norvegicus
ccggctgaggattttatggttctta

SEQ ID NO: 597415 - DNA, 25 bp, Rattus norvegicus
aattcaggcattgcctcgccgctag

SEQ ID NO: 597416 - DNA, 25 bp, Rattus norvegicus
ttctcgcgaattcaggcattgcctc

SEQ ID NO: 597417 - DNA, 25 bp, Rattus norvegicus
ggctgccgttgctgtgcgccacgct

SEQ ID NO: 597418 - DNA, 25 bp, Rattus norvegicus
gcgctttccgcagcggtaagtgaca

SEQ ID NO: 597419 - DNA, 25 bp, Rattus norvegicus
gcgcttctcgcgaattcaggcattg

SEQ ID NO: 597420 - DNA, 25 bp, Rattus norvegicus
agagcgttgtttcggattgttaaga

SEQ ID NO: 597421 - DNA, 25 bp, Rattus norvegicus
gttagttctacttgcccggagccca

SEQ ID NO: 597422 - DNA, 25 bp, Rattus norvegicus
gacggacggaactcctgtgaggaca

SEQ ID NO: 597423 - DNA, 25 bp, Rattus norvegicus
ctccctcagataaggccggaccggg

SEQ ID NO: 597424 - DNA, 25 bp, Rattus norvegicus
gagctgcaaccgaacccggctgtgc

SEQ ID NO: 597425 - DNA, 25 bp, Rattus norvegicus
cggctgtgcgctgggtccctaagac

SEQ ID NO: 597426 - DNA, 25 bp, Rattus norvegicus
gccgcagagacacgcccggttagtt

SEQ ID NO: 597427 - DNA, 25 bp, Rattus norvegicus
tgaaatatcgagagcgtgggccgcc

SEQ ID NO: 597428 - DNA, 25 bp, Rattus norvegicus
cgcgttccgcctctcggaggggtct

SEQ ID NO: 597429 - DNA, 25 bp, Rattus norvegicus
ctcggcttctcggatggtctcgggt

SEQ ID NO: 597430 - DNA, 25 bp, Rattus norvegicus
ggtctcagccgctcttcagtgagtg

SEQ ID NO: 597431 - DNA, 25 bp, Rattus norvegicus
tgcagacaaaggagttgggtcgttc

SEQ ID NO: 597432 - DNA, 25 bp, Rattus norvegicus
tcgttcgggcctttctgccaaggac

SEQ ID NO: 597433 - DNA, 25 bp, Rattus norvegicus
ttctgccaaggacgcggcgctgaaa

SEQ ID NO: 597434 - DNA, 25 bp, Rattus norvegicus
cgaagcctgtgtcccgactctggga

SEQ ID NO: 597435 - DNA, 25 bp, Rattus norvegicus
caccaaagcggcgtttccggagagc

SEQ ID NO: 597436 - DNA, 25 bp, Rattus norvegicus
tgaggaagactgttccgatcccttc

SEQ ID NO: 597437 - DNA, 25 bp, Rattus norvegicus
agaaacgaccgcagctctggctacg

SEQ ID NO: 597438 - DNA, 25 bp, Rattus norvegicus
tggctacggcctatgccctaactgc

SEQ ID NO: 597439 - DNA, 25 bp, Rattus norvegicus
cctaactgctgcgtctggcccggaa

SEQ ID NO: 597440 - DNA, 25 bp, Rattus norvegicus
tctggcccggaaaccgtgcatcagg

SEQ ID NO: 597441 - DNA, 25 bp, Rattus norvegicus
catcaggccggagacagaggttccc

SEQ ID NO: 597442 - DNA, 25 bp, Rattus norvegicus
gaacggccactcaccggcatgactg

SEQ ID NO: 597443 - DNA, 25 bp, Rattus norvegicus
cgaggactagaacgcctctcccgaa

SEQ ID NO: 597444 - DNA, 25 bp, Rattus norvegicus
gcgtttccggagagcgctcctggaa

SEQ ID NO: 597445 - DNA, 25 bp, Rattus norvegicus
ctttccggggtctagcttccgcaag

SEQ ID NO: 597446 - DNA, 25 bp, Rattus norvegicus
tcaccggcatgactgacgcggcaca

SEQ ID NO: 597447 - DNA, 25 bp, Rattus norvegicus
ccgccctttgaggaagactgttccg

SEQ ID NO: 597448 - DNA, 25 bp, Rattus norvegicus
ccgccctagggatgggctctactta

SEQ ID NO: 597449 - DNA, 25 bp, Rattus norvegicus
tggcggcgctgatgccatcttcttt

SEQ ID NO: 597450 - DNA, 25 bp, Rattus norvegicus
tgccgctagtgcatgtgcatcgccg

SEQ ID NO: 597451 - DNA, 25 bp, Rattus norvegicus
tggctaccgaggtccttacccagca

SEQ ID NO: 597452 - DNA, 25 bp, Rattus norvegicus
tacccagcaggagtaatttcacgtc

SEQ ID NO: 597453 - DNA, 25 bp, Rattus norvegicus
taaaataggagtcgaggctggatcc

SEQ ID NO: 597454 - DNA, 25 bp, Rattus norvegicus
cgagactagtgcacgacccaaaata

SEQ ID NO: 597455 - DNA, 25 bp, Rattus norvegicus
gattccagcggcgaagattagcggc

SEQ ID NO: 597456 - DNA, 25 bp, Rattus norvegicus
gacagcctctatcaagattccagcg

SEQ ID NO: 597457 - DNA, 25 bp, Rattus norvegicus
cacgatatcctttccttggttggga

SEQ ID NO: 597458 - DNA, 25 bp, Rattus norvegicus
tctgcgctcagagtacatcccatgg

SEQ ID NO: 597459 - DNA, 25 bp, Rattus norvegicus
ggctctctcctctgcgctcagagta

SEQ ID NO: 597460 - DNA, 25 bp, Rattus norvegicus
tcaatcgccttgctccgctcgaggg

SEQ ID NO: 597461 - DNA, 25 bp, Rattus norvegicus
taatttcacgtctttggcggcgctg

SEQ ID NO: 597462 - DNA, 25 bp, Rattus norvegicus
tcaaaggggagaaaatcacgatatc

SEQ ID NO: 597463 - DNA, 25 bp, Rattus norvegicus
gccaccctgagttgggtcaagggaa

SEQ ID NO: 597464 - DNA, 25 bp, Rattus norvegicus
cccgtgacagcacggacgaccaatg

SEQ ID NO: 597465 - DNA, 25 bp, Rattus norvegicus
tggctccttgaaacacaggcggatg

SEQ ID NO: 597466 - DNA, 25 bp, Rattus norvegicus
tgtctgtgtcatgtctgtgcagctg

SEQ ID NO: 597467 - DNA, 25 bp, Rattus norvegicus
gctcagcagctgcagtgactgtgtg

SEQ ID NO: 597468 - DNA, 25 bp, Rattus norvegicus
gataggcgcctcttggaaggtcacg

SEQ ID NO: 597469 - DNA, 25 bp, Rattus norvegicus
gctgctccacgccagaaggactctt

SEQ ID NO: 597470 - DNA, 25 bp, Rattus norvegicus
cggtagctgcttgcagtgaccctcc

SEQ ID NO: 597471 - DNA, 25 bp, Rattus norvegicus
aaggactcttccaagcaccgggagc

SEQ ID NO: 597472 - DNA, 25 bp, Rattus norvegicus
cccttcagggcagggcctgctagca

SEQ ID NO: 597473 - DNA, 25 bp, Rattus norvegicus
aagcacctccctcggctggttggct

SEQ ID NO: 597474 - DNA, 25 bp, Rattus norvegicus
acgaccaatggggagcgccagaaat

SEQ ID NO: 597475 - DNA, 25 bp, Rattus norvegicus
gcgccagaaatgtgcgtctctagtg

SEQ ID NO: 597476 - DNA, 25 bp, Rattus norvegicus
accaacgcggcgagcgagcacagga

SEQ ID NO: 597477 - DNA, 25 bp, Rattus norvegicus
tgagccggggtttccgagtaagcaa

SEQ ID NO: 597478 - DNA, 25 bp, Rattus norvegicus
gcgccctgtcaggtattgttctacg

SEQ ID NO: 597479 - DNA, 25 bp, Rattus norvegicus
gtccacactcgttcgctaaccgagg

SEQ ID NO: 597480 - DNA, 25 bp, Rattus norvegicus
tgcacggtacagcagtccacactcg

SEQ ID NO: 597481 - DNA, 25 bp, Rattus norvegicus
tctccgcgaatctgggctgcacggt

SEQ ID NO: 597482 - DNA, 25 bp, Rattus norvegicus
aggtgcacggtgtctccgcgaatct

SEQ ID NO: 597483 - DNA, 25 bp, Rattus norvegicus
ttccgagtaagcaagccggcgggct

SEQ ID NO: 597484 - DNA, 25 bp, Rattus norvegicus
ctcaaggagcaaaagtacgaccggc

SEQ ID NO: 597485 - DNA, 25 bp, Rattus norvegicus
catggctcagcaagggaagatactc

SEQ ID NO: 597486 - DNA, 25 bp, Rattus norvegicus
tacttacgcggctctgctgatcgtg

SEQ ID NO: 597487 - DNA, 25 bp, Rattus norvegicus
taggtggaggcctacttacgcggct

SEQ ID NO: 597488 - DNA, 25 bp, Rattus norvegicus
aaaggctcttaatgcgcctgcgtga

SEQ ID NO: 597489 - DNA, 25 bp, Rattus norvegicus
ggcttcccagtgacgcctgcgcagt

SEQ ID NO: 597490 - DNA, 25 bp, Rattus norvegicus
ctccgccacgctgtgcgcggttgga

SEQ ID NO: 597491 - DNA, 25 bp, Rattus norvegicus
gcagacctgccgaggttaacaaatc

SEQ ID NO: 597492 - DNA, 25 bp, Rattus norvegicus
gacaccgtcccggaggctcttcagg

SEQ ID NO: 597493 - DNA, 25 bp, Rattus norvegicus
accgcgctcagcaagctattcgatg

SEQ ID NO: 597494 - DNA, 25 bp, Rattus norvegicus
ctgcgcagagctttgttgaactagc

SEQ ID NO: 597495 - DNA, 25 bp, Rattus norvegicus
tagctcaggggccaagccgggaact

SEQ ID NO: 597496 - DNA, 25 bp, Rattus norvegicus
tgaactagcggttgcagcagacctg

SEQ ID NO: 597497 - DNA, 25 bp, Rattus norvegicus
gcttttctctccttctccaagatgg

SEQ ID NO: 597498 - DNA, 25 bp, Rattus norvegicus
gctccctggttgctcgcgcttttct

SEQ ID NO: 597499 - DNA, 25 bp, Rattus norvegicus
ctcgactgaggctccctggttgctc

SEQ ID NO: 597500 - DNA, 25 bp, Rattus norvegicus
agtctgcgctctgggctcgactgag

SEQ ID NO: 597501 - DNA, 25 bp, Rattus norvegicus
tagcaccgcggtaggagtctgcgct

SEQ ID NO: 597502 - DNA, 25 bp, Rattus norvegicus
acgctctttcgctggcgccgtagca

SEQ ID NO: 597503 - DNA, 25 bp, Rattus norvegicus
tattcgatgcgctcgacgctctttc

SEQ ID NO: 597504 - DNA, 25 bp, Rattus norvegicus
gctccctgagctgcgcagagctttg

SEQ ID NO: 597505 - DNA, 25 bp, Rattus norvegicus
gcgcaggcttagagcctctcccggg

SEQ ID NO: 597506 - DNA, 25 bp, Rattus norvegicus
atggggattgatgcttgatgtaacc

SEQ ID NO: 597507 - DNA, 25 bp, Rattus norvegicus
ccatggtcgggagactcgggtttat

SEQ ID NO: 597508 - DNA, 25 bp, Rattus norvegicus
cttgatgtaaccaataggcaggaga

SEQ ID NO: 597509 - DNA, 25 bp, Rattus norvegicus
cgtggcttaggagccagctctccca

SEQ ID NO: 597510 - DNA, 25 bp, Rattus norvegicus
cggttgctgtcacctgattctggga

SEQ ID NO: 597511 - DNA, 25 bp, Rattus norvegicus
tcacattccgagacgccggggtatc

SEQ ID NO: 597512 - DNA, 25 bp, Rattus norvegicus
tgtggctcagccaatgtgtgcgtgc

SEQ ID NO: 597513 - DNA, 25 bp, Rattus norvegicus
cagttctcccgtgggacagcggatc

SEQ ID NO: 597514 - DNA, 25 bp, Rattus norvegicus
tcccacctgattgacaagagcacag

SEQ ID NO: 597515 - DNA, 25 bp, Rattus norvegicus
taccctatgactcccacctgattga

SEQ ID NO: 597516 - DNA, 25 bp, Rattus norvegicus
gagcacaggccaatcggaattctta

SEQ ID NO: 597517 - DNA, 25 bp, Rattus norvegicus
accctgggacctgtcggagtccaca

SEQ ID NO: 597518 - DNA, 25 bp, Rattus norvegicus
agccgcggcaatggactttctcctg

SEQ ID NO: 597519 - DNA, 25 bp, Rattus norvegicus
gcgaaaacagacctcgggaccgtga

SEQ ID NO: 597520 - DNA, 25 bp, Rattus norvegicus
actcagcagaaaaggctcgacttcg

SEQ ID NO: 597521 - DNA, 25 bp, Rattus norvegicus
cgggaccgtgactcagcatcacgca

SEQ ID NO: 597522 - DNA, 25 bp, Rattus norvegicus
cgggaaccatgactcagcgaaaaca

SEQ ID NO: 597523 - DNA, 25 bp, Rattus norvegicus
tcaattccgagcaacgggaaccatg

SEQ ID NO: 597524 - DNA, 25 bp, Rattus norvegicus
cagaaggaacgtgtcaggccagcac

SEQ ID NO: 597525 - DNA, 25 bp, Rattus norvegicus
cccagtccacagaaggaacgtgtca

SEQ ID NO: 597526 - DNA, 25 bp, Rattus norvegicus
gatccgagactgaactctttgtccc

SEQ ID NO: 597527 - DNA, 25 bp, Rattus norvegicus
cctttaggtgcaggatccgagactg

SEQ ID NO: 597528 - DNA, 25 bp, Rattus norvegicus
cgccatagttccctgcctttaggtg

SEQ ID NO: 597529 - DNA, 25 bp, Rattus norvegicus
gtttgcttgctgtcccgccatagtt

SEQ ID NO: 597530 - DNA, 25 bp, Rattus norvegicus
agccagcaaatagctgtttgcttgc

SEQ ID NO: 597531 - DNA, 25 bp, Rattus norvegicus
cgaccgagcagcagccagcaaatag

SEQ ID NO: 597532 - DNA, 25 bp, Rattus norvegicus
cccggaccttgactcagcagaaaag

SEQ ID NO: 597533 - DNA, 25 bp, Rattus norvegicus
tgttgcaacaacagccagaacgccg

SEQ ID NO: 597534 - DNA, 25 bp, Rattus norvegicus
agtttccgcctccaaccagcgagtg

SEQ ID NO: 597535 - DNA, 25 bp, Rattus norvegicus
ggccaccacgtgactcgagtactta

SEQ ID NO: 597536 - DNA, 25 bp, Rattus norvegicus
agcagagccatctcgagcggagccc

SEQ ID NO: 597537 - DNA, 25 bp, Rattus norvegicus
agcggagccagcctgaactagccca

SEQ ID NO: 597538 - DNA, 25 bp, Rattus norvegicus
tgaactagcccagtcccgcgatgga

SEQ ID NO: 597539 - DNA, 25 bp, Rattus norvegicus
atggagcgcccacagctcgacaggc

SEQ ID NO: 597540 - DNA, 25 bp, Rattus norvegicus
ctcgacaggcaagcgactacttggg

SEQ ID NO: 597541 - DNA, 25 bp, Rattus norvegicus
actacttggggacgggaactgtgat

SEQ ID NO: 597542 - DNA, 25 bp, Rattus norvegicus
ggaactgtgatgtcccgcgtccctt

SEQ ID NO: 597543 - DNA, 25 bp, Rattus norvegicus
gcgtcccttgtccagcctagaaatg

SEQ ID NO: 597544 - DNA, 25 bp, Rattus norvegicus
cctagaaatgcaggctgcgggacca

SEQ ID NO: 597545 - DNA, 25 bp, Rattus norvegicus
actcgagtacttaaagggctggcgc

SEQ ID NO: 597546 - DNA, 25 bp, Rattus norvegicus
acagtcgccagtcgcctccagagtt

SEQ ID NO: 597547 - DNA, 25 bp, Rattus norvegicus
agctcagaagtttcgcgccaaaacg

SEQ ID NO: 597548 - DNA, 25 bp, Rattus norvegicus
cttcaagtacaggtgggacagcgtc

SEQ ID NO: 597549 - DNA, 25 bp, Rattus norvegicus
atcgcacgggcttcaccttcaagta

SEQ ID NO: 597550 - DNA, 25 bp, Rattus norvegicus
ggagttcctacgacagtaccgagtg

SEQ ID NO: 597551 - DNA, 25 bp, Rattus norvegicus
acagaagcgcttcaaggagttccta

SEQ ID NO: 597552 - DNA, 25 bp, Rattus norvegicus
aggctcgcaagtcgcacctacagaa

SEQ ID NO: 597553 - DNA, 25 bp, Rattus norvegicus
gggcattttctacagcgacagcttc

SEQ ID NO: 597554 - DNA, 25 bp, Rattus norvegicus
ggcttcgacgatccgggcattttct

SEQ ID NO: 597555 - DNA, 25 bp, Rattus norvegicus
cccaggtacagtcatgtcgggcttc

SEQ ID NO: 597556 - DNA, 25 bp, Rattus norvegicus
gcgcagagcggtccaatagctgtcc

SEQ ID NO: 597557 - DNA, 25 bp, Rattus norvegicus
atcatcttgggaatccggccttgga

SEQ ID NO: 597558 - DNA, 25 bp, Rattus norvegicus
gtcccgcctcataaaatggagaccg

SEQ ID NO: 597559 - DNA, 25 bp, Rattus norvegicus
ctttgttcagctagcgccacggtca

SEQ ID NO: 597560 - DNA, 25 bp, Rattus norvegicus
ccggaaagagttggtcagtgacgtc

SEQ ID NO: 597561 - DNA, 25 bp, Rattus norvegicus
atctgtacgcagtgaccctggagcc

SEQ ID NO: 597562 - DNA, 25 bp, Rattus norvegicus
ggtcagcagcccgacttcgggcagc

SEQ ID NO: 597563 - DNA, 25 bp, Rattus norvegicus
tgagtctccagggttcgcttctaca

SEQ ID NO: 597564 - DNA, 25 bp, Rattus norvegicus
gtgcagcatccggagctcgagcttg

SEQ ID NO: 597565 - DNA, 25 bp, Rattus norvegicus
ccgcgcgcaggaggatctgtacgca

SEQ ID NO: 597566 - DNA, 25 bp, Rattus norvegicus
ccgacttcgggcagccaggaaggcc

SEQ ID NO: 597567 - DNA, 25 bp, Rattus norvegicus
gtcctttccgcgagggtcagcagcc

SEQ ID NO: 597568 - DNA, 25 bp, Rattus norvegicus
aggagcaagcggtggtcctttccgc

SEQ ID NO: 597569 - DNA, 25 bp, Rattus norvegicus
acacgcgcgctgagcgcagctagcg

SEQ ID NO: 597570 - DNA, 25 bp, Rattus norvegicus
gggcggcgttcaaggctccttccca

SEQ ID NO: 597571 - DNA, 25 bp, Rattus norvegicus
gacgaagttggagctgctgagcctc

SEQ ID NO: 597572 - DNA, 25 bp, Rattus norvegicus
atcccgggtggactccacgttcgct

SEQ ID NO: 597573 - DNA, 25 bp, Rattus norvegicus
tccggagctcgagcttgggccatcc

SEQ ID NO: 597574 - DNA, 25 bp, Rattus norvegicus
gctggagacacacaccgatcgtcac

SEQ ID NO: 597575 - DNA, 25 bp, Rattus norvegicus
tgcctatggcatggtctcgcccttc

SEQ ID NO: 597576 - DNA, 25 bp, Rattus norvegicus
cgagatgttctacgtgctgttcagc

SEQ ID NO: 597577 - DNA, 25 bp, Rattus norvegicus
tgaaaactgcgcctacttcgaggtg

SEQ ID NO: 597578 - DNA, 25 bp, Rattus norvegicus
gcctacttcgaggtgtcagccaaga

SEQ ID NO: 597579 - DNA, 25 bp, Rattus norvegicus
gtcagccaagaagaacacgaacgta

SEQ ID NO: 597580 - DNA, 25 bp, Rattus norvegicus
cacgaacgtaaacgagatgttctac

SEQ ID NO: 597581 - DNA, 25 bp, Rattus norvegicus
gtgctgttcagcatggccaagctgc

SEQ ID NO: 597582 - DNA, 25 bp, Rattus norvegicus
acgagatgagccctgcactgcacca

SEQ ID NO: 597583 - DNA, 25 bp, Rattus norvegicus
tgcactgcaccacaagatctccgtg

SEQ ID NO: 597584 - DNA, 25 bp, Rattus norvegicus
accacaagatctccgtgcagtacgg

SEQ ID NO: 597585 - DNA, 25 bp, Rattus norvegicus
ctccgtgcagtacggtgacgccttc

SEQ ID NO: 597586 - DNA, 25 bp, Rattus norvegicus
tccggggatgaaaactgcgcctact

SEQ ID NO: 597587 - DNA, 25 bp, Rattus norvegicus
accaaggtcgcaggtgcctatggca

SEQ ID NO: 597588 - DNA, 25 bp, Rattus norvegicus
ttctgcatgcgtcgcaccaaggtcg

SEQ ID NO: 597589 - DNA, 25 bp, Rattus norvegicus
cggagagcgtggtttcagcatcaag

SEQ ID NO: 597590 - DNA, 25 bp, Rattus norvegicus
cttgacatcagagtgggttcccata

SEQ ID NO: 597591 - DNA, 25 bp, Rattus norvegicus
gatcctggcttctcctgtgttgtga

SEQ ID NO: 597592 - DNA, 25 bp, Rattus norvegicus
gggtgcatctgctttccttatcctc

SEQ ID NO: 597593 - DNA, 25 bp, Rattus norvegicus
tctcgctggctgagaacaagtccta

SEQ ID NO: 597594 - DNA, 25 bp, Rattus norvegicus
tgcaggcggaccagagctccaaaaa

SEQ ID NO: 597595 - DNA, 25 bp, Rattus norvegicus
cccgctgaccaagtgaggaaccgaa

SEQ ID NO: 597596 - DNA, 25 bp, Rattus norvegicus
tcagcatcaaggttgcgcgccaccg

SEQ ID NO: 597597 - DNA, 25 bp, Rattus norvegicus
aagctcctggatccttgacatcaga

SEQ ID NO: 597598 - DNA, 25 bp, Rattus norvegicus
attcttcagcagcaccagacgccgg

SEQ ID NO: 597599 - DNA, 25 bp, Rattus norvegicus
ggaggaatccgtagcagagatctga

SEQ ID NO: 597600 - DNA, 25 bp, Rattus norvegicus
tggagcagggattgctgcacccagc

SEQ ID NO: 597601 - DNA, 25 bp, Rattus norvegicus
tcccataccaggatggtgaggcatt

SEQ ID NO: 597602 - DNA, 25 bp, Rattus norvegicus
gccagacacctaggtcggccttgtt

SEQ ID NO: 597603 - DNA, 25 bp, Rattus norvegicus
tcgcagacaggacggagcagaaact

SEQ ID NO: 597604 - DNA, 25 bp, Rattus norvegicus
agcttcctgctttcacacgtgggga

SEQ ID NO: 597605 - DNA, 25 bp, Rattus norvegicus
cggagcgactcagcgataggctgta

SEQ ID NO: 597606 - DNA, 25 bp, Rattus norvegicus
gttcttagaacgctcagacctctcg

SEQ ID NO: 597607 - DNA, 25 bp, Rattus norvegicus
tcgcggcccacggtggttcttagaa

SEQ ID NO: 597608 - DNA, 25 bp, Rattus norvegicus
ttaacttgcggaggtcgcggcccac

SEQ ID NO: 597609 - DNA, 25 bp, Rattus norvegicus
acaggggcgtaatcacaagtggctc

SEQ ID NO: 597610 - DNA, 25 bp, Rattus norvegicus
gcgtctaaacgccagcctggttgct

SEQ ID NO: 597611 - DNA, 25 bp, Rattus norvegicus
cggtcagaggaggaacgccctgcat

SEQ ID NO: 597612 - DNA, 25 bp, Rattus norvegicus
cgccctgcatagttaaaaggagtca

SEQ ID NO: 597613 - DNA, 25 bp, Rattus norvegicus
tcagagctgcaagcccgtaacggca

SEQ ID NO: 597614 - DNA, 25 bp, Rattus norvegicus
tgggcagggcctatctaggtcccgc

SEQ ID NO: 597615 - DNA, 25 bp, Rattus norvegicus
caagcctggagtcctccggagcgac

SEQ ID NO: 597616 - DNA, 25 bp, Rattus norvegicus
gagcagaaactctcccgcggggctc

SEQ ID NO: 597617 - DNA, 25 bp, Rattus norvegicus
cttgggcagcaagtactggagtgcc

SEQ ID NO: 597618 - DNA, 25 bp, Rattus norvegicus
ggcgtccgtgcactccatgatcaca

SEQ ID NO: 597619 - DNA, 25 bp, Rattus norvegicus
gcccacggaggatgcaaccggagca

SEQ ID NO: 597620 - DNA, 25 bp, Rattus norvegicus
cggcacgcgtgctatgtaacaagga

SEQ ID NO: 597621 - DNA, 25 bp, Rattus norvegicus
tgatcacacgcaaggtcaccatcgc

SEQ ID NO: 597622 - DNA, 25 bp, Rattus norvegicus
ttcctgctaatggtgcgtgatggcc

SEQ ID NO: 597623 - DNA, 25 bp, Rattus norvegicus
acactcaagtcgtccgtctacctgg

SEQ ID NO: 597624 - DNA, 25 bp, Rattus norvegicus
tcatcctggaggtgatcgccaagca

SEQ ID NO: 597625 - DNA, 25 bp, Rattus norvegicus
ggccatgcaggccttcatcctggag

SEQ ID NO: 597626 - DNA, 25 bp, Rattus norvegicus
cctcatgcgcgccatgttggacgcg

SEQ ID NO: 597627 - DNA, 25 bp, Rattus norvegicus
agaccatgccgctcatctttgtggg

SEQ ID NO: 597628 - DNA, 25 bp, Rattus norvegicus
ggagtaccgttacggcaagaccatg

SEQ ID NO: 597629 - DNA, 25 bp, Rattus norvegicus
gcgccgaccacgtggagtaccgtta

SEQ ID NO: 597630 - DNA, 25 bp, Rattus norvegicus
ctggaccaagtcaggccgcgagaag

SEQ ID NO: 597631 - DNA, 25 bp, Rattus norvegicus
gcgtcctgacgctgacactaaataa

SEQ ID NO: 597632 - DNA, 25 bp, Rattus norvegicus
cccgtgacgctggttcaggcactat

SEQ ID NO: 597633 - DNA, 25 bp, Rattus norvegicus
tcgccgattacaacgcgaggacctc

SEQ ID NO: 597634 - DNA, 25 bp, Rattus norvegicus
cggcagccaagctcttcctctgggg

SEQ ID NO: 597635 - DNA, 25 bp, Rattus norvegicus
tagcctttccttctcgcgacatggg

SEQ ID NO: 597636 - DNA, 25 bp, Rattus norvegicus
ggtcctgaggacattttaatcactc

SEQ ID NO: 597637 - DNA, 25 bp, Rattus norvegicus
gcggtggcttccttgggataacacc

SEQ ID NO: 597638 - DNA, 25 bp, Rattus norvegicus
atttccgccagcgagtgacgcactt

SEQ ID NO: 597639 - DNA, 25 bp, Rattus norvegicus
ggtcacatccgggtttcggctagcg

SEQ ID NO: 597640 - DNA, 25 bp, Rattus norvegicus
ttagcgttaagtcgctgccggggca

SEQ ID NO: 597641 - DNA, 25 bp, Rattus norvegicus
agcgaggccttccagtactcagaca

SEQ ID NO: 597642 - DNA, 25 bp, Rattus norvegicus
actcggcctcagttccgatgggaac

SEQ ID NO: 597643 - DNA, 25 bp, Rattus norvegicus
tgcttgcagagggaccagacatcca

SEQ ID NO: 597644 - DNA, 25 bp, Rattus norvegicus
gggataacaccttctccgcctttga

SEQ ID NO: 597645 - DNA, 25 bp, Rattus norvegicus
cgagcagtctaaggcggtcccgctc

SEQ ID NO: 597646 - DNA, 25 bp, Rattus norvegicus
cgacctgaccagtgaagaggaggaa

SEQ ID NO: 597647 - DNA, 25 bp, Rattus norvegicus
ggcgatcccgtgacccgcaggtgca

SEQ ID NO: 597648 - DNA, 25 bp, Rattus norvegicus
tgcacgcggacatagctggcccgtc

SEQ ID NO: 597649 - DNA, 25 bp, Rattus norvegicus
gggacgcgctggataacgaagcttc

SEQ ID NO: 597650 - DNA, 25 bp, Rattus norvegicus
ggataacgaagcttctgcggcgttg

SEQ ID NO: 597651 - DNA, 25 bp, Rattus norvegicus
ccctctttgtggctgcagttggcaa

SEQ ID NO: 597652 - DNA, 25 bp, Rattus norvegicus
acgtccctagttgcggcgatcccgt

SEQ ID NO: 597653 - DNA, 25 bp, Rattus norvegicus
tatagagtctcaaatggtgcggcca

SEQ ID NO: 597654 - DNA, 25 bp, Rattus norvegicus
gctctgaccactcttgtcattgtcg

SEQ ID NO: 597655 - DNA, 25 bp, Rattus norvegicus
tcattgtcgctgcaggtcttcgatc

SEQ ID NO: 597656 - DNA, 25 bp, Rattus norvegicus
tcgatcttgagcgaagtgtccaccc

SEQ ID NO: 597657 - DNA, 25 bp, Rattus norvegicus
tgcctgaccgagcaacgtccctagt

SEQ ID NO: 597658 - DNA, 25 bp, Rattus norvegicus
cagagtctatggtgaggagcgtata

SEQ ID NO: 597659 - DNA, 25 bp, Rattus norvegicus
ttgctcacgaggagcgggtcatctc

SEQ ID NO: 597660 - DNA, 25 bp, Rattus norvegicus
atctccaacctcagcaaggtgctgg

SEQ ID NO: 597661 - DNA, 25 bp, Rattus norvegicus
actacgaggaataccgcctggcgga

SEQ ID NO: 597662 - DNA, 25 bp, Rattus norvegicus
tctttgagacactgcaggacaagta

SEQ ID NO: 597663 - DNA, 25 bp, Rattus norvegicus
tgagtgtgcccgcatctttgagaca

SEQ ID NO: 597664 - DNA, 25 bp, Rattus norvegicus
aggaatgtgagcaccgcatgcagcc

SEQ ID NO: 597665 - DNA, 25 bp, Rattus norvegicus
agcctgtcgcacgagctcgagaaga

SEQ ID NO: 597666 - DNA, 25 bp, Rattus norvegicus
atcatccagagcgaccggcagctgc

SEQ ID NO: 597667 - DNA, 25 bp, Rattus norvegicus
agcgtacggagcaggagatcatcca

SEQ ID NO: 597668 - DNA, 25 bp, Rattus norvegicus
tgcagctgctcattgagcgtacgga

SEQ ID NO: 597669 - DNA, 25 bp, Rattus norvegicus
ctgcctgagctggagcataacctgc

SEQ ID NO: 597670 - DNA, 25 bp, Rattus norvegicus
tgcctcccacagctggcaaggaagc

SEQ ID NO: 597671 - DNA, 25 bp, Rattus norvegicus
ctgacccgctcacgctggatgagtg

SEQ ID NO: 597672 - DNA, 25 bp, Rattus norvegicus
aagacagccgaggtgcttgctcacg

SEQ ID NO: 597673 - DNA, 25 bp, Rattus norvegicus
ggccactgcactccaccgttcggaa

SEQ ID NO: 597674 - DNA, 25 bp, Rattus norvegicus
aggctcgcgtcacaccgtacgtcat

SEQ ID NO: 597675 - DNA, 25 bp, Rattus norvegicus
accacactcactcggcctccagcag

SEQ ID NO: 597676 - DNA, 25 bp, Rattus norvegicus
cgcagcaccgcctcgctgtccgcct

SEQ ID NO: 597677 - DNA, 25 bp, Rattus norvegicus
gaccgccgccatgtcactgacgtca

SEQ ID NO: 597678 - DNA, 25 bp, Rattus norvegicus
aagccgccgacatcacaggctcgcg

SEQ ID NO: 597679 - DNA, 25 bp, Rattus norvegicus
cagggtcccggctcctgaccaccga

SEQ ID NO: 597680 - DNA, 25 bp, Rattus norvegicus
gtcacaccgtacgtcatcgccaagc

SEQ ID NO: 597681 - DNA, 25 bp, Rattus norvegicus
gtccgcgcgtgattgcctggctgta

SEQ ID NO: 597682 - DNA, 25 bp, Rattus norvegicus
tgcctggctgtaggacgcaggtatt

SEQ ID NO: 597683 - DNA, 25 bp, Rattus norvegicus
attgggtgctgtcccgcggcccgta

SEQ ID NO: 597684 - DNA, 25 bp, Rattus norvegicus
agcccgggctctcggagggcttaag

SEQ ID NO: 597685 - DNA, 25 bp, Rattus norvegicus
cttaagggcgtgagacccgggcgat

SEQ ID NO: 597686 - DNA, 25 bp, Rattus norvegicus
caccgttcggaagccgccacgaccg

SEQ ID NO: 597687 - DNA, 25 bp, Rattus norvegicus
cccgtgtgctctgccaggtttttct

SEQ ID NO: 597688 - DNA, 25 bp, Rattus norvegicus
ccgtcctcctgagtcacggagaaga

SEQ ID NO: 597689 - DNA, 25 bp, Rattus norvegicus
agaagagtctgagggtcacgcgccc

SEQ ID NO: 597690 - DNA, 25 bp, Rattus norvegicus
tcacgcgcccatcgagtggtacatc

SEQ ID NO: 597691 - DNA, 25 bp, Rattus norvegicus
cccggcgcatccaatgcgggatgga

SEQ ID NO: 597692 - DNA, 25 bp, Rattus norvegicus
gtggtacatcccacaccaccgtgga

SEQ ID NO: 597693 - DNA, 25 bp, Rattus norvegicus
tggacgcacaaagctggaagaggac

SEQ ID NO: 597694 - DNA, 25 bp, Rattus norvegicus
ctctgcggcactctggagcctgcag

SEQ ID NO: 597695 - DNA, 25 bp, Rattus norvegicus
ccgctgcctagtgcagacatagcca

SEQ ID NO: 597696 - DNA, 25 bp, Rattus norvegicus
tcctggcgacgctggaagcttctga

SEQ ID NO: 597697 - DNA, 25 bp, Rattus norvegicus
gtagctttacaacccactgcggttc

SEQ ID NO: 597698 - DNA, 25 bp, Rattus norvegicus
gcgagtggttgtacctgtagcttta

SEQ ID NO: 597699 - DNA, 25 bp, Rattus norvegicus
caggtttttctgctcgccagagcga

SEQ ID NO: 597700 - DNA, 25 bp, Rattus norvegicus
acaccaccgtggatgcccgtgtgct

SEQ ID NO: 597701 - DNA, 25 bp, Rattus norvegicus
agcagagagatcctgtcgggtcccg

SEQ ID NO: 597702 - DNA, 25 bp, Rattus norvegicus
atcaaggcagaaggatcgggcagcc

SEQ ID NO: 597703 - DNA, 25 bp, Rattus norvegicus
acagagagatccgtgtggccggtcc

SEQ ID NO: 597704 - DNA, 25 bp, Rattus norvegicus
tcattgtagctacggagccggggtc

SEQ ID NO: 597705 - DNA, 25 bp, Rattus norvegicus
ggcggtgccacagtcattgtagcta

SEQ ID NO: 597706 - DNA, 25 bp, Rattus norvegicus
caaggcgaccaggagcagagagatc

SEQ ID NO: 597707 - DNA, 25 bp, Rattus norvegicus
tcgggtcagccgcaacaactttacc

SEQ ID NO: 597708 - DNA, 25 bp, Rattus norvegicus
cgagtgttcccggaccagccgagac

SEQ ID NO: 597709 - DNA, 25 bp, Rattus norvegicus
tgcccagcccggattccggaaggtc

SEQ ID NO: 597710 - DNA, 25 bp, Rattus norvegicus
agatctggaccgaaggctctgagca

SEQ ID NO: 597711 - DNA, 25 bp, Rattus norvegicus
acccaaggcgggagtccttcagatg

SEQ ID NO: 597712 - DNA, 25 bp, Rattus norvegicus
accgaaggctctgagcagccggacc

SEQ ID NO: 597713 - DNA, 25 bp, Rattus norvegicus
ctctccggcagggacgaggtgccca

SEQ ID NO: 597714 - DNA, 25 bp, Rattus norvegicus
cagccggaatcaggcagtgcggtcc

SEQ ID NO: 597715 - DNA, 25 bp, Rattus norvegicus
acctcagctcgcgagccgtgcttga

SEQ ID NO: 597716 - DNA, 25 bp, Rattus norvegicus
tggcgcaggtcatgtttttaattac

SEQ ID NO: 597717 - DNA, 25 bp, Rattus norvegicus
gatttaatggcgcaggtcatgtttt

SEQ ID NO: 597718 - DNA, 25 bp, Rattus norvegicus
gggagcgtgcggcattaaaaaaatg

SEQ ID NO: 597719 - DNA, 25 bp, Rattus norvegicus
agggtcctcttctcaggaacaccct

SEQ ID NO: 597720 - DNA, 25 bp, Rattus norvegicus
gtcaaatgggtttgccagagggtcc

SEQ ID NO: 597721 - DNA, 25 bp, Rattus norvegicus
ccagagttttcgagtcaaatgggtt

SEQ ID NO: 597722 - DNA, 25 bp, Rattus norvegicus
gtcgccagagttttcgagtcaaatg

SEQ ID NO: 597723 - DNA, 25 bp, Rattus norvegicus
cctgtgcgtcgccagagttttcgag

SEQ ID NO: 597724 - DNA, 25 bp, Rattus norvegicus
ttttaattacctcagctcgcgagcc

SEQ ID NO: 597725 - DNA, 25 bp, Rattus norvegicus
cggcactcccgggttgcctgtgcgt

SEQ ID NO: 597726 - DNA, 25 bp, Rattus norvegicus
tattggagaagccacccacggcact

SEQ ID NO: 597727 - DNA, 25 bp, Rattus norvegicus
tgagtggttattggagaagccaccc

SEQ ID NO: 597728 - DNA, 25 bp, Rattus norvegicus
ccgtgcttgagcttgagtggttatt

SEQ ID NO: 597729 - DNA, 25 bp, Rattus norvegicus
ctcacgatgtgcctcggagccggtc

SEQ ID NO: 597730 - DNA, 25 bp, Rattus norvegicus
gcctgttagcgctaatgcagactga

SEQ ID NO: 597731 - DNA, 25 bp, Rattus norvegicus
tctggagcctgttagcgctaatgca

SEQ ID NO: 597732 - DNA, 25 bp, Rattus norvegicus
agcccgctcggtctggagcctgtta

SEQ ID NO: 597733 - DNA, 25 bp, Rattus norvegicus
ggtaacgcgcctattgcattagccc

SEQ ID NO: 597734 - DNA, 25 bp, Rattus norvegicus
caggtaacgcgcctattgcattagc

SEQ ID NO: 597735 - DNA, 25 bp, Rattus norvegicus
cgacctggtaatgtagcctgtgccc

SEQ ID NO: 597736 - DNA, 25 bp, Rattus norvegicus
aggaggccgacctggtaatgtagcc

SEQ ID NO: 597737 - DNA, 25 bp, Rattus norvegicus
acagcacggggatcccgggctccag

SEQ ID NO: 597738 - DNA, 25 bp, Rattus norvegicus
agcgcactcacgtggcggacagcac

SEQ ID NO: 597739 - DNA, 25 bp, Rattus norvegicus
gcgcacagagcgcactcacgtggcg

SEQ ID NO: 597740 - DNA, 25 bp, Rattus norvegicus
cacacttaccggtcccgcgcgcaca

SEQ ID NO: 597741 - DNA, 25 bp, Rattus norvegicus
tcggagccggtctgcacacttaccg

SEQ ID NO: 597742 - DNA, 25 bp, Rattus norvegicus
taatgcagactgacagcgtggccgg

SEQ ID NO: 597743 - DNA, 25 bp, Rattus norvegicus
aatcgcagccaaggggcgcagcagc

SEQ ID NO: 597744 - DNA, 25 bp, Rattus norvegicus
cggagacgctgtccaatcgcagcca

SEQ ID NO: 597745 - DNA, 25 bp, Rattus norvegicus
cgaggcggccattggtccttacaca

SEQ ID NO: 597746 - DNA, 25 bp, Rattus norvegicus
tggtccttacacacggccgggagca

SEQ ID NO: 597747 - DNA, 25 bp, Rattus norvegicus
tcggctgagcgcgactatatagcgg

SEQ ID NO: 597748 - DNA, 25 bp, Rattus norvegicus
tcagccgcacaggtacatgggcccg

SEQ ID NO: 597749 - DNA, 25 bp, Rattus norvegicus
cgcgccgactttccaggatgatgta

SEQ ID NO: 597750 - DNA, 25 bp, Rattus norvegicus
ttccaggatgatgtagctgggcctg

SEQ ID NO: 597751 - DNA, 25 bp, Rattus norvegicus
tagctgggcctggaccctaaggaag

SEQ ID NO: 597752 - DNA, 25 bp, Rattus norvegicus
gaccctaaggaagccttcggatatg

SEQ ID NO: 597753 - DNA, 25 bp, Rattus norvegicus
gagcccaagctgagagcgtgatcgc

SEQ ID NO: 597754 - DNA, 25 bp, Rattus norvegicus
ctgagagcgtgatcgcgcctcccag

SEQ ID NO: 597755 - DNA, 25 bp, Rattus norvegicus
ggcccttggacggagacgctgtcca

SEQ ID NO: 597756 - DNA, 25 bp, Rattus norvegicus
gcatgttcggctgagcgcgactata

SEQ ID NO: 597757 - DNA, 25 bp, Rattus norvegicus
attccggtgcccgacccgagcaaag

SEQ ID NO: 597758 - DNA, 25 bp, Rattus norvegicus
tcgaaaactagagacgcccagccgc

SEQ ID NO: 597759 - DNA, 25 bp, Rattus norvegicus
gccgcactgatcctcgtctgctgga

SEQ ID NO: 597760 - DNA, 25 bp, Rattus norvegicus
ctgatcctcgtctgctggacgaagg

SEQ ID NO: 597761 - DNA, 25 bp, Rattus norvegicus
aagaaggacgcctggcgaggtacca

SEQ ID NO: 597762 - DNA, 25 bp, Rattus norvegicus
cccggcaccgtagccgccacagcgg

SEQ ID NO: 597763 - DNA, 25 bp, Rattus norvegicus
ccgcctcggcgcatcggttcatgat

SEQ ID NO: 597764 - DNA, 25 bp, Rattus norvegicus
cggcgcatcggttcatgatggattc

SEQ ID NO: 597765 - DNA, 25 bp, Rattus norvegicus
tcatgatggattccggtgcccgacc

SEQ ID NO: 597766 - DNA, 25 bp, Rattus norvegicus
tgcccgacccgagcaaagcgaagga

SEQ ID NO: 597767 - DNA, 25 bp, Rattus norvegicus
gacccgaagtgagcggtcgaataca

SEQ ID NO: 597768 - DNA, 25 bp, Rattus norvegicus
cggtcgaatacagaagaagagctcc

SEQ ID NO: 597769 - DNA, 25 bp, Rattus norvegicus
ccgagcaaagcgaaggacccgaagt

SEQ ID NO: 597770 - DNA, 25 bp, Rattus norvegicus
gaagagctccaagtcgaaaactaga

SEQ ID NO: 597771 - DNA, 25 bp, Rattus norvegicus
ccagcaggcagcacaggacgcagag

SEQ ID NO: 597772 - DNA, 25 bp, Rattus norvegicus
acgggatcccacgtaccagtacgca

SEQ ID NO: 597773 - DNA, 25 bp, Rattus norvegicus
gtctcataacgggatcccacgtacc

SEQ ID NO: 597774 - DNA, 25 bp, Rattus norvegicus
ggctcagggtctcataacgggatcc

SEQ ID NO: 597775 - DNA, 25 bp, Rattus norvegicus
ttctccgggctcagggtctcataac

SEQ ID NO: 597776 - DNA, 25 bp, Rattus norvegicus
aattgcctcagcttctccgggctca

SEQ ID NO: 597777 - DNA, 25 bp, Rattus norvegicus
ctttactcaattgcctcagcttctc

SEQ ID NO: 597778 - DNA, 25 bp, Rattus norvegicus
tccacggcgttctgagaccccttta

SEQ ID NO: 597779 - DNA, 25 bp, Rattus norvegicus
accctgaggtcgctggctgtgccct

SEQ ID NO: 597780 - DNA, 25 bp, Rattus norvegicus
gcgtgtcaccctgaggtcgctggct

SEQ ID NO: 597781 - DNA, 25 bp, Rattus norvegicus
aatcgtgcctccatccttgcgctcc

SEQ ID NO: 597782 - DNA, 25 bp, Rattus norvegicus
cagcacaggacgcagagaacccgca

SEQ ID NO: 597783 - DNA, 25 bp, Rattus norvegicus
gccggggaacttgatgatgggcgac

SEQ ID NO: 597784 - DNA, 25 bp, Rattus norvegicus
agaacccgcagagggccgacgagca

SEQ ID NO: 597785 - DNA, 25 bp, Rattus norvegicus
cgttccagaagacagaggggcccat

SEQ ID NO: 597786 - DNA, 25 bp, Rattus norvegicus
tgtctggtttccttacagggctgca

SEQ ID NO: 597787 - DNA, 25 bp, Rattus norvegicus
aatacgcctccctgcgagctgtgcg

SEQ ID NO: 597788 - DNA, 25 bp, Rattus norvegicus
tacggcctgtgcgttccagaagaca

SEQ ID NO: 597789 - DNA, 25 bp, Rattus norvegicus
tgattctatgacaccagcgcgcggt

SEQ ID NO: 597790 - DNA, 25 bp, Rattus norvegicus
gccgccatacgggtgtccaaagggc

SEQ ID NO: 597791 - DNA, 25 bp, Rattus norvegicus
ccttgctcaggtcggtgattctatg

SEQ ID NO: 597792 - DNA, 25 bp, Rattus norvegicus
tgcaaccggcgagaaacgtcaaaga

SEQ ID NO: 597793 - DNA, 25 bp, Rattus norvegicus
cttgctccgcgaggtttgtgcaacc

SEQ ID NO: 597794 - DNA, 25 bp, Rattus norvegicus
gcactctcggatacactctttcttg

SEQ ID NO: 597795 - DNA, 25 bp, Rattus norvegicus
cgggccaccgaatgtgccaagggca

SEQ ID NO: 597796 - DNA, 25 bp, Rattus norvegicus
tgtgacgtcacggtaatcccgggcc

SEQ ID NO: 597797 - DNA, 25 bp, Rattus norvegicus
ggggcccatggatcggcagaattaa

SEQ ID NO: 597798 - DNA, 25 bp, Rattus norvegicus
ggagctgaccgccagttccttagcc

SEQ ID NO: 597799 - DNA, 25 bp, Rattus norvegicus
gcagcggcgcatcaattattcaccg

SEQ ID NO: 597800 - DNA, 25 bp, Rattus norvegicus
tcagcctagcgcgtttgaaaacttc

SEQ ID NO: 597801 - DNA, 25 bp, Rattus norvegicus
gcgccagataaaacgcggctgcggc

SEQ ID NO: 597802 - DNA, 25 bp, Rattus norvegicus
agcccgcgcgtttgactgcaaagca

SEQ ID NO: 597803 - DNA, 25 bp, Rattus norvegicus
aataataaatcacagcggccggcgg

SEQ ID NO: 597804 - DNA, 25 bp, Rattus norvegicus
cggccgcgcgctggtaaataataaa

SEQ ID NO: 597805 - DNA, 25 bp, Rattus norvegicus
attgtaacagttctgcgagcagcca

SEQ ID NO: 597806 - DNA, 25 bp, Rattus norvegicus
aggccactaacgaggccagattgta

SEQ ID NO: 597807 - DNA, 25 bp, Rattus norvegicus
ggcttcggcgggaaaatcaatcagc

SEQ ID NO: 597808 - DNA, 25 bp, Rattus norvegicus
tttccgcagccgctttgagagcagc

SEQ ID NO: 597809 - DNA, 25 bp, Rattus norvegicus
aacacgggctcttgttgcgggaaga

SEQ ID NO: 597810 - DNA, 25 bp, Rattus norvegicus
cggagcccgagatgccatgaaagcc

SEQ ID NO: 597811 - DNA, 25 bp, Rattus norvegicus
ctgcgcctcgtcaccggcttgaaag

SEQ ID NO: 597812 - DNA, 25 bp, Rattus norvegicus
tccaaggcaggaaaactttgtggtc

SEQ ID NO: 597813 - DNA, 25 bp, Rattus norvegicus
aggtccttaggctgcagtccctgct

SEQ ID NO: 597814 - DNA, 25 bp, Rattus norvegicus
cgcacccggtactctgaggtcctta

SEQ ID NO: 597815 - DNA, 25 bp, Rattus norvegicus
ctctgaggtccttaggctgcagtcc

SEQ ID NO: 597816 - DNA, 25 bp, Rattus norvegicus
tcaaggtcgcccaagtggtaggtgc

SEQ ID NO: 597817 - DNA, 25 bp, Rattus norvegicus
ttggccgcctcaaggtcgcccaagt

SEQ ID NO: 597818 - DNA, 25 bp, Rattus norvegicus
gcagcccgtaccaacccaccaccga

SEQ ID NO: 597819 - DNA, 25 bp, Rattus norvegicus
tcgagcacctccatgatctcgggcg

SEQ ID NO: 597820 - DNA, 25 bp, Rattus norvegicus
ctcggccggagtctgccttctgctg

SEQ ID NO: 597821 - DNA, 25 bp, Rattus norvegicus
agtctgccttctgctgctccgaagc

SEQ ID NO: 597822 - DNA, 25 bp, Rattus norvegicus
cctccctgcttcgtctacgaggttg

SEQ ID NO: 597823 - DNA, 25 bp, Rattus norvegicus
ctgctccgaagcctcaggggtgcct

SEQ ID NO: 597824 - DNA, 25 bp, Rattus norvegicus
tgcttcgtctacgaggttggtgcgc

SEQ ID NO: 597825 - DNA, 25 bp, Rattus norvegicus
cttctttacccgcacccggccgctg

SEQ ID NO: 597826 - DNA, 25 bp, Rattus norvegicus
aggggtgcctggtccctgcacacct

SEQ ID NO: 597827 - DNA, 25 bp, Rattus norvegicus
ctcggagcaaataaaagcagatttc

SEQ ID NO: 597828 - DNA, 25 bp, Rattus norvegicus
tttgcatccatcaggcgggagcgct

SEQ ID NO: 597829 - DNA, 25 bp, Rattus norvegicus
tttacatttgcatccatcaggcggg

SEQ ID NO: 597830 - DNA, 25 bp, Rattus norvegicus
tggcgcaggcctttctgtaacacca

SEQ ID NO: 597831 - DNA, 25 bp, Rattus norvegicus
gtaacaccacggctgcgaagaattg

SEQ ID NO: 597832 - DNA, 25 bp, Rattus norvegicus
tgcgaagaattgcagtgctgagcga

SEQ ID NO: 597833 - DNA, 25 bp, Rattus norvegicus
agtgctgagcgacgcgccgctcctt

SEQ ID NO: 597834 - DNA, 25 bp, Rattus norvegicus
tgcatgcctcggaaaataagttagc

SEQ ID NO: 597835 - DNA, 25 bp, Rattus norvegicus
tagcaaacggggagccgtttatctc

SEQ ID NO: 597836 - DNA, 25 bp, Rattus norvegicus
agccgtttatctcttttatcttggg

SEQ ID NO: 597837 - DNA, 25 bp, Rattus norvegicus
atctcttttatcttggggcctgatc

SEQ ID NO: 597838 - DNA, 25 bp, Rattus norvegicus
ggggcctgatccaattaaataagtg

SEQ ID NO: 597839 - DNA, 25 bp, Rattus norvegicus
gcgtcagaaatcagcgctgccgggc

SEQ ID NO: 597840 - DNA, 25 bp, Rattus norvegicus
gatttcactgggaaagtgacgtctg

SEQ ID NO: 597841 - DNA, 25 bp, Rattus norvegicus
agcgctctgcgaccggcgccgctct

SEQ ID NO: 597842 - DNA, 25 bp, Rattus norvegicus
cgccgctctcgttcccaggcagccc

SEQ ID NO: 597843 - DNA, 25 bp, Rattus norvegicus
aggacagacactcggggcaacaatt

SEQ ID NO: 597844 - DNA, 25 bp, Rattus norvegicus
gggagtatgcgttgaagtacgaaaa

SEQ ID NO: 597845 - DNA, 25 bp, Rattus norvegicus
gaaaagaaaaccacggcggactgca

SEQ ID NO: 597846 - DNA, 25 bp, Rattus norvegicus
accacggcggactgcagacgccagg

SEQ ID NO: 597847 - DNA, 25 bp, Rattus norvegicus
acgccaggctcaggagagatgcacg

SEQ ID NO: 597848 - DNA, 25 bp, Rattus norvegicus
ccgcagacccgggatgccgcgccac

SEQ ID NO: 597849 - DNA, 25 bp, Rattus norvegicus
tgcacgcaaaggacagacactcggg

SEQ ID NO: 597850 - DNA, 25 bp, Rattus norvegicus
tttgcatcgcctagccctgagcctg

SEQ ID NO: 597851 - DNA, 25 bp, Rattus norvegicus
tcggggcaacaattgcccaggcctt

SEQ ID NO: 597852 - DNA, 25 bp, Rattus norvegicus
tgcccaggccttgtgtttgcatcgc

SEQ ID NO: 597853 - DNA, 25 bp, Rattus norvegicus
ttgtgtttgcatcgcctagccctga

SEQ ID NO: 597854 - DNA, 25 bp, Rattus norvegicus
tcaggagagatgcacgcaaaggaca

SEQ ID NO: 597855 - DNA, 25 bp, Rattus norvegicus
ggacacagcttcacctctgattggg

SEQ ID NO: 597856 - DNA, 25 bp, Rattus norvegicus
agtccgcttccctcagagtgctagc

SEQ ID NO: 597857 - DNA, 25 bp, Rattus norvegicus
tttgtgccaccgagagcccaagtct

SEQ ID NO: 597858 - DNA, 25 bp, Rattus norvegicus
tcaggccggagcgtaactatataca

SEQ ID NO: 597859 - DNA, 25 bp, Rattus norvegicus
tctggtccaggacgaagacttctga

SEQ ID NO: 597860 - DNA, 25 bp, Rattus norvegicus
acatcagtgtctcggctctggtcca

SEQ ID NO: 597861 - DNA, 25 bp, Rattus norvegicus
gaggctgcctctccggctaaccatt

SEQ ID NO: 597862 - DNA, 25 bp, Rattus norvegicus
gagggtcttcgtctgcgtattgtca

SEQ ID NO: 597863 - DNA, 25 bp, Rattus norvegicus
tctgattgggcgtcggtatccatta

SEQ ID NO: 597864 - DNA, 25 bp, Rattus norvegicus
cagtttgattagctagggccgtgcc

SEQ ID NO: 597865 - DNA, 25 bp, Rattus norvegicus
gcaatgattctctctggcccgcaaa

SEQ ID NO: 597866 - DNA, 25 bp, Rattus norvegicus
gccgccgcaaattacagacgcactg

SEQ ID NO: 597867 - DNA, 25 bp, Rattus norvegicus
acggccgcagagtgcacacaccaaa

SEQ ID NO: 597868 - DNA, 25 bp, Rattus norvegicus
acctctggatgacgtagtccgcttc

SEQ ID NO: 597869 - DNA, 25 bp, Rattus norvegicus
gcacgattcaacaccgtctggttta

SEQ ID NO: 597870 - DNA, 25 bp, Rattus norvegicus
cagggtagtgaggacccgcatcctc

SEQ ID NO: 597871 - DNA, 25 bp, Rattus norvegicus
ccacagtttgggcttggctagcacg

SEQ ID NO: 597872 - DNA, 25 bp, Rattus norvegicus
tctctgccagagaccacagtttggg

SEQ ID NO: 597873 - DNA, 25 bp, Rattus norvegicus
tgcctccaagggtttgcccgcctat

SEQ ID NO: 597874 - DNA, 25 bp, Rattus norvegicus
agccatagttcgtgtagcccggata

SEQ ID NO: 597875 - DNA, 25 bp, Rattus norvegicus
ccattgaaatgagagccaggacccg

SEQ ID NO: 597876 - DNA, 25 bp, Rattus norvegicus
ttaaaatccgagtcgctgaggctgc

SEQ ID NO: 597877 - DNA, 25 bp, Rattus norvegicus
gtctttagccaaaacgtccgcacga

SEQ ID NO: 597878 - DNA, 25 bp, Rattus norvegicus
ccttgtccgaggatgtggctatctc

SEQ ID NO: 597879 - DNA, 25 bp, Rattus norvegicus
tgccttcagtttccttgccggcggg

SEQ ID NO: 597880 - DNA, 25 bp, Rattus norvegicus
ccgtgaagatgtccgaaggagccat

SEQ ID NO: 597881 - DNA, 25 bp, Rattus norvegicus
tcctgtgggcaaaacccaggctgtc

SEQ ID NO: 597882 - DNA, 25 bp, Rattus norvegicus
ggctcgtcctcgtcgttcttttcca

SEQ ID NO: 597883 - DNA, 25 bp, Rattus norvegicus
gcccgaagaagagcggccgagctca

SEQ ID NO: 597884 - DNA, 25 bp, Rattus norvegicus
agaaatttgcggtctgtcccagagc

SEQ ID NO: 597885 - DNA, 25 bp, Rattus norvegicus
agctctggggcaaatgttgttcttc

SEQ ID NO: 597886 - DNA, 25 bp, Rattus norvegicus
ggcgatcccagcaagacgcggcttt

SEQ ID NO: 597887 - DNA, 25 bp, Rattus norvegicus
acgcggctttcgctagagtgattcc

SEQ ID NO: 597888 - DNA, 25 bp, Rattus norvegicus
cccgcggctcgagtaaagccgaaca

SEQ ID NO: 597889 - DNA, 25 bp, Rattus norvegicus
gccgaacaagacaatcgctcaagtt

SEQ ID NO: 597890 - DNA, 25 bp, Rattus norvegicus
ttgaggattctgacgccttgtgcgc

SEQ ID NO: 597891 - DNA, 25 bp, Rattus norvegicus
cactcaccacgtacgagaaggcggc

SEQ ID NO: 597892 - DNA, 25 bp, Rattus norvegicus
cccgaaatgacgctggtgctgtatg

SEQ ID NO: 597893 - DNA, 25 bp, Rattus norvegicus
cggacggctggtacaagtagccctg

SEQ ID NO: 597894 - DNA, 25 bp, Rattus norvegicus
taggacatggccacacacgggcatg

SEQ ID NO: 597895 - DNA, 25 bp, Rattus norvegicus
aaggtcctgccaagatgctaagttg

SEQ ID NO: 597896 - DNA, 25 bp, Rattus norvegicus
cgctcaagtttgcaagggccgcaaa

SEQ ID NO: 597897 - DNA, 25 bp, Rattus norvegicus
atccgcaaaggccagccgaggtcag

SEQ ID NO: 597898 - DNA, 25 bp, Rattus norvegicus
ctggcagagtggaaaacgacggaaa

SEQ ID NO: 597899 - DNA, 25 bp, Rattus norvegicus
cggcctcttcgtcggctggcagagt

SEQ ID NO: 597900 - DNA, 25 bp, Rattus norvegicus
ctgttcaggccggaggttggaaagt

SEQ ID NO: 597901 - DNA, 25 bp, Rattus norvegicus
acgacggaaagacagccagggcgca

SEQ ID NO: 597902 - DNA, 25 bp, Rattus norvegicus
acagccagggcgcagctgaagatcc

SEQ ID NO: 597903 - DNA, 25 bp, Rattus norvegicus
gcgcagctgaagatccgtaagcatc

SEQ ID NO: 597904 - DNA, 25 bp, Rattus norvegicus
gctgaagatccgtaagcatccgcaa

SEQ ID NO: 597905 - DNA, 25 bp, Rattus norvegicus
gtaagcatccgcaaaggccagccga

SEQ ID NO: 597906 - DNA, 25 bp, Rattus norvegicus
cagccgaggtcaggagcacagctga

SEQ ID NO: 597907 - DNA, 25 bp, Rattus norvegicus
cacagctgaggaggtcgtgtggttc

SEQ ID NO: 597908 - DNA, 25 bp, Rattus norvegicus
tgtggttcgtggagaagaatgttcc

SEQ ID NO: 597909 - DNA, 25 bp, Rattus norvegicus
cgtggagaagaatgttccggtgacc

SEQ ID NO: 597910 - DNA, 25 bp, Rattus norvegicus
gatccgtaagcatccgcaaaggcca

SEQ ID NO: 597911 - DNA, 25 bp, Rattus norvegicus
tctcgtgctccttctggggccggag

SEQ ID NO: 597912 - DNA, 25 bp, Rattus norvegicus
caaatccggtttggggcccacgctg

SEQ ID NO: 597913 - DNA, 25 bp, Rattus norvegicus
tgctgccgcagcctttctgaccggc

SEQ ID NO: 597914 - DNA, 25 bp, Rattus norvegicus
gaccggcggctctcaactccgagaa

SEQ ID NO: 597915 - DNA, 25 bp, Rattus norvegicus
tctcaactccgagaaagaagtttgc

SEQ ID NO: 597916 - DNA, 25 bp, Rattus norvegicus
caaagtttcccgtagcgcctctgga

SEQ ID NO: 597917 - DNA, 25 bp, Rattus norvegicus
tagcgcctctggaccagggacagcc

SEQ ID NO: 597918 - DNA, 25 bp, Rattus norvegicus
gcctccaaggccctgatggcttaca

SEQ ID NO: 597919 - DNA, 25 bp, Rattus norvegicus
cctgatggcttacagggctcaacca

SEQ ID NO: 597920 - DNA, 25 bp, Rattus norvegicus
ggcttacagggctcaaccagcgttg

SEQ ID NO: 597921 - DNA, 25 bp, Rattus norvegicus
gagggccagtttcgaggtgtacaaa

SEQ ID NO: 597922 - DNA, 25 bp, Rattus norvegicus
aaccagcgttgcacggcagacgagc

SEQ ID NO: 597923 - DNA, 25 bp, Rattus norvegicus
gcacgctggggagtctcgtgctcct

SEQ ID NO: 597924 - DNA, 25 bp, Rattus norvegicus
cagtttcgaggtgtacaaatccggt

SEQ ID NO: 597925 - DNA, 25 bp, Rattus norvegicus
aacgaggcgcctcacagtcgagaca

SEQ ID NO: 597926 - DNA, 25 bp, Rattus norvegicus
cccttaggcctgcaagaccatctaa

SEQ ID NO: 597927 - DNA, 25 bp, Rattus norvegicus
gtcgagacacacataagcccaaagc

SEQ ID NO: 597928 - DNA, 25 bp, Rattus norvegicus
acataagcccaaagcacacgcgttc

SEQ ID NO: 597929 - DNA, 25 bp, Rattus norvegicus
agaccatctaacatagccggaagtg

SEQ ID NO: 597930 - DNA, 25 bp, Rattus norvegicus
acggctgactagctgagagcccggc

SEQ ID NO: 597931 - DNA, 25 bp, Rattus norvegicus
cagcctgtccgtgcggcgaggaacc

SEQ ID NO: 597932 - DNA, 25 bp, Rattus norvegicus
gctcgccgatccgacagtcacggaa

SEQ ID NO: 597933 - DNA, 25 bp, Rattus norvegicus
ccgacagtcacggaagtattcctga

SEQ ID NO: 597934 - DNA, 25 bp, Rattus norvegicus
agtattcctgacctcctctcggagg

SEQ ID NO: 597935 - DNA, 25 bp, Rattus norvegicus
cgggtttgccttcaaggagtgcttc

SEQ ID NO: 597936 - DNA, 25 bp, Rattus norvegicus
gtgcttccgggtcaagtatctcctg

SEQ ID NO: 597937 - DNA, 25 bp, Rattus norvegicus
ctgaggtaaacaagctctcgagccc

SEQ ID NO: 597938 - DNA, 25 bp, Rattus norvegicus
tcaagtatctcctgggacggaaggc

SEQ ID NO: 597939 - DNA, 25 bp, Rattus norvegicus
tgcccatcttcccacagctggtaag

SEQ ID NO: 597940 - DNA, 25 bp, Rattus norvegicus
cagctggtaagatccggagaaaccc

SEQ ID NO: 597941 - DNA, 25 bp, Rattus norvegicus
tttccatgtgcgcacagggcgctca

SEQ ID NO: 597942 - DNA, 25 bp, Rattus norvegicus
tccaatgtgctttcgtccgtgtacg

SEQ ID NO: 597943 - DNA, 25 bp, Rattus norvegicus
ccgaaagcttggaggagcgaccact

SEQ ID NO: 597944 - DNA, 25 bp, Rattus norvegicus
ctcagtatgagctgaaggacagccc

SEQ ID NO: 597945 - DNA, 25 bp, Rattus norvegicus
aaggacagccctggggtccagcatc

SEQ ID NO: 597946 - DNA, 25 bp, Rattus norvegicus
aacgccacccgggaaagcacaagca

SEQ ID NO: 597947 - DNA, 25 bp, Rattus norvegicus
acaagcacgcttaaggcctggctca

SEQ ID NO: 597948 - DNA, 25 bp, Rattus norvegicus
tggaaaacttagacagcgcggcagc

SEQ ID NO: 597949 - DNA, 25 bp, Rattus norvegicus
acggcgcataggaacggagacttcg

SEQ ID NO: 597950 - DNA, 25 bp, Rattus norvegicus
ggcctaggacccatttcagactgca

SEQ ID NO: 597951 - DNA, 25 bp, Rattus norvegicus
actgcaaaaatagcgactcggacga

SEQ ID NO: 597952 - DNA, 25 bp, Rattus norvegicus
ctcggggtccctatccaatgtgctt

SEQ ID NO: 597953 - DNA, 25 bp, Rattus norvegicus
ggcgcaccacttaagtttcgcagca

SEQ ID NO: 597954 - DNA, 25 bp, Rattus norvegicus
cctctacaggacgaaggagtcggtc

SEQ ID NO: 597955 - DNA, 25 bp, Rattus norvegicus
atgagctttataccctgagtgcctg

SEQ ID NO: 597956 - DNA, 25 bp, Rattus norvegicus
tgggactggagctccctctacagga

SEQ ID NO: 597957 - DNA, 25 bp, Rattus norvegicus
cacgactgtggagaaacctgggact

SEQ ID NO: 597958 - DNA, 25 bp, Rattus norvegicus
ggaacctttggagctaggattgtgt

SEQ ID NO: 597959 - DNA, 25 bp, Rattus norvegicus
tgctttcagagatcacgcgtgggtt

SEQ ID NO: 597960 - DNA, 25 bp, Rattus norvegicus
tgctgggaatccaaggccgaagcca

SEQ ID NO: 597961 - DNA, 25 bp, Rattus norvegicus
tgagaagccggggtgttcacgtttc

SEQ ID NO: 597962 - DNA, 25 bp, Rattus norvegicus
tctccttataggtgcaaagggcgtg

SEQ ID NO: 597963 - DNA, 25 bp, Rattus norvegicus
ttagaggcctttctcaccgcgcttc

SEQ ID NO: 597964 - DNA, 25 bp, Rattus norvegicus
gtttcgcagcagctcggtgtacagg

SEQ ID NO: 597965 - DNA, 25 bp, Rattus norvegicus
aggcgctgtgcacactcaatttaga

SEQ ID NO: 597966 - DNA, 25 bp, Rattus norvegicus
gcgtttgctccctaggtgcttatga

SEQ ID NO: 597967 - DNA, 25 bp, Rattus norvegicus
cgcctcctgtgtgtagttctttcaa

SEQ ID NO: 597968 - DNA, 25 bp, Rattus norvegicus
tttacagcacagacgtgcgcgcgca

SEQ ID NO: 597969 - DNA, 25 bp, Rattus norvegicus
agccagcaaggctagcgtagtccgc

SEQ ID NO: 597970 - DNA, 25 bp, Rattus norvegicus
gccgaatttctccagtcagccagca

SEQ ID NO: 597971 - DNA, 25 bp, Rattus norvegicus
actccttgggcttcggagccgaatt

SEQ ID NO: 597972 - DNA, 25 bp, Rattus norvegicus
tgctccgcgagaatcccgagaactc

SEQ ID NO: 597973 - DNA, 25 bp, Rattus norvegicus
ctgggcgctatagcaacggtaggta

SEQ ID NO: 597974 - DNA, 25 bp, Rattus norvegicus
atgctgcttctaaagccgccttcgc

SEQ ID NO: 597975 - DNA, 25 bp, Rattus norvegicus
ccggactaacgcagaatcccagatg

SEQ ID NO: 597976 - DNA, 25 bp, Rattus norvegicus
aggccctgacatcccttggcttaac

SEQ ID NO: 597977 - DNA, 25 bp, Rattus norvegicus
gcagtctcctgcaaacaaggccctg

SEQ ID NO: 597978 - DNA, 25 bp, Rattus norvegicus
tcccagtgagtaacgggacccgctg

SEQ ID NO: 597979 - DNA, 25 bp, Rattus norvegicus
ccgggaacctacagagaactacatt

SEQ ID NO: 597980 - DNA, 25 bp, Rattus norvegicus
ggcgccattgtctctgatacctaga

SEQ ID NO: 597981 - DNA, 25 bp, Rattus norvegicus
ggcgtccaggtaagcgtcctaccta

SEQ ID NO: 597982 - DNA, 25 bp, Rattus norvegicus
cacccgagcggcactaacttgattg

SEQ ID NO: 597983 - DNA, 25 bp, Rattus norvegicus
aacttgattggcaggacggagcgcc

SEQ ID NO: 597984 - DNA, 25 bp, Rattus norvegicus
agcacctcccggaagtacgaccttg

SEQ ID NO: 597985 - DNA, 25 bp, Rattus norvegicus
ggaaccactcgccatgggcgtccga

SEQ ID NO: 597986 - DNA, 25 bp, Rattus norvegicus
accacggcccgagatgctgttggcc

SEQ ID NO: 597987 - DNA, 25 bp, Rattus norvegicus
cctgtggctaccgagtcgtcagggc

SEQ ID NO: 597988 - DNA, 25 bp, Rattus norvegicus
gcattcggttccctgtggtgctctg

SEQ ID NO: 597989 - DNA, 25 bp, Rattus norvegicus
tagcttccaagctagggccgggcac

SEQ ID NO: 597990 - DNA, 25 bp, Rattus norvegicus
cagccttgcatcacctcgggacagg

SEQ ID NO: 597991 - DNA, 25 bp, Rattus norvegicus
tgtccagattccctacgtgctccga

SEQ ID NO: 597992 - DNA, 25 bp, Rattus norvegicus
tacgtgctccgagaccggattgtgc

SEQ ID NO: 597993 - DNA, 25 bp, Rattus norvegicus
ctcgggacaggtttgtccagattcc

SEQ ID NO: 597994 - DNA, 25 bp, Rattus norvegicus
cgtcctacctatgggcctgtggcta

SEQ ID NO: 597995 - DNA, 25 bp, Rattus norvegicus
tgtagctctcgctcatgctgcggta

SEQ ID NO: 597996 - DNA, 25 bp, Rattus norvegicus
gtcagcagcccgtaatgctactgtg

SEQ ID NO: 597997 - DNA, 25 bp, Rattus norvegicus
ggccgcggctcttcagatgagctta

SEQ ID NO: 597998 - DNA, 25 bp, Rattus norvegicus
agatgccatggcacacccggaggcc

SEQ ID NO: 597999 - DNA, 25 bp, Rattus norvegicus
cgactggttgcctccagatgccatg

SEQ ID NO: 598000 - DNA, 25 bp, Rattus norvegicus
cgaaccgctgttggatctgatggct

SEQ ID NO: 598001 - DNA, 25 bp, Rattus norvegicus
tcgtccatgttaaggcggctgcaca

SEQ ID NO: 598002 - DNA, 25 bp, Rattus norvegicus
tcacacggaagcaagccggaaactt

SEQ ID NO: 598003 - DNA, 25 bp, Rattus norvegicus
tctgagcacgcacctccagcgtgta

SEQ ID NO: 598004 - DNA, 25 bp, Rattus norvegicus
acttccgcggaggatctgagcacgc

SEQ ID NO: 598005 - DNA, 25 bp, Rattus norvegicus
gtgcggtgcaaacgaccaagtgacc

SEQ ID NO: 598006 - DNA, 25 bp, Rattus norvegicus
cgtctcctaagacggctgcacagca

SEQ ID NO: 598007 - DNA, 25 bp, Rattus norvegicus
gccggaaacttaatgcgtctcctaa

SEQ ID NO: 598008 - DNA, 25 bp, Rattus norvegicus
ggctgcacagctcttcgaaccgctg

SEQ ID NO: 598009 - DNA, 25 bp, Rattus norvegicus
tccgcaggatcttcatcaaacaggc

SEQ ID NO: 598010 - DNA, 25 bp, Rattus norvegicus
ttggagaagccaggaaaaccacggc

SEQ ID NO: 598011 - DNA, 25 bp, Rattus norvegicus
ccctggtctctaatccctttcgatg

SEQ ID NO: 598012 - DNA, 25 bp, Rattus norvegicus
tggaggcgctcgaggtcacacagcc

SEQ ID NO: 598013 - DNA, 25 bp, Rattus norvegicus
tctcacccaccgctctggagggaag

SEQ ID NO: 598014 - DNA, 25 bp, Rattus norvegicus
atccctttcgatggcctcgtgggtt

SEQ ID NO: 598015 - DNA, 25 bp, Rattus norvegicus
tcgagctcgctacagaaaagccgta

SEQ ID NO: 598016 - DNA, 25 bp, Rattus norvegicus
cggtggcccaaattcacgcgatttc

SEQ ID NO: 598017 - DNA, 25 bp, Rattus norvegicus
acgcgatttccctgcgctggagatg

SEQ ID NO: 598018 - DNA, 25 bp, Rattus norvegicus
ccggggccacatagcggcgctatct

SEQ ID NO: 598019 - DNA, 25 bp, Rattus norvegicus
gctatctggtcgagcctcggcctca

SEQ ID NO: 598020 - DNA, 25 bp, Rattus norvegicus
cggctcgggcctgattctgattcga

SEQ ID NO: 598021 - DNA, 25 bp, Rattus norvegicus
ctctggagggaagcggaaacccgct

SEQ ID NO: 598022 - DNA, 25 bp, Rattus norvegicus
aacaggccgctacgtctccacagag

SEQ ID NO: 598023 - DNA, 25 bp, Rattus norvegicus
cgcgctgcagcgcactgtgaccgag

SEQ ID NO: 598024 - DNA, 25 bp, Rattus norvegicus
gcagcgcactgtgaccgagctaccg

SEQ ID NO: 598025 - DNA, 25 bp, Rattus norvegicus
gcgctgcagcgcactgtgaccgagc

SEQ ID NO: 598026 - DNA, 25 bp, Rattus norvegicus
ccgcgctgcagtgactgtgaccgag

SEQ ID NO: 598027 - DNA, 25 bp, Rattus norvegicus
gctaccgcgctgcagcgcactgtga

SEQ ID NO: 598028 - DNA, 25 bp, Rattus norvegicus
agctaccgcgctgcagcgcactgtg

SEQ ID NO: 598029 - DNA, 25 bp, Rattus norvegicus
cgagctaccgcgctgcagtgactgt

SEQ ID NO: 598030 - DNA, 25 bp, Rattus norvegicus
ctgcagcgcactgtgaccgagctac

SEQ ID NO: 598031 - DNA, 25 bp, Rattus norvegicus
ctaccgcgctgcagtgactgtgacc

SEQ ID NO: 598032 - DNA, 25 bp, Rattus norvegicus
ggcacggtgaccgagctaccgcgct

SEQ ID NO: 598033 - DNA, 25 bp, Rattus norvegicus
accgcgctgcagtgactgtgaccga

SEQ ID NO: 598034 - DNA, 25 bp, Rattus norvegicus
cagcgcactgtgaccgagctaccgc

SEQ ID NO: 598035 - DNA, 25 bp, Rattus norvegicus
tgcagcgcactgtgaccgagctacc

SEQ ID NO: 598036 - DNA, 25 bp, Rattus norvegicus
agcgcactgtgaccgagctaccgcg

SEQ ID NO: 598037 - DNA, 25 bp, Rattus norvegicus
cccaagaaaggaggatacccacgcg

SEQ ID NO: 598038 - DNA, 25 bp, Rattus norvegicus
agcaatgtttgctgtcccgctgcgc

SEQ ID NO: 598039 - DNA, 25 bp, Rattus norvegicus
ggcacttaccggctgctcggccagg

SEQ ID NO: 598040 - DNA, 25 bp, Rattus norvegicus
cagcaaccggcgtctcatttgcata

SEQ ID NO: 598041 - DNA, 25 bp, Rattus norvegicus
catttgcatatctgtgaccgcgccg

SEQ ID NO: 598042 - DNA, 25 bp, Rattus norvegicus
ctcgggtcgtcgctcggtcctgcta

SEQ ID NO: 598043 - DNA, 25 bp, Rattus norvegicus
gtcctgctagggctacccaagaaag

SEQ ID NO: 598044 - DNA, 25 bp, Rattus norvegicus
actccggcgggctctggaagccctt

SEQ ID NO: 598045 - DNA, 25 bp, Rattus norvegicus
gaagcccttctgagcggagtggctc

SEQ ID NO: 598046 - DNA, 25 bp, Rattus norvegicus
gcggagtggctctgacccaccacgt

SEQ ID NO: 598047 - DNA, 25 bp, Rattus norvegicus
tgtactcaccgccacgactaagact

SEQ ID NO: 598048 - DNA, 25 bp, Rattus norvegicus
ctcttagactgacacgcgcggccgg

SEQ ID NO: 598049 - DNA, 25 bp, Rattus norvegicus
ggggcgcatgtactcaccgccacga

SEQ ID NO: 598050 - DNA, 25 bp, Rattus norvegicus
gccagtctccaccagttgagcaatg

SEQ ID NO: 598051 - DNA, 25 bp, Rattus norvegicus
gaatccttaccttggctgccggcgc

SEQ ID NO: 598052 - DNA, 25 bp, Rattus norvegicus
atgcagctgggccttcccacgcggg

SEQ ID NO: 598053 - DNA, 25 bp, Rattus norvegicus
gcggaaatgcagctgggccttccca

SEQ ID NO: 598054 - DNA, 25 bp, Rattus norvegicus
cacctagtggccgtaaggaggtagc

SEQ ID NO: 598055 - DNA, 25 bp, Rattus norvegicus
agacaggcgcccactagagcgcagg

SEQ ID NO: 598056 - DNA, 25 bp, Rattus norvegicus
ccctaggactctggttccatctgtc

SEQ ID NO: 598057 - DNA, 25 bp, Rattus norvegicus
acacgcccgaggaatccttaccttg

SEQ ID NO: 598058 - DNA, 25 bp, Rattus norvegicus
attctagggacacgcccgaggaatc

SEQ ID NO: 598059 - DNA, 25 bp, Rattus norvegicus
agcctcagacattctagggacacgc

SEQ ID NO: 598060 - DNA, 25 bp, Rattus norvegicus
acaaacgaggttgcgcggcggccaa

SEQ ID NO: 598061 - DNA, 25 bp, Rattus norvegicus
tcaatgcagaccacaaacgaggttg

SEQ ID NO: 598062 - DNA, 25 bp, Rattus norvegicus
tgtcctcgctggtcatcaatgcaga

SEQ ID NO: 598063 - DNA, 25 bp, Rattus norvegicus
gctctgtcctcgctggtcatcaatg

SEQ ID NO: 598064 - DNA, 25 bp, Rattus norvegicus
ggactctggttccatctgtctccct

SEQ ID NO: 598065 - DNA, 25 bp, Rattus norvegicus
tagtctacaccagggatatccaagc

SEQ ID NO: 598066 - DNA, 25 bp, Rattus norvegicus
atccaagcagaagggtcggtagagt

SEQ ID NO: 598067 - DNA, 25 bp, Rattus norvegicus
tgccaggagccacttacacaggtta

SEQ ID NO: 598068 - DNA, 25 bp, Rattus norvegicus
ccaggagccacttacacaggttagt

SEQ ID NO: 598069 - DNA, 25 bp, Rattus norvegicus
ggagccacttacacaggttagtttc

SEQ ID NO: 598070 - DNA, 25 bp, Rattus norvegicus
cacttacacaggttagtttctgggc

SEQ ID NO: 598071 - DNA, 25 bp, Rattus norvegicus
cacaggttagtttctgggcttagtc

SEQ ID NO: 598072 - DNA, 25 bp, Rattus norvegicus
tagtttctgggcttagtctacacca

SEQ ID NO: 598073 - DNA, 25 bp, Rattus norvegicus
gggcttagtctacaccagggatatc

SEQ ID NO: 598074 - DNA, 25 bp, Rattus norvegicus
gcttagtctacaccagggatatcca

SEQ ID NO: 598075 - DNA, 25 bp, Rattus norvegicus
ccagggatatccaagcagaagggtc

SEQ ID NO: 598076 - DNA, 25 bp, Rattus norvegicus
ggatatccaagcagaagggtcggta

SEQ ID NO: 598077 - DNA, 25 bp, Rattus norvegicus
tcggtagagtagaggagttgggata

SEQ ID NO: 598078 - DNA, 25 bp, Rattus norvegicus
tctacaccagggatatccaagcaga

SEQ ID NO: 598079 - DNA, 25 bp, Rattus norvegicus
cccagcgcagtagatgtagcgtgtc

SEQ ID NO: 598080 - DNA, 25 bp, Rattus norvegicus
actgagcgatgagcaaggtgccctc

SEQ ID NO: 598081 - DNA, 25 bp, Rattus norvegicus
aggtgccctcggcatacaggttgcg

SEQ ID NO: 598082 - DNA, 25 bp, Rattus norvegicus
aaagagtggactgcagcttcccagc

SEQ ID NO: 598083 - DNA, 25 bp, Rattus norvegicus
ctctagctagctgagagctggcaga

SEQ ID NO: 598084 - DNA, 25 bp, Rattus norvegicus
taactccgggactttggcaaagctg

SEQ ID NO: 598085 - DNA, 25 bp, Rattus norvegicus
gaagcaggacgcaccattggagccc

SEQ ID NO: 598086 - DNA, 25 bp, Rattus norvegicus
cctggaggatggagatgctctataa

SEQ ID NO: 598087 - DNA, 25 bp, Rattus norvegicus
gcgcctagggctcaaccatggatct

SEQ ID NO: 598088 - DNA, 25 bp, Rattus norvegicus
ccatggatcttttggcggaaggcga

SEQ ID NO: 598089 - DNA, 25 bp, Rattus norvegicus
cccacggcgctgacatagtggagga

SEQ ID NO: 598090 - DNA, 25 bp, Rattus norvegicus
ggccgcttctgctggccgaactgct

SEQ ID NO: 598091 - DNA, 25 bp, Rattus norvegicus
gggccctcctgcatcctggaggatg

SEQ ID NO: 598092 - DNA, 25 bp, Rattus norvegicus
aaggcaggtctgattggcacgtacc

SEQ ID NO: 598093 - DNA, 25 bp, Rattus norvegicus
tgctgcactttctttccgatctttc

SEQ ID NO: 598094 - DNA, 25 bp, Rattus norvegicus
atgtgaggttctaccccgcggcggc

SEQ ID NO: 598095 - DNA, 25 bp, Rattus norvegicus
cggcctggacttcgcgcagtgcctg

SEQ ID NO: 598096 - DNA, 25 bp, Rattus norvegicus
acttcgcgcagtgcctggggtacta

SEQ ID NO: 598097 - DNA, 25 bp, Rattus norvegicus
cagtgcctggggtactacggctaca

SEQ ID NO: 598098 - DNA, 25 bp, Rattus norvegicus
cctggggtactacggctacagcaag

SEQ ID NO: 598099 - DNA, 25 bp, Rattus norvegicus
actacggctacagcaaggtgaccgg

SEQ ID NO: 598100 - DNA, 25 bp, Rattus norvegicus
tgcactttctttccgatctttcctt

SEQ ID NO: 598101 - DNA, 25 bp, Rattus norvegicus
agcctgctgcactttctttccgatc

SEQ ID NO: 598102 - DNA, 25 bp, Rattus norvegicus
ttcccacccgctggtttctcggtgc

SEQ ID NO: 598103 - DNA, 25 bp, Rattus norvegicus
cccggcatggatgtgaggttctacc

SEQ ID NO: 598104 - DNA, 25 bp, Rattus norvegicus
gggtactacggctacagcaaggtga

SEQ ID NO: 598105 - DNA, 25 bp, Rattus norvegicus
ctagcctgctgcactttctttccga

SEQ ID NO: 598106 - DNA, 25 bp, Rattus norvegicus
ggcgcgtccctcgtcccgcctagcc

SEQ ID NO: 598107 - DNA, 25 bp, Rattus norvegicus
gcagtgcttcgccagcttgctgaca

SEQ ID NO: 598108 - DNA, 25 bp, Rattus norvegicus
gcttgctgacacttcggcgaccgca

SEQ ID NO: 598109 - DNA, 25 bp, Rattus norvegicus
ggcgcgagacaatggcctataattg

SEQ ID NO: 598110 - DNA, 25 bp, Rattus norvegicus
cctcatttctctccgggccaaaggg

SEQ ID NO: 598111 - DNA, 25 bp, Rattus norvegicus
tctccgtcgtcgaggactcaaaaga

SEQ ID NO: 598112 - DNA, 25 bp, Rattus norvegicus
cgcgaagcagcagattttgcgtttt

SEQ ID NO: 598113 - DNA, 25 bp, Rattus norvegicus
agcacgtgtgaagcatctccctgga

SEQ ID NO: 598114 - DNA, 25 bp, Rattus norvegicus
gctccattgggtttctggccaccga

SEQ ID NO: 598115 - DNA, 25 bp, Rattus norvegicus
ccggaggccaggactttcaagaagc

SEQ ID NO: 598116 - DNA, 25 bp, Rattus norvegicus
ggcggctctaaataccggcagattc

SEQ ID NO: 598117 - DNA, 25 bp, Rattus norvegicus
agggcgcacgttggtgtgttttcaa

SEQ ID NO: 598118 - DNA, 25 bp, Rattus norvegicus
ttcaagcgcgccgatttgcgggata

SEQ ID NO: 598119 - DNA, 25 bp, Rattus norvegicus
ctttaaacgtgctcaggtctgctca

SEQ ID NO: 598120 - DNA, 25 bp, Rattus norvegicus
tagggacgagtgctagctttaaacg

SEQ ID NO: 598121 - DNA, 25 bp, Rattus norvegicus
tgaaggaacactcacgaaacgggga

SEQ ID NO: 598122 - DNA, 25 bp, Rattus norvegicus
gggctgctttctggtagctcttaaa

SEQ ID NO: 598123 - DNA, 25 bp, Rattus norvegicus
tcgatttcaatttgccgggccaggc

SEQ ID NO: 598124 - DNA, 25 bp, Rattus norvegicus
actcggcgcgtctgattttatttca

SEQ ID NO: 598125 - DNA, 25 bp, Rattus norvegicus
ggaagcaagcgaagcctcaacattt

SEQ ID NO: 598126 - DNA, 25 bp, Rattus norvegicus
cccagctgatgtttgagccagcatg

SEQ ID NO: 598127 - DNA, 25 bp, Rattus norvegicus
ccgccgctcgatttccgtaattttg

SEQ ID NO: 598128 - DNA, 25 bp, Rattus norvegicus
taattatagcaggacacatgcgcgc

SEQ ID NO: 598129 - DNA, 25 bp, Rattus norvegicus
tttgaatagcgctggcccgatgcca

SEQ ID NO: 598130 - DNA, 25 bp, Rattus norvegicus
gggtctgcagcaaatcacgaactaa

SEQ ID NO: 598131 - DNA, 25 bp, Rattus norvegicus
tcgccaagagggttaaccaagagtc

SEQ ID NO: 598132 - DNA, 25 bp, Rattus norvegicus
atgctaattcgggtcggcccagccc

SEQ ID NO: 598133 - DNA, 25 bp, Rattus norvegicus
ggctcctgggcgagcatgctaattc

SEQ ID NO: 598134 - DNA, 25 bp, Rattus norvegicus
gatgccaatcgcctttcaaagagcc

SEQ ID NO: 598135 - DNA, 25 bp, Rattus norvegicus
ccacgaggggccaagcagtgacagc

SEQ ID NO: 598136 - DNA, 25 bp, Rattus norvegicus
gtccgcgggatacccacagggctgc

SEQ ID NO: 598137 - DNA, 25 bp, Rattus norvegicus
ggtggccgcagtcctgcggtgtccc

SEQ ID NO: 598138 - DNA, 25 bp, Rattus norvegicus
accctcccgggtcaccgcgctgcag

SEQ ID NO: 598139 - DNA, 25 bp, Rattus norvegicus
gcgcctttgccaccctcccgggtca

SEQ ID NO: 598140 - DNA, 25 bp, Rattus norvegicus
gacggtctagtaggtctcgtcggtc

SEQ ID NO: 598141 - DNA, 25 bp, Rattus norvegicus
cagtgacagcgcctttgccaccctc

SEQ ID NO: 598142 - DNA, 25 bp, Rattus norvegicus
cagccctggcacgaagtctggggac

SEQ ID NO: 598143 - DNA, 25 bp, Rattus norvegicus
ctagtaggtctcgtcggtccaggag

SEQ ID NO: 598144 - DNA, 25 bp, Rattus norvegicus
aggggcgtctttcccagccctggca

SEQ ID NO: 598145 - DNA, 25 bp, Rattus norvegicus
tttcccagccctggcacgaagtctg

SEQ ID NO: 598146 - DNA, 25 bp, Rattus norvegicus
cggccaccacgaggggccaagcagt

SEQ ID NO: 598147 - DNA, 25 bp, Rattus norvegicus
ccctggcacgaagtctggggacgta

SEQ ID NO: 598148 - DNA, 25 bp, Rattus norvegicus
gaagtctggggacgtaggggatatc

SEQ ID NO: 598149 - DNA, 25 bp, Rattus norvegicus
gcggcagatgactaataacggttga

SEQ ID NO: 598150 - DNA, 25 bp, Rattus norvegicus
atcaaaggaccggaacgccacaaag

SEQ ID NO: 598151 - DNA, 25 bp, Rattus norvegicus
tgcccagatcaaaggaccggaacgc

SEQ ID NO: 598152 - DNA, 25 bp, Rattus norvegicus
cgcacctgcagtgcggccaaatgtc

SEQ ID NO: 598153 - DNA, 25 bp, Rattus norvegicus
tttgtgcccagatcaaaggaccgga

SEQ ID NO: 598154 - DNA, 25 bp, Rattus norvegicus
gccgccctttgtgcccagatcaaag

SEQ ID NO: 598155 - DNA, 25 bp, Rattus norvegicus
tgcggccaaatgtcattgtcgcttc

SEQ ID NO: 598156 - DNA, 25 bp, Rattus norvegicus
tgtcattgtcgcttctgcggggcga

SEQ ID NO: 598157 - DNA, 25 bp, Rattus norvegicus
gacgcacctccgaggcggcagatga

SEQ ID NO: 598158 - DNA, 25 bp, Rattus norvegicus
gcccagggctttgtattaactgccc

SEQ ID NO: 598159 - DNA, 25 bp, Rattus norvegicus
tccgaggcggcagatgactaataac

SEQ ID NO: 598160 - DNA, 25 bp, Rattus norvegicus
tgcagtgcggccaaatgtcattgtc

SEQ ID NO: 598161 - DNA, 25 bp, Rattus norvegicus
cggtgcccagggctttgtattaact

SEQ ID NO: 598162 - DNA, 25 bp, Rattus norvegicus
taacggttgatgagaattgatggga

SEQ ID NO: 598163 - DNA, 25 bp, Rattus norvegicus
atccagagaaccgtccctgcgcgcg

SEQ ID NO: 598164 - DNA, 25 bp, Rattus norvegicus
gctagccaatcacatccagagaacc

SEQ ID NO: 598165 - DNA, 25 bp, Rattus norvegicus
agaagccacgctagccaatcacatc

SEQ ID NO: 598166 - DNA, 25 bp, Rattus norvegicus
gggaggatagaagccacgctagcca

SEQ ID NO: 598167 - DNA, 25 bp, Rattus norvegicus
agccgaacctgctacctgggcccgc

SEQ ID NO: 598168 - DNA, 25 bp, Rattus norvegicus
caggcttcagaaccggcgtcccggg

SEQ ID NO: 598169 - DNA, 25 bp, Rattus norvegicus
gcagccgcggttgacgtcagaagct

SEQ ID NO: 598170 - DNA, 25 bp, Rattus norvegicus
ccgcggttgacgtcagaagctcgtc

SEQ ID NO: 598171 - DNA, 25 bp, Rattus norvegicus
tgacgtcagaagctcgtcggcccgg

SEQ ID NO: 598172 - DNA, 25 bp, Rattus norvegicus
cccgaggcagggcaggaacactaga

SEQ ID NO: 598173 - DNA, 25 bp, Rattus norvegicus
gcaggaacactagagacctagcttc

SEQ ID NO: 598174 - DNA, 25 bp, Rattus norvegicus
ccagtatttacctcaggcgcgcggg

SEQ ID NO: 598175 - DNA, 25 bp, Rattus norvegicus
ctccgccgctcaaggcgcccgaggc

SEQ ID NO: 598176 - DNA, 25 bp, Rattus norvegicus
tagagacctagcttcagccgcgcgg

SEQ ID NO: 598177 - DNA, 25 bp, Rattus norvegicus
tccagctccggtcccactcgggctc

SEQ ID NO: 598178 - DNA, 25 bp, Rattus norvegicus
ccgaaggatgtagggagaccagcgc

SEQ ID NO: 598179 - DNA, 25 bp, Rattus norvegicus
cagtgccggctccagcttcggctcc

SEQ ID NO: 598180 - DNA, 25 bp, Rattus norvegicus
cggatgccaccgctcgggctggact

SEQ ID NO: 598181 - DNA, 25 bp, Rattus norvegicus
tccgcctgggcctgctgtgcgtgca

SEQ ID NO: 598182 - DNA, 25 bp, Rattus norvegicus
gctcgcgccaccgtcaccctctcgg

SEQ ID NO: 598183 - DNA, 25 bp, Rattus norvegicus
ccgacacccacacagaggcgggagg

SEQ ID NO: 598184 - DNA, 25 bp, Rattus norvegicus
ccttactcggcttggctgcggcgct

SEQ ID NO: 598185 - DNA, 25 bp, Rattus norvegicus
caggcgtcccgggaaaaccgctcag

SEQ ID NO: 598186 - DNA, 25 bp, Rattus norvegicus
aaaccgctcagttctcgcgcggtga

SEQ ID NO: 598187 - DNA, 25 bp, Rattus norvegicus
agttctcgcgcggtgaggttccgct

SEQ ID NO: 598188 - DNA, 25 bp, Rattus norvegicus
gtgaggttccgctccggaccgcgtc

SEQ ID NO: 598189 - DNA, 25 bp, Rattus norvegicus
ccgcgtgcgtaagcagcgggtaccc

SEQ ID NO: 598190 - DNA, 25 bp, Rattus norvegicus
ccacggcccgggtcattgctgagac

SEQ ID NO: 598191 - DNA, 25 bp, Rattus norvegicus
aggggcgccaccctgaaggagctca

SEQ ID NO: 598192 - DNA, 25 bp, Rattus norvegicus
ctgcaggagaagctcacggcgcact

SEQ ID NO: 598193 - DNA, 25 bp, Rattus norvegicus
cgagttcgccgacttccttacgcgg

SEQ ID NO: 598194 - DNA, 25 bp, Rattus norvegicus
agtacctgcggctgctgtacgccgt

SEQ ID NO: 598195 - DNA, 25 bp, Rattus norvegicus
agaccatctgcgaacggcgcctgga

SEQ ID NO: 598196 - DNA, 25 bp, Rattus norvegicus
aacctgtcggccgagaccatctgcg

SEQ ID NO: 598197 - DNA, 25 bp, Rattus norvegicus
tgctctctgcgccatgctcgtgtgc

SEQ ID NO: 598198 - DNA, 25 bp, Rattus norvegicus
ctcaccgtgcgggagtatctgtcct

SEQ ID NO: 598199 - DNA, 25 bp, Rattus norvegicus
cggaagcgcctgaccgggaacctgt

SEQ ID NO: 598200 - DNA, 25 bp, Rattus norvegicus
agggccctcctgaagcgcttcgggc

SEQ ID NO: 598201 - DNA, 25 bp, Rattus norvegicus
tactcggacttcgagaggctgcaga

SEQ ID NO: 598202 - DNA, 25 bp, Rattus norvegicus
cagactgggagcttcgacagcgaca

SEQ ID NO: 598203 - DNA, 25 bp, Rattus norvegicus
taccaggtcgtggtcatccagactg

SEQ ID NO: 598204 - DNA, 25 bp, Rattus norvegicus
ctctgcccacagatgtaccaggtcg

SEQ ID NO: 598205 - DNA, 25 bp, Rattus norvegicus
catccgggcgtcctaagccatgcgt

SEQ ID NO: 598206 - DNA, 25 bp, Rattus norvegicus
cgggcgtcctaagccatgcgtccgg

SEQ ID NO: 598207 - DNA, 25 bp, Rattus norvegicus
cattggccggcagcggcccatcaaa

SEQ ID NO: 598208 - DNA, 25 bp, Rattus norvegicus
gactccgcgtcagccttgctcgcct

SEQ ID NO: 598209 - DNA, 25 bp, Rattus norvegicus
taatgagatccagcggcaaggcggt

SEQ ID NO: 598210 - DNA, 25 bp, Rattus norvegicus
ccggcagcggcccatcaaaggcgag

SEQ ID NO: 598211 - DNA, 25 bp, Rattus norvegicus
tgacccggcttcgagtgaagtttcc

SEQ ID NO: 598212 - DNA, 25 bp, Rattus norvegicus
ggcagccctggtaatgagatccagc

SEQ ID NO: 598213 - DNA, 25 bp, Rattus norvegicus
atccagcggcaaggcggttcgcgcc

SEQ ID NO: 598214 - DNA, 25 bp, Rattus norvegicus
taccttccgggctctccctgcgctt

SEQ ID NO: 598215 - DNA, 25 bp, Rattus norvegicus
cctgcgcttgcacacggcggctgtg

SEQ ID NO: 598216 - DNA, 25 bp, Rattus norvegicus
cacacggcggctgtgggcacatcgc

SEQ ID NO: 598217 - DNA, 25 bp, Rattus norvegicus
cgggcgaggacaatgacccggcttc

SEQ ID NO: 598218 - DNA, 25 bp, Rattus norvegicus
ctgaggcagccctggtaatgagatc

SEQ ID NO: 598219 - DNA, 25 bp, Rattus norvegicus
cagagctgctcacgctggtacccag

SEQ ID NO: 598220 - DNA, 25 bp, Rattus norvegicus
gtgacagccgcatgtaataaaagcc

SEQ ID NO: 598221 - DNA, 25 bp, Rattus norvegicus
cagccgagcacctgggtaaacacgc

SEQ ID NO: 598222 - DNA, 25 bp, Rattus norvegicus
gtgccctggcgactccacttgcaga

SEQ ID NO: 598223 - DNA, 25 bp, Rattus norvegicus
cagcggccacttcaaagcggggcgc

SEQ ID NO: 598224 - DNA, 25 bp, Rattus norvegicus
acctgggtaaacacgcgcagcctgg

SEQ ID NO: 598225 - DNA, 25 bp, Rattus norvegicus
cttgcacggtggctctgcatcccag

SEQ ID NO: 598226 - DNA, 25 bp, Rattus norvegicus
ttctaagcctgcgtttgcgcggtgg

SEQ ID NO: 598227 - DNA, 25 bp, Rattus norvegicus
gcccgcgagccttggaagaagcctt

SEQ ID NO: 598228 - DNA, 25 bp, Rattus norvegicus
cgtgccgagcgctctgctaagctcg

SEQ ID NO: 598229 - DNA, 25 bp, Rattus norvegicus
agaaccgtccttgtcctgcggcgca

SEQ ID NO: 598230 - DNA, 25 bp, Rattus norvegicus
agaagccttggcctttctaagcctg

SEQ ID NO: 598231 - DNA, 25 bp, Rattus norvegicus
ggggttgtcagctccaagggaaatc

SEQ ID NO: 598232 - DNA, 25 bp, Rattus norvegicus
tccaagggaaatccgcccaggagga

SEQ ID NO: 598233 - DNA, 25 bp, Rattus norvegicus
cctccacgagaaggcagtagaaatg

SEQ ID NO: 598234 - DNA, 25 bp, Rattus norvegicus
tgcgggcaccaggatcatttgttac

SEQ ID NO: 598235 - DNA, 25 bp, Rattus norvegicus
cctccttgtctgaaggcgtgccgga

SEQ ID NO: 598236 - DNA, 25 bp, Rattus norvegicus
ctgatttgtccacagccggcagtgc

SEQ ID NO: 598237 - DNA, 25 bp, Rattus norvegicus
cccggagaagcaaggtgcgctgatt

SEQ ID NO: 598238 - DNA, 25 bp, Rattus norvegicus
tgcccgtttggttttcacagggaca

SEQ ID NO: 598239 - DNA, 25 bp, Rattus norvegicus
ctgtggaccttaagctgcccgtttg

SEQ ID NO: 598240 - DNA, 25 bp, Rattus norvegicus
ggtagctgaagcgttcgcctcccga

SEQ ID NO: 598241 - DNA, 25 bp, Rattus norvegicus
gcgtcttccaccacaatgcctggta

SEQ ID NO: 598242 - DNA, 25 bp, Rattus norvegicus
tactgacctgatgaagaactccggc

SEQ ID NO: 598243 - DNA, 25 bp, Rattus norvegicus
tggcccacaggaagtcctcgcgtta

SEQ ID NO: 598244 - DNA, 25 bp, Rattus norvegicus
cgcagttcgggaaccggttcttgag

SEQ ID NO: 598245 - DNA, 25 bp, Rattus norvegicus
cagacgccactacctccgaaagggg

SEQ ID NO: 598246 - DNA, 25 bp, Rattus norvegicus
gaggcgtttccgtctccggtgtcat

SEQ ID NO: 598247 - DNA, 25 bp, Rattus norvegicus
atacggccattgagcgcacggaggc

SEQ ID NO: 598248 - DNA, 25 bp, Rattus norvegicus
ctcgccgcgcagtctgtgcaaaaca

SEQ ID NO: 598249 - DNA, 25 bp, Rattus norvegicus
ctggacatagacaagagcgtgagtc

SEQ ID NO: 598250 - DNA, 25 bp, Rattus norvegicus
atctcgcagaagaaactcaagctgg

SEQ ID NO: 598251 - DNA, 25 bp, Rattus norvegicus
agggtgcagaaaagcatctcgcaga

SEQ ID NO: 598252 - DNA, 25 bp, Rattus norvegicus
cctccttcagcaagagggtgcagaa

SEQ ID NO: 598253 - DNA, 25 bp, Rattus norvegicus
gcgggcaacgcctccttcagcaaga

SEQ ID NO: 598254 - DNA, 25 bp, Rattus norvegicus
gccagagctgctgcctcatcgcgga

SEQ ID NO: 598255 - DNA, 25 bp, Rattus norvegicus
agatgaacggcttcagcacggagga

SEQ ID NO: 598256 - DNA, 25 bp, Rattus norvegicus
cgatggtgcccaatgggaactgcca

SEQ ID NO: 598257 - DNA, 25 bp, Rattus norvegicus
caggagcacagagcaaccgggcctc

SEQ ID NO: 598258 - DNA, 25 bp, Rattus norvegicus
cccgcccatataaagaatacggcca

SEQ ID NO: 598259 - DNA, 25 bp, Rattus norvegicus
tgcaaaacaggggactcaggttcgt

SEQ ID NO: 598260 - DNA, 25 bp, Rattus norvegicus
tcgcggagctcagagcgcgcatgac

SEQ ID NO: 598261 - DNA, 25 bp, Rattus norvegicus
gtcttctcgtgagggacctcgcgcc

SEQ ID NO: 598262 - DNA, 25 bp, Rattus norvegicus
cccgacccgcggagatcctccggcg

SEQ ID NO: 598263 - DNA, 25 bp, Rattus norvegicus
cttctacgagggtgaggaaccacgg

SEQ ID NO: 598264 - DNA, 25 bp, Rattus norvegicus
acacttctacgagggtgaggaacca

SEQ ID NO: 598265 - DNA, 25 bp, Rattus norvegicus
tcggaccgacacttctacgagggtg

SEQ ID NO: 598266 - DNA, 25 bp, Rattus norvegicus
ctccaccacaggctgcagcgccgcc

SEQ ID NO: 598267 - DNA, 25 bp, Rattus norvegicus
cccggtgggacatgggcaagaagca

SEQ ID NO: 598268 - DNA, 25 bp, Rattus norvegicus
caggggccactacgcgccgcagcct

SEQ ID NO: 598269 - DNA, 25 bp, Rattus norvegicus
cgcgtggtcttctcgtgagggacct

SEQ ID NO: 598270 - DNA, 25 bp, Rattus norvegicus
cgtcccgcgcgtggtcttctcgtga

SEQ ID NO: 598271 - DNA, 25 bp, Rattus norvegicus
cccgccactgctttcgcgcttctgc

SEQ ID NO: 598272 - DNA, 25 bp, Rattus norvegicus
cacccagaccgcttggtggcccttc

SEQ ID NO: 598273 - DNA, 25 bp, Rattus norvegicus
cacaagaagcacaagtcggaccgac

SEQ ID NO: 598274 - DNA, 25 bp, Rattus norvegicus
ggaaccacgggcctgccagcagagc

SEQ ID NO: 598275 - DNA, 25 bp, Rattus norvegicus
gctcggtcatctccggtgtccctga

SEQ ID NO: 598276 - DNA, 25 bp, Rattus norvegicus
cctgtgtgtcctgtcccgcgggatc

SEQ ID NO: 598277 - DNA, 25 bp, Rattus norvegicus
gccttaggtcaccagccagacctca

SEQ ID NO: 598278 - DNA, 25 bp, Rattus norvegicus
ctccggtgtccctgaggctgcagga

SEQ ID NO: 598279 - DNA, 25 bp, Rattus norvegicus
gaccctgttacctgcggcgctcggt

SEQ ID NO: 598280 - DNA, 25 bp, Rattus norvegicus
gcgtagctgcctctgaccctgttac

SEQ ID NO: 598281 - DNA, 25 bp, Rattus norvegicus
agacctcatctccgggttcccaaag

SEQ ID NO: 598282 - DNA, 25 bp, Rattus norvegicus
cactgaccttatggagcgcggactg

SEQ ID NO: 598283 - DNA, 25 bp, Rattus norvegicus
cccagctggtcgcactgaccttatg

SEQ ID NO: 598284 - DNA, 25 bp, Rattus norvegicus
gctcgggagctctggagttcccgcc

SEQ ID NO: 598285 - DNA, 25 bp, Rattus norvegicus
gatcggaggcaaggaccccacaacc

SEQ ID NO: 598286 - DNA, 25 bp, Rattus norvegicus
cccgatccgggaagaaagcttcaga

SEQ ID NO: 598287 - DNA, 25 bp, Rattus norvegicus
agcctcccatgaccaccctgtgtgt

SEQ ID NO: 598288 - DNA, 25 bp, Rattus norvegicus
aggagggagccacgcccgcagcctt

SEQ ID NO: 598289 - DNA, 25 bp, Rattus norvegicus
gccctccgctgggttgcagcaggct

SEQ ID NO: 598290 - DNA, 25 bp, Rattus norvegicus
cgctgccgtacgacgctagcactca

SEQ ID NO: 598291 - DNA, 25 bp, Rattus norvegicus
cgtctccaggggcaggaagtcccgc

SEQ ID NO: 598292 - DNA, 25 bp, Rattus norvegicus
aggaagtcccgctgctccgcgggca

SEQ ID NO: 598293 - DNA, 25 bp, Rattus norvegicus
ttgtcacgtttcctcttgttgctgc

SEQ ID NO: 598294 - DNA, 25 bp, Rattus norvegicus
ggccttgttgtcacgtttcctcttg

SEQ ID NO: 598295 - DNA, 25 bp, Rattus norvegicus
aggtgctggccttgttgtcacgttt

SEQ ID NO: 598296 - DNA, 25 bp, Rattus norvegicus
agtccgtaggtgctggccttgttgt

SEQ ID NO: 598297 - DNA, 25 bp, Rattus norvegicus
ttgcagcaggctgtagttgagtccg

SEQ ID NO: 598298 - DNA, 25 bp, Rattus norvegicus
ctcttccacggggtcccgctgtaca

SEQ ID NO: 598299 - DNA, 25 bp, Rattus norvegicus
ctggttgtagttccgtctcttccac

SEQ ID NO: 598300 - DNA, 25 bp, Rattus norvegicus
tccctggttgtagttccgtctcttc

SEQ ID NO: 598301 - DNA, 25 bp, Rattus norvegicus
ccacgactccctggttgtagttccg

SEQ ID NO: 598302 - DNA, 25 bp, Rattus norvegicus
cagcaggctgtagttgagtccgtag

SEQ ID NO: 598303 - DNA, 25 bp, Rattus norvegicus
tggggtcgcacgtacctgggcctcc

SEQ ID NO: 598304 - DNA, 25 bp, Rattus norvegicus
aaccgtcccgcgctagcttagctgg

SEQ ID NO: 598305 - DNA, 25 bp, Rattus norvegicus
cgcgctagcttagctggggtcgcac

SEQ ID NO: 598306 - DNA, 25 bp, Rattus norvegicus
tccagcgccgccgaggaacacgagg

SEQ ID NO: 598307 - DNA, 25 bp, Rattus norvegicus
cggctgccgactccgcggaaagtga

SEQ ID NO: 598308 - DNA, 25 bp, Rattus norvegicus
cgactccgcggaaagtgactggttt

SEQ ID NO: 598309 - DNA, 25 bp, Rattus norvegicus
aagtgactggtttgcgccacccacc

SEQ ID NO: 598310 - DNA, 25 bp, Rattus norvegicus
cactagaagggcgggcttccgctca

SEQ ID NO: 598311 - DNA, 25 bp, Rattus norvegicus
gcttccgctcaagggccgggtttgc

SEQ ID NO: 598312 - DNA, 25 bp, Rattus norvegicus
acgcgcacctcggttccggagcggt

SEQ ID NO: 598313 - DNA, 25 bp, Rattus norvegicus
acctcggttccggagcggtctcagc

SEQ ID NO: 598314 - DNA, 25 bp, Rattus norvegicus
tctcagcggcctctgtgtcgcgagt

SEQ ID NO: 598315 - DNA, 25 bp, Rattus norvegicus
gtgtcgcgagtcctggcaccactgc

SEQ ID NO: 598316 - DNA, 25 bp, Rattus norvegicus
cactgcccggctcgagggccacaca

SEQ ID NO: 598317 - DNA, 25 bp, Rattus norvegicus
gtccgactcttacccatggcgacag

SEQ ID NO: 598318 - DNA, 25 bp, Rattus norvegicus
tcagacgctctagaactcacctcag

SEQ ID NO: 598319 - DNA, 25 bp, Rattus norvegicus
tcccttaccgctagacttgagtcca

SEQ ID NO: 598320 - DNA, 25 bp, Rattus norvegicus
tagacttgagtccagcagcagcggc

SEQ ID NO: 598321 - DNA, 25 bp, Rattus norvegicus
ctgtgggaaccaagacgtcagagtc

SEQ ID NO: 598322 - DNA, 25 bp, Rattus norvegicus
tgagcacgcgcgttgcagcacctct

SEQ ID NO: 598323 - DNA, 25 bp, Rattus norvegicus
ctcggcctgacagctacctacaggg

SEQ ID NO: 598324 - DNA, 25 bp, Rattus norvegicus
tgctcgcagggacactgactcagac

SEQ ID NO: 598325 - DNA, 25 bp, Rattus norvegicus
cggtctaggtacacatgggaaagca

SEQ ID NO: 598326 - DNA, 25 bp, Rattus norvegicus
tactgcagcagcagtcgatggggcc

SEQ ID NO: 598327 - DNA, 25 bp, Rattus norvegicus
gccctgggcaacttctagtctccga

SEQ ID NO: 598328 - DNA, 25 bp, Rattus norvegicus
tctccgacgttacttggcgtctctc

SEQ ID NO: 598329 - DNA, 25 bp, Rattus norvegicus
ggcgtctctcttcagctggtcggat

SEQ ID NO: 598330 - DNA, 25 bp, Rattus norvegicus
cttgaagcgcttcgtccgactctta

SEQ ID NO: 598331 - DNA, 25 bp, Rattus norvegicus
ccagcgctaggcgttcaactggaag

SEQ ID NO: 598332 - DNA, 25 bp, Rattus norvegicus
ggctcgtgcggttgtcaaaccaacg

SEQ ID NO: 598333 - DNA, 25 bp, Rattus norvegicus
gctgatatagccatggcgccgcctc

SEQ ID NO: 598334 - DNA, 25 bp, Rattus norvegicus
cgttcaactggaagggccgagaata

SEQ ID NO: 598335 - DNA, 25 bp, Rattus norvegicus
ggctaatttcagcaaacgccttcgg

SEQ ID NO: 598336 - DNA, 25 bp, Rattus norvegicus
actagttttctattggctaatttca

SEQ ID NO: 598337 - DNA, 25 bp, Rattus norvegicus
gcttattgggtatctttgccagacc

SEQ ID NO: 598338 - DNA, 25 bp, Rattus norvegicus
ttagaaccgttgagcttattgggta

SEQ ID NO: 598339 - DNA, 25 bp, Rattus norvegicus
agcgaattcatgtcggccggcagct

SEQ ID NO: 598340 - DNA, 25 bp, Rattus norvegicus
ttccgcctgttccagcgaattcatg

SEQ ID NO: 598341 - DNA, 25 bp, Rattus norvegicus
cgaagcgggcgacacacactacctt

SEQ ID NO: 598342 - DNA, 25 bp, Rattus norvegicus
tacaacacacaagggctcgtcaatg

SEQ ID NO: 598343 - DNA, 25 bp, Rattus norvegicus
acggaaaatgaattcgcactctaca

SEQ ID NO: 598344 - DNA, 25 bp, Rattus norvegicus
ccgagaatagcgagcagtcaggctg

SEQ ID NO: 598345 - DNA, 25 bp, Rattus norvegicus
ggcaacttatcgatcgccgagattg

SEQ ID NO: 598346 - DNA, 25 bp, Rattus norvegicus
agcgtgtgccatctgccgcctgtca

SEQ ID NO: 598347 - DNA, 25 bp, Rattus norvegicus
taacgctggacatccctaggctgtg

SEQ ID NO: 598348 - DNA, 25 bp, Rattus norvegicus
gcggctttcagtccctgcgggaagc

SEQ ID NO: 598349 - DNA, 25 bp, Rattus norvegicus
tgcactcagaggcacaagctgcgga

SEQ ID NO: 598350 - DNA, 25 bp, Rattus norvegicus
tggtcagtgatgacagtcctaaccc

SEQ ID NO: 598351 - DNA, 25 bp, Rattus norvegicus
ggtcagactctatcctctccgggga

SEQ ID NO: 598352 - DNA, 25 bp, Rattus norvegicus
tctgtctcccgcagtcggagcgttt

SEQ ID NO: 598353 - DNA, 25 bp, Rattus norvegicus
ttgccttggcgacgcatagctcggt

SEQ ID NO: 598354 - DNA, 25 bp, Rattus norvegicus
cctttctctgcaggtgccggcctgt

SEQ ID NO: 598355 - DNA, 25 bp, Rattus norvegicus
gggtggcatctacctcggcaatcag

SEQ ID NO: 598356 - DNA, 25 bp, Rattus norvegicus
taactcgtctccgaggggacacagc

SEQ ID NO: 598357 - DNA, 25 bp, Rattus norvegicus
gccgagcgatccgacctaaggtggc

SEQ ID NO: 598358 - DNA, 25 bp, Rattus norvegicus
cggcaatcagcccagcacgagcttg

SEQ ID NO: 598359 - DNA, 25 bp, Rattus norvegicus
cgctgggtcccagagaagattttca

SEQ ID NO: 598360 - DNA, 25 bp, Rattus norvegicus
gcagttgttttaccatcgcgacatc

SEQ ID NO: 598361 - DNA, 25 bp, Rattus norvegicus
cgcgcacctcttccttaagcagttg

SEQ ID NO: 598362 - DNA, 25 bp, Rattus norvegicus
acacggcgattgaatatttattacg

SEQ ID NO: 598363 - DNA, 25 bp, Rattus norvegicus
tcgcgccttttagggaagaacgaga

SEQ ID NO: 598364 - DNA, 25 bp, Rattus norvegicus
cagagctcagccatcaaatagtgtc

SEQ ID NO: 598365 - DNA, 25 bp, Rattus norvegicus
caaccggggatgcagacatagctcg

SEQ ID NO: 598366 - DNA, 25 bp, Rattus norvegicus
accatgctttcctgtggggcgagtt

SEQ ID NO: 598367 - DNA, 25 bp, Rattus norvegicus
tggatcactcaagagcgcgacgtgg

SEQ ID NO: 598368 - DNA, 25 bp, Rattus norvegicus
ttgcaggtatatccgaaggcctatg

SEQ ID NO: 598369 - DNA, 25 bp, Rattus norvegicus
tcgaagtcaccggtttgcaggtata

SEQ ID NO: 598370 - DNA, 25 bp, Rattus norvegicus
cgcctaatgcggagcaaactcaaaa

SEQ ID NO: 598371 - DNA, 25 bp, Rattus norvegicus
atctggaaggcccacgcctaatgcg

SEQ ID NO: 598372 - DNA, 25 bp, Rattus norvegicus
ttgccaaccacgacttccaaagagg

SEQ ID NO: 598373 - DNA, 25 bp, Rattus norvegicus
tccgcgatggctgctcaaggatgct

SEQ ID NO: 598374 - DNA, 25 bp, Rattus norvegicus
agctgcagcacctgggacgccatgc

SEQ ID NO: 598375 - DNA, 25 bp, Rattus norvegicus
gggctcagcgccctgagctaagcac

SEQ ID NO: 598376 - DNA, 25 bp, Rattus norvegicus
ctcagtacgccggtgcgtaaccggg

SEQ ID NO: 598377 - DNA, 25 bp, Rattus norvegicus
gcgtaaccgggtgctccagtcgcgc

SEQ ID NO: 598378 - DNA, 25 bp, Rattus norvegicus
cccaatccgcggcagacgctgaata

SEQ ID NO: 598379 - DNA, 25 bp, Rattus norvegicus
cgcggcagacgctgaataccacgga

SEQ ID NO: 598380 - DNA, 25 bp, Rattus norvegicus
acgctgaataccacggaccggcaca

SEQ ID NO: 598381 - DNA, 25 bp, Rattus norvegicus
gaataccacggaccggcacagcgcg

SEQ ID NO: 598382 - DNA, 25 bp, Rattus norvegicus
caggtgcgcgccatgtccaagggaa

SEQ ID NO: 598383 - DNA, 25 bp, Rattus norvegicus
catgtccaagggaaggaggattttc

SEQ ID NO: 598384 - DNA, 25 bp, Rattus norvegicus
aggattttcccatcatgctccgcga

SEQ ID NO: 598385 - DNA, 25 bp, Rattus norvegicus
gctgctcaaggatgctcccgcggct

SEQ ID NO: 598386 - DNA, 25 bp, Rattus norvegicus
atcatgctccgcgatggctgctcaa

SEQ ID NO: 598387 - DNA, 25 bp, Rattus norvegicus
ctctttgccgttcatgaccgcgggg

SEQ ID NO: 598388 - DNA, 25 bp, Rattus norvegicus
aacgtctgtgtacgtacccggcgcg

SEQ ID NO: 598389 - DNA, 25 bp, Rattus norvegicus
tgtccaagtttctccaacgtctgtg

SEQ ID NO: 598390 - DNA, 25 bp, Rattus norvegicus
ttccggtctgtgtccaagtttctcc

SEQ ID NO: 598391 - DNA, 25 bp, Rattus norvegicus
ctgtgccgcacatacttccggtctg

SEQ ID NO: 598392 - DNA, 25 bp, Rattus norvegicus
cggaagctgagccttcacgcagcct

SEQ ID NO: 598393 - DNA, 25 bp, Rattus norvegicus
acagagccagtggtgacagcgcaga

SEQ ID NO: 598394 - DNA, 25 bp, Rattus norvegicus
aaaggccgtcgccagacactgcgga

SEQ ID NO: 598395 - DNA, 25 bp, Rattus norvegicus
tcagctcagcaaaaggccgtcgcca

SEQ ID NO: 598396 - DNA, 25 bp, Rattus norvegicus
cagccgccgggtcagctcagcaaaa

SEQ ID NO: 598397 - DNA, 25 bp, Rattus norvegicus
tttgcaagcgcaggaaccgcagccg

SEQ ID NO: 598398 - DNA, 25 bp, Rattus norvegicus
ggcctcggtttgcaagcgcaggaac

SEQ ID NO: 598399 - DNA, 25 bp, Rattus norvegicus
agcagagcaccagtgccaggcccag

SEQ ID NO: 598400 - DNA, 25 bp, Rattus norvegicus
cggtgacagcagagcaccagtgcca

SEQ ID NO: 598401 - DNA, 25 bp, Rattus norvegicus
ggccctcagccgaaacaagccaaga

SEQ ID NO: 598402 - DNA, 25 bp, Rattus norvegicus
gctcgcacgcgaccgttattcagta

SEQ ID NO: 598403 - DNA, 25 bp, Rattus norvegicus
ctcgcaattcctgccacggtgttta

SEQ ID NO: 598404 - DNA, 25 bp, Rattus norvegicus
agcaccggtcggctcattacgacga

SEQ ID NO: 598405 - DNA, 25 bp, Rattus norvegicus
cgttattcagtaccgcggagatgcc

SEQ ID NO: 598406 - DNA, 25 bp, Rattus norvegicus
ttcagacgcaggaaaccgattgctc

SEQ ID NO: 598407 - DNA, 25 bp, Rattus norvegicus
aggcactcggtgttgttcagacgca

SEQ ID NO: 598408 - DNA, 25 bp, Rattus norvegicus
gagcacgcgcactcaacgccgagtt

SEQ ID NO: 598409 - DNA, 25 bp, Rattus norvegicus
acaagccaagatctgagcacgcgca

SEQ ID NO: 598410 - DNA, 25 bp, Rattus norvegicus
tttacagccgagactaatggggccc

SEQ ID NO: 598411 - DNA, 25 bp, Rattus norvegicus
gcgcgagcagggagaaactcacacc

SEQ ID NO: 598412 - DNA, 25 bp, Rattus norvegicus
ttggtctagttaaagcgcgggcttg

SEQ ID NO: 598413 - DNA, 25 bp, Rattus norvegicus
ctcattacgacgaggtgttggtcta

SEQ ID NO: 598414 - DNA, 25 bp, Rattus norvegicus
gcggagatgcctgtcttagcgcacc

SEQ ID NO: 598415 - DNA, 25 bp, Rattus norvegicus
gcgcttggatccacagtccgagcca

SEQ ID NO: 598416 - DNA, 25 bp, Rattus norvegicus
cacttccgagtgtggactgtgacgc

SEQ ID NO: 598417 - DNA, 25 bp, Rattus norvegicus
gcagtcaccaccgttgccgccgtcc

SEQ ID NO: 598418 - DNA, 25 bp, Rattus norvegicus
ttcccggggcgcttggatccacagt

SEQ ID NO: 598419 - DNA, 25 bp, Rattus norvegicus
ttccgagtgtggactgtgacgcgca

SEQ ID NO: 598420 - DNA, 25 bp, Rattus norvegicus
ttggatccacagtccgagccactgc

SEQ ID NO: 598421 - DNA, 25 bp, Rattus norvegicus
gcgtctccggctgccactgcagctc

SEQ ID NO: 598422 - DNA, 25 bp, Rattus norvegicus
actgcagctcccgtccaagcgcgtc

SEQ ID NO: 598423 - DNA, 25 bp, Rattus norvegicus
gtccgcagcgcctgagtgcagctcg

SEQ ID NO: 598424 - DNA, 25 bp, Rattus norvegicus
agtgcagctcggtcctgggactctc

SEQ ID NO: 598425 - DNA, 25 bp, Rattus norvegicus
tgggactctctctcgcgtggccggc

SEQ ID NO: 598426 - DNA, 25 bp, Rattus norvegicus
tgcagcccgcacctcccgtggggct

SEQ ID NO: 598427 - DNA, 25 bp, Rattus norvegicus
ccgcccacttccgagtgtggactgt

SEQ ID NO: 598428 - DNA, 25 bp, Rattus norvegicus
ggagcgcagccagccgcacgatgca

SEQ ID NO: 598429 - DNA, 25 bp, Rattus norvegicus
aagcggtgaggattctgtgccgccc

SEQ ID NO: 598430 - DNA, 25 bp, Rattus norvegicus
caccaccttctgttggaaccctgaa

SEQ ID NO: 598431 - DNA, 25 bp, Rattus norvegicus
tggaaccctgaaactcaccggcgca

SEQ ID NO: 598432 - DNA, 25 bp, Rattus norvegicus
ctcctgtgaaagaatggtgctcggc

SEQ ID NO: 598433 - DNA, 25 bp, Rattus norvegicus
tgcattctctgccatacccgtctga

SEQ ID NO: 598434 - DNA, 25 bp, Rattus norvegicus
acccgtctgagcaacaggtgtgacc

SEQ ID NO: 598435 - DNA, 25 bp, Rattus norvegicus
tccggctcagagattcacgaaaatg

SEQ ID NO: 598436 - DNA, 25 bp, Rattus norvegicus
gaaaatgccagtcgccacgcctatg

SEQ ID NO: 598437 - DNA, 25 bp, Rattus norvegicus
gccacgcctatgaactccagcaatg

SEQ ID NO: 598438 - DNA, 25 bp, Rattus norvegicus
aatggtcgggaactttgcagcttgc

SEQ ID NO: 598439 - DNA, 25 bp, Rattus norvegicus
gcagcttgcttgttcctccctgagg

SEQ ID NO: 598440 - DNA, 25 bp, Rattus norvegicus
gggaggtgctcccacttcattgccc

SEQ ID NO: 598441 - DNA, 25 bp, Rattus norvegicus
cgggacaacgctacacggttgttca

SEQ ID NO: 598442 - DNA, 25 bp, Rattus norvegicus
cccggagtggaaaacttggaatgag

SEQ ID NO: 598443 - DNA, 25 bp, Rattus norvegicus
gcagcgtctgcaagttcgcgccgct

SEQ ID NO: 598444 - DNA, 25 bp, Rattus norvegicus
agtccgggtgaatccggcccgcgat

SEQ ID NO: 598445 - DNA, 25 bp, Rattus norvegicus
tcacgccggtgctgatccacgtaaa

SEQ ID NO: 598446 - DNA, 25 bp, Rattus norvegicus
tgatccacgtaaaggccgctcgtcg

SEQ ID NO: 598447 - DNA, 25 bp, Rattus norvegicus
cgaagataggggcaccgaaagccca

SEQ ID NO: 598448 - DNA, 25 bp, Rattus norvegicus
aggggcaccgaaagcccacagcctg

SEQ ID NO: 598449 - DNA, 25 bp, Rattus norvegicus
cccacagcctggtagaagggccagg

SEQ ID NO: 598450 - DNA, 25 bp, Rattus norvegicus
acgctcaccgcttccgtgaagcagt

SEQ ID NO: 598451 - DNA, 25 bp, Rattus norvegicus
cgcttccgtgaagcagtcagggccc

SEQ ID NO: 598452 - DNA, 25 bp, Rattus norvegicus
ggcggtgtccggataccatcatccg

SEQ ID NO: 598453 - DNA, 25 bp, Rattus norvegicus
catcgcggcgggagccagcttcctg

SEQ ID NO: 598454 - DNA, 25 bp, Rattus norvegicus
ctgctccgagccgagctgctcggtg

SEQ ID NO: 598455 - DNA, 25 bp, Rattus norvegicus
cctcgctgctacctgtttaactgca

SEQ ID NO: 598456 - DNA, 25 bp, Rattus norvegicus
tgtttaactgcacagcccgcggccg

SEQ ID NO: 598457 - DNA, 25 bp, Rattus norvegicus
gaagaagaatgtccgcaagccgaga

SEQ ID NO: 598458 - DNA, 25 bp, Rattus norvegicus
caagccgagacacaggggcaccaca

SEQ ID NO: 598459 - DNA, 25 bp, Rattus norvegicus
ccatcggggagcagcagccatggac

SEQ ID NO: 598460 - DNA, 25 bp, Rattus norvegicus
ggagcagcagccatggacctgcgct

SEQ ID NO: 598461 - DNA, 25 bp, Rattus norvegicus
agcctcagcaagagccacgaggtga

SEQ ID NO: 598462 - DNA, 25 bp, Rattus norvegicus
ccacgaggtgatgaagaagaatgtc

SEQ ID NO: 598463 - DNA, 25 bp, Rattus norvegicus
acacaggggcaccacaagcggcgcg

SEQ ID NO: 598464 - DNA, 25 bp, Rattus norvegicus
tgatgaagaagaatgtccgcaagcc

SEQ ID NO: 598465 - DNA, 25 bp, Rattus norvegicus
gcgccctggagctgctcagagtgtt

SEQ ID NO: 598466 - DNA, 25 bp, Rattus norvegicus
ctggagctgctcagagtgttcaagg

SEQ ID NO: 598467 - DNA, 25 bp, Rattus norvegicus
gttcaaggacaagcgcgcacttgag

SEQ ID NO: 598468 - DNA, 25 bp, Rattus norvegicus
ggacaagcgcgcacttgagctcatc

SEQ ID NO: 598469 - DNA, 25 bp, Rattus norvegicus
cgcgcacttgagctcatcaagacga

SEQ ID NO: 598470 - DNA, 25 bp, Rattus norvegicus
tcatcaagacgagggtgggcaccca

SEQ ID NO: 598471 - DNA, 25 bp, Rattus norvegicus
ataccgtggtacctgctgcgctctt

SEQ ID NO: 598472 - DNA, 25 bp, Rattus norvegicus
cgttagaaggtctcgcgcctgtgct

SEQ ID NO: 598473 - DNA, 25 bp, Rattus norvegicus
acagtctgctgcgttagaaggtctc

SEQ ID NO: 598474 - DNA, 25 bp, Rattus norvegicus
agagccgggtgccacatcgctgctg

SEQ ID NO: 598475 - DNA, 25 bp, Rattus norvegicus
acatcgctgctgctcagctccagga

SEQ ID NO: 598476 - DNA, 25 bp, Rattus norvegicus
gccgacacgcataccgtggtacctg

SEQ ID NO: 598477 - DNA, 25 bp, Rattus norvegicus
aatgcaaacagtctgctgcgttaga

SEQ ID NO: 598478 - DNA, 25 bp, Rattus norvegicus
gtacctgctgcgctcttcgtcacag

SEQ ID NO: 598479 - DNA, 25 bp, Rattus norvegicus
gtcacagccctctgcgctatcccgg

SEQ ID NO: 598480 - DNA, 25 bp, Rattus norvegicus
gctatcccggagctggcagcagtca

SEQ ID NO: 598481 - DNA, 25 bp, Rattus norvegicus
ccggagctggcagcagtcaggtccc

SEQ ID NO: 598482 - DNA, 25 bp, Rattus norvegicus
cccgctgcgcacgtgaatgcaaaca

SEQ ID NO: 598483 - DNA, 25 bp, Rattus norvegicus
cagcggcttccaccctggtcccaga

SEQ ID NO: 598484 - DNA, 25 bp, Rattus norvegicus
tcagctccaggagccgacacgcata

SEQ ID NO: 598485 - DNA, 25 bp, Rattus norvegicus
caagtgcttgtagccaatcggaggc

SEQ ID NO: 598486 - DNA, 25 bp, Rattus norvegicus
agaccatctacctgctctttcggaa

SEQ ID NO: 598487 - DNA, 25 bp, Rattus norvegicus
gcttccgccgctcaagtgcttgtag

SEQ ID NO: 598488 - DNA, 25 bp, Rattus norvegicus
gcctgtaaggaacctagagaccatc

SEQ ID NO: 598489 - DNA, 25 bp, Rattus norvegicus
ggcgactcgtgcactgccaagcttc

SEQ ID NO: 598490 - DNA, 25 bp, Rattus norvegicus
aagcttcagcaggagttcgctctcg

SEQ ID NO: 598491 - DNA, 25 bp, Rattus norvegicus
tcgctctcggaaaacgaaaagttgc

SEQ ID NO: 598492 - DNA, 25 bp, Rattus norvegicus
agttgcttttgtctatttcagtgta

SEQ ID NO: 598493 - DNA, 25 bp, Rattus norvegicus
caccagtcctcactgtggaaaagaa

SEQ ID NO: 598494 - DNA, 25 bp, Rattus norvegicus
ggagagtccctgaatgcgcaaattt

SEQ ID NO: 598495 - DNA, 25 bp, Rattus norvegicus
atttcgcgacgctccctcacttaag

SEQ ID NO: 598496 - DNA, 25 bp, Rattus norvegicus
ccctcacttaagacacgagcagaga

SEQ ID NO: 598497 - DNA, 25 bp, Rattus norvegicus
agagacgcgtgtgcactaagaacta

SEQ ID NO: 598498 - DNA, 25 bp, Rattus norvegicus
atttcccatgctgcaccgagtccga

SEQ ID NO: 598499 - DNA, 25 bp, Rattus norvegicus
gcgctgctggcctacaccgccaaca

SEQ ID NO: 598500 - DNA, 25 bp, Rattus norvegicus
acgttgccgcccaacaatttggcga

SEQ ID NO: 598501 - DNA, 25 bp, Rattus norvegicus
ctcaagaacgttgccgcccaacaat

SEQ ID NO: 598502 - DNA, 25 bp, Rattus norvegicus
gcttccgcgtccctcaagaacgttg

SEQ ID NO: 598503 - DNA, 25 bp, Rattus norvegicus
ggggctttgcttccgcgtccctcaa

SEQ ID NO: 598504 - DNA, 25 bp, Rattus norvegicus
ggacctggcgccaccgttaggctag

SEQ ID NO: 598505 - DNA, 25 bp, Rattus norvegicus
tgctccggaaccaccgatctcccgg

SEQ ID NO: 598506 - DNA, 25 bp, Rattus norvegicus
ccgaggccctgcaactgctccggaa

SEQ ID NO: 598507 - DNA, 25 bp, Rattus norvegicus
agaccctccactttctgctcaccga

SEQ ID NO: 598508 - DNA, 25 bp, Rattus norvegicus
taccttcaccacttctcgttcaaga

SEQ ID NO: 598509 - DNA, 25 bp, Rattus norvegicus
gctcccgggcccattaccttcacca

SEQ ID NO: 598510 - DNA, 25 bp, Rattus norvegicus
caaggagttcaacgcggcagtgcgc

SEQ ID NO: 598511 - DNA, 25 bp, Rattus norvegicus
acaatttggcgaggacaccttcttc

SEQ ID NO: 598512 - DNA, 25 bp, Rattus norvegicus
ccctgcacaaggagttcaacgcggc

SEQ ID NO: 598513 - DNA, 25 bp, Rattus norvegicus
tctccacgaagtcggccagactggc

SEQ ID NO: 598514 - DNA, 25 bp, Rattus norvegicus
gagcagcagccataggtgaggaccc

SEQ ID NO: 598515 - DNA, 25 bp, Rattus norvegicus
tgaggacccgcctgcgtgctggcat

SEQ ID NO: 598516 - DNA, 25 bp, Rattus norvegicus
cgccattcaacgttctccacgaagt

SEQ ID NO: 598517 - DNA, 25 bp, Rattus norvegicus
ccgaggtcgcacatccagctggtgc

SEQ ID NO: 598518 - DNA, 25 bp, Rattus norvegicus
cggcgcagcaacagagtaaaggtca

SEQ ID NO: 598519 - DNA, 25 bp, Rattus norvegicus
tggtgcccaccgtgcgtccatgagc

SEQ ID NO: 598520 - DNA, 25 bp, Rattus norvegicus
tccatgagccgaaggtcaggccgca

SEQ ID NO: 598521 - DNA, 25 bp, Rattus norvegicus
aagggaaggcagacacgtccacacg

SEQ ID NO: 598522 - DNA, 25 bp, Rattus norvegicus
acgtccacacggcacgagctgcgtg

SEQ ID NO: 598523 - DNA, 25 bp, Rattus norvegicus
gtcgtgccgcacaaccacgttggtg

SEQ ID NO: 598524 - DNA, 25 bp, Rattus norvegicus
aaccacgttggtgctggctgaggca

SEQ ID NO: 598525 - DNA, 25 bp, Rattus norvegicus
tgcgtgtccgccctgtagacaggag

SEQ ID NO: 598526 - DNA, 25 bp, Rattus norvegicus
aaaggtcacatctgggtagggctca

SEQ ID NO: 598527 - DNA, 25 bp, Rattus norvegicus
gtcacacgccgtctaccgtcagagg

SEQ ID NO: 598528 - DNA, 25 bp, Rattus norvegicus
gcgtagaggcccgactgcgtcacac

SEQ ID NO: 598529 - DNA, 25 bp, Rattus norvegicus
gagtgagagcccaggtccttccgtc

SEQ ID NO: 598530 - DNA, 25 bp, Rattus norvegicus
acttacagcggtgtgtctggagtga

SEQ ID NO: 598531 - DNA, 25 bp, Rattus norvegicus
gtcagcgctcccgacttacagcggt

SEQ ID NO: 598532 - DNA, 25 bp, Rattus norvegicus
aggggatgatctacctgcccagccc

SEQ ID NO: 598533 - DNA, 25 bp, Rattus norvegicus
tgccggtacagaggggatgatctac

SEQ ID NO: 598534 - DNA, 25 bp, Rattus norvegicus
gttgtccggcgcagatgccggtaca

SEQ ID NO: 598535 - DNA, 25 bp, Rattus norvegicus
attggcaggccggtccgccactcga

SEQ ID NO: 598536 - DNA, 25 bp, Rattus norvegicus
cccgttattcattgggtgacgagcg

SEQ ID NO: 598537 - DNA, 25 bp, Rattus norvegicus
tgggtgacgagcgttttgaaaccga

SEQ ID NO: 598538 - DNA, 25 bp, Rattus norvegicus
tgaaaccgaacgtgaaggcggtctc

SEQ ID NO: 598539 - DNA, 25 bp, Rattus norvegicus
aacgtgaaggcggtctctgattagg

SEQ ID NO: 598540 - DNA, 25 bp, Rattus norvegicus
acgccgtctaccgtcagaggtcggc

SEQ ID NO: 598541 - DNA, 25 bp, Rattus norvegicus
gcagacagcagaagcccgcgctgtc

SEQ ID NO: 598542 - DNA, 25 bp, Rattus norvegicus
actcaacccagccaccagcgatcgg

SEQ ID NO: 598543 - DNA, 25 bp, Rattus norvegicus
agccaccagcgatcggctcgcggtg

SEQ ID NO: 598544 - DNA, 25 bp, Rattus norvegicus
gcccgcccaacttgcagtgaacgaa

SEQ ID NO: 598545 - DNA, 25 bp, Rattus norvegicus
tgcagtgaacgaaaacctcccgccc

SEQ ID NO: 598546 - DNA, 25 bp, Rattus norvegicus
ccggctcgtgggtactcagtcccga

SEQ ID NO: 598547 - DNA, 25 bp, Rattus norvegicus
gctcgtgggtactcagtcccgaccg

SEQ ID NO: 598548 - DNA, 25 bp, Rattus norvegicus
gggtccctcgcagacagcagaagcc

SEQ ID NO: 598549 - DNA, 25 bp, Rattus norvegicus
acttccgagcctctcacggttcgga

SEQ ID NO: 598550 - DNA, 25 bp, Rattus norvegicus
ctcacggttcggatctcaggggtcc

SEQ ID NO: 598551 - DNA, 25 bp, Rattus norvegicus
gttcggatctcaggggtccctcgca

SEQ ID NO: 598552 - DNA, 25 bp, Rattus norvegicus
ggatctcaggggtccctcgcagaca

SEQ ID NO: 598553 - DNA, 25 bp, Rattus norvegicus
tctcaggggtccctcgcagacagca

SEQ ID NO: 598554 - DNA, 25 bp, Rattus norvegicus
gctgtccctgggatcccacactcaa

SEQ ID NO: 598555 - DNA, 25 bp, Rattus norvegicus
ttcagccttgaaggcctcggggtca

SEQ ID NO: 598556 - DNA, 25 bp, Rattus norvegicus
gactcggcctggcatcgggaccata

SEQ ID NO: 598557 - DNA, 25 bp, Rattus norvegicus
ttggccagcacgtccatcaagtagg

SEQ ID NO: 598558 - DNA, 25 bp, Rattus norvegicus
cgcgaccgccatccgtcttttttag

SEQ ID NO: 598559 - DNA, 25 bp, Rattus norvegicus
ccaggcgcagagtcttgatcttgga

SEQ ID NO: 598560 - DNA, 25 bp, Rattus norvegicus
ggcacattggggatgcactcacgca

SEQ ID NO: 598561 - DNA, 25 bp, Rattus norvegicus
agagcttggtgtccgcaggcacatt

SEQ ID NO: 598562 - DNA, 25 bp, Rattus norvegicus
cagctccgcgaacgcactgttaatg

SEQ ID NO: 598563 - DNA, 25 bp, Rattus norvegicus
gttaatgctctctgtgcgcctccgc

SEQ ID NO: 598564 - DNA, 25 bp, Rattus norvegicus
gcctccgctcctttttgggtcctga

SEQ ID NO: 598565 - DNA, 25 bp, Rattus norvegicus
ggtcctgaaccttttcgcctgggca

SEQ ID NO: 598566 - DNA, 25 bp, Rattus norvegicus
agctctggaagtaaggccgctcctg

SEQ ID NO: 598567 - DNA, 25 bp, Rattus norvegicus
cgggaccataggcagccgctgctac

SEQ ID NO: 598568 - DNA, 25 bp, Rattus norvegicus
gggtcacctgcttgtgcatccttgg

SEQ ID NO: 598569 - DNA, 25 bp, Rattus norvegicus
ctgcttggagcggtaggaccgcacc

SEQ ID NO: 598570 - DNA, 25 bp, Rattus norvegicus
cccaaaacaggatgtcgtgtcgtgg

SEQ ID NO: 598571 - DNA, 25 bp, Rattus norvegicus
aaacaggatgtcgtgtcgtggttcc

SEQ ID NO: 598572 - DNA, 25 bp, Rattus norvegicus
atgtcgtgtcgtggttccgcacctc

SEQ ID NO: 598573 - DNA, 25 bp, Rattus norvegicus
cgtgtcgtggttccgcacctcgcgg

SEQ ID NO: 598574 - DNA, 25 bp, Rattus norvegicus
cttgttccctgatcttgccttggcg

SEQ ID NO: 598575 - DNA, 25 bp, Rattus norvegicus
tgttccctgatcttgccttggcgcg

SEQ ID NO: 598576 - DNA, 25 bp, Rattus norvegicus
tgatcttgccttggcgcgcggctgc

SEQ ID NO: 598577 - DNA, 25 bp, Rattus norvegicus
gagacaagcgagtgggcggcctcgt

SEQ ID NO: 598578 - DNA, 25 bp, Rattus norvegicus
gcttggagcggtaggaccgcaccca

SEQ ID NO: 598579 - DNA, 25 bp, Rattus norvegicus
taggaccgcacccaggcttgaggtc

SEQ ID NO: 598580 - DNA, 25 bp, Rattus norvegicus
gcacccaggcttgaggtccggcctg

SEQ ID NO: 598581 - DNA, 25 bp, Rattus norvegicus
tccggcctgggccctggagacaagc

SEQ ID NO: 598582 - DNA, 25 bp, Rattus norvegicus
ttccctgatcttgccttggcgcgcg

SEQ ID NO: 598583 - DNA, 25 bp, Rattus norvegicus
ttaggatcctagagacatcggtgtc

SEQ ID NO: 598584 - DNA, 25 bp, Rattus norvegicus
ggacccacagttggaccggagactc

SEQ ID NO: 598585 - DNA, 25 bp, Rattus norvegicus
acgccgaagccctagctgctgaggc

SEQ ID NO: 598586 - DNA, 25 bp, Rattus norvegicus
tgacctcggcctaggagtcttagga

SEQ ID NO: 598587 - DNA, 25 bp, Rattus norvegicus
ttattccgggataagccggctctgg

SEQ ID NO: 598588 - DNA, 25 bp, Rattus norvegicus
tgagttacctgagcaactgcgtgtc

SEQ ID NO: 598589 - DNA, 25 bp, Rattus norvegicus
atccggatagggcagtagctgtcac

SEQ ID NO: 598590 - DNA, 25 bp, Rattus norvegicus
gtctgtcatcctagtgcggggtttc

SEQ ID NO: 598591 - DNA, 25 bp, Rattus norvegicus
cataatcacttcaggcggttccggg

SEQ ID NO: 598592 - DNA, 25 bp, Rattus norvegicus
tgggccaaacctagcgggaccataa

SEQ ID NO: 598593 - DNA, 25 bp, Rattus norvegicus
ggagactccgatccttctgcgtcca

SEQ ID NO: 598594 - DNA, 25 bp, Rattus norvegicus
gggcacttgaccttcggttgtcgaa

SEQ ID NO: 598595 - DNA, 25 bp, Rattus norvegicus
ctgcgtccaaacttggggcacttga

SEQ ID NO: 598596 - DNA, 25 bp, Rattus norvegicus
tgctcaaactctccggaagcagcta

SEQ ID NO: 598597 - DNA, 25 bp, Rattus norvegicus
aggagaaagtgctgtctgtccggca

SEQ ID NO: 598598 - DNA, 25 bp, Rattus norvegicus
gtttcaacctctcggtctgagcggc

SEQ ID NO: 598599 - DNA, 25 bp, Rattus norvegicus
tcctatcttcgcctcggagctgcta

SEQ ID NO: 598600 - DNA, 25 bp, Rattus norvegicus
cggagctgctaactggtctcgaacc

SEQ ID NO: 598601 - DNA, 25 bp, Rattus norvegicus
ctcagcacttcagcttctagcggcg

SEQ ID NO: 598602 - DNA, 25 bp, Rattus norvegicus
cttctagcggcgatgcatgtgatca

SEQ ID NO: 598603 - DNA, 25 bp, Rattus norvegicus
cgatgcatgtgatcaagcgaggtga

SEQ ID NO: 598604 - DNA, 25 bp, Rattus norvegicus
tttggttcgtcccttctggaggaga

SEQ ID NO: 598605 - DNA, 25 bp, Rattus norvegicus
agtgcccagcggttactctcgccag

SEQ ID NO: 598606 - DNA, 25 bp, Rattus norvegicus
gtctgtccggcagtttcaacctctc

SEQ ID NO: 598607 - DNA, 25 bp, Rattus norvegicus
attcgaattccgtcgcgttgctttg

SEQ ID NO: 598608 - DNA, 25 bp, Rattus norvegicus
cgttgctttgtacgtcacgggtggc

SEQ ID NO: 598609 - DNA, 25 bp, Rattus norvegicus
cgtcaaaaacgtcattcgaattccg

SEQ ID NO: 598610 - DNA, 25 bp, Rattus norvegicus
tgacagtcgtctctatcctatcttc

SEQ ID NO: 598611 - DNA, 25 bp, Rattus norvegicus
atccggtctcccttgctactcggtg

SEQ ID NO: 598612 - DNA, 25 bp, Rattus norvegicus
catcgggaaccctggatccggtctc

SEQ ID NO: 598613 - DNA, 25 bp, Rattus norvegicus
cccgagtccacggtacgagcttgta

SEQ ID NO: 598614 - DNA, 25 bp, Rattus norvegicus
ccttgctactcggtggtggggtcat

SEQ ID NO: 598615 - DNA, 25 bp, Rattus norvegicus
tcaggcagctccgtcaggcttgcgc

SEQ ID NO: 598616 - DNA, 25 bp, Rattus norvegicus
caggcttgcgccaggttgccaaagc

SEQ ID NO: 598617 - DNA, 25 bp, Rattus norvegicus
gcgccaggttgccaaagccgagcct

SEQ ID NO: 598618 - DNA, 25 bp, Rattus norvegicus
tccacggtacgagcttgtagggtga

SEQ ID NO: 598619 - DNA, 25 bp, Rattus norvegicus
ggagccaggcgatcttgtaaacatt

SEQ ID NO: 598620 - DNA, 25 bp, Rattus norvegicus
ggcgatcttgtaaacattcagtccc

SEQ ID NO: 598621 - DNA, 25 bp, Rattus norvegicus
tttaagggcggccaaagactgcgag

SEQ ID NO: 598622 - DNA, 25 bp, Rattus norvegicus
tgagcgcgaaactggaagacacccg

SEQ ID NO: 598623 - DNA, 25 bp, Rattus norvegicus
ctcagcactccgctggggctcgtta

SEQ ID NO: 598624 - DNA, 25 bp, Rattus norvegicus
gccagcaaaacatcgggaaccctgg

SEQ ID NO: 598625 - DNA, 25 bp, Rattus norvegicus
gagggcccagctcttgcctgggctc

SEQ ID NO: 598626 - DNA, 25 bp, Rattus norvegicus
tgcagacgttggacggaacagatcc

SEQ ID NO: 598627 - DNA, 25 bp, Rattus norvegicus
cggaacagatcctggcatgtgattc

SEQ ID NO: 598628 - DNA, 25 bp, Rattus norvegicus
tcctggcatgtgattcgtcggttcc

SEQ ID NO: 598629 - DNA, 25 bp, Rattus norvegicus
catgtgattcgtcggttcctgcgcc

SEQ ID NO: 598630 - DNA, 25 bp, Rattus norvegicus
attcgtcggttcctgcgccgtgggc

SEQ ID NO: 598631 - DNA, 25 bp, Rattus norvegicus
gatcctggagcgctacggaagtcgc

SEQ ID NO: 598632 - DNA, 25 bp, Rattus norvegicus
tacggaagtcgcgagggcccagctc

SEQ ID NO: 598633 - DNA, 25 bp, Rattus norvegicus
cgcgggcgcttgctccagcacactg

SEQ ID NO: 598634 - DNA, 25 bp, Rattus norvegicus
cctgcggggtactctgagccgagaa

SEQ ID NO: 598635 - DNA, 25 bp, Rattus norvegicus
acgttggacggaacagatcctggca

SEQ ID NO: 598636 - DNA, 25 bp, Rattus norvegicus
gaacaaccaatcacgccactctgag

SEQ ID NO: 598637 - DNA, 25 bp, Rattus norvegicus
cgccactctgagtgcagacgttgga

SEQ ID NO: 598638 - DNA, 25 bp, Rattus norvegicus
cagcacactgcggactggagctctg

SEQ ID NO: 598639 - DNA, 25 bp, Rattus norvegicus
gctccgagaggaagttttaaacaca

SEQ ID NO: 598640 - DNA, 25 bp, Rattus norvegicus
tgcctcagtgcgaacgccacttggc

SEQ ID NO: 598641 - DNA, 25 bp, Rattus norvegicus
tgatagctctgcctcagtgcgaacg

SEQ ID NO: 598642 - DNA, 25 bp, Rattus norvegicus
ttgcctggcctgatagctctgcctc

SEQ ID NO: 598643 - DNA, 25 bp, Rattus norvegicus
gtctccctgttggtttgcctggcct

SEQ ID NO: 598644 - DNA, 25 bp, Rattus norvegicus
gtgcgttggggtcagacagacaccc

SEQ ID NO: 598645 - DNA, 25 bp, Rattus norvegicus
ttttgtgcgaagagactgtccggga

SEQ ID NO: 598646 - DNA, 25 bp, Rattus norvegicus
acccggggctcagagtctccctgtt

SEQ ID NO: 598647 - DNA, 25 bp, Rattus norvegicus
ttggttttgtgcgaagagactgtcc

SEQ ID NO: 598648 - DNA, 25 bp, Rattus norvegicus
aaatatggcgccaggtcagcggttg

SEQ ID NO: 598649 - DNA, 25 bp, Rattus norvegicus
cgtcgagtttgaaaatatggcgcca

SEQ ID NO: 598650 - DNA, 25 bp, Rattus norvegicus
cgccggcgtcgagtttgaaaatatg

SEQ ID NO: 598651 - DNA, 25 bp, Rattus norvegicus
ttggtcccgcccatcccagaacacc

SEQ ID NO: 598652 - DNA, 25 bp, Rattus norvegicus
gttttaaacacagccgaagctccga

SEQ ID NO: 598653 - DNA, 25 bp, Rattus norvegicus
aaaccaactacaaggattctgctca

SEQ ID NO: 598654 - DNA, 25 bp, Rattus norvegicus
ccgacatgcggaaggtggcggccaa

SEQ ID NO: 598655 - DNA, 25 bp, Rattus norvegicus
acttgctggccgacatgcggaaggt

SEQ ID NO: 598656 - DNA, 25 bp, Rattus norvegicus
gagcaacttgctggccgacatgcgg

SEQ ID NO: 598657 - DNA, 25 bp, Rattus norvegicus
ctgagcaacttgctggccgacatgc

SEQ ID NO: 598658 - DNA, 25 bp, Rattus norvegicus
agcagtgcgtcatggggctgctcaa

SEQ ID NO: 598659 - DNA, 25 bp, Rattus norvegicus
ccctacgagcagtgcgtcatggggc

SEQ ID NO: 598660 - DNA, 25 bp, Rattus norvegicus
aactacaaggattctgctcagcgtc

SEQ ID NO: 598661 - DNA, 25 bp, Rattus norvegicus
acaaggattctgctcagcgtcgttc

SEQ ID NO: 598662 - DNA, 25 bp, Rattus norvegicus
aaggattctgctcagcgtcgttctt

SEQ ID NO: 598663 - DNA, 25 bp, Rattus norvegicus
cgcgggtgcctcacccagctcacca

SEQ ID NO: 598664 - DNA, 25 bp, Rattus norvegicus
tgcctcacccagctcaccaagttcg

SEQ ID NO: 598665 - DNA, 25 bp, Rattus norvegicus
tcgcgccctacgagcagtgcgtcat

SEQ ID NO: 598666 - DNA, 25 bp, Rattus norvegicus
gcgccctacgagcagtgcgtcatgg

SEQ ID NO: 598667 - DNA, 25 bp, Rattus norvegicus
ctccttttagggtcttaatcatatg

SEQ ID NO: 598668 - DNA, 25 bp, Rattus norvegicus
atgtgctccttttagggtcttaatc

SEQ ID NO: 598669 - DNA, 25 bp, Rattus norvegicus
tacatttggcactttctccccttta

SEQ ID NO: 598670 - DNA, 25 bp, Rattus norvegicus
tccctcttacatttggcactttctc

SEQ ID NO: 598671 - DNA, 25 bp, Rattus norvegicus
atttctattccctcttacatttggc

SEQ ID NO: 598672 - DNA, 25 bp, Rattus norvegicus
ttcatttctctctccatttctattc

SEQ ID NO: 598673 - DNA, 25 bp, Rattus norvegicus
ctccaaagtctttggttccgcagtg

SEQ ID NO: 598674 - DNA, 25 bp, Rattus norvegicus
caaagtctttggttccgcagtgcta

SEQ ID NO: 598675 - DNA, 25 bp, Rattus norvegicus
aagtctttggttccgcagtgctacc

SEQ ID NO: 598676 - DNA, 25 bp, Rattus norvegicus
cacgcacgcagcgaattccttccca

SEQ ID NO: 598677 - DNA, 25 bp, Rattus norvegicus
attccttcccagcatagtattttta

SEQ ID NO: 598678 - DNA, 25 bp, Rattus norvegicus
ccttcccagcatagtatttttaata

SEQ ID NO: 598679 - DNA, 25 bp, Rattus norvegicus
cccagcatagtatttttaatacttg

SEQ ID NO: 598680 - DNA, 25 bp, Rattus norvegicus
ttagcttttccctttcatttctctc

SEQ ID NO: 598681 - DNA, 25 bp, Rattus norvegicus
ctgggagggcaaacgaaacaccgct

SEQ ID NO: 598682 - DNA, 25 bp, Rattus norvegicus
cgcagagatgcgagccacaggtgct

SEQ ID NO: 598683 - DNA, 25 bp, Rattus norvegicus
ccacaggtgctgagagctttgtgcc

SEQ ID NO: 598684 - DNA, 25 bp, Rattus norvegicus
cggtgatgtcggcacaagctaagcg

SEQ ID NO: 598685 - DNA, 25 bp, Rattus norvegicus
cgtaccaaatgttaacggtgatgtc

SEQ ID NO: 598686 - DNA, 25 bp, Rattus norvegicus
cactgagaagccgtaccaaatgtta

SEQ ID NO: 598687 - DNA, 25 bp, Rattus norvegicus
accatgacgataggcactgagaagc

SEQ ID NO: 598688 - DNA, 25 bp, Rattus norvegicus
catccacgatgaccatgacgatagg

SEQ ID NO: 598689 - DNA, 25 bp, Rattus norvegicus
gcaatgaggatcacatccacgatga

SEQ ID NO: 598690 - DNA, 25 bp, Rattus norvegicus
cgagtatgacacagcaatgaggatc

SEQ ID NO: 598691 - DNA, 25 bp, Rattus norvegicus
ctcggaggatgagcgagtatgacac

SEQ ID NO: 598692 - DNA, 25 bp, Rattus norvegicus
ggcaaacgaaacaccgctcggagga

SEQ ID NO: 598693 - DNA, 25 bp, Rattus norvegicus
agctttgtgccgagcatcctgggag

SEQ ID NO: 598694 - DNA, 25 bp, Rattus norvegicus
aaacatgaggatgacgcagagatgc

SEQ ID NO: 598695 - DNA, 25 bp, Rattus norvegicus
cggcgtttcataggggacgacctga

SEQ ID NO: 598696 - DNA, 25 bp, Rattus norvegicus
gctaggtgagttcaggccgccgcca

SEQ ID NO: 598697 - DNA, 25 bp, Rattus norvegicus
tttcataggggacgacctgagaaga

SEQ ID NO: 598698 - DNA, 25 bp, Rattus norvegicus
cccttctgaggattccggcgtttca

SEQ ID NO: 598699 - DNA, 25 bp, Rattus norvegicus
aaaggagcggctccacaccctcagg

SEQ ID NO: 598700 - DNA, 25 bp, Rattus norvegicus
gcattccaagaaaggagcggctcca

SEQ ID NO: 598701 - DNA, 25 bp, Rattus norvegicus
cccatccgcattccaagaaaggagc

SEQ ID NO: 598702 - DNA, 25 bp, Rattus norvegicus
cgtttcctggcaacggccgagcgca

SEQ ID NO: 598703 - DNA, 25 bp, Rattus norvegicus
gtcgacgctcgtttcctggcaacgg

SEQ ID NO: 598704 - DNA, 25 bp, Rattus norvegicus
cccagctagagcgtcgacgctcgtt

SEQ ID NO: 598705 - DNA, 25 bp, Rattus norvegicus
gtaccagctcattggccgggcccgg

SEQ ID NO: 598706 - DNA, 25 bp, Rattus norvegicus
tagacagcggcgtaccagctcattg

SEQ ID NO: 598707 - DNA, 25 bp, Rattus norvegicus
agtgacgcaccgctagacagcggcg

SEQ ID NO: 598708 - DNA, 25 bp, Rattus norvegicus
gcgaacctcacgcaaccgcccagtg

SEQ ID NO: 598709 - DNA, 25 bp, Rattus norvegicus
gatccgccgagtccagtgaccttga

SEQ ID NO: 598710 - DNA, 25 bp, Rattus norvegicus
cagtgaccttgacgccacgggcaat

SEQ ID NO: 598711 - DNA, 25 bp, Rattus norvegicus
tagggcagtaaatcaaggacctgtc

SEQ ID NO: 598712 - DNA, 25 bp, Rattus norvegicus
tcaaggacctgtcagggttcgggta

SEQ ID NO: 598713 - DNA, 25 bp, Rattus norvegicus
ttcgggtaattacaggaactccata

SEQ ID NO: 598714 - DNA, 25 bp, Rattus norvegicus
ccttatctaaatagggcagtaaatc

SEQ ID NO: 598715 - DNA, 25 bp, Rattus norvegicus
gcctgtttatattagcgcggtgtaa

SEQ ID NO: 598716 - DNA, 25 bp, Rattus norvegicus
gcgctataaatcagccctcgggcca

SEQ ID NO: 598717 - DNA, 25 bp, Rattus norvegicus
gtcgcgcaggaacgcgctataaatc

SEQ ID NO: 598718 - DNA, 25 bp, Rattus norvegicus
ttagggaatcgcgtcgcgcaggaac

SEQ ID NO: 598719 - DNA, 25 bp, Rattus norvegicus
cgcggtgtaaaatattctcgctgtc

SEQ ID NO: 598720 - DNA, 25 bp, Rattus norvegicus
ggccggccgcctgtttatattagcg

SEQ ID NO: 598721 - DNA, 25 bp, Rattus norvegicus
tctcgctgtcttagggaatcgcgtc

SEQ ID NO: 598722 - DNA, 25 bp, Rattus norvegicus
ctcgggccatttgctgcggcagcct

SEQ ID NO: 598723 - DNA, 25 bp, Rattus norvegicus
tagagcctggaaccggctgaggtta

SEQ ID NO: 598724 - DNA, 25 bp, Rattus norvegicus
ggaaccggtgctagagctcgcttag

SEQ ID NO: 598725 - DNA, 25 bp, Rattus norvegicus
tgctagagctcgcttagcagagcta

SEQ ID NO: 598726 - DNA, 25 bp, Rattus norvegicus
ttagcagagctaagtgggacttcac

SEQ ID NO: 598727 - DNA, 25 bp, Rattus norvegicus
agtgggacttcactggagccatgga

SEQ ID NO: 598728 - DNA, 25 bp, Rattus norvegicus
ctgctcaagctgaaccgcagcgtgc

SEQ ID NO: 598729 - DNA, 25 bp, Rattus norvegicus
aaccgcagcgtgcagggaccaggac

SEQ ID NO: 598730 - DNA, 25 bp, Rattus norvegicus
gggtgtctcccttctcaacagcagt

SEQ ID NO: 598731 - DNA, 25 bp, Rattus norvegicus
caacagcagtagtgccgggaacctc

SEQ ID NO: 598732 - DNA, 25 bp, Rattus norvegicus
tgccgggaacctcagctgtgaaccc

SEQ ID NO: 598733 - DNA, 25 bp, Rattus norvegicus
cagtcactcaggagcgcgcgctgaa

SEQ ID NO: 598734 - DNA, 25 bp, Rattus norvegicus
gtcacctggtgggacaaaaagccgc

SEQ ID NO: 598735 - DNA, 25 bp, Rattus norvegicus
aaaagccgcctagagcctggaaccg

SEQ ID NO: 598736 - DNA, 25 bp, Rattus norvegicus
cgccgagagtcacctggtgggacaa

SEQ ID NO: 598737 - DNA, 25 bp, Rattus norvegicus
agcccacgcgctccgccttggccag

SEQ ID NO: 598738 - DNA, 25 bp, Rattus norvegicus
agcaacccgtggttggcctccagtc

SEQ ID NO: 598739 - DNA, 25 bp, Rattus norvegicus
tgcactgcccgctcctgggctgcgt

SEQ ID NO: 598740 - DNA, 25 bp, Rattus norvegicus
agcttctccagcaaagtcaccacgg

SEQ ID NO: 598741 - DNA, 25 bp, Rattus norvegicus
cagcagctgcgccagtgtgttgctg

SEQ ID NO: 598742 - DNA, 25 bp, Rattus norvegicus
ttctccagcaaagtcaccacggtga

SEQ ID NO: 598743 - DNA, 25 bp, Rattus norvegicus
ccttggccagcagctgcgccagtgt

SEQ ID NO: 598744 - DNA, 25 bp, Rattus norvegicus
ctctagcatggtggccagcttctcc

SEQ ID NO: 598745 - DNA, 25 bp, Rattus norvegicus
tcccgcagcgcctctagcatggtgg

SEQ ID NO: 598746 - DNA, 25 bp, Rattus norvegicus
cgcctctagcatggtggccagcttc

SEQ ID NO: 598747 - DNA, 25 bp, Rattus norvegicus
gccactctggatgcggcgcaccgag

SEQ ID NO: 598748 - DNA, 25 bp, Rattus norvegicus
tcagcgcgcccaggccactctggat

SEQ ID NO: 598749 - DNA, 25 bp, Rattus norvegicus
tgtcgtggctgcgactcagcgcgcc

SEQ ID NO: 598750 - DNA, 25 bp, Rattus norvegicus
agtcaccacggtgacggcgtgcacc

SEQ ID NO: 598751 - DNA, 25 bp, Rattus norvegicus
caggcctccagtgtatcccgcacgg

SEQ ID NO: 598752 - DNA, 25 bp, Rattus norvegicus
cacggctccacccagctcccaggac

SEQ ID NO: 598753 - DNA, 25 bp, Rattus norvegicus
atcaactcacctcggcgtctgcagg

SEQ ID NO: 598754 - DNA, 25 bp, Rattus norvegicus
tgcagggccctggtcgtgcaccgac

SEQ ID NO: 598755 - DNA, 25 bp, Rattus norvegicus
accgacgccgggagacgcgcctaga

SEQ ID NO: 598756 - DNA, 25 bp, Rattus norvegicus
gcgcctagagcacggagtctgatcc

SEQ ID NO: 598757 - DNA, 25 bp, Rattus norvegicus
ttgaccctttcgcgagctctgcggc

SEQ ID NO: 598758 - DNA, 25 bp, Rattus norvegicus
tgcagacccttgaccctttcgcgag

SEQ ID NO: 598759 - DNA, 25 bp, Rattus norvegicus
tgcgagcagcactagctgcagctgc

SEQ ID NO: 598760 - DNA, 25 bp, Rattus norvegicus
cgagcgagtgcgagcagcactagct

SEQ ID NO: 598761 - DNA, 25 bp, Rattus norvegicus
aagctgcagggctccggcaacaccg

SEQ ID NO: 598762 - DNA, 25 bp, Rattus norvegicus
cacggagtctgatccgccagcgaag

SEQ ID NO: 598763 - DNA, 25 bp, Rattus norvegicus
tctgatccgccagcgaaggagggaa

SEQ ID NO: 598764 - DNA, 25 bp, Rattus norvegicus
aaggtggctcaagctgcagggctcc

SEQ ID NO: 598765 - DNA, 25 bp, Rattus norvegicus
cagcactgagaggagcaggtcgcct

SEQ ID NO: 598766 - DNA, 25 bp, Rattus norvegicus
gtacatggagctcggcctacgcact

SEQ ID NO: 598767 - DNA, 25 bp, Rattus norvegicus
cgtgctgtgtacaccagctcatatg

SEQ ID NO: 598768 - DNA, 25 bp, Rattus norvegicus
aggtcgccttctgtacgtgctgtgt

SEQ ID NO: 598769 - DNA, 25 bp, Rattus norvegicus
tcctaccaacacgaaagacgagttc

SEQ ID NO: 598770 - DNA, 25 bp, Rattus norvegicus
gcacatgactgccaggaccaccggg

SEQ ID NO: 598771 - DNA, 25 bp, Rattus norvegicus
ccggctgtccatagagcagcactga

SEQ ID NO: 598772 - DNA, 25 bp, Rattus norvegicus
tgtggtccaccaccggtaccgcaag

SEQ ID NO: 598773 - DNA, 25 bp, Rattus norvegicus
gacgagttcatcctcaattggattg

SEQ ID NO: 598774 - DNA, 25 bp, Rattus norvegicus
tggattgtctttccgtttgccaccg

SEQ ID NO: 598775 - DNA, 25 bp, Rattus norvegicus
ttgccaccggtgctgtacatggagc

SEQ ID NO: 598776 - DNA, 25 bp, Rattus norvegicus
acgcactgccttctggcgcacatga

SEQ ID NO: 598777 - DNA, 25 bp, Rattus norvegicus
ccgggagacttgacccggcgcttca

SEQ ID NO: 598778 - DNA, 25 bp, Rattus norvegicus
ccggcgcttcacatcatctggggaa

SEQ ID NO: 598779 - DNA, 25 bp, Rattus norvegicus
tggacagagacaggagcagcttttg

SEQ ID NO: 598780 - DNA, 25 bp, Rattus norvegicus
tgagcagccacagcccaaagaatcc

SEQ ID NO: 598781 - DNA, 25 bp, Rattus norvegicus
cccggtgctctcacagacacggaca

SEQ ID NO: 598782 - DNA, 25 bp, Rattus norvegicus
tggacctcacgtgagcagccacagc

SEQ ID NO: 598783 - DNA, 25 bp, Rattus norvegicus
acgcctcacgtggacagagacagga

SEQ ID NO: 598784 - DNA, 25 bp, Rattus norvegicus
cagcttttgaaaagcatctgcgccc

SEQ ID NO: 598785 - DNA, 25 bp, Rattus norvegicus
gctcggacccacacaccgtcgctag

SEQ ID NO: 598786 - DNA, 25 bp, Rattus norvegicus
accgtcgctagcaccaggatccaca

SEQ ID NO: 598787 - DNA, 25 bp, Rattus norvegicus
atacactggaggactagacgcaccc

SEQ ID NO: 598788 - DNA, 25 bp, Rattus norvegicus
aacccgcgctcctaaaatgaaccat

SEQ ID NO: 598789 - DNA, 25 bp, Rattus norvegicus
caaacatggacctcacgtgagcagc

SEQ ID NO: 598790 - DNA, 25 bp, Rattus norvegicus
cagacacggacacgcctcacgtgga

SEQ ID NO: 598791 - DNA, 25 bp, Rattus norvegicus
agtgcaaggcccggactgcagccac

SEQ ID NO: 598792 - DNA, 25 bp, Rattus norvegicus
gaggactagacgcacccttggggcc

SEQ ID NO: 598793 - DNA, 25 bp, Rattus norvegicus
tccggacggaagtggcgtacgccat

SEQ ID NO: 598794 - DNA, 25 bp, Rattus norvegicus
agccggccacgtcgcagagaaaaag

SEQ ID NO: 598795 - DNA, 25 bp, Rattus norvegicus
tgtttccaggggtacacgcaagaac

SEQ ID NO: 598796 - DNA, 25 bp, Rattus norvegicus
gtgcgttcaacttcccttcgtccaa

SEQ ID NO: 598797 - DNA, 25 bp, Rattus norvegicus
tccaagtacgtccttctcacctggg

SEQ ID NO: 598798 - DNA, 25 bp, Rattus norvegicus
gttccagttcccgtcgcgatcctag

SEQ ID NO: 598799 - DNA, 25 bp, Rattus norvegicus
cctagcagcaggtcagagatttggc

SEQ ID NO: 598800 - DNA, 25 bp, Rattus norvegicus
atttggcggaagtgacatgctctct

SEQ ID NO: 598801 - DNA, 25 bp, Rattus norvegicus
gttagacgcgcagtttgtttccagg

SEQ ID NO: 598802 - DNA, 25 bp, Rattus norvegicus
ctctctgggcagaagaagccggcca

SEQ ID NO: 598803 - DNA, 25 bp, Rattus norvegicus
taagttgctctctgggttagacgcg

SEQ ID NO: 598804 - DNA, 25 bp, Rattus norvegicus
gcgagcctggagctacgccttcaag

SEQ ID NO: 598805 - DNA, 25 bp, Rattus norvegicus
gcagcagcaactgagaaacgtgagt

SEQ ID NO: 598806 - DNA, 25 bp, Rattus norvegicus
aacgtgagtgagagctaagttgctc

SEQ ID NO: 598807 - DNA, 25 bp, Rattus norvegicus
ccggagctgatctagccactgcaga

SEQ ID NO: 598808 - DNA, 25 bp, Rattus norvegicus
agaaccctcgccatctcgaatgaga

SEQ ID NO: 598809 - DNA, 25 bp, Rattus norvegicus
tgccagagaacccagctaaaggcta

SEQ ID NO: 598810 - DNA, 25 bp, Rattus norvegicus
gatcgacggatcaccaggacacaga

SEQ ID NO: 598811 - DNA, 25 bp, Rattus norvegicus
aggacacagagcctatccaacgctg

SEQ ID NO: 598812 - DNA, 25 bp, Rattus norvegicus
atcctccctcttctacgtgcaaata

SEQ ID NO: 598813 - DNA, 25 bp, Rattus norvegicus
tacgagcattcaacacgagaccctg

SEQ ID NO: 598814 - DNA, 25 bp, Rattus norvegicus
cgcaacgcgcactcaagattccaga

SEQ ID NO: 598815 - DNA, 25 bp, Rattus norvegicus
tccagcgtcaatatgcgcggctccg

SEQ ID NO: 598816 - DNA, 25 bp, Rattus norvegicus
cgccgtattaagttccgacgcaatg

SEQ ID NO: 598817 - DNA, 25 bp, Rattus norvegicus
gacgcaatgcgcctggctcagtgta

SEQ ID NO: 598818 - DNA, 25 bp, Rattus norvegicus
gaggtctctgaggaagcaatgcttc

SEQ ID NO: 598819 - DNA, 25 bp, Rattus norvegicus
ggcgctagcttacctccaaaacgcg

SEQ ID NO: 598820 - DNA, 25 bp, Rattus norvegicus
tcagtgtacacgcatagcctttttg

SEQ ID NO: 598821 - DNA, 25 bp, Rattus norvegicus
cggagcagagcaccatcgagtgtaa

SEQ ID NO: 598822 - DNA, 25 bp, Rattus norvegicus
atctctacagtagctctgagccggg

SEQ ID NO: 598823 - DNA, 25 bp, Rattus norvegicus
tggagccagaccaaactcggccgga

SEQ ID NO: 598824 - DNA, 25 bp, Rattus norvegicus
ggacgctgctatggacgacattttc

SEQ ID NO: 598825 - DNA, 25 bp, Rattus norvegicus
aagccgtgttctagggccgtgactc

SEQ ID NO: 598826 - DNA, 25 bp, Rattus norvegicus
attttcactcagtgccgggagggca

SEQ ID NO: 598827 - DNA, 25 bp, Rattus norvegicus
gccctgttccatgctggtcttgcaa

SEQ ID NO: 598828 - DNA, 25 bp, Rattus norvegicus
cgagtgtaaccgctcctgagctaga

SEQ ID NO: 598829 - DNA, 25 bp, Rattus norvegicus
aactcttcaaatagcccggtgcagg

SEQ ID NO: 598830 - DNA, 25 bp, Rattus norvegicus
ggccggaagccaccgagagaaattc

SEQ ID NO: 598831 - DNA, 25 bp, Rattus norvegicus
tccgagaatcctaggactggagcca

SEQ ID NO: 598832 - DNA, 25 bp, Rattus norvegicus
ttcgggctcctcaaacataccggtg

SEQ ID NO: 598833 - DNA, 25 bp, Rattus norvegicus
cagtcgccgcctgaacctgtgttgt

SEQ ID NO: 598834 - DNA, 25 bp, Rattus norvegicus
ccgctgacgccaactcaggaaacta

SEQ ID NO: 598835 - DNA, 25 bp, Rattus norvegicus
tcgcccaggcgcacgttgcgtgacg

SEQ ID NO: 598836 - DNA, 25 bp, Rattus norvegicus
gcggcaaccagagctacttccgctt

SEQ ID NO: 598837 - DNA, 25 bp, Rattus norvegicus
ggaaaggcggcaaccagagctactt

SEQ ID NO: 598838 - DNA, 25 bp, Rattus norvegicus
ctgcagtggcgactccagctccagg

SEQ ID NO: 598839 - DNA, 25 bp, Rattus norvegicus
tggctttgctctccgcggccgtgct

SEQ ID NO: 598840 - DNA, 25 bp, Rattus norvegicus
cgtgcctgcagtggcgactccagct

SEQ ID NO: 598841 - DNA, 25 bp, Rattus norvegicus
gtgagaagcgcagggtccccccaac

SEQ ID NO: 598842 - DNA, 25 bp, Rattus norvegicus
gaatcaacaacacaggtgagaagcg

SEQ ID NO: 598843 - DNA, 25 bp, Rattus norvegicus
ccgaagctgaaggagaatcaacaac

SEQ ID NO: 598844 - DNA, 25 bp, Rattus norvegicus
cgcctgctgccaccgaagctgaagg

SEQ ID NO: 598845 - DNA, 25 bp, Rattus norvegicus
gggcttcacttctccgttggccgcg

SEQ ID NO: 598846 - DNA, 25 bp, Rattus norvegicus
cgcacgttgcgtgacgtcacagttc

SEQ ID NO: 598847 - DNA, 25 bp, Rattus norvegicus
ctctccgcggccgtgctagtgggca

SEQ ID NO: 598848 - DNA, 25 bp, Rattus norvegicus
gctgcggcacccagtcggagattcc

SEQ ID NO: 598849 - DNA, 25 bp, Rattus norvegicus
ctcagctcgctgttcacggtccaag

SEQ ID NO: 598850 - DNA, 25 bp, Rattus norvegicus
gccggcccagactcaaagtccaaga

SEQ ID NO: 598851 - DNA, 25 bp, Rattus norvegicus
tgctcgttctcgtcttgcacgcgca

SEQ ID NO: 598852 - DNA, 25 bp, Rattus norvegicus
ccgcgtctgaagcacggaaagtata

SEQ ID NO: 598853 - DNA, 25 bp, Rattus norvegicus
tcagcaggcggtatcgcacgtcact

SEQ ID NO: 598854 - DNA, 25 bp, Rattus norvegicus
cgatccagaccacgaggagcgctga

SEQ ID NO: 598855 - DNA, 25 bp, Rattus norvegicus
tgtggcttccacgatcagcaacagc

SEQ ID NO: 598856 - DNA, 25 bp, Rattus norvegicus
tttcatccgtgacaaagacccgcgc

SEQ ID NO: 598857 - DNA, 25 bp, Rattus norvegicus
acaggggcgttgtcattttcatccg

SEQ ID NO: 598858 - DNA, 25 bp, Rattus norvegicus
tctggatcccgagctaccacgtgca

SEQ ID NO: 598859 - DNA, 25 bp, Rattus norvegicus
cggacagcgctcctagagatcaaga

SEQ ID NO: 598860 - DNA, 25 bp, Rattus norvegicus
gggtgcctcgtcgttgacgtcaaca

SEQ ID NO: 598861 - DNA, 25 bp, Rattus norvegicus
tgacgttgtactcctgctgagggaa

SEQ ID NO: 598862 - DNA, 25 bp, Rattus norvegicus
agttggtagcctgccttagctttcc

SEQ ID NO: 598863 - DNA, 25 bp, Rattus norvegicus
cccggtgtctcgtgagcatggccct

SEQ ID NO: 598864 - DNA, 25 bp, Rattus norvegicus
atcggcgtgggcatctagtagcgca

SEQ ID NO: 598865 - DNA, 25 bp, Rattus norvegicus
ctttgcaactttgcggttcggggag

SEQ ID NO: 598866 - DNA, 25 bp, Rattus norvegicus
ccgagcggagtctgcctttgaactt

SEQ ID NO: 598867 - DNA, 25 bp, Rattus norvegicus
tgaacatgtgtcacggctccgagcg

SEQ ID NO: 598868 - DNA, 25 bp, Rattus norvegicus
ctggagagtgcgtgttcagtgaaca

SEQ ID NO: 598869 - DNA, 25 bp, Rattus norvegicus
tttcctatgcgtgtcggcgcctgga

SEQ ID NO: 598870 - DNA, 25 bp, Rattus norvegicus
cctgtgtgccctgtgtttcctatgc

SEQ ID NO: 598871 - DNA, 25 bp, Rattus norvegicus
caacggcatgcctcgggcctagctt

SEQ ID NO: 598872 - DNA, 25 bp, Rattus norvegicus
agtgacgcgggcgtttccttcagag

SEQ ID NO: 598873 - DNA, 25 bp, Rattus norvegicus
ggtgaacggacagccgcctccaggt

SEQ ID NO: 598874 - DNA, 25 bp, Rattus norvegicus
tagtagcgcaccactcgggcacagc

SEQ ID NO: 598875 - DNA, 25 bp, Rattus norvegicus
tgaacccgtggacgaagcacgcgcc

SEQ ID NO: 598876 - DNA, 25 bp, Rattus norvegicus
agcatggcccttgagtttgaccgtc

SEQ ID NO: 598877 - DNA, 25 bp, Rattus norvegicus
taggcctgtgagcaagttccgtaga

SEQ ID NO: 598878 - DNA, 25 bp, Rattus norvegicus
gcccatgtcgcctcgatgcgttcgt

SEQ ID NO: 598879 - DNA, 25 bp, Rattus norvegicus
tgcgttcgtggcgaactaggcctgt

SEQ ID NO: 598880 - DNA, 25 bp, Rattus norvegicus
gggtttctcctgcactgcctcaacg

SEQ ID NO: 598881 - DNA, 25 bp, Rattus norvegicus
tccgtagaaggtggatccgggactc

SEQ ID NO: 598882 - DNA, 25 bp, Rattus norvegicus
agcggcagctaaagacaacctcatg

SEQ ID NO: 598883 - DNA, 25 bp, Rattus norvegicus
tcactttccagaggacgcatgcgca

SEQ ID NO: 598884 - DNA, 25 bp, Rattus norvegicus
cgttctcggctgagtcgcctgccag

SEQ ID NO: 598885 - DNA, 25 bp, Rattus norvegicus
agagcctgcctagctggcagtctga

SEQ ID NO: 598886 - DNA, 25 bp, Rattus norvegicus
ggcccgacgtgttgacgtttctgga

SEQ ID NO: 598887 - DNA, 25 bp, Rattus norvegicus
gcctcaaggtctgcgggtgctaagt

SEQ ID NO: 598888 - DNA, 25 bp, Rattus norvegicus
tgctaagtagcgagctagggatctc

SEQ ID NO: 598889 - DNA, 25 bp, Rattus norvegicus
cttgcgcatgcgcatcagagcctgc

SEQ ID NO: 598890 - DNA, 25 bp, Rattus norvegicus
tgcctcaacgacctggggcgttctc

SEQ ID NO: 598891 - DNA, 25 bp, Rattus norvegicus
tgcacagcacgatgtacacgatgtc

SEQ ID NO: 598892 - DNA, 25 bp, Rattus norvegicus
gtccatgcacagcacgatgtacacg

SEQ ID NO: 598893 - DNA, 25 bp, Rattus norvegicus
ttgtccatgcacagcacgatgtaca

SEQ ID NO: 598894 - DNA, 25 bp, Rattus norvegicus
ctgccgtgcttgtccatgcacagca

SEQ ID NO: 598895 - DNA, 25 bp, Rattus norvegicus
ggtctccctgccgtgcttgtccatg

SEQ ID NO: 598896 - DNA, 25 bp, Rattus norvegicus
ggccgtgaacttgccagtgtcctgc

SEQ ID NO: 598897 - DNA, 25 bp, Rattus norvegicus
agggcccagagacctgctaggctga

SEQ ID NO: 598898 - DNA, 25 bp, Rattus norvegicus
cacagcacgatgtacacgatgtcca

SEQ ID NO: 598899 - DNA, 25 bp, Rattus norvegicus
acttgccagtgtcctgcagggcgct

SEQ ID NO: 598900 - DNA, 25 bp, Rattus norvegicus
gatgtacacgatgtccatgcccagc

SEQ ID NO: 598901 - DNA, 25 bp, Rattus norvegicus
tgtacacgatgtccatgcccagcgc

SEQ ID NO: 598902 - DNA, 25 bp, Rattus norvegicus
acgatgtacacgatgtccatgccca

SEQ ID NO: 598903 - DNA, 25 bp, Rattus norvegicus
agcacgatgtacacgatgtccatgc

SEQ ID NO: 598904 - DNA, 25 bp, Rattus norvegicus
tcagggcccagagacctgctaggct

SEQ ID NO: 598905 - DNA, 25 bp, Rattus norvegicus
ctctttctgtgtggggtctttgtgt

SEQ ID NO: 598906 - DNA, 25 bp, Rattus norvegicus
tggcctgggagctggtccagccgtc

SEQ ID NO: 598907 - DNA, 25 bp, Rattus norvegicus
actggccagggctcgagccaaggcc

SEQ ID NO: 598908 - DNA, 25 bp, Rattus norvegicus
gtgtcctggacaggccggcgagcac

SEQ ID NO: 598909 - DNA, 25 bp, Rattus norvegicus
ctgagtctgcgggttcgccctgggt

SEQ ID NO: 598910 - DNA, 25 bp, Rattus norvegicus
ccggagccatgacggccaaggaggc

SEQ ID NO: 598911 - DNA, 25 bp, Rattus norvegicus
ctgtgccggagccatgacggccaag

SEQ ID NO: 598912 - DNA, 25 bp, Rattus norvegicus
taagagtaattgtgggagaggggcc

SEQ ID NO: 598913 - DNA, 25 bp, Rattus norvegicus
gttctctttctgtgtggggtctttg

SEQ ID NO: 598914 - DNA, 25 bp, Rattus norvegicus
tgaagttctctttctgtgtggggtc

SEQ ID NO: 598915 - DNA, 25 bp, Rattus norvegicus
gggctcttggatccggtttgccaga

SEQ ID NO: 598916 - DNA, 25 bp, Rattus norvegicus
atgggctcttggatccggtttgcca

SEQ ID NO: 598917 - DNA, 25 bp, Rattus norvegicus
ttttgatgggctcttggatccggtt

SEQ ID NO: 598918 - DNA, 25 bp, Rattus norvegicus
cgctgtgccggagccatgacggcca

SEQ ID NO: 598919 - DNA, 25 bp, Rattus norvegicus
ggaccttaacagcaggcggtggccc

SEQ ID NO: 598920 - DNA, 25 bp, Rattus norvegicus
ccgcactggctttccctacggaggg

SEQ ID NO: 598921 - DNA, 25 bp, Rattus norvegicus
gcctcgtacgtgcacgtgatccatg

SEQ ID NO: 598922 - DNA, 25 bp, Rattus norvegicus
tgatccatgcgctggagtctggccc

SEQ ID NO: 598923 - DNA, 25 bp, Rattus norvegicus
agctctggcccgctatgcccaggtg

SEQ ID NO: 598924 - DNA, 25 bp, Rattus norvegicus
tggttccagcctctgcctgtcctgt

SEQ ID NO: 598925 - DNA, 25 bp, Rattus norvegicus
agctgcaggtgtcgccgggttcctt

SEQ ID NO: 598926 - DNA, 25 bp, Rattus norvegicus
gcagcggtcgcctcagcagctctat

SEQ ID NO: 598927 - DNA, 25 bp, Rattus norvegicus
ctcagcagctctatggtgtttacca

SEQ ID NO: 598928 - DNA, 25 bp, Rattus norvegicus
atggtgtttaccaggcctgccttgg

SEQ ID NO: 598929 - DNA, 25 bp, Rattus norvegicus
ccttggcagcgaggatgactggaac

SEQ ID NO: 598930 - DNA, 25 bp, Rattus norvegicus
cgacgagcaggacgatagctccaca

SEQ ID NO: 598931 - DNA, 25 bp, Rattus norvegicus
cgcctaccaggaccttaacagcagg

SEQ ID NO: 598932 - DNA, 25 bp, Rattus norvegicus
gcaggacgatagctccacagtggca

SEQ ID NO: 598933 - DNA, 25 bp, Rattus norvegicus
gagcgcgactactccgagcatccta

SEQ ID NO: 598934 - DNA, 25 bp, Rattus norvegicus
tgagagctactcgagccgcgactac

SEQ ID NO: 598935 - DNA, 25 bp, Rattus norvegicus
actatggccactcgagcgcgcgaga

SEQ ID NO: 598936 - DNA, 25 bp, Rattus norvegicus
cgaaaccgctttcggcaagtatggc

SEQ ID NO: 598937 - DNA, 25 bp, Rattus norvegicus
gcgactacacctaccgcgactatgg

SEQ ID NO: 598938 - DNA, 25 bp, Rattus norvegicus
tatgccactgaagcgcggaccaccg

SEQ ID NO: 598939 - DNA, 25 bp, Rattus norvegicus
gggatttcgacctgcgaccttcgcg

SEQ ID NO: 598940 - DNA, 25 bp, Rattus norvegicus
tggcccaggccaccaagccggtgtt

SEQ ID NO: 598941 - DNA, 25 bp, Rattus norvegicus
caagtccctggatggtaaggccatc

SEQ ID NO: 598942 - DNA, 25 bp, Rattus norvegicus
cgcccgagacatgaacggccaagtc

SEQ ID NO: 598943 - DNA, 25 bp, Rattus norvegicus
aagtccagaggcttcgccttcgtca

SEQ ID NO: 598944 - DNA, 25 bp, Rattus norvegicus
tcctgatgaaggaccgggaaacctc

SEQ ID NO: 598945 - DNA, 25 bp, Rattus norvegicus
ggccgcatcatcgaggtgctcctga

SEQ ID NO: 598946 - DNA, 25 bp, Rattus norvegicus
gcgcgcgagatgaatgcccttccag

SEQ ID NO: 598947 - DNA, 25 bp, Rattus norvegicus
gcgccttttctgcagcggcggtgaa

SEQ ID NO: 598948 - DNA, 25 bp, Rattus norvegicus
aggcttgaaggagccacgcccgcca

SEQ ID NO: 598949 - DNA, 25 bp, Rattus norvegicus
gcctgatgctggaacccggcgaact

SEQ ID NO: 598950 - DNA, 25 bp, Rattus norvegicus
aagcagctcacccatggcctgatgc

SEQ ID NO: 598951 - DNA, 25 bp, Rattus norvegicus
caagtaggtctccacaagcagctca

SEQ ID NO: 598952 - DNA, 25 bp, Rattus norvegicus
aagatttcatctaccacctgcggga

SEQ ID NO: 598953 - DNA, 25 bp, Rattus norvegicus
acttggggaacctagccagggcctg

SEQ ID NO: 598954 - DNA, 25 bp, Rattus norvegicus
ggagcacgacagctgccaagatttc

SEQ ID NO: 598955 - DNA, 25 bp, Rattus norvegicus
gctctcggagagctgcatgcaaccg

SEQ ID NO: 598956 - DNA, 25 bp, Rattus norvegicus
tcttctcctgcagtgggctagagcc

SEQ ID NO: 598957 - DNA, 25 bp, Rattus norvegicus
tccggagcgaaattaggctcttctc

SEQ ID NO: 598958 - DNA, 25 bp, Rattus norvegicus
ccgttcagagcgcaaggtccggagc

SEQ ID NO: 598959 - DNA, 25 bp, Rattus norvegicus
cggctcgtacttcctgatcctgggc

SEQ ID NO: 598960 - DNA, 25 bp, Rattus norvegicus
agtgggtgaccattgagcccaagta

SEQ ID NO: 598961 - DNA, 25 bp, Rattus norvegicus
gtcggaggatctcggtacccacaca

SEQ ID NO: 598962 - DNA, 25 bp, Rattus norvegicus
cagggaccgacttccaggtgcaagc

SEQ ID NO: 598963 - DNA, 25 bp, Rattus norvegicus
ctctgtcccgcaggtgttagcatgc

SEQ ID NO: 598964 - DNA, 25 bp, Rattus norvegicus
cgcctgagctctgactctggatatc

SEQ ID NO: 598965 - DNA, 25 bp, Rattus norvegicus
ctctggatatccgaggccacgggta

SEQ ID NO: 598966 - DNA, 25 bp, Rattus norvegicus
ctgcgaataccggtgcgggaatcca

SEQ ID NO: 598967 - DNA, 25 bp, Rattus norvegicus
tccatgctggtagctctgggagctc

SEQ ID NO: 598968 - DNA, 25 bp, Rattus norvegicus
gaggtaccgggagaagctcatcttc

SEQ ID NO: 598969 - DNA, 25 bp, Rattus norvegicus
tggcagtcgcttgccttcacagcgg

SEQ ID NO: 598970 - DNA, 25 bp, Rattus norvegicus
agacaacctgctccgggctacggtc

SEQ ID NO: 598971 - DNA, 25 bp, Rattus norvegicus
gtccgcttcgggacaaaccaggtca

SEQ ID NO: 598972 - DNA, 25 bp, Rattus norvegicus
accaggtcacccactgagggtcggc

SEQ ID NO: 598973 - DNA, 25 bp, Rattus norvegicus
ccactggtgcttagagtctctcctg

SEQ ID NO: 598974 - DNA, 25 bp, Rattus norvegicus
aggtgcaagcctgccagtccgcttc

SEQ ID NO: 598975 - DNA, 25 bp, Rattus norvegicus
ttcgtacagctgagaagactgtccc

SEQ ID NO: 598976 - DNA, 25 bp, Rattus norvegicus
gtccatgtggaggttttgcagcgca

SEQ ID NO: 598977 - DNA, 25 bp, Rattus norvegicus
aagcgcttccgtgtgttgccgagtc

SEQ ID NO: 598978 - DNA, 25 bp, Rattus norvegicus
acctcattctggctggccgcatttc

SEQ ID NO: 598979 - DNA, 25 bp, Rattus norvegicus
agaggcgaccgcgacctcattctgg

SEQ ID NO: 598980 - DNA, 25 bp, Rattus norvegicus
caccgcgtgactccaaataacacga

SEQ ID NO: 598981 - DNA, 25 bp, Rattus norvegicus
aagactgtcccacagggcgccgaga

SEQ ID NO: 598982 - DNA, 25 bp, Rattus norvegicus
ccagggtggatcttcgtacagctga

SEQ ID NO: 598983 - DNA, 25 bp, Rattus norvegicus
ctgcgccagtcggaagtgttccttc

SEQ ID NO: 598984 - DNA, 25 bp, Rattus norvegicus
gccattctgccttgtgcttcttgtg

SEQ ID NO: 598985 - DNA, 25 bp, Rattus norvegicus
cttcgtacgacgagcgccattctgc

SEQ ID NO: 598986 - DNA, 25 bp, Rattus norvegicus
gggctccgcaccttcgtacgacgag

SEQ ID NO: 598987 - DNA, 25 bp, Rattus norvegicus
tgagctgtgaagagtccgaccatgc

SEQ ID NO: 598988 - DNA, 25 bp, Rattus norvegicus
gcggaagtagatttgtccgggactc

SEQ ID NO: 598989 - DNA, 25 bp, Rattus norvegicus
tcttttccggcgtcggtagagcgcc

SEQ ID NO: 598990 - DNA, 25 bp, Rattus norvegicus
cgggcggaggactgtaccattcgcc

SEQ ID NO: 598991 - DNA, 25 bp, Rattus norvegicus
atcttttccggcgtcggtagagcgc

SEQ ID NO: 598992 - DNA, 25 bp, Rattus norvegicus
atgtgtgctccacgttgccatggca

SEQ ID NO: 598993 - DNA, 25 bp, Rattus norvegicus
ttccgatgtgtgctccacgttgcca

SEQ ID NO: 598994 - DNA, 25 bp, Rattus norvegicus
atttccgatgtgtgctccacgttgc

SEQ ID NO: 598995 - DNA, 25 bp, Rattus norvegicus
acttatttccgatgtgtgctccacg

SEQ ID NO: 598996 - DNA, 25 bp, Rattus norvegicus
ggcaactggactgcttatttactta

SEQ ID NO: 598997 - DNA, 25 bp, Rattus norvegicus
gcggcaactggactgcttatttact

SEQ ID NO: 598998 - DNA, 25 bp, Rattus norvegicus
ctgcggcaactggactgcttattta

SEQ ID NO: 598999 - DNA, 25 bp, Rattus norvegicus
ggctgcggcaactggactgcttatt

SEQ ID NO: 599000 - DNA, 25 bp, Rattus norvegicus
tctccgccaatagcgagggcgcacg

SEQ ID NO: 599001 - DNA, 25 bp, Rattus norvegicus
tgcttatttacttatttccgatgtg

SEQ ID NO: 599002 - DNA, 25 bp, Rattus norvegicus
ctctgtctccgccaatagcgagggc

SEQ ID NO: 599003 - DNA, 25 bp, Rattus norvegicus
tactgtggagtacgccatggctgcg

SEQ ID NO: 599004 - DNA, 25 bp, Rattus norvegicus
cggctgcccagtcggcgctcacctt

SEQ ID NO: 599005 - DNA, 25 bp, Rattus norvegicus
tctgtactgtggagtacgccatggc

SEQ ID NO: 599006 - DNA, 25 bp, Rattus norvegicus
actctctgtactgtggagtacgcca

SEQ ID NO: 599007 - DNA, 25 bp, Rattus norvegicus
gcgccactctctgtactgtggagta

SEQ ID NO: 599008 - DNA, 25 bp, Rattus norvegicus
agccggctcacacccgacccgcagg

SEQ ID NO: 599009 - DNA, 25 bp, Rattus norvegicus
ggccagcgccactctctgtactgtg

SEQ ID NO: 599010 - DNA, 25 bp, Rattus norvegicus
aggacgagcccagaggccagcgcca

SEQ ID NO: 599011 - DNA, 25 bp, Rattus norvegicus
acggccaggacgagcccagaggcca

SEQ ID NO: 599012 - DNA, 25 bp, Rattus norvegicus
cgacacggccaggacgagcccagag

SEQ ID NO: 599013 - DNA, 25 bp, Rattus norvegicus
caagaaggccttgggcagcagcagc

SEQ ID NO: 599014 - DNA, 25 bp, Rattus norvegicus
cttcccgcgggacaagaaggccttg

SEQ ID NO: 599015 - DNA, 25 bp, Rattus norvegicus
cgcttcccgcgggacaagaaggcct

SEQ ID NO: 599016 - DNA, 25 bp, Rattus norvegicus
tgtggagtacgccatggctgcgtac

SEQ ID NO: 599017 - DNA, 25 bp, Rattus norvegicus
gccgaagggtagagaggctcaacct

SEQ ID NO: 599018 - DNA, 25 bp, Rattus norvegicus
ggcttgcgtctcattgtcgtgttgg

SEQ ID NO: 599019 - DNA, 25 bp, Rattus norvegicus
ttgttgcaaatcgtaggccgctctg

SEQ ID NO: 599020 - DNA, 25 bp, Rattus norvegicus
ggctcaaccttctggtttgttgcaa

SEQ ID NO: 599021 - DNA, 25 bp, Rattus norvegicus
cacgcctcgagtgacgcgaagagta

SEQ ID NO: 599022 - DNA, 25 bp, Rattus norvegicus
agcgcgtgtatctgagcgcgcactg

SEQ ID NO: 599023 - DNA, 25 bp, Rattus norvegicus
ggcatacctcgttttgcgcacgcgc

SEQ ID NO: 599024 - DNA, 25 bp, Rattus norvegicus
ccgaggcgcgacttaggatatttca

SEQ ID NO: 599025 - DNA, 25 bp, Rattus norvegicus
tttacacagcttgacgccgtctgag

SEQ ID NO: 599026 - DNA, 25 bp, Rattus norvegicus
gacttaggatatttcagaacccaga

SEQ ID NO: 599027 - DNA, 25 bp, Rattus norvegicus
tctcattgtcgtgttgggttcctgg

SEQ ID NO: 599028 - DNA, 25 bp, Rattus norvegicus
cccagaaggggatccaatttacaca

SEQ ID NO: 599029 - DNA, 25 bp, Rattus norvegicus
gaggccgcagggcatacctcgtttt

SEQ ID NO: 599030 - DNA, 25 bp, Rattus norvegicus
ggaagtgcctccgtggcgacccatc

SEQ ID NO: 599031 - DNA, 25 bp, Rattus norvegicus
cgggctctaattacccgcttgtccg

SEQ ID NO: 599032 - DNA, 25 bp, Rattus norvegicus
cgccagtccagagaccgggagacct

SEQ ID NO: 599033 - DNA, 25 bp, Rattus norvegicus
cctccggcagcaagcgggctctaat

SEQ ID NO: 599034 - DNA, 25 bp, Rattus norvegicus
ccgctgctcggctcggccgggaaaa

SEQ ID NO: 599035 - DNA, 25 bp, Rattus norvegicus
aaagggcgccgactccgggcgcact

SEQ ID NO: 599036 - DNA, 25 bp, Rattus norvegicus
ccgtgtctgtgtccctgagtcccgg

SEQ ID NO: 599037 - DNA, 25 bp, Rattus norvegicus
ctctagttcctttctcccttgaagc

SEQ ID NO: 599038 - DNA, 25 bp, Rattus norvegicus
gaccagagggcactctgaacctcca

SEQ ID NO: 599039 - DNA, 25 bp, Rattus norvegicus
ccagagcgcagagaccagagggcac

SEQ ID NO: 599040 - DNA, 25 bp, Rattus norvegicus
gctcagagccaagcgccagagcgca

SEQ ID NO: 599041 - DNA, 25 bp, Rattus norvegicus
gccgcagagaccaaacgctcagagc

SEQ ID NO: 599042 - DNA, 25 bp, Rattus norvegicus
atttgctgggcactcggcgcctctc

SEQ ID NO: 599043 - DNA, 25 bp, Rattus norvegicus
tttctcccttgaagctgctgatttg

SEQ ID NO: 599044 - DNA, 25 bp, Rattus norvegicus
atcatctcgggcactccgtgtccag

SEQ ID NO: 599045 - DNA, 25 bp, Rattus norvegicus
acacagggcactggtccagcttcca

SEQ ID NO: 599046 - DNA, 25 bp, Rattus norvegicus
actcgcagctcggactgtcgccaaa

SEQ ID NO: 599047 - DNA, 25 bp, Rattus norvegicus
accatagtattcaagcggctccagc

SEQ ID NO: 599048 - DNA, 25 bp, Rattus norvegicus
gtcctcttggtccaaaaccatagta

SEQ ID NO: 599049 - DNA, 25 bp, Rattus norvegicus
cagagcccgcgctgttcccaagtgt

SEQ ID NO: 599050 - DNA, 25 bp, Rattus norvegicus
ggttgagaccagtgcctgggcctct

SEQ ID NO: 599051 - DNA, 25 bp, Rattus norvegicus
cagcttccaagcttccgggaagccg

SEQ ID NO: 599052 - DNA, 25 bp, Rattus norvegicus
caaaggggcgcctgcgctgctttct

SEQ ID NO: 599053 - DNA, 25 bp, Rattus norvegicus
ctcatcccggtgaggaacacggggc

SEQ ID NO: 599054 - DNA, 25 bp, Rattus norvegicus
ggggagacttcctcatcccggtgag

SEQ ID NO: 599055 - DNA, 25 bp, Rattus norvegicus
ccagctaacaggctccaggatgcgc

SEQ ID NO: 599056 - DNA, 25 bp, Rattus norvegicus
tgcagtgtgcccagctaacaggctc

SEQ ID NO: 599057 - DNA, 25 bp, Rattus norvegicus
tctctgtacgctccggattcctgca

SEQ ID NO: 599058 - DNA, 25 bp, Rattus norvegicus
cggctccaagcagcggttgagacca

SEQ ID NO: 599059 - DNA, 25 bp, Rattus norvegicus
actaggcccgctgtgaggccactca

SEQ ID NO: 599060 - DNA, 25 bp, Rattus norvegicus
cctgacagaggcgtacacttgatga

SEQ ID NO: 599061 - DNA, 25 bp, Rattus norvegicus
tacacttgatgagaatggtcgccca

SEQ ID NO: 599062 - DNA, 25 bp, Rattus norvegicus
aatggtcgcccaatcccgaatgcca

SEQ ID NO: 599063 - DNA, 25 bp, Rattus norvegicus
gtcagcaccgggacaaagcacgata

SEQ ID NO: 599064 - DNA, 25 bp, Rattus norvegicus
aagcacgatagctaacgcgaagccc

SEQ ID NO: 599065 - DNA, 25 bp, Rattus norvegicus
ctctccgcgcgcaagtgaagcctgt

SEQ ID NO: 599066 - DNA, 25 bp, Rattus norvegicus
gtgtccgcacaacggtgcccacgtg

SEQ ID NO: 599067 - DNA, 25 bp, Rattus norvegicus
cagggaagcctgtctcgagtacaaa

SEQ ID NO: 599068 - DNA, 25 bp, Rattus norvegicus
tgtctcgagtacaaagcggcgcttt

SEQ ID NO: 599069 - DNA, 25 bp, Rattus norvegicus
cgctatcgtgacaggatgttcgaca

SEQ ID NO: 599070 - DNA, 25 bp, Rattus norvegicus
atgttcgacagtcacggcccaggtg

SEQ ID NO: 599071 - DNA, 25 bp, Rattus norvegicus
ggcctaatagcacatgaacgtagtc

SEQ ID NO: 599072 - DNA, 25 bp, Rattus norvegicus
agcggcgcttttcaacagcactgtc

SEQ ID NO: 599073 - DNA, 25 bp, Rattus norvegicus
gtgttcttctcgtggcctccgcttc

SEQ ID NO: 599074 - DNA, 25 bp, Rattus norvegicus
cttctgggccggaaatggagcctta

SEQ ID NO: 599075 - DNA, 25 bp, Rattus norvegicus
gcgccttctacctcgcgagacttgg

SEQ ID NO: 599076 - DNA, 25 bp, Rattus norvegicus
tctgccaccgccatggtaggtgttc

SEQ ID NO: 599077 - DNA, 25 bp, Rattus norvegicus
ccgccatggtaggtgttcttctcgt

SEQ ID NO: 599078 - DNA, 25 bp, Rattus norvegicus
tggcctccgcttccttgtggcggct

SEQ ID NO: 599079 - DNA, 25 bp, Rattus norvegicus
cttgtggcggctgggcgctctacct

SEQ ID NO: 599080 - DNA, 25 bp, Rattus norvegicus
ctgcctttcggctgcttgccctggt

SEQ ID NO: 599081 - DNA, 25 bp, Rattus norvegicus
ttgccctggtcttagtgggtctcca

SEQ ID NO: 599082 - DNA, 25 bp, Rattus norvegicus
cgcccacccacacggaaaggaagag

SEQ ID NO: 599083 - DNA, 25 bp, Rattus norvegicus
tccatggctgcaagtagcctgcggg

SEQ ID NO: 599084 - DNA, 25 bp, Rattus norvegicus
ccggaagtcgctgacgtctgagccc

SEQ ID NO: 599085 - DNA, 25 bp, Rattus norvegicus
tagtgggtctccatggctgcaagta

SEQ ID NO: 599086 - DNA, 25 bp, Rattus norvegicus
gccggaaatggagccttagtcccac

SEQ ID NO: 599087 - DNA, 25 bp, Rattus norvegicus
tgcctgggcctggagtagagaaaat

SEQ ID NO: 599088 - DNA, 25 bp, Rattus norvegicus
ccagaggagggagactgctcccgca

SEQ ID NO: 599089 - DNA, 25 bp, Rattus norvegicus
caccaactctggaaaccgcggcccg

SEQ ID NO: 599090 - DNA, 25 bp, Rattus norvegicus
acctagtactcacgcagcaggagcc

SEQ ID NO: 599091 - DNA, 25 bp, Rattus norvegicus
cagggctggccacgatcgcccagga

SEQ ID NO: 599092 - DNA, 25 bp, Rattus norvegicus
cttggtgagccgcagaaccggagtc

SEQ ID NO: 599093 - DNA, 25 bp, Rattus norvegicus
aaccggagtccgagtcctatgcgcc

SEQ ID NO: 599094 - DNA, 25 bp, Rattus norvegicus
agcagaagcagcgactcctgagtga

SEQ ID NO: 599095 - DNA, 25 bp, Rattus norvegicus
agcagcgactcctgagtgaccggga

SEQ ID NO: 599096 - DNA, 25 bp, Rattus norvegicus
ctgagtgaccgggagccacttacct

SEQ ID NO: 599097 - DNA, 25 bp, Rattus norvegicus
ccacactgcgtagcccgggccagac

SEQ ID NO: 599098 - DNA, 25 bp, Rattus norvegicus
gagccacttacctcctccgcccgag

SEQ ID NO: 599099 - DNA, 25 bp, Rattus norvegicus
ccgggagctccgcacagtctgagct

SEQ ID NO: 599100 - DNA, 25 bp, Rattus norvegicus
cgcacctagtactcacgcagcagga

SEQ ID NO: 599101 - DNA, 25 bp, Rattus norvegicus
tgcggttgacttgtctgtgtatgtg

SEQ ID NO: 599102 - DNA, 25 bp, Rattus norvegicus
gtggaccggcgctcgctacagcgct

SEQ ID NO: 599103 - DNA, 25 bp, Rattus norvegicus
ctgtgtatgtgtccagggagacatg

SEQ ID NO: 599104 - DNA, 25 bp, Rattus norvegicus
ctaccaggaacgatggtcggtcccg

SEQ ID NO: 599105 - DNA, 25 bp, Rattus norvegicus
aagggctgtggactggcattctcca

SEQ ID NO: 599106 - DNA, 25 bp, Rattus norvegicus
aaggctggaaccacgtgctcctcga

SEQ ID NO: 599107 - DNA, 25 bp, Rattus norvegicus
tctgaagctgtttaaggctggaacc

SEQ ID NO: 599108 - DNA, 25 bp, Rattus norvegicus
aagcaccgcttcacgtctgaagctg

SEQ ID NO: 599109 - DNA, 25 bp, Rattus norvegicus
ttctccagagcgatccagaggctgc

SEQ ID NO: 599110 - DNA, 25 bp, Rattus norvegicus
ctgtacccagggtctgagaagcgga

SEQ ID NO: 599111 - DNA, 25 bp, Rattus norvegicus
tagcttagcaactgggcgcgaaaga

SEQ ID NO: 599112 - DNA, 25 bp, Rattus norvegicus
gacctcgaacaagaagcaccgcttc

SEQ ID NO: 599113 - DNA, 25 bp, Rattus norvegicus
accgcgcgcagcagttagcttagca

SEQ ID NO: 599114 - DNA, 25 bp, Rattus norvegicus
agacatggaatactgcctggcggcc

SEQ ID NO: 599115 - DNA, 25 bp, Rattus norvegicus
cggcgcgagaagcagcacgtacagc

SEQ ID NO: 599116 - DNA, 25 bp, Rattus norvegicus
tcggctcctgtgcttcggtacgaac

SEQ ID NO: 599117 - DNA, 25 bp, Rattus norvegicus
tccgtagatcggaagcctaccgggc

SEQ ID NO: 599118 - DNA, 25 bp, Rattus norvegicus
caggagagaccgagcgtccgtagat

SEQ ID NO: 599119 - DNA, 25 bp, Rattus norvegicus
gtgctacgcatggagacctggccag

SEQ ID NO: 599120 - DNA, 25 bp, Rattus norvegicus
ggcgagagctggcaaatcctgcatc

SEQ ID NO: 599121 - DNA, 25 bp, Rattus norvegicus
gggactcaccttggcagcgcctgtc

SEQ ID NO: 599122 - DNA, 25 bp, Rattus norvegicus
cacgtacagcgctaggcaggacatg

SEQ ID NO: 599123 - DNA, 25 bp, Rattus norvegicus
agcaggcttccgcaccataggctcg

SEQ ID NO: 599124 - DNA, 25 bp, Rattus norvegicus
cataggctcgccatcgcgggagcca

SEQ ID NO: 599125 - DNA, 25 bp, Rattus norvegicus
cgccgggtcagctgcgagaaagcct

SEQ ID NO: 599126 - DNA, 25 bp, Rattus norvegicus
gcggcaggccggatgagcctcatcc

SEQ ID NO: 599127 - DNA, 25 bp, Rattus norvegicus
caggccatgcggacctagtgcggca

SEQ ID NO: 599128 - DNA, 25 bp, Rattus norvegicus
actgcggaagccaagagggtgctac

SEQ ID NO: 599129 - DNA, 25 bp, Rattus norvegicus
ccctctggcgcaaggttcaggaacg

SEQ ID NO: 599130 - DNA, 25 bp, Rattus norvegicus
actgcatgaaatgggctgtgcggcc

SEQ ID NO: 599131 - DNA, 25 bp, Rattus norvegicus
ctagcggagccgcttgcccaacagt

SEQ ID NO: 599132 - DNA, 25 bp, Rattus norvegicus
caccctgcggaggaggaccgactaa

SEQ ID NO: 599133 - DNA, 25 bp, Rattus norvegicus
cccaacctgaggaaaaagcaagcta

SEQ ID NO: 599134 - DNA, 25 bp, Rattus norvegicus
ggggtctatctagggtcaactacta

SEQ ID NO: 599135 - DNA, 25 bp, Rattus norvegicus
atcggctgagtctttgtggatgaac

SEQ ID NO: 599136 - DNA, 25 bp, Rattus norvegicus
tgtccttggacgagcccagcttttt

SEQ ID NO: 599137 - DNA, 25 bp, Rattus norvegicus
tgatgtcacgggtaacagccagtgc

SEQ ID NO: 599138 - DNA, 25 bp, Rattus norvegicus
ccttttatagccgagcgtgatgtca

SEQ ID NO: 599139 - DNA, 25 bp, Rattus norvegicus
aacatcgctgagacgtccgcggccg

SEQ ID NO: 599140 - DNA, 25 bp, Rattus norvegicus
tgaggagccctgagtaaaacatcgc

SEQ ID NO: 599141 - DNA, 25 bp, Rattus norvegicus
tgtggatgaactgcaccgcctgctt

SEQ ID NO: 599142 - DNA, 25 bp, Rattus norvegicus
gcccagctttttgaggccgtccagg

SEQ ID NO: 599143 - DNA, 25 bp, Rattus norvegicus
ttgcctcgcgccctcgggtaggaca

SEQ ID NO: 599144 - DNA, 25 bp, Rattus norvegicus
ggatccaggctccacaagtctctct

SEQ ID NO: 599145 - DNA, 25 bp, Rattus norvegicus
gccggatgcgcagagctctgagctt

SEQ ID NO: 599146 - DNA, 25 bp, Rattus norvegicus
gcgctgcgagaaccgctgttaaagc

SEQ ID NO: 599147 - DNA, 25 bp, Rattus norvegicus
gcgagtctcactgtctcctttcttc

SEQ ID NO: 599148 - DNA, 25 bp, Rattus norvegicus
tttcttctccgtgggtgctgcgttt

SEQ ID NO: 599149 - DNA, 25 bp, Rattus norvegicus
acagcttcgtggtgtcggcgtacgc

SEQ ID NO: 599150 - DNA, 25 bp, Rattus norvegicus
cgcaaaggagcggaagagaccgacc

SEQ ID NO: 599151 - DNA, 25 bp, Rattus norvegicus
ccactggccttgaagtaccggtgtc

SEQ ID NO: 599152 - DNA, 25 bp, Rattus norvegicus
ttcagtccaagcacggtgaggagcc

SEQ ID NO: 599153 - DNA, 25 bp, Rattus norvegicus
ccagcggcgacatggggaaatttca

SEQ ID NO: 599154 - DNA, 25 bp, Rattus norvegicus
aggctcgaacctcggacgtgcgcct

SEQ ID NO: 599155 - DNA, 25 bp, Rattus norvegicus
tgccgctgcagcctgcaagaggaga

SEQ ID NO: 599156 - DNA, 25 bp, Rattus norvegicus
tggaacatcgcgcacgggacaagca

SEQ ID NO: 599157 - DNA, 25 bp, Rattus norvegicus
ccgttggtgcgaccctggtcgggtg

SEQ ID NO: 599158 - DNA, 25 bp, Rattus norvegicus
gaccctggtcgggtgggacggcaga

SEQ ID NO: 599159 - DNA, 25 bp, Rattus norvegicus
cacactcaccctcgggcggcccgtt

SEQ ID NO: 599160 - DNA, 25 bp, Rattus norvegicus
ttccctgcgccgtgccaggtgcgcc

SEQ ID NO: 599161 - DNA, 25 bp, Rattus norvegicus
ctcaggagtcccttccctgcgccgt

SEQ ID NO: 599162 - DNA, 25 bp, Rattus norvegicus
tacgcaagggaactcaggagtccct

SEQ ID NO: 599163 - DNA, 25 bp, Rattus norvegicus
actacgcaagggaactcaggagtcc

SEQ ID NO: 599164 - DNA, 25 bp, Rattus norvegicus
ccggagactacgcaagggaactcag

SEQ ID NO: 599165 - DNA, 25 bp, Rattus norvegicus
atccggagactacgcaagggaactc

SEQ ID NO: 599166 - DNA, 25 bp, Rattus norvegicus
tctcgggatccggagactacgcaag

SEQ ID NO: 599167 - DNA, 25 bp, Rattus norvegicus
ggctctcgggatccggagactacgc

SEQ ID NO: 599168 - DNA, 25 bp, Rattus norvegicus
aaggctctcgggatccggagactac

SEQ ID NO: 599169 - DNA, 25 bp, Rattus norvegicus
cggagacttagggtgaaggctctcg

SEQ ID NO: 599170 - DNA, 25 bp, Rattus norvegicus
ggagactacgcaagggaactcagga

SEQ ID NO: 599171 - DNA, 25 bp, Rattus norvegicus
gcgcagcgaagccaaagatgcctcc

SEQ ID NO: 599172 - DNA, 25 bp, Rattus norvegicus
gagctccggtacggtggttcgcaac

SEQ ID NO: 599173 - DNA, 25 bp, Rattus norvegicus
ctcagccgaggagctccggtacggt

SEQ ID NO: 599174 - DNA, 25 bp, Rattus norvegicus
gcccacgcggacgaggaagacggag

SEQ ID NO: 599175 - DNA, 25 bp, Rattus norvegicus
gaagccaaagatgcctccgggcgcc

SEQ ID NO: 599176 - DNA, 25 bp, Rattus norvegicus
aagccgcgcctctcactctagtgcg

SEQ ID NO: 599177 - DNA, 25 bp, Rattus norvegicus
cggaggtccgcgcagcgaagccaaa

SEQ ID NO: 599178 - DNA, 25 bp, Rattus norvegicus
gtccgcgcagcgaagccaaagatgc

SEQ ID NO: 599179 - DNA, 25 bp, Rattus norvegicus
ccgcgcagcgaagccaaagatgcct

SEQ ID NO: 599180 - DNA, 25 bp, Rattus norvegicus
cagcgaagccaaagatgcctccggg

SEQ ID NO: 599181 - DNA, 25 bp, Rattus norvegicus
tgcagcgcgcgcagtaccagttggg

SEQ ID NO: 599182 - DNA, 25 bp, Rattus norvegicus
gcggctctggtttcatctccgcggc

SEQ ID NO: 599183 - DNA, 25 bp, Rattus norvegicus
ggctctggtttcatctccgcggccg

SEQ ID NO: 599184 - DNA, 25 bp, Rattus norvegicus
tggtttcatctccgcggccgccgag

SEQ ID NO: 599185 - DNA, 25 bp, Rattus norvegicus
ggttgcgacgccctttagagaaatc

SEQ ID NO: 599186 - DNA, 25 bp, Rattus norvegicus
tgacaaaatagtcggcgaagcgact

SEQ ID NO: 599187 - DNA, 25 bp, Rattus norvegicus
gccgcatcctggacgctgtcctaag

SEQ ID NO: 599188 - DNA, 25 bp, Rattus norvegicus
gctgtcctaagcaccgcagccggag

SEQ ID NO: 599189 - DNA, 25 bp, Rattus norvegicus
ccgcagccggagcaagctagaggaa

SEQ ID NO: 599190 - DNA, 25 bp, Rattus norvegicus
ctccgggcgcaaaggatgacgtgat

SEQ ID NO: 599191 - DNA, 25 bp, Rattus norvegicus
ggatgacgtgatgctctttgggccc

SEQ ID NO: 599192 - DNA, 25 bp, Rattus norvegicus
gcctgggcttccagagcagtcacca

SEQ ID NO: 599193 - DNA, 25 bp, Rattus norvegicus
tccagagcagtcaccacagagtggc

SEQ ID NO: 599194 - DNA, 25 bp, Rattus norvegicus
ctgacacttggctcgtgctggccgc

SEQ ID NO: 599195 - DNA, 25 bp, Rattus norvegicus
ccacgcggttgcgacgccctttaga

SEQ ID NO: 599196 - DNA, 25 bp, Rattus norvegicus
cctttagagaaatcgggtgcggtgt

SEQ ID NO: 599197 - DNA, 25 bp, Rattus norvegicus
tccagcccgcagatgacaaaatagt

SEQ ID NO: 599198 - DNA, 25 bp, Rattus norvegicus
ccacagagtggccagtggtcagctg

SEQ ID NO: 599199 - DNA, 25 bp, Rattus norvegicus
gcgcagcttacgtcacgcggaagtg

SEQ ID NO: 599200 - DNA, 25 bp, Rattus norvegicus
catgagcagtcgcattggcaagtca

SEQ ID NO: 599201 - DNA, 25 bp, Rattus norvegicus
cacctcactcgagcagggcgcatga

SEQ ID NO: 599202 - DNA, 25 bp, Rattus norvegicus
accgcgagacaagtcagggccgacc

SEQ ID NO: 599203 - DNA, 25 bp, Rattus norvegicus
ttccagagatatcaggtgagggccc

SEQ ID NO: 599204 - DNA, 25 bp, Rattus norvegicus
acttgacagtcagcggagccttcca

SEQ ID NO: 599205 - DNA, 25 bp, Rattus norvegicus
acctgagacgacctcgaaaacttga

SEQ ID NO: 599206 - DNA, 25 bp, Rattus norvegicus
gaacgattaaagctcctcccgcagc

SEQ ID NO: 599207 - DNA, 25 bp, Rattus norvegicus
ggcaagtcatgggtctgcggcctaa

SEQ ID NO: 599208 - DNA, 25 bp, Rattus norvegicus
taaagagctcccagcggtgccgcac

SEQ ID NO: 599209 - DNA, 25 bp, Rattus norvegicus
tctgcctttcgccatggctgctgca

SEQ ID NO: 599210 - DNA, 25 bp, Rattus norvegicus
gtgaggccttgagtacttcagactc

SEQ ID NO: 599211 - DNA, 25 bp, Rattus norvegicus
tcagactctttgttccgccgaccgg

SEQ ID NO: 599212 - DNA, 25 bp, Rattus norvegicus
aggaccgatttctctgcgcagctta

SEQ ID NO: 599213 - DNA, 25 bp, Rattus norvegicus
ggaccggcaggccaagccttccagg

SEQ ID NO: 599214 - DNA, 25 bp, Rattus norvegicus
tcaatgaagtaaggacggccggcta

SEQ ID NO: 599215 - DNA, 25 bp, Rattus norvegicus
ccacgccgaggcgagaaggttctat

SEQ ID NO: 599216 - DNA, 25 bp, Rattus norvegicus
gctgagcgccagctcaatgaagtaa

SEQ ID NO: 599217 - DNA, 25 bp, Rattus norvegicus
acggtctggacacatggccggctct

SEQ ID NO: 599218 - DNA, 25 bp, Rattus norvegicus
agcgcgtcgccgacgagcctatttg

SEQ ID NO: 599219 - DNA, 25 bp, Rattus norvegicus
aacaccatcatcgaggcccttcggg

SEQ ID NO: 599220 - DNA, 25 bp, Rattus norvegicus
gcgcggcgatggatcccaacaccat

SEQ ID NO: 599221 - DNA, 25 bp, Rattus norvegicus
ttctgcctcagtagcaccggtgtcc

SEQ ID NO: 599222 - DNA, 25 bp, Rattus norvegicus
gagtggcgctatttctgcctcagta

SEQ ID NO: 599223 - DNA, 25 bp, Rattus norvegicus
tccatgtgcgcagtgagtggcgcta

SEQ ID NO: 599224 - DNA, 25 bp, Rattus norvegicus
ctatccggggccttggcgcttctct

SEQ ID NO: 599225 - DNA, 25 bp, Rattus norvegicus
cgagaaggttctatccggggccttg

SEQ ID NO: 599226 - DNA, 25 bp, Rattus norvegicus
tctcgttcggcttccgagtgggcct

SEQ ID NO: 599227 - DNA, 25 bp, Rattus norvegicus
agttatgattccgtacctggcgcca

SEQ ID NO: 599228 - DNA, 25 bp, Rattus norvegicus
ccagtctccggcatcagcaaagcta

SEQ ID NO: 599229 - DNA, 25 bp, Rattus norvegicus
ccgcaatagcaaggcaaggaccatc

SEQ ID NO: 599230 - DNA, 25 bp, Rattus norvegicus
gcctgtagggaaaatggcgcccatc

SEQ ID NO: 599231 - DNA, 25 bp, Rattus norvegicus
tttgctacaaaatggcgcctcccgc

SEQ ID NO: 599232 - DNA, 25 bp, Rattus norvegicus
gagcagttctgccaaccagtcaggc

SEQ ID NO: 599233 - DNA, 25 bp, Rattus norvegicus
gccagccattcaggcgcgggtagaa

SEQ ID NO: 599234 - DNA, 25 bp, Rattus norvegicus
cagtgagtgacgtaatggcagccca

SEQ ID NO: 599235 - DNA, 25 bp, Rattus norvegicus
actcagaattgctatgcgggttgcg

SEQ ID NO: 599236 - DNA, 25 bp, Rattus norvegicus
agtgtgcattattctccgcccggcc

SEQ ID NO: 599237 - DNA, 25 bp, Rattus norvegicus
tgctcatgcccgtccttaggcctgg

SEQ ID NO: 599238 - DNA, 25 bp, Rattus norvegicus
gcccgagcagaagtggagtttatta

SEQ ID NO: 599239 - DNA, 25 bp, Rattus norvegicus
tggcggtttcctacccgtcagctaa

SEQ ID NO: 599240 - DNA, 25 bp, Rattus norvegicus
aatcggcataattcactcgtcagtg

SEQ ID NO: 599241 - DNA, 25 bp, Rattus norvegicus
agccagcgagttcccgccaaaatcg

SEQ ID NO: 599242 - DNA, 25 bp, Rattus norvegicus
gtcacctacgactgcctactttctg

SEQ ID NO: 599243 - DNA, 25 bp, Rattus norvegicus
gtttcggctcttcgtcgcccgtcaa

SEQ ID NO: 599244 - DNA, 25 bp, Rattus norvegicus
gactcggccttccaggagcctgatt

SEQ ID NO: 599245 - DNA, 25 bp, Rattus norvegicus
tactttctgggcagctcgttctcgc

SEQ ID NO: 599246 - DNA, 25 bp, Rattus norvegicus
ccgggaaatgagcttcctgagccga

SEQ ID NO: 599247 - DNA, 25 bp, Rattus norvegicus
ggtcagtctccgctggacataatcg

SEQ ID NO: 599248 - DNA, 25 bp, Rattus norvegicus
ttcaccagcagtggaccggtcagtc

SEQ ID NO: 599249 - DNA, 25 bp, Rattus norvegicus
ccaaaatcgcgtagccggttccatc

SEQ ID NO: 599250 - DNA, 25 bp, Rattus norvegicus
ctgtgcaatcgaggcccactcattg

SEQ ID NO: 599251 - DNA, 25 bp, Rattus norvegicus
ttcacatagattctgggcgggcttc

SEQ ID NO: 599252 - DNA, 25 bp, Rattus norvegicus
caggctccggtccacttcacataga

SEQ ID NO: 599253 - DNA, 25 bp, Rattus norvegicus
acttgcggccgaacttgagaccttc

SEQ ID NO: 599254 - DNA, 25 bp, Rattus norvegicus
cagtttgcggcagaagctcatcttc

SEQ ID NO: 599255 - DNA, 25 bp, Rattus norvegicus
gtctccaagtcgcaactcaaggtga

SEQ ID NO: 599256 - DNA, 25 bp, Rattus norvegicus
cgtccacaggtcttggggctactga

SEQ ID NO: 599257 - DNA, 25 bp, Rattus norvegicus
cagcgtcgtctgtggagatcctgct

SEQ ID NO: 599258 - DNA, 25 bp, Rattus norvegicus
tcctgctggaagcagagtagctgaa

SEQ ID NO: 599259 - DNA, 25 bp, Rattus norvegicus
ggggcttgaaagacgaactgctcaa

SEQ ID NO: 599260 - DNA, 25 bp, Rattus norvegicus
ggaccgcagcggcaaggtctccaag

SEQ ID NO: 599261 - DNA, 25 bp, Rattus norvegicus
gtcccgccgcagtgtccacagggag

SEQ ID NO: 599262 - DNA, 25 bp, Rattus norvegicus
ggcggcggtccttactcttccttca

SEQ ID NO: 599263 - DNA, 25 bp, Rattus norvegicus
tactcttccttcaggcgtccgggcg

SEQ ID NO: 599264 - DNA, 25 bp, Rattus norvegicus
ccacgacggctgaggtgcgctccaa

SEQ ID NO: 599265 - DNA, 25 bp, Rattus norvegicus
tgcgctccaagaggcaccgcgggac

SEQ ID NO: 599266 - DNA, 25 bp, Rattus norvegicus
tctccgggacactgagcagagcctc

SEQ ID NO: 599267 - DNA, 25 bp, Rattus norvegicus
ctactgagcgcgtgccaagcggctc

SEQ ID NO: 599268 - DNA, 25 bp, Rattus norvegicus
tgctcaaagccatctggcacgcctt

SEQ ID NO: 599269 - DNA, 25 bp, Rattus norvegicus
accaccgaagccgagcgcttagagg

SEQ ID NO: 599270 - DNA, 25 bp, Rattus norvegicus
tttgacaaccgaggcgcgcactgcg

SEQ ID NO: 599271 - DNA, 25 bp, Rattus norvegicus
actgcagctaggctccgcagagccg

SEQ ID NO: 599272 - DNA, 25 bp, Rattus norvegicus
acacccttacctggcttctcgtggt

SEQ ID NO: 599273 - DNA, 25 bp, Rattus norvegicus
cctggcttctcgtggtcgtagccta

SEQ ID NO: 599274 - DNA, 25 bp, Rattus norvegicus
tagcagcggcgcttcagccatgttt

SEQ ID NO: 599275 - DNA, 25 bp, Rattus norvegicus
cttcagccatgtttgacaaccgagg

SEQ ID NO: 599276 - DNA, 25 bp, Rattus norvegicus
gccgctcggacacgcggttctggaa

SEQ ID NO: 599277 - DNA, 25 bp, Rattus norvegicus
ccacaatgaagtagtcggccaaccg

SEQ ID NO: 599278 - DNA, 25 bp, Rattus norvegicus
gtagtcggccaaccgggccatgacc

SEQ ID NO: 599279 - DNA, 25 bp, Rattus norvegicus
ccgagcgcttagaggcccggctgct

SEQ ID NO: 599280 - DNA, 25 bp, Rattus norvegicus
ccgggcgagctcagcattttccctt

SEQ ID NO: 599281 - DNA, 25 bp, Rattus norvegicus
gcattttcccttcggcggctgtagc

SEQ ID NO: 599282 - DNA, 25 bp, Rattus norvegicus
ggtcgtagcctaccacaatgaagta

SEQ ID NO: 599283 - DNA, 25 bp, Rattus norvegicus
gctggtttccatcgccctgatgtta

SEQ ID NO: 599284 - DNA, 25 bp, Rattus norvegicus
cgcagttccgaaagaagtgagtttg

SEQ ID NO: 599285 - DNA, 25 bp, Rattus norvegicus
gacacttcctcgcagttccgaaaga

SEQ ID NO: 599286 - DNA, 25 bp, Rattus norvegicus
gcggacaccgcacggctcgacactt

SEQ ID NO: 599287 - DNA, 25 bp, Rattus norvegicus
cgtgttgctcacactcggcttcttg

SEQ ID NO: 599288 - DNA, 25 bp, Rattus norvegicus
gttcgctcgccgttctcggcgcgga

SEQ ID NO: 599289 - DNA, 25 bp, Rattus norvegicus
cctgatgttattgggttcgctcgcc

SEQ ID NO: 599290 - DNA, 25 bp, Rattus norvegicus
gattgtgcagctggccgtgttgctc

SEQ ID NO: 599291 - DNA, 25 bp, Rattus norvegicus
actcggcttcttgctcctttccagg

SEQ ID NO: 599292 - DNA, 25 bp, Rattus norvegicus
tcttgctcctttccagggtatcgga

SEQ ID NO: 599293 - DNA, 25 bp, Rattus norvegicus
tttccagggtatcggagcatcgcta

SEQ ID NO: 599294 - DNA, 25 bp, Rattus norvegicus
tcggagcatcgctacagaatgaagc

SEQ ID NO: 599295 - DNA, 25 bp, Rattus norvegicus
tcgctacagaatgaagctggtttcc

SEQ ID NO: 599296 - DNA, 25 bp, Rattus norvegicus
atgaagctggtttccatcgccctga

SEQ ID NO: 599297 - DNA, 25 bp, Rattus norvegicus
tgtgctcagagacccgaacctccgc

SEQ ID NO: 599298 - DNA, 25 bp, Rattus norvegicus
ccagcgcctcgggtaactgcgggtc

SEQ ID NO: 599299 - DNA, 25 bp, Rattus norvegicus
gcctcgggtaactgcgggtcttcca

SEQ ID NO: 599300 - DNA, 25 bp, Rattus norvegicus
cgggtcttccaggtagtgcgcgatt

SEQ ID NO: 599301 - DNA, 25 bp, Rattus norvegicus
cttccaggtagtgcgcgattccgct

SEQ ID NO: 599302 - DNA, 25 bp, Rattus norvegicus
tagtgcgcgattccgctgcgcaggc

SEQ ID NO: 599303 - DNA, 25 bp, Rattus norvegicus
gcctggtccggtccagcttcgggta

SEQ ID NO: 599304 - DNA, 25 bp, Rattus norvegicus
ccgcacctgcgctccagcccggcag

SEQ ID NO: 599305 - DNA, 25 bp, Rattus norvegicus
cgcccgggtgcttaggtttcctgct

SEQ ID NO: 599306 - DNA, 25 bp, Rattus norvegicus
ctccgaacctggtgagtgcgcacca

SEQ ID NO: 599307 - DNA, 25 bp, Rattus norvegicus
cgaacctggtgagtgcgcaccatgc

SEQ ID NO: 599308 - DNA, 25 bp, Rattus norvegicus
gtgcgcaccatgctgcaccgctgac

SEQ ID NO: 599309 - DNA, 25 bp, Rattus norvegicus
accgctgaccttgggccggcgccct

SEQ ID NO: 599310 - DNA, 25 bp, Rattus norvegicus
gtgcttaggtttcctgctggcagct

SEQ ID NO: 599311 - DNA, 25 bp, Rattus norvegicus
tttcgccacacctggggaagagcgg

SEQ ID NO: 599312 - DNA, 25 bp, Rattus norvegicus
gtgaagatgcgcatccggcactttc

SEQ ID NO: 599313 - DNA, 25 bp, Rattus norvegicus
catttctgcagggactcgggccagg

SEQ ID NO: 599314 - DNA, 25 bp, Rattus norvegicus
acacagtgctgtccctgtagcccgg

SEQ ID NO: 599315 - DNA, 25 bp, Rattus norvegicus
tgtagcccggctgctggcctacggc

SEQ ID NO: 599316 - DNA, 25 bp, Rattus norvegicus
ccacggcagacaccttgtgctggcg

SEQ ID NO: 599317 - DNA, 25 bp, Rattus norvegicus
acaccttgtgctggcgcagcaggaa

SEQ ID NO: 599318 - DNA, 25 bp, Rattus norvegicus
caggaacggcagaagcatgagcatc

SEQ ID NO: 599319 - DNA, 25 bp, Rattus norvegicus
gtgcacgatccaccacacatcgatg

SEQ ID NO: 599320 - DNA, 25 bp, Rattus norvegicus
cacacatcgatgttgccgtcgctga

SEQ ID NO: 599321 - DNA, 25 bp, Rattus norvegicus
atgttgccgtcgctgaagcgctcct

SEQ ID NO: 599322 - DNA, 25 bp, Rattus norvegicus
agcgctcctggttctgcgggaacaa

SEQ ID NO: 599323 - DNA, 25 bp, Rattus norvegicus
cggcactttcgccacacctggggaa

SEQ ID NO: 599324 - DNA, 25 bp, Rattus norvegicus
tccacctgggcgaccgtgaagatgc

SEQ ID NO: 599325 - DNA, 25 bp, Rattus norvegicus
tgaaccgcactgaccctaagagcct

SEQ ID NO: 599326 - DNA, 25 bp, Rattus norvegicus
cacgacgtgacagaacgcgaacttc

SEQ ID NO: 599327 - DNA, 25 bp, Rattus norvegicus
ggcccttctggtctggcgcgatccg

SEQ ID NO: 599328 - DNA, 25 bp, Rattus norvegicus
ggagaagggtcctccagcgctgaac

SEQ ID NO: 599329 - DNA, 25 bp, Rattus norvegicus
tcctccagcgctgaacattgcggtg

SEQ ID NO: 599330 - DNA, 25 bp, Rattus norvegicus
agcgctgaacattgcggtgctgctg

SEQ ID NO: 599331 - DNA, 25 bp, Rattus norvegicus
tgctgggtcacagccacgacgtgac

SEQ ID NO: 599332 - DNA, 25 bp, Rattus norvegicus
cgcgaacttcgaaatctgtggggcc

SEQ ID NO: 599333 - DNA, 25 bp, Rattus norvegicus
cttcgaaatctgtggggcccagagc

SEQ ID NO: 599334 - DNA, 25 bp, Rattus norvegicus
ttgatgaaccgcactgaccctaaga

SEQ ID NO: 599335 - DNA, 25 bp, Rattus norvegicus
ctaagagcctcatcacgcatgtgtg

SEQ ID NO: 599336 - DNA, 25 bp, Rattus norvegicus
tcacgcatgtgtgcgacctcatgtc

SEQ ID NO: 599337 - DNA, 25 bp, Rattus norvegicus
gcgacctcatgtccggggcgcgcat

SEQ ID NO: 599338 - DNA, 25 bp, Rattus norvegicus
aacgtggtggcgttattgatgaacc

SEQ ID NO: 599339 - DNA, 25 bp, Rattus norvegicus
aacagctaaactgctcagggcgcca

SEQ ID NO: 599340 - DNA, 25 bp, Rattus norvegicus
tcagcaaaccagtcgcacctcagtg

SEQ ID NO: 599341 - DNA, 25 bp, Rattus norvegicus
tgcttagctaaacccgctaggcggc

SEQ ID NO: 599342 - DNA, 25 bp, Rattus norvegicus
cgccttggccgctgcttagctaaac

SEQ ID NO: 599343 - DNA, 25 bp, Rattus norvegicus
gcgctggaaggctcaccctgttcaa

SEQ ID NO: 599344 - DNA, 25 bp, Rattus norvegicus
gaaagcccggctacacaccctggtg

SEQ ID NO: 599345 - DNA, 25 bp, Rattus norvegicus
gccctgaatagaggggcctagttcc

SEQ ID NO: 599346 - DNA, 25 bp, Rattus norvegicus
gcccgcaaccgaggccctgaataga

SEQ ID NO: 599347 - DNA, 25 bp, Rattus norvegicus
ggaatcggtgcccaaagcccgcaac

SEQ ID NO: 599348 - DNA, 25 bp, Rattus norvegicus
gaaggcggacccagagcattcaccc

SEQ ID NO: 599349 - DNA, 25 bp, Rattus norvegicus
ctctcagcaccaacgcgaaggcgga

SEQ ID NO: 599350 - DNA, 25 bp, Rattus norvegicus
agcttgagttggtccctgaaacctc

SEQ ID NO: 599351 - DNA, 25 bp, Rattus norvegicus
ggcgccagcgccaagattcaaaaca

SEQ ID NO: 599352 - DNA, 25 bp, Rattus norvegicus
tcagtgacgtaaggccacgccctca

SEQ ID NO: 599353 - DNA, 25 bp, Rattus norvegicus
cttgcaagactggaagcccggacta

SEQ ID NO: 599354 - DNA, 25 bp, Rattus norvegicus
tgagcgccgagtaaaccacggatta

SEQ ID NO: 599355 - DNA, 25 bp, Rattus norvegicus
gcgtggtttcgcctcgtcaacacca

SEQ ID NO: 599356 - DNA, 25 bp, Rattus norvegicus
gttcccgaaggctcttggtcaccta

SEQ ID NO: 599357 - DNA, 25 bp, Rattus norvegicus
tacggctggcacaacgacaacctcg

SEQ ID NO: 599358 - DNA, 25 bp, Rattus norvegicus
gtctttccaaagaaggctgcgccgg

SEQ ID NO: 599359 - DNA, 25 bp, Rattus norvegicus
ctggaacacgccctcctgatagtgc

SEQ ID NO: 599360 - DNA, 25 bp, Rattus norvegicus
aagctcgttgtttcagcggccgaca

SEQ ID NO: 599361 - DNA, 25 bp, Rattus norvegicus
ggtgtggtaacctcttgcaagactg

SEQ ID NO: 599362 - DNA, 25 bp, Rattus norvegicus
gcgcctgctttcagagctcgccatg

SEQ ID NO: 599363 - DNA, 25 bp, Rattus norvegicus
agcaccgactttgctccgcttgata

SEQ ID NO: 599364 - DNA, 25 bp, Rattus norvegicus
ctggtcacctttctggctgcaagga

SEQ ID NO: 599365 - DNA, 25 bp, Rattus norvegicus
tgaacttggacgatcccagcaccga

SEQ ID NO: 599366 - DNA, 25 bp, Rattus norvegicus
tcgcctgtagcctgcttcttgttga

SEQ ID NO: 599367 - DNA, 25 bp, Rattus norvegicus
caacagacgcgcctcatcggagagc

SEQ ID NO: 599368 - DNA, 25 bp, Rattus norvegicus
gcctcatcggagagcgactcagatg

SEQ ID NO: 599369 - DNA, 25 bp, Rattus norvegicus
agcgactcagatgacaaccagaaca

SEQ ID NO: 599370 - DNA, 25 bp, Rattus norvegicus
accagaacaagtctggcagcgaggc

SEQ ID NO: 599371 - DNA, 25 bp, Rattus norvegicus
caggagtccgatgaggattccgaca

SEQ ID NO: 599372 - DNA, 25 bp, Rattus norvegicus
gattccgacagtgaccagccgtcca

SEQ ID NO: 599373 - DNA, 25 bp, Rattus norvegicus
gccgtccagaaagagaaggcgctcc

SEQ ID NO: 599374 - DNA, 25 bp, Rattus norvegicus
aaagagaaggcgctccggctctgag

SEQ ID NO: 599375 - DNA, 25 bp, Rattus norvegicus
ccggctctgagcagtcggacaatga

SEQ ID NO: 599376 - DNA, 25 bp, Rattus norvegicus
gacaatgagtctgcgcagtccggga

SEQ ID NO: 599377 - DNA, 25 bp, Rattus norvegicus
gaggctcagagaatgagaacgattc

SEQ ID NO: 599378 - DNA, 25 bp, Rattus norvegicus
gattctcgcccggtttctccaagtg

SEQ ID NO: 599379 - DNA, 25 bp, Rattus norvegicus
tctccaagtgcagagtcggaccacg

SEQ ID NO: 599380 - DNA, 25 bp, Rattus norvegicus
tctgatgatgacgagaggcccaaca

SEQ ID NO: 599381 - DNA, 25 bp, Rattus norvegicus
tatccaatcagcagccgggcttccg

SEQ ID NO: 599382 - DNA, 25 bp, Rattus norvegicus
cgagtggctccttcgctatccaatc

SEQ ID NO: 599383 - DNA, 25 bp, Rattus norvegicus
tgagattcgctctccgcttcgcctg

SEQ ID NO: 599384 - DNA, 25 bp, Rattus norvegicus
aggcgtgtctgaagccgaacttatc

SEQ ID NO: 599385 - DNA, 25 bp, Rattus norvegicus
cctagctctttggttggcacgggaa

SEQ ID NO: 599386 - DNA, 25 bp, Rattus norvegicus
ctgttcccggatcccacgtcaggat

SEQ ID NO: 599387 - DNA, 25 bp, Rattus norvegicus
ttcaccgagaactcagcagctgcta

SEQ ID NO: 599388 - DNA, 25 bp, Rattus norvegicus
agctgcctcctctggatccggtcgt

SEQ ID NO: 599389 - DNA, 25 bp, Rattus norvegicus
cggggacggcttgaaactcagctca

SEQ ID NO: 599390 - DNA, 25 bp, Rattus norvegicus
catattcgcgaaggctctggggcca

SEQ ID NO: 599391 - DNA, 25 bp, Rattus norvegicus
gcctcggctgccatggcctacaaag

SEQ ID NO: 599392 - DNA, 25 bp, Rattus norvegicus
cctacaaagggactgagattcgctc

SEQ ID NO: 599393 - DNA, 25 bp, Rattus norvegicus
ttccactcgacaagaagcggccagg

SEQ ID NO: 599394 - DNA, 25 bp, Rattus norvegicus
gccgcagtgcgcaaagccatattcg

SEQ ID NO: 599395 - DNA, 25 bp, Rattus norvegicus
ctcgactctcgcaaggagcggccta

SEQ ID NO: 599396 - DNA, 25 bp, Rattus norvegicus
tcgccggtgctgtcgacaatgaagt

SEQ ID NO: 599397 - DNA, 25 bp, Rattus norvegicus
ccgagcacgagaccgccattttaga

SEQ ID NO: 599398 - DNA, 25 bp, Rattus norvegicus
ccttcagcgaggatctatggggcca

SEQ ID NO: 599399 - DNA, 25 bp, Rattus norvegicus
tgaaggtacacttagggctccactg

SEQ ID NO: 599400 - DNA, 25 bp, Rattus norvegicus
tgtcgtagcctaccattgcctcagg

SEQ ID NO: 599401 - DNA, 25 bp, Rattus norvegicus
gcgacagagtttatccctaccacca

SEQ ID NO: 599402 - DNA, 25 bp, Rattus norvegicus
accaatccgcgctgagtagtgaggc

SEQ ID NO: 599403 - DNA, 25 bp, Rattus norvegicus
tctctgagttctccggtcagtcgtg

SEQ ID NO: 599404 - DNA, 25 bp, Rattus norvegicus
ggctcctccaattccacgtggctga

SEQ ID NO: 599405 - DNA, 25 bp, Rattus norvegicus
tcggcatttccctcagctctggcgt

SEQ ID NO: 599406 - DNA, 25 bp, Rattus norvegicus
gcgtcctgcaagagctgccgtgaca

SEQ ID NO: 599407 - DNA, 25 bp, Rattus norvegicus
caggattcctctcgctcgggatgtc

SEQ ID NO: 599408 - DNA, 25 bp, Rattus norvegicus
gagcgacttcgctgttgtccaatca

SEQ ID NO: 599409 - DNA, 25 bp, Rattus norvegicus
tcaagtttgcagctcccgccgctgg

SEQ ID NO: 599410 - DNA, 25 bp, Rattus norvegicus
tgagccgcggcgctcaagtttgcag

SEQ ID NO: 599411 - DNA, 25 bp, Rattus norvegicus
cacctaagtctctccaaaggcgggt

SEQ ID NO: 599412 - DNA, 25 bp, Rattus norvegicus
tccggacacggtggtgtctcccgca

SEQ ID NO: 599413 - DNA, 25 bp, Rattus norvegicus
ccgctggccaccctgaaaaagagct

SEQ ID NO: 599414 - DNA, 25 bp, Rattus norvegicus
cccttggcacgtctggggcctctgg

SEQ ID NO: 599415 - DNA, 25 bp, Rattus norvegicus
tgcagggctgggaaactttgtcact

SEQ ID NO: 599416 - DNA, 25 bp, Rattus norvegicus
tgggtgcgccagcacctaagtctct

SEQ ID NO: 599417 - DNA, 25 bp, Rattus norvegicus
ccgcagtggcgtgacgagacctgca

SEQ ID NO: 599418 - DNA, 25 bp, Rattus norvegicus
ctttccctaggcagtcacgggtggc

SEQ ID NO: 599419 - DNA, 25 bp, Rattus norvegicus
agagctccacaaaggaaacggggtg

SEQ ID NO: 599420 - DNA, 25 bp, Rattus norvegicus
ggccaccctgaaaaagagctccaca

SEQ ID NO: 599421 - DNA, 25 bp, Rattus norvegicus
taggagatgccaccagcccgcgctg

SEQ ID NO: 599422 - DNA, 25 bp, Rattus norvegicus
aactttgtcactgccagggccgggc

SEQ ID NO: 599423 - DNA, 25 bp, Rattus norvegicus
ggcagcacacgttcctcaggccagg

SEQ ID NO: 599424 - DNA, 25 bp, Rattus norvegicus
agaagatcccgagctcgccacggca

SEQ ID NO: 599425 - DNA, 25 bp, Rattus norvegicus
gcagagcaagaggtgagaagatccc

SEQ ID NO: 599426 - DNA, 25 bp, Rattus norvegicus
accagcatagcgttgcgtattccgg

SEQ ID NO: 599427 - DNA, 25 bp, Rattus norvegicus
ttacaccgttcctcgaccagcatag

SEQ ID NO: 599428 - DNA, 25 bp, Rattus norvegicus
ttcccggtagtgaaaggtgcttaca

SEQ ID NO: 599429 - DNA, 25 bp, Rattus norvegicus
gcggggctttgaactggaacccatc

SEQ ID NO: 599430 - DNA, 25 bp, Rattus norvegicus
gggaggatgactaccactgccattc

SEQ ID NO: 599431 - DNA, 25 bp, Rattus norvegicus
aacccatccgtgacgcaggggcctg

SEQ ID NO: 599432 - DNA, 25 bp, Rattus norvegicus
tctttcctgagacgcagagccaccg

SEQ ID NO: 599433 - DNA, 25 bp, Rattus norvegicus
cagactaggcccgaagcctgcggtc

SEQ ID NO: 599434 - DNA, 25 bp, Rattus norvegicus
acgcatcaaagactggacccgagga

SEQ ID NO: 599435 - DNA, 25 bp, Rattus norvegicus
tttttccattgattgccgcgggccg

SEQ ID NO: 599436 - DNA, 25 bp, Rattus norvegicus
gcgcgcccactgagctgaattctcg

SEQ ID NO: 599437 - DNA, 25 bp, Rattus norvegicus
tacacagcaaaatatcccggagcca

SEQ ID NO: 599438 - DNA, 25 bp, Rattus norvegicus
tatcccggagccactgcatgtttgc

SEQ ID NO: 599439 - DNA, 25 bp, Rattus norvegicus
cgccgctagcagcatacacagcaaa

SEQ ID NO: 599440 - DNA, 25 bp, Rattus norvegicus
ctctgccggagtccaagtggccgtc

SEQ ID NO: 599441 - DNA, 25 bp, Rattus norvegicus
cctcctgagggtagttaagagccgg

SEQ ID NO: 599442 - DNA, 25 bp, Rattus norvegicus
ttcctcctgagggtagttaagagcc

SEQ ID NO: 599443 - DNA, 25 bp, Rattus norvegicus
cgtagcttcctcctgagggtagtta

SEQ ID NO: 599444 - DNA, 25 bp, Rattus norvegicus
attgagcgtagcttcctcctgaggg

SEQ ID NO: 599445 - DNA, 25 bp, Rattus norvegicus
ctctcggaacatctcattgagcgta

SEQ ID NO: 599446 - DNA, 25 bp, Rattus norvegicus
ctctacctctcggaacatctcattg

SEQ ID NO: 599447 - DNA, 25 bp, Rattus norvegicus
ttgtgctgagtgtcttccatcagct

SEQ ID NO: 599448 - DNA, 25 bp, Rattus norvegicus
cgcagtttgtgctgagtgtcttcca

SEQ ID NO: 599449 - DNA, 25 bp, Rattus norvegicus
tcctccaccgcgctgcgcagtttgt

SEQ ID NO: 599450 - DNA, 25 bp, Rattus norvegicus
gccactgcatgtttgctccgcgctg

SEQ ID NO: 599451 - DNA, 25 bp, Rattus norvegicus
gaatatgcactgtacgcggcgtgga

SEQ ID NO: 599452 - DNA, 25 bp, Rattus norvegicus
gctcacccacttcgaatgaacaaag

SEQ ID NO: 599453 - DNA, 25 bp, Rattus norvegicus
cttcgaatgaacaaagctgagctgc

SEQ ID NO: 599454 - DNA, 25 bp, Rattus norvegicus
caaagctgagctgcaagatggatct

SEQ ID NO: 599455 - DNA, 25 bp, Rattus norvegicus
ctgcaagatggatctggtcacgacc

SEQ ID NO: 599456 - DNA, 25 bp, Rattus norvegicus
atggatctggtcacgaccggtcgca

SEQ ID NO: 599457 - DNA, 25 bp, Rattus norvegicus
gtcacgaccggtcgcagggcttcca

SEQ ID NO: 599458 - DNA, 25 bp, Rattus norvegicus
cagccggagcagaatatgcactgta

SEQ ID NO: 599459 - DNA, 25 bp, Rattus norvegicus
cgtggatgcagaagccctggtacca

SEQ ID NO: 599460 - DNA, 25 bp, Rattus norvegicus
cctggtaccagaaagctgcagcctg

SEQ ID NO: 599461 - DNA, 25 bp, Rattus norvegicus
gtaccagaaagctgcagcctgcgcc

SEQ ID NO: 599462 - DNA, 25 bp, Rattus norvegicus
gggcggttgcacagccaatcgctct

SEQ ID NO: 599463 - DNA, 25 bp, Rattus norvegicus
gttgcacagccaatcgctctccagg

SEQ ID NO: 599464 - DNA, 25 bp, Rattus norvegicus
agggcttccacagagcagccggagc

SEQ ID NO: 599465 - DNA, 25 bp, Rattus norvegicus
aaagccagaagcttgcctggagcgc

SEQ ID NO: 599466 - DNA, 25 bp, Rattus norvegicus
gggtcctgtcaacccaccgtctgtg

SEQ ID NO: 599467 - DNA, 25 bp, Rattus norvegicus
ctcagatgatagtcgcggtagctcc

SEQ ID NO: 599468 - DNA, 25 bp, Rattus norvegicus
tcatcgtttgtcctgttccgggtcc

SEQ ID NO: 599469 - DNA, 25 bp, Rattus norvegicus
atcaatctctgggtccgcctctaca

SEQ ID NO: 599470 - DNA, 25 bp, Rattus norvegicus
cccaccgtctgtgcgcaagcaatga

SEQ ID NO: 599471 - DNA, 25 bp, Rattus norvegicus
tgcgcaagcaatgacgacaacgata

SEQ ID NO: 599472 - DNA, 25 bp, Rattus norvegicus
gacgacaacgatatgggaacacatc

SEQ ID NO: 599473 - DNA, 25 bp, Rattus norvegicus
tatgggaacacatcaggactcgctg

SEQ ID NO: 599474 - DNA, 25 bp, Rattus norvegicus
aacacatcaggactcgctgctgccg

SEQ ID NO: 599475 - DNA, 25 bp, Rattus norvegicus
tgctgccgcaccaaagccagaagct

SEQ ID NO: 599476 - DNA, 25 bp, Rattus norvegicus
ctaaccgggcggctcagatgatagt

SEQ ID NO: 599477 - DNA, 25 bp, Rattus norvegicus
gtcgcggtagctccatcaatctctg

SEQ ID NO: 599478 - DNA, 25 bp, Rattus norvegicus
cggcactcagagctcatcgtttgtc

SEQ ID NO: 599479 - DNA, 25 bp, Rattus norvegicus
ctctgcctttgtcccgttgcaggtg

SEQ ID NO: 599480 - DNA, 25 bp, Rattus norvegicus
gggtggccacgcccactaaaggctc

SEQ ID NO: 599481 - DNA, 25 bp, Rattus norvegicus
catggctccgttagactctgcgtcc

SEQ ID NO: 599482 - DNA, 25 bp, Rattus norvegicus
agcagaagggcccagcctctgcctt

SEQ ID NO: 599483 - DNA, 25 bp, Rattus norvegicus
accgtaaagttcgtgggcatggctc

SEQ ID NO: 599484 - DNA, 25 bp, Rattus norvegicus
tcttccgtgcgctcagcagcttcgt

SEQ ID NO: 599485 - DNA, 25 bp, Rattus norvegicus
agacccgggttcttccgtgcgctca

SEQ ID NO: 599486 - DNA, 25 bp, Rattus norvegicus
aggatccgcgctctcgggagacccg

SEQ ID NO: 599487 - DNA, 25 bp, Rattus norvegicus
tagggcaggcaggatccgcgctctc

SEQ ID NO: 599488 - DNA, 25 bp, Rattus norvegicus
tgcggccaagctcacccggcgtagg

SEQ ID NO: 599489 - DNA, 25 bp, Rattus norvegicus
cccgttgcaggtgcggccaagctca

SEQ ID NO: 599490 - DNA, 25 bp, Rattus norvegicus
ccacggctcaggaaaagtttgcccg

SEQ ID NO: 599491 - DNA, 25 bp, Rattus norvegicus
ccagagcggcccagcggcagcagaa

SEQ ID NO: 599492 - DNA, 25 bp, Rattus norvegicus
ggccgccgccaaccaacgagccaga

SEQ ID NO: 599493 - DNA, 25 bp, Rattus norvegicus
ggttccgaatctctgcgccctcaga

SEQ ID NO: 599494 - DNA, 25 bp, Rattus norvegicus
cggcagttccgtccgggacctcaga

SEQ ID NO: 599495 - DNA, 25 bp, Rattus norvegicus
ccgcgagaccttcggtaagaccgag

SEQ ID NO: 599496 - DNA, 25 bp, Rattus norvegicus
acctgaagcccggaggcccgcgaga

SEQ ID NO: 599497 - DNA, 25 bp, Rattus norvegicus
cgccctcagacaggggccaagcaag

SEQ ID NO: 599498 - DNA, 25 bp, Rattus norvegicus
tagggtagggcttcagcccacgtgc

SEQ ID NO: 599499 - DNA, 25 bp, Rattus norvegicus
ctcgtcttcggacgccctgtcattg

SEQ ID NO: 599500 - DNA, 25 bp, Rattus norvegicus
cagcccagggctgggtcttcgacct

SEQ ID NO: 599501 - DNA, 25 bp, Rattus norvegicus
gaccattggctgtgcgtcttcggcc

SEQ ID NO: 599502 - DNA, 25 bp, Rattus norvegicus
gttccgcgctgcacgaccattggct

SEQ ID NO: 599503 - DNA, 25 bp, Rattus norvegicus
aggctgcagtggtgacagccgtccc

SEQ ID NO: 599504 - DNA, 25 bp, Rattus norvegicus
agcccacgtgcgtccgaggctgcag

SEQ ID NO: 599505 - DNA, 25 bp, Rattus norvegicus
acgccctgtcattggctgagcctta

SEQ ID NO: 599506 - DNA, 25 bp, Rattus norvegicus
ccaagcaaggcaggcgctgacctga

SEQ ID NO: 599507 - DNA, 25 bp, Rattus norvegicus
ggcgcgccttgcaatgtctccttgt

SEQ ID NO: 599508 - DNA, 25 bp, Rattus norvegicus
cgagctgcctcaaatgcctggaata

SEQ ID NO: 599509 - DNA, 25 bp, Rattus norvegicus
cctggaataattccgcttccgtttg

SEQ ID NO: 599510 - DNA, 25 bp, Rattus norvegicus
tttggaaagccgcagcctcagtccc

SEQ ID NO: 599511 - DNA, 25 bp, Rattus norvegicus
ctccgtcccgcaagaaggatgactc

SEQ ID NO: 599512 - DNA, 25 bp, Rattus norvegicus
aagcggcactgctctccctggatct

SEQ ID NO: 599513 - DNA, 25 bp, Rattus norvegicus
aggtccttttctgaagcggcactgc

SEQ ID NO: 599514 - DNA, 25 bp, Rattus norvegicus
agccttcattggtctgctgagcgcc

SEQ ID NO: 599515 - DNA, 25 bp, Rattus norvegicus
agccaaggaaggtaggaacagccga

SEQ ID NO: 599516 - DNA, 25 bp, Rattus norvegicus
ccaaccggatcggtgtcatcgctgg

SEQ ID NO: 599517 - DNA, 25 bp, Rattus norvegicus
ggctgttgtcccagagtccaggccc

SEQ ID NO: 599518 - DNA, 25 bp, Rattus norvegicus
gatgactcgttcttggggaaacttg

SEQ ID NO: 599519 - DNA, 25 bp, Rattus norvegicus
gcgcccgaggactggcatttgccaa

SEQ ID NO: 599520 - DNA, 25 bp, Rattus norvegicus
gccaagtttctgctggaaagttttc

SEQ ID NO: 599521 - DNA, 25 bp, Rattus norvegicus
tcggtcctggcgttcatttcattcc

SEQ ID NO: 599522 - DNA, 25 bp, Rattus norvegicus
tcgctgccagcgcacaccaggaggg

SEQ ID NO: 599523 - DNA, 25 bp, Rattus norvegicus
cgtcaccgcgatcggcgctttgtgt

SEQ ID NO: 599524 - DNA, 25 bp, Rattus norvegicus
cggcgctttgtgtgcggctcccgaa

SEQ ID NO: 599525 - DNA, 25 bp, Rattus norvegicus
gcgcacctcgctccttgtctgggaa

SEQ ID NO: 599526 - DNA, 25 bp, Rattus norvegicus
tcgctccttgtctgggaagcgccga

SEQ ID NO: 599527 - DNA, 25 bp, Rattus norvegicus
aagcgccgagttcggcgcgatcacg

SEQ ID NO: 599528 - DNA, 25 bp, Rattus norvegicus
cccttccagtctgggagcgtcgctg

SEQ ID NO: 599529 - DNA, 25 bp, Rattus norvegicus
ggctgtctaggcgtcaccgcgatcg

SEQ ID NO: 599530 - DNA, 25 bp, Rattus norvegicus
atttcattcctgtcctcattccgca

SEQ ID NO: 599531 - DNA, 25 bp, Rattus norvegicus
ccctccggagcgagttcggtcctgg

SEQ ID NO: 599532 - DNA, 25 bp, Rattus norvegicus
ccggcggcatgacgtcaccgaggct

SEQ ID NO: 599533 - DNA, 25 bp, Rattus norvegicus
gtttcctgaagagcaacctcccttc

SEQ ID NO: 599534 - DNA, 25 bp, Rattus norvegicus
acactcgcttccagctcgcggggag

SEQ ID NO: 599535 - DNA, 25 bp, Rattus norvegicus
atgcgaaggcatggagtcaactacg

SEQ ID NO: 599536 - DNA, 25 bp, Rattus norvegicus
gtcaactacgtgcaggatacctatc

SEQ ID NO: 599537 - DNA, 25 bp, Rattus norvegicus
caaggtgcacctagaccgcatgcga

SEQ ID NO: 599538 - DNA, 25 bp, Rattus norvegicus
tagaccgctacgaggccaaggtgca

SEQ ID NO: 599539 - DNA, 25 bp, Rattus norvegicus
agctggaccgcgagatagaccgcta

SEQ ID NO: 599540 - DNA, 25 bp, Rattus norvegicus
ggatcacacgatccgccagcaggtg

SEQ ID NO: 599541 - DNA, 25 bp, Rattus norvegicus
atctggtgctgtcgcaggatcacac

SEQ ID NO: 599542 - DNA, 25 bp, Rattus norvegicus
tacgcaaggccttccgcaagctggc

SEQ ID NO: 599543 - DNA, 25 bp, Rattus norvegicus
aatgtacgcttcgtgctggtgcgca

SEQ ID NO: 599544 - DNA, 25 bp, Rattus norvegicus
tcctgcccaacaagacgcggatctt

SEQ ID NO: 599545 - DNA, 25 bp, Rattus norvegicus
ccgcagtgctattgcatcgtggaga

SEQ ID NO: 599546 - DNA, 25 bp, Rattus norvegicus
tcctggttgcgctatggatccttcg

SEQ ID NO: 599547 - DNA, 25 bp, Rattus norvegicus
gacttgctcctcacgtcctggttgc

SEQ ID NO: 599548 - DNA, 25 bp, Rattus norvegicus
tcgaccggccaactcctgaaaagga

SEQ ID NO: 599549 - DNA, 25 bp, Rattus norvegicus
ggcgtgtgcttctgtgcaccaaatg

SEQ ID NO: 599550 - DNA, 25 bp, Rattus norvegicus
ccctgggacactgacaacgggcacg

SEQ ID NO: 599551 - DNA, 25 bp, Rattus norvegicus
cgtccttatggcctgtcttggggct

SEQ ID NO: 599552 - DNA, 25 bp, Rattus norvegicus
ccaagacaattcagttcgcgcgctc

SEQ ID NO: 599553 - DNA, 25 bp, Rattus norvegicus
gcgaattggtttgggttgtccgcca

SEQ ID NO: 599554 - DNA, 25 bp, Rattus norvegicus
cgcggagccgaacgcgaattggttt

SEQ ID NO: 599555 - DNA, 25 bp, Rattus norvegicus
actggattggctatcttaacgcgga

SEQ ID NO: 599556 - DNA, 25 bp, Rattus norvegicus
agcggcttttctatcggtcactgga

SEQ ID NO: 599557 - DNA, 25 bp, Rattus norvegicus
cgacatttagggaaggcagaaagta

SEQ ID NO: 599558 - DNA, 25 bp, Rattus norvegicus
aaccagccctgacgtcttgccattg

SEQ ID NO: 599559 - DNA, 25 bp, Rattus norvegicus
ccgattggtccactcctcggggcgt

SEQ ID NO: 599560 - DNA, 25 bp, Rattus norvegicus
agaaatccacagagcgcgccgattg

SEQ ID NO: 599561 - DNA, 25 bp, Rattus norvegicus
tgaaggctggggcaagaaatccaca

SEQ ID NO: 599562 - DNA, 25 bp, Rattus norvegicus
tcttgccattggtcagcggcttttc

SEQ ID NO: 599563 - DNA, 25 bp, Rattus norvegicus
gagtagtgtttcagggtctccgctg

SEQ ID NO: 599564 - DNA, 25 bp, Rattus norvegicus
ccgagagttgaggagaagagctaca

SEQ ID NO: 599565 - DNA, 25 bp, Rattus norvegicus
ctcgcgagacttcgcactaggaaga

SEQ ID NO: 599566 - DNA, 25 bp, Rattus norvegicus
ctgtgctttagtttgcctgtggact

SEQ ID NO: 599567 - DNA, 25 bp, Rattus norvegicus
tggactttgcgttcggcagtcagcc

SEQ ID NO: 599568 - DNA, 25 bp, Rattus norvegicus
cacgcttcctgtcacctttagggaa

SEQ ID NO: 599569 - DNA, 25 bp, Rattus norvegicus
gtctccgggccagtaaaagcagtgc

SEQ ID NO: 599570 - DNA, 25 bp, Rattus norvegicus
cctgggagacttctaggagagcgtt

SEQ ID NO: 599571 - DNA, 25 bp, Rattus norvegicus
agagcgtttctctcagcagagcgaa

SEQ ID NO: 599572 - DNA, 25 bp, Rattus norvegicus
ggccgctgcttggtttcaaatgctc

SEQ ID NO: 599573 - DNA, 25 bp, Rattus norvegicus
aaatgctctgctgttggcgggaacc

SEQ ID NO: 599574 - DNA, 25 bp, Rattus norvegicus
gggaaccggtgcactagctgacaca

SEQ ID NO: 599575 - DNA, 25 bp, Rattus norvegicus
gcccttgagacgtccaccgagagtt

SEQ ID NO: 599576 - DNA, 25 bp, Rattus norvegicus
ggctctttagctgcttctcgcgaga

SEQ ID NO: 599577 - DNA, 25 bp, Rattus norvegicus
gccaataggcgaaccgctgtctgtc

SEQ ID NO: 599578 - DNA, 25 bp, Rattus norvegicus
ccagggtgcacgttggtagtaccca

SEQ ID NO: 599579 - DNA, 25 bp, Rattus norvegicus
tagtacccaagcacgctgcgatggc

SEQ ID NO: 599580 - DNA, 25 bp, Rattus norvegicus
tgcgatggctgccactagtcccgca

SEQ ID NO: 599581 - DNA, 25 bp, Rattus norvegicus
actagtcccgcaccttttgcatggg

SEQ ID NO: 599582 - DNA, 25 bp, Rattus norvegicus
caccttttgcatgggctgggctcca

SEQ ID NO: 599583 - DNA, 25 bp, Rattus norvegicus
agagtgtgagcgagagccaatcaga

SEQ ID NO: 599584 - DNA, 25 bp, Rattus norvegicus
tcagaagcagacgtggaaaagaggc

SEQ ID NO: 599585 - DNA, 25 bp, Rattus norvegicus
cgcaatagcggtcccagccaatagg

SEQ ID NO: 599586 - DNA, 25 bp, Rattus norvegicus
tgtctgtccgctcttcagcagccgg

SEQ ID NO: 599587 - DNA, 25 bp, Rattus norvegicus
agagcgaggcccgagcttccgcatc

SEQ ID NO: 599588 - DNA, 25 bp, Rattus norvegicus
cttccgcatcgaggtaagcagcacg

SEQ ID NO: 599589 - DNA, 25 bp, Rattus norvegicus
aagcagcacgggctctgtcgtaggc

SEQ ID NO: 599590 - DNA, 25 bp, Rattus norvegicus
tccggacccgtgacgcaatagcggt

SEQ ID NO: 599591 - DNA, 25 bp, Rattus norvegicus
tctcggatgagaccctggacaaagt

SEQ ID NO: 599592 - DNA, 25 bp, Rattus norvegicus
acacagagttcagcctccgcgtgga

SEQ ID NO: 599593 - DNA, 25 bp, Rattus norvegicus
ccgctaatcgccagctcagaaacaa

SEQ ID NO: 599594 - DNA, 25 bp, Rattus norvegicus
ccctggacaaagtggccaagtcgga

SEQ ID NO: 599595 - DNA, 25 bp, Rattus norvegicus
tcagaaacaaaacagcactgcgctg

SEQ ID NO: 599596 - DNA, 25 bp, Rattus norvegicus
cagcgctcgctttctcggatgagac

SEQ ID NO: 599597 - DNA, 25 bp, Rattus norvegicus
ggtcctcgagaatgaggctatctcc

SEQ ID NO: 599598 - DNA, 25 bp, Rattus norvegicus
atcagcataaagttgggaggtcctc

SEQ ID NO: 599599 - DNA, 25 bp, Rattus norvegicus
gacaggggtctgcaacatcagcata

SEQ ID NO: 599600 - DNA, 25 bp, Rattus norvegicus
cttggagtaaaagtgtcctgacagg

SEQ ID NO: 599601 - DNA, 25 bp, Rattus norvegicus
tctgcagctcccgtcacttggagta

SEQ ID NO: 599602 - DNA, 25 bp, Rattus norvegicus
agcgcagctccgcagccaaagcgag

SEQ ID NO: 599603 - DNA, 25 bp, Rattus norvegicus
gggatccgggcgcaaatcagccctc

SEQ ID NO: 599604 - DNA, 25 bp, Rattus norvegicus
agtcggagggctactgcagccgcat

SEQ ID NO: 599605 - DNA, 25 bp, Rattus norvegicus
cgataaggtggaactgcgcttccca

SEQ ID NO: 599606 - DNA, 25 bp, Rattus norvegicus
ttagagctccgggaggaagacaacg

SEQ ID NO: 599607 - DNA, 25 bp, Rattus norvegicus
tgcagacctgcccttagagctccgg

SEQ ID NO: 599608 - DNA, 25 bp, Rattus norvegicus
tggagcgccctaggcagcagaccct

SEQ ID NO: 599609 - DNA, 25 bp, Rattus norvegicus
ccgggctggggtactacatatgcat

SEQ ID NO: 599610 - DNA, 25 bp, Rattus norvegicus
caccgctacaaatggccgtctgggg

SEQ ID NO: 599611 - DNA, 25 bp, Rattus norvegicus
gagcgcgatcctcttcgcggctctg

SEQ ID NO: 599612 - DNA, 25 bp, Rattus norvegicus
aggccgtctccaagcacctggatga

SEQ ID NO: 599613 - DNA, 25 bp, Rattus norvegicus
gccctctgggccacattcctgagaa

SEQ ID NO: 599614 - DNA, 25 bp, Rattus norvegicus
ccgccctgaccgcagcgataaggtg

SEQ ID NO: 599615 - DNA, 25 bp, Rattus norvegicus
tgccaccaaggcaagcgcgaggtcc

SEQ ID NO: 599616 - DNA, 25 bp, Rattus norvegicus
agcctccaagtagtccgggccatcg

SEQ ID NO: 599617 - DNA, 25 bp, Rattus norvegicus
gtggtgcgaagcctccaagtagtcc

SEQ ID NO: 599618 - DNA, 25 bp, Rattus norvegicus
cacattcctgagaagccggagtcct

SEQ ID NO: 599619 - DNA, 25 bp, Rattus norvegicus
cctcttaaaggagaaatagcggcgg

SEQ ID NO: 599620 - DNA, 25 bp, Rattus norvegicus
gtaggcagctgtcttcccgctccaa

SEQ ID NO: 599621 - DNA, 25 bp, Rattus norvegicus
cccattcattgcagacagagcgggg

SEQ ID NO: 599622 - DNA, 25 bp, Rattus norvegicus
ctcgcagctcgccaagttcctgttg

SEQ ID NO: 599623 - DNA, 25 bp, Rattus norvegicus
tggaacagtggtgcctcctcaagga

SEQ ID NO: 599624 - DNA, 25 bp, Rattus norvegicus
gcgccgcagcaagtgccgcattcgg

SEQ ID NO: 599625 - DNA, 25 bp, Rattus norvegicus
gcatatggcctctccggtggcagac

SEQ ID NO: 599626 - DNA, 25 bp, Rattus norvegicus
agggtccactctggctctaagaagg

SEQ ID NO: 599627 - DNA, 25 bp, Rattus norvegicus
gaggtcttttcccttgcctgcaacc

SEQ ID NO: 599628 - DNA, 25 bp, Rattus norvegicus
tgcaagtttccagtcgaggtctttt

SEQ ID NO: 599629 - DNA, 25 bp, Rattus norvegicus
cctccagacaaggagtgcaagtttc

SEQ ID NO: 599630 - DNA, 25 bp, Rattus norvegicus
cccacgaggattggcccggtgctct

SEQ ID NO: 599631 - DNA, 25 bp, Rattus norvegicus
cttctgtggctttcgagcccgcacg

SEQ ID NO: 599632 - DNA, 25 bp, Rattus norvegicus
gagcgctgcggagccactatggtct

SEQ ID NO: 599633 - DNA, 25 bp, Rattus norvegicus
agctgtggagtcgaggtccacacca

SEQ ID NO: 599634 - DNA, 25 bp, Rattus norvegicus
ggtccacaccacagtgacaactcgg

SEQ ID NO: 599635 - DNA, 25 bp, Rattus norvegicus
agaatcttgggactcctccgccgtg

SEQ ID NO: 599636 - DNA, 25 bp, Rattus norvegicus
agtgacaactcggagcaccacgtca

SEQ ID NO: 599637 - DNA, 25 bp, Rattus norvegicus
aactcggagcaccacgtcacggggc

SEQ ID NO: 599638 - DNA, 25 bp, Rattus norvegicus
cggggccgcgattgccaacataaca

SEQ ID NO: 599639 - DNA, 25 bp, Rattus norvegicus
cggcctagtcaagcgcccggcatct

SEQ ID NO: 599640 - DNA, 25 bp, Rattus norvegicus
acagtcgtatctgttcgaggagggc

SEQ ID NO: 599641 - DNA, 25 bp, Rattus norvegicus
taggaccgtcgactaccggtccaga

SEQ ID NO: 599642 - DNA, 25 bp, Rattus norvegicus
cagcaagcgaagacgctgcagaatc

SEQ ID NO: 599643 - DNA, 25 bp, Rattus norvegicus
acgctgcagaatcttgggactcctc

SEQ ID NO: 599644 - DNA, 25 bp, Rattus norvegicus
tcggggcccaggctgctacctggct

SEQ ID NO: 599645 - DNA, 25 bp, Rattus norvegicus
ccaggctgctacctggctccgtggg

SEQ ID NO: 599646 - DNA, 25 bp, Rattus norvegicus
tgccaacataacacagtcgtatctg

SEQ ID NO: 599647 - DNA, 25 bp, Rattus norvegicus
atgggcagcgcatctacttcttgtg

SEQ ID NO: 599648 - DNA, 25 bp, Rattus norvegicus
cgccgcgatgactgctggatgcgaa

SEQ ID NO: 599649 - DNA, 25 bp, Rattus norvegicus
ccaggcgccgcgatgactgctggat

SEQ ID NO: 599650 - DNA, 25 bp, Rattus norvegicus
acatgttggcgtcggaacgccaggc

SEQ ID NO: 599651 - DNA, 25 bp, Rattus norvegicus
caccacgaagcgctgggacatgttg

SEQ ID NO: 599652 - DNA, 25 bp, Rattus norvegicus
ctctgtgctgggatcaccacgaagc

SEQ ID NO: 599653 - DNA, 25 bp, Rattus norvegicus
gtcccgctctgtgctgggatcacca

SEQ ID NO: 599654 - DNA, 25 bp, Rattus norvegicus
gccgctgccaccttctgccctgggt

SEQ ID NO: 599655 - DNA, 25 bp, Rattus norvegicus
atgactgctggatgcgaaggtctgc

SEQ ID NO: 599656 - DNA, 25 bp, Rattus norvegicus
agcgcatctacttcttgtgttttca

SEQ ID NO: 599657 - DNA, 25 bp, Rattus norvegicus
atgcgaaggtctgccggtgctgacc

SEQ ID NO: 599658 - DNA, 25 bp, Rattus norvegicus
agtagcgcagaatgggcagcgcatc

SEQ ID NO: 599659 - DNA, 25 bp, Rattus norvegicus
cgcagaatgggcagcgcatctactt

SEQ ID NO: 599660 - DNA, 25 bp, Rattus norvegicus
ttcttgtgttttcagagcggccgcc

SEQ ID NO: 599661 - DNA, 25 bp, Rattus norvegicus
acacaccatagctccggcgaggtta

SEQ ID NO: 599662 - DNA, 25 bp, Rattus norvegicus
ataggccgcctaggttactgatcgc

SEQ ID NO: 599663 - DNA, 25 bp, Rattus norvegicus
gccaggccgcagatgctgaatcact

SEQ ID NO: 599664 - DNA, 25 bp, Rattus norvegicus
gaatcactgcaggagcatgtccgtg

SEQ ID NO: 599665 - DNA, 25 bp, Rattus norvegicus
atgtccgtgaggtaagctccctctc

SEQ ID NO: 599666 - DNA, 25 bp, Rattus norvegicus
ggactcggggctcaacacaccatag

SEQ ID NO: 599667 - DNA, 25 bp, Rattus norvegicus
agagccacggatcagcgtttaacgc

SEQ ID NO: 599668 - DNA, 25 bp, Rattus norvegicus
cgaggttacaaccagacacagcagc

SEQ ID NO: 599669 - DNA, 25 bp, Rattus norvegicus
cagcggacacaggaacacggcctca

SEQ ID NO: 599670 - DNA, 25 bp, Rattus norvegicus
cggcctcaactacggttcggtgatc

SEQ ID NO: 599671 - DNA, 25 bp, Rattus norvegicus
ttcggtgatcgtcaaagaaggctgc

SEQ ID NO: 599672 - DNA, 25 bp, Rattus norvegicus
gccgacgcaggaagtgcagtctatc

SEQ ID NO: 599673 - DNA, 25 bp, Rattus norvegicus
agtgcagtctatcccagagccacgg

SEQ ID NO: 599674 - DNA, 25 bp, Rattus norvegicus
gcctcagggaacagaggccgatccc

SEQ ID NO: 599675 - DNA, 25 bp, Rattus norvegicus
gcttctgcaacgtggagccgccggc

SEQ ID NO: 599676 - DNA, 25 bp, Rattus norvegicus
tcagcatcgcctgtgccttcttctt

SEQ ID NO: 599677 - DNA, 25 bp, Rattus norvegicus
agccgtgaccgctctgcgaagctcg

SEQ ID NO: 599678 - DNA, 25 bp, Rattus norvegicus
acgtgaagagctgcgtgagcccgct

SEQ ID NO: 599679 - DNA, 25 bp, Rattus norvegicus
gccgctctccactgcgggcatgagg

SEQ ID NO: 599680 - DNA, 25 bp, Rattus norvegicus
agccggccctgggacaccgagaatc

SEQ ID NO: 599681 - DNA, 25 bp, Rattus norvegicus
tgagcgcttgctcgctcagcctcag

SEQ ID NO: 599682 - DNA, 25 bp, Rattus norvegicus
caggcctctgctgtcgtgcctggtc

SEQ ID NO: 599683 - DNA, 25 bp, Rattus norvegicus
tgtggtgggtgtccttctccggcct

SEQ ID NO: 599684 - DNA, 25 bp, Rattus norvegicus
tgacgctcgcgcctcgcgtgaggct

SEQ ID NO: 599685 - DNA, 25 bp, Rattus norvegicus
tgcctgcctgctgctacctgggcga

SEQ ID NO: 599686 - DNA, 25 bp, Rattus norvegicus
gcgggacacgccagccatgaggtcc

SEQ ID NO: 599687 - DNA, 25 bp, Rattus norvegicus
cctgcgcaacggctacgtgaagagc

SEQ ID NO: 599688 - DNA, 25 bp, Rattus norvegicus
acctctgccgcttctgcaacgtgga

SEQ ID NO: 599689 - DNA, 25 bp, Rattus norvegicus
atgttgccgatgaatggcagccgcg

SEQ ID NO: 599690 - DNA, 25 bp, Rattus norvegicus
acccggctctgcttcctcatgtaga

SEQ ID NO: 599691 - DNA, 25 bp, Rattus norvegicus
aaggtccgcgtcgaggcctacctcg

SEQ ID NO: 599692 - DNA, 25 bp, Rattus norvegicus
ccagggagcagatgttgccgatgaa

SEQ ID NO: 599693 - DNA, 25 bp, Rattus norvegicus
gggaagcccgctggacgtctctgcc

SEQ ID NO: 599694 - DNA, 25 bp, Rattus norvegicus
gctggacgtctctgcctcaggagct

SEQ ID NO: 599695 - DNA, 25 bp, Rattus norvegicus
tgcctcaggagctggcggaccacca

SEQ ID NO: 599696 - DNA, 25 bp, Rattus norvegicus
cggaccaccagcacgagtagtagca

SEQ ID NO: 599697 - DNA, 25 bp, Rattus norvegicus
ccagcacgagtagtagcagaaggaa

SEQ ID NO: 599698 - DNA, 25 bp, Rattus norvegicus
tagcagaaggaaagcgcccgcgagc

SEQ ID NO: 599699 - DNA, 25 bp, Rattus norvegicus
ctccgggcagctgaaacattggcca

SEQ ID NO: 599700 - DNA, 25 bp, Rattus norvegicus
agctgaaacattggccaaggctggg

SEQ ID NO: 599701 - DNA, 25 bp, Rattus norvegicus
aaccagttggtttcgctgaggcccg

SEQ ID NO: 599702 - DNA, 25 bp, Rattus norvegicus
tctgcttcctcatgtagacgtgggg

SEQ ID NO: 599703 - DNA, 25 bp, Rattus norvegicus
acactcagcatttgtgctcctgtgc

SEQ ID NO: 599704 - DNA, 25 bp, Rattus norvegicus
tgtacttttctcgaactcccacact

SEQ ID NO: 599705 - DNA, 25 bp, Rattus norvegicus
gaaacaggcgaaagcgggagggcga

SEQ ID NO: 599706 - DNA, 25 bp, Rattus norvegicus
gggcgagcgtataacacgcaggcca

SEQ ID NO: 599707 - DNA, 25 bp, Rattus norvegicus
gagcgtataacacgcaggccacggc

SEQ ID NO: 599708 - DNA, 25 bp, Rattus norvegicus
gcacgttgcgggaagcgagcgacaa

SEQ ID NO: 599709 - DNA, 25 bp, Rattus norvegicus
aaaaatgatacgagagaagagcagc

SEQ ID NO: 599710 - DNA, 25 bp, Rattus norvegicus
cacgcggaacgaagagcgtggggcc

SEQ ID NO: 599711 - DNA, 25 bp, Rattus norvegicus
ctcggctgcacacactcagcatttg

SEQ ID NO: 599712 - DNA, 25 bp, Rattus norvegicus
cggctgcacacactcagcatttgtg

SEQ ID NO: 599713 - DNA, 25 bp, Rattus norvegicus
tgtgctcctgtgctcctgtgtactt

SEQ ID NO: 599714 - DNA, 25 bp, Rattus norvegicus
gctcctgtgtacttttctcgaactc

SEQ ID NO: 599715 - DNA, 25 bp, Rattus norvegicus
cactcttacacacctctgtgtgttc

SEQ ID NO: 599716 - DNA, 25 bp, Rattus norvegicus
atttgtgctcctgtgctcctgtgta

SEQ ID NO: 599717 - DNA, 25 bp, Rattus norvegicus
ggtgagccgggtctctaattagacc

SEQ ID NO: 599718 - DNA, 25 bp, Rattus norvegicus
acaaacacttggcagggcgcgcgcc

SEQ ID NO: 599719 - DNA, 25 bp, Rattus norvegicus
ggccgaagacaacgcagtcctcagc

SEQ ID NO: 599720 - DNA, 25 bp, Rattus norvegicus
ccgcaggggccgaagacaacgcagt

SEQ ID NO: 599721 - DNA, 25 bp, Rattus norvegicus
ggcgcgcgccgccaggaaagagtct

SEQ ID NO: 599722 - DNA, 25 bp, Rattus norvegicus
agccttgcaggccacggtgcctggc

SEQ ID NO: 599723 - DNA, 25 bp, Rattus norvegicus
tgacagcgcgcggtctccaccgtgg

SEQ ID NO: 599724 - DNA, 25 bp, Rattus norvegicus
tcccacagatgacagcgcgcggtct

SEQ ID NO: 599725 - DNA, 25 bp, Rattus norvegicus
gttctcattccagagctcccacaga

SEQ ID NO: 599726 - DNA, 25 bp, Rattus norvegicus
tggagcctccgggtgatggcccaac

SEQ ID NO: 599727 - DNA, 25 bp, Rattus norvegicus
tctctaattagacccgaccacgttc

SEQ ID NO: 599728 - DNA, 25 bp, Rattus norvegicus
caacccaggggtgagccgggtctct

SEQ ID NO: 599729 - DNA, 25 bp, Rattus norvegicus
attagacccgaccacgttctcattc

SEQ ID NO: 599730 - DNA, 25 bp, Rattus norvegicus
aggggctccgaaatagccctcgcgc

SEQ ID NO: 599731 - DNA, 25 bp, Rattus norvegicus
tgctgagcaaagaggaccaccgttg

SEQ ID NO: 599732 - DNA, 25 bp, Rattus norvegicus
gcgcaaaggacctggaagtcgaacc

SEQ ID NO: 599733 - DNA, 25 bp, Rattus norvegicus
agcctttgcacaagcccgggtcctt

SEQ ID NO: 599734 - DNA, 25 bp, Rattus norvegicus
ctggccgttcctttgcagcagttca

SEQ ID NO: 599735 - DNA, 25 bp, Rattus norvegicus
gctaatctgtcctccgcagagcctg

SEQ ID NO: 599736 - DNA, 25 bp, Rattus norvegicus
ttatcttaaagctgcgcggacccgg

SEQ ID NO: 599737 - DNA, 25 bp, Rattus norvegicus
cgaccaccttttatctgtccgaaca

SEQ ID NO: 599738 - DNA, 25 bp, Rattus norvegicus
ggtccttcttcgcactgccctttaa

SEQ ID NO: 599739 - DNA, 25 bp, Rattus norvegicus
ctcttagaactgtggcggcgcagtc

SEQ ID NO: 599740 - DNA, 25 bp, Rattus norvegicus
gactggctgacactgacgcctctta

SEQ ID NO: 599741 - DNA, 25 bp, Rattus norvegicus
accaccgttgggttgcgaactgcct

SEQ ID NO: 599742 - DNA, 25 bp, Rattus norvegicus
gactggaactcgaatgtcccgggaa

SEQ ID NO: 599743 - DNA, 25 bp, Rattus norvegicus
ccgaaatgggaggttcagaagccca

SEQ ID NO: 599744 - DNA, 25 bp, Rattus norvegicus
ggcggcgcagtcacaccgcgaatca

SEQ ID NO: 599745 - DNA, 25 bp, Rattus norvegicus
tgccgcccgttaactcaagtctgcg

SEQ ID NO: 599746 - DNA, 25 bp, Rattus norvegicus
agcgctgagcgcacaagtttgctgc

SEQ ID NO: 599747 - DNA, 25 bp, Rattus norvegicus
taggtcaattagctgagcctgggga

SEQ ID NO: 599748 - DNA, 25 bp, Rattus norvegicus
gcgcagagaaactaaccccagaggt

SEQ ID NO: 599749 - DNA, 25 bp, Rattus norvegicus
gcacaagtttgctgccggggtgcca

SEQ ID NO: 599750 - DNA, 25 bp, Rattus norvegicus
cccaacaggtagctcgcactgctgc

SEQ ID NO: 599751 - DNA, 25 bp, Rattus norvegicus
gctctcctaagtcgttcgctccgtc

SEQ ID NO: 599752 - DNA, 25 bp, Rattus norvegicus
ggctccaggatggtacctcacggga

SEQ ID NO: 599753 - DNA, 25 bp, Rattus norvegicus
agtccacagcaagcgagcggcgccg

SEQ ID NO: 599754 - DNA, 25 bp, Rattus norvegicus
agccgcgactctgccaagggctgcg

SEQ ID NO: 599755 - DNA, 25 bp, Rattus norvegicus
gcgccgcgggagtaaaaggcattaa

SEQ ID NO: 599756 - DNA, 25 bp, Rattus norvegicus
tacctcacgggagggctccttgtgc

SEQ ID NO: 599757 - DNA, 25 bp, Rattus norvegicus
gcgactctgccaagggctgcgctcg

SEQ ID NO: 599758 - DNA, 25 bp, Rattus norvegicus
ggagtcggtgctaggtcaattagct

SEQ ID NO: 599759 - DNA, 25 bp, Rattus norvegicus
tttgcacctcgaccaaccaaaggca

SEQ ID NO: 599760 - DNA, 25 bp, Rattus norvegicus
agaagtctacgaagggcacccgaca

SEQ ID NO: 599761 - DNA, 25 bp, Rattus norvegicus
aatcctggaacacacacgctcactt

SEQ ID NO: 599762 - DNA, 25 bp, Rattus norvegicus
acttctcctggggtccggagccatc

SEQ ID NO: 599763 - DNA, 25 bp, Rattus norvegicus
cccaggctttgaaatgccaggactc

SEQ ID NO: 599764 - DNA, 25 bp, Rattus norvegicus
tgccaggactcagaagggaagaaga

SEQ ID NO: 599765 - DNA, 25 bp, Rattus norvegicus
tgcgggttccaagaagtctacgaag

SEQ ID NO: 599766 - DNA, 25 bp, Rattus norvegicus
gtgtttgtgtccctttgcacctcga

SEQ ID NO: 599767 - DNA, 25 bp, Rattus norvegicus
ccaaaggcaactcggctttactaag

SEQ ID NO: 599768 - DNA, 25 bp, Rattus norvegicus
gctttactaagtttggcctcgcacc

SEQ ID NO: 599769 - DNA, 25 bp, Rattus norvegicus
tttggcctcgcacctccagagaaga

SEQ ID NO: 599770 - DNA, 25 bp, Rattus norvegicus
ctccagagaagaggcacgaactggt

SEQ ID NO: 599771 - DNA, 25 bp, Rattus norvegicus
cgaactggtgagacaaggcgcgcac

SEQ ID NO: 599772 - DNA, 25 bp, Rattus norvegicus
gctgacttacctgcgtgctgcggtt

SEQ ID NO: 599773 - DNA, 25 bp, Rattus norvegicus
tccactcgaagtccgtgtgcacgcg

SEQ ID NO: 599774 - DNA, 25 bp, Rattus norvegicus
ccgcgtcgtaatgagtctggttgta

SEQ ID NO: 599775 - DNA, 25 bp, Rattus norvegicus
ttccattggcgaagtggccgcagaa

SEQ ID NO: 599776 - DNA, 25 bp, Rattus norvegicus
ccactcgcgcctgacgatcttgaag

SEQ ID NO: 599777 - DNA, 25 bp, Rattus norvegicus
gtagccttgcacgatcttgggcaga

SEQ ID NO: 599778 - DNA, 25 bp, Rattus norvegicus
cctccgaaaggctagctgtccagaa

SEQ ID NO: 599779 - DNA, 25 bp, Rattus norvegicus
tgtcctcagcgttctggctctcatc

SEQ ID NO: 599780 - DNA, 25 bp, Rattus norvegicus
cagatcctcgtgtggctccagcaca

SEQ ID NO: 599781 - DNA, 25 bp, Rattus norvegicus
tgcacgtccactggcagctaatgcg

SEQ ID NO: 599782 - DNA, 25 bp, Rattus norvegicus
taatgcgctccgatccagactctgc

SEQ ID NO: 599783 - DNA, 25 bp, Rattus norvegicus
tggtctcctcgcgttccagagtttc

SEQ ID NO: 599784 - DNA, 25 bp, Rattus norvegicus
cgggtccactgacatcccagggctg

SEQ ID NO: 599785 - DNA, 25 bp, Rattus norvegicus
agtccgaattgtccacgcagtcctc

SEQ ID NO: 599786 - DNA, 25 bp, Rattus norvegicus
acgttgaactgtgccttgtcctgcc

SEQ ID NO: 599787 - DNA, 25 bp, Rattus norvegicus
tgccaccttgagtcgagtcagggcc

SEQ ID NO: 599788 - DNA, 25 bp, Rattus norvegicus
actctatcagcagggtcgccacagc

SEQ ID NO: 599789 - DNA, 25 bp, Rattus norvegicus
agctaacctgtttcgggtgtccacg

SEQ ID NO: 599790 - DNA, 25 bp, Rattus norvegicus
tcgctggccaggcttagctaacctg

SEQ ID NO: 599791 - DNA, 25 bp, Rattus norvegicus
gcggagttaacacggtgagcccaca

SEQ ID NO: 599792 - DNA, 25 bp, Rattus norvegicus
cgtactattgacctgccctggcgga

SEQ ID NO: 599793 - DNA, 25 bp, Rattus norvegicus
cctgcgcaagcgtactattgacctg

SEQ ID NO: 599794 - DNA, 25 bp, Rattus norvegicus
gcagcacgctgattggctcactcta

SEQ ID NO: 599795 - DNA, 25 bp, Rattus norvegicus
tcacctcaatgcgttgcggacagcg

SEQ ID NO: 599796 - DNA, 25 bp, Rattus norvegicus
cgagccgcgttcacctcaatgcgtt

SEQ ID NO: 599797 - DNA, 25 bp, Rattus norvegicus
gccggcctggaacaacctgcgcagg

SEQ ID NO: 599798 - DNA, 25 bp, Rattus norvegicus
acccactcagtcaggcgggcgactt

SEQ ID NO: 599799 - DNA, 25 bp, Rattus norvegicus
cggcgcccgaatgacgcgagactgt

SEQ ID NO: 599800 - DNA, 25 bp, Rattus norvegicus
ggggtctccagaagctgtcactaca

SEQ ID NO: 599801 - DNA, 25 bp, Rattus norvegicus
acggctgacattccggcccaacgac

SEQ ID NO: 599802 - DNA, 25 bp, Rattus norvegicus
agtttccatcctagaagcgcttctg

SEQ ID NO: 599803 - DNA, 25 bp, Rattus norvegicus
gagcctgcaggctcaggtgattcca

SEQ ID NO: 599804 - DNA, 25 bp, Rattus norvegicus
tgcaggctcaggtgattccaggaaa

SEQ ID NO: 599805 - DNA, 25 bp, Rattus norvegicus
gtgattccaggaaacctccagcgtc

SEQ ID NO: 599806 - DNA, 25 bp, Rattus norvegicus
ggttggggctagagtttccatccta

SEQ ID NO: 599807 - DNA, 25 bp, Rattus norvegicus
tagaagcgcttctgcctgcttcggc

SEQ ID NO: 599808 - DNA, 25 bp, Rattus norvegicus
cctgcttcggcggatacacagacgc

SEQ ID NO: 599809 - DNA, 25 bp, Rattus norvegicus
tcggcggatacacagacgcgcgcgc

SEQ ID NO: 599810 - DNA, 25 bp, Rattus norvegicus
acacacagagtcactaagtcagtca

SEQ ID NO: 599811 - DNA, 25 bp, Rattus norvegicus
gagtcactaagtcagtcacgcacga

SEQ ID NO: 599812 - DNA, 25 bp, Rattus norvegicus
agtcagtcacgcacgaacgcacggc

SEQ ID NO: 599813 - DNA, 25 bp, Rattus norvegicus
acgaacgcacggctgacattccggc

SEQ ID NO: 599814 - DNA, 25 bp, Rattus norvegicus
acgcacgaacgcacggctgacattc

SEQ ID NO: 599815 - DNA, 25 bp, Rattus norvegicus
agtctcacccgcacggggtgaaacg

SEQ ID NO: 599816 - DNA, 25 bp, Rattus norvegicus
cgaagaaagcgtagcctccgagggc

SEQ ID NO: 599817 - DNA, 25 bp, Rattus norvegicus
cgagatgcttcgctcggcctcctgg

SEQ ID NO: 599818 - DNA, 25 bp, Rattus norvegicus
tgggaattgtagtttaaatcgctga

SEQ ID NO: 599819 - DNA, 25 bp, Rattus norvegicus
cgctgaagatggcttagtcaggcca

SEQ ID NO: 599820 - DNA, 25 bp, Rattus norvegicus
gtcaggccagtaaagagtgaatcca

SEQ ID NO: 599821 - DNA, 25 bp, Rattus norvegicus
acaactcccagtgtgctccagggta

SEQ ID NO: 599822 - DNA, 25 bp, Rattus norvegicus
ctctgcgttctggagtggcgctgct

SEQ ID NO: 599823 - DNA, 25 bp, Rattus norvegicus
tcgcgtttgaggagaactgcgagtc

SEQ ID NO: 599824 - DNA, 25 bp, Rattus norvegicus
actgcgagtctgtttggcctatacc

SEQ ID NO: 599825 - DNA, 25 bp, Rattus norvegicus
tatacccatcggtatcccagctacg

SEQ ID NO: 599826 - DNA, 25 bp, Rattus norvegicus
cagctacgatgagtgctgcccggga

SEQ ID NO: 599827 - DNA, 25 bp, Rattus norvegicus
gggtgaaacgttcagcctctcccga

SEQ ID NO: 599828 - DNA, 25 bp, Rattus norvegicus
ggaaagctccctctacacgccgaag

SEQ ID NO: 599829 - DNA, 25 bp, Rattus norvegicus
cgcatctgccagtatcgacggggca

SEQ ID NO: 599830 - DNA, 25 bp, Rattus norvegicus
gcgaccggaggaatctgacatattg

SEQ ID NO: 599831 - DNA, 25 bp, Rattus norvegicus
cccaacgagatgaacttcttcacgt

SEQ ID NO: 599832 - DNA, 25 bp, Rattus norvegicus
cgttctttaagaagcggcgctcatt

SEQ ID NO: 599833 - DNA, 25 bp, Rattus norvegicus
agctgctggaataggggtcgcatct

SEQ ID NO: 599834 - DNA, 25 bp, Rattus norvegicus
acatattggcactttgcgtggttca

SEQ ID NO: 599835 - DNA, 25 bp, Rattus norvegicus
gttcgaaatctgcagtgcgaccgga

SEQ ID NO: 599836 - DNA, 25 bp, Rattus norvegicus
acccgctggtttgctgttcgaaatc

SEQ ID NO: 599837 - DNA, 25 bp, Rattus norvegicus
gctggtgtccatggcatccggcacc

SEQ ID NO: 599838 - DNA, 25 bp, Rattus norvegicus
ctgtgtaaccggagcaaactcgtga

SEQ ID NO: 599839 - DNA, 25 bp, Rattus norvegicus
ccgtatacctgccaggggctgctgt

SEQ ID NO: 599840 - DNA, 25 bp, Rattus norvegicus
gcaggcccgaagaaagccgtatacc

SEQ ID NO: 599841 - DNA, 25 bp, Rattus norvegicus
agaccggcaggcaccagctcgcgga

SEQ ID NO: 599842 - DNA, 25 bp, Rattus norvegicus
ctttgcgtggttcatgagcagctgc

SEQ ID NO: 599843 - DNA, 25 bp, Rattus norvegicus
cttcccaaggggagattaatcaggg

SEQ ID NO: 599844 - DNA, 25 bp, Rattus norvegicus
aacagctttgggacacagaacgtgc

SEQ ID NO: 599845 - DNA, 25 bp, Rattus norvegicus
cacattcctttcctcgcagaggatg

SEQ ID NO: 599846 - DNA, 25 bp, Rattus norvegicus
ctcgcagaggatgctgcgaactgga

SEQ ID NO: 599847 - DNA, 25 bp, Rattus norvegicus
cctaacagtccagagggcgccctag

SEQ ID NO: 599848 - DNA, 25 bp, Rattus norvegicus
tcgcaaagagcccacacccacttga

SEQ ID NO: 599849 - DNA, 25 bp, Rattus norvegicus
gggacacagaacgtgcccgggcctc

SEQ ID NO: 599850 - DNA, 25 bp, Rattus norvegicus
gccaccggtcaacagctttgggaca

SEQ ID NO: 599851 - DNA, 25 bp, Rattus norvegicus
ccaaggttccatacgctcgctccga

SEQ ID NO: 599852 - DNA, 25 bp, Rattus norvegicus
gtgcgtgcacacacctgcaggctgc

SEQ ID NO: 599853 - DNA, 25 bp, Rattus norvegicus
ccgagaaagttcgtgcgtgcacaca

SEQ ID NO: 599854 - DNA, 25 bp, Rattus norvegicus
tcccagcgtcctgcccgagaaagtt

SEQ ID NO: 599855 - DNA, 25 bp, Rattus norvegicus
aatcaggggccggatgaattctctc

SEQ ID NO: 599856 - DNA, 25 bp, Rattus norvegicus
gggccggatgaattctctcccaacc

SEQ ID NO: 599857 - DNA, 25 bp, Rattus norvegicus
tcccgttctactagcccaggcagag

SEQ ID NO: 599858 - DNA, 25 bp, Rattus norvegicus
agccagcgcggctacactagcgtcg

SEQ ID NO: 599859 - DNA, 25 bp, Rattus norvegicus
ttcaggcggctaagctcccgttcta

SEQ ID NO: 599860 - DNA, 25 bp, Rattus norvegicus
ccgcctctcacgcacttgatgaaga

SEQ ID NO: 599861 - DNA, 25 bp, Rattus norvegicus
tcgcgggtagagttccaagaatatc

SEQ ID NO: 599862 - DNA, 25 bp, Rattus norvegicus
aatatcattggctgaccgggagccc

SEQ ID NO: 599863 - DNA, 25 bp, Rattus norvegicus
ccatcccatccctgagaagcaagga

SEQ ID NO: 599864 - DNA, 25 bp, Rattus norvegicus
acgccgtaggaccagtgctcaggta

SEQ ID NO: 599865 - DNA, 25 bp, Rattus norvegicus
ctctatgaagaaactggcgccctcc

SEQ ID NO: 599866 - DNA, 25 bp, Rattus norvegicus
ttggtcaaacttgcacagccgtggc

SEQ ID NO: 599867 - DNA, 25 bp, Rattus norvegicus
ccgggcgcttacctgagcggatcat

SEQ ID NO: 599868 - DNA, 25 bp, Rattus norvegicus
gcggatcatgtgaccggagttgacc

SEQ ID NO: 599869 - DNA, 25 bp, Rattus norvegicus
cactacgggagaggtgcacctgtta

SEQ ID NO: 599870 - DNA, 25 bp, Rattus norvegicus
tggtgcgggctcacttactctatga

SEQ ID NO: 599871 - DNA, 25 bp, Rattus norvegicus
tggaacaaaaatcggccttaggatg

SEQ ID NO: 599872 - DNA, 25 bp, Rattus norvegicus
gtcgtcagacgtcaacttcagccac

SEQ ID NO: 599873 - DNA, 25 bp, Rattus norvegicus
acgtcaacttcagccactgtagatg

SEQ ID NO: 599874 - DNA, 25 bp, Rattus norvegicus
tcaccgtgggcacgctacggcggta

SEQ ID NO: 599875 - DNA, 25 bp, Rattus norvegicus
tgtagatggaacaaaaatcggcctt

SEQ ID NO: 599876 - DNA, 25 bp, Rattus norvegicus
atcggccttaggatgagaaagcacg

SEQ ID NO: 599877 - DNA, 25 bp, Rattus norvegicus
ccttaggatgagaaagcacggcgac

SEQ ID NO: 599878 - DNA, 25 bp, Rattus norvegicus
ggcgacaatcttccacctcgggccc

SEQ ID NO: 599879 - DNA, 25 bp, Rattus norvegicus
tcctctgcgcacagatcgcttccca

SEQ ID NO: 599880 - DNA, 25 bp, Rattus norvegicus
gatcgcttcccacgtctccctccaa

SEQ ID NO: 599881 - DNA, 25 bp, Rattus norvegicus
ttaacctctactcaccgtgggcacg

SEQ ID NO: 599882 - DNA, 25 bp, Rattus norvegicus
tctactcaccgtgggcacgctacgg

SEQ ID NO: 599883 - DNA, 25 bp, Rattus norvegicus
gaaagcacggcgacaatcttccacc

SEQ ID NO: 599884 - DNA, 25 bp, Rattus norvegicus
aacttcagccactgtagatggaaca

SEQ ID NO: 599885 - DNA, 25 bp, Rattus norvegicus
gttcgagtggttcgtcatgcctccc

SEQ ID NO: 599886 - DNA, 25 bp, Rattus norvegicus
tctacttgggcggagcacagaaccg

SEQ ID NO: 599887 - DNA, 25 bp, Rattus norvegicus
gtcctgcgtcaaagtctctgctcgg

SEQ ID NO: 599888 - DNA, 25 bp, Rattus norvegicus
tcaaagtctctgctcgggctgaggg

SEQ ID NO: 599889 - DNA, 25 bp, Rattus norvegicus
ccgagcgggaagtcagccttctatt

SEQ ID NO: 599890 - DNA, 25 bp, Rattus norvegicus
cgggaagtcagccttctattcagaa

SEQ ID NO: 599891 - DNA, 25 bp, Rattus norvegicus
gccttctattcagaagttgcgtctg

SEQ ID NO: 599892 - DNA, 25 bp, Rattus norvegicus
cagaagttgcgtctgagggaaccta

SEQ ID NO: 599893 - DNA, 25 bp, Rattus norvegicus
tgcggtacgggatgagagcaatacc

SEQ ID NO: 599894 - DNA, 25 bp, Rattus norvegicus
ctctagatggttaacaccaggcttc

SEQ ID NO: 599895 - DNA, 25 bp, Rattus norvegicus
atggttaacaccaggcttccaagcc

SEQ ID NO: 599896 - DNA, 25 bp, Rattus norvegicus
ctgcctgcgcgcctgttctacttgg

SEQ ID NO: 599897 - DNA, 25 bp, Rattus norvegicus
gcgcctgttctacttgggcggagca

SEQ ID NO: 599898 - DNA, 25 bp, Rattus norvegicus
ctccctttctctctagatggttaac

SEQ ID NO: 599899 - DNA, 25 bp, Rattus norvegicus
cgctgaggagagcttcgactgactc

SEQ ID NO: 599900 - DNA, 25 bp, Rattus norvegicus
ccctgaggaacgagtcagagaggat

SEQ ID NO: 599901 - DNA, 25 bp, Rattus norvegicus
tgacacggatggtctacctgaggtg

SEQ ID NO: 599902 - DNA, 25 bp, Rattus norvegicus
gccctcaaaggtccgagccatgttt

SEQ ID NO: 599903 - DNA, 25 bp, Rattus norvegicus
agcctcttacctcacgctacgggag

SEQ ID NO: 599904 - DNA, 25 bp, Rattus norvegicus
tcagctggctcagccggccgctgag

SEQ ID NO: 599905 - DNA, 25 bp, Rattus norvegicus
aacccaagccttcgcgccctcaaag

SEQ ID NO: 599906 - DNA, 25 bp, Rattus norvegicus
agagcttcgactgactccgcggcca

SEQ ID NO: 599907 - DNA, 25 bp, Rattus norvegicus
gccagccgagcactgtacgtcactt

SEQ ID NO: 599908 - DNA, 25 bp, Rattus norvegicus
gcactgtacgtcacttccgatggta

SEQ ID NO: 599909 - DNA, 25 bp, Rattus norvegicus
tcacttccgatggtacaagcaccgc

SEQ ID NO: 599910 - DNA, 25 bp, Rattus norvegicus
cttgggcgccttacgattggctgac

SEQ ID NO: 599911 - DNA, 25 bp, Rattus norvegicus
acgattggctgacacggatggtcta

SEQ ID NO: 599912 - DNA, 25 bp, Rattus norvegicus
gagccatgtttttctcccgcctcag

SEQ ID NO: 599913 - DNA, 25 bp, Rattus norvegicus
cgggcacgcattaggcagtggatca

SEQ ID NO: 599914 - DNA, 25 bp, Rattus norvegicus
tctccatggcaaccaggaggcgggc

SEQ ID NO: 599915 - DNA, 25 bp, Rattus norvegicus
gcatcagtcggcttagcctcgcgca

SEQ ID NO: 599916 - DNA, 25 bp, Rattus norvegicus
tgtcagaggcggaggcagtctccat

SEQ ID NO: 599917 - DNA, 25 bp, Rattus norvegicus
ccaattagcagctgtcagaggcgga

SEQ ID NO: 599918 - DNA, 25 bp, Rattus norvegicus
ccaataggcgttctccgaggtccgg

SEQ ID NO: 599919 - DNA, 25 bp, Rattus norvegicus
gtaggcgcgtccctggaccaactca

SEQ ID NO: 599920 - DNA, 25 bp, Rattus norvegicus
ggtcttcccaaagcgccttcgcgta

SEQ ID NO: 599921 - DNA, 25 bp, Rattus norvegicus
gtccctcttggcttggtcttcccaa

SEQ ID NO: 599922 - DNA, 25 bp, Rattus norvegicus
tcacccgtgtcggagagcgccacgt

SEQ ID NO: 599923 - DNA, 25 bp, Rattus norvegicus
actctgcagagaaggttagtggcgc

SEQ ID NO: 599924 - DNA, 25 bp, Rattus norvegicus
tccggagccggaccaattagcagct

SEQ ID NO: 599925 - DNA, 25 bp, Rattus norvegicus
agagcgccacgtccctcttggcttg

SEQ ID NO: 599926 - DNA, 25 bp, Rattus norvegicus
tggaccaactcaccaataggcgttc

SEQ ID NO: 599927 - DNA, 25 bp, Rattus norvegicus
ccgtaaggcctgctacttagccaga

SEQ ID NO: 599928 - DNA, 25 bp, Rattus norvegicus
cgtgatggcgtatttccgtttcctc

SEQ ID NO: 599929 - DNA, 25 bp, Rattus norvegicus
cacccacctgtagtgacctagagtc

SEQ ID NO: 599930 - DNA, 25 bp, Rattus norvegicus
gcacgccgagcgttgcacttacatc

SEQ ID NO: 599931 - DNA, 25 bp, Rattus norvegicus
ggtgccatcttgtacggacgctgaa

SEQ ID NO: 599932 - DNA, 25 bp, Rattus norvegicus
atgcattcatttcacttaggcttgg

SEQ ID NO: 599933 - DNA, 25 bp, Rattus norvegicus
cacctgctgttgttctcttcagaaa

SEQ ID NO: 599934 - DNA, 25 bp, Rattus norvegicus
taccgatctccatcacctgctgttg

SEQ ID NO: 599935 - DNA, 25 bp, Rattus norvegicus
atggctgctctcttgtacgacacta

SEQ ID NO: 599936 - DNA, 25 bp, Rattus norvegicus
cccgcccttgttccttatgcaaaga

SEQ ID NO: 599937 - DNA, 25 bp, Rattus norvegicus
gttcgtcccaggcagtgaatgttca

SEQ ID NO: 599938 - DNA, 25 bp, Rattus norvegicus
agagtccgccggcttcattgaaccg

SEQ ID NO: 599939 - DNA, 25 bp, Rattus norvegicus
cccgctgcaagtctcgggaaaggtt

SEQ ID NO: 599940 - DNA, 25 bp, Rattus norvegicus
ctcgaatttggagggactaccgatc

SEQ ID NO: 599941 - DNA, 25 bp, Rattus norvegicus
ggccacgacgtataggctacctcca

SEQ ID NO: 599942 - DNA, 25 bp, Rattus norvegicus
gcacagatgtcgaacggatgaactc

SEQ ID NO: 599943 - DNA, 25 bp, Rattus norvegicus
acctggggtaaagcgatggcacaga

SEQ ID NO: 599944 - DNA, 25 bp, Rattus norvegicus
acgacctcggcaggggtctataggc

SEQ ID NO: 599945 - DNA, 25 bp, Rattus norvegicus
gcgggcagacagaggatacgacctc

SEQ ID NO: 599946 - DNA, 25 bp, Rattus norvegicus
ggctcccgcaaggtgctacccatag

SEQ ID NO: 599947 - DNA, 25 bp, Rattus norvegicus
acagcacccgcagacacgagaagct

SEQ ID NO: 599948 - DNA, 25 bp, Rattus norvegicus
tgggacactcgggactccacagcac

SEQ ID NO: 599949 - DNA, 25 bp, Rattus norvegicus
cagggagtggctgagccgaattccc

SEQ ID NO: 599950 - DNA, 25 bp, Rattus norvegicus
cttccttaacttggcagggagtggc

SEQ ID NO: 599951 - DNA, 25 bp, Rattus norvegicus
gcgcgaagagtaaaccacactaact

SEQ ID NO: 599952 - DNA, 25 bp, Rattus norvegicus
caaggcatgttttacgcgcgaagag

SEQ ID NO: 599953 - DNA, 25 bp, Rattus norvegicus
ggctcctcaggacactgccaaggca

SEQ ID NO: 599954 - DNA, 25 bp, Rattus norvegicus
gacgtataggctacctccacggctc

SEQ ID NO: 599955 - DNA, 25 bp, Rattus norvegicus
tcctcattggatagaccgcactccg

SEQ ID NO: 599956 - DNA, 25 bp, Rattus norvegicus
cgcggagctgaaagactctggccaa

SEQ ID NO: 599957 - DNA, 25 bp, Rattus norvegicus
atcaacgagcgcgaacacaccaaac

SEQ ID NO: 599958 - DNA, 25 bp, Rattus norvegicus
accagcacggtaacccgagcgcggg

SEQ ID NO: 599959 - DNA, 25 bp, Rattus norvegicus
cccgcaggccgcttatataggctcg

SEQ ID NO: 599960 - DNA, 25 bp, Rattus norvegicus
tataggctcgctgcctttcccgaca

SEQ ID NO: 599961 - DNA, 25 bp, Rattus norvegicus
ggccatcgttccagacgcacggtta

SEQ ID NO: 599962 - DNA, 25 bp, Rattus norvegicus
cgcacggttatcaacgagcgcgaac

SEQ ID NO: 599963 - DNA, 25 bp, Rattus norvegicus
atagaccgcactccggcttctggga

SEQ ID NO: 599964 - DNA, 25 bp, Rattus norvegicus
ttctgggaagccaggccaaccggca

SEQ ID NO: 599965 - DNA, 25 bp, Rattus norvegicus
ccaaccggcagctagcgcatgactt

SEQ ID NO: 599966 - DNA, 25 bp, Rattus norvegicus
cgcatgacttgaaatccaggtcaaa

SEQ ID NO: 599967 - DNA, 25 bp, Rattus norvegicus
ccaggtcaaaggagagtgaagctgc

SEQ ID NO: 599968 - DNA, 25 bp, Rattus norvegicus
gcgaaactcgctcctcattggatag

SEQ ID NO: 599969 - DNA, 25 bp, Rattus norvegicus
ggggctctgcggctcattaccttcc

SEQ ID NO: 599970 - DNA, 25 bp, Rattus norvegicus
tcacccacctgggttgccagtcatt

SEQ ID NO: 599971 - DNA, 25 bp, Rattus norvegicus
tgccgacaccctaggagcctgggga

SEQ ID NO: 599972 - DNA, 25 bp, Rattus norvegicus
gcggggctattggtcacagaatatg

SEQ ID NO: 599973 - DNA, 25 bp, Rattus norvegicus
cttatgacaggggtagggtcaccta

SEQ ID NO: 599974 - DNA, 25 bp, Rattus norvegicus
tctgtggctgctgaacctagagagg

SEQ ID NO: 599975 - DNA, 25 bp, Rattus norvegicus
ccagagtgacaagagccaaggcttc

SEQ ID NO: 599976 - DNA, 25 bp, Rattus norvegicus
agagccaaggcttcgcttcaaggcg

SEQ ID NO: 599977 - DNA, 25 bp, Rattus norvegicus
ttcaaggcgaggtccgcgtaaagcc

SEQ ID NO: 599978 - DNA, 25 bp, Rattus norvegicus
tgtggagaaggcgagaactacttga

SEQ ID NO: 599979 - DNA, 25 bp, Rattus norvegicus
cagggacacaagcagactcggcttc

SEQ ID NO: 599980 - DNA, 25 bp, Rattus norvegicus
tacactccgaggaccggcagtcagg

SEQ ID NO: 599981 - DNA, 25 bp, Rattus norvegicus
acctgctcgagaggcaccagagtga

SEQ ID NO: 599982 - DNA, 25 bp, Rattus norvegicus
agtcattccagctccgcgggtactt

SEQ ID NO: 599983 - DNA, 25 bp, Rattus norvegicus
gttgcacaagccgactgccctcaag

SEQ ID NO: 599984 - DNA, 25 bp, Rattus norvegicus
aggcgccgcacaaaggtcgccagcg

SEQ ID NO: 599985 - DNA, 25 bp, Rattus norvegicus
acctcccgatatcggctgcgcagta

SEQ ID NO: 599986 - DNA, 25 bp, Rattus norvegicus
tatcggctgcgcagtagagagcgca

SEQ ID NO: 599987 - DNA, 25 bp, Rattus norvegicus
atcgtgctctaggtcgggatgaacc

SEQ ID NO: 599988 - DNA, 25 bp, Rattus norvegicus
cgggatgaacctcccacgtgcggga

SEQ ID NO: 599989 - DNA, 25 bp, Rattus norvegicus
tcccacgtgcgggaaccaaggcgca

SEQ ID NO: 599990 - DNA, 25 bp, Rattus norvegicus
caggggtgtgcttagaaaatcgtca

SEQ ID NO: 599991 - DNA, 25 bp, Rattus norvegicus
gtgcttagaaaatcgtcagaatccc

SEQ ID NO: 599992 - DNA, 25 bp, Rattus norvegicus
cgtcagaatcccagccattgagagc

SEQ ID NO: 599993 - DNA, 25 bp, Rattus norvegicus
cagccattgagagcccgcggcggaa

SEQ ID NO: 599994 - DNA, 25 bp, Rattus norvegicus
cgggacccaagagaattaagcgttg

SEQ ID NO: 599995 - DNA, 25 bp, Rattus norvegicus
caagagaattaagcgttgtagcgga

SEQ ID NO: 599996 - DNA, 25 bp, Rattus norvegicus
gtcgccagcggccacacctcccgat

SEQ ID NO: 599997 - DNA, 25 bp, Rattus norvegicus
agttttataccagccgcacccgacg

SEQ ID NO: 599998 - DNA, 25 bp, Rattus norvegicus
gacgcgcctagaacccggctgtaga

SEQ ID NO: 599999 - DNA, 25 bp, Rattus norvegicus
agggcaggagccacctatttagggt

SEQ ID NO: 600000 - DNA, 25 bp, Rattus norvegicus
gcggcttggcgaaagttttatacca

SEQ ID NO: 600001 - DNA, 25 bp, Rattus norvegicus
ccctccctgatcgacagcagggttt

SEQ ID NO: 600002 - DNA, 25 bp, Rattus norvegicus
ggcaggcaatagagtggcacctatc

SEQ ID NO: 600003 - DNA, 25 bp, Rattus norvegicus
ttcctggttgcaaaaaagctggggc

SEQ ID NO: 600004 - DNA, 25 bp, Rattus norvegicus
cccaaccttggagtgcttcctggtt

SEQ ID NO: 600005 - DNA, 25 bp, Rattus norvegicus
acggccagccagcaagacatcagtg

SEQ ID NO: 600006 - DNA, 25 bp, Rattus norvegicus
ctatttagggtggacctggcagcca

SEQ ID NO: 600007 - DNA, 25 bp, Rattus norvegicus
agccaccgtcctacctggatgtatc

SEQ ID NO: 600008 - DNA, 25 bp, Rattus norvegicus
agctccagaacacgcacaggtgcct

SEQ ID NO: 600009 - DNA, 25 bp, Rattus norvegicus
gcagggccctccataccgaaatctg

SEQ ID NO: 600010 - DNA, 25 bp, Rattus norvegicus
gcgcagaacctggatgcccaaggtc

SEQ ID NO: 600011 - DNA, 25 bp, Rattus norvegicus
gcgctgcccacctggatgaagtctc

SEQ ID NO: 600012 - DNA, 25 bp, Rattus norvegicus
accctcaggttgagcgtgtaccgca

SEQ ID NO: 600013 - DNA, 25 bp, Rattus norvegicus
gtcgccggattttatgctgttcgta

SEQ ID NO: 600014 - DNA, 25 bp, Rattus norvegicus
gtcagagcaggttcagtccctaggc

SEQ ID NO: 600015 - DNA, 25 bp, Rattus norvegicus
caaagccagcgctccaccggtgatg

SEQ ID NO: 600016 - DNA, 25 bp, Rattus norvegicus
tacgatccggctcacatgcgccttg

SEQ ID NO: 600017 - DNA, 25 bp, Rattus norvegicus
gcgccttgctgtgacctagcacatg

SEQ ID NO: 600018 - DNA, 25 bp, Rattus norvegicus
agtctcagtggcaccagcacgtcga

SEQ ID NO: 600019 - DNA, 25 bp, Rattus norvegicus
gcgcacttcgtgctcatagtaactc

SEQ ID NO: 600020 - DNA, 25 bp, Rattus norvegicus
ctctccagcaagatgctcaggcctg

SEQ ID NO: 600021 - DNA, 25 bp, Rattus norvegicus
ctggctcttgcaaggatctggctga

SEQ ID NO: 600022 - DNA, 25 bp, Rattus norvegicus
atagccaccttgagcagcgggaagc

SEQ ID NO: 600023 - DNA, 25 bp, Rattus norvegicus
tagaggcacactagcgccgtgcaca

SEQ ID NO: 600024 - DNA, 25 bp, Rattus norvegicus
gcacatgtggcgataggcgcacttc

SEQ ID NO: 600025 - DNA, 25 bp, Rattus norvegicus
cacttcaaatagtcaccggcgaaga

SEQ ID NO: 600026 - DNA, 25 bp, Rattus norvegicus
gacgtcttcccagtgacatccgtga

SEQ ID NO: 600027 - DNA, 25 bp, Rattus norvegicus
ctaggccctggattacacccgattg

SEQ ID NO: 600028 - DNA, 25 bp, Rattus norvegicus
ggcatcccacggaagcggccgctat

SEQ ID NO: 600029 - DNA, 25 bp, Rattus norvegicus
cgctggtgacagtgcagccacagtc

SEQ ID NO: 600030 - DNA, 25 bp, Rattus norvegicus
ccaatcgcgctctcgactcagggtg

SEQ ID NO: 600031 - DNA, 25 bp, Rattus norvegicus
ctcgactcagggtgatgacgcttaa

SEQ ID NO: 600032 - DNA, 25 bp, Rattus norvegicus
tgacgcttaaatgctgcggaagacc

SEQ ID NO: 600033 - DNA, 25 bp, Rattus norvegicus
tgcggaagaccgagccagcggaaac

SEQ ID NO: 600034 - DNA, 25 bp, Rattus norvegicus
cacccgattggttgggaatgaccga

SEQ ID NO: 600035 - DNA, 25 bp, Rattus norvegicus
gctgtgctccctctcgatcattggg

SEQ ID NO: 600036 - DNA, 25 bp, Rattus norvegicus
atcattgggatgtcgtgaaggcgcc

SEQ ID NO: 600037 - DNA, 25 bp, Rattus norvegicus
tgcttgtgacgtatagacgtcttcc

SEQ ID NO: 600038 - DNA, 25 bp, Rattus norvegicus
ctatgtactctattggctgtgctcc

SEQ ID NO: 600039 - DNA, 25 bp, Rattus norvegicus
aacctacctgggtgtacggctcgct

SEQ ID NO: 600040 - DNA, 25 bp, Rattus norvegicus
tcgggttccggatgacgtcacagag

SEQ ID NO: 600041 - DNA, 25 bp, Rattus norvegicus
cctcttcgggttccggatgacgtca

SEQ ID NO: 600042 - DNA, 25 bp, Rattus norvegicus
ctcatcacggctcggcgaggaccct

SEQ ID NO: 600043 - DNA, 25 bp, Rattus norvegicus
gcccgcgttgccctcgctcatcacg

SEQ ID NO: 600044 - DNA, 25 bp, Rattus norvegicus
tgtacggctcgctgccggctggacc

SEQ ID NO: 600045 - DNA, 25 bp, Rattus norvegicus
cgtgtggaaagtgaggactgcctcc

SEQ ID NO: 600046 - DNA, 25 bp, Rattus norvegicus
gaaagtgaggactgcctcctcagct

SEQ ID NO: 600047 - DNA, 25 bp, Rattus norvegicus
tcctcagctcggccggcagggcaag

SEQ ID NO: 600048 - DNA, 25 bp, Rattus norvegicus
cggcacgtccgctgcccaccgcttt

SEQ ID NO: 600049 - DNA, 25 bp, Rattus norvegicus
tatcccgcggaggaccaggacggcc

SEQ ID NO: 600050 - DNA, 25 bp, Rattus norvegicus
ggaggaccaggacggccaccctgtc

SEQ ID NO: 600051 - DNA, 25 bp, Rattus norvegicus
cccgcacgcctggtcccgccgcaac

SEQ ID NO: 600052 - DNA, 25 bp, Rattus norvegicus
cgccgcaacctacctgggtgtacgg

SEQ ID NO: 600053 - DNA, 25 bp, Rattus norvegicus
ccgcctgagggacccgtaatatggc

SEQ ID NO: 600054 - DNA, 25 bp, Rattus norvegicus
tccagtctgaactgagacccgggga

SEQ ID NO: 600055 - DNA, 25 bp, Rattus norvegicus
tttctacgggtccagtctgaactga

SEQ ID NO: 600056 - DNA, 25 bp, Rattus norvegicus
ttcgtctttctacgggtccagtctg

SEQ ID NO: 600057 - DNA, 25 bp, Rattus norvegicus
tgctagaggactgggttcgtctttc

SEQ ID NO: 600058 - DNA, 25 bp, Rattus norvegicus
ttattaaggaggctggtccacgggc

SEQ ID NO: 600059 - DNA, 25 bp, Rattus norvegicus
gactgaggcctttgcttattaagga

SEQ ID NO: 600060 - DNA, 25 bp, Rattus norvegicus
ctgaaccgactgaggcctttgctta

SEQ ID NO: 600061 - DNA, 25 bp, Rattus norvegicus
agaaggcggcgaacccagatgcgct

SEQ ID NO: 600062 - DNA, 25 bp, Rattus norvegicus
caggatcccgcgttgccgcctgagg

SEQ ID NO: 600063 - DNA, 25 bp, Rattus norvegicus
gcgacagcggttgccaggatcccgc

SEQ ID NO: 600064 - DNA, 25 bp, Rattus norvegicus
cagtcaccggaagtaccggccctga

SEQ ID NO: 600065 - DNA, 25 bp, Rattus norvegicus
tgcccgccaaacagtcaccggaagt

SEQ ID NO: 600066 - DNA, 25 bp, Rattus norvegicus
gatgcgctctgactgaaccgactga

SEQ ID NO: 600067 - DNA, 25 bp, Rattus norvegicus
cctcggtcccgatgtggctgagccg

SEQ ID NO: 600068 - DNA, 25 bp, Rattus norvegicus
tctggtgagtacagccggtttctgc

SEQ ID NO: 600069 - DNA, 25 bp, Rattus norvegicus
attgtgttctcagccctacgccagc

SEQ ID NO: 600070 - DNA, 25 bp, Rattus norvegicus
ccaggaacttcctgtctatttccgg

SEQ ID NO: 600071 - DNA, 25 bp, Rattus norvegicus
ttcctgtctatttccggcgtcgcca

SEQ ID NO: 600072 - DNA, 25 bp, Rattus norvegicus
ccatcttgcttccggtttccgaggg

SEQ ID NO: 600073 - DNA, 25 bp, Rattus norvegicus
ccttctggtgagtacagccggtttc

SEQ ID NO: 600074 - DNA, 25 bp, Rattus norvegicus
agacagctgccttctggtgagtaca

SEQ ID NO: 600075 - DNA, 25 bp, Rattus norvegicus
tatgtgtagtcagacagctgccttc

SEQ ID NO: 600076 - DNA, 25 bp, Rattus norvegicus
cgggacatctatgtgtagtcagaca

SEQ ID NO: 600077 - DNA, 25 bp, Rattus norvegicus
cagcctgtcgggacatctatgtgta

SEQ ID NO: 600078 - DNA, 25 bp, Rattus norvegicus
tgtcgccctcggtcccgatgtggct

SEQ ID NO: 600079 - DNA, 25 bp, Rattus norvegicus
tctgtgcggggctgagttcacagcc

SEQ ID NO: 600080 - DNA, 25 bp, Rattus norvegicus
ggttggattgtgttctcagccctac

SEQ ID NO: 600081 - DNA, 25 bp, Rattus norvegicus
cctgttgttcagagcgctaagacgc

SEQ ID NO: 600082 - DNA, 25 bp, Rattus norvegicus
tgggcccaagtcacatctctgcaac

SEQ ID NO: 600083 - DNA, 25 bp, Rattus norvegicus
agccgagcccgcctcactgcatcgc

SEQ ID NO: 600084 - DNA, 25 bp, Rattus norvegicus
cagcgccgacgcttctgctggccct

SEQ ID NO: 600085 - DNA, 25 bp, Rattus norvegicus
accgcgctagctggtactcaccgac

SEQ ID NO: 600086 - DNA, 25 bp, Rattus norvegicus
gcttctcaaatccacggcgggaaaa

SEQ ID NO: 600087 - DNA, 25 bp, Rattus norvegicus
actgcatcgcccttccgagctgcgg

SEQ ID NO: 600088 - DNA, 25 bp, Rattus norvegicus
cagctctgctcaacctaggaccgga

SEQ ID NO: 600089 - DNA, 25 bp, Rattus norvegicus
tgctcaacctaggaccggagccgca

SEQ ID NO: 600090 - DNA, 25 bp, Rattus norvegicus
cggagccgcagctagcccgcaaccc

SEQ ID NO: 600091 - DNA, 25 bp, Rattus norvegicus
cccaggcgcctgttgttcagagcgc

SEQ ID NO: 600092 - DNA, 25 bp, Rattus norvegicus
cgctaagacgcctttctcatccaaa

SEQ ID NO: 600093 - DNA, 25 bp, Rattus norvegicus
ttcagagcgctaagacgcctttctc

SEQ ID NO: 600094 - DNA, 25 bp, Rattus norvegicus
gatcctctccggagcttctcaaatc

SEQ ID NO: 600095 - DNA, 25 bp, Rattus norvegicus
tcctggagccggagtgtgcacctcc

SEQ ID NO: 600096 - DNA, 25 bp, Rattus norvegicus
gcccaagccgcaagctgagctattc

SEQ ID NO: 600097 - DNA, 25 bp, Rattus norvegicus
caagctgagctattcgcagcgaggt

SEQ ID NO: 600098 - DNA, 25 bp, Rattus norvegicus
tcagcagcttcctggatggtgtgtg

SEQ ID NO: 600099 - DNA, 25 bp, Rattus norvegicus
gtgcgtgtgctccatgagcgcgccc

SEQ ID NO: 600100 - DNA, 25 bp, Rattus norvegicus
tccagccctggctggtgtcctcgag

SEQ ID NO: 600101 - DNA, 25 bp, Rattus norvegicus
ggtgtcctcgagtggctgcgcacct

SEQ ID NO: 600102 - DNA, 25 bp, Rattus norvegicus
tgccctcctagataggcagctccgt

SEQ ID NO: 600103 - DNA, 25 bp, Rattus norvegicus
agctccgttctctagcagggcgcag

SEQ ID NO: 600104 - DNA, 25 bp, Rattus norvegicus
cggagtgtgcacctccctcctagga

SEQ ID NO: 600105 - DNA, 25 bp, Rattus norvegicus
tccctcctaggaccgctcagctccc

SEQ ID NO: 600106 - DNA, 25 bp, Rattus norvegicus
agccaatcagcagcttcctggatgg

SEQ ID NO: 600107 - DNA, 25 bp, Rattus norvegicus
ggcacgaagcccaagccgcaagctg

SEQ ID NO: 600108 - DNA, 25 bp, Rattus norvegicus
ataggcagctccgttctctagcagg

SEQ ID NO: 600109 - DNA, 25 bp, Rattus norvegicus
aatccacgttcctcggcgtcttcgt

SEQ ID NO: 600110 - DNA, 25 bp, Rattus norvegicus
aggcactttccgatggctcagattc

SEQ ID NO: 600111 - DNA, 25 bp, Rattus norvegicus
caagcagtcgggcaaggcactttcc

SEQ ID NO: 600112 - DNA, 25 bp, Rattus norvegicus
cggggtgattgcgtcacacgtacgc

SEQ ID NO: 600113 - DNA, 25 bp, Rattus norvegicus
tgtggccgccatgctacctacaatc

SEQ ID NO: 600114 - DNA, 25 bp, Rattus norvegicus
actgggatttgcctttgcgctttcc

SEQ ID NO: 600115 - DNA, 25 bp, Rattus norvegicus
aggtgatgaggatgccctgcaagcc

SEQ ID NO: 600116 - DNA, 25 bp, Rattus norvegicus
gcgctcgttcatgttgcaggtgatg

SEQ ID NO: 600117 - DNA, 25 bp, Rattus norvegicus
cgccatactcgttgagcaggctgta

SEQ ID NO: 600118 - DNA, 25 bp, Rattus norvegicus
ggtccgtacatgtcgtcgccatact

SEQ ID NO: 600119 - DNA, 25 bp, Rattus norvegicus
tagcaccgtacaggcgcagcaaagc

SEQ ID NO: 600120 - DNA, 25 bp, Rattus norvegicus
agcgaggtcgtgctagcaccgtaca

SEQ ID NO: 600121 - DNA, 25 bp, Rattus norvegicus
ggccgcaatagcagtcacaccaggg

SEQ ID NO: 600122 - DNA, 25 bp, Rattus norvegicus
cacgtacgcgacaatttgccaagca

SEQ ID NO: 600123 - DNA, 25 bp, Rattus norvegicus
taggtccgcggctttttctatgaga

SEQ ID NO: 600124 - DNA, 25 bp, Rattus norvegicus
agaccaaacgcctgcggatgaccgc

SEQ ID NO: 600125 - DNA, 25 bp, Rattus norvegicus
catcccggaccttacgtttcgcaga

SEQ ID NO: 600126 - DNA, 25 bp, Rattus norvegicus
ttcgcagagttcaacggccggaagt

SEQ ID NO: 600127 - DNA, 25 bp, Rattus norvegicus
ggacccttttcagatccagaccaaa

SEQ ID NO: 600128 - DNA, 25 bp, Rattus norvegicus
gcggcagacgaagccggttcctgta

SEQ ID NO: 600129 - DNA, 25 bp, Rattus norvegicus
cgagaccgagaagaccaggaccctt

SEQ ID NO: 600130 - DNA, 25 bp, Rattus norvegicus
aacgcggacttatagtctgcactga

SEQ ID NO: 600131 - DNA, 25 bp, Rattus norvegicus
ctatgagagccaagcgtagtaaact

SEQ ID NO: 600132 - DNA, 25 bp, Rattus norvegicus
gtagtaaactggttcgagctgcttc

SEQ ID NO: 600133 - DNA, 25 bp, Rattus norvegicus
cgagctgcttcgagggaaaaataaa

SEQ ID NO: 600134 - DNA, 25 bp, Rattus norvegicus
gcgcctcagggagcgtttcgaactc

SEQ ID NO: 600135 - DNA, 25 bp, Rattus norvegicus
tcgaactccgcgacgcctgagactg

SEQ ID NO: 600136 - DNA, 25 bp, Rattus norvegicus
tttctcggactcctccaacttggcg

SEQ ID NO: 600137 - DNA, 25 bp, Rattus norvegicus
cagaaacttttcctagcccggccag

SEQ ID NO: 600138 - DNA, 25 bp, Rattus norvegicus
gctgagcccaagttcatgaagagtc

SEQ ID NO: 600139 - DNA, 25 bp, Rattus norvegicus
taatctttaagctgctcgctgagcc

SEQ ID NO: 600140 - DNA, 25 bp, Rattus norvegicus
ccgcgccttccgcagaaagttaatc

SEQ ID NO: 600141 - DNA, 25 bp, Rattus norvegicus
gcgccgccaacaaatcgccttttga

SEQ ID NO: 600142 - DNA, 25 bp, Rattus norvegicus
gctctgatgtcaggcgctttgcatg

SEQ ID NO: 600143 - DNA, 25 bp, Rattus norvegicus
tgtggacccgagctaacaagtcctg

SEQ ID NO: 600144 - DNA, 25 bp, Rattus norvegicus
aactggctccgagtggcacacgact

SEQ ID NO: 600145 - DNA, 25 bp, Rattus norvegicus
gcggcgaacgcgattgacaactcca

SEQ ID NO: 600146 - DNA, 25 bp, Rattus norvegicus
ggtacgagcaccactgccaggacta

SEQ ID NO: 600147 - DNA, 25 bp, Rattus norvegicus
aggatgcccatcacgtcggtccaga

SEQ ID NO: 600148 - DNA, 25 bp, Rattus norvegicus
ttcccaggtagctcaccaggatgcc

SEQ ID NO: 600149 - DNA, 25 bp, Rattus norvegicus
cacacgacttgcctctattggagag

SEQ ID NO: 600150 - DNA, 25 bp, Rattus norvegicus
tcccgggctcaagaaagcgtttagc

SEQ ID NO: 600151 - DNA, 25 bp, Rattus norvegicus
acgcccaccaccaagctggtaaagg

SEQ ID NO: 600152 - DNA, 25 bp, Rattus norvegicus
gtatgcaccacgtacaccacgaaca

SEQ ID NO: 600153 - DNA, 25 bp, Rattus norvegicus
cgtgtgcgtgacgtcagcctcttgc

SEQ ID NO: 600154 - DNA, 25 bp, Rattus norvegicus
gattcgccggatttgccggccgccg

SEQ ID NO: 600155 - DNA, 25 bp, Rattus norvegicus
cgccgcgggattcgccggatttgcc

SEQ ID NO: 600156 - DNA, 25 bp, Rattus norvegicus
accaagctggtaaaggagctgcggc

SEQ ID NO: 600157 - DNA, 25 bp, Rattus norvegicus
acgataccatacataacccagcagg

SEQ ID NO: 600158 - DNA, 25 bp, Rattus norvegicus
acggacgggtatagacgataccata

SEQ ID NO: 600159 - DNA, 25 bp, Rattus norvegicus
cgtcacccgagcacggacgggtata

SEQ ID NO: 600160 - DNA, 25 bp, Rattus norvegicus
gctggatgcagttggcgtcacccga

SEQ ID NO: 600161 - DNA, 25 bp, Rattus norvegicus
ccgacgctcacctgcagcttgggcc

SEQ ID NO: 600162 - DNA, 25 bp, Rattus norvegicus
gccgggaagcgccttcttagggctc

SEQ ID NO: 600163 - DNA, 25 bp, Rattus norvegicus
acccagcaggtatgcaccacgtaca

SEQ ID NO: 600164 - DNA, 25 bp, Rattus norvegicus
ggccgctccacatggcgccgcaacc

SEQ ID NO: 600165 - DNA, 25 bp, Rattus norvegicus
ggtcttccggcaccatcttgctttg

SEQ ID NO: 600166 - DNA, 25 bp, Rattus norvegicus
ccggtctcggtgaaactcggtcaca

SEQ ID NO: 600167 - DNA, 25 bp, Rattus norvegicus
tcacagaaattctcggtaccacttt

SEQ ID NO: 600168 - DNA, 25 bp, Rattus norvegicus
aacaagtggcgagggatgacctccc

SEQ ID NO: 600169 - DNA, 25 bp, Rattus norvegicus
ggactcacgagcaggtccaagacta

SEQ ID NO: 600170 - DNA, 25 bp, Rattus norvegicus
agccatgaagctcctcagcagggcc

SEQ ID NO: 600171 - DNA, 25 bp, Rattus norvegicus
ccaagactagagttgggcgcggcta

SEQ ID NO: 600172 - DNA, 25 bp, Rattus norvegicus
aggataaccttaacatgctgcgtgc

SEQ ID NO: 600173 - DNA, 25 bp, Rattus norvegicus
ctgcgtgctcgcaagactcatccgg

SEQ ID NO: 600174 - DNA, 25 bp, Rattus norvegicus
gccttccggagcagtagagcacaga

SEQ ID NO: 600175 - DNA, 25 bp, Rattus norvegicus
tgcacgccgggaaacttggtcttcc

SEQ ID NO: 600176 - DNA, 25 bp, Rattus norvegicus
tgctgtctgcagctttgaccgtagg

SEQ ID NO: 600177 - DNA, 25 bp, Rattus norvegicus
tgaccgtaggaaagggcaactgcta

SEQ ID NO: 600178 - DNA, 25 bp, Rattus norvegicus
gcacagagtgcgtagaaggccgctc

SEQ ID NO: 600179 - DNA, 25 bp, Rattus norvegicus
cgggaaggctctgcagggcagtcct

SEQ ID NO: 600180 - DNA, 25 bp, Rattus norvegicus
cggactggatcaacaccggggagtc

SEQ ID NO: 600181 - DNA, 25 bp, Rattus norvegicus
atcgccaacccggactggatcaaca

SEQ ID NO: 600182 - DNA, 25 bp, Rattus norvegicus
ttcgccatcgccagcatcgccaacc

SEQ ID NO: 600183 - DNA, 25 bp, Rattus norvegicus
ttctggccgccgatatcttcgccat

SEQ ID NO: 600184 - DNA, 25 bp, Rattus norvegicus
atgtctctttctggccgccgatatc

SEQ ID NO: 600185 - DNA, 25 bp, Rattus norvegicus
caggatgtctctttctggccgccga

SEQ ID NO: 600186 - DNA, 25 bp, Rattus norvegicus
tcatctcaggatgtctctttctggc

SEQ ID NO: 600187 - DNA, 25 bp, Rattus norvegicus
actgaccatcatctcaggatgtctc

SEQ ID NO: 600188 - DNA, 25 bp, Rattus norvegicus
ggataaactgaccatcatctcagga

SEQ ID NO: 600189 - DNA, 25 bp, Rattus norvegicus
ggcgatggataaactgaccatcatc

SEQ ID NO: 600190 - DNA, 25 bp, Rattus norvegicus
cggggcgatggataaactgaccatc

SEQ ID NO: 600191 - DNA, 25 bp, Rattus norvegicus
actggatcaacaccggggagtcggc

SEQ ID NO: 600192 - DNA, 25 bp, Rattus norvegicus
cgcgtggtttcgcttccgggtgagg

SEQ ID NO: 600193 - DNA, 25 bp, Rattus norvegicus
agggtctctccttcgtgtctcggag

SEQ ID NO: 600194 - DNA, 25 bp, Rattus norvegicus
cgcgcctgtcccactttgggaggta

SEQ ID NO: 600195 - DNA, 25 bp, Rattus norvegicus
cccgaaaggagcttctttggttgca

SEQ ID NO: 600196 - DNA, 25 bp, Rattus norvegicus
gcggggctcagtatttgcgcctata

SEQ ID NO: 600197 - DNA, 25 bp, Rattus norvegicus
ggagaacccgcctgtccctctgaag

SEQ ID NO: 600198 - DNA, 25 bp, Rattus norvegicus
tcacgcggcacagtaaccggcttta

SEQ ID NO: 600199 - DNA, 25 bp, Rattus norvegicus
ctgtgcgagcctcagtcgaggaatc

SEQ ID NO: 600200 - DNA, 25 bp, Rattus norvegicus
gagatctgtgcagcatacgcccttg

SEQ ID NO: 600201 - DNA, 25 bp, Rattus norvegicus
tacgcccttgcagcattgttgttga

SEQ ID NO: 600202 - DNA, 25 bp, Rattus norvegicus
cgccaaggggctgagcattcatatg

SEQ ID NO: 600203 - DNA, 25 bp, Rattus norvegicus
cctcgggccaaatctagcttgtgtc

SEQ ID NO: 600204 - DNA, 25 bp, Rattus norvegicus
ctgtgtgtgactgatcgcgtgtatt

SEQ ID NO: 600205 - DNA, 25 bp, Rattus norvegicus
cggctttagacccaaacgctcagga

SEQ ID NO: 600206 - DNA, 25 bp, Rattus norvegicus
ccctctgaagcgctcaagcagcatt

SEQ ID NO: 600207 - DNA, 25 bp, Rattus norvegicus
cgttgccttagctgaactgggttaa

SEQ ID NO: 600208 - DNA, 25 bp, Rattus norvegicus
acgtgtccgccggagtttctccagc

SEQ ID NO: 600209 - DNA, 25 bp, Rattus norvegicus
tgtgtttaaacagagtggcgactgc

SEQ ID NO: 600210 - DNA, 25 bp, Rattus norvegicus
cgcctcattcattgatctgtgttta

SEQ ID NO: 600211 - DNA, 25 bp, Rattus norvegicus
ggcccgggacgcctcattcattgat

SEQ ID NO: 600212 - DNA, 25 bp, Rattus norvegicus
tgggttaactcagccctagcgggcc

SEQ ID NO: 600213 - DNA, 25 bp, Rattus norvegicus
ctgagcaccggcgacaaggagaaag

SEQ ID NO: 600214 - DNA, 25 bp, Rattus norvegicus
ccgcgctgctgactaggccagagag

SEQ ID NO: 600215 - DNA, 25 bp, Rattus norvegicus
gtgtgctctctgcaccacgagtggc

SEQ ID NO: 600216 - DNA, 25 bp, Rattus norvegicus
ccctgccgtcaatgtgtgctctctg

SEQ ID NO: 600217 - DNA, 25 bp, Rattus norvegicus
cggagaggtgagacccgactcagca

SEQ ID NO: 600218 - DNA, 25 bp, Rattus norvegicus
catggccgctccctgatagaagacc

SEQ ID NO: 600219 - DNA, 25 bp, Rattus norvegicus
tttctccagcagcaacatggccgct

SEQ ID NO: 600220 - DNA, 25 bp, Rattus norvegicus
cgactcagcagcctcgggattctgg

SEQ ID NO: 600221 - DNA, 25 bp, Rattus norvegicus
cctccggcagctgacaggcctgaga

SEQ ID NO: 600222 - DNA, 25 bp, Rattus norvegicus
gttcctgcgggcagcactcaccatg

SEQ ID NO: 600223 - DNA, 25 bp, Rattus norvegicus
ctgacaggcctgagacgcccggact

SEQ ID NO: 600224 - DNA, 25 bp, Rattus norvegicus
tgagacgcccggactgccaggctca

SEQ ID NO: 600225 - DNA, 25 bp, Rattus norvegicus
tgccaggctcagctgacggatcaaa

SEQ ID NO: 600226 - DNA, 25 bp, Rattus norvegicus
aggctcagctgacggatcaaatgta

SEQ ID NO: 600227 - DNA, 25 bp, Rattus norvegicus
ctgacggatcaaatgtaaagatggc

SEQ ID NO: 600228 - DNA, 25 bp, Rattus norvegicus
taaagatggcgtgagacaaagaccc

SEQ ID NO: 600229 - DNA, 25 bp, Rattus norvegicus
gtgagacaaagacccgcgaactagc

SEQ ID NO: 600230 - DNA, 25 bp, Rattus norvegicus
gcgaactagcgaacccgcgaaggcc

SEQ ID NO: 600231 - DNA, 25 bp, Rattus norvegicus
cctgtgcccagggtgcgtgcctgat

SEQ ID NO: 600232 - DNA, 25 bp, Rattus norvegicus
gcgtgcctgattgggtcgcacctca

SEQ ID NO: 600233 - DNA, 25 bp, Rattus norvegicus
gcctgattgggtcgcacctcagtcc

SEQ ID NO: 600234 - DNA, 25 bp, Rattus norvegicus
aaccctgagggttcctgcgggcagc

SEQ ID NO: 600235 - DNA, 25 bp, Rattus norvegicus
tcttcccacacgagggtttcagatg

SEQ ID NO: 600236 - DNA, 25 bp, Rattus norvegicus
ttcagatgcgggtcaactcttctcc

SEQ ID NO: 600237 - DNA, 25 bp, Rattus norvegicus
aggtttcaagccgatccagtgtgcc

SEQ ID NO: 600238 - DNA, 25 bp, Rattus norvegicus
cgtcgcgtctcctcagttgagtgca

SEQ ID NO: 600239 - DNA, 25 bp, Rattus norvegicus
ttaaagcgccaagcatcagccaggg

SEQ ID NO: 600240 - DNA, 25 bp, Rattus norvegicus
agggctcatcctctatctcgaactc

SEQ ID NO: 600241 - DNA, 25 bp, Rattus norvegicus
ctccacaaggttatctgccagcatg

SEQ ID NO: 600242 - DNA, 25 bp, Rattus norvegicus
aacgtggcactttggcagaaccctc

SEQ ID NO: 600243 - DNA, 25 bp, Rattus norvegicus
gaggcgccttgaccaatcacgaatg

SEQ ID NO: 600244 - DNA, 25 bp, Rattus norvegicus
cgaatgagccgcttgtagagtgaca

SEQ ID NO: 600245 - DNA, 25 bp, Rattus norvegicus
agtgacagcgacctcagccaataga

SEQ ID NO: 600246 - DNA, 25 bp, Rattus norvegicus
gtccgcggaccatcagccaataaag

SEQ ID NO: 600247 - DNA, 25 bp, Rattus norvegicus
agctcctcctcttttgtctgcgtcg

SEQ ID NO: 600248 - DNA, 25 bp, Rattus norvegicus
ccagtgtgccgaggactacggattc

SEQ ID NO: 600249 - DNA, 25 bp, Rattus norvegicus
gcgccacggagaacgtatacgccct

SEQ ID NO: 600250 - DNA, 25 bp, Rattus norvegicus
acttggcggcgatggctcgagctcc

SEQ ID NO: 600251 - DNA, 25 bp, Rattus norvegicus
acacgcaccaggtactgggccgcgg

SEQ ID NO: 600252 - DNA, 25 bp, Rattus norvegicus
gcgggaaggacacgcaccaggtact

SEQ ID NO: 600253 - DNA, 25 bp, Rattus norvegicus
tacgtgaacatgactagcggccctg

SEQ ID NO: 600254 - DNA, 25 bp, Rattus norvegicus
ctcccgctctctgtacgtgaacatg

SEQ ID NO: 600255 - DNA, 25 bp, Rattus norvegicus
ccagcctctcacaaacttttccggg

SEQ ID NO: 600256 - DNA, 25 bp, Rattus norvegicus
tgagaaggccgtgcgcctgccgctc

SEQ ID NO: 600257 - DNA, 25 bp, Rattus norvegicus
gcatttgtacgtgcaccgggtggaa

SEQ ID NO: 600258 - DNA, 25 bp, Rattus norvegicus
cctcctgcatttgtacgtgcaccgg

SEQ ID NO: 600259 - DNA, 25 bp, Rattus norvegicus
cgctcattgggcagggagaacgccc

SEQ ID NO: 600260 - DNA, 25 bp, Rattus norvegicus
cacggagaacgtatacgccctttct

SEQ ID NO: 600261 - DNA, 25 bp, Rattus norvegicus
gcccagcggcgccttttgtttggcg

SEQ ID NO: 600262 - DNA, 25 bp, Rattus norvegicus
cccgtctccgctcattgggcaggga

SEQ ID NO: 600263 - DNA, 25 bp, Rattus norvegicus
atgatgggaatgcagccacctggtc

SEQ ID NO: 600264 - DNA, 25 bp, Rattus norvegicus
gacgtcaggcggctccttaaataga

SEQ ID NO: 600265 - DNA, 25 bp, Rattus norvegicus
tttatccgagtgcacccggacgttc

SEQ ID NO: 600266 - DNA, 25 bp, Rattus norvegicus
cccgagcagtgctggagtttatccg

SEQ ID NO: 600267 - DNA, 25 bp, Rattus norvegicus
tacagcttcctgtgctgctgcgacg

SEQ ID NO: 600268 - DNA, 25 bp, Rattus norvegicus
tgtccttgtcctgcacttacctgtg

SEQ ID NO: 600269 - DNA, 25 bp, Rattus norvegicus
cgggcccatggagctatggcctata

SEQ ID NO: 600270 - DNA, 25 bp, Rattus norvegicus
aggatgatatcccttacgcctagtc

SEQ ID NO: 600271 - DNA, 25 bp, Rattus norvegicus
gcaggtgccacctcggaaaccatga

SEQ ID NO: 600272 - DNA, 25 bp, Rattus norvegicus
atggtgctcacccaagccagctgtc

SEQ ID NO: 600273 - DNA, 25 bp, Rattus norvegicus
cccatcgcctagcaccgggagatga

SEQ ID NO: 600274 - DNA, 25 bp, Rattus norvegicus
tccgaacccgacacgcgtgagagtc

SEQ ID NO: 600275 - DNA, 25 bp, Rattus norvegicus
tccttaaatagagccggtagcgcgc

SEQ ID NO: 600276 - DNA, 25 bp, Rattus norvegicus
cttcttcgacaggaattacggccga

SEQ ID NO: 600277 - DNA, 25 bp, Rattus norvegicus
tgtacgcactgcacctggagagctg

SEQ ID NO: 600278 - DNA, 25 bp, Rattus norvegicus
cgtcagtggtgagcggctcatcacc

SEQ ID NO: 600279 - DNA, 25 bp, Rattus norvegicus
acttcgtcagtggtgagcggctcat

SEQ ID NO: 600280 - DNA, 25 bp, Rattus norvegicus
ggctccggtacttcccgctggccca

SEQ ID NO: 600281 - DNA, 25 bp, Rattus norvegicus
ggcatgtacgcactgcacctggaga

SEQ ID NO: 600282 - DNA, 25 bp, Rattus norvegicus
tccgcatcggcatgtacgcactgca

SEQ ID NO: 600283 - DNA, 25 bp, Rattus norvegicus
ttggaacgccatccgcatcggcatg

SEQ ID NO: 600284 - DNA, 25 bp, Rattus norvegicus
gatgtgtcttggaacgccatccgca

SEQ ID NO: 600285 - DNA, 25 bp, Rattus norvegicus
agggcttgtccttccgcaaccgcag

SEQ ID NO: 600286 - DNA, 25 bp, Rattus norvegicus
accttcgagggcttgtccttccgca

SEQ ID NO: 600287 - DNA, 25 bp, Rattus norvegicus
acgctttccaagaagccggacatcc

SEQ ID NO: 600288 - DNA, 25 bp, Rattus norvegicus
cgcagacgctttccaagaagccgga

SEQ ID NO: 600289 - DNA, 25 bp, Rattus norvegicus
acccggtgacccgagccatctctga

SEQ ID NO: 600290 - DNA, 25 bp, Rattus norvegicus
cccagatccacttcgtcagtggtga

SEQ ID NO: 600291 - DNA, 25 bp, Rattus norvegicus
cagggcgtggtgacttccaagaaaa

SEQ ID NO: 600292 - DNA, 25 bp, Rattus norvegicus
ctcgggatacagaagctgagctgtc

SEQ ID NO: 600293 - DNA, 25 bp, Rattus norvegicus
gagctgtcgcgttttctgagccggt

SEQ ID NO: 600294 - DNA, 25 bp, Rattus norvegicus
aggagcgcatctcggatcttctctg

SEQ ID NO: 600295 - DNA, 25 bp, Rattus norvegicus
tcccagccttgaagagcatgcattg

SEQ ID NO: 600296 - DNA, 25 bp, Rattus norvegicus
tgcattgaccgcgactgttctttcc

SEQ ID NO: 600297 - DNA, 25 bp, Rattus norvegicus
aaagattattctgtccacgggtggc

SEQ ID NO: 600298 - DNA, 25 bp, Rattus norvegicus
cgcttctggccgtgccacttggaga

SEQ ID NO: 600299 - DNA, 25 bp, Rattus norvegicus
ggttccaggtacttgagcagctaca

SEQ ID NO: 600300 - DNA, 25 bp, Rattus norvegicus
tctgagaggtaagctcagccgcgtc

SEQ ID NO: 600301 - DNA, 25 bp, Rattus norvegicus
cagccgtgacccttcggatctgaga

SEQ ID NO: 600302 - DNA, 25 bp, Rattus norvegicus
gaggagcgtctccagactgtacaca

SEQ ID NO: 600303 - DNA, 25 bp, Rattus norvegicus
gtggcgggatgctgaaacattacca

SEQ ID NO: 600304 - DNA, 25 bp, Rattus norvegicus
cacttggagatgcttggctttatga

SEQ ID NO: 600305 - DNA, 25 bp, Rattus norvegicus
ggagcagctttctaaacaggtatga

SEQ ID NO: 600306 - DNA, 25 bp, Rattus norvegicus
cagttccgtccctgacagcgtctga

SEQ ID NO: 600307 - DNA, 25 bp, Rattus norvegicus
aatgaccgcagttccgtccctgaca

SEQ ID NO: 600308 - DNA, 25 bp, Rattus norvegicus
tcgcacccgggcaatgaccgcagtt

SEQ ID NO: 600309 - DNA, 25 bp, Rattus norvegicus
aggtatgacagcgacctccgcgcgc

SEQ ID NO: 600310 - DNA, 25 bp, Rattus norvegicus
tctaaacaggtatgacagcgacctc

SEQ ID NO: 600311 - DNA, 25 bp, Rattus norvegicus
gcacattggagcagctttctaaaca

SEQ ID NO: 600312 - DNA, 25 bp, Rattus norvegicus
atcactgcacattggagcagctttc

SEQ ID NO: 600313 - DNA, 25 bp, Rattus norvegicus
gccaccaccttagctgccatcactg

SEQ ID NO: 600314 - DNA, 25 bp, Rattus norvegicus
gccactcggacggacgccaccacct

SEQ ID NO: 600315 - DNA, 25 bp, Rattus norvegicus
tgacccagctccacagccactcgga

SEQ ID NO: 600316 - DNA, 25 bp, Rattus norvegicus
tccgtccctgacagcgtctgagagc

SEQ ID NO: 600317 - DNA, 25 bp, Rattus norvegicus
cgcctacagcgtccctggctctaca

SEQ ID NO: 600318 - DNA, 25 bp, Rattus norvegicus
tggctctacaggtgacccagctcca

SEQ ID NO: 600319 - DNA, 25 bp, Rattus norvegicus
tgggctcccaacgactggttccagc

SEQ ID NO: 600320 - DNA, 25 bp, Rattus norvegicus
agatgcgtaagaagcgatcctgatc

SEQ ID NO: 600321 - DNA, 25 bp, Rattus norvegicus
gatcctgatccttacctgactcctg

SEQ ID NO: 600322 - DNA, 25 bp, Rattus norvegicus
actcctgcgtcaggcttcagctctg

SEQ ID NO: 600323 - DNA, 25 bp, Rattus norvegicus
tctgaggtcctgtaagcctccagtc

SEQ ID NO: 600324 - DNA, 25 bp, Rattus norvegicus
gcgggtctcagcctcgagctcttat

SEQ ID NO: 600325 - DNA, 25 bp, Rattus norvegicus
ccctgcatcacttggggactaggat

SEQ ID NO: 600326 - DNA, 25 bp, Rattus norvegicus
ctttgcaaggttatagagtctcggc

SEQ ID NO: 600327 - DNA, 25 bp, Rattus norvegicus
cgtgagatcagggtacctccaggta

SEQ ID NO: 600328 - DNA, 25 bp, Rattus norvegicus
ccagacggacagttggtttccaaga

SEQ ID NO: 600329 - DNA, 25 bp, Rattus norvegicus
ccacttcttccttcggtgttgtacg

SEQ ID NO: 600330 - DNA, 25 bp, Rattus norvegicus
gtccaggtctccatccctgttcgtg

SEQ ID NO: 600331 - DNA, 25 bp, Rattus norvegicus
ccagcgaggttgtcagaagcagatc

SEQ ID NO: 600332 - DNA, 25 bp, Rattus norvegicus
tttccaagagggatcagtccaggtc

SEQ ID NO: 600333 - DNA, 25 bp, Rattus norvegicus
actgttcctgttggggttgcggact

SEQ ID NO: 600334 - DNA, 25 bp, Rattus norvegicus
ggacttcgcgcagttccaattggta

SEQ ID NO: 600335 - DNA, 25 bp, Rattus norvegicus
aacgttgccatagtgactgttcctg

SEQ ID NO: 600336 - DNA, 25 bp, Rattus norvegicus
tcttccggaagtcagtgaacgttgc

SEQ ID NO: 600337 - DNA, 25 bp, Rattus norvegicus
tcgcgcaccgtacttcttccggaag

SEQ ID NO: 600338 - DNA, 25 bp, Rattus norvegicus
gaatctgaatgtccctcctcgcgca

SEQ ID NO: 600339 - DNA, 25 bp, Rattus norvegicus
ctgaacccacctcgcctgtaatttg

SEQ ID NO: 600340 - DNA, 25 bp, Rattus norvegicus
cctttggggctcctgtctgaaccca

SEQ ID NO: 600341 - DNA, 25 bp, Rattus norvegicus
tcggccaggaacttggagaagtcca

SEQ ID NO: 600342 - DNA, 25 bp, Rattus norvegicus
ctcctggatgaacaactgcagcttc

SEQ ID NO: 600343 - DNA, 25 bp, Rattus norvegicus
cttcacgtcgaagtcatcggccagg

SEQ ID NO: 600344 - DNA, 25 bp, Rattus norvegicus
actgcagcttcatcaccagggtggc

SEQ ID NO: 600345 - DNA, 25 bp, Rattus norvegicus
ggccgcattgatccagtccttcacg

SEQ ID NO: 600346 - DNA, 25 bp, Rattus norvegicus
tgtaatttgccgacccgtcagcgcg

SEQ ID NO: 600347 - DNA, 25 bp, Rattus norvegicus
acacagagaggcacgtgatagggcg

SEQ ID NO: 600348 - DNA, 25 bp, Rattus norvegicus
aagctgcagccaccgacgccgccta

SEQ ID NO: 600349 - DNA, 25 bp, Rattus norvegicus
gggcctgttgggcacgcccattcct

SEQ ID NO: 600350 - DNA, 25 bp, Rattus norvegicus
cgccgcctagctctccagctgccga

SEQ ID NO: 600351 - DNA, 25 bp, Rattus norvegicus
cagctgccgacgcggcagacacaga

SEQ ID NO: 600352 - DNA, 25 bp, Rattus norvegicus
caggatcacgtgtggcgcgatgcta

SEQ ID NO: 600353 - DNA, 25 bp, Rattus norvegicus
cacgtgtggcgcgatgctactcact

SEQ ID NO: 600354 - DNA, 25 bp, Rattus norvegicus
cgtgtggcgcgatgctactcactga

SEQ ID NO: 600355 - DNA, 25 bp, Rattus norvegicus
tactcactgagccacagctccagtg

SEQ ID NO: 600356 - DNA, 25 bp, Rattus norvegicus
cacagctccagtgccgccgctgagc

SEQ ID NO: 600357 - DNA, 25 bp, Rattus norvegicus
gccctccgccgactcggtccctgcg

SEQ ID NO: 600358 - DNA, 25 bp, Rattus norvegicus
acagccgtcgctgccatctgccctg

SEQ ID NO: 600359 - DNA, 25 bp, Rattus norvegicus
tgctcaaaagctgcagccaccgacg

SEQ ID NO: 600360 - DNA, 25 bp, Rattus norvegicus
gttgggcacgcccattcctgggtcc

SEQ ID NO: 600361 - DNA, 25 bp, Rattus norvegicus
agccaagcatggacacggaggccga

SEQ ID NO: 600362 - DNA, 25 bp, Rattus norvegicus
cccttcggttgtgggaatgctaaag

SEQ ID NO: 600363 - DNA, 25 bp, Rattus norvegicus
cggtgggtggtgtacacaatcatca

SEQ ID NO: 600364 - DNA, 25 bp, Rattus norvegicus
ggggccaatctcagccagctcgctt

SEQ ID NO: 600365 - DNA, 25 bp, Rattus norvegicus
tccggccagcctgtgtgaaattagg

SEQ ID NO: 600366 - DNA, 25 bp, Rattus norvegicus
aggcgggtctccatagaaacctcca

SEQ ID NO: 600367 - DNA, 25 bp, Rattus norvegicus
tgggcccattcttgtcgcaggcttg

SEQ ID NO: 600368 - DNA, 25 bp, Rattus norvegicus
agcgagcgggcgatttctcagaccc

SEQ ID NO: 600369 - DNA, 25 bp, Rattus norvegicus
aatgcactgccgctcagggacagag

SEQ ID NO: 600370 - DNA, 25 bp, Rattus norvegicus
ccctctggacaagggcggcaatgca

SEQ ID NO: 600371 - DNA, 25 bp, Rattus norvegicus
gcgcggcggggaaaacctcattcca

SEQ ID NO: 600372 - DNA, 25 bp, Rattus norvegicus
cgtgggcttcttcgcacgtcacttc

SEQ ID NO: 600373 - DNA, 25 bp, Rattus norvegicus
gcggcgtcacgtccgtcaggattac

SEQ ID NO: 600374 - DNA, 25 bp, Rattus norvegicus
agcgccgccatgtggaatagaaaca

SEQ ID NO: 600375 - DNA, 25 bp, Rattus norvegicus
agcggatctccgtcggcacggcata

SEQ ID NO: 600376 - DNA, 25 bp, Rattus norvegicus
ctgccgtgcgctctgacgtccaggt

SEQ ID NO: 600377 - DNA, 25 bp, Rattus norvegicus
agcaaggccgacgagcctcagccga

SEQ ID NO: 600378 - DNA, 25 bp, Rattus norvegicus
cacaaggcgcagatggcctcagcgg

SEQ ID NO: 600379 - DNA, 25 bp, Rattus norvegicus
cgcgcgctgacacaaggcgcagatg

SEQ ID NO: 600380 - DNA, 25 bp, Rattus norvegicus
ggcagaaacgatggccgcagtcagc

SEQ ID NO: 600381 - DNA, 25 bp, Rattus norvegicus
acgcacgcccggcagaaacgatggc

SEQ ID NO: 600382 - DNA, 25 bp, Rattus norvegicus
gcagtcatcggcacactcggggcat

SEQ ID NO: 600383 - DNA, 25 bp, Rattus norvegicus
tgccagcagtcatcggcacactcgg

SEQ ID NO: 600384 - DNA, 25 bp, Rattus norvegicus
cggccatgcggcaagcagagcacag

SEQ ID NO: 600385 - DNA, 25 bp, Rattus norvegicus
cacggcatagcagctgcaacgcggc

SEQ ID NO: 600386 - DNA, 25 bp, Rattus norvegicus
cggcaagcagagcacagcggatctc

SEQ ID NO: 600387 - DNA, 25 bp, Rattus norvegicus
acgtccaggtcctggcagttgcgcg

SEQ ID NO: 600388 - DNA, 25 bp, Rattus norvegicus
aacgcggcctcgctagcagggccat

SEQ ID NO: 600389 - DNA, 25 bp, Rattus norvegicus
ggttcttctccagattccctcaggg

SEQ ID NO: 600390 - DNA, 25 bp, Rattus norvegicus
ctgcgacgtacagagcggcgcttga

SEQ ID NO: 600391 - DNA, 25 bp, Rattus norvegicus
gcgccttacgcctgcgacgtacaga

SEQ ID NO: 600392 - DNA, 25 bp, Rattus norvegicus
gccgaagccgctggtagcgccttac

SEQ ID NO: 600393 - DNA, 25 bp, Rattus norvegicus
catggctacgccaacccaggatgca

SEQ ID NO: 600394 - DNA, 25 bp, Rattus norvegicus
acacgagacgccatggctacgccaa

SEQ ID NO: 600395 - DNA, 25 bp, Rattus norvegicus
caaaggacacgagacgccatggcta

SEQ ID NO: 600396 - DNA, 25 bp, Rattus norvegicus
cggacacaggcgcaaaggacacgag

SEQ ID NO: 600397 - DNA, 25 bp, Rattus norvegicus
tgacccctgactagctccggcaaag

SEQ ID NO: 600398 - DNA, 25 bp, Rattus norvegicus
tccctcagggcagagaatggtgctg

SEQ ID NO: 600399 - DNA, 25 bp, Rattus norvegicus
gggctgcagagtcccggttcttctc

SEQ ID NO: 600400 - DNA, 25 bp, Rattus norvegicus
agtcacctgcgcgagcgccaaggtg

SEQ ID NO: 600401 - DNA, 25 bp, Rattus norvegicus
aaagtcaccgcgagtcacctgcgcg

SEQ ID NO: 600402 - DNA, 25 bp, Rattus norvegicus
tgagcggccgggccaaagccaacgt

SEQ ID NO: 600403 - DNA, 25 bp, Rattus norvegicus
tgggcgaactgctgtataacaagtc

SEQ ID NO: 600404 - DNA, 25 bp, Rattus norvegicus
cttctccgcacaactgaggggcttc

SEQ ID NO: 600405 - DNA, 25 bp, Rattus norvegicus
cggaaagctcttccatcgggatgga

SEQ ID NO: 600406 - DNA, 25 bp, Rattus norvegicus
caaacgcaaggagcagccgtcgcca

SEQ ID NO: 600407 - DNA, 25 bp, Rattus norvegicus
accctcactgggtgactggcgagtc

SEQ ID NO: 600408 - DNA, 25 bp, Rattus norvegicus
gcgctacccgctctggccaattaaa

SEQ ID NO: 600409 - DNA, 25 bp, Rattus norvegicus
aaaattgccgtttgctctgcgcacg

SEQ ID NO: 600410 - DNA, 25 bp, Rattus norvegicus
ttaatcgatgagagtccagggcgcg

SEQ ID NO: 600411 - DNA, 25 bp, Rattus norvegicus
gtggacagacaaccggaagtagcta

SEQ ID NO: 600412 - DNA, 25 bp, Rattus norvegicus
gcctgagcgactgacaggatcctga

SEQ ID NO: 600413 - DNA, 25 bp, Rattus norvegicus
aggactggacggtcacccttcctgt

SEQ ID NO: 600414 - DNA, 25 bp, Rattus norvegicus
cccttccttggatgacttggaaaca

SEQ ID NO: 600415 - DNA, 25 bp, Rattus norvegicus
acttggaaacacgtagagacgcttc

SEQ ID NO: 600416 - DNA, 25 bp, Rattus norvegicus
gtagctagaatcaccggcagcctga

SEQ ID NO: 600417 - DNA, 25 bp, Rattus norvegicus
tcctgatggatccacgcagccggcg

SEQ ID NO: 600418 - DNA, 25 bp, Rattus norvegicus
agctggaaagctggctcgagcacca

SEQ ID NO: 600419 - DNA, 25 bp, Rattus norvegicus
tttaaaggcggctgcgccgtagagc

SEQ ID NO: 600420 - DNA, 25 bp, Rattus norvegicus
gattccggaggtcctgatggatcca

SEQ ID NO: 600421 - DNA, 25 bp, Rattus norvegicus
gagcaccagccgacctagggaaagg

SEQ ID NO: 600422 - DNA, 25 bp, Rattus norvegicus
gcatcatgaatgcagcggccaaagc

SEQ ID NO: 600423 - DNA, 25 bp, Rattus norvegicus
cgtggagcaacatcggcatcatgaa

SEQ ID NO: 600424 - DNA, 25 bp, Rattus norvegicus
ctacccggccaggtccgtggagcaa

SEQ ID NO: 600425 - DNA, 25 bp, Rattus norvegicus
agcagagcaggatcctctgcaccta

SEQ ID NO: 600426 - DNA, 25 bp, Rattus norvegicus
tcccagcgctgcgtttgaattcggg

SEQ ID NO: 600427 - DNA, 25 bp, Rattus norvegicus
tgtaacgttcccagcgctgcgtttg

SEQ ID NO: 600428 - DNA, 25 bp, Rattus norvegicus
gcgcaggcccttgtaacgttcccag

SEQ ID NO: 600429 - DNA, 25 bp, Rattus norvegicus
tagagcactcccatggtgccgcgcg

SEQ ID NO: 600430 - DNA, 25 bp, Rattus norvegicus
cccgctggcgaaagagattccggag

SEQ ID NO: 600431 - DNA, 25 bp, Rattus norvegicus
ggtcccagacagctggtcgccaggc

SEQ ID NO: 600432 - DNA, 25 bp, Rattus norvegicus
cggtgccaagcacagctggaccagc

SEQ ID NO: 600433 - DNA, 25 bp, Rattus norvegicus
atctgtccagcgcagtctgcggtcc

SEQ ID NO: 600434 - DNA, 25 bp, Rattus norvegicus
agcgctgcggctaagaacacttggc

SEQ ID NO: 600435 - DNA, 25 bp, Rattus norvegicus
tggctggtggtgactgatatgtaaa

SEQ ID NO: 600436 - DNA, 25 bp, Rattus norvegicus
tgatatgtaaagcagctggcggctc

SEQ ID NO: 600437 - DNA, 25 bp, Rattus norvegicus
ggggcctgggttccatgcaaatgaa

SEQ ID NO: 600438 - DNA, 25 bp, Rattus norvegicus
gccctccggcagaagaacgtgcacg

SEQ ID NO: 600439 - DNA, 25 bp, Rattus norvegicus
tgcacgaggtgaagaaccacaaatt

SEQ ID NO: 600440 - DNA, 25 bp, Rattus norvegicus
gccactgcaccgacttcatttggtg

SEQ ID NO: 600441 - DNA, 25 bp, Rattus norvegicus
acttcatttggtgagagtgcgccgc

SEQ ID NO: 600442 - DNA, 25 bp, Rattus norvegicus
tcccaaatggccaatccctcaggtg

SEQ ID NO: 600443 - DNA, 25 bp, Rattus norvegicus
aatccctcaggtgctgggtcctccg

SEQ ID NO: 600444 - DNA, 25 bp, Rattus norvegicus
aggcgccttttcgacacctggctca

SEQ ID NO: 600445 - DNA, 25 bp, Rattus norvegicus
tggactgaccgctactgactgcacc

SEQ ID NO: 600446 - DNA, 25 bp, Rattus norvegicus
ataaagagggaatccagcgaagccc

SEQ ID NO: 600447 - DNA, 25 bp, Rattus norvegicus
acattgtgccggttggcggatcctc

SEQ ID NO: 600448 - DNA, 25 bp, Rattus norvegicus
tcttgccggcccttagcatgagcga

SEQ ID NO: 600449 - DNA, 25 bp, Rattus norvegicus
cggcccttgcagtccctgcttaaga

SEQ ID NO: 600450 - DNA, 25 bp, Rattus norvegicus
tcggactctaacgtgtggactgacc

SEQ ID NO: 600451 - DNA, 25 bp, Rattus norvegicus
cgcggggtcattcggactctaacgt

SEQ ID NO: 600452 - DNA, 25 bp, Rattus norvegicus
cccatccacggagagagactagccg

SEQ ID NO: 600453 - DNA, 25 bp, Rattus norvegicus
ggacccagccgggtgacattgtgcc

SEQ ID NO: 600454 - DNA, 25 bp, Rattus norvegicus
gttcaccgcgtagcctcaggttcca

SEQ ID NO: 600455 - DNA, 25 bp, Rattus norvegicus
tcaggttccacgcagggagtcacaa

SEQ ID NO: 600456 - DNA, 25 bp, Rattus norvegicus
agggagtcacaaagcgccgggtcac

SEQ ID NO: 600457 - DNA, 25 bp, Rattus norvegicus
tgcgctttgtgacgcagacggtccc

SEQ ID NO: 600458 - DNA, 25 bp, Rattus norvegicus
atagtttctccggttcaccgcgtag

SEQ ID NO: 600459 - DNA, 25 bp, Rattus norvegicus
ggccaggagccagcctacagcgctg

SEQ ID NO: 600460 - DNA, 25 bp, Rattus norvegicus
gcagcagctccgttttcacgcgcat

SEQ ID NO: 600461 - DNA, 25 bp, Rattus norvegicus
gggttacagctctgggctccgccgc

SEQ ID NO: 600462 - DNA, 25 bp, Rattus norvegicus
taccgcgcgggttacagctctgggc

SEQ ID NO: 600463 - DNA, 25 bp, Rattus norvegicus
agccagcctacagcgctgccgcagg

SEQ ID NO: 600464 - DNA, 25 bp, Rattus norvegicus
acacacatgaggtgagaggaccgga

SEQ ID NO: 600465 - DNA, 25 bp, Rattus norvegicus
tttacacacatgaggtgagaggacc

SEQ ID NO: 600466 - DNA, 25 bp, Rattus norvegicus
tagtgcactttacacacatgaggtg

SEQ ID NO: 600467 - DNA, 25 bp, Rattus norvegicus
gcgctagtgcactttacacacatga

SEQ ID NO: 600468 - DNA, 25 bp, Rattus norvegicus
cacgcgctagtgcactttacacaca

SEQ ID NO: 600469 - DNA, 25 bp, Rattus norvegicus
cggagggcttgaggctcgcgagcct

SEQ ID NO: 600470 - DNA, 25 bp, Rattus norvegicus
aaaatggcgctggtgcagcggctcg

SEQ ID NO: 600471 - DNA, 25 bp, Rattus norvegicus
tgcactttacacacatgaggtgaga

SEQ ID NO: 600472 - DNA, 25 bp, Rattus norvegicus
tgccgcaggacccttcgggctgatg

SEQ ID NO: 600473 - DNA, 25 bp, Rattus norvegicus
tgagcctctcagatcttggcccggt

SEQ ID NO: 600474 - DNA, 25 bp, Rattus norvegicus
tggagcctaaccgaacagggccgaa

SEQ ID NO: 600475 - DNA, 25 bp, Rattus norvegicus
cggtgacggaggctacaattcgacc

SEQ ID NO: 600476 - DNA, 25 bp, Rattus norvegicus
ccaataggagacgaatgagcgtggc

SEQ ID NO: 600477 - DNA, 25 bp, Rattus norvegicus
cccggcggttctgaattagagccga

SEQ ID NO: 600478 - DNA, 25 bp, Rattus norvegicus
tgggcagagcagagccaaacttagc

SEQ ID NO: 600479 - DNA, 25 bp, Rattus norvegicus
ctacctactctagtggtgacaatta

SEQ ID NO: 600480 - DNA, 25 bp, Rattus norvegicus
agccgagccgaaagaggccgaaact

SEQ ID NO: 600481 - DNA, 25 bp, Rattus norvegicus
gccgaaaccagataggtgtagccga

SEQ ID NO: 600482 - DNA, 25 bp, Rattus norvegicus
caattagaacgcgagtgagcctctc

SEQ ID NO: 600483 - DNA, 25 bp, Rattus norvegicus
accggccgaaaccagagaagtcagg

SEQ ID NO: 600484 - DNA, 25 bp, Rattus norvegicus
ccgaaccaatcggtgagcaaggggt

SEQ ID NO: 600485 - DNA, 25 bp, Rattus norvegicus
tggcgggtcctacctacatcgcttc

SEQ ID NO: 600486 - DNA, 25 bp, Rattus norvegicus
tgtagccgagctggccaacaccggc

SEQ ID NO: 600487 - DNA, 25 bp, Rattus norvegicus
catcacaatggaggacatggtcatg

SEQ ID NO: 600488 - DNA, 25 bp, Rattus norvegicus
tgtcttactcgttcccgggtgctca

SEQ ID NO: 600489 - DNA, 25 bp, Rattus norvegicus
gcttgcacgacagacttcagacatg

SEQ ID NO: 600490 - DNA, 25 bp, Rattus norvegicus
ttcagacatgcatctctgcacatga

SEQ ID NO: 600491 - DNA, 25 bp, Rattus norvegicus
ctgcacatgacagtaccgtgggaca

SEQ ID NO: 600492 - DNA, 25 bp, Rattus norvegicus
ccgtgggacatgtcagtactgataa

SEQ ID NO: 600493 - DNA, 25 bp, Rattus norvegicus
cagtactgataaatgacaaggccca

SEQ ID NO: 600494 - DNA, 25 bp, Rattus norvegicus
ccatgctacagggaaccacaataac

SEQ ID NO: 600495 - DNA, 25 bp, Rattus norvegicus
atggcatcaaagtaggaggaatgtg

SEQ ID NO: 600496 - DNA, 25 bp, Rattus norvegicus
cagtgagaaggtgtcttactcgttc

SEQ ID NO: 600497 - DNA, 25 bp, Rattus norvegicus
cccagattgggatgtctctgctttc

SEQ ID NO: 600498 - DNA, 25 bp, Rattus norvegicus
tctgctttccgccttcatcacaatg

SEQ ID NO: 600499 - DNA, 25 bp, Rattus norvegicus
catggtgaccgggatggcatcaaag

SEQ ID NO: 600500 - DNA, 25 bp, Rattus norvegicus
agcatagccatagctgccagtgaga

SEQ ID NO: 600501 - DNA, 25 bp, Rattus norvegicus
tgtgcctgtttcttgcctcttttcc

SEQ ID NO: 600502 - DNA, 25 bp, Rattus norvegicus
tcgagctgtgactttgacgacgagg

SEQ ID NO: 600503 - DNA, 25 bp, Rattus norvegicus
agtcctcgttttcttcctgcgcgtc

SEQ ID NO: 600504 - DNA, 25 bp, Rattus norvegicus
tccatgtccctggtgggtgccacac

SEQ ID NO: 600505 - DNA, 25 bp, Rattus norvegicus
tgctgctttagtctgtgcctgtttc

SEQ ID NO: 600506 - DNA, 25 bp, Rattus norvegicus
atcgcgccttatccttgctgcttta

SEQ ID NO: 600507 - DNA, 25 bp, Rattus norvegicus
cccgggcgccaatcagctgaaaggt

SEQ ID NO: 600508 - DNA, 25 bp, Rattus norvegicus
taacaaacgtcatgtcccgggcgcc

SEQ ID NO: 600509 - DNA, 25 bp, Rattus norvegicus
gcctgactggacgaggaacttaatc

SEQ ID NO: 600510 - DNA, 25 bp, Rattus norvegicus
aagaatcttccaatggcctgactgg

SEQ ID NO: 600511 - DNA, 25 bp, Rattus norvegicus
tgcaggcggagcctaaagaatcttc

SEQ ID NO: 600512 - DNA, 25 bp, Rattus norvegicus
tttcaagaaacttccgggttgtgca

SEQ ID NO: 600513 - DNA, 25 bp, Rattus norvegicus
cgtcaccagcatgtccgggctttca

SEQ ID NO: 600514 - DNA, 25 bp, Rattus norvegicus
ccaccggctcgagggagtcctcgtt

SEQ ID NO: 600515 - DNA, 25 bp, Rattus norvegicus
cttctctagagaccgcgaagctgga

SEQ ID NO: 600516 - DNA, 25 bp, Rattus norvegicus
tcctgccttaagctgggcagacgcc

SEQ ID NO: 600517 - DNA, 25 bp, Rattus norvegicus
cgaagctggacaggcaacggcaatg

SEQ ID NO: 600518 - DNA, 25 bp, Rattus norvegicus
tgatgtcggaccctacttctctaga

SEQ ID NO: 600519 - DNA, 25 bp, Rattus norvegicus
tgcagcccagggactttaggaatga

SEQ ID NO: 600520 - DNA, 25 bp, Rattus norvegicus
agagcgtgcagcaccgcgacttgca

SEQ ID NO: 600521 - DNA, 25 bp, Rattus norvegicus
gtgaaccgctggcaagcagcctctt

SEQ ID NO: 600522 - DNA, 25 bp, Rattus norvegicus
aagaagctatgagcaaggcctcgcg

SEQ ID NO: 600523 - DNA, 25 bp, Rattus norvegicus
acctcggccagaggggaagaagcta

SEQ ID NO: 600524 - DNA, 25 bp, Rattus norvegicus
tcctcctcacgagggtgccgggaac

SEQ ID NO: 600525 - DNA, 25 bp, Rattus norvegicus
cagcgttcagggttcctcctcacga

SEQ ID NO: 600526 - DNA, 25 bp, Rattus norvegicus
caggagtgtccaggctcccagcagc

SEQ ID NO: 600527 - DNA, 25 bp, Rattus norvegicus
tacgcatgcgctactcgcgaccagg

SEQ ID NO: 600528 - DNA, 25 bp, Rattus norvegicus
caacggcaatgagcgtcctgcctta

SEQ ID NO: 600529 - DNA, 25 bp, Rattus norvegicus
cgaagaagggttccaagaaagccat

SEQ ID NO: 600530 - DNA, 25 bp, Rattus norvegicus
gaaagccatcaccaaggcacagaaa

SEQ ID NO: 600531 - DNA, 25 bp, Rattus norvegicus
gaagggttccaagaaagccatcacc

SEQ ID NO: 600532 - DNA, 25 bp, Rattus norvegicus
aagaaagccatcaccaaggcacaga

SEQ ID NO: 600533 - DNA, 25 bp, Rattus norvegicus
agccatcaccaaggcacagaaaaag

SEQ ID NO: 600534 - DNA, 25 bp, Rattus norvegicus
ccatcaccaaggcacagaaaaagga

SEQ ID NO: 600535 - DNA, 25 bp, Rattus norvegicus
atcaccaaggcacagaaaaaggatg

SEQ ID NO: 600536 - DNA, 25 bp, Rattus norvegicus
ccaagaaagccatcaccaaggcaca

SEQ ID NO: 600537 - DNA, 25 bp, Rattus norvegicus
cgctccactcccgcgccgaagaagg

SEQ ID NO: 600538 - DNA, 25 bp, Rattus norvegicus
gaagaagggttccaagaaagccatc

SEQ ID NO: 600539 - DNA, 25 bp, Rattus norvegicus
aagggttccaagaaagccatcacca

SEQ ID NO: 600540 - DNA, 25 bp, Rattus norvegicus
gggttccaagaaagccatcaccaag

SEQ ID NO: 600541 - DNA, 25 bp, Rattus norvegicus
ggttccaagaaagccatcaccaagg

SEQ ID NO: 600542 - DNA, 25 bp, Rattus norvegicus
ttccaagaaagccatcaccaaggca

SEQ ID NO: 600543 - DNA, 25 bp, Rattus norvegicus
gctacaattccctccaagagtcttg

SEQ ID NO: 600544 - DNA, 25 bp, Rattus norvegicus
cctccgcaggcacgcgcgaggcgca

SEQ ID NO: 600545 - DNA, 25 bp, Rattus norvegicus
ccaggatctccgctctcccgggcgc

SEQ ID NO: 600546 - DNA, 25 bp, Rattus norvegicus
cgactcccgtgggagcgcagcgcca

SEQ ID NO: 600547 - DNA, 25 bp, Rattus norvegicus
cgaacgcgggcacctccgactcccg

SEQ ID NO: 600548 - DNA, 25 bp, Rattus norvegicus
gaacgctggcgaacgcgggcacctc

SEQ ID NO: 600549 - DNA, 25 bp, Rattus norvegicus
tggcgcacgcctccgctctcgcgca

SEQ ID NO: 600550 - DNA, 25 bp, Rattus norvegicus
agtcttgagcgaacgctggcgaacg

SEQ ID NO: 600551 - DNA, 25 bp, Rattus norvegicus
ccaagagtcttgagcgaacgctggc

SEQ ID NO: 600552 - DNA, 25 bp, Rattus norvegicus
tccctccaagagtcttgagcgaacg

SEQ ID NO: 600553 - DNA, 25 bp, Rattus norvegicus
tgggctacaattccctccaagagtc

SEQ ID NO: 600554 - DNA, 25 bp, Rattus norvegicus
gctctgggctacaattccctccaag

SEQ ID NO: 600555 - DNA, 25 bp, Rattus norvegicus
cccagcgcacgacggcccgggccag

SEQ ID NO: 600556 - DNA, 25 bp, Rattus norvegicus
ctccaagagtcttgagcgaacgctg

SEQ ID NO: 600557 - DNA, 25 bp, Rattus norvegicus
agtccacccggacgtaagggcagtg

SEQ ID NO: 600558 - DNA, 25 bp, Rattus norvegicus
agctgctcttcatgtgcaccctatc

SEQ ID NO: 600559 - DNA, 25 bp, Rattus norvegicus
atgtgcaccctatccctgtccgtca

SEQ ID NO: 600560 - DNA, 25 bp, Rattus norvegicus
tgtccgtcacctacctgtgctacag

SEQ ID NO: 600561 - DNA, 25 bp, Rattus norvegicus
cctacctgtgctacagcctgctggg

SEQ ID NO: 600562 - DNA, 25 bp, Rattus norvegicus
ctgcagttcccgctggcgctgcagg

SEQ ID NO: 600563 - DNA, 25 bp, Rattus norvegicus
cccaggcgctgatcatcggggtcaa

SEQ ID NO: 600564 - DNA, 25 bp, Rattus norvegicus
acaggaactacgagaagggactgga

SEQ ID NO: 600565 - DNA, 25 bp, Rattus norvegicus
ctgctggaggctatccgagtccacc

SEQ ID NO: 600566 - DNA, 25 bp, Rattus norvegicus
ggcgcgcaagctgctcttcatgtgc

SEQ ID NO: 600567 - DNA, 25 bp, Rattus norvegicus
ttcttcgacaggaactacgagaagg

SEQ ID NO: 600568 - DNA, 25 bp, Rattus norvegicus
cgtagagccgcacttcttcgacagg

SEQ ID NO: 600569 - DNA, 25 bp, Rattus norvegicus
cagtgggcgtagagccgcacttctt

SEQ ID NO: 600570 - DNA, 25 bp, Rattus norvegicus
ctgatcatcggggtcaagaaaggag

SEQ ID NO: 600571 - DNA, 25 bp, Rattus norvegicus
ctccttctcacggatgcttctcagg

SEQ ID NO: 600572 - DNA, 25 bp, Rattus norvegicus
tcgcactcttccctaggtacgtgcg

SEQ ID NO: 600573 - DNA, 25 bp, Rattus norvegicus
gggcttaggacgctgctgcgagcgt

SEQ ID NO: 600574 - DNA, 25 bp, Rattus norvegicus
ttgggtcgcaggctcgccaatctga

SEQ ID NO: 600575 - DNA, 25 bp, Rattus norvegicus
cggtgtggcgggacctcgcactctt

SEQ ID NO: 600576 - DNA, 25 bp, Rattus norvegicus
atgctccgtgctggacttgcttggg

SEQ ID NO: 600577 - DNA, 25 bp, Rattus norvegicus
ttccctaggtacgtgcgcgcttcac

SEQ ID NO: 600578 - DNA, 25 bp, Rattus norvegicus
gccaatctgagcacgcgcctccttc

SEQ ID NO: 600579 - DNA, 25 bp, Rattus norvegicus
tctcacggatgcttctcaggctcta

SEQ ID NO: 600580 - DNA, 25 bp, Rattus norvegicus
acagagactgggtgccctctagcgg

SEQ ID NO: 600581 - DNA, 25 bp, Rattus norvegicus
gcgatgctccgtgctggacttgctt

SEQ ID NO: 600582 - DNA, 25 bp, Rattus norvegicus
tcacggatgcttctcaggctctagc

SEQ ID NO: 600583 - DNA, 25 bp, Rattus norvegicus
tcaggctctagcagtcacagagact

SEQ ID NO: 600584 - DNA, 25 bp, Rattus norvegicus
tcgcaggctcgccaatctgagcacg

SEQ ID NO: 600585 - DNA, 25 bp, Rattus norvegicus
cgtgaccctactgtcgccttctagg

SEQ ID NO: 600586 - DNA, 25 bp, Rattus norvegicus
tcgccagcgacgagagacacaagcc

SEQ ID NO: 600587 - DNA, 25 bp, Rattus norvegicus
gcccgtccaagtgccagagaggtta

SEQ ID NO: 600588 - DNA, 25 bp, Rattus norvegicus
gctgcgggagttgcttagattcaaa

SEQ ID NO: 600589 - DNA, 25 bp, Rattus norvegicus
cttagattcaaagcgctggccgtga

SEQ ID NO: 600590 - DNA, 25 bp, Rattus norvegicus
ctcaggcgagcaggaacggtttcgc

SEQ ID NO: 600591 - DNA, 25 bp, Rattus norvegicus
gaagccgcatgcgtagcagctgtcc

SEQ ID NO: 600592 - DNA, 25 bp, Rattus norvegicus
tgtccgctcggcacaaacggtagga

SEQ ID NO: 600593 - DNA, 25 bp, Rattus norvegicus
cttctaggctttggttagtggttca

SEQ ID NO: 600594 - DNA, 25 bp, Rattus norvegicus
catgcgtgaaattgccgtgacccta

SEQ ID NO: 600595 - DNA, 25 bp, Rattus norvegicus
ctgtgctaaggccagccgaagaatc

SEQ ID NO: 600596 - DNA, 25 bp, Rattus norvegicus
ccagccgagtcagaagtggtcgata

SEQ ID NO: 600597 - DNA, 25 bp, Rattus norvegicus
agcctgtgccttatgtcatcctcta

SEQ ID NO: 600598 - DNA, 25 bp, Rattus norvegicus
ccgtaagcagacagaggtcccggta

SEQ ID NO: 600599 - DNA, 25 bp, Rattus norvegicus
aatatctagtcagcgccaaagcccg

SEQ ID NO: 600600 - DNA, 25 bp, Rattus norvegicus
ctctctgaaggagagcccacggcgg

SEQ ID NO: 600601 - DNA, 25 bp, Rattus norvegicus
gtgccctttgcgagcctcaatatct

SEQ ID NO: 600602 - DNA, 25 bp, Rattus norvegicus
cccaaagctttcatacgtaccgcaa

SEQ ID NO: 600603 - DNA, 25 bp, Rattus norvegicus
atacgtaccgcaaacctgcgaggtc

SEQ ID NO: 600604 - DNA, 25 bp, Rattus norvegicus
aaacctgcgaggtcacgccggaagc

SEQ ID NO: 600605 - DNA, 25 bp, Rattus norvegicus
agatcgccaatatggagctcctatt

SEQ ID NO: 600606 - DNA, 25 bp, Rattus norvegicus
gtgaactgtgagcattctcccgctc

SEQ ID NO: 600607 - DNA, 25 bp, Rattus norvegicus
gctcaccacgagagtacttccgttt

SEQ ID NO: 600608 - DNA, 25 bp, Rattus norvegicus
cgctgttgccatggcgcctggacac

SEQ ID NO: 600609 - DNA, 25 bp, Rattus norvegicus
cctggacacctgtgggctgcgttcc

SEQ ID NO: 600610 - DNA, 25 bp, Rattus norvegicus
tgcgttccgagctacgcggtttccc

SEQ ID NO: 600611 - DNA, 25 bp, Rattus norvegicus
cccgcttctcgctctctgaaggaga

SEQ ID NO: 600612 - DNA, 25 bp, Rattus norvegicus
tcctattggtgaactgtgagcattc

SEQ ID NO: 600613 - DNA, 25 bp, Rattus norvegicus
cgcgtggagcctgaacacacaggta

SEQ ID NO: 600614 - DNA, 25 bp, Rattus norvegicus
cgtcgcatgtaaataaggggcacca

SEQ ID NO: 600615 - DNA, 25 bp, Rattus norvegicus
accggccagtgatggataaggaacc

SEQ ID NO: 600616 - DNA, 25 bp, Rattus norvegicus
actcaggcagcctcggcagtccggt

SEQ ID NO: 600617 - DNA, 25 bp, Rattus norvegicus
gcatgcaaataagccggcgatctcg

SEQ ID NO: 600618 - DNA, 25 bp, Rattus norvegicus
catgtaaatgacctgcacggggcgg

SEQ ID NO: 600619 - DNA, 25 bp, Rattus norvegicus
gaaaccgggcgaggtccttcgcgca

SEQ ID NO: 600620 - DNA, 25 bp, Rattus norvegicus
aacacacaggtaggaacgggcagtg

SEQ ID NO: 600621 - DNA, 25 bp, Rattus norvegicus
taaggaaccgatctgggctggaacc

SEQ ID NO: 600622 - DNA, 25 bp, Rattus norvegicus
gctggaaccagagcccgcggatcct

SEQ ID NO: 600623 - DNA, 25 bp, Rattus norvegicus
tgtaggtcgagcgagtgaacagctc

SEQ ID NO: 600624 - DNA, 25 bp, Rattus norvegicus
cgagtgaacagctcgcgtactgtga

SEQ ID NO: 600625 - DNA, 25 bp, Rattus norvegicus
tcgcgtactgtgaaactcaggcagc

SEQ ID NO: 600626 - DNA, 25 bp, Rattus norvegicus
gcgatctcgcaaggcccagaggacc

SEQ ID NO: 600627 - DNA, 25 bp, Rattus norvegicus
ccgggcccaagatagtgtccagctt

SEQ ID NO: 600628 - DNA, 25 bp, Rattus norvegicus
cgcggctcctcgtagaaactgatgc

SEQ ID NO: 600629 - DNA, 25 bp, Rattus norvegicus
tgagtttcttctccattggtccgga

SEQ ID NO: 600630 - DNA, 25 bp, Rattus norvegicus
gtgtctcggggtggaattcaaagcc

SEQ ID NO: 600631 - DNA, 25 bp, Rattus norvegicus
ggctgtccctcatccttcggaggtg

SEQ ID NO: 600632 - DNA, 25 bp, Rattus norvegicus
cctctagggatggacggttagtgtc

SEQ ID NO: 600633 - DNA, 25 bp, Rattus norvegicus
ctgcaaacagtgtcagggccgcttc

SEQ ID NO: 600634 - DNA, 25 bp, Rattus norvegicus
cgggctcaatgagatgagtttcttc

SEQ ID NO: 600635 - DNA, 25 bp, Rattus norvegicus
cgtacagcgacccaaggcctaggga

SEQ ID NO: 600636 - DNA, 25 bp, Rattus norvegicus
gacccaatgcgcctgcgtacagcga

SEQ ID NO: 600637 - DNA, 25 bp, Rattus norvegicus
ctcttcagttagcagcgcccggagc

SEQ ID NO: 600638 - DNA, 25 bp, Rattus norvegicus
aacaacgactcgagcgcgtccatgg

SEQ ID NO: 600639 - DNA, 25 bp, Rattus norvegicus
gtgcgtgactaaggcccgccacaga

SEQ ID NO: 600640 - DNA, 25 bp, Rattus norvegicus
aaactcctgcgtgtagggttccagc

SEQ ID NO: 600641 - DNA, 25 bp, Rattus norvegicus
tgcgcggggaaatgacttcaagccg

SEQ ID NO: 600642 - DNA, 25 bp, Rattus norvegicus
agtggagccgaccagcgcacccgaa

SEQ ID NO: 600643 - DNA, 25 bp, Rattus norvegicus
agttggcagcaatgcccgcgtcagc

SEQ ID NO: 600644 - DNA, 25 bp, Rattus norvegicus
gcagctctgcgcgaagttggcagca

SEQ ID NO: 600645 - DNA, 25 bp, Rattus norvegicus
caggttcaaggccacggccaggagc

SEQ ID NO: 600646 - DNA, 25 bp, Rattus norvegicus
aagagcaacgccagcaggttcaagg

SEQ ID NO: 600647 - DNA, 25 bp, Rattus norvegicus
gtgccctggcaccagtacgtggtga

SEQ ID NO: 600648 - DNA, 25 bp, Rattus norvegicus
ttgggcacccgttgcgtgccctggc

SEQ ID NO: 600649 - DNA, 25 bp, Rattus norvegicus
aacggcgcagctggaagcgctcgtc

SEQ ID NO: 600650 - DNA, 25 bp, Rattus norvegicus
tgccagtatggaaacggcgcagctg

SEQ ID NO: 600651 - DNA, 25 bp, Rattus norvegicus
cgcacgagtaccagatgccagtatg

SEQ ID NO: 600652 - DNA, 25 bp, Rattus norvegicus
agctcttcctcgcacgagtaccaga

SEQ ID NO: 600653 - DNA, 25 bp, Rattus norvegicus
acacgccctgggacctgcagctagg

SEQ ID NO: 600654 - DNA, 25 bp, Rattus norvegicus
ttcaagccgaagagggaccacacgc

SEQ ID NO: 600655 - DNA, 25 bp, Rattus norvegicus
gtacagcagcgctgcggagaaccta

SEQ ID NO: 600656 - DNA, 25 bp, Rattus norvegicus
cgctcagtcgcagctcgtgcacgaa

SEQ ID NO: 600657 - DNA, 25 bp, Rattus norvegicus
cagatggagcacagccgaccgagct

SEQ ID NO: 600658 - DNA, 25 bp, Rattus norvegicus
cgagctcagcggagcggagccaaac

SEQ ID NO: 600659 - DNA, 25 bp, Rattus norvegicus
accgctctgggctatgagtgcgcct

SEQ ID NO: 600660 - DNA, 25 bp, Rattus norvegicus
ctcaacctggatagagtacagcagc

SEQ ID NO: 600661 - DNA, 25 bp, Rattus norvegicus
agggtgttaagtcggcttgcacgca

SEQ ID NO: 600662 - DNA, 25 bp, Rattus norvegicus
acctacctgggccttctgcagggcg

SEQ ID NO: 600663 - DNA, 25 bp, Rattus norvegicus
ggctgccgttgagaagaccctccca

SEQ ID NO: 600664 - DNA, 25 bp, Rattus norvegicus
agatcctggaaatgggctgccgttg

SEQ ID NO: 600665 - DNA, 25 bp, Rattus norvegicus
acagtaggcctcctagctgagcgga

SEQ ID NO: 600666 - DNA, 25 bp, Rattus norvegicus
cgatactaggccacggagacacaca

SEQ ID NO: 600667 - DNA, 25 bp, Rattus norvegicus
ggtgacaatccaggttccgatacta

SEQ ID NO: 600668 - DNA, 25 bp, Rattus norvegicus
gcacgtccgctgctctaggtgacaa

SEQ ID NO: 600669 - DNA, 25 bp, Rattus norvegicus
ttcaggtcatggtcccggcaggctc

SEQ ID NO: 600670 - DNA, 25 bp, Rattus norvegicus
gagccgcacctgacggttcactggc

SEQ ID NO: 600671 - DNA, 25 bp, Rattus norvegicus
gtcccgctcgcacagttcaggtcat

SEQ ID NO: 600672 - DNA, 25 bp, Rattus norvegicus
caatccggaatcaagtgagggcaga

SEQ ID NO: 600673 - DNA, 25 bp, Rattus norvegicus
tccagccgacacctttaaaaggagc

SEQ ID NO: 600674 - DNA, 25 bp, Rattus norvegicus
cgaagcgattcatccagacctcggc

SEQ ID NO: 600675 - DNA, 25 bp, Rattus norvegicus
actcaaaagcagaaaattgggttca

SEQ ID NO: 600676 - DNA, 25 bp, Rattus norvegicus
aaattgggttcagaggcggctacac

SEQ ID NO: 600677 - DNA, 25 bp, Rattus norvegicus
cggccggctcagaagagaggcccac

SEQ ID NO: 600678 - DNA, 25 bp, Rattus norvegicus
tgccaacagcccaacgcgccggaag

SEQ ID NO: 600679 - DNA, 25 bp, Rattus norvegicus
aagtggcgagcaccaggcggctcct

SEQ ID NO: 600680 - DNA, 25 bp, Rattus norvegicus
ctgcggcgctggaaccggaccaatc

SEQ ID NO: 600681 - DNA, 25 bp, Rattus norvegicus
cggaccaatccggaatcaagtgagg

SEQ ID NO: 600682 - DNA, 25 bp, Rattus norvegicus
cccagctaagactgaaggggcagag

SEQ ID NO: 600683 - DNA, 25 bp, Rattus norvegicus
ggcgcagccctctactaagtgtatt

SEQ ID NO: 600684 - DNA, 25 bp, Rattus norvegicus
tgcggcccgcgataataagaagacg

SEQ ID NO: 600685 - DNA, 25 bp, Rattus norvegicus
ctgtgctggaatacctgactgctga

SEQ ID NO: 600686 - DNA, 25 bp, Rattus norvegicus
agctcgtgcaaaagcgaagtctcgc

SEQ ID NO: 600687 - DNA, 25 bp, Rattus norvegicus
gcttgctggcgcttacagattcgtt

SEQ ID NO: 600688 - DNA, 25 bp, Rattus norvegicus
gtctagcctccctcctgatcatata

SEQ ID NO: 600689 - DNA, 25 bp, Rattus norvegicus
ggcatccaataggaaggctcagtct

SEQ ID NO: 600690 - DNA, 25 bp, Rattus norvegicus
gggcgtcccttctgattggcttata

SEQ ID NO: 600691 - DNA, 25 bp, Rattus norvegicus
tggatccggcataatgtctagttgc

SEQ ID NO: 600692 - DNA, 25 bp, Rattus norvegicus
cgtcatctcggggtaaggcatatgc

SEQ ID NO: 600693 - DNA, 25 bp, Rattus norvegicus
tctagttgcactggagaaaccggcg

SEQ ID NO: 600694 - DNA, 25 bp, Rattus norvegicus
gtgtgcaccgccttctccgtaaggg

SEQ ID NO: 600695 - DNA, 25 bp, Rattus norvegicus
atatgcaaattaggagggctcgggc

SEQ ID NO: 600696 - DNA, 25 bp, Rattus norvegicus
acagattcgttttttgccagctttc

SEQ ID NO: 600697 - DNA, 25 bp, Rattus norvegicus
gacgtagcgacagctccaacccggg

SEQ ID NO: 600698 - DNA, 25 bp, Rattus norvegicus
ctttgtgtctcgcttggaggagccg

SEQ ID NO: 600699 - DNA, 25 bp, Rattus norvegicus
ctctttgtgtctcgcttggaggagc

SEQ ID NO: 600700 - DNA, 25 bp, Rattus norvegicus
gacgtctctttgtgtctcgcttgga

SEQ ID NO: 600701 - DNA, 25 bp, Rattus norvegicus
tgaaggacgtctctttgtgtctcgc

SEQ ID NO: 600702 - DNA, 25 bp, Rattus norvegicus
aggctgaaggacgtctctttgtgtc

SEQ ID NO: 600703 - DNA, 25 bp, Rattus norvegicus
agccgaggctgaaggacgtctcttt

SEQ ID NO: 600704 - DNA, 25 bp, Rattus norvegicus
gaaggaagtccagagtgcgcgctcc

SEQ ID NO: 600705 - DNA, 25 bp, Rattus norvegicus
agtggcagcgaggtccccagagccc

SEQ ID NO: 600706 - DNA, 25 bp, Rattus norvegicus
cccaggtaagtggaacctaggtgag

SEQ ID NO: 600707 - DNA, 25 bp, Rattus norvegicus
cccagcccaggtaagtggaacctag

SEQ ID NO: 600708 - DNA, 25 bp, Rattus norvegicus
tcgcgtccctgctcatggtggtggt

SEQ ID NO: 600709 - DNA, 25 bp, Rattus norvegicus
cctttcgcgtccctgctcatggtgg

SEQ ID NO: 600710 - DNA, 25 bp, Rattus norvegicus
tccgctgctcctgcacaccgggact

SEQ ID NO: 600711 - DNA, 25 bp, Rattus norvegicus
cgagtaagcggcactataccctaca

SEQ ID NO: 600712 - DNA, 25 bp, Rattus norvegicus
gcgagtaagcggcactataccctac

SEQ ID NO: 600713 - DNA, 25 bp, Rattus norvegicus
ctcaccgagagtggcagcggctcgc

SEQ ID NO: 600714 - DNA, 25 bp, Rattus norvegicus
tgctcaccgagagtggcagcggctc

SEQ ID NO: 600715 - DNA, 25 bp, Rattus norvegicus
acgctttacggagcctgctctacgc

SEQ ID NO: 600716 - DNA, 25 bp, Rattus norvegicus
gagtaagcggcactataccctacac

SEQ ID NO: 600717 - DNA, 25 bp, Rattus norvegicus
tgtgaagcgagtaagcggcactata

SEQ ID NO: 600718 - DNA, 25 bp, Rattus norvegicus
cgtgtgaagcgagtaagcggcacta

SEQ ID NO: 600719 - DNA, 25 bp, Rattus norvegicus
ccgtgtgaagcgagtaagcggcact

SEQ ID NO: 600720 - DNA, 25 bp, Rattus norvegicus
ttgaccgtgagtgccgccgcgtgaa

SEQ ID NO: 600721 - DNA, 25 bp, Rattus norvegicus
tgtttgaccgtgagtgccgccgcgt

SEQ ID NO: 600722 - DNA, 25 bp, Rattus norvegicus
tgctgtttgaccgtgagtgccgccg

SEQ ID NO: 600723 - DNA, 25 bp, Rattus norvegicus
tgaagcgagtaagcggcactatacc

SEQ ID NO: 600724 - DNA, 25 bp, Rattus norvegicus
gacgctttacggagcctgctctacg

SEQ ID NO: 600725 - DNA, 25 bp, Rattus norvegicus
tgagctcacatctgagctgcggcgg

SEQ ID NO: 600726 - DNA, 25 bp, Rattus norvegicus
gccttgaggctccagggccactcaa

SEQ ID NO: 600727 - DNA, 25 bp, Rattus norvegicus
cccgtactagggacaaggagcagcc

SEQ ID NO: 600728 - DNA, 25 bp, Rattus norvegicus
atcgagatctgcgtctgagccgctg

SEQ ID NO: 600729 - DNA, 25 bp, Rattus norvegicus
ttggccacagccatcgagatctgcg

SEQ ID NO: 600730 - DNA, 25 bp, Rattus norvegicus
gcaggtggtattggccacagccatc

SEQ ID NO: 600731 - DNA, 25 bp, Rattus norvegicus
tcgcttcctcaagcatgagctcaca

SEQ ID NO: 600732 - DNA, 25 bp, Rattus norvegicus
gccaaggaggtctttcgcttcctca

SEQ ID NO: 600733 - DNA, 25 bp, Rattus norvegicus
gccgatgccttcttcgaggaatttg

SEQ ID NO: 600734 - DNA, 25 bp, Rattus norvegicus
tcactggcaacttcccgtgggaggc

SEQ ID NO: 600735 - DNA, 25 bp, Rattus norvegicus
ctcatcttctgcgtgctcactggca

SEQ ID NO: 600736 - DNA, 25 bp, Rattus norvegicus
ggcattcggcgtgctcatcttctgc

SEQ ID NO: 600737 - DNA, 25 bp, Rattus norvegicus
aagctggctgacttcggcatgacgc

SEQ ID NO: 600738 - DNA, 25 bp, Rattus norvegicus
tccagggccactcaagcgcactgtg

SEQ ID NO: 600739 - DNA, 25 bp, Rattus norvegicus
ttccgacagaggagaggacacgtga

SEQ ID NO: 600740 - DNA, 25 bp, Rattus norvegicus
tcatctgggtcatctgcttggctga

SEQ ID NO: 600741 - DNA, 25 bp, Rattus norvegicus
aacggcgccgtgtcggatccggcca

SEQ ID NO: 600742 - DNA, 25 bp, Rattus norvegicus
atggtccctggggaatcgcaaccgc

SEQ ID NO: 600743 - DNA, 25 bp, Rattus norvegicus
aaaggacttcgaggagacttgccca

SEQ ID NO: 600744 - DNA, 25 bp, Rattus norvegicus
gagacttgcccaccgtcgcctagga

SEQ ID NO: 600745 - DNA, 25 bp, Rattus norvegicus
cgtcgcctaggagcgtgctccgatg

SEQ ID NO: 600746 - DNA, 25 bp, Rattus norvegicus
tgctccgatgcacagtgcaccactg

SEQ ID NO: 600747 - DNA, 25 bp, Rattus norvegicus
aggcgctggcccgtcatctgggtca

SEQ ID NO: 600748 - DNA, 25 bp, Rattus norvegicus
caccactgcgaaaagccctgggttt

SEQ ID NO: 600749 - DNA, 25 bp, Rattus norvegicus
cgtcattccctctggttccgacaga

SEQ ID NO: 600750 - DNA, 25 bp, Rattus norvegicus
ggagcaggaagaccacgacccagcc

SEQ ID NO: 600751 - DNA, 25 bp, Rattus norvegicus
cccgggaatgagtgcgccacactcg

SEQ ID NO: 600752 - DNA, 25 bp, Rattus norvegicus
tgggtttcgtcattccctctggttc

SEQ ID NO: 600753 - DNA, 25 bp, Rattus norvegicus
cacggtgtctggaatgagcctagtc

SEQ ID NO: 600754 - DNA, 25 bp, Rattus norvegicus
cccacattagcgtctgtacctttca

SEQ ID NO: 600755 - DNA, 25 bp, Rattus norvegicus
tcgtcgctgtcactgaccaagtcca

SEQ ID NO: 600756 - DNA, 25 bp, Rattus norvegicus
tcggaccaatgtacgcggggctcct

SEQ ID NO: 600757 - DNA, 25 bp, Rattus norvegicus
tgtacctttcattggacgaacagcc

SEQ ID NO: 600758 - DNA, 25 bp, Rattus norvegicus
aggggttccgccatctctcacacag

SEQ ID NO: 600759 - DNA, 25 bp, Rattus norvegicus
cacgtcttctcaggggttccgccat

SEQ ID NO: 600760 - DNA, 25 bp, Rattus norvegicus
gggacctcggaccacgtcttctcag

SEQ ID NO: 600761 - DNA, 25 bp, Rattus norvegicus
ctggaatgagcctagtcggagaccg

SEQ ID NO: 600762 - DNA, 25 bp, Rattus norvegicus
accaagtccacaagcacggtgtctg

SEQ ID NO: 600763 - DNA, 25 bp, Rattus norvegicus
agaacctcttcgtcgctgtcactga

SEQ ID NO: 600764 - DNA, 25 bp, Rattus norvegicus
tgggtccgcgaccacttccagaacc

SEQ ID NO: 600765 - DNA, 25 bp, Rattus norvegicus
gggcgacaggcacctctcctgggtc

SEQ ID NO: 600766 - DNA, 25 bp, Rattus norvegicus
tggacgaacagcctgccggtcatca

SEQ ID NO: 600767 - DNA, 25 bp, Rattus norvegicus
ggcagcacttcgctgtaacgcgagc

SEQ ID NO: 600768 - DNA, 25 bp, Rattus norvegicus
actcgaatgccttctgcctctcttg

SEQ ID NO: 600769 - DNA, 25 bp, Rattus norvegicus
gccagcagccctaggtgagaaccga

SEQ ID NO: 600770 - DNA, 25 bp, Rattus norvegicus
gaatccgccgtttgggctgagacga

SEQ ID NO: 600771 - DNA, 25 bp, Rattus norvegicus
tcaccagtgagtgcgggaatccgcc

SEQ ID NO: 600772 - DNA, 25 bp, Rattus norvegicus
acagccgagcggatccggaaacagc

SEQ ID NO: 600773 - DNA, 25 bp, Rattus norvegicus
cgtggtctttggattaggcaggtaa

SEQ ID NO: 600774 - DNA, 25 bp, Rattus norvegicus
agcgctccgagcttccagggagcta

SEQ ID NO: 600775 - DNA, 25 bp, Rattus norvegicus
agactacggaagaccgggagcgctc

SEQ ID NO: 600776 - DNA, 25 bp, Rattus norvegicus
ctcttgaggcaccagaagaagacta

SEQ ID NO: 600777 - DNA, 25 bp, Rattus norvegicus
ctgcaggactaaggccaggcgttcc

SEQ ID NO: 600778 - DNA, 25 bp, Rattus norvegicus
gactgcgccaggcttcagaacgcca

SEQ ID NO: 600779 - DNA, 25 bp, Rattus norvegicus
ggtttcgcacctctgccactgactg

SEQ ID NO: 600780 - DNA, 25 bp, Rattus norvegicus
ctcgagtggagcctgagaagactct

SEQ ID NO: 600781 - DNA, 25 bp, Rattus norvegicus
tggaggccaagaagacttacgtacg

SEQ ID NO: 600782 - DNA, 25 bp, Rattus norvegicus
tggcggcagcgactctattacgagc

SEQ ID NO: 600783 - DNA, 25 bp, Rattus norvegicus
cccatttctgcaaggtcggctgcgg

SEQ ID NO: 600784 - DNA, 25 bp, Rattus norvegicus
gggcgctccgcattttcctcctaaa

SEQ ID NO: 600785 - DNA, 25 bp, Rattus norvegicus
tccctgattccaagcgccttctttt

SEQ ID NO: 600786 - DNA, 25 bp, Rattus norvegicus
ccggtcgccgagtactaccacaatg

SEQ ID NO: 600787 - DNA, 25 bp, Rattus norvegicus
tgatctgctgttccaagtgcccgtc

SEQ ID NO: 600788 - DNA, 25 bp, Rattus norvegicus
cgaccctcatttccgccggaagtga

SEQ ID NO: 600789 - DNA, 25 bp, Rattus norvegicus
gctagaggctcccaaagtcgctgtc

SEQ ID NO: 600790 - DNA, 25 bp, Rattus norvegicus
tggccgtggccatagaaactttctg

SEQ ID NO: 600791 - DNA, 25 bp, Rattus norvegicus
ccatgcccggatataagtggccgtg

SEQ ID NO: 600792 - DNA, 25 bp, Rattus norvegicus
cgcgagacaccagaaacctcctttt

SEQ ID NO: 600793 - DNA, 25 bp, Rattus norvegicus
ccctcaggttgaactgtgaaaattc

SEQ ID NO: 600794 - DNA, 25 bp, Rattus norvegicus
atcgcccttcttgtgtcgcggccta

SEQ ID NO: 600795 - DNA, 25 bp, Rattus norvegicus
gccaagatgctttcggctccgcggc

SEQ ID NO: 600796 - DNA, 25 bp, Rattus norvegicus
tggcggctgaggcttcaacatgatg

SEQ ID NO: 600797 - DNA, 25 bp, Rattus norvegicus
ggagtcccgttctcacctgacgctg

SEQ ID NO: 600798 - DNA, 25 bp, Rattus norvegicus
ctttctctccgacctgttggcacga

SEQ ID NO: 600799 - DNA, 25 bp, Rattus norvegicus
gagaccgcccggagatctttctctc

SEQ ID NO: 600800 - DNA, 25 bp, Rattus norvegicus
actaggcccagagagccgagcactg

SEQ ID NO: 600801 - DNA, 25 bp, Rattus norvegicus
caacacccttttccgacggagctgg

SEQ ID NO: 600802 - DNA, 25 bp, Rattus norvegicus
agagagatcgccaagcaggggaccc

SEQ ID NO: 600803 - DNA, 25 bp, Rattus norvegicus
ctctattggctacagccggggaccc

SEQ ID NO: 600804 - DNA, 25 bp, Rattus norvegicus
ccattggtcaaactgtgggccgcgc

SEQ ID NO: 600805 - DNA, 25 bp, Rattus norvegicus
ggagggaacaatctgctcccaagtc

SEQ ID NO: 600806 - DNA, 25 bp, Rattus norvegicus
cttactggctacaccgggaagagga

SEQ ID NO: 600807 - DNA, 25 bp, Rattus norvegicus
gaccgcgagatcctccgtggtaatg

SEQ ID NO: 600808 - DNA, 25 bp, Rattus norvegicus
caacatgatggcagcgtccggaaga

SEQ ID NO: 600809 - DNA, 25 bp, Rattus norvegicus
atcggcccgaaagccgagcgagatc

SEQ ID NO: 600810 - DNA, 25 bp, Rattus norvegicus
ctcactgtccgagccggtggtgaaa

SEQ ID NO: 600811 - DNA, 25 bp, Rattus norvegicus
aaaaccgggacatggcgacggtgct

SEQ ID NO: 600812 - DNA, 25 bp, Rattus norvegicus
cgctcgtggcccgaagctaaggaaa

SEQ ID NO: 600813 - DNA, 25 bp, Rattus norvegicus
taaggaaaaccacagagtcaggggc

SEQ ID NO: 600814 - DNA, 25 bp, Rattus norvegicus
tcaggggctacgatctcccgaccag

SEQ ID NO: 600815 - DNA, 25 bp, Rattus norvegicus
ctccacggagcacgaggcccaagag

SEQ ID NO: 600816 - DNA, 25 bp, Rattus norvegicus
gagacacgaaccagctgagctcccg

SEQ ID NO: 600817 - DNA, 25 bp, Rattus norvegicus
tgagctcccgagtctcgagaacggg

SEQ ID NO: 600818 - DNA, 25 bp, Rattus norvegicus
gcagatccgcccgaaaaccgagcag

SEQ ID NO: 600819 - DNA, 25 bp, Rattus norvegicus
tccgcccgaaagcagagacgatgac

SEQ ID NO: 600820 - DNA, 25 bp, Rattus norvegicus
ggacagggacgactccgactcactg

SEQ ID NO: 600821 - DNA, 25 bp, Rattus norvegicus
acgatgacggcaggaaccgcgcgac

SEQ ID NO: 600822 - DNA, 25 bp, Rattus norvegicus
cgaaaggcgagatccgcccgaaagc

SEQ ID NO: 600823 - DNA, 25 bp, Rattus norvegicus
actacgtttcccagggtgcaatgca

SEQ ID NO: 600824 - DNA, 25 bp, Rattus norvegicus
tacctccacgcagcgcgggaacgaa

SEQ ID NO: 600825 - DNA, 25 bp, Rattus norvegicus
ggccatggcaaggtacctccacgca

SEQ ID NO: 600826 - DNA, 25 bp, Rattus norvegicus
agcgcgacgtgctgtttttccctgg

SEQ ID NO: 600827 - DNA, 25 bp, Rattus norvegicus
gccatcgcagttaccagcgcgacgt

SEQ ID NO: 600828 - DNA, 25 bp, Rattus norvegicus
acgttccagtgattcgctcttcccg

SEQ ID NO: 600829 - DNA, 25 bp, Rattus norvegicus
ctatcgtgtgaggaaacgttccagt

SEQ ID NO: 600830 - DNA, 25 bp, Rattus norvegicus
acgtaagtgcgggactatcgtgtga

SEQ ID NO: 600831 - DNA, 25 bp, Rattus norvegicus
tgccgcgaaccttcgaacgtaagtg

SEQ ID NO: 600832 - DNA, 25 bp, Rattus norvegicus
aacagcgtgtgtggttcttgacgtg

SEQ ID NO: 600833 - DNA, 25 bp, Rattus norvegicus
cgctcgaccgcgctcataagagaaa

SEQ ID NO: 600834 - DNA, 25 bp, Rattus norvegicus
cggcatgcgcagaggagtcctccgc

SEQ ID NO: 600835 - DNA, 25 bp, Rattus norvegicus
caatgcagcacgtcacagagaagta

SEQ ID NO: 600836 - DNA, 25 bp, Rattus norvegicus
tctctgaggcggcttctgcggaaac

SEQ ID NO: 600837 - DNA, 25 bp, Rattus norvegicus
gtgaccttctataatcaaggggacg

SEQ ID NO: 600838 - DNA, 25 bp, Rattus norvegicus
gctggatatataagtccaaactcgg

SEQ ID NO: 600839 - DNA, 25 bp, Rattus norvegicus
gatcagactgtgaccttctataatc

SEQ ID NO: 600840 - DNA, 25 bp, Rattus norvegicus
atcagactgtgaccttctataatca

SEQ ID NO: 600841 - DNA, 25 bp, Rattus norvegicus
cagactgtgaccttctataatcaag

SEQ ID NO: 600842 - DNA, 25 bp, Rattus norvegicus
gactgtgaccttctataatcaaggg

SEQ ID NO: 600843 - DNA, 25 bp, Rattus norvegicus
ctgtgaccttctataatcaagggga

SEQ ID NO: 600844 - DNA, 25 bp, Rattus norvegicus
gaccttctataatcaaggggacgga

SEQ ID NO: 600845 - DNA, 25 bp, Rattus norvegicus
ttctataatcaaggggacggagaac

SEQ ID NO: 600846 - DNA, 25 bp, Rattus norvegicus
tataatcaaggggacggagaacttc

SEQ ID NO: 600847 - DNA, 25 bp, Rattus norvegicus
cctgcccgggcggtggattcaagac

SEQ ID NO: 600848 - DNA, 25 bp, Rattus norvegicus
gcccgggcggtggattcaagaccca

SEQ ID NO: 600849 - DNA, 25 bp, Rattus norvegicus
ccttctataatcaaggggacggaga

SEQ ID NO: 600850 - DNA, 25 bp, Rattus norvegicus
tggctggatatataagtccaaactc

SEQ ID NO: 600851 - DNA, 25 bp, Rattus norvegicus
acagctcgggaaccaccgcggtgac

SEQ ID NO: 600852 - DNA, 25 bp, Rattus norvegicus
tgaaagctctggctgatcccattgg

SEQ ID NO: 600853 - DNA, 25 bp, Rattus norvegicus
tgatcccattggctgcgtgagatgc

SEQ ID NO: 600854 - DNA, 25 bp, Rattus norvegicus
ctcaagggcgttttccgattggtcg

SEQ ID NO: 600855 - DNA, 25 bp, Rattus norvegicus
acctgggcttgctcaagggcgtttt

SEQ ID NO: 600856 - DNA, 25 bp, Rattus norvegicus
cctctcgagcttcggaacctgggct

SEQ ID NO: 600857 - DNA, 25 bp, Rattus norvegicus
acgtgctttgccctctcgagcttcg

SEQ ID NO: 600858 - DNA, 25 bp, Rattus norvegicus
ccttgggagaagcaacgtgctttgc

SEQ ID NO: 600859 - DNA, 25 bp, Rattus norvegicus
gcgcctcggccttgggagaagcaac

SEQ ID NO: 600860 - DNA, 25 bp, Rattus norvegicus
ctgcaatttggccttccggaggttt

SEQ ID NO: 600861 - DNA, 25 bp, Rattus norvegicus
aaccaccgcggtgacggctgcaatt

SEQ ID NO: 600862 - DNA, 25 bp, Rattus norvegicus
gtgcagcgcacagctcgggaaccac

SEQ ID NO: 600863 - DNA, 25 bp, Rattus norvegicus
tccgattggtcggtgtgaaagctct

SEQ ID NO: 600864 - DNA, 25 bp, Rattus norvegicus
cggtgacggctgcaatttggccttc

SEQ ID NO: 600865 - DNA, 25 bp, Rattus norvegicus
attcctggaaaaccggcagagcgac

SEQ ID NO: 600866 - DNA, 25 bp, Rattus norvegicus
tggcttcttcttaccagggtcctcg

SEQ ID NO: 600867 - DNA, 25 bp, Rattus norvegicus
caccttttttgcgacccgcgttgtg

SEQ ID NO: 600868 - DNA, 25 bp, Rattus norvegicus
acccgacgagcaggattgacagtga

SEQ ID NO: 600869 - DNA, 25 bp, Rattus norvegicus
tgccgagggttctgacagtagagca

SEQ ID NO: 600870 - DNA, 25 bp, Rattus norvegicus
tgctgcatgtcccatccggactttc

SEQ ID NO: 600871 - DNA, 25 bp, Rattus norvegicus
cacggaacgatggtcctgcaaattc

SEQ ID NO: 600872 - DNA, 25 bp, Rattus norvegicus
ggagccttccggttagataccaatg

SEQ ID NO: 600873 - DNA, 25 bp, Rattus norvegicus
gctaactgctgggagggaacttccc

SEQ ID NO: 600874 - DNA, 25 bp, Rattus norvegicus
acttcccgagtgctggtaattcagg

SEQ ID NO: 600875 - DNA, 25 bp, Rattus norvegicus
tggtcatggaactcagcgccgacta

SEQ ID NO: 600876 - DNA, 25 bp, Rattus norvegicus
ctctgaaccgttgcgcgaccagctt

SEQ ID NO: 600877 - DNA, 25 bp, Rattus norvegicus
agttcgagggaaagccactgctcca

SEQ ID NO: 600878 - DNA, 25 bp, Rattus norvegicus
gtagccaggactgcaaaaacgttgc

SEQ ID NO: 600879 - DNA, 25 bp, Rattus norvegicus
gaggtcctttccctggcacccgaga

SEQ ID NO: 600880 - DNA, 25 bp, Rattus norvegicus
cccgaacagatgctgacgcgaatca

SEQ ID NO: 600881 - DNA, 25 bp, Rattus norvegicus
acccgctcccatgctgtcagctcca

SEQ ID NO: 600882 - DNA, 25 bp, Rattus norvegicus
ggcaaagctgggacccgctcccatg

SEQ ID NO: 600883 - DNA, 25 bp, Rattus norvegicus
tgcgccggcctcctctgggtggcag

SEQ ID NO: 600884 - DNA, 25 bp, Rattus norvegicus
gcagcgcccctttgggcggagctca

SEQ ID NO: 600885 - DNA, 25 bp, Rattus norvegicus
cggagctcatggaggcccggccctt

SEQ ID NO: 600886 - DNA, 25 bp, Rattus norvegicus
cgaacagatgctgacgcgaatcaac

SEQ ID NO: 600887 - DNA, 25 bp, Rattus norvegicus
tgacgcgaatcaactcttcttttaa

SEQ ID NO: 600888 - DNA, 25 bp, Rattus norvegicus
gcgaatcaactcttcttttaatgtc

SEQ ID NO: 600889 - DNA, 25 bp, Rattus norvegicus
actcttcttttaatgtcaaaacgca

SEQ ID NO: 600890 - DNA, 25 bp, Rattus norvegicus
ttaatgtcaaaacgcaaaaaatatc

SEQ ID NO: 600891 - DNA, 25 bp, Rattus norvegicus
cgcaaaaaatatccgttccttcatc

SEQ ID NO: 600892 - DNA, 25 bp, Rattus norvegicus
gcccgcagcctcctcgaggtccttt

SEQ ID NO: 600893 - DNA, 25 bp, Rattus norvegicus
gaacgcagacgcatggcgcccttac

SEQ ID NO: 600894 - DNA, 25 bp, Rattus norvegicus
ctgtcctcaaatcacacggcccatg

SEQ ID NO: 600895 - DNA, 25 bp, Rattus norvegicus
tttcctctgtcctcaaatcacacgg

SEQ ID NO: 600896 - DNA, 25 bp, Rattus norvegicus
tgcacttttcctctgtcctcaaatc

SEQ ID NO: 600897 - DNA, 25 bp, Rattus norvegicus
agaacctgcacttttcctctgtcct

SEQ ID NO: 600898 - DNA, 25 bp, Rattus norvegicus
aggaaacacagaacctgcacttttc

SEQ ID NO: 600899 - DNA, 25 bp, Rattus norvegicus
cgaaacgcaggaaacacagaacctg

SEQ ID NO: 600900 - DNA, 25 bp, Rattus norvegicus
gcttcacctgcgcacgaaacgcagg

SEQ ID NO: 600901 - DNA, 25 bp, Rattus norvegicus
agaacgcagacgcatggcgccctta

SEQ ID NO: 600902 - DNA, 25 bp, Rattus norvegicus
aaagtccacagaacgcagacgcatg

SEQ ID NO: 600903 - DNA, 25 bp, Rattus norvegicus
tcggcttcttgaatcggcagggatc

SEQ ID NO: 600904 - DNA, 25 bp, Rattus norvegicus
gctccgtcggcttcttgaatcggca

SEQ ID NO: 600905 - DNA, 25 bp, Rattus norvegicus
cagctccgtcggcttcttgaatcgg

SEQ ID NO: 600906 - DNA, 25 bp, Rattus norvegicus
gcgcacgaaacgcaggaaacacaga

SEQ ID NO: 600907 - DNA, 25 bp, Rattus norvegicus
attcgacgtgggcccacgctacacg

SEQ ID NO: 600908 - DNA, 25 bp, Rattus norvegicus
acgcagctgcagtacatcggcgagg

SEQ ID NO: 600909 - DNA, 25 bp, Rattus norvegicus
acacgcagctgcagtacatcggcga

SEQ ID NO: 600910 - DNA, 25 bp, Rattus norvegicus
tacacgcagctgcagtacatcggcg

SEQ ID NO: 600911 - DNA, 25 bp, Rattus norvegicus
ctacacgcagctgcagtacatcggc

SEQ ID NO: 600912 - DNA, 25 bp, Rattus norvegicus
acgctacacgcagctgcagtacatc

SEQ ID NO: 600913 - DNA, 25 bp, Rattus norvegicus
agccattcgacgtgggcccacgcta

SEQ ID NO: 600914 - DNA, 25 bp, Rattus norvegicus
tgcgtgcccgggacatggggtccgg

SEQ ID NO: 600915 - DNA, 25 bp, Rattus norvegicus
tggtgaaggggcagccattcgacgt

SEQ ID NO: 600916 - DNA, 25 bp, Rattus norvegicus
gacagcaggtgcgtgcccgggacat

SEQ ID NO: 600917 - DNA, 25 bp, Rattus norvegicus
cttcagagcggggacagcaggtgcg

SEQ ID NO: 600918 - DNA, 25 bp, Rattus norvegicus
cgcgtacggcatggtcaggtgaggg

SEQ ID NO: 600919 - DNA, 25 bp, Rattus norvegicus
cagtacatcggcgagggcgcgtacg

SEQ ID NO: 600920 - DNA, 25 bp, Rattus norvegicus
gctacacgcagctgcagtacatcgg

SEQ ID NO: 600921 - DNA, 25 bp, Rattus norvegicus
cggcagcagctggtctcggtgtaaa

SEQ ID NO: 600922 - DNA, 25 bp, Rattus norvegicus
tgcagccgcatttccgggcgagctg

SEQ ID NO: 600923 - DNA, 25 bp, Rattus norvegicus
tcagcctgcgctggccgccgtatga

SEQ ID NO: 600924 - DNA, 25 bp, Rattus norvegicus
ggcctggaccgacgtctctgcgcgt

SEQ ID NO: 600925 - DNA, 25 bp, Rattus norvegicus
aggtgaggcctggaccgacgtctct

SEQ ID NO: 600926 - DNA, 25 bp, Rattus norvegicus
cctccacgcgcccaggcgaggtgag

SEQ ID NO: 600927 - DNA, 25 bp, Rattus norvegicus
taaacaagtcgaggcggctgcgaac

SEQ ID NO: 600928 - DNA, 25 bp, Rattus norvegicus
gctggtctcggtgtaaacaagtcga

SEQ ID NO: 600929 - DNA, 25 bp, Rattus norvegicus
ggtactccgattggccacgacggcc

SEQ ID NO: 600930 - DNA, 25 bp, Rattus norvegicus
atgcggtactccgattggccacgac

SEQ ID NO: 600931 - DNA, 25 bp, Rattus norvegicus
tttgcatgcggtactccgattggcc

SEQ ID NO: 600932 - DNA, 25 bp, Rattus norvegicus
ccctcatttgcatgcggtactccga

SEQ ID NO: 600933 - DNA, 25 bp, Rattus norvegicus
tcggtgtaaacaagtcgaggcggct

SEQ ID NO: 600934 - DNA, 25 bp, Rattus norvegicus
agttgcagccgcatttccgggcgag

SEQ ID NO: 600935 - DNA, 25 bp, Rattus norvegicus
tctcctgggaaaagcgaaggcgagc

SEQ ID NO: 600936 - DNA, 25 bp, Rattus norvegicus
ttctcagctgagttcgcccagacga

SEQ ID NO: 600937 - DNA, 25 bp, Rattus norvegicus
ctggccttagcgcacagggccttga

SEQ ID NO: 600938 - DNA, 25 bp, Rattus norvegicus
agggccttgacttcgctctctttga

SEQ ID NO: 600939 - DNA, 25 bp, Rattus norvegicus
tccaggtcgctgatttccgccatgg

SEQ ID NO: 600940 - DNA, 25 bp, Rattus norvegicus
gagcccgccaatcagagggtccgtg

SEQ ID NO: 600941 - DNA, 25 bp, Rattus norvegicus
ctagaggggcctcggacaattaccg

SEQ ID NO: 600942 - DNA, 25 bp, Rattus norvegicus
ttaccgccgctgagactccagctga

SEQ ID NO: 600943 - DNA, 25 bp, Rattus norvegicus
ttccggcctcgctgcggaagcaaag

SEQ ID NO: 600944 - DNA, 25 bp, Rattus norvegicus
aagggaaacctgttctcgcgcgcgc

SEQ ID NO: 600945 - DNA, 25 bp, Rattus norvegicus
cgcgccggaagtgacatatacaagt

SEQ ID NO: 600946 - DNA, 25 bp, Rattus norvegicus
cacgcctctttcgaggcatcgggaa

SEQ ID NO: 600947 - DNA, 25 bp, Rattus norvegicus
gaacgcttccgggatatgacaaacc

SEQ ID NO: 600948 - DNA, 25 bp, Rattus norvegicus
ctctttgataagttcgcagcgccgc

SEQ ID NO: 600949 - DNA, 25 bp, Rattus norvegicus
gccgtccaattgcaagcgggcattg

SEQ ID NO: 600950 - DNA, 25 bp, Rattus norvegicus
tggcaaggtacgcaggcaaatcctc

SEQ ID NO: 600951 - DNA, 25 bp, Rattus norvegicus
agggcgcgttcgatcccttcctatc

SEQ ID NO: 600952 - DNA, 25 bp, Rattus norvegicus
aacgcagaagttccgagcttgcctg

SEQ ID NO: 600953 - DNA, 25 bp, Rattus norvegicus
gcagttgcagcctgacgtcactaca

SEQ ID NO: 600954 - DNA, 25 bp, Rattus norvegicus
atgatggctggcctcttctcctaga

SEQ ID NO: 600955 - DNA, 25 bp, Rattus norvegicus
gctaggacgtgactcgagccacatc

SEQ ID NO: 600956 - DNA, 25 bp, Rattus norvegicus
tttttcccttgcagggacgcgagcc

SEQ ID NO: 600957 - DNA, 25 bp, Rattus norvegicus
gttccaagagaacgcagcctattca

SEQ ID NO: 600958 - DNA, 25 bp, Rattus norvegicus
agaacctcgttctgcggcgcgttcc

SEQ ID NO: 600959 - DNA, 25 bp, Rattus norvegicus
ccgatcacgtgtgaaagggcgctca

SEQ ID NO: 600960 - DNA, 25 bp, Rattus norvegicus
cccggactagtgtgcggaccacatc

SEQ ID NO: 600961 - DNA, 25 bp, Rattus norvegicus
tagcctggccttgcctagcagattg

SEQ ID NO: 600962 - DNA, 25 bp, Rattus norvegicus
cgagcatcgtgactcagccggaatg

SEQ ID NO: 600963 - DNA, 25 bp, Rattus norvegicus
ggtccgaaccgccaaggcgccagca

SEQ ID NO: 600964 - DNA, 25 bp, Rattus norvegicus
gcgccgcctagggtccgaaccgcca

SEQ ID NO: 600965 - DNA, 25 bp, Rattus norvegicus
gcttcttgccgttgccttggcgacc

SEQ ID NO: 600966 - DNA, 25 bp, Rattus norvegicus
ttgccgttgccttggcgaccgcagc

SEQ ID NO: 600967 - DNA, 25 bp, Rattus norvegicus
cgaccgcagcgtcgcgactacggcg

SEQ ID NO: 600968 - DNA, 25 bp, Rattus norvegicus
ctgcttcttgccgttgccttggcga

SEQ ID NO: 600969 - DNA, 25 bp, Rattus norvegicus
gcctagaaggttggcgctgcttctt

SEQ ID NO: 600970 - DNA, 25 bp, Rattus norvegicus
cgccagcaccgcctagaaggttggc

SEQ ID NO: 600971 - DNA, 25 bp, Rattus norvegicus
cagtttacagattccgcgccgccta

SEQ ID NO: 600972 - DNA, 25 bp, Rattus norvegicus
gcggcgggcagtttacagattccgc

SEQ ID NO: 600973 - DNA, 25 bp, Rattus norvegicus
agcacctacaaacaccgggcggcgg

SEQ ID NO: 600974 - DNA, 25 bp, Rattus norvegicus
ccaggttcctgctccctcgggccac

SEQ ID NO: 600975 - DNA, 25 bp, Rattus norvegicus
ccgcctagaaggttggcgctgcttc

SEQ ID NO: 600976 - DNA, 25 bp, Rattus norvegicus
agtttacagattccgcgccgcctag

SEQ ID NO: 600977 - DNA, 25 bp, Rattus norvegicus
cacgccaagttctcgggtgagtgtg

SEQ ID NO: 600978 - DNA, 25 bp, Rattus norvegicus
tggagtgtgcactcgcgtgcgttct

SEQ ID NO: 600979 - DNA, 25 bp, Rattus norvegicus
cctctcgcggaggtgcacgccaagt

SEQ ID NO: 600980 - DNA, 25 bp, Rattus norvegicus
gctatggcaaccaggcccggtggtc

SEQ ID NO: 600981 - DNA, 25 bp, Rattus norvegicus
cactcgcgtgcgttctggggcccgt

SEQ ID NO: 600982 - DNA, 25 bp, Rattus norvegicus
gccgcttctcgctcggtcctcgccc

SEQ ID NO: 600983 - DNA, 25 bp, Rattus norvegicus
cacacgtgtggagtgtgcactcgcg

SEQ ID NO: 600984 - DNA, 25 bp, Rattus norvegicus
cgagcacacgtgtggagtgtgcact

SEQ ID NO: 600985 - DNA, 25 bp, Rattus norvegicus
cgcgtgtcagctggcccaaggcgca

SEQ ID NO: 600986 - DNA, 25 bp, Rattus norvegicus
tgtgcacgcgtgtcagctggcccaa

SEQ ID NO: 600987 - DNA, 25 bp, Rattus norvegicus
ccaagttctcgggtgagtgtgcacg

SEQ ID NO: 600988 - DNA, 25 bp, Rattus norvegicus
aggtgcacgccaagttctcgggtga

SEQ ID NO: 600989 - DNA, 25 bp, Rattus norvegicus
agctggggaacaccgggcgcctctc

SEQ ID NO: 600990 - DNA, 25 bp, Rattus norvegicus
tctggggcccgtgcctggccctctt

SEQ ID NO: 600991 - DNA, 25 bp, Rattus norvegicus
tcagtgttggcgagaataccttttc

SEQ ID NO: 600992 - DNA, 25 bp, Rattus norvegicus
gggcagcgtgaaaaactacgttata

SEQ ID NO: 600993 - DNA, 25 bp, Rattus norvegicus
ctacgttatacgagacggccagtgc

SEQ ID NO: 600994 - DNA, 25 bp, Rattus norvegicus
cggccagtgccgaaccggcttctaa

SEQ ID NO: 600995 - DNA, 25 bp, Rattus norvegicus
gagcagaaatctccctcaagagcta

SEQ ID NO: 600996 - DNA, 25 bp, Rattus norvegicus
tctggctaagttttccgtcccagta

SEQ ID NO: 600997 - DNA, 25 bp, Rattus norvegicus
acatcggaggctcaacggtcccttt

SEQ ID NO: 600998 - DNA, 25 bp, Rattus norvegicus
tgcgcgtgcgcaaactactgtcaaa

SEQ ID NO: 600999 - DNA, 25 bp, Rattus norvegicus
ggaattcactcgcagcttctttcga

SEQ ID NO: 601000 - DNA, 25 bp, Rattus norvegicus
aaggaacgcagcttccagtggcttc

SEQ ID NO: 601001 - DNA, 25 bp, Rattus norvegicus
agtagagtcccgctacccaagtccg

SEQ ID NO: 601002 - DNA, 25 bp, Rattus norvegicus
gtccgttcatgacccgcctgggaga

SEQ ID NO: 601003 - DNA, 25 bp, Rattus norvegicus
ctgtcaaacgaactgaaagtggccc

SEQ ID NO: 601004 - DNA, 25 bp, Rattus norvegicus
ttccggactttgcaacgccgtacga

SEQ ID NO: 601005 - DNA, 25 bp, Rattus norvegicus
cgcggcctcacctttgtagagctga

SEQ ID NO: 601006 - DNA, 25 bp, Rattus norvegicus
cccgaagactgaggaacgtcgtcta

SEQ ID NO: 601007 - DNA, 25 bp, Rattus norvegicus
aaagcgccgcctactgggccagcgg

SEQ ID NO: 601008 - DNA, 25 bp, Rattus norvegicus
tgcagcgttctgattggtttacccg

SEQ ID NO: 601009 - DNA, 25 bp, Rattus norvegicus
acccgcctgtcgaactgatgtcatc

SEQ ID NO: 601010 - DNA, 25 bp, Rattus norvegicus
gggaaggagtaaatgtcaggcaaca

SEQ ID NO: 601011 - DNA, 25 bp, Rattus norvegicus
tcaggcaacaagaagactgtagagc

SEQ ID NO: 601012 - DNA, 25 bp, Rattus norvegicus
ttgacagtgtttgcgtgcggccaac

SEQ ID NO: 601013 - DNA, 25 bp, Rattus norvegicus
tgcggccaaccatagcagaaaaaga

SEQ ID NO: 601014 - DNA, 25 bp, Rattus norvegicus
aatatatgcacaccggagccaaggg

SEQ ID NO: 601015 - DNA, 25 bp, Rattus norvegicus
ccacatgctgactggaaagcgccgc

SEQ ID NO: 601016 - DNA, 25 bp, Rattus norvegicus
acctttgtagagctgagccactgcc

SEQ ID NO: 601017 - DNA, 25 bp, Rattus norvegicus
acagcttctgctgcttgtgttcggg

SEQ ID NO: 601018 - DNA, 25 bp, Rattus norvegicus
ttggagaaccagtgctccggcccgt

SEQ ID NO: 601019 - DNA, 25 bp, Rattus norvegicus
taggccaccccgtcgacacccagtg

SEQ ID NO: 601020 - DNA, 25 bp, Rattus norvegicus
gaccagaagtcaccgaggggccagc

SEQ ID NO: 601021 - DNA, 25 bp, Rattus norvegicus
cctccttatcaacatgacactgaca

SEQ ID NO: 601022 - DNA, 25 bp, Rattus norvegicus
ctccttatcaacatgacactgacaa

SEQ ID NO: 601023 - DNA, 25 bp, Rattus norvegicus
tatcaacatgacactgacaaaccgg

SEQ ID NO: 601024 - DNA, 25 bp, Rattus norvegicus
caacatgacactgacaaaccggaag

SEQ ID NO: 601025 - DNA, 25 bp, Rattus norvegicus
acatgacactgacaaaccggaaggc

SEQ ID NO: 601026 - DNA, 25 bp, Rattus norvegicus
catgacactgacaaaccggaaggcc

SEQ ID NO: 601027 - DNA, 25 bp, Rattus norvegicus
atgacactgacaaaccggaaggccc

SEQ ID NO: 601028 - DNA, 25 bp, Rattus norvegicus
cgccgcagggaccagaagtcaccga

SEQ ID NO: 601029 - DNA, 25 bp, Rattus norvegicus
ccgcagggaccagaagtcaccgagg

SEQ ID NO: 601030 - DNA, 25 bp, Rattus norvegicus
cagaagtcaccgaggggccagccca

SEQ ID NO: 601031 - DNA, 25 bp, Rattus norvegicus
agaagtcaccgaggggccagcccag

SEQ ID NO: 601032 - DNA, 25 bp, Rattus norvegicus
gccgcagggaccagaagtcaccgag

SEQ ID NO: 601033 - DNA, 25 bp, Rattus norvegicus
ctttcgcgctgcgactgagcctgtt

SEQ ID NO: 601034 - DNA, 25 bp, Rattus norvegicus
ggcccagacgacaagctgccctgga

SEQ ID NO: 601035 - DNA, 25 bp, Rattus norvegicus
tgcgctaggaaggaaagctgtggtc

SEQ ID NO: 601036 - DNA, 25 bp, Rattus norvegicus
cgctgcgactgagcctgttgctagg

SEQ ID NO: 601037 - DNA, 25 bp, Rattus norvegicus
ccaagcgcgctatccgaggactgct

SEQ ID NO: 601038 - DNA, 25 bp, Rattus norvegicus
cgctatccgaggactgctggagaga

SEQ ID NO: 601039 - DNA, 25 bp, Rattus norvegicus
ggtggagcccaagcgcgctatccga

SEQ ID NO: 601040 - DNA, 25 bp, Rattus norvegicus
ccacgcggatcctgggtgggaagag

SEQ ID NO: 601041 - DNA, 25 bp, Rattus norvegicus
tcgcctgtagctgccgcggcccaga

SEQ ID NO: 601042 - DNA, 25 bp, Rattus norvegicus
tatccgaggactgctggagagagct

SEQ ID NO: 601043 - DNA, 25 bp, Rattus norvegicus
actgctggagagagctgtagcgcat

SEQ ID NO: 601044 - DNA, 25 bp, Rattus norvegicus
catgcgcccgccacgctttcgcgct

SEQ ID NO: 601045 - DNA, 25 bp, Rattus norvegicus
ggcgcggtatgcacgccgggccaaa

SEQ ID NO: 601046 - DNA, 25 bp, Rattus norvegicus
aggagaaaggcttggcttgcttggg

SEQ ID NO: 601047 - DNA, 25 bp, Rattus norvegicus
tcacggggcaggacaccatgctcaa

SEQ ID NO: 601048 - DNA, 25 bp, Rattus norvegicus
ccgcgtggaagtgctcacagatgcg

SEQ ID NO: 601049 - DNA, 25 bp, Rattus norvegicus
gcatgctggactgcaacggcgccac

SEQ ID NO: 601050 - DNA, 25 bp, Rattus norvegicus
aagtgctcacagatgcgggaggtat

SEQ ID NO: 601051 - DNA, 25 bp, Rattus norvegicus
ggacaccatgctcaaggccatgttc

SEQ ID NO: 601052 - DNA, 25 bp, Rattus norvegicus
gtgggcggctcgctgcactacacca

SEQ ID NO: 601053 - DNA, 25 bp, Rattus norvegicus
caagtatgtgaagctgaacgtgggc

SEQ ID NO: 601054 - DNA, 25 bp, Rattus norvegicus
cccgaacagcaagtatgtgaagctg

SEQ ID NO: 601055 - DNA, 25 bp, Rattus norvegicus
tggctccccctcgtacagtctgaag

SEQ ID NO: 601056 - DNA, 25 bp, Rattus norvegicus
gctgcggccgaatgcctggagtccc

SEQ ID NO: 601057 - DNA, 25 bp, Rattus norvegicus
ctcactggcatgtcggccgaggcct

SEQ ID NO: 601058 - DNA, 25 bp, Rattus norvegicus
gagagcttcgactgtcacccgcgtc

SEQ ID NO: 601059 - DNA, 25 bp, Rattus norvegicus
gcggagagagcttcgactgtcaccc

SEQ ID NO: 601060 - DNA, 25 bp, Rattus norvegicus
caaggccatgttcagcggccgcgtg

SEQ ID NO: 601061 - DNA, 25 bp, Rattus norvegicus
tcaagcccttcaaggcccgcccgcg

SEQ ID NO: 601062 - DNA, 25 bp, Rattus norvegicus
ccctggagaggtcggcctgtgacac

SEQ ID NO: 601063 - DNA, 25 bp, Rattus norvegicus
ggtacaggggcacagtgccaacctc

SEQ ID NO: 601064 - DNA, 25 bp, Rattus norvegicus
tgaggccggtgctcttgaactgcaa

SEQ ID NO: 601065 - DNA, 25 bp, Rattus norvegicus
ggccggtgctcttgaactgcaaatc

SEQ ID NO: 601066 - DNA, 25 bp, Rattus norvegicus
ctcttgaactgcaaatccggccgtg

SEQ ID NO: 601067 - DNA, 25 bp, Rattus norvegicus
ttgaactgcaaatccggccgtgggc

SEQ ID NO: 601068 - DNA, 25 bp, Rattus norvegicus
ccctagcttggttaagccagatcca

SEQ ID NO: 601069 - DNA, 25 bp, Rattus norvegicus
ttggttaagccagatccagcactga

SEQ ID NO: 601070 - DNA, 25 bp, Rattus norvegicus
tccagcactgaaccagacgcgagtt

SEQ ID NO: 601071 - DNA, 25 bp, Rattus norvegicus
cactgaaccagacgcgagttggcga

SEQ ID NO: 601072 - DNA, 25 bp, Rattus norvegicus
acgcgagttggcgaaaacggcttca

SEQ ID NO: 601073 - DNA, 25 bp, Rattus norvegicus
cttcagccaatcaagcccttcaagg

SEQ ID NO: 601074 - DNA, 25 bp, Rattus norvegicus
tggcgaaaacggcttcagccaatca

SEQ ID NO: 601075 - DNA, 25 bp, Rattus norvegicus
ccctgcgggctctaacagctgggat

SEQ ID NO: 601076 - DNA, 25 bp, Rattus norvegicus
tgcagattccctctcaggtctcttc

SEQ ID NO: 601077 - DNA, 25 bp, Rattus norvegicus
gtggaacctgggctcgaatcctccc

SEQ ID NO: 601078 - DNA, 25 bp, Rattus norvegicus
taagttgcccaatctctcggggagg

SEQ ID NO: 601079 - DNA, 25 bp, Rattus norvegicus
ctcggaacggaggaatcgctacacc

SEQ ID NO: 601080 - DNA, 25 bp, Rattus norvegicus
ttgcctccaggagtttacgccgtcc

SEQ ID NO: 601081 - DNA, 25 bp, Rattus norvegicus
tacgccgtccatgaaatgcaaaatg

SEQ ID NO: 601082 - DNA, 25 bp, Rattus norvegicus
tcttcttttgcggatggctctcgag

SEQ ID NO: 601083 - DNA, 25 bp, Rattus norvegicus
ccctccctcggtgcgttggtacgag

SEQ ID NO: 601084 - DNA, 25 bp, Rattus norvegicus
ggccttaaagggacctcagccatta

SEQ ID NO: 601085 - DNA, 25 bp, Rattus norvegicus
tccttcctccgatgttcttaacgtc

SEQ ID NO: 601086 - DNA, 25 bp, Rattus norvegicus
cccgttgctggagacagcagctctt

SEQ ID NO: 601087 - DNA, 25 bp, Rattus norvegicus
ggtctcttctgcttctcccttttca

SEQ ID NO: 601088 - DNA, 25 bp, Rattus norvegicus
acagcagctcttgcccatcggaagg

SEQ ID NO: 601089 - DNA, 25 bp, Rattus norvegicus
ctgcccctcccgatagcccaaggga

SEQ ID NO: 601090 - DNA, 25 bp, Rattus norvegicus
tcacgcgcacctcctggtggggcac

SEQ ID NO: 601091 - DNA, 25 bp, Rattus norvegicus
tttctcacgcgcacctcctggtggg

SEQ ID NO: 601092 - DNA, 25 bp, Rattus norvegicus
ttttctcacgcgcacctcctggtgg

SEQ ID NO: 601093 - DNA, 25 bp, Rattus norvegicus
ccctccctgccttttctcacgcgca

SEQ ID NO: 601094 - DNA, 25 bp, Rattus norvegicus
cgggaccactcgtgccccctccctg

SEQ ID NO: 601095 - DNA, 25 bp, Rattus norvegicus
tgccaggccccgtgttacctgggta

SEQ ID NO: 601096 - DNA, 25 bp, Rattus norvegicus
cgccaacggtcaccgggggatcctg

SEQ ID NO: 601097 - DNA, 25 bp, Rattus norvegicus
agggaacctcgtgccaggccccgtg

SEQ ID NO: 601098 - DNA, 25 bp, Rattus norvegicus
acgcgcacctcctggtggggcaccc

SEQ ID NO: 601099 - DNA, 25 bp, Rattus norvegicus
gatcctggcagagacgtaggtttgc

SEQ ID NO: 601100 - DNA, 25 bp, Rattus norvegicus
atcctggcagagacgtaggtttgcg

SEQ ID NO: 601101 - DNA, 25 bp, Rattus norvegicus
gaacctcgtgccaggccccgtgtta

SEQ ID NO: 601102 - DNA, 25 bp, Rattus norvegicus
ttctcacgcgcacctcctggtgggg

SEQ ID NO: 601103 - DNA, 25 bp, Rattus norvegicus
ggccagccttggctcctgtgtggat

SEQ ID NO: 601104 - DNA, 25 bp, Rattus norvegicus
tactcacctggaatggactctgggc

SEQ ID NO: 601105 - DNA, 25 bp, Rattus norvegicus
cgagaaccgggagcaagtccacttg

SEQ ID NO: 601106 - DNA, 25 bp, Rattus norvegicus
cagccgctgcggctgattcttgcgc

SEQ ID NO: 601107 - DNA, 25 bp, Rattus norvegicus
gcagtaaccactgcagcggcagcag

SEQ ID NO: 601108 - DNA, 25 bp, Rattus norvegicus
gcttcagggccgctgtgtccactgt

SEQ ID NO: 601109 - DNA, 25 bp, Rattus norvegicus
agacagatgcaaccggggccacagc

SEQ ID NO: 601110 - DNA, 25 bp, Rattus norvegicus
ttctccaagacagatgcaaccgggg

SEQ ID NO: 601111 - DNA, 25 bp, Rattus norvegicus
cgcacaaagcgcaaatgtagggccc

SEQ ID NO: 601112 - DNA, 25 bp, Rattus norvegicus
tcttgaactccttggcgcacaaagc

SEQ ID NO: 601113 - DNA, 25 bp, Rattus norvegicus
caaagaagcgggactggagctcagc

SEQ ID NO: 601114 - DNA, 25 bp, Rattus norvegicus
atggcttcgtgccttcggaggttgt

SEQ ID NO: 601115 - DNA, 25 bp, Rattus norvegicus
ggcatcttcatagcacccgagggga

SEQ ID NO: 601116 - DNA, 25 bp, Rattus norvegicus
tcggaggttgtagccgttcttgaac

SEQ ID NO: 601117 - DNA, 25 bp, Rattus norvegicus
ctgcggctttttcttagccctaacg

SEQ ID NO: 601118 - DNA, 25 bp, Rattus norvegicus
taattcggccgtctcgggctcgctt

SEQ ID NO: 601119 - DNA, 25 bp, Rattus norvegicus
gccatctcccgttgctgcggctttt

SEQ ID NO: 601120 - DNA, 25 bp, Rattus norvegicus
tctaaactcccgaaggcagcgaata

SEQ ID NO: 601121 - DNA, 25 bp, Rattus norvegicus
cgaatagaggacaggcggcgcccac

SEQ ID NO: 601122 - DNA, 25 bp, Rattus norvegicus
gcccggccaggatagttcgggacaa

SEQ ID NO: 601123 - DNA, 25 bp, Rattus norvegicus
cgggacaaccgctactctgtaagtt

SEQ ID NO: 601124 - DNA, 25 bp, Rattus norvegicus
gcgtacctgagctggccgacgccat

SEQ ID NO: 601125 - DNA, 25 bp, Rattus norvegicus
ttcttcggaccgcttctctcttttg

SEQ ID NO: 601126 - DNA, 25 bp, Rattus norvegicus
ctctcttttgaattgccggggtccg

SEQ ID NO: 601127 - DNA, 25 bp, Rattus norvegicus
tctcaaattcgaccaatcacggcta

SEQ ID NO: 601128 - DNA, 25 bp, Rattus norvegicus
atcacggctacttaccgccggaagt

SEQ ID NO: 601129 - DNA, 25 bp, Rattus norvegicus
tctaactctccgtaattcggccgtc

SEQ ID NO: 601130 - DNA, 25 bp, Rattus norvegicus
tctgtaagtttcacacacgatgccc

SEQ ID NO: 601131 - DNA, 25 bp, Rattus norvegicus
ctggcgccttagtagcctcggaacc

SEQ ID NO: 601132 - DNA, 25 bp, Rattus norvegicus
cgtacttgcctcacgggatttgaag

SEQ ID NO: 601133 - DNA, 25 bp, Rattus norvegicus
aacccgaattccacatagcgacctg

SEQ ID NO: 601134 - DNA, 25 bp, Rattus norvegicus
ccaactcggcgtagaagctagaagc

SEQ ID NO: 601135 - DNA, 25 bp, Rattus norvegicus
agccgcagggattcaaacaatctta

SEQ ID NO: 601136 - DNA, 25 bp, Rattus norvegicus
tacccgctgacgctcacctaggaat

SEQ ID NO: 601137 - DNA, 25 bp, Rattus norvegicus
tcgccggtattacatccggggcatc

SEQ ID NO: 601138 - DNA, 25 bp, Rattus norvegicus
tgtgaagactgccataggacccgga

SEQ ID NO: 601139 - DNA, 25 bp, Rattus norvegicus
agtggcttcacttctatccaaaaga

SEQ ID NO: 601140 - DNA, 25 bp, Rattus norvegicus
acgggcggatgtatccctttagcca

SEQ ID NO: 601141 - DNA, 25 bp, Rattus norvegicus
tctccgcaggaagtaacgtaagacc

SEQ ID NO: 601142 - DNA, 25 bp, Rattus norvegicus
cgtaagacctgcaaagactcgcgtg

SEQ ID NO: 601143 - DNA, 25 bp, Rattus norvegicus
tagcgacctgctcggccatgtccaa

SEQ ID NO: 601144 - DNA, 25 bp, Rattus norvegicus
gactcgcgtgaactccgtacttgcc

SEQ ID NO: 601145 - DNA, 25 bp, Rattus norvegicus
caaaaccaaggccacggacgtctcg

SEQ ID NO: 601146 - DNA, 25 bp, Rattus norvegicus
ctcttccgtctttggagtgtctgtc

SEQ ID NO: 601147 - DNA, 25 bp, Rattus norvegicus
aaggccacggacgtctcggctcctg

SEQ ID NO: 601148 - DNA, 25 bp, Rattus norvegicus
ctctgccgctggtgcggggaactct

SEQ ID NO: 601149 - DNA, 25 bp, Rattus norvegicus
ggaactcttgcgtcttcgcggcttc

SEQ ID NO: 601150 - DNA, 25 bp, Rattus norvegicus
gcctccagggttagctctaccgtgc

SEQ ID NO: 601151 - DNA, 25 bp, Rattus norvegicus
ctaccgtgctgcctgtagctgtcgt

SEQ ID NO: 601152 - DNA, 25 bp, Rattus norvegicus
tctgtaacgatcctgggacccaggc

SEQ ID NO: 601153 - DNA, 25 bp, Rattus norvegicus
aagtggccgtagtcactggcggtcc

SEQ ID NO: 601154 - DNA, 25 bp, Rattus norvegicus
agatgctgaggagccgccgatgtct

SEQ ID NO: 601155 - DNA, 25 bp, Rattus norvegicus
cgatgtctcggcgaactacgcctgc

SEQ ID NO: 601156 - DNA, 25 bp, Rattus norvegicus
ctacgcctgcgcgagggaaggccct

SEQ ID NO: 601157 - DNA, 25 bp, Rattus norvegicus
cgaggccgaggtctgtaacgatcct

SEQ ID NO: 601158 - DNA, 25 bp, Rattus norvegicus
aggcgaggctcgagcctcttccgtc

SEQ ID NO: 601159 - DNA, 25 bp, Rattus norvegicus
caagcgggttaccatcatgcccaaa

SEQ ID NO: 601160 - DNA, 25 bp, Rattus norvegicus
ggcattgcgagagatccggcgctac

SEQ ID NO: 601161 - DNA, 25 bp, Rattus norvegicus
aagtcgacgggaggcaaggctccac

SEQ ID NO: 601162 - DNA, 25 bp, Rattus norvegicus
aggcaaggctccacgcaagcagcta

SEQ ID NO: 601163 - DNA, 25 bp, Rattus norvegicus
cgcaagcagctagccacgaaggtgg

SEQ ID NO: 601164 - DNA, 25 bp, Rattus norvegicus
gaaggtggcacgcaagagcgctcca

SEQ ID NO: 601165 - DNA, 25 bp, Rattus norvegicus
taccaccctggtactgtggcattgc

SEQ ID NO: 601166 - DNA, 25 bp, Rattus norvegicus
accgttccagcgcttggtccgtgaa

SEQ ID NO: 601167 - DNA, 25 bp, Rattus norvegicus
aggaggcctgcgagtcgtacctcgt

SEQ ID NO: 601168 - DNA, 25 bp, Rattus norvegicus
agtcgtacctcgtggggctcttcga

SEQ ID NO: 601169 - DNA, 25 bp, Rattus norvegicus
ggctcttcgaggacacgaacctgtg

SEQ ID NO: 601170 - DNA, 25 bp, Rattus norvegicus
tatccatgccaagcgggttaccatc

SEQ ID NO: 601171 - DNA, 25 bp, Rattus norvegicus
catccagttggctcggcgcatacgc

SEQ ID NO: 601172 - DNA, 25 bp, Rattus norvegicus
cgaacctgtgcgctatccatgccaa

SEQ ID NO: 601173 - DNA, 25 bp, Rattus norvegicus
ctggctgctgggtccctgttgtact

SEQ ID NO: 601174 - DNA, 25 bp, Rattus norvegicus
tgcagcgcgctacacagccctgggg

SEQ ID NO: 601175 - DNA, 25 bp, Rattus norvegicus
gccgcgccagttgaccagccgagga

SEQ ID NO: 601176 - DNA, 25 bp, Rattus norvegicus
accagccgaggaggcacgccactaa

SEQ ID NO: 601177 - DNA, 25 bp, Rattus norvegicus
gaggcacgccactaacgccgcaggg

SEQ ID NO: 601178 - DNA, 25 bp, Rattus norvegicus
cacggctagaactggtgctggccgc

SEQ ID NO: 601179 - DNA, 25 bp, Rattus norvegicus
ccgcgctgataggtaatggatgctt

SEQ ID NO: 601180 - DNA, 25 bp, Rattus norvegicus
gctcctccgggtcctagagcggttc

SEQ ID NO: 601181 - DNA, 25 bp, Rattus norvegicus
agcccgtacccgagccgctggctgc

SEQ ID NO: 601182 - DNA, 25 bp, Rattus norvegicus
gggtccctgttgtactgcagggaac

SEQ ID NO: 601183 - DNA, 25 bp, Rattus norvegicus
cagcgggtgccctcggagtcaccag

SEQ ID NO: 601184 - DNA, 25 bp, Rattus norvegicus
agaactggtgctggccgccgctgcc

SEQ ID NO: 601185 - DNA, 25 bp, Rattus norvegicus
agcggttcgccgaggcccgtgcttc

SEQ ID NO: 601186 - DNA, 25 bp, Rattus norvegicus
gtcctagagcggttcgccgaggccc

SEQ ID NO: 601187 - DNA, 25 bp, Rattus norvegicus
cccaaggttgctcgagaagcacagt

SEQ ID NO: 601188 - DNA, 25 bp, Rattus norvegicus
gggcacagattctccacctcggacg

SEQ ID NO: 601189 - DNA, 25 bp, Rattus norvegicus
ccgggagggtcaagacctcttctgc

SEQ ID NO: 601190 - DNA, 25 bp, Rattus norvegicus
cgcgcgagtcttcttccagagtcct

SEQ ID NO: 601191 - DNA, 25 bp, Rattus norvegicus
acctcggacgacttccaagcctagg

SEQ ID NO: 601192 - DNA, 25 bp, Rattus norvegicus
gaggcgtctttaaggctttggtctc

SEQ ID NO: 601193 - DNA, 25 bp, Rattus norvegicus
tccctcctctaggatccagtggcta

SEQ ID NO: 601194 - DNA, 25 bp, Rattus norvegicus
ccaccagcagggaaaagtgacagtg

SEQ ID NO: 601195 - DNA, 25 bp, Rattus norvegicus
agcacagttcgcgtctgcagggcaa

SEQ ID NO: 601196 - DNA, 25 bp, Rattus norvegicus
ctgtatggctgcgaggtacctgaac

SEQ ID NO: 601197 - DNA, 25 bp, Rattus norvegicus
cgtggagcaactgggtcagctgtat

SEQ ID NO: 601198 - DNA, 25 bp, Rattus norvegicus
cacccgggaattttccgtggctctg

SEQ ID NO: 601199 - DNA, 25 bp, Rattus norvegicus
ggagcgtgttgctgcttgatttctc

SEQ ID NO: 601200 - DNA, 25 bp, Rattus norvegicus
cagccgctgggcaagtgcaacagca

SEQ ID NO: 601201 - DNA, 25 bp, Rattus norvegicus
cttgaaggccgggttaggcatcttc

SEQ ID NO: 601202 - DNA, 25 bp, Rattus norvegicus
tcagccggtcccttagcgctcgggt

SEQ ID NO: 601203 - DNA, 25 bp, Rattus norvegicus
ggcttcagctccagcgggccttcag

SEQ ID NO: 601204 - DNA, 25 bp, Rattus norvegicus
cgagcaccgaacctcgggctggtga

SEQ ID NO: 601205 - DNA, 25 bp, Rattus norvegicus
ggccagatgctctagccaatgaatg

SEQ ID NO: 601206 - DNA, 25 bp, Rattus norvegicus
gttaggcacagaagcccaggcctca

SEQ ID NO: 601207 - DNA, 25 bp, Rattus norvegicus
ggtcgccgatacctcagagtcccgg

SEQ ID NO: 601208 - DNA, 25 bp, Rattus norvegicus
ccgacccaggctccggggagtgact

SEQ ID NO: 601209 - DNA, 25 bp, Rattus norvegicus
catcttctgttcgttaggagtttcc

SEQ ID NO: 601210 - DNA, 25 bp, Rattus norvegicus
tagaacttggttgcggggccttgaa

SEQ ID NO: 601211 - DNA, 25 bp, Rattus norvegicus
tccgactgagggtggttagaacttg

SEQ ID NO: 601212 - DNA, 25 bp, Rattus norvegicus
caacgcgggcacagcaatctcggtg

SEQ ID NO: 601213 - DNA, 25 bp, Rattus norvegicus
gccgcaagcgggcaaacagcaagct

SEQ ID NO: 601214 - DNA, 25 bp, Rattus norvegicus
gagctggagattcgaactgttcagg

SEQ ID NO: 601215 - DNA, 25 bp, Rattus norvegicus
cgagaagccttacgcgtgcccggac

SEQ ID NO: 601216 - DNA, 25 bp, Rattus norvegicus
cgagacttcaagctacccgccagtg

SEQ ID NO: 601217 - DNA, 25 bp, Rattus norvegicus
gccgtctctacatctgcgcgggctg

SEQ ID NO: 601218 - DNA, 25 bp, Rattus norvegicus
acatgcggcgccgtctctacatctg

SEQ ID NO: 601219 - DNA, 25 bp, Rattus norvegicus
accgttccaacctggcggagcatgc

SEQ ID NO: 601220 - DNA, 25 bp, Rattus norvegicus
tgcggcacgcgcttcgctcagagct

SEQ ID NO: 601221 - DNA, 25 bp, Rattus norvegicus
gagccttcggcggaagttcgtgcct

SEQ ID NO: 601222 - DNA, 25 bp, Rattus norvegicus
gagctccaattacgcgcagcatctg

SEQ ID NO: 601223 - DNA, 25 bp, Rattus norvegicus
gcgcttcgcgcagagctccaattac

SEQ ID NO: 601224 - DNA, 25 bp, Rattus norvegicus
gcccggaatgcgacaagcgcttctc

SEQ ID NO: 601225 - DNA, 25 bp, Rattus norvegicus
agcgaccttaccagtgcccggaatg

SEQ ID NO: 601226 - DNA, 25 bp, Rattus norvegicus
tcggcactgaccaagcacggtcgca

SEQ ID NO: 601227 - DNA, 25 bp, Rattus norvegicus
tgcttctcgcagaagtcggcactga

SEQ ID NO: 601228 - DNA, 25 bp, Rattus norvegicus
aagttcgtgcctggcgcgccaccga

SEQ ID NO: 601229 - DNA, 25 bp, Rattus norvegicus
cgttgtttgcttaatgggcgccaga

SEQ ID NO: 601230 - DNA, 25 bp, Rattus norvegicus
cagaagcctaatgtgacgttgtttg

SEQ ID NO: 601231 - DNA, 25 bp, Rattus norvegicus
aggtacgaaatcaatctgggaaaga

SEQ ID NO: 601232 - DNA, 25 bp, Rattus norvegicus
cctcgagttctttcgcccaggcgaa

SEQ ID NO: 601233 - DNA, 25 bp, Rattus norvegicus
tttcaagtgtattttcggtgccctc

SEQ ID NO: 601234 - DNA, 25 bp, Rattus norvegicus
cctagaccaatctgaagggagtttc

SEQ ID NO: 601235 - DNA, 25 bp, Rattus norvegicus
tcttctccggcctagaccaatctga

SEQ ID NO: 601236 - DNA, 25 bp, Rattus norvegicus
agacggatttttgctacgcaccgcc

SEQ ID NO: 601237 - DNA, 25 bp, Rattus norvegicus
ggggacccaatcatatagacggatt

SEQ ID NO: 601238 - DNA, 25 bp, Rattus norvegicus
ccaaagtgaaatagcagacgcggag

SEQ ID NO: 601239 - DNA, 25 bp, Rattus norvegicus
gcgggagcaaactccgcgccacgtt

SEQ ID NO: 601240 - DNA, 25 bp, Rattus norvegicus
gagccgcctctagggttccgaccaa

SEQ ID NO: 601241 - DNA, 25 bp, Rattus norvegicus
gttccgaccaatcacggtttctctg

SEQ ID NO: 601242 - DNA, 25 bp, Rattus norvegicus
caccggtaccagcttgggacattcc

SEQ ID NO: 601243 - DNA, 25 bp, Rattus norvegicus
gcgattctaattgccacggtgggta

SEQ ID NO: 601244 - DNA, 25 bp, Rattus norvegicus
ccagaaggccctggtacctgcaggc

SEQ ID NO: 601245 - DNA, 25 bp, Rattus norvegicus
gtagttggagaaactccggccagca

SEQ ID NO: 601246 - DNA, 25 bp, Rattus norvegicus
aggttaggcctggagatgatctacc

SEQ ID NO: 601247 - DNA, 25 bp, Rattus norvegicus
atcggaagactcaagccacgctgcc

SEQ ID NO: 601248 - DNA, 25 bp, Rattus norvegicus
ttgacagtcgctccatccaatgatc

SEQ ID NO: 601249 - DNA, 25 bp, Rattus norvegicus
tccaatgatcattctcgtaccgaga

SEQ ID NO: 601250 - DNA, 25 bp, Rattus norvegicus
attaaccgtctgcttgcaccaccgg

SEQ ID NO: 601251 - DNA, 25 bp, Rattus norvegicus
ttcatgccggagaagctcgtcagcc

SEQ ID NO: 601252 - DNA, 25 bp, Rattus norvegicus
tgcagcctcagcctttcatgccgga

SEQ ID NO: 601253 - DNA, 25 bp, Rattus norvegicus
cctccaggagtttgagcagggtctc

SEQ ID NO: 601254 - DNA, 25 bp, Rattus norvegicus
cgcgtcagtccctccaggagtttga

SEQ ID NO: 601255 - DNA, 25 bp, Rattus norvegicus
aggagtccatcccaatgctcagcga

SEQ ID NO: 601256 - DNA, 25 bp, Rattus norvegicus
cgagaggcgggcttcctttattcaa

SEQ ID NO: 601257 - DNA, 25 bp, Rattus norvegicus
gtcatcacacttataaggtcgctcc

SEQ ID NO: 601258 - DNA, 25 bp, Rattus norvegicus
ccgcactcagggcacttaaagggct

SEQ ID NO: 601259 - DNA, 25 bp, Rattus norvegicus
catggatggctagaacagaactctg

SEQ ID NO: 601260 - DNA, 25 bp, Rattus norvegicus
tgcgagcatggatggctagaacaga

SEQ ID NO: 601261 - DNA, 25 bp, Rattus norvegicus
acagctgtatgtgcggcctggcaga

SEQ ID NO: 601262 - DNA, 25 bp, Rattus norvegicus
gccacagtcgggacagctgtatgtg

SEQ ID NO: 601263 - DNA, 25 bp, Rattus norvegicus
acacacagcgcagcggtatggcctc

SEQ ID NO: 601264 - DNA, 25 bp, Rattus norvegicus
aggaacgacagaagcccttgccaca

SEQ ID NO: 601265 - DNA, 25 bp, Rattus norvegicus
gctttgcgagaaggcctttccacag

SEQ ID NO: 601266 - DNA, 25 bp, Rattus norvegicus
ctatgcacgcgatggtgctgcagca

SEQ ID NO: 601267 - DNA, 25 bp, Rattus norvegicus
ttccacagtcatcacacttataagg

SEQ ID NO: 601268 - DNA, 25 bp, Rattus norvegicus
cagggcacttaaagggcttttcacg

SEQ ID NO: 601269 - DNA, 25 bp, Rattus norvegicus
cagcgtggaggaacgacagaagccc

SEQ ID NO: 601270 - DNA, 25 bp, Rattus norvegicus
cggagctttgcgagaaggcctttcc

SEQ ID NO: 601271 - DNA, 25 bp, Rattus norvegicus
tctcggcctaaccagggagctgtct

SEQ ID NO: 601272 - DNA, 25 bp, Rattus norvegicus
tgcctgtatcgcgagtctcggccta

SEQ ID NO: 601273 - DNA, 25 bp, Rattus norvegicus
gtctgcagatttctccgaccatgtg

SEQ ID NO: 601274 - DNA, 25 bp, Rattus norvegicus
atcgcgggcagacgctcatttgacc

SEQ ID NO: 601275 - DNA, 25 bp, Rattus norvegicus
atttgaccgcacatccaggctctga

SEQ ID NO: 601276 - DNA, 25 bp, Rattus norvegicus
ttgttgccagagaaacagctcctcc

SEQ ID NO: 601277 - DNA, 25 bp, Rattus norvegicus
cactccgcccacgattggtcgttgg

SEQ ID NO: 601278 - DNA, 25 bp, Rattus norvegicus
aactccgagcctgagacctttagtc

SEQ ID NO: 601279 - DNA, 25 bp, Rattus norvegicus
tggcattaaccctggactggatctc

SEQ ID NO: 601280 - DNA, 25 bp, Rattus norvegicus
aaggtctctgattgtcctgtggccc

SEQ ID NO: 601281 - DNA, 25 bp, Rattus norvegicus
cgcaaaggccggacgtcttgaccct

SEQ ID NO: 601282 - DNA, 25 bp, Rattus norvegicus
tagatcctgcgacccagttcgagtg

SEQ ID NO: 601283 - DNA, 25 bp, Rattus norvegicus
tggcgatggcagacgatagatcctg

SEQ ID NO: 601284 - DNA, 25 bp, Rattus norvegicus
cgacagcagtttgtgtgcctgtatc

SEQ ID NO: 601285 - DNA, 25 bp, Rattus norvegicus
gccgtttctacctcgtctcctggtg

SEQ ID NO: 601286 - DNA, 25 bp, Rattus norvegicus
agtgcgggcgctccttgcgagccgc

SEQ ID NO: 601287 - DNA, 25 bp, Rattus norvegicus
ctgcgttcctgcgagccgcagtgcg

SEQ ID NO: 601288 - DNA, 25 bp, Rattus norvegicus
aactggatctgcgttcctgcgagcc

SEQ ID NO: 601289 - DNA, 25 bp, Rattus norvegicus
ctggtgatgaactggatctgcgttc

SEQ ID NO: 601290 - DNA, 25 bp, Rattus norvegicus
tctcctggtgatgaactggatctgc

SEQ ID NO: 601291 - DNA, 25 bp, Rattus norvegicus
tacctcgtctcctggtgatgaactg

SEQ ID NO: 601292 - DNA, 25 bp, Rattus norvegicus
gtttctacctcgtctcctggtgatg

SEQ ID NO: 601293 - DNA, 25 bp, Rattus norvegicus
ctcgcctactcgctccagctctggg

SEQ ID NO: 601294 - DNA, 25 bp, Rattus norvegicus
gcctcaccttgtcgggcaccagctg

SEQ ID NO: 601295 - DNA, 25 bp, Rattus norvegicus
gccctcccatgacggtccagcctca

SEQ ID NO: 601296 - DNA, 25 bp, Rattus norvegicus
gggtccgctgtttgccctcccatga

SEQ ID NO: 601297 - DNA, 25 bp, Rattus norvegicus
tcgtctcctggtgatgaactggatc

SEQ ID NO: 601298 - DNA, 25 bp, Rattus norvegicus
agctctgggaagttgctgggaccgc

SEQ ID NO: 601299 - DNA, 25 bp, Rattus norvegicus
taaacggggtcatgccgctgtgcac

SEQ ID NO: 601300 - DNA, 25 bp, Rattus norvegicus
ctgcaatttcagagccctggcgaaa

SEQ ID NO: 601301 - DNA, 25 bp, Rattus norvegicus
cgatgaggcctctcctttcggtgta

SEQ ID NO: 601302 - DNA, 25 bp, Rattus norvegicus
tccgctcacagtaagggcagcgatg

SEQ ID NO: 601303 - DNA, 25 bp, Rattus norvegicus
agcgctgtgtgaaagtccgctcaca

SEQ ID NO: 601304 - DNA, 25 bp, Rattus norvegicus
tcagcgcaacagtaaggcttctccc

SEQ ID NO: 601305 - DNA, 25 bp, Rattus norvegicus
ctggtgctcatggagcccagagctc

SEQ ID NO: 601306 - DNA, 25 bp, Rattus norvegicus
cacagactgtgcaactaaacggggt

SEQ ID NO: 601307 - DNA, 25 bp, Rattus norvegicus
tttagaatcagcaaaggctctgcca

SEQ ID NO: 601308 - DNA, 25 bp, Rattus norvegicus
tgtggcgccgaagatatttagaatc

SEQ ID NO: 601309 - DNA, 25 bp, Rattus norvegicus
agtcagggcaggaataaggcttttc

SEQ ID NO: 601310 - DNA, 25 bp, Rattus norvegicus
ctggcgaaagcagcgtccgcagtca

SEQ ID NO: 601311 - DNA, 25 bp, Rattus norvegicus
ccgcctgtgggctgcaatttcagag

SEQ ID NO: 601312 - DNA, 25 bp, Rattus norvegicus
tgaagcggcgtccacaatcagcgca

SEQ ID NO: 601313 - DNA, 25 bp, Rattus norvegicus
cacgaggtttcactagtgtgtttac

SEQ ID NO: 601314 - DNA, 25 bp, Rattus norvegicus
ccttggcctttgtccggcgccagga

SEQ ID NO: 601315 - DNA, 25 bp, Rattus norvegicus
tgtgtagaccagagacagggcaggc

SEQ ID NO: 601316 - DNA, 25 bp, Rattus norvegicus
gccgtgcaaatctcgcgaggaaaca

SEQ ID NO: 601317 - DNA, 25 bp, Rattus norvegicus
agagcagaacgatcggcaaccgggt

SEQ ID NO: 601318 - DNA, 25 bp, Rattus norvegicus
cgcgtcaggcgcctggctctgtacg

SEQ ID NO: 601319 - DNA, 25 bp, Rattus norvegicus
gtcctgggcactagcggttccgacc

SEQ ID NO: 601320 - DNA, 25 bp, Rattus norvegicus
atcactactaatccggaccgaaccg

SEQ ID NO: 601321 - DNA, 25 bp, Rattus norvegicus
agtgtgtttacaccgatcactacta

SEQ ID NO: 601322 - DNA, 25 bp, Rattus norvegicus
tctcgcgaggaaacacgaggtttca

SEQ ID NO: 601323 - DNA, 25 bp, Rattus norvegicus
ttcccagccgtgcaaatctcgcgag

SEQ ID NO: 601324 - DNA, 25 bp, Rattus norvegicus
cctcagccgccctgtcaggcgcggc

SEQ ID NO: 601325 - DNA, 25 bp, Rattus norvegicus
tgagacgcagcccaaccgtcggcct

SEQ ID NO: 601326 - DNA, 25 bp, Rattus norvegicus
gctctgtacgcgagctcggggatct

SEQ ID NO: 601327 - DNA, 25 bp, Rattus norvegicus
cgcaatgtcggatgcactcgcggca

SEQ ID NO: 601328 - DNA, 25 bp, Rattus norvegicus
ctggctttctagttccctgccgctg

SEQ ID NO: 601329 - DNA, 25 bp, Rattus norvegicus
tagcaagccgctgcctgactctgca

SEQ ID NO: 601330 - DNA, 25 bp, Rattus norvegicus
gtccagaacttttctaaattgctga

SEQ ID NO: 601331 - DNA, 25 bp, Rattus norvegicus
ttctagttccctgccgctgtccaga

SEQ ID NO: 601332 - DNA, 25 bp, Rattus norvegicus
gaaatcttaaaggagccctgcctgg

SEQ ID NO: 601333 - DNA, 25 bp, Rattus norvegicus
cagccgctgcgggaaatcttaaagg

SEQ ID NO: 601334 - DNA, 25 bp, Rattus norvegicus
gttgctcaagtgctcagccagccgc

SEQ ID NO: 601335 - DNA, 25 bp, Rattus norvegicus
ccgcagttgctcaagtgctcagcca

SEQ ID NO: 601336 - DNA, 25 bp, Rattus norvegicus
ttgctacccgcagttgctcaagtgc

SEQ ID NO: 601337 - DNA, 25 bp, Rattus norvegicus
tgcgttccggcttgctacccgcagt

SEQ ID NO: 601338 - DNA, 25 bp, Rattus norvegicus
gccgccgcactacacaggctggggt

SEQ ID NO: 601339 - DNA, 25 bp, Rattus norvegicus
cctgactctgcagccgcggtaggac

SEQ ID NO: 601340 - DNA, 25 bp, Rattus norvegicus
cctgccgctgtccagaacttttcta

SEQ ID NO: 601341 - DNA, 25 bp, Rattus norvegicus
tagccggacatgtccgcggtcggta

SEQ ID NO: 601342 - DNA, 25 bp, Rattus norvegicus
aatctgctgagccatgtggagtccc

SEQ ID NO: 601343 - DNA, 25 bp, Rattus norvegicus
tcccgcgaagtgctagcctaggcgt

SEQ ID NO: 601344 - DNA, 25 bp, Rattus norvegicus
cgtgtcagcccaacgccctaagggt

SEQ ID NO: 601345 - DNA, 25 bp, Rattus norvegicus
ggtcgcctgcctagccggacatgtc

SEQ ID NO: 601346 - DNA, 25 bp, Rattus norvegicus
tcccggagcaatctgctgagccatg

SEQ ID NO: 601347 - DNA, 25 bp, Rattus norvegicus
gcggaggcccttcccggagcaatct

SEQ ID NO: 601348 - DNA, 25 bp, Rattus norvegicus
gcttacagaacgcaggctgtgcgga

SEQ ID NO: 601349 - DNA, 25 bp, Rattus norvegicus
cccgagcttacagaacgcaggctgt

SEQ ID NO: 601350 - DNA, 25 bp, Rattus norvegicus
ccggtgagaaatacacggccacgtc

SEQ ID NO: 601351 - DNA, 25 bp, Rattus norvegicus
cccattcctccggtgagaaatacac

SEQ ID NO: 601352 - DNA, 25 bp, Rattus norvegicus
tacagggctctctgtgccggtcgca

SEQ ID NO: 601353 - DNA, 25 bp, Rattus norvegicus
agcctaggcgtccaggaagattctc

SEQ ID NO: 601354 - DNA, 25 bp, Rattus norvegicus
aacgccctaagggtcgcctgcctag

SEQ ID NO: 601355 - DNA, 25 bp, Rattus norvegicus
gtacacggctacgtctgagaagctc

SEQ ID NO: 601356 - DNA, 25 bp, Rattus norvegicus
tgctgcactgcaggacccacagtgt

SEQ ID NO: 601357 - DNA, 25 bp, Rattus norvegicus
cccacagtgtaaagcacagcgctac

SEQ ID NO: 601358 - DNA, 25 bp, Rattus norvegicus
acagcgctactctaggtgaccagga

SEQ ID NO: 601359 - DNA, 25 bp, Rattus norvegicus
ctctaggtgaccaggaaggttctca

SEQ ID NO: 601360 - DNA, 25 bp, Rattus norvegicus
accaggaaggttctcaccgaaagag

SEQ ID NO: 601361 - DNA, 25 bp, Rattus norvegicus
ggtacagggctctctccgccggctg

SEQ ID NO: 601362 - DNA, 25 bp, Rattus norvegicus
cacagtcccgggcttatagaactca

SEQ ID NO: 601363 - DNA, 25 bp, Rattus norvegicus
ccgggcttatagaactcaggctgtg

SEQ ID NO: 601364 - DNA, 25 bp, Rattus norvegicus
tagaactcaggctgtgccgaggccc

SEQ ID NO: 601365 - DNA, 25 bp, Rattus norvegicus
tgccgaggcccttccaggggtaatc

SEQ ID NO: 601366 - DNA, 25 bp, Rattus norvegicus
ggaccacttggtcagtaccgcccaa

SEQ ID NO: 601367 - DNA, 25 bp, Rattus norvegicus
gggtaatccgctgcgccatggcaac

SEQ ID NO: 601368 - DNA, 25 bp, Rattus norvegicus
cactagtcggggacgacggaccact

SEQ ID NO: 601369 - DNA, 25 bp, Rattus norvegicus
cgctcttagcccgacttagcctgga

SEQ ID NO: 601370 - DNA, 25 bp, Rattus norvegicus
ctccgcgaagtttgctcaagcgctc

SEQ ID NO: 601371 - DNA, 25 bp, Rattus norvegicus
gcggcccggactatttcacggacca

SEQ ID NO: 601372 - DNA, 25 bp, Rattus norvegicus
gtccctggcggtgttgctctccgtc

SEQ ID NO: 601373 - DNA, 25 bp, Rattus norvegicus
tttgctcaagcgctctgggtaccac

SEQ ID NO: 601374 - DNA, 25 bp, Rattus norvegicus
tgcagtttgcagctccgcgaagttt

SEQ ID NO: 601375 - DNA, 25 bp, Rattus norvegicus
cagccacccgggttgcagtttgcag

SEQ ID NO: 601376 - DNA, 25 bp, Rattus norvegicus
acttagcctggacctgctagccggg

SEQ ID NO: 601377 - DNA, 25 bp, Rattus norvegicus
ctgtgtggtccagttaggagcagcc

SEQ ID NO: 601378 - DNA, 25 bp, Rattus norvegicus
gggagttcccaagtccgctcttagc

SEQ ID NO: 601379 - DNA, 25 bp, Rattus norvegicus
tgtctctgagcgctgctccagggag

SEQ ID NO: 601380 - DNA, 25 bp, Rattus norvegicus
cgctccgaatctgcaggtgggacca

SEQ ID NO: 601381 - DNA, 25 bp, Rattus norvegicus
ctatttcacggaccagacaagggaa

SEQ ID NO: 601382 - DNA, 25 bp, Rattus norvegicus
ccaaattggacactctggatcaaca

SEQ ID NO: 601383 - DNA, 25 bp, Rattus norvegicus
tgcgacggtggctgatcagtaaaga

SEQ ID NO: 601384 - DNA, 25 bp, Rattus norvegicus
tcttgaagcgaacaccacattctgg

SEQ ID NO: 601385 - DNA, 25 bp, Rattus norvegicus
tcggactggggctccaggcacagcc

SEQ ID NO: 601386 - DNA, 25 bp, Rattus norvegicus
cagcccggatcccaggccttcggcc

SEQ ID NO: 601387 - DNA, 25 bp, Rattus norvegicus
ccctgagcaggaacggtggatccat

SEQ ID NO: 601388 - DNA, 25 bp, Rattus norvegicus
ggaacggtggatccattgatgtgct

SEQ ID NO: 601389 - DNA, 25 bp, Rattus norvegicus
ttgatgtgctttcactgcgaacttc

SEQ ID NO: 601390 - DNA, 25 bp, Rattus norvegicus
tgcgaacttcctcttgaagcgaaca

SEQ ID NO: 601391 - DNA, 25 bp, Rattus norvegicus
agcgaacaccacattctggacaggg

SEQ ID NO: 601392 - DNA, 25 bp, Rattus norvegicus
ccacattctggacaggggaagggtc

SEQ ID NO: 601393 - DNA, 25 bp, Rattus norvegicus
tcaccagagtgcatgcgacggtggc

SEQ ID NO: 601394 - DNA, 25 bp, Rattus norvegicus
gctgatcagtaaagacgggtaggta

SEQ ID NO: 601395 - DNA, 25 bp, Rattus norvegicus
ggtaaaccggcgtccacagtccaca

SEQ ID NO: 601396 - DNA, 25 bp, Rattus norvegicus
aagggtcgctcaccagagtgcatgc

SEQ ID NO: 601397 - DNA, 25 bp, Rattus norvegicus
atcctgcccgggcagcggcttggct

SEQ ID NO: 601398 - DNA, 25 bp, Rattus norvegicus
gctagcaaccggtgctgaaagaacc

SEQ ID NO: 601399 - DNA, 25 bp, Rattus norvegicus
ctcctgcggggagaaatacacggct

SEQ ID NO: 601400 - DNA, 25 bp, Rattus norvegicus
gcggggagaaatacacggctacgtc

SEQ ID NO: 601401 - DNA, 25 bp, Rattus norvegicus
tccgcgaagctcacaagctcaggct

SEQ ID NO: 601402 - DNA, 25 bp, Rattus norvegicus
aagctcacaagctcaggcttcctga

SEQ ID NO: 601403 - DNA, 25 bp, Rattus norvegicus
caagctcaggcttcctgaaaccagg

SEQ ID NO: 601404 - DNA, 25 bp, Rattus norvegicus
tgaaaccaggccagatctccccagg

SEQ ID NO: 601405 - DNA, 25 bp, Rattus norvegicus
cccaggcatcggaaccagtagtggg

SEQ ID NO: 601406 - DNA, 25 bp, Rattus norvegicus
acatcagggatcctgcccgggcagc

SEQ ID NO: 601407 - DNA, 25 bp, Rattus norvegicus
cttccggcctctgcaactgcgggaa

SEQ ID NO: 601408 - DNA, 25 bp, Rattus norvegicus
gcctctgcaactgcgggaagccacg

SEQ ID NO: 601409 - DNA, 25 bp, Rattus norvegicus
cccttggtcacggttgctagcaacc

SEQ ID NO: 601410 - DNA, 25 bp, Rattus norvegicus
ggtggcgacatcagggatcctgccc

SEQ ID NO: 601411 - DNA, 25 bp, Rattus norvegicus
ctagggcactgatgaggcttctcac

SEQ ID NO: 601412 - DNA, 25 bp, Rattus norvegicus
acagtcatcgcaggcgtgcagcttc

SEQ ID NO: 601413 - DNA, 25 bp, Rattus norvegicus
agcgacgcccgcaactagggcactg

SEQ ID NO: 601414 - DNA, 25 bp, Rattus norvegicus
attctaggcaggtgtagggcttctc

SEQ ID NO: 601415 - DNA, 25 bp, Rattus norvegicus
cggaaacgacggctgcattctaggc

SEQ ID NO: 601416 - DNA, 25 bp, Rattus norvegicus
gtcaggacacgggtaaggcttctct

SEQ ID NO: 601417 - DNA, 25 bp, Rattus norvegicus
aaacgccgctcacagtcaggacacg

SEQ ID NO: 601418 - DNA, 25 bp, Rattus norvegicus
ccagagtgcacacgccggtggctaa

SEQ ID NO: 601419 - DNA, 25 bp, Rattus norvegicus
tcacagtgctcacaggcatagggcc

SEQ ID NO: 601420 - DNA, 25 bp, Rattus norvegicus
agaagcgggcttcacagtgctcaca

SEQ ID NO: 601421 - DNA, 25 bp, Rattus norvegicus
tccttcggaaggcacggccacagtc

SEQ ID NO: 601422 - DNA, 25 bp, Rattus norvegicus
tggatggccaaggagccgctccttc

SEQ ID NO: 601423 - DNA, 25 bp, Rattus norvegicus
tgcagcttctcttccgtgtgggtgc

SEQ ID NO: 601424 - DNA, 25 bp, Rattus norvegicus
ccaaggaccggctccgtcgaaagca

SEQ ID NO: 601425 - DNA, 25 bp, Rattus norvegicus
gagtaggtccaacctctccgggtgc

SEQ ID NO: 601426 - DNA, 25 bp, Rattus norvegicus
accggaagatgccttcggggaagat

SEQ ID NO: 601427 - DNA, 25 bp, Rattus norvegicus
tgagaagcaccggaagatgccttcg

SEQ ID NO: 601428 - DNA, 25 bp, Rattus norvegicus
cctgctggaacttgggtgagaagca

SEQ ID NO: 601429 - DNA, 25 bp, Rattus norvegicus
cgttattcagggaactcctgctgga

SEQ ID NO: 601430 - DNA, 25 bp, Rattus norvegicus
aatctgaatcggctgcctgaggggc

SEQ ID NO: 601431 - DNA, 25 bp, Rattus norvegicus
aaggcggcgccattggacctgctcc

SEQ ID NO: 601432 - DNA, 25 bp, Rattus norvegicus
acatccgcgaacttcaaggcccttg

SEQ ID NO: 601433 - DNA, 25 bp, Rattus norvegicus
aggagaagtacacggccacatccgc

SEQ ID NO: 601434 - DNA, 25 bp, Rattus norvegicus
acatcccggtacagagtcctctgcg

SEQ ID NO: 601435 - DNA, 25 bp, Rattus norvegicus
cgcgcatcacatcccggtacagagt

SEQ ID NO: 601436 - DNA, 25 bp, Rattus norvegicus
cgtaagcagattgggccgggcctca

SEQ ID NO: 601437 - DNA, 25 bp, Rattus norvegicus
acaaaccgatcgcaggtcaggaccc

SEQ ID NO: 601438 - DNA, 25 bp, Rattus norvegicus
ccttcggccgggaggaaatctgaat

SEQ ID NO: 601439 - DNA, 25 bp, Rattus norvegicus
cgctgtgtaaggctggctttaaaga

SEQ ID NO: 601440 - DNA, 25 bp, Rattus norvegicus
ggcaggagatttcacgtagtttctc

SEQ ID NO: 601441 - DNA, 25 bp, Rattus norvegicus
cccggatccttggaaagctgcggtg

SEQ ID NO: 601442 - DNA, 25 bp, Rattus norvegicus
taaggctggctttaaagaagccgga

SEQ ID NO: 601443 - DNA, 25 bp, Rattus norvegicus
tccttggaaagctgcggtgagcgac

SEQ ID NO: 601444 - DNA, 25 bp, Rattus norvegicus
acagcgctgtgtaaggctggcttta

SEQ ID NO: 601445 - DNA, 25 bp, Rattus norvegicus
ctgacggttggacagcgctgtgtaa

SEQ ID NO: 601446 - DNA, 25 bp, Rattus norvegicus
aaaggcctctgacggttggacagcg

SEQ ID NO: 601447 - DNA, 25 bp, Rattus norvegicus
gagaaaaaggcctctgacggttgga

SEQ ID NO: 601448 - DNA, 25 bp, Rattus norvegicus
gcggtgcctaagacacagagaaaaa

SEQ ID NO: 601449 - DNA, 25 bp, Rattus norvegicus
tgggcggtgcctaagacacagagaa

SEQ ID NO: 601450 - DNA, 25 bp, Rattus norvegicus
gtgattgggcggtgcctaagacaca

SEQ ID NO: 601451 - DNA, 25 bp, Rattus norvegicus
gagatttcacgtagtttctcctaac

SEQ ID NO: 601452 - DNA, 25 bp, Rattus norvegicus
tgggagctgttgaaaaccccggatc

SEQ ID NO: 601453 - DNA, 25 bp, Rattus norvegicus
agggcctgtgccctgccgggagccg

SEQ ID NO: 601454 - DNA, 25 bp, Rattus norvegicus
accgggatgctgacggctgtacccg

SEQ ID NO: 601455 - DNA, 25 bp, Rattus norvegicus
agaccgggatgctgacggctgtacc

SEQ ID NO: 601456 - DNA, 25 bp, Rattus norvegicus
cgcctgacttgagctcgggagaccg

SEQ ID NO: 601457 - DNA, 25 bp, Rattus norvegicus
acccggctctgagcggccggtcggg

SEQ ID NO: 601458 - DNA, 25 bp, Rattus norvegicus
cccttggaggaagggcctgtgccct

SEQ ID NO: 601459 - DNA, 25 bp, Rattus norvegicus
gagccgcaggcggactatgaagggc

SEQ ID NO: 601460 - DNA, 25 bp, Rattus norvegicus
ggcggactatgaagggcggagtccc

SEQ ID NO: 601461 - DNA, 25 bp, Rattus norvegicus
aggagctggctctcactccccactc

SEQ ID NO: 601462 - DNA, 25 bp, Rattus norvegicus
ccatggatttgcctggggactccag

SEQ ID NO: 601463 - DNA, 25 bp, Rattus norvegicus
atttgcctggggactccaggtgaga

SEQ ID NO: 601464 - DNA, 25 bp, Rattus norvegicus
gactccaggtgagagcgtaccccgc

SEQ ID NO: 601465 - DNA, 25 bp, Rattus norvegicus
gcccgcctgacttgagctcgggaga

SEQ ID NO: 601466 - DNA, 25 bp, Rattus norvegicus
ccgcctgacttgagctcgggagacc

SEQ ID NO: 601467 - DNA, 25 bp, Rattus norvegicus
gtccctggtcctcagcttcatctgg

SEQ ID NO: 601468 - DNA, 25 bp, Rattus norvegicus
atgcggcgctgagggccgtcaccat

SEQ ID NO: 601469 - DNA, 25 bp, Rattus norvegicus
tctcttgtccctgtgcaagcgccag

SEQ ID NO: 601470 - DNA, 25 bp, Rattus norvegicus
ccggagctctcttgtccctgtgcaa

SEQ ID NO: 601471 - DNA, 25 bp, Rattus norvegicus
tgttttaaagaggaagccggagctc

SEQ ID NO: 601472 - DNA, 25 bp, Rattus norvegicus
gggccagcggatcctgttttaaaga

SEQ ID NO: 601473 - DNA, 25 bp, Rattus norvegicus
tctctgggccttggccttggggcaa

SEQ ID NO: 601474 - DNA, 25 bp, Rattus norvegicus
cggccgcccagttttagtcgtcgcg

SEQ ID NO: 601475 - DNA, 25 bp, Rattus norvegicus
ctggacaatttgaggcctcgcctta

SEQ ID NO: 601476 - DNA, 25 bp, Rattus norvegicus
cacagtggagtcgtcttaaaggggc

SEQ ID NO: 601477 - DNA, 25 bp, Rattus norvegicus
acgaagacgctgctcgcggcgagac

SEQ ID NO: 601478 - DNA, 25 bp, Rattus norvegicus
tgaggcctcgccttaaagggacggc

SEQ ID NO: 601479 - DNA, 25 bp, Rattus norvegicus
tagaccagccggacacagtggagtc

SEQ ID NO: 601480 - DNA, 25 bp, Rattus norvegicus
tcagcttcatctggagagcggcctg

SEQ ID NO: 601481 - DNA, 25 bp, Rattus norvegicus
gtacccactacccaggaggctaaga

SEQ ID NO: 601482 - DNA, 25 bp, Rattus norvegicus
gttccatcgggtgcaaccggcccat

SEQ ID NO: 601483 - DNA, 25 bp, Rattus norvegicus
cggcgcagaggaacctacggcccaa

SEQ ID NO: 601484 - DNA, 25 bp, Rattus norvegicus
cgcccgctcgccaaaatggcagaaa

SEQ ID NO: 601485 - DNA, 25 bp, Rattus norvegicus
gcagaaatggcacggcgcttgcacc

SEQ ID NO: 601486 - DNA, 25 bp, Rattus norvegicus
gggagccgctaaccaccttctgcgg

SEQ ID NO: 601487 - DNA, 25 bp, Rattus norvegicus
acgacctcaaggtgcgttccatcgg

SEQ ID NO: 601488 - DNA, 25 bp, Rattus norvegicus
caaccggcccatgcctggtgcgaag

SEQ ID NO: 601489 - DNA, 25 bp, Rattus norvegicus
gccttgattacttcaccgacccagt

SEQ ID NO: 601490 - DNA, 25 bp, Rattus norvegicus
ggcaccacgaagagcctgatccagg

SEQ ID NO: 601491 - DNA, 25 bp, Rattus norvegicus
ccagtgatgactgactgcggccaca

SEQ ID NO: 601492 - DNA, 25 bp, Rattus norvegicus
aagagtgccgctatctgctccgggc

SEQ ID NO: 601493 - DNA, 25 bp, Rattus norvegicus
agcccagtgccggaagtacccacta

SEQ ID NO: 601494 - DNA, 25 bp, Rattus norvegicus
tgcgctctctctgcggaatagcttg

SEQ ID NO: 601495 - DNA, 25 bp, Rattus norvegicus
ccagttactgtgtatcgcgagaaga

SEQ ID NO: 601496 - DNA, 25 bp, Rattus norvegicus
tctgagtcctgtgacccagtctatg

SEQ ID NO: 601497 - DNA, 25 bp, Rattus norvegicus
ctgacggacgcggacttctgagtcc

SEQ ID NO: 601498 - DNA, 25 bp, Rattus norvegicus
ttgcgcacgaactcttccttcctga

SEQ ID NO: 601499 - DNA, 25 bp, Rattus norvegicus
tccatttaggagaccgagactttgc

SEQ ID NO: 601500 - DNA, 25 bp, Rattus norvegicus
gggcgcatgcccaccataatccatt

SEQ ID NO: 601501 - DNA, 25 bp, Rattus norvegicus
tgagacgaatagtccgggcgcatgc

SEQ ID NO: 601502 - DNA, 25 bp, Rattus norvegicus
gtcaagcgaagtggcacctggtgtc

SEQ ID NO: 601503 - DNA, 25 bp, Rattus norvegicus
tgactgcgcgcgcatctacgagcgc

SEQ ID NO: 601504 - DNA, 25 bp, Rattus norvegicus
tttaaagcagtgaaggcggtgacca

SEQ ID NO: 601505 - DNA, 25 bp, Rattus norvegicus
tgatctcaccttcgtggcgtgacta

SEQ ID NO: 601506 - DNA, 25 bp, Rattus norvegicus
gctgagagtagcgtctcctttttct

SEQ ID NO: 601507 - DNA, 25 bp, Rattus norvegicus
tctggcggtagcgataacgagcctt

SEQ ID NO: 601508 - DNA, 25 bp, Rattus norvegicus
tcctgagccttttgcggtctgttga

SEQ ID NO: 601509 - DNA, 25 bp, Rattus norvegicus
cgagtgaaatccaagatggtggcgc

SEQ ID NO: 601510 - DNA, 25 bp, Rattus norvegicus
tctaatcgagcccattcgtctcggg

SEQ ID NO: 601511 - DNA, 25 bp, Rattus norvegicus
ggagaagactacgaccactctaatc

SEQ ID NO: 601512 - DNA, 25 bp, Rattus norvegicus
gctgaaccgcgaggagaagactacg

SEQ ID NO: 601513 - DNA, 25 bp, Rattus norvegicus
gccgctatgtctggcctcagcaaca

SEQ ID NO: 601514 - DNA, 25 bp, Rattus norvegicus
ggagagctctgagctgtccctccgc

SEQ ID NO: 601515 - DNA, 25 bp, Rattus norvegicus
atttctgcaggtgacggaagtgccg

SEQ ID NO: 601516 - DNA, 25 bp, Rattus norvegicus
acaggtctgctctctgatttctgca

SEQ ID NO: 601517 - DNA, 25 bp, Rattus norvegicus
acgctcgggactacagaactctgga

SEQ ID NO: 601518 - DNA, 25 bp, Rattus norvegicus
gctctgacgcctgcgctgtgcgtct

SEQ ID NO: 601519 - DNA, 25 bp, Rattus norvegicus
ttggctgaccctaccgtaagtgcgg

SEQ ID NO: 601520 - DNA, 25 bp, Rattus norvegicus
gccggtgacgtcgagtgaaatccaa

SEQ ID NO: 601521 - DNA, 25 bp, Rattus norvegicus
tcttccacggttggtggacttttgc

SEQ ID NO: 601522 - DNA, 25 bp, Rattus norvegicus
cctgcagatgtgtccaggaggacgc

SEQ ID NO: 601523 - DNA, 25 bp, Rattus norvegicus
tggccctattgttccccggcggctg

SEQ ID NO: 601524 - DNA, 25 bp, Rattus norvegicus
cctccgggcgggagcacccaccctg

SEQ ID NO: 601525 - DNA, 25 bp, Rattus norvegicus
cccacagcggacgcccaggctgccc

SEQ ID NO: 601526 - DNA, 25 bp, Rattus norvegicus
agcggaccagggctagagcgcctcc

SEQ ID NO: 601527 - DNA, 25 bp, Rattus norvegicus
aggaggcagcgagaccgccctcgac

SEQ ID NO: 601528 - DNA, 25 bp, Rattus norvegicus
tgaccaggaggcagcgagaccgccc

SEQ ID NO: 601529 - DNA, 25 bp, Rattus norvegicus
tgaccctgaccaggaggcagcgaga

SEQ ID NO: 601530 - DNA, 25 bp, Rattus norvegicus
ccagggtgaccctgaccaggaggca

SEQ ID NO: 601531 - DNA, 25 bp, Rattus norvegicus
aaagctcagccggaccgccggcgtt

SEQ ID NO: 601532 - DNA, 25 bp, Rattus norvegicus
accctgaccaggaggcagcgagacc

SEQ ID NO: 601533 - DNA, 25 bp, Rattus norvegicus
ggagcacccaccctgttcccggctc

SEQ ID NO: 601534 - DNA, 25 bp, Rattus norvegicus
aggcggctgccttccgcggaggtgc

SEQ ID NO: 601535 - DNA, 25 bp, Rattus norvegicus
gccctcgcgcggttcccacaatccc

SEQ ID NO: 601536 - DNA, 25 bp, Rattus norvegicus
cggcccagggtgaccctgaccagga

SEQ ID NO: 601537 - DNA, 25 bp, Rattus norvegicus
ctcttaacgtcacggccactaggta

SEQ ID NO: 601538 - DNA, 25 bp, Rattus norvegicus
catccgcagtaagggactctgtaga

SEQ ID NO: 601539 - DNA, 25 bp, Rattus norvegicus
cggacttactagagacgccttacga

SEQ ID NO: 601540 - DNA, 25 bp, Rattus norvegicus
acaacggcactctgcggctgggaaa

SEQ ID NO: 601541 - DNA, 25 bp, Rattus norvegicus
cccaaggatgggacaacggcactct

SEQ ID NO: 601542 - DNA, 25 bp, Rattus norvegicus
cgatttgtctatgcgcaggtcccta

SEQ ID NO: 601543 - DNA, 25 bp, Rattus norvegicus
tcgttaggtgagtgtccgatttgtc

SEQ ID NO: 601544 - DNA, 25 bp, Rattus norvegicus
ttcatcagccatagcccaggcagtc

SEQ ID NO: 601545 - DNA, 25 bp, Rattus norvegicus
tgcaggatggccaagccttcatcag

SEQ ID NO: 601546 - DNA, 25 bp, Rattus norvegicus
gaggaacttgcagccgcatctcggt

SEQ ID NO: 601547 - DNA, 25 bp, Rattus norvegicus
cctcgccaaccaggggaggaacttg

SEQ ID NO: 601548 - DNA, 25 bp, Rattus norvegicus
ttactgtgccgcttggttctctctc

SEQ ID NO: 601549 - DNA, 25 bp, Rattus norvegicus
tcctgctgctggtcctttactgtgc

SEQ ID NO: 601550 - DNA, 25 bp, Rattus norvegicus
cggaagctctccaggtctgggcata

SEQ ID NO: 601551 - DNA, 25 bp, Rattus norvegicus
aggtggcttggctgtatccctgacc

SEQ ID NO: 601552 - DNA, 25 bp, Rattus norvegicus
tcgatttagatcacagctggtgggc

SEQ ID NO: 601553 - DNA, 25 bp, Rattus norvegicus
gcttggctgtatccctgacccgggg

SEQ ID NO: 601554 - DNA, 25 bp, Rattus norvegicus
ggcagcgctcaccatctccggacct

SEQ ID NO: 601555 - DNA, 25 bp, Rattus norvegicus
atctccggaccttctcgatggtcgc

SEQ ID NO: 601556 - DNA, 25 bp, Rattus norvegicus
cggaccttctcgatggtcgccatca

SEQ ID NO: 601557 - DNA, 25 bp, Rattus norvegicus
gatggtcgccatcacctttttgatg

SEQ ID NO: 601558 - DNA, 25 bp, Rattus norvegicus
cgccatcacctttttgatgtcatct

SEQ ID NO: 601559 - DNA, 25 bp, Rattus norvegicus
gatgtcatctttggcccggctccgg

SEQ ID NO: 601560 - DNA, 25 bp, Rattus norvegicus
ctgcggtccggcgatctcaggctgc

SEQ ID NO: 601561 - DNA, 25 bp, Rattus norvegicus
cccgcctggcttcctgagaccgcgc

SEQ ID NO: 601562 - DNA, 25 bp, Rattus norvegicus
tgggcgtccctgaaatgctctgtgt

SEQ ID NO: 601563 - DNA, 25 bp, Rattus norvegicus
cgtccctgaaatgctctgtgtgcgc

SEQ ID NO: 601564 - DNA, 25 bp, Rattus norvegicus
gccctgtcgatttagatcacagctg

SEQ ID NO: 601565 - DNA, 25 bp, Rattus norvegicus
agcctgtcgccacctccgccctctt

SEQ ID NO: 601566 - DNA, 25 bp, Rattus norvegicus
cctggaggacgctgcccgccaggtt

SEQ ID NO: 601567 - DNA, 25 bp, Rattus norvegicus
tattggatgctgtgcgccgccgcca

SEQ ID NO: 601568 - DNA, 25 bp, Rattus norvegicus
cccgcgctattggatgctgtgcgcc

SEQ ID NO: 601569 - DNA, 25 bp, Rattus norvegicus
ccttgagtgctctgcccgcgctatt

SEQ ID NO: 601570 - DNA, 25 bp, Rattus norvegicus
atgcagccgccttgagtgctctgcc

SEQ ID NO: 601571 - DNA, 25 bp, Rattus norvegicus
ctgcggcaggatgcagccgccttga

SEQ ID NO: 601572 - DNA, 25 bp, Rattus norvegicus
gggcttctcaccaccgcggctgccg

SEQ ID NO: 601573 - DNA, 25 bp, Rattus norvegicus
cacgtgtgcggcctctatggcgagt

SEQ ID NO: 601574 - DNA, 25 bp, Rattus norvegicus
ggctccacgtgtgcggcctctatgg

SEQ ID NO: 601575 - DNA, 25 bp, Rattus norvegicus
tcttcacctccaacagtgcggcagg

SEQ ID NO: 601576 - DNA, 25 bp, Rattus norvegicus
acctccaacagtgcggcaggcgtct

SEQ ID NO: 601577 - DNA, 25 bp, Rattus norvegicus
gcaggcgtcttctcagctaaggtgc

SEQ ID NO: 601578 - DNA, 25 bp, Rattus norvegicus
ctcagctaaggtgctggggctccac

SEQ ID NO: 601579 - DNA, 25 bp, Rattus norvegicus
ttgtagtcatccttcccgctccttc

SEQ ID NO: 601580 - DNA, 25 bp, Rattus norvegicus
tgcttgtagtcatccttcccgctcc

SEQ ID NO: 601581 - DNA, 25 bp, Rattus norvegicus
agtgcctggaaaggaggtcgggtcg

SEQ ID NO: 601582 - DNA, 25 bp, Rattus norvegicus
cgtgtgagtgcctggaaaggaggtc

SEQ ID NO: 601583 - DNA, 25 bp, Rattus norvegicus
accagagggcgtgtgagtgcctgga

SEQ ID NO: 601584 - DNA, 25 bp, Rattus norvegicus
gttgtggaccagagggcgtgtgagt

SEQ ID NO: 601585 - DNA, 25 bp, Rattus norvegicus
taccacacacgcggagggttgtgga

SEQ ID NO: 601586 - DNA, 25 bp, Rattus norvegicus
aggtaccacacacgcggagggttgt

SEQ ID NO: 601587 - DNA, 25 bp, Rattus norvegicus
caggtaccacacacgcggagggttg

SEQ ID NO: 601588 - DNA, 25 bp, Rattus norvegicus
tcaggtaccacacacgcggagggtt

SEQ ID NO: 601589 - DNA, 25 bp, Rattus norvegicus
gtcaggtaccacacacgcggagggt

SEQ ID NO: 601590 - DNA, 25 bp, Rattus norvegicus
cgtcaggtaccacacacgcggaggg

SEQ ID NO: 601591 - DNA, 25 bp, Rattus norvegicus
ccgtcaggtaccacacacgcggagg

SEQ ID NO: 601592 - DNA, 25 bp, Rattus norvegicus
tgtagtcatccttcccgctccttct

SEQ ID NO: 601593 - DNA, 25 bp, Rattus norvegicus
ccatgctcggctcccagcgtggcaa

SEQ ID NO: 601594 - DNA, 25 bp, Rattus norvegicus
tcctgctacggggagtctctggcca

SEQ ID NO: 601595 - DNA, 25 bp, Rattus norvegicus
ggagtctctggccaactggactata

SEQ ID NO: 601596 - DNA, 25 bp, Rattus norvegicus
tggactataattcccgccatgctcg

SEQ ID NO: 601597 - DNA, 25 bp, Rattus norvegicus
ttcgccatcttatttgtagtaccgg

SEQ ID NO: 601598 - DNA, 25 bp, Rattus norvegicus
gcgtggcaaccctttcgccatctta

SEQ ID NO: 601599 - DNA, 25 bp, Rattus norvegicus
ttgtagtaccggctggccctagtgt

SEQ ID NO: 601600 - DNA, 25 bp, Rattus norvegicus
gtgtgccacttttcccaccatagcg

SEQ ID NO: 601601 - DNA, 25 bp, Rattus norvegicus
tttcccaccatagcgctagaatttg

SEQ ID NO: 601602 - DNA, 25 bp, Rattus norvegicus
cgctagaatttggagaactacaact

SEQ ID NO: 601603 - DNA, 25 bp, Rattus norvegicus
tacaactcccgtcgtgctttgcacg

SEQ ID NO: 601604 - DNA, 25 bp, Rattus norvegicus
tcccgtcgtgctttgcacgcattcg

SEQ ID NO: 601605 - DNA, 25 bp, Rattus norvegicus
tggccaactggactataattcccgc

SEQ ID NO: 601606 - DNA, 25 bp, Rattus norvegicus
tggccctagtgtgccacttttccca

SEQ ID NO: 601607 - DNA, 25 bp, Rattus norvegicus
ccactcccattcatcctcagcctgg

SEQ ID NO: 601608 - DNA, 25 bp, Rattus norvegicus
cattcatcctcagcctggcctctcc

SEQ ID NO: 601609 - DNA, 25 bp, Rattus norvegicus
ctgggcagctcccactcccattcat

SEQ ID NO: 601610 - DNA, 25 bp, Rattus norvegicus
tgggcagctcccactcccattcatc

SEQ ID NO: 601611 - DNA, 25 bp, Rattus norvegicus
gggcagctcccactcccattcatcc

SEQ ID NO: 601612 - DNA, 25 bp, Rattus norvegicus
ggcagctcccactcccattcatcct

SEQ ID NO: 601613 - DNA, 25 bp, Rattus norvegicus
gcagctcccactcccattcatcctc

SEQ ID NO: 601614 - DNA, 25 bp, Rattus norvegicus
agctcccactcccattcatcctcag

SEQ ID NO: 601615 - DNA, 25 bp, Rattus norvegicus
cccactcccattcatcctcagcctg

SEQ ID NO: 601616 - DNA, 25 bp, Rattus norvegicus
cactcccattcatcctcagcctggc

SEQ ID NO: 601617 - DNA, 25 bp, Rattus norvegicus
tcccattcatcctcagcctggcctc

SEQ ID NO: 601618 - DNA, 25 bp, Rattus norvegicus
ctcccattcatcctcagcctggcct

SEQ ID NO: 601619 - DNA, 25 bp, Rattus norvegicus
ccattcatcctcagcctggcctctc

SEQ ID NO: 601620 - DNA, 25 bp, Rattus norvegicus
tcttctccaaccttctttcctataa

SEQ ID NO: 601621 - DNA, 25 bp, Rattus norvegicus
cgggacacgtgtgaggtgggttcat

SEQ ID NO: 601622 - DNA, 25 bp, Rattus norvegicus
tcatacccgggactgagtggggccc

SEQ ID NO: 601623 - DNA, 25 bp, Rattus norvegicus
cgggcaaaagctgagcaccctgcgc

SEQ ID NO: 601624 - DNA, 25 bp, Rattus norvegicus
ggcccgggcaaaagctgagcaccct

SEQ ID NO: 601625 - DNA, 25 bp, Rattus norvegicus
aggtgggttcatgcggctcctcctc

SEQ ID NO: 601626 - DNA, 25 bp, Rattus norvegicus
agctgagcaccctgcgcccaaggag

SEQ ID NO: 601627 - DNA, 25 bp, Rattus norvegicus
ctgagggactgagccccccagagca

SEQ ID NO: 601628 - DNA, 25 bp, Rattus norvegicus
ccctggaagggccacgccgcagccc

SEQ ID NO: 601629 - DNA, 25 bp, Rattus norvegicus
catctccactcgctgctgtcccggc

SEQ ID NO: 601630 - DNA, 25 bp, Rattus norvegicus
gacccgccgggagctgccgagaagg

SEQ ID NO: 601631 - DNA, 25 bp, Rattus norvegicus
gggagagatggctcccgggacacgt

SEQ ID NO: 601632 - DNA, 25 bp, Rattus norvegicus
ctgagactcatacccgggactgagt

SEQ ID NO: 601633 - DNA, 25 bp, Rattus norvegicus
gagctgagactcatacccgggactg

SEQ ID NO: 601634 - DNA, 25 bp, Rattus norvegicus
aaaagctgagcaccctgcgcccaag

SEQ ID NO: 601635 - DNA, 25 bp, Rattus norvegicus
gactgccatttctgccgagacatga

SEQ ID NO: 601636 - DNA, 25 bp, Rattus norvegicus
ccgggcctgtgttcgaactgagtgc

SEQ ID NO: 601637 - DNA, 25 bp, Rattus norvegicus
ggggactgccatttctgccgagaca

SEQ ID NO: 601638 - DNA, 25 bp, Rattus norvegicus
agtcttgacccgcatgcccggtacg

SEQ ID NO: 601639 - DNA, 25 bp, Rattus norvegicus
acgccgaacccgctgccgtcgttgc

SEQ ID NO: 601640 - DNA, 25 bp, Rattus norvegicus
aatgtcgtcgagcagccggggaccg

SEQ ID NO: 601641 - DNA, 25 bp, Rattus norvegicus
gccatttctgccgagacatgaagaa

SEQ ID NO: 601642 - DNA, 25 bp, Rattus norvegicus
ccgggcgcatgaagcagtcgtgcct

SEQ ID NO: 601643 - DNA, 25 bp, Rattus norvegicus
agtcgtgcctgcttcggcagtgcac

SEQ ID NO: 601644 - DNA, 25 bp, Rattus norvegicus
tcgttgccgggcctgtgttcgaact

SEQ ID NO: 601645 - DNA, 25 bp, Rattus norvegicus
gcctgcttcggcagtgcaccgcggt

SEQ ID NO: 601646 - DNA, 25 bp, Rattus norvegicus
agtgcaccgcggtgagtcttgaccc

SEQ ID NO: 601647 - DNA, 25 bp, Rattus norvegicus
accgcggtgagtcttgacccgcatg

SEQ ID NO: 601648 - DNA, 25 bp, Rattus norvegicus
actgagtgcggggactgccatttct

SEQ ID NO: 601649 - DNA, 25 bp, Rattus norvegicus
ggtccttctcccagctcacgtgtgg

SEQ ID NO: 601650 - DNA, 25 bp, Rattus norvegicus
tgcgccctcgcgcacacgaatggag

SEQ ID NO: 601651 - DNA, 25 bp, Rattus norvegicus
tgcccgctgtcacctagagccagat

SEQ ID NO: 601652 - DNA, 25 bp, Rattus norvegicus
ttgcccacgatctggcagctcagcg

SEQ ID NO: 601653 - DNA, 25 bp, Rattus norvegicus
agcgtggcatccttgccaacagata

SEQ ID NO: 601654 - DNA, 25 bp, Rattus norvegicus
acaaaagcctttggccgcgtcagga

SEQ ID NO: 601655 - DNA, 25 bp, Rattus norvegicus
tcttccacactgtctcgggcttggg

SEQ ID NO: 601656 - DNA, 25 bp, Rattus norvegicus
tggcgttcctcgctcgacacacgta

SEQ ID NO: 601657 - DNA, 25 bp, Rattus norvegicus
ccagtgggttctctgctcgaacttc

SEQ ID NO: 601658 - DNA, 25 bp, Rattus norvegicus
tttggaccagctcacagcaggttgc

SEQ ID NO: 601659 - DNA, 25 bp, Rattus norvegicus
cgtgtttgccttcggtcaccgtgca

SEQ ID NO: 601660 - DNA, 25 bp, Rattus norvegicus
ctcgaacttcgtaggtgccaccatc

SEQ ID NO: 601661 - DNA, 25 bp, Rattus norvegicus
tcgccggtcacaaagcagctgaggc

SEQ ID NO: 601662 - DNA, 25 bp, Rattus norvegicus
tcggcatccgagtccaccacgagag

SEQ ID NO: 601663 - DNA, 25 bp, Rattus norvegicus
gtggtgtagctgctctcagaatgaa

SEQ ID NO: 601664 - DNA, 25 bp, Rattus norvegicus
tcggtaactattcccgctggctctg

SEQ ID NO: 601665 - DNA, 25 bp, Rattus norvegicus
gctggctctgccttactgcctggaa

SEQ ID NO: 601666 - DNA, 25 bp, Rattus norvegicus
ccttactgcctggaatggggtcccg

SEQ ID NO: 601667 - DNA, 25 bp, Rattus norvegicus
tgggccgtcccttcttggggctaca

SEQ ID NO: 601668 - DNA, 25 bp, Rattus norvegicus
ttggggctacaaggcgcctcggccc

SEQ ID NO: 601669 - DNA, 25 bp, Rattus norvegicus
agcgtttgtggtgtagctgctctca

SEQ ID NO: 601670 - DNA, 25 bp, Rattus norvegicus
agtcgcacttctgctctgctgtcgg

SEQ ID NO: 601671 - DNA, 25 bp, Rattus norvegicus
gctcagccacgtaccgggagttcgt

SEQ ID NO: 601672 - DNA, 25 bp, Rattus norvegicus
accgggagttcgtgcaccgcggcta

SEQ ID NO: 601673 - DNA, 25 bp, Rattus norvegicus
accgcggctacctcgaccttatggg

SEQ ID NO: 601674 - DNA, 25 bp, Rattus norvegicus
agtcagcactctctgcgggcgctca

SEQ ID NO: 601675 - DNA, 25 bp, Rattus norvegicus
tcagccgggctaagctcaaagcctc

SEQ ID NO: 601676 - DNA, 25 bp, Rattus norvegicus
ccctccttgaccgtcagcgtttgtg

SEQ ID NO: 601677 - DNA, 25 bp, Rattus norvegicus
cgcccacaataggatccgcagattc

SEQ ID NO: 601678 - DNA, 25 bp, Rattus norvegicus
tgcggccaatcttcaggctccctgg

SEQ ID NO: 601679 - DNA, 25 bp, Rattus norvegicus
tgcagtccactctccggggaatgcg

SEQ ID NO: 601680 - DNA, 25 bp, Rattus norvegicus
cgtcgttggacgcaccactcaaatc

SEQ ID NO: 601681 - DNA, 25 bp, Rattus norvegicus
cgcctcgcgaatctgcgtcgttgga

SEQ ID NO: 601682 - DNA, 25 bp, Rattus norvegicus
gagcgcgcatcctgtccactcgttt

SEQ ID NO: 601683 - DNA, 25 bp, Rattus norvegicus
cctcataggcatttgggctgcgcaa

SEQ ID NO: 601684 - DNA, 25 bp, Rattus norvegicus
aacggtggcgaatctgcactgcagc

SEQ ID NO: 601685 - DNA, 25 bp, Rattus norvegicus
gattttcttgactctaccgcaggtg

SEQ ID NO: 601686 - DNA, 25 bp, Rattus norvegicus
ctcggcgaaccaggcgtgattttct

SEQ ID NO: 601687 - DNA, 25 bp, Rattus norvegicus
ggtcaactccgccaacagggctcgg

SEQ ID NO: 601688 - DNA, 25 bp, Rattus norvegicus
ggcggctccttgagttgttctacta

SEQ ID NO: 601689 - DNA, 25 bp, Rattus norvegicus
cgcagattcgctattcgactcctta

SEQ ID NO: 601690 - DNA, 25 bp, Rattus norvegicus
cccgtggatctctccgcagtacttg

SEQ ID NO: 601691 - DNA, 25 bp, Rattus norvegicus
gctgaggccaggcagagacaggggc

SEQ ID NO: 601692 - DNA, 25 bp, Rattus norvegicus
gcagctcctgagtccgatccttcat

SEQ ID NO: 601693 - DNA, 25 bp, Rattus norvegicus
atgcggctgcggcacagggttggat

SEQ ID NO: 601694 - DNA, 25 bp, Rattus norvegicus
gccgactgggctctgcctaggctgc

SEQ ID NO: 601695 - DNA, 25 bp, Rattus norvegicus
tccgagggatgtgcgggtaaggtgc

SEQ ID NO: 601696 - DNA, 25 bp, Rattus norvegicus
cccggctagacctccgagggatgtg

SEQ ID NO: 601697 - DNA, 25 bp, Rattus norvegicus
gcacccggctagacctccgagggat

SEQ ID NO: 601698 - DNA, 25 bp, Rattus norvegicus
ctcttgcctctgtgctggaggccgg

SEQ ID NO: 601699 - DNA, 25 bp, Rattus norvegicus
ctgcctcttgcctctgtgctggagg

SEQ ID NO: 601700 - DNA, 25 bp, Rattus norvegicus
tctctgcctcttgcctctgtgctgg

SEQ ID NO: 601701 - DNA, 25 bp, Rattus norvegicus
ttcatcctgcgacgggctcctcctc

SEQ ID NO: 601702 - DNA, 25 bp, Rattus norvegicus
gtccgatccttcatcctgcgacggg

SEQ ID NO: 601703 - DNA, 25 bp, Rattus norvegicus
ctgagtccgatccttcatcctgcga

SEQ ID NO: 601704 - DNA, 25 bp, Rattus norvegicus
tctgcctaggctgcggtggcgatgc

SEQ ID NO: 601705 - DNA, 25 bp, Rattus norvegicus
ggtgatgtgagatacgaggctctca

SEQ ID NO: 601706 - DNA, 25 bp, Rattus norvegicus
acgaggctctcagactgcgtgcaga

SEQ ID NO: 601707 - DNA, 25 bp, Rattus norvegicus
cctttgggcaactagatttcagttc

SEQ ID NO: 601708 - DNA, 25 bp, Rattus norvegicus
caaccctttgggcaactagatttca

SEQ ID NO: 601709 - DNA, 25 bp, Rattus norvegicus
agatgacgcattcccaaccctttgg

SEQ ID NO: 601710 - DNA, 25 bp, Rattus norvegicus
actgcgtgcagatgacgcattccca

SEQ ID NO: 601711 - DNA, 25 bp, Rattus norvegicus
cgccggaacacgtgactggctgtcg

SEQ ID NO: 601712 - DNA, 25 bp, Rattus norvegicus
ctgacagcgccggaacacgtgactg

SEQ ID NO: 601713 - DNA, 25 bp, Rattus norvegicus
agacgtcgctgacagcgccggaaca

SEQ ID NO: 601714 - DNA, 25 bp, Rattus norvegicus
cgagactgaggtccgagacgtcgct

SEQ ID NO: 601715 - DNA, 25 bp, Rattus norvegicus
agctatcggggcacagctcagacgc

SEQ ID NO: 601716 - DNA, 25 bp, Rattus norvegicus
gcacagctcagacgctggggtgtca

SEQ ID NO: 601717 - DNA, 25 bp, Rattus norvegicus
ctctcagactgcgtgcagatgacgc

SEQ ID NO: 601718 - DNA, 25 bp, Rattus norvegicus
acgtcgcgagactgaggtccgagac

SEQ ID NO: 601719 - DNA, 25 bp, Rattus norvegicus
agtccctgtggtcctgggcgcacat

SEQ ID NO: 601720 - DNA, 25 bp, Rattus norvegicus
tgcagcccatctgcaaactcgagcg

SEQ ID NO: 601721 - DNA, 25 bp, Rattus norvegicus
caccaaggtaagctgcggccacctg

SEQ ID NO: 601722 - DNA, 25 bp, Rattus norvegicus
gcccgcagctgaagcctcgggagca

SEQ ID NO: 601723 - DNA, 25 bp, Rattus norvegicus
gctcagtggccatgggcccgcagct

SEQ ID NO: 601724 - DNA, 25 bp, Rattus norvegicus
acacgccgagcgagctggtgctcag

SEQ ID NO: 601725 - DNA, 25 bp, Rattus norvegicus
caggcagttccaccgagcagcggag

SEQ ID NO: 601726 - DNA, 25 bp, Rattus norvegicus
cgggagtagaagagccactgagcca

SEQ ID NO: 601727 - DNA, 25 bp, Rattus norvegicus
gagctcttcacccttagtccctgtg

SEQ ID NO: 601728 - DNA, 25 bp, Rattus norvegicus
agagagccggagctcttcaccctta

SEQ ID NO: 601729 - DNA, 25 bp, Rattus norvegicus
tctcagcaggatcgcagagagccgg

SEQ ID NO: 601730 - DNA, 25 bp, Rattus norvegicus
gtccgggtacgttctcagcaggatc

SEQ ID NO: 601731 - DNA, 25 bp, Rattus norvegicus
ccttcattctcagtccgggtacgtt

SEQ ID NO: 601732 - DNA, 25 bp, Rattus norvegicus
ccactgagccatgggcgcaggcagt

SEQ ID NO: 601733 - DNA, 25 bp, Rattus norvegicus
gagtcgcgttggtggtgcactcagg

SEQ ID NO: 601734 - DNA, 25 bp, Rattus norvegicus
ttcgagtcgcgttggtggtgcactc

SEQ ID NO: 601735 - DNA, 25 bp, Rattus norvegicus
cgagtcgcgttggtggtgcactcag

SEQ ID NO: 601736 - DNA, 25 bp, Rattus norvegicus
agtcgcgttggtggtgcactcaggt

SEQ ID NO: 601737 - DNA, 25 bp, Rattus norvegicus
tcgcgttggtggtgcactcaggtgc

SEQ ID NO: 601738 - DNA, 25 bp, Rattus norvegicus
ttggtggtgcactcaggtgccgccc

SEQ ID NO: 601739 - DNA, 25 bp, Rattus norvegicus
tggtgcactcaggtgccgcccggct

SEQ ID NO: 601740 - DNA, 25 bp, Rattus norvegicus
gtgcactcaggtgccgcccggctga

SEQ ID NO: 601741 - DNA, 25 bp, Rattus norvegicus
tgcactcaggtgccgcccggctgag

SEQ ID NO: 601742 - DNA, 25 bp, Rattus norvegicus
actcaggtgccgcccggctgagcag

SEQ ID NO: 601743 - DNA, 25 bp, Rattus norvegicus
ccgcccggctgagcagcccggacga

SEQ ID NO: 601744 - DNA, 25 bp, Rattus norvegicus
cgcccggctgagcagcccggacgac

SEQ ID NO: 601745 - DNA, 25 bp, Rattus norvegicus
gcccggctgagcagcccggacgacg

SEQ ID NO: 601746 - DNA, 25 bp, Rattus norvegicus
tcgagtcgcgttggtggtgcactca

SEQ ID NO: 601747 - DNA, 25 bp, Rattus norvegicus
cgctggagtgaggactcctggtttt

SEQ ID NO: 601748 - DNA, 25 bp, Rattus norvegicus
gtggtgccaatgactccgatcctgg

SEQ ID NO: 601749 - DNA, 25 bp, Rattus norvegicus
ggtgccaatgactccgatcctggca

SEQ ID NO: 601750 - DNA, 25 bp, Rattus norvegicus
ccgatcctggcagggggataacatc

SEQ ID NO: 601751 - DNA, 25 bp, Rattus norvegicus
ccgcagagagcaagtggtgccaatg

SEQ ID NO: 601752 - DNA, 25 bp, Rattus norvegicus
agagagcaagtggtgccaatgactc

SEQ ID NO: 601753 - DNA, 25 bp, Rattus norvegicus
caagtggtgccaatgactccgatcc

SEQ ID NO: 601754 - DNA, 25 bp, Rattus norvegicus
gggataacatctcagacgatgaaga

SEQ ID NO: 601755 - DNA, 25 bp, Rattus norvegicus
acgatgaagatgaggttcgagtcgc

SEQ ID NO: 601756 - DNA, 25 bp, Rattus norvegicus
cccatggttcctgcgggacgagaac

SEQ ID NO: 601757 - DNA, 25 bp, Rattus norvegicus
gttcctgcgggacgagaaccgcaga

SEQ ID NO: 601758 - DNA, 25 bp, Rattus norvegicus
cggaagcccatggttcctgcgggac

SEQ ID NO: 601759 - DNA, 25 bp, Rattus norvegicus
atcccggaagcccatggttcctgcg

SEQ ID NO: 601760 - DNA, 25 bp, Rattus norvegicus
agaaccgcagagagcaagtggtgcc

SEQ ID NO: 601761 - DNA, 25 bp, Rattus norvegicus
gaggccctcgccacacagacaaaag

SEQ ID NO: 601762 - DNA, 25 bp, Rattus norvegicus
tgagcctaggcatccacagcgctga

SEQ ID NO: 601763 - DNA, 25 bp, Rattus norvegicus
cgcagacgtgtcctacctggttcga

SEQ ID NO: 601764 - DNA, 25 bp, Rattus norvegicus
ttctaggacctgctgggctcgaagc

SEQ ID NO: 601765 - DNA, 25 bp, Rattus norvegicus
atgctcgtggctggtcaactccgtc

SEQ ID NO: 601766 - DNA, 25 bp, Rattus norvegicus
cagacgggaaactgagggcacctca

SEQ ID NO: 601767 - DNA, 25 bp, Rattus norvegicus
tggttcgattttcgcaggctccgca

SEQ ID NO: 601768 - DNA, 25 bp, Rattus norvegicus
tgcctagcgctgacagagctctgga

SEQ ID NO: 601769 - DNA, 25 bp, Rattus norvegicus
aaggccgctttccttgctcaggagg

SEQ ID NO: 601770 - DNA, 25 bp, Rattus norvegicus
tgctcaggaggaaggaaaaacttac

SEQ ID NO: 601771 - DNA, 25 bp, Rattus norvegicus
ccgaatctacagaagcagagaagta

SEQ ID NO: 601772 - DNA, 25 bp, Rattus norvegicus
acgccaggccgattgacggtgtaca

SEQ ID NO: 601773 - DNA, 25 bp, Rattus norvegicus
tgacggtgtacacccgccaagtcgc

SEQ ID NO: 601774 - DNA, 25 bp, Rattus norvegicus
agcacgtaacatggcggactctagg

SEQ ID NO: 601775 - DNA, 25 bp, Rattus norvegicus
cagggctcctccaggtggtgcccat

SEQ ID NO: 601776 - DNA, 25 bp, Rattus norvegicus
gggaacagctgatggccgtgcccac

SEQ ID NO: 601777 - DNA, 25 bp, Rattus norvegicus
cacaagagggaagaacccgccacgg

SEQ ID NO: 601778 - DNA, 25 bp, Rattus norvegicus
gcgcagacacaagagggaagaaccc

SEQ ID NO: 601779 - DNA, 25 bp, Rattus norvegicus
gacagtacagcgcagacacaagagg

SEQ ID NO: 601780 - DNA, 25 bp, Rattus norvegicus
tggtgcccatgtcgacagtacagcg

SEQ ID NO: 601781 - DNA, 25 bp, Rattus norvegicus
tgcaagccgcaaacgtccagggctc

SEQ ID NO: 601782 - DNA, 25 bp, Rattus norvegicus
aggcatagtgcaagccgcaaacgtc

SEQ ID NO: 601783 - DNA, 25 bp, Rattus norvegicus
gctaggccagcgaggcatagtgcaa

SEQ ID NO: 601784 - DNA, 25 bp, Rattus norvegicus
ttcacgtgcagtgcgtacagtgaga

SEQ ID NO: 601785 - DNA, 25 bp, Rattus norvegicus
gccgccttcacgtgcagtgcgtaca

SEQ ID NO: 601786 - DNA, 25 bp, Rattus norvegicus
gtaatcctcattgcgggcgcgcgcc

SEQ ID NO: 601787 - DNA, 25 bp, Rattus norvegicus
cagagcgcgcggtaatcctcattgc

SEQ ID NO: 601788 - DNA, 25 bp, Rattus norvegicus
atggccgtgcccacgtcgcagagcg

SEQ ID NO: 601789 - DNA, 25 bp, Rattus norvegicus
cccgccaggtctcgaaatcgtggag

SEQ ID NO: 601790 - DNA, 25 bp, Rattus norvegicus
ggctcccgggcagaaaatagtgttc

SEQ ID NO: 601791 - DNA, 25 bp, Rattus norvegicus
cgaaatcgtggagagagctgtcaga

SEQ ID NO: 601792 - DNA, 25 bp, Rattus norvegicus
ttcctggaagcgttctcgtgcgcca

SEQ ID NO: 601793 - DNA, 25 bp, Rattus norvegicus
tagcgccaggtctgaagcgaagttc

SEQ ID NO: 601794 - DNA, 25 bp, Rattus norvegicus
tcacgcgcgtcctcagctgcagtag

SEQ ID NO: 601795 - DNA, 25 bp, Rattus norvegicus
ggcacacagcactcggagccgcagt

SEQ ID NO: 601796 - DNA, 25 bp, Rattus norvegicus
ctgaggagcgtgcacattccgcata

SEQ ID NO: 601797 - DNA, 25 bp, Rattus norvegicus
gtgacaccaccagctgttcaacagc

SEQ ID NO: 601798 - DNA, 25 bp, Rattus norvegicus
ggccgtacaggcagtgacaccacca

SEQ ID NO: 601799 - DNA, 25 bp, Rattus norvegicus
tcctcctcctggtaggcggggcaaa

SEQ ID NO: 601800 - DNA, 25 bp, Rattus norvegicus
gatttccgcagcgagttcctgccgc

SEQ ID NO: 601801 - DNA, 25 bp, Rattus norvegicus
tcctggtcaggaccggatttccgca

SEQ ID NO: 601802 - DNA, 25 bp, Rattus norvegicus
gagccgcagtcaggttcacgcgcgt

SEQ ID NO: 601803 - DNA, 25 bp, Rattus norvegicus
tggcctccaccgtgatgcaggctca

SEQ ID NO: 601804 - DNA, 25 bp, Rattus norvegicus
gtcggagccccccacgatgcgggaa

SEQ ID NO: 601805 - DNA, 25 bp, Rattus norvegicus
cccacgatgcgggaagagggctcag

SEQ ID NO: 601806 - DNA, 25 bp, Rattus norvegicus
cgtttagcggtagagaacctggaca

SEQ ID NO: 601807 - DNA, 25 bp, Rattus norvegicus
cggtagagaacctggacaaagactg

SEQ ID NO: 601808 - DNA, 25 bp, Rattus norvegicus
agaacctggacaaagactgtactca

SEQ ID NO: 601809 - DNA, 25 bp, Rattus norvegicus
cctggacaaagactgtactcacgtc

SEQ ID NO: 601810 - DNA, 25 bp, Rattus norvegicus
gacaaagactgtactcacgtcacga

SEQ ID NO: 601811 - DNA, 25 bp, Rattus norvegicus
ctgtactcacgtcacgaaacagtga

SEQ ID NO: 601812 - DNA, 25 bp, Rattus norvegicus
acggccaagtgccaggatgcgcgtc

SEQ ID NO: 601813 - DNA, 25 bp, Rattus norvegicus
acgtcacgaaacagtgagcagcgga

SEQ ID NO: 601814 - DNA, 25 bp, Rattus norvegicus
cagatgtggcctccaccgtgatgca

SEQ ID NO: 601815 - DNA, 25 bp, Rattus norvegicus
cctgccacggccaagtgccaggatg

SEQ ID NO: 601816 - DNA, 25 bp, Rattus norvegicus
tgagcagcggagaggacccaggaag

SEQ ID NO: 601817 - DNA, 25 bp, Rattus norvegicus
gtcaatagtcccaacaggaagggtg

SEQ ID NO: 601818 - DNA, 25 bp, Rattus norvegicus
gtgcgcaagcccagatagagccacc

SEQ ID NO: 601819 - DNA, 25 bp, Rattus norvegicus
cctcagctagccgatgggtgcgcaa

SEQ ID NO: 601820 - DNA, 25 bp, Rattus norvegicus
agtgaaggcgggcaccacagctgcc

SEQ ID NO: 601821 - DNA, 25 bp, Rattus norvegicus
cgctgccatcttgggcgctagtgaa

SEQ ID NO: 601822 - DNA, 25 bp, Rattus norvegicus
ggaaccacggactgggcagtgtctc

SEQ ID NO: 601823 - DNA, 25 bp, Rattus norvegicus
ctatccgtggagttgccgcggaaaa

SEQ ID NO: 601824 - DNA, 25 bp, Rattus norvegicus
gcaagtccaggctacactatccgtg

SEQ ID NO: 601825 - DNA, 25 bp, Rattus norvegicus
ttaaggcgcgcccatccagccggaa

SEQ ID NO: 601826 - DNA, 25 bp, Rattus norvegicus
agcggcagctcattggtcaatagtc

SEQ ID NO: 601827 - DNA, 25 bp, Rattus norvegicus
cccgaaagcggcagctcattggtca

SEQ ID NO: 601828 - DNA, 25 bp, Rattus norvegicus
gaaatgggcataggccgcacgcgca

SEQ ID NO: 601829 - DNA, 25 bp, Rattus norvegicus
cctgcacatttaggaaatgggcata

SEQ ID NO: 601830 - DNA, 25 bp, Rattus norvegicus
ccatccagccggaagcaagtccagg

SEQ ID NO: 601831 - DNA, 25 bp, Rattus norvegicus
tgtgggtttttgtcgcgagaccctc

SEQ ID NO: 601832 - DNA, 25 bp, Rattus norvegicus
gcctcgctttgtcgcagtgctgcat

SEQ ID NO: 601833 - DNA, 25 bp, Rattus norvegicus
gagaccgggtcgtaccattctgccc

SEQ ID NO: 601834 - DNA, 25 bp, Rattus norvegicus
ggacggacgagagagagttaccaca

SEQ ID NO: 601835 - DNA, 25 bp, Rattus norvegicus
ctcctatcttcctggggtctctgta

SEQ ID NO: 601836 - DNA, 25 bp, Rattus norvegicus
tctctgtatcctcgggaagacctgg

SEQ ID NO: 601837 - DNA, 25 bp, Rattus norvegicus
ccttgcgccgttcgacttggtacgt

SEQ ID NO: 601838 - DNA, 25 bp, Rattus norvegicus
cgtcccttcgcagtcgtctggaatc

SEQ ID NO: 601839 - DNA, 25 bp, Rattus norvegicus
gtctggaatcctgttgcttggcggc

SEQ ID NO: 601840 - DNA, 25 bp, Rattus norvegicus
cgcggacatggcttcaaacggtatg

SEQ ID NO: 601841 - DNA, 25 bp, Rattus norvegicus
gttccctcgcagcaaggcttttgtg

SEQ ID NO: 601842 - DNA, 25 bp, Rattus norvegicus
cgcggagactgtgtgctttctctca

SEQ ID NO: 601843 - DNA, 25 bp, Rattus norvegicus
ctttctctcatggaccgttcacttg

SEQ ID NO: 601844 - DNA, 25 bp, Rattus norvegicus
agaccctcggcggaagacttctggt

SEQ ID NO: 601845 - DNA, 25 bp, Rattus norvegicus
ccatgtttgacgtgtgctggcacga

SEQ ID NO: 601846 - DNA, 25 bp, Rattus norvegicus
cgccagcaggagaagacacgtgcca

SEQ ID NO: 601847 - DNA, 25 bp, Rattus norvegicus
ccagttcgacaagacggtagcggta

SEQ ID NO: 601848 - DNA, 25 bp, Rattus norvegicus
tagtggcgaagcagctgctgtcaca

SEQ ID NO: 601849 - DNA, 25 bp, Rattus norvegicus
ctcggcctgcgcgatggcaagatcc

SEQ ID NO: 601850 - DNA, 25 bp, Rattus norvegicus
tggcaagatcctggaggcacacgtg

SEQ ID NO: 601851 - DNA, 25 bp, Rattus norvegicus
agagaggccaccagcgcgcattggc

SEQ ID NO: 601852 - DNA, 25 bp, Rattus norvegicus
gcgcattggcctctacctaagcttt

SEQ ID NO: 601853 - DNA, 25 bp, Rattus norvegicus
ctaagctttgcagatggcgtcctga

SEQ ID NO: 601854 - DNA, 25 bp, Rattus norvegicus
ggcgtcctgactttctatgatgcaa

SEQ ID NO: 601855 - DNA, 25 bp, Rattus norvegicus
gatgcaagcaacaccgacgcgctta

SEQ ID NO: 601856 - DNA, 25 bp, Rattus norvegicus
cttttcatgagcgtctgcctgggcc

SEQ ID NO: 601857 - DNA, 25 bp, Rattus norvegicus
acgacaagggcaagaattctcagcc

SEQ ID NO: 601858 - DNA, 25 bp, Rattus norvegicus
gacgcgcttacaccgctcttttctt

SEQ ID NO: 601859 - DNA, 25 bp, Rattus norvegicus
agtctggctttcagggcccttgatc

SEQ ID NO: 601860 - DNA, 25 bp, Rattus norvegicus
gcatgcattgcacgcgcctcttact

SEQ ID NO: 601861 - DNA, 25 bp, Rattus norvegicus
tgcactaagcttggcgccgactaca

SEQ ID NO: 601862 - DNA, 25 bp, Rattus norvegicus
aacagctcactcttcggcctgggag

SEQ ID NO: 601863 - DNA, 25 bp, Rattus norvegicus
cgtctgattcttggagcaacagctc

SEQ ID NO: 601864 - DNA, 25 bp, Rattus norvegicus
cttccagttccgctctctcagagta

SEQ ID NO: 601865 - DNA, 25 bp, Rattus norvegicus
tgccaagaaagtctgaacgtcgctg

SEQ ID NO: 601866 - DNA, 25 bp, Rattus norvegicus
cctgtcgggaacctagcacttttga

SEQ ID NO: 601867 - DNA, 25 bp, Rattus norvegicus
gcttagcgagaccttcctgtcggga

SEQ ID NO: 601868 - DNA, 25 bp, Rattus norvegicus
gaagcggcagcgaactttcccggta

SEQ ID NO: 601869 - DNA, 25 bp, Rattus norvegicus
aaggcgctcggttttctaaatgcca

SEQ ID NO: 601870 - DNA, 25 bp, Rattus norvegicus
tgcgactgtgcaagtacccgagttc

SEQ ID NO: 601871 - DNA, 25 bp, Rattus norvegicus
acggactcgctctcgttttgcctcg

SEQ ID NO: 601872 - DNA, 25 bp, Rattus norvegicus
ggacagccctaagactccacagtgg

SEQ ID NO: 601873 - DNA, 25 bp, Rattus norvegicus
cttatgttgcgaagttgcaggagtc

SEQ ID NO: 601874 - DNA, 25 bp, Rattus norvegicus
gataactacatctcggcactcagcg

SEQ ID NO: 601875 - DNA, 25 bp, Rattus norvegicus
tttctccttaggaatgcctcgcgcc

SEQ ID NO: 601876 - DNA, 25 bp, Rattus norvegicus
gccagggctgccaaggacccatttt

SEQ ID NO: 601877 - DNA, 25 bp, Rattus norvegicus
tctggcacccagactgcttcgtgtg

SEQ ID NO: 601878 - DNA, 25 bp, Rattus norvegicus
gcttcgctgattagtcgctccattt

SEQ ID NO: 601879 - DNA, 25 bp, Rattus norvegicus
cgctccatttctgtgcgacttatgt

SEQ ID NO: 601880 - DNA, 25 bp, Rattus norvegicus
ccctcgtcagggttttggctcattt

SEQ ID NO: 601881 - DNA, 25 bp, Rattus norvegicus
gcccttctccggaggcagcttcttt

SEQ ID NO: 601882 - DNA, 25 bp, Rattus norvegicus
cttctttgagcacgagggtcgccca

SEQ ID NO: 601883 - DNA, 25 bp, Rattus norvegicus
ggtcgcccactgtgtgaaaaccatt

SEQ ID NO: 601884 - DNA, 25 bp, Rattus norvegicus
gaaaaccatttccacgctcagcgtg

SEQ ID NO: 601885 - DNA, 25 bp, Rattus norvegicus
ctcagcgtggttcgttgtgtgccac

SEQ ID NO: 601886 - DNA, 25 bp, Rattus norvegicus
tgactggccgctgtgtatctgctct

SEQ ID NO: 601887 - DNA, 25 bp, Rattus norvegicus
actgcaggctcccatcggcagcagc

SEQ ID NO: 601888 - DNA, 25 bp, Rattus norvegicus
gtccaacgcggcaaaaagctagaca

SEQ ID NO: 601889 - DNA, 25 bp, Rattus norvegicus
cgcggcaaaaagctagacaaactac

SEQ ID NO: 601890 - DNA, 25 bp, Rattus norvegicus
agctagacaaactacgtacatttcc

SEQ ID NO: 601891 - DNA, 25 bp, Rattus norvegicus
actacgtacatttcctgtttggcta

SEQ ID NO: 601892 - DNA, 25 bp, Rattus norvegicus
gtacatttcctgtttggctacggtg

SEQ ID NO: 601893 - DNA, 25 bp, Rattus norvegicus
cgagtcggtccaacgcggcaaaaag

SEQ ID NO: 601894 - DNA, 25 bp, Rattus norvegicus
gcgaagctcagcgagtcggtccaac

SEQ ID NO: 601895 - DNA, 25 bp, Rattus norvegicus
ccgcaggctcgcagtgtcagccatc

SEQ ID NO: 601896 - DNA, 25 bp, Rattus norvegicus
tgctcggtgcatagcggcgcccgca

SEQ ID NO: 601897 - DNA, 25 bp, Rattus norvegicus
ccggagccgaattgctcggtgcata

SEQ ID NO: 601898 - DNA, 25 bp, Rattus norvegicus
catttcctgtttggctacggtggcc

SEQ ID NO: 601899 - DNA, 25 bp, Rattus norvegicus
ccgaattgctcggtgcatagcggcg

SEQ ID NO: 601900 - DNA, 25 bp, Rattus norvegicus
agcgctgagccctgtcccactgcag

SEQ ID NO: 601901 - DNA, 25 bp, Rattus norvegicus
cattatccacgaaggactccgcgta

SEQ ID NO: 601902 - DNA, 25 bp, Rattus norvegicus
atcttcagtttcagcttagggtagc

SEQ ID NO: 601903 - DNA, 25 bp, Rattus norvegicus
gggtctccgatctgcttgcacactt

SEQ ID NO: 601904 - DNA, 25 bp, Rattus norvegicus
gctgcacgcagcatgtcgctttctg

SEQ ID NO: 601905 - DNA, 25 bp, Rattus norvegicus
cacttccaggtcatcgtagccatta

SEQ ID NO: 601906 - DNA, 25 bp, Rattus norvegicus
ctcgccggctagtacccaagtgaca

SEQ ID NO: 601907 - DNA, 25 bp, Rattus norvegicus
tgacacggaccgcaccagttcttgc

SEQ ID NO: 601908 - DNA, 25 bp, Rattus norvegicus
ttgcaacttttaatcctctcgtgga

SEQ ID NO: 601909 - DNA, 25 bp, Rattus norvegicus
tctccgttagtggttaggctccggc

SEQ ID NO: 601910 - DNA, 25 bp, Rattus norvegicus
ctccggccgcagagtcaaagccatg

SEQ ID NO: 601911 - DNA, 25 bp, Rattus norvegicus
tgcacatggctgagactcggaactc

SEQ ID NO: 601912 - DNA, 25 bp, Rattus norvegicus
ctccgcgtactgagggagctgtaac

SEQ ID NO: 601913 - DNA, 25 bp, Rattus norvegicus
gctgtaacgctttcagccactcgta

SEQ ID NO: 601914 - DNA, 25 bp, Rattus norvegicus
gcgtctagcagcgaagtggattccc

SEQ ID NO: 601915 - DNA, 25 bp, Rattus norvegicus
cctggtggagtaacttatgctgtga

SEQ ID NO: 601916 - DNA, 25 bp, Rattus norvegicus
acgtatgcagtcgtacccaagggta

SEQ ID NO: 601917 - DNA, 25 bp, Rattus norvegicus
acagtgcccggcctctgtgacgtat

SEQ ID NO: 601918 - DNA, 25 bp, Rattus norvegicus
ccggcctctgtgacgtatgcagtcg

SEQ ID NO: 601919 - DNA, 25 bp, Rattus norvegicus
ggcctctgtgacgtatgcagtcgta

SEQ ID NO: 601920 - DNA, 25 bp, Rattus norvegicus
ctctgtgacgtatgcagtcgtaccc

SEQ ID NO: 601921 - DNA, 25 bp, Rattus norvegicus
gtgacgtatgcagtcgtacccaagg

SEQ ID NO: 601922 - DNA, 25 bp, Rattus norvegicus
tatgcagtcgtacccaagggtaccc

SEQ ID NO: 601923 - DNA, 25 bp, Rattus norvegicus
gctgtcccgggccaccagccaccat

SEQ ID NO: 601924 - DNA, 25 bp, Rattus norvegicus
accagccaccatgccctggtggagt

SEQ ID NO: 601925 - DNA, 25 bp, Rattus norvegicus
caccatgccctggtggagtaactta

SEQ ID NO: 601926 - DNA, 25 bp, Rattus norvegicus
ttatgctgtgagtagcgcgccccct

SEQ ID NO: 601927 - DNA, 25 bp, Rattus norvegicus
tgccctggtggagtaacttatgctg

SEQ ID NO: 601928 - DNA, 25 bp, Rattus norvegicus
ccatgccctggtggagtaacttatg

SEQ ID NO: 601929 - DNA, 25 bp, Rattus norvegicus
agtcgcttaccagacggcggccgct

SEQ ID NO: 601930 - DNA, 25 bp, Rattus norvegicus
gcgcgccggcacatattttaacttg

SEQ ID NO: 601931 - DNA, 25 bp, Rattus norvegicus
cctatggattccagcgccggctcaa

SEQ ID NO: 601932 - DNA, 25 bp, Rattus norvegicus
ctcccagccgggagacgtacagtgt

SEQ ID NO: 601933 - DNA, 25 bp, Rattus norvegicus
ccaggtctacccgattccgtgggcg

SEQ ID NO: 601934 - DNA, 25 bp, Rattus norvegicus
tgctcacgccgcgaatacccgggag

SEQ ID NO: 601935 - DNA, 25 bp, Rattus norvegicus
gaggcgtcaccagagtcccaagcca

SEQ ID NO: 601936 - DNA, 25 bp, Rattus norvegicus
acagacctgggagaacgctgccgga

SEQ ID NO: 601937 - DNA, 25 bp, Rattus norvegicus
agcctctgcggttccagagtggatc

SEQ ID NO: 601938 - DNA, 25 bp, Rattus norvegicus
tttaacttggacgacactcgggtgc

SEQ ID NO: 601939 - DNA, 25 bp, Rattus norvegicus
tgttcagtgtccctgccaggcccaa

SEQ ID NO: 601940 - DNA, 25 bp, Rattus norvegicus
acgacactcgggtgcagtctcagga

SEQ ID NO: 601941 - DNA, 25 bp, Rattus norvegicus
agtctcaggaggacctttgcgctca

SEQ ID NO: 601942 - DNA, 25 bp, Rattus norvegicus
tgcgctcaactaccggaatcctatg

SEQ ID NO: 601943 - DNA, 25 bp, Rattus norvegicus
ggagctgtccgggaagtaaactaca

SEQ ID NO: 601944 - DNA, 25 bp, Rattus norvegicus
ggtactcacagagtccggggctgtc

SEQ ID NO: 601945 - DNA, 25 bp, Rattus norvegicus
tgtccgtcgtcttccatcatggtgg

SEQ ID NO: 601946 - DNA, 25 bp, Rattus norvegicus
tactgaacccggctcttgggctcgc

SEQ ID NO: 601947 - DNA, 25 bp, Rattus norvegicus
ggacactgcgctccaaccaggagga

SEQ ID NO: 601948 - DNA, 25 bp, Rattus norvegicus
cctgtccggcaaaagtggctgaaga

SEQ ID NO: 601949 - DNA, 25 bp, Rattus norvegicus
gcctggccaaagagtacaccctacg

SEQ ID NO: 601950 - DNA, 25 bp, Rattus norvegicus
acaccctacgactggacacaacgga

SEQ ID NO: 601951 - DNA, 25 bp, Rattus norvegicus
ctgccctcagaactgctggtccgtg

SEQ ID NO: 601952 - DNA, 25 bp, Rattus norvegicus
ctgtagttcaaggaagacccagagc

SEQ ID NO: 601953 - DNA, 25 bp, Rattus norvegicus
aggatcgctcctagcatcttaaggc

SEQ ID NO: 601954 - DNA, 25 bp, Rattus norvegicus
ttggtccagtgtgagcttctgctcc

SEQ ID NO: 601955 - DNA, 25 bp, Rattus norvegicus
ccagagcggtttcttcaactgcgga

SEQ ID NO: 601956 - DNA, 25 bp, Rattus norvegicus
ccgcgaaatcaagtctctgggaatt

SEQ ID NO: 601957 - DNA, 25 bp, Rattus norvegicus
cctttggcagctaggaggctatttc

SEQ ID NO: 601958 - DNA, 25 bp, Rattus norvegicus
agatcaagatcgacccgcagaccgg

SEQ ID NO: 601959 - DNA, 25 bp, Rattus norvegicus
tggcccttcttcgtggaccacaaca

SEQ ID NO: 601960 - DNA, 25 bp, Rattus norvegicus
cctaaggtgagtggaactagacgtc

SEQ ID NO: 601961 - DNA, 25 bp, Rattus norvegicus
actagacgtcccacctcgacggtga

SEQ ID NO: 601962 - DNA, 25 bp, Rattus norvegicus
cagggctacgcgagtcacttcactc

SEQ ID NO: 601963 - DNA, 25 bp, Rattus norvegicus
tgcgccaggagagtccctaaccgta

SEQ ID NO: 601964 - DNA, 25 bp, Rattus norvegicus
cggtgacatcgggtggttttccaca

SEQ ID NO: 601965 - DNA, 25 bp, Rattus norvegicus
tggttttccacagcctcttgcgagg

SEQ ID NO: 601966 - DNA, 25 bp, Rattus norvegicus
ttcccggacacatcggctacacaga

SEQ ID NO: 601967 - DNA, 25 bp, Rattus norvegicus
cgccgcgattatagccgatgactca

SEQ ID NO: 601968 - DNA, 25 bp, Rattus norvegicus
ccgccaagttctctggatgggacca

SEQ ID NO: 601969 - DNA, 25 bp, Rattus norvegicus
tttaattcataaaggtgcccgcacc

SEQ ID NO: 601970 - DNA, 25 bp, Rattus norvegicus
ccagaagtttctagccggccagttg

SEQ ID NO: 601971 - DNA, 25 bp, Rattus norvegicus
ctgcaggcaaagaagggcggcacct

SEQ ID NO: 601972 - DNA, 25 bp, Rattus norvegicus
tgagccctgaacacggcggactgtc

SEQ ID NO: 601973 - DNA, 25 bp, Rattus norvegicus
ttcgccaggttctgatcgtgcgctc

SEQ ID NO: 601974 - DNA, 25 bp, Rattus norvegicus
cagctgcacgcactaccaggctgta

SEQ ID NO: 601975 - DNA, 25 bp, Rattus norvegicus
gccgagacccaggtgtgccatttca

SEQ ID NO: 601976 - DNA, 25 bp, Rattus norvegicus
acaggcataggcagctaaccacata

SEQ ID NO: 601977 - DNA, 25 bp, Rattus norvegicus
ggccgcgacacgaagcagtccacta

SEQ ID NO: 601978 - DNA, 25 bp, Rattus norvegicus
ggcggcacctcgaagccatacagta

SEQ ID NO: 601979 - DNA, 25 bp, Rattus norvegicus
accagctgagctacgtacacgcgca

SEQ ID NO: 601980 - DNA, 25 bp, Rattus norvegicus
ttggcagccacatcttccgttcgct

SEQ ID NO: 601981 - DNA, 25 bp, Rattus norvegicus
ggcgatggacagcatagcccaggta

SEQ ID NO: 601982 - DNA, 25 bp, Rattus norvegicus
acagtcttctcggttggccgcgaca

SEQ ID NO: 601983 - DNA, 25 bp, Rattus norvegicus
tagcccaggtacatgacagaaggtg

SEQ ID NO: 601984 - DNA, 25 bp, Rattus norvegicus
cccgagaggttgcattgagccctga

SEQ ID NO: 601985 - DNA, 25 bp, Rattus norvegicus
ccttggcgcgcactcttgtctaagt

SEQ ID NO: 601986 - DNA, 25 bp, Rattus norvegicus
atggagctctttcaggccaaggacc

SEQ ID NO: 601987 - DNA, 25 bp, Rattus norvegicus
ctctttcaggccaaggaccactaca

SEQ ID NO: 601988 - DNA, 25 bp, Rattus norvegicus
gccggcatggagctctttcaggcca

SEQ ID NO: 601989 - DNA, 25 bp, Rattus norvegicus
acttggggatgtcagctctggtcct

SEQ ID NO: 601990 - DNA, 25 bp, Rattus norvegicus
aggacgcctgcatcgctcctgggcg

SEQ ID NO: 601991 - DNA, 25 bp, Rattus norvegicus
ggaggaggacgcctgcatcgctcct

SEQ ID NO: 601992 - DNA, 25 bp, Rattus norvegicus
ctcggagtctcctcgaggcacgggc

SEQ ID NO: 601993 - DNA, 25 bp, Rattus norvegicus
tgtccgaccgtgttctcggccggcg

SEQ ID NO: 601994 - DNA, 25 bp, Rattus norvegicus
actcttgtctaagtgaggcgggaaa

SEQ ID NO: 601995 - DNA, 25 bp, Rattus norvegicus
ccctttttagtgcacctccagtatg

SEQ ID NO: 601996 - DNA, 25 bp, Rattus norvegicus
cacctccagtatgcggtgcctgggg

SEQ ID NO: 601997 - DNA, 25 bp, Rattus norvegicus
cctgggctgtccgaccgtgttctcg

SEQ ID NO: 601998 - DNA, 25 bp, Rattus norvegicus
ggtggttcctcggagtctcctcgag

SEQ ID NO: 601999 - DNA, 25 bp, Rattus norvegicus
gaagaagccttgcacgatcccgagc

SEQ ID NO: 602000 - DNA, 25 bp, Rattus norvegicus
ggagccaggccgtcaatcactgcca

SEQ ID NO: 602001 - DNA, 25 bp, Rattus norvegicus
aggggagatcgtcccagcctccact

SEQ ID NO: 602002 - DNA, 25 bp, Rattus norvegicus
aggaaggctactgtgcttgagtata

SEQ ID NO: 602003 - DNA, 25 bp, Rattus norvegicus
ccacttctcacaatggcgggaaatc

SEQ ID NO: 602004 - DNA, 25 bp, Rattus norvegicus
ccgcgctaccagagacctgggtgga

SEQ ID NO: 602005 - DNA, 25 bp, Rattus norvegicus
acggtgacgagtgtctcagagctgc

SEQ ID NO: 602006 - DNA, 25 bp, Rattus norvegicus
agatagggcaatcccggggccgcca

SEQ ID NO: 602007 - DNA, 25 bp, Rattus norvegicus
ggctcagccagtcttctccacaggg

SEQ ID NO: 602008 - DNA, 25 bp, Rattus norvegicus
agtatagtggtcaccgtgttcgcgc

SEQ ID NO: 602009 - DNA, 25 bp, Rattus norvegicus
tcagagctgctgtccagcgaccgga

SEQ ID NO: 602010 - DNA, 25 bp, Rattus norvegicus
ggacctctcgtgtctgcaggacccg

SEQ ID NO: 602011 - DNA, 25 bp, Rattus norvegicus
agccctcggcagtgattctcccgga

SEQ ID NO: 602012 - DNA, 25 bp, Rattus norvegicus
gccattttggagacgggtagagata

SEQ ID NO: 602013 - DNA, 25 bp, Rattus norvegicus
cctcgtcaggcactaacttactctt

SEQ ID NO: 602014 - DNA, 25 bp, Rattus norvegicus
caccttattgattttgggcgacgtc

SEQ ID NO: 602015 - DNA, 25 bp, Rattus norvegicus
gcttccctgctcttacccggaggta

SEQ ID NO: 602016 - DNA, 25 bp, Rattus norvegicus
tcctcggccacggagttcagtttca

SEQ ID NO: 602017 - DNA, 25 bp, Rattus norvegicus
accatggcggataggaaggctaacg

SEQ ID NO: 602018 - DNA, 25 bp, Rattus norvegicus
aatcggtcccttagtcgctgtcctg

SEQ ID NO: 602019 - DNA, 25 bp, Rattus norvegicus
ggcgacgtcagcttccggaagaaaa

SEQ ID NO: 602020 - DNA, 25 bp, Rattus norvegicus
attccagcggctggcctagtatcgc

SEQ ID NO: 602021 - DNA, 25 bp, Rattus norvegicus
ccctctatgttgtgattccagcggc

SEQ ID NO: 602022 - DNA, 25 bp, Rattus norvegicus
taggattcagaaccctcatcggcca

SEQ ID NO: 602023 - DNA, 25 bp, Rattus norvegicus
tctgcgatttcgagcgtcaaatagc

SEQ ID NO: 602024 - DNA, 25 bp, Rattus norvegicus
gtccggaacaactcagaatctgcga

SEQ ID NO: 602025 - DNA, 25 bp, Rattus norvegicus
ttcagtttcaacgtgcccttcatcc

SEQ ID NO: 602026 - DNA, 25 bp, Rattus norvegicus
gtctgaagccgattccaccttattg

SEQ ID NO: 602027 - DNA, 25 bp, Rattus norvegicus
tgcgagccctgctcttcggggtctt

SEQ ID NO: 602028 - DNA, 25 bp, Rattus norvegicus
ctgcttgcaagtgagcagggagttc

SEQ ID NO: 602029 - DNA, 25 bp, Rattus norvegicus
aagcagcactgcttgcaagtgagca

SEQ ID NO: 602030 - DNA, 25 bp, Rattus norvegicus
gaggctgggactcaacccttcccgc

SEQ ID NO: 602031 - DNA, 25 bp, Rattus norvegicus
tccctcaccgcccaggctccggaga

SEQ ID NO: 602032 - DNA, 25 bp, Rattus norvegicus
ctgccgctgcgggagctactctggc

SEQ ID NO: 602033 - DNA, 25 bp, Rattus norvegicus
agctactctggctgcaccatgcggg

SEQ ID NO: 602034 - DNA, 25 bp, Rattus norvegicus
tgagcagggagttcctgacgcgccc

SEQ ID NO: 602035 - DNA, 25 bp, Rattus norvegicus
agatcggggtgcgagccctgctctt

SEQ ID NO: 602036 - DNA, 25 bp, Rattus norvegicus
gctcttcggggtcttcgtgtaagta

SEQ ID NO: 602037 - DNA, 25 bp, Rattus norvegicus
ccagagccaagagtcgccggctgga

SEQ ID NO: 602038 - DNA, 25 bp, Rattus norvegicus
aagagagccagagccaagagtcgcc

SEQ ID NO: 602039 - DNA, 25 bp, Rattus norvegicus
cttcgtgtaagtagtggtgcaccgc

SEQ ID NO: 602040 - DNA, 25 bp, Rattus norvegicus
ccatgcgggagctggccattgagat

SEQ ID NO: 602041 - DNA, 25 bp, Rattus norvegicus
gactgtggcgcggacgcagctaccc

SEQ ID NO: 602042 - DNA, 25 bp, Rattus norvegicus
gaacttcaaagtgtcagcgcgcacc

SEQ ID NO: 602043 - DNA, 25 bp, Rattus norvegicus
tcaacgcgcacaacaaggcggcggt

SEQ ID NO: 602044 - DNA, 25 bp, Rattus norvegicus
cggggctctcaacgcgcacaacaag

SEQ ID NO: 602045 - DNA, 25 bp, Rattus norvegicus
cgcgcaccctcaccggggctctcaa

SEQ ID NO: 602046 - DNA, 25 bp, Rattus norvegicus
ttcaaagtgtcagcgcgcaccctca

SEQ ID NO: 602047 - DNA, 25 bp, Rattus norvegicus
accctacaccgtgaacttcaaagtg

SEQ ID NO: 602048 - DNA, 25 bp, Rattus norvegicus
gcgatgttaccctacaccgtgaact

SEQ ID NO: 602049 - DNA, 25 bp, Rattus norvegicus
cgcgtgtcgcttcctgcctggcggt

SEQ ID NO: 602050 - DNA, 25 bp, Rattus norvegicus
cagtgcttccggcagccggtcttgg

SEQ ID NO: 602051 - DNA, 25 bp, Rattus norvegicus
gcagctacccggactttggaacgga

SEQ ID NO: 602052 - DNA, 25 bp, Rattus norvegicus
gccgcgatgttaccctacaccgtga

SEQ ID NO: 602053 - DNA, 25 bp, Rattus norvegicus
ccggactttggaacggaagagctgc

SEQ ID NO: 602054 - DNA, 25 bp, Rattus norvegicus
aacggaagagctgcgcgtgtcgctt

SEQ ID NO: 602055 - DNA, 25 bp, Rattus norvegicus
gcgttcggtacgacgattaccttga

SEQ ID NO: 602056 - DNA, 25 bp, Rattus norvegicus
tgaacactcgcagcgctcaggaacg

SEQ ID NO: 602057 - DNA, 25 bp, Rattus norvegicus
aactttgctggcgagtggtgaacac

SEQ ID NO: 602058 - DNA, 25 bp, Rattus norvegicus
tggcgttgcctactccaaactttgc

SEQ ID NO: 602059 - DNA, 25 bp, Rattus norvegicus
gccctcggatctgggcagcagcaga

SEQ ID NO: 602060 - DNA, 25 bp, Rattus norvegicus
taccttgaatggcagcgctcctctg

SEQ ID NO: 602061 - DNA, 25 bp, Rattus norvegicus
ccggcggcagagacagatgtcagca

SEQ ID NO: 602062 - DNA, 25 bp, Rattus norvegicus
tgagctcaaaggaacgcgcccagta

SEQ ID NO: 602063 - DNA, 25 bp, Rattus norvegicus
gaacctccgcctatgggctgtgcca

SEQ ID NO: 602064 - DNA, 25 bp, Rattus norvegicus
ctgtgtagtaccaggctggagcttc

SEQ ID NO: 602065 - DNA, 25 bp, Rattus norvegicus
agaacctctcccaagggtctgtgta

SEQ ID NO: 602066 - DNA, 25 bp, Rattus norvegicus
tccctttggggatgttgcctgacac

SEQ ID NO: 602067 - DNA, 25 bp, Rattus norvegicus
caaaggtgtcatccgggcatctcca

SEQ ID NO: 602068 - DNA, 25 bp, Rattus norvegicus
aggcgatgagctcggaggaaaactc

SEQ ID NO: 602069 - DNA, 25 bp, Rattus norvegicus
ctgagggcagctttccgctatttcc

SEQ ID NO: 602070 - DNA, 25 bp, Rattus norvegicus
agtagccggccttcagccctttgta

SEQ ID NO: 602071 - DNA, 25 bp, Rattus norvegicus
tttgtattccaccaccgaggccatg

SEQ ID NO: 602072 - DNA, 25 bp, Rattus norvegicus
ccctggactcgcaatagccgcagta

SEQ ID NO: 602073 - DNA, 25 bp, Rattus norvegicus
cgctatttccgttcttcctcggtga

SEQ ID NO: 602074 - DNA, 25 bp, Rattus norvegicus
ccatgggagcgactgccaaagttgc

SEQ ID NO: 602075 - DNA, 25 bp, Rattus norvegicus
aaggacctgacaccctacgtgattg

SEQ ID NO: 602076 - DNA, 25 bp, Rattus norvegicus
gaagatcgcgcgaagccactcgagc

SEQ ID NO: 602077 - DNA, 25 bp, Rattus norvegicus
agttctacgcagctgccgctatctc

SEQ ID NO: 602078 - DNA, 25 bp, Rattus norvegicus
tactctacaaggctgggcgaaggcg

SEQ ID NO: 602079 - DNA, 25 bp, Rattus norvegicus
ggtctggccctcaaaatactctaca

SEQ ID NO: 602080 - DNA, 25 bp, Rattus norvegicus
gttgctcttgcaatagccacactgg

SEQ ID NO: 602081 - DNA, 25 bp, Rattus norvegicus
tacggccacctaagtctctcgcaga

SEQ ID NO: 602082 - DNA, 25 bp, Rattus norvegicus
cctgctaggacggagcaaaatcctg

SEQ ID NO: 602083 - DNA, 25 bp, Rattus norvegicus
ggaatcggagatgtgctgcagctca

SEQ ID NO: 602084 - DNA, 25 bp, Rattus norvegicus
ggccgcagatcgtgcactcgtactt

SEQ ID NO: 602085 - DNA, 25 bp, Rattus norvegicus
gtgcactcgtacttgcgcctcttca

SEQ ID NO: 602086 - DNA, 25 bp, Rattus norvegicus
tgcctgctccaggttgtcgatgtcc

SEQ ID NO: 602087 - DNA, 25 bp, Rattus norvegicus
ccaggttgtcgatgtccgcaatgtc

SEQ ID NO: 602088 - DNA, 25 bp, Rattus norvegicus
gtgtctccgactgttgctgcccatc

SEQ ID NO: 602089 - DNA, 25 bp, Rattus norvegicus
ttccagagcatccttgcccaggtcg

SEQ ID NO: 602090 - DNA, 25 bp, Rattus norvegicus
ctgcagctcactgtcgctgatcatc

SEQ ID NO: 602091 - DNA, 25 bp, Rattus norvegicus
tccggtacttccagagcatccttgc

SEQ ID NO: 602092 - DNA, 25 bp, Rattus norvegicus
cccaggtcggctgcattgctgcaga

SEQ ID NO: 602093 - DNA, 25 bp, Rattus norvegicus
cccggtgtggatctgcaggtgctcc

SEQ ID NO: 602094 - DNA, 25 bp, Rattus norvegicus
tctgcaggtgctcccgcaggctgct

SEQ ID NO: 602095 - DNA, 25 bp, Rattus norvegicus
tcgatgtccgcaatgtctgagggcg

SEQ ID NO: 602096 - DNA, 25 bp, Rattus norvegicus
cattgctgcagagcgacaggggccc

SEQ ID NO: 602097 - DNA, 25 bp, Rattus norvegicus
cgccaccttacgttggacggagttg

SEQ ID NO: 602098 - DNA, 25 bp, Rattus norvegicus
ggaagttcgcgccagaaactgaaac

SEQ ID NO: 602099 - DNA, 25 bp, Rattus norvegicus
gccttgcaacttcggagcggcggaa

SEQ ID NO: 602100 - DNA, 25 bp, Rattus norvegicus
agacatcgcgccaattcgccttgca

SEQ ID NO: 602101 - DNA, 25 bp, Rattus norvegicus
tcggtgtcctccaagctcgggcgct

SEQ ID NO: 602102 - DNA, 25 bp, Rattus norvegicus
cgcctgaatcagacggctcggtgtc

SEQ ID NO: 602103 - DNA, 25 bp, Rattus norvegicus
cgggtccatcagctcgtcgcctgaa

SEQ ID NO: 602104 - DNA, 25 bp, Rattus norvegicus
gtactcggcctccaagcaggccggg

SEQ ID NO: 602105 - DNA, 25 bp, Rattus norvegicus
cgcctagggtgcacttaataaacaa

SEQ ID NO: 602106 - DNA, 25 bp, Rattus norvegicus
tactgatggcggatctggcggcaca

SEQ ID NO: 602107 - DNA, 25 bp, Rattus norvegicus
taataaacaagcgaaggcgcgccgc

SEQ ID NO: 602108 - DNA, 25 bp, Rattus norvegicus
cgcgcgagagcacagcgacgcctgt

SEQ ID NO: 602109 - DNA, 25 bp, Rattus norvegicus
cggcacaggccctggtcgtactcgg

SEQ ID NO: 602110 - DNA, 25 bp, Rattus norvegicus
ccaaggtcgcctagggtgcacttaa

SEQ ID NO: 602111 - DNA, 25 bp, Rattus norvegicus
tgcgtttcctgggtccacccgcgtg

SEQ ID NO: 602112 - DNA, 25 bp, Rattus norvegicus
ttggccgccagacaaagccgtgcca

SEQ ID NO: 602113 - DNA, 25 bp, Rattus norvegicus
accttggccgccagacaaagccgtg

SEQ ID NO: 602114 - DNA, 25 bp, Rattus norvegicus
tcccgggtaagtgcgcagtggccac

SEQ ID NO: 602115 - DNA, 25 bp, Rattus norvegicus
cgatcatcccgggtaagtgcgcagt

SEQ ID NO: 602116 - DNA, 25 bp, Rattus norvegicus
tacgtgagggccagccccgatcatc

SEQ ID NO: 602117 - DNA, 25 bp, Rattus norvegicus
cgccaggctcggaggactcagcctg

SEQ ID NO: 602118 - DNA, 25 bp, Rattus norvegicus
tgctgtaacttttcccgagcctttc

SEQ ID NO: 602119 - DNA, 25 bp, Rattus norvegicus
tggccttttgtgctgtaacttttcc

SEQ ID NO: 602120 - DNA, 25 bp, Rattus norvegicus
ccagtcattggccttttgtgctgta

SEQ ID NO: 602121 - DNA, 25 bp, Rattus norvegicus
agcgctctcccagtcattggccttt

SEQ ID NO: 602122 - DNA, 25 bp, Rattus norvegicus
gcagcacattcctggccggggagga

SEQ ID NO: 602123 - DNA, 25 bp, Rattus norvegicus
ggctccctagcctgcgggtgcgctt

SEQ ID NO: 602124 - DNA, 25 bp, Rattus norvegicus
aggctcggaggactcagcctgtccg

SEQ ID NO: 602125 - DNA, 25 bp, Rattus norvegicus
cgagaaagagcgcagactaggctca

SEQ ID NO: 602126 - DNA, 25 bp, Rattus norvegicus
cgcagcgttgctgcgcaggcgtact

SEQ ID NO: 602127 - DNA, 25 bp, Rattus norvegicus
ttccaccaagagatagccgcaggtc

SEQ ID NO: 602128 - DNA, 25 bp, Rattus norvegicus
gactcgtcacttccaccaagagata

SEQ ID NO: 602129 - DNA, 25 bp, Rattus norvegicus
cgcaaagcgtcagcgccggtcactt

SEQ ID NO: 602130 - DNA, 25 bp, Rattus norvegicus
gcgcagaccgagtacgcaaagcgtc

SEQ ID NO: 602131 - DNA, 25 bp, Rattus norvegicus
acataccggagtgccgcagagctgc

SEQ ID NO: 602132 - DNA, 25 bp, Rattus norvegicus
agggaccgcccgcaggactacgtca

SEQ ID NO: 602133 - DNA, 25 bp, Rattus norvegicus
aggcaaccagatgtcagcgcactca

SEQ ID NO: 602134 - DNA, 25 bp, Rattus norvegicus
agtcccgctccggaggcaaccagat

SEQ ID NO: 602135 - DNA, 25 bp, Rattus norvegicus
caagggaaacatgcggccgcaagtc

SEQ ID NO: 602136 - DNA, 25 bp, Rattus norvegicus
acagagtcactggagacggcacgca

SEQ ID NO: 602137 - DNA, 25 bp, Rattus norvegicus
ttgcccatccctgtcgtctggggtc

SEQ ID NO: 602138 - DNA, 25 bp, Rattus norvegicus
ggcgtactgcactgttttcccaatg

SEQ ID NO: 602139 - DNA, 25 bp, Rattus norvegicus
gcgggacatacaacttagactttga

SEQ ID NO: 602140 - DNA, 25 bp, Rattus norvegicus
aggaaatccaccgagtccgtgccac

SEQ ID NO: 602141 - DNA, 25 bp, Rattus norvegicus
gtcgtggttcccgatggccctcgca

SEQ ID NO: 602142 - DNA, 25 bp, Rattus norvegicus
agcgagtccgtggaaggaagccctt

SEQ ID NO: 602143 - DNA, 25 bp, Rattus norvegicus
cctcggcggtgttcgatgaagacaa

SEQ ID NO: 602144 - DNA, 25 bp, Rattus norvegicus
tgaagacaagccgatagccagcagc

SEQ ID NO: 602145 - DNA, 25 bp, Rattus norvegicus
agccagcagcgggacatacaactta

SEQ ID NO: 602146 - DNA, 25 bp, Rattus norvegicus
cttagactttgacagcatcgagctg

SEQ ID NO: 602147 - DNA, 25 bp, Rattus norvegicus
gctggtggataactttcagagtttg

SEQ ID NO: 602148 - DNA, 25 bp, Rattus norvegicus
gtttggagccatgctctgccgacta

SEQ ID NO: 602149 - DNA, 25 bp, Rattus norvegicus
gcatcgagctggtggataactttca

SEQ ID NO: 602150 - DNA, 25 bp, Rattus norvegicus
tgagcacgcggaggaaatccaccga

SEQ ID NO: 602151 - DNA, 25 bp, Rattus norvegicus
gccagcgacttcgacggtgcttcgt

SEQ ID NO: 602152 - DNA, 25 bp, Rattus norvegicus
gctctgccgactataagggtcagga

SEQ ID NO: 602153 - DNA, 25 bp, Rattus norvegicus
agccgagcctcgtggtcctcgaaaa

SEQ ID NO: 602154 - DNA, 25 bp, Rattus norvegicus
agttccacgtcccaagccgagcctc

SEQ ID NO: 602155 - DNA, 25 bp, Rattus norvegicus
tcgtggtcctcgaaaacttcaagcc

SEQ ID NO: 602156 - DNA, 25 bp, Rattus norvegicus
acgcccgattcctttgcccgccacg

SEQ ID NO: 602157 - DNA, 25 bp, Rattus norvegicus
gagcctgtcgggacttgtagtgttc

SEQ ID NO: 602158 - DNA, 25 bp, Rattus norvegicus
acttgtagtgttcgccgttgggagt

SEQ ID NO: 602159 - DNA, 25 bp, Rattus norvegicus
ctcagtcgctgtctggtcgggtaga

SEQ ID NO: 602160 - DNA, 25 bp, Rattus norvegicus
cgctccgggcagctgagtgcctgaa

SEQ ID NO: 602161 - DNA, 25 bp, Rattus norvegicus
ggctcacagtccctagcgtcctcgc

SEQ ID NO: 602162 - DNA, 25 bp, Rattus norvegicus
cccgccgctcgatcccgcatagccc

SEQ ID NO: 602163 - DNA, 25 bp, Rattus norvegicus
cgcgagccaacaccctggaactagg

SEQ ID NO: 602164 - DNA, 25 bp, Rattus norvegicus
ttcaagccccaggatgcagcgcggc

SEQ ID NO: 602165 - DNA, 25 bp, Rattus norvegicus
ctggaactaggaagacgcccgattc

SEQ ID NO: 602166 - DNA, 25 bp, Rattus norvegicus
ggagtgcccgctccggaatctcagt

SEQ ID NO: 602167 - DNA, 25 bp, Rattus norvegicus
ggagtcgccatgcagttcctgcgta

SEQ ID NO: 602168 - DNA, 25 bp, Rattus norvegicus
ttccctctgctaagtggtcactttg

SEQ ID NO: 602169 - DNA, 25 bp, Rattus norvegicus
gctggacgacctgggaactttccca

SEQ ID NO: 602170 - DNA, 25 bp, Rattus norvegicus
ggaactttcccaagcgatcgcgcgc

SEQ ID NO: 602171 - DNA, 25 bp, Rattus norvegicus
gcccggcaggtttccctctgctaag

SEQ ID NO: 602172 - DNA, 25 bp, Rattus norvegicus
gacgtacaccaacctgtgccagctg

SEQ ID NO: 602173 - DNA, 25 bp, Rattus norvegicus
agcgcggattttcggctgtggtcca

SEQ ID NO: 602174 - DNA, 25 bp, Rattus norvegicus
ggcagcgacgccaagacgtacacca

SEQ ID NO: 602175 - DNA, 25 bp, Rattus norvegicus
gctcctgtctttgctactgctgctg

SEQ ID NO: 602176 - DNA, 25 bp, Rattus norvegicus
gccacagtacgacggcgcgcacagg

SEQ ID NO: 602177 - DNA, 25 bp, Rattus norvegicus
ggctgcaatgcgtagtgcccttcgg

SEQ ID NO: 602178 - DNA, 25 bp, Rattus norvegicus
tcaccgccgctaggccaatgggctt

SEQ ID NO: 602179 - DNA, 25 bp, Rattus norvegicus
tctgtccggagcactgcgatcctac

SEQ ID NO: 602180 - DNA, 25 bp, Rattus norvegicus
gccaatgggcttgaccgtacggcct

SEQ ID NO: 602181 - DNA, 25 bp, Rattus norvegicus
ccagcagctgctcgaagtccaagtc

SEQ ID NO: 602182 - DNA, 25 bp, Rattus norvegicus
tcagcagcgtgactgtcatccggcc

SEQ ID NO: 602183 - DNA, 25 bp, Rattus norvegicus
cagctgctcgaagtccaagtcttgg

SEQ ID NO: 602184 - DNA, 25 bp, Rattus norvegicus
caagtcttgggcacgtggcccagtc

SEQ ID NO: 602185 - DNA, 25 bp, Rattus norvegicus
gcacaccactgacccgcagcctcgc

SEQ ID NO: 602186 - DNA, 25 bp, Rattus norvegicus
cagtccgggtaagaaatagactttg

SEQ ID NO: 602187 - DNA, 25 bp, Rattus norvegicus
ccgccgtcagcagcgtgactgtcat

SEQ ID NO: 602188 - DNA, 25 bp, Rattus norvegicus
gcacgtggcccagtccgggtaagaa

SEQ ID NO: 602189 - DNA, 25 bp, Rattus norvegicus
ggtaagaaatagactttgggtcagc

SEQ ID NO: 602190 - DNA, 25 bp, Rattus norvegicus
cacgccgcatcccaggacgaggtta

SEQ ID NO: 602191 - DNA, 25 bp, Rattus norvegicus
tcccaggacgaggttagcgtcggtc

SEQ ID NO: 602192 - DNA, 25 bp, Rattus norvegicus
ggtccagtcccgcatcttcgatcgc

SEQ ID NO: 602193 - DNA, 25 bp, Rattus norvegicus
acctccaagcactgccgccctccgc

SEQ ID NO: 602194 - DNA, 25 bp, Rattus norvegicus
gcagcctcgcccacctccaagcact

SEQ ID NO: 602195 - DNA, 25 bp, Rattus norvegicus
gcctaagctgggactgtgcgtcctc

SEQ ID NO: 602196 - DNA, 25 bp, Rattus norvegicus
actgcgcgtgcgcaccgggcgcaaa

SEQ ID NO: 602197 - DNA, 25 bp, Rattus norvegicus
caccgggcgcaaaggttcctggaga

SEQ ID NO: 602198 - DNA, 25 bp, Rattus norvegicus
aaggttcctggagaccgcatcaagg

SEQ ID NO: 602199 - DNA, 25 bp, Rattus norvegicus
ccgcatcaagggcatgagaaccgca

SEQ ID NO: 602200 - DNA, 25 bp, Rattus norvegicus
agggcatgagaaccgcagcaggtta

SEQ ID NO: 602201 - DNA, 25 bp, Rattus norvegicus
ctactcacagcgacgggcggcctaa

SEQ ID NO: 602202 - DNA, 25 bp, Rattus norvegicus
actgtgcgtcctctgcggcttgccg

SEQ ID NO: 602203 - DNA, 25 bp, Rattus norvegicus
gcggccggaaagtcgacttttgctc

SEQ ID NO: 602204 - DNA, 25 bp, Rattus norvegicus
gacttttgctcgtgctctggctctg

SEQ ID NO: 602205 - DNA, 25 bp, Rattus norvegicus
cgtgctctggctctgcggttgcagc

SEQ ID NO: 602206 - DNA, 25 bp, Rattus norvegicus
gtagccgtcctctcctatgacgatg

SEQ ID NO: 602207 - DNA, 25 bp, Rattus norvegicus
tatgacgatgtgctgcctcttgcgc

SEQ ID NO: 602208 - DNA, 25 bp, Rattus norvegicus
gcagcaggttatggggctactcaca

SEQ ID NO: 602209 - DNA, 25 bp, Rattus norvegicus
ggcccgcaatgaagccggcacttta

SEQ ID NO: 602210 - DNA, 25 bp, Rattus norvegicus
gccatatttgttgtgtctccgctcc

SEQ ID NO: 602211 - DNA, 25 bp, Rattus norvegicus
gtcgcagctgtagccgccatatttg

SEQ ID NO: 602212 - DNA, 25 bp, Rattus norvegicus
ctcagcgttcgtcagcgtcgcagct

SEQ ID NO: 602213 - DNA, 25 bp, Rattus norvegicus
ctcctgacaactgcaccgaggaatc

SEQ ID NO: 602214 - DNA, 25 bp, Rattus norvegicus
cgccgtggaagctgatatcccatta

SEQ ID NO: 602215 - DNA, 25 bp, Rattus norvegicus
ccattccgtcaacgtgccatgcgta

SEQ ID NO: 602216 - DNA, 25 bp, Rattus norvegicus
acgccttgcccaagtctcgcgtgag

SEQ ID NO: 602217 - DNA, 25 bp, Rattus norvegicus
aaggcggtgttagccggcccgcaat

SEQ ID NO: 602218 - DNA, 25 bp, Rattus norvegicus
accctccgctgtggccaaggctaag

SEQ ID NO: 602219 - DNA, 25 bp, Rattus norvegicus
aagtaccgagtcaccacgctgccag

SEQ ID NO: 602220 - DNA, 25 bp, Rattus norvegicus
gggcggcggacccagacatctacaa

SEQ ID NO: 602221 - DNA, 25 bp, Rattus norvegicus
tacaagctcaagaaagtaccgagtc

SEQ ID NO: 602222 - DNA, 25 bp, Rattus norvegicus
gtgccatgcgtaaccgtagcgccgc

SEQ ID NO: 602223 - DNA, 25 bp, Rattus norvegicus
agttccgtttatggtctgatttccg

SEQ ID NO: 602224 - DNA, 25 bp, Rattus norvegicus
tttccgggaaaagtggcctccagca

SEQ ID NO: 602225 - DNA, 25 bp, Rattus norvegicus
ggaatccaatcccacttgctgagaa

SEQ ID NO: 602226 - DNA, 25 bp, Rattus norvegicus
atctttcctgcgtgctgggctacga

SEQ ID NO: 602227 - DNA, 25 bp, Rattus norvegicus
tggttaacttccttccgcctctagc

SEQ ID NO: 602228 - DNA, 25 bp, Rattus norvegicus
gcctgacacctgcaaacccgagttt

SEQ ID NO: 602229 - DNA, 25 bp, Rattus norvegicus
ctgcagttacgggatgcctgacacc

SEQ ID NO: 602230 - DNA, 25 bp, Rattus norvegicus
ccagggctggtgtcactgcagttac

SEQ ID NO: 602231 - DNA, 25 bp, Rattus norvegicus
cagaggtttgcattgcccgcgcact

SEQ ID NO: 602232 - DNA, 25 bp, Rattus norvegicus
ctttgagatcccagcgcagaggttt

SEQ ID NO: 602233 - DNA, 25 bp, Rattus norvegicus
tctcgcaggtgggagacctggcctt

SEQ ID NO: 602234 - DNA, 25 bp, Rattus norvegicus
cgccgcagccaaaggtgccctggag

SEQ ID NO: 602235 - DNA, 25 bp, Rattus norvegicus
ggaacctgctcaacggagaccatca

SEQ ID NO: 602236 - DNA, 25 bp, Rattus norvegicus
cgttctccatcaggaacctgctcaa

SEQ ID NO: 602237 - DNA, 25 bp, Rattus norvegicus
agcaggacgcacaaattgtatttca

SEQ ID NO: 602238 - DNA, 25 bp, Rattus norvegicus
atggggcttaggagcttgtgccatg

SEQ ID NO: 602239 - DNA, 25 bp, Rattus norvegicus
caaattgtatttcagcgccgggtcc

SEQ ID NO: 602240 - DNA, 25 bp, Rattus norvegicus
aattgtatttcagcgccgggtcctt

SEQ ID NO: 602241 - DNA, 25 bp, Rattus norvegicus
gggtccttccgggttaatgagctga

SEQ ID NO: 602242 - DNA, 25 bp, Rattus norvegicus
tccttccgggttaatgagctgacac

SEQ ID NO: 602243 - DNA, 25 bp, Rattus norvegicus
ccgggttaatgagctgacaccatga

SEQ ID NO: 602244 - DNA, 25 bp, Rattus norvegicus
ccatgattaaagctgaccatttgta

SEQ ID NO: 602245 - DNA, 25 bp, Rattus norvegicus
gaccatttgtaatgtgtctcgaccc

SEQ ID NO: 602246 - DNA, 25 bp, Rattus norvegicus
ccgccgagccctgaagaggttaatg

SEQ ID NO: 602247 - DNA, 25 bp, Rattus norvegicus
cctgaagaggttaatgcggtgacga

SEQ ID NO: 602248 - DNA, 25 bp, Rattus norvegicus
ttaatgcggtgacgaaggccggcac

SEQ ID NO: 602249 - DNA, 25 bp, Rattus norvegicus
gctgacaccatgattaaagctgacc

SEQ ID NO: 602250 - DNA, 25 bp, Rattus norvegicus
ctggacccgctgtgatggggcttag

SEQ ID NO: 602251 - DNA, 25 bp, Rattus norvegicus
cgctttttctcttgcgcacttggga

SEQ ID NO: 602252 - DNA, 25 bp, Rattus norvegicus
tggccagggcaccaaataaagtttc

SEQ ID NO: 602253 - DNA, 25 bp, Rattus norvegicus
cgcaagcgcactaaaagcctcaggc

SEQ ID NO: 602254 - DNA, 25 bp, Rattus norvegicus
cagctgggacacgtgactgcctgaa

SEQ ID NO: 602255 - DNA, 25 bp, Rattus norvegicus
actgcctgaacacgtgaccactttg

SEQ ID NO: 602256 - DNA, 25 bp, Rattus norvegicus
tcctctagagcttccgctcgcgtag

SEQ ID NO: 602257 - DNA, 25 bp, Rattus norvegicus
cgcgtagccggaagtcctttgcatc

SEQ ID NO: 602258 - DNA, 25 bp, Rattus norvegicus
tttgcatcccatgctctgtccctgg

SEQ ID NO: 602259 - DNA, 25 bp, Rattus norvegicus
tttctgagttcaaaagcgcttttta

SEQ ID NO: 602260 - DNA, 25 bp, Rattus norvegicus
tccaacgctttctttctgggctccg

SEQ ID NO: 602261 - DNA, 25 bp, Rattus norvegicus
tttctctccgctcaggacgtggggt

SEQ ID NO: 602262 - DNA, 25 bp, Rattus norvegicus
gcacttgggagaaaatccggtgttg

SEQ ID NO: 602263 - DNA, 25 bp, Rattus norvegicus
tgctcgatcttcaggctgagagttc

SEQ ID NO: 602264 - DNA, 25 bp, Rattus norvegicus
ctgggctccgtagccgttaccgttg

SEQ ID NO: 602265 - DNA, 25 bp, Rattus norvegicus
atgcgggtccgctactaaacgtgct

SEQ ID NO: 602266 - DNA, 25 bp, Rattus norvegicus
atttcttatgaacccaggatgggca

SEQ ID NO: 602267 - DNA, 25 bp, Rattus norvegicus
gccgctgtcctcgtttctggagaga

SEQ ID NO: 602268 - DNA, 25 bp, Rattus norvegicus
aaggctggaaggctccggcttgcta

SEQ ID NO: 602269 - DNA, 25 bp, Rattus norvegicus
tttctggagagacagggttgagaca

SEQ ID NO: 602270 - DNA, 25 bp, Rattus norvegicus
gttgagacaaggaatacaggcgaca

SEQ ID NO: 602271 - DNA, 25 bp, Rattus norvegicus
ggcgacaatctaagctgccttcagc

SEQ ID NO: 602272 - DNA, 25 bp, Rattus norvegicus
tcttggtttcctccgatttcttatg

SEQ ID NO: 602273 - DNA, 25 bp, Rattus norvegicus
accatccagtccatcctgggcgggg

SEQ ID NO: 602274 - DNA, 25 bp, Rattus norvegicus
ggtggccagccaggaaacgcagctt

SEQ ID NO: 602275 - DNA, 25 bp, Rattus norvegicus
aacgcagcttgtctgtgtcctcgga

SEQ ID NO: 602276 - DNA, 25 bp, Rattus norvegicus
ccttgcctgggtaaggatcgcacgt

SEQ ID NO: 602277 - DNA, 25 bp, Rattus norvegicus
cccttaacctctatgcaaatgaggc

SEQ ID NO: 602278 - DNA, 25 bp, Rattus norvegicus
ctactaaacgtgctccgggagcttc

SEQ ID NO: 602279 - DNA, 25 bp, Rattus norvegicus
ttcccacctatcgagtaacattctg

SEQ ID NO: 602280 - DNA, 25 bp, Rattus norvegicus
aggggacttcccgacatctgtgtcg

SEQ ID NO: 602281 - DNA, 25 bp, Rattus norvegicus
ccggcgcttgcaggacatctgggtt

SEQ ID NO: 602282 - DNA, 25 bp, Rattus norvegicus
ttgtggtggaggattgtcatctaca

SEQ ID NO: 602283 - DNA, 25 bp, Rattus norvegicus
catctacagtgacgggtttcttttg

SEQ ID NO: 602284 - DNA, 25 bp, Rattus norvegicus
gcgtggttcggcttcaatttcccac

SEQ ID NO: 602285 - DNA, 25 bp, Rattus norvegicus
cggcttcaatttcccacctatcgag

SEQ ID NO: 602286 - DNA, 25 bp, Rattus norvegicus
cgagtaacattctgcactgcgagtc

SEQ ID NO: 602287 - DNA, 25 bp, Rattus norvegicus
ctacgaggtctctcccatgataagg

SEQ ID NO: 602288 - DNA, 25 bp, Rattus norvegicus
ctcccatgataaggtggcggccgca

SEQ ID NO: 602289 - DNA, 25 bp, Rattus norvegicus
cgtgtcttgggtgccggcaacaacc

SEQ ID NO: 602290 - DNA, 25 bp, Rattus norvegicus
ccatcactgaggagtaaatgggagg

SEQ ID NO: 602291 - DNA, 25 bp, Rattus norvegicus
ctgcactgcgagtctacgaggtctc

SEQ ID NO: 602292 - DNA, 25 bp, Rattus norvegicus
caaatgggaggggacttcccgacat

SEQ ID NO: 602293 - DNA, 25 bp, Rattus norvegicus
cagttcgctactgcgagtgccggtg

SEQ ID NO: 602294 - DNA, 25 bp, Rattus norvegicus
agccaagtgtaccagctcgagtcca

SEQ ID NO: 602295 - DNA, 25 bp, Rattus norvegicus
ctgcagctcaccgagacccaggtta

SEQ ID NO: 602296 - DNA, 25 bp, Rattus norvegicus
ggttaagacttggtttcagaatcgc

SEQ ID NO: 602297 - DNA, 25 bp, Rattus norvegicus
agcgacagctttccgccgagctaga

SEQ ID NO: 602298 - DNA, 25 bp, Rattus norvegicus
tagaggcggccaacatggcacacgc

SEQ ID NO: 602299 - DNA, 25 bp, Rattus norvegicus
tggcacacgcgtcggcgcagactct

SEQ ID NO: 602300 - DNA, 25 bp, Rattus norvegicus
ttggtatttcgggacagttcgctac

SEQ ID NO: 602301 - DNA, 25 bp, Rattus norvegicus
ctctacaacctgtacaacaagcttg

SEQ ID NO: 602302 - DNA, 25 bp, Rattus norvegicus
gcttgactactgacacgcccgctgg

SEQ ID NO: 602303 - DNA, 25 bp, Rattus norvegicus
ctggtcgcctgcagttgcctgcata

SEQ ID NO: 602304 - DNA, 25 bp, Rattus norvegicus
tcggtatccttactggggctccgga

SEQ ID NO: 602305 - DNA, 25 bp, Rattus norvegicus
agcggccaagaagaagacgcgcacc

SEQ ID NO: 602306 - DNA, 25 bp, Rattus norvegicus
tctcgtgggcatgccgttggtattt

SEQ ID NO: 602307 - DNA, 25 bp, Rattus norvegicus
acccggttgcctctgggaatgagcc

SEQ ID NO: 602308 - DNA, 25 bp, Rattus norvegicus
aaagcgtcagcttggggtccagagc

SEQ ID NO: 602309 - DNA, 25 bp, Rattus norvegicus
tggcgtcctcctgtgcggagtaaaa

SEQ ID NO: 602310 - DNA, 25 bp, Rattus norvegicus
gctgggaacaccaggaaaagccgga

SEQ ID NO: 602311 - DNA, 25 bp, Rattus norvegicus
tgggctagacaaagctgggaacacc

SEQ ID NO: 602312 - DNA, 25 bp, Rattus norvegicus
ggatctcggttttttgggctagaca

SEQ ID NO: 602313 - DNA, 25 bp, Rattus norvegicus
gttctccggctagggacacagttgc

SEQ ID NO: 602314 - DNA, 25 bp, Rattus norvegicus
gccgggcaaggaggtgaacatctcc

SEQ ID NO: 602315 - DNA, 25 bp, Rattus norvegicus
agccctcgcagggttctccggctag

SEQ ID NO: 602316 - DNA, 25 bp, Rattus norvegicus
cgcgccgcgaaagactaagccagga

SEQ ID NO: 602317 - DNA, 25 bp, Rattus norvegicus
atagaatccagatcccgagcccgcg

SEQ ID NO: 602318 - DNA, 25 bp, Rattus norvegicus
ttgggatgcgctctgagatagaatc

SEQ ID NO: 602319 - DNA, 25 bp, Rattus norvegicus
acatctccctggtactgggatctcg

SEQ ID NO: 602320 - DNA, 25 bp, Rattus norvegicus
taaaactggagtgtgagaaagcgtc

SEQ ID NO: 602321 - DNA, 25 bp, Rattus norvegicus
cgctttgcctgcgagtgctctgaag

SEQ ID NO: 602322 - DNA, 25 bp, Rattus norvegicus
ggcaggcagtagatcagaccaatca

SEQ ID NO: 602323 - DNA, 25 bp, Rattus norvegicus
atcagctaccgagatcgagccgttg

SEQ ID NO: 602324 - DNA, 25 bp, Rattus norvegicus
aatgataggcctgctccagagcttc

SEQ ID NO: 602325 - DNA, 25 bp, Rattus norvegicus
cgcggcttccctttgagccggaaca

SEQ ID NO: 602326 - DNA, 25 bp, Rattus norvegicus
gttgcctaggcgaacacgaggtaga

SEQ ID NO: 602327 - DNA, 25 bp, Rattus norvegicus
ttcggtcgaggtccattgtgttcta

SEQ ID NO: 602328 - DNA, 25 bp, Rattus norvegicus
tgttgctccggtaagggactcaatc

SEQ ID NO: 602329 - DNA, 25 bp, Rattus norvegicus
cttagcgtttgttctacagatgacc

SEQ ID NO: 602330 - DNA, 25 bp, Rattus norvegicus
cagatgaccggttcgaatgaattca

SEQ ID NO: 602331 - DNA, 25 bp, Rattus norvegicus
agctgaaccagccacccgaggatgg

SEQ ID NO: 602332 - DNA, 25 bp, Rattus norvegicus
gatggcatctcctcggttaagttca

SEQ ID NO: 602333 - DNA, 25 bp, Rattus norvegicus
gtctcctcctgggatacgtccgtgc

SEQ ID NO: 602334 - DNA, 25 bp, Rattus norvegicus
cgagccgttggctttcgaaatgagc

SEQ ID NO: 602335 - DNA, 25 bp, Rattus norvegicus
ccgatctgtctgttcattggccttc

SEQ ID NO: 602336 - DNA, 25 bp, Rattus norvegicus
tcctccggaatcttggtcccactga

SEQ ID NO: 602337 - DNA, 25 bp, Rattus norvegicus
ggctattccctgagacccactggtg

SEQ ID NO: 602338 - DNA, 25 bp, Rattus norvegicus
ggccgctccgattggtacccagaga

SEQ ID NO: 602339 - DNA, 25 bp, Rattus norvegicus
tacccagagacagtggcagatgccc

SEQ ID NO: 602340 - DNA, 25 bp, Rattus norvegicus
cggcgcgctccaagttcattgtctg

SEQ ID NO: 602341 - DNA, 25 bp, Rattus norvegicus
ttctgcccgtagagagctcactcca

SEQ ID NO: 602342 - DNA, 25 bp, Rattus norvegicus
ttcagttcctagtcgacccagggtc

SEQ ID NO: 602343 - DNA, 25 bp, Rattus norvegicus
agcgaattctgactccttggggcgg

SEQ ID NO: 602344 - DNA, 25 bp, Rattus norvegicus
tctgtctcggagctcggaccacatt

SEQ ID NO: 602345 - DNA, 25 bp, Rattus norvegicus
ggaccacattcgctctgtctaggga

SEQ ID NO: 602346 - DNA, 25 bp, Rattus norvegicus
ggacacagccaggatcgcacagcga

SEQ ID NO: 602347 - DNA, 25 bp, Rattus norvegicus
agactccttagtcaggccgcttcgg

SEQ ID NO: 602348 - DNA, 25 bp, Rattus norvegicus
cagtgagcacgactaggggaatccc

SEQ ID NO: 602349 - DNA, 25 bp, Rattus norvegicus
cggcgcgcacgtagtacctgacagc

SEQ ID NO: 602350 - DNA, 25 bp, Rattus norvegicus
aacaccgagagtccgggtagctccg

SEQ ID NO: 602351 - DNA, 25 bp, Rattus norvegicus
cgctaagcgacactgactgtatttc

SEQ ID NO: 602352 - DNA, 25 bp, Rattus norvegicus
gcccgttctctcagttcattggcta

SEQ ID NO: 602353 - DNA, 25 bp, Rattus norvegicus
tttaagacgacgtgtctgtcccgcc

SEQ ID NO: 602354 - DNA, 25 bp, Rattus norvegicus
cggcgcgtcaggctgtttaagacga

SEQ ID NO: 602355 - DNA, 25 bp, Rattus norvegicus
acgaagcccgatgtggcagcccggc

SEQ ID NO: 602356 - DNA, 25 bp, Rattus norvegicus
tgtatttcagccacgaagcccgatg

SEQ ID NO: 602357 - DNA, 25 bp, Rattus norvegicus
acctgacagcgtccgctaagcgaca

SEQ ID NO: 602358 - DNA, 25 bp, Rattus norvegicus
tggagactccggaacaccgagagtc

SEQ ID NO: 602359 - DNA, 25 bp, Rattus norvegicus
ttctcaaagccgaggcctccaaggc

SEQ ID NO: 602360 - DNA, 25 bp, Rattus norvegicus
atcgggtgcccaaggatcggatccc

SEQ ID NO: 602361 - DNA, 25 bp, Rattus norvegicus
gtggtcacaagttcacagctctgtc

SEQ ID NO: 602362 - DNA, 25 bp, Rattus norvegicus
ccctcccggtgacgtggtcacaagt

SEQ ID NO: 602363 - DNA, 25 bp, Rattus norvegicus
tctgaaagggcaaagcgccgggaac

SEQ ID NO: 602364 - DNA, 25 bp, Rattus norvegicus
cggcctctaatgagcccgcgtgggc

SEQ ID NO: 602365 - DNA, 25 bp, Rattus norvegicus
tggcttggcgcagctggactccgct

SEQ ID NO: 602366 - DNA, 25 bp, Rattus norvegicus
gaacttgttttctagggccaccagc

SEQ ID NO: 602367 - DNA, 25 bp, Rattus norvegicus
cgcgtggctcggaacttgttttcta

SEQ ID NO: 602368 - DNA, 25 bp, Rattus norvegicus
ttgacctgtgtctccgtgaggctga

SEQ ID NO: 602369 - DNA, 25 bp, Rattus norvegicus
ctgaaaccaaattttgacctgtgtc

SEQ ID NO: 602370 - DNA, 25 bp, Rattus norvegicus
ttggtcctgcggttctgaaaccaaa

SEQ ID NO: 602371 - DNA, 25 bp, Rattus norvegicus
cttcttccacttggtcctgcggttc

SEQ ID NO: 602372 - DNA, 25 bp, Rattus norvegicus
ccctgggttctgcttcttccacttg

SEQ ID NO: 602373 - DNA, 25 bp, Rattus norvegicus
cgtcaccgcgttgggtgtcccaggc

SEQ ID NO: 602374 - DNA, 25 bp, Rattus norvegicus
aggactactcccagtggcactacca

SEQ ID NO: 602375 - DNA, 25 bp, Rattus norvegicus
cgggccaggactactcccagtggca

SEQ ID NO: 602376 - DNA, 25 bp, Rattus norvegicus
tcagagccttccaccggggacgcgg

SEQ ID NO: 602377 - DNA, 25 bp, Rattus norvegicus
cgggatggatgcgttcaaccttatc

SEQ ID NO: 602378 - DNA, 25 bp, Rattus norvegicus
cgggagagcagctcgcgtgaatttc

SEQ ID NO: 602379 - DNA, 25 bp, Rattus norvegicus
ctctccagccgcgaactggaatttc

SEQ ID NO: 602380 - DNA, 25 bp, Rattus norvegicus
cctcccatgctgcagagactcgtga

SEQ ID NO: 602381 - DNA, 25 bp, Rattus norvegicus
atgctgtgtgaacgtcctcccatgc

SEQ ID NO: 602382 - DNA, 25 bp, Rattus norvegicus
gctctccattcgtggggtcacggtg

SEQ ID NO: 602383 - DNA, 25 bp, Rattus norvegicus
ctagagggacccttgcacgccaatg

SEQ ID NO: 602384 - DNA, 25 bp, Rattus norvegicus
tgcagccactatcctgggcagccgg

SEQ ID NO: 602385 - DNA, 25 bp, Rattus norvegicus
gtgcagtgagcacttgcagccacta

SEQ ID NO: 602386 - DNA, 25 bp, Rattus norvegicus
aggattggcacttgcgctggccaga

SEQ ID NO: 602387 - DNA, 25 bp, Rattus norvegicus
cttatcttcagcagcggttcggcca

SEQ ID NO: 602388 - DNA, 25 bp, Rattus norvegicus
cagcatgcccgtcttccgcgggttg

SEQ ID NO: 602389 - DNA, 25 bp, Rattus norvegicus
ctgcggatccaagatgtccaggacc

SEQ ID NO: 602390 - DNA, 25 bp, Rattus norvegicus
ctcgcgtgaatttctgcggatccaa

SEQ ID NO: 602391 - DNA, 25 bp, Rattus norvegicus
agctgctattgcaggctctgtggag

SEQ ID NO: 602392 - DNA, 25 bp, Rattus norvegicus
gggtgctgcttgatatctccggcgt

SEQ ID NO: 602393 - DNA, 25 bp, Rattus norvegicus
acatttcccaagcatctctgcgcgg

SEQ ID NO: 602394 - DNA, 25 bp, Rattus norvegicus
gcccgccagctgaggactacatttc

SEQ ID NO: 602395 - DNA, 25 bp, Rattus norvegicus
tggttcctagtttgcgccggcccgc

SEQ ID NO: 602396 - DNA, 25 bp, Rattus norvegicus
ctggcccacgtggttcctagtttgc

SEQ ID NO: 602397 - DNA, 25 bp, Rattus norvegicus
ccaagcatctctgcgcgggagacgc

SEQ ID NO: 602398 - DNA, 25 bp, Rattus norvegicus
tgcttgatatctccggcgtgctgta

SEQ ID NO: 602399 - DNA, 25 bp, Rattus norvegicus
tatctccggcgtgctgtatgacagc

SEQ ID NO: 602400 - DNA, 25 bp, Rattus norvegicus
cgtgctgtatgacagcggcacaggc

SEQ ID NO: 602401 - DNA, 25 bp, Rattus norvegicus
caacgctgggttcgggtgtacagct

SEQ ID NO: 602402 - DNA, 25 bp, Rattus norvegicus
gttcccgctagctcctccttctcgc

SEQ ID NO: 602403 - DNA, 25 bp, Rattus norvegicus
tggcgaggttagtgagatcaacgta

SEQ ID NO: 602404 - DNA, 25 bp, Rattus norvegicus
cggcggagctgctattgcaggctct

SEQ ID NO: 602405 - DNA, 25 bp, Rattus norvegicus
ccgagcgctttgtaccgagcgacta

SEQ ID NO: 602406 - DNA, 25 bp, Rattus norvegicus
gtgtccagtgaacccgcagggcgaa

SEQ ID NO: 602407 - DNA, 25 bp, Rattus norvegicus
taaccgacatcggtcaggccgcctg

SEQ ID NO: 602408 - DNA, 25 bp, Rattus norvegicus
gacttgtcacttcatgaactgtttg

SEQ ID NO: 602409 - DNA, 25 bp, Rattus norvegicus
cagcattaaggaaagagcgaacgca

SEQ ID NO: 602410 - DNA, 25 bp, Rattus norvegicus
cgatccgccgcctaacaaggagaca

SEQ ID NO: 602411 - DNA, 25 bp, Rattus norvegicus
gccagcgtgctgacaagtctcacga

SEQ ID NO: 602412 - DNA, 25 bp, Rattus norvegicus
ccagggaagtagcaccgcacaagtc

SEQ ID NO: 602413 - DNA, 25 bp, Rattus norvegicus
gaactgtttgcaactcgtcccttta

SEQ ID NO: 602414 - DNA, 25 bp, Rattus norvegicus
ccgccgagcgcagactttgtctgca

SEQ ID NO: 602415 - DNA, 25 bp, Rattus norvegicus
gtctgcagcgctaggtttgctcttc

SEQ ID NO: 602416 - DNA, 25 bp, Rattus norvegicus
tgtcatgcaaacgatgcggaacttc

SEQ ID NO: 602417 - DNA, 25 bp, Rattus norvegicus
tcagtcagcagccttggagtcgtcc

SEQ ID NO: 602418 - DNA, 25 bp, Rattus norvegicus
acaagtctcacgacctgcaccgggg

SEQ ID NO: 602419 - DNA, 25 bp, Rattus norvegicus
cagcgtgtcgcccagtccgctgatg

SEQ ID NO: 602420 - DNA, 25 bp, Rattus norvegicus
aggtgccctactacctggagaacga

SEQ ID NO: 602421 - DNA, 25 bp, Rattus norvegicus
gtagccgctgtgtccggtctggcct

SEQ ID NO: 602422 - DNA, 25 bp, Rattus norvegicus
caccacttcggggtagccgctgtgt

SEQ ID NO: 602423 - DNA, 25 bp, Rattus norvegicus
tacaggtacctgcaccacttcgggg

SEQ ID NO: 602424 - DNA, 25 bp, Rattus norvegicus
agcgcctacgctgtacgcgacaccg

SEQ ID NO: 602425 - DNA, 25 bp, Rattus norvegicus
cggccgcctttggtgccaatagtct

SEQ ID NO: 602426 - DNA, 25 bp, Rattus norvegicus
gcatcacttacggtccggggtccga

SEQ ID NO: 602427 - DNA, 25 bp, Rattus norvegicus
tctatggccagtcgagcatcactta

SEQ ID NO: 602428 - DNA, 25 bp, Rattus norvegicus
gcctcggctccggtctatggccagt

SEQ ID NO: 602429 - DNA, 25 bp, Rattus norvegicus
agggcgccgcctacgagttcaacgc

SEQ ID NO: 602430 - DNA, 25 bp, Rattus norvegicus
tggacaacagcaagcccgccgtgtt

SEQ ID NO: 602431 - DNA, 25 bp, Rattus norvegicus
gaggtgtacgtggacaacagcaagc

SEQ ID NO: 602432 - DNA, 25 bp, Rattus norvegicus
tactacctggagaacgagcccagcg

SEQ ID NO: 602433 - DNA, 25 bp, Rattus norvegicus
caggcgcacaggaacgttagttaga

SEQ ID NO: 602434 - DNA, 25 bp, Rattus norvegicus
ctgctggccgcactgtaagtgcttg

SEQ ID NO: 602435 - DNA, 25 bp, Rattus norvegicus
gggactagacctttgctgagcattc

SEQ ID NO: 602436 - DNA, 25 bp, Rattus norvegicus
ccctcgttcgcagtggttacaagaa

SEQ ID NO: 602437 - DNA, 25 bp, Rattus norvegicus
ccggcccgagccgtgaagaagaatt

SEQ ID NO: 602438 - DNA, 25 bp, Rattus norvegicus
gcgacctcacctggtacgcgaagga

SEQ ID NO: 602439 - DNA, 25 bp, Rattus norvegicus
tcgctgatggcaccagtaggccgct

SEQ ID NO: 602440 - DNA, 25 bp, Rattus norvegicus
cgtgaagaagaattggcagccgtgc

SEQ ID NO: 602441 - DNA, 25 bp, Rattus norvegicus
tactgaagaaggtgcagcggctcca

SEQ ID NO: 602442 - DNA, 25 bp, Rattus norvegicus
gaactacctgggcaactcgctgatg

SEQ ID NO: 602443 - DNA, 25 bp, Rattus norvegicus
actgacaagcagagggagaactacc

SEQ ID NO: 602444 - DNA, 25 bp, Rattus norvegicus
gtggcgggcaagaccagttcaattg

SEQ ID NO: 602445 - DNA, 25 bp, Rattus norvegicus
agcggctccagcaccatgttcggct

SEQ ID NO: 602446 - DNA, 25 bp, Rattus norvegicus
ggagtccgactccagaccgtagata

SEQ ID NO: 602447 - DNA, 25 bp, Rattus norvegicus
catgtcgctcggcaactaacgggca

SEQ ID NO: 602448 - DNA, 25 bp, Rattus norvegicus
atagagacgcaactcgagcagaggg

SEQ ID NO: 602449 - DNA, 25 bp, Rattus norvegicus
taacgggcagtcgaagccgccatag

SEQ ID NO: 602450 - DNA, 25 bp, Rattus norvegicus
ccgccatagagacgcaactcgagca

SEQ ID NO: 602451 - DNA, 25 bp, Rattus norvegicus
tcgaagccgccatagagacgcaact

SEQ ID NO: 602452 - DNA, 25 bp, Rattus norvegicus
gagactgcgcggagaccacagcacc

SEQ ID NO: 602453 - DNA, 25 bp, Rattus norvegicus
ccgccacactcactgttctcgtgtc

SEQ ID NO: 602454 - DNA, 25 bp, Rattus norvegicus
cgcggacgggacgaagtcatccgcc

SEQ ID NO: 602455 - DNA, 25 bp, Rattus norvegicus
ggacgaagtcatccgccacgggact

SEQ ID NO: 602456 - DNA, 25 bp, Rattus norvegicus
gctcggcaactaacgggcagtcgaa

SEQ ID NO: 602457 - DNA, 25 bp, Rattus norvegicus
gttgccctcagcatccgcgttcatg

SEQ ID NO: 602458 - DNA, 25 bp, Rattus norvegicus
ctgccctctcgagactgcgcggaga

SEQ ID NO: 602459 - DNA, 25 bp, Rattus norvegicus
atccgcgttcatgtcgctcggcaac

SEQ ID NO: 602460 - DNA, 25 bp, Rattus norvegicus
acgggactgccctctcgagactgcg

SEQ ID NO: 602461 - DNA, 25 bp, Rattus norvegicus
ccttccagctccagtactccgcggg

SEQ ID NO: 602462 - DNA, 25 bp, Rattus norvegicus
cagcaacgccgaccacgtaggtgtc

SEQ ID NO: 602463 - DNA, 25 bp, Rattus norvegicus
gccgcttggggccttcggctttctc

SEQ ID NO: 602464 - DNA, 25 bp, Rattus norvegicus
tcccggggacaaaccgatgagctgt

SEQ ID NO: 602465 - DNA, 25 bp, Rattus norvegicus
caaaccgatgagctgtgacccaggc

SEQ ID NO: 602466 - DNA, 25 bp, Rattus norvegicus
tgagctgtgacccaggcggctcccg

SEQ ID NO: 602467 - DNA, 25 bp, Rattus norvegicus
gtcctggcacagctgttcttagtcc

SEQ ID NO: 602468 - DNA, 25 bp, Rattus norvegicus
gctgttcttagtccaacggacctaa

SEQ ID NO: 602469 - DNA, 25 bp, Rattus norvegicus
gcatccggaaggctgtgcatcctcc

SEQ ID NO: 602470 - DNA, 25 bp, Rattus norvegicus
tggagatttccatcatggcggcttc

SEQ ID NO: 602471 - DNA, 25 bp, Rattus norvegicus
gctacaccttcagcgctgtgtgttt

SEQ ID NO: 602472 - DNA, 25 bp, Rattus norvegicus
tgtgtgtttccacagcgccaacagc

SEQ ID NO: 602473 - DNA, 25 bp, Rattus norvegicus
atggcggcttccatttcgggctaca

SEQ ID NO: 602474 - DNA, 25 bp, Rattus norvegicus
ttcgggctacaccttcagcgctgtg

SEQ ID NO: 602475 - DNA, 25 bp, Rattus norvegicus
tatttagctctagggtcttgaccgc

SEQ ID NO: 602476 - DNA, 25 bp, Rattus norvegicus
tgaccgccgccattcggagtcttca

SEQ ID NO: 602477 - DNA, 25 bp, Rattus norvegicus
ggcccgcggagaacatgtcctgact

SEQ ID NO: 602478 - DNA, 25 bp, Rattus norvegicus
tcacaggacggtgagcagcaaggtc

SEQ ID NO: 602479 - DNA, 25 bp, Rattus norvegicus
aaggtccagttcctgacgttgtgca

SEQ ID NO: 602480 - DNA, 25 bp, Rattus norvegicus
caagactcgcgctagttcaaagctc

SEQ ID NO: 602481 - DNA, 25 bp, Rattus norvegicus
aagctctggggactcagctgtaaga

SEQ ID NO: 602482 - DNA, 25 bp, Rattus norvegicus
tcagctgtaagagcccacggcggtc

SEQ ID NO: 602483 - DNA, 25 bp, Rattus norvegicus
aggcgtatcctgcacttttatttga

SEQ ID NO: 602484 - DNA, 25 bp, Rattus norvegicus
tctagcctcacaatcaggacgcatg

SEQ ID NO: 602485 - DNA, 25 bp, Rattus norvegicus
gaggcctcgggaccaatcacaggac

SEQ ID NO: 602486 - DNA, 25 bp, Rattus norvegicus
ggacgcatgctgctgacatcacggc

SEQ ID NO: 602487 - DNA, 25 bp, Rattus norvegicus
gctccgggaaagaggcgatcaccta

SEQ ID NO: 602488 - DNA, 25 bp, Rattus norvegicus
atcacctattggctgcgcctcctga

SEQ ID NO: 602489 - DNA, 25 bp, Rattus norvegicus
actcccgggcgtagtgtatggacac

SEQ ID NO: 602490 - DNA, 25 bp, Rattus norvegicus
cttggggccgagtgctttacccact

SEQ ID NO: 602491 - DNA, 25 bp, Rattus norvegicus
cccgcccgctttttctgggttgcag

SEQ ID NO: 602492 - DNA, 25 bp, Rattus norvegicus
ccttaaaatgacacacgcacacaga

SEQ ID NO: 602493 - DNA, 25 bp, Rattus norvegicus
gctcccgagccaccttaaaatgaca

SEQ ID NO: 602494 - DNA, 25 bp, Rattus norvegicus
cttacctcgtcctgggtcgttggcg

SEQ ID NO: 602495 - DNA, 25 bp, Rattus norvegicus
ggggcgctgaccaaagatgtcctcg

SEQ ID NO: 602496 - DNA, 25 bp, Rattus norvegicus
tgagcaggtgccagatttccctgtc

SEQ ID NO: 602497 - DNA, 25 bp, Rattus norvegicus
agcaagggatgaaccaacgacttcg

SEQ ID NO: 602498 - DNA, 25 bp, Rattus norvegicus
aacgacttcgtatatgcccgtcaag

SEQ ID NO: 602499 - DNA, 25 bp, Rattus norvegicus
tgcccgtcaagtgttctacccactg

SEQ ID NO: 602500 - DNA, 25 bp, Rattus norvegicus
tcccaaagtatgagcaggtgccaga

SEQ ID NO: 602501 - DNA, 25 bp, Rattus norvegicus
tcttgctggtcccaaagtatgagca

SEQ ID NO: 602502 - DNA, 25 bp, Rattus norvegicus
caaagatgtcctcggatgccggccc

SEQ ID NO: 602503 - DNA, 25 bp, Rattus norvegicus
tgtgagagccttgacgccactggct

SEQ ID NO: 602504 - DNA, 25 bp, Rattus norvegicus
gccactggctttgattacgcgacta

SEQ ID NO: 602505 - DNA, 25 bp, Rattus norvegicus
ggagggctcagcctcctatcccaga

SEQ ID NO: 602506 - DNA, 25 bp, Rattus norvegicus
tgtttgccaacaaagaccggccacg

SEQ ID NO: 602507 - DNA, 25 bp, Rattus norvegicus
ctggacctttgggtaaatctcgcga

SEQ ID NO: 602508 - DNA, 25 bp, Rattus norvegicus
gcgagatttgatcgcgttacctaga

SEQ ID NO: 602509 - DNA, 25 bp, Rattus norvegicus
agtctctcgctctgaggttctcctg

SEQ ID NO: 602510 - DNA, 25 bp, Rattus norvegicus
agcaggagccgaggcttctccatca

SEQ ID NO: 602511 - DNA, 25 bp, Rattus norvegicus
cggaatccgaggagccttctgcaca

SEQ ID NO: 602512 - DNA, 25 bp, Rattus norvegicus
tttgcgagcctaggagggacatcgc

SEQ ID NO: 602513 - DNA, 25 bp, Rattus norvegicus
gggacatcgcgtagcttctggaact

SEQ ID NO: 602514 - DNA, 25 bp, Rattus norvegicus
tggaactttcctccacgcttccttg

SEQ ID NO: 602515 - DNA, 25 bp, Rattus norvegicus
tggcacctcttgtacagacggtatc

SEQ ID NO: 602516 - DNA, 25 bp, Rattus norvegicus
ttacgcgactacgtgagaccgcacc

SEQ ID NO: 602517 - DNA, 25 bp, Rattus norvegicus
agcgttccggtgctcctacattaga

SEQ ID NO: 602518 - DNA, 25 bp, Rattus norvegicus
gtccggtctggatctgcggaccttc

SEQ ID NO: 602519 - DNA, 25 bp, Rattus norvegicus
cagtgtgaccggcaacatggcatcc

SEQ ID NO: 602520 - DNA, 25 bp, Rattus norvegicus
gtgggactcaaccagggcgctttct

SEQ ID NO: 602521 - DNA, 25 bp, Rattus norvegicus
atggcagattactccagtgggactc

SEQ ID NO: 602522 - DNA, 25 bp, Rattus norvegicus
ccattgatgctaaggtggaagtata

SEQ ID NO: 602523 - DNA, 25 bp, Rattus norvegicus
cattagaccctaggagcgtgtgcca

SEQ ID NO: 602524 - DNA, 25 bp, Rattus norvegicus
catggcatccaaggctaagaagcga

SEQ ID NO: 602525 - DNA, 25 bp, Rattus norvegicus
taccgataaccgagagtggcctctc

SEQ ID NO: 602526 - DNA, 25 bp, Rattus norvegicus
agaccggggctgctaagtaccgata

SEQ ID NO: 602527 - DNA, 25 bp, Rattus norvegicus
cgacacctacctcgcgggctaagag

SEQ ID NO: 602528 - DNA, 25 bp, Rattus norvegicus
cgcaagcctgtgtcctagtccagtc

SEQ ID NO: 602529 - DNA, 25 bp, Rattus norvegicus
gcggtgtcagcgatcgccaagacct

SEQ ID NO: 602530 - DNA, 25 bp, Rattus norvegicus
acgcagacggatgggttaaaccact

SEQ ID NO: 602531 - DNA, 25 bp, Rattus norvegicus
cgctctgcgtttccacgtcactttt

SEQ ID NO: 602532 - DNA, 25 bp, Rattus norvegicus
cgcgtggtccttaaaggagctgaca

SEQ ID NO: 602533 - DNA, 25 bp, Rattus norvegicus
gtccttaaaggagctgacagcgcct

SEQ ID NO: 602534 - DNA, 25 bp, Rattus norvegicus
agctgacagcgccttctcgagcacg

SEQ ID NO: 602535 - DNA, 25 bp, Rattus norvegicus
acagcgccttctcgagcacggggcg

SEQ ID NO: 602536 - DNA, 25 bp, Rattus norvegicus
cacggggcgcggctctactgaagcc

SEQ ID NO: 602537 - DNA, 25 bp, Rattus norvegicus
gctgacgttcgcgtggtccttaaag

SEQ ID NO: 602538 - DNA, 25 bp, Rattus norvegicus
ttgtcagggcaacccaagagacgcc

SEQ ID NO: 602539 - DNA, 25 bp, Rattus norvegicus
agacgcccgccgaggacaggcgtta

SEQ ID NO: 602540 - DNA, 25 bp, Rattus norvegicus
gagcagctgaccatggagcccaaga

SEQ ID NO: 602541 - DNA, 25 bp, Rattus norvegicus
ccatggagcccaagagtaagcggcg

SEQ ID NO: 602542 - DNA, 25 bp, Rattus norvegicus
gcctgccctgccgttacctgcagcg

SEQ ID NO: 602543 - DNA, 25 bp, Rattus norvegicus
agtcagctgggccaggtctcgaacc

SEQ ID NO: 602544 - DNA, 25 bp, Rattus norvegicus
agctgggccaggtctcgaacccgcg

SEQ ID NO: 602545 - DNA, 25 bp, Rattus norvegicus
agatgcgccctggtgcgtctcctct

SEQ ID NO: 602546 - DNA, 25 bp, Rattus norvegicus
tctccttgccgctgtggcacttgcg

SEQ ID NO: 602547 - DNA, 25 bp, Rattus norvegicus
ttcccagcctcaggatgatgtggcc

SEQ ID NO: 602548 - DNA, 25 bp, Rattus norvegicus
gcgggtgacttacctcgggctgcac

SEQ ID NO: 602549 - DNA, 25 bp, Rattus norvegicus
tcgcggagcagcaagtctagccttt

SEQ ID NO: 602550 - DNA, 25 bp, Rattus norvegicus
gagccgcccttgaccgttgcaataa

SEQ ID NO: 602551 - DNA, 25 bp, Rattus norvegicus
ttgcaataaatgagcagcctgtccg

SEQ ID NO: 602552 - DNA, 25 bp, Rattus norvegicus
gtctgtgcaatggatccgcggccag

SEQ ID NO: 602553 - DNA, 25 bp, Rattus norvegicus
agcagtcgccgttctcattaccacg

SEQ ID NO: 602554 - DNA, 25 bp, Rattus norvegicus
cattaccacggaacaaattagcgtc

SEQ ID NO: 602555 - DNA, 25 bp, Rattus norvegicus
tcctatccactctccggggtggcta

SEQ ID NO: 602556 - DNA, 25 bp, Rattus norvegicus
cgtagacccggcttcgtggcgcaaa

SEQ ID NO: 602557 - DNA, 25 bp, Rattus norvegicus
cgcaaaggcgcgagaacgcacactt

SEQ ID NO: 602558 - DNA, 25 bp, Rattus norvegicus
aggaggggttcctcagatgcgccct

SEQ ID NO: 602559 - DNA, 25 bp, Rattus norvegicus
cggggtcattgtttgtgtgcgtttt

SEQ ID NO: 602560 - DNA, 25 bp, Rattus norvegicus
cccaccaaacgagaggagaagtacg

SEQ ID NO: 602561 - DNA, 25 bp, Rattus norvegicus
cttttgtttggcatccgggattccg

SEQ ID NO: 602562 - DNA, 25 bp, Rattus norvegicus
aagatggcggcctaggcgcacagtt

SEQ ID NO: 602563 - DNA, 25 bp, Rattus norvegicus
cttattcccgcgcattcgctctgtg

SEQ ID NO: 602564 - DNA, 25 bp, Rattus norvegicus
tcccgtgtgttcctgagtgcgcagg

SEQ ID NO: 602565 - DNA, 25 bp, Rattus norvegicus
tgtgcgttttggcttcttcgggaaa

SEQ ID NO: 602566 - DNA, 25 bp, Rattus norvegicus
ctggttttgcctttgtcgcttcccg

SEQ ID NO: 602567 - DNA, 25 bp, Rattus norvegicus
actcaggcgctcctgtttcccgggg

SEQ ID NO: 602568 - DNA, 25 bp, Rattus norvegicus
gaagtctccttttctcgcgtgagga

SEQ ID NO: 602569 - DNA, 25 bp, Rattus norvegicus
cagcgcacggatctgtgaagtctcc

SEQ ID NO: 602570 - DNA, 25 bp, Rattus norvegicus
gaacacttttcattgtgcagcgcac

SEQ ID NO: 602571 - DNA, 25 bp, Rattus norvegicus
gattccgggtgaacacttttcattg

SEQ ID NO: 602572 - DNA, 25 bp, Rattus norvegicus
ttcgctctgtgtagtcccgtgtgtt

SEQ ID NO: 602573 - DNA, 25 bp, Rattus norvegicus
agtgtctggccaaggctccaggtcc

SEQ ID NO: 602574 - DNA, 25 bp, Rattus norvegicus
acctttggctgcttactggtaagtg

SEQ ID NO: 602575 - DNA, 25 bp, Rattus norvegicus
gccaccaggtctacactgggctaca

SEQ ID NO: 602576 - DNA, 25 bp, Rattus norvegicus
cggacccagacgaagccagtttagg

SEQ ID NO: 602577 - DNA, 25 bp, Rattus norvegicus
gggtctgcacccatctgccagcgat

SEQ ID NO: 602578 - DNA, 25 bp, Rattus norvegicus
accagaggactgagcagagggcacc

SEQ ID NO: 602579 - DNA, 25 bp, Rattus norvegicus
atgctgggctcctcttacctttggc

SEQ ID NO: 602580 - DNA, 25 bp, Rattus norvegicus
gctcaggcatgtcttgccgcggacc

SEQ ID NO: 602581 - DNA, 25 bp, Rattus norvegicus
gggcagagcatccacggcaaggatc

SEQ ID NO: 602582 - DNA, 25 bp, Rattus norvegicus
cgtgctcctcagatgtcctcattta

SEQ ID NO: 602583 - DNA, 25 bp, Rattus norvegicus
attgtcttcagcgagatccggggcc

SEQ ID NO: 602584 - DNA, 25 bp, Rattus norvegicus
gctactctatggagccgagcgacca

SEQ ID NO: 602585 - DNA, 25 bp, Rattus norvegicus
gtcctcatttactgcaattgtcttc

SEQ ID NO: 602586 - DNA, 25 bp, Rattus norvegicus
ccagcgatcaagtacagcgggctcg

SEQ ID NO: 602587 - DNA, 25 bp, Rattus norvegicus
aaacctggcttcctggagaagagcc

SEQ ID NO: 602588 - DNA, 25 bp, Rattus norvegicus
caaagtcgctctgtttccggatcgg

SEQ ID NO: 602589 - DNA, 25 bp, Rattus norvegicus
tctgcaccctgacgccttcgttggg

SEQ ID NO: 602590 - DNA, 25 bp, Rattus norvegicus
acaccggctccggagattagaacgc

SEQ ID NO: 602591 - DNA, 25 bp, Rattus norvegicus
tggtttcgctcccacaagatggcgg

SEQ ID NO: 602592 - DNA, 25 bp, Rattus norvegicus
tgaagctgccggttagcctttaaga

SEQ ID NO: 602593 - DNA, 25 bp, Rattus norvegicus
ggcccaaggctcatgccgtttctga

SEQ ID NO: 602594 - DNA, 25 bp, Rattus norvegicus
gacacccgagtgaccttgacgccgt

SEQ ID NO: 602595 - DNA, 25 bp, Rattus norvegicus
ctctaggccgacaggaacaggactc

SEQ ID NO: 602596 - DNA, 25 bp, Rattus norvegicus
ccttcacgaatagcgcttgcgcgtc

SEQ ID NO: 602597 - DNA, 25 bp, Rattus norvegicus
gcacgcgcatcttcctgcggaattc

SEQ ID NO: 602598 - DNA, 25 bp, Rattus norvegicus
ttgaggccagtaagcgttctagagc

SEQ ID NO: 602599 - DNA, 25 bp, Rattus norvegicus
atggatttccctgtcctacggcgcg

SEQ ID NO: 602600 - DNA, 25 bp, Rattus norvegicus
aattccagcccattccgcggatgcg

SEQ ID NO: 602601 - DNA, 25 bp, Rattus norvegicus
ttcaggtttcaagcggcgaggtgac

SEQ ID NO: 602602 - DNA, 25 bp, Rattus norvegicus
tctccctgtggttcgcagcgcgtcg

SEQ ID NO: 602603 - DNA, 25 bp, Rattus norvegicus
tgctatttaccttgatccggccttg

SEQ ID NO: 602604 - DNA, 25 bp, Rattus norvegicus
agagtacaacaatcccagcccagtg

SEQ ID NO: 602605 - DNA, 25 bp, Rattus norvegicus
caggatgccctggtgacagagtaca

SEQ ID NO: 602606 - DNA, 25 bp, Rattus norvegicus
ggtctccggcgctgtccgcagagct

SEQ ID NO: 602607 - DNA, 25 bp, Rattus norvegicus
tgccgccctggccttgtagccgggt

SEQ ID NO: 602608 - DNA, 25 bp, Rattus norvegicus
gaacgcctcttccaggctgcgtgca

SEQ ID NO: 602609 - DNA, 25 bp, Rattus norvegicus
atccggccttgttcaggtttcaagc

SEQ ID NO: 602610 - DNA, 25 bp, Rattus norvegicus
tctctgtctctacctttgctattta

SEQ ID NO: 602611 - DNA, 25 bp, Rattus norvegicus
tgttgccttacacctgtcattcctc

SEQ ID NO: 602612 - DNA, 25 bp, Rattus norvegicus
ttgctgcagtgtgttgccttacacc

SEQ ID NO: 602613 - DNA, 25 bp, Rattus norvegicus
cgcgtcggcgtgcaagcacaaactt

SEQ ID NO: 602614 - DNA, 25 bp, Rattus norvegicus
cgaggtgacgctagcgaacgcctct

SEQ ID NO: 602615 - DNA, 25 bp, Rattus norvegicus
ggcgccctacacacctggaccagga

SEQ ID NO: 602616 - DNA, 25 bp, Rattus norvegicus
tactcctactcagcgctcatcgcca

SEQ ID NO: 602617 - DNA, 25 bp, Rattus norvegicus
ggctggtaaggccaccctactccta

SEQ ID NO: 602618 - DNA, 25 bp, Rattus norvegicus
agctgttgaggctggtaaggccacc

SEQ ID NO: 602619 - DNA, 25 bp, Rattus norvegicus
ctatccggacagcaggagctgttga

SEQ ID NO: 602620 - DNA, 25 bp, Rattus norvegicus
tcgcatggctgagtctatccggaca

SEQ ID NO: 602621 - DNA, 25 bp, Rattus norvegicus
cgccgatctcgcatggctgagtcta

SEQ ID NO: 602622 - DNA, 25 bp, Rattus norvegicus
ctcagcccttcaggcggtctggcgg

SEQ ID NO: 602623 - DNA, 25 bp, Rattus norvegicus
ttgcggtctcaggttcgctcctcag

SEQ ID NO: 602624 - DNA, 25 bp, Rattus norvegicus
ctgtgggtgaactcgaccgcgctca

SEQ ID NO: 602625 - DNA, 25 bp, Rattus norvegicus
aggaccggctccaacctatgctgca

SEQ ID NO: 602626 - DNA, 25 bp, Rattus norvegicus
atggccattcaaagcgcgccgctgc

SEQ ID NO: 602627 - DNA, 25 bp, Rattus norvegicus
aaagcgcgccgctgcgcaggttgac

SEQ ID NO: 602628 - DNA, 25 bp, Rattus norvegicus
aacctatgctgcagcggcccttgcg

SEQ ID NO: 602629 - DNA, 25 bp, Rattus norvegicus
accgggatatcctgagccactgcca

SEQ ID NO: 602630 - DNA, 25 bp, Rattus norvegicus
tccagaaagtggactgagttacgcc

SEQ ID NO: 602631 - DNA, 25 bp, Rattus norvegicus
cgacagcaccgatccctgggaggtg

SEQ ID NO: 602632 - DNA, 25 bp, Rattus norvegicus
cttgcacattgagcagaccgggata

SEQ ID NO: 602633 - DNA, 25 bp, Rattus norvegicus
cttcggaagaagtcaccggcggcgt

SEQ ID NO: 602634 - DNA, 25 bp, Rattus norvegicus
gtgctacgtccaagccaggtccttg

SEQ ID NO: 602635 - DNA, 25 bp, Rattus norvegicus
cacagggtgctagagactggagatc

SEQ ID NO: 602636 - DNA, 25 bp, Rattus norvegicus
gatcttgtgatctacctgcccgagg

SEQ ID NO: 602637 - DNA, 25 bp, Rattus norvegicus
gggccggacagatttcctgctctcc

SEQ ID NO: 602638 - DNA, 25 bp, Rattus norvegicus
gaacttggctaccacctcagcagcg

SEQ ID NO: 602639 - DNA, 25 bp, Rattus norvegicus
ctcagcagcgctctctgtgagcagc

SEQ ID NO: 602640 - DNA, 25 bp, Rattus norvegicus
cagggcttgagactggagcttttcc

SEQ ID NO: 602641 - DNA, 25 bp, Rattus norvegicus
gaggtggctgtgcttcccttgcaca

SEQ ID NO: 602642 - DNA, 25 bp, Rattus norvegicus
tgagttacgccaactcccggctcag

SEQ ID NO: 602643 - DNA, 25 bp, Rattus norvegicus
gacaccgatgtcagcttcgcgtcta

SEQ ID NO: 602644 - DNA, 25 bp, Rattus norvegicus
taggcagagcgtcccagattttcag

SEQ ID NO: 602645 - DNA, 25 bp, Rattus norvegicus
accaggccagagttacgtgcaggaa

SEQ ID NO: 602646 - DNA, 25 bp, Rattus norvegicus
gccatacgggcagcgagagaccaat

SEQ ID NO: 602647 - DNA, 25 bp, Rattus norvegicus
ctaagtgctgcgattgggccatacg

SEQ ID NO: 602648 - DNA, 25 bp, Rattus norvegicus
cggttcaaattctggcgctaagtgc

SEQ ID NO: 602649 - DNA, 25 bp, Rattus norvegicus
tgacagcgaaagttagctctgcccg

SEQ ID NO: 602650 - DNA, 25 bp, Rattus norvegicus
gctcctcagctggttctgacagcga

SEQ ID NO: 602651 - DNA, 25 bp, Rattus norvegicus
catcgccgctccgtttgatggtgac

SEQ ID NO: 602652 - DNA, 25 bp, Rattus norvegicus
tcaccttccaaacaggcaggagctg

SEQ ID NO: 602653 - DNA, 25 bp, Rattus norvegicus
ggggcagctctgtcaaacgcaaagg

SEQ ID NO: 602654 - DNA, 25 bp, Rattus norvegicus
tgacttccgaaaatgctacaggggc

SEQ ID NO: 602655 - DNA, 25 bp, Rattus norvegicus
ttcgcgtctacttgggaagttctca

SEQ ID NO: 602656 - DNA, 25 bp, Rattus norvegicus
ttctcagtgtgtgagcgtgacttcc

SEQ ID NO: 602657 - DNA, 25 bp, Rattus norvegicus
cgtgctcggcccacagaaagccctc

SEQ ID NO: 602658 - DNA, 25 bp, Rattus norvegicus
gatctcacagctccgcaaccctctg

SEQ ID NO: 602659 - DNA, 25 bp, Rattus norvegicus
cgttccacgatctcacagctccgca

SEQ ID NO: 602660 - DNA, 25 bp, Rattus norvegicus
taatactctccgttccacgatctca

SEQ ID NO: 602661 - DNA, 25 bp, Rattus norvegicus
gcttaatactctccgttccacgatc

SEQ ID NO: 602662 - DNA, 25 bp, Rattus norvegicus
tggcttaatactctccgttccacga

SEQ ID NO: 602663 - DNA, 25 bp, Rattus norvegicus
ggctggcttaatactctccgttcca

SEQ ID NO: 602664 - DNA, 25 bp, Rattus norvegicus
caggctggcttaatactctccgttc

SEQ ID NO: 602665 - DNA, 25 bp, Rattus norvegicus
taccaggctggcttaatactctccg

SEQ ID NO: 602666 - DNA, 25 bp, Rattus norvegicus
gtaccaggctggcttaatactctcc

SEQ ID NO: 602667 - DNA, 25 bp, Rattus norvegicus
cgcgtaccaggctggcttaatactc

SEQ ID NO: 602668 - DNA, 25 bp, Rattus norvegicus
ctccgcgtaccaggctggcttaata

SEQ ID NO: 602669 - DNA, 25 bp, Rattus norvegicus
cgcaaccctctgcaacctggctctg

SEQ ID NO: 602670 - DNA, 25 bp, Rattus norvegicus
gcctccgcgtaccaggctggcttaa

SEQ ID NO: 602671 - DNA, 25 bp, Rattus norvegicus
cacagcgagagctctgagggcctcg

SEQ ID NO: 602672 - DNA, 25 bp, Rattus norvegicus
ggaggggccacaaaacaagacacga

SEQ ID NO: 602673 - DNA, 25 bp, Rattus norvegicus
gtgcagcaccacagcgagagctctg

SEQ ID NO: 602674 - DNA, 25 bp, Rattus norvegicus
ctactgcaacaaagcaaacatggtc

SEQ ID NO: 602675 - DNA, 25 bp, Rattus norvegicus
ggctggacggcactactgcaacaaa

SEQ ID NO: 602676 - DNA, 25 bp, Rattus norvegicus
tgagaatgagaaaatgccgtgtgtg

SEQ ID NO: 602677 - DNA, 25 bp, Rattus norvegicus
agatgacattggcaggtgagaatga

SEQ ID NO: 602678 - DNA, 25 bp, Rattus norvegicus
cttctgtttcactgcggagatgaca

SEQ ID NO: 602679 - DNA, 25 bp, Rattus norvegicus
gcgctcttctgtttcactgcggaga

SEQ ID NO: 602680 - DNA, 25 bp, Rattus norvegicus
accacgggcgcgaaagcgctcttct

SEQ ID NO: 602681 - DNA, 25 bp, Rattus norvegicus
ttcccattggcgctggtgcaggaag

SEQ ID NO: 602682 - DNA, 25 bp, Rattus norvegicus
tcaccttgaagtccgttcccattgg

SEQ ID NO: 602683 - DNA, 25 bp, Rattus norvegicus
acaagacacgacatgcttcggctcg

SEQ ID NO: 602684 - DNA, 25 bp, Rattus norvegicus
gcaaacatggtcagcacgcgcgcgc

SEQ ID NO: 602685 - DNA, 25 bp, Rattus norvegicus
atacgaaggcccgatcgctctgtcg

SEQ ID NO: 602686 - DNA, 25 bp, Rattus norvegicus
cgctgcactacagacgcccggggag

SEQ ID NO: 602687 - DNA, 25 bp, Rattus norvegicus
cctctctcccgcagttgggcggtgt

SEQ ID NO: 602688 - DNA, 25 bp, Rattus norvegicus
tcgctctgtcggaagaagtcgatca

SEQ ID NO: 602689 - DNA, 25 bp, Rattus norvegicus
taggtttcaacggacgccctctctc

SEQ ID NO: 602690 - DNA, 25 bp, Rattus norvegicus
ctctggccattgtcttatacgaagg

SEQ ID NO: 602691 - DNA, 25 bp, Rattus norvegicus
aacctggcggcgtcctctggccatt

SEQ ID NO: 602692 - DNA, 25 bp, Rattus norvegicus
gcagcctcacagtcggttcctggcg

SEQ ID NO: 602693 - DNA, 25 bp, Rattus norvegicus
ggggacagcaaagacacgggtaaca

SEQ ID NO: 602694 - DNA, 25 bp, Rattus norvegicus
gccttcatacacgatggcctgcgtg

SEQ ID NO: 602695 - DNA, 25 bp, Rattus norvegicus
ccggatttttgtcctggccttcata

SEQ ID NO: 602696 - DNA, 25 bp, Rattus norvegicus
gcacgcggcacatctccggattttt

SEQ ID NO: 602697 - DNA, 25 bp, Rattus norvegicus
tgatctcatgggtcagcagcacgcg

SEQ ID NO: 602698 - DNA, 25 bp, Rattus norvegicus
aagtcgatcagagtgcgctgcacta

SEQ ID NO: 602699 - DNA, 25 bp, Rattus norvegicus
ggcccgcctgctccaaagacaaata

SEQ ID NO: 602700 - DNA, 25 bp, Rattus norvegicus
gggtgcgatcgccagtgtacactta

SEQ ID NO: 602701 - DNA, 25 bp, Rattus norvegicus
gtgtacacttactttctctttctcc

SEQ ID NO: 602702 - DNA, 25 bp, Rattus norvegicus
ctccacaaagtccacaaaagcggtc

SEQ ID NO: 602703 - DNA, 25 bp, Rattus norvegicus
aagcggtcctttcgatctccaccgg

SEQ ID NO: 602704 - DNA, 25 bp, Rattus norvegicus
gcctgtcgtagagcgccagcacgaa

SEQ ID NO: 602705 - DNA, 25 bp, Rattus norvegicus
cgccagcacgaagtggaagaaattg

SEQ ID NO: 602706 - DNA, 25 bp, Rattus norvegicus
aaggaggctgcttctcgaagtgcgc

SEQ ID NO: 602707 - DNA, 25 bp, Rattus norvegicus
tgtgcatccacgagcgcaccgggtt

SEQ ID NO: 602708 - DNA, 25 bp, Rattus norvegicus
cccgcgcggaatattctcctgaatc

SEQ ID NO: 602709 - DNA, 25 bp, Rattus norvegicus
tgaatcccaaacatgaacactgctg

SEQ ID NO: 602710 - DNA, 25 bp, Rattus norvegicus
gcacagagaagttgctcggcccttg

SEQ ID NO: 602711 - DNA, 25 bp, Rattus norvegicus
tgtcatcctagccaggcggcgtccg

SEQ ID NO: 602712 - DNA, 25 bp, Rattus norvegicus
cgcgctcaacgtggtgtcatcctag

SEQ ID NO: 602713 - DNA, 25 bp, Rattus norvegicus
tccaaacgcctgaaaagcagagcag

SEQ ID NO: 602714 - DNA, 25 bp, Rattus norvegicus
aaagagcgctcagcctctccggcga

SEQ ID NO: 602715 - DNA, 25 bp, Rattus norvegicus
gcgacccggagctggtgtccagtct

SEQ ID NO: 602716 - DNA, 25 bp, Rattus norvegicus
cggagctggtgtccagtctgttaca

SEQ ID NO: 602717 - DNA, 25 bp, Rattus norvegicus
tgtccagtctgttacaaggtccttg

SEQ ID NO: 602718 - DNA, 25 bp, Rattus norvegicus
ttacaaggtccttgcggtggccagg

SEQ ID NO: 602719 - DNA, 25 bp, Rattus norvegicus
agctccaaacgcctgaaaagcagag

SEQ ID NO: 602720 - DNA, 25 bp, Rattus norvegicus
gcagagcagacactgcgggcgccag

SEQ ID NO: 602721 - DNA, 25 bp, Rattus norvegicus
cgccgcccaacctgggtgagcgcgc

SEQ ID NO: 602722 - DNA, 25 bp, Rattus norvegicus
ctgcggcttcccgacctggtttcga

SEQ ID NO: 602723 - DNA, 25 bp, Rattus norvegicus
ccggattcggttcccaggcgctcgg

SEQ ID NO: 602724 - DNA, 25 bp, Rattus norvegicus
ctcggcccgcccaaaggagatctgt

SEQ ID NO: 602725 - DNA, 25 bp, Rattus norvegicus
cccaaaggagatctgtgcgacgccg

SEQ ID NO: 602726 - DNA, 25 bp, Rattus norvegicus
ggtccttgcggtggccaggtctccc

SEQ ID NO: 602727 - DNA, 25 bp, Rattus norvegicus
cggatttacggggagaggcttcaat

SEQ ID NO: 602728 - DNA, 25 bp, Rattus norvegicus
ccggagcaggcagtgaccttaaaga

SEQ ID NO: 602729 - DNA, 25 bp, Rattus norvegicus
tccctacgtcgtgccggagcaggca

SEQ ID NO: 602730 - DNA, 25 bp, Rattus norvegicus
gagtcagtcagatggccagtgccca

SEQ ID NO: 602731 - DNA, 25 bp, Rattus norvegicus
cccagatgtcaagccggagtcagtc

SEQ ID NO: 602732 - DNA, 25 bp, Rattus norvegicus
cacaccagtgggctcccagatgtca

SEQ ID NO: 602733 - DNA, 25 bp, Rattus norvegicus
atagcagcatcaagcgcttcgcgtg

SEQ ID NO: 602734 - DNA, 25 bp, Rattus norvegicus
agtattccttttgtgcggatttacg

SEQ ID NO: 602735 - DNA, 25 bp, Rattus norvegicus
cccaacgcgatttgcacgggtggcc

SEQ ID NO: 602736 - DNA, 25 bp, Rattus norvegicus
tccagggacctgattgggaaggacc

SEQ ID NO: 602737 - DNA, 25 bp, Rattus norvegicus
tcagatgggcgtccagggacctgat

SEQ ID NO: 602738 - DNA, 25 bp, Rattus norvegicus
ccagaccgctcctacgggtcagatg

SEQ ID NO: 602739 - DNA, 25 bp, Rattus norvegicus
gctctggccagtgacctaaccattc

SEQ ID NO: 602740 - DNA, 25 bp, Rattus norvegicus
gcttcgcgtgccacacaccagtggg

SEQ ID NO: 602741 - DNA, 25 bp, Rattus norvegicus
gacgggctcgccatctttaaccagg

SEQ ID NO: 602742 - DNA, 25 bp, Rattus norvegicus
cagcgcacgggctgctgggcacaaa

SEQ ID NO: 602743 - DNA, 25 bp, Rattus norvegicus
ccggcgctttcattgtggtccgggc

SEQ ID NO: 602744 - DNA, 25 bp, Rattus norvegicus
cacgcgacgggctcgccatctttaa

SEQ ID NO: 602745 - DNA, 25 bp, Rattus norvegicus
ccgagttcgcgcattgtgcagcgca

SEQ ID NO: 602746 - DNA, 25 bp, Rattus norvegicus
tcgccatctttaaccaggccgggct

SEQ ID NO: 602747 - DNA, 25 bp, Rattus norvegicus
attgcggagacacctgcaaggcgcg

SEQ ID NO: 602748 - DNA, 25 bp, Rattus norvegicus
cacaaagcgccggagtcgtaaatta

SEQ ID NO: 602749 - DNA, 25 bp, Rattus norvegicus
agtcgtaaattaggaccgaggtgtg

SEQ ID NO: 602750 - DNA, 25 bp, Rattus norvegicus
attaggaccgaggtgtgttggctcc

SEQ ID NO: 602751 - DNA, 25 bp, Rattus norvegicus
gtgcgccaggttcatctgcacctgc

SEQ ID NO: 602752 - DNA, 25 bp, Rattus norvegicus
ataacttgtaagtgcgctgcccggc

SEQ ID NO: 602753 - DNA, 25 bp, Rattus norvegicus
gcccggcgtcgcacttaattgcgga

SEQ ID NO: 602754 - DNA, 25 bp, Rattus norvegicus
tcgcacttaattgcggagacacctg

SEQ ID NO: 602755 - DNA, 25 bp, Rattus norvegicus
tttgctcagttaaggctcctgaatc

SEQ ID NO: 602756 - DNA, 25 bp, Rattus norvegicus
cggaggtgaccaagtttgacaaaca

SEQ ID NO: 602757 - DNA, 25 bp, Rattus norvegicus
tagagaggagagccagagcgcccac

SEQ ID NO: 602758 - DNA, 25 bp, Rattus norvegicus
ttctgagtgaaaaacgcgtaggcgc

SEQ ID NO: 602759 - DNA, 25 bp, Rattus norvegicus
cagttaaggctcctgaatcccgacc

SEQ ID NO: 602760 - DNA, 25 bp, Rattus norvegicus
gaaaaacgcgtaggcgcctcctgcg

SEQ ID NO: 602761 - DNA, 25 bp, Rattus norvegicus
ccacgatatttattttgctcagtta

SEQ ID NO: 602762 - DNA, 25 bp, Rattus norvegicus
gcctcctgcggaggtgaccaagttt

SEQ ID NO: 602763 - DNA, 25 bp, Rattus norvegicus
atgccgcctcttcccacgatattta

SEQ ID NO: 602764 - DNA, 25 bp, Rattus norvegicus
ctctggttttctatgccgcctcttc

SEQ ID NO: 602765 - DNA, 25 bp, Rattus norvegicus
gggtcgtaggctctggttttctatg

SEQ ID NO: 602766 - DNA, 25 bp, Rattus norvegicus
gaaaactcaggggtcgtaggctctg

SEQ ID NO: 602767 - DNA, 25 bp, Rattus norvegicus
gtttgacaaacagcgcctcctgggg

SEQ ID NO: 602768 - DNA, 25 bp, Rattus norvegicus
cccgggtacagaagaattttctgag

SEQ ID NO: 602769 - DNA, 25 bp, Rattus norvegicus
gtgcctgcgtatacccgccatgctg

SEQ ID NO: 602770 - DNA, 25 bp, Rattus norvegicus
ggcgccagctggtacttttaaaatc

SEQ ID NO: 602771 - DNA, 25 bp, Rattus norvegicus
tttcgtgcccaaagcagaacagacc

SEQ ID NO: 602772 - DNA, 25 bp, Rattus norvegicus
agaggacgccctcggttgcccaata

SEQ ID NO: 602773 - DNA, 25 bp, Rattus norvegicus
gggtagctccgacttctgcctgaag

SEQ ID NO: 602774 - DNA, 25 bp, Rattus norvegicus
ctgcctgaaggtctgtgatgagtac

SEQ ID NO: 602775 - DNA, 25 bp, Rattus norvegicus
gatgagtacagacagggccctggtc

SEQ ID NO: 602776 - DNA, 25 bp, Rattus norvegicus
cctggtcttcctccatcatctgtta

SEQ ID NO: 602777 - DNA, 25 bp, Rattus norvegicus
catctgttacgagagagtttgctga

SEQ ID NO: 602778 - DNA, 25 bp, Rattus norvegicus
ggctcatgccggaaaacttgggttc

SEQ ID NO: 602779 - DNA, 25 bp, Rattus norvegicus
tccggacccgcctctctaggattta

SEQ ID NO: 602780 - DNA, 25 bp, Rattus norvegicus
ctctctaggatttaggcgcgctcta

SEQ ID NO: 602781 - DNA, 25 bp, Rattus norvegicus
cggcgccgagctgtagctcttaaaa

SEQ ID NO: 602782 - DNA, 25 bp, Rattus norvegicus
ttgcacgcgcgtgccaataggcagg

SEQ ID NO: 602783 - DNA, 25 bp, Rattus norvegicus
tgccacagagccagcgcctgggaca

SEQ ID NO: 602784 - DNA, 25 bp, Rattus norvegicus
gaacagcgcgcaaagtgcgccaatc

SEQ ID NO: 602785 - DNA, 25 bp, Rattus norvegicus
gcctgggacacggagtccacgctgc

SEQ ID NO: 602786 - DNA, 25 bp, Rattus norvegicus
aggcggtcctgtaggatgccacaga

SEQ ID NO: 602787 - DNA, 25 bp, Rattus norvegicus
tcagcggcgctctgaaggcggtcct

SEQ ID NO: 602788 - DNA, 25 bp, Rattus norvegicus
tagctgcgttcagcggcgctctgaa

SEQ ID NO: 602789 - DNA, 25 bp, Rattus norvegicus
gctgggatttccttagctgcgttca

SEQ ID NO: 602790 - DNA, 25 bp, Rattus norvegicus
cggtttagcaacaagctgggatttc

SEQ ID NO: 602791 - DNA, 25 bp, Rattus norvegicus
ctcgaaaaggagcagcggtttagca

SEQ ID NO: 602792 - DNA, 25 bp, Rattus norvegicus
tggcggggtctctcagactcgaaaa

SEQ ID NO: 602793 - DNA, 25 bp, Rattus norvegicus
ctctgatagacagctggtgcgtggc

SEQ ID NO: 602794 - DNA, 25 bp, Rattus norvegicus
aatgctctgacggagctctgataga

SEQ ID NO: 602795 - DNA, 25 bp, Rattus norvegicus
gcctctccgcaaaaaatgctctgac

SEQ ID NO: 602796 - DNA, 25 bp, Rattus norvegicus
aagtttttagatcgaacagcgcgca

SEQ ID NO: 602797 - DNA, 25 bp, Rattus norvegicus
cggagcccttacctgagccacggaa

SEQ ID NO: 602798 - DNA, 25 bp, Rattus norvegicus
ctccctggcgcccaagtccagcggc

SEQ ID NO: 602799 - DNA, 25 bp, Rattus norvegicus
gcccggccacgctgaacagcccgcc

SEQ ID NO: 602800 - DNA, 25 bp, Rattus norvegicus
catccagtgtccctcgcccggccac

SEQ ID NO: 602801 - DNA, 25 bp, Rattus norvegicus
ggggatctggctccgcatccagtgt

SEQ ID NO: 602802 - DNA, 25 bp, Rattus norvegicus
cagaccctcgggcaccggggatctg

SEQ ID NO: 602803 - DNA, 25 bp, Rattus norvegicus
cagtgaaggcctcgcaaaagttccc

SEQ ID NO: 602804 - DNA, 25 bp, Rattus norvegicus
ccacaccagtgaaggcctcgcaaaa

SEQ ID NO: 602805 - DNA, 25 bp, Rattus norvegicus
tgtcaccgtgccacaccagtgaagg

SEQ ID NO: 602806 - DNA, 25 bp, Rattus norvegicus
gagccgccaagcctccctcagtctt

SEQ ID NO: 602807 - DNA, 25 bp, Rattus norvegicus
caactttgagggctctgcagccgcc

SEQ ID NO: 602808 - DNA, 25 bp, Rattus norvegicus
agttcaactttgagggctctgcagc

SEQ ID NO: 602809 - DNA, 25 bp, Rattus norvegicus
cgctcgacgcgcgaagttcaacttt

SEQ ID NO: 602810 - DNA, 25 bp, Rattus norvegicus
aacctctcctccgacgggcgtggtg

SEQ ID NO: 602811 - DNA, 25 bp, Rattus norvegicus
ctgaggtgcggggaattctttcacc

SEQ ID NO: 602812 - DNA, 25 bp, Rattus norvegicus
gccctcctctcattccttgtgattg

SEQ ID NO: 602813 - DNA, 25 bp, Rattus norvegicus
cttctgcaacccttggtcggtggga

SEQ ID NO: 602814 - DNA, 25 bp, Rattus norvegicus
ggtcgtttgtttaagatatgccaca

SEQ ID NO: 602815 - DNA, 25 bp, Rattus norvegicus
cgttcacaaagtcagtcccaaaggt

SEQ ID NO: 602816 - DNA, 25 bp, Rattus norvegicus
ccttgtgattggttactgagtcctg

SEQ ID NO: 602817 - DNA, 25 bp, Rattus norvegicus
ggaattctttcacccgccacaggtc

SEQ ID NO: 602818 - DNA, 25 bp, Rattus norvegicus
caggagtagccgaaacccgagtctc

SEQ ID NO: 602819 - DNA, 25 bp, Rattus norvegicus
caggctgtccatgcggcttagcgaa

SEQ ID NO: 602820 - DNA, 25 bp, Rattus norvegicus
ggaaccactcgaccacgtgtctgga

SEQ ID NO: 602821 - DNA, 25 bp, Rattus norvegicus
gactgtgcctcacagaggggctgca

SEQ ID NO: 602822 - DNA, 25 bp, Rattus norvegicus
cgtagcctgaagaacagactgtgcc

SEQ ID NO: 602823 - DNA, 25 bp, Rattus norvegicus
ctgagtcctgatagatacaccgcgg

SEQ ID NO: 602824 - DNA, 25 bp, Rattus norvegicus
ggcttgtcgcttctccgttcacaaa

SEQ ID NO: 602825 - DNA, 25 bp, Rattus norvegicus
ctcgtggtccaacggcggccttagt

SEQ ID NO: 602826 - DNA, 25 bp, Rattus norvegicus
ctagggaagcagagcacaatggacc

SEQ ID NO: 602827 - DNA, 25 bp, Rattus norvegicus
tcaccagctgacttagggagggtct

SEQ ID NO: 602828 - DNA, 25 bp, Rattus norvegicus
ctaggtccgggactttcctgaatca

SEQ ID NO: 602829 - DNA, 25 bp, Rattus norvegicus
gcaggccgagcctagtccctaggtc

SEQ ID NO: 602830 - DNA, 25 bp, Rattus norvegicus
agtcttggctggtgatcagccggca

SEQ ID NO: 602831 - DNA, 25 bp, Rattus norvegicus
agacccgcatgtgggcgcctcctga

SEQ ID NO: 602832 - DNA, 25 bp, Rattus norvegicus
agcacaatggacctgccctccggag

SEQ ID NO: 602833 - DNA, 25 bp, Rattus norvegicus
aacgccgcatgtgcgggttgagctc

SEQ ID NO: 602834 - DNA, 25 bp, Rattus norvegicus
tcaaaaccaagtatgcgggtcggca

SEQ ID NO: 602835 - DNA, 25 bp, Rattus norvegicus
gagctactgcgcctcaaaaccaagt

SEQ ID NO: 602836 - DNA, 25 bp, Rattus norvegicus
tgcccggcagtttgaggagctactg

SEQ ID NO: 602837 - DNA, 25 bp, Rattus norvegicus
gtgcgcagcctcctcgagtgtccat

SEQ ID NO: 602838 - DNA, 25 bp, Rattus norvegicus
cgcctcctgaaggaagtcttggctg

SEQ ID NO: 602839 - DNA, 25 bp, Rattus norvegicus
tggccaatggctctagctgacggtg

SEQ ID NO: 602840 - DNA, 25 bp, Rattus norvegicus
agaatcgttacctgtccgtggagca

SEQ ID NO: 602841 - DNA, 25 bp, Rattus norvegicus
ggggcaacccgcaatactgagcctg

SEQ ID NO: 602842 - DNA, 25 bp, Rattus norvegicus
ctgcgtcctgatggtgtagggaacc

SEQ ID NO: 602843 - DNA, 25 bp, Rattus norvegicus
tgccaatgtatgactgcgcggctgc

SEQ ID NO: 602844 - DNA, 25 bp, Rattus norvegicus
accggacgtcgaagcatgaactttc

SEQ ID NO: 602845 - DNA, 25 bp, Rattus norvegicus
tgccgggtctaacgcgctctaacga

SEQ ID NO: 602846 - DNA, 25 bp, Rattus norvegicus
cgggcttcggagctaactctcttgg

SEQ ID NO: 602847 - DNA, 25 bp, Rattus norvegicus
aactctcttggtttcgcgatgcggc

SEQ ID NO: 602848 - DNA, 25 bp, Rattus norvegicus
actgattcttctactctggtcccta

SEQ ID NO: 602849 - DNA, 25 bp, Rattus norvegicus
tggtccctagcccactcggttatcg

SEQ ID NO: 602850 - DNA, 25 bp, Rattus norvegicus
cggttatcgctactggtggccaatg

SEQ ID NO: 602851 - DNA, 25 bp, Rattus norvegicus
gtctgcattcatcggccacgggaga

SEQ ID NO: 602852 - DNA, 25 bp, Rattus norvegicus
acggcaggattaggggctccagact

SEQ ID NO: 602853 - DNA, 25 bp, Rattus norvegicus
ggcagatccacggaggttccgcgtt

SEQ ID NO: 602854 - DNA, 25 bp, Rattus norvegicus
gcgctctctattggcagatccacgg

SEQ ID NO: 602855 - DNA, 25 bp, Rattus norvegicus
ctctctattggcagatccacggagg

SEQ ID NO: 602856 - DNA, 25 bp, Rattus norvegicus
gccgagcgctctctattggcagatc

SEQ ID NO: 602857 - DNA, 25 bp, Rattus norvegicus
agcgctctctattggcagatccacg

SEQ ID NO: 602858 - DNA, 25 bp, Rattus norvegicus
cgagcgctctctattggcagatcca

SEQ ID NO: 602859 - DNA, 25 bp, Rattus norvegicus
attggcagatccacggaggttccgc

SEQ ID NO: 602860 - DNA, 25 bp, Rattus norvegicus
ctattggcagatccacggaggttcc

SEQ ID NO: 602861 - DNA, 25 bp, Rattus norvegicus
gcacgcaggtgctgggttccaggtg

SEQ ID NO: 602862 - DNA, 25 bp, Rattus norvegicus
aggtgctccgggattcagagacccc

SEQ ID NO: 602863 - DNA, 25 bp, Rattus norvegicus
cacggccgagcgctctctattggca

SEQ ID NO: 602864 - DNA, 25 bp, Rattus norvegicus
acggccgagcgctctctattggcag

SEQ ID NO: 602865 - DNA, 25 bp, Rattus norvegicus
tctattggcagatccacggaggttc

SEQ ID NO: 602866 - DNA, 25 bp, Rattus norvegicus
cagatccacggaggttccgcgttcc

SEQ ID NO: 602867 - DNA, 25 bp, Rattus norvegicus
agcggctacgcaggcccaacctcaa

SEQ ID NO: 602868 - DNA, 25 bp, Rattus norvegicus
aagaaagtctgaggccttaagaacg

SEQ ID NO: 602869 - DNA, 25 bp, Rattus norvegicus
aaacagctcgcgcagacgcagtcgg

SEQ ID NO: 602870 - DNA, 25 bp, Rattus norvegicus
ctctttccatagaccgcagcggcta

SEQ ID NO: 602871 - DNA, 25 bp, Rattus norvegicus
gacactctttccatagaccgcagcg

SEQ ID NO: 602872 - DNA, 25 bp, Rattus norvegicus
tctgctggccgactattccaagaca

SEQ ID NO: 602873 - DNA, 25 bp, Rattus norvegicus
gccatctatatctgctggccgacta

SEQ ID NO: 602874 - DNA, 25 bp, Rattus norvegicus
acaccactcgagaaggccatctata

SEQ ID NO: 602875 - DNA, 25 bp, Rattus norvegicus
ctagcccttacaccactcgagaagg

SEQ ID NO: 602876 - DNA, 25 bp, Rattus norvegicus
agggcgtcgcgtcctagcccttaca

SEQ ID NO: 602877 - DNA, 25 bp, Rattus norvegicus
gccttaagaacgcagagggcgtcgc

SEQ ID NO: 602878 - DNA, 25 bp, Rattus norvegicus
gggtccaggccttcgagcatccaat

SEQ ID NO: 602879 - DNA, 25 bp, Rattus norvegicus
gagcatccaatccagccggccgcag

SEQ ID NO: 602880 - DNA, 25 bp, Rattus norvegicus
ggccgactattccaagacactcttt

SEQ ID NO: 602881 - DNA, 25 bp, Rattus norvegicus
ctgagtcccgcttcgggggtctgtc

SEQ ID NO: 602882 - DNA, 25 bp, Rattus norvegicus
agacgaccatggacgctggcctcga

SEQ ID NO: 602883 - DNA, 25 bp, Rattus norvegicus
gcgttgtcttgtgagaccctcggcc

SEQ ID NO: 602884 - DNA, 25 bp, Rattus norvegicus
tcttgtgagaccctcggccggccaa

SEQ ID NO: 602885 - DNA, 25 bp, Rattus norvegicus
ggacgcaggcatggggagagactgt

SEQ ID NO: 602886 - DNA, 25 bp, Rattus norvegicus
accatggacgctggcctcgaggtct

SEQ ID NO: 602887 - DNA, 25 bp, Rattus norvegicus
ctcggccggccaagcataagagagg

SEQ ID NO: 602888 - DNA, 25 bp, Rattus norvegicus
cagatggccatagagggccagtctc

SEQ ID NO: 602889 - DNA, 25 bp, Rattus norvegicus
agatggctatggactccggcctcgg

SEQ ID NO: 602890 - DNA, 25 bp, Rattus norvegicus
ggagatggctatggactccggcctc

SEQ ID NO: 602891 - DNA, 25 bp, Rattus norvegicus
gtggacgctagccttgggaggctgt

SEQ ID NO: 602892 - DNA, 25 bp, Rattus norvegicus
agagactgtggctgagtcccgcttc

SEQ ID NO: 602893 - DNA, 25 bp, Rattus norvegicus
cgtcggtagggagaccgctgtggac

SEQ ID NO: 602894 - DNA, 25 bp, Rattus norvegicus
acgctggcctcgaggtctgtgaaac

SEQ ID NO: 602895 - DNA, 25 bp, Rattus norvegicus
gtaagatgcaccgagactcaccgcc

SEQ ID NO: 602896 - DNA, 25 bp, Rattus norvegicus
aaaggagccggagcccaactgcgac

SEQ ID NO: 602897 - DNA, 25 bp, Rattus norvegicus
agcttgcgccgctcagctctgaggc

SEQ ID NO: 602898 - DNA, 25 bp, Rattus norvegicus
tagcagggcagcttgcgccgctcag

SEQ ID NO: 602899 - DNA, 25 bp, Rattus norvegicus
ccactgagaggtagcagggcagctt

SEQ ID NO: 602900 - DNA, 25 bp, Rattus norvegicus
cctgggaagtgaccactgagaggta

SEQ ID NO: 602901 - DNA, 25 bp, Rattus norvegicus
acaggcctgggaagtgaccactgag

SEQ ID NO: 602902 - DNA, 25 bp, Rattus norvegicus
ctctgcgacatggtggctccgcaaa

SEQ ID NO: 602903 - DNA, 25 bp, Rattus norvegicus
acacagaactgcatcgcggcctcca

SEQ ID NO: 602904 - DNA, 25 bp, Rattus norvegicus
cccacagcctcaccctgcaggttct

SEQ ID NO: 602905 - DNA, 25 bp, Rattus norvegicus
gtactgtctgtaagatgcaccgaga

SEQ ID NO: 602906 - DNA, 25 bp, Rattus norvegicus
ccggcctgtgaaggtactgtctgta

SEQ ID NO: 602907 - DNA, 25 bp, Rattus norvegicus
cccgaccggcctgtgaaggtactgt

SEQ ID NO: 602908 - DNA, 25 bp, Rattus norvegicus
cgacatggtggctccgcaaaggagc

SEQ ID NO: 602909 - DNA, 25 bp, Rattus norvegicus
ttaagaagcagaataggggaagata

SEQ ID NO: 602910 - DNA, 25 bp, Rattus norvegicus
cacgctggggtccttgtggacctcg

SEQ ID NO: 602911 - DNA, 25 bp, Rattus norvegicus
ataggggaagataaagagcgcacgc

SEQ ID NO: 602912 - DNA, 25 bp, Rattus norvegicus
caaggcgggaaggaattaagaagca

SEQ ID NO: 602913 - DNA, 25 bp, Rattus norvegicus
ctgtgacgcagcgtctggggctcca

SEQ ID NO: 602914 - DNA, 25 bp, Rattus norvegicus
ccagcaggagaagctgtgacgcagc

SEQ ID NO: 602915 - DNA, 25 bp, Rattus norvegicus
ttcgcctctcgagccagcaggagaa

SEQ ID NO: 602916 - DNA, 25 bp, Rattus norvegicus
tttgcagttgcttcgcctctcgagc

SEQ ID NO: 602917 - DNA, 25 bp, Rattus norvegicus
cagaaagttttgcagttgcttcgcc

SEQ ID NO: 602918 - DNA, 25 bp, Rattus norvegicus
cgcggtgaagttctgcagaaagttt

SEQ ID NO: 602919 - DNA, 25 bp, Rattus norvegicus
ccaggtttcgccacgcggtgaagtt

SEQ ID NO: 602920 - DNA, 25 bp, Rattus norvegicus
ccaggacttacagccgcccaggttt

SEQ ID NO: 602921 - DNA, 25 bp, Rattus norvegicus
cctaggctggccaggacttacagcc

SEQ ID NO: 602922 - DNA, 25 bp, Rattus norvegicus
agataaagagcgcacgctggggtcc

SEQ ID NO: 602923 - DNA, 25 bp, Rattus norvegicus
cgtgtgaatcgccaacagcattttc

SEQ ID NO: 602924 - DNA, 25 bp, Rattus norvegicus
cccacagcggagagttaatgatata

SEQ ID NO: 602925 - DNA, 25 bp, Rattus norvegicus
ccgagccgagcacagtgggatatca

SEQ ID NO: 602926 - DNA, 25 bp, Rattus norvegicus
ttcgcagggacattgtgctccgagc

SEQ ID NO: 602927 - DNA, 25 bp, Rattus norvegicus
gtcgcggtggcatttggtaatcaca

SEQ ID NO: 602928 - DNA, 25 bp, Rattus norvegicus
ccacaatggccagcgatattttata

SEQ ID NO: 602929 - DNA, 25 bp, Rattus norvegicus
agccacctgagagcggaatgcgccg

SEQ ID NO: 602930 - DNA, 25 bp, Rattus norvegicus
cttaatcttgtcgtcttcgcaggga

SEQ ID NO: 602931 - DNA, 25 bp, Rattus norvegicus
tgcgacactgtcacgccgcgttagc

SEQ ID NO: 602932 - DNA, 25 bp, Rattus norvegicus
gggaaatcctctttcagacgcttta

SEQ ID NO: 602933 - DNA, 25 bp, Rattus norvegicus
ggtaatcacacggaggcacaaaagg

SEQ ID NO: 602934 - DNA, 25 bp, Rattus norvegicus
caacctggaagtatgcgctgcccgc

SEQ ID NO: 602935 - DNA, 25 bp, Rattus norvegicus
atcgccggccagtcatagcaacctg

SEQ ID NO: 602936 - DNA, 25 bp, Rattus norvegicus
atgaatccggctttgtgcgacactg

SEQ ID NO: 602937 - DNA, 25 bp, Rattus norvegicus
ctggcactgagtattcagggctggc

SEQ ID NO: 602938 - DNA, 25 bp, Rattus norvegicus
agaagcctgatcgaggggaaccttg

SEQ ID NO: 602939 - DNA, 25 bp, Rattus norvegicus
agcagaggtgggatcctcaggatcc

SEQ ID NO: 602940 - DNA, 25 bp, Rattus norvegicus
gcaccctacagctgacccgggaggg

SEQ ID NO: 602941 - DNA, 25 bp, Rattus norvegicus
acgcgctctgcagggctcttttcgc

SEQ ID NO: 602942 - DNA, 25 bp, Rattus norvegicus
cactgcgatggctgagcccggccgt

SEQ ID NO: 602943 - DNA, 25 bp, Rattus norvegicus
ccaccggctcctggcactgagtatt

SEQ ID NO: 602944 - DNA, 25 bp, Rattus norvegicus
gaatagaaaagggtggcgacgccca

SEQ ID NO: 602945 - DNA, 25 bp, Rattus norvegicus
gccagagttggggtttttgcctctc

SEQ ID NO: 602946 - DNA, 25 bp, Rattus norvegicus
cctctctgggagatttttcgcgttc

SEQ ID NO: 602947 - DNA, 25 bp, Rattus norvegicus
tcgcgttccactggccgtttatttc

SEQ ID NO: 602948 - DNA, 25 bp, Rattus norvegicus
ctggccgtttatttcacctcgccgg

SEQ ID NO: 602949 - DNA, 25 bp, Rattus norvegicus
tgcagggctcttttcgctccaccgg

SEQ ID NO: 602950 - DNA, 25 bp, Rattus norvegicus
gcggagatggcaccggaatagaaaa

SEQ ID NO: 602951 - DNA, 25 bp, Rattus norvegicus
aggacaatgagaaccagcggctgca

SEQ ID NO: 602952 - DNA, 25 bp, Rattus norvegicus
cccgacaaggtgaagaccgtgctcc

SEQ ID NO: 602953 - DNA, 25 bp, Rattus norvegicus
gtaagcacgccgtcctggtcacgga

SEQ ID NO: 602954 - DNA, 25 bp, Rattus norvegicus
tggtcacggagctcaagaccaagct

SEQ ID NO: 602955 - DNA, 25 bp, Rattus norvegicus
agctcaagaccaagctgcacgagga

SEQ ID NO: 602956 - DNA, 25 bp, Rattus norvegicus
cacgaggagaagatgaaggagctgc

SEQ ID NO: 602957 - DNA, 25 bp, Rattus norvegicus
ccgagctgctgagggtcatcaagat

SEQ ID NO: 602958 - DNA, 25 bp, Rattus norvegicus
tgagcacgagcagcgtaagcacgcc

SEQ ID NO: 602959 - DNA, 25 bp, Rattus norvegicus
gggtcatcaagattaaggacaatga

SEQ ID NO: 602960 - DNA, 25 bp, Rattus norvegicus
aggccttgctcaacaccctgcggga

SEQ ID NO: 602961 - DNA, 25 bp, Rattus norvegicus
tgctcaacaccctgcgggatggcgc

SEQ ID NO: 602962 - DNA, 25 bp, Rattus norvegicus
atggcgcgcccgacaaggtgaagac

SEQ ID NO: 602963 - DNA, 25 bp, Rattus norvegicus
aaggtgaagaccgtgctcctgtgcg

SEQ ID NO: 602964 - DNA, 25 bp, Rattus norvegicus
ctgctgagggtcatcaagattaagg

SEQ ID NO: 602965 - DNA, 25 bp, Rattus norvegicus
cgaaggccggaatttaaaggctctg

SEQ ID NO: 602966 - DNA, 25 bp, Rattus norvegicus
atgcgtgattctgggagctcagccc

SEQ ID NO: 602967 - DNA, 25 bp, Rattus norvegicus
cccacctccaaatgcgtgattctgg

SEQ ID NO: 602968 - DNA, 25 bp, Rattus norvegicus
caaggcgtgaaaaagccgctaagtc

SEQ ID NO: 602969 - DNA, 25 bp, Rattus norvegicus
gagaacttccggcaaggcgtgaaaa

SEQ ID NO: 602970 - DNA, 25 bp, Rattus norvegicus
atgtagcgagaacttccggcaaggc

SEQ ID NO: 602971 - DNA, 25 bp, Rattus norvegicus
atttaaaggctctgccggaaatgta

SEQ ID NO: 602972 - DNA, 25 bp, Rattus norvegicus
ccaggaagaactatgcaggtcgcga

SEQ ID NO: 602973 - DNA, 25 bp, Rattus norvegicus
cactccaggaagaactatgcaggtc

SEQ ID NO: 602974 - DNA, 25 bp, Rattus norvegicus
acatacagagaacactccaggaaga

SEQ ID NO: 602975 - DNA, 25 bp, Rattus norvegicus
cgcagaaacccgctccgcatgctgg

SEQ ID NO: 602976 - DNA, 25 bp, Rattus norvegicus
aagctggggactcccagcgtccaga

SEQ ID NO: 602977 - DNA, 25 bp, Rattus norvegicus
tcccgctccttctcgttcagcagcc

SEQ ID NO: 602978 - DNA, 25 bp, Rattus norvegicus
ctgccggaaatgtagcgagaacttc

SEQ ID NO: 602979 - DNA, 25 bp, Rattus norvegicus
ccgatggcgttcaagtggacattgc

SEQ ID NO: 602980 - DNA, 25 bp, Rattus norvegicus
cggggcctggatgcaaataagctaa

SEQ ID NO: 602981 - DNA, 25 bp, Rattus norvegicus
atggccagcggacacagcctttgtt

SEQ ID NO: 602982 - DNA, 25 bp, Rattus norvegicus
ggcctcaaagcactcggacgtccga

SEQ ID NO: 602983 - DNA, 25 bp, Rattus norvegicus
agcctttgttggctccgggcctcaa

SEQ ID NO: 602984 - DNA, 25 bp, Rattus norvegicus
gagctctgtctccaggatggccagc

SEQ ID NO: 602985 - DNA, 25 bp, Rattus norvegicus
ccagagcataggtggtcggcctact

SEQ ID NO: 602986 - DNA, 25 bp, Rattus norvegicus
gccagctctctgaactcgggtgatc

SEQ ID NO: 602987 - DNA, 25 bp, Rattus norvegicus
aaacccgttgctcagtcggcgcaca

SEQ ID NO: 602988 - DNA, 25 bp, Rattus norvegicus
cgtgagtcctacacctgttccagtg

SEQ ID NO: 602989 - DNA, 25 bp, Rattus norvegicus
ttggcttgcacgctcaacggacgac

SEQ ID NO: 602990 - DNA, 25 bp, Rattus norvegicus
gcccgtggatcaggatgtccttcca

SEQ ID NO: 602991 - DNA, 25 bp, Rattus norvegicus
gggctagctcacactcggacttcct

SEQ ID NO: 602992 - DNA, 25 bp, Rattus norvegicus
ataagctaatcggagcccagcgctg

SEQ ID NO: 602993 - DNA, 25 bp, Rattus norvegicus
ctggcgagcaatcaggaattcccta

SEQ ID NO: 602994 - DNA, 25 bp, Rattus norvegicus
ccttcaggaatgctgtgactggcga

SEQ ID NO: 602995 - DNA, 25 bp, Rattus norvegicus
ttccttcacagagcggcggagactt

SEQ ID NO: 602996 - DNA, 25 bp, Rattus norvegicus
gctaatcgccttcctcctatcttga

SEQ ID NO: 602997 - DNA, 25 bp, Rattus norvegicus
gtaggctcgacccttgcaccgaaaa

SEQ ID NO: 602998 - DNA, 25 bp, Rattus norvegicus
taccagcggacaagggtctagtttg

SEQ ID NO: 602999 - DNA, 25 bp, Rattus norvegicus
tggtattagattccctgcgccgcgc

SEQ ID NO: 603000 - DNA, 25 bp, Rattus norvegicus
ttgctcctagtactggctctggctc

SEQ ID NO: 603001 - DNA, 25 bp, Rattus norvegicus
ccgaccctacgagagcagagcgcta

SEQ ID NO: 603002 - DNA, 25 bp, Rattus norvegicus
gctggatgccgatatggacgacata

SEQ ID NO: 603003 - DNA, 25 bp, Rattus norvegicus
ctccgctgtcttcgtacaaaaagtc

SEQ ID NO: 603004 - DNA, 25 bp, Rattus norvegicus
cctcaaactttaggccgcggctttg

SEQ ID NO: 603005 - DNA, 25 bp, Rattus norvegicus
cagtgggcggtttcactcaccatcc

SEQ ID NO: 603006 - DNA, 25 bp, Rattus norvegicus
tggcgactgcatcccaacgcagaga

SEQ ID NO: 603007 - DNA, 25 bp, Rattus norvegicus
tctggtctgcagaagcatcgctcga

SEQ ID NO: 603008 - DNA, 25 bp, Rattus norvegicus
ctctcaacgtttctttttggccttg

SEQ ID NO: 603009 - DNA, 25 bp, Rattus norvegicus
ccacctccagcgtaagaggcggtaa

SEQ ID NO: 603010 - DNA, 25 bp, Rattus norvegicus
agcgcacgcgtattggagccattcc

SEQ ID NO: 603011 - DNA, 25 bp, Rattus norvegicus
cagcgtctccgtggtgaccgtgtat

SEQ ID NO: 603012 - DNA, 25 bp, Rattus norvegicus
gtcacaaactaacgggcgtagactc

SEQ ID NO: 603013 - DNA, 25 bp, Rattus norvegicus
cagcggtcagctccggaggcctgaa

SEQ ID NO: 603014 - DNA, 25 bp, Rattus norvegicus
tatgccgcgtagctcgctcgtttgt

SEQ ID NO: 603015 - DNA, 25 bp, Rattus norvegicus
ctcgctcgtttgttaggcggtgcct

SEQ ID NO: 603016 - DNA, 25 bp, Rattus norvegicus
cagccgacgttttagggcggagtct

SEQ ID NO: 603017 - DNA, 25 bp, Rattus norvegicus
gggtgggataactgttacgtcaatc

SEQ ID NO: 603018 - DNA, 25 bp, Rattus norvegicus
tgttacgtcaatcaccgctggccgg

SEQ ID NO: 603019 - DNA, 25 bp, Rattus norvegicus
aagcccgagggtccattgctctgga

SEQ ID NO: 603020 - DNA, 25 bp, Rattus norvegicus
cattgctctggaagacgatctggtc

SEQ ID NO: 603021 - DNA, 25 bp, Rattus norvegicus
cggctcagagagctttgtgacgtca

SEQ ID NO: 603022 - DNA, 25 bp, Rattus norvegicus
caatgcgttgccagcccagctctaa

SEQ ID NO: 603023 - DNA, 25 bp, Rattus norvegicus
gccagcgtggcgtcaagattaacga

SEQ ID NO: 603024 - DNA, 25 bp, Rattus norvegicus
gtacagaccggtagacatgggaccc

SEQ ID NO: 603025 - DNA, 25 bp, Rattus norvegicus
ttgccggggtactctagtacagacc

SEQ ID NO: 603026 - DNA, 25 bp, Rattus norvegicus
ccaggcctgactcgcttcaagtaca

SEQ ID NO: 603027 - DNA, 25 bp, Rattus norvegicus
tgacagtgacactaggcctcttgta

SEQ ID NO: 603028 - DNA, 25 bp, Rattus norvegicus
cctcaaacggacaggagccctagtc

SEQ ID NO: 603029 - DNA, 25 bp, Rattus norvegicus
ccgcgctttaggaggtcctcaaacg

SEQ ID NO: 603030 - DNA, 25 bp, Rattus norvegicus
cctgctggattgcacgaaaaagtga

SEQ ID NO: 603031 - DNA, 25 bp, Rattus norvegicus
tgcagagcctagtcccaggagacgc

SEQ ID NO: 603032 - DNA, 25 bp, Rattus norvegicus
taccaagtggacataggagccgtgc

SEQ ID NO: 603033 - DNA, 25 bp, Rattus norvegicus
tcctagagctctggatagaataatc

SEQ ID NO: 603034 - DNA, 25 bp, Rattus norvegicus
tcttgtaagggtcccactggtgtcc

SEQ ID NO: 603035 - DNA, 25 bp, Rattus norvegicus
cccgggctgaaatgcgttccacatc

SEQ ID NO: 603036 - DNA, 25 bp, Rattus norvegicus
aatatgcgcgtaaccgcggcagggc

SEQ ID NO: 603037 - DNA, 25 bp, Rattus norvegicus
gccttgttagcagggccgtgacgtc

SEQ ID NO: 603038 - DNA, 25 bp, Rattus norvegicus
ttaagaggcgccttgttagcagggc

SEQ ID NO: 603039 - DNA, 25 bp, Rattus norvegicus
gtcatccaaactcgcggctccttta

SEQ ID NO: 603040 - DNA, 25 bp, Rattus norvegicus
gctgcagtcatccaaactcgcggct

SEQ ID NO: 603041 - DNA, 25 bp, Rattus norvegicus
ctaaaagagggcgggctgcagtcat

SEQ ID NO: 603042 - DNA, 25 bp, Rattus norvegicus
tcccaacaagagaggctaaaagagg

SEQ ID NO: 603043 - DNA, 25 bp, Rattus norvegicus
ccagggctcccaacaagagaggcta

SEQ ID NO: 603044 - DNA, 25 bp, Rattus norvegicus
agaggttctaggagctccagggctc

SEQ ID NO: 603045 - DNA, 25 bp, Rattus norvegicus
ggctgaaatgcgttccacatcgggg

SEQ ID NO: 603046 - DNA, 25 bp, Rattus norvegicus
tggacccgggctgaaatgcgttcca

SEQ ID NO: 603047 - DNA, 25 bp, Rattus norvegicus
cccacgatccacctacgtcagactc

SEQ ID NO: 603048 - DNA, 25 bp, Rattus norvegicus
gcaggatagaggttctaggagctcc

SEQ ID NO: 603049 - DNA, 25 bp, Rattus norvegicus
ggccaacgtgggctcgctcttcgac

SEQ ID NO: 603050 - DNA, 25 bp, Rattus norvegicus
tcttcgacgacgtaagtgccgcgcc

SEQ ID NO: 603051 - DNA, 25 bp, Rattus norvegicus
ttcgacgacgtaagtgccgcgccgt

SEQ ID NO: 603052 - DNA, 25 bp, Rattus norvegicus
cgacgacgtaagtgccgcgccgtcg

SEQ ID NO: 603053 - DNA, 25 bp, Rattus norvegicus
ctcgctcttcgacgacgtaagtgcc

SEQ ID NO: 603054 - DNA, 25 bp, Rattus norvegicus
tccgcccgggcaccatggcggggaa

SEQ ID NO: 603055 - DNA, 25 bp, Rattus norvegicus
cggtcctgctggtcacggccaacgt

SEQ ID NO: 603056 - DNA, 25 bp, Rattus norvegicus
cgctcttcgacgacgtaagtgccgc

SEQ ID NO: 603057 - DNA, 25 bp, Rattus norvegicus
tcacggccaacgtgggctcgctctt

SEQ ID NO: 603058 - DNA, 25 bp, Rattus norvegicus
ccaacgtgggctcgctcttcgacga

SEQ ID NO: 603059 - DNA, 25 bp, Rattus norvegicus
gtgggctcgctcttcgacgacgtaa

SEQ ID NO: 603060 - DNA, 25 bp, Rattus norvegicus
ggctcgctcttcgacgacgtaagtg

SEQ ID NO: 603061 - DNA, 25 bp, Rattus norvegicus
tcctgctggtcacggccaacgtggg

SEQ ID NO: 603062 - DNA, 25 bp, Rattus norvegicus
ctggtcacggccaacgtgggctcgc

SEQ ID NO: 603063 - DNA, 25 bp, Rattus norvegicus
ctctgggcctgccaagtacttggtc

SEQ ID NO: 603064 - DNA, 25 bp, Rattus norvegicus
cgccaagttcgagggtttgtgcttt

SEQ ID NO: 603065 - DNA, 25 bp, Rattus norvegicus
aagccgcgtgatcttctcgtcatcg

SEQ ID NO: 603066 - DNA, 25 bp, Rattus norvegicus
ggccggttgtactcgtcatcatcct

SEQ ID NO: 603067 - DNA, 25 bp, Rattus norvegicus
ttctttttagccgacgccatctctg

SEQ ID NO: 603068 - DNA, 25 bp, Rattus norvegicus
ctcggtcatgcccagagagtaggca

SEQ ID NO: 603069 - DNA, 25 bp, Rattus norvegicus
aagtcggccgcgagtgtttcttctt

SEQ ID NO: 603070 - DNA, 25 bp, Rattus norvegicus
taccgaatcccgtgcgggccactta

SEQ ID NO: 603071 - DNA, 25 bp, Rattus norvegicus
cgaagtagacacctgcggacgaggc

SEQ ID NO: 603072 - DNA, 25 bp, Rattus norvegicus
agcccgttgagacggggcagacttc

SEQ ID NO: 603073 - DNA, 25 bp, Rattus norvegicus
cgtcccaggatgtcgctgatgccgt

SEQ ID NO: 603074 - DNA, 25 bp, Rattus norvegicus
gtgcctagaggcaactgcgcgccaa

SEQ ID NO: 603075 - DNA, 25 bp, Rattus norvegicus
ggggaacagcgacgtcttcatctca

SEQ ID NO: 603076 - DNA, 25 bp, Rattus norvegicus
cttggtctgctcgaaagtcttctcc

SEQ ID NO: 603077 - DNA, 25 bp, Rattus norvegicus
tagacatgcctagcgcaatcctcgc

SEQ ID NO: 603078 - DNA, 25 bp, Rattus norvegicus
aggcgcttcctcttgagcccaggaa

SEQ ID NO: 603079 - DNA, 25 bp, Rattus norvegicus
agtgtgtccgcgctcctagacatgc

SEQ ID NO: 603080 - DNA, 25 bp, Rattus norvegicus
aaaattctcacaggagctgaggctc

SEQ ID NO: 603081 - DNA, 25 bp, Rattus norvegicus
agacctgtgtagagcgcagccactg

SEQ ID NO: 603082 - DNA, 25 bp, Rattus norvegicus
aggcttctcagctcttctcctgaag

SEQ ID NO: 603083 - DNA, 25 bp, Rattus norvegicus
gattagatgtacttcggctcgctgg

SEQ ID NO: 603084 - DNA, 25 bp, Rattus norvegicus
ttccaggcaagctgtcggagtgttc

SEQ ID NO: 603085 - DNA, 25 bp, Rattus norvegicus
gaggcttctatccaactgagttttc

SEQ ID NO: 603086 - DNA, 25 bp, Rattus norvegicus
tgagttttcaccagcggtgcgcgcc

SEQ ID NO: 603087 - DNA, 25 bp, Rattus norvegicus
gcgccggtaccttgacgctctcaat

SEQ ID NO: 603088 - DNA, 25 bp, Rattus norvegicus
gctctcaatcctctcgtttgtgttc

SEQ ID NO: 603089 - DNA, 25 bp, Rattus norvegicus
tttgtgttcgaggagagatctgcgc

SEQ ID NO: 603090 - DNA, 25 bp, Rattus norvegicus
gttctaattagaagcctggctcagc

SEQ ID NO: 603091 - DNA, 25 bp, Rattus norvegicus
gacttttctggactcgcggaagaca

SEQ ID NO: 603092 - DNA, 25 bp, Rattus norvegicus
tggcttcgttttcgctccacctcga

SEQ ID NO: 603093 - DNA, 25 bp, Rattus norvegicus
acctcgattatgaccgcgtgtgctc

SEQ ID NO: 603094 - DNA, 25 bp, Rattus norvegicus
agtgccgcaattctgggctcgaacc

SEQ ID NO: 603095 - DNA, 25 bp, Rattus norvegicus
ccctgggtagagtatggacttttct

SEQ ID NO: 603096 - DNA, 25 bp, Rattus norvegicus
gactccagctcttgagggacccaga

SEQ ID NO: 603097 - DNA, 25 bp, Rattus norvegicus
gggacccagagctgtgagcaacatg

SEQ ID NO: 603098 - DNA, 25 bp, Rattus norvegicus
ccgtggcaagcggacagggaacaaa

SEQ ID NO: 603099 - DNA, 25 bp, Rattus norvegicus
caaacgaaccgactaggaagagcgc

SEQ ID NO: 603100 - DNA, 25 bp, Rattus norvegicus
aagagcgcgggtcctctgcgagaca

SEQ ID NO: 603101 - DNA, 25 bp, Rattus norvegicus
ggtaggtgtgctctagcctttcaca

SEQ ID NO: 603102 - DNA, 25 bp, Rattus norvegicus
tctagcctttcacacgctacagagc

SEQ ID NO: 603103 - DNA, 25 bp, Rattus norvegicus
acggagtgagaagtcctgaaatccc

SEQ ID NO: 603104 - DNA, 25 bp, Rattus norvegicus
tgctccgaggaactggccatggaga

SEQ ID NO: 603105 - DNA, 25 bp, Rattus norvegicus
gtctctttaaatcgactctgcagtg

SEQ ID NO: 603106 - DNA, 25 bp, Rattus norvegicus
cggtccttcattcccctggctgttg

SEQ ID NO: 603107 - DNA, 25 bp, Rattus norvegicus
catggttacagctcctgcttcccgg

SEQ ID NO: 603108 - DNA, 25 bp, Rattus norvegicus
agggagccagggcacggcgcgctgc

SEQ ID NO: 603109 - DNA, 25 bp, Rattus norvegicus
cattcccgctctgccgcagggagcc

SEQ ID NO: 603110 - DNA, 25 bp, Rattus norvegicus
ggctgggaagaaccattcccgctct

SEQ ID NO: 603111 - DNA, 25 bp, Rattus norvegicus
tcgactctgcagtgtgacgggcagc

SEQ ID NO: 603112 - DNA, 25 bp, Rattus norvegicus
aaatcgactctgcagtgtgacgggc

SEQ ID NO: 603113 - DNA, 25 bp, Rattus norvegicus
ggttgtctctttaaatcgactctgc

SEQ ID NO: 603114 - DNA, 25 bp, Rattus norvegicus
ctctttaaatcgactctgcagtgtg

SEQ ID NO: 603115 - DNA, 25 bp, Rattus norvegicus
tgctgcagaaatcaggcgcgcaggc

SEQ ID NO: 603116 - DNA, 25 bp, Rattus norvegicus
tgttgctgcagaaatcaggcgcgca

SEQ ID NO: 603117 - DNA, 25 bp, Rattus norvegicus
tttaaatcgactctgcagtgtgacg

SEQ ID NO: 603118 - DNA, 25 bp, Rattus norvegicus
atggttacagctcctgcttcccggc

SEQ ID NO: 603119 - DNA, 25 bp, Rattus norvegicus
gttgaagacatctgcggagcccaaa

SEQ ID NO: 603120 - DNA, 25 bp, Rattus norvegicus
cgcgtagctggcggtgcccagctca

SEQ ID NO: 603121 - DNA, 25 bp, Rattus norvegicus
ccgtttggcgacactgcggcaggca

SEQ ID NO: 603122 - DNA, 25 bp, Rattus norvegicus
tcaccgtttggcgacactgcggcag

SEQ ID NO: 603123 - DNA, 25 bp, Rattus norvegicus
gcctcaccgtttggcgacactgcgg

SEQ ID NO: 603124 - DNA, 25 bp, Rattus norvegicus
tcccggcccgccagtgaccacggcc

SEQ ID NO: 603125 - DNA, 25 bp, Rattus norvegicus
tagttgaagacatctgcggagccca

SEQ ID NO: 603126 - DNA, 25 bp, Rattus norvegicus
gctcagcccggcaggctcagaggcg

SEQ ID NO: 603127 - DNA, 25 bp, Rattus norvegicus
acgtagttgaagacatctgcggagc

SEQ ID NO: 603128 - DNA, 25 bp, Rattus norvegicus
ggctgacgtagttgaagacatctgc

SEQ ID NO: 603129 - DNA, 25 bp, Rattus norvegicus
ggaggctgacgtagttgaagacatc

SEQ ID NO: 603130 - DNA, 25 bp, Rattus norvegicus
cccggaggctgacgtagttgaagac

SEQ ID NO: 603131 - DNA, 25 bp, Rattus norvegicus
ggccagctaggacggggatctgccc

SEQ ID NO: 603132 - DNA, 25 bp, Rattus norvegicus
gccagtgaccacggccctcagggag

SEQ ID NO: 603133 - DNA, 25 bp, Rattus norvegicus
tcgcgcctgagaccatctcgattta

SEQ ID NO: 603134 - DNA, 25 bp, Rattus norvegicus
tctggcgacatcagtgaggaggctc

SEQ ID NO: 603135 - DNA, 25 bp, Rattus norvegicus
ctcaaggtgtcgatgtctctgtgcc

SEQ ID NO: 603136 - DNA, 25 bp, Rattus norvegicus
gatgcgtgagtcaccgtcgcaaccc

SEQ ID NO: 603137 - DNA, 25 bp, Rattus norvegicus
tccgagtccgagtgtgctcaaggct

SEQ ID NO: 603138 - DNA, 25 bp, Rattus norvegicus
ttcagaggtcgcgtcttaccaggtg

SEQ ID NO: 603139 - DNA, 25 bp, Rattus norvegicus
atgttatttcttatcctctccggga

SEQ ID NO: 603140 - DNA, 25 bp, Rattus norvegicus
agcccacccatcagtgcaaagcaga

SEQ ID NO: 603141 - DNA, 25 bp, Rattus norvegicus
tcgccacctacttccctgtggggtg

SEQ ID NO: 603142 - DNA, 25 bp, Rattus norvegicus
caacttcacgaagccgcgaggaggt

SEQ ID NO: 603143 - DNA, 25 bp, Rattus norvegicus
ggaccacgcgggattcaacttcacg

SEQ ID NO: 603144 - DNA, 25 bp, Rattus norvegicus
agcagggacacccaaagccgtgacc

SEQ ID NO: 603145 - DNA, 25 bp, Rattus norvegicus
gctgagatttctcctcccgggagca

SEQ ID NO: 603146 - DNA, 25 bp, Rattus norvegicus
aggtccctgaaggtgctgagatttc

SEQ ID NO: 603147 - DNA, 25 bp, Rattus norvegicus
ttcccgcgggatcacgaattcttcg

SEQ ID NO: 603148 - DNA, 25 bp, Rattus norvegicus
cgtctggagaggacagaaacagtca

SEQ ID NO: 603149 - DNA, 25 bp, Rattus norvegicus
aacagtcagaggctgtcgtaccgtg

SEQ ID NO: 603150 - DNA, 25 bp, Rattus norvegicus
caagcccaggctggtagaccggacc

SEQ ID NO: 603151 - DNA, 25 bp, Rattus norvegicus
cggcagaggcccaagagaatcaggc

SEQ ID NO: 603152 - DNA, 25 bp, Rattus norvegicus
gaatcaggctcttcaccgctgcagg

SEQ ID NO: 603153 - DNA, 25 bp, Rattus norvegicus
ggaggcacccttccgatatgcgccg

SEQ ID NO: 603154 - DNA, 25 bp, Rattus norvegicus
attcttcgaggtgcgtgagaaaccc

SEQ ID NO: 603155 - DNA, 25 bp, Rattus norvegicus
acccggcgaaagatctcctgagctc

SEQ ID NO: 603156 - DNA, 25 bp, Rattus norvegicus
accaaggggttggatgcatctctgt

SEQ ID NO: 603157 - DNA, 25 bp, Rattus norvegicus
atgtgcagcggcacctgtacttgca

SEQ ID NO: 603158 - DNA, 25 bp, Rattus norvegicus
tgctcacgcaagtgtccgagacgcc

SEQ ID NO: 603159 - DNA, 25 bp, Rattus norvegicus
gcagggtcgccacaggaagttaata

SEQ ID NO: 603160 - DNA, 25 bp, Rattus norvegicus
tgtacttgcaggacatgctcacgca

SEQ ID NO: 603161 - DNA, 25 bp, Rattus norvegicus
acctgagtttcagtgaggctcaagc

SEQ ID NO: 603162 - DNA, 25 bp, Rattus norvegicus
cgtggtttgcgattggttttgtgtt

SEQ ID NO: 603163 - DNA, 25 bp, Rattus norvegicus
attgcttctggtgaaacttgcgctc

SEQ ID NO: 603164 - DNA, 25 bp, Rattus norvegicus
ggacaagtattgcttctggtgaaac

SEQ ID NO: 603165 - DNA, 25 bp, Rattus norvegicus
cgcgctcggcaatggacaagtattg

SEQ ID NO: 603166 - DNA, 25 bp, Rattus norvegicus
cagtgaggctcaagctgctggagaa

SEQ ID NO: 603167 - DNA, 25 bp, Rattus norvegicus
accggcccagcgaggatcccaggaa

SEQ ID NO: 603168 - DNA, 25 bp, Rattus norvegicus
cagcgaggatcccaggaacagcgtt

SEQ ID NO: 603169 - DNA, 25 bp, Rattus norvegicus
caggaacagcgttgccgccgaaagt

SEQ ID NO: 603170 - DNA, 25 bp, Rattus norvegicus
aaatgccgccggcagtagtggcttg

SEQ ID NO: 603171 - DNA, 25 bp, Rattus norvegicus
cagtagtggcttggcagtcagcttc

SEQ ID NO: 603172 - DNA, 25 bp, Rattus norvegicus
gcttggcagtcagcttcagcttctc

SEQ ID NO: 603173 - DNA, 25 bp, Rattus norvegicus
ctgcagccgcttggccttggctcgg

SEQ ID NO: 603174 - DNA, 25 bp, Rattus norvegicus
ccagatcttgacctgagtttcagtg

SEQ ID NO: 603175 - DNA, 25 bp, Rattus norvegicus
tgaaggggagtggtccctgctctat

SEQ ID NO: 603176 - DNA, 25 bp, Rattus norvegicus
ctgagacgcgtaaaacccaacggcg

SEQ ID NO: 603177 - DNA, 25 bp, Rattus norvegicus
gcctgactgagacgcgtaaaaccca

SEQ ID NO: 603178 - DNA, 25 bp, Rattus norvegicus
ctagccgcctgactgagacgcgtaa

SEQ ID NO: 603179 - DNA, 25 bp, Rattus norvegicus
ttgcccgggccatgcatgggatagc

SEQ ID NO: 603180 - DNA, 25 bp, Rattus norvegicus
tcatgtcgagtgttgcccgggccat

SEQ ID NO: 603181 - DNA, 25 bp, Rattus norvegicus
gagtggtccctgctctatgtggccc

SEQ ID NO: 603182 - DNA, 25 bp, Rattus norvegicus
gcctccagcagtgactcgacgctga

SEQ ID NO: 603183 - DNA, 25 bp, Rattus norvegicus
agaccgggagactgagcacttacgt

SEQ ID NO: 603184 - DNA, 25 bp, Rattus norvegicus
ttttcagggcctgagaccgggagac

SEQ ID NO: 603185 - DNA, 25 bp, Rattus norvegicus
gcggtcgcttttcagggcctgagac

SEQ ID NO: 603186 - DNA, 25 bp, Rattus norvegicus
tttgacagtgcggtcgcttttcagg

SEQ ID NO: 603187 - DNA, 25 bp, Rattus norvegicus
caccttagattttcgagctttgaca

SEQ ID NO: 603188 - DNA, 25 bp, Rattus norvegicus
cccgccgcgttcatgtcgagtgttg

SEQ ID NO: 603189 - DNA, 25 bp, Rattus norvegicus
cctggataaacaggcggtacactgc

SEQ ID NO: 603190 - DNA, 25 bp, Rattus norvegicus
cccggctgtgaaaatcgtttcaagg

SEQ ID NO: 603191 - DNA, 25 bp, Rattus norvegicus
tgagctggaaaatacaattggcttc

SEQ ID NO: 603192 - DNA, 25 bp, Rattus norvegicus
gtgcgccgcttaatgagctggaaaa

SEQ ID NO: 603193 - DNA, 25 bp, Rattus norvegicus
gccaggcgctttgtgcgccgcttaa

SEQ ID NO: 603194 - DNA, 25 bp, Rattus norvegicus
gacctggggaatccgcgccgtcagc

SEQ ID NO: 603195 - DNA, 25 bp, Rattus norvegicus
gtacactgcggggacaaagcacggc

SEQ ID NO: 603196 - DNA, 25 bp, Rattus norvegicus
gggcactgttcaaagggcctggata

SEQ ID NO: 603197 - DNA, 25 bp, Rattus norvegicus
ttccgggttcggcaggattctccca

SEQ ID NO: 603198 - DNA, 25 bp, Rattus norvegicus
tcctttaatcactgcccggcggctg

SEQ ID NO: 603199 - DNA, 25 bp, Rattus norvegicus
cagcggcgtccagatgttgtgagcc

SEQ ID NO: 603200 - DNA, 25 bp, Rattus norvegicus
accgagtttttgtcgcgatgcgctg

SEQ ID NO: 603201 - DNA, 25 bp, Rattus norvegicus
gctggcatctgtaaccgagtttttg

SEQ ID NO: 603202 - DNA, 25 bp, Rattus norvegicus
aaagcacggccgtctctgtcggggc

SEQ ID NO: 603203 - DNA, 25 bp, Rattus norvegicus
cctcacgcgcgtgcttgagggccga

SEQ ID NO: 603204 - DNA, 25 bp, Rattus norvegicus
gaggctctatagagccggctctgca

SEQ ID NO: 603205 - DNA, 25 bp, Rattus norvegicus
tgagctgccggtcaaaggagctttc

SEQ ID NO: 603206 - DNA, 25 bp, Rattus norvegicus
aaggagctttcaggcgtcaccaggg

SEQ ID NO: 603207 - DNA, 25 bp, Rattus norvegicus
ccgagctgcagatcgagaggaacgc

SEQ ID NO: 603208 - DNA, 25 bp, Rattus norvegicus
agcggacttcgagcgtgtcaccact

SEQ ID NO: 603209 - DNA, 25 bp, Rattus norvegicus
agcgtgtcaccactcgcagcgctgg

SEQ ID NO: 603210 - DNA, 25 bp, Rattus norvegicus
gctgcagatcgagaggaacgcgcca

SEQ ID NO: 603211 - DNA, 25 bp, Rattus norvegicus
tgctgcgcgttcagaggctctatag

SEQ ID NO: 603212 - DNA, 25 bp, Rattus norvegicus
aatggcagcgccactcaatggccac

SEQ ID NO: 603213 - DNA, 25 bp, Rattus norvegicus
gctgccggtcaaaggagctttcagg

SEQ ID NO: 603214 - DNA, 25 bp, Rattus norvegicus
cctggcagctgctgcgcgttcagag

SEQ ID NO: 603215 - DNA, 25 bp, Rattus norvegicus
ctggcacaatggcagcgccactcaa

SEQ ID NO: 603216 - DNA, 25 bp, Rattus norvegicus
cgtcaccagggagcggacttcgagc

SEQ ID NO: 603217 - DNA, 25 bp, Rattus norvegicus
tcaagggctcctgcgtgaatcgcac

SEQ ID NO: 603218 - DNA, 25 bp, Rattus norvegicus
tgagcacaaccatggctgcagaatc

SEQ ID NO: 603219 - DNA, 25 bp, Rattus norvegicus
tgcccttgagcacaaccatggctgc

SEQ ID NO: 603220 - DNA, 25 bp, Rattus norvegicus
cgtcgggatgcccttgagcacaacc

SEQ ID NO: 603221 - DNA, 25 bp, Rattus norvegicus
gagacagcaccgtcgggatgccctt

SEQ ID NO: 603222 - DNA, 25 bp, Rattus norvegicus
caacagctcaggagacagcaccgtc

SEQ ID NO: 603223 - DNA, 25 bp, Rattus norvegicus
gcgcgaacaacagctcaggagacag

SEQ ID NO: 603224 - DNA, 25 bp, Rattus norvegicus
cgcgcaagcgcgaacaacagctcag

SEQ ID NO: 603225 - DNA, 25 bp, Rattus norvegicus
catgctcaccaatctcgtctccgtg

SEQ ID NO: 603226 - DNA, 25 bp, Rattus norvegicus
ggctgcactgccaactctctacatg

SEQ ID NO: 603227 - DNA, 25 bp, Rattus norvegicus
acctcagagggctgcactgccaact

SEQ ID NO: 603228 - DNA, 25 bp, Rattus norvegicus
tgcgtgaatcgcacctcagagggct

SEQ ID NO: 603229 - DNA, 25 bp, Rattus norvegicus
caaccatggctgcagaatcggtgga

SEQ ID NO: 603230 - DNA, 25 bp, Rattus norvegicus
gggctcctgcgtgaatcgcacctca

SEQ ID NO: 603231 - DNA, 25 bp, Rattus norvegicus
ccctccaagctggagaaatttattt

SEQ ID NO: 603232 - DNA, 25 bp, Rattus norvegicus
caaggtcccgggtggcatcatgcat

SEQ ID NO: 603233 - DNA, 25 bp, Rattus norvegicus
ttgcactttgagttcgccaaggtcc

SEQ ID NO: 603234 - DNA, 25 bp, Rattus norvegicus
agcgatctttagagggacacccatt

SEQ ID NO: 603235 - DNA, 25 bp, Rattus norvegicus
gggatgcctgaacccagcgatcttt

SEQ ID NO: 603236 - DNA, 25 bp, Rattus norvegicus
tctctactagctttcccaggtctgg

SEQ ID NO: 603237 - DNA, 25 bp, Rattus norvegicus
gggcgcgtctcttcgcctttagttc

SEQ ID NO: 603238 - DNA, 25 bp, Rattus norvegicus
cgttagcagttttgccgcgtcgttg

SEQ ID NO: 603239 - DNA, 25 bp, Rattus norvegicus
gcactcgactgtctatgcgttagca

SEQ ID NO: 603240 - DNA, 25 bp, Rattus norvegicus
ttcttgtgctttcttctggcgctcg

SEQ ID NO: 603241 - DNA, 25 bp, Rattus norvegicus
tccagatgttccttgcactgagccc

SEQ ID NO: 603242 - DNA, 25 bp, Rattus norvegicus
gccgcggtgttcctgccaaaaggct

SEQ ID NO: 603243 - DNA, 25 bp, Rattus norvegicus
cctcgggaacacgtctgggagacct

SEQ ID NO: 603244 - DNA, 25 bp, Rattus norvegicus
gcaagatgctggatgggtcccttct

SEQ ID NO: 603245 - DNA, 25 bp, Rattus norvegicus
acccgaggcgaagcgccggaattct

SEQ ID NO: 603246 - DNA, 25 bp, Rattus norvegicus
ctaaagggatgtacccgtgacctgg

SEQ ID NO: 603247 - DNA, 25 bp, Rattus norvegicus
gagacggaagctaaagggatgtacc

SEQ ID NO: 603248 - DNA, 25 bp, Rattus norvegicus
ccaagccagacggagacggaagcta

SEQ ID NO: 603249 - DNA, 25 bp, Rattus norvegicus
cccagattccaagccagacggagac

SEQ ID NO: 603250 - DNA, 25 bp, Rattus norvegicus
ctgcagaattgctccgccccagatt

SEQ ID NO: 603251 - DNA, 25 bp, Rattus norvegicus
agagacgatttgtcccgcccacaga

SEQ ID NO: 603252 - DNA, 25 bp, Rattus norvegicus
ccatggcggagagacgatttgtccc

SEQ ID NO: 603253 - DNA, 25 bp, Rattus norvegicus
cagcagagcacgcagggccgccatg

SEQ ID NO: 603254 - DNA, 25 bp, Rattus norvegicus
aacagcgagttgcaggctctgggca

SEQ ID NO: 603255 - DNA, 25 bp, Rattus norvegicus
ggacaacagcgagttgcaggctctg

SEQ ID NO: 603256 - DNA, 25 bp, Rattus norvegicus
attctgggcagcgaactggggacaa

SEQ ID NO: 603257 - DNA, 25 bp, Rattus norvegicus
cggtgtacgcactcacccgaggcga

SEQ ID NO: 603258 - DNA, 25 bp, Rattus norvegicus
agcgaactggggacaacagcgagtt

SEQ ID NO: 603259 - DNA, 25 bp, Rattus norvegicus
ctgcgggtcctggaggctaccgcct

SEQ ID NO: 603260 - DNA, 25 bp, Rattus norvegicus
cccgcctctgctgcggcggcctacg

SEQ ID NO: 603261 - DNA, 25 bp, Rattus norvegicus
tacggccacgggtcagaagtactct

SEQ ID NO: 603262 - DNA, 25 bp, Rattus norvegicus
cacgggtcagaagtactctgagcta

SEQ ID NO: 603263 - DNA, 25 bp, Rattus norvegicus
agaagtactctgagctagccatggc

SEQ ID NO: 603264 - DNA, 25 bp, Rattus norvegicus
tactctgagctagccatggctgccc

SEQ ID NO: 603265 - DNA, 25 bp, Rattus norvegicus
gctgtgcagaggctttgccaccacc

SEQ ID NO: 603266 - DNA, 25 bp, Rattus norvegicus
accgggctgctccacacctgcgggt

SEQ ID NO: 603267 - DNA, 25 bp, Rattus norvegicus
ggggccgcatccgttcagaacgctg

SEQ ID NO: 603268 - DNA, 25 bp, Rattus norvegicus
atccgttcagaacgctgcttcggta

SEQ ID NO: 603269 - DNA, 25 bp, Rattus norvegicus
cagaacgctgcttcggtaaccgctc

SEQ ID NO: 603270 - DNA, 25 bp, Rattus norvegicus
ctgcttcggtaaccgctccttggtc

SEQ ID NO: 603271 - DNA, 25 bp, Rattus norvegicus
cggcctacggccacgggtcagaagt

SEQ ID NO: 603272 - DNA, 25 bp, Rattus norvegicus
agaggctttgccaccaccgggctgc

SEQ ID NO: 603273 - DNA, 25 bp, Rattus norvegicus
gagctcttccgacaccagcgacatg

SEQ ID NO: 603274 - DNA, 25 bp, Rattus norvegicus
gcctcatgcgcagttccgcacggaa

SEQ ID NO: 603275 - DNA, 25 bp, Rattus norvegicus
ccctgcaaggtcacgatgtagcacg

SEQ ID NO: 603276 - DNA, 25 bp, Rattus norvegicus
tccgttgttcgccttcctggcatcg

SEQ ID NO: 603277 - DNA, 25 bp, Rattus norvegicus
tcagagtcagcctcatgcgcagttc

SEQ ID NO: 603278 - DNA, 25 bp, Rattus norvegicus
cgcacggaacctaagcgcgccggaa

SEQ ID NO: 603279 - DNA, 25 bp, Rattus norvegicus
cgcgccggaaccctgtgaacagatc

SEQ ID NO: 603280 - DNA, 25 bp, Rattus norvegicus
tgtgaacagatccaggctctagcgg

SEQ ID NO: 603281 - DNA, 25 bp, Rattus norvegicus
ggtccgtctgcgagctcttccgaca

SEQ ID NO: 603282 - DNA, 25 bp, Rattus norvegicus
ccagcgacatgaggctgtggccgca

SEQ ID NO: 603283 - DNA, 25 bp, Rattus norvegicus
tcacgatgtagcacgctggtttccc

SEQ ID NO: 603284 - DNA, 25 bp, Rattus norvegicus
tggtttcccggccacatggccaagg

SEQ ID NO: 603285 - DNA, 25 bp, Rattus norvegicus
ccacatggccaagggtgaggccagc

SEQ ID NO: 603286 - DNA, 25 bp, Rattus norvegicus
ccagttcgccgagcactcagagtca

SEQ ID NO: 603287 - DNA, 25 bp, Rattus norvegicus
gtcctgaggtcctcctccagccaga

SEQ ID NO: 603288 - DNA, 25 bp, Rattus norvegicus
tgccgctcaaaagcaggcaaatacg

SEQ ID NO: 603289 - DNA, 25 bp, Rattus norvegicus
gccggccttacacgcactcttgatg

SEQ ID NO: 603290 - DNA, 25 bp, Rattus norvegicus
agcaggcaaatacgtggactgtgta

SEQ ID NO: 603291 - DNA, 25 bp, Rattus norvegicus
tgcagccgccactcgcagagaggag

SEQ ID NO: 603292 - DNA, 25 bp, Rattus norvegicus
aggcctagctctccaggtcctgagg

SEQ ID NO: 603293 - DNA, 25 bp, Rattus norvegicus
ccgttctcatcgtcctccaggccta

SEQ ID NO: 603294 - DNA, 25 bp, Rattus norvegicus
tagactcctcggtcggtcccgttgc

SEQ ID NO: 603295 - DNA, 25 bp, Rattus norvegicus
tagctgtagactcctcggtcggtcc

SEQ ID NO: 603296 - DNA, 25 bp, Rattus norvegicus
tccaggcccagtagctgtagactcc

SEQ ID NO: 603297 - DNA, 25 bp, Rattus norvegicus
tacgtggactgtgtacggaccctga

SEQ ID NO: 603298 - DNA, 25 bp, Rattus norvegicus
ctgagccggaagtccaggcccagta

SEQ ID NO: 603299 - DNA, 25 bp, Rattus norvegicus
tgtacggaccctgagccggaagtcc

SEQ ID NO: 603300 - DNA, 25 bp, Rattus norvegicus
ccactcgcagagaggagctgtagcg

SEQ ID NO: 603301 - DNA, 25 bp, Rattus norvegicus
ccaggcgatcttcccatcctatata

SEQ ID NO: 603302 - DNA, 25 bp, Rattus norvegicus
gcagtgagtaccctggcgccaaatc

SEQ ID NO: 603303 - DNA, 25 bp, Rattus norvegicus
ccttgtgcctctgcgtttaacgaca

SEQ ID NO: 603304 - DNA, 25 bp, Rattus norvegicus
cgctcgggtagcaaagtttctgctc

SEQ ID NO: 603305 - DNA, 25 bp, Rattus norvegicus
tccgctcgctgctcccggaataaga

SEQ ID NO: 603306 - DNA, 25 bp, Rattus norvegicus
ctggcttaaatatgggtgtcccgtc

SEQ ID NO: 603307 - DNA, 25 bp, Rattus norvegicus
gcataagccgctccgcagaagtttg

SEQ ID NO: 603308 - DNA, 25 bp, Rattus norvegicus
gaagtttgctttgtcgcccgcagga

SEQ ID NO: 603309 - DNA, 25 bp, Rattus norvegicus
tctagtccagtccaccacttgtttg

SEQ ID NO: 603310 - DNA, 25 bp, Rattus norvegicus
cacgggctccatggtaagatgcttc

SEQ ID NO: 603311 - DNA, 25 bp, Rattus norvegicus
taagatgcttctctacccgctgggc

SEQ ID NO: 603312 - DNA, 25 bp, Rattus norvegicus
gatacagctgcttctccgtgaccac

SEQ ID NO: 603313 - DNA, 25 bp, Rattus norvegicus
cagcgggcgcaagattgcaacctca

SEQ ID NO: 603314 - DNA, 25 bp, Rattus norvegicus
ccgtaccggaacagagcagtgagta

SEQ ID NO: 603315 - DNA, 25 bp, Rattus norvegicus
aactctagaccacgtggccagagcg

SEQ ID NO: 603316 - DNA, 25 bp, Rattus norvegicus
gggctccacactcaacggctgcggt

SEQ ID NO: 603317 - DNA, 25 bp, Rattus norvegicus
atcccagtcagcgatcccagtcagc

SEQ ID NO: 603318 - DNA, 25 bp, Rattus norvegicus
gcagacctcctcagtcctcgacagg

SEQ ID NO: 603319 - DNA, 25 bp, Rattus norvegicus
cccgtggagcaggtctgctgatccc

SEQ ID NO: 603320 - DNA, 25 bp, Rattus norvegicus
aggtctgctgatccctcgggctcca

SEQ ID NO: 603321 - DNA, 25 bp, Rattus norvegicus
gactgtcccagtcagcgatcccagt

SEQ ID NO: 603322 - DNA, 25 bp, Rattus norvegicus
cacactcaacggctgcggtctggtg

SEQ ID NO: 603323 - DNA, 25 bp, Rattus norvegicus
cggtctggtggccatactgctccac

SEQ ID NO: 603324 - DNA, 25 bp, Rattus norvegicus
tggtggccatactgctccacctctt

SEQ ID NO: 603325 - DNA, 25 bp, Rattus norvegicus
tgccacagcagcttccagactgtta

SEQ ID NO: 603326 - DNA, 25 bp, Rattus norvegicus
cagactgttaaacactgcgcctgcg

SEQ ID NO: 603327 - DNA, 25 bp, Rattus norvegicus
tgcgcggctaactctagaccacgtg

SEQ ID NO: 603328 - DNA, 25 bp, Rattus norvegicus
cctgcgcagtacactgcgcggctaa

SEQ ID NO: 603329 - DNA, 25 bp, Rattus norvegicus
gggcggcattatcctctggaacatt

SEQ ID NO: 603330 - DNA, 25 bp, Rattus norvegicus
aggctcggctgttctcccagcattc

SEQ ID NO: 603331 - DNA, 25 bp, Rattus norvegicus
cacagccgggttgctccaccttaag

SEQ ID NO: 603332 - DNA, 25 bp, Rattus norvegicus
cggcgctccctcttttatcacagta

SEQ ID NO: 603333 - DNA, 25 bp, Rattus norvegicus
agatgaccgcgagaatcgtcttccc

SEQ ID NO: 603334 - DNA, 25 bp, Rattus norvegicus
tgcccggctaaccacgtacattatt

SEQ ID NO: 603335 - DNA, 25 bp, Rattus norvegicus
aagcgtgcgttactatgcccggcta

SEQ ID NO: 603336 - DNA, 25 bp, Rattus norvegicus
gcctctcgagtgctgaaatttaaaa

SEQ ID NO: 603337 - DNA, 25 bp, Rattus norvegicus
ttagataggtctgcccgtttctgcc

SEQ ID NO: 603338 - DNA, 25 bp, Rattus norvegicus
gtcgcttttccaccggtgttcttca

SEQ ID NO: 603339 - DNA, 25 bp, Rattus norvegicus
caccgactctgccttaagctaagtg

SEQ ID NO: 603340 - DNA, 25 bp, Rattus norvegicus
ctggaacattgcttgtgtcaccgtg

SEQ ID NO: 603341 - DNA, 25 bp, Rattus norvegicus
ctaagtggcatgcagacctggctcc

SEQ ID NO: 603342 - DNA, 25 bp, Rattus norvegicus
ctgacactgagtagaggcaagcgcc

SEQ ID NO: 603343 - DNA, 25 bp, Rattus norvegicus
ttggccgaagccaagaacgcggtta

SEQ ID NO: 603344 - DNA, 25 bp, Rattus norvegicus
gcgcttactgcggtcaggaattaca

SEQ ID NO: 603345 - DNA, 25 bp, Rattus norvegicus
agcgccatgatgctctgcaggctta

SEQ ID NO: 603346 - DNA, 25 bp, Rattus norvegicus
tagagggtcaagtgccatccgaatc

SEQ ID NO: 603347 - DNA, 25 bp, Rattus norvegicus
cagccctcggaacgttaaccctatg

SEQ ID NO: 603348 - DNA, 25 bp, Rattus norvegicus
tctccgtctgtgagactctgactta

SEQ ID NO: 603349 - DNA, 25 bp, Rattus norvegicus
gcggccaataccagtcgacagctca

SEQ ID NO: 603350 - DNA, 25 bp, Rattus norvegicus
ctggggagccaaatcaggagatctc

SEQ ID NO: 603351 - DNA, 25 bp, Rattus norvegicus
gggtgataactaacgctctctgagc

SEQ ID NO: 603352 - DNA, 25 bp, Rattus norvegicus
tggcaccgtttggaagagctataca

SEQ ID NO: 603353 - DNA, 25 bp, Rattus norvegicus
cgactgcctggtatttgtgttccca

SEQ ID NO: 603354 - DNA, 25 bp, Rattus norvegicus
tccggtttcagaggacccacgactg

SEQ ID NO: 603355 - DNA, 25 bp, Rattus norvegicus
gtcctcgtcagacaccatccggttt

SEQ ID NO: 603356 - DNA, 25 bp, Rattus norvegicus
ccggccttcttacagcagagtcaga

SEQ ID NO: 603357 - DNA, 25 bp, Rattus norvegicus
aggcgctcggacacacacactttca

SEQ ID NO: 603358 - DNA, 25 bp, Rattus norvegicus
cccggcaggcatcggcaaaaccatg

SEQ ID NO: 603359 - DNA, 25 bp, Rattus norvegicus
ccatggccgccaagaaaatcctcta

SEQ ID NO: 603360 - DNA, 25 bp, Rattus norvegicus
tggactttgccttcttcatgccgtg

SEQ ID NO: 603361 - DNA, 25 bp, Rattus norvegicus
gcttggcggacctgatactggaaca

SEQ ID NO: 603362 - DNA, 25 bp, Rattus norvegicus
cgcatcgtctactgttcatcctgga

SEQ ID NO: 603363 - DNA, 25 bp, Rattus norvegicus
cctttcgaggctacgagtggcttga

SEQ ID NO: 603364 - DNA, 25 bp, Rattus norvegicus
tgcccgctccgtgaagatcaacaag

SEQ ID NO: 603365 - DNA, 25 bp, Rattus norvegicus
tgagacgctgtacgcactgtgcttt

SEQ ID NO: 603366 - DNA, 25 bp, Rattus norvegicus
cgcgcttaccgcttcgtgaaagaga

SEQ ID NO: 603367 - DNA, 25 bp, Rattus norvegicus
gtgcgcggcttctcagacaaagaca

SEQ ID NO: 603368 - DNA, 25 bp, Rattus norvegicus
agggcagactttgctcaccacagtg

SEQ ID NO: 603369 - DNA, 25 bp, Rattus norvegicus
cggtgcagacgaattgcctacttta

SEQ ID NO: 603370 - DNA, 25 bp, Rattus norvegicus
gctcgcttgctggtgacttcacgca

SEQ ID NO: 603371 - DNA, 25 bp, Rattus norvegicus
tggattgctggcacaccctaacgcg

SEQ ID NO: 603372 - DNA, 25 bp, Rattus norvegicus
tcacggattggttgtaagcaggctg

SEQ ID NO: 603373 - DNA, 25 bp, Rattus norvegicus
catcacggattggttgtaagcaggc

SEQ ID NO: 603374 - DNA, 25 bp, Rattus norvegicus
ctccgagcatcacggattggttgta

SEQ ID NO: 603375 - DNA, 25 bp, Rattus norvegicus
ccgcctccgagcatcacggattggt

SEQ ID NO: 603376 - DNA, 25 bp, Rattus norvegicus
tagcaccgcagcgtggatgctgctc

SEQ ID NO: 603377 - DNA, 25 bp, Rattus norvegicus
cgcgtcgtgtggattgctggcacac

SEQ ID NO: 603378 - DNA, 25 bp, Rattus norvegicus
caccaggtgaatgcgcgcgtcgtgt

SEQ ID NO: 603379 - DNA, 25 bp, Rattus norvegicus
cgaacaccaggtgaatgcgcgcgtc

SEQ ID NO: 603380 - DNA, 25 bp, Rattus norvegicus
gcggccgacgaacaccaggtgaatg

SEQ ID NO: 603381 - DNA, 25 bp, Rattus norvegicus
attggctcgggcaacgcgaccgtcg

SEQ ID NO: 603382 - DNA, 25 bp, Rattus norvegicus
aagcgcgcggccgacgaacaccagg

SEQ ID NO: 603383 - DNA, 25 bp, Rattus norvegicus
cagcgtggatgctgctcggtcccgc

SEQ ID NO: 603384 - DNA, 25 bp, Rattus norvegicus
ccgtttcacggtgggtagcaccgca

SEQ ID NO: 603385 - DNA, 25 bp, Rattus norvegicus
agacacactggcacgctccactgga

SEQ ID NO: 603386 - DNA, 25 bp, Rattus norvegicus
gaagggcttcctgctacctaacctg

SEQ ID NO: 603387 - DNA, 25 bp, Rattus norvegicus
accactcggtgaacgcttgtacgcc

SEQ ID NO: 603388 - DNA, 25 bp, Rattus norvegicus
cgcgcacacactgagagctccaagg

SEQ ID NO: 603389 - DNA, 25 bp, Rattus norvegicus
cggagggaaagcctgacttcgaata

SEQ ID NO: 603390 - DNA, 25 bp, Rattus norvegicus
tgctggaatgtcacacctctggttt

SEQ ID NO: 603391 - DNA, 25 bp, Rattus norvegicus
tccttctcagtggtttctgctgtga

SEQ ID NO: 603392 - DNA, 25 bp, Rattus norvegicus
agacacgcacctttgccgagcggta

SEQ ID NO: 603393 - DNA, 25 bp, Rattus norvegicus
ggtactgcctagctgcgcgttagca

SEQ ID NO: 603394 - DNA, 25 bp, Rattus norvegicus
tgaacttcattcaagcgccggacgc

SEQ ID NO: 603395 - DNA, 25 bp, Rattus norvegicus
cctcttaggacgcagttatcctttg

SEQ ID NO: 603396 - DNA, 25 bp, Rattus norvegicus
cgccttctcctatgctgacttcgtg

SEQ ID NO: 603397 - DNA, 25 bp, Rattus norvegicus
gcgtgttttccagcgccttcactga

SEQ ID NO: 603398 - DNA, 25 bp, Rattus norvegicus
gtcccagacccagcagcgtgaactt

SEQ ID NO: 603399 - DNA, 25 bp, Rattus norvegicus
cccgcagcggacaaaggaccatgcg

SEQ ID NO: 603400 - DNA, 25 bp, Rattus norvegicus
tcgcgactctgttaggcgggacgcc

SEQ ID NO: 603401 - DNA, 25 bp, Rattus norvegicus
caagagggcacggtgttcccaaggc

SEQ ID NO: 603402 - DNA, 25 bp, Rattus norvegicus
tcacgtatgtgcaccggagcctggt

SEQ ID NO: 603403 - DNA, 25 bp, Rattus norvegicus
acctgcgccgcgtggctcacgtatg

SEQ ID NO: 603404 - DNA, 25 bp, Rattus norvegicus
aaggtccgcaagcagatgaagctgc

SEQ ID NO: 603405 - DNA, 25 bp, Rattus norvegicus
tggttcccggtgaagaaggtccgca

SEQ ID NO: 603406 - DNA, 25 bp, Rattus norvegicus
tgttccaaccagctccgctatattg

SEQ ID NO: 603407 - DNA, 25 bp, Rattus norvegicus
acaaaggaccatgcggtgctgcagg

SEQ ID NO: 603408 - DNA, 25 bp, Rattus norvegicus
gagtcgtggccgaatcccgtagccc

SEQ ID NO: 603409 - DNA, 25 bp, Rattus norvegicus
tctgttaggcgggacgcccaatgac

SEQ ID NO: 603410 - DNA, 25 bp, Rattus norvegicus
cgcccaatgacgtcagcagtaacgc

SEQ ID NO: 603411 - DNA, 25 bp, Rattus norvegicus
ccacgatgccgtggttcccggtgaa

SEQ ID NO: 603412 - DNA, 25 bp, Rattus norvegicus
cgtcagcagtaacgccagggaccct

SEQ ID NO: 603413 - DNA, 25 bp, Rattus norvegicus
tgggcgccatggacttcgagctgct

SEQ ID NO: 603414 - DNA, 25 bp, Rattus norvegicus
acatggagcggcttaatgcacggca

SEQ ID NO: 603415 - DNA, 25 bp, Rattus norvegicus
ccgctggcgtgaggatgctattgac

SEQ ID NO: 603416 - DNA, 25 bp, Rattus norvegicus
ggatgctattgactggcagcgcaca

SEQ ID NO: 603417 - DNA, 25 bp, Rattus norvegicus
gtggctcagtacatggagcggctta

SEQ ID NO: 603418 - DNA, 25 bp, Rattus norvegicus
cacattcagcgtgggcgccatggac

SEQ ID NO: 603419 - DNA, 25 bp, Rattus norvegicus
tcctgagaccgaagcagtggacgtg

SEQ ID NO: 603420 - DNA, 25 bp, Rattus norvegicus
gctgcgctccgactggaacgacctg

SEQ ID NO: 603421 - DNA, 25 bp, Rattus norvegicus
cgactggaacgacctgcgctgtaac

SEQ ID NO: 603422 - DNA, 25 bp, Rattus norvegicus
acctgcgctgtaacgtgtccgggaa

SEQ ID NO: 603423 - DNA, 25 bp, Rattus norvegicus
tgtccgggaacctgcagcttcctga

SEQ ID NO: 603424 - DNA, 25 bp, Rattus norvegicus
gaacctgcagcttcctgagaccgaa

SEQ ID NO: 603425 - DNA, 25 bp, Rattus norvegicus
tgactggcagcgcacattcagcgtg

SEQ ID NO: 603426 - DNA, 25 bp, Rattus norvegicus
cttaatgcacggcatggcgggtacg

SEQ ID NO: 603427 - DNA, 25 bp, Rattus norvegicus
gaacgtggaaaagcgccgcgactcc

SEQ ID NO: 603428 - DNA, 25 bp, Rattus norvegicus
tcttcctgcgattgccgggagcccg

SEQ ID NO: 603429 - DNA, 25 bp, Rattus norvegicus
aatatgtcttcctgcgattgccggg

SEQ ID NO: 603430 - DNA, 25 bp, Rattus norvegicus
ccagcgcctttcagaatatgtcttc

SEQ ID NO: 603431 - DNA, 25 bp, Rattus norvegicus
agccgccagcgcctttcagaatatg

SEQ ID NO: 603432 - DNA, 25 bp, Rattus norvegicus
cggaagccgcttcctcctggaactg

SEQ ID NO: 603433 - DNA, 25 bp, Rattus norvegicus
gcttctcgcttctacgcatcgtgaa

SEQ ID NO: 603434 - DNA, 25 bp, Rattus norvegicus
tcggttaatcagctctgcctcgcag

SEQ ID NO: 603435 - DNA, 25 bp, Rattus norvegicus
gtggagctacaaccctcggttaatc

SEQ ID NO: 603436 - DNA, 25 bp, Rattus norvegicus
ggcgttgagtggagctacaaccctc

SEQ ID NO: 603437 - DNA, 25 bp, Rattus norvegicus
tggggagtgcactcacgtggttctc

SEQ ID NO: 603438 - DNA, 25 bp, Rattus norvegicus
agcgggttgcagttgtaatgcgatc

SEQ ID NO: 603439 - DNA, 25 bp, Rattus norvegicus
gtaatgcgatctggggagtgcactc

SEQ ID NO: 603440 - DNA, 25 bp, Rattus norvegicus
catcgtgaacgtggaaaagcgccgc

SEQ ID NO: 603441 - DNA, 25 bp, Rattus norvegicus
caaaaggtcggcagagggctctgta

SEQ ID NO: 603442 - DNA, 25 bp, Rattus norvegicus
ccgacagcgactcaggttcaccaaa

SEQ ID NO: 603443 - DNA, 25 bp, Rattus norvegicus
actcaggttcaccaaaaggtcggca

SEQ ID NO: 603444 - DNA, 25 bp, Rattus norvegicus
gactcagggaacagagtagggacca

SEQ ID NO: 603445 - DNA, 25 bp, Rattus norvegicus
caggacaagggtggtacccgctcgc

SEQ ID NO: 603446 - DNA, 25 bp, Rattus norvegicus
tcctctgggcggtcgctataggaca

SEQ ID NO: 603447 - DNA, 25 bp, Rattus norvegicus
ctcgcggcaagaggtcgcggtcctc

SEQ ID NO: 603448 - DNA, 25 bp, Rattus norvegicus
ctgaggcttcagaataaaatttaca

SEQ ID NO: 603449 - DNA, 25 bp, Rattus norvegicus
cgcggtcctctaggaagagcttgta

SEQ ID NO: 603450 - DNA, 25 bp, Rattus norvegicus
gtcctctaggaagagcttgtatccc

SEQ ID NO: 603451 - DNA, 25 bp, Rattus norvegicus
tgagacgccgacagcgactcaggtt

SEQ ID NO: 603452 - DNA, 25 bp, Rattus norvegicus
tacaaatttgcggtcctctgggcgg

SEQ ID NO: 603453 - DNA, 25 bp, Rattus norvegicus
acgccgctccaactgaggcttcaga

SEQ ID NO: 603454 - DNA, 25 bp, Rattus norvegicus
ggtcgctataggacacgtacgcatc

SEQ ID NO: 603455 - DNA, 25 bp, Rattus norvegicus
ctgaggagcgtctccagctagccgt

SEQ ID NO: 603456 - DNA, 25 bp, Rattus norvegicus
tcccaccgggaagcagcaacggaga

SEQ ID NO: 603457 - DNA, 25 bp, Rattus norvegicus
ggagacaccgtagtttccgccattc

SEQ ID NO: 603458 - DNA, 25 bp, Rattus norvegicus
agacaacatggaggccgtgaagacc

SEQ ID NO: 603459 - DNA, 25 bp, Rattus norvegicus
acagcgaggttcgtaccgcaacccg

SEQ ID NO: 603460 - DNA, 25 bp, Rattus norvegicus
aagcttgagtgtggaggccgcttcc

SEQ ID NO: 603461 - DNA, 25 bp, Rattus norvegicus
tcttcgctgcgcgttgcaggttccc

SEQ ID NO: 603462 - DNA, 25 bp, Rattus norvegicus
gtcagcgcttcctcctgtgtcttcg

SEQ ID NO: 603463 - DNA, 25 bp, Rattus norvegicus
gaccgcgtccgccatattggatgcc

SEQ ID NO: 603464 - DNA, 25 bp, Rattus norvegicus
gccgactctgagtgcgcggctcgac

SEQ ID NO: 603465 - DNA, 25 bp, Rattus norvegicus
tggcctgtaccgtctcgatggtatg

SEQ ID NO: 603466 - DNA, 25 bp, Rattus norvegicus
agagcaacgctcaccggcgggacca

SEQ ID NO: 603467 - DNA, 25 bp, Rattus norvegicus
cactttgggtttttctcagagcaac

SEQ ID NO: 603468 - DNA, 25 bp, Rattus norvegicus
cgtgaagaccttcaacagcgaggtt

SEQ ID NO: 603469 - DNA, 25 bp, Rattus norvegicus
acctttaggtcttgactccgccctg

SEQ ID NO: 603470 - DNA, 25 bp, Rattus norvegicus
cccgccttgcccacgtaccgtcacg

SEQ ID NO: 603471 - DNA, 25 bp, Rattus norvegicus
ctaagccacgccctatcctccttgc

SEQ ID NO: 603472 - DNA, 25 bp, Rattus norvegicus
ccagagcctggccacgccattgacc

SEQ ID NO: 603473 - DNA, 25 bp, Rattus norvegicus
tggaaccgcccacgcaccagagcct

SEQ ID NO: 603474 - DNA, 25 bp, Rattus norvegicus
ttgactccgccctggaaccgcccac

SEQ ID NO: 603475 - DNA, 25 bp, Rattus norvegicus
cattctgggctggacctttaggtct

SEQ ID NO: 603476 - DNA, 25 bp, Rattus norvegicus
gcagcgcattctgggctggaccttt

SEQ ID NO: 603477 - DNA, 25 bp, Rattus norvegicus
gctgcagggcctggcagcgcattct

SEQ ID NO: 603478 - DNA, 25 bp, Rattus norvegicus
ggggcctcctgcatccaacgcctgc

SEQ ID NO: 603479 - DNA, 25 bp, Rattus norvegicus
tggtcctccttaaaggcggactctc

SEQ ID NO: 603480 - DNA, 25 bp, Rattus norvegicus
gtaccgtcacgtcagtccacccgaa

SEQ ID NO: 603481 - DNA, 25 bp, Rattus norvegicus
agagcggcttggtcctccttaaagg

SEQ ID NO: 603482 - DNA, 25 bp, Rattus norvegicus
ctctagtttaccgagagcggcttgg

SEQ ID NO: 603483 - DNA, 25 bp, Rattus norvegicus
cttcttttggtgagggtctctccgc

SEQ ID NO: 603484 - DNA, 25 bp, Rattus norvegicus
atccctcccatctagctgcttaggg

SEQ ID NO: 603485 - DNA, 25 bp, Rattus norvegicus
tagcggcccgcaagccggtggactc

SEQ ID NO: 603486 - DNA, 25 bp, Rattus norvegicus
tctgagtctccgctgctcgagggcc

SEQ ID NO: 603487 - DNA, 25 bp, Rattus norvegicus
atctagctgcttagggcctgggctt

SEQ ID NO: 603488 - DNA, 25 bp, Rattus norvegicus
tgatggcactaacaccttcttttgg

SEQ ID NO: 603489 - DNA, 25 bp, Rattus norvegicus
ccggaggctcgggatctgagtctcc

SEQ ID NO: 603490 - DNA, 25 bp, Rattus norvegicus
ggtcggagttatgacagatgattta

SEQ ID NO: 603491 - DNA, 25 bp, Rattus norvegicus
cagatgatttagtttggagtcggga

SEQ ID NO: 603492 - DNA, 25 bp, Rattus norvegicus
tcgggaaacgtcagggcccagatcg

SEQ ID NO: 603493 - DNA, 25 bp, Rattus norvegicus
gcccagatcgtccaggggaacgcct

SEQ ID NO: 603494 - DNA, 25 bp, Rattus norvegicus
atcgtccaggggaacgcctcgccag

SEQ ID NO: 603495 - DNA, 25 bp, Rattus norvegicus
tcgccagagcttagcggcccgcaag

SEQ ID NO: 603496 - DNA, 25 bp, Rattus norvegicus
tccgaggtctacgatgatggcacta

SEQ ID NO: 603497 - DNA, 25 bp, Rattus norvegicus
cgtcatccaagtgcgccgcgttcgt

SEQ ID NO: 603498 - DNA, 25 bp, Rattus norvegicus
acgcaatgagatggcgtcatccaag

SEQ ID NO: 603499 - DNA, 25 bp, Rattus norvegicus
gctcttcaccggctgagctgggtac

SEQ ID NO: 603500 - DNA, 25 bp, Rattus norvegicus
agctgggtacggacttctcagtgac

SEQ ID NO: 603501 - DNA, 25 bp, Rattus norvegicus
cggacttctcagtgaccacgagcta

SEQ ID NO: 603502 - DNA, 25 bp, Rattus norvegicus
tcagtgaccacgagctaacatagca

SEQ ID NO: 603503 - DNA, 25 bp, Rattus norvegicus
gagctaacatagcacctgaaactga

SEQ ID NO: 603504 - DNA, 25 bp, Rattus norvegicus
acctgaaactgacctcaggaagacc

SEQ ID NO: 603505 - DNA, 25 bp, Rattus norvegicus
agacctggagcgtgacggcgacctc

SEQ ID NO: 603506 - DNA, 25 bp, Rattus norvegicus
cgacctccggactggagtggaagaa

SEQ ID NO: 603507 - DNA, 25 bp, Rattus norvegicus
cctacgaggcgtgtcctcgccgtgg

SEQ ID NO: 603508 - DNA, 25 bp, Rattus norvegicus
caccgccggaggtaacgcaatgaga

SEQ ID NO: 603509 - DNA, 25 bp, Rattus norvegicus
gcgtgcgtacactcatgtaccagga

SEQ ID NO: 603510 - DNA, 25 bp, Rattus norvegicus
ctgcgcggcctacgaggcgtgtcct

SEQ ID NO: 603511 - DNA, 25 bp, Rattus norvegicus
acagtggttacgagcctgggattcc

SEQ ID NO: 603512 - DNA, 25 bp, Rattus norvegicus
ctcggcttggtctattcagctagca

SEQ ID NO: 603513 - DNA, 25 bp, Rattus norvegicus
acagggtttttactcaggtggtgca

SEQ ID NO: 603514 - DNA, 25 bp, Rattus norvegicus
tgttccacccactcaagcaagtagg

SEQ ID NO: 603515 - DNA, 25 bp, Rattus norvegicus
tactgcgtccacttgaagaacgacc

SEQ ID NO: 603516 - DNA, 25 bp, Rattus norvegicus
tcgaggtcccaacactgcagcagct

SEQ ID NO: 603517 - DNA, 25 bp, Rattus norvegicus
cgcgctcctcgtgctttggagaaga

SEQ ID NO: 603518 - DNA, 25 bp, Rattus norvegicus
ggcccaggagcggaaaggtcattcc

SEQ ID NO: 603519 - DNA, 25 bp, Rattus norvegicus
aggccgccgatgattggtcgaactc

SEQ ID NO: 603520 - DNA, 25 bp, Rattus norvegicus
ctccggagagaaactggtgtacgct

SEQ ID NO: 603521 - DNA, 25 bp, Rattus norvegicus
tgggtgctgcagtcaacagtgattc

SEQ ID NO: 603522 - DNA, 25 bp, Rattus norvegicus
cctgttatgattggctgagcaaccc

SEQ ID NO: 603523 - DNA, 25 bp, Rattus norvegicus
tgagcaacccatccgtcagaagccg

SEQ ID NO: 603524 - DNA, 25 bp, Rattus norvegicus
tcgcgttgagagagcctgccaaaga

SEQ ID NO: 603525 - DNA, 25 bp, Rattus norvegicus
actcaagctacggaggccttccctg

SEQ ID NO: 603526 - DNA, 25 bp, Rattus norvegicus
aatttctgccgtcccgcgtcgtctg

SEQ ID NO: 603527 - DNA, 25 bp, Rattus norvegicus
atttccgaatttctgccgtcccgcg

SEQ ID NO: 603528 - DNA, 25 bp, Rattus norvegicus
gtcctgattggatggagccagcgtc

SEQ ID NO: 603529 - DNA, 25 bp, Rattus norvegicus
cgcagactcaagctacggaggcctt

SEQ ID NO: 603530 - DNA, 25 bp, Rattus norvegicus
gatccggccgcagactcaagctacg

SEQ ID NO: 603531 - DNA, 25 bp, Rattus norvegicus
gacagcaccgggatccggccgcaga

SEQ ID NO: 603532 - DNA, 25 bp, Rattus norvegicus
caggacccgggacagcaccgggatc

SEQ ID NO: 603533 - DNA, 25 bp, Rattus norvegicus
gaagcgaggggacccagaccacgca

SEQ ID NO: 603534 - DNA, 25 bp, Rattus norvegicus
atcttaaggtgggtcggccatgacg

SEQ ID NO: 603535 - DNA, 25 bp, Rattus norvegicus
tccaaatcttaaggtgggtcggcca

SEQ ID NO: 603536 - DNA, 25 bp, Rattus norvegicus
agccagcgctccaaatcttaaggtg

SEQ ID NO: 603537 - DNA, 25 bp, Rattus norvegicus
acaaccagaagccagcgctccaaat

SEQ ID NO: 603538 - DNA, 25 bp, Rattus norvegicus
ggccggaacgctcaccatttccgaa

SEQ ID NO: 603539 - DNA, 25 bp, Rattus norvegicus
ttgatcaacagaggtgagcatccca

SEQ ID NO: 603540 - DNA, 25 bp, Rattus norvegicus
gcctccgagctaatggaatgccgtg

SEQ ID NO: 603541 - DNA, 25 bp, Rattus norvegicus
cttgaaggccgagagccaatgaggc

SEQ ID NO: 603542 - DNA, 25 bp, Rattus norvegicus
ggcaccgaagctcctgagtcccgga

SEQ ID NO: 603543 - DNA, 25 bp, Rattus norvegicus
ccggcaagtacccaggtgagctatg

SEQ ID NO: 603544 - DNA, 25 bp, Rattus norvegicus
gagctatgccgggttctcgagactc

SEQ ID NO: 603545 - DNA, 25 bp, Rattus norvegicus
tatagggcgggagacacacgcctcc

SEQ ID NO: 603546 - DNA, 25 bp, Rattus norvegicus
acgcgcttccgcgttgatcaacaga

SEQ ID NO: 603547 - DNA, 25 bp, Rattus norvegicus
tctcgagactcctgagcactgggcg

SEQ ID NO: 603548 - DNA, 25 bp, Rattus norvegicus
cttcgaccgaggagaagcggatctg

SEQ ID NO: 603549 - DNA, 25 bp, Rattus norvegicus
tgcacctgcatctgtccgctacgga

SEQ ID NO: 603550 - DNA, 25 bp, Rattus norvegicus
accgagtaacgagccaatggggcgt

SEQ ID NO: 603551 - DNA, 25 bp, Rattus norvegicus
aaagccgccaatgggagtgggtata

SEQ ID NO: 603552 - DNA, 25 bp, Rattus norvegicus
agcatcccaggcgactggatcctgc

SEQ ID NO: 603553 - DNA, 25 bp, Rattus norvegicus
ggggcattctaacttctcgacatcc

SEQ ID NO: 603554 - DNA, 25 bp, Rattus norvegicus
tgagagctcggacagcaatgccctg

SEQ ID NO: 603555 - DNA, 25 bp, Rattus norvegicus
ggctcccatttatccgggcggcgga

SEQ ID NO: 603556 - DNA, 25 bp, Rattus norvegicus
agtcggactgtaccaactgcactga

SEQ ID NO: 603557 - DNA, 25 bp, Rattus norvegicus
ctgcactgaggtgagagccacagcc

SEQ ID NO: 603558 - DNA, 25 bp, Rattus norvegicus
acagcctggtctagtgcactggtga

SEQ ID NO: 603559 - DNA, 25 bp, Rattus norvegicus
ctacttgcggtcgtgttcggacaga

SEQ ID NO: 603560 - DNA, 25 bp, Rattus norvegicus
tggtatcctctgacagcactcgtgg

SEQ ID NO: 603561 - DNA, 25 bp, Rattus norvegicus
cggtgtcccagtcgtgtctgaccgc

SEQ ID NO: 603562 - DNA, 25 bp, Rattus norvegicus
ttccggaagagtgtgggtacacttc

SEQ ID NO: 603563 - DNA, 25 bp, Rattus norvegicus
ttctcgacatcctccgccgtgagtt

SEQ ID NO: 603564 - DNA, 25 bp, Rattus norvegicus
actcgtgggttagtcagtgtcctga

SEQ ID NO: 603565 - DNA, 25 bp, Rattus norvegicus
gctaggcctacgtcgcactggctgt

SEQ ID NO: 603566 - DNA, 25 bp, Rattus norvegicus
caatgccctgctagatactggtatc

SEQ ID NO: 603567 - DNA, 25 bp, Rattus norvegicus
cgactgcgccaaggcggagactctt

SEQ ID NO: 603568 - DNA, 25 bp, Rattus norvegicus
cggaaaccgcagctgggctctcaca

SEQ ID NO: 603569 - DNA, 25 bp, Rattus norvegicus
caccaccgtaagactccggaattcg

SEQ ID NO: 603570 - DNA, 25 bp, Rattus norvegicus
ctccggaattcgaaagtgctacttt

SEQ ID NO: 603571 - DNA, 25 bp, Rattus norvegicus
tcgaaagtgctactttaattagagg

SEQ ID NO: 603572 - DNA, 25 bp, Rattus norvegicus
agtccgggcgctgagctagacgtaa

SEQ ID NO: 603573 - DNA, 25 bp, Rattus norvegicus
gtaagtgttgtctgcgactgcgcca

SEQ ID NO: 603574 - DNA, 25 bp, Rattus norvegicus
ttgagaaccaccacatcagcctctg

SEQ ID NO: 603575 - DNA, 25 bp, Rattus norvegicus
gcggtgggttcgttgagaaccacca

SEQ ID NO: 603576 - DNA, 25 bp, Rattus norvegicus
ttgccgaaccacacagccttgtagc

SEQ ID NO: 603577 - DNA, 25 bp, Rattus norvegicus
aggcactggcgctgtccacgtcggc

SEQ ID NO: 603578 - DNA, 25 bp, Rattus norvegicus
cttctggtcagggtcatcatcatca

SEQ ID NO: 603579 - DNA, 25 bp, Rattus norvegicus
cggagactcttcttctggtcagggt

SEQ ID NO: 603580 - DNA, 25 bp, Rattus norvegicus
cgctgagctagacgtaagtgttgtc

SEQ ID NO: 603581 - DNA, 25 bp, Rattus norvegicus
actacttcatcgtgagcctggcggc

SEQ ID NO: 603582 - DNA, 25 bp, Rattus norvegicus
gctgctcatcggcatggtgttggca

SEQ ID NO: 603583 - DNA, 25 bp, Rattus norvegicus
catcgtgagcctggcggctgccgac

SEQ ID NO: 603584 - DNA, 25 bp, Rattus norvegicus
tgagcgtggcctccgagcgcatcct

SEQ ID NO: 603585 - DNA, 25 bp, Rattus norvegicus
tcgctcgtttgcgtgagcgtggcct

SEQ ID NO: 603586 - DNA, 25 bp, Rattus norvegicus
catggtgttggcagggaactcgctc

SEQ ID NO: 603587 - DNA, 25 bp, Rattus norvegicus
tccttaggtactggcaccggacttg

SEQ ID NO: 603588 - DNA, 25 bp, Rattus norvegicus
agagtccttaggtactggcaccgga

SEQ ID NO: 603589 - DNA, 25 bp, Rattus norvegicus
aacagcagcgctactggtgacggtg

SEQ ID NO: 603590 - DNA, 25 bp, Rattus norvegicus
cgccatggggaacagcagcgctact

SEQ ID NO: 603591 - DNA, 25 bp, Rattus norvegicus
tgcagagtctcagctagggcgccat

SEQ ID NO: 603592 - DNA, 25 bp, Rattus norvegicus
ccaggctcagcgccttgcagagtct

SEQ ID NO: 603593 - DNA, 25 bp, Rattus norvegicus
cgggattccggatagcccctgactg

SEQ ID NO: 603594 - DNA, 25 bp, Rattus norvegicus
gcagggaactcgctcgtttgcgtga

SEQ ID NO: 603595 - DNA, 25 bp, Rattus norvegicus
cctgtccgctcatgctactgcttta

SEQ ID NO: 603596 - DNA, 25 bp, Rattus norvegicus
agcgcaaggcgatgagagtcctgcc

SEQ ID NO: 603597 - DNA, 25 bp, Rattus norvegicus
tcttcccgcagaaagagaggcgcca

SEQ ID NO: 603598 - DNA, 25 bp, Rattus norvegicus
tgtctgctccctgatgcagcgctcg

SEQ ID NO: 603599 - DNA, 25 bp, Rattus norvegicus
gctactgctttactgggccactttc

SEQ ID NO: 603600 - DNA, 25 bp, Rattus norvegicus
accgcgactacgtggtctactcatc

SEQ ID NO: 603601 - DNA, 25 bp, Rattus norvegicus
gcgatccaaccgtgtgctgcctgga

SEQ ID NO: 603602 - DNA, 25 bp, Rattus norvegicus
cctcaatgatgtgcccggtcgcgat

SEQ ID NO: 603603 - DNA, 25 bp, Rattus norvegicus
tgcgctacaaccagcagggtcagtg

SEQ ID NO: 603604 - DNA, 25 bp, Rattus norvegicus
ctgtgaccgtgccactgcgctacaa

SEQ ID NO: 603605 - DNA, 25 bp, Rattus norvegicus
tcctctaggtttgtggctgtgaccg

SEQ ID NO: 603606 - DNA, 25 bp, Rattus norvegicus
tcctgtgctccttcctctaggtttg

SEQ ID NO: 603607 - DNA, 25 bp, Rattus norvegicus
ttccggtcagctgctccattcggcg

SEQ ID NO: 603608 - DNA, 25 bp, Rattus norvegicus
ccgtctccagcagaccagagtcaga

SEQ ID NO: 603609 - DNA, 25 bp, Rattus norvegicus
gctggctccgcaaacttctctgatt

SEQ ID NO: 603610 - DNA, 25 bp, Rattus norvegicus
gagccgagctaatgtcccgagtgta

SEQ ID NO: 603611 - DNA, 25 bp, Rattus norvegicus
tcccgagtgtagaaccgaggctctc

SEQ ID NO: 603612 - DNA, 25 bp, Rattus norvegicus
aggctctccgaagtttcccgaagtg

SEQ ID NO: 603613 - DNA, 25 bp, Rattus norvegicus
cccgaagtgcagaatcgagctagta

SEQ ID NO: 603614 - DNA, 25 bp, Rattus norvegicus
agcgtttcttcctcgctgtctagga

SEQ ID NO: 603615 - DNA, 25 bp, Rattus norvegicus
tcactaaccgatggagctggctggc

SEQ ID NO: 603616 - DNA, 25 bp, Rattus norvegicus
tctcgccggcttccaacgaaattta

SEQ ID NO: 603617 - DNA, 25 bp, Rattus norvegicus
tcgcggacagacactggagccacta

SEQ ID NO: 603618 - DNA, 25 bp, Rattus norvegicus
aggcctagccgaactccgccgaatg

SEQ ID NO: 603619 - DNA, 25 bp, Rattus norvegicus
cgccgaatgcctccgagcagagttc

SEQ ID NO: 603620 - DNA, 25 bp, Rattus norvegicus
ttctatccgaaagctcccgagtgtt

SEQ ID NO: 603621 - DNA, 25 bp, Rattus norvegicus
agtcctcgtctctgcttaacaccgg

SEQ ID NO: 603622 - DNA, 25 bp, Rattus norvegicus
atgaaaggctatttgggctggctcc

SEQ ID NO: 603623 - DNA, 25 bp, Rattus norvegicus
atgagctctcttggcgcgctctgcc

SEQ ID NO: 603624 - DNA, 25 bp, Rattus norvegicus
tcggactggagcgtctcctggatct

SEQ ID NO: 603625 - DNA, 25 bp, Rattus norvegicus
gccgtccagcaccttcctgatgttg

SEQ ID NO: 603626 - DNA, 25 bp, Rattus norvegicus
ttcctcatggtctcgcccaagggtc

SEQ ID NO: 603627 - DNA, 25 bp, Rattus norvegicus
gcccaagggtctcccagctacgagg

SEQ ID NO: 603628 - DNA, 25 bp, Rattus norvegicus
tacgaggcccaggtagcagaggcac

SEQ ID NO: 603629 - DNA, 25 bp, Rattus norvegicus
caccggctgctaaggagtccgagcc

SEQ ID NO: 603630 - DNA, 25 bp, Rattus norvegicus
gccgctgaagcctagaggcggcttc

SEQ ID NO: 603631 - DNA, 25 bp, Rattus norvegicus
tcccaacaggaagggcagcgacggc

SEQ ID NO: 603632 - DNA, 25 bp, Rattus norvegicus
agcatggcccggacacccggaatcg

SEQ ID NO: 603633 - DNA, 25 bp, Rattus norvegicus
ggccggcggcttaaatcatccttcg

SEQ ID NO: 603634 - DNA, 25 bp, Rattus norvegicus
tcatccttcgccgaggaccaggggc

SEQ ID NO: 603635 - DNA, 25 bp, Rattus norvegicus
aatcttcccacgacagcttggccga

SEQ ID NO: 603636 - DNA, 25 bp, Rattus norvegicus
gctcccttcaccttgcagagttgga

SEQ ID NO: 603637 - DNA, 25 bp, Rattus norvegicus
gaccggtcctctgtgttgggacttg

SEQ ID NO: 603638 - DNA, 25 bp, Rattus norvegicus
aaggtgagcattctgggcttggcca

SEQ ID NO: 603639 - DNA, 25 bp, Rattus norvegicus
caattagggttcaactgtgccatcc

SEQ ID NO: 603640 - DNA, 25 bp, Rattus norvegicus
cccacgcgtggcacgaatacaatta

SEQ ID NO: 603641 - DNA, 25 bp, Rattus norvegicus
ctcagaagtgaggtcttgccctgcc

SEQ ID NO: 603642 - DNA, 25 bp, Rattus norvegicus
gggcagaatccctttccagaagact

SEQ ID NO: 603643 - DNA, 25 bp, Rattus norvegicus
tgtccagcttggctcagggcagaat

SEQ ID NO: 603644 - DNA, 25 bp, Rattus norvegicus
gcggcttcgtgttctctcttgtcca

SEQ ID NO: 603645 - DNA, 25 bp, Rattus norvegicus
ggtgctgcaagcacagtcccagctt

SEQ ID NO: 603646 - DNA, 25 bp, Rattus norvegicus
ctcagcgagcggagaacaaagtgac

SEQ ID NO: 603647 - DNA, 25 bp, Rattus norvegicus
agaaaccttgaccttcgcgggctca

SEQ ID NO: 603648 - DNA, 25 bp, Rattus norvegicus
cagtgcggagctagagaaaccttga

SEQ ID NO: 603649 - DNA, 25 bp, Rattus norvegicus
agcggcgaagatcgctctcactgcg

SEQ ID NO: 603650 - DNA, 25 bp, Rattus norvegicus
agcttccaccagtgggccaggctca

SEQ ID NO: 603651 - DNA, 25 bp, Rattus norvegicus
ggccgacgtagtccgacaaagagtc

SEQ ID NO: 603652 - DNA, 25 bp, Rattus norvegicus
cgtggtctatggcaaggtctccaag

SEQ ID NO: 603653 - DNA, 25 bp, Rattus norvegicus
gtctccaagtacatgggcggggctc

SEQ ID NO: 603654 - DNA, 25 bp, Rattus norvegicus
tcgcctccaggcttctttagctttg

SEQ ID NO: 603655 - DNA, 25 bp, Rattus norvegicus
tgtgggttaccacgcaccagctacc

SEQ ID NO: 603656 - DNA, 25 bp, Rattus norvegicus
agctaccgcctcagctgtgcgcgtt

SEQ ID NO: 603657 - DNA, 25 bp, Rattus norvegicus
cggtaaaacgccagaggatggagtc

SEQ ID NO: 603658 - DNA, 25 bp, Rattus norvegicus
ctgacacgggtgatttcaacggtaa

SEQ ID NO: 603659 - DNA, 25 bp, Rattus norvegicus
ggtgtatgcgccctatagaagctgc

SEQ ID NO: 603660 - DNA, 25 bp, Rattus norvegicus
cccaattttggaacctgtatgggtg

SEQ ID NO: 603661 - DNA, 25 bp, Rattus norvegicus
gattggtgagtctgtggaacgttca

SEQ ID NO: 603662 - DNA, 25 bp, Rattus norvegicus
ggaacgttcaaggatcaatagcctc

SEQ ID NO: 603663 - DNA, 25 bp, Rattus norvegicus
agcctctgggctattggtgaccctg

SEQ ID NO: 603664 - DNA, 25 bp, Rattus norvegicus
gcgctactaaggaagagaactcaga

SEQ ID NO: 603665 - DNA, 25 bp, Rattus norvegicus
ggcagcctctccgacgccatggcta

SEQ ID NO: 603666 - DNA, 25 bp, Rattus norvegicus
gcgcatgcgtgagacacaaagggcg

SEQ ID NO: 603667 - DNA, 25 bp, Rattus norvegicus
cgcaaggcgtagtggattggtcgca

SEQ ID NO: 603668 - DNA, 25 bp, Rattus norvegicus
caggctgatatttgcgcgagagacg

SEQ ID NO: 603669 - DNA, 25 bp, Rattus norvegicus
ccttcagggagtgaaatgcgcatgc

SEQ ID NO: 603670 - DNA, 25 bp, Rattus norvegicus
ccatggctacaacccaggctgatat

SEQ ID NO: 603671 - DNA, 25 bp, Rattus norvegicus
agggctcgccttcagggagtgaaat

SEQ ID NO: 603672 - DNA, 25 bp, Rattus norvegicus
gccgctggccaccaggagacaggca

SEQ ID NO: 603673 - DNA, 25 bp, Rattus norvegicus
tcggaagcgccgctggccaccagga

SEQ ID NO: 603674 - DNA, 25 bp, Rattus norvegicus
gcgcgcctcaccttcggaagcgccg

SEQ ID NO: 603675 - DNA, 25 bp, Rattus norvegicus
ggaaacgacgcggaacttgcttgaa

SEQ ID NO: 603676 - DNA, 25 bp, Rattus norvegicus
acgacgcggaacttgcttgaagatg

SEQ ID NO: 603677 - DNA, 25 bp, Rattus norvegicus
cggaacttgcttgaagatgtgggca

SEQ ID NO: 603678 - DNA, 25 bp, Rattus norvegicus
cccaggctgatatttgcgcgagaga

SEQ ID NO: 603679 - DNA, 25 bp, Rattus norvegicus
ggaactgacctgctagcactcacca

SEQ ID NO: 603680 - DNA, 25 bp, Rattus norvegicus
gctccgccctaagtttttgctgcta

SEQ ID NO: 603681 - DNA, 25 bp, Rattus norvegicus
tacgggaactgacctgctagcactc

SEQ ID NO: 603682 - DNA, 25 bp, Rattus norvegicus
tgggcgctacgggaactgacctgct

SEQ ID NO: 603683 - DNA, 25 bp, Rattus norvegicus
ttccagcaacctagccagatttggg

SEQ ID NO: 603684 - DNA, 25 bp, Rattus norvegicus
gtgtctgagcagatgtcacctctcc

SEQ ID NO: 603685 - DNA, 25 bp, Rattus norvegicus
agccgcagtgtctgagcagatgtca

SEQ ID NO: 603686 - DNA, 25 bp, Rattus norvegicus
ctgccggagccgcagtgtctgagca

SEQ ID NO: 603687 - DNA, 25 bp, Rattus norvegicus
tgtcgtggtacccaccggtccaggc

SEQ ID NO: 603688 - DNA, 25 bp, Rattus norvegicus
gagcacggccttccacacccggaga

SEQ ID NO: 603689 - DNA, 25 bp, Rattus norvegicus
gtttttgctgctatcggctccccct

SEQ ID NO: 603690 - DNA, 25 bp, Rattus norvegicus
cctagccagatttgggtgggcgcta

SEQ ID NO: 603691 - DNA, 25 bp, Rattus norvegicus
cacccggagacagcctgtcgtggta

SEQ ID NO: 603692 - DNA, 25 bp, Rattus norvegicus
ttttccttccagcaacctagccaga

SEQ ID NO: 603693 - DNA, 25 bp, Rattus norvegicus
cttggcacttgaaaaaactcttgtt

SEQ ID NO: 603694 - DNA, 25 bp, Rattus norvegicus
cgcgtcccggagacttctgggtagc

SEQ ID NO: 603695 - DNA, 25 bp, Rattus norvegicus
tcgggagactctcgcctatgttaca

SEQ ID NO: 603696 - DNA, 25 bp, Rattus norvegicus
gccgagggttgcatattttccgtga

SEQ ID NO: 603697 - DNA, 25 bp, Rattus norvegicus
ctccgcattgcacgttgggagctgt

SEQ ID NO: 603698 - DNA, 25 bp, Rattus norvegicus
tgaggtctgtccaccgcaaccgagt

SEQ ID NO: 603699 - DNA, 25 bp, Rattus norvegicus
cccttatcgtcaatgggaggcgccc

SEQ ID NO: 603700 - DNA, 25 bp, Rattus norvegicus
ttccggcgcacccttatcgtcaatg

SEQ ID NO: 603701 - DNA, 25 bp, Rattus norvegicus
gcaaatttcttgcttccggcgcacc

SEQ ID NO: 603702 - DNA, 25 bp, Rattus norvegicus
catgaccggggacaaggcaaatttc

SEQ ID NO: 603703 - DNA, 25 bp, Rattus norvegicus
ttgttgtgggaaacacatgaccggg

SEQ ID NO: 603704 - DNA, 25 bp, Rattus norvegicus
tgttacaggagcacttggcacttga

SEQ ID NO: 603705 - DNA, 25 bp, Rattus norvegicus
catgctgggaacgtgaggcgaaaaa

SEQ ID NO: 603706 - DNA, 25 bp, Rattus norvegicus
caaccgagtgagtaccctggccggc

SEQ ID NO: 603707 - DNA, 25 bp, Rattus norvegicus
accgccacagcgctggtcactgggg

SEQ ID NO: 603708 - DNA, 25 bp, Rattus norvegicus
ctaatcacgatgttcccaagggaga

SEQ ID NO: 603709 - DNA, 25 bp, Rattus norvegicus
actgcccgcaggacgtctaatcacg

SEQ ID NO: 603710 - DNA, 25 bp, Rattus norvegicus
cccaggttatcaagactgcgggacc

SEQ ID NO: 603711 - DNA, 25 bp, Rattus norvegicus
tgatccagttgggtcgcgcgcccag

SEQ ID NO: 603712 - DNA, 25 bp, Rattus norvegicus
ggccgttccctgcttgatccagttg

SEQ ID NO: 603713 - DNA, 25 bp, Rattus norvegicus
tggaacatctcgttcgctggctgcg

SEQ ID NO: 603714 - DNA, 25 bp, Rattus norvegicus
gcttcctcggggtctaccacattgg

SEQ ID NO: 603715 - DNA, 25 bp, Rattus norvegicus
ctcacatctacggagcctcggcagg

SEQ ID NO: 603716 - DNA, 25 bp, Rattus norvegicus
tctaccacattggagtggcctcctg

SEQ ID NO: 603717 - DNA, 25 bp, Rattus norvegicus
caagggagaccaagtggaacatctc

SEQ ID NO: 603718 - DNA, 25 bp, Rattus norvegicus
gccggtggatgctctagcgtcccac

SEQ ID NO: 603719 - DNA, 25 bp, Rattus norvegicus
tcggcaggggcgcttaccgccacag

SEQ ID NO: 603720 - DNA, 25 bp, Rattus norvegicus
tggtggccaacgccactcacatcta

SEQ ID NO: 603721 - DNA, 25 bp, Rattus norvegicus
tctctttctggaacggctgtgttcc

SEQ ID NO: 603722 - DNA, 25 bp, Rattus norvegicus
cgcggctcgcaggtaggcatttgct

SEQ ID NO: 603723 - DNA, 25 bp, Rattus norvegicus
aggtaggcatttgctcgcaggtccc

SEQ ID NO: 603724 - DNA, 25 bp, Rattus norvegicus
caggtcccgcggctggggtcccagt

SEQ ID NO: 603725 - DNA, 25 bp, Rattus norvegicus
tagctccagtgatcgcaccttcgga

SEQ ID NO: 603726 - DNA, 25 bp, Rattus norvegicus
tgatcgcaccttcggaccgccgtat

SEQ ID NO: 603727 - DNA, 25 bp, Rattus norvegicus
cgcaccttcggaccgccgtatggag

SEQ ID NO: 603728 - DNA, 25 bp, Rattus norvegicus
tcgcaggtaggcatttgctcgcagg

SEQ ID NO: 603729 - DNA, 25 bp, Rattus norvegicus
gagcggcgaccgcacgcatctcttt

SEQ ID NO: 603730 - DNA, 25 bp, Rattus norvegicus
tttctggaacggctgtgttcctggg

SEQ ID NO: 603731 - DNA, 25 bp, Rattus norvegicus
ttcctggggtgaaggcagctagccc

SEQ ID NO: 603732 - DNA, 25 bp, Rattus norvegicus
gtgaaggcagctagcccagacgtgc

SEQ ID NO: 603733 - DNA, 25 bp, Rattus norvegicus
aggcagctagcccagacgtgcgtgc

SEQ ID NO: 603734 - DNA, 25 bp, Rattus norvegicus
accgccgtatggagcggcgaccgca

SEQ ID NO: 603735 - DNA, 25 bp, Rattus norvegicus
tgtgctatcccggttcctctaaggc

SEQ ID NO: 603736 - DNA, 25 bp, Rattus norvegicus
cagcagcttcgggagcagcgacagc

SEQ ID NO: 603737 - DNA, 25 bp, Rattus norvegicus
cctctaaggcgggagagtgaacacg

SEQ ID NO: 603738 - DNA, 25 bp, Rattus norvegicus
atcatgcctgtgctatcccggttcc

SEQ ID NO: 603739 - DNA, 25 bp, Rattus norvegicus
ctcgggaatgatcatgcctgtgcta

SEQ ID NO: 603740 - DNA, 25 bp, Rattus norvegicus
gcagagacttggctcgggaatgatc

SEQ ID NO: 603741 - DNA, 25 bp, Rattus norvegicus
ggaaattctgatgcgcgcatccgcc

SEQ ID NO: 603742 - DNA, 25 bp, Rattus norvegicus
ttgggttctctagaggaaattctga

SEQ ID NO: 603743 - DNA, 25 bp, Rattus norvegicus
gagcgacccgagctgttgggttctc

SEQ ID NO: 603744 - DNA, 25 bp, Rattus norvegicus
gcatcctccaggcaatgggctgtga

SEQ ID NO: 603745 - DNA, 25 bp, Rattus norvegicus
tccgatcgcatcctccaggcaatgg

SEQ ID NO: 603746 - DNA, 25 bp, Rattus norvegicus
tagaggaaattctgatgcgcgcatc

SEQ ID NO: 603747 - DNA, 25 bp, Rattus norvegicus
gcggactgtatgaagagctggagca

SEQ ID NO: 603748 - DNA, 25 bp, Rattus norvegicus
cgcgacggtctggagcaggcacttc

SEQ ID NO: 603749 - DNA, 25 bp, Rattus norvegicus
tgccggggctggtatttcaaagcgt

SEQ ID NO: 603750 - DNA, 25 bp, Rattus norvegicus
tcgcccagccgacttcagtatttca

SEQ ID NO: 603751 - DNA, 25 bp, Rattus norvegicus
ttcaaagcgtggttggtgagtgctc

SEQ ID NO: 603752 - DNA, 25 bp, Rattus norvegicus
tgagtgctccgaagccgaagggtat

SEQ ID NO: 603753 - DNA, 25 bp, Rattus norvegicus
gtgtcctgagttccttgcttactgg

SEQ ID NO: 603754 - DNA, 25 bp, Rattus norvegicus
ttcagtatttcatcccgtcggtggg

SEQ ID NO: 603755 - DNA, 25 bp, Rattus norvegicus
tgcttactggtgttcctagtctccg

SEQ ID NO: 603756 - DNA, 25 bp, Rattus norvegicus
ggccgagcattctctgtactccgaa

SEQ ID NO: 603757 - DNA, 25 bp, Rattus norvegicus
agcctctgtggttcttgggcaggcc

SEQ ID NO: 603758 - DNA, 25 bp, Rattus norvegicus
cctggcggtctctttcgtggagaaa

SEQ ID NO: 603759 - DNA, 25 bp, Rattus norvegicus
ggaaagttaaagtctgatcacccta

SEQ ID NO: 603760 - DNA, 25 bp, Rattus norvegicus
cttcatctctgtgacgcggggattc

SEQ ID NO: 603761 - DNA, 25 bp, Rattus norvegicus
tccgaatgagcgctcctacagtggc

SEQ ID NO: 603762 - DNA, 25 bp, Rattus norvegicus
gatcaccctattcattgtccctgga

SEQ ID NO: 603763 - DNA, 25 bp, Rattus norvegicus
tgccttgattgacagctgctccgcc

SEQ ID NO: 603764 - DNA, 25 bp, Rattus norvegicus
ttccgccgctacagaaccgtcggtg

SEQ ID NO: 603765 - DNA, 25 bp, Rattus norvegicus
cctcggtgtactctgcctgtagcag

SEQ ID NO: 603766 - DNA, 25 bp, Rattus norvegicus
cttacccgaggtgcccagccagagt

SEQ ID NO: 603767 - DNA, 25 bp, Rattus norvegicus
attgcgcacggccaaagcggtcttc

SEQ ID NO: 603768 - DNA, 25 bp, Rattus norvegicus
cgcgtttctcgtgttgccttgattg

SEQ ID NO: 603769 - DNA, 25 bp, Rattus norvegicus
tatatcccggctacggcatccgagc

SEQ ID NO: 603770 - DNA, 25 bp, Rattus norvegicus
ctcccgcagtggtggtatatcccgg

SEQ ID NO: 603771 - DNA, 25 bp, Rattus norvegicus
ccgctcccgtgattactctgaagtg

SEQ ID NO: 603772 - DNA, 25 bp, Rattus norvegicus
tcgcccaaagcgcagggctcattac

SEQ ID NO: 603773 - DNA, 25 bp, Rattus norvegicus
ctgccggcagcagtttttcaaagcc

SEQ ID NO: 603774 - DNA, 25 bp, Rattus norvegicus
ttaccgacgatcttcccgcaggtga

SEQ ID NO: 603775 - DNA, 25 bp, Rattus norvegicus
taggcttcccatttgttaccgacga

SEQ ID NO: 603776 - DNA, 25 bp, Rattus norvegicus
ctgtagcagacccaggtaggcttcc

SEQ ID NO: 603777 - DNA, 25 bp, Rattus norvegicus
cgctgacaacggctgtagccactga

SEQ ID NO: 603778 - DNA, 25 bp, Rattus norvegicus
cggcggcttcttcggcctgcactcg

SEQ ID NO: 603779 - DNA, 25 bp, Rattus norvegicus
cgctgcagcagcctgtatgggcgcg

SEQ ID NO: 603780 - DNA, 25 bp, Rattus norvegicus
gcgcagcccttctccggagagcaag

SEQ ID NO: 603781 - DNA, 25 bp, Rattus norvegicus
ggacgaatccacgtaccggcgcagc

SEQ ID NO: 603782 - DNA, 25 bp, Rattus norvegicus
cagcacggacgaatccacgtaccgg

SEQ ID NO: 603783 - DNA, 25 bp, Rattus norvegicus
gctccagcacggacgaatccacgta

SEQ ID NO: 603784 - DNA, 25 bp, Rattus norvegicus
gatgcgccgctccagcacggacgaa

SEQ ID NO: 603785 - DNA, 25 bp, Rattus norvegicus
ctgacaacggctgtagccactgagc

SEQ ID NO: 603786 - DNA, 25 bp, Rattus norvegicus
gctgctaccgcttgccctgggaggt

SEQ ID NO: 603787 - DNA, 25 bp, Rattus norvegicus
caaggcagcccaggcgcgctataca

SEQ ID NO: 603788 - DNA, 25 bp, Rattus norvegicus
cggagcgctgacaacggctgtagcc

SEQ ID NO: 603789 - DNA, 25 bp, Rattus norvegicus
tgtagccactgagcttggcggcggg

SEQ ID NO: 603790 - DNA, 25 bp, Rattus norvegicus
gtgggagccaagtcgcgcgcccgct

SEQ ID NO: 603791 - DNA, 25 bp, Rattus norvegicus
gctttggagacgattgcccgcctct

SEQ ID NO: 603792 - DNA, 25 bp, Rattus norvegicus
cacccgggagaactgacgactcagc

SEQ ID NO: 603793 - DNA, 25 bp, Rattus norvegicus
acctgaggagcagagctggactgac

SEQ ID NO: 603794 - DNA, 25 bp, Rattus norvegicus
acagagcggtccaccacagagcgtc

SEQ ID NO: 603795 - DNA, 25 bp, Rattus norvegicus
tcaaatcccgctcatcctgaagtgc

SEQ ID NO: 603796 - DNA, 25 bp, Rattus norvegicus
cgctcgcagtccgaacaacttaatg

SEQ ID NO: 603797 - DNA, 25 bp, Rattus norvegicus
cttgccggaaatgacgaagaagaca

SEQ ID NO: 603798 - DNA, 25 bp, Rattus norvegicus
gaaattctgggaaagctgcttcgcc

SEQ ID NO: 603799 - DNA, 25 bp, Rattus norvegicus
caggaattttctatggcgtgcagga

SEQ ID NO: 603800 - DNA, 25 bp, Rattus norvegicus
acacacgcggcaggaattttctatg

SEQ ID NO: 603801 - DNA, 25 bp, Rattus norvegicus
ccgaggcagccatgagacctacata

SEQ ID NO: 603802 - DNA, 25 bp, Rattus norvegicus
aagtgccgagctttcccgaggcagc

SEQ ID NO: 603803 - DNA, 25 bp, Rattus norvegicus
cagcctcaagtccaggaggaaattc

SEQ ID NO: 603804 - DNA, 25 bp, Rattus norvegicus
ctttattgggtagagaaacttgccg

SEQ ID NO: 603805 - DNA, 25 bp, Rattus norvegicus
acgccagcttcctagatgccttgcg

SEQ ID NO: 603806 - DNA, 25 bp, Rattus norvegicus
actctgcccgtcctgtccggggaga

SEQ ID NO: 603807 - DNA, 25 bp, Rattus norvegicus
ggagaggctcgctgcccgacgttcc

SEQ ID NO: 603808 - DNA, 25 bp, Rattus norvegicus
tgaagcagtcccattgccgccactg

SEQ ID NO: 603809 - DNA, 25 bp, Rattus norvegicus
cgacgttcccgcatcatgacgcgga

SEQ ID NO: 603810 - DNA, 25 bp, Rattus norvegicus
tcccgcatcatgacgcggaagatga

SEQ ID NO: 603811 - DNA, 25 bp, Rattus norvegicus
cgcggaagatgaagcagtcccattg

SEQ ID NO: 603812 - DNA, 25 bp, Rattus norvegicus
ccttcatgtcaggagaccggccaga

SEQ ID NO: 603813 - DNA, 25 bp, Rattus norvegicus
ggagaccggccagaaccatcaagca

SEQ ID NO: 603814 - DNA, 25 bp, Rattus norvegicus
agaaccatcaagcacggccggaaga

SEQ ID NO: 603815 - DNA, 25 bp, Rattus norvegicus
gacgattcagcgagccggaagtccc

SEQ ID NO: 603816 - DNA, 25 bp, Rattus norvegicus
aagcacggccggaagacgattcagc

SEQ ID NO: 603817 - DNA, 25 bp, Rattus norvegicus
ttagaggcggagtctcgtagctgca

SEQ ID NO: 603818 - DNA, 25 bp, Rattus norvegicus
tgccgggctcaccttcatgtcagga

SEQ ID NO: 603819 - DNA, 25 bp, Rattus norvegicus
gcctgaaagataatcgtatggcttc

SEQ ID NO: 603820 - DNA, 25 bp, Rattus norvegicus
agggcacctatgaggacgcggctct

SEQ ID NO: 603821 - DNA, 25 bp, Rattus norvegicus
gggacacttcctgcaccgctctagg

SEQ ID NO: 603822 - DNA, 25 bp, Rattus norvegicus
gctctaggaccgaggaggtctcctc

SEQ ID NO: 603823 - DNA, 25 bp, Rattus norvegicus
aggtctcctcatctcaatggttcgc

SEQ ID NO: 603824 - DNA, 25 bp, Rattus norvegicus
ggctttagctttgtgggtcttcgta

SEQ ID NO: 603825 - DNA, 25 bp, Rattus norvegicus
cttccctgctcctctcgtgtgggtg

SEQ ID NO: 603826 - DNA, 25 bp, Rattus norvegicus
gcggcgctggcgaaatgccagaatt

SEQ ID NO: 603827 - DNA, 25 bp, Rattus norvegicus
gtaaggggatctccctgtgaccacc

SEQ ID NO: 603828 - DNA, 25 bp, Rattus norvegicus
tgtgaccacccgcatcccgtgtgtg

SEQ ID NO: 603829 - DNA, 25 bp, Rattus norvegicus
tctcaaagccaacgctgccagagtc

SEQ ID NO: 603830 - DNA, 25 bp, Rattus norvegicus
gccagagtcacccaaatcagtacga

SEQ ID NO: 603831 - DNA, 25 bp, Rattus norvegicus
ggcgatccactgtgcttgccgaagc

SEQ ID NO: 603832 - DNA, 25 bp, Rattus norvegicus
cagtacgactagagaaatgcagacc

SEQ ID NO: 603833 - DNA, 25 bp, Rattus norvegicus
cacctctggggttctccaagcggta

SEQ ID NO: 603834 - DNA, 25 bp, Rattus norvegicus
taactgtgagtgtcagacgccgggc

SEQ ID NO: 603835 - DNA, 25 bp, Rattus norvegicus
tccgatatccgtaactgtgagtgtc

SEQ ID NO: 603836 - DNA, 25 bp, Rattus norvegicus
gcggtcttcatctccgatatccgta

SEQ ID NO: 603837 - DNA, 25 bp, Rattus norvegicus
atgcgaggcctagcggtcttcatct

SEQ ID NO: 603838 - DNA, 25 bp, Rattus norvegicus
ggtcgcaaagatgccggccgtatcc

SEQ ID NO: 603839 - DNA, 25 bp, Rattus norvegicus
tccaagcggtaaacctgctctatcc

SEQ ID NO: 603840 - DNA, 25 bp, Rattus norvegicus
gcttgctccgcacctctggggttct

SEQ ID NO: 603841 - DNA, 25 bp, Rattus norvegicus
taacaggcggcgcttgcttgctccg

SEQ ID NO: 603842 - DNA, 25 bp, Rattus norvegicus
ccaagaggtgataacaggcggcgct

SEQ ID NO: 603843 - DNA, 25 bp, Rattus norvegicus
tagaaggatccttcaccaagaggtg

SEQ ID NO: 603844 - DNA, 25 bp, Rattus norvegicus
ccggtatacattagaaggatccttc

SEQ ID NO: 603845 - DNA, 25 bp, Rattus norvegicus
gagatcggggctactccggtataca

SEQ ID NO: 603846 - DNA, 25 bp, Rattus norvegicus
tccagggctactcggcgtgacggcc

SEQ ID NO: 603847 - DNA, 25 bp, Rattus norvegicus
taaacctgagcgctcccttgcgggc

SEQ ID NO: 603848 - DNA, 25 bp, Rattus norvegicus
tcttccggctaatccgcgcaggcgt

SEQ ID NO: 603849 - DNA, 25 bp, Rattus norvegicus
tacctgaaggtaggacccgcgaagc

SEQ ID NO: 603850 - DNA, 25 bp, Rattus norvegicus
ggcggcaaagcaacccacgagaggc

SEQ ID NO: 603851 - DNA, 25 bp, Rattus norvegicus
cccgcgaggcaatcggctctttagt

SEQ ID NO: 603852 - DNA, 25 bp, Rattus norvegicus
cccaagcacagagctcggcagtagc

SEQ ID NO: 603853 - DNA, 25 bp, Rattus norvegicus
gtcgctactccgtatgggtacctga

SEQ ID NO: 603854 - DNA, 25 bp, Rattus norvegicus
cagtggttccctctggagctcagta

SEQ ID NO: 603855 - DNA, 25 bp, Rattus norvegicus
gactgtctgcgcatgcctaaacctg

SEQ ID NO: 603856 - DNA, 25 bp, Rattus norvegicus
tcccttgcgggcagaaacctgctca

SEQ ID NO: 603857 - DNA, 25 bp, Rattus norvegicus
ctgcaggacgcacctataaccggga

SEQ ID NO: 603858 - DNA, 25 bp, Rattus norvegicus
gggacgttcatctcaactcggctga

SEQ ID NO: 603859 - DNA, 25 bp, Rattus norvegicus
gtagtttcctgtatacgcctgcgca

SEQ ID NO: 603860 - DNA, 25 bp, Rattus norvegicus
cccttaaaatggctgtcagactgtc

SEQ ID NO: 603861 - DNA, 25 bp, Rattus norvegicus
ctggcagtgccacagaaagtgcgtg

SEQ ID NO: 603862 - DNA, 25 bp, Rattus norvegicus
ggccctaccggctggagaagacgct

SEQ ID NO: 603863 - DNA, 25 bp, Rattus norvegicus
ccacccggccgaaggaggccgcaga

SEQ ID NO: 603864 - DNA, 25 bp, Rattus norvegicus
ccctcagaccactggttgcgggagg

SEQ ID NO: 603865 - DNA, 25 bp, Rattus norvegicus
cccaagaccatgcagcgcggcttgg

SEQ ID NO: 603866 - DNA, 25 bp, Rattus norvegicus
gcagcatgggagatgcctgccggct

SEQ ID NO: 603867 - DNA, 25 bp, Rattus norvegicus
ccggctgctggcagtgccacagaaa

SEQ ID NO: 603868 - DNA, 25 bp, Rattus norvegicus
cccgcattgtgcgaccgagcgagcg

SEQ ID NO: 603869 - DNA, 25 bp, Rattus norvegicus
catctgccgtctgccgcgttaatag

SEQ ID NO: 603870 - DNA, 25 bp, Rattus norvegicus
ccgtctgccgcgttaataggcgtgc

SEQ ID NO: 603871 - DNA, 25 bp, Rattus norvegicus
gccgcgttaataggcgtgctgcctg

SEQ ID NO: 603872 - DNA, 25 bp, Rattus norvegicus
gagcagctgcgtcccggccgcatga

SEQ ID NO: 603873 - DNA, 25 bp, Rattus norvegicus
cacgcgcagtatgtggggccctacc

SEQ ID NO: 603874 - DNA, 25 bp, Rattus norvegicus
cagtgccacagaaagtgcgtggccc

SEQ ID NO: 603875 - DNA, 25 bp, Rattus norvegicus
cagcccgtcaatccgcggcgaggga

SEQ ID NO: 603876 - DNA, 25 bp, Rattus norvegicus
ctgtggccaagtaggattatactga

SEQ ID NO: 603877 - DNA, 25 bp, Rattus norvegicus
ttatactgacccaacagcagggccg

SEQ ID NO: 603878 - DNA, 25 bp, Rattus norvegicus
cgggcaccgccacagagtagagaac

SEQ ID NO: 603879 - DNA, 25 bp, Rattus norvegicus
ccacagagtagagaaccgagacgcg

SEQ ID NO: 603880 - DNA, 25 bp, Rattus norvegicus
cggcttgctgggacgcgtagtccca

SEQ ID NO: 603881 - DNA, 25 bp, Rattus norvegicus
aagtaaacactcgatggctcccgcc

SEQ ID NO: 603882 - DNA, 25 bp, Rattus norvegicus
cgaaggccggcatctctgtggccaa

SEQ ID NO: 603883 - DNA, 25 bp, Rattus norvegicus
atgagccagtccatggctgcgcgga

SEQ ID NO: 603884 - DNA, 25 bp, Rattus norvegicus
cgaagaccgggtgcccgactcgcag

SEQ ID NO: 603885 - DNA, 25 bp, Rattus norvegicus
ctcactctcctcaaaagtaaattgg

SEQ ID NO: 603886 - DNA, 25 bp, Rattus norvegicus
gtcacttgggcggaagaactttcgc

SEQ ID NO: 603887 - DNA, 25 bp, Rattus norvegicus
taaattggaagaaagtcacttgggc

SEQ ID NO: 603888 - DNA, 25 bp, Rattus norvegicus
cggcggccggaagtaaacactcgat

SEQ ID NO: 603889 - DNA, 25 bp, Rattus norvegicus
cgcccggccaaaggcggagaacaca

SEQ ID NO: 603890 - DNA, 25 bp, Rattus norvegicus
gcggagaacacagcgcctggaccct

SEQ ID NO: 603891 - DNA, 25 bp, Rattus norvegicus
agacgggctgtccagcttgcagagc

SEQ ID NO: 603892 - DNA, 25 bp, Rattus norvegicus
gaagcaccagggtccgtcgggtgac

SEQ ID NO: 603893 - DNA, 25 bp, Rattus norvegicus
ctggggagtccagtggcggcaccca

SEQ ID NO: 603894 - DNA, 25 bp, Rattus norvegicus
agggccagacggctgaccagggcca

SEQ ID NO: 603895 - DNA, 25 bp, Rattus norvegicus
gccgacagggccgagaggccgtgcc

SEQ ID NO: 603896 - DNA, 25 bp, Rattus norvegicus
gtctgccgggccgtgtctccaaagt

SEQ ID NO: 603897 - DNA, 25 bp, Rattus norvegicus
tgccgggccgtgtctccaaagttta

SEQ ID NO: 603898 - DNA, 25 bp, Rattus norvegicus
ctccaaagtttagggccaggccatg

SEQ ID NO: 603899 - DNA, 25 bp, Rattus norvegicus
aaagtttagggccaggccatgagcg

SEQ ID NO: 603900 - DNA, 25 bp, Rattus norvegicus
ggcactctggaacggagtccgggct

SEQ ID NO: 603901 - DNA, 25 bp, Rattus norvegicus
cccagacgggctgtccagcttgcag

SEQ ID NO: 603902 - DNA, 25 bp, Rattus norvegicus
cggccaaaggcggagaacacagcgc

SEQ ID NO: 603903 - DNA, 25 bp, Rattus norvegicus
aagagcttccttcaggacgcaaacc

SEQ ID NO: 603904 - DNA, 25 bp, Rattus norvegicus
ggtagagccacctattcctccgtgc

SEQ ID NO: 603905 - DNA, 25 bp, Rattus norvegicus
ctgctcgcggggtagagccacctat

SEQ ID NO: 603906 - DNA, 25 bp, Rattus norvegicus
gaaaaagcccctggcgtcgcctgca

SEQ ID NO: 603907 - DNA, 25 bp, Rattus norvegicus
attcctccgtgctccaaagagcttc

SEQ ID NO: 603908 - DNA, 25 bp, Rattus norvegicus
tccttcaggacgcaaacccgcagaa

SEQ ID NO: 603909 - DNA, 25 bp, Rattus norvegicus
tcaggacgcaaacccgcagaaacct

SEQ ID NO: 603910 - DNA, 25 bp, Rattus norvegicus
gtgtcagcgcctggctcacctggct

SEQ ID NO: 603911 - DNA, 25 bp, Rattus norvegicus
acctggctctcgcttgccctggggt

SEQ ID NO: 603912 - DNA, 25 bp, Rattus norvegicus
gcgcccgctccgttccgccacccat

SEQ ID NO: 603913 - DNA, 25 bp, Rattus norvegicus
tcgctcgggacggagcgcgcgtact

SEQ ID NO: 603914 - DNA, 25 bp, Rattus norvegicus
ctttggacccgaccggtgtcagcgc

SEQ ID NO: 603915 - DNA, 25 bp, Rattus norvegicus
gaggtcatgccgagcgaaaaagccc

SEQ ID NO: 603916 - DNA, 25 bp, Rattus norvegicus
ggatgaggtcatgccgagcgaaaaa

SEQ ID NO: 603917 - DNA, 25 bp, Rattus norvegicus
ccgggccgctgtctgcccgctgatc

SEQ ID NO: 603918 - DNA, 25 bp, Rattus norvegicus
cacccggcgcccgtgagatgatagc

SEQ ID NO: 603919 - DNA, 25 bp, Rattus norvegicus
ggagctctgcgccactaggcgcacc

SEQ ID NO: 603920 - DNA, 25 bp, Rattus norvegicus
cccggcgcccgtgagatgatagcag

SEQ ID NO: 603921 - DNA, 25 bp, Rattus norvegicus
accgttggttgcagcagccaccagt

SEQ ID NO: 603922 - DNA, 25 bp, Rattus norvegicus
ggttgcagcagccaccagtaccgct

SEQ ID NO: 603923 - DNA, 25 bp, Rattus norvegicus
tcacctactggcgactcggcgagtg

SEQ ID NO: 603924 - DNA, 25 bp, Rattus norvegicus
ctcggagcgcgcgtccttccgctct

SEQ ID NO: 603925 - DNA, 25 bp, Rattus norvegicus
gcgtcgcagacacctccgcctcctc

SEQ ID NO: 603926 - DNA, 25 bp, Rattus norvegicus
cgctgatcgcgtcccagcggcccaa

SEQ ID NO: 603927 - DNA, 25 bp, Rattus norvegicus
gcagccagagcctgactcacggcag

SEQ ID NO: 603928 - DNA, 25 bp, Rattus norvegicus
agagcctgactcacggcagcgtcgc

SEQ ID NO: 603929 - DNA, 25 bp, Rattus norvegicus
tgactcacggcagcgtcgcagacac

SEQ ID NO: 603930 - DNA, 25 bp, Rattus norvegicus
cgagtgggtcggacccctgagcctc

SEQ ID NO: 603931 - DNA, 25 bp, Rattus norvegicus
ggactccaggtgacgcgccctgcat

SEQ ID NO: 603932 - DNA, 25 bp, Rattus norvegicus
aggcgtgccctactctgggcctacg

SEQ ID NO: 603933 - DNA, 25 bp, Rattus norvegicus
atgacaccgcagtccggcggagtca

SEQ ID NO: 603934 - DNA, 25 bp, Rattus norvegicus
ggcttataggcaggatgacaccgca

SEQ ID NO: 603935 - DNA, 25 bp, Rattus norvegicus
tcgccggcttataggcaggatgaca

SEQ ID NO: 603936 - DNA, 25 bp, Rattus norvegicus
taatgccagaggtcgccggcttata

SEQ ID NO: 603937 - DNA, 25 bp, Rattus norvegicus
gcaaagcttaatgccagaggtcgcc

SEQ ID NO: 603938 - DNA, 25 bp, Rattus norvegicus
gacggcccgaagagagcaaagctta

SEQ ID NO: 603939 - DNA, 25 bp, Rattus norvegicus
ctgcatggtcgcgacggcccgaaga

SEQ ID NO: 603940 - DNA, 25 bp, Rattus norvegicus
gccgagaatgagcagcaagacgccg

SEQ ID NO: 603941 - DNA, 25 bp, Rattus norvegicus
ccaggaggccgagaatgagcagcaa

SEQ ID NO: 603942 - DNA, 25 bp, Rattus norvegicus
ctcacctgataagcgcggaggagga

SEQ ID NO: 603943 - DNA, 25 bp, Rattus norvegicus
ccggtcctcacctgataagcgcgga

SEQ ID NO: 603944 - DNA, 25 bp, Rattus norvegicus
aggtgacgcgccctgcatctccgaa

SEQ ID NO: 603945 - DNA, 25 bp, Rattus norvegicus
ctttgcaagtcagtggcttgtgccc

SEQ ID NO: 603946 - DNA, 25 bp, Rattus norvegicus
gatgaacagccaaccgcatctcatg

SEQ ID NO: 603947 - DNA, 25 bp, Rattus norvegicus
ccctcactcgttgatgaacagccaa

SEQ ID NO: 603948 - DNA, 25 bp, Rattus norvegicus
ccgcatctcatggttgtttgtcttc

SEQ ID NO: 603949 - DNA, 25 bp, Rattus norvegicus
gttgtttgtcttcgcatgcctctga

SEQ ID NO: 603950 - DNA, 25 bp, Rattus norvegicus
tcttcgcatgcctctgatggcacca

SEQ ID NO: 603951 - DNA, 25 bp, Rattus norvegicus
caccactaaccgtccatgtttgtta

SEQ ID NO: 603952 - DNA, 25 bp, Rattus norvegicus
actggtcgtctttctttgcaagtca

SEQ ID NO: 603953 - DNA, 25 bp, Rattus norvegicus
cctcgctcgtttatctcatggccga

SEQ ID NO: 603954 - DNA, 25 bp, Rattus norvegicus
tcgtttatctcatggccgacacgtc

SEQ ID NO: 603955 - DNA, 25 bp, Rattus norvegicus
atctcatggccgacacgtctccgtg

SEQ ID NO: 603956 - DNA, 25 bp, Rattus norvegicus
gccgacacgtctccgtgtttgctta

SEQ ID NO: 603957 - DNA, 25 bp, Rattus norvegicus
gtctccgtgtttgcttaatcgtccg

SEQ ID NO: 603958 - DNA, 25 bp, Rattus norvegicus
cgtccatgtttgttaactggtcgtc

SEQ ID NO: 603959 - DNA, 25 bp, Rattus norvegicus
ctaagacttttagcagctccggaga

SEQ ID NO: 603960 - DNA, 25 bp, Rattus norvegicus
cggggagagccaggaatgttccttc

SEQ ID NO: 603961 - DNA, 25 bp, Rattus norvegicus
ggcacgatctttactggggcggaaa

SEQ ID NO: 603962 - DNA, 25 bp, Rattus norvegicus
cgaggcttatttgtgtggcacgatc

SEQ ID NO: 603963 - DNA, 25 bp, Rattus norvegicus
cggcaaagggcatccgaggcttatt

SEQ ID NO: 603964 - DNA, 25 bp, Rattus norvegicus
cagctccggagacgcgccctgaaaa

SEQ ID NO: 603965 - DNA, 25 bp, Rattus norvegicus
ggaatgttccttcccggctgcgagc

SEQ ID NO: 603966 - DNA, 25 bp, Rattus norvegicus
gcggaggcctctgcgacgcctgtct

SEQ ID NO: 603967 - DNA, 25 bp, Rattus norvegicus
tgcggatcatactgcgtggcgtaga

SEQ ID NO: 603968 - DNA, 25 bp, Rattus norvegicus
atcatactgcgtggcgtagaggccc

SEQ ID NO: 603969 - DNA, 25 bp, Rattus norvegicus
ccaccctgctggagaagccttcgag

SEQ ID NO: 603970 - DNA, 25 bp, Rattus norvegicus
gaaaatggcccgctcggcaaagggc

SEQ ID NO: 603971 - DNA, 25 bp, Rattus norvegicus
agaagccttcgagttcccagtcggg

SEQ ID NO: 603972 - DNA, 25 bp, Rattus norvegicus
tcggccgagggcaacgccacatctg

SEQ ID NO: 603973 - DNA, 25 bp, Rattus norvegicus
tgggcggtgcatgatgatagcatac

SEQ ID NO: 603974 - DNA, 25 bp, Rattus norvegicus
tggaaaatggcgtattgcacggtgc

SEQ ID NO: 603975 - DNA, 25 bp, Rattus norvegicus
tgagccaggctgtagccaccagccg

SEQ ID NO: 603976 - DNA, 25 bp, Rattus norvegicus
aagccgctgagccaggctgtagcca

SEQ ID NO: 603977 - DNA, 25 bp, Rattus norvegicus
aaatggcgtattgcacggtgcaacc

SEQ ID NO: 603978 - DNA, 25 bp, Rattus norvegicus
agacaacgcactcggtgcagcccag

SEQ ID NO: 603979 - DNA, 25 bp, Rattus norvegicus
ggcagccaagacaacgcactcggtg

SEQ ID NO: 603980 - DNA, 25 bp, Rattus norvegicus
gccatggcagccaagacaacgcact

SEQ ID NO: 603981 - DNA, 25 bp, Rattus norvegicus
tagcggtccagagccatggcagcca

SEQ ID NO: 603982 - DNA, 25 bp, Rattus norvegicus
cacgtagcggtccagagccatggca

SEQ ID NO: 603983 - DNA, 25 bp, Rattus norvegicus
acagatggccacgtagcggtccaga

SEQ ID NO: 603984 - DNA, 25 bp, Rattus norvegicus
ggagtggctcacagatggccacgta

SEQ ID NO: 603985 - DNA, 25 bp, Rattus norvegicus
tgatgatagcataccggagtggctc

SEQ ID NO: 603986 - DNA, 25 bp, Rattus norvegicus
ggtgcaacccccgtaactgatggtc

SEQ ID NO: 603987 - DNA, 25 bp, Rattus norvegicus
acagccagcggctacggccgatttg

SEQ ID NO: 603988 - DNA, 25 bp, Rattus norvegicus
ctgtcaatcacagccagcggctacg

SEQ ID NO: 603989 - DNA, 25 bp, Rattus norvegicus
gctacggccgatttggccgacagcc

SEQ ID NO: 603990 - DNA, 25 bp, Rattus norvegicus
gccaccgcggcgtagtgtcctggct

SEQ ID NO: 603991 - DNA, 25 bp, Rattus norvegicus
ccttcctgaccaggaggtgcggctg

SEQ ID NO: 603992 - DNA, 25 bp, Rattus norvegicus
gccaagcgggctgcctagcccaggt

SEQ ID NO: 603993 - DNA, 25 bp, Rattus norvegicus
tgtgttgtgagtaaagtcgtggccc

SEQ ID NO: 603994 - DNA, 25 bp, Rattus norvegicus
tggggcaaaccggtacagagtgcac

SEQ ID NO: 603995 - DNA, 25 bp, Rattus norvegicus
gtacagagtgcacgcgggctttttg

SEQ ID NO: 603996 - DNA, 25 bp, Rattus norvegicus
cgcggaatgtgttgtgagtaaagtc

SEQ ID NO: 603997 - DNA, 25 bp, Rattus norvegicus
ctgtgcaatgagtgtaaggctgaga

SEQ ID NO: 603998 - DNA, 25 bp, Rattus norvegicus
ctgtgcggggccagcgtcgctcctt

SEQ ID NO: 603999 - DNA, 25 bp, Rattus norvegicus
agcgtcgctccttcctgaccaggag

SEQ ID NO: 604000 - DNA, 25 bp, Rattus norvegicus
gcgtagtgtcctggctgtcaatcac

SEQ ID NO: 604001 - DNA, 25 bp, Rattus norvegicus
tgagagcccttacctggaagccggc

SEQ ID NO: 604002 - DNA, 25 bp, Rattus norvegicus
tatgcaaaccgaacagcgggcgaag

SEQ ID NO: 604003 - DNA, 25 bp, Rattus norvegicus
agagcccttacctggaagccggcga

SEQ ID NO: 604004 - DNA, 25 bp, Rattus norvegicus
agcccttacctggaagccggcgacg

SEQ ID NO: 604005 - DNA, 25 bp, Rattus norvegicus
ccatctccctgctgcgggtatgcaa

SEQ ID NO: 604006 - DNA, 25 bp, Rattus norvegicus
cctgagagcccttacctggaagccg

SEQ ID NO: 604007 - DNA, 25 bp, Rattus norvegicus
ctgctgcgggtatgcaaaccgaaca

SEQ ID NO: 604008 - DNA, 25 bp, Rattus norvegicus
ctgcgggtatgcaaaccgaacagcg

SEQ ID NO: 604009 - DNA, 25 bp, Rattus norvegicus
tccctgctgcgggtatgcaaaccga

SEQ ID NO: 604010 - DNA, 25 bp, Rattus norvegicus
ggtatgcaaaccgaacagcgggcga

SEQ ID NO: 604011 - DNA, 25 bp, Rattus norvegicus
ggcgaaggcccttctgccgggcact

SEQ ID NO: 604012 - DNA, 25 bp, Rattus norvegicus
cttctgccgggcactcctctgccag

SEQ ID NO: 604013 - DNA, 25 bp, Rattus norvegicus
cgggcactcctctgccagcgccgct

SEQ ID NO: 604014 - DNA, 25 bp, Rattus norvegicus
cgggtatgcaaaccgaacagcgggc

SEQ ID NO: 604015 - DNA, 25 bp, Rattus norvegicus
cccaggggccaacaggataatttgg

SEQ ID NO: 604016 - DNA, 25 bp, Rattus norvegicus
ctccgcatctctaggcctctaaagg

SEQ ID NO: 604017 - DNA, 25 bp, Rattus norvegicus
atttgcttagttgcaggttcggccc

SEQ ID NO: 604018 - DNA, 25 bp, Rattus norvegicus
cagttccctgtccttagcactttga

SEQ ID NO: 604019 - DNA, 25 bp, Rattus norvegicus
cccagaaggtccagataacagttcc

SEQ ID NO: 604020 - DNA, 25 bp, Rattus norvegicus
gggccagagctcactaaattgcttc

SEQ ID NO: 604021 - DNA, 25 bp, Rattus norvegicus
ggcgggaatcgtagctcaaaccaga

SEQ ID NO: 604022 - DNA, 25 bp, Rattus norvegicus
ccatgacagatctgggccctgcgta

SEQ ID NO: 604023 - DNA, 25 bp, Rattus norvegicus
gggctgcaaggcacctcgaatagca

SEQ ID NO: 604024 - DNA, 25 bp, Rattus norvegicus
ggcgcatcccagcaggcagagttaa

SEQ ID NO: 604025 - DNA, 25 bp, Rattus norvegicus
ggacctgtgcccagttagaggatta

SEQ ID NO: 604026 - DNA, 25 bp, Rattus norvegicus
ccacatgtcatgtttccggggtgcc

SEQ ID NO: 604027 - DNA, 25 bp, Rattus norvegicus
tgcgcccttccgcagaaaaagaagc

SEQ ID NO: 604028 - DNA, 25 bp, Rattus norvegicus
cctctaaagggctactactggcgga

SEQ ID NO: 604029 - DNA, 25 bp, Rattus norvegicus
tgtacgctccctaacgactaacaac

SEQ ID NO: 604030 - DNA, 25 bp, Rattus norvegicus
ccaggatccgcggtgccaaggaact

SEQ ID NO: 604031 - DNA, 25 bp, Rattus norvegicus
cgcggtgccaaggaactctcacgga

SEQ ID NO: 604032 - DNA, 25 bp, Rattus norvegicus
aactctcacggagcaggggcgccct

SEQ ID NO: 604033 - DNA, 25 bp, Rattus norvegicus
cacaggcgacgcagactgggagcac

SEQ ID NO: 604034 - DNA, 25 bp, Rattus norvegicus
acgcagactgggagcaccgactcca

SEQ ID NO: 604035 - DNA, 25 bp, Rattus norvegicus
gggagcaccgactccacggagcacg

SEQ ID NO: 604036 - DNA, 25 bp, Rattus norvegicus
acgcgcctgagccagctgtattttc

SEQ ID NO: 604037 - DNA, 25 bp, Rattus norvegicus
cccttctggacaaccagagggtttg

SEQ ID NO: 604038 - DNA, 25 bp, Rattus norvegicus
ggccttgtacgctccctaacgacta

SEQ ID NO: 604039 - DNA, 25 bp, Rattus norvegicus
cggcacacgcctatccggccttgta

SEQ ID NO: 604040 - DNA, 25 bp, Rattus norvegicus
ctcaggcgccgcgagcctaggcgaa

SEQ ID NO: 604041 - DNA, 25 bp, Rattus norvegicus
gcagactcgtccctggctcagtttg

SEQ ID NO: 604042 - DNA, 25 bp, Rattus norvegicus
gagccagctgtattttccggttttg

SEQ ID NO: 604043 - DNA, 25 bp, Rattus norvegicus
cactgctgcaggattccctagggca

SEQ ID NO: 604044 - DNA, 25 bp, Rattus norvegicus
gcgtacacattctgcaaagctgaca

SEQ ID NO: 604045 - DNA, 25 bp, Rattus norvegicus
agtatagataactctccgccgcccg

SEQ ID NO: 604046 - DNA, 25 bp, Rattus norvegicus
caggtctccctttacgcggctcaag

SEQ ID NO: 604047 - DNA, 25 bp, Rattus norvegicus
tcggtgcgccacaggaaaagtgctc

SEQ ID NO: 604048 - DNA, 25 bp, Rattus norvegicus
tcaagcttgcattcagcgccggggc

SEQ ID NO: 604049 - DNA, 25 bp, Rattus norvegicus
agtgcaggctccagcgactccagac

SEQ ID NO: 604050 - DNA, 25 bp, Rattus norvegicus
ttaccagctttacgcggttgcgctc

SEQ ID NO: 604051 - DNA, 25 bp, Rattus norvegicus
cagcgcctggaagcccaagtttacc

SEQ ID NO: 604052 - DNA, 25 bp, Rattus norvegicus
tactcagcttcttgttggcgccgcc

SEQ ID NO: 604053 - DNA, 25 bp, Rattus norvegicus
ctgcagcgcacggatgtactctacc

SEQ ID NO: 604054 - DNA, 25 bp, Rattus norvegicus
gccgagtagcgggtgttaatagacc

SEQ ID NO: 604055 - DNA, 25 bp, Rattus norvegicus
gggtaagtctctccctcgcagctgc

SEQ ID NO: 604056 - DNA, 25 bp, Rattus norvegicus
tacgcggctcaagcggctccttttt

SEQ ID NO: 604057 - DNA, 25 bp, Rattus norvegicus
ttcgtcttctgggtgagcagccact

SEQ ID NO: 604058 - DNA, 25 bp, Rattus norvegicus
tacgtctcaatagccgcaccgcagt

SEQ ID NO: 604059 - DNA, 25 bp, Rattus norvegicus
ccggacctagcggtctataaagagt

SEQ ID NO: 604060 - DNA, 25 bp, Rattus norvegicus
ctataaagagtgaagagctcggcgc

SEQ ID NO: 604061 - DNA, 25 bp, Rattus norvegicus
agcgcgcccttgcttcaaagcggta

SEQ ID NO: 604062 - DNA, 25 bp, Rattus norvegicus
cttcaaagcggtagcgactctagcg

SEQ ID NO: 604063 - DNA, 25 bp, Rattus norvegicus
gtagcgactctagcgcctccggcta

SEQ ID NO: 604064 - DNA, 25 bp, Rattus norvegicus
aagcgacccaggctatcttccagtc

SEQ ID NO: 604065 - DNA, 25 bp, Rattus norvegicus
tacctgctcttcgtcttcaatttcg

SEQ ID NO: 604066 - DNA, 25 bp, Rattus norvegicus
ctaggcccagctgagaaggcgcagc

SEQ ID NO: 604067 - DNA, 25 bp, Rattus norvegicus
aggcgcagcgcaaccgcgaagttgc

SEQ ID NO: 604068 - DNA, 25 bp, Rattus norvegicus
aagttgcggcgccacctgtgggctc

SEQ ID NO: 604069 - DNA, 25 bp, Rattus norvegicus
gccgagagctgagcttccgggcctc

SEQ ID NO: 604070 - DNA, 25 bp, Rattus norvegicus
gtggaaggctgcaccaaatgcatca

SEQ ID NO: 604071 - DNA, 25 bp, Rattus norvegicus
gtattgtgggaatcacggctccgcc

SEQ ID NO: 604072 - DNA, 25 bp, Rattus norvegicus
tgccttcagtgtgtgcccagagagg

SEQ ID NO: 604073 - DNA, 25 bp, Rattus norvegicus
aactggttgtagctcgcagtgcgta

SEQ ID NO: 604074 - DNA, 25 bp, Rattus norvegicus
gtgacgcacttcctcgtgtcggacc

SEQ ID NO: 604075 - DNA, 25 bp, Rattus norvegicus
ttccgacggacgacgctagaagcct

SEQ ID NO: 604076 - DNA, 25 bp, Rattus norvegicus
tagaagcctcaaccctttgcgattg

SEQ ID NO: 604077 - DNA, 25 bp, Rattus norvegicus
gcgattggcagttaaccctagagta

SEQ ID NO: 604078 - DNA, 25 bp, Rattus norvegicus
tcttcgggatggcacacatgttaca

SEQ ID NO: 604079 - DNA, 25 bp, Rattus norvegicus
ctcgggcgctgaagccacaatattc

SEQ ID NO: 604080 - DNA, 25 bp, Rattus norvegicus
aatattctgatagcccgagactcgg

SEQ ID NO: 604081 - DNA, 25 bp, Rattus norvegicus
aggccagtaccgtgcctgtttctgc

SEQ ID NO: 604082 - DNA, 25 bp, Rattus norvegicus
gctgcgctttgctaagagctcgtga

SEQ ID NO: 604083 - DNA, 25 bp, Rattus norvegicus
ctttcgtcatttctgggtggatttc

SEQ ID NO: 604084 - DNA, 25 bp, Rattus norvegicus
cgagactcggtttcccaggaatcca

SEQ ID NO: 604085 - DNA, 25 bp, Rattus norvegicus
cgggtgagccttgacccgcgcgtct

SEQ ID NO: 604086 - DNA, 25 bp, Rattus norvegicus
cgcaccgaccggaatgcggagatca

SEQ ID NO: 604087 - DNA, 25 bp, Rattus norvegicus
tgcggagatcagactggcatgcctt

SEQ ID NO: 604088 - DNA, 25 bp, Rattus norvegicus
catgccttggcgtagcaggtagccc

SEQ ID NO: 604089 - DNA, 25 bp, Rattus norvegicus
tgcgctgccttcatctctgctctga

SEQ ID NO: 604090 - DNA, 25 bp, Rattus norvegicus
cggggtcctgtctggccatggacac

SEQ ID NO: 604091 - DNA, 25 bp, Rattus norvegicus
cccgcccaatgctgagaggaagcgc

SEQ ID NO: 604092 - DNA, 25 bp, Rattus norvegicus
agcgcgggactagcaaagaagtgtc

SEQ ID NO: 604093 - DNA, 25 bp, Rattus norvegicus
ggaggcacggtctacgcgcccatcg

SEQ ID NO: 604094 - DNA, 25 bp, Rattus norvegicus
gcgtctccatctacagtacgcgtcg

SEQ ID NO: 604095 - DNA, 25 bp, Rattus norvegicus
agggccgcgtctacaacttcctcga

SEQ ID NO: 604096 - DNA, 25 bp, Rattus norvegicus
gtgtttcgtgtaccacttcaccgtg

SEQ ID NO: 604097 - DNA, 25 bp, Rattus norvegicus
accacttcaccgtgtgagtaacctc

SEQ ID NO: 604098 - DNA, 25 bp, Rattus norvegicus
tcccttttcactggagctggccgaa

SEQ ID NO: 604099 - DNA, 25 bp, Rattus norvegicus
ggtccggcgagctttaatgcgcaga

SEQ ID NO: 604100 - DNA, 25 bp, Rattus norvegicus
gctttaatgcgcagacaaagcctca

SEQ ID NO: 604101 - DNA, 25 bp, Rattus norvegicus
tcctcgcgccagatggccgcggaaa

SEQ ID NO: 604102 - DNA, 25 bp, Rattus norvegicus
cagatggccgcggaaatgctaattt

SEQ ID NO: 604103 - DNA, 25 bp, Rattus norvegicus
gcggaaatgctaatttcgggcgccc

SEQ ID NO: 604104 - DNA, 25 bp, Rattus norvegicus
ccgcgtttaattgcgactccgcaga

SEQ ID NO: 604105 - DNA, 25 bp, Rattus norvegicus
ttaattgcgactccgcagatgggcc

SEQ ID NO: 604106 - DNA, 25 bp, Rattus norvegicus
ttgcgactccgcagatgggccgcga

SEQ ID NO: 604107 - DNA, 25 bp, Rattus norvegicus
ccatgtagatgagcgcggccaggcc

SEQ ID NO: 604108 - DNA, 25 bp, Rattus norvegicus
atgcgcagacaaagcctcatttgca

SEQ ID NO: 604109 - DNA, 25 bp, Rattus norvegicus
actgaggggccggactggcctatgc

SEQ ID NO: 604110 - DNA, 25 bp, Rattus norvegicus
cggcgagctttaatgcgcagacaaa

SEQ ID NO: 604111 - DNA, 25 bp, Rattus norvegicus
gcaggtcaatgccgcggcacactcg

SEQ ID NO: 604112 - DNA, 25 bp, Rattus norvegicus
ccggccatgtagatgagcgcggcca

SEQ ID NO: 604113 - DNA, 25 bp, Rattus norvegicus
ttgtgaagcccgtgagacaatgagc

SEQ ID NO: 604114 - DNA, 25 bp, Rattus norvegicus
ggaggcacctgctcgcctgaaaggc

SEQ ID NO: 604115 - DNA, 25 bp, Rattus norvegicus
gccgggactcagaatgaactccgcg

SEQ ID NO: 604116 - DNA, 25 bp, Rattus norvegicus
tgaactccgcgtggctttgaatccg

SEQ ID NO: 604117 - DNA, 25 bp, Rattus norvegicus
aatccgggctcacatatggttggta

SEQ ID NO: 604118 - DNA, 25 bp, Rattus norvegicus
tatggttggtaattagctggctatc

SEQ ID NO: 604119 - DNA, 25 bp, Rattus norvegicus
gctggctatctcttggcgttaaatg

SEQ ID NO: 604120 - DNA, 25 bp, Rattus norvegicus
tcgcccggttcgcatccataataga

SEQ ID NO: 604121 - DNA, 25 bp, Rattus norvegicus
ccataatagacacgaacagagttgc

SEQ ID NO: 604122 - DNA, 25 bp, Rattus norvegicus
cagagttgcgattgttcgctgttgc

SEQ ID NO: 604123 - DNA, 25 bp, Rattus norvegicus
tgcgtcgacgcggatttgacatatg

SEQ ID NO: 604124 - DNA, 25 bp, Rattus norvegicus
ttgacatatggttgcgcggagccca

SEQ ID NO: 604125 - DNA, 25 bp, Rattus norvegicus
tggatgaacggaatcgggactcctg

SEQ ID NO: 604126 - DNA, 25 bp, Rattus norvegicus
tgaaaggcccataaatcgccgccgg

SEQ ID NO: 604127 - DNA, 25 bp, Rattus norvegicus
tcaacgacgaggacctgacgcaggt

SEQ ID NO: 604128 - DNA, 25 bp, Rattus norvegicus
gtttctttgttagcaggagcgtgca

SEQ ID NO: 604129 - DNA, 25 bp, Rattus norvegicus
ggacaagttaccttgcgcccgctgc

SEQ ID NO: 604130 - DNA, 25 bp, Rattus norvegicus
ttcccagcctggacaagttaccttg

SEQ ID NO: 604131 - DNA, 25 bp, Rattus norvegicus
gcgccagtccaccaaacctgaaagt

SEQ ID NO: 604132 - DNA, 25 bp, Rattus norvegicus
gatctaccgcgtccttccgggagca

SEQ ID NO: 604133 - DNA, 25 bp, Rattus norvegicus
gctacgagagagacaagggcccgca

SEQ ID NO: 604134 - DNA, 25 bp, Rattus norvegicus
aggccgcaacgaagaggctacgaga

SEQ ID NO: 604135 - DNA, 25 bp, Rattus norvegicus
ccatccattggtcaacgggtttctt

SEQ ID NO: 604136 - DNA, 25 bp, Rattus norvegicus
gcgagtcgcatctgctcaacgacga

SEQ ID NO: 604137 - DNA, 25 bp, Rattus norvegicus
gcaagtgtcagaactgcttcaagcc

SEQ ID NO: 604138 - DNA, 25 bp, Rattus norvegicus
ttcaggccaacatcttcaacaagag

SEQ ID NO: 604139 - DNA, 25 bp, Rattus norvegicus
caaggagaacccgtgcagaaaattt

SEQ ID NO: 604140 - DNA, 25 bp, Rattus norvegicus
tagccgacatgtcggcggccaagga

SEQ ID NO: 604141 - DNA, 25 bp, Rattus norvegicus
tgcgcagcagccctcggagagaagc

SEQ ID NO: 604142 - DNA, 25 bp, Rattus norvegicus
cgtgaaaacaaacacaggggccgcg

SEQ ID NO: 604143 - DNA, 25 bp, Rattus norvegicus
gtcagactcgttttccaccttcgta

SEQ ID NO: 604144 - DNA, 25 bp, Rattus norvegicus
accttcgtagcgctccctttagacg

SEQ ID NO: 604145 - DNA, 25 bp, Rattus norvegicus
ggataatagttgctccggctcgctc

SEQ ID NO: 604146 - DNA, 25 bp, Rattus norvegicus
gcgctccctttagacgtgaaaacaa

SEQ ID NO: 604147 - DNA, 25 bp, Rattus norvegicus
ataatagttgctccggctcgctcgg

SEQ ID NO: 604148 - DNA, 25 bp, Rattus norvegicus
accggaggcacgaggggactgaaca

SEQ ID NO: 604149 - DNA, 25 bp, Rattus norvegicus
gccgagtccagtccgcgttttgcaa

SEQ ID NO: 604150 - DNA, 25 bp, Rattus norvegicus
agtccagtccgcgttttgcaagtgc

SEQ ID NO: 604151 - DNA, 25 bp, Rattus norvegicus
gtccgcgttttgcaagtgcgcagca

SEQ ID NO: 604152 - DNA, 25 bp, Rattus norvegicus
cgttttgcaagtgcgcagcagccct

SEQ ID NO: 604153 - DNA, 25 bp, Rattus norvegicus
ccctcggagagaagcggataatagt

SEQ ID NO: 604154 - DNA, 25 bp, Rattus norvegicus
gtagcgctccctttagacgtgaaaa

SEQ ID NO: 604155 - DNA, 25 bp, Rattus norvegicus
cccatggtcgaaggctgtgcaaacg

SEQ ID NO: 604156 - DNA, 25 bp, Rattus norvegicus
cacctgcaccgtctcgcggtagaag

SEQ ID NO: 604157 - DNA, 25 bp, Rattus norvegicus
caccgttcgcattggccgcagcagt

SEQ ID NO: 604158 - DNA, 25 bp, Rattus norvegicus
aggctggtccttcagctcctgattc

SEQ ID NO: 604159 - DNA, 25 bp, Rattus norvegicus
agtcgccacgtctgggatctggtct

SEQ ID NO: 604160 - DNA, 25 bp, Rattus norvegicus
cccagaacgcgggatgacagccaca

SEQ ID NO: 604161 - DNA, 25 bp, Rattus norvegicus
atgacagccacagccaccggaggtg

SEQ ID NO: 604162 - DNA, 25 bp, Rattus norvegicus
agttgaagtcccagcggttctggtc

SEQ ID NO: 604163 - DNA, 25 bp, Rattus norvegicus
tgcgcgctatcactgggaaggtgtc

SEQ ID NO: 604164 - DNA, 25 bp, Rattus norvegicus
tggaggccaagcgttccatcgctgt

SEQ ID NO: 604165 - DNA, 25 bp, Rattus norvegicus
gacagcttcttgatcgcaccgttcg

SEQ ID NO: 604166 - DNA, 25 bp, Rattus norvegicus
gtacacgtcggacatgcccatggtc

SEQ ID NO: 604167 - DNA, 25 bp, Rattus norvegicus
ccatcgctgttctgctgcggaggta

SEQ ID NO: 604168 - DNA, 25 bp, Rattus norvegicus
agaggcacatcctgctggaagttga

SEQ ID NO: 604169 - DNA, 25 bp, Rattus norvegicus
ttcttggggccgctgccagacacgt

SEQ ID NO: 604170 - DNA, 25 bp, Rattus norvegicus
tgcggttacagaagaaccccgccgc

SEQ ID NO: 604171 - DNA, 25 bp, Rattus norvegicus
cagcagtaagcagctccctgcgcga

SEQ ID NO: 604172 - DNA, 25 bp, Rattus norvegicus
ggcgaacgccctcccgcaccagttc

SEQ ID NO: 604173 - DNA, 25 bp, Rattus norvegicus
ccctgcagagggagactacgaacaa

SEQ ID NO: 604174 - DNA, 25 bp, Rattus norvegicus
ctgccagacacgtcctccgcaggtg

SEQ ID NO: 604175 - DNA, 25 bp, Rattus norvegicus
aggtgccggcctctctccggtgacg

SEQ ID NO: 604176 - DNA, 25 bp, Rattus norvegicus
acatgcggcccaggctccgattaca

SEQ ID NO: 604177 - DNA, 25 bp, Rattus norvegicus
gctccgattacagggcctgccttgt

SEQ ID NO: 604178 - DNA, 25 bp, Rattus norvegicus
acagggcctgccttgtactcggggt

SEQ ID NO: 604179 - DNA, 25 bp, Rattus norvegicus
ggggtcctcattctccaggaatggg

SEQ ID NO: 604180 - DNA, 25 bp, Rattus norvegicus
cctcattctccaggaatgggtggga

SEQ ID NO: 604181 - DNA, 25 bp, Rattus norvegicus
tacgaacaaggaactgccgcaggca

SEQ ID NO: 604182 - DNA, 25 bp, Rattus norvegicus
gggagactacgaacaaggaactgcc

SEQ ID NO: 604183 - DNA, 25 bp, Rattus norvegicus
agcagctctcgactgtgcagcggaa

SEQ ID NO: 604184 - DNA, 25 bp, Rattus norvegicus
tttaagtctccaggtggggccagca

SEQ ID NO: 604185 - DNA, 25 bp, Rattus norvegicus
tggtactcaccacggacccagagct

SEQ ID NO: 604186 - DNA, 25 bp, Rattus norvegicus
ctgatacctgaagcggcgaaactcc

SEQ ID NO: 604187 - DNA, 25 bp, Rattus norvegicus
cggttctggtagtcgatcagcgcca

SEQ ID NO: 604188 - DNA, 25 bp, Rattus norvegicus
gcggaagtcgatctccttgtaaaag

SEQ ID NO: 604189 - DNA, 25 bp, Rattus norvegicus
gtgtgctccacgcagtccaccttga

SEQ ID NO: 604190 - DNA, 25 bp, Rattus norvegicus
ccaccttgaggatggaatggaagta

SEQ ID NO: 604191 - DNA, 25 bp, Rattus norvegicus
aagtacagctccttgggccgatcgc

SEQ ID NO: 604192 - DNA, 25 bp, Rattus norvegicus
ggccctgcctacagaggaatgcacc

SEQ ID NO: 604193 - DNA, 25 bp, Rattus norvegicus
acaggctgtcgcttcgcttctccag

SEQ ID NO: 604194 - DNA, 25 bp, Rattus norvegicus
cgccctcgcaaagaatctcatcgga

SEQ ID NO: 604195 - DNA, 25 bp, Rattus norvegicus
gcttgcaccaaatgcgctcgctctg

SEQ ID NO: 604196 - DNA, 25 bp, Rattus norvegicus
cagcgcttcttcttccagacctgga

SEQ ID NO: 604197 - DNA, 25 bp, Rattus norvegicus
tcccaggcgcggtctaagacaaggc

SEQ ID NO: 604198 - DNA, 25 bp, Rattus norvegicus
gcacgcgcggttccgtgcctattta

SEQ ID NO: 604199 - DNA, 25 bp, Rattus norvegicus
tagtgacgtgtacttcggcgcacgc

SEQ ID NO: 604200 - DNA, 25 bp, Rattus norvegicus
agcccgcgagctatatgtaaataga

SEQ ID NO: 604201 - DNA, 25 bp, Rattus norvegicus
gtgcggcatccaatcaaaatctgtt

SEQ ID NO: 604202 - DNA, 25 bp, Rattus norvegicus
accaggcactaggaggtgcggcatc

SEQ ID NO: 604203 - DNA, 25 bp, Rattus norvegicus
gagatgtttatcaactgcaccaggc

SEQ ID NO: 604204 - DNA, 25 bp, Rattus norvegicus
caagacgggcgatgaatggacaata

SEQ ID NO: 604205 - DNA, 25 bp, Rattus norvegicus
tccgccctctgggagcaagacgggc

SEQ ID NO: 604206 - DNA, 25 bp, Rattus norvegicus
tgccattggccgtactgccaggctc

SEQ ID NO: 604207 - DNA, 25 bp, Rattus norvegicus
ggcgggaacaaagcgcgctgacctt

SEQ ID NO: 604208 - DNA, 25 bp, Rattus norvegicus
tgttcctctcaaggaaccgcctgcg

SEQ ID NO: 604209 - DNA, 25 bp, Rattus norvegicus
ccgtgcctatttaaaggggctgttg

SEQ ID NO: 604210 - DNA, 25 bp, Rattus norvegicus
ggtctaagacaaggcgcacccaggc

SEQ ID NO: 604211 - DNA, 25 bp, Rattus norvegicus
actccagttcaggttggcgcggaac

SEQ ID NO: 604212 - DNA, 25 bp, Rattus norvegicus
ggaagtcctgcccaagcagtcctct

SEQ ID NO: 604213 - DNA, 25 bp, Rattus norvegicus
aatctgatgcaaccgcggcgccgga

SEQ ID NO: 604214 - DNA, 25 bp, Rattus norvegicus
ttccagaatctgatgcaaccgcggc

SEQ ID NO: 604215 - DNA, 25 bp, Rattus norvegicus
tgccgccacagacgctttccagaat

SEQ ID NO: 604216 - DNA, 25 bp, Rattus norvegicus
tgggaatcaagacccgcgtctgccg

SEQ ID NO: 604217 - DNA, 25 bp, Rattus norvegicus
tgccatcactgggaatcaagacccg

SEQ ID NO: 604218 - DNA, 25 bp, Rattus norvegicus
gaggaacctgccatcactgggaatc

SEQ ID NO: 604219 - DNA, 25 bp, Rattus norvegicus
taggcaactgcgaactgacgccggc

SEQ ID NO: 604220 - DNA, 25 bp, Rattus norvegicus
gaacgatgggagaatactccagttc

SEQ ID NO: 604221 - DNA, 25 bp, Rattus norvegicus
aggttggcgcggaacttaaatgaga

SEQ ID NO: 604222 - DNA, 25 bp, Rattus norvegicus
cggcacgtccagtagctaggcaact

SEQ ID NO: 604223 - DNA, 25 bp, Rattus norvegicus
ctcttccggcacgtccagtagctag

SEQ ID NO: 604224 - DNA, 25 bp, Rattus norvegicus
aatgagaagcgtattcccggggtgc

SEQ ID NO: 604225 - DNA, 25 bp, Rattus norvegicus
gagaagaccaagaagcccaatgcgc

SEQ ID NO: 604226 - DNA, 25 bp, Rattus norvegicus
cggcgactccgtttcagagagaaga

SEQ ID NO: 604227 - DNA, 25 bp, Rattus norvegicus
ttgactaatatcctgagccggccca

SEQ ID NO: 604228 - DNA, 25 bp, Rattus norvegicus
acagcgcggtggctttcctctgcaa

SEQ ID NO: 604229 - DNA, 25 bp, Rattus norvegicus
tcctctgcaactcggggatccggtc

SEQ ID NO: 604230 - DNA, 25 bp, Rattus norvegicus
ggaccgtatctactcacttgcaaaa

SEQ ID NO: 604231 - DNA, 25 bp, Rattus norvegicus
cagtagcaaaaaggaccggcgactc

SEQ ID NO: 604232 - DNA, 25 bp, Rattus norvegicus
agcaaccacagcactagtccggctg

SEQ ID NO: 604233 - DNA, 25 bp, Rattus norvegicus
gcccaatgcgcagaagccaatcatt

SEQ ID NO: 604234 - DNA, 25 bp, Rattus norvegicus
cagccgcgggaccttttatagaacg

SEQ ID NO: 604235 - DNA, 25 bp, Rattus norvegicus
ttatagaacgctggtgtggccacgc

SEQ ID NO: 604236 - DNA, 25 bp, Rattus norvegicus
cccttgccatgtccggttgactaat

SEQ ID NO: 604237 - DNA, 25 bp, Rattus norvegicus
cctcccatcgctatcggtgcttata

SEQ ID NO: 604238 - DNA, 25 bp, Rattus norvegicus
ttgcaaaaaccgattcagcagcagc

SEQ ID NO: 604239 - DNA, 25 bp, Rattus norvegicus
gctggggacccagtccctgcccaga

SEQ ID NO: 604240 - DNA, 25 bp, Rattus norvegicus
tgctggttgcactcaatgctgggcc

SEQ ID NO: 604241 - DNA, 25 bp, Rattus norvegicus
accgtgctggttgcactcaatgctg

SEQ ID NO: 604242 - DNA, 25 bp, Rattus norvegicus
cagcggagctcctaccgtgctggtt

SEQ ID NO: 604243 - DNA, 25 bp, Rattus norvegicus
ggagctcctaccgtgctggttgcac

SEQ ID NO: 604244 - DNA, 25 bp, Rattus norvegicus
gctcctaccgtgctggttgcactca

SEQ ID NO: 604245 - DNA, 25 bp, Rattus norvegicus
tcagctgtcgctgagcagcaggaaa

SEQ ID NO: 604246 - DNA, 25 bp, Rattus norvegicus
ctgtcgctgagcagcaggaaatacc

SEQ ID NO: 604247 - DNA, 25 bp, Rattus norvegicus
tcgctgagcagcaggaaataccaga

SEQ ID NO: 604248 - DNA, 25 bp, Rattus norvegicus
ggaaataccagagggctgatccagg

SEQ ID NO: 604249 - DNA, 25 bp, Rattus norvegicus
gagagcgcggcggacgcaaaacccc

SEQ ID NO: 604250 - DNA, 25 bp, Rattus norvegicus
ggaccaagggcggattggctgctgg

SEQ ID NO: 604251 - DNA, 25 bp, Rattus norvegicus
ggttgcactcaatgctgggccgagc

SEQ ID NO: 604252 - DNA, 25 bp, Rattus norvegicus
cctaccgtgctggttgcactcaatg

SEQ ID NO: 604253 - DNA, 25 bp, Rattus norvegicus
tctcactttcacactgcgcgccctt

SEQ ID NO: 604254 - DNA, 25 bp, Rattus norvegicus
gacctcacagaggatactagcccgg

SEQ ID NO: 604255 - DNA, 25 bp, Rattus norvegicus
acagaggatactagcccggctgacc

SEQ ID NO: 604256 - DNA, 25 bp, Rattus norvegicus
ggctgacctgtccacgcctgcgtag

SEQ ID NO: 604257 - DNA, 25 bp, Rattus norvegicus
tccacgcctgcgtagcgtagttttc

SEQ ID NO: 604258 - DNA, 25 bp, Rattus norvegicus
cctgcgtagcgtagttttctaaatg

SEQ ID NO: 604259 - DNA, 25 bp, Rattus norvegicus
gcgtagttttctaaatgcctgtccc

SEQ ID NO: 604260 - DNA, 25 bp, Rattus norvegicus
cctcaagctcgcgataggcccgccc

SEQ ID NO: 604261 - DNA, 25 bp, Rattus norvegicus
ggcgttggaacggagacctcacaga

SEQ ID NO: 604262 - DNA, 25 bp, Rattus norvegicus
gtcgtcacagcccagcttctgcaca

SEQ ID NO: 604263 - DNA, 25 bp, Rattus norvegicus
ggaagcaccgtcctttcgccctcca

SEQ ID NO: 604264 - DNA, 25 bp, Rattus norvegicus
ccctcccacgcctgagcaaagcacc

SEQ ID NO: 604265 - DNA, 25 bp, Rattus norvegicus
gcaaagcacccgttaaagcagggtc

SEQ ID NO: 604266 - DNA, 25 bp, Rattus norvegicus
tgcacacccttcagaactgcgccgg

SEQ ID NO: 604267 - DNA, 25 bp, Rattus norvegicus
gagccatgatctcgctgtcccttga

SEQ ID NO: 604268 - DNA, 25 bp, Rattus norvegicus
acaagaaccttggatgcgacctgga

SEQ ID NO: 604269 - DNA, 25 bp, Rattus norvegicus
ttgggccagcaaaaccctgaagagg

SEQ ID NO: 604270 - DNA, 25 bp, Rattus norvegicus
tctatttcatgcttgggatctcctg

SEQ ID NO: 604271 - DNA, 25 bp, Rattus norvegicus
agcgttctgactccttctccgggtc

SEQ ID NO: 604272 - DNA, 25 bp, Rattus norvegicus
ctcccggcaaggtccagttacaaga

SEQ ID NO: 604273 - DNA, 25 bp, Rattus norvegicus
cctgtacccatagtggctgaggatg

SEQ ID NO: 604274 - DNA, 25 bp, Rattus norvegicus
ttccagaagccacggcgaccgagtc

SEQ ID NO: 604275 - DNA, 25 bp, Rattus norvegicus
aagcgtgtgcctctggattccagaa

SEQ ID NO: 604276 - DNA, 25 bp, Rattus norvegicus
ggttctggatatcaggtcctccctg

SEQ ID NO: 604277 - DNA, 25 bp, Rattus norvegicus
ccagttgcttgctttgcgcacgatc

SEQ ID NO: 604278 - DNA, 25 bp, Rattus norvegicus
agcaggtggatcagcctctatttca

SEQ ID NO: 604279 - DNA, 25 bp, Rattus norvegicus
tcgggcacctaacctggcttcttga

SEQ ID NO: 604280 - DNA, 25 bp, Rattus norvegicus
ccctgagcctgtgaactgatgcttc

SEQ ID NO: 604281 - DNA, 25 bp, Rattus norvegicus
cccgcgctggtgcagtagttgcact

SEQ ID NO: 604282 - DNA, 25 bp, Rattus norvegicus
tcagccgtagcaccaagcgcttgcg

SEQ ID NO: 604283 - DNA, 25 bp, Rattus norvegicus
agccaacgcatcaaccacggcagtg

SEQ ID NO: 604284 - DNA, 25 bp, Rattus norvegicus
cacctgtgaggggaagaagagcacc

SEQ ID NO: 604285 - DNA, 25 bp, Rattus norvegicus
aagcctcggtgcaggtcacctgtga

SEQ ID NO: 604286 - DNA, 25 bp, Rattus norvegicus
gggcctgcagtaaagcctcggtgca

SEQ ID NO: 604287 - DNA, 25 bp, Rattus norvegicus
aactctcgctgtgtgggagactgca

SEQ ID NO: 604288 - DNA, 25 bp, Rattus norvegicus
gcaggcggctcagcgaactctcgct

SEQ ID NO: 604289 - DNA, 25 bp, Rattus norvegicus
cgaagaggcagagctccaagctgga

SEQ ID NO: 604290 - DNA, 25 bp, Rattus norvegicus
tagttgcactgcacgtcccagctgc

SEQ ID NO: 604291 - DNA, 25 bp, Rattus norvegicus
gccatgtagtcgcagtccgtgatga

SEQ ID NO: 604292 - DNA, 25 bp, Rattus norvegicus
agcaggccgatctgagagccgttga

SEQ ID NO: 604293 - DNA, 25 bp, Rattus norvegicus
ggcggtttacctgccttgcgcagca

SEQ ID NO: 604294 - DNA, 25 bp, Rattus norvegicus
cacgtcccagctgcgggctagagaa

SEQ ID NO: 604295 - DNA, 25 bp, Rattus norvegicus
tggagtccgaaacctccgatcctgg

SEQ ID NO: 604296 - DNA, 25 bp, Rattus norvegicus
ggccctgtaccctgacaactcatca

SEQ ID NO: 604297 - DNA, 25 bp, Rattus norvegicus
ggccacgcaagatcccgccctattc

SEQ ID NO: 604298 - DNA, 25 bp, Rattus norvegicus
acgatacacggatcctggccctgca

SEQ ID NO: 604299 - DNA, 25 bp, Rattus norvegicus
gctcagcactggagtccgaaacctc

SEQ ID NO: 604300 - DNA, 25 bp, Rattus norvegicus
aacctccgatcctggggttccgatg

SEQ ID NO: 604301 - DNA, 25 bp, Rattus norvegicus
tggggttccgatgctctcatccaga

SEQ ID NO: 604302 - DNA, 25 bp, Rattus norvegicus
ctgcgaccagggacttcgagtctcc

SEQ ID NO: 604303 - DNA, 25 bp, Rattus norvegicus
ggacttcgagtctccaatcctggcc

SEQ ID NO: 604304 - DNA, 25 bp, Rattus norvegicus
accgagaacacctggtcctggcctg

SEQ ID NO: 604305 - DNA, 25 bp, Rattus norvegicus
tggcctggaatcctgactccggggt

SEQ ID NO: 604306 - DNA, 25 bp, Rattus norvegicus
tgactccggggtccaagccttacac

SEQ ID NO: 604307 - DNA, 25 bp, Rattus norvegicus
cccgaggcacgatacacggatcctg

SEQ ID NO: 604308 - DNA, 25 bp, Rattus norvegicus
ggatgaacggctcagcactggagtc

SEQ ID NO: 604309 - DNA, 25 bp, Rattus norvegicus
cgctgtgacggtactgtaggtgtgc

SEQ ID NO: 604310 - DNA, 25 bp, Rattus norvegicus
tgtgcaggccgctgtgacggtactg

SEQ ID NO: 604311 - DNA, 25 bp, Rattus norvegicus
gcaggccgctgtgacggtactgtag

SEQ ID NO: 604312 - DNA, 25 bp, Rattus norvegicus
acggtactgtaggtgtgcaggccgc

SEQ ID NO: 604313 - DNA, 25 bp, Rattus norvegicus
gtgtgcaggccgctgtgacggtact

SEQ ID NO: 604314 - DNA, 25 bp, Rattus norvegicus
ggtactgtaggtgtgcaggccgctg

SEQ ID NO: 604315 - DNA, 25 bp, Rattus norvegicus
tgacggtactgtaggtgtgcaggcc

SEQ ID NO: 604316 - DNA, 25 bp, Rattus norvegicus
caggccgctgtgacggtactgtagg

SEQ ID NO: 604317 - DNA, 25 bp, Rattus norvegicus
gtactgtaggtgtgcaggccgctgt

SEQ ID NO: 604318 - DNA, 25 bp, Rattus norvegicus
gccgctgtgacggtactgtaggtgt

SEQ ID NO: 604319 - DNA, 25 bp, Rattus norvegicus
tgcaggccgctgtgacggtactgta

SEQ ID NO: 604320 - DNA, 25 bp, Rattus norvegicus
actgtaggtgtgcaggccgctgtga

SEQ ID NO: 604321 - DNA, 25 bp, Rattus norvegicus
gctgtgacggtactgtaggtgtgca

SEQ ID NO: 604322 - DNA, 25 bp, Rattus norvegicus
gacggtactgtaggtgtgcaggccg

SEQ ID NO: 604323 - DNA, 25 bp, Rattus norvegicus
caacgtgcccgacgtccggcgcgtc

SEQ ID NO: 604324 - DNA, 25 bp, Rattus norvegicus
tccctggcccgccaccgtgcgcggc

SEQ ID NO: 604325 - DNA, 25 bp, Rattus norvegicus
ggctgcgggccgacccacgcagccc

SEQ ID NO: 604326 - DNA, 25 bp, Rattus norvegicus
tatttctcactttagctccgcccat

SEQ ID NO: 604327 - DNA, 25 bp, Rattus norvegicus
cgtcgccggcgtcaacgtgcccgac

SEQ ID NO: 604328 - DNA, 25 bp, Rattus norvegicus
cccgctcgtcacgaaggccggcccg

SEQ ID NO: 604329 - DNA, 25 bp, Rattus norvegicus
gtcggcgcgagcgtcagctccgccc

SEQ ID NO: 604330 - DNA, 25 bp, Rattus norvegicus
gcgcatgcgctagttccgcggtggt

SEQ ID NO: 604331 - DNA, 25 bp, Rattus norvegicus
gggcagcccatccagagctccaatt

SEQ ID NO: 604332 - DNA, 25 bp, Rattus norvegicus
gcccatccagagctccaattggcta

SEQ ID NO: 604333 - DNA, 25 bp, Rattus norvegicus
ccagagctccaattggctatttctc

SEQ ID NO: 604334 - DNA, 25 bp, Rattus norvegicus
gctccaattggctatttctcacttt

SEQ ID NO: 604335 - DNA, 25 bp, Rattus norvegicus
tggctatttctcactttagctccgc

SEQ ID NO: 604336 - DNA, 25 bp, Rattus norvegicus
cgggacactggcgagcgcagagaac

SEQ ID NO: 604337 - DNA, 25 bp, Rattus norvegicus
ttcccgcctagcgtctcgcgagaag

SEQ ID NO: 604338 - DNA, 25 bp, Rattus norvegicus
gccggggtactcctcagagatccca

SEQ ID NO: 604339 - DNA, 25 bp, Rattus norvegicus
tggcatccgctgtcgcagtatcttg

SEQ ID NO: 604340 - DNA, 25 bp, Rattus norvegicus
atccgtcagatcgttgcccgacagg

SEQ ID NO: 604341 - DNA, 25 bp, Rattus norvegicus
ctcgcggcacaggaacttgagatcc

SEQ ID NO: 604342 - DNA, 25 bp, Rattus norvegicus
tttcgtttactcacgcgctcgcggc

SEQ ID NO: 604343 - DNA, 25 bp, Rattus norvegicus
tgctccagcagcaccgagaacaggt

SEQ ID NO: 604344 - DNA, 25 bp, Rattus norvegicus
cgctgcagtaggtcgtgtctgccca

SEQ ID NO: 604345 - DNA, 25 bp, Rattus norvegicus
agtccgtcccagctgcagcaagcag

SEQ ID NO: 604346 - DNA, 25 bp, Rattus norvegicus
gaagtctaaatcacacgcatgcgcc

SEQ ID NO: 604347 - DNA, 25 bp, Rattus norvegicus
ccctggcgcggaacagatttcattc

SEQ ID NO: 604348 - DNA, 25 bp, Rattus norvegicus
gcttccgcccgtactcgcgatgttt

SEQ ID NO: 604349 - DNA, 25 bp, Rattus norvegicus
tcttggacagctaagccgcgttggc

SEQ ID NO: 604350 - DNA, 25 bp, Rattus norvegicus
ctgcacgcgctccagctttcgttta

SEQ ID NO: 604351 - DNA, 25 bp, Rattus norvegicus
acctcatagcgctgcttccgcttta

SEQ ID NO: 604352 - DNA, 25 bp, Rattus norvegicus
gctctgcctgcgcagcttcaggtag

SEQ ID NO: 604353 - DNA, 25 bp, Rattus norvegicus
gggttcgaggttgaagtccacctca

SEQ ID NO: 604354 - DNA, 25 bp, Rattus norvegicus
ggccgggataccactcactcatttc

SEQ ID NO: 604355 - DNA, 25 bp, Rattus norvegicus
cgcagcttcaggtagcggatgaatt

SEQ ID NO: 604356 - DNA, 25 bp, Rattus norvegicus
tactcctcgcggtccgaggggctct

SEQ ID NO: 604357 - DNA, 25 bp, Rattus norvegicus
gctttatgtactcctcgcggtccga

SEQ ID NO: 604358 - DNA, 25 bp, Rattus norvegicus
gctgcttccgctttatgtactcctc

SEQ ID NO: 604359 - DNA, 25 bp, Rattus norvegicus
gttgaagtccacctcatagcgctgc

SEQ ID NO: 604360 - DNA, 25 bp, Rattus norvegicus
cttcaggtagcggatgaattttttc

SEQ ID NO: 604361 - DNA, 25 bp, Rattus norvegicus
tttccatgtactcgggcgtgaggcc

SEQ ID NO: 604362 - DNA, 25 bp, Rattus norvegicus
tcactcatttccatgtactcgggcg

SEQ ID NO: 604363 - DNA, 25 bp, Rattus norvegicus
gggataccactcactcatttccatg

SEQ ID NO: 604364 - DNA, 25 bp, Rattus norvegicus
caggtagcggatgaattttttcatc

SEQ ID NO: 604365 - DNA, 25 bp, Rattus norvegicus
gtcgagtacttctcggggaccctca

SEQ ID NO: 604366 - DNA, 25 bp, Rattus norvegicus
agagtatagccggtcgcgtgcactt

SEQ ID NO: 604367 - DNA, 25 bp, Rattus norvegicus
gcgtgcacttggtcccagcagcagc

SEQ ID NO: 604368 - DNA, 25 bp, Rattus norvegicus
gcggccacgcgggtcagattttccg

SEQ ID NO: 604369 - DNA, 25 bp, Rattus norvegicus
gaggacgcacagagtatagccggtc

SEQ ID NO: 604370 - DNA, 25 bp, Rattus norvegicus
ttaaagatataagcgcaggggcggc

SEQ ID NO: 604371 - DNA, 25 bp, Rattus norvegicus
tcaccgtgccctcggacggcaggta

SEQ ID NO: 604372 - DNA, 25 bp, Rattus norvegicus
gggaccctcatggtggcctcgcgct

SEQ ID NO: 604373 - DNA, 25 bp, Rattus norvegicus
ctcggacggcaggtagcccaggtcc

SEQ ID NO: 604374 - DNA, 25 bp, Rattus norvegicus
tcctccgctgggagcgtcgagtact

SEQ ID NO: 604375 - DNA, 25 bp, Rattus norvegicus
cagatgttcacgatgtggacgctgc

SEQ ID NO: 604376 - DNA, 25 bp, Rattus norvegicus
tcctcgatggcgcagatgttcacga

SEQ ID NO: 604377 - DNA, 25 bp, Rattus norvegicus
cccaggtcctcgatggcgcagatgt

SEQ ID NO: 604378 - DNA, 25 bp, Rattus norvegicus
cgccggctccgccttaaagatataa

SEQ ID NO: 604379 - DNA, 25 bp, Rattus norvegicus
tccaggctgatgtcgctgtcctgtg

SEQ ID NO: 604380 - DNA, 25 bp, Rattus norvegicus
agccctccaggctgatgtcgctgtc

SEQ ID NO: 604381 - DNA, 25 bp, Rattus norvegicus
actccctgggtccagcagagggacc

SEQ ID NO: 604382 - DNA, 25 bp, Rattus norvegicus
cccaggggtcacggggtcacctgca

SEQ ID NO: 604383 - DNA, 25 bp, Rattus norvegicus
ctctggcactctcggtccgcagggg

SEQ ID NO: 604384 - DNA, 25 bp, Rattus norvegicus
gcctcgtgtacgattgtttccggtc

SEQ ID NO: 604385 - DNA, 25 bp, Rattus norvegicus
tcgggtcaagccctccaggctgatg

SEQ ID NO: 604386 - DNA, 25 bp, Rattus norvegicus
cgattgtttccggtcccctctggca

SEQ ID NO: 604387 - DNA, 25 bp, Rattus norvegicus
ctgtcctgtgtgtcctgcatgatgt

SEQ ID NO: 604388 - DNA, 25 bp, Rattus norvegicus
cctgtgtgtcctgcatgatgtgttc

SEQ ID NO: 604389 - DNA, 25 bp, Rattus norvegicus
ctgcatgatgtgttcgctccggact

SEQ ID NO: 604390 - DNA, 25 bp, Rattus norvegicus
atgatgtgttcgctccggactccct

SEQ ID NO: 604391 - DNA, 25 bp, Rattus norvegicus
tccggactccctgggtccagcagag

SEQ ID NO: 604392 - DNA, 25 bp, Rattus norvegicus
gtcctgtgcctcgtgtacgattgtt

SEQ ID NO: 604393 - DNA, 25 bp, Rattus norvegicus
gccaaacgccctttcttcagaactg

SEQ ID NO: 604394 - DNA, 25 bp, Rattus norvegicus
tgctcagcttgctggaacccggctg

SEQ ID NO: 604395 - DNA, 25 bp, Rattus norvegicus
cacggccgccttttgttgccaaacg

SEQ ID NO: 604396 - DNA, 25 bp, Rattus norvegicus
tgtgttcggcaaagaaacaggaccc

SEQ ID NO: 604397 - DNA, 25 bp, Rattus norvegicus
cccattcctgggtgaaaattcagtc

SEQ ID NO: 604398 - DNA, 25 bp, Rattus norvegicus
gatctggcttctgctgctcagcttg

SEQ ID NO: 604399 - DNA, 25 bp, Rattus norvegicus
ggacaaggatttatcgccctcttta

SEQ ID NO: 604400 - DNA, 25 bp, Rattus norvegicus
tttctcagtgaaaagccgttggaca

SEQ ID NO: 604401 - DNA, 25 bp, Rattus norvegicus
ccggttctgacacgtttgtatttct

SEQ ID NO: 604402 - DNA, 25 bp, Rattus norvegicus
cgatcttagagagctgccctcccgt

SEQ ID NO: 604403 - DNA, 25 bp, Rattus norvegicus
ggcagccttgagaacagcgcctata

SEQ ID NO: 604404 - DNA, 25 bp, Rattus norvegicus
gatgcgccgaggacactccactaga

SEQ ID NO: 604405 - DNA, 25 bp, Rattus norvegicus
gcaagctctactgcgctaccaagta

SEQ ID NO: 604406 - DNA, 25 bp, Rattus norvegicus
cgcggtcccagctaccgatcttaga

SEQ ID NO: 604407 - DNA, 25 bp, Rattus norvegicus
tatatataccactgctcggcggggc

SEQ ID NO: 604408 - DNA, 25 bp, Rattus norvegicus
gggcgccggctatatataccactgc

SEQ ID NO: 604409 - DNA, 25 bp, Rattus norvegicus
cccgtttgctctcgtggcttcgact

SEQ ID NO: 604410 - DNA, 25 bp, Rattus norvegicus
tggcttcgacttgcgcgcagcactc

SEQ ID NO: 604411 - DNA, 25 bp, Rattus norvegicus
cgactacagggacgctgctgcccgg

SEQ ID NO: 604412 - DNA, 25 bp, Rattus norvegicus
aacggcacgcggcacgccgaattgg

SEQ ID NO: 604413 - DNA, 25 bp, Rattus norvegicus
gggactacctgctgggcctcaaaag

SEQ ID NO: 604414 - DNA, 25 bp, Rattus norvegicus
gcctcaaaaggctgcggagactcta

SEQ ID NO: 604415 - DNA, 25 bp, Rattus norvegicus
actctactgcaacgtgggcatcgga

SEQ ID NO: 604416 - DNA, 25 bp, Rattus norvegicus
ctgggctcccggtgccgaattccag

SEQ ID NO: 604417 - DNA, 25 bp, Rattus norvegicus
tgccgaattccagcgctttcactcg

SEQ ID NO: 604418 - DNA, 25 bp, Rattus norvegicus
agcccgggacaagcgcccagactga

SEQ ID NO: 604419 - DNA, 25 bp, Rattus norvegicus
taccggcagacaggagacgagctct

SEQ ID NO: 604420 - DNA, 25 bp, Rattus norvegicus
agacaggagacgagctcttaatgcg

SEQ ID NO: 604421 - DNA, 25 bp, Rattus norvegicus
cccagtgactctcgccttgtggagt

SEQ ID NO: 604422 - DNA, 25 bp, Rattus norvegicus
ccctcctcaccggtacgcagctgtc

SEQ ID NO: 604423 - DNA, 25 bp, Rattus norvegicus
agactcaagggcctgatcaccgacc

SEQ ID NO: 604424 - DNA, 25 bp, Rattus norvegicus
agggcctgatcaccgacccaagagg

SEQ ID NO: 604425 - DNA, 25 bp, Rattus norvegicus
atcaccgacccaagaggggacgccg

SEQ ID NO: 604426 - DNA, 25 bp, Rattus norvegicus
tctgcgcgctggtcagctcatcctt

SEQ ID NO: 604427 - DNA, 25 bp, Rattus norvegicus
gcgctggtcagctcatccttctcaa

SEQ ID NO: 604428 - DNA, 25 bp, Rattus norvegicus
agctcatccttctcaaagtcacagc

SEQ ID NO: 604429 - DNA, 25 bp, Rattus norvegicus
agcgtccaccgttgctcctagctgg

SEQ ID NO: 604430 - DNA, 25 bp, Rattus norvegicus
actctcgccttgtggagtccacgcg

SEQ ID NO: 604431 - DNA, 25 bp, Rattus norvegicus
cttgtggagtccacgcgcgaggcaa

SEQ ID NO: 604432 - DNA, 25 bp, Rattus norvegicus
gcaagcagaggacgcacagagagca

SEQ ID NO: 604433 - DNA, 25 bp, Rattus norvegicus
tggtcagctcatccttctcaaagtc

SEQ ID NO: 604434 - DNA, 25 bp, Rattus norvegicus
gcgcgcagactcaagggcctgatca

SEQ ID NO: 604435 - DNA, 25 bp, Rattus norvegicus
gccgtcacctcaagctagggtcacg

SEQ ID NO: 604436 - DNA, 25 bp, Rattus norvegicus
tagaacgcccggtgaataggcgtga

SEQ ID NO: 604437 - DNA, 25 bp, Rattus norvegicus
ggatgagtagaacgcccggtgaata

SEQ ID NO: 604438 - DNA, 25 bp, Rattus norvegicus
ccttcgctgggatgagtagaacgcc

SEQ ID NO: 604439 - DNA, 25 bp, Rattus norvegicus
ccggatattaccttcgctgggatga

SEQ ID NO: 604440 - DNA, 25 bp, Rattus norvegicus
tcgaattccgcctatccggatatta

SEQ ID NO: 604441 - DNA, 25 bp, Rattus norvegicus
cggatggccgacaagaaagcggtct

SEQ ID NO: 604442 - DNA, 25 bp, Rattus norvegicus
cacctcaagctagggtcacggggcg

SEQ ID NO: 604443 - DNA, 25 bp, Rattus norvegicus
acaagaaagcggtctgaatctgggg

SEQ ID NO: 604444 - DNA, 25 bp, Rattus norvegicus
ggtccctcagcctcagtgctttggg

SEQ ID NO: 604445 - DNA, 25 bp, Rattus norvegicus
gagtcgcttctcgagccaggaccct

SEQ ID NO: 604446 - DNA, 25 bp, Rattus norvegicus
gaccgccagtctgggagtcgcttct

SEQ ID NO: 604447 - DNA, 25 bp, Rattus norvegicus
cagatcccgggaccgccagtctggg

SEQ ID NO: 604448 - DNA, 25 bp, Rattus norvegicus
ccattcctttgtcgaattccgccta

SEQ ID NO: 604449 - DNA, 25 bp, Rattus norvegicus
cctctattcttgcagtcggagcgca

SEQ ID NO: 604450 - DNA, 25 bp, Rattus norvegicus
cgctcgcttggtgttagctccagga

SEQ ID NO: 604451 - DNA, 25 bp, Rattus norvegicus
gttagtactgctcgctgggccacct

SEQ ID NO: 604452 - DNA, 25 bp, Rattus norvegicus
gcagcggcgatccttgtctaacttg

SEQ ID NO: 604453 - DNA, 25 bp, Rattus norvegicus
gccttagggcacagcggaaaacttc

SEQ ID NO: 604454 - DNA, 25 bp, Rattus norvegicus
cgacattctccagttgcccgggcta

SEQ ID NO: 604455 - DNA, 25 bp, Rattus norvegicus
gccttatcgttctccagctctgtga

SEQ ID NO: 604456 - DNA, 25 bp, Rattus norvegicus
tcccatctgggaagccttatcgttc

SEQ ID NO: 604457 - DNA, 25 bp, Rattus norvegicus
gctgggccacctgtttttgagcgta

SEQ ID NO: 604458 - DNA, 25 bp, Rattus norvegicus
aagagttggacgtgtcgccaggtaa

SEQ ID NO: 604459 - DNA, 25 bp, Rattus norvegicus
tccattggcccggagctcaaagggg

SEQ ID NO: 604460 - DNA, 25 bp, Rattus norvegicus
ttcaaaacaaaggtcccgtggcagc

SEQ ID NO: 604461 - DNA, 25 bp, Rattus norvegicus
gagaacaccttctgtccctgccgag

SEQ ID NO: 604462 - DNA, 25 bp, Rattus norvegicus
ctctgctctgctttcccatctggga

SEQ ID NO: 604463 - DNA, 25 bp, Rattus norvegicus
tgccatcaaggacgtcagcagcgtg

SEQ ID NO: 604464 - DNA, 25 bp, Rattus norvegicus
cccagtctgtgtcggatgaaggtcc

SEQ ID NO: 604465 - DNA, 25 bp, Rattus norvegicus
gccacctttgtagctgccttcacga

SEQ ID NO: 604466 - DNA, 25 bp, Rattus norvegicus
acctctgcatgagcgccgacggcaa

SEQ ID NO: 604467 - DNA, 25 bp, Rattus norvegicus
cactctttctctatggctggggcaa

SEQ ID NO: 604468 - DNA, 25 bp, Rattus norvegicus
cgcggttgctctgaagacaattgcc

SEQ ID NO: 604469 - DNA, 25 bp, Rattus norvegicus
ttgcagatctgttggagttccgcgc

SEQ ID NO: 604470 - DNA, 25 bp, Rattus norvegicus
ttgctgggcccaggcaactttttcc

SEQ ID NO: 604471 - DNA, 25 bp, Rattus norvegicus
tctaggagcacgtggatatgtcacc

SEQ ID NO: 604472 - DNA, 25 bp, Rattus norvegicus
tcgagtcccttaggatctaggagca

SEQ ID NO: 604473 - DNA, 25 bp, Rattus norvegicus
cgaagtgagtatccaccagcgtgtc

SEQ ID NO: 604474 - DNA, 25 bp, Rattus norvegicus
actgcttcctgcgtatccggagtga

SEQ ID NO: 604475 - DNA, 25 bp, Rattus norvegicus
tacctgtactctgctggtccctacg

SEQ ID NO: 604476 - DNA, 25 bp, Rattus norvegicus
ggggcaagattacccgcctgcagta

SEQ ID NO: 604477 - DNA, 25 bp, Rattus norvegicus
tcgccatctgcgagctgccactttt

SEQ ID NO: 604478 - DNA, 25 bp, Rattus norvegicus
tgtcctttaattgccgcacatacgg

SEQ ID NO: 604479 - DNA, 25 bp, Rattus norvegicus
gctgccactttttcttgtcctttaa

SEQ ID NO: 604480 - DNA, 25 bp, Rattus norvegicus
caggacatatttgacgccgtcgtga

SEQ ID NO: 604481 - DNA, 25 bp, Rattus norvegicus
caaaatgacaggagtgcgaggaccc

SEQ ID NO: 604482 - DNA, 25 bp, Rattus norvegicus
gccggctggcgattgctacacaaaa

SEQ ID NO: 604483 - DNA, 25 bp, Rattus norvegicus
tgggcatttgtgctcgtgtctcgcc

SEQ ID NO: 604484 - DNA, 25 bp, Rattus norvegicus
gtggcttcttcaatctgggcatttg

SEQ ID NO: 604485 - DNA, 25 bp, Rattus norvegicus
gcgcggcataaacggaagtggcttc

SEQ ID NO: 604486 - DNA, 25 bp, Rattus norvegicus
tggcttctttagcttgccgtcctta

SEQ ID NO: 604487 - DNA, 25 bp, Rattus norvegicus
catgcgtagagaggtgggctttttt

SEQ ID NO: 604488 - DNA, 25 bp, Rattus norvegicus
cccacatattacctacgcatgcgta

SEQ ID NO: 604489 - DNA, 25 bp, Rattus norvegicus
gaggagcaaggcttcactcgggcta

SEQ ID NO: 604490 - DNA, 25 bp, Rattus norvegicus
actgaaccagccgtgccagggagga

SEQ ID NO: 604491 - DNA, 25 bp, Rattus norvegicus
cctccgaggagcgcgacaggatgac

SEQ ID NO: 604492 - DNA, 25 bp, Rattus norvegicus
cacgggagaaacctgggcacgacat

SEQ ID NO: 604493 - DNA, 25 bp, Rattus norvegicus
tcggccgccctctgctggcagaaaa

SEQ ID NO: 604494 - DNA, 25 bp, Rattus norvegicus
gggaaggcgttgcttattcagaata

SEQ ID NO: 604495 - DNA, 25 bp, Rattus norvegicus
cgacatagaagggtgacacaccaga

SEQ ID NO: 604496 - DNA, 25 bp, Rattus norvegicus
attcagaatatcctcgtggggcctc

SEQ ID NO: 604497 - DNA, 25 bp, Rattus norvegicus
gtgcccttgaaaatacacgggagaa

SEQ ID NO: 604498 - DNA, 25 bp, Rattus norvegicus
ccgcgctgtgcccttgaaaatacac

SEQ ID NO: 604499 - DNA, 25 bp, Rattus norvegicus
agctgtatcgggaagtccgcgctgt

SEQ ID NO: 604500 - DNA, 25 bp, Rattus norvegicus
cgcttgcagctgtatcgggaagtcc

SEQ ID NO: 604501 - DNA, 25 bp, Rattus norvegicus
gacacttggcgcttgcagctgtatc

SEQ ID NO: 604502 - DNA, 25 bp, Rattus norvegicus
atctgaatgacacttggcgcttgca

SEQ ID NO: 604503 - DNA, 25 bp, Rattus norvegicus
cctctgctggcagaaaatctgaatg

SEQ ID NO: 604504 - DNA, 25 bp, Rattus norvegicus
acacaccagagagggaaggcgttgc

SEQ ID NO: 604505 - DNA, 25 bp, Rattus norvegicus
ccacaaggcagggaagcccaccgta

SEQ ID NO: 604506 - DNA, 25 bp, Rattus norvegicus
ccgcaccctttttatagattgcaca

SEQ ID NO: 604507 - DNA, 25 bp, Rattus norvegicus
ggaagacctcctcttcgcacttctg

SEQ ID NO: 604508 - DNA, 25 bp, Rattus norvegicus
ttttatagattgcacagagggattc

SEQ ID NO: 604509 - DNA, 25 bp, Rattus norvegicus
agagggattccggtggccaattccg

SEQ ID NO: 604510 - DNA, 25 bp, Rattus norvegicus
ggatgcgctctagccctgcgggttc

SEQ ID NO: 604511 - DNA, 25 bp, Rattus norvegicus
tgcgggttcccagtacccacccatc

SEQ ID NO: 604512 - DNA, 25 bp, Rattus norvegicus
cccgttgaaattaggaagccacaag

SEQ ID NO: 604513 - DNA, 25 bp, Rattus norvegicus
aggccgccgcgctgcatttcccaga

SEQ ID NO: 604514 - DNA, 25 bp, Rattus norvegicus
gggcaccgctcaagcgcacgcgaga

SEQ ID NO: 604515 - DNA, 25 bp, Rattus norvegicus
cgctcaagcgcacgcgagacacaaa

SEQ ID NO: 604516 - DNA, 25 bp, Rattus norvegicus
cgcgagacacaaaggtggcgtccca

SEQ ID NO: 604517 - DNA, 25 bp, Rattus norvegicus
acaaaggtggcgtcccaggccgccg

SEQ ID NO: 604518 - DNA, 25 bp, Rattus norvegicus
cccacccatcatgaaactgaaaggg

SEQ ID NO: 604519 - DNA, 25 bp, Rattus norvegicus
gcgcgcaggtctcctcagtcttaag

SEQ ID NO: 604520 - DNA, 25 bp, Rattus norvegicus
tgtctgctgctgacgcgcgctgcct

SEQ ID NO: 604521 - DNA, 25 bp, Rattus norvegicus
ctggtgttccatggcgcggccgcct

SEQ ID NO: 604522 - DNA, 25 bp, Rattus norvegicus
agcacaggagctggtgttccatggc

SEQ ID NO: 604523 - DNA, 25 bp, Rattus norvegicus
cttcgcagcacaggagctggtgttc

SEQ ID NO: 604524 - DNA, 25 bp, Rattus norvegicus
atggtctccacttcgcagcacagga

SEQ ID NO: 604525 - DNA, 25 bp, Rattus norvegicus
cggatggtctccacttcgcagcaca

SEQ ID NO: 604526 - DNA, 25 bp, Rattus norvegicus
tacgcgcggcggatggtctccactt

SEQ ID NO: 604527 - DNA, 25 bp, Rattus norvegicus
cagcacccggtcgttgaggagattg

SEQ ID NO: 604528 - DNA, 25 bp, Rattus norvegicus
ttaagcatggctcgcagcacccggt

SEQ ID NO: 604529 - DNA, 25 bp, Rattus norvegicus
tcagtcttaagcatggctcgcagca

SEQ ID NO: 604530 - DNA, 25 bp, Rattus norvegicus
tctcctcagtcttaagcatggctcg

SEQ ID NO: 604531 - DNA, 25 bp, Rattus norvegicus
gcaggtctcctcagtcttaagcatg

SEQ ID NO: 604532 - DNA, 25 bp, Rattus norvegicus
tcgcgctctacgaccggtctccgga

SEQ ID NO: 604533 - DNA, 25 bp, Rattus norvegicus
cgaggaacttcgttgagctcttcgc

SEQ ID NO: 604534 - DNA, 25 bp, Rattus norvegicus
caaaagtgcaagtccggttagcggg

SEQ ID NO: 604535 - DNA, 25 bp, Rattus norvegicus
ccaagttaggcgaactattcacata

SEQ ID NO: 604536 - DNA, 25 bp, Rattus norvegicus
cgggcagatctccacgaggaacttc

SEQ ID NO: 604537 - DNA, 25 bp, Rattus norvegicus
tccggactcagcgttgttactaggc

SEQ ID NO: 604538 - DNA, 25 bp, Rattus norvegicus
cctgcgagctgagcaggctagccta

SEQ ID NO: 604539 - DNA, 25 bp, Rattus norvegicus
ttatagagctgtgcgctatcacccg

SEQ ID NO: 604540 - DNA, 25 bp, Rattus norvegicus
cgggcggcagtgaacatgatttata

SEQ ID NO: 604541 - DNA, 25 bp, Rattus norvegicus
cgcccggctgccttttcattcataa

SEQ ID NO: 604542 - DNA, 25 bp, Rattus norvegicus
agtgattccactgtagctccgaagg

SEQ ID NO: 604543 - DNA, 25 bp, Rattus norvegicus
cggatccttcgggacagtgattcca

SEQ ID NO: 604544 - DNA, 25 bp, Rattus norvegicus
taggcggcacgcaagacacaaaccc

SEQ ID NO: 604545 - DNA, 25 bp, Rattus norvegicus
ccgaagaaactggtaagggagcgca

SEQ ID NO: 604546 - DNA, 25 bp, Rattus norvegicus
ttcataaaatccctaccgggcggca

SEQ ID NO: 604547 - DNA, 25 bp, Rattus norvegicus
tttcagttccagttagccattgtta

SEQ ID NO: 604548 - DNA, 25 bp, Rattus norvegicus
atggcagcccacgtgctacgcggct

SEQ ID NO: 604549 - DNA, 25 bp, Rattus norvegicus
acccggcagcaatcttgggcctctg

SEQ ID NO: 604550 - DNA, 25 bp, Rattus norvegicus
caatcttgggcctctggcagtagcc

SEQ ID NO: 604551 - DNA, 25 bp, Rattus norvegicus
tcccgcagagaagcgggcgcaccta

SEQ ID NO: 604552 - DNA, 25 bp, Rattus norvegicus
gcgcacctacgtggggtcacctgta

SEQ ID NO: 604553 - DNA, 25 bp, Rattus norvegicus
gggtcacctgtagccgcatacctgg

SEQ ID NO: 604554 - DNA, 25 bp, Rattus norvegicus
ttcctctccgcacgctggaggcgtt

SEQ ID NO: 604555 - DNA, 25 bp, Rattus norvegicus
atacctggcggcaacttgaaaggtc

SEQ ID NO: 604556 - DNA, 25 bp, Rattus norvegicus
cgagaaaacgcttccgaatttgagc

SEQ ID NO: 604557 - DNA, 25 bp, Rattus norvegicus
aaaggtcttggctgtttcagttcca

SEQ ID NO: 604558 - DNA, 25 bp, Rattus norvegicus
tttagccttcaagtcgcccgagaaa

SEQ ID NO: 604559 - DNA, 25 bp, Rattus norvegicus
ttgaggaacccatgccgtttagcgc

SEQ ID NO: 604560 - DNA, 25 bp, Rattus norvegicus
ggttccggaggcactacagctttcc

SEQ ID NO: 604561 - DNA, 25 bp, Rattus norvegicus
ctggctagccttcgcggttccacaa

SEQ ID NO: 604562 - DNA, 25 bp, Rattus norvegicus
gaaccctggctagccttcgcggttc

SEQ ID NO: 604563 - DNA, 25 bp, Rattus norvegicus
gcgagagcccgaggacgctcccaaa

SEQ ID NO: 604564 - DNA, 25 bp, Rattus norvegicus
tagccttcgcggttccacaaacgcg

SEQ ID NO: 604565 - DNA, 25 bp, Rattus norvegicus
ggccgcaccgcgcattccgcgcatt

SEQ ID NO: 604566 - DNA, 25 bp, Rattus norvegicus
tgtttcgccgccacgtggtcgtcct

SEQ ID NO: 604567 - DNA, 25 bp, Rattus norvegicus
acgtggtcgtcctgagcgccgcgct

SEQ ID NO: 604568 - DNA, 25 bp, Rattus norvegicus
agcgccgcgcttaccgtaaagcttg

SEQ ID NO: 604569 - DNA, 25 bp, Rattus norvegicus
ttaccgtaaagcttggaggcgacgc

SEQ ID NO: 604570 - DNA, 25 bp, Rattus norvegicus
ccgtaaagcttggaggcgacgcgca

SEQ ID NO: 604571 - DNA, 25 bp, Rattus norvegicus
cccaaaggtaagatgtggatgtgca

SEQ ID NO: 604572 - DNA, 25 bp, Rattus norvegicus
tgtggatgtgcacttctgtagtggc

SEQ ID NO: 604573 - DNA, 25 bp, Rattus norvegicus
gtgcacttctgtagtggcgccgagc

SEQ ID NO: 604574 - DNA, 25 bp, Rattus norvegicus
cgaggacgctcccaaaggtaagatg

SEQ ID NO: 604575 - DNA, 25 bp, Rattus norvegicus
ggctgacgtaatccccaaacatctc

SEQ ID NO: 604576 - DNA, 25 bp, Rattus norvegicus
ctgggcgggctgtgtagcagcagca

SEQ ID NO: 604577 - DNA, 25 bp, Rattus norvegicus
acttctggaggccagcgcggtccga

SEQ ID NO: 604578 - DNA, 25 bp, Rattus norvegicus
atcacttctggaggccagcgcggtc

SEQ ID NO: 604579 - DNA, 25 bp, Rattus norvegicus
tagctatcacttctggaggccagcg

SEQ ID NO: 604580 - DNA, 25 bp, Rattus norvegicus
aattagctatcacttctggaggcca

SEQ ID NO: 604581 - DNA, 25 bp, Rattus norvegicus
cccaattagctatcacttctggagg

SEQ ID NO: 604582 - DNA, 25 bp, Rattus norvegicus
gcagacaatcgagccctttctctcc

SEQ ID NO: 604583 - DNA, 25 bp, Rattus norvegicus
tgccgcagacaatcgagccctttct

SEQ ID NO: 604584 - DNA, 25 bp, Rattus norvegicus
gctgccgcagacaatcgagcccttt

SEQ ID NO: 604585 - DNA, 25 bp, Rattus norvegicus
ctgcagggcgaagcggccgcctcct

SEQ ID NO: 604586 - DNA, 25 bp, Rattus norvegicus
ccctgcccgccaggctgacgtaatc

SEQ ID NO: 604587 - DNA, 25 bp, Rattus norvegicus
ggccacgaggcttgcagggaggccc

SEQ ID NO: 604588 - DNA, 25 bp, Rattus norvegicus
ttccggctgccgcagacaatcgagc

SEQ ID NO: 604589 - DNA, 25 bp, Rattus norvegicus
cgctgccagccagggtactgatttc

SEQ ID NO: 604590 - DNA, 25 bp, Rattus norvegicus
ccggttgctactgtggaaaaatggc

SEQ ID NO: 604591 - DNA, 25 bp, Rattus norvegicus
ctgggccacaaaactctccacggtg

SEQ ID NO: 604592 - DNA, 25 bp, Rattus norvegicus
aactagcggtgcttctgccgactgc

SEQ ID NO: 604593 - DNA, 25 bp, Rattus norvegicus
gcgtagcatcttggcatcccaggga

SEQ ID NO: 604594 - DNA, 25 bp, Rattus norvegicus
cgctatgcggtcttgcagtcttctc

SEQ ID NO: 604595 - DNA, 25 bp, Rattus norvegicus
gtgctgcccattgacccagcgaata

SEQ ID NO: 604596 - DNA, 25 bp, Rattus norvegicus
ccgcatgtgtgtctgagttcgcctt

SEQ ID NO: 604597 - DNA, 25 bp, Rattus norvegicus
gtttcctgtactctctgccaagcca

SEQ ID NO: 604598 - DNA, 25 bp, Rattus norvegicus
atctgcagtaggatccctgtttccc

SEQ ID NO: 604599 - DNA, 25 bp, Rattus norvegicus
ttccctactgggcttgtgcgttgac

SEQ ID NO: 604600 - DNA, 25 bp, Rattus norvegicus
tgcgttgacgcacaaagttcgcgcc

SEQ ID NO: 604601 - DNA, 25 bp, Rattus norvegicus
acgagtccatctgctccgtggtgca

SEQ ID NO: 604602 - DNA, 25 bp, Rattus norvegicus
gactgatgcttcctgctcggccatt

SEQ ID NO: 604603 - DNA, 25 bp, Rattus norvegicus
cccttgcaccgagtctagcgcgtga

SEQ ID NO: 604604 - DNA, 25 bp, Rattus norvegicus
ccgcggagaaacgtagatagttccg

SEQ ID NO: 604605 - DNA, 25 bp, Rattus norvegicus
ggaacccgctcgcaactgtcctgag

SEQ ID NO: 604606 - DNA, 25 bp, Rattus norvegicus
tcctgaggctgtcgccaccgttctg

SEQ ID NO: 604607 - DNA, 25 bp, Rattus norvegicus
tagcgcgtgacccagccggaccgaa

SEQ ID NO: 604608 - DNA, 25 bp, Rattus norvegicus
ggaaggcaacgccagagactagcca

SEQ ID NO: 604609 - DNA, 25 bp, Rattus norvegicus
ccagagactagccacggcgagcggt

SEQ ID NO: 604610 - DNA, 25 bp, Rattus norvegicus
cgccgacaggagactaggatgcgcc

SEQ ID NO: 604611 - DNA, 25 bp, Rattus norvegicus
aggagactaggatgcgccgagccac

SEQ ID NO: 604612 - DNA, 25 bp, Rattus norvegicus
gccgagccacgctgtgctgcgttac

SEQ ID NO: 604613 - DNA, 25 bp, Rattus norvegicus
tgcgttacgctcttccaagccaaga

SEQ ID NO: 604614 - DNA, 25 bp, Rattus norvegicus
aagccaagagtccaagcgccctcgg

SEQ ID NO: 604615 - DNA, 25 bp, Rattus norvegicus
ccgtctcccggatgctgggccggaa

SEQ ID NO: 604616 - DNA, 25 bp, Rattus norvegicus
cgcaactgtcctgaggctgtcgcca

SEQ ID NO: 604617 - DNA, 25 bp, Rattus norvegicus
ctggtatcacctttgggagcgtgga

SEQ ID NO: 604618 - DNA, 25 bp, Rattus norvegicus
gccgccgtccacagactcggtaaga

SEQ ID NO: 604619 - DNA, 25 bp, Rattus norvegicus
ccacagactcggtaagacaccggga

SEQ ID NO: 604620 - DNA, 25 bp, Rattus norvegicus
gcgcgctggtatcacctttgggagc

SEQ ID NO: 604621 - DNA, 25 bp, Rattus norvegicus
agacccagactgtgcccgtggggta

SEQ ID NO: 604622 - DNA, 25 bp, Rattus norvegicus
tacgcgtgagccgcgcattggagaa

SEQ ID NO: 604623 - DNA, 25 bp, Rattus norvegicus
gaccacggctcttgatgtctcaccg

SEQ ID NO: 604624 - DNA, 25 bp, Rattus norvegicus
atcccgggacgggaggaaagatgct

SEQ ID NO: 604625 - DNA, 25 bp, Rattus norvegicus
cccagactgggcaagatgcctccgt

SEQ ID NO: 604626 - DNA, 25 bp, Rattus norvegicus
tgggcaagatgcctccgttccggac

SEQ ID NO: 604627 - DNA, 25 bp, Rattus norvegicus
agatgcctccgttccggacgcatgg

SEQ ID NO: 604628 - DNA, 25 bp, Rattus norvegicus
gacgcatgggaccacggctcttgat

SEQ ID NO: 604629 - DNA, 25 bp, Rattus norvegicus
ttcccccgcgctgtgacggatctgg

SEQ ID NO: 604630 - DNA, 25 bp, Rattus norvegicus
ccgccctgaactgggcgcgctggta

SEQ ID NO: 604631 - DNA, 25 bp, Rattus norvegicus
caggctcgattctctcgggagtttg

SEQ ID NO: 604632 - DNA, 25 bp, Rattus norvegicus
cctacttttctcagccatcacgtga

SEQ ID NO: 604633 - DNA, 25 bp, Rattus norvegicus
agccatcacgtgaccctggccgggt

SEQ ID NO: 604634 - DNA, 25 bp, Rattus norvegicus
tcccgggcagtacactgggatggca

SEQ ID NO: 604635 - DNA, 25 bp, Rattus norvegicus
tctgtcctcggacaaagcgggtcgg

SEQ ID NO: 604636 - DNA, 25 bp, Rattus norvegicus
gttgcatgcgacatctgtcctcgga

SEQ ID NO: 604637 - DNA, 25 bp, Rattus norvegicus
gcaggctgttttgttgcatgcgaca

SEQ ID NO: 604638 - DNA, 25 bp, Rattus norvegicus
aaccctttgaggcacggtgctggca

SEQ ID NO: 604639 - DNA, 25 bp, Rattus norvegicus
tttcgcagtgaaaccctttgaggca

SEQ ID NO: 604640 - DNA, 25 bp, Rattus norvegicus
ctcttgcccattttgcccattcata

SEQ ID NO: 604641 - DNA, 25 bp, Rattus norvegicus
tcacggaacgggcaggctcgattct

SEQ ID NO: 604642 - DNA, 25 bp, Rattus norvegicus
ttggctcagacccagtggtcacgga

SEQ ID NO: 604643 - DNA, 25 bp, Rattus norvegicus
ccggtggaacaggatccgagcgccc

SEQ ID NO: 604644 - DNA, 25 bp, Rattus norvegicus
gcccattcataaaagcgctgtaatt

SEQ ID NO: 604645 - DNA, 25 bp, Rattus norvegicus
aacggtccgtccaacctctcaggag

SEQ ID NO: 604646 - DNA, 25 bp, Rattus norvegicus
gtccaacctctcaggagctgggcgg

SEQ ID NO: 604647 - DNA, 25 bp, Rattus norvegicus
cgcgtcgtgtcgctgtactccggtc

SEQ ID NO: 604648 - DNA, 25 bp, Rattus norvegicus
tcggcgccatgactggccccgaaga

SEQ ID NO: 604649 - DNA, 25 bp, Rattus norvegicus
tggccgacgcctacctgggcgccac

SEQ ID NO: 604650 - DNA, 25 bp, Rattus norvegicus
taccggccgccttgcttggcgactt

SEQ ID NO: 604651 - DNA, 25 bp, Rattus norvegicus
tgcttggcgacttcccggggctgcc

SEQ ID NO: 604652 - DNA, 25 bp, Rattus norvegicus
tccgcagctcagacgacgccgctcc

SEQ ID NO: 604653 - DNA, 25 bp, Rattus norvegicus
cgcctacagcgtgcacgtgctgtcg

SEQ ID NO: 604654 - DNA, 25 bp, Rattus norvegicus
gtgcacgtgctgtcgtcgttacttc

SEQ ID NO: 604655 - DNA, 25 bp, Rattus norvegicus
tcgtcgttacttcccggtgctcgcg

SEQ ID NO: 604656 - DNA, 25 bp, Rattus norvegicus
cgctgttgccgctaagcgccggagt

SEQ ID NO: 604657 - DNA, 25 bp, Rattus norvegicus
cgtgatcccagtaagcgcaggcagg

SEQ ID NO: 604658 - DNA, 25 bp, Rattus norvegicus
aagcgccggagtgcgcgtgatccca

SEQ ID NO: 604659 - DNA, 25 bp, Rattus norvegicus
tgcagggacttgtagttttagatcc

SEQ ID NO: 604660 - DNA, 25 bp, Rattus norvegicus
cacgtttgctcccagagttggacga

SEQ ID NO: 604661 - DNA, 25 bp, Rattus norvegicus
caccgccttcgtcgcaggggatgca

SEQ ID NO: 604662 - DNA, 25 bp, Rattus norvegicus
ttttagatccttaagtcacgtttgc

SEQ ID NO: 604663 - DNA, 25 bp, Rattus norvegicus
taagtcacgtttgctcccagagttg

SEQ ID NO: 604664 - DNA, 25 bp, Rattus norvegicus
gaaagtaggactcggaaaatcgagc

SEQ ID NO: 604665 - DNA, 25 bp, Rattus norvegicus
ctcccagagttggacgacgagagaa

SEQ ID NO: 604666 - DNA, 25 bp, Rattus norvegicus
aaaatcgagcgctggtgcccggtgc

SEQ ID NO: 604667 - DNA, 25 bp, Rattus norvegicus
gagcaccacaaagcctagtaccttg

SEQ ID NO: 604668 - DNA, 25 bp, Rattus norvegicus
ctcggaaaatcgagcgctggtgccc

SEQ ID NO: 604669 - DNA, 25 bp, Rattus norvegicus
cagcgggctccgaaaagaaagtagg

SEQ ID NO: 604670 - DNA, 25 bp, Rattus norvegicus
aactacatatcccagcgggctccga

SEQ ID NO: 604671 - DNA, 25 bp, Rattus norvegicus
acgacgagagaaggaactacatatc

SEQ ID NO: 604672 - DNA, 25 bp, Rattus norvegicus
ttggacgacgagagaaggaactaca

SEQ ID NO: 604673 - DNA, 25 bp, Rattus norvegicus
gccgctatttatacccggtgggagc

SEQ ID NO: 604674 - DNA, 25 bp, Rattus norvegicus
agggccgctgtgaccggaacccgct

SEQ ID NO: 604675 - DNA, 25 bp, Rattus norvegicus
taccttgagcagtggtgggaaccgg

SEQ ID NO: 604676 - DNA, 25 bp, Rattus norvegicus
gcgtagctggttagtgcaggtccaa

SEQ ID NO: 604677 - DNA, 25 bp, Rattus norvegicus
tagtgcaggtccaagtgtctccgtc

SEQ ID NO: 604678 - DNA, 25 bp, Rattus norvegicus
ggtccaagtgtctccgtccaggcgt

SEQ ID NO: 604679 - DNA, 25 bp, Rattus norvegicus
tgtctccgtccaggcgtggcgtaga

SEQ ID NO: 604680 - DNA, 25 bp, Rattus norvegicus
atttatacccggtgggagctgccgc

SEQ ID NO: 604681 - DNA, 25 bp, Rattus norvegicus
gctgccgccgctatttatacccggt

SEQ ID NO: 604682 - DNA, 25 bp, Rattus norvegicus
gcacgaggatccctcgacgtgtccg

SEQ ID NO: 604683 - DNA, 25 bp, Rattus norvegicus
cgtagggaagcgcacgaggatccct

SEQ ID NO: 604684 - DNA, 25 bp, Rattus norvegicus
cgctcactgcatggcgcagatcagc

SEQ ID NO: 604685 - DNA, 25 bp, Rattus norvegicus
agggtcgctcactgcatggcgcaga

SEQ ID NO: 604686 - DNA, 25 bp, Rattus norvegicus
tcctgcgagtcccaagggccgctgt

SEQ ID NO: 604687 - DNA, 25 bp, Rattus norvegicus
agaatcattggcctgtctctcccgc

SEQ ID NO: 604688 - DNA, 25 bp, Rattus norvegicus
gcgtccaaagttcgcagtcgcctcg

SEQ ID NO: 604689 - DNA, 25 bp, Rattus norvegicus
ctgagttacctggaagcgcccaaga

SEQ ID NO: 604690 - DNA, 25 bp, Rattus norvegicus
gggatcaccgacaccatcagcgaag

SEQ ID NO: 604691 - DNA, 25 bp, Rattus norvegicus
tttctcggaggacaagagtccaaca

SEQ ID NO: 604692 - DNA, 25 bp, Rattus norvegicus
aagacccgcagctagtcgcgctcag

SEQ ID NO: 604693 - DNA, 25 bp, Rattus norvegicus
tccgatgactctgctaatgcctaga

SEQ ID NO: 604694 - DNA, 25 bp, Rattus norvegicus
tccaacaaaggccttcgcgaagctc

SEQ ID NO: 604695 - DNA, 25 bp, Rattus norvegicus
cgcgaagctctccagcgagttgaca

SEQ ID NO: 604696 - DNA, 25 bp, Rattus norvegicus
cccaaaatggcggacgtatcaagca

SEQ ID NO: 604697 - DNA, 25 bp, Rattus norvegicus
cgagttgacaagctccgggagatcc

SEQ ID NO: 604698 - DNA, 25 bp, Rattus norvegicus
tcccgagaagtcactggaaaggccc

SEQ ID NO: 604699 - DNA, 25 bp, Rattus norvegicus
gccagagtcacctcggcgtccaaag

SEQ ID NO: 604700 - DNA, 25 bp, Rattus norvegicus
actcaacggcggaggctgaagattc

SEQ ID NO: 604701 - DNA, 25 bp, Rattus norvegicus
atctcggtgttcacaagggtctgcg

SEQ ID NO: 604702 - DNA, 25 bp, Rattus norvegicus
gggatcattgatctcggtgttcaca

SEQ ID NO: 604703 - DNA, 25 bp, Rattus norvegicus
ccacggcaatgccatcgggatcatt

SEQ ID NO: 604704 - DNA, 25 bp, Rattus norvegicus
tatctgtccagtagaggttccgggc

SEQ ID NO: 604705 - DNA, 25 bp, Rattus norvegicus
ttctgtcagtgcctgtatctgtcca

SEQ ID NO: 604706 - DNA, 25 bp, Rattus norvegicus
gcgagtcacctcaattctgtcagtg

SEQ ID NO: 604707 - DNA, 25 bp, Rattus norvegicus
aggtgccgttgaggcgagtcacctc

SEQ ID NO: 604708 - DNA, 25 bp, Rattus norvegicus
cggacaccaggatctttcgggaggt

SEQ ID NO: 604709 - DNA, 25 bp, Rattus norvegicus
aagggtctgcgcacctgagccatcc

SEQ ID NO: 604710 - DNA, 25 bp, Rattus norvegicus
ggatagcccgcacctcgtcatctgt

SEQ ID NO: 604711 - DNA, 25 bp, Rattus norvegicus
tcgtcatctgtccagtacacgtagc

SEQ ID NO: 604712 - DNA, 25 bp, Rattus norvegicus
acacgtagccctccagtgggtcata

SEQ ID NO: 604713 - DNA, 25 bp, Rattus norvegicus
tccagtgggtcatagtcgatggcga

SEQ ID NO: 604714 - DNA, 25 bp, Rattus norvegicus
cgatggcgatggcatgccgaatgtc

SEQ ID NO: 604715 - DNA, 25 bp, Rattus norvegicus
cgcccgcaacttgcaaagtagctgg

SEQ ID NO: 604716 - DNA, 25 bp, Rattus norvegicus
aacttgcaaagtagctggggcggcc

SEQ ID NO: 604717 - DNA, 25 bp, Rattus norvegicus
ggccatcacgatgcccgtgggcgca

SEQ ID NO: 604718 - DNA, 25 bp, Rattus norvegicus
ataggccaggcctgtcccgggccat

SEQ ID NO: 604719 - DNA, 25 bp, Rattus norvegicus
tagttcgcgataggccaggcctgtc

SEQ ID NO: 604720 - DNA, 25 bp, Rattus norvegicus
aagttttcccagtagttcgcgatag

SEQ ID NO: 604721 - DNA, 25 bp, Rattus norvegicus
cgcaagcaggctcgcgaaaagtttt

SEQ ID NO: 604722 - DNA, 25 bp, Rattus norvegicus
aacttctggcacttcccagggctcg

SEQ ID NO: 604723 - DNA, 25 bp, Rattus norvegicus
aacttcctagcttgcaacttctggc

SEQ ID NO: 604724 - DNA, 25 bp, Rattus norvegicus
ggttttccgaacttcctagcttgca

SEQ ID NO: 604725 - DNA, 25 bp, Rattus norvegicus
gtcaacgagacagcagccagggcca

SEQ ID NO: 604726 - DNA, 25 bp, Rattus norvegicus
tgacagcccacgcaggtcaacgaga

SEQ ID NO: 604727 - DNA, 25 bp, Rattus norvegicus
tcaccggggcacctggcaggtgtca

SEQ ID NO: 604728 - DNA, 25 bp, Rattus norvegicus
gtcggcgccgtttccatgtcgtccg

SEQ ID NO: 604729 - DNA, 25 bp, Rattus norvegicus
gcgagccagcgacagcctattggtc

SEQ ID NO: 604730 - DNA, 25 bp, Rattus norvegicus
agcactctacggacactcgacagta

SEQ ID NO: 604731 - DNA, 25 bp, Rattus norvegicus
gggcagtttgcgagcactctacgga

SEQ ID NO: 604732 - DNA, 25 bp, Rattus norvegicus
tcgccatccgatcctgggcagtttg

SEQ ID NO: 604733 - DNA, 25 bp, Rattus norvegicus
gggttgacggctatcgccatccgat

SEQ ID NO: 604734 - DNA, 25 bp, Rattus norvegicus
cgagcccttagagaagcatggatgc

SEQ ID NO: 604735 - DNA, 25 bp, Rattus norvegicus
cccatgaactggttggggatggaca

SEQ ID NO: 604736 - DNA, 25 bp, Rattus norvegicus
ctgccgtccagggaactgtcgtgaa

SEQ ID NO: 604737 - DNA, 25 bp, Rattus norvegicus
tgaatcgctgaagtggctgcgctgc

SEQ ID NO: 604738 - DNA, 25 bp, Rattus norvegicus
ctaactgggtttcgctgcggtccac

SEQ ID NO: 604739 - DNA, 25 bp, Rattus norvegicus
cagtgagatcagctaactgggtttc

SEQ ID NO: 604740 - DNA, 25 bp, Rattus norvegicus
ggggctcagcgctcaccagtgagat

SEQ ID NO: 604741 - DNA, 25 bp, Rattus norvegicus
gtcctgccttcgtgacgtctttccg

SEQ ID NO: 604742 - DNA, 25 bp, Rattus norvegicus
cagcctattggtcctgccttcgtga

SEQ ID NO: 604743 - DNA, 25 bp, Rattus norvegicus
ctcgaccgcttatccagcatgaaaa

SEQ ID NO: 604744 - DNA, 25 bp, Rattus norvegicus
caagtccgcgaaggcgccaccttgt

SEQ ID NO: 604745 - DNA, 25 bp, Rattus norvegicus
tcagtgaagccggtgagccattccc

SEQ ID NO: 604746 - DNA, 25 bp, Rattus norvegicus
gtctctcgtcactgctgctcggcgt

SEQ ID NO: 604747 - DNA, 25 bp, Rattus norvegicus
ggctctccgcgtgctactctgtaaa

SEQ ID NO: 604748 - DNA, 25 bp, Rattus norvegicus
tgtgatgcgccgcagtgtccaatca

SEQ ID NO: 604749 - DNA, 25 bp, Rattus norvegicus
ctgcgcatggatccaggagcacaca

SEQ ID NO: 604750 - DNA, 25 bp, Rattus norvegicus
tcatcaggtcggtgactgcggcacc

SEQ ID NO: 604751 - DNA, 25 bp, Rattus norvegicus
ccaccttgtgagtgctggcaaccga

SEQ ID NO: 604752 - DNA, 25 bp, Rattus norvegicus
atgaaaaccaagttctgcaccgggg

SEQ ID NO: 604753 - DNA, 25 bp, Rattus norvegicus
cttcgcgaggaccagttccacatca

SEQ ID NO: 604754 - DNA, 25 bp, Rattus norvegicus
ggcctacctgtggtgcaaggaattc

SEQ ID NO: 604755 - DNA, 25 bp, Rattus norvegicus
gccgctagcggacgaacaacccgag

SEQ ID NO: 604756 - DNA, 25 bp, Rattus norvegicus
ctgtgccgcagccaatgggaaagcg

SEQ ID NO: 604757 - DNA, 25 bp, Rattus norvegicus
agcacgaggagtgctgctcacgacc

SEQ ID NO: 604758 - DNA, 25 bp, Rattus norvegicus
gtcggacactgttcacgaactgctc

SEQ ID NO: 604759 - DNA, 25 bp, Rattus norvegicus
gaggttgtgtcacttccgccgacca

SEQ ID NO: 604760 - DNA, 25 bp, Rattus norvegicus
tccggaatgtccctagcggaagtca

SEQ ID NO: 604761 - DNA, 25 bp, Rattus norvegicus
tgctccagagcagacgccatgtttc

SEQ ID NO: 604762 - DNA, 25 bp, Rattus norvegicus
accagtgacggccaagggaccaatg

SEQ ID NO: 604763 - DNA, 25 bp, Rattus norvegicus
cctcaccttgagctgagagctgtcg

SEQ ID NO: 604764 - DNA, 25 bp, Rattus norvegicus
gctaagggcggtcccaacatccgca

SEQ ID NO: 604765 - DNA, 25 bp, Rattus norvegicus
caggtccaggagaaggtagagctaa

SEQ ID NO: 604766 - DNA, 25 bp, Rattus norvegicus
tgcgctcctaccctaagtaccaagg

SEQ ID NO: 604767 - DNA, 25 bp, Rattus norvegicus
ccggcgacccactaaagcctggagg

SEQ ID NO: 604768 - DNA, 25 bp, Rattus norvegicus
gaaggaaagtctccacggcccgaga

SEQ ID NO: 604769 - DNA, 25 bp, Rattus norvegicus
agggaccaatggacgctccggaatg

SEQ ID NO: 604770 - DNA, 25 bp, Rattus norvegicus
tggtggccaaagcaacagaggtagc

SEQ ID NO: 604771 - DNA, 25 bp, Rattus norvegicus
gcaggatactcacctacgtagactc

SEQ ID NO: 604772 - DNA, 25 bp, Rattus norvegicus
atggttctggaggtcccggaatcgt

SEQ ID NO: 604773 - DNA, 25 bp, Rattus norvegicus
ccgctgagttgcctccacccggagt

SEQ ID NO: 604774 - DNA, 25 bp, Rattus norvegicus
agacccttgtccaggcggagaaagc

SEQ ID NO: 604775 - DNA, 25 bp, Rattus norvegicus
gctcctcagtttagcaggatactca

SEQ ID NO: 604776 - DNA, 25 bp, Rattus norvegicus
gcggggagactagacccttgtccag

SEQ ID NO: 604777 - DNA, 25 bp, Rattus norvegicus
cgtagactcgtctctcaactcagga

SEQ ID NO: 604778 - DNA, 25 bp, Rattus norvegicus
tcgtctctcaactcaggacttagga

SEQ ID NO: 604779 - DNA, 25 bp, Rattus norvegicus
caggacttaggatctgagcccgccc

SEQ ID NO: 604780 - DNA, 25 bp, Rattus norvegicus
tgcagctcactccagctccgaaata

SEQ ID NO: 604781 - DNA, 25 bp, Rattus norvegicus
tccagctccgaaataccagagtggg

SEQ ID NO: 604782 - DNA, 25 bp, Rattus norvegicus
ctccgaaataccagagtgggcgtgg

SEQ ID NO: 604783 - DNA, 25 bp, Rattus norvegicus
atgaaatggttctggaggtcccgga

SEQ ID NO: 604784 - DNA, 25 bp, Rattus norvegicus
gctggggctcctcagtttagcagga

SEQ ID NO: 604785 - DNA, 25 bp, Rattus norvegicus
ggtcagtggtgacacccgtccgacc

SEQ ID NO: 604786 - DNA, 25 bp, Rattus norvegicus
gcctaagttcgggatgctgccattg

SEQ ID NO: 604787 - DNA, 25 bp, Rattus norvegicus
cgtccctggcccaggtgcgggtcaa

SEQ ID NO: 604788 - DNA, 25 bp, Rattus norvegicus
ccaccttgaagtgcagcggctccgt

SEQ ID NO: 604789 - DNA, 25 bp, Rattus norvegicus
cttgccttggacacccaccttgaag

SEQ ID NO: 604790 - DNA, 25 bp, Rattus norvegicus
cgaccctgtcgttgcgtcacccaaa

SEQ ID NO: 604791 - DNA, 25 bp, Rattus norvegicus
cttcacgaggtcagtggtgacaccc

SEQ ID NO: 604792 - DNA, 25 bp, Rattus norvegicus
gatacaagacttcacgaggtcagtg

SEQ ID NO: 604793 - DNA, 25 bp, Rattus norvegicus
gccgacccgctagatacaagacttc

SEQ ID NO: 604794 - DNA, 25 bp, Rattus norvegicus
gtccggagccgacccgctagataca

SEQ ID NO: 604795 - DNA, 25 bp, Rattus norvegicus
gcacagaagccgcaggtccggagcc

SEQ ID NO: 604796 - DNA, 25 bp, Rattus norvegicus
gcgtttggcccgcagttcgcgaaag

SEQ ID NO: 604797 - DNA, 25 bp, Rattus norvegicus
atgctgccattggacgagcttctca

SEQ ID NO: 604798 - DNA, 25 bp, Rattus norvegicus
cagttcgcgaaagggcacagaagcc

SEQ ID NO: 604799 - DNA, 25 bp, Rattus norvegicus
ctaggtaaaaggagcattcggtctc

SEQ ID NO: 604800 - DNA, 25 bp, Rattus norvegicus
gtcctcctgactgcccacagccggg

SEQ ID NO: 604801 - DNA, 25 bp, Rattus norvegicus
caggtcctcctgactgcccacagcc

SEQ ID NO: 604802 - DNA, 25 bp, Rattus norvegicus
ggagcattcggtctcctttgttcca

SEQ ID NO: 604803 - DNA, 25 bp, Rattus norvegicus
taggtaaaaggagcattcggtctcc

SEQ ID NO: 604804 - DNA, 25 bp, Rattus norvegicus
atggagtgggattcctcgtccgctc

SEQ ID NO: 604805 - DNA, 25 bp, Rattus norvegicus
gcctaggtaaaaggagcattcggtc

SEQ ID NO: 604806 - DNA, 25 bp, Rattus norvegicus
cgcctaggtaaaaggagcattcggt

SEQ ID NO: 604807 - DNA, 25 bp, Rattus norvegicus
cccgcctaggtaaaaggagcattcg

SEQ ID NO: 604808 - DNA, 25 bp, Rattus norvegicus
tcccgcctaggtaaaaggagcattc

SEQ ID NO: 604809 - DNA, 25 bp, Rattus norvegicus
ctcccgcctaggtaaaaggagcatt

SEQ ID NO: 604810 - DNA, 25 bp, Rattus norvegicus
cgctcccgcctaggtaaaaggagca

SEQ ID NO: 604811 - DNA, 25 bp, Rattus norvegicus
ggagtgggattcctcgtccgctccc

SEQ ID NO: 604812 - DNA, 25 bp, Rattus norvegicus
aaggagcattcggtctcctttgttc

SEQ ID NO: 604813 - DNA, 25 bp, Rattus norvegicus
ggtacgccggcttgccgacgcacta

SEQ ID NO: 604814 - DNA, 25 bp, Rattus norvegicus
tagcacggaccactgccgggttacg

SEQ ID NO: 604815 - DNA, 25 bp, Rattus norvegicus
cctcacttgcggactggtgtcaccg

SEQ ID NO: 604816 - DNA, 25 bp, Rattus norvegicus
ctgactgcctgtccgcagaggacga

SEQ ID NO: 604817 - DNA, 25 bp, Rattus norvegicus
tgctctacactctgcgctctagtcg

SEQ ID NO: 604818 - DNA, 25 bp, Rattus norvegicus
ctagtcgcctggttgggaggcacaa

SEQ ID NO: 604819 - DNA, 25 bp, Rattus norvegicus
gcacaaaggggaagtcaggtacgcc

SEQ ID NO: 604820 - DNA, 25 bp, Rattus norvegicus
gacgcactacctgtggcccgcatat

SEQ ID NO: 604821 - DNA, 25 bp, Rattus norvegicus
tggcccgcatatccctctgaatttt

SEQ ID NO: 604822 - DNA, 25 bp, Rattus norvegicus
cccttattgcaaactggagagagac

SEQ ID NO: 604823 - DNA, 25 bp, Rattus norvegicus
ttgacttcgccctcagcaaaaattg

SEQ ID NO: 604824 - DNA, 25 bp, Rattus norvegicus
cagcaaaaattgaggacaccggggt

SEQ ID NO: 604825 - DNA, 25 bp, Rattus norvegicus
accggggtcgatatcgcaccactcg

SEQ ID NO: 604826 - DNA, 25 bp, Rattus norvegicus
gacgtctgggacatgctgcctgact

SEQ ID NO: 604827 - DNA, 25 bp, Rattus norvegicus
gaataatccggtggagaacccagta

SEQ ID NO: 604828 - DNA, 25 bp, Rattus norvegicus
tcctgacagaagaacgcgcgtggct

SEQ ID NO: 604829 - DNA, 25 bp, Rattus norvegicus
ctggaagccacggagaaccgctgcc

SEQ ID NO: 604830 - DNA, 25 bp, Rattus norvegicus
agtccaggcgcagcctagagctttc

SEQ ID NO: 604831 - DNA, 25 bp, Rattus norvegicus
aaccacctggccgaggagcagaagt

SEQ ID NO: 604832 - DNA, 25 bp, Rattus norvegicus
tcaccaggaaagagtagaaaccacc

SEQ ID NO: 604833 - DNA, 25 bp, Rattus norvegicus
tctctcctgggaggatccgtcacca

SEQ ID NO: 604834 - DNA, 25 bp, Rattus norvegicus
ggctcctacggagcagctcctgaca

SEQ ID NO: 604835 - DNA, 25 bp, Rattus norvegicus
ctaggcttggcttctccggacagaa

SEQ ID NO: 604836 - DNA, 25 bp, Rattus norvegicus
gccctcgtcgcactaggcttggctt

SEQ ID NO: 604837 - DNA, 25 bp, Rattus norvegicus
ccggggctgagccttgcaaacaagt

SEQ ID NO: 604838 - DNA, 25 bp, Rattus norvegicus
gagccaggagcctttttccgggcgc

SEQ ID NO: 604839 - DNA, 25 bp, Rattus norvegicus
gagaacccagtacaggaccgaagtc

SEQ ID NO: 604840 - DNA, 25 bp, Rattus norvegicus
cagcacggagggcaacgaactgatc

SEQ ID NO: 604841 - DNA, 25 bp, Rattus norvegicus
cccgcagccagaggcgtgtccagat

SEQ ID NO: 604842 - DNA, 25 bp, Rattus norvegicus
ggaagtgcgtcacacgtcccgcagc

SEQ ID NO: 604843 - DNA, 25 bp, Rattus norvegicus
ccggcgcgacagaaacacacgggtg

SEQ ID NO: 604844 - DNA, 25 bp, Rattus norvegicus
tccgaaccgagggaccggcgcgaca

SEQ ID NO: 604845 - DNA, 25 bp, Rattus norvegicus
agcatcgcggaagccggaccagtca

SEQ ID NO: 604846 - DNA, 25 bp, Rattus norvegicus
aatgccgtgctgctagcatcgcgga

SEQ ID NO: 604847 - DNA, 25 bp, Rattus norvegicus
agacgcacagatacccgcacgggaa

SEQ ID NO: 604848 - DNA, 25 bp, Rattus norvegicus
tgccgctgctgagacgcacagatac

SEQ ID NO: 604849 - DNA, 25 bp, Rattus norvegicus
gccagaatcagggtgggcctcaccg

SEQ ID NO: 604850 - DNA, 25 bp, Rattus norvegicus
gaggcgtgtccagatgcctccgcgc

SEQ ID NO: 604851 - DNA, 25 bp, Rattus norvegicus
agtcccgagttggaaccgctcattt

SEQ ID NO: 604852 - DNA, 25 bp, Rattus norvegicus
gctcatttttaatccaggccgggta

SEQ ID NO: 604853 - DNA, 25 bp, Rattus norvegicus
accgacccgccgagaaaatgccgtg

SEQ ID NO: 604854 - DNA, 25 bp, Rattus norvegicus
ggagagcatcagtcccgagttggaa

SEQ ID NO: 604855 - DNA, 25 bp, Rattus norvegicus
ctgcgtagacagaggtgtggactca

SEQ ID NO: 604856 - DNA, 25 bp, Rattus norvegicus
agctcggcaactcccggctcctgcc

SEQ ID NO: 604857 - DNA, 25 bp, Rattus norvegicus
aatcgggtagcggagctcggcaact

SEQ ID NO: 604858 - DNA, 25 bp, Rattus norvegicus
tcaacacagtggagggaatcgggta

SEQ ID NO: 604859 - DNA, 25 bp, Rattus norvegicus
ccggatgctgagtcaacacagtgga

SEQ ID NO: 604860 - DNA, 25 bp, Rattus norvegicus
gctgggcggcgcgaacttactagct

SEQ ID NO: 604861 - DNA, 25 bp, Rattus norvegicus
ccagagccgccagccttataagggg

SEQ ID NO: 604862 - DNA, 25 bp, Rattus norvegicus
cgatgaagtatctcagacgcagacg

SEQ ID NO: 604863 - DNA, 25 bp, Rattus norvegicus
tgtggactcaaagctgcgtggacga

SEQ ID NO: 604864 - DNA, 25 bp, Rattus norvegicus
ccagccttataaggggcattgcgcc

SEQ ID NO: 604865 - DNA, 25 bp, Rattus norvegicus
ttactagctgctgcgtagacagagg

SEQ ID NO: 604866 - DNA, 25 bp, Rattus norvegicus
gcgaacttactagctgctgcgtaga

SEQ ID NO: 604867 - DNA, 25 bp, Rattus norvegicus
gctgcgtggacgatgaagtatctca

SEQ ID NO: 604868 - DNA, 25 bp, Rattus norvegicus
ctcagacgcagacgaataaaggccc

SEQ ID NO: 604869 - DNA, 25 bp, Rattus norvegicus
gcgtgcagatcgcttgccaatcaga

SEQ ID NO: 604870 - DNA, 25 bp, Rattus norvegicus
tcgaggtcttgtagagaaacggctc

SEQ ID NO: 604871 - DNA, 25 bp, Rattus norvegicus
gcctgcaggggcaagattcagccaa

SEQ ID NO: 604872 - DNA, 25 bp, Rattus norvegicus
tgacagctgagcacaccaatcgaga

SEQ ID NO: 604873 - DNA, 25 bp, Rattus norvegicus
caccaatcgagagtgaggaacggtc

SEQ ID NO: 604874 - DNA, 25 bp, Rattus norvegicus
ttccggccggagctctatttaccag

SEQ ID NO: 604875 - DNA, 25 bp, Rattus norvegicus
taatcggattgaaagcgcgccggcc

SEQ ID NO: 604876 - DNA, 25 bp, Rattus norvegicus
gctctatttaccaggggcgtgcaga

SEQ ID NO: 604877 - DNA, 25 bp, Rattus norvegicus
cccgaactcgccaattgaggaggac

SEQ ID NO: 604878 - DNA, 25 bp, Rattus norvegicus
cgccgcactaaggagttgggatgtc

SEQ ID NO: 604879 - DNA, 25 bp, Rattus norvegicus
gtccctacaggtgaggcgccaactc

SEQ ID NO: 604880 - DNA, 25 bp, Rattus norvegicus
actccaccgttgctcgtcttattcg

SEQ ID NO: 604881 - DNA, 25 bp, Rattus norvegicus
tcttattcgggcagtcgaggtcttg

SEQ ID NO: 604882 - DNA, 25 bp, Rattus norvegicus
ctcggacctcgggactaatcggatt

SEQ ID NO: 604883 - DNA, 25 bp, Rattus norvegicus
gggcacaacgaactcccaccttgtg

SEQ ID NO: 604884 - DNA, 25 bp, Rattus norvegicus
aagggataccagtggaccgctcctg

SEQ ID NO: 604885 - DNA, 25 bp, Rattus norvegicus
cgctcctgcaccagcctggaatggg

SEQ ID NO: 604886 - DNA, 25 bp, Rattus norvegicus
agtcggtgaagaccaagggtgcata

SEQ ID NO: 604887 - DNA, 25 bp, Rattus norvegicus
gtgcatacagttcaggacccgcgtc

SEQ ID NO: 604888 - DNA, 25 bp, Rattus norvegicus
cgtcccggctagagtggtgaaagca

SEQ ID NO: 604889 - DNA, 25 bp, Rattus norvegicus
ttgcacaggctcatgagggctgctt

SEQ ID NO: 604890 - DNA, 25 bp, Rattus norvegicus
ggcgcccaccaaaagctagaggtga

SEQ ID NO: 604891 - DNA, 25 bp, Rattus norvegicus
tctaggagtgaagtacacggaaccc

SEQ ID NO: 604892 - DNA, 25 bp, Rattus norvegicus
cctaaggttctggtcttggaagcca

SEQ ID NO: 604893 - DNA, 25 bp, Rattus norvegicus
tgctgttttggtaagcgctggacgc

SEQ ID NO: 604894 - DNA, 25 bp, Rattus norvegicus
gctacgtggaaaagaggtcagctct

SEQ ID NO: 604895 - DNA, 25 bp, Rattus norvegicus
ggtcagctctgagcctttctgctgc

SEQ ID NO: 604896 - DNA, 25 bp, Rattus norvegicus
acaccttggtggacatgggtctagg

SEQ ID NO: 604897 - DNA, 25 bp, Rattus norvegicus
atgcgcaccgcgcttcagaagagag

SEQ ID NO: 604898 - DNA, 25 bp, Rattus norvegicus
gctcggtagcttccggacctgtttc

SEQ ID NO: 604899 - DNA, 25 bp, Rattus norvegicus
cggcaacttccggactcgctcggta

SEQ ID NO: 604900 - DNA, 25 bp, Rattus norvegicus
tcttgcgatgagatccgccatcctc

SEQ ID NO: 604901 - DNA, 25 bp, Rattus norvegicus
cccgtcctctcgaagtcttgcgatg

SEQ ID NO: 604902 - DNA, 25 bp, Rattus norvegicus
acgcttttggatcccgtcctctcga

SEQ ID NO: 604903 - DNA, 25 bp, Rattus norvegicus
ggccctcctgtatcacacgcttttg

SEQ ID NO: 604904 - DNA, 25 bp, Rattus norvegicus
tgaaattccggcaactctcctcggc

SEQ ID NO: 604905 - DNA, 25 bp, Rattus norvegicus
gaggatggacacaaaccttagtgcc

SEQ ID NO: 604906 - DNA, 25 bp, Rattus norvegicus
ttgggcatgcgcaacctctcaccta

SEQ ID NO: 604907 - DNA, 25 bp, Rattus norvegicus
tagggtgactagcagctgcgctttg

SEQ ID NO: 604908 - DNA, 25 bp, Rattus norvegicus
ccgcatgtaagaggtagggtgacta

SEQ ID NO: 604909 - DNA, 25 bp, Rattus norvegicus
gtcgagctccgcatgtaagaggtag

SEQ ID NO: 604910 - DNA, 25 bp, Rattus norvegicus
ccttagtgccatcctgaaattccgg

SEQ ID NO: 604911 - DNA, 25 bp, Rattus norvegicus
caccttctccgggagcgtgtccctt

SEQ ID NO: 604912 - DNA, 25 bp, Rattus norvegicus
tgcggactttgagggcggcttcctc

SEQ ID NO: 604913 - DNA, 25 bp, Rattus norvegicus
cctgcgcgtctgtccgcggaggagg

SEQ ID NO: 604914 - DNA, 25 bp, Rattus norvegicus
tgcgtctgcccagggccttgggcga

SEQ ID NO: 604915 - DNA, 25 bp, Rattus norvegicus
tgccccgctacgagctgagcggagc

SEQ ID NO: 604916 - DNA, 25 bp, Rattus norvegicus
ccctgcgggtgctagtggacatgga

SEQ ID NO: 604917 - DNA, 25 bp, Rattus norvegicus
tgtcggagcagtacggacgtctgca

SEQ ID NO: 604918 - DNA, 25 bp, Rattus norvegicus
gagcagtacggacgtctgcagcctg

SEQ ID NO: 604919 - DNA, 25 bp, Rattus norvegicus
agtacggacgtctgcagcctgggct

SEQ ID NO: 604920 - DNA, 25 bp, Rattus norvegicus
cagcctgggctgagcgtgagcacct

SEQ ID NO: 604921 - DNA, 25 bp, Rattus norvegicus
tgagcgtgagcacctgccggccctg

SEQ ID NO: 604922 - DNA, 25 bp, Rattus norvegicus
catggacggcgtgcttgcggacttt

SEQ ID NO: 604923 - DNA, 25 bp, Rattus norvegicus
gatcagcacccacgtcgcgcccacc

SEQ ID NO: 604924 - DNA, 25 bp, Rattus norvegicus
cttcccggacctgcccttcgtggcg

SEQ ID NO: 604925 - DNA, 25 bp, Rattus norvegicus
cgcgagactctgacgtgattcccga

SEQ ID NO: 604926 - DNA, 25 bp, Rattus norvegicus
cccgattcgaggtgactgatgaaga

SEQ ID NO: 604927 - DNA, 25 bp, Rattus norvegicus
acgccttcgagctgaccctggagga

SEQ ID NO: 604928 - DNA, 25 bp, Rattus norvegicus
ccagttcagcatcgatgacgccttc

SEQ ID NO: 604929 - DNA, 25 bp, Rattus norvegicus
gcaaatcttcgctcctagggctaca

SEQ ID NO: 604930 - DNA, 25 bp, Rattus norvegicus
ggccgttgtagagggcaaatcttcg

SEQ ID NO: 604931 - DNA, 25 bp, Rattus norvegicus
ttcccgaatcaactcggcattctgc

SEQ ID NO: 604932 - DNA, 25 bp, Rattus norvegicus
ctcaccttcttgtccgggatagggc

SEQ ID NO: 604933 - DNA, 25 bp, Rattus norvegicus
tgtcgctcaccaaggtagcctctgg

SEQ ID NO: 604934 - DNA, 25 bp, Rattus norvegicus
ggcattctgcactcaggcctgtgga

SEQ ID NO: 604935 - DNA, 25 bp, Rattus norvegicus
cggagaagtctaatgccggagcctc

SEQ ID NO: 604936 - DNA, 25 bp, Rattus norvegicus
ccggagcctcttcctagagatgcca

SEQ ID NO: 604937 - DNA, 25 bp, Rattus norvegicus
tggccctgctgtctcaccttcttgt

SEQ ID NO: 604938 - DNA, 25 bp, Rattus norvegicus
gtcccggctacgctaccaggtgaat

SEQ ID NO: 604939 - DNA, 25 bp, Rattus norvegicus
gtctaaatcaaacacggccgccatg

SEQ ID NO: 604940 - DNA, 25 bp, Rattus norvegicus
ctgtcggaatgcctctcgggagtcg

SEQ ID NO: 604941 - DNA, 25 bp, Rattus norvegicus
gcccggagggaaacactcaccgcag

SEQ ID NO: 604942 - DNA, 25 bp, Rattus norvegicus
cccactctcaagtcgggttggaaga

SEQ ID NO: 604943 - DNA, 25 bp, Rattus norvegicus
tgttgacgcaagctagcctcaccgc

SEQ ID NO: 604944 - DNA, 25 bp, Rattus norvegicus
gcagccgcgcgctctgttgacgcaa

SEQ ID NO: 604945 - DNA, 25 bp, Rattus norvegicus
agccctaggcttgtgctctacgtca

SEQ ID NO: 604946 - DNA, 25 bp, Rattus norvegicus
accaggcagcgctctgactgacagc

SEQ ID NO: 604947 - DNA, 25 bp, Rattus norvegicus
ttcctcggtctccaagtctaaatca

SEQ ID NO: 604948 - DNA, 25 bp, Rattus norvegicus
gcagggttgaactccggctcgccct

SEQ ID NO: 604949 - DNA, 25 bp, Rattus norvegicus
actcaccgcagggttgaactccggc

SEQ ID NO: 604950 - DNA, 25 bp, Rattus norvegicus
aaaatggcgcctgtcggaatgcctc

SEQ ID NO: 604951 - DNA, 25 bp, Rattus norvegicus
gttggaagaaaaaatggcgcctgtc

SEQ ID NO: 604952 - DNA, 25 bp, Rattus norvegicus
ctctgactgacagccctaggcttgt

SEQ ID NO: 604953 - DNA, 25 bp, Rattus norvegicus
tgcctcctcagctgagcgtctcagg

SEQ ID NO: 604954 - DNA, 25 bp, Rattus norvegicus
tgcgcggactgagctaacatcaacc

SEQ ID NO: 604955 - DNA, 25 bp, Rattus norvegicus
tgagaacgaagtccacgcctgggcc

SEQ ID NO: 604956 - DNA, 25 bp, Rattus norvegicus
gcgtgcgtccgaccactgtgagaac

SEQ ID NO: 604957 - DNA, 25 bp, Rattus norvegicus
ttcagcttaaggaccacgggagtca

SEQ ID NO: 604958 - DNA, 25 bp, Rattus norvegicus
gtcagtgtgcacttggcgtccacca

SEQ ID NO: 604959 - DNA, 25 bp, Rattus norvegicus
gccgcatgtctctaggcacaggcca

SEQ ID NO: 604960 - DNA, 25 bp, Rattus norvegicus
ggcgccgatcaccagcagctgcttt

SEQ ID NO: 604961 - DNA, 25 bp, Rattus norvegicus
acgaacttcttgctgacgccgccgg

SEQ ID NO: 604962 - DNA, 25 bp, Rattus norvegicus
tcagaacacgatttgggccgcgtcc

SEQ ID NO: 604963 - DNA, 25 bp, Rattus norvegicus
gcggccgctcttgtctgaagaacta

SEQ ID NO: 604964 - DNA, 25 bp, Rattus norvegicus
cccgtgctcaccgaggaagtcagtg

SEQ ID NO: 604965 - DNA, 25 bp, Rattus norvegicus
gcacaggccactattcagcttaagg

SEQ ID NO: 604966 - DNA, 25 bp, Rattus norvegicus
agctgctttccgtccatgaggtggc

SEQ ID NO: 604967 - DNA, 25 bp, Rattus norvegicus
gtccgacagcgagaagctcaacctg

SEQ ID NO: 604968 - DNA, 25 bp, Rattus norvegicus
gccatgtccgacagcgagaagctca

SEQ ID NO: 604969 - DNA, 25 bp, Rattus norvegicus
acagcgagaagctcaacctggattc

SEQ ID NO: 604970 - DNA, 25 bp, Rattus norvegicus
cgagaagctcaacctggattccatc

SEQ ID NO: 604971 - DNA, 25 bp, Rattus norvegicus
aacctggattccatcatcgggcgcc

SEQ ID NO: 604972 - DNA, 25 bp, Rattus norvegicus
gggcccatcgccgtccggaagtaga

SEQ ID NO: 604973 - DNA, 25 bp, Rattus norvegicus
catcgccgtccggaagtagagcgcg

SEQ ID NO: 604974 - DNA, 25 bp, Rattus norvegicus
gacaggccgtgaggttctatggcca

SEQ ID NO: 604975 - DNA, 25 bp, Rattus norvegicus
cctaggctttggagcgcgctccgag

SEQ ID NO: 604976 - DNA, 25 bp, Rattus norvegicus
tccctgcgcctaggctttggagcgc

SEQ ID NO: 604977 - DNA, 25 bp, Rattus norvegicus
cgtgaggttctatggccacggcagc

SEQ ID NO: 604978 - DNA, 25 bp, Rattus norvegicus
ccacggcagccctccctactccctg

SEQ ID NO: 604979 - DNA, 25 bp, Rattus norvegicus
tggattccatcatcgggcgcctgct

SEQ ID NO: 604980 - DNA, 25 bp, Rattus norvegicus
gcgccgccatgtccgacagcgagaa

SEQ ID NO: 604981 - DNA, 25 bp, Rattus norvegicus
tggccggacccagcaggaaaaagtc

SEQ ID NO: 604982 - DNA, 25 bp, Rattus norvegicus
gcagcgcctcgagcggctgcctgac

SEQ ID NO: 604983 - DNA, 25 bp, Rattus norvegicus
ctgcctgactaggcggcccgtggca

SEQ ID NO: 604984 - DNA, 25 bp, Rattus norvegicus
ccgggcagggagtggacgcgacgga

SEQ ID NO: 604985 - DNA, 25 bp, Rattus norvegicus
agcgggcagcggctcattcgagccc

SEQ ID NO: 604986 - DNA, 25 bp, Rattus norvegicus
accgcagtggcctgggagtgattac

SEQ ID NO: 604987 - DNA, 25 bp, Rattus norvegicus
cccagcaggaaaaagtccgtcggcg

SEQ ID NO: 604988 - DNA, 25 bp, Rattus norvegicus
agcgccgagactgccggcagcgcct

SEQ ID NO: 604989 - DNA, 25 bp, Rattus norvegicus
tgcctggccggacccagcaggaaaa

SEQ ID NO: 604990 - DNA, 25 bp, Rattus norvegicus
ctgcctggccggacccagcaggaaa

SEQ ID NO: 604991 - DNA, 25 bp, Rattus norvegicus
tgattactgcgggagggatttgtgg

SEQ ID NO: 604992 - DNA, 25 bp, Rattus norvegicus
ggagtgattactgcgggagggattt

SEQ ID NO: 604993 - DNA, 25 bp, Rattus norvegicus
ccgcagtggcctgggagtgattact

SEQ ID NO: 604994 - DNA, 25 bp, Rattus norvegicus
cagcaggaaaaagtccgtcggcggc

SEQ ID NO: 604995 - DNA, 25 bp, Rattus norvegicus
aacagtaggttgcttggggctctgc

SEQ ID NO: 604996 - DNA, 25 bp, Rattus norvegicus
ctttttaaggcctgtgttgcggatc

SEQ ID NO: 604997 - DNA, 25 bp, Rattus norvegicus
agaaaacagggatcctccagtcgtg

SEQ ID NO: 604998 - DNA, 25 bp, Rattus norvegicus
tcaagcgtcagtgggcacgtgaccc

SEQ ID NO: 604999 - DNA, 25 bp, Rattus norvegicus
tgagcgccttcaaacagtaggttgc

SEQ ID NO: 605000 - DNA, 25 bp, Rattus norvegicus
actctgctggctttgagcgccttca

SEQ ID NO: 605001 - DNA, 25 bp, Rattus norvegicus
tggcgcgatgacgtacgacgacgca

SEQ ID NO: 605002 - DNA, 25 bp, Rattus norvegicus
cctactagagtgtcgctggcgcgat

SEQ ID NO: 605003 - DNA, 25 bp, Rattus norvegicus
cacgcattgcatcacggttttactg

SEQ ID NO: 605004 - DNA, 25 bp, Rattus norvegicus
gcccaaccttcgctgctacaagtta

SEQ ID NO: 605005 - DNA, 25 bp, Rattus norvegicus
gtcctacctgctggcgcaaggactc

SEQ ID NO: 605006 - DNA, 25 bp, Rattus norvegicus
cgaccttagtgtccctgcagggcta

SEQ ID NO: 605007 - DNA, 25 bp, Rattus norvegicus
tccagtcgtgtggaccgacccgagt

SEQ ID NO: 605008 - DNA, 25 bp, Rattus norvegicus
ctcgcggtggactccacgggctaca

SEQ ID NO: 605009 - DNA, 25 bp, Rattus norvegicus
ttcccatggaaacgagaggacattc

SEQ ID NO: 605010 - DNA, 25 bp, Rattus norvegicus
tctaccttgccgagtaggggccgaa

SEQ ID NO: 605011 - DNA, 25 bp, Rattus norvegicus
gtcgaactcttggatgccctgcctc

SEQ ID NO: 605012 - DNA, 25 bp, Rattus norvegicus
tgcccaggcctgaaaggtcgaactc

SEQ ID NO: 605013 - DNA, 25 bp, Rattus norvegicus
gttggttcaaacgagcagtagtctc

SEQ ID NO: 605014 - DNA, 25 bp, Rattus norvegicus
gcccgagcgtcgcagttggttcaaa

SEQ ID NO: 605015 - DNA, 25 bp, Rattus norvegicus
agaggacattcattgcgcctgtgcg

SEQ ID NO: 605016 - DNA, 25 bp, Rattus norvegicus
cctcagagaagaactgtcccgatta

SEQ ID NO: 605017 - DNA, 25 bp, Rattus norvegicus
ccttttatctgagggagcaatattc

SEQ ID NO: 605018 - DNA, 25 bp, Rattus norvegicus
ccggtcctgccttccttttatctga

SEQ ID NO: 605019 - DNA, 25 bp, Rattus norvegicus
taattgtcggcaaatccggtcctgc

SEQ ID NO: 605020 - DNA, 25 bp, Rattus norvegicus
gtccctggaggcaggtgaagttccc

SEQ ID NO: 605021 - DNA, 25 bp, Rattus norvegicus
cccggagaatttggcagtgttggtc

SEQ ID NO: 605022 - DNA, 25 bp, Rattus norvegicus
ctaataggcctgaggaatggacaca

SEQ ID NO: 605023 - DNA, 25 bp, Rattus norvegicus
tcccacaggcgtggagtggccactt

SEQ ID NO: 605024 - DNA, 25 bp, Rattus norvegicus
ccacttgccggtggcgagcgactca

SEQ ID NO: 605025 - DNA, 25 bp, Rattus norvegicus
tggcgagcgactcactgtgaccagc

SEQ ID NO: 605026 - DNA, 25 bp, Rattus norvegicus
cgccataaggcaggcaggccaggaa

SEQ ID NO: 605027 - DNA, 25 bp, Rattus norvegicus
caggccaggaacacctgggcgagca

SEQ ID NO: 605028 - DNA, 25 bp, Rattus norvegicus
aactatacggtcagtccctgccttc

SEQ ID NO: 605029 - DNA, 25 bp, Rattus norvegicus
cctgccttcgcacaaccaggaagaa

SEQ ID NO: 605030 - DNA, 25 bp, Rattus norvegicus
tcgcacaaccaggaagaagagattg

SEQ ID NO: 605031 - DNA, 25 bp, Rattus norvegicus
agagattggagcctggcacctcctc

SEQ ID NO: 605032 - DNA, 25 bp, Rattus norvegicus
ttaaagggcccgactcatgaccagt

SEQ ID NO: 605033 - DNA, 25 bp, Rattus norvegicus
gactcatgaccagtctggccgcata

SEQ ID NO: 605034 - DNA, 25 bp, Rattus norvegicus
catagagcccgtaccgagcgacagc

SEQ ID NO: 605035 - DNA, 25 bp, Rattus norvegicus
agtctggccgcatagagcccgtacc

SEQ ID NO: 605036 - DNA, 25 bp, Rattus norvegicus
tcactgtgaccagcgccataaggca

SEQ ID NO: 605037 - DNA, 25 bp, Rattus norvegicus
ctgtccagtctccagggcaaccata

SEQ ID NO: 605038 - DNA, 25 bp, Rattus norvegicus
atttgcccagactagccggtgcagc

SEQ ID NO: 605039 - DNA, 25 bp, Rattus norvegicus
caggaacagccggaacctcatttcg

SEQ ID NO: 605040 - DNA, 25 bp, Rattus norvegicus
cgtagctacggcaaccactgcaggc

SEQ ID NO: 605041 - DNA, 25 bp, Rattus norvegicus
ctacatggagttagggcgtggcctc

SEQ ID NO: 605042 - DNA, 25 bp, Rattus norvegicus
ttggcctgcgcctggcacgtctact

SEQ ID NO: 605043 - DNA, 25 bp, Rattus norvegicus
agtgaacggcccagcccttcttggc

SEQ ID NO: 605044 - DNA, 25 bp, Rattus norvegicus
cggcctccagttcgcggtgccgatt

SEQ ID NO: 605045 - DNA, 25 bp, Rattus norvegicus
cggctgtgcagtgcggcctccagtt

SEQ ID NO: 605046 - DNA, 25 bp, Rattus norvegicus
cagggcctcaccttgcggctgtgca

SEQ ID NO: 605047 - DNA, 25 bp, Rattus norvegicus
ggagtgaaaccaaccggatcagatc

SEQ ID NO: 605048 - DNA, 25 bp, Rattus norvegicus
agctacggggtggattccgcacctt

SEQ ID NO: 605049 - DNA, 25 bp, Rattus norvegicus
aacctcatttcgaagcgccagggtc

SEQ ID NO: 605050 - DNA, 25 bp, Rattus norvegicus
cggtgccgatttgcccagactagcc

SEQ ID NO: 605051 - DNA, 25 bp, Rattus norvegicus
gccgccattttgaacccgtcagatt

SEQ ID NO: 605052 - DNA, 25 bp, Rattus norvegicus
tcacacaaatgagggccaggcggcc

SEQ ID NO: 605053 - DNA, 25 bp, Rattus norvegicus
cccgcctctgctaggtggtcaaaca

SEQ ID NO: 605054 - DNA, 25 bp, Rattus norvegicus
cccactactctaggaagggttgtga

SEQ ID NO: 605055 - DNA, 25 bp, Rattus norvegicus
acacacgcacagagaacttcgcctg

SEQ ID NO: 605056 - DNA, 25 bp, Rattus norvegicus
tttcaggtctctcgctaggccggat

SEQ ID NO: 605057 - DNA, 25 bp, Rattus norvegicus
tctaacgcggatacaccgccggagc

SEQ ID NO: 605058 - DNA, 25 bp, Rattus norvegicus
tccgggacacacgtgaacgcgcacg

SEQ ID NO: 605059 - DNA, 25 bp, Rattus norvegicus
taaaaagcagcgcactcccgccggg

SEQ ID NO: 605060 - DNA, 25 bp, Rattus norvegicus
cgtcagattctcacatacacacagc

SEQ ID NO: 605061 - DNA, 25 bp, Rattus norvegicus
aggaggatccgctgaagcagccgcc

SEQ ID NO: 605062 - DNA, 25 bp, Rattus norvegicus
gctcctctgtgcagcgaaccggttt

SEQ ID NO: 605063 - DNA, 25 bp, Rattus norvegicus
catgccatagcagtgggccagacca

SEQ ID NO: 605064 - DNA, 25 bp, Rattus norvegicus
agctcctccgggcttactgcgcagg

SEQ ID NO: 605065 - DNA, 25 bp, Rattus norvegicus
aatgtacatgaggtcgctatgcacg

SEQ ID NO: 605066 - DNA, 25 bp, Rattus norvegicus
tgcacgctaggtctgcgagcaaagg

SEQ ID NO: 605067 - DNA, 25 bp, Rattus norvegicus
cacgctaggtctgcgagcaaagggc

SEQ ID NO: 605068 - DNA, 25 bp, Rattus norvegicus
taggtctgcgagcaaagggcgccaa

SEQ ID NO: 605069 - DNA, 25 bp, Rattus norvegicus
tctgcgagcaaagggcgccaagatg

SEQ ID NO: 605070 - DNA, 25 bp, Rattus norvegicus
tgcgagcaaagggcgccaagatgcc

SEQ ID NO: 605071 - DNA, 25 bp, Rattus norvegicus
atgccaaaggcatctccgtggtcgc

SEQ ID NO: 605072 - DNA, 25 bp, Rattus norvegicus
tgccaaaggcatctccgtggtcgcc

SEQ ID NO: 605073 - DNA, 25 bp, Rattus norvegicus
cgctatgcacgctaggtctgcgagc

SEQ ID NO: 605074 - DNA, 25 bp, Rattus norvegicus
aggtcgctatgcacgctaggtctgc

SEQ ID NO: 605075 - DNA, 25 bp, Rattus norvegicus
atgaggtcgctatgcacgctaggtc

SEQ ID NO: 605076 - DNA, 25 bp, Rattus norvegicus
tacatgaggtcgctatgcacgctag

SEQ ID NO: 605077 - DNA, 25 bp, Rattus norvegicus
tatgcacgctaggtctgcgagcaaa

SEQ ID NO: 605078 - DNA, 25 bp, Rattus norvegicus
tgtacatgaggtcgctatgcacgct

SEQ ID NO: 605079 - DNA, 25 bp, Rattus norvegicus
taggcacaacgctgagggtcatcgc

SEQ ID NO: 605080 - DNA, 25 bp, Rattus norvegicus
gaagcttcttgttcctcagagcctt

SEQ ID NO: 605081 - DNA, 25 bp, Rattus norvegicus
tcagagcctttttgtgcagcacgtc

SEQ ID NO: 605082 - DNA, 25 bp, Rattus norvegicus
agtactgcacagacaccttgcggtg

SEQ ID NO: 605083 - DNA, 25 bp, Rattus norvegicus
ccttgcggtgcaagtcagggctcat

SEQ ID NO: 605084 - DNA, 25 bp, Rattus norvegicus
tcagggctcatctcgctaggcagct

SEQ ID NO: 605085 - DNA, 25 bp, Rattus norvegicus
cagcttggccatggcaaagagcgca

SEQ ID NO: 605086 - DNA, 25 bp, Rattus norvegicus
aagagcgcacggaacatctggtcca

SEQ ID NO: 605087 - DNA, 25 bp, Rattus norvegicus
ctggtccaggctgctattcttcttg

SEQ ID NO: 605088 - DNA, 25 bp, Rattus norvegicus
gctattcttcttggccgagatctcg

SEQ ID NO: 605089 - DNA, 25 bp, Rattus norvegicus
ccgagatctcgaagtaggcacaacg

SEQ ID NO: 605090 - DNA, 25 bp, Rattus norvegicus
cgctgctccacttcgcggtagaagt

SEQ ID NO: 605091 - DNA, 25 bp, Rattus norvegicus
gctgcccgcacgcagaagcttcttg

SEQ ID NO: 605092 - DNA, 25 bp, Rattus norvegicus
tttgttaccgcaaatgaccagcggc

SEQ ID NO: 605093 - DNA, 25 bp, Rattus norvegicus
tcccacgccggcctccctcagttgg

SEQ ID NO: 605094 - DNA, 25 bp, Rattus norvegicus
taaacagccgggtgaaccgcgtgtg

SEQ ID NO: 605095 - DNA, 25 bp, Rattus norvegicus
tgccccgcgttggtgtgccagagca

SEQ ID NO: 605096 - DNA, 25 bp, Rattus norvegicus
cagacgcacggagtgtgaggggccc

SEQ ID NO: 605097 - DNA, 25 bp, Rattus norvegicus
cgcaaggagagggactgagtgcatc

SEQ ID NO: 605098 - DNA, 25 bp, Rattus norvegicus
gactgagtgcatcggtccccatgcc

SEQ ID NO: 605099 - DNA, 25 bp, Rattus norvegicus
ggtccccatgcccagggcgcttgtg

SEQ ID NO: 605100 - DNA, 25 bp, Rattus norvegicus
tcccggttctacctctgctcccacg

SEQ ID NO: 605101 - DNA, 25 bp, Rattus norvegicus
tccctcagttggctcgctcaggagc

SEQ ID NO: 605102 - DNA, 25 bp, Rattus norvegicus
tcagttggctcgctcaggagcccag

SEQ ID NO: 605103 - DNA, 25 bp, Rattus norvegicus
tacgccacccctgcagtgtagcggg

SEQ ID NO: 605104 - DNA, 25 bp, Rattus norvegicus
ctggagccgcgcctcacggatcggg

SEQ ID NO: 605105 - DNA, 25 bp, Rattus norvegicus
tcgaacggagcagcgccgcagtccg

SEQ ID NO: 605106 - DNA, 25 bp, Rattus norvegicus
gacgcaggtccgactcccggttcta

SEQ ID NO: 605107 - DNA, 25 bp, Rattus norvegicus
gtgcccttagctaacgtttctcctg

SEQ ID NO: 605108 - DNA, 25 bp, Rattus norvegicus
gcgacctcttctgtatctgctaaag

SEQ ID NO: 605109 - DNA, 25 bp, Rattus norvegicus
ctgctaaagagtacgtgcatctggc

SEQ ID NO: 605110 - DNA, 25 bp, Rattus norvegicus
gcggtttgaagagacacgtgctact

SEQ ID NO: 605111 - DNA, 25 bp, Rattus norvegicus
ctcgagtgaatgaattgcaggtccc

SEQ ID NO: 605112 - DNA, 25 bp, Rattus norvegicus
ggatgagcttccagacggaccactt

SEQ ID NO: 605113 - DNA, 25 bp, Rattus norvegicus
cccacgtgaggcttacaaggaaagg

SEQ ID NO: 605114 - DNA, 25 bp, Rattus norvegicus
gtgaggcgccaacgcttaaacgcga

SEQ ID NO: 605115 - DNA, 25 bp, Rattus norvegicus
gatagggtcattcatccaatctttg

SEQ ID NO: 605116 - DNA, 25 bp, Rattus norvegicus
ctcaaccaatggaaagtcttacggg

SEQ ID NO: 605117 - DNA, 25 bp, Rattus norvegicus
cggagccagtgctgcagcaagtttg

SEQ ID NO: 605118 - DNA, 25 bp, Rattus norvegicus
accgcagctgttccctgtcagtgga

SEQ ID NO: 605119 - DNA, 25 bp, Rattus norvegicus
tgtccgcggcattctgcaccttact

SEQ ID NO: 605120 - DNA, 25 bp, Rattus norvegicus
gcttatataagggttgcgcgcgcca

SEQ ID NO: 605121 - DNA, 25 bp, Rattus norvegicus
gcgttgtcccaaggcgctgccgcag

SEQ ID NO: 605122 - DNA, 25 bp, Rattus norvegicus
acgggtctttgtcacatgtctctgg

SEQ ID NO: 605123 - DNA, 25 bp, Rattus norvegicus
accatctcccagagacgggtctttg

SEQ ID NO: 605124 - DNA, 25 bp, Rattus norvegicus
agacaaagcgccagctctaaggccc

SEQ ID NO: 605125 - DNA, 25 bp, Rattus norvegicus
caaatccctggcgtggactgtggct

SEQ ID NO: 605126 - DNA, 25 bp, Rattus norvegicus
agcatcctgtaaccgctcaggcggg

SEQ ID NO: 605127 - DNA, 25 bp, Rattus norvegicus
gcgcgccacgaacacgcacgtggag

SEQ ID NO: 605128 - DNA, 25 bp, Rattus norvegicus
gctcacctggtgtccgtcgctcagg

SEQ ID NO: 605129 - DNA, 25 bp, Rattus norvegicus
ctgaaggtcacaaccgttctgcatc

SEQ ID NO: 605130 - DNA, 25 bp, Rattus norvegicus
ggccgggtgcaaacccgcactgtta

SEQ ID NO: 605131 - DNA, 25 bp, Rattus norvegicus
cactgttactgggaccctcgcgttc

SEQ ID NO: 605132 - DNA, 25 bp, Rattus norvegicus
tgggaccctcgcgttcgcagataca

SEQ ID NO: 605133 - DNA, 25 bp, Rattus norvegicus
ttcgcagatacacactgaaggtcac

SEQ ID NO: 605134 - DNA, 25 bp, Rattus norvegicus
gctctgcagacaaccagacaaagcg

SEQ ID NO: 605135 - DNA, 25 bp, Rattus norvegicus
aatatataacacacgcgtcccgggc

SEQ ID NO: 605136 - DNA, 25 bp, Rattus norvegicus
ccttgccttgctgtgagtctcagga

SEQ ID NO: 605137 - DNA, 25 bp, Rattus norvegicus
ctcagccactcggacaggttggaga

SEQ ID NO: 605138 - DNA, 25 bp, Rattus norvegicus
tggagacctcctgtagccacaagtc

SEQ ID NO: 605139 - DNA, 25 bp, Rattus norvegicus
tagccacaagtcctgcgggagcagc

SEQ ID NO: 605140 - DNA, 25 bp, Rattus norvegicus
gcctgaactccgtcgttggccactt

SEQ ID NO: 605141 - DNA, 25 bp, Rattus norvegicus
cccttgcactgtagttgacactgtg

SEQ ID NO: 605142 - DNA, 25 bp, Rattus norvegicus
ctggccgcgataccgacagtaaacg

SEQ ID NO: 605143 - DNA, 25 bp, Rattus norvegicus
ctgaagcaggagaacacagacaccc

SEQ ID NO: 605144 - DNA, 25 bp, Rattus norvegicus
tccacacgtagaggctgcccacgta

SEQ ID NO: 605145 - DNA, 25 bp, Rattus norvegicus
ggcagctcgctcttccacacgtaga

SEQ ID NO: 605146 - DNA, 25 bp, Rattus norvegicus
acactgtgtgcttggagcagcttta

SEQ ID NO: 605147 - DNA, 25 bp, Rattus norvegicus
ggccacttgggtctgtgatcctcta

SEQ ID NO: 605148 - DNA, 25 bp, Rattus norvegicus
atcctctagcagtgagggaggcctc

SEQ ID NO: 605149 - DNA, 25 bp, Rattus norvegicus
gtctcgccaagacgcggccctcggc

SEQ ID NO: 605150 - DNA, 25 bp, Rattus norvegicus
cccttcccgcccgaccgtgcgctcg

SEQ ID NO: 605151 - DNA, 25 bp, Rattus norvegicus
tgaagagcgcccacggcccggcagt

SEQ ID NO: 605152 - DNA, 25 bp, Rattus norvegicus
tttcaaagcgctctgaccgccctcg

SEQ ID NO: 605153 - DNA, 25 bp, Rattus norvegicus
ggcccttttcaaagcgctctgaccg

SEQ ID NO: 605154 - DNA, 25 bp, Rattus norvegicus
ctcggcccttttcaaagcgctctga

SEQ ID NO: 605155 - DNA, 25 bp, Rattus norvegicus
gagactttcccacggtctcgccaag

SEQ ID NO: 605156 - DNA, 25 bp, Rattus norvegicus
ccaggcggtgactcctgagactttc

SEQ ID NO: 605157 - DNA, 25 bp, Rattus norvegicus
aggccaggcggtgactcctgagact

SEQ ID NO: 605158 - DNA, 25 bp, Rattus norvegicus
tacaggtggcgcagctgccaaggtt

SEQ ID NO: 605159 - DNA, 25 bp, Rattus norvegicus
ctcgcttcagtaggcggatgggcgg

SEQ ID NO: 605160 - DNA, 25 bp, Rattus norvegicus
cctgaggcggctcgcttcagtaggc

SEQ ID NO: 605161 - DNA, 25 bp, Rattus norvegicus
aggcggtgactcctgagactttccc

SEQ ID NO: 605162 - DNA, 25 bp, Rattus norvegicus
tgcctgaggcggctcgcttcagtag

SEQ ID NO: 605163 - DNA, 25 bp, Rattus norvegicus
gtcgcctgggctcggagcacttctg

SEQ ID NO: 605164 - DNA, 25 bp, Rattus norvegicus
cagcgcatgtttttagcggtgcgtg

SEQ ID NO: 605165 - DNA, 25 bp, Rattus norvegicus
gggaactaccgaaggagcgacagtc

SEQ ID NO: 605166 - DNA, 25 bp, Rattus norvegicus
gcacttctggcagcgcatgttttta

SEQ ID NO: 605167 - DNA, 25 bp, Rattus norvegicus
atgcgatgcccagtgcccgggtcct

SEQ ID NO: 605168 - DNA, 25 bp, Rattus norvegicus
acgcgctcatggatcggggtcgcct

SEQ ID NO: 605169 - DNA, 25 bp, Rattus norvegicus
aagagttggactggcagacgcgctc

SEQ ID NO: 605170 - DNA, 25 bp, Rattus norvegicus
ccaggtatccctgtgaagactatgg

SEQ ID NO: 605171 - DNA, 25 bp, Rattus norvegicus
aggagcgacagtcctgcatttgccc

SEQ ID NO: 605172 - DNA, 25 bp, Rattus norvegicus
cactgcaggaacctagaggggccgc

SEQ ID NO: 605173 - DNA, 25 bp, Rattus norvegicus
gcgagctccagatggtcccgggcct

SEQ ID NO: 605174 - DNA, 25 bp, Rattus norvegicus
aggctattgtcctccttccgcggcg

SEQ ID NO: 605175 - DNA, 25 bp, Rattus norvegicus
tccgcacccaggtaggtgcagccgg

SEQ ID NO: 605176 - DNA, 25 bp, Rattus norvegicus
cctgtgcgggacatccaggtatccc

SEQ ID NO: 605177 - DNA, 25 bp, Rattus norvegicus
gttgctcatagtacgagtcgctgtg

SEQ ID NO: 605178 - DNA, 25 bp, Rattus norvegicus
gcggggctcctcagcggacccttag

SEQ ID NO: 605179 - DNA, 25 bp, Rattus norvegicus
tacgagtcgctgtgtgctctgcagc

SEQ ID NO: 605180 - DNA, 25 bp, Rattus norvegicus
gctctgcagcggctctgtctgggta

SEQ ID NO: 605181 - DNA, 25 bp, Rattus norvegicus
taggagaaggcgtgatgtccacttc

SEQ ID NO: 605182 - DNA, 25 bp, Rattus norvegicus
aaggcgtgatgtccacttccggccc

SEQ ID NO: 605183 - DNA, 25 bp, Rattus norvegicus
tcagcggacccttagctcgggcggc

SEQ ID NO: 605184 - DNA, 25 bp, Rattus norvegicus
gcctagctagctcgttcgccttttg

SEQ ID NO: 605185 - DNA, 25 bp, Rattus norvegicus
ttttgttccggcgtgcgaggaactg

SEQ ID NO: 605186 - DNA, 25 bp, Rattus norvegicus
tcgggcgtgcgtgtgtaaatcagaa

SEQ ID NO: 605187 - DNA, 25 bp, Rattus norvegicus
atcagaaggcgtttggctcggagcc

SEQ ID NO: 605188 - DNA, 25 bp, Rattus norvegicus
ccttctccttaattgtgcagacaga

SEQ ID NO: 605189 - DNA, 25 bp, Rattus norvegicus
tgtgcagacagaaaaatcccttcca

SEQ ID NO: 605190 - DNA, 25 bp, Rattus norvegicus
acagtccctcgtttgctctgtcggc

SEQ ID NO: 605191 - DNA, 25 bp, Rattus norvegicus
tcccaaggccgtgattggctagcca

SEQ ID NO: 605192 - DNA, 25 bp, Rattus norvegicus
gcccactcattttctgaggaaggtc

SEQ ID NO: 605193 - DNA, 25 bp, Rattus norvegicus
ttggggcccactcattttctgagga

SEQ ID NO: 605194 - DNA, 25 bp, Rattus norvegicus
caccacccggaggtaggagaggatg

SEQ ID NO: 605195 - DNA, 25 bp, Rattus norvegicus
tagggttctctctgacgcgggaccc

SEQ ID NO: 605196 - DNA, 25 bp, Rattus norvegicus
ttttgtagggttctctctgacgcgg

SEQ ID NO: 605197 - DNA, 25 bp, Rattus norvegicus
cgccattttgtagggttctctctga

SEQ ID NO: 605198 - DNA, 25 bp, Rattus norvegicus
ccgtcgccattttgtagggttctct

SEQ ID NO: 605199 - DNA, 25 bp, Rattus norvegicus
ctggcgcgcgagaaagcgcccggtc

SEQ ID NO: 605200 - DNA, 25 bp, Rattus norvegicus
tgtgcggccacaggattggtcgccc

SEQ ID NO: 605201 - DNA, 25 bp, Rattus norvegicus
cctcccaaggccgtgattggctagc

SEQ ID NO: 605202 - DNA, 25 bp, Rattus norvegicus
gcgggctgaccttcgctccgcagtg

SEQ ID NO: 605203 - DNA, 25 bp, Rattus norvegicus
ctcattttctgaggaaggtcccggg

SEQ ID NO: 605204 - DNA, 25 bp, Rattus norvegicus
ctccgcagtgccgtcaccacatgac

SEQ ID NO: 605205 - DNA, 25 bp, Rattus norvegicus
gcaccgatagcagccgctctggtct

SEQ ID NO: 605206 - DNA, 25 bp, Rattus norvegicus
agcacggcagcgcttgtagtaggca

SEQ ID NO: 605207 - DNA, 25 bp, Rattus norvegicus
gcttgtagtaggcatcgagcgctcc

SEQ ID NO: 605208 - DNA, 25 bp, Rattus norvegicus
gcgctccgtacgtgttgttgtaata

SEQ ID NO: 605209 - DNA, 25 bp, Rattus norvegicus
cgtgttgttgtaatacaatgaatcc

SEQ ID NO: 605210 - DNA, 25 bp, Rattus norvegicus
taactcatggtgtaaggcgtacgca

SEQ ID NO: 605211 - DNA, 25 bp, Rattus norvegicus
aggcgtacgcactgctccatattgc

SEQ ID NO: 605212 - DNA, 25 bp, Rattus norvegicus
gcactgctccatattgctcattata

SEQ ID NO: 605213 - DNA, 25 bp, Rattus norvegicus
gctcattatattgctcggtcaagtc

SEQ ID NO: 605214 - DNA, 25 bp, Rattus norvegicus
ggtcaagtctgccacacggcccgaa

SEQ ID NO: 605215 - DNA, 25 bp, Rattus norvegicus
cacacggcccgaacggtctatcgga

SEQ ID NO: 605216 - DNA, 25 bp, Rattus norvegicus
cgaacggtctatcggacactctttg

SEQ ID NO: 605217 - DNA, 25 bp, Rattus norvegicus
tcctaagccggctggtggacaactg

SEQ ID NO: 605218 - DNA, 25 bp, Rattus norvegicus
atcggacactctttggaccagtgcc

SEQ ID NO: 605219 - DNA, 25 bp, Rattus norvegicus
ggcgctcgaacaggctgcgcaattc

SEQ ID NO: 605220 - DNA, 25 bp, Rattus norvegicus
atcttccaagtgttcaggggcctcg

SEQ ID NO: 605221 - DNA, 25 bp, Rattus norvegicus
cgcgcatgtgcacgaaggcaaactg

SEQ ID NO: 605222 - DNA, 25 bp, Rattus norvegicus
gcaaactgtttcatgacggcgcagc

SEQ ID NO: 605223 - DNA, 25 bp, Rattus norvegicus
ggcgcagctcatgaccgtgccatag

SEQ ID NO: 605224 - DNA, 25 bp, Rattus norvegicus
agactggacctctcctacagcgaca

SEQ ID NO: 605225 - DNA, 25 bp, Rattus norvegicus
gaacgacccgcagtcctctacagga

SEQ ID NO: 605226 - DNA, 25 bp, Rattus norvegicus
gcaggcgctctaacctagccaattg

SEQ ID NO: 605227 - DNA, 25 bp, Rattus norvegicus
cagatgtcctttgacgcagccaatc

SEQ ID NO: 605228 - DNA, 25 bp, Rattus norvegicus
gggaagttggcgctccctcaaccaa

SEQ ID NO: 605229 - DNA, 25 bp, Rattus norvegicus
agcctcagtgtctgcggtaagcctc

SEQ ID NO: 605230 - DNA, 25 bp, Rattus norvegicus
ccgacactatataagcttggcgatc

SEQ ID NO: 605231 - DNA, 25 bp, Rattus norvegicus
tcctggcttgtgcatgcagccgata

SEQ ID NO: 605232 - DNA, 25 bp, Rattus norvegicus
gcagccgatacattgcccacgaaaa

SEQ ID NO: 605233 - DNA, 25 bp, Rattus norvegicus
cttatatgcagctgaccgaagcctg

SEQ ID NO: 605234 - DNA, 25 bp, Rattus norvegicus
gccttggagcctgaggctgtgctcc

SEQ ID NO: 605235 - DNA, 25 bp, Rattus norvegicus
gagctggcctggaatcttgagtaca

SEQ ID NO: 605236 - DNA, 25 bp, Rattus norvegicus
gccgggatactcagttcagagtcgc

SEQ ID NO: 605237 - DNA, 25 bp, Rattus norvegicus
aagtccaaactaccgccacgcgaga

SEQ ID NO: 605238 - DNA, 25 bp, Rattus norvegicus
tgtgctccagacctacgtgcgctgg

SEQ ID NO: 605239 - DNA, 25 bp, Rattus norvegicus
agacgcagtgacctccgccttggag

SEQ ID NO: 605240 - DNA, 25 bp, Rattus norvegicus
gggctcctcctagacgcagtgacct

SEQ ID NO: 605241 - DNA, 25 bp, Rattus norvegicus
tgggctggcacctcccagccaaggt

SEQ ID NO: 605242 - DNA, 25 bp, Rattus norvegicus
aatcttgagtacaggcagcgggctc

SEQ ID NO: 605243 - DNA, 25 bp, Rattus norvegicus
tcatcgcggccagtttcattgggca

SEQ ID NO: 605244 - DNA, 25 bp, Rattus norvegicus
ggcacatcttcttgatcatcgcggc

SEQ ID NO: 605245 - DNA, 25 bp, Rattus norvegicus
ttcagagtcgcttgggcacatcttc

SEQ ID NO: 605246 - DNA, 25 bp, Rattus norvegicus
cgtgcgctggaaggaaaacaagtcc

SEQ ID NO: 605247 - DNA, 25 bp, Rattus norvegicus
taccgaggaccgactttgtctcacc

SEQ ID NO: 605248 - DNA, 25 bp, Rattus norvegicus
cgccaggtgtccaagcggctagcaa

SEQ ID NO: 605249 - DNA, 25 bp, Rattus norvegicus
cgcttgcaaagctgaaagtggggcc

SEQ ID NO: 605250 - DNA, 25 bp, Rattus norvegicus
gccgatttaccaccagttgctgagt

SEQ ID NO: 605251 - DNA, 25 bp, Rattus norvegicus
ctccagatgtctcggctttgcaatc

SEQ ID NO: 605252 - DNA, 25 bp, Rattus norvegicus
aggaacctgacctcaagccgattta

SEQ ID NO: 605253 - DNA, 25 bp, Rattus norvegicus
ccagctcagtgggaactacctagta

SEQ ID NO: 605254 - DNA, 25 bp, Rattus norvegicus
tttggcgtcctctaccagctcagtg

SEQ ID NO: 605255 - DNA, 25 bp, Rattus norvegicus
tgccgtcgctctagttcccttagta

SEQ ID NO: 605256 - DNA, 25 bp, Rattus norvegicus
caggcgcattgatgccgtcgctcta

SEQ ID NO: 605257 - DNA, 25 bp, Rattus norvegicus
cgaggctccacatgaagctttcact

SEQ ID NO: 605258 - DNA, 25 bp, Rattus norvegicus
gggcccagatctaagccgtccggta

SEQ ID NO: 605259 - DNA, 25 bp, Rattus norvegicus
gagaccaacgcaactcagctttgtg

SEQ ID NO: 605260 - DNA, 25 bp, Rattus norvegicus
ccacacaaccggtagggtccagaga

SEQ ID NO: 605261 - DNA, 25 bp, Rattus norvegicus
acgctgatcgcgaccgtggtcctga

SEQ ID NO: 605262 - DNA, 25 bp, Rattus norvegicus
gtaaataagcgagcgcgcaagcgcc

SEQ ID NO: 605263 - DNA, 25 bp, Rattus norvegicus
caagcgcccggaatcggtgccgatt

SEQ ID NO: 605264 - DNA, 25 bp, Rattus norvegicus
caattacggccgtactgcggtgaca

SEQ ID NO: 605265 - DNA, 25 bp, Rattus norvegicus
gttccagggttgtagggagacactc

SEQ ID NO: 605266 - DNA, 25 bp, Rattus norvegicus
ggagacactctgtagcctctgaagg

SEQ ID NO: 605267 - DNA, 25 bp, Rattus norvegicus
ccttgggtcgcttgatctgcgagtt

SEQ ID NO: 605268 - DNA, 25 bp, Rattus norvegicus
ctgcgagtttgtgggtcagtgaatc

SEQ ID NO: 605269 - DNA, 25 bp, Rattus norvegicus
gagcagcttcgacctcgctatggcg

SEQ ID NO: 605270 - DNA, 25 bp, Rattus norvegicus
gcttttgtggctgttgacgctgatc

SEQ ID NO: 605271 - DNA, 25 bp, Rattus norvegicus
ctgccaagccctgggcggatgacga

SEQ ID NO: 605272 - DNA, 25 bp, Rattus norvegicus
tggtccacgtgcctcgcgtaaataa

SEQ ID NO: 605273 - DNA, 25 bp, Rattus norvegicus
gcttcgcgctggacatgtacaatta

SEQ ID NO: 605274 - DNA, 25 bp, Rattus norvegicus
aagcctggagcctgtcctcccagga

SEQ ID NO: 605275 - DNA, 25 bp, Rattus norvegicus
atcctctcggagtggcagcaagcca

SEQ ID NO: 605276 - DNA, 25 bp, Rattus norvegicus
ggggctgcaactcaatcctctcgga

SEQ ID NO: 605277 - DNA, 25 bp, Rattus norvegicus
ggcgacggcttctttttgacacctg

SEQ ID NO: 605278 - DNA, 25 bp, Rattus norvegicus
ggcgccggcaccaaccggatttcga

SEQ ID NO: 605279 - DNA, 25 bp, Rattus norvegicus
cggatttcgaacatctagtcagtta

SEQ ID NO: 605280 - DNA, 25 bp, Rattus norvegicus
ccctgtaagtctggagcgctacgca

SEQ ID NO: 605281 - DNA, 25 bp, Rattus norvegicus
aggagctcctattggtcgcgacaga

SEQ ID NO: 605282 - DNA, 25 bp, Rattus norvegicus
cgcgacagacatcagtccgctgcta

SEQ ID NO: 605283 - DNA, 25 bp, Rattus norvegicus
ccaatacggaagcagtgggatccca

SEQ ID NO: 605284 - DNA, 25 bp, Rattus norvegicus
tgggatcccagctatccgaaagccg

SEQ ID NO: 605285 - DNA, 25 bp, Rattus norvegicus
cctggagctgacttacgtgatggta

SEQ ID NO: 605286 - DNA, 25 bp, Rattus norvegicus
cgctggctgcttatcagctgctcaa

SEQ ID NO: 605287 - DNA, 25 bp, Rattus norvegicus
gctgctcaatctgctgggcaacatg

SEQ ID NO: 605288 - DNA, 25 bp, Rattus norvegicus
ttcctgcgttcggatcccagcattc

SEQ ID NO: 605289 - DNA, 25 bp, Rattus norvegicus
gaactgcgcagaggcaggcccgcac

SEQ ID NO: 605290 - DNA, 25 bp, Rattus norvegicus
atacgcgcgcgcacgcagtcagtac

SEQ ID NO: 605291 - DNA, 25 bp, Rattus norvegicus
agtgcccagacgtgcgcagcaaatc

SEQ ID NO: 605292 - DNA, 25 bp, Rattus norvegicus
caaatccaagacctgctacggcagg

SEQ ID NO: 605293 - DNA, 25 bp, Rattus norvegicus
acctgctacggcagggacgcgccta

SEQ ID NO: 605294 - DNA, 25 bp, Rattus norvegicus
cgcctcacctgacggcgttctgggg

SEQ ID NO: 605295 - DNA, 25 bp, Rattus norvegicus
gttctggggctctcagtgcgctgcc

SEQ ID NO: 605296 - DNA, 25 bp, Rattus norvegicus
gtgcagcctcgtcacggggacactc

SEQ ID NO: 605297 - DNA, 25 bp, Rattus norvegicus
aggtcgccctcaggctgcctactta

SEQ ID NO: 605298 - DNA, 25 bp, Rattus norvegicus
cccaacgttggaggaactgcgcaga

SEQ ID NO: 605299 - DNA, 25 bp, Rattus norvegicus
cccgtgctaggaaagggcacaatga

SEQ ID NO: 605300 - DNA, 25 bp, Rattus norvegicus
gcatacgcagatacaccaggcggcc

SEQ ID NO: 605301 - DNA, 25 bp, Rattus norvegicus
ggaagagggatgtgcacacaagccc

SEQ ID NO: 605302 - DNA, 25 bp, Rattus norvegicus
acagcccagcgcatacgcagataca

SEQ ID NO: 605303 - DNA, 25 bp, Rattus norvegicus
tcggtacatgactgccggccgtgga

SEQ ID NO: 605304 - DNA, 25 bp, Rattus norvegicus
gcccttggtggatcggtacatgact

SEQ ID NO: 605305 - DNA, 25 bp, Rattus norvegicus
gtcttttcgcccaggctcttgctcg

SEQ ID NO: 605306 - DNA, 25 bp, Rattus norvegicus
gaacacctgcggtcctttcccgatg

SEQ ID NO: 605307 - DNA, 25 bp, Rattus norvegicus
aggctgggctaaagcaagctgcagc

SEQ ID NO: 605308 - DNA, 25 bp, Rattus norvegicus
tttcccgatgcaccggaggcttcct

SEQ ID NO: 605309 - DNA, 25 bp, Rattus norvegicus
ccttatatagctcctgacaggcgtg

SEQ ID NO: 605310 - DNA, 25 bp, Rattus norvegicus
cctggcttccgacgtcatctcgtga

SEQ ID NO: 605311 - DNA, 25 bp, Rattus norvegicus
cgttgatctggtcgcggcgcgcctt

SEQ ID NO: 605312 - DNA, 25 bp, Rattus norvegicus
ggttccgaatctcggcgttgatctg

SEQ ID NO: 605313 - DNA, 25 bp, Rattus norvegicus
cagcagttccttgaggttccgaatc

SEQ ID NO: 605314 - DNA, 25 bp, Rattus norvegicus
tccgcttcagccaacggcagcagtt

SEQ ID NO: 605315 - DNA, 25 bp, Rattus norvegicus
ggaccttgtccgcttcagccaacgg

SEQ ID NO: 605316 - DNA, 25 bp, Rattus norvegicus
gcctgcctcgatccgccttatatag

SEQ ID NO: 605317 - DNA, 25 bp, Rattus norvegicus
tgaatgagccgcagcaagcagagga

SEQ ID NO: 605318 - DNA, 25 bp, Rattus norvegicus
ccatggcaacagagtgtcgcggtta

SEQ ID NO: 605319 - DNA, 25 bp, Rattus norvegicus
gctgcggctctcttccaaaataggc

SEQ ID NO: 605320 - DNA, 25 bp, Rattus norvegicus
tctcttccaaaataggcaagaactg

SEQ ID NO: 605321 - DNA, 25 bp, Rattus norvegicus
gagcgcagacgtcacgcagggcctc

SEQ ID NO: 605322 - DNA, 25 bp, Rattus norvegicus
ttcgtctgcatcacgttgccatggc

SEQ ID NO: 605323 - DNA, 25 bp, Rattus norvegicus
gtcgcggttagcagatgaatgagcc

SEQ ID NO: 605324 - DNA, 25 bp, Rattus norvegicus
cgccactctgccagttgccttaaaa

SEQ ID NO: 605325 - DNA, 25 bp, Rattus norvegicus
gggcttccaagaccggccaggactc

SEQ ID NO: 605326 - DNA, 25 bp, Rattus norvegicus
tgagctctggcgaagccgccactct

SEQ ID NO: 605327 - DNA, 25 bp, Rattus norvegicus
cgcatcagcagaagggctgcggctc

SEQ ID NO: 605328 - DNA, 25 bp, Rattus norvegicus
ttgccttaaaaaggcgccagcgcgc

SEQ ID NO: 605329 - DNA, 25 bp, Rattus norvegicus
ccagcgcgcgcgcatcagcagaagg

SEQ ID NO: 605330 - DNA, 25 bp, Rattus norvegicus
ccggccaggactctaccgttcaggg

SEQ ID NO: 605331 - DNA, 25 bp, Rattus norvegicus
gagccgtggtccgagcttgcaaaac

SEQ ID NO: 605332 - DNA, 25 bp, Rattus norvegicus
tgcggacatcatggcgcacggaaac

SEQ ID NO: 605333 - DNA, 25 bp, Rattus norvegicus
ctggtgcaataggactgcggacatc

SEQ ID NO: 605334 - DNA, 25 bp, Rattus norvegicus
cctccctgcagtgggcctggtgcaa

SEQ ID NO: 605335 - DNA, 25 bp, Rattus norvegicus
caggtgcaacctccctgcagtgggc

SEQ ID NO: 605336 - DNA, 25 bp, Rattus norvegicus
ctgcgtaggcgcaggtgcaacctcc

SEQ ID NO: 605337 - DNA, 25 bp, Rattus norvegicus
ttcggcttcctagccctgcgtaggc

SEQ ID NO: 605338 - DNA, 25 bp, Rattus norvegicus
agcgttgctgcccttcggcttccta

SEQ ID NO: 605339 - DNA, 25 bp, Rattus norvegicus
gattcccagacaccggccagcgttg

SEQ ID NO: 605340 - DNA, 25 bp, Rattus norvegicus
cgaccttgggattcccagacaccgg

SEQ ID NO: 605341 - DNA, 25 bp, Rattus norvegicus
ggctacagcactccctccgaccttg

SEQ ID NO: 605342 - DNA, 25 bp, Rattus norvegicus
ctggaccctctcactggctacagca

SEQ ID NO: 605343 - DNA, 25 bp, Rattus norvegicus
acgtggtccagtgttacccaacctg

SEQ ID NO: 605344 - DNA, 25 bp, Rattus norvegicus
ccgagcttgcaaaacgtggtccagt

SEQ ID NO: 605345 - DNA, 25 bp, Rattus norvegicus
ccttaaagaggtgctctcgggtctc

SEQ ID NO: 605346 - DNA, 25 bp, Rattus norvegicus
cctgctgtcccagttgaggactttg

SEQ ID NO: 605347 - DNA, 25 bp, Rattus norvegicus
gactttgagggcgaagtccacgcca

SEQ ID NO: 605348 - DNA, 25 bp, Rattus norvegicus
cacgccaatggtggcgcggtagttc

SEQ ID NO: 605349 - DNA, 25 bp, Rattus norvegicus
aagagctggtgcacatagcgcttga

SEQ ID NO: 605350 - DNA, 25 bp, Rattus norvegicus
tcgccgatgaccagcaccttaaaga

SEQ ID NO: 605351 - DNA, 25 bp, Rattus norvegicus
tctccggaaccgcagtggccgtttc

SEQ ID NO: 605352 - DNA, 25 bp, Rattus norvegicus
gtttcgccctgttgcccgagtctct

SEQ ID NO: 605353 - DNA, 25 bp, Rattus norvegicus
ggccgtgggaacttctctctcaagg

SEQ ID NO: 605354 - DNA, 25 bp, Rattus norvegicus
ccggcgatgcagtcatgcgagtcac

SEQ ID NO: 605355 - DNA, 25 bp, Rattus norvegicus
tgcgagtcacgggacccggaaccta

SEQ ID NO: 605356 - DNA, 25 bp, Rattus norvegicus
ccaggacagtctgggtgcaccctac

SEQ ID NO: 605357 - DNA, 25 bp, Rattus norvegicus
cttccttttctcgtgcgactctgcg

SEQ ID NO: 605358 - DNA, 25 bp, Rattus norvegicus
atgatgcttgtcttgcccacgccga

SEQ ID NO: 605359 - DNA, 25 bp, Rattus norvegicus
gctcaaagaggacctcgcgccattc

SEQ ID NO: 605360 - DNA, 25 bp, Rattus norvegicus
ttctctactccgtactgggcccaga

SEQ ID NO: 605361 - DNA, 25 bp, Rattus norvegicus
ctactccgtactgggcccagagagg

SEQ ID NO: 605362 - DNA, 25 bp, Rattus norvegicus
gcgatctagtgcagggcctccctct

SEQ ID NO: 605363 - DNA, 25 bp, Rattus norvegicus
gcaggaggcgtaccgcgagctcaaa

SEQ ID NO: 605364 - DNA, 25 bp, Rattus norvegicus
gtaccgcgagctcaaagaggacctc

SEQ ID NO: 605365 - DNA, 25 bp, Rattus norvegicus
tttctctcgcttctcttccaatttc

SEQ ID NO: 605366 - DNA, 25 bp, Rattus norvegicus
tgaagtgcctgcgactcggggtcca

SEQ ID NO: 605367 - DNA, 25 bp, Rattus norvegicus
tccaatttctctactccgtactggg

SEQ ID NO: 605368 - DNA, 25 bp, Rattus norvegicus
accggggagccctagctctgtgacc

SEQ ID NO: 605369 - DNA, 25 bp, Rattus norvegicus
ctactacaggtaggcaccggggagc

SEQ ID NO: 605370 - DNA, 25 bp, Rattus norvegicus
tgatcgctactacaggtaggcaccg

SEQ ID NO: 605371 - DNA, 25 bp, Rattus norvegicus
aggacctcgcgccattcaaggatga

SEQ ID NO: 605372 - DNA, 25 bp, Rattus norvegicus
cgccattcaaggatgatcgctacta

SEQ ID NO: 605373 - DNA, 25 bp, Rattus norvegicus
aacgatgtcatcttggccacgcatg

SEQ ID NO: 605374 - DNA, 25 bp, Rattus norvegicus
gagaaccgcgtcatcacgccagtga

SEQ ID NO: 605375 - DNA, 25 bp, Rattus norvegicus
ctccgcgatccgtagaccaggtaaa

SEQ ID NO: 605376 - DNA, 25 bp, Rattus norvegicus
acagtatttcgagttcttcccgccg

SEQ ID NO: 605377 - DNA, 25 bp, Rattus norvegicus
ggcaatgctgcagctgctctaccta

SEQ ID NO: 605378 - DNA, 25 bp, Rattus norvegicus
ccgcgctcatgttggtggcaatgct

SEQ ID NO: 605379 - DNA, 25 bp, Rattus norvegicus
tccggcgagcgcaccaaaatttcag

SEQ ID NO: 605380 - DNA, 25 bp, Rattus norvegicus
cgcggctaggttcagcgtttgcaaa

SEQ ID NO: 605381 - DNA, 25 bp, Rattus norvegicus
cgattatcgcgtctacaggggtcta

SEQ ID NO: 605382 - DNA, 25 bp, Rattus norvegicus
tgatgcacaagctctgccagggttt

SEQ ID NO: 605383 - DNA, 25 bp, Rattus norvegicus
tccgtttcagtgttcgcggccacca

SEQ ID NO: 605384 - DNA, 25 bp, Rattus norvegicus
ttctggatgccagcggcgattatcg

SEQ ID NO: 605385 - DNA, 25 bp, Rattus norvegicus
tactgcacctgtccggacttctgga

SEQ ID NO: 605386 - DNA, 25 bp, Rattus norvegicus
tgcaaatgtcctacgccatccgatg

SEQ ID NO: 605387 - DNA, 25 bp, Rattus norvegicus
aaacacaaggcaggctccaggtcgc

SEQ ID NO: 605388 - DNA, 25 bp, Rattus norvegicus
cgggacacgcgagcctggtaccctt

SEQ ID NO: 605389 - DNA, 25 bp, Rattus norvegicus
agctggctgccttgtcgaggtccga

SEQ ID NO: 605390 - DNA, 25 bp, Rattus norvegicus
ctgcatgagggttttctggagagtc

SEQ ID NO: 605391 - DNA, 25 bp, Rattus norvegicus
cccaggcccagtgtcacggagtgtg

SEQ ID NO: 605392 - DNA, 25 bp, Rattus norvegicus
cctttcggggtgacgccaccggctg

SEQ ID NO: 605393 - DNA, 25 bp, Rattus norvegicus
agcctggtacccttccgagagcggc

SEQ ID NO: 605394 - DNA, 25 bp, Rattus norvegicus
cctgtggaggccgagttccacgcct

SEQ ID NO: 605395 - DNA, 25 bp, Rattus norvegicus
ttccacgcctttggaggcaagaaga

SEQ ID NO: 605396 - DNA, 25 bp, Rattus norvegicus
aggcaagaagacctgtggggatact

SEQ ID NO: 605397 - DNA, 25 bp, Rattus norvegicus
gctgacatttggagctttggtcaca

SEQ ID NO: 605398 - DNA, 25 bp, Rattus norvegicus
cagaggggaagcgaaacacaaggca

SEQ ID NO: 605399 - DNA, 25 bp, Rattus norvegicus
ctttggtcacaactggaggccttca

SEQ ID NO: 605400 - DNA, 25 bp, Rattus norvegicus
tgtaggagctgcatgagggttttct

SEQ ID NO: 605401 - DNA, 25 bp, Rattus norvegicus
tcctggagaaagagggacctgcgca

SEQ ID NO: 605402 - DNA, 25 bp, Rattus norvegicus
cggcatgcctggacaccagtagttc

SEQ ID NO: 605403 - DNA, 25 bp, Rattus norvegicus
accagtagttccattgtaagctcca

SEQ ID NO: 605404 - DNA, 25 bp, Rattus norvegicus
taagctccacaatgggcgccttctg

SEQ ID NO: 605405 - DNA, 25 bp, Rattus norvegicus
ggcgccttctgatgacgtacacgga

SEQ ID NO: 605406 - DNA, 25 bp, Rattus norvegicus
gaagcgtcgacacctcctggagaaa

SEQ ID NO: 605407 - DNA, 25 bp, Rattus norvegicus
tgcgcagctctcttcgggagaccaa

SEQ ID NO: 605408 - DNA, 25 bp, Rattus norvegicus
agaccaacggcggagcgttcacctg

SEQ ID NO: 605409 - DNA, 25 bp, Rattus norvegicus
gcgttcacctgtgtccgacagctct

SEQ ID NO: 605410 - DNA, 25 bp, Rattus norvegicus
cagtctctgcggtgcgtatggccac

SEQ ID NO: 605411 - DNA, 25 bp, Rattus norvegicus
tgcgtatggccacgcctagcgctgg

SEQ ID NO: 605412 - DNA, 25 bp, Rattus norvegicus
tcggagtcaaagcagagacttaacc

SEQ ID NO: 605413 - DNA, 25 bp, Rattus norvegicus
agcagagacttaaccggcccggctc

SEQ ID NO: 605414 - DNA, 25 bp, Rattus norvegicus
acgtacacggaagcgtcgacacctc

SEQ ID NO: 605415 - DNA, 25 bp, Rattus norvegicus
gctcgaaggctcgtgcacactggct

SEQ ID NO: 605416 - DNA, 25 bp, Rattus norvegicus
ggagaccaggacaccgccttcacta

SEQ ID NO: 605417 - DNA, 25 bp, Rattus norvegicus
gtcggacccgccaacgggctgctat

SEQ ID NO: 605418 - DNA, 25 bp, Rattus norvegicus
ccgccaacgggctgctatggattgg

SEQ ID NO: 605419 - DNA, 25 bp, Rattus norvegicus
aggctcggcaatgccagccacagcg

SEQ ID NO: 605420 - DNA, 25 bp, Rattus norvegicus
tgcagcggcaggctcggcaatgcca

SEQ ID NO: 605421 - DNA, 25 bp, Rattus norvegicus
gcgccgcacattcctggaggcttgg

SEQ ID NO: 605422 - DNA, 25 bp, Rattus norvegicus
gcttcatatggaccacgggagacca

SEQ ID NO: 605423 - DNA, 25 bp, Rattus norvegicus
caggacaccgccttcactaactggg

SEQ ID NO: 605424 - DNA, 25 bp, Rattus norvegicus
actaactgggcccagccggctacgg

SEQ ID NO: 605425 - DNA, 25 bp, Rattus norvegicus
ggcccagcgctgtgctgcccttgag

SEQ ID NO: 605426 - DNA, 25 bp, Rattus norvegicus
tgcccttgaggccagcggagaacat

SEQ ID NO: 605427 - DNA, 25 bp, Rattus norvegicus
cggagaacatcgctggctcgaaggc

SEQ ID NO: 605428 - DNA, 25 bp, Rattus norvegicus
acagcgcccactgcggggcttcata

SEQ ID NO: 605429 - DNA, 25 bp, Rattus norvegicus
accatgtgcactgtagtcaaactca

SEQ ID NO: 605430 - DNA, 25 bp, Rattus norvegicus
gcctctaggtagtcgtccaggccct

SEQ ID NO: 605431 - DNA, 25 bp, Rattus norvegicus
tccaggccctcgttggcactgaaga

SEQ ID NO: 605432 - DNA, 25 bp, Rattus norvegicus
ttggcactgaagaagcgggccctct

SEQ ID NO: 605433 - DNA, 25 bp, Rattus norvegicus
ccctctgcgtgaggtacgaggcctc

SEQ ID NO: 605434 - DNA, 25 bp, Rattus norvegicus
agcactcccaaagctgaagcacttg

SEQ ID NO: 605435 - DNA, 25 bp, Rattus norvegicus
cttggtgaaacgcagccgcgtggct

SEQ ID NO: 605436 - DNA, 25 bp, Rattus norvegicus
cgtggctgcatggtctgccaggccc

SEQ ID NO: 605437 - DNA, 25 bp, Rattus norvegicus
ggagacgtcacggacaccatgtgca

SEQ ID NO: 605438 - DNA, 25 bp, Rattus norvegicus
gactgtccgccctctcatggtagac

SEQ ID NO: 605439 - DNA, 25 bp, Rattus norvegicus
cgccctctcatggtagacctgtgtg

SEQ ID NO: 605440 - DNA, 25 bp, Rattus norvegicus
acctgtgtggtggtataggcgtccc

SEQ ID NO: 605441 - DNA, 25 bp, Rattus norvegicus
cccattgcggtagcgagtgatctgg

SEQ ID NO: 605442 - DNA, 25 bp, Rattus norvegicus
gcccacgagctccttggagacgtca

SEQ ID NO: 605443 - DNA, 25 bp, Rattus norvegicus
ccgctgaagagtgcactgagcccag

SEQ ID NO: 605444 - DNA, 25 bp, Rattus norvegicus
ctcggcggccgctgaagagtgcact

SEQ ID NO: 605445 - DNA, 25 bp, Rattus norvegicus
caggggctcgccgtccggaacgagc

SEQ ID NO: 605446 - DNA, 25 bp, Rattus norvegicus
cggccgctgaagagtgcactgagcc

SEQ ID NO: 605447 - DNA, 25 bp, Rattus norvegicus
gccgctgaagagtgcactgagccca

SEQ ID NO: 605448 - DNA, 25 bp, Rattus norvegicus
cccggggcatgataagcaggggcgc

SEQ ID NO: 605449 - DNA, 25 bp, Rattus norvegicus
tccggcatggtgtcctggctgcttc

SEQ ID NO: 605450 - DNA, 25 bp, Rattus norvegicus
cttccggcatggtgtcctggctgct

SEQ ID NO: 605451 - DNA, 25 bp, Rattus norvegicus
cgccttccggcatggtgtcctggct

SEQ ID NO: 605452 - DNA, 25 bp, Rattus norvegicus
ttcgccttccggcatggtgtcctgg

SEQ ID NO: 605453 - DNA, 25 bp, Rattus norvegicus
cccgcaatctccaccttcgccttcc

SEQ ID NO: 605454 - DNA, 25 bp, Rattus norvegicus
cgagcgcgggcacctccccgcaatc

SEQ ID NO: 605455 - DNA, 25 bp, Rattus norvegicus
ccgtccggaacgagcgcgggcacct

SEQ ID NO: 605456 - DNA, 25 bp, Rattus norvegicus
cgctgaagagtgcactgagcccagc

SEQ ID NO: 605457 - DNA, 25 bp, Rattus norvegicus
actcagcgaagtctacccttgggta

SEQ ID NO: 605458 - DNA, 25 bp, Rattus norvegicus
attcctcttggactgcgttgcgtca

SEQ ID NO: 605459 - DNA, 25 bp, Rattus norvegicus
gtggcggactccacagggcattttc

SEQ ID NO: 605460 - DNA, 25 bp, Rattus norvegicus
ggacgcgttatcactctcccggagc

SEQ ID NO: 605461 - DNA, 25 bp, Rattus norvegicus
cgggcgacaacagcacgtcctagca

SEQ ID NO: 605462 - DNA, 25 bp, Rattus norvegicus
gccatggcttaccactcgggatatg

SEQ ID NO: 605463 - DNA, 25 bp, Rattus norvegicus
agagcttgaccgatcgccgcattcc

SEQ ID NO: 605464 - DNA, 25 bp, Rattus norvegicus
gagccaactttgtgccctgactagc

SEQ ID NO: 605465 - DNA, 25 bp, Rattus norvegicus
gactagctgagtctgtccggatctc

SEQ ID NO: 605466 - DNA, 25 bp, Rattus norvegicus
gatctcaatctttcctactggcgta

SEQ ID NO: 605467 - DNA, 25 bp, Rattus norvegicus
acccattggctggtagcgccgcaaa

SEQ ID NO: 605468 - DNA, 25 bp, Rattus norvegicus
agagcatcttgagtagcgccgtccc

SEQ ID NO: 605469 - DNA, 25 bp, Rattus norvegicus
cacgctgcagcatgtcctggacttc

SEQ ID NO: 605470 - DNA, 25 bp, Rattus norvegicus
gcgccgcaaattagcaagcctatta

SEQ ID NO: 605471 - DNA, 25 bp, Rattus norvegicus
gcggaacctgtagtttccatggata

SEQ ID NO: 605472 - DNA, 25 bp, Rattus norvegicus
agggaacccgagcagcggtgcaccc

SEQ ID NO: 605473 - DNA, 25 bp, Rattus norvegicus
aggcgcaacccagggaacccgagca

SEQ ID NO: 605474 - DNA, 25 bp, Rattus norvegicus
agtttccatggatattcgacttgcc

SEQ ID NO: 605475 - DNA, 25 bp, Rattus norvegicus
gctgccttgcggaacctgtagtttc

SEQ ID NO: 605476 - DNA, 25 bp, Rattus norvegicus
atacttccgactcgggttgcgccgc

SEQ ID NO: 605477 - DNA, 25 bp, Rattus norvegicus
gctgcgcagccgcaaatacttccga

SEQ ID NO: 605478 - DNA, 25 bp, Rattus norvegicus
tccgcctcccgttccaagatggtgg

SEQ ID NO: 605479 - DNA, 25 bp, Rattus norvegicus
tcactattcggggttcatggcggca

SEQ ID NO: 605480 - DNA, 25 bp, Rattus norvegicus
cggggctcactcactattcggggtt

SEQ ID NO: 605481 - DNA, 25 bp, Rattus norvegicus
ccatagacaggatcgaggctgcgcc

SEQ ID NO: 605482 - DNA, 25 bp, Rattus norvegicus
gccagacaacttcggcaagcatata

SEQ ID NO: 605483 - DNA, 25 bp, Rattus norvegicus
ccgcgcagttctgaccaaggccaga

SEQ ID NO: 605484 - DNA, 25 bp, Rattus norvegicus
attcgacttgccactgctgcgcagg

SEQ ID NO: 605485 - DNA, 25 bp, Rattus norvegicus
gccgacctgcaccttctgctttggt

SEQ ID NO: 605486 - DNA, 25 bp, Rattus norvegicus
agtttatgtaaagcccagccttggg

SEQ ID NO: 605487 - DNA, 25 bp, Rattus norvegicus
tcaagacgcagagcactagggcatt

SEQ ID NO: 605488 - DNA, 25 bp, Rattus norvegicus
tgaagtgaggctggaccctgattcc

SEQ ID NO: 605489 - DNA, 25 bp, Rattus norvegicus
ggtgcccagtactatctcgtcctga

SEQ ID NO: 605490 - DNA, 25 bp, Rattus norvegicus
gatcctcgaccgtgagctcgtctcg

SEQ ID NO: 605491 - DNA, 25 bp, Rattus norvegicus
ctagggcattgtaaggcgttcccaa

SEQ ID NO: 605492 - DNA, 25 bp, Rattus norvegicus
ttccggaactgtcctaatcaagacg

SEQ ID NO: 605493 - DNA, 25 bp, Rattus norvegicus
gaccaccggctcaggccagtttatg

SEQ ID NO: 605494 - DNA, 25 bp, Rattus norvegicus
gtctagcctagggagacgcattgcg

SEQ ID NO: 605495 - DNA, 25 bp, Rattus norvegicus
ccaggtcccaaagggtgtacagatc

SEQ ID NO: 605496 - DNA, 25 bp, Rattus norvegicus
tcgaggaagcaccatcgtggccatg

SEQ ID NO: 605497 - DNA, 25 bp, Rattus norvegicus
tgactcagcttctcctctcgaggaa

SEQ ID NO: 605498 - DNA, 25 bp, Rattus norvegicus
agtcagaaactacaggccctccggg

SEQ ID NO: 605499 - DNA, 25 bp, Rattus norvegicus
agcggctcagcgcgtctcctcagaa

SEQ ID NO: 605500 - DNA, 25 bp, Rattus norvegicus
tgagatctgcagaacacgtagtgga

SEQ ID NO: 605501 - DNA, 25 bp, Rattus norvegicus
gactgtacgggagcgcgctcagccc

SEQ ID NO: 605502 - DNA, 25 bp, Rattus norvegicus
cgcggtcccgaacaggagaggactg

SEQ ID NO: 605503 - DNA, 25 bp, Rattus norvegicus
ttgcaggcctctggcgtgatggctc

SEQ ID NO: 605504 - DNA, 25 bp, Rattus norvegicus
ttgcgtcccttgcaggcctctggcg

SEQ ID NO: 605505 - DNA, 25 bp, Rattus norvegicus
tccgcgttccgccatggcctggcca

SEQ ID NO: 605506 - DNA, 25 bp, Rattus norvegicus
gcgtctcctcagaacgcccggcgga

SEQ ID NO: 605507 - DNA, 25 bp, Rattus norvegicus
ggcacgcgagctactcgcaggcttc

SEQ ID NO: 605508 - DNA, 25 bp, Rattus norvegicus
atctgcagaacacgtagtggaggcg

SEQ ID NO: 605509 - DNA, 25 bp, Rattus norvegicus
gctggtcacgcgttgcgcggaaatt

SEQ ID NO: 605510 - DNA, 25 bp, Rattus norvegicus
ggagcgcgagccaccagcgaacctg

SEQ ID NO: 605511 - DNA, 25 bp, Rattus norvegicus
aggccaccgcgacggccatggaggt

SEQ ID NO: 605512 - DNA, 25 bp, Rattus norvegicus
gttgcgcggaaattggacagcccgc

SEQ ID NO: 605513 - DNA, 25 bp, Rattus norvegicus
tgcccattcgcctcaccctggatcg

SEQ ID NO: 605514 - DNA, 25 bp, Rattus norvegicus
agccctcctcttgactgcccattcg

SEQ ID NO: 605515 - DNA, 25 bp, Rattus norvegicus
cgccacaagcccacgcagccctcct

SEQ ID NO: 605516 - DNA, 25 bp, Rattus norvegicus
taaccaagctccactccgccacaag

SEQ ID NO: 605517 - DNA, 25 bp, Rattus norvegicus
atctcctgggtaaccaagctccact

SEQ ID NO: 605518 - DNA, 25 bp, Rattus norvegicus
tggatctcctgggtaaccaagctcc

SEQ ID NO: 605519 - DNA, 25 bp, Rattus norvegicus
aacttggcgaggtcaggccccaccg

SEQ ID NO: 605520 - DNA, 25 bp, Rattus norvegicus
acccggagcaggccaacttggcgag

SEQ ID NO: 605521 - DNA, 25 bp, Rattus norvegicus
caaggggtgagcatcacccggagca

SEQ ID NO: 605522 - DNA, 25 bp, Rattus norvegicus
acacagaatcaaggggtgagcatca

SEQ ID NO: 605523 - DNA, 25 bp, Rattus norvegicus
tgggacgaaacacagaatcaagggg

SEQ ID NO: 605524 - DNA, 25 bp, Rattus norvegicus
tccctatgggacgaaacacagaatc

SEQ ID NO: 605525 - DNA, 25 bp, Rattus norvegicus
cctcgcgactccctatgggacgaaa

SEQ ID NO: 605526 - DNA, 25 bp, Rattus norvegicus
gcccgtggatctcctgggtaaccaa

SEQ ID NO: 605527 - DNA, 25 bp, Rattus norvegicus
acgaatggtttctgtaaagtgccga

SEQ ID NO: 605528 - DNA, 25 bp, Rattus norvegicus
cgcagtcgcgctctgatgcgttttc

SEQ ID NO: 605529 - DNA, 25 bp, Rattus norvegicus
gacgcctgcccacgtgacaggtgtc

SEQ ID NO: 605530 - DNA, 25 bp, Rattus norvegicus
gacgccatccctaaagctgctgttg

SEQ ID NO: 605531 - DNA, 25 bp, Rattus norvegicus
tctccgagatggaaccgtaagtggc

SEQ ID NO: 605532 - DNA, 25 bp, Rattus norvegicus
ggctggtccgagattgcttcaagtc

SEQ ID NO: 605533 - DNA, 25 bp, Rattus norvegicus
gcttcaagtccggagtcagtaggga

SEQ ID NO: 605534 - DNA, 25 bp, Rattus norvegicus
cccgacgcgcttcttagtggcgttt

SEQ ID NO: 605535 - DNA, 25 bp, Rattus norvegicus
tggcacagcctcgttagatctctcg

SEQ ID NO: 605536 - DNA, 25 bp, Rattus norvegicus
ctctcgggtgctgagttttatacga

SEQ ID NO: 605537 - DNA, 25 bp, Rattus norvegicus
acgagttttacaatgtgctgacttg

SEQ ID NO: 605538 - DNA, 25 bp, Rattus norvegicus
tgctgacttgggacacgaatggttt

SEQ ID NO: 605539 - DNA, 25 bp, Rattus norvegicus
acgaggcaaactcacacccgaggga

SEQ ID NO: 605540 - DNA, 25 bp, Rattus norvegicus
ctgctgttgacgcagctgtcgcccg

SEQ ID NO: 605541 - DNA, 25 bp, Rattus norvegicus
tttccgggaatgcaaagccggaggc

SEQ ID NO: 605542 - DNA, 25 bp, Rattus norvegicus
gcaaagaggagggataccgttctcc

SEQ ID NO: 605543 - DNA, 25 bp, Rattus norvegicus
ggcctctgtgctctagtctagcaaa

SEQ ID NO: 605544 - DNA, 25 bp, Rattus norvegicus
tggtgcttctttgcgctgtccttca

SEQ ID NO: 605545 - DNA, 25 bp, Rattus norvegicus
tgctaaggtactctcggcctctgtg

SEQ ID NO: 605546 - DNA, 25 bp, Rattus norvegicus
cgtggcttccagacctgctaaggta

SEQ ID NO: 605547 - DNA, 25 bp, Rattus norvegicus
cttctgggaccaggagccaaggccc

SEQ ID NO: 605548 - DNA, 25 bp, Rattus norvegicus
tcatgctccgcgcttctgggaccag

SEQ ID NO: 605549 - DNA, 25 bp, Rattus norvegicus
ctaagcggcgttccactcgggaggt

SEQ ID NO: 605550 - DNA, 25 bp, Rattus norvegicus
acgcagtcgggccagatgatcaggc

SEQ ID NO: 605551 - DNA, 25 bp, Rattus norvegicus
ctgtccttcacggacgaggcacggg

SEQ ID NO: 605552 - DNA, 25 bp, Rattus norvegicus
atggcagcgcctggcccgtcatgct

SEQ ID NO: 605553 - DNA, 25 bp, Rattus norvegicus
atgatcaggcagctgcgtggttgct

SEQ ID NO: 605554 - DNA, 25 bp, Rattus norvegicus
ttgctctggggccatttcctctcct

SEQ ID NO: 605555 - DNA, 25 bp, Rattus norvegicus
gaggtcttctcgcttgtcatgattg

SEQ ID NO: 605556 - DNA, 25 bp, Rattus norvegicus
cagtcatctgcgcttcgaccgtgca

SEQ ID NO: 605557 - DNA, 25 bp, Rattus norvegicus
cgtgcagaactcgagcgcctcatgc

SEQ ID NO: 605558 - DNA, 25 bp, Rattus norvegicus
tacgttactatcctgcgcgaacctg

SEQ ID NO: 605559 - DNA, 25 bp, Rattus norvegicus
gccgccatgttcgagtcgcttttca

SEQ ID NO: 605560 - DNA, 25 bp, Rattus norvegicus
accctagctgcgagcaccagttctg

SEQ ID NO: 605561 - DNA, 25 bp, Rattus norvegicus
tttgctcacaacacgctggcctatg

SEQ ID NO: 605562 - DNA, 25 bp, Rattus norvegicus
cccgaggtgcagtactcaaactatc

SEQ ID NO: 605563 - DNA, 25 bp, Rattus norvegicus
cctgggacctagatgacgtgctcta

SEQ ID NO: 605564 - DNA, 25 bp, Rattus norvegicus
tgcccagattcgcacaaagcagctg

SEQ ID NO: 605565 - DNA, 25 bp, Rattus norvegicus
gcctagccgcaaagtggacatcatg

SEQ ID NO: 605566 - DNA, 25 bp, Rattus norvegicus
ggccctactacggaggcttgcctca

SEQ ID NO: 605567 - DNA, 25 bp, Rattus norvegicus
ctcaagcttgctatgcccgaggtgc

SEQ ID NO: 605568 - DNA, 25 bp, Rattus norvegicus
tactaccgtccaggcgagcacttcg

SEQ ID NO: 605569 - DNA, 25 bp, Rattus norvegicus
aaggcccatcgccagcgggaagtga

SEQ ID NO: 605570 - DNA, 25 bp, Rattus norvegicus
acaggttctggcgttctccggtcct

SEQ ID NO: 605571 - DNA, 25 bp, Rattus norvegicus
ttctggcgttctccggtcctgcggc

SEQ ID NO: 605572 - DNA, 25 bp, Rattus norvegicus
cggtcctgcggctccgcagctcagc

SEQ ID NO: 605573 - DNA, 25 bp, Rattus norvegicus
agcacccgcgggtcgtcgggtgaca

SEQ ID NO: 605574 - DNA, 25 bp, Rattus norvegicus
cagaatgcgagcaggccaaggccca

SEQ ID NO: 605575 - DNA, 25 bp, Rattus norvegicus
agagctccatcctgcccggctttta

SEQ ID NO: 605576 - DNA, 25 bp, Rattus norvegicus
tcgggtgacaggttctggcgttctc

SEQ ID NO: 605577 - DNA, 25 bp, Rattus norvegicus
atgcgagcaggccaaggcccatcgc

SEQ ID NO: 605578 - DNA, 25 bp, Rattus norvegicus
ccagcgggaagtgaggacgctccat

SEQ ID NO: 605579 - DNA, 25 bp, Rattus norvegicus
aggacgctccatagccgccgattca

SEQ ID NO: 605580 - DNA, 25 bp, Rattus norvegicus
ccatagccgccgattcagtgtcaga

SEQ ID NO: 605581 - DNA, 25 bp, Rattus norvegicus
ccgccgattcagtgtcagagctcca

SEQ ID NO: 605582 - DNA, 25 bp, Rattus norvegicus
attcagtgtcagagctccatcctgc

SEQ ID NO: 605583 - DNA, 25 bp, Rattus norvegicus
gagctgctttcaccgtcaacctgga

SEQ ID NO: 605584 - DNA, 25 bp, Rattus norvegicus
cctgcagacggaaggtaggaacacc

SEQ ID NO: 605585 - DNA, 25 bp, Rattus norvegicus
ggtccctttcaggaagccacgctgc

SEQ ID NO: 605586 - DNA, 25 bp, Rattus norvegicus
gaagtgcaattcacggcgcggtttc

SEQ ID NO: 605587 - DNA, 25 bp, Rattus norvegicus
tgtgcgcggccttcaaaataatccc

SEQ ID NO: 605588 - DNA, 25 bp, Rattus norvegicus
ccgccgatacctcaagcagctagaa

SEQ ID NO: 605589 - DNA, 25 bp, Rattus norvegicus
gcgcgcttctgcgatggactcctct

SEQ ID NO: 605590 - DNA, 25 bp, Rattus norvegicus
tcaacctggaaaacggagcttgctt

SEQ ID NO: 605591 - DNA, 25 bp, Rattus norvegicus
tcgaagggtctttctgcttgaagcg

SEQ ID NO: 605592 - DNA, 25 bp, Rattus norvegicus
tgctccactgcaaaggcgcgcttct

SEQ ID NO: 605593 - DNA, 25 bp, Rattus norvegicus
tgacgcttccgaggagaatactttt

SEQ ID NO: 605594 - DNA, 25 bp, Rattus norvegicus
tcccgtctgtgggattgacgcttcc

SEQ ID NO: 605595 - DNA, 25 bp, Rattus norvegicus
cgcggtttcctcagagtcaggttta

SEQ ID NO: 605596 - DNA, 25 bp, Rattus norvegicus
gccacgctgctttcgatggattttg

SEQ ID NO: 605597 - DNA, 25 bp, Rattus norvegicus
cacgcgcgcctgtagagactgcgaa

SEQ ID NO: 605598 - DNA, 25 bp, Rattus norvegicus
gagactgcgaaatcaagattctcgc

SEQ ID NO: 605599 - DNA, 25 bp, Rattus norvegicus
gacgacgcaaaatgggaacacttcc

SEQ ID NO: 605600 - DNA, 25 bp, Rattus norvegicus
ggcctcatagccttcatcgcgtttc

SEQ ID NO: 605601 - DNA, 25 bp, Rattus norvegicus
tggcttcgttcacgaccatgcgcgc

SEQ ID NO: 605602 - DNA, 25 bp, Rattus norvegicus
gctgctccgatgcttgtgtttcttg

SEQ ID NO: 605603 - DNA, 25 bp, Rattus norvegicus
tgtttcttgtgctctcgatgccgtg

SEQ ID NO: 605604 - DNA, 25 bp, Rattus norvegicus
ggttccgcttggcttcgttcacgac

SEQ ID NO: 605605 - DNA, 25 bp, Rattus norvegicus
acccgaacccagacgacgcaaaatg

SEQ ID NO: 605606 - DNA, 25 bp, Rattus norvegicus
caggtactgatctctgggcacgcgc

SEQ ID NO: 605607 - DNA, 25 bp, Rattus norvegicus
ctgttgccggaaactaagaggggct

SEQ ID NO: 605608 - DNA, 25 bp, Rattus norvegicus
ggcctgcctgggaacctccaaaggc

SEQ ID NO: 605609 - DNA, 25 bp, Rattus norvegicus
accgattgagagtgcgcgttcccac

SEQ ID NO: 605610 - DNA, 25 bp, Rattus norvegicus
cccatgattagtgcgtccgcctgga

SEQ ID NO: 605611 - DNA, 25 bp, Rattus norvegicus
caagcgctgggctttggatcctcta

SEQ ID NO: 605612 - DNA, 25 bp, Rattus norvegicus
gaagacctgcacctcccgggattct

SEQ ID NO: 605613 - DNA, 25 bp, Rattus norvegicus
gtgcgcgtccttctcagggatcgcc

SEQ ID NO: 605614 - DNA, 25 bp, Rattus norvegicus
cgccctccaagctaaagtacgaacg

SEQ ID NO: 605615 - DNA, 25 bp, Rattus norvegicus
cgaacgttagctccgcctcctgaag

SEQ ID NO: 605616 - DNA, 25 bp, Rattus norvegicus
ccgcgcgttatacttcttcttcttg

SEQ ID NO: 605617 - DNA, 25 bp, Rattus norvegicus
cttcttgcttggcatctcggggcct

SEQ ID NO: 605618 - DNA, 25 bp, Rattus norvegicus
accacttctcgcagggtcctagtgc

SEQ ID NO: 605619 - DNA, 25 bp, Rattus norvegicus
gccgttcgtagaaaagcagctccca

SEQ ID NO: 605620 - DNA, 25 bp, Rattus norvegicus
ctctgtcctatcaggttcgagtccg

SEQ ID NO: 605621 - DNA, 25 bp, Rattus norvegicus
tggtcctcgcgcagactctgtccta

SEQ ID NO: 605622 - DNA, 25 bp, Rattus norvegicus
cctgtgaacactaatggcggcgggt

SEQ ID NO: 605623 - DNA, 25 bp, Rattus norvegicus
tggaggcaacccttacctgtgaaca

SEQ ID NO: 605624 - DNA, 25 bp, Rattus norvegicus
tcaccggcggaaaccgcgcgttata

SEQ ID NO: 605625 - DNA, 25 bp, Rattus norvegicus
ctgtatagatagagctcatgggccc

SEQ ID NO: 605626 - DNA, 25 bp, Rattus norvegicus
tgcagtggttcagcccaagaacttt

SEQ ID NO: 605627 - DNA, 25 bp, Rattus norvegicus
cagcccagggcatgtaccgagactt

SEQ ID NO: 605628 - DNA, 25 bp, Rattus norvegicus
agttagtctagtatgcccgggatta

SEQ ID NO: 605629 - DNA, 25 bp, Rattus norvegicus
agctaactctaatggtcgcgactga

SEQ ID NO: 605630 - DNA, 25 bp, Rattus norvegicus
tcgcgactgaggatcctgcacattc

SEQ ID NO: 605631 - DNA, 25 bp, Rattus norvegicus
tctgggcacataggagactgggtcc

SEQ ID NO: 605632 - DNA, 25 bp, Rattus norvegicus
tggctgttcgtgtgtcgctctaatt

SEQ ID NO: 605633 - DNA, 25 bp, Rattus norvegicus
acgcggtcaagtcctcatctttttg

SEQ ID NO: 605634 - DNA, 25 bp, Rattus norvegicus
ggttcctggagaccacgaagtgttg

SEQ ID NO: 605635 - DNA, 25 bp, Rattus norvegicus
agtcggtcgctttttcccagtagag

SEQ ID NO: 605636 - DNA, 25 bp, Rattus norvegicus
tgcacattctgcgtggtccgggaac

SEQ ID NO: 605637 - DNA, 25 bp, Rattus norvegicus
cgctctaattgtccgtgtcccttta

SEQ ID NO: 605638 - DNA, 25 bp, Rattus norvegicus
acccagtcgggacagcgaattctta

SEQ ID NO: 605639 - DNA, 25 bp, Rattus norvegicus
ctggaacttccatcgcctaggtcgc

SEQ ID NO: 605640 - DNA, 25 bp, Rattus norvegicus
gctcagccgaagctgcgaccaggtc

SEQ ID NO: 605641 - DNA, 25 bp, Rattus norvegicus
accaggtctggaggtccacggcatt

SEQ ID NO: 605642 - DNA, 25 bp, Rattus norvegicus
tgagctcacggatctcacccaggtg

SEQ ID NO: 605643 - DNA, 25 bp, Rattus norvegicus
ggcgccctcagtcatcaggagagca

SEQ ID NO: 605644 - DNA, 25 bp, Rattus norvegicus
ctgcctcggcctccatagttgatca

SEQ ID NO: 605645 - DNA, 25 bp, Rattus norvegicus
cccagtgctaggcaaagctccttaa

SEQ ID NO: 605646 - DNA, 25 bp, Rattus norvegicus
ctccatagttgatcaggcagctgca

SEQ ID NO: 605647 - DNA, 25 bp, Rattus norvegicus
ttaagggccagattttcccgcagca

SEQ ID NO: 605648 - DNA, 25 bp, Rattus norvegicus
ggccttccagctcggctagcttctg

SEQ ID NO: 605649 - DNA, 25 bp, Rattus norvegicus
ttgggtcccaaagagctgccactgg

SEQ ID NO: 605650 - DNA, 25 bp, Rattus norvegicus
ttggcgctctgagtccaggaagcag

SEQ ID NO: 605651 - DNA, 25 bp, Rattus norvegicus
acgccggttgagctgtttgagctca

SEQ ID NO: 605652 - DNA, 25 bp, Rattus norvegicus
tggcgtggaaaatgcggcgccctca

SEQ ID NO: 605653 - DNA, 25 bp, Rattus norvegicus
gtccagtgagctgcgcggtccgtcc

SEQ ID NO: 605654 - DNA, 25 bp, Rattus norvegicus
caacgcgtgagtggcctccagcgga

SEQ ID NO: 605655 - DNA, 25 bp, Rattus norvegicus
cctgcgcttcatgactcgtggggcg

SEQ ID NO: 605656 - DNA, 25 bp, Rattus norvegicus
aggcctgcgcttcatgactcgtggg

SEQ ID NO: 605657 - DNA, 25 bp, Rattus norvegicus
caggaatccgccgaagggcgggcgg

SEQ ID NO: 605658 - DNA, 25 bp, Rattus norvegicus
tgttgcggccgagtatatgctgcgc

SEQ ID NO: 605659 - DNA, 25 bp, Rattus norvegicus
agtcaacgcgtgagtggcctccagc

SEQ ID NO: 605660 - DNA, 25 bp, Rattus norvegicus
tggagtcaacgcgtgagtggcctcc

SEQ ID NO: 605661 - DNA, 25 bp, Rattus norvegicus
cgcaggcactgctggagtcaacgcg

SEQ ID NO: 605662 - DNA, 25 bp, Rattus norvegicus
cgcccgcaggcactgctggagtcaa

SEQ ID NO: 605663 - DNA, 25 bp, Rattus norvegicus
cggtccaagattgcggccctgagcc

SEQ ID NO: 605664 - DNA, 25 bp, Rattus norvegicus
cttcctggggccgcgcgtccagtga

SEQ ID NO: 605665 - DNA, 25 bp, Rattus norvegicus
gtccacaggcgactccaggcagcgc

SEQ ID NO: 605666 - DNA, 25 bp, Rattus norvegicus
ccgagtatatgctgcgcggagcgga

SEQ ID NO: 605667 - DNA, 25 bp, Rattus norvegicus
tcatgccctaataaggacatctagg

SEQ ID NO: 605668 - DNA, 25 bp, Rattus norvegicus
ctcaagcagccttataaggagcctg

SEQ ID NO: 605669 - DNA, 25 bp, Rattus norvegicus
ttcagctgtcatgccggaagtcgct

SEQ ID NO: 605670 - DNA, 25 bp, Rattus norvegicus
ccggaagtcgctgggcgcccaattc

SEQ ID NO: 605671 - DNA, 25 bp, Rattus norvegicus
ttcgcagaccctcgtctcaatctag

SEQ ID NO: 605672 - DNA, 25 bp, Rattus norvegicus
agaccctcgtctcaatctagctttc

SEQ ID NO: 605673 - DNA, 25 bp, Rattus norvegicus
ggagctcgtcttctctttagcctcg

SEQ ID NO: 605674 - DNA, 25 bp, Rattus norvegicus
cggaagaagcgcgtctccagggtaa

SEQ ID NO: 605675 - DNA, 25 bp, Rattus norvegicus
cgtctccagggtaactgcgtagccc

SEQ ID NO: 605676 - DNA, 25 bp, Rattus norvegicus
ccgttgctctgggaaactgcgagtc

SEQ ID NO: 605677 - DNA, 25 bp, Rattus norvegicus
ctctgggaaactgcgagtctcgttt

SEQ ID NO: 605678 - DNA, 25 bp, Rattus norvegicus
ccctctggaggctcatgccctaata

SEQ ID NO: 605679 - DNA, 25 bp, Rattus norvegicus
tataaggagcctgcagctggcgctt

SEQ ID NO: 605680 - DNA, 25 bp, Rattus norvegicus
agtctcgtttaaggcggagctcgtc

SEQ ID NO: 605681 - DNA, 25 bp, Rattus norvegicus
ccctggggccactagagaaaagcgc

SEQ ID NO: 605682 - DNA, 25 bp, Rattus norvegicus
acctgattgagtagccggctcctga

SEQ ID NO: 605683 - DNA, 25 bp, Rattus norvegicus
ccattctgcttttgcgccagcgcga

SEQ ID NO: 605684 - DNA, 25 bp, Rattus norvegicus
gcctcaagctctgcggaactgggta

SEQ ID NO: 605685 - DNA, 25 bp, Rattus norvegicus
ctatttcggtgcaaagtcctcggac

SEQ ID NO: 605686 - DNA, 25 bp, Rattus norvegicus
tcattgtgcggctcctactaaacgg

SEQ ID NO: 605687 - DNA, 25 bp, Rattus norvegicus
cggcggctctgttcttctgtagctc

SEQ ID NO: 605688 - DNA, 25 bp, Rattus norvegicus
gtttccggaaacatggtgagcacta

SEQ ID NO: 605689 - DNA, 25 bp, Rattus norvegicus
cactgcgcctaagggaagcggtttc

SEQ ID NO: 605690 - DNA, 25 bp, Rattus norvegicus
cccgagcgagattaagggtctcatt

SEQ ID NO: 605691 - DNA, 25 bp, Rattus norvegicus
ggcaacgctctctggttctcgatgg

SEQ ID NO: 605692 - DNA, 25 bp, Rattus norvegicus
ccctctgcggataggttggtctcca

SEQ ID NO: 605693 - DNA, 25 bp, Rattus norvegicus
tcaacacgggtttacaggctatctc

SEQ ID NO: 605694 - DNA, 25 bp, Rattus norvegicus
gctctacacgagctaaggccttttg

SEQ ID NO: 605695 - DNA, 25 bp, Rattus norvegicus
ctcgcggcgcgcagagaaaggaatc

SEQ ID NO: 605696 - DNA, 25 bp, Rattus norvegicus
gaaaggaatcgtgtgagcgctcaca

SEQ ID NO: 605697 - DNA, 25 bp, Rattus norvegicus
gcgcgaaaagagaggaacgagccca

SEQ ID NO: 605698 - DNA, 25 bp, Rattus norvegicus
aatggctactgagggcactcgcagg

SEQ ID NO: 605699 - DNA, 25 bp, Rattus norvegicus
cggcggccagtgaataatggctact

SEQ ID NO: 605700 - DNA, 25 bp, Rattus norvegicus
aggccgtctctaattacctcctgtc

SEQ ID NO: 605701 - DNA, 25 bp, Rattus norvegicus
ggacgtggccacaaggccgtctcta

SEQ ID NO: 605702 - DNA, 25 bp, Rattus norvegicus
cgcatcgtgctagcccagtggacgt

SEQ ID NO: 605703 - DNA, 25 bp, Rattus norvegicus
gtgagagccgcgagagcgtctcctt

SEQ ID NO: 605704 - DNA, 25 bp, Rattus norvegicus
tgacctggccacagcggtgagagcc

SEQ ID NO: 605705 - DNA, 25 bp, Rattus norvegicus
aggaacctcgcagcagtgacctggc

SEQ ID NO: 605706 - DNA, 25 bp, Rattus norvegicus
tttaggcgcctaggaacctcgcagc

SEQ ID NO: 605707 - DNA, 25 bp, Rattus norvegicus
ccactcggtctttaggcgcctagga

SEQ ID NO: 605708 - DNA, 25 bp, Rattus norvegicus
gcgctcacatatttttctcccaagg

SEQ ID NO: 605709 - DNA, 25 bp, Rattus norvegicus
gaatgatgtcattctcccggcgtga

SEQ ID NO: 605710 - DNA, 25 bp, Rattus norvegicus
agacggacagtctggacagcagacc

SEQ ID NO: 605711 - DNA, 25 bp, Rattus norvegicus
tcggtacttggcagacggacagtct

SEQ ID NO: 605712 - DNA, 25 bp, Rattus norvegicus
tgtcatcctacatgccacaacaaga

SEQ ID NO: 605713 - DNA, 25 bp, Rattus norvegicus
aagatgcctcatttcccaaccacgg

SEQ ID NO: 605714 - DNA, 25 bp, Rattus norvegicus
ccaaggctgaggtctgcagcagtgc

SEQ ID NO: 605715 - DNA, 25 bp, Rattus norvegicus
cagggaccctgaccactaccaataa

SEQ ID NO: 605716 - DNA, 25 bp, Rattus norvegicus
aggctcatcagcctcgggccaggtg

SEQ ID NO: 605717 - DNA, 25 bp, Rattus norvegicus
agcagaagctgcgtcttcccaggcg

SEQ ID NO: 605718 - DNA, 25 bp, Rattus norvegicus
acggcccatctggaggttacctcct

SEQ ID NO: 605719 - DNA, 25 bp, Rattus norvegicus
tacctcctcggaggcctggaagtct

SEQ ID NO: 605720 - DNA, 25 bp, Rattus norvegicus
gaagtcttccatcttccctctagcg

SEQ ID NO: 605721 - DNA, 25 bp, Rattus norvegicus
cttcgcccgccgagtagagtggact

SEQ ID NO: 605722 - DNA, 25 bp, Rattus norvegicus
aaccacggcccaaggctgaggtctg

SEQ ID NO: 605723 - DNA, 25 bp, Rattus norvegicus
cactagggcagcttggcgccaccag

SEQ ID NO: 605724 - DNA, 25 bp, Rattus norvegicus
cggacctaaggcgatcgtcaccgga

SEQ ID NO: 605725 - DNA, 25 bp, Rattus norvegicus
gtctgtggagaaagagcttccgtta

SEQ ID NO: 605726 - DNA, 25 bp, Rattus norvegicus
aggcgatcgtcaccggagtcacact

SEQ ID NO: 605727 - DNA, 25 bp, Rattus norvegicus
cgccttcttctaacgggcacgagca

SEQ ID NO: 605728 - DNA, 25 bp, Rattus norvegicus
tctaacgggcacgagcagaagtgca

SEQ ID NO: 605729 - DNA, 25 bp, Rattus norvegicus
cgagcagaagtgcacaggcgcacta

SEQ ID NO: 605730 - DNA, 25 bp, Rattus norvegicus
aagagcttccgttactgttttcaca

SEQ ID NO: 605731 - DNA, 25 bp, Rattus norvegicus
ttactgttttcacacccgggctgga

SEQ ID NO: 605732 - DNA, 25 bp, Rattus norvegicus
tcacacccgggctggaaagaatgga

SEQ ID NO: 605733 - DNA, 25 bp, Rattus norvegicus
gaatggaggaaacagcttacagagc

SEQ ID NO: 605734 - DNA, 25 bp, Rattus norvegicus
aggaaacagcttacagagccgcggg

SEQ ID NO: 605735 - DNA, 25 bp, Rattus norvegicus
gataccgggcgcccataggaagccc

SEQ ID NO: 605736 - DNA, 25 bp, Rattus norvegicus
gtgcacaggcgcactagggcagctt

SEQ ID NO: 605737 - DNA, 25 bp, Rattus norvegicus
accacgcgtggcgtttccaactacg

SEQ ID NO: 605738 - DNA, 25 bp, Rattus norvegicus
ggcgcctcacctggcacgtagatct

SEQ ID NO: 605739 - DNA, 25 bp, Rattus norvegicus
ggagctcgctccagttcctcttgca

SEQ ID NO: 605740 - DNA, 25 bp, Rattus norvegicus
ttcctcttgcacgtggagacgcatg

SEQ ID NO: 605741 - DNA, 25 bp, Rattus norvegicus
aacgcgcggggcatcttcaattcct

SEQ ID NO: 605742 - DNA, 25 bp, Rattus norvegicus
aggcgccggaatagggacagttcaa

SEQ ID NO: 605743 - DNA, 25 bp, Rattus norvegicus
agcgagcgtctttcagctagactgg

SEQ ID NO: 605744 - DNA, 25 bp, Rattus norvegicus
cggctgctcgcgaagtcttcaagtg

SEQ ID NO: 605745 - DNA, 25 bp, Rattus norvegicus
ccggcgtgctcacgtttgcaaacta

SEQ ID NO: 605746 - DNA, 25 bp, Rattus norvegicus
accggtttccattccgctgcgggtg

SEQ ID NO: 605747 - DNA, 25 bp, Rattus norvegicus
aacgttatttgcaccggcgctcgca

SEQ ID NO: 605748 - DNA, 25 bp, Rattus norvegicus
cgctctgtgggcgatggcacaaaac

SEQ ID NO: 605749 - DNA, 25 bp, Rattus norvegicus
ttcaagctttattggctcgcggcgg

SEQ ID NO: 605750 - DNA, 25 bp, Rattus norvegicus
ttctcttccactggatcggggttga

SEQ ID NO: 605751 - DNA, 25 bp, Rattus norvegicus
ccagggcctgggaacgcagttcaat

SEQ ID NO: 605752 - DNA, 25 bp, Rattus norvegicus
tgcacggcgagacagttactcagac

SEQ ID NO: 605753 - DNA, 25 bp, Rattus norvegicus
tcagacctggcgaaaccagcgagtc

SEQ ID NO: 605754 - DNA, 25 bp, Rattus norvegicus
actcaagcggtgagagaggccgacc

SEQ ID NO: 605755 - DNA, 25 bp, Rattus norvegicus
agcgacgctgtggtttcgatgccct

SEQ ID NO: 605756 - DNA, 25 bp, Rattus norvegicus
atgcccttcgtaggcggaaggctta

SEQ ID NO: 605757 - DNA, 25 bp, Rattus norvegicus
aggcttaatgagctctcagcacgca

SEQ ID NO: 605758 - DNA, 25 bp, Rattus norvegicus
tccgaagcctccagatttcatcttg

SEQ ID NO: 605759 - DNA, 25 bp, Rattus norvegicus
tgttgcttccggcatcatctccgaa

SEQ ID NO: 605760 - DNA, 25 bp, Rattus norvegicus
cttcgggcaaaggtcaacagctacc

SEQ ID NO: 605761 - DNA, 25 bp, Rattus norvegicus
ccctgttggcaatccgtgcgacttc

SEQ ID NO: 605762 - DNA, 25 bp, Rattus norvegicus
tcctatcctgtagaggcctgggctg

SEQ ID NO: 605763 - DNA, 25 bp, Rattus norvegicus
tttcatcttgggacctgggcattgc

SEQ ID NO: 605764 - DNA, 25 bp, Rattus norvegicus
agctaccatccggttgcgactctgg

SEQ ID NO: 605765 - DNA, 25 bp, Rattus norvegicus
ccaggcccagtcttatggctttgca

SEQ ID NO: 605766 - DNA, 25 bp, Rattus norvegicus
acaaagcggacgaggcacaggagcc

SEQ ID NO: 605767 - DNA, 25 bp, Rattus norvegicus
agctgaacttctcaggggacgcgga

SEQ ID NO: 605768 - DNA, 25 bp, Rattus norvegicus
ggctgatagggaagctgaacttctc

SEQ ID NO: 605769 - DNA, 25 bp, Rattus norvegicus
agatgtagctgtcccgccagggttt

SEQ ID NO: 605770 - DNA, 25 bp, Rattus norvegicus
ggctttgcatgtccctcctgcagga

SEQ ID NO: 605771 - DNA, 25 bp, Rattus norvegicus
agaggccgccgattcattctccggg

SEQ ID NO: 605772 - DNA, 25 bp, Rattus norvegicus
catgtgacgttctggtcagccggcc

SEQ ID NO: 605773 - DNA, 25 bp, Rattus norvegicus
aagctgcacctcctgccatgtgacg

SEQ ID NO: 605774 - DNA, 25 bp, Rattus norvegicus
gtggcgccgcaccagctaagctgca

SEQ ID NO: 605775 - DNA, 25 bp, Rattus norvegicus
ctggggacgataaacagcgtattca

SEQ ID NO: 605776 - DNA, 25 bp, Rattus norvegicus
ccgagatgaagaacccggaggaagc

SEQ ID NO: 605777 - DNA, 25 bp, Rattus norvegicus
ctgaacctacaagcatccgagatga

SEQ ID NO: 605778 - DNA, 25 bp, Rattus norvegicus
cctgcaggactgcaggtgtcgtttc

SEQ ID NO: 605779 - DNA, 25 bp, Rattus norvegicus
gccggtcactcagatcaagtgttta

SEQ ID NO: 605780 - DNA, 25 bp, Rattus norvegicus
acgccactcatcttcgttgtcctgg

SEQ ID NO: 605781 - DNA, 25 bp, Rattus norvegicus
cacttccggagctgagtgcgctata

SEQ ID NO: 605782 - DNA, 25 bp, Rattus norvegicus
cgaaactgcttgagaggaaaacact

SEQ ID NO: 605783 - DNA, 25 bp, Rattus norvegicus
acacttgagagtcactgccagctgg

SEQ ID NO: 605784 - DNA, 25 bp, Rattus norvegicus
tgccagctggttggtagtaaaaagc

SEQ ID NO: 605785 - DNA, 25 bp, Rattus norvegicus
ggcccggttgaggaatggaacaaca

SEQ ID NO: 605786 - DNA, 25 bp, Rattus norvegicus
gaacaacagggcgttgtaagcctga

SEQ ID NO: 605787 - DNA, 25 bp, Rattus norvegicus
taagcctgaggccaagtactagatg

SEQ ID NO: 605788 - DNA, 25 bp, Rattus norvegicus
ggaatccctactattcgcacagcga

SEQ ID NO: 605789 - DNA, 25 bp, Rattus norvegicus
ggatcatctccgtacgtccaaaagt

SEQ ID NO: 605790 - DNA, 25 bp, Rattus norvegicus
aacgccgagtctgtcacgtgacgcc

SEQ ID NO: 605791 - DNA, 25 bp, Rattus norvegicus
tatgctttgtctggccgcagtgttc

SEQ ID NO: 605792 - DNA, 25 bp, Rattus norvegicus
cgcacagcgattggaggaacgccga

SEQ ID NO: 605793 - DNA, 25 bp, Rattus norvegicus
gcggaagcagcaggcctgagcctct

SEQ ID NO: 605794 - DNA, 25 bp, Rattus norvegicus
agccggatctaggttgggagcatat

SEQ ID NO: 605795 - DNA, 25 bp, Rattus norvegicus
aatggcttcgctttagcgcgccgtg

SEQ ID NO: 605796 - DNA, 25 bp, Rattus norvegicus
cgcctctggcgaatggcttcgcttt

SEQ ID NO: 605797 - DNA, 25 bp, Rattus norvegicus
gcgcccagcgtgagttgcgcacctg

SEQ ID NO: 605798 - DNA, 25 bp, Rattus norvegicus
cctcaggacgaatagcctcggcgtc

SEQ ID NO: 605799 - DNA, 25 bp, Rattus norvegicus
gacacggagcgaaccgcgctgcgta

SEQ ID NO: 605800 - DNA, 25 bp, Rattus norvegicus
aaacagagtgagtaatcgcgggccc

SEQ ID NO: 605801 - DNA, 25 bp, Rattus norvegicus
gcctctccttgtgcagggcgaatgg

SEQ ID NO: 605802 - DNA, 25 bp, Rattus norvegicus
tcagtcactgtgctccgcggaagca

SEQ ID NO: 605803 - DNA, 25 bp, Rattus norvegicus
gaaaacgtgtggaattcagtcactg

SEQ ID NO: 605804 - DNA, 25 bp, Rattus norvegicus
ggccctgcacgagtaggaaaacgtg

SEQ ID NO: 605805 - DNA, 25 bp, Rattus norvegicus
ttgggagcatatggcctgtaacgcg

SEQ ID NO: 605806 - DNA, 25 bp, Rattus norvegicus
caaactcttgagatcagagcggggc

SEQ ID NO: 605807 - DNA, 25 bp, Rattus norvegicus
gcagggctagttctctggtctcaca

SEQ ID NO: 605808 - DNA, 25 bp, Rattus norvegicus
tccacgtgcgtgatgaaaccctctg

SEQ ID NO: 605809 - DNA, 25 bp, Rattus norvegicus
gctcaccagctgcagcgaaaggtta

SEQ ID NO: 605810 - DNA, 25 bp, Rattus norvegicus
cactacagcagcctaacggagtttc

SEQ ID NO: 605811 - DNA, 25 bp, Rattus norvegicus
tgtccacagtgcgtaccagacctgg

SEQ ID NO: 605812 - DNA, 25 bp, Rattus norvegicus
ccttagttttggactctggctcacc

SEQ ID NO: 605813 - DNA, 25 bp, Rattus norvegicus
ccgcgcccgtggtatagatcaagtt

SEQ ID NO: 605814 - DNA, 25 bp, Rattus norvegicus
gaaggtccaggccaatacatcgcga

SEQ ID NO: 605815 - DNA, 25 bp, Rattus norvegicus
atcgcgacaggcacaattgaagacc

SEQ ID NO: 605816 - DNA, 25 bp, Rattus norvegicus
gtctctgctgagatgcccaacaagc

SEQ ID NO: 605817 - DNA, 25 bp, Rattus norvegicus
gcgaagccgaatccagcgaagtagt

SEQ ID NO: 605818 - DNA, 25 bp, Rattus norvegicus
agccaggtcctgcaggtactgttga

SEQ ID NO: 605819 - DNA, 25 bp, Rattus norvegicus
cccatcgagtcgtagcgtgatcgcc

SEQ ID NO: 605820 - DNA, 25 bp, Rattus norvegicus
gtggtctccgcgaacgtgaagcgtt

SEQ ID NO: 605821 - DNA, 25 bp, Rattus norvegicus
ctggcgcaggatctgcaacacctga

SEQ ID NO: 605822 - DNA, 25 bp, Rattus norvegicus
gcatgcgcccgttagaacctgttgg

SEQ ID NO: 605823 - DNA, 25 bp, Rattus norvegicus
ggcttacgcctctacttccgggtca

SEQ ID NO: 605824 - DNA, 25 bp, Rattus norvegicus
tgaccgtaagtcaagtcgtcgcttg

SEQ ID NO: 605825 - DNA, 25 bp, Rattus norvegicus
ttccagtttgcgttaccgggtcaca

SEQ ID NO: 605826 - DNA, 25 bp, Rattus norvegicus
ggctggaactcctcaaggctacttc

SEQ ID NO: 605827 - DNA, 25 bp, Rattus norvegicus
gtcgccattgggtaacgacttaatg

SEQ ID NO: 605828 - DNA, 25 bp, Rattus norvegicus
ggcgcgcgcagtcaaattctagaga

SEQ ID NO: 605829 - DNA, 25 bp, Rattus norvegicus
caaaagcttggggttctgcgttcgc

SEQ ID NO: 605830 - DNA, 25 bp, Rattus norvegicus
ctctcggagtgccagtgataggtcc

SEQ ID NO: 605831 - DNA, 25 bp, Rattus norvegicus
ctccggtggcccagaactgttgtaa

SEQ ID NO: 605832 - DNA, 25 bp, Rattus norvegicus
gcagtcagccgatcaggccggaata

SEQ ID NO: 605833 - DNA, 25 bp, Rattus norvegicus
ggtccgacttagatttcacgccatg

SEQ ID NO: 605834 - DNA, 25 bp, Rattus norvegicus
ggcgcaaagcttttccaatgcgtta

SEQ ID NO: 605835 - DNA, 25 bp, Rattus norvegicus
gcgcgagctgacactgctgctacag

SEQ ID NO: 605836 - DNA, 25 bp, Rattus norvegicus
tccggagcttaggaactactgagcc

SEQ ID NO: 605837 - DNA, 25 bp, Rattus norvegicus
gctgctccggagcttaggaactact

SEQ ID NO: 605838 - DNA, 25 bp, Rattus norvegicus
ttaggaactactgagccgcgaggag

SEQ ID NO: 605839 - DNA, 25 bp, Rattus norvegicus
aactgacgcgcgcagcacgcgagca

SEQ ID NO: 605840 - DNA, 25 bp, Rattus norvegicus
agcagctgcgacggcgcgagcacct

SEQ ID NO: 605841 - DNA, 25 bp, Rattus norvegicus
gccgacgcggcaccttcaagcggag

SEQ ID NO: 605842 - DNA, 25 bp, Rattus norvegicus
gctgctacagcaggtggaccgagaa

SEQ ID NO: 605843 - DNA, 25 bp, Rattus norvegicus
acagcaggtggaccgagaacggcca

SEQ ID NO: 605844 - DNA, 25 bp, Rattus norvegicus
gtggaccgagaacggccacacgtgc

SEQ ID NO: 605845 - DNA, 25 bp, Rattus norvegicus
aacggccacacgtgcgccgccgacg

SEQ ID NO: 605846 - DNA, 25 bp, Rattus norvegicus
gcggcaccttcaagcggagcaagct

SEQ ID NO: 605847 - DNA, 25 bp, Rattus norvegicus
agcacgcgagcagcggtcccaggca

SEQ ID NO: 605848 - DNA, 25 bp, Rattus norvegicus
gagcaagctccgagcgagggatggc

SEQ ID NO: 605849 - DNA, 25 bp, Rattus norvegicus
tcacggcgaccgagctactggtgga

SEQ ID NO: 605850 - DNA, 25 bp, Rattus norvegicus
cgcaatctgtatcgggaagctggtc

SEQ ID NO: 605851 - DNA, 25 bp, Rattus norvegicus
atctgtatcgggaagctggtccggc

SEQ ID NO: 605852 - DNA, 25 bp, Rattus norvegicus
ggcgtttcgagcaccggtcctactg

SEQ ID NO: 605853 - DNA, 25 bp, Rattus norvegicus
cggtcctactgtgagcaaccagtga

SEQ ID NO: 605854 - DNA, 25 bp, Rattus norvegicus
ctgtgagcaaccagtgagaaacttc

SEQ ID NO: 605855 - DNA, 25 bp, Rattus norvegicus
cagtgagaaacttcccgagagtgcc

SEQ ID NO: 605856 - DNA, 25 bp, Rattus norvegicus
ctcaagttcgcaatctgtatcggga

SEQ ID NO: 605857 - DNA, 25 bp, Rattus norvegicus
gaaacttcccgagagtgccgtctcc

SEQ ID NO: 605858 - DNA, 25 bp, Rattus norvegicus
gttcacctcaagttcgcaatctgta

SEQ ID NO: 605859 - DNA, 25 bp, Rattus norvegicus
ggaaggagttcacctcaagttcgca

SEQ ID NO: 605860 - DNA, 25 bp, Rattus norvegicus
tggagaaggaaggagttcacctcaa

SEQ ID NO: 605861 - DNA, 25 bp, Rattus norvegicus
cgaccgagctactggtggaagaatt

SEQ ID NO: 605862 - DNA, 25 bp, Rattus norvegicus
gaagaattggggctgagatgtcgcg

SEQ ID NO: 605863 - DNA, 25 bp, Rattus norvegicus
atctggcacaggtacgtcatgacga

SEQ ID NO: 605864 - DNA, 25 bp, Rattus norvegicus
agcagccgagacacgcccagggcag

SEQ ID NO: 605865 - DNA, 25 bp, Rattus norvegicus
agaagcaccatgtccgctggctcga

SEQ ID NO: 605866 - DNA, 25 bp, Rattus norvegicus
catgacgatgagcttgtcaggtacg

SEQ ID NO: 605867 - DNA, 25 bp, Rattus norvegicus
gtgcagaaggcacggatctggcaca

SEQ ID NO: 605868 - DNA, 25 bp, Rattus norvegicus
cagctcctgcccagtgcagaaggca

SEQ ID NO: 605869 - DNA, 25 bp, Rattus norvegicus
acgataagtgccagagccaccgccg

SEQ ID NO: 605870 - DNA, 25 bp, Rattus norvegicus
tgggcgtttcccacacgataagtgc

SEQ ID NO: 605871 - DNA, 25 bp, Rattus norvegicus
ctgcgtttaggcagtccggcaggct

SEQ ID NO: 605872 - DNA, 25 bp, Rattus norvegicus
tgcgccaggtctcctgcgtttaggc

SEQ ID NO: 605873 - DNA, 25 bp, Rattus norvegicus
catgttcgcgtagccgctgcgccag

SEQ ID NO: 605874 - DNA, 25 bp, Rattus norvegicus
ccttaggctctgtagacgcttcagc

SEQ ID NO: 605875 - DNA, 25 bp, Rattus norvegicus
gcggttcacagcctccttaggctct

SEQ ID NO: 605876 - DNA, 25 bp, Rattus norvegicus
gtcaggtacggacagaagcaccatg

SEQ ID NO: 605877 - DNA, 25 bp, Rattus norvegicus
cgcaaccgcgggatcttttaacact

SEQ ID NO: 605878 - DNA, 25 bp, Rattus norvegicus
tcgaggaaatgctactccacgtgct

SEQ ID NO: 605879 - DNA, 25 bp, Rattus norvegicus
ctgcaccgagcggagtcgaggaaat

SEQ ID NO: 605880 - DNA, 25 bp, Rattus norvegicus
ctcgcttacgactccgcggaggagt

SEQ ID NO: 605881 - DNA, 25 bp, Rattus norvegicus
accagcgaggtgagccggccaatat

SEQ ID NO: 605882 - DNA, 25 bp, Rattus norvegicus
agccaccgtgcacgaccagcgaggt

SEQ ID NO: 605883 - DNA, 25 bp, Rattus norvegicus
acgtggtggcacaccgaatgctccc

SEQ ID NO: 605884 - DNA, 25 bp, Rattus norvegicus
gtggggactcccaagtccgcgcaca

SEQ ID NO: 605885 - DNA, 25 bp, Rattus norvegicus
tcttcacaaattgggatcggccggg

SEQ ID NO: 605886 - DNA, 25 bp, Rattus norvegicus
tcacttcgtgaagcaaccgttgccc

SEQ ID NO: 605887 - DNA, 25 bp, Rattus norvegicus
gccgctccggaacagcgacaactta

SEQ ID NO: 605888 - DNA, 25 bp, Rattus norvegicus
gcgacaacttactggcttgggcatc

SEQ ID NO: 605889 - DNA, 25 bp, Rattus norvegicus
tccgcagtccggagcttaagaactg

SEQ ID NO: 605890 - DNA, 25 bp, Rattus norvegicus
ctccactgtccctcaggcgtgggga

SEQ ID NO: 605891 - DNA, 25 bp, Rattus norvegicus
tcccgaccgcaaagacagtttggtg

SEQ ID NO: 605892 - DNA, 25 bp, Rattus norvegicus
aagatacgtctgaggttcggaccta

SEQ ID NO: 605893 - DNA, 25 bp, Rattus norvegicus
cccgtccgagaagatacgtctgagg

SEQ ID NO: 605894 - DNA, 25 bp, Rattus norvegicus
tgaggttcggacctaggctgtgctt

SEQ ID NO: 605895 - DNA, 25 bp, Rattus norvegicus
ttcggacctaggctgtgcttgttgg

SEQ ID NO: 605896 - DNA, 25 bp, Rattus norvegicus
cgtcgagctggtcggagctccgaat

SEQ ID NO: 605897 - DNA, 25 bp, Rattus norvegicus
tccgaattgcgagcgcgccgtttcc

SEQ ID NO: 605898 - DNA, 25 bp, Rattus norvegicus
agctggtcggagctccgaattgcga

SEQ ID NO: 605899 - DNA, 25 bp, Rattus norvegicus
tccgagaagatacgtctgaggttcg

SEQ ID NO: 605900 - DNA, 25 bp, Rattus norvegicus
gagcgcgccgtttcctggagccgca

SEQ ID NO: 605901 - DNA, 25 bp, Rattus norvegicus
gagtcccgaccgcaaagacagtttg

SEQ ID NO: 605902 - DNA, 25 bp, Rattus norvegicus
tcggagctccgaattgcgagcgcgc

SEQ ID NO: 605903 - DNA, 25 bp, Rattus norvegicus
caaagacagtttggtgggcgcccgc

SEQ ID NO: 605904 - DNA, 25 bp, Rattus norvegicus
tggagggaacgagtcccgaccgcaa

SEQ ID NO: 605905 - DNA, 25 bp, Rattus norvegicus
ccgctgcagagcctaaattggcaga

SEQ ID NO: 605906 - DNA, 25 bp, Rattus norvegicus
gccagtgcagagtcgaggttaaccg

SEQ ID NO: 605907 - DNA, 25 bp, Rattus norvegicus
cctaaattggcagagcccgcggcgt

SEQ ID NO: 605908 - DNA, 25 bp, Rattus norvegicus
cgactcagctcgtcgtggatgcggc

SEQ ID NO: 605909 - DNA, 25 bp, Rattus norvegicus
ctccgttggctgtagacacgctcta

SEQ ID NO: 605910 - DNA, 25 bp, Rattus norvegicus
tccacgagccaccactagcgttaag

SEQ ID NO: 605911 - DNA, 25 bp, Rattus norvegicus
tagcgttaagaaggccgctgaggcc

SEQ ID NO: 605912 - DNA, 25 bp, Rattus norvegicus
ccaccgggcgcctcagttgagggca

SEQ ID NO: 605913 - DNA, 25 bp, Rattus norvegicus
gttcatagccagaccgcgcggaccg

SEQ ID NO: 605914 - DNA, 25 bp, Rattus norvegicus
ctcctacgtttgctgcggactgctg

SEQ ID NO: 605915 - DNA, 25 bp, Rattus norvegicus
gctgcggactgctgcccagaggacc

SEQ ID NO: 605916 - DNA, 25 bp, Rattus norvegicus
agaggacccgctctctgtggcccgg

SEQ ID NO: 605917 - DNA, 25 bp, Rattus norvegicus
caggccgggctttgttccgtcccag

SEQ ID NO: 605918 - DNA, 25 bp, Rattus norvegicus
ctcagttgagggcagcccgttcata

SEQ ID NO: 605919 - DNA, 25 bp, Rattus norvegicus
gctgcacgtttgaccctgacctaca

SEQ ID NO: 605920 - DNA, 25 bp, Rattus norvegicus
ggaggctcccaggtgaaatcatcga

SEQ ID NO: 605921 - DNA, 25 bp, Rattus norvegicus
tcgtctcagcttcagtcggaggctc

SEQ ID NO: 605922 - DNA, 25 bp, Rattus norvegicus
taaccacggagcaggtagtcgccca

SEQ ID NO: 605923 - DNA, 25 bp, Rattus norvegicus
ggctagtgcccaaacaacccgagcg

SEQ ID NO: 605924 - DNA, 25 bp, Rattus norvegicus
acctgcaccgttcaaggccatgttg

SEQ ID NO: 605925 - DNA, 25 bp, Rattus norvegicus
gggctcaccggaaatgatgcaaata

SEQ ID NO: 605926 - DNA, 25 bp, Rattus norvegicus
cgcctccctcatgtagcaaactgaa

SEQ ID NO: 605927 - DNA, 25 bp, Rattus norvegicus
gccagaattatccatgggtaccgcc

SEQ ID NO: 605928 - DNA, 25 bp, Rattus norvegicus
cgctttactcaaagaggggcgtgtc

SEQ ID NO: 605929 - DNA, 25 bp, Rattus norvegicus
tgacctacacgctcggctattagcc

SEQ ID NO: 605930 - DNA, 25 bp, Rattus norvegicus
catcgacatctaggggagacagatc

SEQ ID NO: 605931 - DNA, 25 bp, Rattus norvegicus
cgtgtcgcctagcatgcggtaacca

SEQ ID NO: 605932 - DNA, 25 bp, Rattus norvegicus
gtgacgtttacatggtcttcctggc

SEQ ID NO: 605933 - DNA, 25 bp, Rattus norvegicus
gggctccaatatgacgctcatcgga

SEQ ID NO: 605934 - DNA, 25 bp, Rattus norvegicus
ccagtgtcgggacagctgtcagcag

SEQ ID NO: 605935 - DNA, 25 bp, Rattus norvegicus
cggacctgtctgaagggccagtgtc

SEQ ID NO: 605936 - DNA, 25 bp, Rattus norvegicus
cggtgatctgcaagcggacctgtct

SEQ ID NO: 605937 - DNA, 25 bp, Rattus norvegicus
cccgcgaacgcttcaaggtggtctt

SEQ ID NO: 605938 - DNA, 25 bp, Rattus norvegicus
gacagctgtcagcagggctccaata

SEQ ID NO: 605939 - DNA, 25 bp, Rattus norvegicus
ggcctcagttctcccggccagggaa

SEQ ID NO: 605940 - DNA, 25 bp, Rattus norvegicus
gaaaacaactgctcacttctccctg

SEQ ID NO: 605941 - DNA, 25 bp, Rattus norvegicus
gcgctccagccagggaaaacaactg

SEQ ID NO: 605942 - DNA, 25 bp, Rattus norvegicus
acatcgtcgcttctccgggcagcag

SEQ ID NO: 605943 - DNA, 25 bp, Rattus norvegicus
aaggtggtctttgcgccggtgatct

SEQ ID NO: 605944 - DNA, 25 bp, Rattus norvegicus
ctcatcggagagaacggccacagca

SEQ ID NO: 605945 - DNA, 25 bp, Rattus norvegicus
gcgaaagacgcgtgaaccagaagga

SEQ ID NO: 605946 - DNA, 25 bp, Rattus norvegicus
cggccagggaactttcttcgctctc

SEQ ID NO: 605947 - DNA, 25 bp, Rattus norvegicus
gtgcgtgtccatcaccctcctgaag

SEQ ID NO: 605948 - DNA, 25 bp, Rattus norvegicus
gaagcttccgttcaggtgcaccgca

SEQ ID NO: 605949 - DNA, 25 bp, Rattus norvegicus
ccctgtggtgaacgtgcgtgtccat

SEQ ID NO: 605950 - DNA, 25 bp, Rattus norvegicus
gtcgcgaccctccagaagcgggaca

SEQ ID NO: 605951 - DNA, 25 bp, Rattus norvegicus
ctcagcagaaggtactaggagactg

SEQ ID NO: 605952 - DNA, 25 bp, Rattus norvegicus
tggggccaggacaaatctcagcaga

SEQ ID NO: 605953 - DNA, 25 bp, Rattus norvegicus
acaacatgcagccttcttggtgccc

SEQ ID NO: 605954 - DNA, 25 bp, Rattus norvegicus
ggagggtcctcctgcacaacatgca

SEQ ID NO: 605955 - DNA, 25 bp, Rattus norvegicus
tgcaggtgatcgcagatcctcccgg

SEQ ID NO: 605956 - DNA, 25 bp, Rattus norvegicus
cacgccatttatgcggtgcaggtga

SEQ ID NO: 605957 - DNA, 25 bp, Rattus norvegicus
gtctgtggctagcaaacacgccatt

SEQ ID NO: 605958 - DNA, 25 bp, Rattus norvegicus
ccttgtcccagaaggagagtctgtg

SEQ ID NO: 605959 - DNA, 25 bp, Rattus norvegicus
aactggagccggcaccggcagttca

SEQ ID NO: 605960 - DNA, 25 bp, Rattus norvegicus
ctgccaggtgcctgccgcaggaact

SEQ ID NO: 605961 - DNA, 25 bp, Rattus norvegicus
cctgttccacagagcatggcccaga

SEQ ID NO: 605962 - DNA, 25 bp, Rattus norvegicus
cgcagcgccagtgtctgagcccgga

SEQ ID NO: 605963 - DNA, 25 bp, Rattus norvegicus
gggctcctaccgctgcgagtgtcac

SEQ ID NO: 605964 - DNA, 25 bp, Rattus norvegicus
gggtacccagtgcagaccgtgcccg

SEQ ID NO: 605965 - DNA, 25 bp, Rattus norvegicus
ctttcgatgactgttgctgccgcca

SEQ ID NO: 605966 - DNA, 25 bp, Rattus norvegicus
cctgggccgattttgagtcctgtca

SEQ ID NO: 605967 - DNA, 25 bp, Rattus norvegicus
atggcccagagcgacgagaagtatg

SEQ ID NO: 605968 - DNA, 25 bp, Rattus norvegicus
acatggatgagtgccaggatccggc

SEQ ID NO: 605969 - DNA, 25 bp, Rattus norvegicus
ggcgacattcgtcctgggccgattt

SEQ ID NO: 605970 - DNA, 25 bp, Rattus norvegicus
cagagcccaggctgaattgtgatca

SEQ ID NO: 605971 - DNA, 25 bp, Rattus norvegicus
tgtcccatagacatggatgagtgcc

SEQ ID NO: 605972 - DNA, 25 bp, Rattus norvegicus
ctcctcttgatgtgggtcctgttcc

SEQ ID NO: 605973 - DNA, 25 bp, Rattus norvegicus
ggctgaattgtgatcaccacctcca

SEQ ID NO: 605974 - DNA, 25 bp, Rattus norvegicus
gggacctgccctcactttcgatgac

SEQ ID NO: 605975 - DNA, 25 bp, Rattus norvegicus
gcctgcagagcagcgcagtacctca

SEQ ID NO: 605976 - DNA, 25 bp, Rattus norvegicus
gggcaaagaaccacatcgtcgccgc

SEQ ID NO: 605977 - DNA, 25 bp, Rattus norvegicus
gtcccgggcaaagaaccacatcgtc

SEQ ID NO: 605978 - DNA, 25 bp, Rattus norvegicus
gctcagggttcagctcgaacgggaa

SEQ ID NO: 605979 - DNA, 25 bp, Rattus norvegicus
acctcacctttttgcggcctcggtg

SEQ ID NO: 605980 - DNA, 25 bp, Rattus norvegicus
agcagcgcagtacctcacctttttg

SEQ ID NO: 605981 - DNA, 25 bp, Rattus norvegicus
gtccggtttgcttgtccatccctcg

SEQ ID NO: 605982 - DNA, 25 bp, Rattus norvegicus
cgaagccggcattcagactaggaaa

SEQ ID NO: 605983 - DNA, 25 bp, Rattus norvegicus
cgcgacacagcgaagccggcattca

SEQ ID NO: 605984 - DNA, 25 bp, Rattus norvegicus
gggatctttggtcgccgccacgtca

SEQ ID NO: 605985 - DNA, 25 bp, Rattus norvegicus
gcccgttgccgggatctttggtcgc

SEQ ID NO: 605986 - DNA, 25 bp, Rattus norvegicus
ttgcttgtccatccctcggttcttc

SEQ ID NO: 605987 - DNA, 25 bp, Rattus norvegicus
attcagactaggaaaggccgaggtc

SEQ ID NO: 605988 - DNA, 25 bp, Rattus norvegicus
ttccgcccgccacgtcgtcactggt

SEQ ID NO: 605989 - DNA, 25 bp, Rattus norvegicus
gacttctcgggcgttgccactgctt

SEQ ID NO: 605990 - DNA, 25 bp, Rattus norvegicus
aggggatgacgtcagtgcgagcagc

SEQ ID NO: 605991 - DNA, 25 bp, Rattus norvegicus
ctcgggcgttgccactgcttgctgc

SEQ ID NO: 605992 - DNA, 25 bp, Rattus norvegicus
cgcatgacttctcgggcgttgccac

SEQ ID NO: 605993 - DNA, 25 bp, Rattus norvegicus
ccggagcgcatgacttctcgggcgt

SEQ ID NO: 605994 - DNA, 25 bp, Rattus norvegicus
atctctgcggtggtgagtcaggcat

SEQ ID NO: 605995 - DNA, 25 bp, Rattus norvegicus
agcgcctggaaaattccaccgagtg

SEQ ID NO: 605996 - DNA, 25 bp, Rattus norvegicus
ggcagagcgcctggaaaattccacc

SEQ ID NO: 605997 - DNA, 25 bp, Rattus norvegicus
cggcagagcgcctggaaaattccac

SEQ ID NO: 605998 - DNA, 25 bp, Rattus norvegicus
ggctcgaaagtagggccggcagagc

SEQ ID NO: 605999 - DNA, 25 bp, Rattus norvegicus
gcctcaggtcaccacgccccgatga

SEQ ID NO: 606000 - DNA, 25 bp, Rattus norvegicus
ctggaaaattccaccgagtggcgga

SEQ ID NO: 606001 - DNA, 25 bp, Rattus norvegicus
cccgatgaggctcgaaagtagggcc

SEQ ID NO: 606002 - DNA, 25 bp, Rattus norvegicus
ttgccactgcttgctgcgggaggga

SEQ ID NO: 606003 - DNA, 25 bp, Rattus norvegicus
taacagaccctggaggccgttgccc

SEQ ID NO: 606004 - DNA, 25 bp, Rattus norvegicus
ttccgtggaagtgcgaatcgttgct

SEQ ID NO: 606005 - DNA, 25 bp, Rattus norvegicus
gtgtttccttgttctgagcagccga

SEQ ID NO: 606006 - DNA, 25 bp, Rattus norvegicus
tccgggatgacctcgtgtttccttg

SEQ ID NO: 606007 - DNA, 25 bp, Rattus norvegicus
ctgccctcacagtgctccgggatga

SEQ ID NO: 606008 - DNA, 25 bp, Rattus norvegicus
ctaaggatgtgcagttagacggccc

SEQ ID NO: 606009 - DNA, 25 bp, Rattus norvegicus
gttgacctcaccgaagcctccatag

SEQ ID NO: 606010 - DNA, 25 bp, Rattus norvegicus
cgtctgcacgcttctttaaggaggc

SEQ ID NO: 606011 - DNA, 25 bp, Rattus norvegicus
ggtcgcaatgtaacggcctcttctc

SEQ ID NO: 606012 - DNA, 25 bp, Rattus norvegicus
ttagccttgtctcaagcggacggga

SEQ ID NO: 606013 - DNA, 25 bp, Rattus norvegicus
gaagtcggctaactgctccctctta

SEQ ID NO: 606014 - DNA, 25 bp, Rattus norvegicus
gcctgagcaagcctagagcgaagtc

SEQ ID NO: 606015 - DNA, 25 bp, Rattus norvegicus
gaaagtctccgaagtggcctgagca

SEQ ID NO: 606016 - DNA, 25 bp, Rattus norvegicus
cccaggagctgtagctagtccagga

SEQ ID NO: 606017 - DNA, 25 bp, Rattus norvegicus
tcctctccgggaggcatcacttcgt

SEQ ID NO: 606018 - DNA, 25 bp, Rattus norvegicus
aggcatcacttcgtccggacccaga

SEQ ID NO: 606019 - DNA, 25 bp, Rattus norvegicus
ttcgtccggacccagagaaggatgc

SEQ ID NO: 606020 - DNA, 25 bp, Rattus norvegicus
cggacccagagaaggatgcgatccc

SEQ ID NO: 606021 - DNA, 25 bp, Rattus norvegicus
cttgtcggcggtcatcccagcacag

SEQ ID NO: 606022 - DNA, 25 bp, Rattus norvegicus
ccagcacagcgttcgggctgtctct

SEQ ID NO: 606023 - DNA, 25 bp, Rattus norvegicus
tcacctgctgcgctgcgtcttactt

SEQ ID NO: 606024 - DNA, 25 bp, Rattus norvegicus
ttcgggctgtctctgcacgcagcca

SEQ ID NO: 606025 - DNA, 25 bp, Rattus norvegicus
cgctgccaacttggccaacttcggg

SEQ ID NO: 606026 - DNA, 25 bp, Rattus norvegicus
cctcctgggtaaggcgctgccaact

SEQ ID NO: 606027 - DNA, 25 bp, Rattus norvegicus
ctgcgctgcgtcttacttctcgggg

SEQ ID NO: 606028 - DNA, 25 bp, Rattus norvegicus
cgcgtcctccgagcgtcgcaggaat

SEQ ID NO: 606029 - DNA, 25 bp, Rattus norvegicus
agcgtcgcaggaatgggacccatcc

SEQ ID NO: 606030 - DNA, 25 bp, Rattus norvegicus
aggaatgggacccatccgacctgcc

SEQ ID NO: 606031 - DNA, 25 bp, Rattus norvegicus
gagtgtgcaaggaacagctgcttca

SEQ ID NO: 606032 - DNA, 25 bp, Rattus norvegicus
catctttggtcaagtggagtgtgca

SEQ ID NO: 606033 - DNA, 25 bp, Rattus norvegicus
agccctggcctcatttatcatcatc

SEQ ID NO: 606034 - DNA, 25 bp, Rattus norvegicus
tcgcggacgcgcacttaaccgaacg

SEQ ID NO: 606035 - DNA, 25 bp, Rattus norvegicus
agctcggacgctgtctttcgcggac

SEQ ID NO: 606036 - DNA, 25 bp, Rattus norvegicus
gaagcgctcctttatgcattattta

SEQ ID NO: 606037 - DNA, 25 bp, Rattus norvegicus
agctgcttcactcggctgacttccg

SEQ ID NO: 606038 - DNA, 25 bp, Rattus norvegicus
acagtccctgcggatctgtggctga

SEQ ID NO: 606039 - DNA, 25 bp, Rattus norvegicus
tggccctctccggattggcggaaag

SEQ ID NO: 606040 - DNA, 25 bp, Rattus norvegicus
tcctgcggattttctcccggcgaca

SEQ ID NO: 606041 - DNA, 25 bp, Rattus norvegicus
ccgcgctctgcctttgtcttacatg

SEQ ID NO: 606042 - DNA, 25 bp, Rattus norvegicus
acatggccgaaacatctgtagcatc

SEQ ID NO: 606043 - DNA, 25 bp, Rattus norvegicus
cccgcaccctgagtggctgtaggaa

SEQ ID NO: 606044 - DNA, 25 bp, Rattus norvegicus
tcgcctcgttcggtgccagaggact

SEQ ID NO: 606045 - DNA, 25 bp, Rattus norvegicus
gagtccgctgcctcactccagaatg

SEQ ID NO: 606046 - DNA, 25 bp, Rattus norvegicus
tggcgcacgcgtactcacgcgtttc

SEQ ID NO: 606047 - DNA, 25 bp, Rattus norvegicus
ggagatttggcgcacgcgtactcac

SEQ ID NO: 606048 - DNA, 25 bp, Rattus norvegicus
ctgccgcgggaggaagcacaaaccc

SEQ ID NO: 606049 - DNA, 25 bp, Rattus norvegicus
cgctgagggtcgacttgcttgcgtt

SEQ ID NO: 606050 - DNA, 25 bp, Rattus norvegicus
ctcaggtcccgctgagggtcgactt

SEQ ID NO: 606051 - DNA, 25 bp, Rattus norvegicus
tctggacccaccactacgcccgccg

SEQ ID NO: 606052 - DNA, 25 bp, Rattus norvegicus
acccgactaggcctccagttctgga

SEQ ID NO: 606053 - DNA, 25 bp, Rattus norvegicus
cagggtcgcagagtccgctgcctca

SEQ ID NO: 606054 - DNA, 25 bp, Rattus norvegicus
gcagggtgtggccacgctctcacct

SEQ ID NO: 606055 - DNA, 25 bp, Rattus norvegicus
tactcacgcgtttcgtccttcggtc

SEQ ID NO: 606056 - DNA, 25 bp, Rattus norvegicus
ccgactgaaggagccaatcggagcc

SEQ ID NO: 606057 - DNA, 25 bp, Rattus norvegicus
gactaggcctccagttctggaccca

SEQ ID NO: 606058 - DNA, 25 bp, Rattus norvegicus
gacttgcttgcgttgcgccgcggac

SEQ ID NO: 606059 - DNA, 25 bp, Rattus norvegicus
acagcaaggacttcccgggcatgtc

SEQ ID NO: 606060 - DNA, 25 bp, Rattus norvegicus
gctcacgagggcgagcgctaaaaaa

SEQ ID NO: 606061 - DNA, 25 bp, Rattus norvegicus
aggcgctaagccttctcaggacaca

SEQ ID NO: 606062 - DNA, 25 bp, Rattus norvegicus
agaccactcacagcttcactacatt

SEQ ID NO: 606063 - DNA, 25 bp, Rattus norvegicus
tcctgtacaggagagatttttaaaa

SEQ ID NO: 606064 - DNA, 25 bp, Rattus norvegicus
gggcatgtccttctctctgtctttt

SEQ ID NO: 606065 - DNA, 25 bp, Rattus norvegicus
cctaccagcagtcgcacagcaagga

SEQ ID NO: 606066 - DNA, 25 bp, Rattus norvegicus
tttccaaaagaagcccagcgccttc

SEQ ID NO: 606067 - DNA, 25 bp, Rattus norvegicus
agaaggacgctcgtcggggactcta

SEQ ID NO: 606068 - DNA, 25 bp, Rattus norvegicus
tgagcctctcgttcgcagtccgcag

SEQ ID NO: 606069 - DNA, 25 bp, Rattus norvegicus
gtcaccgggctgcttaaatcttagg

SEQ ID NO: 606070 - DNA, 25 bp, Rattus norvegicus
tgcgcaggcgcgattggaaaactat

SEQ ID NO: 606071 - DNA, 25 bp, Rattus norvegicus
atcttaggatcccagcaggtacggc

SEQ ID NO: 606072 - DNA, 25 bp, Rattus norvegicus
aggacacacggtcctcgatcctctg

SEQ ID NO: 606073 - DNA, 25 bp, Rattus norvegicus
gtaggccgccgcttccttgcgtcat

SEQ ID NO: 606074 - DNA, 25 bp, Rattus norvegicus
atcagagcgcgcgaccaaaatagcg

SEQ ID NO: 606075 - DNA, 25 bp, Rattus norvegicus
tagcgcactataaatgctggcggga

SEQ ID NO: 606076 - DNA, 25 bp, Rattus norvegicus
ccggaagttgttagcagcggctcta

SEQ ID NO: 606077 - DNA, 25 bp, Rattus norvegicus
cggctctaaactctggcggcaattt

SEQ ID NO: 606078 - DNA, 25 bp, Rattus norvegicus
ctcacgggcttctcttcagacagta

SEQ ID NO: 606079 - DNA, 25 bp, Rattus norvegicus
tcgtcatcggggctgaccaatcaga

SEQ ID NO: 606080 - DNA, 25 bp, Rattus norvegicus
ccttgcgtcattcaggccgcttgta

SEQ ID NO: 606081 - DNA, 25 bp, Rattus norvegicus
tgtagcgcggttagagtcgcacttc

SEQ ID NO: 606082 - DNA, 25 bp, Rattus norvegicus
ttagagtcgcacttccggtgggatc

SEQ ID NO: 606083 - DNA, 25 bp, Rattus norvegicus
accttttggcgcacgagcgtgtcgt

SEQ ID NO: 606084 - DNA, 25 bp, Rattus norvegicus
ggacgagtccttctccaccctagga

SEQ ID NO: 606085 - DNA, 25 bp, Rattus norvegicus
tccaccctaggagcggtctggctcg

SEQ ID NO: 606086 - DNA, 25 bp, Rattus norvegicus
cggcaatttggtttgtaagtgagta

SEQ ID NO: 606087 - DNA, 25 bp, Rattus norvegicus
ggcctttttctctgggttgcatatc

SEQ ID NO: 606088 - DNA, 25 bp, Rattus norvegicus
ctccgcctgggctaagtctcaatgt

SEQ ID NO: 606089 - DNA, 25 bp, Rattus norvegicus
ttcccgatatctgggaggggccttg

SEQ ID NO: 606090 - DNA, 25 bp, Rattus norvegicus
attgcaattatcgaggaccttgccc

SEQ ID NO: 606091 - DNA, 25 bp, Rattus norvegicus
ttctagggtcccaaggagcataccc

SEQ ID NO: 606092 - DNA, 25 bp, Rattus norvegicus
tgggttgcatatcggaccacagtga

SEQ ID NO: 606093 - DNA, 25 bp, Rattus norvegicus
tcaatgtctgtttggcgcacggcca

SEQ ID NO: 606094 - DNA, 25 bp, Rattus norvegicus
cacggccagacttcggacgtgcagg

SEQ ID NO: 606095 - DNA, 25 bp, Rattus norvegicus
ggtggatcgcccataggcctttttc

SEQ ID NO: 606096 - DNA, 25 bp, Rattus norvegicus
cgtgctccagtacccgaggtggatc

SEQ ID NO: 606097 - DNA, 25 bp, Rattus norvegicus
tataacgcggcgttctagggtccca

SEQ ID NO: 606098 - DNA, 25 bp, Rattus norvegicus
caccgaggaactgcgtgctccagta

SEQ ID NO: 606099 - DNA, 25 bp, Rattus norvegicus
gttccaggcagacgcccaccgagga

SEQ ID NO: 606100 - DNA, 25 bp, Rattus norvegicus
ccacagtgagggtagaattgcaatt

SEQ ID NO: 606101 - DNA, 25 bp, Rattus norvegicus
gagtcgcctgttttgctaagatccg

SEQ ID NO: 606102 - DNA, 25 bp, Rattus norvegicus
gttgagcgtcgggatctcgtactgt

SEQ ID NO: 606103 - DNA, 25 bp, Rattus norvegicus
gagaggtctcgatccggagagaaaa

SEQ ID NO: 606104 - DNA, 25 bp, Rattus norvegicus
ctgtagctgctcctggagtcgcctg

SEQ ID NO: 606105 - DNA, 25 bp, Rattus norvegicus
ctcgtactgtggctggcgtccggat

SEQ ID NO: 606106 - DNA, 25 bp, Rattus norvegicus
tcagtgggcaagtaagttgagcgtc

SEQ ID NO: 606107 - DNA, 25 bp, Rattus norvegicus
cctgtgcgcgtcagtgggcaagtaa

SEQ ID NO: 606108 - DNA, 25 bp, Rattus norvegicus
ctcccattgcggctgcgtaggacgc

SEQ ID NO: 606109 - DNA, 25 bp, Rattus norvegicus
gcgcttgcgcgaggtccggctcaac

SEQ ID NO: 606110 - DNA, 25 bp, Rattus norvegicus
aaacgctttgcctagcgcgcgcttg

SEQ ID NO: 606111 - DNA, 25 bp, Rattus norvegicus
tgctacagccaggaaaaacccgcca

SEQ ID NO: 606112 - DNA, 25 bp, Rattus norvegicus
ttgcttccgaatgctacagccagga

SEQ ID NO: 606113 - DNA, 25 bp, Rattus norvegicus
tcgatccggagagaaaacttgcttc

SEQ ID NO: 606114 - DNA, 25 bp, Rattus norvegicus
cgtccggatctcgtactgtagctgc

SEQ ID NO: 606115 - DNA, 25 bp, Rattus norvegicus
gccgccaccacagccctcgacccgc

SEQ ID NO: 606116 - DNA, 25 bp, Rattus norvegicus
tctgccggacgctagacaaacggta

SEQ ID NO: 606117 - DNA, 25 bp, Rattus norvegicus
gaacggacttctgccggacgctaga

SEQ ID NO: 606118 - DNA, 25 bp, Rattus norvegicus
ctggctggatgagaacggacttctg

SEQ ID NO: 606119 - DNA, 25 bp, Rattus norvegicus
aactgcttgctgaagccgcccctgg

SEQ ID NO: 606120 - DNA, 25 bp, Rattus norvegicus
aagcagggtttacctctagctgccc

SEQ ID NO: 606121 - DNA, 25 bp, Rattus norvegicus
ggcgcagctgtcctccagcccagcc

SEQ ID NO: 606122 - DNA, 25 bp, Rattus norvegicus
cctccgggaaggtactggggatgat

SEQ ID NO: 606123 - DNA, 25 bp, Rattus norvegicus
ccgcagatcgagttgcagagccgcg

SEQ ID NO: 606124 - DNA, 25 bp, Rattus norvegicus
aactagggccgcagatcgagttgca

SEQ ID NO: 606125 - DNA, 25 bp, Rattus norvegicus
gtatttttaactagggccgcagatc

SEQ ID NO: 606126 - DNA, 25 bp, Rattus norvegicus
gccggacgctagacaaacggtagcc

SEQ ID NO: 606127 - DNA, 25 bp, Rattus norvegicus
tcggcgcgaagcagggtttacctct

SEQ ID NO: 606128 - DNA, 25 bp, Rattus norvegicus
ttagactgggatagaagggcaccgc

SEQ ID NO: 606129 - DNA, 25 bp, Rattus norvegicus
ggtcgacgtgtaggactttgccctc

SEQ ID NO: 606130 - DNA, 25 bp, Rattus norvegicus
ctccggttctcggagtggaccctgc

SEQ ID NO: 606131 - DNA, 25 bp, Rattus norvegicus
agtggttctctatcctgccgctgca

SEQ ID NO: 606132 - DNA, 25 bp, Rattus norvegicus
aggcgacctgagtggttctctatcc

SEQ ID NO: 606133 - DNA, 25 bp, Rattus norvegicus
ctcctagcgttcacaggtgcgcgaa

SEQ ID NO: 606134 - DNA, 25 bp, Rattus norvegicus
tgcgaggttcgcaactcctagcgtt

SEQ ID NO: 606135 - DNA, 25 bp, Rattus norvegicus
cctgtcagatggctggagacctcag

SEQ ID NO: 606136 - DNA, 25 bp, Rattus norvegicus
ttgccctcctgggtcactgagatca

SEQ ID NO: 606137 - DNA, 25 bp, Rattus norvegicus
gccgccggaagtgaggtgtcttacc

SEQ ID NO: 606138 - DNA, 25 bp, Rattus norvegicus
gcgtacttggtacggtccactccgc

SEQ ID NO: 606139 - DNA, 25 bp, Rattus norvegicus
ttggtacacgcaaagcgtacttggt

SEQ ID NO: 606140 - DNA, 25 bp, Rattus norvegicus
cagaagcgcggggaaaattggtaca

SEQ ID NO: 606141 - DNA, 25 bp, Rattus norvegicus
atctctcgctagttccagctgcctg

SEQ ID NO: 606142 - DNA, 25 bp, Rattus norvegicus
cgccgtcagttttcggcctgtcaga

SEQ ID NO: 606143 - DNA, 25 bp, Rattus norvegicus
ctgcggccttgtctccgttttcatc

SEQ ID NO: 606144 - DNA, 25 bp, Rattus norvegicus
cgcacgcaagtcttccagtcatgga

SEQ ID NO: 606145 - DNA, 25 bp, Rattus norvegicus
catggagaatgactcggaatacatt

SEQ ID NO: 606146 - DNA, 25 bp, Rattus norvegicus
gccatctttgctcctccaatgagtg

SEQ ID NO: 606147 - DNA, 25 bp, Rattus norvegicus
aggcaaaggacacgggcgattctgc

SEQ ID NO: 606148 - DNA, 25 bp, Rattus norvegicus
ccaatgagtgacatctgcgcgcgca

SEQ ID NO: 606149 - DNA, 25 bp, Rattus norvegicus
cccaatgaacgaacgcctgcgtaaa

SEQ ID NO: 606150 - DNA, 25 bp, Rattus norvegicus
taggcggtacaaacaaccaacgatc

SEQ ID NO: 606151 - DNA, 25 bp, Rattus norvegicus
taagcggtctttgagcacagagggt

SEQ ID NO: 606152 - DNA, 25 bp, Rattus norvegicus
tcgcgcagtagtgacgtggcacgca

SEQ ID NO: 606153 - DNA, 25 bp, Rattus norvegicus
ttgactccatcttcgcggttgcagc

SEQ ID NO: 606154 - DNA, 25 bp, Rattus norvegicus
gcacgcggtagtaagcggtctttga

SEQ ID NO: 606155 - DNA, 25 bp, Rattus norvegicus
ttttcatccgggtccctgacgagcc

SEQ ID NO: 606156 - DNA, 25 bp, Rattus norvegicus
cggaatacatttgctgccatctttg

SEQ ID NO: 606157 - DNA, 25 bp, Rattus norvegicus
attacgccggctgcgtgaacaacgc

SEQ ID NO: 606158 - DNA, 25 bp, Rattus norvegicus
cctatatcatggaggggacgacgac

SEQ ID NO: 606159 - DNA, 25 bp, Rattus norvegicus
ctgcccaatgtgctgttcgcctatg

SEQ ID NO: 606160 - DNA, 25 bp, Rattus norvegicus
tgaagactccagtgtcgccagaccg

SEQ ID NO: 606161 - DNA, 25 bp, Rattus norvegicus
tggggagccacttgctgaagactcc

SEQ ID NO: 606162 - DNA, 25 bp, Rattus norvegicus
gcaccggcccacgttttctggagga

SEQ ID NO: 606163 - DNA, 25 bp, Rattus norvegicus
tctggactttgggaacgtttagcgc

SEQ ID NO: 606164 - DNA, 25 bp, Rattus norvegicus
cgaagacttttaccgcgaccaagtg

SEQ ID NO: 606165 - DNA, 25 bp, Rattus norvegicus
caagcggcaccagtttccatggagc

SEQ ID NO: 606166 - DNA, 25 bp, Rattus norvegicus
tcccagaaatgtgccgaaaggaagc

SEQ ID NO: 606167 - DNA, 25 bp, Rattus norvegicus
ctctggagagttactgagaagtccc

SEQ ID NO: 606168 - DNA, 25 bp, Rattus norvegicus
agcttgggcgacttctacgcttgcc

SEQ ID NO: 606169 - DNA, 25 bp, Rattus norvegicus
caagtgctaagagagctccgcggcc

SEQ ID NO: 606170 - DNA, 25 bp, Rattus norvegicus
acgcttgcccaacgagctactctgg

SEQ ID NO: 606171 - DNA, 25 bp, Rattus norvegicus
gctgtgggtagaggatgcacactca

SEQ ID NO: 606172 - DNA, 25 bp, Rattus norvegicus
ctcagcatcgctgggccaacggaag

SEQ ID NO: 606173 - DNA, 25 bp, Rattus norvegicus
gaagcgcggtactgcatcctgccgt

SEQ ID NO: 606174 - DNA, 25 bp, Rattus norvegicus
acaggcttgggatccagtctggcta

SEQ ID NO: 606175 - DNA, 25 bp, Rattus norvegicus
tcacccggttttctcgatttgcggc

SEQ ID NO: 606176 - DNA, 25 bp, Rattus norvegicus
gcggcctttagaaacgcctcccata

SEQ ID NO: 606177 - DNA, 25 bp, Rattus norvegicus
ctcctttaaatcgtcccatgatgca

SEQ ID NO: 606178 - DNA, 25 bp, Rattus norvegicus
gcccatgggcagtttgtagtcggac

SEQ ID NO: 606179 - DNA, 25 bp, Rattus norvegicus
cttgagtctgaagcagcacagggtc

SEQ ID NO: 606180 - DNA, 25 bp, Rattus norvegicus
atccaccgcgcctggcttcggtttt

SEQ ID NO: 606181 - DNA, 25 bp, Rattus norvegicus
gacggctgtactccttcactgtgcg

SEQ ID NO: 606182 - DNA, 25 bp, Rattus norvegicus
cgaagccttcttgcacttgagtctg

SEQ ID NO: 606183 - DNA, 25 bp, Rattus norvegicus
gctccgcagccggacacatgtctgg

SEQ ID NO: 606184 - DNA, 25 bp, Rattus norvegicus
tggctcaacctccagtcggtgcagg

SEQ ID NO: 606185 - DNA, 25 bp, Rattus norvegicus
tttcttgccgaccagccctttcgga

SEQ ID NO: 606186 - DNA, 25 bp, Rattus norvegicus
tggtcacttacccagctcgggcggc

SEQ ID NO: 606187 - DNA, 25 bp, Rattus norvegicus
gcatcggcttggtcacttacccagc

SEQ ID NO: 606188 - DNA, 25 bp, Rattus norvegicus
caatcatcgtggagaagcaaggttt

SEQ ID NO: 606189 - DNA, 25 bp, Rattus norvegicus
tggaggctcggtgctcaccgtgcca

SEQ ID NO: 606190 - DNA, 25 bp, Rattus norvegicus
gcctgctggaggctcggtgctcacc

SEQ ID NO: 606191 - DNA, 25 bp, Rattus norvegicus
aggcgcgggctagcaggcctttctt

SEQ ID NO: 606192 - DNA, 25 bp, Rattus norvegicus
cgtggagaagcaaggtttagaaact

SEQ ID NO: 606193 - DNA, 25 bp, Rattus norvegicus
gggctagcaggcctttcttgccgac

SEQ ID NO: 606194 - DNA, 25 bp, Rattus norvegicus
ctgacttggccaatcatcgtggaga

SEQ ID NO: 606195 - DNA, 25 bp, Rattus norvegicus
gacgcgtctgacttggccaatcatc

SEQ ID NO: 606196 - DNA, 25 bp, Rattus norvegicus
tgtcgcgcttgggacgcgtctgact

SEQ ID NO: 606197 - DNA, 25 bp, Rattus norvegicus
cccattggctgtcgcgcttgggacg

SEQ ID NO: 606198 - DNA, 25 bp, Rattus norvegicus
gctgctccgccaagcccaagaggtg

SEQ ID NO: 606199 - DNA, 25 bp, Rattus norvegicus
tgacgtccgagtcatcaccactgcg

SEQ ID NO: 606200 - DNA, 25 bp, Rattus norvegicus
gtcatcacgtgaccacaagagtgtg

SEQ ID NO: 606201 - DNA, 25 bp, Rattus norvegicus
tggttccgccttcgtcatcacgtga

SEQ ID NO: 606202 - DNA, 25 bp, Rattus norvegicus
attggctagtctggtgcttggttcc

SEQ ID NO: 606203 - DNA, 25 bp, Rattus norvegicus
ccgctcccgtttcctattggctagt

SEQ ID NO: 606204 - DNA, 25 bp, Rattus norvegicus
tcttcttcagaatggtcagaagccc

SEQ ID NO: 606205 - DNA, 25 bp, Rattus norvegicus
tgagcagccgcagctctcgctcttt

SEQ ID NO: 606206 - DNA, 25 bp, Rattus norvegicus
tccgaggatacagcatgagcagccg

SEQ ID NO: 606207 - DNA, 25 bp, Rattus norvegicus
cgtgacgcaccaccggcaatgggta

SEQ ID NO: 606208 - DNA, 25 bp, Rattus norvegicus
cgcgcctcgcagtgatactggagtc

SEQ ID NO: 606209 - DNA, 25 bp, Rattus norvegicus
taagcccgctcttgagaccaccggt

SEQ ID NO: 606210 - DNA, 25 bp, Rattus norvegicus
agaccaccggtctgccttttgcacg

SEQ ID NO: 606211 - DNA, 25 bp, Rattus norvegicus
gccctgcagagtggtatggcccgac

SEQ ID NO: 606212 - DNA, 25 bp, Rattus norvegicus
accgttctggtgctccgaggataca

SEQ ID NO: 606213 - DNA, 25 bp, Rattus norvegicus
ctgggccctggcagcacgcgaccct

SEQ ID NO: 606214 - DNA, 25 bp, Rattus norvegicus
cacgcgaccctcggcagaaatctct

SEQ ID NO: 606215 - DNA, 25 bp, Rattus norvegicus
gccgaccctagaggttgccttggtg

SEQ ID NO: 606216 - DNA, 25 bp, Rattus norvegicus
aatctctggactcagatccgcgcgg

SEQ ID NO: 606217 - DNA, 25 bp, Rattus norvegicus
agaaatctctggactcagatccgcg

SEQ ID NO: 606218 - DNA, 25 bp, Rattus norvegicus
tctctggactcagatccgcgcggtg

SEQ ID NO: 606219 - DNA, 25 bp, Rattus norvegicus
gtgctggagcatgcccccagctcag

SEQ ID NO: 606220 - DNA, 25 bp, Rattus norvegicus
ccagctcagccccaaaaggggtcgg

SEQ ID NO: 606221 - DNA, 25 bp, Rattus norvegicus
gctcccaggctctgggggtgctgga

SEQ ID NO: 606222 - DNA, 25 bp, Rattus norvegicus
ggcggcgctcctgggttcgctccca

SEQ ID NO: 606223 - DNA, 25 bp, Rattus norvegicus
ccttagcggtggttccgccgctcgg

SEQ ID NO: 606224 - DNA, 25 bp, Rattus norvegicus
gtccttagcggtggttccgccgctc

SEQ ID NO: 606225 - DNA, 25 bp, Rattus norvegicus
tggaggagacgacggttcaagggtc

SEQ ID NO: 606226 - DNA, 25 bp, Rattus norvegicus
aaatctctggactcagatccgcgcg

SEQ ID NO: 606227 - DNA, 25 bp, Rattus norvegicus
tttcatctcgcaaagagtccagtcc

SEQ ID NO: 606228 - DNA, 25 bp, Rattus norvegicus
gaggttaaaggtcctcccactcaga

SEQ ID NO: 606229 - DNA, 25 bp, Rattus norvegicus
cccactcagaatttatgcgcaagcg

SEQ ID NO: 606230 - DNA, 25 bp, Rattus norvegicus
tatgcgcaagcgtaaactacgattg

SEQ ID NO: 606231 - DNA, 25 bp, Rattus norvegicus
actacgattgggagcttttcatctc

SEQ ID NO: 606232 - DNA, 25 bp, Rattus norvegicus
aatcagtgggcctcgcccttctcaa

SEQ ID NO: 606233 - DNA, 25 bp, Rattus norvegicus
cccttctcaatgaccaatggcagtg

SEQ ID NO: 606234 - DNA, 25 bp, Rattus norvegicus
gctctagtgaacagcgcagccggac

SEQ ID NO: 606235 - DNA, 25 bp, Rattus norvegicus
cgagatgtcacgatggctgtggcca

SEQ ID NO: 606236 - DNA, 25 bp, Rattus norvegicus
cccgcagcttgtaacaaggaggtta

SEQ ID NO: 606237 - DNA, 25 bp, Rattus norvegicus
aactgtgtgaaagagcgtgtctgcc

SEQ ID NO: 606238 - DNA, 25 bp, Rattus norvegicus
cagccttcccgcagcttgtaacaag

SEQ ID NO: 606239 - DNA, 25 bp, Rattus norvegicus
gtggccatggtcgaactgtgtgaaa

SEQ ID NO: 606240 - DNA, 25 bp, Rattus norvegicus
actgtcgccctacggttacagcctt

SEQ ID NO: 606241 - DNA, 25 bp, Rattus norvegicus
aaggtaacgccgtgtgcctcagtgc

SEQ ID NO: 606242 - DNA, 25 bp, Rattus norvegicus
tgatgagacctgagaagacgcggct

SEQ ID NO: 606243 - DNA, 25 bp, Rattus norvegicus
tgcctcagtgcggaggctgctgtca

SEQ ID NO: 606244 - DNA, 25 bp, Rattus norvegicus
tgttcctgatctttcaaaggccgtc

SEQ ID NO: 606245 - DNA, 25 bp, Rattus norvegicus
gcagttccggccagctggatttccg

SEQ ID NO: 606246 - DNA, 25 bp, Rattus norvegicus
tggaggtaagaacgccaggcagttc

SEQ ID NO: 606247 - DNA, 25 bp, Rattus norvegicus
caacctgaggttccgcctggaggta

SEQ ID NO: 606248 - DNA, 25 bp, Rattus norvegicus
ctggatttccggactggtcggtaga

SEQ ID NO: 606249 - DNA, 25 bp, Rattus norvegicus
cagcagtaggtcactggtaccctag

SEQ ID NO: 606250 - DNA, 25 bp, Rattus norvegicus
tagctggagacgtgtaagtagtgcc

SEQ ID NO: 606251 - DNA, 25 bp, Rattus norvegicus
cccttcggtgaaggtgggctctgaa

SEQ ID NO: 606252 - DNA, 25 bp, Rattus norvegicus
tacggtctgtcatcgccgacgccat

SEQ ID NO: 606253 - DNA, 25 bp, Rattus norvegicus
gttgtttcttcttctgccacgccgc

SEQ ID NO: 606254 - DNA, 25 bp, Rattus norvegicus
tctcccgggaacctggagcgagtca

SEQ ID NO: 606255 - DNA, 25 bp, Rattus norvegicus
ggttgccaaggcaccacagccacga

SEQ ID NO: 606256 - DNA, 25 bp, Rattus norvegicus
ccagctctgtctccggcagcatgtt

SEQ ID NO: 606257 - DNA, 25 bp, Rattus norvegicus
cacagccacgaactcgcgatattta

SEQ ID NO: 606258 - DNA, 25 bp, Rattus norvegicus
gctccggcttataaaggggccgctc

SEQ ID NO: 606259 - DNA, 25 bp, Rattus norvegicus
agctgtacgcgcagaagctgctgcc

SEQ ID NO: 606260 - DNA, 25 bp, Rattus norvegicus
agggcgctcttgtggtctgtacgcc

SEQ ID NO: 606261 - DNA, 25 bp, Rattus norvegicus
gctcggtcctgtagcagccagctct

SEQ ID NO: 606262 - DNA, 25 bp, Rattus norvegicus
acgagttccattcgccggctctgga

SEQ ID NO: 606263 - DNA, 25 bp, Rattus norvegicus
ttccgcaagcttaacgccttcggca

SEQ ID NO: 606264 - DNA, 25 bp, Rattus norvegicus
actccttcatcgcagtcatgcatgg

SEQ ID NO: 606265 - DNA, 25 bp, Rattus norvegicus
ccgccacttgatcgagcaggacttc

SEQ ID NO: 606266 - DNA, 25 bp, Rattus norvegicus
aaacccatggtgctcctggtcggcc

SEQ ID NO: 606267 - DNA, 25 bp, Rattus norvegicus
gctgacttcgacaacaaacccatgg

SEQ ID NO: 606268 - DNA, 25 bp, Rattus norvegicus
ggagcactatcgcttccacgagttc

SEQ ID NO: 606269 - DNA, 25 bp, Rattus norvegicus
ggtaggttccatctagggtaatgtc

SEQ ID NO: 606270 - DNA, 25 bp, Rattus norvegicus
gttccatctagggtaatgtctcatg

SEQ ID NO: 606271 - DNA, 25 bp, Rattus norvegicus
ggctccagggctgcaaccgtcccta

SEQ ID NO: 606272 - DNA, 25 bp, Rattus norvegicus
cctggctaagggacaggccgctggc

SEQ ID NO: 606273 - DNA, 25 bp, Rattus norvegicus
cgggaagttgcggtaggttccatct

SEQ ID NO: 606274 - DNA, 25 bp, Rattus norvegicus
ttgcggtaggttccatctagggtaa

SEQ ID NO: 606275 - DNA, 25 bp, Rattus norvegicus
tctagggtaatgtctcatgaggatc

SEQ ID NO: 606276 - DNA, 25 bp, Rattus norvegicus
accttcaccttcagccgcggctccc

SEQ ID NO: 606277 - DNA, 25 bp, Rattus norvegicus
aatgtctcatgaggatctaggtggg

SEQ ID NO: 606278 - DNA, 25 bp, Rattus norvegicus
tggcaaggtcatcaggggatcttct

SEQ ID NO: 606279 - DNA, 25 bp, Rattus norvegicus
ctcccacttcctggacgagggtcgg

SEQ ID NO: 606280 - DNA, 25 bp, Rattus norvegicus
gggatcttcttgtgaccccaacgga

SEQ ID NO: 606281 - DNA, 25 bp, Rattus norvegicus
tcatcaggggatcttcttgtgaccc

SEQ ID NO: 606282 - DNA, 25 bp, Rattus norvegicus
aggtcatcaggggatcttcttgtga

SEQ ID NO: 606283 - DNA, 25 bp, Rattus norvegicus
aggctgcgcccttagcgctgggaac

SEQ ID NO: 606284 - DNA, 25 bp, Rattus norvegicus
gagcttctgctgctcttcgccactg

SEQ ID NO: 606285 - DNA, 25 bp, Rattus norvegicus
tacaagcgccagctcccgtgcagag

SEQ ID NO: 606286 - DNA, 25 bp, Rattus norvegicus
gtgccgctggcacctttgctctcta

SEQ ID NO: 606287 - DNA, 25 bp, Rattus norvegicus
cagctcccgtgcagagcctggggtt

SEQ ID NO: 606288 - DNA, 25 bp, Rattus norvegicus
ccttagcgctgggaaccggcctggt

SEQ ID NO: 606289 - DNA, 25 bp, Rattus norvegicus
tcagcctcagcgagcttctgctgct

SEQ ID NO: 606290 - DNA, 25 bp, Rattus norvegicus
gctgctcaatgaggctgcgccctta

SEQ ID NO: 606291 - DNA, 25 bp, Rattus norvegicus
gctctctacccgctgctcaatgagg

SEQ ID NO: 606292 - DNA, 25 bp, Rattus norvegicus
tgctcttcgccactgctggcgtcta

SEQ ID NO: 606293 - DNA, 25 bp, Rattus norvegicus
ccactgctggcgtctacgtggatgg

SEQ ID NO: 606294 - DNA, 25 bp, Rattus norvegicus
gcgctggccgcaagtcacgaagcca

SEQ ID NO: 606295 - DNA, 25 bp, Rattus norvegicus
cgcatccgagagctacaagcgccag

SEQ ID NO: 606296 - DNA, 25 bp, Rattus norvegicus
cactgggtgctgtggagctcagcct

SEQ ID NO: 606297 - DNA, 25 bp, Rattus norvegicus
tgacctggtgctcctctccttggtt

SEQ ID NO: 606298 - DNA, 25 bp, Rattus norvegicus
attgctgccctctatgcccgattca

SEQ ID NO: 606299 - DNA, 25 bp, Rattus norvegicus
ccagtggccgacctatccatcattg

SEQ ID NO: 606300 - DNA, 25 bp, Rattus norvegicus
ggtggcctcacctacttcccagtgg

SEQ ID NO: 606301 - DNA, 25 bp, Rattus norvegicus
tttcctggctgtcaaccgtgtcatc

SEQ ID NO: 606302 - DNA, 25 bp, Rattus norvegicus
gttctgggcttcgtagagcatttcc

SEQ ID NO: 606303 - DNA, 25 bp, Rattus norvegicus
actctccttgggacttgcgggaggc

SEQ ID NO: 606304 - DNA, 25 bp, Rattus norvegicus
gttcgccttttggacaggctccaga

SEQ ID NO: 606305 - DNA, 25 bp, Rattus norvegicus
ctccagagggctaggtagagattgc

SEQ ID NO: 606306 - DNA, 25 bp, Rattus norvegicus
gaggtctttgggacgcagcctcatc

SEQ ID NO: 606307 - DNA, 25 bp, Rattus norvegicus
aggcccttggttgaaaggtctcaga

SEQ ID NO: 606308 - DNA, 25 bp, Rattus norvegicus
aaggtctcagaaaccgagccgccgc

SEQ ID NO: 606309 - DNA, 25 bp, Rattus norvegicus
aaggccgcccagaagacgctgttcc

SEQ ID NO: 606310 - DNA, 25 bp, Rattus norvegicus
tctgcgctctatcgacgacgtggtg

SEQ ID NO: 606311 - DNA, 25 bp, Rattus norvegicus
gtgacaccgtcacgtccgaactggc

SEQ ID NO: 606312 - DNA, 25 bp, Rattus norvegicus
gcatcttcacatcccgccgcgggag

SEQ ID NO: 606313 - DNA, 25 bp, Rattus norvegicus
aggaggagggtgcatcttcacatcc

SEQ ID NO: 606314 - DNA, 25 bp, Rattus norvegicus
cgacgtttacaaggtgcgctgcgcg

SEQ ID NO: 606315 - DNA, 25 bp, Rattus norvegicus
cctatggcgacgtttacaaggtgcg

SEQ ID NO: 606316 - DNA, 25 bp, Rattus norvegicus
gccgggacctatggcgacgtttaca

SEQ ID NO: 606317 - DNA, 25 bp, Rattus norvegicus
cgcttcgagctgctgcagcgtgttg

SEQ ID NO: 606318 - DNA, 25 bp, Rattus norvegicus
aggatccgcgggaccgcttcgagct

SEQ ID NO: 606319 - DNA, 25 bp, Rattus norvegicus
tcgttgcaggatccgcgggaccgct

SEQ ID NO: 606320 - DNA, 25 bp, Rattus norvegicus
ccggctccgcagcttgcgcccgccg

SEQ ID NO: 606321 - DNA, 25 bp, Rattus norvegicus
tgagtctcgccgctgtgcctgcctg

SEQ ID NO: 606322 - DNA, 25 bp, Rattus norvegicus
acggcctctgagtctcgccgctgtg

SEQ ID NO: 606323 - DNA, 25 bp, Rattus norvegicus
ctcctctcggctaggcggaacggcg

SEQ ID NO: 606324 - DNA, 25 bp, Rattus norvegicus
tcacgtccgaactggccgcggtgaa

SEQ ID NO: 606325 - DNA, 25 bp, Rattus norvegicus
cgttctctctacgtcatagactttg

SEQ ID NO: 606326 - DNA, 25 bp, Rattus norvegicus
aatcccgtggcactacgacgccgag

SEQ ID NO: 606327 - DNA, 25 bp, Rattus norvegicus
ggagtcgtttcagccaatcccgtgg

SEQ ID NO: 606328 - DNA, 25 bp, Rattus norvegicus
gccaatgagctaaacgttctctcta

SEQ ID NO: 606329 - DNA, 25 bp, Rattus norvegicus
cctcagagctcagtccgcgcagtaa

SEQ ID NO: 606330 - DNA, 25 bp, Rattus norvegicus
gtaacaagaagtgcgcgctgcgaca

SEQ ID NO: 606331 - DNA, 25 bp, Rattus norvegicus
catttcgtcgcctggcctaacggtt

SEQ ID NO: 606332 - DNA, 25 bp, Rattus norvegicus
tcccgacgcgtattgaaaagaacta

SEQ ID NO: 606333 - DNA, 25 bp, Rattus norvegicus
aagaactagtgctccgccaatcgga

SEQ ID NO: 606334 - DNA, 25 bp, Rattus norvegicus
acttcctgggcccaaaggcagcttc

SEQ ID NO: 606335 - DNA, 25 bp, Rattus norvegicus
aggcagcttcgggtcgagcctaatg

SEQ ID NO: 606336 - DNA, 25 bp, Rattus norvegicus
taaccagggccttgtccttagtggc

SEQ ID NO: 606337 - DNA, 25 bp, Rattus norvegicus
tgagttgagccgatagagcacgaga

SEQ ID NO: 606338 - DNA, 25 bp, Rattus norvegicus
gaggcgcttacctccatcctcttta

SEQ ID NO: 606339 - DNA, 25 bp, Rattus norvegicus
taggtctactggttcccggacagtc

SEQ ID NO: 606340 - DNA, 25 bp, Rattus norvegicus
cactcggggcggatacaaaatttga

SEQ ID NO: 606341 - DNA, 25 bp, Rattus norvegicus
tctaatggcttacgggacactcggg

SEQ ID NO: 606342 - DNA, 25 bp, Rattus norvegicus
gtcagaagactcgttggcacccgga

SEQ ID NO: 606343 - DNA, 25 bp, Rattus norvegicus
ggcagtcaaggtcccatccatgtca

SEQ ID NO: 606344 - DNA, 25 bp, Rattus norvegicus
ctgaacacgtttcctactcggaagg

SEQ ID NO: 606345 - DNA, 25 bp, Rattus norvegicus
gacccgaacttttcgactctgaaca

SEQ ID NO: 606346 - DNA, 25 bp, Rattus norvegicus
tccaaggcacgatgggaagattctc

SEQ ID NO: 606347 - DNA, 25 bp, Rattus norvegicus
tgagttagcgcattaacctcccgcg

SEQ ID NO: 606348 - DNA, 25 bp, Rattus norvegicus
gtcaaagagacagagcgtggccatt

SEQ ID NO: 606349 - DNA, 25 bp, Rattus norvegicus
caaggtcggcgtacttcctgtagca

SEQ ID NO: 606350 - DNA, 25 bp, Rattus norvegicus
caggcgacaggctcatggtaggaat

SEQ ID NO: 606351 - DNA, 25 bp, Rattus norvegicus
tcccgcgcatgagcccttcaagttt

SEQ ID NO: 606352 - DNA, 25 bp, Rattus norvegicus
cgtggccatttctccagtcagaaga

SEQ ID NO: 606353 - DNA, 25 bp, Rattus norvegicus
acgagcgctggcacagggtccatcc

SEQ ID NO: 606354 - DNA, 25 bp, Rattus norvegicus
cacagggtccatcccgccatggcaa

SEQ ID NO: 606355 - DNA, 25 bp, Rattus norvegicus
gatgcaaggcaaccccactatggtg

SEQ ID NO: 606356 - DNA, 25 bp, Rattus norvegicus
atcccgccatggcaacagcagcagg

SEQ ID NO: 606357 - DNA, 25 bp, Rattus norvegicus
catgccaagcaaggagcaggcgccc

SEQ ID NO: 606358 - DNA, 25 bp, Rattus norvegicus
ttgggcttctttactaccccagata

SEQ ID NO: 606359 - DNA, 25 bp, Rattus norvegicus
caggaacccctcagatgcaaggcaa

SEQ ID NO: 606360 - DNA, 25 bp, Rattus norvegicus
agcatgccaagcaaggagcaggcgc

SEQ ID NO: 606361 - DNA, 25 bp, Rattus norvegicus
accacgagcgctggcacagggtcca

SEQ ID NO: 606362 - DNA, 25 bp, Rattus norvegicus
aagcaaggagcaggcgcccctcgtc

SEQ ID NO: 606363 - DNA, 25 bp, Rattus norvegicus
cagatacgacgactaccaccacgag

SEQ ID NO: 606364 - DNA, 25 bp, Rattus norvegicus
ggcttctttactaccccagatacga

SEQ ID NO: 606365 - DNA, 25 bp, Rattus norvegicus
gatacgacgactaccaccacgagcg

SEQ ID NO: 606366 - DNA, 25 bp, Rattus norvegicus
tgcagcatgccaagcaaggagcagg

SEQ ID NO: 606367 - DNA, 25 bp, Rattus norvegicus
atccttcctgactacggagcttcca

SEQ ID NO: 606368 - DNA, 25 bp, Rattus norvegicus
aggcttggcgccttcttggctcctc

SEQ ID NO: 606369 - DNA, 25 bp, Rattus norvegicus
gcttccacgctatctggggagggtc

SEQ ID NO: 606370 - DNA, 25 bp, Rattus norvegicus
gggccagatccttcctgactacgga

SEQ ID NO: 606371 - DNA, 25 bp, Rattus norvegicus
acttgggccagatccttcctgacta

SEQ ID NO: 606372 - DNA, 25 bp, Rattus norvegicus
ggtacttgggccagatccttcctga

SEQ ID NO: 606373 - DNA, 25 bp, Rattus norvegicus
agtcggtcggtacttgggccagatc

SEQ ID NO: 606374 - DNA, 25 bp, Rattus norvegicus
aggtcagcggccagcttagttggtc

SEQ ID NO: 606375 - DNA, 25 bp, Rattus norvegicus
ccatactaggtcagcggccagctta

SEQ ID NO: 606376 - DNA, 25 bp, Rattus norvegicus
tgtccatactaggtcagcggccagc

SEQ ID NO: 606377 - DNA, 25 bp, Rattus norvegicus
agcgctctgtccatactaggtcagc

SEQ ID NO: 606378 - DNA, 25 bp, Rattus norvegicus
ccagcgctctgtccatactaggtca

SEQ ID NO: 606379 - DNA, 25 bp, Rattus norvegicus
ttcccagcgctctgtccatactagg

SEQ ID NO: 606380 - DNA, 25 bp, Rattus norvegicus
tccacgctatctggggagggtccag

SEQ ID NO: 606381 - DNA, 25 bp, Rattus norvegicus
aaaaccagctcacattctgtcccag

SEQ ID NO: 606382 - DNA, 25 bp, Rattus norvegicus
ttcctcgctctttgaggctccactg

SEQ ID NO: 606383 - DNA, 25 bp, Rattus norvegicus
agggcatcgcaaggactcgcagccc

SEQ ID NO: 606384 - DNA, 25 bp, Rattus norvegicus
cctcgctctttgaggctccactgga

SEQ ID NO: 606385 - DNA, 25 bp, Rattus norvegicus
cgctctttgaggctccactggacca

SEQ ID NO: 606386 - DNA, 25 bp, Rattus norvegicus
gctctttgaggctccactggaccaa

SEQ ID NO: 606387 - DNA, 25 bp, Rattus norvegicus
tcgttcattcattcctcgctctttg

SEQ ID NO: 606388 - DNA, 25 bp, Rattus norvegicus
ttgaggctccactggaccaaaacca

SEQ ID NO: 606389 - DNA, 25 bp, Rattus norvegicus
tcattcctcgctctttgaggctcca

SEQ ID NO: 606390 - DNA, 25 bp, Rattus norvegicus
tggaccaaaaccagctcacattctg

SEQ ID NO: 606391 - DNA, 25 bp, Rattus norvegicus
cccagggcatcgcaaggactcgcag

SEQ ID NO: 606392 - DNA, 25 bp, Rattus norvegicus
gttcattcattcctcgctctttgag

SEQ ID NO: 606393 - DNA, 25 bp, Rattus norvegicus
tcattcattcctcgctctttgaggc

SEQ ID NO: 606394 - DNA, 25 bp, Rattus norvegicus
aggctccactggaccaaaaccagct

SEQ ID NO: 606395 - DNA, 25 bp, Rattus norvegicus
agagggtaaggcacttagagccacc

SEQ ID NO: 606396 - DNA, 25 bp, Rattus norvegicus
cacttagagccacccgcaggagggg

SEQ ID NO: 606397 - DNA, 25 bp, Rattus norvegicus
ggcacttagagccacccgcaggagg

SEQ ID NO: 606398 - DNA, 25 bp, Rattus norvegicus
aaggcacttagagccacccgcagga

SEQ ID NO: 606399 - DNA, 25 bp, Rattus norvegicus
ggtaaggcacttagagccacccgca

SEQ ID NO: 606400 - DNA, 25 bp, Rattus norvegicus
tttcggagagggtaaggcacttaga

SEQ ID NO: 606401 - DNA, 25 bp, Rattus norvegicus
ctttcggagagggtaaggcacttag

SEQ ID NO: 606402 - DNA, 25 bp, Rattus norvegicus
agctttcggagagggtaaggcactt

SEQ ID NO: 606403 - DNA, 25 bp, Rattus norvegicus
tcctgggtgggacagagctttcgga

SEQ ID NO: 606404 - DNA, 25 bp, Rattus norvegicus
cctagggatctcctaggggcaggcc

SEQ ID NO: 606405 - DNA, 25 bp, Rattus norvegicus
agggtgcggcccctagggatctcct

SEQ ID NO: 606406 - DNA, 25 bp, Rattus norvegicus
cgggtcccaagagtgagtgagcgag

SEQ ID NO: 606407 - DNA, 25 bp, Rattus norvegicus
tccgcgctgcgggtcccaagagtga

SEQ ID NO: 606408 - DNA, 25 bp, Rattus norvegicus
taaggcacttagagccacccgcagg

SEQ ID NO: 606409 - DNA, 25 bp, Rattus norvegicus
tccctagcgcgagtctttgtcgcct

SEQ ID NO: 606410 - DNA, 25 bp, Rattus norvegicus
cgattccgtattctgtcgcttttca

SEQ ID NO: 606411 - DNA, 25 bp, Rattus norvegicus
cgtattctgtcgcttttcagtggca

SEQ ID NO: 606412 - DNA, 25 bp, Rattus norvegicus
attctgtcgcttttcagtggcatca

SEQ ID NO: 606413 - DNA, 25 bp, Rattus norvegicus
ttcagtggcatcaggttggtttgca

SEQ ID NO: 606414 - DNA, 25 bp, Rattus norvegicus
ggcgatccgattccgtattctgtcg

SEQ ID NO: 606415 - DNA, 25 bp, Rattus norvegicus
gtgctgcctccctagcgcgagtctt

SEQ ID NO: 606416 - DNA, 25 bp, Rattus norvegicus
gtcgcttttcagtggcatcaggttg

SEQ ID NO: 606417 - DNA, 25 bp, Rattus norvegicus
agcgcgagtctttgtcgcctccagg

SEQ ID NO: 606418 - DNA, 25 bp, Rattus norvegicus
tttgtcgcctccaggggcgctccta

SEQ ID NO: 606419 - DNA, 25 bp, Rattus norvegicus
cctccaggggcgctcctacttcgcc

SEQ ID NO: 606420 - DNA, 25 bp, Rattus norvegicus
ggtttgcagtgctgcctccctagcg

SEQ ID NO: 606421 - DNA, 25 bp, Rattus norvegicus
tggcatcaggttggtttgcagtgct

SEQ ID NO: 606422 - DNA, 25 bp, Rattus norvegicus
gtcggcgatccgattccgtattctg

SEQ ID NO: 606423 - DNA, 25 bp, Rattus norvegicus
tgcggcgtgcttaaagcctgtttcc

SEQ ID NO: 606424 - DNA, 25 bp, Rattus norvegicus
tgtagttcatcaccctttcccaagc

SEQ ID NO: 606425 - DNA, 25 bp, Rattus norvegicus
gcgctcctgcgcaaagacagccagg

SEQ ID NO: 606426 - DNA, 25 bp, Rattus norvegicus
gcctgtttccgttccaagagggatc

SEQ ID NO: 606427 - DNA, 25 bp, Rattus norvegicus
gctgccgcagctagtgtagttcatc

SEQ ID NO: 606428 - DNA, 25 bp, Rattus norvegicus
ggcccagcttttgcggcgtgcttaa

SEQ ID NO: 606429 - DNA, 25 bp, Rattus norvegicus
tcaaatgagttcttggcccagcttt

SEQ ID NO: 606430 - DNA, 25 bp, Rattus norvegicus
cggaaagggaggtcaaatgagttct

SEQ ID NO: 606431 - DNA, 25 bp, Rattus norvegicus
cgctctggctgcgtgggaagtatac

SEQ ID NO: 606432 - DNA, 25 bp, Rattus norvegicus
ccagactgttatcccgcacagcggg

SEQ ID NO: 606433 - DNA, 25 bp, Rattus norvegicus
tggaccaaaacccagactgttatcc

SEQ ID NO: 606434 - DNA, 25 bp, Rattus norvegicus
ctcaagctgagggtggaccaaaacc

SEQ ID NO: 606435 - DNA, 25 bp, Rattus norvegicus
ccagtgtctcaagctgagggtggac

SEQ ID NO: 606436 - DNA, 25 bp, Rattus norvegicus
ttccaagagggatcacgcgctcctg

SEQ ID NO: 606437 - DNA, 25 bp, Rattus norvegicus
agtccatttcccaactagcgagttg

SEQ ID NO: 606438 - DNA, 25 bp, Rattus norvegicus
caactagcgagttgcaccatcccgg

SEQ ID NO: 606439 - DNA, 25 bp, Rattus norvegicus
ttcccaactagcgagttgcaccatc

SEQ ID NO: 606440 - DNA, 25 bp, Rattus norvegicus
cggaagcctctcagctagtccattt

SEQ ID NO: 606441 - DNA, 25 bp, Rattus norvegicus
ctgcgggctcgccagctaccaaccc

SEQ ID NO: 606442 - DNA, 25 bp, Rattus norvegicus
tccatttcccaactagcgagttgca

SEQ ID NO: 606443 - DNA, 25 bp, Rattus norvegicus
ttcctgcgggctcgccagctaccaa

SEQ ID NO: 606444 - DNA, 25 bp, Rattus norvegicus
ccggaagcctctcagctagtccatt

SEQ ID NO: 606445 - DNA, 25 bp, Rattus norvegicus
gaagcctctcagctagtccatttcc

SEQ ID NO: 606446 - DNA, 25 bp, Rattus norvegicus
ggaagcctctcagctagtccatttc

SEQ ID NO: 606447 - DNA, 25 bp, Rattus norvegicus
tctcagctagtccatttcccaacta

SEQ ID NO: 606448 - DNA, 25 bp, Rattus norvegicus
tgggccggaagcctctcagctagtc

SEQ ID NO: 606449 - DNA, 25 bp, Rattus norvegicus
agctagtccatttcccaactagcga

SEQ ID NO: 606450 - DNA, 25 bp, Rattus norvegicus
catttcccaactagcgagttgcacc

SEQ ID NO: 606451 - DNA, 25 bp, Rattus norvegicus
cactcgtccgtcagtgttgcgtggt

SEQ ID NO: 606452 - DNA, 25 bp, Rattus norvegicus
gttgcgtggtccaatgcgtgtgctt

SEQ ID NO: 606453 - DNA, 25 bp, Rattus norvegicus
atgctgccgtcagtcggtgttgcag

SEQ ID NO: 606454 - DNA, 25 bp, Rattus norvegicus
agcagccgccctgactctcagagca

SEQ ID NO: 606455 - DNA, 25 bp, Rattus norvegicus
agagcatcctcctccgagcggcacc

SEQ ID NO: 606456 - DNA, 25 bp, Rattus norvegicus
cggacgataccgctggtcccggatc

SEQ ID NO: 606457 - DNA, 25 bp, Rattus norvegicus
gataccgctggtcccggatctgtta

SEQ ID NO: 606458 - DNA, 25 bp, Rattus norvegicus
ggtcccggatctgttacctgccgta

SEQ ID NO: 606459 - DNA, 25 bp, Rattus norvegicus
tgttacctgccgtagacccagcggt

SEQ ID NO: 606460 - DNA, 25 bp, Rattus norvegicus
gtagacccagcggtctcgaggctcg

SEQ ID NO: 606461 - DNA, 25 bp, Rattus norvegicus
cttctgcacctttgcattggccgtg

SEQ ID NO: 606462 - DNA, 25 bp, Rattus norvegicus
ctggcggcttctgcacctttgcatt

SEQ ID NO: 606463 - DNA, 25 bp, Rattus norvegicus
tttgcattggccgtgccactcgtcc

SEQ ID NO: 606464 - DNA, 25 bp, Rattus norvegicus
gccgtgccactcgtccgtcagtgtt

SEQ ID NO: 606465 - DNA, 25 bp, Rattus norvegicus
aacggcggcctctgcaccgtgctag

SEQ ID NO: 606466 - DNA, 25 bp, Rattus norvegicus
ctgggtccatggcattgtgaatcga

SEQ ID NO: 606467 - DNA, 25 bp, Rattus norvegicus
ggcgagctcagcttcagcctgcgca

SEQ ID NO: 606468 - DNA, 25 bp, Rattus norvegicus
gactgcgacttcctggagctgctgc

SEQ ID NO: 606469 - DNA, 25 bp, Rattus norvegicus
tgcgcttcacgctgtcttgcgccga

SEQ ID NO: 606470 - DNA, 25 bp, Rattus norvegicus
gagcccgccacgctgcagttggaca

SEQ ID NO: 606471 - DNA, 25 bp, Rattus norvegicus
gaccgctggcacatggtgctgctga

SEQ ID NO: 606472 - DNA, 25 bp, Rattus norvegicus
ctggccaacctgaagctgggcgagc

SEQ ID NO: 606473 - DNA, 25 bp, Rattus norvegicus
gctgcgactgcagccacactggctt

SEQ ID NO: 606474 - DNA, 25 bp, Rattus norvegicus
ccacactggcttcggcggcaagttc

SEQ ID NO: 606475 - DNA, 25 bp, Rattus norvegicus
caagttctgcagtgaaggtgagccc

SEQ ID NO: 606476 - DNA, 25 bp, Rattus norvegicus
gagggagaacgcacatcagcacgcc

SEQ ID NO: 606477 - DNA, 25 bp, Rattus norvegicus
tcagcacgccacagttgcacggagg

SEQ ID NO: 606478 - DNA, 25 bp, Rattus norvegicus
gcaccgtcaagtacgagccgccttt

SEQ ID NO: 606479 - DNA, 25 bp, Rattus norvegicus
gctgcgtgcgagacctcttcataga

SEQ ID NO: 606480 - DNA, 25 bp, Rattus norvegicus
tgcatcgggactggctttctgggtc

SEQ ID NO: 606481 - DNA, 25 bp, Rattus norvegicus
ctgtgattgcatcgggactggcttt

SEQ ID NO: 606482 - DNA, 25 bp, Rattus norvegicus
gaaccggttcgtctgtgattgcatc

SEQ ID NO: 606483 - DNA, 25 bp, Rattus norvegicus
ggctggaaccggttcgtctgtgatt

SEQ ID NO: 606484 - DNA, 25 bp, Rattus norvegicus
ccctgtcgtaatggtggcatctgtc

SEQ ID NO: 606485 - DNA, 25 bp, Rattus norvegicus
accctgaagcagtgtgcatcggccc

SEQ ID NO: 606486 - DNA, 25 bp, Rattus norvegicus
tgcacctttctgctctcgggagacc

SEQ ID NO: 606487 - DNA, 25 bp, Rattus norvegicus
ttctgctctcgggagaccctgaagc

SEQ ID NO: 606488 - DNA, 25 bp, Rattus norvegicus
cgagacctcttcatagatggacgga

SEQ ID NO: 606489 - DNA, 25 bp, Rattus norvegicus
catagatggacggagtcgagatctc

SEQ ID NO: 606490 - DNA, 25 bp, Rattus norvegicus
atctccggggcctggctgaggcaca

SEQ ID NO: 606491 - DNA, 25 bp, Rattus norvegicus
ggagctgtgggcgttgcacctttct

SEQ ID NO: 606492 - DNA, 25 bp, Rattus norvegicus
gcgttgcacctttctgctctcggga

SEQ ID NO: 606493 - DNA, 25 bp, Rattus norvegicus
cgaatccagcagcaccacgggcatg

SEQ ID NO: 606494 - DNA, 25 bp, Rattus norvegicus
tctctacgccatgtacaagtaccgc

SEQ ID NO: 606495 - DNA, 25 bp, Rattus norvegicus
cgacgacagcgactgcgaggagccc

SEQ ID NO: 606496 - DNA, 25 bp, Rattus norvegicus
ggcggcgctctgcatccttatcctt

SEQ ID NO: 606497 - DNA, 25 bp, Rattus norvegicus
catgtacaagtaccgcaaccgcgac

SEQ ID NO: 606498 - DNA, 25 bp, Rattus norvegicus
gaagtgatccgcgaatccagcagca

SEQ ID NO: 606499 - DNA, 25 bp, Rattus norvegicus
gcggtggaagtgatccgcgaatcca

SEQ ID NO: 606500 - DNA, 25 bp, Rattus norvegicus
aatgaaccaccgagacccactgcag

SEQ ID NO: 606501 - DNA, 25 bp, Rattus norvegicus
tgcccgcgggcaaaatgaaccaccg

SEQ ID NO: 606502 - DNA, 25 bp, Rattus norvegicus
taacctcaggacagatggggccacg

SEQ ID NO: 606503 - DNA, 25 bp, Rattus norvegicus
cccgacctaacctcaggacagatgg

SEQ ID NO: 606504 - DNA, 25 bp, Rattus norvegicus
cggggaggtctttgactccagcctc

SEQ ID NO: 606505 - DNA, 25 bp, Rattus norvegicus
tcgcctccggggaggtctttgactc

SEQ ID NO: 606506 - DNA, 25 bp, Rattus norvegicus
tccttatccttctctacgccatgta

SEQ ID NO: 606507 - DNA, 25 bp, Rattus norvegicus
agctcgggtttcaccgggtgctctg

SEQ ID NO: 606508 - DNA, 25 bp, Rattus norvegicus
tctgatcccggaagctctgtgtttc

SEQ ID NO: 606509 - DNA, 25 bp, Rattus norvegicus
tgcctgggttcggaatctggacagc

SEQ ID NO: 606510 - DNA, 25 bp, Rattus norvegicus
cccagaagtgcctgggttcggaatc

SEQ ID NO: 606511 - DNA, 25 bp, Rattus norvegicus
ttactggcggtcactgccgtcccag

SEQ ID NO: 606512 - DNA, 25 bp, Rattus norvegicus
tttaaccgcaactgcgccagcgcgc

SEQ ID NO: 606513 - DNA, 25 bp, Rattus norvegicus
tccgcgctgatttcacctgtcaggc

SEQ ID NO: 606514 - DNA, 25 bp, Rattus norvegicus
ttcaccgggtgctctgaatggggcc

SEQ ID NO: 606515 - DNA, 25 bp, Rattus norvegicus
cccgacggcagcagctcgggtttca

SEQ ID NO: 606516 - DNA, 25 bp, Rattus norvegicus
agcgcacatggccaatcagcagccg

SEQ ID NO: 606517 - DNA, 25 bp, Rattus norvegicus
aagctctgtgtttctaccgctggtt

SEQ ID NO: 606518 - DNA, 25 bp, Rattus norvegicus
ggtgagcgcacatggccaatcagca

SEQ ID NO: 606519 - DNA, 25 bp, Rattus norvegicus
gcgtccgcgctgatttcacctgtca

SEQ ID NO: 606520 - DNA, 25 bp, Rattus norvegicus
tagcgggcgtccgcctttaaccgca

SEQ ID NO: 606521 - DNA, 25 bp, Rattus norvegicus
cgccttttggccagcggcgcgttct

SEQ ID NO: 606522 - DNA, 25 bp, Rattus norvegicus
ggcgcgttctccacactcttcaaaa

SEQ ID NO: 606523 - DNA, 25 bp, Rattus norvegicus
ctcttcaaaaagaagccctcgcgct

SEQ ID NO: 606524 - DNA, 25 bp, Rattus norvegicus
gaagccctcgcgctttcctcggtta

SEQ ID NO: 606525 - DNA, 25 bp, Rattus norvegicus
aaaggagaggatgaatgtcccaccc

SEQ ID NO: 606526 - DNA, 25 bp, Rattus norvegicus
cccgccagatttgggtttgctaatc

SEQ ID NO: 606527 - DNA, 25 bp, Rattus norvegicus
actgccgtcctgaagccacgagctg

SEQ ID NO: 606528 - DNA, 25 bp, Rattus norvegicus
cattgagcccggagcgcactgctgg

SEQ ID NO: 606529 - DNA, 25 bp, Rattus norvegicus
ttaccatgaaagtggcattgagccc

SEQ ID NO: 606530 - DNA, 25 bp, Rattus norvegicus
ttctaacccatcaaaggcgggctcc

SEQ ID NO: 606531 - DNA, 25 bp, Rattus norvegicus
atgcatcccacagtgcccagatcta

SEQ ID NO: 606532 - DNA, 25 bp, Rattus norvegicus
tgggtttgctaatcctcgccttggc

SEQ ID NO: 606533 - DNA, 25 bp, Rattus norvegicus
gctaatcctcgccttggcatgcatc

SEQ ID NO: 606534 - DNA, 25 bp, Rattus norvegicus
agaggactccagcacatccggcgtg

SEQ ID NO: 606535 - DNA, 25 bp, Rattus norvegicus
ggctgacaccaagctccgaaggatc

SEQ ID NO: 606536 - DNA, 25 bp, Rattus norvegicus
tgcagcgtactgcagggtgaagcaa

SEQ ID NO: 606537 - DNA, 25 bp, Rattus norvegicus
tgaagcaaggcgtctgcatgggccc

SEQ ID NO: 606538 - DNA, 25 bp, Rattus norvegicus
gggccgcagtctcgcgaacccaaag

SEQ ID NO: 606539 - DNA, 25 bp, Rattus norvegicus
cgcgaacccaaagtcgatgatcttc

SEQ ID NO: 606540 - DNA, 25 bp, Rattus norvegicus
aagtcgatgatcttcaccggggccc

SEQ ID NO: 606541 - DNA, 25 bp, Rattus norvegicus
cccaggagtgtcgtctgcgtacaag

SEQ ID NO: 606542 - DNA, 25 bp, Rattus norvegicus
tcgtctgcgtacaagatgttctacc

SEQ ID NO: 606543 - DNA, 25 bp, Rattus norvegicus
acaagatgttctaccggagggaggc

SEQ ID NO: 606544 - DNA, 25 bp, Rattus norvegicus
tcctcatgcatgaagctcacggctg

SEQ ID NO: 606545 - DNA, 25 bp, Rattus norvegicus
aaggatctggctagcctcggactcg

SEQ ID NO: 606546 - DNA, 25 bp, Rattus norvegicus
ctcggactcgctgaagagtcgcttc

SEQ ID NO: 606547 - DNA, 25 bp, Rattus norvegicus
gagtcgcttcttgcggatgtgctcc

SEQ ID NO: 606548 - DNA, 25 bp, Rattus norvegicus
acctcgggtttcaggtcacggtgca

SEQ ID NO: 606549 - DNA, 25 bp, Rattus norvegicus
tcctcatgcccggtcaggttggctg

SEQ ID NO: 606550 - DNA, 25 bp, Rattus norvegicus
gaaagcctcctagcctggcgtcggt

SEQ ID NO: 606551 - DNA, 25 bp, Rattus norvegicus
cctttggatggcatgtggctgcagc

SEQ ID NO: 606552 - DNA, 25 bp, Rattus norvegicus
ggagaaagcctcctagcctggcgtc

SEQ ID NO: 606553 - DNA, 25 bp, Rattus norvegicus
gcgaagttctccacgctcaccttct

SEQ ID NO: 606554 - DNA, 25 bp, Rattus norvegicus
tgagcccagcgggtcgctgactctt

SEQ ID NO: 606555 - DNA, 25 bp, Rattus norvegicus
gggtcgctgactcttgccatccgtc

SEQ ID NO: 606556 - DNA, 25 bp, Rattus norvegicus
tcgggatctggcacccaccttcggt

SEQ ID NO: 606557 - DNA, 25 bp, Rattus norvegicus
ccaccttcggtgatctgcagctcca

SEQ ID NO: 606558 - DNA, 25 bp, Rattus norvegicus
tctgcagctccacggcgcagccctc

SEQ ID NO: 606559 - DNA, 25 bp, Rattus norvegicus
cctcatcctcgtctcccatggcggg

SEQ ID NO: 606560 - DNA, 25 bp, Rattus norvegicus
cgccggttacatggcggctccggcc

SEQ ID NO: 606561 - DNA, 25 bp, Rattus norvegicus
tcaggcggctggaacgtgacagaac

SEQ ID NO: 606562 - DNA, 25 bp, Rattus norvegicus
ctgcagcgggagaaagcctcctagc

SEQ ID NO: 606563 - DNA, 25 bp, Rattus norvegicus
tgcctaggacgcaaaacctcagctg

SEQ ID NO: 606564 - DNA, 25 bp, Rattus norvegicus
ggtccgcatcaaccctgtggagttc

SEQ ID NO: 606565 - DNA, 25 bp, Rattus norvegicus
aatctcctcagctcgcatgtgcggg

SEQ ID NO: 606566 - DNA, 25 bp, Rattus norvegicus
gctccggtgcgacaacatgaaactg

SEQ ID NO: 606567 - DNA, 25 bp, Rattus norvegicus
gtccggggaagtagccaactgcttc

SEQ ID NO: 606568 - DNA, 25 bp, Rattus norvegicus
agttcttcccatctctgttgccgca

SEQ ID NO: 606569 - DNA, 25 bp, Rattus norvegicus
cgccgcgacacatgtgatttgcata

SEQ ID NO: 606570 - DNA, 25 bp, Rattus norvegicus
ttttacattcaaccagagcgccgcg

SEQ ID NO: 606571 - DNA, 25 bp, Rattus norvegicus
ccgatgtgaccgtttctgaccctta

SEQ ID NO: 606572 - DNA, 25 bp, Rattus norvegicus
agaagttcctggcttaccgatgtga

SEQ ID NO: 606573 - DNA, 25 bp, Rattus norvegicus
gatcttccagaggtcgcacgcctta

SEQ ID NO: 606574 - DNA, 25 bp, Rattus norvegicus
accgatccggctatgctgcctagga

SEQ ID NO: 606575 - DNA, 25 bp, Rattus norvegicus
accggtcaccttgatcggggccata

SEQ ID NO: 606576 - DNA, 25 bp, Rattus norvegicus
cgcacgccttatttgtatacagaaa

SEQ ID NO: 606577 - DNA, 25 bp, Rattus norvegicus
aactctactctgtgagggcgtcgaa

SEQ ID NO: 606578 - DNA, 25 bp, Rattus norvegicus
tcactgcggtgaccgaatgaaggtc

SEQ ID NO: 606579 - DNA, 25 bp, Rattus norvegicus
cgcgagcggacaaaactcaaggtca

SEQ ID NO: 606580 - DNA, 25 bp, Rattus norvegicus
cctgaggaccctcgaatgaagaagc

SEQ ID NO: 606581 - DNA, 25 bp, Rattus norvegicus
gatgggacacttgaccgatttggta

SEQ ID NO: 606582 - DNA, 25 bp, Rattus norvegicus
ctacatatgcataaggggtggggcc

SEQ ID NO: 606583 - DNA, 25 bp, Rattus norvegicus
gggcgtcgaacgtgcatgtaaatga

SEQ ID NO: 606584 - DNA, 25 bp, Rattus norvegicus
tctggcttataagagtgggcgtagc

SEQ ID NO: 606585 - DNA, 25 bp, Rattus norvegicus
agccggagcacccttgcatcacgaa

SEQ ID NO: 606586 - DNA, 25 bp, Rattus norvegicus
ggaccaggtgccctatgctaatatc

SEQ ID NO: 606587 - DNA, 25 bp, Rattus norvegicus
ggtcggcctgcgcatgcaaaacagg

SEQ ID NO: 606588 - DNA, 25 bp, Rattus norvegicus
cacaaaaggacatcgcggctgcttc

SEQ ID NO: 606589 - DNA, 25 bp, Rattus norvegicus
ccgctggctgcttgtaggacacaaa

SEQ ID NO: 606590 - DNA, 25 bp, Rattus norvegicus
tgagagggcgtggttatataactac

SEQ ID NO: 606591 - DNA, 25 bp, Rattus norvegicus
acgcgcactctggattccgcggttg

SEQ ID NO: 606592 - DNA, 25 bp, Rattus norvegicus
gtacgcgcactctggattccgcggt

SEQ ID NO: 606593 - DNA, 25 bp, Rattus norvegicus
aggtacgcgcactctggattccgcg

SEQ ID NO: 606594 - DNA, 25 bp, Rattus norvegicus
caggtacgcgcactctggattccgc

SEQ ID NO: 606595 - DNA, 25 bp, Rattus norvegicus
ccaggtacgcgcactctggattccg

SEQ ID NO: 606596 - DNA, 25 bp, Rattus norvegicus
gctccctgtagcttcctcagcggga

SEQ ID NO: 606597 - DNA, 25 bp, Rattus norvegicus
tgctccctgtagcttcctcagcggg

SEQ ID NO: 606598 - DNA, 25 bp, Rattus norvegicus
ctggcggcgctgctccctgtagctt

SEQ ID NO: 606599 - DNA, 25 bp, Rattus norvegicus
tgctcagggcggcgctgcttctcct

SEQ ID NO: 606600 - DNA, 25 bp, Rattus norvegicus
gcgcctgctgctcagggcggcgctg

SEQ ID NO: 606601 - DNA, 25 bp, Rattus norvegicus
acgcattccgggctcccgatggccc

SEQ ID NO: 606602 - DNA, 25 bp, Rattus norvegicus
gccacccacgctcggtccccacgca

SEQ ID NO: 606603 - DNA, 25 bp, Rattus norvegicus
tcctcagcgggacccccaggtacgc

SEQ ID NO: 606604 - DNA, 25 bp, Rattus norvegicus
ccctgtagcttcctcagcgggaccc

SEQ ID NO: 606605 - DNA, 25 bp, Rattus norvegicus
ggactcgtcgatgaaggccagattc

SEQ ID NO: 606606 - DNA, 25 bp, Rattus norvegicus
gggagtctcgaccttctctgcgggt

SEQ ID NO: 606607 - DNA, 25 bp, Rattus norvegicus
actggggtaatccagagctgaggcc

SEQ ID NO: 606608 - DNA, 25 bp, Rattus norvegicus
ttctcactggggtaatccagagctg

SEQ ID NO: 606609 - DNA, 25 bp, Rattus norvegicus
ctcgtcgatgaaggccagattctca

SEQ ID NO: 606610 - DNA, 25 bp, Rattus norvegicus
tctgaggactcgtcgatgaaggcca

SEQ ID NO: 606611 - DNA, 25 bp, Rattus norvegicus
tcactctgcgtgtctgaggactcgt

SEQ ID NO: 606612 - DNA, 25 bp, Rattus norvegicus
agccacgctcactctgcgtgtctga

SEQ ID NO: 606613 - DNA, 25 bp, Rattus norvegicus
acgaggcagggcacagccacgctca

SEQ ID NO: 606614 - DNA, 25 bp, Rattus norvegicus
ggccttgtctcgaagacgcccagga

SEQ ID NO: 606615 - DNA, 25 bp, Rattus norvegicus
caccggcacggccttgtctcgaaga

SEQ ID NO: 606616 - DNA, 25 bp, Rattus norvegicus
gagatcctgtccctacaccggcacg

SEQ ID NO: 606617 - DNA, 25 bp, Rattus norvegicus
gcgggccagagatcctgtccctaca

SEQ ID NO: 606618 - DNA, 25 bp, Rattus norvegicus
ggccagattctcactggggtaatcc

SEQ ID NO: 606619 - DNA, 25 bp, Rattus norvegicus
gggagcttaaccctaccagagctgc

SEQ ID NO: 606620 - DNA, 25 bp, Rattus norvegicus
tttggctgcggccaggtctcccgcg

SEQ ID NO: 606621 - DNA, 25 bp, Rattus norvegicus
aggtgacagcggcagcccagagacc

SEQ ID NO: 606622 - DNA, 25 bp, Rattus norvegicus
ttacgccgacgcctccgagcgtgac

SEQ ID NO: 606623 - DNA, 25 bp, Rattus norvegicus
taccagagctgcgtctccctacgtg

SEQ ID NO: 606624 - DNA, 25 bp, Rattus norvegicus
tccttgggagcttaaccctaccaga

SEQ ID NO: 606625 - DNA, 25 bp, Rattus norvegicus
ctgcccactctgtggctgcggcttt

SEQ ID NO: 606626 - DNA, 25 bp, Rattus norvegicus
acacttactgtctgcccactctgtg

SEQ ID NO: 606627 - DNA, 25 bp, Rattus norvegicus
tcccgcgcctgctccacacttactg

SEQ ID NO: 606628 - DNA, 25 bp, Rattus norvegicus
ggggcctgagatccagcccacattc

SEQ ID NO: 606629 - DNA, 25 bp, Rattus norvegicus
attcacgcgcgggaggtgtcccgcc

SEQ ID NO: 606630 - DNA, 25 bp, Rattus norvegicus
ccactcgaggaaggcattcacgcgc

SEQ ID NO: 606631 - DNA, 25 bp, Rattus norvegicus
acggtcacaccactcgaggaaggca

SEQ ID NO: 606632 - DNA, 25 bp, Rattus norvegicus
accggcgacgggacgcacggtcaca

SEQ ID NO: 606633 - DNA, 25 bp, Rattus norvegicus
gtcgatgtcaatgtcctcaggccgc

SEQ ID NO: 606634 - DNA, 25 bp, Rattus norvegicus
ccacatcgcggtagacatgcccatg

SEQ ID NO: 606635 - DNA, 25 bp, Rattus norvegicus
gggactaccatttcccacgcttaga

SEQ ID NO: 606636 - DNA, 25 bp, Rattus norvegicus
cagctcttaatgttggggactacca

SEQ ID NO: 606637 - DNA, 25 bp, Rattus norvegicus
cagtgccattgaccgccagctctta

SEQ ID NO: 606638 - DNA, 25 bp, Rattus norvegicus
cacagggtcgctgaaggaaacttcc

SEQ ID NO: 606639 - DNA, 25 bp, Rattus norvegicus
ggccgcacacaacaagcacctgggt

SEQ ID NO: 606640 - DNA, 25 bp, Rattus norvegicus
ccgagagtagaacaggccgcacaca

SEQ ID NO: 606641 - DNA, 25 bp, Rattus norvegicus
tcttccagaatcaacgcaaggtgcg

SEQ ID NO: 606642 - DNA, 25 bp, Rattus norvegicus
aaggactccgaaaccatgcgccgcg

SEQ ID NO: 606643 - DNA, 25 bp, Rattus norvegicus
acgtaaactgcgtagcggctggcaa

SEQ ID NO: 606644 - DNA, 25 bp, Rattus norvegicus
ggcgtccgttcgctacgtaaactgc

SEQ ID NO: 606645 - DNA, 25 bp, Rattus norvegicus
cccggtgaataaaaggaagtcgatg

SEQ ID NO: 606646 - DNA, 25 bp, Rattus norvegicus
gcggcaacgacttccctgcacaggg

SEQ ID NO: 606647 - DNA, 25 bp, Rattus norvegicus
ctgtcgcccaggaaactagggccgg

SEQ ID NO: 606648 - DNA, 25 bp, Rattus norvegicus
tgtgacagttcctgtcgcccaggaa

SEQ ID NO: 606649 - DNA, 25 bp, Rattus norvegicus
ccgggagcccttagaactggagaga

SEQ ID NO: 606650 - DNA, 25 bp, Rattus norvegicus
ctagggccgggagcccttagaactg

SEQ ID NO: 606651 - DNA, 25 bp, Rattus norvegicus
gtgagacctattcgcggtcataacg

SEQ ID NO: 606652 - DNA, 25 bp, Rattus norvegicus
gggtgagacctattcgcggtcataa

SEQ ID NO: 606653 - DNA, 25 bp, Rattus norvegicus
agatctgtgacagttcctgtcgccc

SEQ ID NO: 606654 - DNA, 25 bp, Rattus norvegicus
aggcccgagtcaggggcctcgagaa

SEQ ID NO: 606655 - DNA, 25 bp, Rattus norvegicus
agtcaggggcctcgagaacgggctt

SEQ ID NO: 606656 - DNA, 25 bp, Rattus norvegicus
ctcgagaacgggcttggggtgagac

SEQ ID NO: 606657 - DNA, 25 bp, Rattus norvegicus
tctgtgacagttcctgtcgcccagg

SEQ ID NO: 606658 - DNA, 25 bp, Rattus norvegicus
ggggtgagacctattcgcggtcata

SEQ ID NO: 606659 - DNA, 25 bp, Rattus norvegicus
aactggagagaggaggcaggcccga

SEQ ID NO: 606660 - DNA, 25 bp, Rattus norvegicus
ttggggtgagacctattcgcggtca

SEQ ID NO: 606661 - DNA, 25 bp, Rattus norvegicus
aagagcgccgcgtccatttcgcaca

SEQ ID NO: 606662 - DNA, 25 bp, Rattus norvegicus
accgaagggtagctcgtccatggcg

SEQ ID NO: 606663 - DNA, 25 bp, Rattus norvegicus
ctcaccgaagggtagctcgtccatg

SEQ ID NO: 606664 - DNA, 25 bp, Rattus norvegicus
ttccagagccgcctcaccgaagggt

SEQ ID NO: 606665 - DNA, 25 bp, Rattus norvegicus
gtccatttcgcacacctcggccagt

SEQ ID NO: 606666 - DNA, 25 bp, Rattus norvegicus
cttcgatgtcggtcaagagcgccgc

SEQ ID NO: 606667 - DNA, 25 bp, Rattus norvegicus
cacgcaccttcgatgtcggtcaaga

SEQ ID NO: 606668 - DNA, 25 bp, Rattus norvegicus
ccgggacacgcaccttcgatgtcgg

SEQ ID NO: 606669 - DNA, 25 bp, Rattus norvegicus
cgacccggcacaggccgcgccagag

SEQ ID NO: 606670 - DNA, 25 bp, Rattus norvegicus
gcacaagttcctggccaagcgacct

SEQ ID NO: 606671 - DNA, 25 bp, Rattus norvegicus
gcacgcgcacaagttcctggccaag

SEQ ID NO: 606672 - DNA, 25 bp, Rattus norvegicus
agtttcactctagatcccaggcgcc

SEQ ID NO: 606673 - DNA, 25 bp, Rattus norvegicus
ggtcccgagagtttcactctagatc

SEQ ID NO: 606674 - DNA, 25 bp, Rattus norvegicus
acctcggccagtgcctgttccagag

SEQ ID NO: 606675 - DNA, 25 bp, Rattus norvegicus
gcagtggtcaggctacactgaagtg

SEQ ID NO: 606676 - DNA, 25 bp, Rattus norvegicus
gggtccctggcatctagccgaatgt

SEQ ID NO: 606677 - DNA, 25 bp, Rattus norvegicus
ctagccgaatgtgactgaaggaatc

SEQ ID NO: 606678 - DNA, 25 bp, Rattus norvegicus
actgcagccaaagggatgatagagc

SEQ ID NO: 606679 - DNA, 25 bp, Rattus norvegicus
ccgaatgtgactgaaggaatccttc

SEQ ID NO: 606680 - DNA, 25 bp, Rattus norvegicus
ggacggtgccactgctttctccaca

SEQ ID NO: 606681 - DNA, 25 bp, Rattus norvegicus
gatgaatttactcccgcgccgcagg

SEQ ID NO: 606682 - DNA, 25 bp, Rattus norvegicus
gtcccatttgatgaatttactcccg

SEQ ID NO: 606683 - DNA, 25 bp, Rattus norvegicus
ctcttacctcgtcccatttgatgaa

SEQ ID NO: 606684 - DNA, 25 bp, Rattus norvegicus
ggggacagccactctcttacctcgt

SEQ ID NO: 606685 - DNA, 25 bp, Rattus norvegicus
cagagtaggggacagccactctctt

SEQ ID NO: 606686 - DNA, 25 bp, Rattus norvegicus
gaaggaatccttcgatcagggcaga

SEQ ID NO: 606687 - DNA, 25 bp, Rattus norvegicus
atccttcgatcagggcagagtaggg

SEQ ID NO: 606688 - DNA, 25 bp, Rattus norvegicus
gccaaagggatgatagagcggaatt

SEQ ID NO: 606689 - DNA, 25 bp, Rattus norvegicus
ccaaacaagtttgcgcatcactgtg

SEQ ID NO: 606690 - DNA, 25 bp, Rattus norvegicus
gagccgcggactacattgcccacaa

SEQ ID NO: 606691 - DNA, 25 bp, Rattus norvegicus
tccggaagccctgtccacgtgtcga

SEQ ID NO: 606692 - DNA, 25 bp, Rattus norvegicus
tggcacctgggcagtgcctagaccc

SEQ ID NO: 606693 - DNA, 25 bp, Rattus norvegicus
gacctagtagggcatcctggcacct

SEQ ID NO: 606694 - DNA, 25 bp, Rattus norvegicus
cgtgagatcggacctagtagggcat

SEQ ID NO: 606695 - DNA, 25 bp, Rattus norvegicus
agctcttcctccaggggcgtgagat

SEQ ID NO: 606696 - DNA, 25 bp, Rattus norvegicus
agacaaacggacaactctacactcc

SEQ ID NO: 606697 - DNA, 25 bp, Rattus norvegicus
acaacccagccagctcagaggggcg

SEQ ID NO: 606698 - DNA, 25 bp, Rattus norvegicus
gcatcactgtgggttctgcagctgg

SEQ ID NO: 606699 - DNA, 25 bp, Rattus norvegicus
gtcctggctattgtaagacaaacgg

SEQ ID NO: 606700 - DNA, 25 bp, Rattus norvegicus
gtggtcgtcccagtcctggctattg

SEQ ID NO: 606701 - DNA, 25 bp, Rattus norvegicus
cagcatcaatgagccgcggactaca

SEQ ID NO: 606702 - DNA, 25 bp, Rattus norvegicus
agccgcggggcgaacagagcctcac

SEQ ID NO: 606703 - DNA, 25 bp, Rattus norvegicus
cagagtcagtgggagctctgctgcc

SEQ ID NO: 606704 - DNA, 25 bp, Rattus norvegicus
agtcagtgggagctctgctgccaaa

SEQ ID NO: 606705 - DNA, 25 bp, Rattus norvegicus
ttgtcaccagagtcagtgggagctc

SEQ ID NO: 606706 - DNA, 25 bp, Rattus norvegicus
ggcaagggaaggtcaccgtcaagta

SEQ ID NO: 606707 - DNA, 25 bp, Rattus norvegicus
accaccggtcttacactcgccgctc

SEQ ID NO: 606708 - DNA, 25 bp, Rattus norvegicus
tcagtgggagctctgctgccaaacc

SEQ ID NO: 606709 - DNA, 25 bp, Rattus norvegicus
ttacactcgccgctcccagtgtgcg

SEQ ID NO: 606710 - DNA, 25 bp, Rattus norvegicus
tcaccagagtcagtgggagctctgc

SEQ ID NO: 606711 - DNA, 25 bp, Rattus norvegicus
cggtttgtcaccagagtcagtggga

SEQ ID NO: 606712 - DNA, 25 bp, Rattus norvegicus
agtcggtttgtcaccagagtcagtg

SEQ ID NO: 606713 - DNA, 25 bp, Rattus norvegicus
cctaagtcggtttgtcaccagagtc

SEQ ID NO: 606714 - DNA, 25 bp, Rattus norvegicus
ggacctaagtcggtttgtcaccaga

SEQ ID NO: 606715 - DNA, 25 bp, Rattus norvegicus
tcggacctaagtcggtttgtcacca

SEQ ID NO: 606716 - DNA, 25 bp, Rattus norvegicus
aaggtcaccgtcaagtacgaccgca

SEQ ID NO: 606717 - DNA, 25 bp, Rattus norvegicus
gccctgggccatagctcacgcttag

SEQ ID NO: 606718 - DNA, 25 bp, Rattus norvegicus
aacgtgataacgtcacttccgaggc

SEQ ID NO: 606719 - DNA, 25 bp, Rattus norvegicus
tctcctgggtgacaacgtgataacg

SEQ ID NO: 606720 - DNA, 25 bp, Rattus norvegicus
ctcatttggtcctgtctcctgggtg

SEQ ID NO: 606721 - DNA, 25 bp, Rattus norvegicus
tcattggaccttccaaaacccgctg

SEQ ID NO: 606722 - DNA, 25 bp, Rattus norvegicus
aggcgcgtcttcgtcgctacagggc

SEQ ID NO: 606723 - DNA, 25 bp, Rattus norvegicus
aatcccgctcgtgctgtcacttctg

SEQ ID NO: 606724 - DNA, 25 bp, Rattus norvegicus
cttcaggcaagcctgctccaggctg

SEQ ID NO: 606725 - DNA, 25 bp, Rattus norvegicus
atgggccactgggttctgcccttcg

SEQ ID NO: 606726 - DNA, 25 bp, Rattus norvegicus
ctcctaatccagctatgggccactg

SEQ ID NO: 606727 - DNA, 25 bp, Rattus norvegicus
ggatctcacgccctctgtctctgag

SEQ ID NO: 606728 - DNA, 25 bp, Rattus norvegicus
gttagacttcgtctcctgcacagga

SEQ ID NO: 606729 - DNA, 25 bp, Rattus norvegicus
ttagctctccgcaaggctctttggc

SEQ ID NO: 606730 - DNA, 25 bp, Rattus norvegicus
gtggccacgccctcagaaatgttag

SEQ ID NO: 606731 - DNA, 25 bp, Rattus norvegicus
attcccggtctgaacagcggatccc

SEQ ID NO: 606732 - DNA, 25 bp, Rattus norvegicus
tgcagcagcgcaacaagcagcaagc

SEQ ID NO: 606733 - DNA, 25 bp, Rattus norvegicus
aacaagcagcaagcgacggagcagg

SEQ ID NO: 606734 - DNA, 25 bp, Rattus norvegicus
acgtagcgcctcagcggcggcagaa

SEQ ID NO: 606735 - DNA, 25 bp, Rattus norvegicus
ctggcggacaagaggctcatgtgac

SEQ ID NO: 606736 - DNA, 25 bp, Rattus norvegicus
taacacacgtacctgggtacaggcc

SEQ ID NO: 606737 - DNA, 25 bp, Rattus norvegicus
gctcatgtgacctaaacacgcgctc

SEQ ID NO: 606738 - DNA, 25 bp, Rattus norvegicus
cgagcgagcgggatgtctctaacac

SEQ ID NO: 606739 - DNA, 25 bp, Rattus norvegicus
ctcttcagggatattcccggtctga

SEQ ID NO: 606740 - DNA, 25 bp, Rattus norvegicus
cccttggcagaagtagcgggcgcct

SEQ ID NO: 606741 - DNA, 25 bp, Rattus norvegicus
cacttccgccaaccttgagagggca

SEQ ID NO: 606742 - DNA, 25 bp, Rattus norvegicus
tgtctctaacacacgtacctgggta

SEQ ID NO: 606743 - DNA, 25 bp, Rattus norvegicus
ccaaccttgagagggcaccgcgggc

SEQ ID NO: 606744 - DNA, 25 bp, Rattus norvegicus
cgaggggcacctcttcagggatatt

SEQ ID NO: 606745 - DNA, 25 bp, Rattus norvegicus
gaatcgaattcgtccgctccgcgtt

SEQ ID NO: 606746 - DNA, 25 bp, Rattus norvegicus
agacggaaccgcctttcagagaaga

SEQ ID NO: 606747 - DNA, 25 bp, Rattus norvegicus
ctctcattgggctgaaggcctccta

SEQ ID NO: 606748 - DNA, 25 bp, Rattus norvegicus
gcccattggtcctgttctttctgga

SEQ ID NO: 606749 - DNA, 25 bp, Rattus norvegicus
tcaattatagctgacctggccgcgc

SEQ ID NO: 606750 - DNA, 25 bp, Rattus norvegicus
cttgacgacacggattggttgctga

SEQ ID NO: 606751 - DNA, 25 bp, Rattus norvegicus
ctaactgagggagaaccggtccttg

SEQ ID NO: 606752 - DNA, 25 bp, Rattus norvegicus
tataaactgttctccggtgttggcc

SEQ ID NO: 606753 - DNA, 25 bp, Rattus norvegicus
tctgtgcgcctctactattggatta

SEQ ID NO: 606754 - DNA, 25 bp, Rattus norvegicus
gcgccgccttctggaacctactaga

SEQ ID NO: 606755 - DNA, 25 bp, Rattus norvegicus
tcgcgtctgttaggcccggaatatt

SEQ ID NO: 606756 - DNA, 25 bp, Rattus norvegicus
cggtcaccggatccctccaagtttg

SEQ ID NO: 606757 - DNA, 25 bp, Rattus norvegicus
gcgcttccttacatcgcgtctgtta

SEQ ID NO: 606758 - DNA, 25 bp, Rattus norvegicus
gcctcctctgcacctcggaattgga

SEQ ID NO: 606759 - DNA, 25 bp, Rattus norvegicus
ggtttaggacgccagtctcgcgcca

SEQ ID NO: 606760 - DNA, 25 bp, Rattus norvegicus
cccgcaatagcctcacacccatcta

SEQ ID NO: 606761 - DNA, 25 bp, Rattus norvegicus
tttaggacgccagtctcgcgccagc

SEQ ID NO: 606762 - DNA, 25 bp, Rattus norvegicus
cggaggtttaggacgccagtctcgc

SEQ ID NO: 606763 - DNA, 25 bp, Rattus norvegicus
cagcggaggtttaggacgccagtct

SEQ ID NO: 606764 - DNA, 25 bp, Rattus norvegicus
ctctccttgcggcagcggatgcagc

SEQ ID NO: 606765 - DNA, 25 bp, Rattus norvegicus
cgatgctctccttgcggcagcggat

SEQ ID NO: 606766 - DNA, 25 bp, Rattus norvegicus
accgatgctctccttgcggcagcgg

SEQ ID NO: 606767 - DNA, 25 bp, Rattus norvegicus
actcctccaccacaccgatgctctc

SEQ ID NO: 606768 - DNA, 25 bp, Rattus norvegicus
acactcctggccaaggtataccacc

SEQ ID NO: 606769 - DNA, 25 bp, Rattus norvegicus
gtcccatcgcaaacacacactcctg

SEQ ID NO: 606770 - DNA, 25 bp, Rattus norvegicus
gccactgcaagtcccatcgcaaaca

SEQ ID NO: 606771 - DNA, 25 bp, Rattus norvegicus
tctacccggcaccagcctcgaaatc

SEQ ID NO: 606772 - DNA, 25 bp, Rattus norvegicus
tcgaaatcccgccactgcaagtccc

SEQ ID NO: 606773 - DNA, 25 bp, Rattus norvegicus
cgatagggaccaagctgcgttttga

SEQ ID NO: 606774 - DNA, 25 bp, Rattus norvegicus
gctgcgttttgagctacggcaacta

SEQ ID NO: 606775 - DNA, 25 bp, Rattus norvegicus
cggcaactaggcgaaaagacccagg

SEQ ID NO: 606776 - DNA, 25 bp, Rattus norvegicus
ccgcgaaggtggacctgagcacctc

SEQ ID NO: 606777 - DNA, 25 bp, Rattus norvegicus
tgcagagccaagtgtccggccgcct

SEQ ID NO: 606778 - DNA, 25 bp, Rattus norvegicus
accgtaaatagagtccgagtgggcg

SEQ ID NO: 606779 - DNA, 25 bp, Rattus norvegicus
gcgactctccagagcaccgtaaata

SEQ ID NO: 606780 - DNA, 25 bp, Rattus norvegicus
aaataagggaccgagcgcgactctc

SEQ ID NO: 606781 - DNA, 25 bp, Rattus norvegicus
cgccactctcgtcccagagtaaata

SEQ ID NO: 606782 - DNA, 25 bp, Rattus norvegicus
cgcggtctctaagcaggtcgccacg

SEQ ID NO: 606783 - DNA, 25 bp, Rattus norvegicus
tacaagttccagagtgcccagcggc

SEQ ID NO: 606784 - DNA, 25 bp, Rattus norvegicus
tgcagccaccctcgagaagacagac

SEQ ID NO: 606785 - DNA, 25 bp, Rattus norvegicus
gccttgaaggttgactgcagccacc

SEQ ID NO: 606786 - DNA, 25 bp, Rattus norvegicus
aacccaggcgcggagtgccttgaag

SEQ ID NO: 606787 - DNA, 25 bp, Rattus norvegicus
cagcctccgctcaggggaaaggagc

SEQ ID NO: 606788 - DNA, 25 bp, Rattus norvegicus
cgtgctcgcggtctattgccgcctt

SEQ ID NO: 606789 - DNA, 25 bp, Rattus norvegicus
cctcaggggttattccaaggagcgg

SEQ ID NO: 606790 - DNA, 25 bp, Rattus norvegicus
gctggagcctcaggggttattccaa

SEQ ID NO: 606791 - DNA, 25 bp, Rattus norvegicus
aaactttgcggcgacggctggagcc

SEQ ID NO: 606792 - DNA, 25 bp, Rattus norvegicus
gtctcctcgggaaactttgcggcga

SEQ ID NO: 606793 - DNA, 25 bp, Rattus norvegicus
cagcttgccttacctgcgtagcggc

SEQ ID NO: 606794 - DNA, 25 bp, Rattus norvegicus
gggccagcatcacccgctctgggtt

SEQ ID NO: 606795 - DNA, 25 bp, Rattus norvegicus
aaccgtgactcacgcggctagtggg

SEQ ID NO: 606796 - DNA, 25 bp, Rattus norvegicus
tctattgccgccttgtctagggagc

SEQ ID NO: 606797 - DNA, 25 bp, Rattus norvegicus
gttccacctttgcagccgccaggtg

SEQ ID NO: 606798 - DNA, 25 bp, Rattus norvegicus
tgccagtccacagcgcgcgcaggga

SEQ ID NO: 606799 - DNA, 25 bp, Rattus norvegicus
taaaacctcgctctaaccgtgactc

SEQ ID NO: 606800 - DNA, 25 bp, Rattus norvegicus
atcacccgctctgggttcttgactc

SEQ ID NO: 606801 - DNA, 25 bp, Rattus norvegicus
cgcggccctgcttccattgtgaggg

SEQ ID NO: 606802 - DNA, 25 bp, Rattus norvegicus
gttactcaacgcctttcagcagctc

SEQ ID NO: 606803 - DNA, 25 bp, Rattus norvegicus
gcccaccagggacttcgtccttgga

SEQ ID NO: 606804 - DNA, 25 bp, Rattus norvegicus
ctcggctagactgcgaggactcagg

SEQ ID NO: 606805 - DNA, 25 bp, Rattus norvegicus
tggaagcccggcgttactcaacgcc

SEQ ID NO: 606806 - DNA, 25 bp, Rattus norvegicus
tgaagggctccgtcgcacgctacgc

SEQ ID NO: 606807 - DNA, 25 bp, Rattus norvegicus
gagctcctcgggaacgaccagccaa

SEQ ID NO: 606808 - DNA, 25 bp, Rattus norvegicus
tcgggaacgaccagccaaggcttgc

SEQ ID NO: 606809 - DNA, 25 bp, Rattus norvegicus
ccgttcgtaccttcggaatcgctgc

SEQ ID NO: 606810 - DNA, 25 bp, Rattus norvegicus
taccttcggaatcgctgcccagcgg

SEQ ID NO: 606811 - DNA, 25 bp, Rattus norvegicus
gccatctttaaacagcgctgcactg

SEQ ID NO: 606812 - DNA, 25 bp, Rattus norvegicus
ttaaacagcgctgcactggcgatcg

SEQ ID NO: 606813 - DNA, 25 bp, Rattus norvegicus
ctggcgatcgcttccgggttattaa

SEQ ID NO: 606814 - DNA, 25 bp, Rattus norvegicus
ctttcagcagctccggcaaaggcgg

SEQ ID NO: 606815 - DNA, 25 bp, Rattus norvegicus
ctcgccctctgggtgcatctctatt

SEQ ID NO: 606816 - DNA, 25 bp, Rattus norvegicus
tgcgctctgccctgactgacacttg

SEQ ID NO: 606817 - DNA, 25 bp, Rattus norvegicus
ttaccaagacactgccctacagggg

SEQ ID NO: 606818 - DNA, 25 bp, Rattus norvegicus
ctacaggggtgctgaacggattccc

SEQ ID NO: 606819 - DNA, 25 bp, Rattus norvegicus
ccagcaggaactccatctcggcggg

SEQ ID NO: 606820 - DNA, 25 bp, Rattus norvegicus
ggaactccatctcggcgggcctcgt

SEQ ID NO: 606821 - DNA, 25 bp, Rattus norvegicus
gtgcatctctattgggcagcgtcta

SEQ ID NO: 606822 - DNA, 25 bp, Rattus norvegicus
tctctattgggcagcgtctacccag

SEQ ID NO: 606823 - DNA, 25 bp, Rattus norvegicus
ttggacgacactccactctcagtga

SEQ ID NO: 606824 - DNA, 25 bp, Rattus norvegicus
gtccgattggtcacgaagcaagcta

SEQ ID NO: 606825 - DNA, 25 bp, Rattus norvegicus
agcaagctaagtcactggggtctcc

SEQ ID NO: 606826 - DNA, 25 bp, Rattus norvegicus
agctaagtcactggggtctccgtca

SEQ ID NO: 606827 - DNA, 25 bp, Rattus norvegicus
ggacgcctgtgtgccacgggtctcc

SEQ ID NO: 606828 - DNA, 25 bp, Rattus norvegicus
gggtctccgtcagccgtagcggcac

SEQ ID NO: 606829 - DNA, 25 bp, Rattus norvegicus
gaaatgacgtcaggacaagtccctg

SEQ ID NO: 606830 - DNA, 25 bp, Rattus norvegicus
tcccgcggcggcttcgagtggacct

SEQ ID NO: 606831 - DNA, 25 bp, Rattus norvegicus
gggccggtcaggctcctcagcagca

SEQ ID NO: 606832 - DNA, 25 bp, Rattus norvegicus
cgcggagtgaccaaggacaaggacc

SEQ ID NO: 606833 - DNA, 25 bp, Rattus norvegicus
ggacaaggaccagccgaagcccaag

SEQ ID NO: 606834 - DNA, 25 bp, Rattus norvegicus
agccgaagcccaaggtcaggaagtc

SEQ ID NO: 606835 - DNA, 25 bp, Rattus norvegicus
agcccaaggtcaggaagtcaagatg

SEQ ID NO: 606836 - DNA, 25 bp, Rattus norvegicus
tcaggaagtcaagatggccgcaata

SEQ ID NO: 606837 - DNA, 25 bp, Rattus norvegicus
atggccgcaatagccggaagttccg

SEQ ID NO: 606838 - DNA, 25 bp, Rattus norvegicus
agttccggcgctgaagttgatagac

SEQ ID NO: 606839 - DNA, 25 bp, Rattus norvegicus
gttgatagacgcctcagcccggaag

SEQ ID NO: 606840 - DNA, 25 bp, Rattus norvegicus
ttcggaaatgacgtcaggacaagtc

SEQ ID NO: 606841 - DNA, 25 bp, Rattus norvegicus
gagtggacctgagcccgcggcacca

SEQ ID NO: 606842 - DNA, 25 bp, Rattus norvegicus
cagcccggaagtatttcggaaatga

SEQ ID NO: 606843 - DNA, 25 bp, Rattus norvegicus
atggcaacgaccacgcggagcggaa

SEQ ID NO: 606844 - DNA, 25 bp, Rattus norvegicus
cggcaacggcggttcccgatcgaca

SEQ ID NO: 606845 - DNA, 25 bp, Rattus norvegicus
ttcccgatcgacagcgaagcggcgg

SEQ ID NO: 606846 - DNA, 25 bp, Rattus norvegicus
gcgcactacgcatgcgtctcgcaaa

SEQ ID NO: 606847 - DNA, 25 bp, Rattus norvegicus
cgcgccggcgcagaaccggacaaga

SEQ ID NO: 606848 - DNA, 25 bp, Rattus norvegicus
cgcgcggagggcctgagaacagaaa

SEQ ID NO: 606849 - DNA, 25 bp, Rattus norvegicus
agcgtcgcgctaggaatgacgcgca

SEQ ID NO: 606850 - DNA, 25 bp, Rattus norvegicus
cccttggagcctcttgggcggtagt

SEQ ID NO: 606851 - DNA, 25 bp, Rattus norvegicus
cgctaggaatgacgcgcacgcgccg

SEQ ID NO: 606852 - DNA, 25 bp, Rattus norvegicus
ccctcgacagttcgcgtctgtagct

SEQ ID NO: 606853 - DNA, 25 bp, Rattus norvegicus
cagttcgcgtctgtagctatggcaa

SEQ ID NO: 606854 - DNA, 25 bp, Rattus norvegicus
cgcgtctgtagctatggcaacgacc

SEQ ID NO: 606855 - DNA, 25 bp, Rattus norvegicus
cccttctagcacttgccggtaggga

SEQ ID NO: 606856 - DNA, 25 bp, Rattus norvegicus
gtagctatggcaacgaccacgcgga

SEQ ID NO: 606857 - DNA, 25 bp, Rattus norvegicus
ctctcatggtgagcccgatggccta

SEQ ID NO: 606858 - DNA, 25 bp, Rattus norvegicus
cgatggcctagggttaaaagcgcgc

SEQ ID NO: 606859 - DNA, 25 bp, Rattus norvegicus
aggagcactctcatggtgagcccga

SEQ ID NO: 606860 - DNA, 25 bp, Rattus norvegicus
tcgcagtgagcgttagggctgccct

SEQ ID NO: 606861 - DNA, 25 bp, Rattus norvegicus
ttcacaaacttttctgccgtcctcg

SEQ ID NO: 606862 - DNA, 25 bp, Rattus norvegicus
cgcccggtgcagctccgggtctccc

SEQ ID NO: 606863 - DNA, 25 bp, Rattus norvegicus
ccttgccggccaaacagcgagggca

SEQ ID NO: 606864 - DNA, 25 bp, Rattus norvegicus
tgcacggtagcccttgccggccaaa

SEQ ID NO: 606865 - DNA, 25 bp, Rattus norvegicus
atcctcagcacagccgaggggtgcg

SEQ ID NO: 606866 - DNA, 25 bp, Rattus norvegicus
gggaccggggcatcctcagcacagc

SEQ ID NO: 606867 - DNA, 25 bp, Rattus norvegicus
ccgtcctgccgctggggctccagcc

SEQ ID NO: 606868 - DNA, 25 bp, Rattus norvegicus
aactctgctccagcgccgcacgccg

SEQ ID NO: 606869 - DNA, 25 bp, Rattus norvegicus
ccgcctcccggcaactctgctccag

SEQ ID NO: 606870 - DNA, 25 bp, Rattus norvegicus
ctagggttaaaagcgcgctggtccg

SEQ ID NO: 606871 - DNA, 25 bp, Rattus norvegicus
caggctggccaatcacgtgaggaca

SEQ ID NO: 606872 - DNA, 25 bp, Rattus norvegicus
cgccgctcccttttatggaggctca

SEQ ID NO: 606873 - DNA, 25 bp, Rattus norvegicus
accggaagacctgaagcgctccttc

SEQ ID NO: 606874 - DNA, 25 bp, Rattus norvegicus
cgcccacagctttggagagccggta

SEQ ID NO: 606875 - DNA, 25 bp, Rattus norvegicus
gggctgctccgcatcttgcttctag

SEQ ID NO: 606876 - DNA, 25 bp, Rattus norvegicus
aggctcattgtcagcgtccgtcccg

SEQ ID NO: 606877 - DNA, 25 bp, Rattus norvegicus
gctcggcgacgaaacctagagtctc

SEQ ID NO: 606878 - DNA, 25 bp, Rattus norvegicus
tgtactgggaatccggcctctactc

SEQ ID NO: 606879 - DNA, 25 bp, Rattus norvegicus
agccacgggcttcaacgcgtcacga

SEQ ID NO: 606880 - DNA, 25 bp, Rattus norvegicus
gagcgtcacctcgaagcaatccagc

SEQ ID NO: 606881 - DNA, 25 bp, Rattus norvegicus
ggaccgggaactggagatctactcc

SEQ ID NO: 606882 - DNA, 25 bp, Rattus norvegicus
tccgagaggcctgggatttcaaacc

SEQ ID NO: 606883 - DNA, 25 bp, Rattus norvegicus
ctccttcggtgtggatggaagtctc

SEQ ID NO: 606884 - DNA, 25 bp, Rattus norvegicus
agccgcgcacaaaccactgtactgg

SEQ ID NO: 606885 - DNA, 25 bp, Rattus norvegicus
agctgcagctgtagacgcggcaggg

SEQ ID NO: 606886 - DNA, 25 bp, Rattus norvegicus
tcactctggccggatccggggaaac

SEQ ID NO: 606887 - DNA, 25 bp, Rattus norvegicus
gagctgccagcgctagctccaggct

SEQ ID NO: 606888 - DNA, 25 bp, Rattus norvegicus
agaagggagctgtaccgccgcacca

SEQ ID NO: 606889 - DNA, 25 bp, Rattus norvegicus
ccaggcggtcccctgatagcgggct

SEQ ID NO: 606890 - DNA, 25 bp, Rattus norvegicus
cggagagctgctctccgagatgccc

SEQ ID NO: 606891 - DNA, 25 bp, Rattus norvegicus
tgaagcgcgtcgcagaggaccggac

SEQ ID NO: 606892 - DNA, 25 bp, Rattus norvegicus
cgactctttacgagccggagctgca

SEQ ID NO: 606893 - DNA, 25 bp, Rattus norvegicus
aggcgcagcgtgctagctctcttac

SEQ ID NO: 606894 - DNA, 25 bp, Rattus norvegicus
gtatcaaccgcccgctgcggacttg

SEQ ID NO: 606895 - DNA, 25 bp, Rattus norvegicus
tgcggacttgctacctcccgccttc

SEQ ID NO: 606896 - DNA, 25 bp, Rattus norvegicus
agtcacctcggcgactctttacgag

SEQ ID NO: 606897 - DNA, 25 bp, Rattus norvegicus
gtgctagctctcttacactcctctg

SEQ ID NO: 606898 - DNA, 25 bp, Rattus norvegicus
cccggcttgcgctttcgtggccgcc

SEQ ID NO: 606899 - DNA, 25 bp, Rattus norvegicus
aaacaaagcgcagcctgcgtcctgc

SEQ ID NO: 606900 - DNA, 25 bp, Rattus norvegicus
acacgaaggtggatgccccctcctg

SEQ ID NO: 606901 - DNA, 25 bp, Rattus norvegicus
ggttcgcacacgaaggtggatgccc

SEQ ID NO: 606902 - DNA, 25 bp, Rattus norvegicus
agtaagggatgggttcgcacacgaa

SEQ ID NO: 606903 - DNA, 25 bp, Rattus norvegicus
ccacatcgggaaggtcttaagtaag

SEQ ID NO: 606904 - DNA, 25 bp, Rattus norvegicus
ctacgagaaacaaagcgcagcctgc

SEQ ID NO: 606905 - DNA, 25 bp, Rattus norvegicus
cggttacgctacgagaaacaaagcg

SEQ ID NO: 606906 - DNA, 25 bp, Rattus norvegicus
tgctggagacgggaactcttccctt

SEQ ID NO: 606907 - DNA, 25 bp, Rattus norvegicus
tggccttgctggagacgggaactct

SEQ ID NO: 606908 - DNA, 25 bp, Rattus norvegicus
tgccgtccctttctgcgtggccttg

SEQ ID NO: 606909 - DNA, 25 bp, Rattus norvegicus
gtatgccgtccctttctgcgtggcc

SEQ ID NO: 606910 - DNA, 25 bp, Rattus norvegicus
tcgggtatgccgtccctttctgcgt

SEQ ID NO: 606911 - DNA, 25 bp, Rattus norvegicus
ctgttctcgggtatgccgtcccttt

SEQ ID NO: 606912 - DNA, 25 bp, Rattus norvegicus
cttaagtaagggatgggttcgcaca

SEQ ID NO: 606913 - DNA, 25 bp, Rattus norvegicus
agcctgcacttggacgacatccgtg

SEQ ID NO: 606914 - DNA, 25 bp, Rattus norvegicus
ttcgagggggcccagtagcacctcg

SEQ ID NO: 606915 - DNA, 25 bp, Rattus norvegicus
ccagtagcacctcggcgccgacgcc

SEQ ID NO: 606916 - DNA, 25 bp, Rattus norvegicus
aacggaggctgaaggagtcactgca

SEQ ID NO: 606917 - DNA, 25 bp, Rattus norvegicus
ggctgaaggagtcactgcagaactg

SEQ ID NO: 606918 - DNA, 25 bp, Rattus norvegicus
aaggagtcactgcagaactggttcc

SEQ ID NO: 606919 - DNA, 25 bp, Rattus norvegicus
cactgcagaactggttccgggctga

SEQ ID NO: 606920 - DNA, 25 bp, Rattus norvegicus
tccgggctgagtgtctcatggacta

SEQ ID NO: 606921 - DNA, 25 bp, Rattus norvegicus
gctgagtgtctcatggactacgacc

SEQ ID NO: 606922 - DNA, 25 bp, Rattus norvegicus
gtctcatggactacgacccacgggg

SEQ ID NO: 606923 - DNA, 25 bp, Rattus norvegicus
gaatcggctggtgtgcatggcctgc

SEQ ID NO: 606924 - DNA, 25 bp, Rattus norvegicus
tgcccagcctgcacttggacgacat

SEQ ID NO: 606925 - DNA, 25 bp, Rattus norvegicus
cacttggacgacatccgtgctcacg

SEQ ID NO: 606926 - DNA, 25 bp, Rattus norvegicus
cctgcggccgggcactgcccagcct

SEQ ID NO: 606927 - DNA, 25 bp, Rattus norvegicus
ggacgtttatgcaaaccaaccgaga

SEQ ID NO: 606928 - DNA, 25 bp, Rattus norvegicus
ctccagcgcgccatagtcgtaaggc

SEQ ID NO: 606929 - DNA, 25 bp, Rattus norvegicus
ggctatgctccaccctcagactagg

SEQ ID NO: 606930 - DNA, 25 bp, Rattus norvegicus
cggacggcccagcttgtaacagagc

SEQ ID NO: 606931 - DNA, 25 bp, Rattus norvegicus
tccgcaaggacacagctaggcgctg

SEQ ID NO: 606932 - DNA, 25 bp, Rattus norvegicus
agaacacggccgttcgctagcagcc

SEQ ID NO: 606933 - DNA, 25 bp, Rattus norvegicus
cacaacattgctgaggcgcccacga

SEQ ID NO: 606934 - DNA, 25 bp, Rattus norvegicus
gagcctccagtacagggacctcgca

SEQ ID NO: 606935 - DNA, 25 bp, Rattus norvegicus
gtggtacttctcctcggtgacgttc

SEQ ID NO: 606936 - DNA, 25 bp, Rattus norvegicus
gttcagattgttcacgtaggtcgcg

SEQ ID NO: 606937 - DNA, 25 bp, Rattus norvegicus
atctgcgcgttaatgtgcggctcca

SEQ ID NO: 606938 - DNA, 25 bp, Rattus norvegicus
ttctgcccgcgctgaaagggacaga

SEQ ID NO: 606939 - DNA, 25 bp, Rattus norvegicus
acagacttccgtctggacacgggga

SEQ ID NO: 606940 - DNA, 25 bp, Rattus norvegicus
cttgctgtggtgcagctgcatgatc

SEQ ID NO: 606941 - DNA, 25 bp, Rattus norvegicus
ctgatgtcaggttctgggaccctta

SEQ ID NO: 606942 - DNA, 25 bp, Rattus norvegicus
ccattttggaggcttacgaggaggc

SEQ ID NO: 606943 - DNA, 25 bp, Rattus norvegicus
gtgtgtcgcgcgtagtagtcaccct

SEQ ID NO: 606944 - DNA, 25 bp, Rattus norvegicus
ccgcagcagtccttcggtgacactg

SEQ ID NO: 606945 - DNA, 25 bp, Rattus norvegicus
tagtacttggcctccagtgcgcagt

SEQ ID NO: 606946 - DNA, 25 bp, Rattus norvegicus
cagcgcttcgttgttacggccacga

SEQ ID NO: 606947 - DNA, 25 bp, Rattus norvegicus
aaggtgagcaccatcaagcgacaca

SEQ ID NO: 606948 - DNA, 25 bp, Rattus norvegicus
tacttgatggactacgacggcagcc

SEQ ID NO: 606949 - DNA, 25 bp, Rattus norvegicus
tttgttcttctctaggcgacgcgcc

SEQ ID NO: 606950 - DNA, 25 bp, Rattus norvegicus
tcgctccaaggcagccctttgttct

SEQ ID NO: 606951 - DNA, 25 bp, Rattus norvegicus
cagggactgggcttgattcttgcca

SEQ ID NO: 606952 - DNA, 25 bp, Rattus norvegicus
gtggagcgaaaaggccgcacacctg

SEQ ID NO: 606953 - DNA, 25 bp, Rattus norvegicus
ggtgcatcccttctccatggacttc

SEQ ID NO: 606954 - DNA, 25 bp, Rattus norvegicus
agcgacacattctgcaggtgcatcc

SEQ ID NO: 606955 - DNA, 25 bp, Rattus norvegicus
ggggtcagtgtcaacgcccactcta

SEQ ID NO: 606956 - DNA, 25 bp, Rattus norvegicus
atgcgcaggcgcaagaactgtccct

SEQ ID NO: 606957 - DNA, 25 bp, Rattus norvegicus
catgcgcataaagagcctaaggacg

SEQ ID NO: 606958 - DNA, 25 bp, Rattus norvegicus
actcagccgtgctccgcagggagaa

SEQ ID NO: 606959 - DNA, 25 bp, Rattus norvegicus
gactgactccgacagactgactgac

SEQ ID NO: 606960 - DNA, 25 bp, Rattus norvegicus
gtagcctgttcggaagactgactcc

SEQ ID NO: 606961 - DNA, 25 bp, Rattus norvegicus
ttctccgaagtagccggcgtagcct

SEQ ID NO: 606962 - DNA, 25 bp, Rattus norvegicus
atccagcagctagttctccgaagta

SEQ ID NO: 606963 - DNA, 25 bp, Rattus norvegicus
cgatgactccgccatggctgcacga

SEQ ID NO: 606964 - DNA, 25 bp, Rattus norvegicus
gaactcgatccattccgtgcaccta

SEQ ID NO: 606965 - DNA, 25 bp, Rattus norvegicus
tgttcctcaaatgcccgccaagagg

SEQ ID NO: 606966 - DNA, 25 bp, Rattus norvegicus
actgcggtgtcctctcttacagggg

SEQ ID NO: 606967 - DNA, 25 bp, Rattus norvegicus
gctcccgcaggaaaggacgcagtgt

SEQ ID NO: 606968 - DNA, 25 bp, Rattus norvegicus
ttcctagagacctagtcgctcgcgc

SEQ ID NO: 606969 - DNA, 25 bp, Rattus norvegicus
actgggaggccctgcttgcaggtct

SEQ ID NO: 606970 - DNA, 25 bp, Rattus norvegicus
tgggtggacccatacgtgaaaacag

SEQ ID NO: 606971 - DNA, 25 bp, Rattus norvegicus
tacaggaatagagcgaagagagtcc

SEQ ID NO: 606972 - DNA, 25 bp, Rattus norvegicus
caaacgcctcgctggttccgtacgg

SEQ ID NO: 606973 - DNA, 25 bp, Rattus norvegicus
gctggttccgtacggaaacctctca

SEQ ID NO: 606974 - DNA, 25 bp, Rattus norvegicus
gccatcttcgtcatgacacctacgg

SEQ ID NO: 606975 - DNA, 25 bp, Rattus norvegicus
cccgtcaatcagcatcacaagcgtg

SEQ ID NO: 606976 - DNA, 25 bp, Rattus norvegicus
tacaagtcccagagggccattcgcg

SEQ ID NO: 606977 - DNA, 25 bp, Rattus norvegicus
cgcgccaattggaagcagtagagtg

SEQ ID NO: 606978 - DNA, 25 bp, Rattus norvegicus
tcgccacatcatgcccaagggtttg

SEQ ID NO: 606979 - DNA, 25 bp, Rattus norvegicus
gcttgctctacagcggctccaagtt

SEQ ID NO: 606980 - DNA, 25 bp, Rattus norvegicus
gctccaagttccgtggccaccagaa

SEQ ID NO: 606981 - DNA, 25 bp, Rattus norvegicus
gccgcgctacgggaagaaaactaca

SEQ ID NO: 606982 - DNA, 25 bp, Rattus norvegicus
cacgtgctttctctgtctgccaatg

SEQ ID NO: 606983 - DNA, 25 bp, Rattus norvegicus
actacaattcccgatggacccgaga

SEQ ID NO: 606984 - DNA, 25 bp, Rattus norvegicus
ggaacgttctcagtctcagcccgga

SEQ ID NO: 606985 - DNA, 25 bp, Rattus norvegicus
cggtgtctcgcctccgaattcaggg

SEQ ID NO: 606986 - DNA, 25 bp, Rattus norvegicus
cccgtcgccatcatttttggtgtgg

SEQ ID NO: 606987 - DNA, 25 bp, Rattus norvegicus
cagtgctttggctctgaggtgacaa

SEQ ID NO: 606988 - DNA, 25 bp, Rattus norvegicus
gccctggtctacgttttaggcgctg

SEQ ID NO: 606989 - DNA, 25 bp, Rattus norvegicus
agcaggtgaggcgtccaaattttcc

SEQ ID NO: 606990 - DNA, 25 bp, Rattus norvegicus
cctcagcgaactgcagcggtggcat

SEQ ID NO: 606991 - DNA, 25 bp, Rattus norvegicus
acttctgctgaaggaggaggctcca

SEQ ID NO: 606992 - DNA, 25 bp, Rattus norvegicus
gctcctgtcttctgtgcctctgcta

SEQ ID NO: 606993 - DNA, 25 bp, Rattus norvegicus
gctgtctcataagctgtaggctctc

SEQ ID NO: 606994 - DNA, 25 bp, Rattus norvegicus
gcggtgcagcctcgttttattttaa

SEQ ID NO: 606995 - DNA, 25 bp, Rattus norvegicus
ttctccctttgcaaggcctaatggg

SEQ ID NO: 606996 - DNA, 25 bp, Rattus norvegicus
cccgagattccagtacgcagtcaca

SEQ ID NO: 606997 - DNA, 25 bp, Rattus norvegicus
ggcctggactctggggccattaagc

SEQ ID NO: 606998 - DNA, 25 bp, Rattus norvegicus
ggcgtaaacaagtcgggcataaaca

SEQ ID NO: 606999 - DNA, 25 bp, Rattus norvegicus
gactctggggccattaagccggccc

SEQ ID NO: 607000 - DNA, 25 bp, Rattus norvegicus
ctccacttgcctacttggggcgtga

SEQ ID NO: 607001 - DNA, 25 bp, Rattus norvegicus
cgggcataaacaagtcaggcgagta

SEQ ID NO: 607002 - DNA, 25 bp, Rattus norvegicus
ttctgggacctaaacaaaggtgaga

SEQ ID NO: 607003 - DNA, 25 bp, Rattus norvegicus
acaaaggtgagaagcccgggtgcct

SEQ ID NO: 607004 - DNA, 25 bp, Rattus norvegicus
cgagtagctgtcacccgcctggcat

SEQ ID NO: 607005 - DNA, 25 bp, Rattus norvegicus
tggcatccgccgtgcgcggaaaaaa

SEQ ID NO: 607006 - DNA, 25 bp, Rattus norvegicus
agcccagggatcttgtgagccgctt

SEQ ID NO: 607007 - DNA, 25 bp, Rattus norvegicus
gtgagccgcttctgccctacagcga

SEQ ID NO: 607008 - DNA, 25 bp, Rattus norvegicus
cctacagcgagggatttgtcgattc

SEQ ID NO: 607009 - DNA, 25 bp, Rattus norvegicus
agagcgattcggcaggcgtaaacaa

SEQ ID NO: 607010 - DNA, 25 bp, Rattus norvegicus
ttgtcgattcaagggcaagcgcagg

SEQ ID NO: 607011 - DNA, 25 bp, Rattus norvegicus
catacgcttactgaagaggtgcagc

SEQ ID NO: 607012 - DNA, 25 bp, Rattus norvegicus
accgcctgcctttctgctgagttgc

SEQ ID NO: 607013 - DNA, 25 bp, Rattus norvegicus
tgctgagttgctggcgcgccttcct

SEQ ID NO: 607014 - DNA, 25 bp, Rattus norvegicus
tgtccacgcatacgcttactgaaga

SEQ ID NO: 607015 - DNA, 25 bp, Rattus norvegicus
cgcgccctcattccgcgtgtcccgc

SEQ ID NO: 607016 - DNA, 25 bp, Rattus norvegicus
ctctcgccgccgtttgacgcgcgct

SEQ ID NO: 607017 - DNA, 25 bp, Rattus norvegicus
ccgcctcgctcacctcctattctag

SEQ ID NO: 607018 - DNA, 25 bp, Rattus norvegicus
cttgtcccggctggccacagcggga

SEQ ID NO: 607019 - DNA, 25 bp, Rattus norvegicus
ccacagcgggatgggcctgagccca

SEQ ID NO: 607020 - DNA, 25 bp, Rattus norvegicus
ggatccgccttttcagggtcccatg

SEQ ID NO: 607021 - DNA, 25 bp, Rattus norvegicus
ttttcagggtcccatggccatcacg

SEQ ID NO: 607022 - DNA, 25 bp, Rattus norvegicus
tcacgccccaagcagatctcgagga

SEQ ID NO: 607023 - DNA, 25 bp, Rattus norvegicus
tctgtcggcgccttgtcccggctgg

SEQ ID NO: 607024 - DNA, 25 bp, Rattus norvegicus
gcgccagtgtccacgcatacgctta

SEQ ID NO: 607025 - DNA, 25 bp, Rattus norvegicus
tttgccttccttcctcggccgtggc

SEQ ID NO: 607026 - DNA, 25 bp, Rattus norvegicus
acgccaaatcttgaacgcacccttg

SEQ ID NO: 607027 - DNA, 25 bp, Rattus norvegicus
aagggcgtggcgcttgtctaaggct

SEQ ID NO: 607028 - DNA, 25 bp, Rattus norvegicus
tccacccgcttgacatacatgggct

SEQ ID NO: 607029 - DNA, 25 bp, Rattus norvegicus
tccgcctccgctcaacttggccgcg

SEQ ID NO: 607030 - DNA, 25 bp, Rattus norvegicus
aatcttgaacgcacccttgcttccg

SEQ ID NO: 607031 - DNA, 25 bp, Rattus norvegicus
tgacgccaaatcttgaacgcaccct

SEQ ID NO: 607032 - DNA, 25 bp, Rattus norvegicus
ttcacctccagcagctttgccttcc

SEQ ID NO: 607033 - DNA, 25 bp, Rattus norvegicus
acagagaagggcgtggcgcttgtct

SEQ ID NO: 607034 - DNA, 25 bp, Rattus norvegicus
tacatgggctcatcgcagtcggatg

SEQ ID NO: 607035 - DNA, 25 bp, Rattus norvegicus
catacatgggctcatcgcagtcgga

SEQ ID NO: 607036 - DNA, 25 bp, Rattus norvegicus
gcttgacatacatgggctcatcgca

SEQ ID NO: 607037 - DNA, 25 bp, Rattus norvegicus
cccgcttgacatacatgggctcatc

SEQ ID NO: 607038 - DNA, 25 bp, Rattus norvegicus
ttgcttccgcctccgctcaacttgg

SEQ ID NO: 607039 - DNA, 25 bp, Rattus norvegicus
tgcttctccggttccagctcgttca

SEQ ID NO: 607040 - DNA, 25 bp, Rattus norvegicus
ttagcttccctaactgcttctgccg

SEQ ID NO: 607041 - DNA, 25 bp, Rattus norvegicus
gtcgcctagtttggagaggtgtccc

SEQ ID NO: 607042 - DNA, 25 bp, Rattus norvegicus
ctcgttcagctccacatctttcatg

SEQ ID NO: 607043 - DNA, 25 bp, Rattus norvegicus
ttcatgtccacttcggtgtcctggc

SEQ ID NO: 607044 - DNA, 25 bp, Rattus norvegicus
tcgtcttcggccaccttaatcttca

SEQ ID NO: 607045 - DNA, 25 bp, Rattus norvegicus
ccgtgaggctagttagcttagcttc

SEQ ID NO: 607046 - DNA, 25 bp, Rattus norvegicus
tgtcctggctcatggtacctgcaga

SEQ ID NO: 607047 - DNA, 25 bp, Rattus norvegicus
agctcctccttggataagcctgtga

SEQ ID NO: 607048 - DNA, 25 bp, Rattus norvegicus
ccgggctgccagctaccttcaatag

SEQ ID NO: 607049 - DNA, 25 bp, Rattus norvegicus
ccaaccgagccagaagagcagcagc

SEQ ID NO: 607050 - DNA, 25 bp, Rattus norvegicus
ttgtgccaccatctctgtaccggca

SEQ ID NO: 607051 - DNA, 25 bp, Rattus norvegicus
gtccgctgcattcataggctgcttc

SEQ ID NO: 607052 - DNA, 25 bp, Rattus norvegicus
cgtggcgcccgaacgatgataacca

SEQ ID NO: 607053 - DNA, 25 bp, Rattus norvegicus
gtgttcagtaggttcgggatccata

SEQ ID NO: 607054 - DNA, 25 bp, Rattus norvegicus
cccagactgtcgagatgtaacggtc

SEQ ID NO: 607055 - DNA, 25 bp, Rattus norvegicus
agctgcgctgacaacctggacatca

SEQ ID NO: 607056 - DNA, 25 bp, Rattus norvegicus
tcgggaagccaaacctccaacgatg

SEQ ID NO: 607057 - DNA, 25 bp, Rattus norvegicus
gatgacgtctcatccgcagtgggta

SEQ ID NO: 607058 - DNA, 25 bp, Rattus norvegicus
taggaaccgcctagtagcagccgcc

SEQ ID NO: 607059 - DNA, 25 bp, Rattus norvegicus
tgcgcctctttttccgcgctgcaaa

SEQ ID NO: 607060 - DNA, 25 bp, Rattus norvegicus
aataggcggcggaacactccacacg

SEQ ID NO: 607061 - DNA, 25 bp, Rattus norvegicus
tccacacgcgcctttgggcggaatc

SEQ ID NO: 607062 - DNA, 25 bp, Rattus norvegicus
gggcggaatcctctacccacaattc

SEQ ID NO: 607063 - DNA, 25 bp, Rattus norvegicus
gggcctctgcgacacgctatttata

SEQ ID NO: 607064 - DNA, 25 bp, Rattus norvegicus
tataggccacacgttgttcttttcg

SEQ ID NO: 607065 - DNA, 25 bp, Rattus norvegicus
tcacgtcaacgtgtggatatatttg

SEQ ID NO: 607066 - DNA, 25 bp, Rattus norvegicus
tcgacacgcgggcttagtgtgagta

SEQ ID NO: 607067 - DNA, 25 bp, Rattus norvegicus
gaagaggtagggtttcgctccagta

SEQ ID NO: 607068 - DNA, 25 bp, Rattus norvegicus
gcggcaacgacctgaggagagtagc

SEQ ID NO: 607069 - DNA, 25 bp, Rattus norvegicus
cagttctttggtccggcttccactg

SEQ ID NO: 607070 - DNA, 25 bp, Rattus norvegicus
ggctccagttctttggtccggcttc

SEQ ID NO: 607071 - DNA, 25 bp, Rattus norvegicus
gtgacgtggcggctccagttctttg

SEQ ID NO: 607072 - DNA, 25 bp, Rattus norvegicus
gcggctccgcgaagcgaatatcccg

SEQ ID NO: 607073 - DNA, 25 bp, Rattus norvegicus
ccaggggcaagtcctgctggcggct

SEQ ID NO: 607074 - DNA, 25 bp, Rattus norvegicus
ctcagttcggggcagcagcttgact

SEQ ID NO: 607075 - DNA, 25 bp, Rattus norvegicus
agtaggagtccagcctcggtcggtc

SEQ ID NO: 607076 - DNA, 25 bp, Rattus norvegicus
ctccagtaggagtccagcctcggtc

SEQ ID NO: 607077 - DNA, 25 bp, Rattus norvegicus
ttcgctccagtaggagtccagcctc

SEQ ID NO: 607078 - DNA, 25 bp, Rattus norvegicus
agggtttcgctccagtaggagtcca

SEQ ID NO: 607079 - DNA, 25 bp, Rattus norvegicus
taggcaacagaagaggtagggtttc

SEQ ID NO: 607080 - DNA, 25 bp, Rattus norvegicus
caacagaagaggtagggtttcgctc

SEQ ID NO: 607081 - DNA, 25 bp, Rattus norvegicus
ccctgctcctgagttcagggctaaa

SEQ ID NO: 607082 - DNA, 25 bp, Rattus norvegicus
tcatacaacggttagtgcggggcct

SEQ ID NO: 607083 - DNA, 25 bp, Rattus norvegicus
catggcggacgaagggaagtcatac

SEQ ID NO: 607084 - DNA, 25 bp, Rattus norvegicus
tgtacctgcctgtgccatggcggac

SEQ ID NO: 607085 - DNA, 25 bp, Rattus norvegicus
agagcttctgtcctgagcgccaagg

SEQ ID NO: 607086 - DNA, 25 bp, Rattus norvegicus
cgcgacgtgcttcgccggataaatg

SEQ ID NO: 607087 - DNA, 25 bp, Rattus norvegicus
ttcttctgtgtagctctcgtccctg

SEQ ID NO: 607088 - DNA, 25 bp, Rattus norvegicus
gaggccaggtctccattcttctgtg

SEQ ID NO: 607089 - DNA, 25 bp, Rattus norvegicus
gtgatccgttactcccgttcagagg

SEQ ID NO: 607090 - DNA, 25 bp, Rattus norvegicus
ccacctgcgtggactgtgatccgtt

SEQ ID NO: 607091 - DNA, 25 bp, Rattus norvegicus
ctgcgacttacacgctgccgggatc

SEQ ID NO: 607092 - DNA, 25 bp, Rattus norvegicus
gtcataatccgtcgtagaggcgaga

SEQ ID NO: 607093 - DNA, 25 bp, Rattus norvegicus
tcagggctaaagcagaccgctcagc

SEQ ID NO: 607094 - DNA, 25 bp, Rattus norvegicus
aaggcggggccgacctacaagccat

SEQ ID NO: 607095 - DNA, 25 bp, Rattus norvegicus
accattgtggcgaagacgcggtcca

SEQ ID NO: 607096 - DNA, 25 bp, Rattus norvegicus
tgtgtggatcaggtgtccaatgcgc

SEQ ID NO: 607097 - DNA, 25 bp, Rattus norvegicus
caagtcgcggtttttcactggtgcc

SEQ ID NO: 607098 - DNA, 25 bp, Rattus norvegicus
gggcgttcttccagaaaatcaagtc

SEQ ID NO: 607099 - DNA, 25 bp, Rattus norvegicus
tggttcaacgctttctctgcctcca

SEQ ID NO: 607100 - DNA, 25 bp, Rattus norvegicus
acagctggttcaacgctttctctgc

SEQ ID NO: 607101 - DNA, 25 bp, Rattus norvegicus
gtgccttcggccaacacagctggtt

SEQ ID NO: 607102 - DNA, 25 bp, Rattus norvegicus
tgccttttgccttttcgtgccttcg

SEQ ID NO: 607103 - DNA, 25 bp, Rattus norvegicus
gatgctcaccgctgccttttgcctt

SEQ ID NO: 607104 - DNA, 25 bp, Rattus norvegicus
ttcccagcgggaaccacacagatgc

SEQ ID NO: 607105 - DNA, 25 bp, Rattus norvegicus
cgcggtttttcactggtgcccgaag

SEQ ID NO: 607106 - DNA, 25 bp, Rattus norvegicus
caggtgtccaatgcgcggcgcgtta

SEQ ID NO: 607107 - DNA, 25 bp, Rattus norvegicus
agcgggaaccacacagatgctcacc

SEQ ID NO: 607108 - DNA, 25 bp, Rattus norvegicus
cttccagaaaatcaagtcgcggttt

SEQ ID NO: 607109 - DNA, 25 bp, Rattus norvegicus
ggctgactggccatgcctgtccttt

SEQ ID NO: 607110 - DNA, 25 bp, Rattus norvegicus
aatcacgcgctcgtcggctcggatt

SEQ ID NO: 607111 - DNA, 25 bp, Rattus norvegicus
ggtttcctccctcagcgccattttg

SEQ ID NO: 607112 - DNA, 25 bp, Rattus norvegicus
tttgtggctgcgagacccgcaaata

SEQ ID NO: 607113 - DNA, 25 bp, Rattus norvegicus
aaataaaggctatctccggggctgc

SEQ ID NO: 607114 - DNA, 25 bp, Rattus norvegicus
gcgaaacgcactccaggcccgaagg

SEQ ID NO: 607115 - DNA, 25 bp, Rattus norvegicus
tttgctgctcgtggggatacttgca

SEQ ID NO: 607116 - DNA, 25 bp, Rattus norvegicus
cttgcaccgtttcacagccattctg

SEQ ID NO: 607117 - DNA, 25 bp, Rattus norvegicus
tcccgttcctgacggcaggggacaa

SEQ ID NO: 607118 - DNA, 25 bp, Rattus norvegicus
cgcttaggcgtgaagctgctgtctc

SEQ ID NO: 607119 - DNA, 25 bp, Rattus norvegicus
agcatcctgtgctatgcggcctgca

SEQ ID NO: 607120 - DNA, 25 bp, Rattus norvegicus
tggcttcccgttagtcagagcggtt

SEQ ID NO: 607121 - DNA, 25 bp, Rattus norvegicus
caaacttaggacgaggggcgcttag

SEQ ID NO: 607122 - DNA, 25 bp, Rattus norvegicus
ggcctgcagcgaagagccaatcacg

SEQ ID NO: 607123 - DNA, 25 bp, Rattus norvegicus
tggcacaacgctgctgcgcgaagta

SEQ ID NO: 607124 - DNA, 25 bp, Rattus norvegicus
tcggagatcgagaaggagatcgctc

SEQ ID NO: 607125 - DNA, 25 bp, Rattus norvegicus
ctatggggatcttggagaaaatttc

SEQ ID NO: 607126 - DNA, 25 bp, Rattus norvegicus
atctccgccgaagctgcaactatgg

SEQ ID NO: 607127 - DNA, 25 bp, Rattus norvegicus
atctataggcagtgtgaatctccgc

SEQ ID NO: 607128 - DNA, 25 bp, Rattus norvegicus
gagttccctgcgctgtaatctatag

SEQ ID NO: 607129 - DNA, 25 bp, Rattus norvegicus
cggcatcagacctgagttccctgcg

SEQ ID NO: 607130 - DNA, 25 bp, Rattus norvegicus
tgcgcttcctggttctggctgcttt

SEQ ID NO: 607131 - DNA, 25 bp, Rattus norvegicus
gactctgttcttggtgcgcttcctg

SEQ ID NO: 607132 - DNA, 25 bp, Rattus norvegicus
tccggactcggaatctcgtagcacc

SEQ ID NO: 607133 - DNA, 25 bp, Rattus norvegicus
ctctccacgtggtgtgtccggactc

SEQ ID NO: 607134 - DNA, 25 bp, Rattus norvegicus
accgatggtatctgctctccacgtg

SEQ ID NO: 607135 - DNA, 25 bp, Rattus norvegicus
ctgcgcgaagtaggaaccgatggta

SEQ ID NO: 607136 - DNA, 25 bp, Rattus norvegicus
tgagggaacaactggaaccgcctcc

SEQ ID NO: 607137 - DNA, 25 bp, Rattus norvegicus
ccatccttggactgttttgtgcggg

SEQ ID NO: 607138 - DNA, 25 bp, Rattus norvegicus
cgactctgctgccacggtcggttag

SEQ ID NO: 607139 - DNA, 25 bp, Rattus norvegicus
ctctgattcgagtacccgcggaggc

SEQ ID NO: 607140 - DNA, 25 bp, Rattus norvegicus
agccttgcccaaacctctgattcga

SEQ ID NO: 607141 - DNA, 25 bp, Rattus norvegicus
cgggtcagagcatcttctggacttc

SEQ ID NO: 607142 - DNA, 25 bp, Rattus norvegicus
gtagccgcttctttgccatccttgg

SEQ ID NO: 607143 - DNA, 25 bp, Rattus norvegicus
tttcgagcacgaacgtagccgcttc

SEQ ID NO: 607144 - DNA, 25 bp, Rattus norvegicus
tcccacgggatgtgctgcttttcga

SEQ ID NO: 607145 - DNA, 25 bp, Rattus norvegicus
ggtctttgcaaagcggagtcccacg

SEQ ID NO: 607146 - DNA, 25 bp, Rattus norvegicus
tccggaaatgtgcaccggtctttgc

SEQ ID NO: 607147 - DNA, 25 bp, Rattus norvegicus
cagcttttgtctatgctgcggtccg

SEQ ID NO: 607148 - DNA, 25 bp, Rattus norvegicus
cggtcggttagccagcttttgtcta

SEQ ID NO: 607149 - DNA, 25 bp, Rattus norvegicus
ccggagacggaagtgctccgccatg

SEQ ID NO: 607150 - DNA, 25 bp, Rattus norvegicus
ctggacttccctggctgttgcagcc

SEQ ID NO: 607151 - DNA, 25 bp, Rattus norvegicus
tacggccgatcatgggcaacttctg

SEQ ID NO: 607152 - DNA, 25 bp, Rattus norvegicus
tacgcaagcctgctagaccctaagg

SEQ ID NO: 607153 - DNA, 25 bp, Rattus norvegicus
cgggtttattctcggaggcttagca

SEQ ID NO: 607154 - DNA, 25 bp, Rattus norvegicus
acagcgaatagtctgagagcgccca

SEQ ID NO: 607155 - DNA, 25 bp, Rattus norvegicus
gcaacttctgcacgtagcgggacgc

SEQ ID NO: 607156 - DNA, 25 bp, Rattus norvegicus
cccatacggtgcagggaaagcagtt

SEQ ID NO: 607157 - DNA, 25 bp, Rattus norvegicus
aagcagtttgaaagaggcgcccgcg

SEQ ID NO: 607158 - DNA, 25 bp, Rattus norvegicus
ctcttctggaagacgtctcgcgttc

SEQ ID NO: 607159 - DNA, 25 bp, Rattus norvegicus
ggttccaccgcatgggctttcgtca

SEQ ID NO: 607160 - DNA, 25 bp, Rattus norvegicus
cgctggcagtcagctgcggcatttt

SEQ ID NO: 607161 - DNA, 25 bp, Rattus norvegicus
ttccgcactgaatccggggtagttg

SEQ ID NO: 607162 - DNA, 25 bp, Rattus norvegicus
cggatgtagacaatgcggccagccc

SEQ ID NO: 607163 - DNA, 25 bp, Rattus norvegicus
cggcctgacgccctgcgattataaa

SEQ ID NO: 607164 - DNA, 25 bp, Rattus norvegicus
ctcatagcggcaggtacagcgaata

SEQ ID NO: 607165 - DNA, 25 bp, Rattus norvegicus
ctccatacgcggagccaatcggcgg

SEQ ID NO: 607166 - DNA, 25 bp, Rattus norvegicus
tcaggggttacggaacttgtgtcac

SEQ ID NO: 607167 - DNA, 25 bp, Rattus norvegicus
acttgtgtcacgtgctcgatgaggg

SEQ ID NO: 607168 - DNA, 25 bp, Rattus norvegicus
ccgaggctggtgagcagcccaccgt

SEQ ID NO: 607169 - DNA, 25 bp, Rattus norvegicus
agcccaccgtgagaagcaatccctg

SEQ ID NO: 607170 - DNA, 25 bp, Rattus norvegicus
agaagcaatccctgggtccgggctg

SEQ ID NO: 607171 - DNA, 25 bp, Rattus norvegicus
gggtccgggctggactcgctcacct

SEQ ID NO: 607172 - DNA, 25 bp, Rattus norvegicus
tcacctccggactccggcgtcggga

SEQ ID NO: 607173 - DNA, 25 bp, Rattus norvegicus
gggaggagaaggttgcttccactca

SEQ ID NO: 607174 - DNA, 25 bp, Rattus norvegicus
ccggctcacggtaattccctctctc

SEQ ID NO: 607175 - DNA, 25 bp, Rattus norvegicus
caatcggcggccgtctactgagttc

SEQ ID NO: 607176 - DNA, 25 bp, Rattus norvegicus
ggcggccgtctactgagttctccgc

SEQ ID NO: 607177 - DNA, 25 bp, Rattus norvegicus
gagttctccgcccaccaaagaggcg

SEQ ID NO: 607178 - DNA, 25 bp, Rattus norvegicus
aaggttgcttccactcaccggctca

SEQ ID NO: 607179 - DNA, 25 bp, Rattus norvegicus
tgattggcccggatctctaagagga

SEQ ID NO: 607180 - DNA, 25 bp, Rattus norvegicus
tcctcgctgtcttgttttgggctca

SEQ ID NO: 607181 - DNA, 25 bp, Rattus norvegicus
cacgcttccgtgctacgaggcactt

SEQ ID NO: 607182 - DNA, 25 bp, Rattus norvegicus
cggttatgtcgccttcgctgattgg

SEQ ID NO: 607183 - DNA, 25 bp, Rattus norvegicus
acccggcagtggagtactgaatgtc

SEQ ID NO: 607184 - DNA, 25 bp, Rattus norvegicus
ctgaatgtctcggaagctgctcctc

SEQ ID NO: 607185 - DNA, 25 bp, Rattus norvegicus
gaaaacagcgcggtctctgcctctg

SEQ ID NO: 607186 - DNA, 25 bp, Rattus norvegicus
ttcgcgcggcctcaaaatggatctg

SEQ ID NO: 607187 - DNA, 25 bp, Rattus norvegicus
cttcaggaggcactggatgctgaga

SEQ ID NO: 607188 - DNA, 25 bp, Rattus norvegicus
ggagccaccacctgctcaggctttg

SEQ ID NO: 607189 - DNA, 25 bp, Rattus norvegicus
ggccgagcccgaagcttccgacata

SEQ ID NO: 607190 - DNA, 25 bp, Rattus norvegicus
gtggcgaagagcatgacaacggcaa

SEQ ID NO: 607191 - DNA, 25 bp, Rattus norvegicus
ccgtagaggaacaaggtgaggaact

SEQ ID NO: 607192 - DNA, 25 bp, Rattus norvegicus
agtgaaggaactctgtcgtcctcgg

SEQ ID NO: 607193 - DNA, 25 bp, Rattus norvegicus
ggggtgtttccttcacagcgctttc

SEQ ID NO: 607194 - DNA, 25 bp, Rattus norvegicus
atttcggatagcaattgtgccgggc

SEQ ID NO: 607195 - DNA, 25 bp, Rattus norvegicus
tacatttctgctccggggtgagtgg

SEQ ID NO: 607196 - DNA, 25 bp, Rattus norvegicus
cactgagtgcttcgtgtgccgccgg

SEQ ID NO: 607197 - DNA, 25 bp, Rattus norvegicus
agtgcttcgtgtgccgccggctgtt

SEQ ID NO: 607198 - DNA, 25 bp, Rattus norvegicus
cgccggctgtttcccgcccattcgc

SEQ ID NO: 607199 - DNA, 25 bp, Rattus norvegicus
ggtgcttccgtttctgcttggcctt

SEQ ID NO: 607200 - DNA, 25 bp, Rattus norvegicus
ccttcctttgatcttctttcgtcgg

SEQ ID NO: 607201 - DNA, 25 bp, Rattus norvegicus
cctgtcgttgttgcctcgcgtttat

SEQ ID NO: 607202 - DNA, 25 bp, Rattus norvegicus
tcgttgttgcctcgcgtttattagg

SEQ ID NO: 607203 - DNA, 25 bp, Rattus norvegicus
gtttccttcacagcgctttcgaggc

SEQ ID NO: 607204 - DNA, 25 bp, Rattus norvegicus
tgcctcgcgtttattaggggtagcc

SEQ ID NO: 607205 - DNA, 25 bp, Rattus norvegicus
gacatacatttctgctccggggtga

SEQ ID NO: 607206 - DNA, 25 bp, Rattus norvegicus
ttcgtgtagacatacatttctgctc

SEQ ID NO: 607207 - DNA, 25 bp, Rattus norvegicus
gcgtgcctccatgcgggtacaaaca

SEQ ID NO: 607208 - DNA, 25 bp, Rattus norvegicus
ggatcgttccatattgggaccgctg

SEQ ID NO: 607209 - DNA, 25 bp, Rattus norvegicus
ggtacaaacaggcagccgccatctt

SEQ ID NO: 607210 - DNA, 25 bp, Rattus norvegicus
catcttggacattggctgcaggcgc

SEQ ID NO: 607211 - DNA, 25 bp, Rattus norvegicus
gctgctgtccctgggcccacggaaa

SEQ ID NO: 607212 - DNA, 25 bp, Rattus norvegicus
ctactggcccttgccgctttcattg

SEQ ID NO: 607213 - DNA, 25 bp, Rattus norvegicus
gccgctttcattgcacgctcgtttg

SEQ ID NO: 607214 - DNA, 25 bp, Rattus norvegicus
gctcgtttgaatgctccgccgcttt

SEQ ID NO: 607215 - DNA, 25 bp, Rattus norvegicus
ccgccgcttttgagcgctcatttta

SEQ ID NO: 607216 - DNA, 25 bp, Rattus norvegicus
ctcgggcgccttatactccgtgatc

SEQ ID NO: 607217 - DNA, 25 bp, Rattus norvegicus
tccgtgatctccaatccttacgatg

SEQ ID NO: 607218 - DNA, 25 bp, Rattus norvegicus
atccttacgatgtctaaccggctcg

SEQ ID NO: 607219 - DNA, 25 bp, Rattus norvegicus
aacagtgccgtgcacccttagcgcg

SEQ ID NO: 607220 - DNA, 25 bp, Rattus norvegicus
gctggggaccgccattttaagaaca

SEQ ID NO: 607221 - DNA, 25 bp, Rattus norvegicus
aaacagacagggcacttccgcttcc

SEQ ID NO: 607222 - DNA, 25 bp, Rattus norvegicus
ggaacctcccctctagcctgtggtg

SEQ ID NO: 607223 - DNA, 25 bp, Rattus norvegicus
atcgagatgggctttcccaggggac

SEQ ID NO: 607224 - DNA, 25 bp, Rattus norvegicus
agagcctcatcgagatgggctttcc

SEQ ID NO: 607225 - DNA, 25 bp, Rattus norvegicus
gccttccttcttctcaccgcaggtc

SEQ ID NO: 607226 - DNA, 25 bp, Rattus norvegicus
gtccactctcctcactcagtgtcta

SEQ ID NO: 607227 - DNA, 25 bp, Rattus norvegicus
tgacacaaacagacagggcacttcc

SEQ ID NO: 607228 - DNA, 25 bp, Rattus norvegicus
tccacgtgacacaaacagacagggc

SEQ ID NO: 607229 - DNA, 25 bp, Rattus norvegicus
cctgtctccacgtgacacaaacaga

SEQ ID NO: 607230 - DNA, 25 bp, Rattus norvegicus
tcggcacccgtccaccctgtctcca

SEQ ID NO: 607231 - DNA, 25 bp, Rattus norvegicus
gatctttcgggctctcgtcggcacc

SEQ ID NO: 607232 - DNA, 25 bp, Rattus norvegicus
aggaaggatctttcgggctctcgtc

SEQ ID NO: 607233 - DNA, 25 bp, Rattus norvegicus
ccgcccaccaggaaggatctttcgg

SEQ ID NO: 607234 - DNA, 25 bp, Rattus norvegicus
gggctgacccttgccgccttccttc

SEQ ID NO: 607235 - DNA, 25 bp, Rattus norvegicus
agcctcggagtgtagcaatggcacc

SEQ ID NO: 607236 - DNA, 25 bp, Rattus norvegicus
tccgggaggaaagatcaatcgtcct

SEQ ID NO: 607237 - DNA, 25 bp, Rattus norvegicus
tccggcgtctgaggatagaacctgc

SEQ ID NO: 607238 - DNA, 25 bp, Rattus norvegicus
ggagaccgcaagcaccgaagacata

SEQ ID NO: 607239 - DNA, 25 bp, Rattus norvegicus
gaggatcttcaaagtcaggcccaga

SEQ ID NO: 607240 - DNA, 25 bp, Rattus norvegicus
ccacttacgtgaaggccaccctttg

SEQ ID NO: 607241 - DNA, 25 bp, Rattus norvegicus
ttctctccggaaacaggatcagttg

SEQ ID NO: 607242 - DNA, 25 bp, Rattus norvegicus
gtgcccgcctccaaactgtgattgg

SEQ ID NO: 607243 - DNA, 25 bp, Rattus norvegicus
gggcgtgcaccactttacgtttatg

SEQ ID NO: 607244 - DNA, 25 bp, Rattus norvegicus
gaagttgttcaagcgccgcagggta

SEQ ID NO: 607245 - DNA, 25 bp, Rattus norvegicus
tactaagcagggatcggcgacggaa

SEQ ID NO: 607246 - DNA, 25 bp, Rattus norvegicus
gctgtgatagacgaagggctgacta

SEQ ID NO: 607247 - DNA, 25 bp, Rattus norvegicus
gggctgactacgaaacaccacctca

SEQ ID NO: 607248 - DNA, 25 bp, Rattus norvegicus
agagcgcgcggaacaaccttatata

SEQ ID NO: 607249 - DNA, 25 bp, Rattus norvegicus
cgatgcgacgcggaaccaaagtact

SEQ ID NO: 607250 - DNA, 25 bp, Rattus norvegicus
ctcagagattctggtcgcgtcttcc

SEQ ID NO: 607251 - DNA, 25 bp, Rattus norvegicus
acccgcgtcagggttctcagagatt

SEQ ID NO: 607252 - DNA, 25 bp, Rattus norvegicus
ggatcttaccttgagaacccgcgtc

SEQ ID NO: 607253 - DNA, 25 bp, Rattus norvegicus
cttctccacagaaagccggatctta

SEQ ID NO: 607254 - DNA, 25 bp, Rattus norvegicus
ggatgtccgcgttgtgcgaccctcc

SEQ ID NO: 607255 - DNA, 25 bp, Rattus norvegicus
gtcgcgtttccagtcagcgcgcatg

SEQ ID NO: 607256 - DNA, 25 bp, Rattus norvegicus
gggtcgctgatttctgtcgcgtttc

SEQ ID NO: 607257 - DNA, 25 bp, Rattus norvegicus
gctccagacttagccggactgattt

SEQ ID NO: 607258 - DNA, 25 bp, Rattus norvegicus
cgcgtcttcccggaactcagggatc

SEQ ID NO: 607259 - DNA, 25 bp, Rattus norvegicus
gaaccaaagtactaaggctccagac

SEQ ID NO: 607260 - DNA, 25 bp, Rattus norvegicus
actgattttcttgagaggcggggtc

SEQ ID NO: 607261 - DNA, 25 bp, Rattus norvegicus
gagagcaagcctgttacacccactg

SEQ ID NO: 607262 - DNA, 25 bp, Rattus norvegicus
tacacccactgtgaccgatgcgacg

SEQ ID NO: 607263 - DNA, 25 bp, Rattus norvegicus
accatcgggaaggtgacgactacta

SEQ ID NO: 607264 - DNA, 25 bp, Rattus norvegicus
ctggccaccttacgacgactacggg

SEQ ID NO: 607265 - DNA, 25 bp, Rattus norvegicus
gacctgggcgaatattacgactacc

SEQ ID NO: 607266 - DNA, 25 bp, Rattus norvegicus
aaagtcattgtacgggctcgagggc

SEQ ID NO: 607267 - DNA, 25 bp, Rattus norvegicus
ggcatgcaggctcccgaaagtcatt

SEQ ID NO: 607268 - DNA, 25 bp, Rattus norvegicus
ttcctgccctttgaagacgaggccc

SEQ ID NO: 607269 - DNA, 25 bp, Rattus norvegicus
catggaggcagactccgcaggttcc

SEQ ID NO: 607270 - DNA, 25 bp, Rattus norvegicus
agtgggctcccgtaagctgcccttc

SEQ ID NO: 607271 - DNA, 25 bp, Rattus norvegicus
ttggctgaccaagaagttcctcctc

SEQ ID NO: 607272 - DNA, 25 bp, Rattus norvegicus
gcaaggcgtccacagctatcaattg

SEQ ID NO: 607273 - DNA, 25 bp, Rattus norvegicus
aggcctcgtgcccagtcacttagca

SEQ ID NO: 607274 - DNA, 25 bp, Rattus norvegicus
agaagccctcgttcatggtcatccg

SEQ ID NO: 607275 - DNA, 25 bp, Rattus norvegicus
ctacgaggagcaggagccctatttg

SEQ ID NO: 607276 - DNA, 25 bp, Rattus norvegicus
agcagtcgctatatcactacgagga

SEQ ID NO: 607277 - DNA, 25 bp, Rattus norvegicus
tgtcccacagggtcacatcggcctg

SEQ ID NO: 607278 - DNA, 25 bp, Rattus norvegicus
agaagttttacctcagtcgcagaga

SEQ ID NO: 607279 - DNA, 25 bp, Rattus norvegicus
agcagacctcggagctacaggatga

SEQ ID NO: 607280 - DNA, 25 bp, Rattus norvegicus
gaccgccataggtgagtgtcccaca

SEQ ID NO: 607281 - DNA, 25 bp, Rattus norvegicus
tacaggatgaatgcaggctcggacc

SEQ ID NO: 607282 - DNA, 25 bp, Rattus norvegicus
tcgtcatcatctcagcggcgcggac

SEQ ID NO: 607283 - DNA, 25 bp, Rattus norvegicus
attgtcctggaagtcgccatcgccg

SEQ ID NO: 607284 - DNA, 25 bp, Rattus norvegicus
gccttggccttagcattgtcctgga

SEQ ID NO: 607285 - DNA, 25 bp, Rattus norvegicus
ccgctcagcggtgcaccattgatca

SEQ ID NO: 607286 - DNA, 25 bp, Rattus norvegicus
cgctctctctcctgatcgctgattg

SEQ ID NO: 607287 - DNA, 25 bp, Rattus norvegicus
ctcacctattggctggcgttgggac

SEQ ID NO: 607288 - DNA, 25 bp, Rattus norvegicus
tgcgattggttcctcccagtagagc

SEQ ID NO: 607289 - DNA, 25 bp, Rattus norvegicus
cctgtcaggctggaagaagttttac

SEQ ID NO: 607290 - DNA, 25 bp, Rattus norvegicus
cccgcctcttgtgctgcgattggtt

SEQ ID NO: 607291 - DNA, 25 bp, Rattus norvegicus
cccatattgcttctttctgtatgcc

SEQ ID NO: 607292 - DNA, 25 bp, Rattus norvegicus
cccactcataatttagaatgcgtta

SEQ ID NO: 607293 - DNA, 25 bp, Rattus norvegicus
tagaatgcgttagaccaatggaatg

SEQ ID NO: 607294 - DNA, 25 bp, Rattus norvegicus
accaatggaatggacgtccggccgc

SEQ ID NO: 607295 - DNA, 25 bp, Rattus norvegicus
ccgcgctctggacgagccaatcgga

SEQ ID NO: 607296 - DNA, 25 bp, Rattus norvegicus
tctggacgagccaatcggaaggccg

SEQ ID NO: 607297 - DNA, 25 bp, Rattus norvegicus
gcgggcaataggatacgtggctcaa

SEQ ID NO: 607298 - DNA, 25 bp, Rattus norvegicus
taggatacgtggctcaacgtgcgca

SEQ ID NO: 607299 - DNA, 25 bp, Rattus norvegicus
gtcaaggagcaaacccggtacaaga

SEQ ID NO: 607300 - DNA, 25 bp, Rattus norvegicus
ggagcaaacccggtacaagatggcg

SEQ ID NO: 607301 - DNA, 25 bp, Rattus norvegicus
ccgagtcccatattgcttctttctg

SEQ ID NO: 607302 - DNA, 25 bp, Rattus norvegicus
atcaccctgctactcctggcctcgc

SEQ ID NO: 607303 - DNA, 25 bp, Rattus norvegicus
gaggtagaggcgtcaagccacgccc

SEQ ID NO: 607304 - DNA, 25 bp, Rattus norvegicus
ctggcctcgcaacgggctctttgtc

SEQ ID NO: 607305 - DNA, 25 bp, Rattus norvegicus
aagctgaagctgaaaaacgtgtttc

SEQ ID NO: 607306 - DNA, 25 bp, Rattus norvegicus
tgacagctgcttcccgcttggccct

SEQ ID NO: 607307 - DNA, 25 bp, Rattus norvegicus
tccgtagtctgcaactccgcgaatg

SEQ ID NO: 607308 - DNA, 25 bp, Rattus norvegicus
tgcaactccgcgaatgccgaccaag

SEQ ID NO: 607309 - DNA, 25 bp, Rattus norvegicus
gcgaatgccgaccaagccccaaatg

SEQ ID NO: 607310 - DNA, 25 bp, Rattus norvegicus
tagaactctccgtagtctgcaactc

SEQ ID NO: 607311 - DNA, 25 bp, Rattus norvegicus
ccacgtttagaactctccgtagtct

SEQ ID NO: 607312 - DNA, 25 bp, Rattus norvegicus
gggatgagaccctctgacagctgct

SEQ ID NO: 607313 - DNA, 25 bp, Rattus norvegicus
gcgctggggatgagaccctctgaca

SEQ ID NO: 607314 - DNA, 25 bp, Rattus norvegicus
cctcctctacgctctggtgcagctc

SEQ ID NO: 607315 - DNA, 25 bp, Rattus norvegicus
acttcctggtgtcgatcgccggcct

SEQ ID NO: 607316 - DNA, 25 bp, Rattus norvegicus
aacgtgtttcttgcctacttcctgg

SEQ ID NO: 607317 - DNA, 25 bp, Rattus norvegicus
ggcacggccatgaagctgaagctga

SEQ ID NO: 607318 - DNA, 25 bp, Rattus norvegicus
tgcctacttcctggtgtcgatcgcc

SEQ ID NO: 607319 - DNA, 25 bp, Rattus norvegicus
ctggattccctgagtgccagcccga

SEQ ID NO: 607320 - DNA, 25 bp, Rattus norvegicus
ccgcgcctgtttgtgctgcggcgca

SEQ ID NO: 607321 - DNA, 25 bp, Rattus norvegicus
tctagtggcgtgcacgcgtgctcct

SEQ ID NO: 607322 - DNA, 25 bp, Rattus norvegicus
accactgtctagtggcgtgcacgcg

SEQ ID NO: 607323 - DNA, 25 bp, Rattus norvegicus
ctggaccactgtctagtggcgtgca

SEQ ID NO: 607324 - DNA, 25 bp, Rattus norvegicus
gattccctgagtgccagcccgacgg

SEQ ID NO: 607325 - DNA, 25 bp, Rattus norvegicus
ccgacgccgctgctcggagcaacgc

SEQ ID NO: 607326 - DNA, 25 bp, Rattus norvegicus
ggcttagacgcctccgacgccgctg

SEQ ID NO: 607327 - DNA, 25 bp, Rattus norvegicus
gaggggtggcactgctcctctccgc

SEQ ID NO: 607328 - DNA, 25 bp, Rattus norvegicus
agtaagaggcccagctccacagcgc

SEQ ID NO: 607329 - DNA, 25 bp, Rattus norvegicus
agtggctctggacggccccgtcact

SEQ ID NO: 607330 - DNA, 25 bp, Rattus norvegicus
ccctcccgcgcttgctggcgactcc

SEQ ID NO: 607331 - DNA, 25 bp, Rattus norvegicus
cgtggcctggattccctgagtgcca

SEQ ID NO: 607332 - DNA, 25 bp, Rattus norvegicus
gggagagtaagaggcccagctccac

SEQ ID NO: 607333 - DNA, 25 bp, Rattus norvegicus
tctgagatccgcgacttgatcgctg

SEQ ID NO: 607334 - DNA, 25 bp, Rattus norvegicus
cttgttctccggatcggccgaaggt

SEQ ID NO: 607335 - DNA, 25 bp, Rattus norvegicus
gcagggcaaaccttcccagcggttg

SEQ ID NO: 607336 - DNA, 25 bp, Rattus norvegicus
gttggcaccacacgacgtctgctgg

SEQ ID NO: 607337 - DNA, 25 bp, Rattus norvegicus
ctgactccggtcaggcaggaaccga

SEQ ID NO: 607338 - DNA, 25 bp, Rattus norvegicus
tcgttccggaagaaggcgagcagac

SEQ ID NO: 607339 - DNA, 25 bp, Rattus norvegicus
gcttcgtctggagctgagctttgcc

SEQ ID NO: 607340 - DNA, 25 bp, Rattus norvegicus
agcctcccggacctctttgtgtggc

SEQ ID NO: 607341 - DNA, 25 bp, Rattus norvegicus
catggcggctaacatgtaccgggta

SEQ ID NO: 607342 - DNA, 25 bp, Rattus norvegicus
cagccgtaacggtgctctgagatcc

SEQ ID NO: 607343 - DNA, 25 bp, Rattus norvegicus
accgtcggagttgctaggacccata

SEQ ID NO: 607344 - DNA, 25 bp, Rattus norvegicus
ggacccatagtgcaaagagttaatt

SEQ ID NO: 607345 - DNA, 25 bp, Rattus norvegicus
gctcagagtctaccgcagagacata

SEQ ID NO: 607346 - DNA, 25 bp, Rattus norvegicus
aggagccgagttccttccggaagtg

SEQ ID NO: 607347 - DNA, 25 bp, Rattus norvegicus
agtttcagacccaagccgagagccg

SEQ ID NO: 607348 - DNA, 25 bp, Rattus norvegicus
cggggcagtgtccacagctatacta

SEQ ID NO: 607349 - DNA, 25 bp, Rattus norvegicus
tgcttccgccaggttctcacacttt

SEQ ID NO: 607350 - DNA, 25 bp, Rattus norvegicus
gctccgtcgcttatcaggcttccga

SEQ ID NO: 607351 - DNA, 25 bp, Rattus norvegicus
caggcttccgattggtcggctacgc

SEQ ID NO: 607352 - DNA, 25 bp, Rattus norvegicus
actttttccaactcagcggggcagg

SEQ ID NO: 607353 - DNA, 25 bp, Rattus norvegicus
acggaactgtcgtgcgtacgccttt

SEQ ID NO: 607354 - DNA, 25 bp, Rattus norvegicus
ggccgctgtttccacacgactcaat

SEQ ID NO: 607355 - DNA, 25 bp, Rattus norvegicus
ttactttgcggcagcgccgacagcc

SEQ ID NO: 607356 - DNA, 25 bp, Rattus norvegicus
ttctctgcggaatcaccatggcggc

SEQ ID NO: 607357 - DNA, 25 bp, Rattus norvegicus
ccgccgccatcctttacttgggttg

SEQ ID NO: 607358 - DNA, 25 bp, Rattus norvegicus
gtacgccttttatgccgtcctcgct

SEQ ID NO: 607359 - DNA, 25 bp, Rattus norvegicus
taagtttgccggctccagtgattcc

SEQ ID NO: 607360 - DNA, 25 bp, Rattus norvegicus
cttgtctcccttgcggcttactttg

SEQ ID NO: 607361 - DNA, 25 bp, Rattus norvegicus
ctccagagttggagccaagtttaac

SEQ ID NO: 607362 - DNA, 25 bp, Rattus norvegicus
catctcgaacttcgcgtccggaatc

SEQ ID NO: 607363 - DNA, 25 bp, Rattus norvegicus
tccatgtttactgaggaagttttcc

SEQ ID NO: 607364 - DNA, 25 bp, Rattus norvegicus
tcagagcgctactgggttcctattc

SEQ ID NO: 607365 - DNA, 25 bp, Rattus norvegicus
tgcactgcaggccatcctggtctgg

SEQ ID NO: 607366 - DNA, 25 bp, Rattus norvegicus
catcgcttccaagtgttcttaggtt

SEQ ID NO: 607367 - DNA, 25 bp, Rattus norvegicus
cgcttcgggagtaaagctctttctc

SEQ ID NO: 607368 - DNA, 25 bp, Rattus norvegicus
cgacgcgtcacgcttcgggagtaaa

SEQ ID NO: 607369 - DNA, 25 bp, Rattus norvegicus
tccaacagtttggagcaaacccggc

SEQ ID NO: 607370 - DNA, 25 bp, Rattus norvegicus
gctagtgtcactgcgagagttccaa

SEQ ID NO: 607371 - DNA, 25 bp, Rattus norvegicus
acgaggtgcatttgcgctagtgtca

SEQ ID NO: 607372 - DNA, 25 bp, Rattus norvegicus
ctgagcccacaggtagggaagcgaa

SEQ ID NO: 607373 - DNA, 25 bp, Rattus norvegicus
tgtcgccagcagtcacagcactacg

SEQ ID NO: 607374 - DNA, 25 bp, Rattus norvegicus
ccgcgggtggattgtcgtcccaatt

SEQ ID NO: 607375 - DNA, 25 bp, Rattus norvegicus
gtcaaactggccaagacactgggca

SEQ ID NO: 607376 - DNA, 25 bp, Rattus norvegicus
cagcaaaccgctgcggccgcaaccg

SEQ ID NO: 607377 - DNA, 25 bp, Rattus norvegicus
acagctgacttaccgtaaagcccgg

SEQ ID NO: 607378 - DNA, 25 bp, Rattus norvegicus
acactgggcagcaaaccgctgcggc

SEQ ID NO: 607379 - DNA, 25 bp, Rattus norvegicus
tggccaagacactgggcagcaaacc

SEQ ID NO: 607380 - DNA, 25 bp, Rattus norvegicus
ctccgccggcaacggttccgcgctt

SEQ ID NO: 607381 - DNA, 25 bp, Rattus norvegicus
tgatgtcaaactggccaagacactg

SEQ ID NO: 607382 - DNA, 25 bp, Rattus norvegicus
ccatgatgtcaaactggccaagaca

SEQ ID NO: 607383 - DNA, 25 bp, Rattus norvegicus
ggtcgccatgatgtcaaactggcca

SEQ ID NO: 607384 - DNA, 25 bp, Rattus norvegicus
ggcggtcgccatgatgtcaaactgg

SEQ ID NO: 607385 - DNA, 25 bp, Rattus norvegicus
gcgggcggtcgccatgatgtcaaac

SEQ ID NO: 607386 - DNA, 25 bp, Rattus norvegicus
ccgggactgagtcgcggccgcacga

SEQ ID NO: 607387 - DNA, 25 bp, Rattus norvegicus
aacggttccgcgcttgcgcacgagg

SEQ ID NO: 607388 - DNA, 25 bp, Rattus norvegicus
caagacactgggcagcaaaccgctg

SEQ ID NO: 607389 - DNA, 25 bp, Rattus norvegicus
ccctcgcgctcacttctgcttcaga

SEQ ID NO: 607390 - DNA, 25 bp, Rattus norvegicus
ggcaaggcctaccactgccaccgct

SEQ ID NO: 607391 - DNA, 25 bp, Rattus norvegicus
acctcagggcgctcgtccgggtggc

SEQ ID NO: 607392 - DNA, 25 bp, Rattus norvegicus
cccgcctcgcttgctgtcctccgct

SEQ ID NO: 607393 - DNA, 25 bp, Rattus norvegicus
gtcccggctgctaggcaaggcctac

SEQ ID NO: 607394 - DNA, 25 bp, Rattus norvegicus
cccttcgccgctcctcccaccgcct

SEQ ID NO: 607395 - DNA, 25 bp, Rattus norvegicus
tggccgcctttggtccggcgccgct

SEQ ID NO: 607396 - DNA, 25 bp, Rattus norvegicus
cccgagtcccggctgctaggcaagg

SEQ ID NO: 607397 - DNA, 25 bp, Rattus norvegicus
agagccggctcaacacttacctccc

SEQ ID NO: 607398 - DNA, 25 bp, Rattus norvegicus
ggcctcagagccggctcaacactta

SEQ ID NO: 607399 - DNA, 25 bp, Rattus norvegicus
gagtttggcccatccgcggcggcct

SEQ ID NO: 607400 - DNA, 25 bp, Rattus norvegicus
cagtccgagtttggcccatccgcgg

SEQ ID NO: 607401 - DNA, 25 bp, Rattus norvegicus
gcttggcgcccacgcacccgcccag

SEQ ID NO: 607402 - DNA, 25 bp, Rattus norvegicus
gcttgctgtcctccgctcgcgctcc

SEQ ID NO: 607403 - DNA, 25 bp, Rattus norvegicus
tacgagtccgtttatctgttggctc

SEQ ID NO: 607404 - DNA, 25 bp, Rattus norvegicus
gagcggagctccgaattacaagtcc

SEQ ID NO: 607405 - DNA, 25 bp, Rattus norvegicus
caagtcccagcgtgcactgcgaagg

SEQ ID NO: 607406 - DNA, 25 bp, Rattus norvegicus
agcgcgggcgaatctacgattttca

SEQ ID NO: 607407 - DNA, 25 bp, Rattus norvegicus
cgcaggcgagaaccaaccgggaaat

SEQ ID NO: 607408 - DNA, 25 bp, Rattus norvegicus
cgcggcttcctcagataaagcttcc

SEQ ID NO: 607409 - DNA, 25 bp, Rattus norvegicus
cgagaccaattgacgagcaccacga

SEQ ID NO: 607410 - DNA, 25 bp, Rattus norvegicus
tctgcgttcggaatgacagctttgc

SEQ ID NO: 607411 - DNA, 25 bp, Rattus norvegicus
tcaagtccagcgtggttctgcgttc

SEQ ID NO: 607412 - DNA, 25 bp, Rattus norvegicus
agcggcttcgctagtttcaagtcca

SEQ ID NO: 607413 - DNA, 25 bp, Rattus norvegicus
ttgtctgggcggttacaaaactcca

SEQ ID NO: 607414 - DNA, 25 bp, Rattus norvegicus
aggacgcccatttctcttcgagcta

SEQ ID NO: 607415 - DNA, 25 bp, Rattus norvegicus
ccgcggcaatctacgggttgaggaa

SEQ ID NO: 607416 - DNA, 25 bp, Rattus norvegicus
tggctcttactactgtcaatctgtg

SEQ ID NO: 607417 - DNA, 25 bp, Rattus norvegicus
ggtgagcgacaaggcgaaaactcga

SEQ ID NO: 607418 - DNA, 25 bp, Rattus norvegicus
cgctttccttcagagctagtgcagc

SEQ ID NO: 607419 - DNA, 25 bp, Rattus norvegicus
gttcggagccgtccacggacgcgta

SEQ ID NO: 607420 - DNA, 25 bp, Rattus norvegicus
gtccacggacgcgtaggccgctttc

SEQ ID NO: 607421 - DNA, 25 bp, Rattus norvegicus
acgcgtaggccgctttccttcagag

SEQ ID NO: 607422 - DNA, 25 bp, Rattus norvegicus
cgtaggccgctttccttcagagcta

SEQ ID NO: 607423 - DNA, 25 bp, Rattus norvegicus
aggccgctttccttcagagctagtg

SEQ ID NO: 607424 - DNA, 25 bp, Rattus norvegicus
ttccttcagagctagtgcagcctgc

SEQ ID NO: 607425 - DNA, 25 bp, Rattus norvegicus
ttcagagctagtgcagcctgctgcc

SEQ ID NO: 607426 - DNA, 25 bp, Rattus norvegicus
tagtgcagcctgctgccgcaccaga

SEQ ID NO: 607427 - DNA, 25 bp, Rattus norvegicus
tgctgccgcaccagacttcttgcag

SEQ ID NO: 607428 - DNA, 25 bp, Rattus norvegicus
cgacaaggcgaaaactcgaggggcg

SEQ ID NO: 607429 - DNA, 25 bp, Rattus norvegicus
agaggtgagcgacaaggcgaaaact

SEQ ID NO: 607430 - DNA, 25 bp, Rattus norvegicus
gacttcttgcagctcccggcagagc

SEQ ID NO: 607431 - DNA, 25 bp, Rattus norvegicus
tggcttgggcaacacgcctacagga

SEQ ID NO: 607432 - DNA, 25 bp, Rattus norvegicus
ccacgcactgctggcttgggcaaca

SEQ ID NO: 607433 - DNA, 25 bp, Rattus norvegicus
aagagtcgcctcacaatcacacagg

SEQ ID NO: 607434 - DNA, 25 bp, Rattus norvegicus
ggcaccgctcttgcagcagctcaga

SEQ ID NO: 607435 - DNA, 25 bp, Rattus norvegicus
gaaacgtcccgcttgttgccaggca

SEQ ID NO: 607436 - DNA, 25 bp, Rattus norvegicus
tgggcaacacgcctacaggaagagg

SEQ ID NO: 607437 - DNA, 25 bp, Rattus norvegicus
cttgttgccaggcaccgctcttgca

SEQ ID NO: 607438 - DNA, 25 bp, Rattus norvegicus
gcctgacgcaggatcccgctataaa

SEQ ID NO: 607439 - DNA, 25 bp, Rattus norvegicus
tcccgctataaagtgcggcccgctg

SEQ ID NO: 607440 - DNA, 25 bp, Rattus norvegicus
tacgccagacgttctcgcccagagt

SEQ ID NO: 607441 - DNA, 25 bp, Rattus norvegicus
ctacgtctatctgtccatggtgagt

SEQ ID NO: 607442 - DNA, 25 bp, Rattus norvegicus
tctatctgtccatggtgagtgcggc

SEQ ID NO: 607443 - DNA, 25 bp, Rattus norvegicus
cctcccttgggccacttggtgagct

SEQ ID NO: 607444 - DNA, 25 bp, Rattus norvegicus
ggccacagaaacgtcccgcttgttg

SEQ ID NO: 607445 - DNA, 25 bp, Rattus norvegicus
taacgtctgcggtgattggtggacc

SEQ ID NO: 607446 - DNA, 25 bp, Rattus norvegicus
ggtggaccagagataccgatcgctc

SEQ ID NO: 607447 - DNA, 25 bp, Rattus norvegicus
gaaatcaggatcttggccactgcca

SEQ ID NO: 607448 - DNA, 25 bp, Rattus norvegicus
tcattcggccactcagcactaggga

SEQ ID NO: 607449 - DNA, 25 bp, Rattus norvegicus
gagcttgttagttccgagtcctgga

SEQ ID NO: 607450 - DNA, 25 bp, Rattus norvegicus
gcttttcccgcagttaacatggctg

SEQ ID NO: 607451 - DNA, 25 bp, Rattus norvegicus
ggctgcgactagttattcaccgaga

SEQ ID NO: 607452 - DNA, 25 bp, Rattus norvegicus
ctctgagaccggatagcggccacca

SEQ ID NO: 607453 - DNA, 25 bp, Rattus norvegicus
ttaccgttctgggagcggatcgctt

SEQ ID NO: 607454 - DNA, 25 bp, Rattus norvegicus
ccgagagaacttcaccgtgccaagc

SEQ ID NO: 607455 - DNA, 25 bp, Rattus norvegicus
ttcccttacacggtagggcgcaatg

SEQ ID NO: 607456 - DNA, 25 bp, Rattus norvegicus
cgtgctccattctcgaacgttcttc

SEQ ID NO: 607457 - DNA, 25 bp, Rattus norvegicus
ggcactgtgagactttgcccacttc

SEQ ID NO: 607458 - DNA, 25 bp, Rattus norvegicus
cgcctctctgactttctgatcaatt

SEQ ID NO: 607459 - DNA, 25 bp, Rattus norvegicus
tgcggcggagacctcgggatgtgga

SEQ ID NO: 607460 - DNA, 25 bp, Rattus norvegicus
ggggcccgcctcaaggacacgtgac

SEQ ID NO: 607461 - DNA, 25 bp, Rattus norvegicus
gcctcaaggacacgtgacccgccca

SEQ ID NO: 607462 - DNA, 25 bp, Rattus norvegicus
cggagccgcaaacccttggcggcca

SEQ ID NO: 607463 - DNA, 25 bp, Rattus norvegicus
acccttggcggccagcgggacagac

SEQ ID NO: 607464 - DNA, 25 bp, Rattus norvegicus
cccttggcggccagcgggacagact

SEQ ID NO: 607465 - DNA, 25 bp, Rattus norvegicus
acagactggcggaggagcgattgac

SEQ ID NO: 607466 - DNA, 25 bp, Rattus norvegicus
actggcggaggagcgattgacaggc

SEQ ID NO: 607467 - DNA, 25 bp, Rattus norvegicus
attgacaggcggcagggcagctctg

SEQ ID NO: 607468 - DNA, 25 bp, Rattus norvegicus
ctggggcccgcctcaaggacacgtg

SEQ ID NO: 607469 - DNA, 25 bp, Rattus norvegicus
gcccggcagagttggtggtgcgcgt

SEQ ID NO: 607470 - DNA, 25 bp, Rattus norvegicus
cccgcacgccggtggctctgcgctc

SEQ ID NO: 607471 - DNA, 25 bp, Rattus norvegicus
tggctctgcgctcggtctgggccac

SEQ ID NO: 607472 - DNA, 25 bp, Rattus norvegicus
ggcagggcagctctggggcccggca

SEQ ID NO: 607473 - DNA, 25 bp, Rattus norvegicus
tcagacctctgccacgtaccggggt

SEQ ID NO: 607474 - DNA, 25 bp, Rattus norvegicus
tccggaggacttgtgcatagcggcc

SEQ ID NO: 607475 - DNA, 25 bp, Rattus norvegicus
agatccgccagcatgacctaccagg

SEQ ID NO: 607476 - DNA, 25 bp, Rattus norvegicus
cgtctacgacatcagccgctgggca

SEQ ID NO: 607477 - DNA, 25 bp, Rattus norvegicus
acggtaagctaacccactgccggcg

SEQ ID NO: 607478 - DNA, 25 bp, Rattus norvegicus
ttccgctgggagcagatccgccagc

SEQ ID NO: 607479 - DNA, 25 bp, Rattus norvegicus
accacagcgcggaggacgccacggt

SEQ ID NO: 607480 - DNA, 25 bp, Rattus norvegicus
gcccatcttccgctgggagcagatc

SEQ ID NO: 607481 - DNA, 25 bp, Rattus norvegicus
atcgagcgccgcgtctacgacatca

SEQ ID NO: 607482 - DNA, 25 bp, Rattus norvegicus
gacaagtggctggtcatcgagcgcc

SEQ ID NO: 607483 - DNA, 25 bp, Rattus norvegicus
catgacctaccaggcgacaagtggc

SEQ ID NO: 607484 - DNA, 25 bp, Rattus norvegicus
gcgagcgctgtcagcgcggttataa

SEQ ID NO: 607485 - DNA, 25 bp, Rattus norvegicus
cagccaatagatgtggaggcgccgc

SEQ ID NO: 607486 - DNA, 25 bp, Rattus norvegicus
gacgccacggtaagctaacccactg

SEQ ID NO: 607487 - DNA, 25 bp, Rattus norvegicus
aggcgcaacggctttggtgaccaac

SEQ ID NO: 607488 - DNA, 25 bp, Rattus norvegicus
gctgggacgcagactcccgtatctc

SEQ ID NO: 607489 - DNA, 25 bp, Rattus norvegicus
tccctggctagctgggacgcagact

SEQ ID NO: 607490 - DNA, 25 bp, Rattus norvegicus
ctgtcttggctaggcgacggtctct

SEQ ID NO: 607491 - DNA, 25 bp, Rattus norvegicus
aacactcggcctccggctggacaag

SEQ ID NO: 607492 - DNA, 25 bp, Rattus norvegicus
ttggtgaccaacactcggcctccgg

SEQ ID NO: 607493 - DNA, 25 bp, Rattus norvegicus
cggggatttgcacctgatgctcgca

SEQ ID NO: 607494 - DNA, 25 bp, Rattus norvegicus
ctgggcttttctttgcgcgcttcaa

SEQ ID NO: 607495 - DNA, 25 bp, Rattus norvegicus
acggagtagatctctgaggagctga

SEQ ID NO: 607496 - DNA, 25 bp, Rattus norvegicus
agcggagaaagacggagtagatctc

SEQ ID NO: 607497 - DNA, 25 bp, Rattus norvegicus
cccttcgctggctggagcggagaaa

SEQ ID NO: 607498 - DNA, 25 bp, Rattus norvegicus
actcccgtatctcgcattgtctaag

SEQ ID NO: 607499 - DNA, 25 bp, Rattus norvegicus
gcccgcacggagttaagccctgctg

SEQ ID NO: 607500 - DNA, 25 bp, Rattus norvegicus
atgctcgcacaaaggaggcgcaacg

SEQ ID NO: 607501 - DNA, 25 bp, Rattus norvegicus
ggagctcgctcccacaccactcggc

SEQ ID NO: 607502 - DNA, 25 bp, Rattus norvegicus
aggtccgcgccaacggtgctgaaaa

SEQ ID NO: 607503 - DNA, 25 bp, Rattus norvegicus
ctctcccctagttggcgaggctggc

SEQ ID NO: 607504 - DNA, 25 bp, Rattus norvegicus
tgcgctactttacttgggaggaggt

SEQ ID NO: 607505 - DNA, 25 bp, Rattus norvegicus
cgcgccaacggtgctgaaaaccctg

SEQ ID NO: 607506 - DNA, 25 bp, Rattus norvegicus
gccaacggtgctgaaaaccctgcgc

SEQ ID NO: 607507 - DNA, 25 bp, Rattus norvegicus
aaaccctgcgcgcgaacggcggtct

SEQ ID NO: 607508 - DNA, 25 bp, Rattus norvegicus
cagtagccggagtctctcccgggaa

SEQ ID NO: 607509 - DNA, 25 bp, Rattus norvegicus
caggcttattatggctcccgacccg

SEQ ID NO: 607510 - DNA, 25 bp, Rattus norvegicus
ttatggctcccgacccggtgcagac

SEQ ID NO: 607511 - DNA, 25 bp, Rattus norvegicus
cagctccgccaaatgcgctacttta

SEQ ID NO: 607512 - DNA, 25 bp, Rattus norvegicus
caaatgcgctactttacttgggagg

SEQ ID NO: 607513 - DNA, 25 bp, Rattus norvegicus
ccaaccaggcttattatggctcccg

SEQ ID NO: 607514 - DNA, 25 bp, Rattus norvegicus
gggtcgatttctgctggccccagag

SEQ ID NO: 607515 - DNA, 25 bp, Rattus norvegicus
gtcccttttccgctgtagcttattg

SEQ ID NO: 607516 - DNA, 25 bp, Rattus norvegicus
tccgctgtagcttattgaaggcaga

SEQ ID NO: 607517 - DNA, 25 bp, Rattus norvegicus
cgcgtcccttttccgctgtagctta

SEQ ID NO: 607518 - DNA, 25 bp, Rattus norvegicus
ggatcgcgtcccttttccgctgtag

SEQ ID NO: 607519 - DNA, 25 bp, Rattus norvegicus
cacttcgcgggatcgcgtccctttt

SEQ ID NO: 607520 - DNA, 25 bp, Rattus norvegicus
tgattagacacttcgcgggatcgcg

SEQ ID NO: 607521 - DNA, 25 bp, Rattus norvegicus
gcgtgattagacacttcgcgggatc

SEQ ID NO: 607522 - DNA, 25 bp, Rattus norvegicus
gggctcccgcgtgattagacacttc

SEQ ID NO: 607523 - DNA, 25 bp, Rattus norvegicus
attccgagaacagggctcccgcgtg

SEQ ID NO: 607524 - DNA, 25 bp, Rattus norvegicus
ttcaactattccgagaacagggctc

SEQ ID NO: 607525 - DNA, 25 bp, Rattus norvegicus
aaggaggtcttcaactattccgaga

SEQ ID NO: 607526 - DNA, 25 bp, Rattus norvegicus
gcgatgtcacttggcggtaggccaa

SEQ ID NO: 607527 - DNA, 25 bp, Rattus norvegicus
gattcttagtgcgatgtcacttggc

SEQ ID NO: 607528 - DNA, 25 bp, Rattus norvegicus
cttattgaaggcagagtcggtccgc

SEQ ID NO: 607529 - DNA, 25 bp, Rattus norvegicus
acaagcctgttcttacaatgtcgag

SEQ ID NO: 607530 - DNA, 25 bp, Rattus norvegicus
gcagatttcacagcgggcattcttt

SEQ ID NO: 607531 - DNA, 25 bp, Rattus norvegicus
gccacgtccgatagcagatttcaca

SEQ ID NO: 607532 - DNA, 25 bp, Rattus norvegicus
tagtgtaggccgtgccacgtccgat

SEQ ID NO: 607533 - DNA, 25 bp, Rattus norvegicus
cgcgaacagcctcctgggaagtgta

SEQ ID NO: 607534 - DNA, 25 bp, Rattus norvegicus
acgtgacctaccaggcgcgaacagc

SEQ ID NO: 607535 - DNA, 25 bp, Rattus norvegicus
tcatcacgtgacctaccaggcgcga

SEQ ID NO: 607536 - DNA, 25 bp, Rattus norvegicus
caatgtcgagccgaaatcgtttcca

SEQ ID NO: 607537 - DNA, 25 bp, Rattus norvegicus
cctagctagcagtggtttggatccc

SEQ ID NO: 607538 - DNA, 25 bp, Rattus norvegicus
cgaggcttcacctagctagcagtgg

SEQ ID NO: 607539 - DNA, 25 bp, Rattus norvegicus
tccgcctcgagtgcacgaggcttca

SEQ ID NO: 607540 - DNA, 25 bp, Rattus norvegicus
tcggagacgcttccgcgagacctca

SEQ ID NO: 607541 - DNA, 25 bp, Rattus norvegicus
cgctctcggagacgcttccgcgaga

SEQ ID NO: 607542 - DNA, 25 bp, Rattus norvegicus
gaaatcgtttccagcttcgccgcct

SEQ ID NO: 607543 - DNA, 25 bp, Rattus norvegicus
gtacagtccggccaggctcgcctca

SEQ ID NO: 607544 - DNA, 25 bp, Rattus norvegicus
tcgttgggaagcaacgcgaggatca

SEQ ID NO: 607545 - DNA, 25 bp, Rattus norvegicus
ctgcgttgctttaaagtcgttggga

SEQ ID NO: 607546 - DNA, 25 bp, Rattus norvegicus
ctgggtactgcgttgctttaaagtc

SEQ ID NO: 607547 - DNA, 25 bp, Rattus norvegicus
gtgtctgggtactgcgttgctttaa

SEQ ID NO: 607548 - DNA, 25 bp, Rattus norvegicus
ccggagtcgcaacctcgggcagcag

SEQ ID NO: 607549 - DNA, 25 bp, Rattus norvegicus
tcgcctcacgctcgctacccgcagc

SEQ ID NO: 607550 - DNA, 25 bp, Rattus norvegicus
tgggctccctgtacagtccggccag

SEQ ID NO: 607551 - DNA, 25 bp, Rattus norvegicus
cccgcgcgacagtcccggctgggct

SEQ ID NO: 607552 - DNA, 25 bp, Rattus norvegicus
agcgcttcggtctcgtccaccacct

SEQ ID NO: 607553 - DNA, 25 bp, Rattus norvegicus
taccttcgaagaagcgctgcagcgc

SEQ ID NO: 607554 - DNA, 25 bp, Rattus norvegicus
tctcttaccttcgaagaagcgctgc

SEQ ID NO: 607555 - DNA, 25 bp, Rattus norvegicus
ccgcggtctcttaccttcgaagaag

SEQ ID NO: 607556 - DNA, 25 bp, Rattus norvegicus
cgccctctagcggtacgcccggagt

SEQ ID NO: 607557 - DNA, 25 bp, Rattus norvegicus
tcaccgcttcaccaaggcgggggtg

SEQ ID NO: 607558 - DNA, 25 bp, Rattus norvegicus
gcccggaaaaatcacgctgcccgtg

SEQ ID NO: 607559 - DNA, 25 bp, Rattus norvegicus
ggggtgagtcttctgacaccctcgc

SEQ ID NO: 607560 - DNA, 25 bp, Rattus norvegicus
cacgccgcgcgtagagctcccgcgc

SEQ ID NO: 607561 - DNA, 25 bp, Rattus norvegicus
cactccgccgccagcggtgaccatg

SEQ ID NO: 607562 - DNA, 25 bp, Rattus norvegicus
tattcactaacgttgcttccgcagg

SEQ ID NO: 607563 - DNA, 25 bp, Rattus norvegicus
atggacattgcccagcccgccacgc

SEQ ID NO: 607564 - DNA, 25 bp, Rattus norvegicus
gccacggcgcgcaatggacattgcc

SEQ ID NO: 607565 - DNA, 25 bp, Rattus norvegicus
tgtcggaccggccacggcgcgcaat

SEQ ID NO: 607566 - DNA, 25 bp, Rattus norvegicus
cctcacacctgccacgggcgcgcgt

SEQ ID NO: 607567 - DNA, 25 bp, Rattus norvegicus
ggagctcctcggacctcacacctgc

SEQ ID NO: 607568 - DNA, 25 bp, Rattus norvegicus
cccgtgccacgcgtgtcaccatccc

SEQ ID NO: 607569 - DNA, 25 bp, Rattus norvegicus
gctgcccgtgctgtatccactttgc

SEQ ID NO: 607570 - DNA, 25 bp, Rattus norvegicus
actaacgttgcttccgcagggcgcc

SEQ ID NO: 607571 - DNA, 25 bp, Rattus norvegicus
ggtgccgcaggttcccaacctggta

SEQ ID NO: 607572 - DNA, 25 bp, Rattus norvegicus
caggatacagcgctcgcacgggaca

SEQ ID NO: 607573 - DNA, 25 bp, Rattus norvegicus
tgcccagtcgaacgctttcggacgc

SEQ ID NO: 607574 - DNA, 25 bp, Rattus norvegicus
aacctggtagcgatgcgggcatctc

SEQ ID NO: 607575 - DNA, 25 bp, Rattus norvegicus
caggaccctcggaaggtctcccagt

SEQ ID NO: 607576 - DNA, 25 bp, Rattus norvegicus
tgctccctgtcacgtccctgtagga

SEQ ID NO: 607577 - DNA, 25 bp, Rattus norvegicus
gtccctgtaggagcaggaggctctc

SEQ ID NO: 607578 - DNA, 25 bp, Rattus norvegicus
agatctcgttcagttggcctggacc

SEQ ID NO: 607579 - DNA, 25 bp, Rattus norvegicus
tcgctgaagtcacgctgagaaaccg

SEQ ID NO: 607580 - DNA, 25 bp, Rattus norvegicus
aaaccgtgagcggacgcctggccga

SEQ ID NO: 607581 - DNA, 25 bp, Rattus norvegicus
gcaggcggcgacacaatggtctttt

SEQ ID NO: 607582 - DNA, 25 bp, Rattus norvegicus
catcttaccgcagatttcccggctg

SEQ ID NO: 607583 - DNA, 25 bp, Rattus norvegicus
tgcgcggcagtcctaagatctcgtt

SEQ ID NO: 607584 - DNA, 25 bp, Rattus norvegicus
agcaggaggctctcgctgaagtcac

SEQ ID NO: 607585 - DNA, 25 bp, Rattus norvegicus
cacgcacgcgcatgctcagagtacg

SEQ ID NO: 607586 - DNA, 25 bp, Rattus norvegicus
gcctggcattgaggaccctcgcttc

SEQ ID NO: 607587 - DNA, 25 bp, Rattus norvegicus
cgacccagagtctggcggagtcttc

SEQ ID NO: 607588 - DNA, 25 bp, Rattus norvegicus
gaacgcagtgactacgaggagcatc

SEQ ID NO: 607589 - DNA, 25 bp, Rattus norvegicus
caaacggaagtaccaggaggactca

SEQ ID NO: 607590 - DNA, 25 bp, Rattus norvegicus
tcccgggacaactacaaggcaggca

SEQ ID NO: 607591 - DNA, 25 bp, Rattus norvegicus
ctacacggacctgcgtgagaagctc

SEQ ID NO: 607592 - DNA, 25 bp, Rattus norvegicus
ccgctggttccttaagccacgcatg

SEQ ID NO: 607593 - DNA, 25 bp, Rattus norvegicus
cggcgccttttttcctcaggacgtg

SEQ ID NO: 607594 - DNA, 25 bp, Rattus norvegicus
cgtcgtgaggagagctttaaagtgc

SEQ ID NO: 607595 - DNA, 25 bp, Rattus norvegicus
agctgttctctcgaagctttcggtg

SEQ ID NO: 607596 - DNA, 25 bp, Rattus norvegicus
ctgtacagttgacaccgcgagcaca

SEQ ID NO: 607597 - DNA, 25 bp, Rattus norvegicus
tgattcccgaggattgtgcgctgga

SEQ ID NO: 607598 - DNA, 25 bp, Rattus norvegicus
agctcaagtccatgacgtcccggga

SEQ ID NO: 607599 - DNA, 25 bp, Rattus norvegicus
cacaggccgaatgggtcatgccctc

SEQ ID NO: 607600 - DNA, 25 bp, Rattus norvegicus
gaccctgtggcgtgcaagaccaccg

SEQ ID NO: 607601 - DNA, 25 bp, Rattus norvegicus
gctgttccgtgtccagagctaacgc

SEQ ID NO: 607602 - DNA, 25 bp, Rattus norvegicus
tgtccagagctaacgcccacgagtg

SEQ ID NO: 607603 - DNA, 25 bp, Rattus norvegicus
agagctaacgcccacgagtggccac

SEQ ID NO: 607604 - DNA, 25 bp, Rattus norvegicus
acccgggatggatctccaggccttt

SEQ ID NO: 607605 - DNA, 25 bp, Rattus norvegicus
gatggatctccaggcctttcggagc

SEQ ID NO: 607606 - DNA, 25 bp, Rattus norvegicus
ctccaggcctttcggagcggagtca

SEQ ID NO: 607607 - DNA, 25 bp, Rattus norvegicus
cacccgtggcgcacaggccgaatgg

SEQ ID NO: 607608 - DNA, 25 bp, Rattus norvegicus
atgggtcatgccctccgtagcttag

SEQ ID NO: 607609 - DNA, 25 bp, Rattus norvegicus
gccctccgtagcttagacgagcata

SEQ ID NO: 607610 - DNA, 25 bp, Rattus norvegicus
cttagacgagcatagcagtggagct

SEQ ID NO: 607611 - DNA, 25 bp, Rattus norvegicus
atagcagtggagctccgccgccctt

SEQ ID NO: 607612 - DNA, 25 bp, Rattus norvegicus
cgtgcaagaccaccgccacccgtgg

SEQ ID NO: 607613 - DNA, 25 bp, Rattus norvegicus
cgggacatttgtaggctggatgccc

SEQ ID NO: 607614 - DNA, 25 bp, Rattus norvegicus
caccggcgggtagaacggctgcagc

SEQ ID NO: 607615 - DNA, 25 bp, Rattus norvegicus
ttcacacccggcagtcgggacattt

SEQ ID NO: 607616 - DNA, 25 bp, Rattus norvegicus
tggcagagactcagattcacacccg

SEQ ID NO: 607617 - DNA, 25 bp, Rattus norvegicus
caagtggcagagactcagattcaca

SEQ ID NO: 607618 - DNA, 25 bp, Rattus norvegicus
gttcaagtggcagagactcagattc

SEQ ID NO: 607619 - DNA, 25 bp, Rattus norvegicus
cgtgggttcaagtggcagagactca

SEQ ID NO: 607620 - DNA, 25 bp, Rattus norvegicus
taccagggtcatctgtgccccgggg

SEQ ID NO: 607621 - DNA, 25 bp, Rattus norvegicus
aggcggccagcccaggtaagcgcgg

SEQ ID NO: 607622 - DNA, 25 bp, Rattus norvegicus
ccctttctaccagggtcatctgtgc

SEQ ID NO: 607623 - DNA, 25 bp, Rattus norvegicus
ggctggagccgcacgaattgcaccc

SEQ ID NO: 607624 - DNA, 25 bp, Rattus norvegicus
tgctgtcggctggagccgcacgaat

SEQ ID NO: 607625 - DNA, 25 bp, Rattus norvegicus
ccggcagtcgggacatttgtaggct

SEQ ID NO: 607626 - DNA, 25 bp, Rattus norvegicus
acacccggcagtcgggacatttgta

SEQ ID NO: 607627 - DNA, 25 bp, Rattus norvegicus
gcgcgtgaccaaaccctggggttgc

SEQ ID NO: 607628 - DNA, 25 bp, Rattus norvegicus
gccaccgtactggtctcggttgaaa

SEQ ID NO: 607629 - DNA, 25 bp, Rattus norvegicus
ttgccaggcttcgagtaggtacctg

SEQ ID NO: 607630 - DNA, 25 bp, Rattus norvegicus
cgcgcttgcgatgctcatgtgaccc

SEQ ID NO: 607631 - DNA, 25 bp, Rattus norvegicus
cggagagcacctgaacgagaacgtc

SEQ ID NO: 607632 - DNA, 25 bp, Rattus norvegicus
tccggtcacgtgacgctttggggac

SEQ ID NO: 607633 - DNA, 25 bp, Rattus norvegicus
cgttgcagcttcgactccgctgttg

SEQ ID NO: 607634 - DNA, 25 bp, Rattus norvegicus
gtccggccacttgtggctgtcataa

SEQ ID NO: 607635 - DNA, 25 bp, Rattus norvegicus
gctgtcataagtcgggcggctttgt

SEQ ID NO: 607636 - DNA, 25 bp, Rattus norvegicus
ctttgtgcgactcccgatgcccagt

SEQ ID NO: 607637 - DNA, 25 bp, Rattus norvegicus
ccagtgtgcccgtcgtaagttgcag

SEQ ID NO: 607638 - DNA, 25 bp, Rattus norvegicus
cagagctacggctgggcttttgtcc

SEQ ID NO: 607639 - DNA, 25 bp, Rattus norvegicus
aaagagagttaggaagcgcccaagc

SEQ ID NO: 607640 - DNA, 25 bp, Rattus norvegicus
caagcgcagacgcaaccagggtgct

SEQ ID NO: 607641 - DNA, 25 bp, Rattus norvegicus
aacagccgctgagccagaaccagcg

SEQ ID NO: 607642 - DNA, 25 bp, Rattus norvegicus
gggagagccgaaatgccagcgaccc

SEQ ID NO: 607643 - DNA, 25 bp, Rattus norvegicus
ccgcacactgatgcggcagcagagc

SEQ ID NO: 607644 - DNA, 25 bp, Rattus norvegicus
tgagccagaaccagcggggccgaca

SEQ ID NO: 607645 - DNA, 25 bp, Rattus norvegicus
accagcggggccgacagcccagtca

SEQ ID NO: 607646 - DNA, 25 bp, Rattus norvegicus
ccgacagcccagtcagcccaccacc

SEQ ID NO: 607647 - DNA, 25 bp, Rattus norvegicus
cagctgcaggcccacgcggcctcgg

SEQ ID NO: 607648 - DNA, 25 bp, Rattus norvegicus
cctatggtcgaggtcaggctcggca

SEQ ID NO: 607649 - DNA, 25 bp, Rattus norvegicus
tcaggctcggcagggcacctcggcc

SEQ ID NO: 607650 - DNA, 25 bp, Rattus norvegicus
tcggccggctccaagtaccgggcag

SEQ ID NO: 607651 - DNA, 25 bp, Rattus norvegicus
ccggctccaagtaccgggcagctgg

SEQ ID NO: 607652 - DNA, 25 bp, Rattus norvegicus
ccaggcagctgggaccacgtggtgg

SEQ ID NO: 607653 - DNA, 25 bp, Rattus norvegicus
cacgtggtggggcagattcgaaacc

SEQ ID NO: 607654 - DNA, 25 bp, Rattus norvegicus
gcggcctcggcaccgggctccaacc

SEQ ID NO: 607655 - DNA, 25 bp, Rattus norvegicus
tgcagcgattgcagcgccaccaggc

SEQ ID NO: 607656 - DNA, 25 bp, Rattus norvegicus
ggaccgtgagaagggtcctgaatct

SEQ ID NO: 607657 - DNA, 25 bp, Rattus norvegicus
cgtggactctgcgatgcccatagtc

SEQ ID NO: 607658 - DNA, 25 bp, Rattus norvegicus
tacagcttctgcaagcggctcagtg

SEQ ID NO: 607659 - DNA, 25 bp, Rattus norvegicus
cggtgccgctcacatacagcttctg

SEQ ID NO: 607660 - DNA, 25 bp, Rattus norvegicus
aggcgctccagcttgttgaagtcga

SEQ ID NO: 607661 - DNA, 25 bp, Rattus norvegicus
ccagcagacggttgccgcccaggta

SEQ ID NO: 607662 - DNA, 25 bp, Rattus norvegicus
gcgattgccatagagccagaggcca

SEQ ID NO: 607663 - DNA, 25 bp, Rattus norvegicus
tgcagctgcgcaaagtcggatggca

SEQ ID NO: 607664 - DNA, 25 bp, Rattus norvegicus
agaggccacgcaagcccgtcatgcg

SEQ ID NO: 607665 - DNA, 25 bp, Rattus norvegicus
ccgcaggaagttgccttcgatccag

SEQ ID NO: 607666 - DNA, 25 bp, Rattus norvegicus
cggttgtcgcccatctgcagcgatt

SEQ ID NO: 607667 - DNA, 25 bp, Rattus norvegicus
cgggaactcttcgaagcgattgcca

SEQ ID NO: 607668 - DNA, 25 bp, Rattus norvegicus
cttcgatccagaggcagcgcaggct

SEQ ID NO: 607669 - DNA, 25 bp, Rattus norvegicus
gcttcgggcctagtcgggactctcc

SEQ ID NO: 607670 - DNA, 25 bp, Rattus norvegicus
gaaccctaaatcttcggctctctca

SEQ ID NO: 607671 - DNA, 25 bp, Rattus norvegicus
tctcaagagtcgaggcctgcctgga

SEQ ID NO: 607672 - DNA, 25 bp, Rattus norvegicus
cccgcgccagcgtcgggatcaaggt

SEQ ID NO: 607673 - DNA, 25 bp, Rattus norvegicus
ggatcaaggtgaccaccgccatttc

SEQ ID NO: 607674 - DNA, 25 bp, Rattus norvegicus
cgccatttctccctatagtacagga

SEQ ID NO: 607675 - DNA, 25 bp, Rattus norvegicus
caggaagctagcaaccgaccctctt

SEQ ID NO: 607676 - DNA, 25 bp, Rattus norvegicus
ggacgaaacagtcctagctgccgcc

SEQ ID NO: 607677 - DNA, 25 bp, Rattus norvegicus
cgtcccagcgtatggcggaagtagt

SEQ ID NO: 607678 - DNA, 25 bp, Rattus norvegicus
tcgcagtggttcttcacagcgcggc

SEQ ID NO: 607679 - DNA, 25 bp, Rattus norvegicus
ccataggcagctacgggcgccgact

SEQ ID NO: 607680 - DNA, 25 bp, Rattus norvegicus
cctggacttggcagtggcgccatag

SEQ ID NO: 607681 - DNA, 25 bp, Rattus norvegicus
gcccgagggccctctcaagagtcga

SEQ ID NO: 607682 - DNA, 25 bp, Rattus norvegicus
ggccgatctaaggacttcacccgtg

SEQ ID NO: 607683 - DNA, 25 bp, Rattus norvegicus
agtggccgagcctttagaagcttag

SEQ ID NO: 607684 - DNA, 25 bp, Rattus norvegicus
cgcttccttgcttcgctttgtctta

SEQ ID NO: 607685 - DNA, 25 bp, Rattus norvegicus
agaagcttaggtagcgccctctgta

SEQ ID NO: 607686 - DNA, 25 bp, Rattus norvegicus
agcgctcctaggactcggaccagaa

SEQ ID NO: 607687 - DNA, 25 bp, Rattus norvegicus
ccagcatttcgcctgtttcgggatg

SEQ ID NO: 607688 - DNA, 25 bp, Rattus norvegicus
cggtttttccatcctgcctcgctga

SEQ ID NO: 607689 - DNA, 25 bp, Rattus norvegicus
aaggctttcgctttcccagactctc

SEQ ID NO: 607690 - DNA, 25 bp, Rattus norvegicus
agattgctaattgcccgccacgtta

SEQ ID NO: 607691 - DNA, 25 bp, Rattus norvegicus
tgggaacaccataccggcttccgga

SEQ ID NO: 607692 - DNA, 25 bp, Rattus norvegicus
accgatgtcggttgtcatgggaaca

SEQ ID NO: 607693 - DNA, 25 bp, Rattus norvegicus
gccactctgcgatctgcatcatcta

SEQ ID NO: 607694 - DNA, 25 bp, Rattus norvegicus
cgcggacaagcaccctccaatgtaa

SEQ ID NO: 607695 - DNA, 25 bp, Rattus norvegicus
tctcgctctagctacgcggacaagc

SEQ ID NO: 607696 - DNA, 25 bp, Rattus norvegicus
caggcttgccggaaagtcaattatc

SEQ ID NO: 607697 - DNA, 25 bp, Rattus norvegicus
gcctcttagggcgtaattgaccaaa

SEQ ID NO: 607698 - DNA, 25 bp, Rattus norvegicus
caaaaacttgagctccgggaatgga

SEQ ID NO: 607699 - DNA, 25 bp, Rattus norvegicus
ctcgcggtctcaaaggagctgttcc

SEQ ID NO: 607700 - DNA, 25 bp, Rattus norvegicus
ctctctggcctgcaacgtgtcttag

SEQ ID NO: 607701 - DNA, 25 bp, Rattus norvegicus
actctcgctctcatccgggtactga

SEQ ID NO: 607702 - DNA, 25 bp, Rattus norvegicus
cctaccgcagtgaacggctgtgtga

SEQ ID NO: 607703 - DNA, 25 bp, Rattus norvegicus
actgaggcctctggcggttaggaaa

SEQ ID NO: 607704 - DNA, 25 bp, Rattus norvegicus
tgaggctgtcccgtgatcctctgcg

SEQ ID NO: 607705 - DNA, 25 bp, Rattus norvegicus
tttagtctgcgtacccgaactctcg

SEQ ID NO: 607706 - DNA, 25 bp, Rattus norvegicus
ggttctcagtctcttcgctcgtgcc

SEQ ID NO: 607707 - DNA, 25 bp, Rattus norvegicus
gccggcccaaggacctcaatatgtc

SEQ ID NO: 607708 - DNA, 25 bp, Rattus norvegicus
tgtcgtacaactacgtcgtaacggc

SEQ ID NO: 607709 - DNA, 25 bp, Rattus norvegicus
tcgtaacggcgcagaagcctaccgc

SEQ ID NO: 607710 - DNA, 25 bp, Rattus norvegicus
tcgggctccgtaagtcctccaagag

SEQ ID NO: 607711 - DNA, 25 bp, Rattus norvegicus
gccgaggccagcgattgggcacaat

SEQ ID NO: 607712 - DNA, 25 bp, Rattus norvegicus
attgggcacaatgggcgcgtgactc

SEQ ID NO: 607713 - DNA, 25 bp, Rattus norvegicus
ggtatcgtggccatcccgaggccca

SEQ ID NO: 607714 - DNA, 25 bp, Rattus norvegicus
cacaatgggcgcgtgactccctgtg

SEQ ID NO: 607715 - DNA, 25 bp, Rattus norvegicus
ctcgtggattccggaagtgcaggca

SEQ ID NO: 607716 - DNA, 25 bp, Rattus norvegicus
agctctgaagccttccgccggctgg

SEQ ID NO: 607717 - DNA, 25 bp, Rattus norvegicus
aagtcacatccggtaggggcgggct

SEQ ID NO: 607718 - DNA, 25 bp, Rattus norvegicus
tatgagtgccggtatcgtggccatc

SEQ ID NO: 607719 - DNA, 25 bp, Rattus norvegicus
ccacccgcgtatgagtgccggtatc

SEQ ID NO: 607720 - DNA, 25 bp, Rattus norvegicus
gttgctcctgaagccacccgcgtat

SEQ ID NO: 607721 - DNA, 25 bp, Rattus norvegicus
aggctgtcctctccggttgcctcag

SEQ ID NO: 607722 - DNA, 25 bp, Rattus norvegicus
cgttgccggcgagctctgaagcctt

SEQ ID NO: 607723 - DNA, 25 bp, Rattus norvegicus
cgcactagtaatgggcggagccctg

SEQ ID NO: 607724 - DNA, 25 bp, Rattus norvegicus
ccttccgcgggtgttgctcctgaag

SEQ ID NO: 607725 - DNA, 25 bp, Rattus norvegicus
cctgggccgtttccttgctatttcg

SEQ ID NO: 607726 - DNA, 25 bp, Rattus norvegicus
ctcctacctgctggctccggtggga

SEQ ID NO: 607727 - DNA, 25 bp, Rattus norvegicus
ttcttaggcgcctcctacctgctgg

SEQ ID NO: 607728 - DNA, 25 bp, Rattus norvegicus
gcgggccacactcctcttcttaggc

SEQ ID NO: 607729 - DNA, 25 bp, Rattus norvegicus
cttcaactgggatggtgagcacgcg

SEQ ID NO: 607730 - DNA, 25 bp, Rattus norvegicus
ctcaacagcttgaacttcaactggg

SEQ ID NO: 607731 - DNA, 25 bp, Rattus norvegicus
gtgctctacctcaacagcttgaact

SEQ ID NO: 607732 - DNA, 25 bp, Rattus norvegicus
gaacgcgctgccttctttggcgtca

SEQ ID NO: 607733 - DNA, 25 bp, Rattus norvegicus
gaggcaaccactggtggctcaaggc

SEQ ID NO: 607734 - DNA, 25 bp, Rattus norvegicus
caagcagatccggagagaggcaacc

SEQ ID NO: 607735 - DNA, 25 bp, Rattus norvegicus
gcgccgaacagcagccaagcagatc

SEQ ID NO: 607736 - DNA, 25 bp, Rattus norvegicus
gatgtccgcacttcgcgccgaacag

SEQ ID NO: 607737 - DNA, 25 bp, Rattus norvegicus
caggaagcccacgatgtccgcactt

SEQ ID NO: 607738 - DNA, 25 bp, Rattus norvegicus
ctggccgacgtgtacctgggccgtt

SEQ ID NO: 607739 - DNA, 25 bp, Rattus norvegicus
gctcttcgccttccacaaggtgcgg

SEQ ID NO: 607740 - DNA, 25 bp, Rattus norvegicus
ttcgccttccacaaggtgcggcggc

SEQ ID NO: 607741 - DNA, 25 bp, Rattus norvegicus
gtcctcgcccattgtatggcgagca

SEQ ID NO: 607742 - DNA, 25 bp, Rattus norvegicus
gcacggcgggcacgctcacgtcgtg

SEQ ID NO: 607743 - DNA, 25 bp, Rattus norvegicus
cgcaagatgatgaagtttcggttcc

SEQ ID NO: 607744 - DNA, 25 bp, Rattus norvegicus
atgatgaagtttcggttccggcggc

SEQ ID NO: 607745 - DNA, 25 bp, Rattus norvegicus
gcgcagacccgcagcgcgagaagct

SEQ ID NO: 607746 - DNA, 25 bp, Rattus norvegicus
cgggccgcctctgccctgcgagcgc

SEQ ID NO: 607747 - DNA, 25 bp, Rattus norvegicus
acccgcagcgcgagaagctcaagca

SEQ ID NO: 607748 - DNA, 25 bp, Rattus norvegicus
agaagctcaagcaggagctcttcgc

SEQ ID NO: 607749 - DNA, 25 bp, Rattus norvegicus
tcaagcaggagctcttcgccttcca

SEQ ID NO: 607750 - DNA, 25 bp, Rattus norvegicus
gcaggagctcttcgccttccacaag

SEQ ID NO: 607751 - DNA, 25 bp, Rattus norvegicus
ggagctcttcgccttccacaaggtg

SEQ ID NO: 607752 - DNA, 25 bp, Rattus norvegicus
tcgcccattgtatggcgagcaaggg

SEQ ID NO: 607753 - DNA, 25 bp, Rattus norvegicus
gttccgtcatcgaggcgcactcctt

SEQ ID NO: 607754 - DNA, 25 bp, Rattus norvegicus
catcgaggcgcactccttcccacca

SEQ ID NO: 607755 - DNA, 25 bp, Rattus norvegicus
ccaccaaaggcaggtaaccggcgcg

SEQ ID NO: 607756 - DNA, 25 bp, Rattus norvegicus
accaaaggcaggtaaccggcgcgcg

SEQ ID NO: 607757 - DNA, 25 bp, Rattus norvegicus
gtggctgcgatctggccccacatct

SEQ ID NO: 607758 - DNA, 25 bp, Rattus norvegicus
cgccgctccggccagcctgtttcct

SEQ ID NO: 607759 - DNA, 25 bp, Rattus norvegicus
ggccagcctgtttcctgcgccgccg

SEQ ID NO: 607760 - DNA, 25 bp, Rattus norvegicus
ctcgcggctgcagttcccagacaat

SEQ ID NO: 607761 - DNA, 25 bp, Rattus norvegicus
gcggctgcagttcccagacaatgga

SEQ ID NO: 607762 - DNA, 25 bp, Rattus norvegicus
tgcagttcccagacaatggagcggg

SEQ ID NO: 607763 - DNA, 25 bp, Rattus norvegicus
tcccagacaatggagcgggagcagt

SEQ ID NO: 607764 - DNA, 25 bp, Rattus norvegicus
ggaacgcaggcacatgggctgtccc

SEQ ID NO: 607765 - DNA, 25 bp, Rattus norvegicus
gctgccgcacgttccgtcatcgagg

SEQ ID NO: 607766 - DNA, 25 bp, Rattus norvegicus
gcacgttccgtcatcgaggcgcact

SEQ ID NO: 607767 - DNA, 25 bp, Rattus norvegicus
ccctgggagttggtttatagtctgc

SEQ ID NO: 607768 - DNA, 25 bp, Rattus norvegicus
tcctgcaaatctgtcccttaagctg

SEQ ID NO: 607769 - DNA, 25 bp, Rattus norvegicus
tcacgtgggacttcgctagaaaacg

SEQ ID NO: 607770 - DNA, 25 bp, Rattus norvegicus
gcacagttccctcgcgggaagtgta

SEQ ID NO: 607771 - DNA, 25 bp, Rattus norvegicus
caagcaccgtggacgcatgcgctct

SEQ ID NO: 607772 - DNA, 25 bp, Rattus norvegicus
ctcgctccattacggtttgcatgta

SEQ ID NO: 607773 - DNA, 25 bp, Rattus norvegicus
cctcccaagtatttccaagagaaga

SEQ ID NO: 607774 - DNA, 25 bp, Rattus norvegicus
tggaacggaagcgaagcctttggca

SEQ ID NO: 607775 - DNA, 25 bp, Rattus norvegicus
aagaaatcttcgaggctgtggcatg

SEQ ID NO: 607776 - DNA, 25 bp, Rattus norvegicus
gcaggattcggtgcagatacgagcc

SEQ ID NO: 607777 - DNA, 25 bp, Rattus norvegicus
tacgagcctgcaacgcatttagggc

SEQ ID NO: 607778 - DNA, 25 bp, Rattus norvegicus
ctggcgagcacatggagaattgaga

SEQ ID NO: 607779 - DNA, 25 bp, Rattus norvegicus
ttgcatgtagtagtggtttccctcc

SEQ ID NO: 607780 - DNA, 25 bp, Rattus norvegicus
ggccaccgctatccttcacgtggga

SEQ ID NO: 607781 - DNA, 25 bp, Rattus norvegicus
cgggccttttcctgctcggttgcat

SEQ ID NO: 607782 - DNA, 25 bp, Rattus norvegicus
ccggaagaagccgagccaatgcgga

SEQ ID NO: 607783 - DNA, 25 bp, Rattus norvegicus
tccctgatctgctcgagtgagtgct

SEQ ID NO: 607784 - DNA, 25 bp, Rattus norvegicus
tacgacggcgccatgtccctgatct

SEQ ID NO: 607785 - DNA, 25 bp, Rattus norvegicus
aggcgactggcagcagcgctacgac

SEQ ID NO: 607786 - DNA, 25 bp, Rattus norvegicus
gagctagtccgggaacccgctgtga

SEQ ID NO: 607787 - DNA, 25 bp, Rattus norvegicus
gggcagctgtctacccgcgtccgag

SEQ ID NO: 607788 - DNA, 25 bp, Rattus norvegicus
cagttgtgcgagcatcgccacgccg

SEQ ID NO: 607789 - DNA, 25 bp, Rattus norvegicus
cccacgtgaagcagttgtgcgagca

SEQ ID NO: 607790 - DNA, 25 bp, Rattus norvegicus
tcctgctcggttgcatgctgggaaa

SEQ ID NO: 607791 - DNA, 25 bp, Rattus norvegicus
cgagccaatgcggaaacagccgagt

SEQ ID NO: 607792 - DNA, 25 bp, Rattus norvegicus
tttgcgcagtgatgcgcaattcacg

SEQ ID NO: 607793 - DNA, 25 bp, Rattus norvegicus
ccggccctgcgtgcagggtgcattt

SEQ ID NO: 607794 - DNA, 25 bp, Rattus norvegicus
gtttccgttagctgcagaaggctga

SEQ ID NO: 607795 - DNA, 25 bp, Rattus norvegicus
aatcctccctttgtgcagctttgta

SEQ ID NO: 607796 - DNA, 25 bp, Rattus norvegicus
acagtgccgcggaaccttctgaacc

SEQ ID NO: 607797 - DNA, 25 bp, Rattus norvegicus
cttgtagctttgcaccctcaggata

SEQ ID NO: 607798 - DNA, 25 bp, Rattus norvegicus
cctcaggatagctcggaaccctcta

SEQ ID NO: 607799 - DNA, 25 bp, Rattus norvegicus
cagtgccgcggaatcctcagaaatc

SEQ ID NO: 607800 - DNA, 25 bp, Rattus norvegicus
cgcttgcccgcaaacacggattgtg

SEQ ID NO: 607801 - DNA, 25 bp, Rattus norvegicus
gctgtggatcgccagtaaccctctg

SEQ ID NO: 607802 - DNA, 25 bp, Rattus norvegicus
aacgcgcggtcctgatcatagaacc

SEQ ID NO: 607803 - DNA, 25 bp, Rattus norvegicus
tggagccttacccttgcgtatagca

SEQ ID NO: 607804 - DNA, 25 bp, Rattus norvegicus
ctcgtgtagtttggaaccctcgtga

SEQ ID NO: 607805 - DNA, 25 bp, Rattus norvegicus
tcggaaaccttcaccctggcgctga

SEQ ID NO: 607806 - DNA, 25 bp, Rattus norvegicus
cctggaactcttagctggagccctc

SEQ ID NO: 607807 - DNA, 25 bp, Rattus norvegicus
tggaaccctcacctcgcgtggagtc

SEQ ID NO: 607808 - DNA, 25 bp, Rattus norvegicus
ggagctctcccttcgcggaatcatc

SEQ ID NO: 607809 - DNA, 25 bp, Rattus norvegicus
tggcggtgctcaacacagtacccta

SEQ ID NO: 607810 - DNA, 25 bp, Rattus norvegicus
gccttcatggtacctctggccatca

SEQ ID NO: 607811 - DNA, 25 bp, Rattus norvegicus
gtcagcaagttcctgttggccttca

SEQ ID NO: 607812 - DNA, 25 bp, Rattus norvegicus
gacaccacgtgcgactaccgtcaga

SEQ ID NO: 607813 - DNA, 25 bp, Rattus norvegicus
ctgctcttgaatccagggtctgacc

SEQ ID NO: 607814 - DNA, 25 bp, Rattus norvegicus
gtgctattacaacatgctgctcttg

SEQ ID NO: 607815 - DNA, 25 bp, Rattus norvegicus
ccctatttcgtgttcagggacacca

SEQ ID NO: 607816 - DNA, 25 bp, Rattus norvegicus
cgcgcacagagtctgcctgatgctc

SEQ ID NO: 607817 - DNA, 25 bp, Rattus norvegicus
tgagcctacaactgcatcaccgtgg

SEQ ID NO: 607818 - DNA, 25 bp, Rattus norvegicus
ggcagccatagtggtggccttcata

SEQ ID NO: 607819 - DNA, 25 bp, Rattus norvegicus
ggggccctaccacatcttcagtctg

SEQ ID NO: 607820 - DNA, 25 bp, Rattus norvegicus
attctgtcaccacgctacggcagct

SEQ ID NO: 607821 - DNA, 25 bp, Rattus norvegicus
cgagccacgtggctgtgagcctaca

SEQ ID NO: 607822 - DNA, 25 bp, Rattus norvegicus
gatggccgcatcatgtgctattaca

SEQ ID NO: 607823 - DNA, 25 bp, Rattus norvegicus
tcagactcgtctatttccgtaccgg

SEQ ID NO: 607824 - DNA, 25 bp, Rattus norvegicus
cgccttcatatgacgtcagactcgt

SEQ ID NO: 607825 - DNA, 25 bp, Rattus norvegicus
gtcggcgccttcatatgacgtcaga

SEQ ID NO: 607826 - DNA, 25 bp, Rattus norvegicus
cttcagaatcgtcggcgccttcata

SEQ ID NO: 607827 - DNA, 25 bp, Rattus norvegicus
gtctccgtagccttcagaatcgtcg

SEQ ID NO: 607828 - DNA, 25 bp, Rattus norvegicus
tcacgtgtagtctccgtagccttca

SEQ ID NO: 607829 - DNA, 25 bp, Rattus norvegicus
tacccatggctcacgtgtagtctcc

SEQ ID NO: 607830 - DNA, 25 bp, Rattus norvegicus
ggctgcgcctcagcggcgtacccat

SEQ ID NO: 607831 - DNA, 25 bp, Rattus norvegicus
tctggttgctgggtttccgcgatgc

SEQ ID NO: 607832 - DNA, 25 bp, Rattus norvegicus
tcgtctatttccgtaccgggcagga

SEQ ID NO: 607833 - DNA, 25 bp, Rattus norvegicus
ccgtaccgggcaggaagtgcgcact

SEQ ID NO: 607834 - DNA, 25 bp, Rattus norvegicus
cgtggaaaagcaggggatgtttgtc

SEQ ID NO: 607835 - DNA, 25 bp, Rattus norvegicus
tgggcttagtagacgcatgcgtgtt

SEQ ID NO: 607836 - DNA, 25 bp, Rattus norvegicus
tgttgtgtctggttgctgggtttcc

SEQ ID NO: 607837 - DNA, 25 bp, Rattus norvegicus
caagtgagcggcctggagcaactgc

SEQ ID NO: 607838 - DNA, 25 bp, Rattus norvegicus
cagggcgagagagcagcgctagcac

SEQ ID NO: 607839 - DNA, 25 bp, Rattus norvegicus
taagcgcgtcccaagtgagcggcct

SEQ ID NO: 607840 - DNA, 25 bp, Rattus norvegicus
tgtctcaggtaagcgcgtcccaagt

SEQ ID NO: 607841 - DNA, 25 bp, Rattus norvegicus
gccttgtctcaggtaagcgcgtccc

SEQ ID NO: 607842 - DNA, 25 bp, Rattus norvegicus
gcaggcgccttgtctcaggtaagcg

SEQ ID NO: 607843 - DNA, 25 bp, Rattus norvegicus
cggtccttcatcctggtccaggtga

SEQ ID NO: 607844 - DNA, 25 bp, Rattus norvegicus
agtcggtccttcatcctggtccagg

SEQ ID NO: 607845 - DNA, 25 bp, Rattus norvegicus
tgctccagtcggtccttcatcctgg

SEQ ID NO: 607846 - DNA, 25 bp, Rattus norvegicus
ttcagctgctccagtcggtccttca

SEQ ID NO: 607847 - DNA, 25 bp, Rattus norvegicus
gcggcggactcacggccttcagctg

SEQ ID NO: 607848 - DNA, 25 bp, Rattus norvegicus
aagcgcggcggactcacggccttca

SEQ ID NO: 607849 - DNA, 25 bp, Rattus norvegicus
gtcacttctcctgacggcggatccc

SEQ ID NO: 607850 - DNA, 25 bp, Rattus norvegicus
cggcggcaactctcgaggaggatcg

SEQ ID NO: 607851 - DNA, 25 bp, Rattus norvegicus
cccaagaatgttccgctacgaggtg

SEQ ID NO: 607852 - DNA, 25 bp, Rattus norvegicus
cccagtcagtgacgggaatctcgtg

SEQ ID NO: 607853 - DNA, 25 bp, Rattus norvegicus
tctcgtgactgaaaagcacagcgca

SEQ ID NO: 607854 - DNA, 25 bp, Rattus norvegicus
aggagccgcaagctcaggctctctg

SEQ ID NO: 607855 - DNA, 25 bp, Rattus norvegicus
gcgcagtgtcttgcctagggatctc

SEQ ID NO: 607856 - DNA, 25 bp, Rattus norvegicus
ccgccgctcacactaggaagtcaaa

SEQ ID NO: 607857 - DNA, 25 bp, Rattus norvegicus
gagtggctgcgaccggaaatgaccc

SEQ ID NO: 607858 - DNA, 25 bp, Rattus norvegicus
gagcccgttaagtgcggtaacctga

SEQ ID NO: 607859 - DNA, 25 bp, Rattus norvegicus
tttccttgcgcctccgctcgtggag

SEQ ID NO: 607860 - DNA, 25 bp, Rattus norvegicus
tggagctgccttggagacctgcatt

SEQ ID NO: 607861 - DNA, 25 bp, Rattus norvegicus
gacctgcattgctcctactccgtgg

SEQ ID NO: 607862 - DNA, 25 bp, Rattus norvegicus
gaatgcccacggaagcgtttcccgc

SEQ ID NO: 607863 - DNA, 25 bp, Rattus norvegicus
ttgcctagggatctctttcccgccg

SEQ ID NO: 607864 - DNA, 25 bp, Rattus norvegicus
acacacccgtgtgtacgcgggcagc

SEQ ID NO: 607865 - DNA, 25 bp, Rattus norvegicus
acgccgcttgtttaaaacagattga

SEQ ID NO: 607866 - DNA, 25 bp, Rattus norvegicus
tcaggcgagccacagaatgaagctg

SEQ ID NO: 607867 - DNA, 25 bp, Rattus norvegicus
caaaaagttcgcaagccccgtggtg

SEQ ID NO: 607868 - DNA, 25 bp, Rattus norvegicus
cacagaatgaagctggccctccgta

SEQ ID NO: 607869 - DNA, 25 bp, Rattus norvegicus
tgaagctggccctccgtatttgatg

SEQ ID NO: 607870 - DNA, 25 bp, Rattus norvegicus
cctccgtatttgatggggatgcgta

SEQ ID NO: 607871 - DNA, 25 bp, Rattus norvegicus
cgtagggaatgagacaggcgccctc

SEQ ID NO: 607872 - DNA, 25 bp, Rattus norvegicus
ccctctaggggcgacaaagatggag

SEQ ID NO: 607873 - DNA, 25 bp, Rattus norvegicus
tcacaaggacgcttcacgtagggtc

SEQ ID NO: 607874 - DNA, 25 bp, Rattus norvegicus
caaggacgcttcacgtagggtccgt

SEQ ID NO: 607875 - DNA, 25 bp, Rattus norvegicus
ttccttggttcaggcgagccacaga

SEQ ID NO: 607876 - DNA, 25 bp, Rattus norvegicus
aacagattgagttttccttggttca

SEQ ID NO: 607877 - DNA, 25 bp, Rattus norvegicus
acaggcgccctctaggggcgacaaa

SEQ ID NO: 607878 - DNA, 25 bp, Rattus norvegicus
cctgctcacaaggacgcttcacgta

SEQ ID NO: 607879 - DNA, 25 bp, Rattus norvegicus
tggggcgcgatccacgcggtcacca

SEQ ID NO: 607880 - DNA, 25 bp, Rattus norvegicus
gtacctaagtggatgcggactcctg

SEQ ID NO: 607881 - DNA, 25 bp, Rattus norvegicus
gggcaaaagccctggtgagacacgc

SEQ ID NO: 607882 - DNA, 25 bp, Rattus norvegicus
tgagacacgcttgtaggaacccggg

SEQ ID NO: 607883 - DNA, 25 bp, Rattus norvegicus
cggcgctgcgctgaaaagaaacaga

SEQ ID NO: 607884 - DNA, 25 bp, Rattus norvegicus
ttagtagctgcaaacttgggtcgcg

SEQ ID NO: 607885 - DNA, 25 bp, Rattus norvegicus
aagggcgcgcgtgctctctgcacca

SEQ ID NO: 607886 - DNA, 25 bp, Rattus norvegicus
ctgcaccaggggaccagagaaactc

SEQ ID NO: 607887 - DNA, 25 bp, Rattus norvegicus
gggagctcactttggcgctctgcca

SEQ ID NO: 607888 - DNA, 25 bp, Rattus norvegicus
cgacttctggcagccactggcagca

SEQ ID NO: 607889 - DNA, 25 bp, Rattus norvegicus
gagctgtgccaacgcggtcgccttg

SEQ ID NO: 607890 - DNA, 25 bp, Rattus norvegicus
gtcgccttgctccttgcggagagag

SEQ ID NO: 607891 - DNA, 25 bp, Rattus norvegicus
ttgcctgaacctgctgaccgagctg

SEQ ID NO: 607892 - DNA, 25 bp, Rattus norvegicus
agccaagcccaaggcgcaactggtg

SEQ ID NO: 607893 - DNA, 25 bp, Rattus norvegicus
acttccagtctccagtcgcaacgtg

SEQ ID NO: 607894 - DNA, 25 bp, Rattus norvegicus
tctccagtcgcaacgtggagggtcg

SEQ ID NO: 607895 - DNA, 25 bp, Rattus norvegicus
gtattccctccgtggcatggggtca

SEQ ID NO: 607896 - DNA, 25 bp, Rattus norvegicus
ttcgcggcctgtgggctcaaatccc

SEQ ID NO: 607897 - DNA, 25 bp, Rattus norvegicus
caggcccgggaagactcaccgaggc

SEQ ID NO: 607898 - DNA, 25 bp, Rattus norvegicus
cccatctaaccttgaagtcgttgcc

SEQ ID NO: 607899 - DNA, 25 bp, Rattus norvegicus
aagtcgttgccgctgaggtccacgc

SEQ ID NO: 607900 - DNA, 25 bp, Rattus norvegicus
ctccatggtggcgtagctctcctat

SEQ ID NO: 607901 - DNA, 25 bp, Rattus norvegicus
gcgtagctctcctatgggctaggaa

SEQ ID NO: 607902 - DNA, 25 bp, Rattus norvegicus
gaagtgctgctaggcgactcccaga

SEQ ID NO: 607903 - DNA, 25 bp, Rattus norvegicus
tcccagagcttcaggcctcgagttg

SEQ ID NO: 607904 - DNA, 25 bp, Rattus norvegicus
agcttcaggcctcgagttgtgggac

SEQ ID NO: 607905 - DNA, 25 bp, Rattus norvegicus
tcctgctggagacgatcaccacttc

SEQ ID NO: 607906 - DNA, 25 bp, Rattus norvegicus
gctggctagggcgtattccctccgt

SEQ ID NO: 607907 - DNA, 25 bp, Rattus norvegicus
agcctaagaagtagcctggacgtta

SEQ ID NO: 607908 - DNA, 25 bp, Rattus norvegicus
ctcttgaggggagaagtggtaaatt

SEQ ID NO: 607909 - DNA, 25 bp, Rattus norvegicus
gatactcggcctttctccggcggga

SEQ ID NO: 607910 - DNA, 25 bp, Rattus norvegicus
gctgctcgcagtctctgcaggcttc

SEQ ID NO: 607911 - DNA, 25 bp, Rattus norvegicus
cgtacagacacgcagcgagccaatc

SEQ ID NO: 607912 - DNA, 25 bp, Rattus norvegicus
atttgcgttgcagcttctcctttaa

SEQ ID NO: 607913 - DNA, 25 bp, Rattus norvegicus
ccaatcggggagaaggatcggctcc

SEQ ID NO: 607914 - DNA, 25 bp, Rattus norvegicus
ttcaaccaatcaggaaacggctctg

SEQ ID NO: 607915 - DNA, 25 bp, Rattus norvegicus
accgttaaacggctgcgtctcgcga

SEQ ID NO: 607916 - DNA, 25 bp, Rattus norvegicus
gcgtctcgcgacaatcccaaagtga

SEQ ID NO: 607917 - DNA, 25 bp, Rattus norvegicus
cccacctctggagttcagatcaagc

SEQ ID NO: 607918 - DNA, 25 bp, Rattus norvegicus
gtggcgaggacaaaacgcacctttc

SEQ ID NO: 607919 - DNA, 25 bp, Rattus norvegicus
cggaggcaccgctgttccctcaagg

SEQ ID NO: 607920 - DNA, 25 bp, Rattus norvegicus
tccctcaagggttcttactagccta

SEQ ID NO: 607921 - DNA, 25 bp, Rattus norvegicus
cgaggagctccgaccaataagtgca

SEQ ID NO: 607922 - DNA, 25 bp, Rattus norvegicus
taattggctgctattcctcggaatg

SEQ ID NO: 607923 - DNA, 25 bp, Rattus norvegicus
gaatggtcgcttcttccctgagagc

SEQ ID NO: 607924 - DNA, 25 bp, Rattus norvegicus
tgagagctagctcaaactcctttgg

SEQ ID NO: 607925 - DNA, 25 bp, Rattus norvegicus
tcctttggttcggaagaggtctcgc

SEQ ID NO: 607926 - DNA, 25 bp, Rattus norvegicus
agagcgaaacgcttgcggcttttta

SEQ ID NO: 607927 - DNA, 25 bp, Rattus norvegicus
ggcccaagaagcatcccgggagatg

SEQ ID NO: 607928 - DNA, 25 bp, Rattus norvegicus
ggatgcctccagattgactacagtc

SEQ ID NO: 607929 - DNA, 25 bp, Rattus norvegicus
accaatcggagatggctgaacatta

SEQ ID NO: 607930 - DNA, 25 bp, Rattus norvegicus
tttcaccgctgacaaatggcaagcc

SEQ ID NO: 607931 - DNA, 25 bp, Rattus norvegicus
cgagcgttcgaaccgcggaaacatt

SEQ ID NO: 607932 - DNA, 25 bp, Rattus norvegicus
ggagatttttcacttcacagcaacg

SEQ ID NO: 607933 - DNA, 25 bp, Rattus norvegicus
aatcgccgttctgtgttactgccca

SEQ ID NO: 607934 - DNA, 25 bp, Rattus norvegicus
cggctctaacaacgcgctctgtgta

SEQ ID NO: 607935 - DNA, 25 bp, Rattus norvegicus
ctgactgaagctgcaggtaaacacc

SEQ ID NO: 607936 - DNA, 25 bp, Rattus norvegicus
ctgagttctcagcacccggagctta

SEQ ID NO: 607937 - DNA, 25 bp, Rattus norvegicus
tgcataggagcacacttcggcctta

SEQ ID NO: 607938 - DNA, 25 bp, Rattus norvegicus
tggcattccggctcaccgatgtatc

SEQ ID NO: 607939 - DNA, 25 bp, Rattus norvegicus
taccgagtacggcagcttagcaggc

SEQ ID NO: 607940 - DNA, 25 bp, Rattus norvegicus
tggcttccatggtgctaaggcgaca

SEQ ID NO: 607941 - DNA, 25 bp, Rattus norvegicus
aacagcccgcgtctccggatgcaaa

SEQ ID NO: 607942 - DNA, 25 bp, Rattus norvegicus
acgcgcactgattggttctcactca

SEQ ID NO: 607943 - DNA, 25 bp, Rattus norvegicus
cattggccgcgctcactatcggagc

SEQ ID NO: 607944 - DNA, 25 bp, Rattus norvegicus
cgtgtgatcaattgctcctcctgga

SEQ ID NO: 607945 - DNA, 25 bp, Rattus norvegicus
acccgccttagcagtcaacgcaaga

SEQ ID NO: 607946 - DNA, 25 bp, Rattus norvegicus
gcgaggtgcctactgccttcgcaca

SEQ ID NO: 607947 - DNA, 25 bp, Rattus norvegicus
ttccctggcctctgaataacttcga

SEQ ID NO: 607948 - DNA, 25 bp, Rattus norvegicus
cgctccattagttcgctgtctcagg

SEQ ID NO: 607949 - DNA, 25 bp, Rattus norvegicus
cggcattgaagtccagcacgccatc

SEQ ID NO: 607950 - DNA, 25 bp, Rattus norvegicus
cgctgtgcgtcagagcgcaggccac

SEQ ID NO: 607951 - DNA, 25 bp, Rattus norvegicus
acagagtcgatcatgacccgcagcc

SEQ ID NO: 607952 - DNA, 25 bp, Rattus norvegicus
tcgcgcagtcgcgacggagcttcac

SEQ ID NO: 607953 - DNA, 25 bp, Rattus norvegicus
tgcagcgcgcacaggtactcatagt

SEQ ID NO: 607954 - DNA, 25 bp, Rattus norvegicus
gcagccggtcggcattgaagtccag

SEQ ID NO: 607955 - DNA, 25 bp, Rattus norvegicus
ggtcacggttcaccctgagcgagct

SEQ ID NO: 607956 - DNA, 25 bp, Rattus norvegicus
gccaccagcggcaggtcacggttca

SEQ ID NO: 607957 - DNA, 25 bp, Rattus norvegicus
aaggagctcttgatggccaccagcg

SEQ ID NO: 607958 - DNA, 25 bp, Rattus norvegicus
tcgcacctccggaccgtagaactga

SEQ ID NO: 607959 - DNA, 25 bp, Rattus norvegicus
ccgacgcgacaacctcagtggaggc

SEQ ID NO: 607960 - DNA, 25 bp, Rattus norvegicus
acggagcttcacagagtcgatcatg

SEQ ID NO: 607961 - DNA, 25 bp, Rattus norvegicus
cggcggcaaaactcctttgtggcta

SEQ ID NO: 607962 - DNA, 25 bp, Rattus norvegicus
ctcatagtgcgagaagaagtcggtc

SEQ ID NO: 607963 - DNA, 25 bp, Rattus norvegicus
tggggcgcaccatgcccacgttcga

SEQ ID NO: 607964 - DNA, 25 bp, Rattus norvegicus
gcctgacgggtgtcaccttcgcctt

SEQ ID NO: 607965 - DNA, 25 bp, Rattus norvegicus
cgtgttcctgctgctgtgcctgacg

SEQ ID NO: 607966 - DNA, 25 bp, Rattus norvegicus
cgccttcctcttcgttggtgtggtc

SEQ ID NO: 607967 - DNA, 25 bp, Rattus norvegicus
ggcagccagcccgactactattggt

SEQ ID NO: 607968 - DNA, 25 bp, Rattus norvegicus
cgactactattggtgtcgcgggccc

SEQ ID NO: 607969 - DNA, 25 bp, Rattus norvegicus
agccctgaggaggagtggaacctca

SEQ ID NO: 607970 - DNA, 25 bp, Rattus norvegicus
gtggaacctcaccacgccggagctt

SEQ ID NO: 607971 - DNA, 25 bp, Rattus norvegicus
cggagcttcacgtcccagctgagcg

SEQ ID NO: 607972 - DNA, 25 bp, Rattus norvegicus
gtggccaaggccactgtcaccgcta

SEQ ID NO: 607973 - DNA, 25 bp, Rattus norvegicus
ccacgttcgaccaggcgctgaggaa

SEQ ID NO: 607974 - DNA, 25 bp, Rattus norvegicus
actgtcaccgctacctgctggaaga

SEQ ID NO: 607975 - DNA, 25 bp, Rattus norvegicus
ggaagacaccaataccagctcagag

SEQ ID NO: 607976 - DNA, 25 bp, Rattus norvegicus
tgtggtcttcctgggcagccagccc

SEQ ID NO: 607977 - DNA, 25 bp, Rattus norvegicus
agggcaggccgaggacgccatattc

SEQ ID NO: 607978 - DNA, 25 bp, Rattus norvegicus
cgtgggcacccatcagggctcccgc

SEQ ID NO: 607979 - DNA, 25 bp, Rattus norvegicus
caaaggactgtgttcgccggccggc

SEQ ID NO: 607980 - DNA, 25 bp, Rattus norvegicus
cccgcggcagccaaaggactgtgtt

SEQ ID NO: 607981 - DNA, 25 bp, Rattus norvegicus
gggcaggccgaggacgccatattct

SEQ ID NO: 607982 - DNA, 25 bp, Rattus norvegicus
gcttgagcggccgtgaccgctgctc

SEQ ID NO: 607983 - DNA, 25 bp, Rattus norvegicus
gccaaaggactgtgttcgccggccg

SEQ ID NO: 607984 - DNA, 25 bp, Rattus norvegicus
agccaaaggactgtgttcgccggcc

SEQ ID NO: 607985 - DNA, 25 bp, Rattus norvegicus
gcagccaaaggactgtgttcgccgg

SEQ ID NO: 607986 - DNA, 25 bp, Rattus norvegicus
cggcagccaaaggactgtgttcgcc

SEQ ID NO: 607987 - DNA, 25 bp, Rattus norvegicus
cgcggcagccaaaggactgtgttcg

SEQ ID NO: 607988 - DNA, 25 bp, Rattus norvegicus
gcccgcggcagccaaaggactgtgt

SEQ ID NO: 607989 - DNA, 25 bp, Rattus norvegicus
ggacgccatattctcgccgaccacg

SEQ ID NO: 607990 - DNA, 25 bp, Rattus norvegicus
cccgggctcgcgcagagggaagcgg

SEQ ID NO: 607991 - DNA, 25 bp, Rattus norvegicus
cacagcttagggcagcatcggcagc

SEQ ID NO: 607992 - DNA, 25 bp, Rattus norvegicus
tcagctagggccgtgctctgtgcgc

SEQ ID NO: 607993 - DNA, 25 bp, Rattus norvegicus
agctgcgcagggacaagcgcgacgc

SEQ ID NO: 607994 - DNA, 25 bp, Rattus norvegicus
atcaacgacgagatcgagcggcagc

SEQ ID NO: 607995 - DNA, 25 bp, Rattus norvegicus
cccggaggatcaacgacgagatcga

SEQ ID NO: 607996 - DNA, 25 bp, Rattus norvegicus
caaggaagcccggaggatcaacgac

SEQ ID NO: 607997 - DNA, 25 bp, Rattus norvegicus
ctgcctgagcgaggaggccaaggaa

SEQ ID NO: 607998 - DNA, 25 bp, Rattus norvegicus
cttcggaagaatgactctggagtcc

SEQ ID NO: 607999 - DNA, 25 bp, Rattus norvegicus
tgcagcgaggcacttcggaagaatg

SEQ ID NO: 608000 - DNA, 25 bp, Rattus norvegicus
ctccctgagctcgtccctgacgcgc

SEQ ID NO: 608001 - DNA, 25 bp, Rattus norvegicus
cggtgtgcgccttcggtgtcagcta

SEQ ID NO: 608002 - DNA, 25 bp, Rattus norvegicus
cgctctccaagaaggcggcgtgtga

SEQ ID NO: 608003 - DNA, 25 bp, Rattus norvegicus
ctgggcgcacagcttagggcagcat

SEQ ID NO: 608004 - DNA, 25 bp, Rattus norvegicus
ggcggcctttcctcgcgcgtcccag

SEQ ID NO: 608005 - DNA, 25 bp, Rattus norvegicus
gtcgcttagcaacagaacaccagtc

SEQ ID NO: 608006 - DNA, 25 bp, Rattus norvegicus
gtggtgctaaccgacaggaacgccc

SEQ ID NO: 608007 - DNA, 25 bp, Rattus norvegicus
agcctttccttacagcccagggaga

SEQ ID NO: 608008 - DNA, 25 bp, Rattus norvegicus
cacagaaggaaggtagccgctcgca

SEQ ID NO: 608009 - DNA, 25 bp, Rattus norvegicus
gctccacctatggtgcgggtgctgc

SEQ ID NO: 608010 - DNA, 25 bp, Rattus norvegicus
gaacaccattttcctcagccacgga

SEQ ID NO: 608011 - DNA, 25 bp, Rattus norvegicus
tagtctccgaggaaccggttcaaca

SEQ ID NO: 608012 - DNA, 25 bp, Rattus norvegicus
tccaggttcaccacatagtctccga

SEQ ID NO: 608013 - DNA, 25 bp, Rattus norvegicus
cgttacctttccaaatgcccagaga

SEQ ID NO: 608014 - DNA, 25 bp, Rattus norvegicus
ccgctttacataacttgaagggcga

SEQ ID NO: 608015 - DNA, 25 bp, Rattus norvegicus
gcacggagacgcaaggcttcagtca

SEQ ID NO: 608016 - DNA, 25 bp, Rattus norvegicus
aaggatggctcccttgcccagcaga

SEQ ID NO: 608017 - DNA, 25 bp, Rattus norvegicus
gcctggccttcacgtgcaagtcggc

SEQ ID NO: 608018 - DNA, 25 bp, Rattus norvegicus
cagtccgggcgtggttatgaaaagt

SEQ ID NO: 608019 - DNA, 25 bp, Rattus norvegicus
gttctcgaacatgtcaccgcagtca

SEQ ID NO: 608020 - DNA, 25 bp, Rattus norvegicus
tggcacagagccttgactggcaccc

SEQ ID NO: 608021 - DNA, 25 bp, Rattus norvegicus
aggccacacggagcccacaacattg

SEQ ID NO: 608022 - DNA, 25 bp, Rattus norvegicus
cacaacattgccgagctggcctggc

SEQ ID NO: 608023 - DNA, 25 bp, Rattus norvegicus
actgggtagcccaagtggtgcatga

SEQ ID NO: 608024 - DNA, 25 bp, Rattus norvegicus
tggtgcatgaccgacgccaaaggca

SEQ ID NO: 608025 - DNA, 25 bp, Rattus norvegicus
gtcccgcccgatgatgttctctata

SEQ ID NO: 608026 - DNA, 25 bp, Rattus norvegicus
ttctctatagcgaacgggtgtttga

SEQ ID NO: 608027 - DNA, 25 bp, Rattus norvegicus
cctcctgcatcttgccgggatggga

SEQ ID NO: 608028 - DNA, 25 bp, Rattus norvegicus
gtctgcgcgcagcaccttgaagcgc

SEQ ID NO: 608029 - DNA, 25 bp, Rattus norvegicus
aggctctggtttgccgagtggcaca

SEQ ID NO: 608030 - DNA, 25 bp, Rattus norvegicus
tccgagggatcttgatgaagcagtc

SEQ ID NO: 608031 - DNA, 25 bp, Rattus norvegicus
gtgtagcgcccagaaactgccctta

SEQ ID NO: 608032 - DNA, 25 bp, Rattus norvegicus
ctgctggtggaaatagggcaccatg

SEQ ID NO: 608033 - DNA, 25 bp, Rattus norvegicus
tcacagccgtctgagcagcagctgc

SEQ ID NO: 608034 - DNA, 25 bp, Rattus norvegicus
tcacatgaccgaggctgagggactc

SEQ ID NO: 608035 - DNA, 25 bp, Rattus norvegicus
ttcgagactatcacatgaccgaggc

SEQ ID NO: 608036 - DNA, 25 bp, Rattus norvegicus
gcttgcgcttcgagactatcacatg

SEQ ID NO: 608037 - DNA, 25 bp, Rattus norvegicus
ctgcagcttgcgcttcgagactatc

SEQ ID NO: 608038 - DNA, 25 bp, Rattus norvegicus
cctggctgcgttttgtaatggtccc

SEQ ID NO: 608039 - DNA, 25 bp, Rattus norvegicus
gcgctctcctggctgcgttttgtaa

SEQ ID NO: 608040 - DNA, 25 bp, Rattus norvegicus
cgtctgcgtagacaggctagaaccc

SEQ ID NO: 608041 - DNA, 25 bp, Rattus norvegicus
atgaccgaggctgagggactccgcc

SEQ ID NO: 608042 - DNA, 25 bp, Rattus norvegicus
gtcctcacagccgtctgagcagcag

SEQ ID NO: 608043 - DNA, 25 bp, Rattus norvegicus
gagcagcagctgcagtcgctctgcc

SEQ ID NO: 608044 - DNA, 25 bp, Rattus norvegicus
ttttgagaagaagcgctgctgtggc

SEQ ID NO: 608045 - DNA, 25 bp, Rattus norvegicus
cccgcgggttttgagaagaagcgct

SEQ ID NO: 608046 - DNA, 25 bp, Rattus norvegicus
tagacaggctagaacccggctcgcc

SEQ ID NO: 608047 - DNA, 25 bp, Rattus norvegicus
tggcccttgcttgcgccttagccaa

SEQ ID NO: 608048 - DNA, 25 bp, Rattus norvegicus
atcggggctaggagtcgtctcctta

SEQ ID NO: 608049 - DNA, 25 bp, Rattus norvegicus
cgggagagactttagagtctaacgc

SEQ ID NO: 608050 - DNA, 25 bp, Rattus norvegicus
caggagcccgcgtcctgattagatg

SEQ ID NO: 608051 - DNA, 25 bp, Rattus norvegicus
cctgattagatggagggcccggatt

SEQ ID NO: 608052 - DNA, 25 bp, Rattus norvegicus
gcccggattctagaggaagatgccc

SEQ ID NO: 608053 - DNA, 25 bp, Rattus norvegicus
aagatgcccgtctctggcttctcgg

SEQ ID NO: 608054 - DNA, 25 bp, Rattus norvegicus
gtgcagggcttccttcagaagggcc

SEQ ID NO: 608055 - DNA, 25 bp, Rattus norvegicus
tctacaggctgtgatccacgggtcc

SEQ ID NO: 608056 - DNA, 25 bp, Rattus norvegicus
agcgactcgccaggctcctaagctt

SEQ ID NO: 608057 - DNA, 25 bp, Rattus norvegicus
cttagccaatgagagcgcccgccat

SEQ ID NO: 608058 - DNA, 25 bp, Rattus norvegicus
cagagtccgacctccgtggatagga

SEQ ID NO: 608059 - DNA, 25 bp, Rattus norvegicus
cccagcaagtcagatcggggctagg

SEQ ID NO: 608060 - DNA, 25 bp, Rattus norvegicus
cgacttgcgcgatcaccttccgatg

SEQ ID NO: 608061 - DNA, 25 bp, Rattus norvegicus
gtgggtcactcctactccggttcaa

SEQ ID NO: 608062 - DNA, 25 bp, Rattus norvegicus
cgtcttcagcctaggcgagccaaca

SEQ ID NO: 608063 - DNA, 25 bp, Rattus norvegicus
ccgcagctgccacctagagttagtc

SEQ ID NO: 608064 - DNA, 25 bp, Rattus norvegicus
acccggaacctttcagctgagaggc

SEQ ID NO: 608065 - DNA, 25 bp, Rattus norvegicus
tgcggggacaaaccagactgcaacg

SEQ ID NO: 608066 - DNA, 25 bp, Rattus norvegicus
cccaatgaggggaagactttttctg

SEQ ID NO: 608067 - DNA, 25 bp, Rattus norvegicus
ctttctggggtcagctgaggacatt

SEQ ID NO: 608068 - DNA, 25 bp, Rattus norvegicus
gttacggttacagacaaatgggcca

SEQ ID NO: 608069 - DNA, 25 bp, Rattus norvegicus
gttcaaccctgcaggctgtggtcta

SEQ ID NO: 608070 - DNA, 25 bp, Rattus norvegicus
ggcagctgcgcatctgatgcttaaa

SEQ ID NO: 608071 - DNA, 25 bp, Rattus norvegicus
gagactcgagacacctcctttctgg

SEQ ID NO: 608072 - DNA, 25 bp, Rattus norvegicus
atgtggcatctcttcctcgggattc

SEQ ID NO: 608073 - DNA, 25 bp, Rattus norvegicus
agcggagcgacctcgcgaattctca

SEQ ID NO: 608074 - DNA, 25 bp, Rattus norvegicus
ggaattcctcggacgtccacagtta

SEQ ID NO: 608075 - DNA, 25 bp, Rattus norvegicus
agagatcccgttcaagtccccgcag

SEQ ID NO: 608076 - DNA, 25 bp, Rattus norvegicus
aagcaagaaggctcagtcccggccg

SEQ ID NO: 608077 - DNA, 25 bp, Rattus norvegicus
gcaccgcgtcaggagggcaccgcgg

SEQ ID NO: 608078 - DNA, 25 bp, Rattus norvegicus
gctcccgggcggcacacccactttc

SEQ ID NO: 608079 - DNA, 25 bp, Rattus norvegicus
cacccactttccttattaggacaga

SEQ ID NO: 608080 - DNA, 25 bp, Rattus norvegicus
tttccttattaggacagagtcggag

SEQ ID NO: 608081 - DNA, 25 bp, Rattus norvegicus
gcaagcggcccagaggaagcaagaa

SEQ ID NO: 608082 - DNA, 25 bp, Rattus norvegicus
ccggcccgcctagggagcggctggt

SEQ ID NO: 608083 - DNA, 25 bp, Rattus norvegicus
ggtccctgcgcagagcgaccacttt

SEQ ID NO: 608084 - DNA, 25 bp, Rattus norvegicus
ctgcgcagagcgaccactttctaga

SEQ ID NO: 608085 - DNA, 25 bp, Rattus norvegicus
gcagagcgaccactttctagagatc

SEQ ID NO: 608086 - DNA, 25 bp, Rattus norvegicus
gcgaccactttctagagatcccgtt

SEQ ID NO: 608087 - DNA, 25 bp, Rattus norvegicus
ctttctagagatcccgttcaagtcc

SEQ ID NO: 608088 - DNA, 25 bp, Rattus norvegicus
ccactttctagagatcccgttcaag

SEQ ID NO: 608089 - DNA, 25 bp, Rattus norvegicus
caagcgaatactggcgcgctcagcc

SEQ ID NO: 608090 - DNA, 25 bp, Rattus norvegicus
gctggatcggatcgccaagcgaata

SEQ ID NO: 608091 - DNA, 25 bp, Rattus norvegicus
cctgcagggcgcatgaaagagcgct

SEQ ID NO: 608092 - DNA, 25 bp, Rattus norvegicus
attacctggagcctgtgcctgcagg

SEQ ID NO: 608093 - DNA, 25 bp, Rattus norvegicus
ctggcccggcctagattacctggag

SEQ ID NO: 608094 - DNA, 25 bp, Rattus norvegicus
gatacggctcggtactgtccagctc

SEQ ID NO: 608095 - DNA, 25 bp, Rattus norvegicus
cagtcctgcccgttagatacggctc

SEQ ID NO: 608096 - DNA, 25 bp, Rattus norvegicus
gaagaggactcctgctccatcctag

SEQ ID NO: 608097 - DNA, 25 bp, Rattus norvegicus
tgacttctagatgccacgtgtaccc

SEQ ID NO: 608098 - DNA, 25 bp, Rattus norvegicus
taagcccttactcattgctccggtg

SEQ ID NO: 608099 - DNA, 25 bp, Rattus norvegicus
acaaacgtctctacgctgggctgtg

SEQ ID NO: 608100 - DNA, 25 bp, Rattus norvegicus
tccgtcggacgaacaaggagtcaca

SEQ ID NO: 608101 - DNA, 25 bp, Rattus norvegicus
ctccggtgcgggaaagagtagtcaa

SEQ ID NO: 608102 - DNA, 25 bp, Rattus norvegicus
gctgtggccttacgaagtttaagtc

SEQ ID NO: 608103 - DNA, 25 bp, Rattus norvegicus
ctcctgctgctagcgacgagctgcg

SEQ ID NO: 608104 - DNA, 25 bp, Rattus norvegicus
ccggtagcctggctcctgctgctag

SEQ ID NO: 608105 - DNA, 25 bp, Rattus norvegicus
gcctcaactgcaggggttgtaccgg

SEQ ID NO: 608106 - DNA, 25 bp, Rattus norvegicus
ggacgaggttggtcgcctccacaac

SEQ ID NO: 608107 - DNA, 25 bp, Rattus norvegicus
tcgcctccacaacgacgctaagatg

SEQ ID NO: 608108 - DNA, 25 bp, Rattus norvegicus
acgacgctaagatgggcgaggcttc

SEQ ID NO: 608109 - DNA, 25 bp, Rattus norvegicus
cgaggcttctagacggagccgcaac

SEQ ID NO: 608110 - DNA, 25 bp, Rattus norvegicus
cttctagacggagccgcaacggcgg

SEQ ID NO: 608111 - DNA, 25 bp, Rattus norvegicus
gggctagcctgactgagcaacggaa

SEQ ID NO: 608112 - DNA, 25 bp, Rattus norvegicus
cctgactgagcaacggaagccgagc

SEQ ID NO: 608113 - DNA, 25 bp, Rattus norvegicus
cctgggccgcagatccgtgcgttct

SEQ ID NO: 608114 - DNA, 25 bp, Rattus norvegicus
cgtgcgttctctgcggttgtcgcaa

SEQ ID NO: 608115 - DNA, 25 bp, Rattus norvegicus
ctctgcggttgtcgcaattccgacc

SEQ ID NO: 608116 - DNA, 25 bp, Rattus norvegicus
cagggaacccggtagcctggctcct

SEQ ID NO: 608117 - DNA, 25 bp, Rattus norvegicus
gccggcgatcttcactgcccagtgg

SEQ ID NO: 608118 - DNA, 25 bp, Rattus norvegicus
ctccgctcgaggactcttcgtttgc

SEQ ID NO: 608119 - DNA, 25 bp, Rattus norvegicus
aggctcttagaccatccctggggca

SEQ ID NO: 608120 - DNA, 25 bp, Rattus norvegicus
gcacaactaacttctccggcctggg

SEQ ID NO: 608121 - DNA, 25 bp, Rattus norvegicus
ctaagcggcgcgcacaactaacttc

SEQ ID NO: 608122 - DNA, 25 bp, Rattus norvegicus
tgcccagtggttggtgtagacacgc

SEQ ID NO: 608123 - DNA, 25 bp, Rattus norvegicus
agcagcgcccgctccgcataaatga

SEQ ID NO: 608124 - DNA, 25 bp, Rattus norvegicus
gctatgcggtctgcctccgcgaatc

SEQ ID NO: 608125 - DNA, 25 bp, Rattus norvegicus
tgaatccgtacttgctggctatgcg

SEQ ID NO: 608126 - DNA, 25 bp, Rattus norvegicus
tacctgtcctacgttgatgaatccg

SEQ ID NO: 608127 - DNA, 25 bp, Rattus norvegicus
caaacgactagcttctgggtgcaga

SEQ ID NO: 608128 - DNA, 25 bp, Rattus norvegicus
ccgcagctgcagaggcacatctgga

SEQ ID NO: 608129 - DNA, 25 bp, Rattus norvegicus
agcccagagcatcgccctagagttc

SEQ ID NO: 608130 - DNA, 25 bp, Rattus norvegicus
gcagtgccagcacgcacagcagatc

SEQ ID NO: 608131 - DNA, 25 bp, Rattus norvegicus
ggtggactgtctttctccttccagg

SEQ ID NO: 608132 - DNA, 25 bp, Rattus norvegicus
gtcaaccctgcagccgccatggagg

SEQ ID NO: 608133 - DNA, 25 bp, Rattus norvegicus
tgatttactaaggaccagtgcgctc

SEQ ID NO: 608134 - DNA, 25 bp, Rattus norvegicus
aagatggctgctgcgcgcacggctc

SEQ ID NO: 608135 - DNA, 25 bp, Rattus norvegicus
gaggcggagtcgagtcactccctca

SEQ ID NO: 608136 - DNA, 25 bp, Rattus norvegicus
gacccgccgcggtcatgcggagctt

SEQ ID NO: 608137 - DNA, 25 bp, Rattus norvegicus
tggtgcacggatgagagacgccatc

SEQ ID NO: 608138 - DNA, 25 bp, Rattus norvegicus
gggccacccagcgacacctgattta

SEQ ID NO: 608139 - DNA, 25 bp, Rattus norvegicus
caacccgagccggagtcggagtgct

SEQ ID NO: 608140 - DNA, 25 bp, Rattus norvegicus
tcggaggccaagctcctgagcgacc

SEQ ID NO: 608141 - DNA, 25 bp, Rattus norvegicus
ccgctcaggcttggatctgtgatcc

SEQ ID NO: 608142 - DNA, 25 bp, Rattus norvegicus
tccttccaggaaaagacaggcgtcg

SEQ ID NO: 608143 - DNA, 25 bp, Rattus norvegicus
gacaggcgtcgtgcctcttgtctcc

SEQ ID NO: 608144 - DNA, 25 bp, Rattus norvegicus
cggcccttgcagtagtgctcccggg

SEQ ID NO: 608145 - DNA, 25 bp, Rattus norvegicus
ccctgcttaggggaggttatgaaag

SEQ ID NO: 608146 - DNA, 25 bp, Rattus norvegicus
cggcagttgtgtgcttgaaaccgtc

SEQ ID NO: 608147 - DNA, 25 bp, Rattus norvegicus
cttgacagcgacacgccgaaatatg

SEQ ID NO: 608148 - DNA, 25 bp, Rattus norvegicus
aacgtcctggcgagcagtgcataca

SEQ ID NO: 608149 - DNA, 25 bp, Rattus norvegicus
cgcgcagaactcttacctggtttga

SEQ ID NO: 608150 - DNA, 25 bp, Rattus norvegicus
gccagccggtcaagaactccaactt

SEQ ID NO: 608151 - DNA, 25 bp, Rattus norvegicus
tgctcaggtgagcaaccggcagttg

SEQ ID NO: 608152 - DNA, 25 bp, Rattus norvegicus
ttcgaacccgctttggtgagtactc

SEQ ID NO: 608153 - DNA, 25 bp, Rattus norvegicus
gtgagtactcactgctcgctgcgta

SEQ ID NO: 608154 - DNA, 25 bp, Rattus norvegicus
tccagagtctcctgcgctgtacctg

SEQ ID NO: 608155 - DNA, 25 bp, Rattus norvegicus
gtacctggaacctgactgccgcaag

SEQ ID NO: 608156 - DNA, 25 bp, Rattus norvegicus
tgactgccgcaagggaaaccgcgtt

SEQ ID NO: 608157 - DNA, 25 bp, Rattus norvegicus
gtgcatacagagtccgagggcgctc

SEQ ID NO: 608158 - DNA, 25 bp, Rattus norvegicus
tgaaaccgtcttgcagcctgctctg

SEQ ID NO: 608159 - DNA, 25 bp, Rattus norvegicus
cctcgtggctggttcgcggagccca

SEQ ID NO: 608160 - DNA, 25 bp, Rattus norvegicus
gtattcgttcgtcagcgcgtcgtag

SEQ ID NO: 608161 - DNA, 25 bp, Rattus norvegicus
ttcgtcagcgcgtcgtagcggaagc

SEQ ID NO: 608162 - DNA, 25 bp, Rattus norvegicus
gccgctgcgactttagcctcgttgt

SEQ ID NO: 608163 - DNA, 25 bp, Rattus norvegicus
actttagcctcgttgtcggcgcgtg

SEQ ID NO: 608164 - DNA, 25 bp, Rattus norvegicus
gtcccgaaaccctggcggagcgcag

SEQ ID NO: 608165 - DNA, 25 bp, Rattus norvegicus
cgcgagcacttctggaaggtcatta

SEQ ID NO: 608166 - DNA, 25 bp, Rattus norvegicus
cttctggaaggtcattaacgcgttc

SEQ ID NO: 608167 - DNA, 25 bp, Rattus norvegicus
cgctactacgggtaaggcgcgccct

SEQ ID NO: 608168 - DNA, 25 bp, Rattus norvegicus
gccctctaagcgtattcgttcgtca

SEQ ID NO: 608169 - DNA, 25 bp, Rattus norvegicus
gctggttcgcggagcccacggtcac

SEQ ID NO: 608170 - DNA, 25 bp, Rattus norvegicus
cacctgcgcgcggtcctaagggact

SEQ ID NO: 608171 - DNA, 25 bp, Rattus norvegicus
gcggtcctaagggactgcttcccac

SEQ ID NO: 608172 - DNA, 25 bp, Rattus norvegicus
cattaacgcgttccgctactacggg

SEQ ID NO: 608173 - DNA, 25 bp, Rattus norvegicus
tgcaacaaaacagaaggccaccagg

SEQ ID NO: 608174 - DNA, 25 bp, Rattus norvegicus
gaccatggccgaacctgcgtctgca

SEQ ID NO: 608175 - DNA, 25 bp, Rattus norvegicus
ctcacgttccgcgtgccttggaagc

SEQ ID NO: 608176 - DNA, 25 bp, Rattus norvegicus
tcgggacgtcccgagctcagtgcca

SEQ ID NO: 608177 - DNA, 25 bp, Rattus norvegicus
tgtgttgcggctccctcaacgtccg

SEQ ID NO: 608178 - DNA, 25 bp, Rattus norvegicus
caggttcgaatctccggcgctgtgt

SEQ ID NO: 608179 - DNA, 25 bp, Rattus norvegicus
gggtgtagcagcttcctacaaacta

SEQ ID NO: 608180 - DNA, 25 bp, Rattus norvegicus
cgtgaacccgaacaaccgtgcaaca

SEQ ID NO: 608181 - DNA, 25 bp, Rattus norvegicus
ggatgcacctacgtgaacccgaaca

SEQ ID NO: 608182 - DNA, 25 bp, Rattus norvegicus
ttcgcttagggacagggatgcacct

SEQ ID NO: 608183 - DNA, 25 bp, Rattus norvegicus
tacccgtgtcgtcgcctgttcgctt

SEQ ID NO: 608184 - DNA, 25 bp, Rattus norvegicus
tgcacgagattcacagcacagagga

SEQ ID NO: 608185 - DNA, 25 bp, Rattus norvegicus
gggataagcaaacacctccgctgca

SEQ ID NO: 608186 - DNA, 25 bp, Rattus norvegicus
cgcatcacggcgcaggttcgaatct

SEQ ID NO: 608187 - DNA, 25 bp, Rattus norvegicus
gcgtatctaactgcgatctggaata

SEQ ID NO: 608188 - DNA, 25 bp, Rattus norvegicus
tgaagttttggcaaccgcgtggacc

SEQ ID NO: 608189 - DNA, 25 bp, Rattus norvegicus
tcctggtctccggagtccaagtcct

SEQ ID NO: 608190 - DNA, 25 bp, Rattus norvegicus
tagtctccacccgaacatgattatc

SEQ ID NO: 608191 - DNA, 25 bp, Rattus norvegicus
cagggccgagcggaaactgaaccca

SEQ ID NO: 608192 - DNA, 25 bp, Rattus norvegicus
tcctgcacccgatcgaggttccgag

SEQ ID NO: 608193 - DNA, 25 bp, Rattus norvegicus
gtccgctgctattgcggagctcctg

SEQ ID NO: 608194 - DNA, 25 bp, Rattus norvegicus
tccaagtcctggaggaatccagtcc

SEQ ID NO: 608195 - DNA, 25 bp, Rattus norvegicus
aggaatccgctgtcgcttcggctcc

SEQ ID NO: 608196 - DNA, 25 bp, Rattus norvegicus
cttcggctcctgtggtggtgagaat

SEQ ID NO: 608197 - DNA, 25 bp, Rattus norvegicus
tgcaggtcaaggtaaaaagttcggc

SEQ ID NO: 608198 - DNA, 25 bp, Rattus norvegicus
aaagttcggcctgaagatgttctca

SEQ ID NO: 608199 - DNA, 25 bp, Rattus norvegicus
gatgttctcattggctccggtccgc

SEQ ID NO: 608200 - DNA, 25 bp, Rattus norvegicus
cccgcagtctttcttccgggagttg

SEQ ID NO: 608201 - DNA, 25 bp, Rattus norvegicus
cgattggagcgaaggcctgcttatc

SEQ ID NO: 608202 - DNA, 25 bp, Rattus norvegicus
tccagcgttcctttcgggtcatttg

SEQ ID NO: 608203 - DNA, 25 bp, Rattus norvegicus
tgcgcaggagttgtgcgctccgatt

SEQ ID NO: 608204 - DNA, 25 bp, Rattus norvegicus
gctccgattggagcgaaggcctgct

SEQ ID NO: 608205 - DNA, 25 bp, Rattus norvegicus
ggcctgcttatccagcgttcctttc

SEQ ID NO: 608206 - DNA, 25 bp, Rattus norvegicus
cagcgttcctttcgggtcatttgcc

SEQ ID NO: 608207 - DNA, 25 bp, Rattus norvegicus
ggggtctggacgctccattcctaag

SEQ ID NO: 608208 - DNA, 25 bp, Rattus norvegicus
tctggacgctccattcctaagcggg

SEQ ID NO: 608209 - DNA, 25 bp, Rattus norvegicus
gacgctccattcctaagcgggtcct

SEQ ID NO: 608210 - DNA, 25 bp, Rattus norvegicus
ccgcgtccttgggtccatgcgctga

SEQ ID NO: 608211 - DNA, 25 bp, Rattus norvegicus
tccatgcgctgacgctcggacgcag

SEQ ID NO: 608212 - DNA, 25 bp, Rattus norvegicus
acgctcggacgcaggtacagctaca

SEQ ID NO: 608213 - DNA, 25 bp, Rattus norvegicus
acgcaggtacagctacagcgcaggg

SEQ ID NO: 608214 - DNA, 25 bp, Rattus norvegicus
gcgaaggcctgcttatccagcgttc

SEQ ID NO: 608215 - DNA, 25 bp, Rattus norvegicus
tgtagtcatgaagctcccagcccga

SEQ ID NO: 608216 - DNA, 25 bp, Rattus norvegicus
gagctttcagttgcctctacccaaa

SEQ ID NO: 608217 - DNA, 25 bp, Rattus norvegicus
cttccagctctctctccggtgttgt

SEQ ID NO: 608218 - DNA, 25 bp, Rattus norvegicus
cgacgcgcaggaaagattcagagca

SEQ ID NO: 608219 - DNA, 25 bp, Rattus norvegicus
tccagaactgggagacgcgattagc

SEQ ID NO: 608220 - DNA, 25 bp, Rattus norvegicus
ttccaagcccattccatttgcagtc

SEQ ID NO: 608221 - DNA, 25 bp, Rattus norvegicus
ctgcgaaccgaactcggggagctgc

SEQ ID NO: 608222 - DNA, 25 bp, Rattus norvegicus
ctccgggtctagctagagttgtcct

SEQ ID NO: 608223 - DNA, 25 bp, Rattus norvegicus
ccgcgtgcttgcttacctcgcatga

SEQ ID NO: 608224 - DNA, 25 bp, Rattus norvegicus
ctgtcctgctccgtgtagtcatgaa

SEQ ID NO: 608225 - DNA, 25 bp, Rattus norvegicus
tcggcgtagaactgctccgctgaga

SEQ ID NO: 608226 - DNA, 25 bp, Rattus norvegicus
tgagagaagcatccctttaggcaga

SEQ ID NO: 608227 - DNA, 25 bp, Rattus norvegicus
cctttaggcagatgtcgtggccaca

SEQ ID NO: 608228 - DNA, 25 bp, Rattus norvegicus
ttacctcgcatgatgtggccgctgt

SEQ ID NO: 608229 - DNA, 25 bp, Rattus norvegicus
ggagcacgcccgatcagcgagcaca

SEQ ID NO: 608230 - DNA, 25 bp, Rattus norvegicus
cccgaacgctggtcagagctagagc

SEQ ID NO: 608231 - DNA, 25 bp, Rattus norvegicus
gagctagagcgtcagtcgtccggat

SEQ ID NO: 608232 - DNA, 25 bp, Rattus norvegicus
gtgactaggctacggtgaccgcagc

SEQ ID NO: 608233 - DNA, 25 bp, Rattus norvegicus
aatagaagcgctgcctccttggacc

SEQ ID NO: 608234 - DNA, 25 bp, Rattus norvegicus
agcgagcacaaagaccggcccgact

SEQ ID NO: 608235 - DNA, 25 bp, Rattus norvegicus
tttccctcagatcccgaacgctggt

SEQ ID NO: 608236 - DNA, 25 bp, Rattus norvegicus
ggcgcagctccatctgcggtccgat

SEQ ID NO: 608237 - DNA, 25 bp, Rattus norvegicus
gcctcggtgcttctgcacgaacaaa

SEQ ID NO: 608238 - DNA, 25 bp, Rattus norvegicus
gaagcccgaagagcgccgtcctcgg

SEQ ID NO: 608239 - DNA, 25 bp, Rattus norvegicus
cgcagcttccctggcgaacgcggaa

SEQ ID NO: 608240 - DNA, 25 bp, Rattus norvegicus
agctgtgtgcatctcgtcgtcagtc

SEQ ID NO: 608241 - DNA, 25 bp, Rattus norvegicus
ggctggccgaccagacaatggctga

SEQ ID NO: 608242 - DNA, 25 bp, Rattus norvegicus
ccgaccgggttttcgctgacgcaca

SEQ ID NO: 608243 - DNA, 25 bp, Rattus norvegicus
cgatgcccactcactttgccgctgt

SEQ ID NO: 608244 - DNA, 25 bp, Rattus norvegicus
gtgatcgcgaagcacctccatgggg

SEQ ID NO: 608245 - DNA, 25 bp, Rattus norvegicus
ctcacgccaagaaggtgatcgcgaa

SEQ ID NO: 608246 - DNA, 25 bp, Rattus norvegicus
ttgccgctgtcgctcacgccaagaa

SEQ ID NO: 608247 - DNA, 25 bp, Rattus norvegicus
caggagcgaaccctgaacgcgcggt

SEQ ID NO: 608248 - DNA, 25 bp, Rattus norvegicus
gctcgctctacaggagcgaaccctg

SEQ ID NO: 608249 - DNA, 25 bp, Rattus norvegicus
ttcactgaccaaagagggtgcaccg

SEQ ID NO: 608250 - DNA, 25 bp, Rattus norvegicus
tccaggtggagtggacgaaagtccc

SEQ ID NO: 608251 - DNA, 25 bp, Rattus norvegicus
aagcacctccatggggcaggtccag

SEQ ID NO: 608252 - DNA, 25 bp, Rattus norvegicus
cggggcagcgcaagttcactgacca

SEQ ID NO: 608253 - DNA, 25 bp, Rattus norvegicus
gtggacgaaagtccctcggaagatg

SEQ ID NO: 608254 - DNA, 25 bp, Rattus norvegicus
gtccctcggaagatgagcgccagct

SEQ ID NO: 608255 - DNA, 25 bp, Rattus norvegicus
aagatgagcgccagctgcggcgtcc

SEQ ID NO: 608256 - DNA, 25 bp, Rattus norvegicus
gtccgagccgcacacatggcagcag

SEQ ID NO: 608257 - DNA, 25 bp, Rattus norvegicus
gtagcgactccgctgcgcagtttgt

SEQ ID NO: 608258 - DNA, 25 bp, Rattus norvegicus
cttcctcagacccaaggtgcaggtc

SEQ ID NO: 608259 - DNA, 25 bp, Rattus norvegicus
ggtccagctttcttcgaatctagaa

SEQ ID NO: 608260 - DNA, 25 bp, Rattus norvegicus
cattggctcgaacgcggctgtctat

SEQ ID NO: 608261 - DNA, 25 bp, Rattus norvegicus
acctgtctccggctccgtagcgtag

SEQ ID NO: 608262 - DNA, 25 bp, Rattus norvegicus
tccagtcagtgaccagctcgagccg

SEQ ID NO: 608263 - DNA, 25 bp, Rattus norvegicus
ttagtcagcagaacgcgaacgcgcg

SEQ ID NO: 608264 - DNA, 25 bp, Rattus norvegicus
aacgcgcgtgaaggggccacacgaa

SEQ ID NO: 608265 - DNA, 25 bp, Rattus norvegicus
gggcaccgcagctctcattcgcgtt

SEQ ID NO: 608266 - DNA, 25 bp, Rattus norvegicus
ggagcaaccgaacagagacccgcgc

SEQ ID NO: 608267 - DNA, 25 bp, Rattus norvegicus
gtcccggcagcctcgattttagatg

SEQ ID NO: 608268 - DNA, 25 bp, Rattus norvegicus
attttagatggagtccgctcggagc

SEQ ID NO: 608269 - DNA, 25 bp, Rattus norvegicus
gctcggagcttgagcagggtatccc

SEQ ID NO: 608270 - DNA, 25 bp, Rattus norvegicus
ccgtcgtttcgattggctcttcttt

SEQ ID NO: 608271 - DNA, 25 bp, Rattus norvegicus
tggccatcgcttagacacctgagta

SEQ ID NO: 608272 - DNA, 25 bp, Rattus norvegicus
ggaacgcgccctgccgctattgtct

SEQ ID NO: 608273 - DNA, 25 bp, Rattus norvegicus
tgccgctgaattcagaccggcagcg

SEQ ID NO: 608274 - DNA, 25 bp, Rattus norvegicus
cgaactgcttctcctacggcgtagg

SEQ ID NO: 608275 - DNA, 25 bp, Rattus norvegicus
gaaggatccaagagcgccaagccgg

SEQ ID NO: 608276 - DNA, 25 bp, Rattus norvegicus
ccgctattgtctcggggccgcacaa

SEQ ID NO: 608277 - DNA, 25 bp, Rattus norvegicus
acctgcgcaccttggcgtcttggag

SEQ ID NO: 608278 - DNA, 25 bp, Rattus norvegicus
gctgcttaggggaccctatcgagcc

SEQ ID NO: 608279 - DNA, 25 bp, Rattus norvegicus
gcgctgagtcttcgtctgcaacttg

SEQ ID NO: 608280 - DNA, 25 bp, Rattus norvegicus
ggcgttcttcctgccgagggcagtt

SEQ ID NO: 608281 - DNA, 25 bp, Rattus norvegicus
ggtagtcatctacagccgaaggtca

SEQ ID NO: 608282 - DNA, 25 bp, Rattus norvegicus
tttttccgagaagcacaacatcctg

SEQ ID NO: 608283 - DNA, 25 bp, Rattus norvegicus
acacctgagtagaccgacgctagga

SEQ ID NO: 608284 - DNA, 25 bp, Rattus norvegicus
gttttcgcgaactcccaggtagtca

SEQ ID NO: 608285 - DNA, 25 bp, Rattus norvegicus
ggttgccttcatccactactgcctg

SEQ ID NO: 608286 - DNA, 25 bp, Rattus norvegicus
tctgcttgggcccaagacctaaagt

SEQ ID NO: 608287 - DNA, 25 bp, Rattus norvegicus
ctgcttgggcccaagacctaaagtc

SEQ ID NO: 608288 - DNA, 25 bp, Rattus norvegicus
tgcttgggcccaagacctaaagtcc

SEQ ID NO: 608289 - DNA, 25 bp, Rattus norvegicus
tctcggttgccttcatccactactg

SEQ ID NO: 608290 - DNA, 25 bp, Rattus norvegicus
tgccttcatccactactgcctgctc

SEQ ID NO: 608291 - DNA, 25 bp, Rattus norvegicus
ttcatccactactgcctgctcttca

SEQ ID NO: 608292 - DNA, 25 bp, Rattus norvegicus
actactgcctgctcttcatctcttc

SEQ ID NO: 608293 - DNA, 25 bp, Rattus norvegicus
tcatctcttccctgcaaccctgatc

SEQ ID NO: 608294 - DNA, 25 bp, Rattus norvegicus
atctcttccctgcaaccctgatccc

SEQ ID NO: 608295 - DNA, 25 bp, Rattus norvegicus
acctcacccacttgaccagccgctg

SEQ ID NO: 608296 - DNA, 25 bp, Rattus norvegicus
ccagccgctggaccaggccgctgcc

SEQ ID NO: 608297 - DNA, 25 bp, Rattus norvegicus
cgagatccgggcgaaccgggctggc

SEQ ID NO: 608298 - DNA, 25 bp, Rattus norvegicus
taaagtcccctctcggttgccttca

SEQ ID NO: 608299 - DNA, 25 bp, Rattus norvegicus
ggcaggcactcacgtacctatcatg

SEQ ID NO: 608300 - DNA, 25 bp, Rattus norvegicus
agcgctaagccttctgggagtcgta

SEQ ID NO: 608301 - DNA, 25 bp, Rattus norvegicus
cctcgcgcactaagcgggcctagtg

SEQ ID NO: 608302 - DNA, 25 bp, Rattus norvegicus
tctgtcaggtttagtcatccaggcc

SEQ ID NO: 608303 - DNA, 25 bp, Rattus norvegicus
cccaccagcgtttctgtcaggttta

SEQ ID NO: 608304 - DNA, 25 bp, Rattus norvegicus
ctagcggctcgtagtgttgatcagt

SEQ ID NO: 608305 - DNA, 25 bp, Rattus norvegicus
cggagagattgtacctggcaggcac

SEQ ID NO: 608306 - DNA, 25 bp, Rattus norvegicus
cacccgatccggctattggcgggca

SEQ ID NO: 608307 - DNA, 25 bp, Rattus norvegicus
tggggactggaaactcacacttatg

SEQ ID NO: 608308 - DNA, 25 bp, Rattus norvegicus
cgagcaccgggctaaccttggctaa

SEQ ID NO: 608309 - DNA, 25 bp, Rattus norvegicus
agatgccctcttcagcgagcaccgg

SEQ ID NO: 608310 - DNA, 25 bp, Rattus norvegicus
taagattagcctcagacgggtgccg

SEQ ID NO: 608311 - DNA, 25 bp, Rattus norvegicus
ggtgtccgtgaaagatgccctcttc

SEQ ID NO: 608312 - DNA, 25 bp, Rattus norvegicus
acctatcatggtcaccgggagggtg

SEQ ID NO: 608313 - DNA, 25 bp, Rattus norvegicus
aggctgctctgatcgcgagggcagc

SEQ ID NO: 608314 - DNA, 25 bp, Rattus norvegicus
catgggcaagaagtggagggacgcg

SEQ ID NO: 608315 - DNA, 25 bp, Rattus norvegicus
cgctgctaagcatgggcaagaagtg

SEQ ID NO: 608316 - DNA, 25 bp, Rattus norvegicus
gccacgctgctaagcatgggcaaga

SEQ ID NO: 608317 - DNA, 25 bp, Rattus norvegicus
ccggccacgctgctaagcatgggca

SEQ ID NO: 608318 - DNA, 25 bp, Rattus norvegicus
gagagctgagcgcaggctgctgcga

SEQ ID NO: 608319 - DNA, 25 bp, Rattus norvegicus
agcctactaggcgaaggcggcgcag

SEQ ID NO: 608320 - DNA, 25 bp, Rattus norvegicus
ctttacggagctccggctcaggcgg

SEQ ID NO: 608321 - DNA, 25 bp, Rattus norvegicus
agctttacggagctccggctcaggc

SEQ ID NO: 608322 - DNA, 25 bp, Rattus norvegicus
ggcagctttacggagctccggctca

SEQ ID NO: 608323 - DNA, 25 bp, Rattus norvegicus
cctgctggcagctttacggagctcc

SEQ ID NO: 608324 - DNA, 25 bp, Rattus norvegicus
cagcctgctggcagctttacggagc

SEQ ID NO: 608325 - DNA, 25 bp, Rattus norvegicus
agcgcagcctgctggcagctttacg

SEQ ID NO: 608326 - DNA, 25 bp, Rattus norvegicus
cgcaagcgcagcctgctggcagctt

SEQ ID NO: 608327 - DNA, 25 bp, Rattus norvegicus
cccaatctagggcagtttgttcaac

SEQ ID NO: 608328 - DNA, 25 bp, Rattus norvegicus
gtgtctggcgctcgttggacaaaga

SEQ ID NO: 608329 - DNA, 25 bp, Rattus norvegicus
cccggcttggattggcttataaatg

SEQ ID NO: 608330 - DNA, 25 bp, Rattus norvegicus
ggacaccgggtcgaaagacttcatg

SEQ ID NO: 608331 - DNA, 25 bp, Rattus norvegicus
cttcatgcgtgtgcgcgtagctctt

SEQ ID NO: 608332 - DNA, 25 bp, Rattus norvegicus
cacggttcctgcaaagtcatctcca

SEQ ID NO: 608333 - DNA, 25 bp, Rattus norvegicus
tgcggtgcggactatgtttagaagc

SEQ ID NO: 608334 - DNA, 25 bp, Rattus norvegicus
tcgcgacaccctactctgcagtgtt

SEQ ID NO: 608335 - DNA, 25 bp, Rattus norvegicus
cgcagggcaggttttcctgatcttc

SEQ ID NO: 608336 - DNA, 25 bp, Rattus norvegicus
aggggccagcaaccttcccttgtca

SEQ ID NO: 608337 - DNA, 25 bp, Rattus norvegicus
tttcaaggttagctcacgtgggcac

SEQ ID NO: 608338 - DNA, 25 bp, Rattus norvegicus
cgcccggagctccttgcacgagttt

SEQ ID NO: 608339 - DNA, 25 bp, Rattus norvegicus
cgtgagcgctatatttaccaagggg

SEQ ID NO: 608340 - DNA, 25 bp, Rattus norvegicus
ctgcagcaaagggagcttgatgttc

SEQ ID NO: 608341 - DNA, 25 bp, Rattus norvegicus
tgacgtgatgggattctgcgaaatt

SEQ ID NO: 608342 - DNA, 25 bp, Rattus norvegicus
ttactgagctggagaatgccggagc

SEQ ID NO: 608343 - DNA, 25 bp, Rattus norvegicus
cgcctggctagcagttggctttccc

SEQ ID NO: 608344 - DNA, 25 bp, Rattus norvegicus
ctcggacacgtttgcagtcgaataa

SEQ ID NO: 608345 - DNA, 25 bp, Rattus norvegicus
aataaacttgcgaccgccacgtgtg

SEQ ID NO: 608346 - DNA, 25 bp, Rattus norvegicus
tggcatctctccaaggaaccggctc

SEQ ID NO: 608347 - DNA, 25 bp, Rattus norvegicus
gaggcgctgccggttacgtaaagat

SEQ ID NO: 608348 - DNA, 25 bp, Rattus norvegicus
cctacatggacttcgtggctgccca

SEQ ID NO: 608349 - DNA, 25 bp, Rattus norvegicus
agtgtctggtttccatctccaaccg

SEQ ID NO: 608350 - DNA, 25 bp, Rattus norvegicus
ctgcgactacctgagcgcgaggtga

SEQ ID NO: 608351 - DNA, 25 bp, Rattus norvegicus
ctggaaggattattgcacactggtc

SEQ ID NO: 608352 - DNA, 25 bp, Rattus norvegicus
ggtcaccatcgccaagagcttgttg

SEQ ID NO: 608353 - DNA, 25 bp, Rattus norvegicus
ggacctgaacaaataccgacccatc

SEQ ID NO: 608354 - DNA, 25 bp, Rattus norvegicus
gcgccgtagttctagacgcacctct

SEQ ID NO: 608355 - DNA, 25 bp, Rattus norvegicus
caaagtaggcggtgtcgctttcacc

SEQ ID NO: 608356 - DNA, 25 bp, Rattus norvegicus
cgttggatagcaagtcggcgattcc

SEQ ID NO: 608357 - DNA, 25 bp, Rattus norvegicus
tcgctttcacctgggcttcgggtac

SEQ ID NO: 608358 - DNA, 25 bp, Rattus norvegicus
cacagcgctgtctaactttatgggc

SEQ ID NO: 608359 - DNA, 25 bp, Rattus norvegicus
ctttatgggcgttcctcgaggaagc

SEQ ID NO: 608360 - DNA, 25 bp, Rattus norvegicus
cctcgaggaagcagaacctaaatgc

SEQ ID NO: 608361 - DNA, 25 bp, Rattus norvegicus
ttcgggtacccacagcgctgtctaa

SEQ ID NO: 608362 - DNA, 25 bp, Rattus norvegicus
acccgcctcatacgaccgttggata

SEQ ID NO: 608363 - DNA, 25 bp, Rattus norvegicus
cggcgattcctttggcagcgtcgtt

SEQ ID NO: 608364 - DNA, 25 bp, Rattus norvegicus
gcgtcgtttttctccgccacgcaga

SEQ ID NO: 608365 - DNA, 25 bp, Rattus norvegicus
cgccacgcagaggacttttcgcact

SEQ ID NO: 608366 - DNA, 25 bp, Rattus norvegicus
aaggctacttccatggcagcgcggg

SEQ ID NO: 608367 - DNA, 25 bp, Rattus norvegicus
tttcgcactcctcggaaggctactt

SEQ ID NO: 608368 - DNA, 25 bp, Rattus norvegicus
aaatgcttcttacccgcctcatacg

SEQ ID NO: 608369 - DNA, 25 bp, Rattus norvegicus
tctcgggagagacctcttggaagcc

SEQ ID NO: 608370 - DNA, 25 bp, Rattus norvegicus
agcatctctcgggagagacctcttg

SEQ ID NO: 608371 - DNA, 25 bp, Rattus norvegicus
cgggaactcggaggaagcatctctc

SEQ ID NO: 608372 - DNA, 25 bp, Rattus norvegicus
ttcccactcggagtcgccatcctgg

SEQ ID NO: 608373 - DNA, 25 bp, Rattus norvegicus
cgtcgggttcgagttctttctcttg

SEQ ID NO: 608374 - DNA, 25 bp, Rattus norvegicus
ttgagccctccacgaagagtccgga

SEQ ID NO: 608375 - DNA, 25 bp, Rattus norvegicus
acgattgagccctccacgaagagtc

SEQ ID NO: 608376 - DNA, 25 bp, Rattus norvegicus
gccactcacaagaagttctccatgg

SEQ ID NO: 608377 - DNA, 25 bp, Rattus norvegicus
ttctccatggcgatgcggacgattg

SEQ ID NO: 608378 - DNA, 25 bp, Rattus norvegicus
ggcctgccgccactcacaagaagtt

SEQ ID NO: 608379 - DNA, 25 bp, Rattus norvegicus
ttaggggcagcagctttcccactcg

SEQ ID NO: 608380 - DNA, 25 bp, Rattus norvegicus
tctttctcttgctcgggaactcgga

SEQ ID NO: 608381 - DNA, 25 bp, Rattus norvegicus
atggcgatgcggacgattgagccct

SEQ ID NO: 608382 - DNA, 25 bp, Rattus norvegicus
tccacgaagagtccggacggccgcg

SEQ ID NO: 608383 - DNA, 25 bp, Rattus norvegicus
cgcacatgtgagttgagcgccctgc

SEQ ID NO: 608384 - DNA, 25 bp, Rattus norvegicus
aggtgcgtgggagaccctccttcct

SEQ ID NO: 608385 - DNA, 25 bp, Rattus norvegicus
cacgtccgagcgtggagtttttgcc

SEQ ID NO: 608386 - DNA, 25 bp, Rattus norvegicus
ccagctggccgttaccaggacgcgt

SEQ ID NO: 608387 - DNA, 25 bp, Rattus norvegicus
cgcgtccctggagttgtggcaactc

SEQ ID NO: 608388 - DNA, 25 bp, Rattus norvegicus
cttccgcaggaacccgcacatgtga

SEQ ID NO: 608389 - DNA, 25 bp, Rattus norvegicus
ggacatcactaacgccttccgcagg

SEQ ID NO: 608390 - DNA, 25 bp, Rattus norvegicus
caaagggtggtgaaggacatcacta

SEQ ID NO: 608391 - DNA, 25 bp, Rattus norvegicus
ccaacatggccgagacgaacgagga

SEQ ID NO: 608392 - DNA, 25 bp, Rattus norvegicus
ggcctctgcaagagcgcgcctaagc

SEQ ID NO: 608393 - DNA, 25 bp, Rattus norvegicus
ttcctgacccggaagtgctcggagg

SEQ ID NO: 608394 - DNA, 25 bp, Rattus norvegicus
ttcaatcaacgacaagagctggccc

SEQ ID NO: 608395 - DNA, 25 bp, Rattus norvegicus
ctccacgcctagtgaaccaaaattc

SEQ ID NO: 608396 - DNA, 25 bp, Rattus norvegicus
agcgacctcggagagccacgtccga

SEQ ID NO: 608397 - DNA, 25 bp, Rattus norvegicus
cgccgcattgcaagcgtttagcctt

SEQ ID NO: 608398 - DNA, 25 bp, Rattus norvegicus
ttccagccctggaagcgggaaagct

SEQ ID NO: 608399 - DNA, 25 bp, Rattus norvegicus
cgggaaagctgcgtgtcactaagca

SEQ ID NO: 608400 - DNA, 25 bp, Rattus norvegicus
ctaagcaagagaacacgcggcactg

SEQ ID NO: 608401 - DNA, 25 bp, Rattus norvegicus
gcactgtgtcctaagcgtggccaga

SEQ ID NO: 608402 - DNA, 25 bp, Rattus norvegicus
cacgcagagatctggccagggatga

SEQ ID NO: 608403 - DNA, 25 bp, Rattus norvegicus
aggcagccacgtagtccattccagg

SEQ ID NO: 608404 - DNA, 25 bp, Rattus norvegicus
ccattccaggttcccgaccatgaga

SEQ ID NO: 608405 - DNA, 25 bp, Rattus norvegicus
gcagctggagagcagctttattccc

SEQ ID NO: 608406 - DNA, 25 bp, Rattus norvegicus
ttattcccaggcttggcacggtcgc

SEQ ID NO: 608407 - DNA, 25 bp, Rattus norvegicus
gcttgtttctctcgagcccacgcgg

SEQ ID NO: 608408 - DNA, 25 bp, Rattus norvegicus
aagggtgtgtaccagagagatgcca

SEQ ID NO: 608409 - DNA, 25 bp, Rattus norvegicus
cggccagaagcccagcttgtttctc

SEQ ID NO: 608410 - DNA, 25 bp, Rattus norvegicus
ccagctgtcaggcaaggtaccaccg

SEQ ID NO: 608411 - DNA, 25 bp, Rattus norvegicus
gggctatgtctacacgcaccggctc

SEQ ID NO: 608412 - DNA, 25 bp, Rattus norvegicus
ggaggccatcgaagaagtgaaaacc

SEQ ID NO: 608413 - DNA, 25 bp, Rattus norvegicus
gagagcggcttccacaaccacacgg

SEQ ID NO: 608414 - DNA, 25 bp, Rattus norvegicus
ggaagccatgaacgccgcctactcg

SEQ ID NO: 608415 - DNA, 25 bp, Rattus norvegicus
acgccgacgatgagagcgcctacgc

SEQ ID NO: 608416 - DNA, 25 bp, Rattus norvegicus
agtgaaaaccaggaccatccgttcg

SEQ ID NO: 608417 - DNA, 25 bp, Rattus norvegicus
ccaggagcacgtgtacgaggagatc

SEQ ID NO: 608418 - DNA, 25 bp, Rattus norvegicus
cctacccgcgcatggacagttatga

SEQ ID NO: 608419 - DNA, 25 bp, Rattus norvegicus
aggacatcgaccagatcgtggccga

SEQ ID NO: 608420 - DNA, 25 bp, Rattus norvegicus
agagcatgagctcgcagagcctcga

SEQ ID NO: 608421 - DNA, 25 bp, Rattus norvegicus
ttggtcagcggtacagcaaggaaaa

SEQ ID NO: 608422 - DNA, 25 bp, Rattus norvegicus
agggatgccatctcgctggccatca

SEQ ID NO: 608423 - DNA, 25 bp, Rattus norvegicus
catcaaggacatcaaggaggccatc

SEQ ID NO: 608424 - DNA, 25 bp, Rattus norvegicus
tgcacttccactcgctggagcacga

SEQ ID NO: 608425 - DNA, 25 bp, Rattus norvegicus
tctcggtcacccacggtgacaagtg

SEQ ID NO: 608426 - DNA, 25 bp, Rattus norvegicus
aactagcggcccaaccgttctcaga

SEQ ID NO: 608427 - DNA, 25 bp, Rattus norvegicus
ggcccaaccgttctcagagtctgtc

SEQ ID NO: 608428 - DNA, 25 bp, Rattus norvegicus
caaccgtggcgccaagggacgcgtc

SEQ ID NO: 608429 - DNA, 25 bp, Rattus norvegicus
gcgtcgttgacccaggtccctcaga

SEQ ID NO: 608430 - DNA, 25 bp, Rattus norvegicus
ctggcgacctttaaataggaaggag

SEQ ID NO: 608431 - DNA, 25 bp, Rattus norvegicus
ttaaataggaaggagtcccgcgtgc

SEQ ID NO: 608432 - DNA, 25 bp, Rattus norvegicus
cctccacgcccggaggaggtgctgt

SEQ ID NO: 608433 - DNA, 25 bp, Rattus norvegicus
aggacactcgctggacgttaccgcc

SEQ ID NO: 608434 - DNA, 25 bp, Rattus norvegicus
ccgcccgggaatgcaaccgtatcta

SEQ ID NO: 608435 - DNA, 25 bp, Rattus norvegicus
acggtgacaagtgcgccgtcgcctt

SEQ ID NO: 608436 - DNA, 25 bp, Rattus norvegicus
attcccggttctgtcgttgcagctc

SEQ ID NO: 608437 - DNA, 25 bp, Rattus norvegicus
cttctacggagaattcccggttctg

SEQ ID NO: 608438 - DNA, 25 bp, Rattus norvegicus
caaccgtatctatggcttctacgga

SEQ ID NO: 608439 - DNA, 25 bp, Rattus norvegicus
gctccgatccttaagatactttcta

SEQ ID NO: 608440 - DNA, 25 bp, Rattus norvegicus
cagctcattgtcagtggagggcgcc

SEQ ID NO: 608441 - DNA, 25 bp, Rattus norvegicus
tggctcatccagctcattgtcagtg

SEQ ID NO: 608442 - DNA, 25 bp, Rattus norvegicus
accagcgggtcctcagctggctcat

SEQ ID NO: 608443 - DNA, 25 bp, Rattus norvegicus
tgatggaatacaccagcgggtcctc

SEQ ID NO: 608444 - DNA, 25 bp, Rattus norvegicus
cctcatgctgcaccggctctgagga

SEQ ID NO: 608445 - DNA, 25 bp, Rattus norvegicus
tcgtggcctcgcagcctgcagcaag

SEQ ID NO: 608446 - DNA, 25 bp, Rattus norvegicus
gcgggctcccagtaagccttcctag

SEQ ID NO: 608447 - DNA, 25 bp, Rattus norvegicus
gccacagccatgtaggcgcgggctc

SEQ ID NO: 608448 - DNA, 25 bp, Rattus norvegicus
ccgatcacagccacagccatgtagg

SEQ ID NO: 608449 - DNA, 25 bp, Rattus norvegicus
aacgtcacgttctgactccactttc

SEQ ID NO: 608450 - DNA, 25 bp, Rattus norvegicus
gtcctccgctccgatccttaagata

SEQ ID NO: 608451 - DNA, 25 bp, Rattus norvegicus
ctgcagcaagctgcccacggtgtgc

SEQ ID NO: 608452 - DNA, 25 bp, Rattus norvegicus
gatactttctacagcaccctcgtgg

SEQ ID NO: 608453 - DNA, 25 bp, Rattus norvegicus
agcgctcatagtctcggtcgtagtc

SEQ ID NO: 608454 - DNA, 25 bp, Rattus norvegicus
ctcggtcgtagtccctgtcgatgct

SEQ ID NO: 608455 - DNA, 25 bp, Rattus norvegicus
accgtaggtgttctcggctgcggct

SEQ ID NO: 608456 - DNA, 25 bp, Rattus norvegicus
gctccgttcatagcgggtctctgga

SEQ ID NO: 608457 - DNA, 25 bp, Rattus norvegicus
tggatgggctctgcggtcataagat

SEQ ID NO: 608458 - DNA, 25 bp, Rattus norvegicus
cataagatgggctgtagcggccttc

SEQ ID NO: 608459 - DNA, 25 bp, Rattus norvegicus
agcggccttcgtagtcaggctcata

SEQ ID NO: 608460 - DNA, 25 bp, Rattus norvegicus
cgtagtcaggctcataggcttggtg

SEQ ID NO: 608461 - DNA, 25 bp, Rattus norvegicus
tgtcgatgctccgtccacggctgta

SEQ ID NO: 608462 - DNA, 25 bp, Rattus norvegicus
aggcttggtgataggagcgctcata

SEQ ID NO: 608463 - DNA, 25 bp, Rattus norvegicus
catggtccaggccacgttccaggct

SEQ ID NO: 608464 - DNA, 25 bp, Rattus norvegicus
cacggctgtagtcccgggacacaaa

SEQ ID NO: 608465 - DNA, 25 bp, Rattus norvegicus
ccgggacacaaagtcgcggtctaga

SEQ ID NO: 608466 - DNA, 25 bp, Rattus norvegicus
ctgcgcccgtagtcttcatggtcca

SEQ ID NO: 608467 - DNA, 25 bp, Rattus norvegicus
aagacactgcggtgcgggcgcctac

SEQ ID NO: 608468 - DNA, 25 bp, Rattus norvegicus
agcgatccgacggtcgggtccctcg

SEQ ID NO: 608469 - DNA, 25 bp, Rattus norvegicus
cagcacacggcgatgcgaggcccgt

SEQ ID NO: 608470 - DNA, 25 bp, Rattus norvegicus
tggctccaggggaaacctcgctgga

SEQ ID NO: 608471 - DNA, 25 bp, Rattus norvegicus
tccaggggaaacctcgctggagtcc

SEQ ID NO: 608472 - DNA, 25 bp, Rattus norvegicus
gtgcgggcgcctacgccgactcagt

SEQ ID NO: 608473 - DNA, 25 bp, Rattus norvegicus
cgactcagtccaccgccacctagca

SEQ ID NO: 608474 - DNA, 25 bp, Rattus norvegicus
aactccgccgccaagtgagtgagga

SEQ ID NO: 608475 - DNA, 25 bp, Rattus norvegicus
cacggctacgtgtcggcacacgtga

SEQ ID NO: 608476 - DNA, 25 bp, Rattus norvegicus
cccagtgaagcaacaggacgttaaa

SEQ ID NO: 608477 - DNA, 25 bp, Rattus norvegicus
caaactatagtaacgcgcgcggacg

SEQ ID NO: 608478 - DNA, 25 bp, Rattus norvegicus
tgcgccgcctgaactgaggcgaact

SEQ ID NO: 608479 - DNA, 25 bp, Rattus norvegicus
tcagcctcacggctacgtgtcggca

SEQ ID NO: 608480 - DNA, 25 bp, Rattus norvegicus
ggtgcgcacgcgtgtgccatctccg

SEQ ID NO: 608481 - DNA, 25 bp, Rattus norvegicus
agcagcaggaggctcccgagctctc

SEQ ID NO: 608482 - DNA, 25 bp, Rattus norvegicus
gaagctttgcttcggaggtggccta

SEQ ID NO: 608483 - DNA, 25 bp, Rattus norvegicus
ttctcctccagagaacgactgggga

SEQ ID NO: 608484 - DNA, 25 bp, Rattus norvegicus
ggggttctcacagacaacgattgcg

SEQ ID NO: 608485 - DNA, 25 bp, Rattus norvegicus
acactgtttaaagaacatctcgggg

SEQ ID NO: 608486 - DNA, 25 bp, Rattus norvegicus
gcgcgtccggaggaacactgtttaa

SEQ ID NO: 608487 - DNA, 25 bp, Rattus norvegicus
cacgctggccgacggggaaactcca

SEQ ID NO: 608488 - DNA, 25 bp, Rattus norvegicus
cgccgcgcgcttagaagccagcaag

SEQ ID NO: 608489 - DNA, 25 bp, Rattus norvegicus
aattacaagctgcagtggcggaccc

SEQ ID NO: 608490 - DNA, 25 bp, Rattus norvegicus
tgtcatgcgctctgactccggccgg

SEQ ID NO: 608491 - DNA, 25 bp, Rattus norvegicus
gggcagtgtcatgcgctctgactcc

SEQ ID NO: 608492 - DNA, 25 bp, Rattus norvegicus
gctcgccgcggctcagaattacaag

SEQ ID NO: 608493 - DNA, 25 bp, Rattus norvegicus
ggaggaaacttacgcgctgccagcc

SEQ ID NO: 608494 - DNA, 25 bp, Rattus norvegicus
gcttagaagccagcaagtccggccg

SEQ ID NO: 608495 - DNA, 25 bp, Rattus norvegicus
caaacaccgcgcgtgctctgccctg

SEQ ID NO: 608496 - DNA, 25 bp, Rattus norvegicus
gtggcgacacctggtggctatgccc

SEQ ID NO: 608497 - DNA, 25 bp, Rattus norvegicus
tgcgctccggtatgcagcccagcgg

SEQ ID NO: 608498 - DNA, 25 bp, Rattus norvegicus
cggtatgcagcccagcggcgcgcat

SEQ ID NO: 608499 - DNA, 25 bp, Rattus norvegicus
ccagcggcgcgcatactcacagagt

SEQ ID NO: 608500 - DNA, 25 bp, Rattus norvegicus
gcgcatactcacagagtggcggatg

SEQ ID NO: 608501 - DNA, 25 bp, Rattus norvegicus
tactcacagagtggcggatggcgtc

SEQ ID NO: 608502 - DNA, 25 bp, Rattus norvegicus
gcgttggctgtgacatgtaggcctc

SEQ ID NO: 608503 - DNA, 25 bp, Rattus norvegicus
ttggctgtgacatgtaggcctcggc

SEQ ID NO: 608504 - DNA, 25 bp, Rattus norvegicus
ctgtgacatgtaggcctcggcggcc

SEQ ID NO: 608505 - DNA, 25 bp, Rattus norvegicus
ggcggccgcaggttccaatccgttc

SEQ ID NO: 608506 - DNA, 25 bp, Rattus norvegicus
tgcgcggcgtccgaacgtccacatg

SEQ ID NO: 608507 - DNA, 25 bp, Rattus norvegicus
tgctactcccactcagcggccgctc

SEQ ID NO: 608508 - DNA, 25 bp, Rattus norvegicus
ggcgtccgaacgtccacatgctact

SEQ ID NO: 608509 - DNA, 25 bp, Rattus norvegicus
agcacgtgctctgggaaccagcctc

SEQ ID NO: 608510 - DNA, 25 bp, Rattus norvegicus
cccaggcgccattcgcccgagctcg

SEQ ID NO: 608511 - DNA, 25 bp, Rattus norvegicus
ctcagccgcccaggcgccattcgcc

SEQ ID NO: 608512 - DNA, 25 bp, Rattus norvegicus
gggtccaggtagagcccgccctcag

SEQ ID NO: 608513 - DNA, 25 bp, Rattus norvegicus
cccaatcagtgggcgggtccaggta

SEQ ID NO: 608514 - DNA, 25 bp, Rattus norvegicus
cctagagcggcccaatcagtgggcg

SEQ ID NO: 608515 - DNA, 25 bp, Rattus norvegicus
actaggctctcaccagcgcggctgg

SEQ ID NO: 608516 - DNA, 25 bp, Rattus norvegicus
ggctgtcctaacagcccagcacgtg

SEQ ID NO: 608517 - DNA, 25 bp, Rattus norvegicus
cccaccacgtgacacaccacgtccg

SEQ ID NO: 608518 - DNA, 25 bp, Rattus norvegicus
gggaaccccaaatttggcgcgctga

SEQ ID NO: 608519 - DNA, 25 bp, Rattus norvegicus
cccaaatttggcgcgctgaggccgg

SEQ ID NO: 608520 - DNA, 25 bp, Rattus norvegicus
ctgaggccggagctccactaggctc

SEQ ID NO: 608521 - DNA, 25 bp, Rattus norvegicus
gcagcgggctgtcctaacagcccag

SEQ ID NO: 608522 - DNA, 25 bp, Rattus norvegicus
aggccggagctccactaggctctca

SEQ ID NO: 608523 - DNA, 25 bp, Rattus norvegicus
caaataatcactgggcgcgggctcg

SEQ ID NO: 608524 - DNA, 25 bp, Rattus norvegicus
atcttctcctgagccatgtcgcggc

SEQ ID NO: 608525 - DNA, 25 bp, Rattus norvegicus
caccggaatgaaatcgatgcgcttt

SEQ ID NO: 608526 - DNA, 25 bp, Rattus norvegicus
aggcggatttctccacgtcgttgtc

SEQ ID NO: 608527 - DNA, 25 bp, Rattus norvegicus
cacgtcgttgtcactcaggctgaaa

SEQ ID NO: 608528 - DNA, 25 bp, Rattus norvegicus
ggctgaaactttcctcccaggagtg

SEQ ID NO: 608529 - DNA, 25 bp, Rattus norvegicus
cccaggagtggcttatctgcattgc

SEQ ID NO: 608530 - DNA, 25 bp, Rattus norvegicus
tcgtggaccgtctctcggttgatca

SEQ ID NO: 608531 - DNA, 25 bp, Rattus norvegicus
ccctcctcttgtttgatctggtgca

SEQ ID NO: 608532 - DNA, 25 bp, Rattus norvegicus
ggcgtcctgacacgctcgttcttga

SEQ ID NO: 608533 - DNA, 25 bp, Rattus norvegicus
tcttgaggcgccagcttaatgcgtc

SEQ ID NO: 608534 - DNA, 25 bp, Rattus norvegicus
taatgcgtcattgctgtggcgccgc

SEQ ID NO: 608535 - DNA, 25 bp, Rattus norvegicus
cctctgttcgttccttccgcaaata

SEQ ID NO: 608536 - DNA, 25 bp, Rattus norvegicus
tgatcaggtccatgccctcctcttg

SEQ ID NO: 608537 - DNA, 25 bp, Rattus norvegicus
tcctctggccggcagaacggcaagc

SEQ ID NO: 608538 - DNA, 25 bp, Rattus norvegicus
gccaccgcgggcaagttgtcgggat

SEQ ID NO: 608539 - DNA, 25 bp, Rattus norvegicus
gcccgcagtaggacctaacgattga

SEQ ID NO: 608540 - DNA, 25 bp, Rattus norvegicus
ccggcagaacggcaagcggaccact

SEQ ID NO: 608541 - DNA, 25 bp, Rattus norvegicus
aacggcaagcggaccactaggacca

SEQ ID NO: 608542 - DNA, 25 bp, Rattus norvegicus
agcggaccactaggaccaggcagcc

SEQ ID NO: 608543 - DNA, 25 bp, Rattus norvegicus
gcggcctcgactcccggaggctgca

SEQ ID NO: 608544 - DNA, 25 bp, Rattus norvegicus
ccctgcaaggaagccagaccggttt

SEQ ID NO: 608545 - DNA, 25 bp, Rattus norvegicus
agccagaccggtttgcagcagccga

SEQ ID NO: 608546 - DNA, 25 bp, Rattus norvegicus
accggtttgcagcagccgagcggcc

SEQ ID NO: 608547 - DNA, 25 bp, Rattus norvegicus
ccgagcggcccgcagtaggacctaa

SEQ ID NO: 608548 - DNA, 25 bp, Rattus norvegicus
ggacgcgcaggaaacttacctcctc

SEQ ID NO: 608549 - DNA, 25 bp, Rattus norvegicus
ctaacgattgagtcagtgcgtggga

SEQ ID NO: 608550 - DNA, 25 bp, Rattus norvegicus
ttggcggccgagaccagttgcgcca

SEQ ID NO: 608551 - DNA, 25 bp, Rattus norvegicus
cagtggccgtcctgctgaagtacct

SEQ ID NO: 608552 - DNA, 25 bp, Rattus norvegicus
gccctcaaagagtcctgtgggccgc

SEQ ID NO: 608553 - DNA, 25 bp, Rattus norvegicus
tgcgctggccctcaaagagtcctgt

SEQ ID NO: 608554 - DNA, 25 bp, Rattus norvegicus
caggtagttgcgctggccctcaaag

SEQ ID NO: 608555 - DNA, 25 bp, Rattus norvegicus
agcacactctggatgaagttgggca

SEQ ID NO: 608556 - DNA, 25 bp, Rattus norvegicus
atggacgacagcacactctggatga

SEQ ID NO: 608557 - DNA, 25 bp, Rattus norvegicus
tcgcgcaggtcaatggacgacagca

SEQ ID NO: 608558 - DNA, 25 bp, Rattus norvegicus
gtgcaaccctgcctgtcgcgcaggt

SEQ ID NO: 608559 - DNA, 25 bp, Rattus norvegicus
gccatcgctacccaccaccatcgtg

SEQ ID NO: 608560 - DNA, 25 bp, Rattus norvegicus
cgtcctgctgaagtacctgccatcg

SEQ ID NO: 608561 - DNA, 25 bp, Rattus norvegicus
cacgatctcagtggccgtcctgctg

SEQ ID NO: 608562 - DNA, 25 bp, Rattus norvegicus
ggccgcagccatctgcaccacgatc

SEQ ID NO: 608563 - DNA, 25 bp, Rattus norvegicus
ctcccgctgctactctcagattgtc

SEQ ID NO: 608564 - DNA, 25 bp, Rattus norvegicus
tgctgaagtacctgccatcgctacc

SEQ ID NO: 608565 - DNA, 25 bp, Rattus norvegicus
gaactcgctgcttcctcgagtgctc

SEQ ID NO: 608566 - DNA, 25 bp, Rattus norvegicus
cctcgagtgctcctaagacgtggca

SEQ ID NO: 608567 - DNA, 25 bp, Rattus norvegicus
agtgctcctaagacgtggcacggtg

SEQ ID NO: 608568 - DNA, 25 bp, Rattus norvegicus
cccgggcttggtacaggtcacgccg

SEQ ID NO: 608569 - DNA, 25 bp, Rattus norvegicus
cccggcctgacagggacggttgcag

SEQ ID NO: 608570 - DNA, 25 bp, Rattus norvegicus
tgcgccggttcctgcgggttctcag

SEQ ID NO: 608571 - DNA, 25 bp, Rattus norvegicus
gggttctcaggatccacgaccacag

SEQ ID NO: 608572 - DNA, 25 bp, Rattus norvegicus
tcaggatccacgaccacagcacggt

SEQ ID NO: 608573 - DNA, 25 bp, Rattus norvegicus
gctgcttcctcgagtgctcctaaga

SEQ ID NO: 608574 - DNA, 25 bp, Rattus norvegicus
aggatgaccaagctgaactcgctgc

SEQ ID NO: 608575 - DNA, 25 bp, Rattus norvegicus
cggtgaggatgaccaagctgaactc

SEQ ID NO: 608576 - DNA, 25 bp, Rattus norvegicus
cagaatccagaaccgccgcctgggg

SEQ ID NO: 608577 - DNA, 25 bp, Rattus norvegicus
gtgacacagaatccagaaccgccgc

SEQ ID NO: 608578 - DNA, 25 bp, Rattus norvegicus
cttcctcgagtgctcctaagacgtg

SEQ ID NO: 608579 - DNA, 25 bp, Rattus norvegicus
tagcgatcgctccaggcacttatga

SEQ ID NO: 608580 - DNA, 25 bp, Rattus norvegicus
ccctgcatgatgctctcgatggtga

SEQ ID NO: 608581 - DNA, 25 bp, Rattus norvegicus
tctcgatggtgaaagaggcgcaccc

SEQ ID NO: 608582 - DNA, 25 bp, Rattus norvegicus
gggaccgagatccagagccctggtc

SEQ ID NO: 608583 - DNA, 25 bp, Rattus norvegicus
ttttctaggctcatccgcgtaggcg

SEQ ID NO: 608584 - DNA, 25 bp, Rattus norvegicus
tacgccgaaggaagctgccattgtc

SEQ ID NO: 608585 - DNA, 25 bp, Rattus norvegicus
ggggtccaagctccagtagttgccc

SEQ ID NO: 608586 - DNA, 25 bp, Rattus norvegicus
ctgatgaaggcgcagatgccgctga

SEQ ID NO: 608587 - DNA, 25 bp, Rattus norvegicus
acgcgctcctccttgcaagggtgcg

SEQ ID NO: 608588 - DNA, 25 bp, Rattus norvegicus
cgcaccttcggcttttctaggctca

SEQ ID NO: 608589 - DNA, 25 bp, Rattus norvegicus
gtcgtcttccgtctgatctccatct

SEQ ID NO: 608590 - DNA, 25 bp, Rattus norvegicus
cacctcttctgggtcggagcttaga

SEQ ID NO: 608591 - DNA, 25 bp, Rattus norvegicus
agttgctcaggtcgccgcagtccca

SEQ ID NO: 608592 - DNA, 25 bp, Rattus norvegicus
ttgaagcgcttcctacgccgaagga

SEQ ID NO: 608593 - DNA, 25 bp, Rattus norvegicus
ccagtcgcacttccgcgacaggatt

SEQ ID NO: 608594 - DNA, 25 bp, Rattus norvegicus
cgcaacaacggaagctagacacgct

SEQ ID NO: 608595 - DNA, 25 bp, Rattus norvegicus
aggcacgcccctacgcagagataga

SEQ ID NO: 608596 - DNA, 25 bp, Rattus norvegicus
ggacaatcctccgcgtactcttctt

SEQ ID NO: 608597 - DNA, 25 bp, Rattus norvegicus
tcttccgcctccacggttttcatag

SEQ ID NO: 608598 - DNA, 25 bp, Rattus norvegicus
tccacggttttcatagcaggtaaca

SEQ ID NO: 608599 - DNA, 25 bp, Rattus norvegicus
agctaaaaagctgccgccagtcgca

SEQ ID NO: 608600 - DNA, 25 bp, Rattus norvegicus
tgactctaaggaacagccggccctc

SEQ ID NO: 608601 - DNA, 25 bp, Rattus norvegicus
cgcggggctgatggcgtcaccacaa

SEQ ID NO: 608602 - DNA, 25 bp, Rattus norvegicus
tgatggcgtcaccacaacgcgtcgc

SEQ ID NO: 608603 - DNA, 25 bp, Rattus norvegicus
agctagacacgctttcccggggagg

SEQ ID NO: 608604 - DNA, 25 bp, Rattus norvegicus
acgcgtcgcctagcatgactctaag

SEQ ID NO: 608605 - DNA, 25 bp, Rattus norvegicus
tccagccacgcaacaacggaagcta

SEQ ID NO: 608606 - DNA, 25 bp, Rattus norvegicus
agcaggtaacatgctgccggcagta

SEQ ID NO: 608607 - DNA, 25 bp, Rattus norvegicus
agcgttcccggttcgcgctccgcaa

SEQ ID NO: 608608 - DNA, 25 bp, Rattus norvegicus
ttcgcgctcaagatcaacaggtaag

SEQ ID NO: 608609 - DNA, 25 bp, Rattus norvegicus
agcggccggcgactctaagcatccg

SEQ ID NO: 608610 - DNA, 25 bp, Rattus norvegicus
cgactctaagcatccggagcgcggt

SEQ ID NO: 608611 - DNA, 25 bp, Rattus norvegicus
ctaagcatccggagcgcggttcggc

SEQ ID NO: 608612 - DNA, 25 bp, Rattus norvegicus
atacggaagtttcctccgcgcggct

SEQ ID NO: 608613 - DNA, 25 bp, Rattus norvegicus
ccatggccacgctaccgagcgccga

SEQ ID NO: 608614 - DNA, 25 bp, Rattus norvegicus
tcaacaggtaagacggcacggttcc

SEQ ID NO: 608615 - DNA, 25 bp, Rattus norvegicus
taagacggcacggttcccggccaga

SEQ ID NO: 608616 - DNA, 25 bp, Rattus norvegicus
cagcctcgtcctctgtcacccgtgc

SEQ ID NO: 608617 - DNA, 25 bp, Rattus norvegicus
ctgctccgagcagcgattcgcatca

SEQ ID NO: 608618 - DNA, 25 bp, Rattus norvegicus
ccaccgtcctggctgttctgacagg

SEQ ID NO: 608619 - DNA, 25 bp, Rattus norvegicus
tcctggctgttctgacaggtggccg

SEQ ID NO: 608620 - DNA, 25 bp, Rattus norvegicus
ctccgcgcggctgacagatgaagct

SEQ ID NO: 608621 - DNA, 25 bp, Rattus norvegicus
agtgcagcgcccttttccgagacgt

SEQ ID NO: 608622 - DNA, 25 bp, Rattus norvegicus
gtaccttgcgcgtttctggatcaga

SEQ ID NO: 608623 - DNA, 25 bp, Rattus norvegicus
ggcttgtgtctctgcactccttggc

SEQ ID NO: 608624 - DNA, 25 bp, Rattus norvegicus
ggcagccgcaggttacttttgcgca

SEQ ID NO: 608625 - DNA, 25 bp, Rattus norvegicus
cttttgcgcagcaactgcaggattc

SEQ ID NO: 608626 - DNA, 25 bp, Rattus norvegicus
tgcaggattctgctccgcgatctag

SEQ ID NO: 608627 - DNA, 25 bp, Rattus norvegicus
cgcgatctagtgcaactccggtttg

SEQ ID NO: 608628 - DNA, 25 bp, Rattus norvegicus
actccggtttgattctggcgcttcc

SEQ ID NO: 608629 - DNA, 25 bp, Rattus norvegicus
gggtgcccagtctcacactcttggc

SEQ ID NO: 608630 - DNA, 25 bp, Rattus norvegicus
ggcgcgctggtcctttgataccaac

SEQ ID NO: 608631 - DNA, 25 bp, Rattus norvegicus
gagcggcgattagtactcctttatc

SEQ ID NO: 608632 - DNA, 25 bp, Rattus norvegicus
tcctttatcctgatcccggagcggc

SEQ ID NO: 608633 - DNA, 25 bp, Rattus norvegicus
ctccgggacctgcttgagttcatga

SEQ ID NO: 608634 - DNA, 25 bp, Rattus norvegicus
ttggctagcagtcgcctgggatcac

SEQ ID NO: 608635 - DNA, 25 bp, Rattus norvegicus
cggaatccgagttcggaagaactgg

SEQ ID NO: 608636 - DNA, 25 bp, Rattus norvegicus
gaagcgagaactgtttgggagttta

SEQ ID NO: 608637 - DNA, 25 bp, Rattus norvegicus
cccagcttagcgggctcgtttcggt

SEQ ID NO: 608638 - DNA, 25 bp, Rattus norvegicus
tgacagacctgaacggaatccgagt

SEQ ID NO: 608639 - DNA, 25 bp, Rattus norvegicus
ggaggagtacgaaataccgcgatga

SEQ ID NO: 608640 - DNA, 25 bp, Rattus norvegicus
tgtccttttgtttggggaagcgaga

SEQ ID NO: 608641 - DNA, 25 bp, Rattus norvegicus
gagcagagcactttttgtccttttg

SEQ ID NO: 608642 - DNA, 25 bp, Rattus norvegicus
ggacgaagtgacagagcagagcact

SEQ ID NO: 608643 - DNA, 25 bp, Rattus norvegicus
aagtagtgcttatgtggccgaaggc

SEQ ID NO: 608644 - DNA, 25 bp, Rattus norvegicus
agggtacggaaaagtagtgcttatg

SEQ ID NO: 608645 - DNA, 25 bp, Rattus norvegicus
atattcaggaattacgtagggtacg

SEQ ID NO: 608646 - DNA, 25 bp, Rattus norvegicus
cccgagatattcaggaattacgtag

SEQ ID NO: 608647 - DNA, 25 bp, Rattus norvegicus
gtggcccgcagtacccgagtggacc

SEQ ID NO: 608648 - DNA, 25 bp, Rattus norvegicus
cgaaataccgcgatgacagacctga

SEQ ID NO: 608649 - DNA, 25 bp, Rattus norvegicus
gggaattatacatcgactacgagga

SEQ ID NO: 608650 - DNA, 25 bp, Rattus norvegicus
tgcaggcgctggagcagaagattca

SEQ ID NO: 608651 - DNA, 25 bp, Rattus norvegicus
gctggaattgctttcccgagcccga

SEQ ID NO: 608652 - DNA, 25 bp, Rattus norvegicus
tgtggtgtgaggaagcgctcctaca

SEQ ID NO: 608653 - DNA, 25 bp, Rattus norvegicus
agccacgccggagctcagggagaac

SEQ ID NO: 608654 - DNA, 25 bp, Rattus norvegicus
cagaagattcaggatagcagctgtg

SEQ ID NO: 608655 - DNA, 25 bp, Rattus norvegicus
agctcacggctgacatgcaggcgct

SEQ ID NO: 608656 - DNA, 25 bp, Rattus norvegicus
ttccggcagctcacggctgacatgc

SEQ ID NO: 608657 - DNA, 25 bp, Rattus norvegicus
aggatcagggagttccggcagctca

SEQ ID NO: 608658 - DNA, 25 bp, Rattus norvegicus
agcagagcacacagaggatcaggga

SEQ ID NO: 608659 - DNA, 25 bp, Rattus norvegicus
tcgactacgaggaggaagaaatgga

SEQ ID NO: 608660 - DNA, 25 bp, Rattus norvegicus
gtggcggggaattatacatcgacta

SEQ ID NO: 608661 - DNA, 25 bp, Rattus norvegicus
agcgctcctacagcgcaggcaatgc

SEQ ID NO: 608662 - DNA, 25 bp, Rattus norvegicus
atagcagctgtgaagccacgccgga

SEQ ID NO: 608663 - DNA, 25 bp, Rattus norvegicus
cgagcggactctactgcccacaatg

SEQ ID NO: 608664 - DNA, 25 bp, Rattus norvegicus
gagccagcggcccagagtccaaacg

SEQ ID NO: 608665 - DNA, 25 bp, Rattus norvegicus
tccaaacgccgctcggtaggacagc

SEQ ID NO: 608666 - DNA, 25 bp, Rattus norvegicus
cgtggcgagcacacgatctggagtc

SEQ ID NO: 608667 - DNA, 25 bp, Rattus norvegicus
tggcatagaggcttctccggctctg

SEQ ID NO: 608668 - DNA, 25 bp, Rattus norvegicus
aaagaaagcgcctaccactcccaga

SEQ ID NO: 608669 - DNA, 25 bp, Rattus norvegicus
cacgcggccatcttggagactctcg

SEQ ID NO: 608670 - DNA, 25 bp, Rattus norvegicus
gcctcacgccggaagcctactgtaa

SEQ ID NO: 608671 - DNA, 25 bp, Rattus norvegicus
gcctactgtaagctgccgcgcgcaa

SEQ ID NO: 608672 - DNA, 25 bp, Rattus norvegicus
ctccgcctgaggaaagagtctccga

SEQ ID NO: 608673 - DNA, 25 bp, Rattus norvegicus
agagtctccgagtcgcaaagtgcga

SEQ ID NO: 608674 - DNA, 25 bp, Rattus norvegicus
caaagtgcgagtcgctgagcccacc

SEQ ID NO: 608675 - DNA, 25 bp, Rattus norvegicus
cgattgctcgctcagaaggcggcca

SEQ ID NO: 608676 - DNA, 25 bp, Rattus norvegicus
gagcccagcttacctctctcgggag

SEQ ID NO: 608677 - DNA, 25 bp, Rattus norvegicus
caaactggcggggtttgctccactg

SEQ ID NO: 608678 - DNA, 25 bp, Rattus norvegicus
ttcggggttcaccatacacttgggc

SEQ ID NO: 608679 - DNA, 25 bp, Rattus norvegicus
ccactgggaaggctgccatgattta

SEQ ID NO: 608680 - DNA, 25 bp, Rattus norvegicus
cgcttttctgggaagaatacccata

SEQ ID NO: 608681 - DNA, 25 bp, Rattus norvegicus
gggcgtcccgagatccagacattgc

SEQ ID NO: 608682 - DNA, 25 bp, Rattus norvegicus
tcgcgagattccctgactcagaaga

SEQ ID NO: 608683 - DNA, 25 bp, Rattus norvegicus
ccttccagctgaatttcggggttca

SEQ ID NO: 608684 - DNA, 25 bp, Rattus norvegicus
ggctcagttaactccgctcagggtt

SEQ ID NO: 608685 - DNA, 25 bp, Rattus norvegicus
gtctcgggttctgtctgcttgaatc

SEQ ID NO: 608686 - DNA, 25 bp, Rattus norvegicus
cgggactgccagtgcaagaagtgca

SEQ ID NO: 608687 - DNA, 25 bp, Rattus norvegicus
aggctgcccaaatgcgctcgctgca

SEQ ID NO: 608688 - DNA, 25 bp, Rattus norvegicus
ggggacgaagctccatgcctaacga

SEQ ID NO: 608689 - DNA, 25 bp, Rattus norvegicus
tctgcaccgacggaggttcctcacg

SEQ ID NO: 608690 - DNA, 25 bp, Rattus norvegicus
taacgacgacgcattcggcaagccc

SEQ ID NO: 608691 - DNA, 25 bp, Rattus norvegicus
accacggggtgctatcctggcttaa

SEQ ID NO: 608692 - DNA, 25 bp, Rattus norvegicus
atcctgatcatcgagcggcagcggg

SEQ ID NO: 608693 - DNA, 25 bp, Rattus norvegicus
ctgcgagaagtgcatcctgatcatc

SEQ ID NO: 608694 - DNA, 25 bp, Rattus norvegicus
tcaaggactgcacctgcgagaagtg

SEQ ID NO: 608695 - DNA, 25 bp, Rattus norvegicus
actgtcgcttcaaggactgcacctg

SEQ ID NO: 608696 - DNA, 25 bp, Rattus norvegicus
gcagctgccctgagagcctcggcgt

SEQ ID NO: 608697 - DNA, 25 bp, Rattus norvegicus
tgctatcctggcttaagggccacaa

SEQ ID NO: 608698 - DNA, 25 bp, Rattus norvegicus
cgctgccggaaccacggggtgctat

SEQ ID NO: 608699 - DNA, 25 bp, Rattus norvegicus
cctacctgtacatgggcggcccggt

SEQ ID NO: 608700 - DNA, 25 bp, Rattus norvegicus
agccctgggcatgaacggctacggc

SEQ ID NO: 608701 - DNA, 25 bp, Rattus norvegicus
cgtacctccggctgctgccgacctt

SEQ ID NO: 608702 - DNA, 25 bp, Rattus norvegicus
gcggaggagactgcagccgtacctc

SEQ ID NO: 608703 - DNA, 25 bp, Rattus norvegicus
acccgcgggctgagagcaccatcgg

SEQ ID NO: 608704 - DNA, 25 bp, Rattus norvegicus
ccacaagcgctactgtcgcttcaag

SEQ ID NO: 608705 - DNA, 25 bp, Rattus norvegicus
tgacaccttacgcttttccgcggac

SEQ ID NO: 608706 - DNA, 25 bp, Rattus norvegicus
ttcctccaagtggtccgtgggctct

SEQ ID NO: 608707 - DNA, 25 bp, Rattus norvegicus
tctcttcctccaagtggtccgtggg

SEQ ID NO: 608708 - DNA, 25 bp, Rattus norvegicus
tgggctcctaccctatctcttcctc

SEQ ID NO: 608709 - DNA, 25 bp, Rattus norvegicus
tttgaacacacgctgggctcctacc

SEQ ID NO: 608710 - DNA, 25 bp, Rattus norvegicus
cggccatatctttgaacacacgctg

SEQ ID NO: 608711 - DNA, 25 bp, Rattus norvegicus
cctccagcggccatatctttgaaca

SEQ ID NO: 608712 - DNA, 25 bp, Rattus norvegicus
gtccgtgggctctgccttccgagtc

SEQ ID NO: 608713 - DNA, 25 bp, Rattus norvegicus
cgagtccctgacaccttacgctttt

SEQ ID NO: 608714 - DNA, 25 bp, Rattus norvegicus
gccgaagagagcctggtgctgccct

SEQ ID NO: 608715 - DNA, 25 bp, Rattus norvegicus
tatctttgaacacacgctgggctcc

SEQ ID NO: 608716 - DNA, 25 bp, Rattus norvegicus
agtgccgtggaggtcctgctgtcca

SEQ ID NO: 608717 - DNA, 25 bp, Rattus norvegicus
aggtcctgctgtccagtcggtcctc

SEQ ID NO: 608718 - DNA, 25 bp, Rattus norvegicus
aagagagcctggtgctgccctccag

SEQ ID NO: 608719 - DNA, 25 bp, Rattus norvegicus
tgcccacattttcaggttcagcttc

SEQ ID NO: 608720 - DNA, 25 bp, Rattus norvegicus
tgccggtcgccggttaaacaccaga

SEQ ID NO: 608721 - DNA, 25 bp, Rattus norvegicus
tctgatcttagttaccttctcgaga

SEQ ID NO: 608722 - DNA, 25 bp, Rattus norvegicus
cttctcgagaacaacgcgatgcata

SEQ ID NO: 608723 - DNA, 25 bp, Rattus norvegicus
cgcgatgcataagagtacgagaatc

SEQ ID NO: 608724 - DNA, 25 bp, Rattus norvegicus
tcggcgaggtaaacggcgacttctc

SEQ ID NO: 608725 - DNA, 25 bp, Rattus norvegicus
cttccagatcagagacccggctgca

SEQ ID NO: 608726 - DNA, 25 bp, Rattus norvegicus
ccagtttgggccagaagtggaaagc

SEQ ID NO: 608727 - DNA, 25 bp, Rattus norvegicus
tggtgccgcgaaggaagcttccact

SEQ ID NO: 608728 - DNA, 25 bp, Rattus norvegicus
cagtgctctggccaatcggcttgca

SEQ ID NO: 608729 - DNA, 25 bp, Rattus norvegicus
cgaccaatcagaggatgcggtgctc

SEQ ID NO: 608730 - DNA, 25 bp, Rattus norvegicus
taggtaatactaggaaggggagctc

SEQ ID NO: 608731 - DNA, 25 bp, Rattus norvegicus
gtcccggactgcagagagtgactcc

SEQ ID NO: 608732 - DNA, 25 bp, Rattus norvegicus
aatcagcttgttccctagtcggcga

SEQ ID NO: 608733 - DNA, 25 bp, Rattus norvegicus
gaacccagtccgtcgacggccgatg

SEQ ID NO: 608734 - DNA, 25 bp, Rattus norvegicus
accgttgcgggccacgccacaggaa

SEQ ID NO: 608735 - DNA, 25 bp, Rattus norvegicus
ccttagagagggtcgctgtttgcga

SEQ ID NO: 608736 - DNA, 25 bp, Rattus norvegicus
gctgtttgcgaagggcggctcttca

SEQ ID NO: 608737 - DNA, 25 bp, Rattus norvegicus
tttttctgtcttcctagcgcgcggg

SEQ ID NO: 608738 - DNA, 25 bp, Rattus norvegicus
gcgcgggcaaccgaaccgaactaca

SEQ ID NO: 608739 - DNA, 25 bp, Rattus norvegicus
gaaggcgaggactccagcgcgtccc

SEQ ID NO: 608740 - DNA, 25 bp, Rattus norvegicus
taaactgagccgcacgcccaagtgc

SEQ ID NO: 608741 - DNA, 25 bp, Rattus norvegicus
taaccacggcgtggtgtcctgtctc

SEQ ID NO: 608742 - DNA, 25 bp, Rattus norvegicus
gattctgtcgctggcgggactgcca

SEQ ID NO: 608743 - DNA, 25 bp, Rattus norvegicus
gggactgccagtgcgccaactgcct

SEQ ID NO: 608744 - DNA, 25 bp, Rattus norvegicus
aactgcctgcttgtggtagagcgcc

SEQ ID NO: 608745 - DNA, 25 bp, Rattus norvegicus
tagagcgccagcgagtcatggccgc

SEQ ID NO: 608746 - DNA, 25 bp, Rattus norvegicus
tacagcctagtgtcacgatggaagg

SEQ ID NO: 608747 - DNA, 25 bp, Rattus norvegicus
ggggaggccatgatccggataatcc

SEQ ID NO: 608748 - DNA, 25 bp, Rattus norvegicus
aaacgcgacagttcacccggagcca

SEQ ID NO: 608749 - DNA, 25 bp, Rattus norvegicus
gacttgtttaaagggctccggctgc

SEQ ID NO: 608750 - DNA, 25 bp, Rattus norvegicus
gcagatcttggcagtaggagtagtc

SEQ ID NO: 608751 - DNA, 25 bp, Rattus norvegicus
agtagtctggactggcgcactaagc

SEQ ID NO: 608752 - DNA, 25 bp, Rattus norvegicus
ttgactggtgacagacctttgggta

SEQ ID NO: 608753 - DNA, 25 bp, Rattus norvegicus
cgcggaccttcttgtctggtaccta

SEQ ID NO: 608754 - DNA, 25 bp, Rattus norvegicus
cggataatcctctctgcctgactgt

SEQ ID NO: 608755 - DNA, 25 bp, Rattus norvegicus
tgactgtcacaacaggacccgcacg

SEQ ID NO: 608756 - DNA, 25 bp, Rattus norvegicus
ggagcctcctcctagcgatgacact

SEQ ID NO: 608757 - DNA, 25 bp, Rattus norvegicus
gttccctgctttcgagtttgcttta

SEQ ID NO: 608758 - DNA, 25 bp, Rattus norvegicus
cctcccgctggcgttgcaaaacagg

SEQ ID NO: 608759 - DNA, 25 bp, Rattus norvegicus
tttgcttggtgtctttccttggcca

SEQ ID NO: 608760 - DNA, 25 bp, Rattus norvegicus
tccagcccggatctcattactgagg

SEQ ID NO: 608761 - DNA, 25 bp, Rattus norvegicus
cgcgatcgctgcgttttgggagacc

SEQ ID NO: 608762 - DNA, 25 bp, Rattus norvegicus
tgaacaatggttctgcctcctctgc

SEQ ID NO: 608763 - DNA, 25 bp, Rattus norvegicus
gggctgtagagccactgaacaatgg

SEQ ID NO: 608764 - DNA, 25 bp, Rattus norvegicus
tcacctcccattgacaagggctagg

SEQ ID NO: 608765 - DNA, 25 bp, Rattus norvegicus
ctctgttttacatggttttcacctc

SEQ ID NO: 608766 - DNA, 25 bp, Rattus norvegicus
acttgttgtcatccttctgtgtccc

SEQ ID NO: 608767 - DNA, 25 bp, Rattus norvegicus
agcgtcccttgaacttgttgtcatc

SEQ ID NO: 608768 - DNA, 25 bp, Rattus norvegicus
ctgagctgtcagagccgaggctact

SEQ ID NO: 608769 - DNA, 25 bp, Rattus norvegicus
acagcggcgccactgcaagcggtga

SEQ ID NO: 608770 - DNA, 25 bp, Rattus norvegicus
ctggtaacttgttgtgcggagcgaa

SEQ ID NO: 608771 - DNA, 25 bp, Rattus norvegicus
ctcctctccgaagggctggtaactt

SEQ ID NO: 608772 - DNA, 25 bp, Rattus norvegicus
ctgcattattttccgcccgcagggt

SEQ ID NO: 608773 - DNA, 25 bp, Rattus norvegicus
ccttctctgcaacgcctgcattatt

SEQ ID NO: 608774 - DNA, 25 bp, Rattus norvegicus
ttagggtgtcctgaagcgtcccttg

SEQ ID NO: 608775 - DNA, 25 bp, Rattus norvegicus
tttagcttggtcacgtgtcttcgcg

SEQ ID NO: 608776 - DNA, 25 bp, Rattus norvegicus
ctgtcgagctatactggggtgttta

SEQ ID NO: 608777 - DNA, 25 bp, Rattus norvegicus
agctggattgcgtttagcttggtca

SEQ ID NO: 608778 - DNA, 25 bp, Rattus norvegicus
attggctggtagctggattgcgttt

SEQ ID NO: 608779 - DNA, 25 bp, Rattus norvegicus
tttctaacccatgcgattggctggt

SEQ ID NO: 608780 - DNA, 25 bp, Rattus norvegicus
cctttggttccgctgtccggagcgt

SEQ ID NO: 608781 - DNA, 25 bp, Rattus norvegicus
ctttcaagtgtgtggtcaagcggtc

SEQ ID NO: 608782 - DNA, 25 bp, Rattus norvegicus
cgaactttcaagtgtgtggtcaagc

SEQ ID NO: 608783 - DNA, 25 bp, Rattus norvegicus
gtcctggagtgagagcgaactttca

SEQ ID NO: 608784 - DNA, 25 bp, Rattus norvegicus
agtagcttagaaggcccgcccgcgt

SEQ ID NO: 608785 - DNA, 25 bp, Rattus norvegicus
ctcttgtcgcccgagtagcttagaa

SEQ ID NO: 608786 - DNA, 25 bp, Rattus norvegicus
cccgctctaaatagtctacgatccc

SEQ ID NO: 608787 - DNA, 25 bp, Rattus norvegicus
agggcttttctaacccatgcgattg

SEQ ID NO: 608788 - DNA, 25 bp, Rattus norvegicus
tggtcaagcggtctgtcgagctata

SEQ ID NO: 608789 - DNA, 25 bp, Rattus norvegicus
cactccacaggtttgcgggccttcg

SEQ ID NO: 608790 - DNA, 25 bp, Rattus norvegicus
agctgtgtccacgaagcttcctgga

SEQ ID NO: 608791 - DNA, 25 bp, Rattus norvegicus
gctgctgtcgcatctgcttcgagga

SEQ ID NO: 608792 - DNA, 25 bp, Rattus norvegicus
ctctttcgggacatgcgcttctatg

SEQ ID NO: 608793 - DNA, 25 bp, Rattus norvegicus
ttctatggaccacagcgtcagcgcc

SEQ ID NO: 608794 - DNA, 25 bp, Rattus norvegicus
cagcgcctctggaaccttatggaga

SEQ ID NO: 608795 - DNA, 25 bp, Rattus norvegicus
gggtggcctccaatctcttcgtcct

SEQ ID NO: 608796 - DNA, 25 bp, Rattus norvegicus
gtcctcatctccgtagtggccctgg

SEQ ID NO: 608797 - DNA, 25 bp, Rattus norvegicus
cccatattggagcacgtggagatgc

SEQ ID NO: 608798 - DNA, 25 bp, Rattus norvegicus
gcgatgactacgaggcaaagactga

SEQ ID NO: 608799 - DNA, 25 bp, Rattus norvegicus
cttcacgagcgaggaccagaggcat

SEQ ID NO: 608800 - DNA, 25 bp, Rattus norvegicus
cgtggctttcttcactctggagttc

SEQ ID NO: 608801 - DNA, 25 bp, Rattus norvegicus
gcgccctcaacctggtggacctggt

SEQ ID NO: 608802 - DNA, 25 bp, Rattus norvegicus
acctggtggccattctgcctttcta

SEQ ID NO: 608803 - DNA, 25 bp, Rattus norvegicus
gacatgcgcagaagcactttttgaa

SEQ ID NO: 608804 - DNA, 25 bp, Rattus norvegicus
cgagcccttcctgcgtgggaccggt

SEQ ID NO: 608805 - DNA, 25 bp, Rattus norvegicus
ctccagtgtcgggagcgatcggccc

SEQ ID NO: 608806 - DNA, 25 bp, Rattus norvegicus
agggctcctgcgatgctccagtgtc

SEQ ID NO: 608807 - DNA, 25 bp, Rattus norvegicus
tacggggtctggagcctcaaagaaa

SEQ ID NO: 608808 - DNA, 25 bp, Rattus norvegicus
ctcgtatagcggttgaggtaggtca

SEQ ID NO: 608809 - DNA, 25 bp, Rattus norvegicus
gtcctcgcgactggtgctcgtatag

SEQ ID NO: 608810 - DNA, 25 bp, Rattus norvegicus
tgaagcgactgtccgcccgggatct

SEQ ID NO: 608811 - DNA, 25 bp, Rattus norvegicus
caactccggcaggtgtgtgaagcga

SEQ ID NO: 608812 - DNA, 25 bp, Rattus norvegicus
tcctcctcagctggtgctgtggctt

SEQ ID NO: 608813 - DNA, 25 bp, Rattus norvegicus
gggaccggtgcttgctgcccacgct

SEQ ID NO: 608814 - DNA, 25 bp, Rattus norvegicus
ctttttgaagccaccgcgggagaga

SEQ ID NO: 608815 - DNA, 25 bp, Rattus norvegicus
gagccacagtgaccagacatgcgca

SEQ ID NO: 608816 - DNA, 25 bp, Rattus norvegicus
caacggtcttttcgccggagccaca

SEQ ID NO: 608817 - DNA, 25 bp, Rattus norvegicus
gcggcaggaagcaaccgaacacccg

SEQ ID NO: 608818 - DNA, 25 bp, Rattus norvegicus
ccggctctctgagatccagggtggc

SEQ ID NO: 608819 - DNA, 25 bp, Rattus norvegicus
agggtggcagccctccatccgcgat

SEQ ID NO: 608820 - DNA, 25 bp, Rattus norvegicus
ccgaaggccggctacgctagcaggt

SEQ ID NO: 608821 - DNA, 25 bp, Rattus norvegicus
ctacgctagcaggtgcgggctgccc

SEQ ID NO: 608822 - DNA, 25 bp, Rattus norvegicus
caaacaaaggcagcgcggtaccgtt

SEQ ID NO: 608823 - DNA, 25 bp, Rattus norvegicus
gaccgcgggccgcagcgaactgact

SEQ ID NO: 608824 - DNA, 25 bp, Rattus norvegicus
agcgaactgactcttcggcggcgcg

SEQ ID NO: 608825 - DNA, 25 bp, Rattus norvegicus
gggccggaaatcagctgtgagtcac

SEQ ID NO: 608826 - DNA, 25 bp, Rattus norvegicus
cgcgcacggtctgtttggatacatt

SEQ ID NO: 608827 - DNA, 25 bp, Rattus norvegicus
tctgtttggatacattcctggagtc

SEQ ID NO: 608828 - DNA, 25 bp, Rattus norvegicus
acattcctggagtctcttaaagaga

SEQ ID NO: 608829 - DNA, 25 bp, Rattus norvegicus
aaagagaccgcgctgcgcgtttcgc

SEQ ID NO: 608830 - DNA, 25 bp, Rattus norvegicus
agcgaccggctctctgagatccagg

SEQ ID NO: 608831 - DNA, 25 bp, Rattus norvegicus
ttccagcagctggaggatgccgagc

SEQ ID NO: 608832 - DNA, 25 bp, Rattus norvegicus
tccgggtgtacagggacagaaccac

SEQ ID NO: 608833 - DNA, 25 bp, Rattus norvegicus
tccatccgggtgtacagggacagaa

SEQ ID NO: 608834 - DNA, 25 bp, Rattus norvegicus
ctcgctgggctacgcgtctgtaaac

SEQ ID NO: 608835 - DNA, 25 bp, Rattus norvegicus
gcgtctgtaaacttccagcagctgg

SEQ ID NO: 608836 - DNA, 25 bp, Rattus norvegicus
tgtacagggacagaaccacccgccg

SEQ ID NO: 608837 - DNA, 25 bp, Rattus norvegicus
gatgccgagcgggccttggacacca

SEQ ID NO: 608838 - DNA, 25 bp, Rattus norvegicus
gacaccatgaatttcgatgtgataa

SEQ ID NO: 608839 - DNA, 25 bp, Rattus norvegicus
atttcgatgtgataaagggcaagcc

SEQ ID NO: 608840 - DNA, 25 bp, Rattus norvegicus
aagggcaagccggttcgcatcatgt

SEQ ID NO: 608841 - DNA, 25 bp, Rattus norvegicus
agccggttcgcatcatgtggtctca

SEQ ID NO: 608842 - DNA, 25 bp, Rattus norvegicus
tcatgtggtctcagcgggacccatc

SEQ ID NO: 608843 - DNA, 25 bp, Rattus norvegicus
tggtctcagcgggacccatcgctgc

SEQ ID NO: 608844 - DNA, 25 bp, Rattus norvegicus
ggctacgcgtctgtaaacttccagc

SEQ ID NO: 608845 - DNA, 25 bp, Rattus norvegicus
tcagtggctcgggaaagtgacgctt

SEQ ID NO: 608846 - DNA, 25 bp, Rattus norvegicus
gactgttcgcttgtctgtgtgctcg

SEQ ID NO: 608847 - DNA, 25 bp, Rattus norvegicus
taagtctgcaatccgggctagcgtt

SEQ ID NO: 608848 - DNA, 25 bp, Rattus norvegicus
ggtttccgaaggacttaagtctgca

SEQ ID NO: 608849 - DNA, 25 bp, Rattus norvegicus
cagatttctgggaacgacgccggtt

SEQ ID NO: 608850 - DNA, 25 bp, Rattus norvegicus
tgacgcttgagcctgcagatttctg

SEQ ID NO: 608851 - DNA, 25 bp, Rattus norvegicus
ttttggcccttgaggggatccgtca

SEQ ID NO: 608852 - DNA, 25 bp, Rattus norvegicus
ggactacgtgagttttggcccttga

SEQ ID NO: 608853 - DNA, 25 bp, Rattus norvegicus
ccctatacgcgagaggactacgtga

SEQ ID NO: 608854 - DNA, 25 bp, Rattus norvegicus
gaaatccgtagtttctattggtcca

SEQ ID NO: 608855 - DNA, 25 bp, Rattus norvegicus
ggtggagcttaggaaacacgaaatc

SEQ ID NO: 608856 - DNA, 25 bp, Rattus norvegicus
ccggatcctcggttgtattgtcccg

SEQ ID NO: 608857 - DNA, 25 bp, Rattus norvegicus
tgtgtgctcgttcgcgtcttttttc

SEQ ID NO: 608858 - DNA, 25 bp, Rattus norvegicus
cggttgtattgtcccgtcctggtgc

SEQ ID NO: 608859 - DNA, 25 bp, Rattus norvegicus
tctgccttgaggaaccgtactgcgg

SEQ ID NO: 608860 - DNA, 25 bp, Rattus norvegicus
tcaccttggctgtggattattgtgg

SEQ ID NO: 608861 - DNA, 25 bp, Rattus norvegicus
cctctcggcgatcgctagtggtgtt

SEQ ID NO: 608862 - DNA, 25 bp, Rattus norvegicus
ttgatgggtaacagtcgccaggact

SEQ ID NO: 608863 - DNA, 25 bp, Rattus norvegicus
ctacggtgactatggcgcttgattc

SEQ ID NO: 608864 - DNA, 25 bp, Rattus norvegicus
atgtcccggatgtgatgagctcctc

SEQ ID NO: 608865 - DNA, 25 bp, Rattus norvegicus
aggcaacggttgctataactcacaa

SEQ ID NO: 608866 - DNA, 25 bp, Rattus norvegicus
cacatgtagagaccgaagaatattc

SEQ ID NO: 608867 - DNA, 25 bp, Rattus norvegicus
ggccagggctactttccgtgaaatg

SEQ ID NO: 608868 - DNA, 25 bp, Rattus norvegicus
tgatgacggacccaacactgtgtga

SEQ ID NO: 608869 - DNA, 25 bp, Rattus norvegicus
ccaacactgtgtgagacgcgcgcta

SEQ ID NO: 608870 - DNA, 25 bp, Rattus norvegicus
ctgaatatacgtcatttcctgggcg

SEQ ID NO: 608871 - DNA, 25 bp, Rattus norvegicus
ggtcgtttatccctcgcgggtgatc

SEQ ID NO: 608872 - DNA, 25 bp, Rattus norvegicus
cgcttgattcacaaggcaacggttg

SEQ ID NO: 608873 - DNA, 25 bp, Rattus norvegicus
tcttgggtcctagccctcgggctct

SEQ ID NO: 608874 - DNA, 25 bp, Rattus norvegicus
tcccaaacacactaacaggtctaag

SEQ ID NO: 608875 - DNA, 25 bp, Rattus norvegicus
agtctcgttttgctgtcgcctccca

SEQ ID NO: 608876 - DNA, 25 bp, Rattus norvegicus
tgcactatgtccgtcccaactacgg

SEQ ID NO: 608877 - DNA, 25 bp, Rattus norvegicus
cgggtacatacaactctgcactatg

SEQ ID NO: 608878 - DNA, 25 bp, Rattus norvegicus
gggagccttcgggtacatacaactc

SEQ ID NO: 608879 - DNA, 25 bp, Rattus norvegicus
ccgccagccgccagttaggaagctg

SEQ ID NO: 608880 - DNA, 25 bp, Rattus norvegicus
tcttactgagtaagtgaggggctga

SEQ ID NO: 608881 - DNA, 25 bp, Rattus norvegicus
cggcttcctgttgtgcaacctctta

SEQ ID NO: 608882 - DNA, 25 bp, Rattus norvegicus
aaacaaactcgtgccggcttcctgt

SEQ ID NO: 608883 - DNA, 25 bp, Rattus norvegicus
gccagcaagtgagcgaacgcaacaa

SEQ ID NO: 608884 - DNA, 25 bp, Rattus norvegicus
cttcgtggtgctccctgctaccagg

SEQ ID NO: 608885 - DNA, 25 bp, Rattus norvegicus
aggtgaaggctccagggcccttcgt

SEQ ID NO: 608886 - DNA, 25 bp, Rattus norvegicus
acaggtctaaggacgcgacctcgcc

SEQ ID NO: 608887 - DNA, 25 bp, Rattus norvegicus
ttcccataaaactccagagcgggta

SEQ ID NO: 608888 - DNA, 25 bp, Rattus norvegicus
tgacgttcgagcacacacgctcctt

SEQ ID NO: 608889 - DNA, 25 bp, Rattus norvegicus
ccagtgtctccctcttgacgttcga

SEQ ID NO: 608890 - DNA, 25 bp, Rattus norvegicus
cagctgcttcctgagtgtgagcgcc

SEQ ID NO: 608891 - DNA, 25 bp, Rattus norvegicus
ctttacaaagttgagaggcgacttc

SEQ ID NO: 608892 - DNA, 25 bp, Rattus norvegicus
cagatacactccagtcatgtcttta

SEQ ID NO: 608893 - DNA, 25 bp, Rattus norvegicus
tgtccgcgctacactcagatacact

SEQ ID NO: 608894 - DNA, 25 bp, Rattus norvegicus
gaaaattcgcatccaagcccgcggc

SEQ ID NO: 608895 - DNA, 25 bp, Rattus norvegicus
tccttcggaaaggaaaattcgcatc

SEQ ID NO: 608896 - DNA, 25 bp, Rattus norvegicus
tttccacaacaaagctaggcgagcg

SEQ ID NO: 608897 - DNA, 25 bp, Rattus norvegicus
atggcatccacttaccaggtaaccg

SEQ ID NO: 608898 - DNA, 25 bp, Rattus norvegicus
cgtccctcgcctgcggaacaaagtt

SEQ ID NO: 608899 - DNA, 25 bp, Rattus norvegicus
cccgagtttgcgtctcagagcttga

SEQ ID NO: 608900 - DNA, 25 bp, Rattus norvegicus
ctagccggcgtctagaaactatttc

SEQ ID NO: 608901 - DNA, 25 bp, Rattus norvegicus
aggagccggttttgcgagcacgcaa

SEQ ID NO: 608902 - DNA, 25 bp, Rattus norvegicus
tcaacccgagcgctttcgtttcacg

SEQ ID NO: 608903 - DNA, 25 bp, Rattus norvegicus
gctcaggatcaacccgagcgctttc

SEQ ID NO: 608904 - DNA, 25 bp, Rattus norvegicus
ggaatcactggctgctgctctccac

SEQ ID NO: 608905 - DNA, 25 bp, Rattus norvegicus
ccgcttcctgcggaatcactggctg

SEQ ID NO: 608906 - DNA, 25 bp, Rattus norvegicus
aagcccacgagctcgggatgcgact

SEQ ID NO: 608907 - DNA, 25 bp, Rattus norvegicus
ccatcatggggaagcccacgagctc

SEQ ID NO: 608908 - DNA, 25 bp, Rattus norvegicus
tcacaaacgccggtgcccatcatgg

SEQ ID NO: 608909 - DNA, 25 bp, Rattus norvegicus
gacagcggcccgtgcgctgtgtctc

SEQ ID NO: 608910 - DNA, 25 bp, Rattus norvegicus
ccaaggagactggtgtgaaatcgca

SEQ ID NO: 608911 - DNA, 25 bp, Rattus norvegicus
gcacgcaaaaccacggtgctcggtc

SEQ ID NO: 608912 - DNA, 25 bp, Rattus norvegicus
tgaaatcgcagagggtcagaaactc

SEQ ID NO: 608913 - DNA, 25 bp, Rattus norvegicus
cctcggcctcgctggttggcctggt

SEQ ID NO: 608914 - DNA, 25 bp, Rattus norvegicus
gcagtggcagctctgacagcggccc

SEQ ID NO: 608915 - DNA, 25 bp, Rattus norvegicus
gggcatctgaattcctgtgtcgttt

SEQ ID NO: 608916 - DNA, 25 bp, Rattus norvegicus
ggactcttaattggaagtgccagga

SEQ ID NO: 608917 - DNA, 25 bp, Rattus norvegicus
tttccttactcacccgggcatctga

SEQ ID NO: 608918 - DNA, 25 bp, Rattus norvegicus
cacggctggacctgttctttcctta

SEQ ID NO: 608919 - DNA, 25 bp, Rattus norvegicus
tcaaaaccatccagggacacggctg

SEQ ID NO: 608920 - DNA, 25 bp, Rattus norvegicus
cctagtttcaggtgtagctgtaccc

SEQ ID NO: 608921 - DNA, 25 bp, Rattus norvegicus
gcatccaaaagtgtagctcctagtt

SEQ ID NO: 608922 - DNA, 25 bp, Rattus norvegicus
gcagttcgagaacttaggcatccaa

SEQ ID NO: 608923 - DNA, 25 bp, Rattus norvegicus
cacgcgctgagtgcttgtcactcca

SEQ ID NO: 608924 - DNA, 25 bp, Rattus norvegicus
tcttagaacttaggcatccgggcgg

SEQ ID NO: 608925 - DNA, 25 bp, Rattus norvegicus
gagactttttggctcttagaactta

SEQ ID NO: 608926 - DNA, 25 bp, Rattus norvegicus
ccaggaaatccagctagaacaggtt

SEQ ID NO: 608927 - DNA, 25 bp, Rattus norvegicus
cttgcttcccacctgtaatttagga

SEQ ID NO: 608928 - DNA, 25 bp, Rattus norvegicus
tcgttttcggtgagcacaaggtttc

SEQ ID NO: 608929 - DNA, 25 bp, Rattus norvegicus
cgcgaagtgctgatgaacctgctct

SEQ ID NO: 608930 - DNA, 25 bp, Rattus norvegicus
gtcacaatcgtgctctgcggctcct

SEQ ID NO: 608931 - DNA, 25 bp, Rattus norvegicus
aggttcgagttccagtcgctgctga

SEQ ID NO: 608932 - DNA, 25 bp, Rattus norvegicus
gcgtgccctgcacaagtagctcctg

SEQ ID NO: 608933 - DNA, 25 bp, Rattus norvegicus
gaggacgccggcatgaacttgaacc

SEQ ID NO: 608934 - DNA, 25 bp, Rattus norvegicus
gccatcgacctgtggctgtccaaga

SEQ ID NO: 608935 - DNA, 25 bp, Rattus norvegicus
ggcaccctctactgcctgcttagga

SEQ ID NO: 608936 - DNA, 25 bp, Rattus norvegicus
acgtctccgccaggtgtcacaatcg

SEQ ID NO: 608937 - DNA, 25 bp, Rattus norvegicus
tcttcgccctgctgttggacctact

SEQ ID NO: 608938 - DNA, 25 bp, Rattus norvegicus
cctactgctggtggctgtgattaaa

SEQ ID NO: 608939 - DNA, 25 bp, Rattus norvegicus
cgaccggcgcacaatcagatggaca

SEQ ID NO: 608940 - DNA, 25 bp, Rattus norvegicus
atggacatgtttttcaccctctcgg

SEQ ID NO: 608941 - DNA, 25 bp, Rattus norvegicus
cctctcggtggacaagtactccttt

SEQ ID NO: 608942 - DNA, 25 bp, Rattus norvegicus
ccctgatgaagctgctggagatctc

SEQ ID NO: 608943 - DNA, 25 bp, Rattus norvegicus
cgtggcacaacccagacttccagaa

SEQ ID NO: 608944 - DNA, 25 bp, Rattus norvegicus
cagctggtccttgtcgtgtatgatc

SEQ ID NO: 608945 - DNA, 25 bp, Rattus norvegicus
cccagacttccagaagcggatgtcc

SEQ ID NO: 608946 - DNA, 25 bp, Rattus norvegicus
atccgtagggagtcgtctgtcatcc

SEQ ID NO: 608947 - DNA, 25 bp, Rattus norvegicus
actctgggtctccacgcagagcggc

SEQ ID NO: 608948 - DNA, 25 bp, Rattus norvegicus
ggcgaccttgtagaagactctgggt

SEQ ID NO: 608949 - DNA, 25 bp, Rattus norvegicus
cgcaatccggacatgtctggctggg

SEQ ID NO: 608950 - DNA, 25 bp, Rattus norvegicus
tcgcctgcgcaatccggacatgtct

SEQ ID NO: 608951 - DNA, 25 bp, Rattus norvegicus
cccactcgcgttgggtatagcgatt

SEQ ID NO: 608952 - DNA, 25 bp, Rattus norvegicus
acactgatcagcagatcattggagc

SEQ ID NO: 608953 - DNA, 25 bp, Rattus norvegicus
aagcggatgtccgatagcctctggc

SEQ ID NO: 608954 - DNA, 25 bp, Rattus norvegicus
agtcgtctgtcatccggctggcccg

SEQ ID NO: 608955 - DNA, 25 bp, Rattus norvegicus
ccttgtcgtgtatgatccgtaggga

SEQ ID NO: 608956 - DNA, 25 bp, Rattus norvegicus
ctctgccacactgatcagcagatca

SEQ ID NO: 608957 - DNA, 25 bp, Rattus norvegicus
aggttccactcacgccagggccgtt

SEQ ID NO: 608958 - DNA, 25 bp, Rattus norvegicus
gcccaggtaacagcggcctgcgttc

SEQ ID NO: 608959 - DNA, 25 bp, Rattus norvegicus
cagcggcctgcgttctgctagggac

SEQ ID NO: 608960 - DNA, 25 bp, Rattus norvegicus
aggaggtggccacgcgcgcattccc

SEQ ID NO: 608961 - DNA, 25 bp, Rattus norvegicus
cttccacgagaaaggaggtggccac

SEQ ID NO: 608962 - DNA, 25 bp, Rattus norvegicus
gactgatgccaagccacagccctgg

SEQ ID NO: 608963 - DNA, 25 bp, Rattus norvegicus
gaccggctacttcttcttccgcagt

SEQ ID NO: 608964 - DNA, 25 bp, Rattus norvegicus
cagagggattctgggtaacgaccgt

SEQ ID NO: 608965 - DNA, 25 bp, Rattus norvegicus
cttcgccagcggcagagggattctg

SEQ ID NO: 608966 - DNA, 25 bp, Rattus norvegicus
gaagagagtgacttagacgtgtccc

SEQ ID NO: 608967 - DNA, 25 bp, Rattus norvegicus
gtgcatcggcttcgccagcggcaga

SEQ ID NO: 608968 - DNA, 25 bp, Rattus norvegicus
caccggaaatgacgcactgaccggc

SEQ ID NO: 608969 - DNA, 25 bp, Rattus norvegicus
atgacgcactgaccggctacttctt

SEQ ID NO: 608970 - DNA, 25 bp, Rattus norvegicus
agccctggcagcatcttccacgaga

SEQ ID NO: 608971 - DNA, 25 bp, Rattus norvegicus
tgctgtcctctagattagtgctctc

SEQ ID NO: 608972 - DNA, 25 bp, Rattus norvegicus
cgcttggaactgtcgcgtctgtgtc

SEQ ID NO: 608973 - DNA, 25 bp, Rattus norvegicus
gccagcttgcctcagaccaaaggta

SEQ ID NO: 608974 - DNA, 25 bp, Rattus norvegicus
tcagcaaggtgcagtaaactctttc

SEQ ID NO: 608975 - DNA, 25 bp, Rattus norvegicus
ctttcccacagtcggtgaacactca

SEQ ID NO: 608976 - DNA, 25 bp, Rattus norvegicus
gatcgctcttttcctgctgccctag

SEQ ID NO: 608977 - DNA, 25 bp, Rattus norvegicus
gccgctctcttcaggggagcacatg

SEQ ID NO: 608978 - DNA, 25 bp, Rattus norvegicus
acatggacgctcaccctcggtatgg

SEQ ID NO: 608979 - DNA, 25 bp, Rattus norvegicus
ggctcagccatttaggagtccagtc

SEQ ID NO: 608980 - DNA, 25 bp, Rattus norvegicus
cagtctcactcagggagcactttta

SEQ ID NO: 608981 - DNA, 25 bp, Rattus norvegicus
gcctggctccgcactctagagagtt

SEQ ID NO: 608982 - DNA, 25 bp, Rattus norvegicus
ttttccagattacgaccggcacacg

SEQ ID NO: 608983 - DNA, 25 bp, Rattus norvegicus
gcggcccgagccacattcaatttga

SEQ ID NO: 608984 - DNA, 25 bp, Rattus norvegicus
ccaatcagtacgatgggcggggcct

SEQ ID NO: 608985 - DNA, 25 bp, Rattus norvegicus
ctggagaggtgcttcagctcgaagt

SEQ ID NO: 608986 - DNA, 25 bp, Rattus norvegicus
ctcgaagtgtttggtgatgcgtgac

SEQ ID NO: 608987 - DNA, 25 bp, Rattus norvegicus
gatgcgtgacgacacggtgccctta

SEQ ID NO: 608988 - DNA, 25 bp, Rattus norvegicus
tgacgacacggtgcccttaccggag

SEQ ID NO: 608989 - DNA, 25 bp, Rattus norvegicus
tggcctgggcgctcaaaggctctga

SEQ ID NO: 608990 - DNA, 25 bp, Rattus norvegicus
cctgcagcatgttctggcggagcag

SEQ ID NO: 608991 - DNA, 25 bp, Rattus norvegicus
tctcccggaagtgagcgacggccac

SEQ ID NO: 608992 - DNA, 25 bp, Rattus norvegicus
ctggcccgctggcaactgcaagcgg

SEQ ID NO: 608993 - DNA, 25 bp, Rattus norvegicus
gctcaaaggctctgaggccctggcc

SEQ ID NO: 608994 - DNA, 25 bp, Rattus norvegicus
cggggagcactgtacccgcgtcgca

SEQ ID NO: 608995 - DNA, 25 bp, Rattus norvegicus
agctgcccacggaggccagaggatt

SEQ ID NO: 608996 - DNA, 25 bp, Rattus norvegicus
atctacccgaagctgcccacggagg

SEQ ID NO: 608997 - DNA, 25 bp, Rattus norvegicus
cccgcgcttcttggcattcccggac

SEQ ID NO: 608998 - DNA, 25 bp, Rattus norvegicus
ctgtgccctgcagcatgttctggcg

SEQ ID NO: 608999 - DNA, 25 bp, Rattus norvegicus
aacccaaggagtccgcgcggtgtgc

SEQ ID NO: 609000 - DNA, 25 bp, Rattus norvegicus
aaagcccggtgtccctacgcggatg

SEQ ID NO: 609001 - DNA, 25 bp, Rattus norvegicus
tccctacgcggatgggcggtcccga

SEQ ID NO: 609002 - DNA, 25 bp, Rattus norvegicus
ctgggagcagcaagccttggatcgc

SEQ ID NO: 609003 - DNA, 25 bp, Rattus norvegicus
tcttccatgtcggagccgaagagca

SEQ ID NO: 609004 - DNA, 25 bp, Rattus norvegicus
ttagagggtccatcttccatgtcgg

SEQ ID NO: 609005 - DNA, 25 bp, Rattus norvegicus
tcgcattgttagagggtccatcttc

SEQ ID NO: 609006 - DNA, 25 bp, Rattus norvegicus
gccttcggaagcaactcgcattgtt

SEQ ID NO: 609007 - DNA, 25 bp, Rattus norvegicus
ggaaacactcggtcagccttcggaa

SEQ ID NO: 609008 - DNA, 25 bp, Rattus norvegicus
cttactggggctgaggaaacactcg

SEQ ID NO: 609009 - DNA, 25 bp, Rattus norvegicus
ggccaatatccgtcaggtacacaca

SEQ ID NO: 609010 - DNA, 25 bp, Rattus norvegicus
ttcctgagacccactggccaatatc

SEQ ID NO: 609011 - DNA, 25 bp, Rattus norvegicus
cagaggtgccaccagcttcctgaga

SEQ ID NO: 609012 - DNA, 25 bp, Rattus norvegicus
agcagcaagccttggatcgcaggcg

SEQ ID NO: 609013 - DNA, 25 bp, Rattus norvegicus
cctggttagcttgttgctacgaatc

SEQ ID NO: 609014 - DNA, 25 bp, Rattus norvegicus
ccagctctcccgtgggccaatgaga

SEQ ID NO: 609015 - DNA, 25 bp, Rattus norvegicus
atttcggcaaggacccagacccagc

SEQ ID NO: 609016 - DNA, 25 bp, Rattus norvegicus
taacaacagggtaagcgcgccaatc

SEQ ID NO: 609017 - DNA, 25 bp, Rattus norvegicus
gcgccaatcctgttctcttctgttg

SEQ ID NO: 609018 - DNA, 25 bp, Rattus norvegicus
gagccattgcctcctttggcgcata

SEQ ID NO: 609019 - DNA, 25 bp, Rattus norvegicus
gcataggccgtgaaagtcgtgcaca

SEQ ID NO: 609020 - DNA, 25 bp, Rattus norvegicus
gcgccagggttttcccgcaacacta

SEQ ID NO: 609021 - DNA, 25 bp, Rattus norvegicus
gacccggtgtctagtcgctctgtct

SEQ ID NO: 609022 - DNA, 25 bp, Rattus norvegicus
tgttctaaaccacgtggacgcgtcg

SEQ ID NO: 609023 - DNA, 25 bp, Rattus norvegicus
cactccctcagctacgcggggtgta

SEQ ID NO: 609024 - DNA, 25 bp, Rattus norvegicus
gtgtaacttcctgcgccagaggctg

SEQ ID NO: 609025 - DNA, 25 bp, Rattus norvegicus
cgcccggtcaagatccgcaggattc

SEQ ID NO: 609026 - DNA, 25 bp, Rattus norvegicus
gcggctcctggtcgcgaatagtaaa

SEQ ID NO: 609027 - DNA, 25 bp, Rattus norvegicus
cccacctccgctggcttgcctacgc

SEQ ID NO: 609028 - DNA, 25 bp, Rattus norvegicus
cagggagccacatgtggaagcgaaa

SEQ ID NO: 609029 - DNA, 25 bp, Rattus norvegicus
cggcctcccgccgagctgacaggct

SEQ ID NO: 609030 - DNA, 25 bp, Rattus norvegicus
cccgggaatctccacgcgcgcctcc

SEQ ID NO: 609031 - DNA, 25 bp, Rattus norvegicus
tgcgctaacccgcacccgcctcgct

SEQ ID NO: 609032 - DNA, 25 bp, Rattus norvegicus
aagcacgcccagagactgcgctaac

SEQ ID NO: 609033 - DNA, 25 bp, Rattus norvegicus
gactcattcccagccggctcctcgg

SEQ ID NO: 609034 - DNA, 25 bp, Rattus norvegicus
tcccggccgggctgactcattccca

SEQ ID NO: 609035 - DNA, 25 bp, Rattus norvegicus
tatcagctcggacgcaccggggcct

SEQ ID NO: 609036 - DNA, 25 bp, Rattus norvegicus
ccacatgtggaagcgaaagcaggaa

SEQ ID NO: 609037 - DNA, 25 bp, Rattus norvegicus
tatcctatcagctcggacgcaccgg

SEQ ID NO: 609038 - DNA, 25 bp, Rattus norvegicus
aggccgcaagcacgcccagagactg

SEQ ID NO: 609039 - DNA, 25 bp, Rattus norvegicus
ggcagcggctgcctatcctatcagc

SEQ ID NO: 609040 - DNA, 25 bp, Rattus norvegicus
tagacctcggccctcccgacacgtc

SEQ ID NO: 609041 - DNA, 25 bp, Rattus norvegicus
cattggaaactttggcctggcgtta

SEQ ID NO: 609042 - DNA, 25 bp, Rattus norvegicus
ctctgctttaccgtggcattcagga

SEQ ID NO: 609043 - DNA, 25 bp, Rattus norvegicus
gaagccagttatctttgactgccgc

SEQ ID NO: 609044 - DNA, 25 bp, Rattus norvegicus
ctttaccgtggcattcaggacattg

SEQ ID NO: 609045 - DNA, 25 bp, Rattus norvegicus
ccgtggcattcaggacattgtggta

SEQ ID NO: 609046 - DNA, 25 bp, Rattus norvegicus
gggtacagaagccagttatctttga

SEQ ID NO: 609047 - DNA, 25 bp, Rattus norvegicus
tgagtccattggaaactttggcctg

SEQ ID NO: 609048 - DNA, 25 bp, Rattus norvegicus
cggtggaagccaaacaggtggctca

SEQ ID NO: 609049 - DNA, 25 bp, Rattus norvegicus
ttcacagaggcggtggaagccaaac

SEQ ID NO: 609050 - DNA, 25 bp, Rattus norvegicus
catgatgagcgagtgctgccatcta

SEQ ID NO: 609051 - DNA, 25 bp, Rattus norvegicus
ggaccatgatgagcgagtgctgcca

SEQ ID NO: 609052 - DNA, 25 bp, Rattus norvegicus
tgccgctctcgaccaccgaatgtac

SEQ ID NO: 609053 - DNA, 25 bp, Rattus norvegicus
gtgaactctgctttaccgtggcatt

SEQ ID NO: 609054 - DNA, 25 bp, Rattus norvegicus
ggaaactttggcctggcgttagcag

SEQ ID NO: 609055 - DNA, 25 bp, Rattus norvegicus
acttctcccgagaggcccggatcta

SEQ ID NO: 609056 - DNA, 25 bp, Rattus norvegicus
acatcgagcccagaggcctgcgttc

SEQ ID NO: 609057 - DNA, 25 bp, Rattus norvegicus
actgcgtcgcgcagcatcgcgtcgg

SEQ ID NO: 609058 - DNA, 25 bp, Rattus norvegicus
tgtatttcctgagcggctggcccaa

SEQ ID NO: 609059 - DNA, 25 bp, Rattus norvegicus
tccagtctgaccctcggagagcgtt

SEQ ID NO: 609060 - DNA, 25 bp, Rattus norvegicus
gagagcgttcttcgccgtgctggcc

SEQ ID NO: 609061 - DNA, 25 bp, Rattus norvegicus
aggcggaccgagcagtcaacatcga

SEQ ID NO: 609062 - DNA, 25 bp, Rattus norvegicus
tacagccgagtaagtaggcgccgcc

SEQ ID NO: 609063 - DNA, 25 bp, Rattus norvegicus
cggtcagcgtccgagactgcgtcgc

SEQ ID NO: 609064 - DNA, 25 bp, Rattus norvegicus
aactggcgcgtctaccgccgagcga

SEQ ID NO: 609065 - DNA, 25 bp, Rattus norvegicus
tgagcctgtcgcctcattccggtct

SEQ ID NO: 609066 - DNA, 25 bp, Rattus norvegicus
cctcagcatctggtacagccgagta

SEQ ID NO: 609067 - DNA, 25 bp, Rattus norvegicus
cgcgcgcggaccatgtatttcctga

SEQ ID NO: 609068 - DNA, 25 bp, Rattus norvegicus
gtccaggtcgccagcaaggcggacc

SEQ ID NO: 609069 - DNA, 25 bp, Rattus norvegicus
gacagctgcacgagcgcccgcagag

SEQ ID NO: 609070 - DNA, 25 bp, Rattus norvegicus
ccggcaattcagacctcaaaaggac

SEQ ID NO: 609071 - DNA, 25 bp, Rattus norvegicus
tccgcagcgcctcctagtgagcgga

SEQ ID NO: 609072 - DNA, 25 bp, Rattus norvegicus
tgcgcgcctcggacagcgcggtctt

SEQ ID NO: 609073 - DNA, 25 bp, Rattus norvegicus
tggcgcgcatcgaactcgccctgga

SEQ ID NO: 609074 - DNA, 25 bp, Rattus norvegicus
cgtacctggcttggcgcgcatcgaa

SEQ ID NO: 609075 - DNA, 25 bp, Rattus norvegicus
gccgatcgaccgtacctggcttggc

SEQ ID NO: 609076 - DNA, 25 bp, Rattus norvegicus
tgactccctcgccagggcacagtgg

SEQ ID NO: 609077 - DNA, 25 bp, Rattus norvegicus
ggactctgcataccacggcctgact

SEQ ID NO: 609078 - DNA, 25 bp, Rattus norvegicus
cgacgtgcgcccaaggatcccggga

SEQ ID NO: 609079 - DNA, 25 bp, Rattus norvegicus
tcaaaaggacgctcgggaccatccc

SEQ ID NO: 609080 - DNA, 25 bp, Rattus norvegicus
cgaaagagggagactggcaagtccc

SEQ ID NO: 609081 - DNA, 25 bp, Rattus norvegicus
ccggtaccggcaattcagacctcaa

SEQ ID NO: 609082 - DNA, 25 bp, Rattus norvegicus
tgaggcctctctctgcgggtgcgac

SEQ ID NO: 609083 - DNA, 25 bp, Rattus norvegicus
tctgctccagcaacatctccagttt

SEQ ID NO: 609084 - DNA, 25 bp, Rattus norvegicus
gtgcgcactttttcctctcatacta

SEQ ID NO: 609085 - DNA, 25 bp, Rattus norvegicus
gaggagagctaggtgccctactctc

SEQ ID NO: 609086 - DNA, 25 bp, Rattus norvegicus
gggccgcttcctcagagatccacgg

SEQ ID NO: 609087 - DNA, 25 bp, Rattus norvegicus
tagccctgctgcagctcgtaggtca

SEQ ID NO: 609088 - DNA, 25 bp, Rattus norvegicus
actggccgctggagaacttctcctc

SEQ ID NO: 609089 - DNA, 25 bp, Rattus norvegicus
gaagtccgccacaaactccgtgatg

SEQ ID NO: 609090 - DNA, 25 bp, Rattus norvegicus
aggcggtagcatgtctccagcatca

SEQ ID NO: 609091 - DNA, 25 bp, Rattus norvegicus
tttagagatccagtggtcgacgccg

SEQ ID NO: 609092 - DNA, 25 bp, Rattus norvegicus
cagtttctggccctgtttagagatc

SEQ ID NO: 609093 - DNA, 25 bp, Rattus norvegicus
cttaccgagagagaagcgccaactt

SEQ ID NO: 609094 - DNA, 25 bp, Rattus norvegicus
gaccgggctcgcttaccgagagaga

SEQ ID NO: 609095 - DNA, 25 bp, Rattus norvegicus
gtcggtctgtcagtcccactaggga

SEQ ID NO: 609096 - DNA, 25 bp, Rattus norvegicus
tcatactacccttattcgtcgggcc

SEQ ID NO: 609097 - DNA, 25 bp, Rattus norvegicus
accgggcccggcgacaactgtcagt

SEQ ID NO: 609098 - DNA, 25 bp, Rattus norvegicus
atgcgtaggagcacacggtggctcc

SEQ ID NO: 609099 - DNA, 25 bp, Rattus norvegicus
cccggcgacaactgtcagttagaag

SEQ ID NO: 609100 - DNA, 25 bp, Rattus norvegicus
agccgtgtagagaggcaaagaaaga

SEQ ID NO: 609101 - DNA, 25 bp, Rattus norvegicus
caaagaaagaggtaccgtcgccatt

SEQ ID NO: 609102 - DNA, 25 bp, Rattus norvegicus
cccggcgcgcatgcgtaggagcaca

SEQ ID NO: 609103 - DNA, 25 bp, Rattus norvegicus
aaacccggacttggctcctccacag

SEQ ID NO: 609104 - DNA, 25 bp, Rattus norvegicus
ccggacttggctcctccacaggcct

SEQ ID NO: 609105 - DNA, 25 bp, Rattus norvegicus
ggcccggcgacaactgtcagttaga

SEQ ID NO: 609106 - DNA, 25 bp, Rattus norvegicus
ggcgacaactgtcagttagaagccc

SEQ ID NO: 609107 - DNA, 25 bp, Rattus norvegicus
actgtcagttagaagccccgctggg

SEQ ID NO: 609108 - DNA, 25 bp, Rattus norvegicus
agagccgtgtagagaggcaaagaaa

SEQ ID NO: 609109 - DNA, 25 bp, Rattus norvegicus
ccctgtctacctgcaggggacctgg

SEQ ID NO: 609110 - DNA, 25 bp, Rattus norvegicus
gtaccgtcgccattcccggcgcgca

SEQ ID NO: 609111 - DNA, 25 bp, Rattus norvegicus
gccgccgagacatggcttcttccta

SEQ ID NO: 609112 - DNA, 25 bp, Rattus norvegicus
tgttcgacgtaaggcccgagtgcca

SEQ ID NO: 609113 - DNA, 25 bp, Rattus norvegicus
ggacgtttctcgcaaagccaccatc

SEQ ID NO: 609114 - DNA, 25 bp, Rattus norvegicus
agacgcgcaccatcgaggacgtttc

SEQ ID NO: 609115 - DNA, 25 bp, Rattus norvegicus
gcagagaaccggatccttcagagga

SEQ ID NO: 609116 - DNA, 25 bp, Rattus norvegicus
cgaacggtctagagcgtcagtcttc

SEQ ID NO: 609117 - DNA, 25 bp, Rattus norvegicus
cttcctatttgtgaggcgcaggctg

SEQ ID NO: 609118 - DNA, 25 bp, Rattus norvegicus
tataagtaaacactccgcgccgccg

SEQ ID NO: 609119 - DNA, 25 bp, Rattus norvegicus
acctccatgtgggagctgcatctct

SEQ ID NO: 609120 - DNA, 25 bp, Rattus norvegicus
tttcctatattagcgctctgggccg

SEQ ID NO: 609121 - DNA, 25 bp, Rattus norvegicus
tggcgggcgcaaatccttgtgttaa

SEQ ID NO: 609122 - DNA, 25 bp, Rattus norvegicus
ttgagaccatagagcatcggcctta

SEQ ID NO: 609123 - DNA, 25 bp, Rattus norvegicus
caaatgcgcctagcggatcggaagc

SEQ ID NO: 609124 - DNA, 25 bp, Rattus norvegicus
gtttccttccacctcggagagagtg

SEQ ID NO: 609125 - DNA, 25 bp, Rattus norvegicus
tgagtccacacgtgggcggccctgc

SEQ ID NO: 609126 - DNA, 25 bp, Rattus norvegicus
tggcgtcctcccgtttccttggcaa

SEQ ID NO: 609127 - DNA, 25 bp, Rattus norvegicus
tggcaaccgggcctccctcctcgcg

SEQ ID NO: 609128 - DNA, 25 bp, Rattus norvegicus
tcctcgcgcggagcttgtgccgcta

SEQ ID NO: 609129 - DNA, 25 bp, Rattus norvegicus
cttgtgccgctagtcgcgagggaac

SEQ ID NO: 609130 - DNA, 25 bp, Rattus norvegicus
ctagtcgcgagggaacgtggatcgt

SEQ ID NO: 609131 - DNA, 25 bp, Rattus norvegicus
gtcctgagtccacacgtgggcggcc

SEQ ID NO: 609132 - DNA, 25 bp, Rattus norvegicus
gcggccctgccggttgccgtgggaa

SEQ ID NO: 609133 - DNA, 25 bp, Rattus norvegicus
atcaatcgtgcgtggggccggtcct

SEQ ID NO: 609134 - DNA, 25 bp, Rattus norvegicus
cccatcaatcgtgcgtggggccggt

SEQ ID NO: 609135 - DNA, 25 bp, Rattus norvegicus
agccgcccatcaatcgtgcgtgggg

SEQ ID NO: 609136 - DNA, 25 bp, Rattus norvegicus
aagagccgcccatcaatcgtgcgtg

SEQ ID NO: 609137 - DNA, 25 bp, Rattus norvegicus
cacagcagaagagccgcccatcaat

SEQ ID NO: 609138 - DNA, 25 bp, Rattus norvegicus
tcacgtcttcctccctctagcggcc

SEQ ID NO: 609139 - DNA, 25 bp, Rattus norvegicus
gccctgcccgggatcagataactgc

SEQ ID NO: 609140 - DNA, 25 bp, Rattus norvegicus
aggagttaccgagctgggctactgt

SEQ ID NO: 609141 - DNA, 25 bp, Rattus norvegicus
taccgagctgggctactgtggcagc

SEQ ID NO: 609142 - DNA, 25 bp, Rattus norvegicus
tgggtgcgcgcagaagcttctgcct

SEQ ID NO: 609143 - DNA, 25 bp, Rattus norvegicus
cacgccgagactgcgctgccaccgt

SEQ ID NO: 609144 - DNA, 25 bp, Rattus norvegicus
agggtgccctgtacgatcgaagccc

SEQ ID NO: 609145 - DNA, 25 bp, Rattus norvegicus
tgggaggtgcacgacacgccacacc

SEQ ID NO: 609146 - DNA, 25 bp, Rattus norvegicus
tgcccgggatcagataactgcggcg

SEQ ID NO: 609147 - DNA, 25 bp, Rattus norvegicus
tcttgtcgcgggactgagcgacaga

SEQ ID NO: 609148 - DNA, 25 bp, Rattus norvegicus
cgacagaagccagcggcaagcccgg

SEQ ID NO: 609149 - DNA, 25 bp, Rattus norvegicus
cggcaacggtggcaatgcagccagc

SEQ ID NO: 609150 - DNA, 25 bp, Rattus norvegicus
acggtggcaatgcagccagcgcagc

SEQ ID NO: 609151 - DNA, 25 bp, Rattus norvegicus
actgagcgacagaagccagcggcaa

SEQ ID NO: 609152 - DNA, 25 bp, Rattus norvegicus
ctgtacgatcgaagcccgctgggag

SEQ ID NO: 609153 - DNA, 25 bp, Rattus norvegicus
ggaggcacctgctccgcacacttta

SEQ ID NO: 609154 - DNA, 25 bp, Rattus norvegicus
cacactttaagcgtcgcccgaaggc

SEQ ID NO: 609155 - DNA, 25 bp, Rattus norvegicus
actgcactaactccggcaaagttcc

SEQ ID NO: 609156 - DNA, 25 bp, Rattus norvegicus
gcagcgaactgcactaactccggca

SEQ ID NO: 609157 - DNA, 25 bp, Rattus norvegicus
gcaatgaatgggtgcagcgaactgc

SEQ ID NO: 609158 - DNA, 25 bp, Rattus norvegicus
tgcagtccgtggattccctccctga

SEQ ID NO: 609159 - DNA, 25 bp, Rattus norvegicus
ttcccagtccacgagggtcagcggc

SEQ ID NO: 609160 - DNA, 25 bp, Rattus norvegicus
atgccctggcacacagctgcatgga

SEQ ID NO: 609161 - DNA, 25 bp, Rattus norvegicus
cgagcgaagtcatcgtgtctgggca

SEQ ID NO: 609162 - DNA, 25 bp, Rattus norvegicus
gccgatgtgtctccgagcgaagtca

SEQ ID NO: 609163 - DNA, 25 bp, Rattus norvegicus
cggtctttgtctcccgggccgatgt

SEQ ID NO: 609164 - DNA, 25 bp, Rattus norvegicus
tgcagcatctccctccggtctttgt

SEQ ID NO: 609165 - DNA, 25 bp, Rattus norvegicus
ctcgcttccaagctggggcccggga

SEQ ID NO: 609166 - DNA, 25 bp, Rattus norvegicus
gcacacagctgcatggacgccgtca

SEQ ID NO: 609167 - DNA, 25 bp, Rattus norvegicus
aggtcgcaaacaggaaaaagtcagg

SEQ ID NO: 609168 - DNA, 25 bp, Rattus norvegicus
agtcaggaagagagagatcactttg

SEQ ID NO: 609169 - DNA, 25 bp, Rattus norvegicus
gcaggttcttgatcgcgttggaatt

SEQ ID NO: 609170 - DNA, 25 bp, Rattus norvegicus
tcgcgttggaattgatgagaactga

SEQ ID NO: 609171 - DNA, 25 bp, Rattus norvegicus
actgagttcaaggtggcgctgactc

SEQ ID NO: 609172 - DNA, 25 bp, Rattus norvegicus
gcagagagccatcgttgaaagcacg

SEQ ID NO: 609173 - DNA, 25 bp, Rattus norvegicus
ttgaaagcacgaccaagaaccggac

SEQ ID NO: 609174 - DNA, 25 bp, Rattus norvegicus
agaaccggacagctgccactgcacg

SEQ ID NO: 609175 - DNA, 25 bp, Rattus norvegicus
gcacgcacaaccgtcatctcagaag

SEQ ID NO: 609176 - DNA, 25 bp, Rattus norvegicus
gatcactttgcacagcggctgcaga

SEQ ID NO: 609177 - DNA, 25 bp, Rattus norvegicus
cagagtctgggctgcggaacctcaa

SEQ ID NO: 609178 - DNA, 25 bp, Rattus norvegicus
gctgcggaacctcaacttcggaacc

SEQ ID NO: 609179 - DNA, 25 bp, Rattus norvegicus
agtctcggctgccaggcgcacagct

SEQ ID NO: 609180 - DNA, 25 bp, Rattus norvegicus
tcatctcagaaggtcgcaaacagga

SEQ ID NO: 609181 - DNA, 25 bp, Rattus norvegicus
gagaagagtcccgatcgccgcgccc

SEQ ID NO: 609182 - DNA, 25 bp, Rattus norvegicus
cagcggagaaaagcgccgcagtgcc

SEQ ID NO: 609183 - DNA, 25 bp, Rattus norvegicus
gagcaagagcctcggcggctgctcc

SEQ ID NO: 609184 - DNA, 25 bp, Rattus norvegicus
gtgcgcgctccggagcaagagcctc

SEQ ID NO: 609185 - DNA, 25 bp, Rattus norvegicus
tggtacgcaggatccgcgtccttcc

SEQ ID NO: 609186 - DNA, 25 bp, Rattus norvegicus
tgttccctttgggattcacgaggac

SEQ ID NO: 609187 - DNA, 25 bp, Rattus norvegicus
tcacatcgtgttccctttgggattc

SEQ ID NO: 609188 - DNA, 25 bp, Rattus norvegicus
ggttcacatcgtgttccctttggga

SEQ ID NO: 609189 - DNA, 25 bp, Rattus norvegicus
tctgcctcttgggtctctggtgcct

SEQ ID NO: 609190 - DNA, 25 bp, Rattus norvegicus
ggctctggtccggtctgcctcttgg

SEQ ID NO: 609191 - DNA, 25 bp, Rattus norvegicus
accgcccgcgcccacgttgcgcgtc

SEQ ID NO: 609192 - DNA, 25 bp, Rattus norvegicus
acgttgcgcgtccacccggactcgg

SEQ ID NO: 609193 - DNA, 25 bp, Rattus norvegicus
gcggcggcagaagacgcccactggc

SEQ ID NO: 609194 - DNA, 25 bp, Rattus norvegicus
tgggtctctggtgcctctccggccg

SEQ ID NO: 609195 - DNA, 25 bp, Rattus norvegicus
tcccgcaggtgaaacgcaatgaaaa

SEQ ID NO: 609196 - DNA, 25 bp, Rattus norvegicus
tggttcaccagaggacgacccttgg

SEQ ID NO: 609197 - DNA, 25 bp, Rattus norvegicus
ttacagagcggaagtgtggttcacc

SEQ ID NO: 609198 - DNA, 25 bp, Rattus norvegicus
ttggtgtctgcttccgttacagagc

SEQ ID NO: 609199 - DNA, 25 bp, Rattus norvegicus
ggcctagcggaactatggatttcta

SEQ ID NO: 609200 - DNA, 25 bp, Rattus norvegicus
tagtccggtctcaggaagcagtttc

SEQ ID NO: 609201 - DNA, 25 bp, Rattus norvegicus
ctgtcagtaactaggcgcgtaaagc

SEQ ID NO: 609202 - DNA, 25 bp, Rattus norvegicus
agttctaatgtatccggcgaccgca

SEQ ID NO: 609203 - DNA, 25 bp, Rattus norvegicus
agtccgatcggccatttttaatgag

SEQ ID NO: 609204 - DNA, 25 bp, Rattus norvegicus
ctaaacgctcggcaggaatcatgtc

SEQ ID NO: 609205 - DNA, 25 bp, Rattus norvegicus
gacgctgatgctgcccgtaaccata

SEQ ID NO: 609206 - DNA, 25 bp, Rattus norvegicus
cagttgtcagtttccgtctcgtcta

SEQ ID NO: 609207 - DNA, 25 bp, Rattus norvegicus
agacccagccatggatcgatcactg

SEQ ID NO: 609208 - DNA, 25 bp, Rattus norvegicus
cccgtaaccatagtgaagtccgatc

SEQ ID NO: 609209 - DNA, 25 bp, Rattus norvegicus
aaacaggtccagctcaggatgaacc

SEQ ID NO: 609210 - DNA, 25 bp, Rattus norvegicus
tctccgggtttagggatgagcaaaa

SEQ ID NO: 609211 - DNA, 25 bp, Rattus norvegicus
accgagagtttcagtgtgcagattc

SEQ ID NO: 609212 - DNA, 25 bp, Rattus norvegicus
agcttccctcgacttgagaccaaag

SEQ ID NO: 609213 - DNA, 25 bp, Rattus norvegicus
ctgcctcgcgagtgcaaaagcttcc

SEQ ID NO: 609214 - DNA, 25 bp, Rattus norvegicus
tgtaaatcccgcagggtgcccatgc

SEQ ID NO: 609215 - DNA, 25 bp, Rattus norvegicus
tcctggagcgcgtactgtaaatccc

SEQ ID NO: 609216 - DNA, 25 bp, Rattus norvegicus
atcgatgagagcatcccgctgcctc

SEQ ID NO: 609217 - DNA, 25 bp, Rattus norvegicus
cagcttctggatcagttcgtccttc

SEQ ID NO: 609218 - DNA, 25 bp, Rattus norvegicus
tgtccagttcattctgcagcttctg

SEQ ID NO: 609219 - DNA, 25 bp, Rattus norvegicus
ttaccgagcggtacttgtccagttc

SEQ ID NO: 609220 - DNA, 25 bp, Rattus norvegicus
gtgccaaaggaagccagcgatgtgt

SEQ ID NO: 609221 - DNA, 25 bp, Rattus norvegicus
ttcaccctgcaaggtgctggcgctc

SEQ ID NO: 609222 - DNA, 25 bp, Rattus norvegicus
taaccctgcttactgtgggctcttg

SEQ ID NO: 609223 - DNA, 25 bp, Rattus norvegicus
cggacagtcagggttctctcccagc

SEQ ID NO: 609224 - DNA, 25 bp, Rattus norvegicus
gagcgcggggtagcaaactttccgc

SEQ ID NO: 609225 - DNA, 25 bp, Rattus norvegicus
tagcaaactttccgcggtccttctc

SEQ ID NO: 609226 - DNA, 25 bp, Rattus norvegicus
ccacaggggcgcgtctccacggaga

SEQ ID NO: 609227 - DNA, 25 bp, Rattus norvegicus
gcgtctccacggagagctcgccttt

SEQ ID NO: 609228 - DNA, 25 bp, Rattus norvegicus
ccgccagagacaactacagcacgtg

SEQ ID NO: 609229 - DNA, 25 bp, Rattus norvegicus
ctacagcacgtgatgcacagaaaca

SEQ ID NO: 609230 - DNA, 25 bp, Rattus norvegicus
cctgcgcctacctctcggatttagt

SEQ ID NO: 609231 - DNA, 25 bp, Rattus norvegicus
ctacctctcggatttagtgaacttc

SEQ ID NO: 609232 - DNA, 25 bp, Rattus norvegicus
atttagtgaacttccggaacgcctg

SEQ ID NO: 609233 - DNA, 25 bp, Rattus norvegicus
ttccggaacgcctggcgcaggtcgt

SEQ ID NO: 609234 - DNA, 25 bp, Rattus norvegicus
acctgtaggtctgcggctccgcgga

SEQ ID NO: 609235 - DNA, 25 bp, Rattus norvegicus
agggttctctcccagcgtgggctcc

SEQ ID NO: 609236 - DNA, 25 bp, Rattus norvegicus
caagagacagtagcccgcgccgtcg

SEQ ID NO: 609237 - DNA, 25 bp, Rattus norvegicus
ctccggagccagcagctctgacaga

SEQ ID NO: 609238 - DNA, 25 bp, Rattus norvegicus
ctaatatatatcatacaagtcaggg

SEQ ID NO: 609239 - DNA, 25 bp, Rattus norvegicus
tcacgtgcatggaccaggtaaagtg

SEQ ID NO: 609240 - DNA, 25 bp, Rattus norvegicus
ctctgacagacaagcaggattcctg

SEQ ID NO: 609241 - DNA, 25 bp, Rattus norvegicus
agggactacgtaacattgaaacatg

SEQ ID NO: 609242 - DNA, 25 bp, Rattus norvegicus
aaagtaagttgttccggagctgctc

SEQ ID NO: 609243 - DNA, 25 bp, Rattus norvegicus
ccggtgagagagacacggaaacaga

SEQ ID NO: 609244 - DNA, 25 bp, Rattus norvegicus
acttggagaggcaaacccggtgaga

SEQ ID NO: 609245 - DNA, 25 bp, Rattus norvegicus
tagagctacttggagaggcaaaccc

SEQ ID NO: 609246 - DNA, 25 bp, Rattus norvegicus
gcctttgaaccttgattagagctac

SEQ ID NO: 609247 - DNA, 25 bp, Rattus norvegicus
gcctgtccgtacctttagcctttga

SEQ ID NO: 609248 - DNA, 25 bp, Rattus norvegicus
ggaccaggtaaagtgcctgtccgta

SEQ ID NO: 609249 - DNA, 25 bp, Rattus norvegicus
caagttagtatcacgtgcatggacc

SEQ ID NO: 609250 - DNA, 25 bp, Rattus norvegicus
ttccacacaaatggcctcaaattta

SEQ ID NO: 609251 - DNA, 25 bp, Rattus norvegicus
agtcttcgagaaactaccatcgggg

SEQ ID NO: 609252 - DNA, 25 bp, Rattus norvegicus
tgcgacacttgtgactccctcatga

SEQ ID NO: 609253 - DNA, 25 bp, Rattus norvegicus
tcacttgcacgcgagtcgtggcagc

SEQ ID NO: 609254 - DNA, 25 bp, Rattus norvegicus
tgtaaaatggatggacctcaaactc

SEQ ID NO: 609255 - DNA, 25 bp, Rattus norvegicus
ccatcggggacagttgttagcgaac

SEQ ID NO: 609256 - DNA, 25 bp, Rattus norvegicus
agcagggtacgcaaactcagtcttc

SEQ ID NO: 609257 - DNA, 25 bp, Rattus norvegicus
ccagcccgagagttgtgcgactaaa

SEQ ID NO: 609258 - DNA, 25 bp, Rattus norvegicus
gaagcccaattaggagccagcccga

SEQ ID NO: 609259 - DNA, 25 bp, Rattus norvegicus
tccgcccggatcagaagcccaatta

SEQ ID NO: 609260 - DNA, 25 bp, Rattus norvegicus
ggcccaaatggtgggtttcatccgc

SEQ ID NO: 609261 - DNA, 25 bp, Rattus norvegicus
gaattggagatgctggcccttccca

SEQ ID NO: 609262 - DNA, 25 bp, Rattus norvegicus
ggacccagctgagtcccgcaggaca

SEQ ID NO: 609263 - DNA, 25 bp, Rattus norvegicus
ggcagccgccggaattctttccacg

SEQ ID NO: 609264 - DNA, 25 bp, Rattus norvegicus
gttagcgaactacactggcattttc

SEQ ID NO: 609265 - DNA, 25 bp, Rattus norvegicus
agctgacgccggctccacctgtgcc

SEQ ID NO: 609266 - DNA, 25 bp, Rattus norvegicus
cccacatcgaggtttcgagaccgtc

SEQ ID NO: 609267 - DNA, 25 bp, Rattus norvegicus
gtttcgagaccgtcggccacactcg

SEQ ID NO: 609268 - DNA, 25 bp, Rattus norvegicus
gtcggccacactcgctcggagacca

SEQ ID NO: 609269 - DNA, 25 bp, Rattus norvegicus
tcggagaccacgctcgcattcagag

SEQ ID NO: 609270 - DNA, 25 bp, Rattus norvegicus
atccggaagcgcgttctgctcccgc

SEQ ID NO: 609271 - DNA, 25 bp, Rattus norvegicus
catcgaggtttcgagaccgtcggcc

SEQ ID NO: 609272 - DNA, 25 bp, Rattus norvegicus
accggcccacatcgaggtttcgaga

SEQ ID NO: 609273 - DNA, 25 bp, Rattus norvegicus
tcttcaccggcccacatcgaggttt

SEQ ID NO: 609274 - DNA, 25 bp, Rattus norvegicus
ggtgtcgcacgctcctcggacttct

SEQ ID NO: 609275 - DNA, 25 bp, Rattus norvegicus
caagctgccggacagtcgcccacac

SEQ ID NO: 609276 - DNA, 25 bp, Rattus norvegicus
tgccgggagaactacggccgcctgc

SEQ ID NO: 609277 - DNA, 25 bp, Rattus norvegicus
tcggcagcggtgcaccgccctccgc

SEQ ID NO: 609278 - DNA, 25 bp, Rattus norvegicus
gctcctcggacttctccgcctcttc

SEQ ID NO: 609279 - DNA, 25 bp, Rattus norvegicus
ctctggaccaatggccgctgtggta

SEQ ID NO: 609280 - DNA, 25 bp, Rattus norvegicus
gtggcaacattaccacccaggattg

SEQ ID NO: 609281 - DNA, 25 bp, Rattus norvegicus
ctccaagggttgtggcaacattacc

SEQ ID NO: 609282 - DNA, 25 bp, Rattus norvegicus
cgccttcctccaagggttgtggcaa

SEQ ID NO: 609283 - DNA, 25 bp, Rattus norvegicus
cctacttcggcacgaagacacgcta

SEQ ID NO: 609284 - DNA, 25 bp, Rattus norvegicus
cgccctcttccctgacctcttctgc

SEQ ID NO: 609285 - DNA, 25 bp, Rattus norvegicus
caggacatgcgacagctggccctgc

SEQ ID NO: 609286 - DNA, 25 bp, Rattus norvegicus
caatggccgctgtggtacgatgact

SEQ ID NO: 609287 - DNA, 25 bp, Rattus norvegicus
ggctgctgcagacccgcgagtccgt

SEQ ID NO: 609288 - DNA, 25 bp, Rattus norvegicus
agatccgcaagctgaggcagctgca

SEQ ID NO: 609289 - DNA, 25 bp, Rattus norvegicus
ggtgcagctggtcgccctcatccgt

SEQ ID NO: 609290 - DNA, 25 bp, Rattus norvegicus
gacccggtggcttcggtgcttagcc

SEQ ID NO: 609291 - DNA, 25 bp, Rattus norvegicus
tacgaccaagcagatccgcaagctg

SEQ ID NO: 609292 - DNA, 25 bp, Rattus norvegicus
gagtggccgccgctctggaccaatg

SEQ ID NO: 609293 - DNA, 25 bp, Rattus norvegicus
accgccgccatccacgtctctgcac

SEQ ID NO: 609294 - DNA, 25 bp, Rattus norvegicus
catgtcggagatcaagaagcagaag

SEQ ID NO: 609295 - DNA, 25 bp, Rattus norvegicus
tcccagccgcagcatgtcggagatc

SEQ ID NO: 609296 - DNA, 25 bp, Rattus norvegicus
tgaggagcctttttatacctccttc

SEQ ID NO: 609297 - DNA, 25 bp, Rattus norvegicus
cgcagcatgtcggagatcaagaagc

SEQ ID NO: 609298 - DNA, 25 bp, Rattus norvegicus
cggtcaagggaagtgcgacgtgtct

SEQ ID NO: 609299 - DNA, 25 bp, Rattus norvegicus
agcagaagacggtaggctgccagcc

SEQ ID NO: 609300 - DNA, 25 bp, Rattus norvegicus
aagacggtaggctgccagccgcccg

SEQ ID NO: 609301 - DNA, 25 bp, Rattus norvegicus
ctaccctgccgagcctcagtgggtc

SEQ ID NO: 609302 - DNA, 25 bp, Rattus norvegicus
gacccggagccgagagggaagacac

SEQ ID NO: 609303 - DNA, 25 bp, Rattus norvegicus
agacacgggtgtcccgggacgtgca

SEQ ID NO: 609304 - DNA, 25 bp, Rattus norvegicus
gacgtggacgctaagtctgcgtccc

SEQ ID NO: 609305 - DNA, 25 bp, Rattus norvegicus
ggccaccctccgagcgcctctcgct

SEQ ID NO: 609306 - DNA, 25 bp, Rattus norvegicus
gtctctgcaccctggacccgggctc

SEQ ID NO: 609307 - DNA, 25 bp, Rattus norvegicus
gttaccatgtcaggcgccaacggtt

SEQ ID NO: 609308 - DNA, 25 bp, Rattus norvegicus
gatgaccgcagccagtcgggccaac

SEQ ID NO: 609309 - DNA, 25 bp, Rattus norvegicus
acgggctgcacctggttaccatgtc

SEQ ID NO: 609310 - DNA, 25 bp, Rattus norvegicus
caatggcaaggtgcatacacggcgc

SEQ ID NO: 609311 - DNA, 25 bp, Rattus norvegicus
gccggtgccgcaaccgctttgtcaa

SEQ ID NO: 609312 - DNA, 25 bp, Rattus norvegicus
acggtcagtgcaacattgaattcgc

SEQ ID NO: 609313 - DNA, 25 bp, Rattus norvegicus
tcgccaacatggatgagaagtcaca

SEQ ID NO: 609314 - DNA, 25 bp, Rattus norvegicus
gcgctacctggctgacatgtttacc

SEQ ID NO: 609315 - DNA, 25 bp, Rattus norvegicus
atgtgtggatatccgctggcgctac

SEQ ID NO: 609316 - DNA, 25 bp, Rattus norvegicus
ctggcgctacatgctgctcatcttc

SEQ ID NO: 609317 - DNA, 25 bp, Rattus norvegicus
tctggcctttcttgcctcctggttg

SEQ ID NO: 609318 - DNA, 25 bp, Rattus norvegicus
ctcctggttgctgttcggcatcatc

SEQ ID NO: 609319 - DNA, 25 bp, Rattus norvegicus
ttcggcatcatcttctgggtcattg

SEQ ID NO: 609320 - DNA, 25 bp, Rattus norvegicus
cagcatcgtatcatcagaggaggac

SEQ ID NO: 609321 - DNA, 25 bp, Rattus norvegicus
accaggccgcctacaagagatgtcc

SEQ ID NO: 609322 - DNA, 25 bp, Rattus norvegicus
ccagaggtaagaccagagacgacag

SEQ ID NO: 609323 - DNA, 25 bp, Rattus norvegicus
gcggcgctcaaatgtgaccaacgtg

SEQ ID NO: 609324 - DNA, 25 bp, Rattus norvegicus
ccttggaggttaatccgctggatcc

SEQ ID NO: 609325 - DNA, 25 bp, Rattus norvegicus
ccagcgctgagacctaagggcttgc

SEQ ID NO: 609326 - DNA, 25 bp, Rattus norvegicus
atgtccttgtgagtggccggagtct

SEQ ID NO: 609327 - DNA, 25 bp, Rattus norvegicus
gccctcttacaagcctggtcctgag

SEQ ID NO: 609328 - DNA, 25 bp, Rattus norvegicus
cccggcctcgcacaggaaagaaatg

SEQ ID NO: 609329 - DNA, 25 bp, Rattus norvegicus
aatgcggcctgggagagaacgcttc

SEQ ID NO: 609330 - DNA, 25 bp, Rattus norvegicus
ctgccgagccggtgtgccagtctaa

SEQ ID NO: 609331 - DNA, 25 bp, Rattus norvegicus
acgacagaagcattagcccggcctc

SEQ ID NO: 609332 - DNA, 25 bp, Rattus norvegicus
gcagtgcagggcgatctagtttccc

SEQ ID NO: 609333 - DNA, 25 bp, Rattus norvegicus
tagcgatctagtatccgctgtgccg

SEQ ID NO: 609334 - DNA, 25 bp, Rattus norvegicus
gccagtctaaggcaccgagacggtg

SEQ ID NO: 609335 - DNA, 25 bp, Rattus norvegicus
atccacctgtgagcggtcagcgatc

SEQ ID NO: 609336 - DNA, 25 bp, Rattus norvegicus
tcgtctgttctaaccgggcagcctc

SEQ ID NO: 609337 - DNA, 25 bp, Rattus norvegicus
cagcctctgagcagcttcggaaaga

SEQ ID NO: 609338 - DNA, 25 bp, Rattus norvegicus
caacgcggtcagctagtccgatcca

SEQ ID NO: 609339 - DNA, 25 bp, Rattus norvegicus
ctgaggttcctagggtgctgaccaa

SEQ ID NO: 609340 - DNA, 25 bp, Rattus norvegicus
cgctcgaaagaaacacagggaccta

SEQ ID NO: 609341 - DNA, 25 bp, Rattus norvegicus
tgcaatctgaccacagcgcagggca

SEQ ID NO: 609342 - DNA, 25 bp, Rattus norvegicus
tctaggtaaagacttgccgccgaca

SEQ ID NO: 609343 - DNA, 25 bp, Rattus norvegicus
agactgacaccttgaggacaccgtg

SEQ ID NO: 609344 - DNA, 25 bp, Rattus norvegicus
tgacccacgcgggagacacaatagg

SEQ ID NO: 609345 - DNA, 25 bp, Rattus norvegicus
tttcgggcaaatgaacccagctgcc

SEQ ID NO: 609346 - DNA, 25 bp, Rattus norvegicus
atgcttggctgggagcgttcatctt

SEQ ID NO: 609347 - DNA, 25 bp, Rattus norvegicus
cccgtatgcacaatcatcatgcttg

SEQ ID NO: 609348 - DNA, 25 bp, Rattus norvegicus
ttgccgccgacaaatcctaggaagc

SEQ ID NO: 609349 - DNA, 25 bp, Rattus norvegicus
ggccttcagctaggccgctggcaga

SEQ ID NO: 609350 - DNA, 25 bp, Rattus norvegicus
cgcacaagcaaagagctctgcagcg

SEQ ID NO: 609351 - DNA, 25 bp, Rattus norvegicus
ctctgcagcggcaagggaaaagctg

SEQ ID NO: 609352 - DNA, 25 bp, Rattus norvegicus
ccggcctacttcaccgaggagagtc

SEQ ID NO: 609353 - DNA, 25 bp, Rattus norvegicus
ttcaccgaggagagtcctgtcacgc

SEQ ID NO: 609354 - DNA, 25 bp, Rattus norvegicus
agagtcctgtcacgctctggctgac

SEQ ID NO: 609355 - DNA, 25 bp, Rattus norvegicus
tggctgacccacaactcacctatgt

SEQ ID NO: 609356 - DNA, 25 bp, Rattus norvegicus
cagccttgtcccacagggcgaggta

SEQ ID NO: 609357 - DNA, 25 bp, Rattus norvegicus
tacaggggagcggttatctccttcc

SEQ ID NO: 609358 - DNA, 25 bp, Rattus norvegicus
accagtacccggaacatggcggcgg

SEQ ID NO: 609359 - DNA, 25 bp, Rattus norvegicus
gctcagagaggcgctagcctactca

SEQ ID NO: 609360 - DNA, 25 bp, Rattus norvegicus
tctgctgcagcctcgagtcacgtga

SEQ ID NO: 609361 - DNA, 25 bp, Rattus norvegicus
agtcacgtgactgcgcgcacaagca

SEQ ID NO: 609362 - DNA, 25 bp, Rattus norvegicus
gagcggttatctccttcctcagcag

SEQ ID NO: 609363 - DNA, 25 bp, Rattus norvegicus
gcagccggaccttggcgacgctgct

SEQ ID NO: 609364 - DNA, 25 bp, Rattus norvegicus
gcgtccaacaggaggcgatgacgtc

SEQ ID NO: 609365 - DNA, 25 bp, Rattus norvegicus
ccaacaggaggcgatgacgtctgca

SEQ ID NO: 609366 - DNA, 25 bp, Rattus norvegicus
aggcgatgacgtctgcagcctcgtt

SEQ ID NO: 609367 - DNA, 25 bp, Rattus norvegicus
tcgttgccagagcagtccccaggcg

SEQ ID NO: 609368 - DNA, 25 bp, Rattus norvegicus
atcaaagccacggaggagcggattg

SEQ ID NO: 609369 - DNA, 25 bp, Rattus norvegicus
gttcattgacaggagcagaggcttg

SEQ ID NO: 609370 - DNA, 25 bp, Rattus norvegicus
agtgaaatcaaagccacggaggagc

SEQ ID NO: 609371 - DNA, 25 bp, Rattus norvegicus
tcagcagccggaccttggcgacgct

SEQ ID NO: 609372 - DNA, 25 bp, Rattus norvegicus
gcttggacgtcagcagccggacctt

SEQ ID NO: 609373 - DNA, 25 bp, Rattus norvegicus
agcagaggcttggacgtcagcagcc

SEQ ID NO: 609374 - DNA, 25 bp, Rattus norvegicus
ctgcagcctcgttgccagagcagtc

SEQ ID NO: 609375 - DNA, 25 bp, Rattus norvegicus
cattgacaggagcagaggcttggac

SEQ ID NO: 609376 - DNA, 25 bp, Rattus norvegicus
tgctgttcattgacaggagcagagg

SEQ ID NO: 609377 - DNA, 25 bp, Rattus norvegicus
agccaacgcgaaggaggacgagttc

SEQ ID NO: 609378 - DNA, 25 bp, Rattus norvegicus
ccgacagccagatgttaaccacgtg

SEQ ID NO: 609379 - DNA, 25 bp, Rattus norvegicus
gcgacgttcagcacatcgaagaagg

SEQ ID NO: 609380 - DNA, 25 bp, Rattus norvegicus
cacgcgaagatctcggtgtcgaaga

SEQ ID NO: 609381 - DNA, 25 bp, Rattus norvegicus
aagtcgtaacctgagtggtcctcca

SEQ ID NO: 609382 - DNA, 25 bp, Rattus norvegicus
cacaagtctgtgagtggaccacgga

SEQ ID NO: 609383 - DNA, 25 bp, Rattus norvegicus
gtaccagccaaacggcacaagtctg

SEQ ID NO: 609384 - DNA, 25 bp, Rattus norvegicus
cagcaggcagatcaggacgtgactc

SEQ ID NO: 609385 - DNA, 25 bp, Rattus norvegicus
ttgtagcgtctcaagatgggcaccc

SEQ ID NO: 609386 - DNA, 25 bp, Rattus norvegicus
cacccagggacagaggacatctagc

SEQ ID NO: 609387 - DNA, 25 bp, Rattus norvegicus
gcagctcccagacgctcatgtattg

SEQ ID NO: 609388 - DNA, 25 bp, Rattus norvegicus
accacgaacggtaggcagaagccca

SEQ ID NO: 609389 - DNA, 25 bp, Rattus norvegicus
tgcatcagcgtcactgggaacacga

SEQ ID NO: 609390 - DNA, 25 bp, Rattus norvegicus
gtgacactgaagcatcgcgacgttc

SEQ ID NO: 609391 - DNA, 25 bp, Rattus norvegicus
agcgctccacagtcctctctccggt

SEQ ID NO: 609392 - DNA, 25 bp, Rattus norvegicus
agagcccgccggacactgtcactga

SEQ ID NO: 609393 - DNA, 25 bp, Rattus norvegicus
gccggacactgtcactgaggagatc

SEQ ID NO: 609394 - DNA, 25 bp, Rattus norvegicus
actgtcactgaggagatcccaccgc

SEQ ID NO: 609395 - DNA, 25 bp, Rattus norvegicus
cccggagaaccaaggctctcagtga

SEQ ID NO: 609396 - DNA, 25 bp, Rattus norvegicus
aaccaaggctctcagtgacgccagc

SEQ ID NO: 609397 - DNA, 25 bp, Rattus norvegicus
cgagggtgactctgccctgctgcca

SEQ ID NO: 609398 - DNA, 25 bp, Rattus norvegicus
tgactctgccctgctgccagactgg

SEQ ID NO: 609399 - DNA, 25 bp, Rattus norvegicus
ggggcgcctccaggttatgtaatgc

SEQ ID NO: 609400 - DNA, 25 bp, Rattus norvegicus
aggttatgtaatgctccggcccggc

SEQ ID NO: 609401 - DNA, 25 bp, Rattus norvegicus
cacctcgcggggacagctgcagagc

SEQ ID NO: 609402 - DNA, 25 bp, Rattus norvegicus
atgggtcctcacctcgcggggacag

SEQ ID NO: 609403 - DNA, 25 bp, Rattus norvegicus
cagagctggcgacggtgagcccaca

SEQ ID NO: 609404 - DNA, 25 bp, Rattus norvegicus
gcccgcctgcatcccagggcccatg

SEQ ID NO: 609405 - DNA, 25 bp, Rattus norvegicus
aagccgttgtgcagcagcccgttca

SEQ ID NO: 609406 - DNA, 25 bp, Rattus norvegicus
cccatcgggcggatagcactagcca

SEQ ID NO: 609407 - DNA, 25 bp, Rattus norvegicus
cggcaggacttacgcggcctgttct

SEQ ID NO: 609408 - DNA, 25 bp, Rattus norvegicus
gccggcatttcttggccggagaatc

SEQ ID NO: 609409 - DNA, 25 bp, Rattus norvegicus
ccggagaatcatgctgggcgaacag

SEQ ID NO: 609410 - DNA, 25 bp, Rattus norvegicus
tcccaaggccgagccacttcaaatg

SEQ ID NO: 609411 - DNA, 25 bp, Rattus norvegicus
ttgtgtctaaccgacccatcgggcg

SEQ ID NO: 609412 - DNA, 25 bp, Rattus norvegicus
tttcaacgtgcggaatgaagttctc

SEQ ID NO: 609413 - DNA, 25 bp, Rattus norvegicus
ctttgtatggcggagcgagcctaaa

SEQ ID NO: 609414 - DNA, 25 bp, Rattus norvegicus
taggcactagactgcgagaagcctc

SEQ ID NO: 609415 - DNA, 25 bp, Rattus norvegicus
atgcgggaggaagccagatatttgc

SEQ ID NO: 609416 - DNA, 25 bp, Rattus norvegicus
tgcagaggtttcaggtttgctaatc

SEQ ID NO: 609417 - DNA, 25 bp, Rattus norvegicus
acacctctagggaggacgcagtcca

SEQ ID NO: 609418 - DNA, 25 bp, Rattus norvegicus
accgccaccgacgagtttcaacgtg

SEQ ID NO: 609419 - DNA, 25 bp, Rattus norvegicus
ctgcaggtgaggagctgacgctttt

SEQ ID NO: 609420 - DNA, 25 bp, Rattus norvegicus
catgttcacggggtgcctgacgccg

SEQ ID NO: 609421 - DNA, 25 bp, Rattus norvegicus
ccttgtcatgttcacggggtgcctg

SEQ ID NO: 609422 - DNA, 25 bp, Rattus norvegicus
gacgcctcggccttgtcatgttcac

SEQ ID NO: 609423 - DNA, 25 bp, Rattus norvegicus
agagggcctgaagctgcgacgcctc

SEQ ID NO: 609424 - DNA, 25 bp, Rattus norvegicus
tggctgcttgcacagagggcctgaa

SEQ ID NO: 609425 - DNA, 25 bp, Rattus norvegicus
cattggtcgcccagagcaccaagtc

SEQ ID NO: 609426 - DNA, 25 bp, Rattus norvegicus
tttgaaagtcttttccggaagcgca

SEQ ID NO: 609427 - DNA, 25 bp, Rattus norvegicus
agtcttttccggaagcgcaggcgaa

SEQ ID NO: 609428 - DNA, 25 bp, Rattus norvegicus
tcccagggttcagcgcggtgcctag

SEQ ID NO: 609429 - DNA, 25 bp, Rattus norvegicus
gtgcctagccgccattgtttgaatt

SEQ ID NO: 609430 - DNA, 25 bp, Rattus norvegicus
agccgccattgtttgaatttgaaaa

SEQ ID NO: 609431 - DNA, 25 bp, Rattus norvegicus
tgaatttgaaaaccgagaggatttg

SEQ ID NO: 609432 - DNA, 25 bp, Rattus norvegicus
accgagaggatttggtgctgctcgc

SEQ ID NO: 609433 - DNA, 25 bp, Rattus norvegicus
gcatccaggagctcaccacagggtg

SEQ ID NO: 609434 - DNA, 25 bp, Rattus norvegicus
gtcacctctaggaagccactcagca

SEQ ID NO: 609435 - DNA, 25 bp, Rattus norvegicus
ccactctgccatagttgatctgctc

SEQ ID NO: 609436 - DNA, 25 bp, Rattus norvegicus
caggatggagccgatcacaactttc

SEQ ID NO: 609437 - DNA, 25 bp, Rattus norvegicus
atcgtcagcagcgtgatgagcgtca

SEQ ID NO: 609438 - DNA, 25 bp, Rattus norvegicus
aggcagttgcctgcgatcgtcagca

SEQ ID NO: 609439 - DNA, 25 bp, Rattus norvegicus
ttcttgacgaagcacaccgagatca

SEQ ID NO: 609440 - DNA, 25 bp, Rattus norvegicus
cggtgacactaacgaaaggcatgac

SEQ ID NO: 609441 - DNA, 25 bp, Rattus norvegicus
ttgcagaagaagtggccgaagatcc

SEQ ID NO: 609442 - DNA, 25 bp, Rattus norvegicus
tccatggcgatgaagacgttgcaga

SEQ ID NO: 609443 - DNA, 25 bp, Rattus norvegicus
ggccgtgcagcacatgacgtccatg

SEQ ID NO: 609444 - DNA, 25 bp, Rattus norvegicus
tcacgcacagggtcatgatcgaggc

SEQ ID NO: 609445 - DNA, 25 bp, Rattus norvegicus
cggcctgttccttacctgtcgatgc

SEQ ID NO: 609446 - DNA, 25 bp, Rattus norvegicus
gccgctgctgttaacgtccatcatc

SEQ ID NO: 609447 - DNA, 25 bp, Rattus norvegicus
ctgtgcagacttgcgcgcgggttct

SEQ ID NO: 609448 - DNA, 25 bp, Rattus norvegicus
ctattcgggtctcgcgtgggatctg

SEQ ID NO: 609449 - DNA, 25 bp, Rattus norvegicus
ttttttcaggcgctattcgggtctc

SEQ ID NO: 609450 - DNA, 25 bp, Rattus norvegicus
ccatccagctttgtttggtagtttt

SEQ ID NO: 609451 - DNA, 25 bp, Rattus norvegicus
ctccctaccatccagctttgtttgg

SEQ ID NO: 609452 - DNA, 25 bp, Rattus norvegicus
ttctggcttcgcgttgtcctcccta

SEQ ID NO: 609453 - DNA, 25 bp, Rattus norvegicus
gctcaccgtgagtcttctggcttcg

SEQ ID NO: 609454 - DNA, 25 bp, Rattus norvegicus
ggagaccgctgctcaccgtgagtct

SEQ ID NO: 609455 - DNA, 25 bp, Rattus norvegicus
tctgcgcggactcgtggagaccgct

SEQ ID NO: 609456 - DNA, 25 bp, Rattus norvegicus
ctcagacctgaaggctctgcgcgga

SEQ ID NO: 609457 - DNA, 25 bp, Rattus norvegicus
atttggatctaagagcgggctcaga

SEQ ID NO: 609458 - DNA, 25 bp, Rattus norvegicus
tggcggcgttcgcagatttggatct

SEQ ID NO: 609459 - DNA, 25 bp, Rattus norvegicus
ttctcttgggatgtcagcatggcgg

SEQ ID NO: 609460 - DNA, 25 bp, Rattus norvegicus
gcgggttctcttgggatgtcagcat

SEQ ID NO: 609461 - DNA, 25 bp, Rattus norvegicus
gctggaaggacaaagaccgcgttga

SEQ ID NO: 609462 - DNA, 25 bp, Rattus norvegicus
ggtctgctttcgagacgcctctgga

SEQ ID NO: 609463 - DNA, 25 bp, Rattus norvegicus
tcggcagttccgctccatacgaagc

SEQ ID NO: 609464 - DNA, 25 bp, Rattus norvegicus
cgtttcgagtctcttcttggaaggc

SEQ ID NO: 609465 - DNA, 25 bp, Rattus norvegicus
tcaggccactgaaccggtttgcacc

SEQ ID NO: 609466 - DNA, 25 bp, Rattus norvegicus
acgaagcactggtagatggcccgca

SEQ ID NO: 609467 - DNA, 25 bp, Rattus norvegicus
gttgtccaccttgaagctgcccagg

SEQ ID NO: 609468 - DNA, 25 bp, Rattus norvegicus
aaccgaggcagacgacagcagcaca

SEQ ID NO: 609469 - DNA, 25 bp, Rattus norvegicus
tcgcgcagctctccgacttcgagga

SEQ ID NO: 609470 - DNA, 25 bp, Rattus norvegicus
caggactagggctcaccttgcgctt

SEQ ID NO: 609471 - DNA, 25 bp, Rattus norvegicus
aggataacgtcacccagtccggcgg

SEQ ID NO: 609472 - DNA, 25 bp, Rattus norvegicus
cctgcgtcacatcattggtggtttg

SEQ ID NO: 609473 - DNA, 25 bp, Rattus norvegicus
tgaggcacggtctgcgcctattata

SEQ ID NO: 609474 - DNA, 25 bp, Rattus norvegicus
cgcaggttttgcttccagttgtcca

SEQ ID NO: 609475 - DNA, 25 bp, Rattus norvegicus
cggccacgatcgagtgccttcgcga

SEQ ID NO: 609476 - DNA, 25 bp, Rattus norvegicus
ccggaacgtggcctcccgagagcta

SEQ ID NO: 609477 - DNA, 25 bp, Rattus norvegicus
cccgagagctaggtaagagcgatgc

SEQ ID NO: 609478 - DNA, 25 bp, Rattus norvegicus
agtttttatagtgcggccgatcttc

SEQ ID NO: 609479 - DNA, 25 bp, Rattus norvegicus
ttgcccacgccagggaaccggtgct

SEQ ID NO: 609480 - DNA, 25 bp, Rattus norvegicus
aagctgacgcagttggtgacgctcg

SEQ ID NO: 609481 - DNA, 25 bp, Rattus norvegicus
ggctccgggagtgagcacctctgcc

SEQ ID NO: 609482 - DNA, 25 bp, Rattus norvegicus
cccgcttccgtttggatcggctggg

SEQ ID NO: 609483 - DNA, 25 bp, Rattus norvegicus
gatcggctggggctattatataaga

SEQ ID NO: 609484 - DNA, 25 bp, Rattus norvegicus
gggctattatataagatgccacgga

SEQ ID NO: 609485 - DNA, 25 bp, Rattus norvegicus
tcgggttggagccaaccctgccttc

SEQ ID NO: 609486 - DNA, 25 bp, Rattus norvegicus
cgcagcaggcgtccgtactttgaaa

SEQ ID NO: 609487 - DNA, 25 bp, Rattus norvegicus
caggcgtccgtactttgaaacattt

SEQ ID NO: 609488 - DNA, 25 bp, Rattus norvegicus
cacggtgtttgaagaagctgacgca

SEQ ID NO: 609489 - DNA, 25 bp, Rattus norvegicus
cgctgtttctctttcgctttcccgg

SEQ ID NO: 609490 - DNA, 25 bp, Rattus norvegicus
tgcgtttcccactggtttgcctcaa

SEQ ID NO: 609491 - DNA, 25 bp, Rattus norvegicus
cgggactgcgtttcccactggtttg

SEQ ID NO: 609492 - DNA, 25 bp, Rattus norvegicus
cttgggatcgggactgcgtttccca

SEQ ID NO: 609493 - DNA, 25 bp, Rattus norvegicus
cttcctttccgcgtcggggtgacag

SEQ ID NO: 609494 - DNA, 25 bp, Rattus norvegicus
cgcgacaccgcaagcgctcgcttcc

SEQ ID NO: 609495 - DNA, 25 bp, Rattus norvegicus
ccagccggtgaagggctcgaacctc

SEQ ID NO: 609496 - DNA, 25 bp, Rattus norvegicus
gaaccgagcacctgccagccggtga

SEQ ID NO: 609497 - DNA, 25 bp, Rattus norvegicus
cctgcggagactcgtccggtcccgc

SEQ ID NO: 609498 - DNA, 25 bp, Rattus norvegicus
ctctttcgctttcccgggctcggag

SEQ ID NO: 609499 - DNA, 25 bp, Rattus norvegicus
gcgggcgctgtttctctttcgcttt

SEQ ID NO: 609500 - DNA, 25 bp, Rattus norvegicus
aaccagacaggccttggcgggcgct

SEQ ID NO: 609501 - DNA, 25 bp, Rattus norvegicus
gccctatcgcgccagagccgagtgg

SEQ ID NO: 609502 - DNA, 25 bp, Rattus norvegicus
cgcgccaagtttgcgccggcggcag

SEQ ID NO: 609503 - DNA, 25 bp, Rattus norvegicus
cagcaactagcagtcaaaaagatct

SEQ ID NO: 609504 - DNA, 25 bp, Rattus norvegicus
cccatcccacaattggagcgagaga

SEQ ID NO: 609505 - DNA, 25 bp, Rattus norvegicus
tcccacaattggagcgagagatgcg

SEQ ID NO: 609506 - DNA, 25 bp, Rattus norvegicus
cacaattggagcgagagatgcggct

SEQ ID NO: 609507 - DNA, 25 bp, Rattus norvegicus
caattggagcgagagatgcggctcc

SEQ ID NO: 609508 - DNA, 25 bp, Rattus norvegicus
aggacccagcaactagcagtcaaaa

SEQ ID NO: 609509 - DNA, 25 bp, Rattus norvegicus
acccagcaactagcagtcaaaaaga

SEQ ID NO: 609510 - DNA, 25 bp, Rattus norvegicus
aggtaaaatcagatggttcgtctca

SEQ ID NO: 609511 - DNA, 25 bp, Rattus norvegicus
cagatgttagggcaaggcgatactc

SEQ ID NO: 609512 - DNA, 25 bp, Rattus norvegicus
atgttagggcaaggcgatactctgg

SEQ ID NO: 609513 - DNA, 25 bp, Rattus norvegicus
gcaaggcgatactctggaattctgt

SEQ ID NO: 609514 - DNA, 25 bp, Rattus norvegicus
gttgggaggtaaaatcagatggttc

SEQ ID NO: 609515 - DNA, 25 bp, Rattus norvegicus
agggcaaggcgatactctggaattc

SEQ ID NO: 609516 - DNA, 25 bp, Rattus norvegicus
taaaatcagatggttcgtctcaccc

SEQ ID NO: 609517 - DNA, 25 bp, Rattus norvegicus
aacctggcgtgcagcacgtagctca

SEQ ID NO: 609518 - DNA, 25 bp, Rattus norvegicus
cctggtgcagctcattggaccgaga

SEQ ID NO: 609519 - DNA, 25 bp, Rattus norvegicus
agaggcagtggcgaccgcgacaacc

SEQ ID NO: 609520 - DNA, 25 bp, Rattus norvegicus
agcttcgcaccacgcacttagcgga

SEQ ID NO: 609521 - DNA, 25 bp, Rattus norvegicus
aggcagcttatcagagcccgatcac

SEQ ID NO: 609522 - DNA, 25 bp, Rattus norvegicus
agcccgatcacgtgagctggtccct

SEQ ID NO: 609523 - DNA, 25 bp, Rattus norvegicus
ttctgcagcttatgcgagcctggcg

SEQ ID NO: 609524 - DNA, 25 bp, Rattus norvegicus
ctcggaccaatcagaggcccgattc

SEQ ID NO: 609525 - DNA, 25 bp, Rattus norvegicus
ctgtccctggaacgtgatcaccgcg

SEQ ID NO: 609526 - DNA, 25 bp, Rattus norvegicus
ctcgcagctggccttctgcagctta

SEQ ID NO: 609527 - DNA, 25 bp, Rattus norvegicus
gacccaggcgtgttcctggaacctg

SEQ ID NO: 609528 - DNA, 25 bp, Rattus norvegicus
gcacgtagctcacggctcgcagctg

SEQ ID NO: 609529 - DNA, 25 bp, Rattus norvegicus
cgcggagttgcacgtacctggtgca

SEQ ID NO: 609530 - DNA, 25 bp, Rattus norvegicus
ctggcggggtcttctatggaaacgc

SEQ ID NO: 609531 - DNA, 25 bp, Rattus norvegicus
ttgcacctccatcaaagcggcgggg

SEQ ID NO: 609532 - DNA, 25 bp, Rattus norvegicus
ctgcggagcccaaagatcacacctg

SEQ ID NO: 609533 - DNA, 25 bp, Rattus norvegicus
tgggtcccagcacattcgccaaagg

SEQ ID NO: 609534 - DNA, 25 bp, Rattus norvegicus
tggttccacttgaactcccgcaagg

SEQ ID NO: 609535 - DNA, 25 bp, Rattus norvegicus
ccgcaaggcgcgacaagagtaagtc

SEQ ID NO: 609536 - DNA, 25 bp, Rattus norvegicus
ccataaatacatccgaggtggcctc

SEQ ID NO: 609537 - DNA, 25 bp, Rattus norvegicus
ttccagagcggctgctaaactccca

SEQ ID NO: 609538 - DNA, 25 bp, Rattus norvegicus
ttcctgtaaggaaagcgtcgggcgc

SEQ ID NO: 609539 - DNA, 25 bp, Rattus norvegicus
agaaaaaggatcactctgcggagcc

SEQ ID NO: 609540 - DNA, 25 bp, Rattus norvegicus
tcccgagagggaaatagacgaacag

SEQ ID NO: 609541 - DNA, 25 bp, Rattus norvegicus
gagggaagctcaatgcggatctgtc

SEQ ID NO: 609542 - DNA, 25 bp, Rattus norvegicus
gcctcccaaagtgtagcagcttcgg

SEQ ID NO: 609543 - DNA, 25 bp, Rattus norvegicus
gtgatccactcggtactgcaggctc

SEQ ID NO: 609544 - DNA, 25 bp, Rattus norvegicus
accctttgaagtacggagcagctgc

SEQ ID NO: 609545 - DNA, 25 bp, Rattus norvegicus
ccgagaaggtgaacagccgcgacac

SEQ ID NO: 609546 - DNA, 25 bp, Rattus norvegicus
tccgcccgcgaactgttcgaggctt

SEQ ID NO: 609547 - DNA, 25 bp, Rattus norvegicus
ctggcaggagtggtctccgcagctt

SEQ ID NO: 609548 - DNA, 25 bp, Rattus norvegicus
gagtggtctccgcagcttccgccgt

SEQ ID NO: 609549 - DNA, 25 bp, Rattus norvegicus
ggctcctgctgcctttgctggcttt

SEQ ID NO: 609550 - DNA, 25 bp, Rattus norvegicus
ctgctgcctttgctggctttgctgc

SEQ ID NO: 609551 - DNA, 25 bp, Rattus norvegicus
cggatcatgtctggccgccgctgcg

SEQ ID NO: 609552 - DNA, 25 bp, Rattus norvegicus
ctggtgacgcccgagaaggtgaaca

SEQ ID NO: 609553 - DNA, 25 bp, Rattus norvegicus
ccaggacccgacagagctggcagga

SEQ ID NO: 609554 - DNA, 25 bp, Rattus norvegicus
tccacttcgccgcaggtaaacgcgg

SEQ ID NO: 609555 - DNA, 25 bp, Rattus norvegicus
ctcacctgcaggctcgggcttgcag

SEQ ID NO: 609556 - DNA, 25 bp, Rattus norvegicus
cggtactgccctgtctccgaccttt

SEQ ID NO: 609557 - DNA, 25 bp, Rattus norvegicus
ctctctccgggctcgtgattagggt

SEQ ID NO: 609558 - DNA, 25 bp, Rattus norvegicus
aactgttcgaggcttgccgcaacgg

SEQ ID NO: 609559 - DNA, 25 bp, Rattus norvegicus
cccgctttgtaagcccactgggtcg

SEQ ID NO: 609560 - DNA, 25 bp, Rattus norvegicus
cccacgtttctaattgcagagacgc

SEQ ID NO: 609561 - DNA, 25 bp, Rattus norvegicus
gggaaaaggctctccagaccacctg

SEQ ID NO: 609562 - DNA, 25 bp, Rattus norvegicus
gtgattaaccctgtgctcgccgggg

SEQ ID NO: 609563 - DNA, 25 bp, Rattus norvegicus
aggcccgtgattaaccctgtgctcg

SEQ ID NO: 609564 - DNA, 25 bp, Rattus norvegicus
ccctttgagcgacggaatgtgggcc

SEQ ID NO: 609565 - DNA, 25 bp, Rattus norvegicus
aaggtaacgtgaccgtgcggcgcca

SEQ ID NO: 609566 - DNA, 25 bp, Rattus norvegicus
cactgggtcgcctgaatggcggcaa

SEQ ID NO: 609567 - DNA, 25 bp, Rattus norvegicus
aagaccggacgacctggcctgcaga

SEQ ID NO: 609568 - DNA, 25 bp, Rattus norvegicus
gcagagacgcgggtagactttttaa

SEQ ID NO: 609569 - DNA, 25 bp, Rattus norvegicus
ctgaatggcggcaaggtaacgtgac

SEQ ID NO: 609570 - DNA, 25 bp, Rattus norvegicus
tcgtaatgcaagaccggacgacctg

SEQ ID NO: 609571 - DNA, 25 bp, Rattus norvegicus
tttcggaagctgtcgtaatgcaaga

SEQ ID NO: 609572 - DNA, 25 bp, Rattus norvegicus
caccagcgagttacatttcggaagc

SEQ ID NO: 609573 - DNA, 25 bp, Rattus norvegicus
tggccatgccactcctctgggattc

SEQ ID NO: 609574 - DNA, 25 bp, Rattus norvegicus
ttcctcccgcctgagttggacttca

SEQ ID NO: 609575 - DNA, 25 bp, Rattus norvegicus
cagcaagggcttcttttcgggctgg

SEQ ID NO: 609576 - DNA, 25 bp, Rattus norvegicus
cctggagcctcagcgcaggtagcac

SEQ ID NO: 609577 - DNA, 25 bp, Rattus norvegicus
caggagtctccggaaccgggtctga

SEQ ID NO: 609578 - DNA, 25 bp, Rattus norvegicus
gttggacttcaccagcaagggcttc

SEQ ID NO: 609579 - DNA, 25 bp, Rattus norvegicus
aggaagcagcctcccagcagcagta

SEQ ID NO: 609580 - DNA, 25 bp, Rattus norvegicus
acccaaggagccgtctctggggccg

SEQ ID NO: 609581 - DNA, 25 bp, Rattus norvegicus
tgctctgggctcacgaagcgaccca

SEQ ID NO: 609582 - DNA, 25 bp, Rattus norvegicus
ggcaccaggagctgccagctgcacg

SEQ ID NO: 609583 - DNA, 25 bp, Rattus norvegicus
gacctggcagcgcagggccagctct

SEQ ID NO: 609584 - DNA, 25 bp, Rattus norvegicus
gcccagcagccgtttccagtagtgc

SEQ ID NO: 609585 - DNA, 25 bp, Rattus norvegicus
tgtagctcagcgctggccgtcttgt

SEQ ID NO: 609586 - DNA, 25 bp, Rattus norvegicus
acgcggtgaggagcatcctcggatc

SEQ ID NO: 609587 - DNA, 25 bp, Rattus norvegicus
gcctgccaactaacggggagctcgc

SEQ ID NO: 609588 - DNA, 25 bp, Rattus norvegicus
agccacgtgctggtggcgtcacttc

SEQ ID NO: 609589 - DNA, 25 bp, Rattus norvegicus
tgccgacgctaagtccggcgtgccg

SEQ ID NO: 609590 - DNA, 25 bp, Rattus norvegicus
ggcccatgtccgaaggcctgtgccg

SEQ ID NO: 609591 - DNA, 25 bp, Rattus norvegicus
ctctgctcgggaaacgagcgctgga

SEQ ID NO: 609592 - DNA, 25 bp, Rattus norvegicus
ccatggcggtctccaggtgagtgtc

SEQ ID NO: 609593 - DNA, 25 bp, Rattus norvegicus
agtgtcgccgcctgccaactaacgg

SEQ ID NO: 609594 - DNA, 25 bp, Rattus norvegicus
gagcgctgcttctcgcccagacttt

SEQ ID NO: 609595 - DNA, 25 bp, Rattus norvegicus
ttctcgcccagactttgaggcttcc

SEQ ID NO: 609596 - DNA, 25 bp, Rattus norvegicus
ttccctcggcttgctggcgctttga

SEQ ID NO: 609597 - DNA, 25 bp, Rattus norvegicus
tgagctcgggttacccggagaaatg

SEQ ID NO: 609598 - DNA, 25 bp, Rattus norvegicus
gtcacttccggcgtgccgacgctaa

SEQ ID NO: 609599 - DNA, 25 bp, Rattus norvegicus
tcggcgcgttcgatctggctttttt

SEQ ID NO: 609600 - DNA, 25 bp, Rattus norvegicus
tcgttaaatatgactcggcgcgttc

SEQ ID NO: 609601 - DNA, 25 bp, Rattus norvegicus
cgggaagccctctattctcgccttt

SEQ ID NO: 609602 - DNA, 25 bp, Rattus norvegicus
cggccacttgtggagtcctgaagtc

SEQ ID NO: 609603 - DNA, 25 bp, Rattus norvegicus
ggtgcaacgggctccaacggctgca

SEQ ID NO: 609604 - DNA, 25 bp, Rattus norvegicus
gaagccctctattctcgcctttcag

SEQ ID NO: 609605 - DNA, 25 bp, Rattus norvegicus
cacagtcacggccacttgtggagtc

SEQ ID NO: 609606 - DNA, 25 bp, Rattus norvegicus
cttgtggagtcctgaagtccctgga

SEQ ID NO: 609607 - DNA, 25 bp, Rattus norvegicus
ggagtcctgaagtccctggagtctg

SEQ ID NO: 609608 - DNA, 25 bp, Rattus norvegicus
tctgggtgtacacgtaacgctctta

SEQ ID NO: 609609 - DNA, 25 bp, Rattus norvegicus
ggtgtacacgtaacgctcttacctg

SEQ ID NO: 609610 - DNA, 25 bp, Rattus norvegicus
caacgggctccaacggctgcaggtg

SEQ ID NO: 609611 - DNA, 25 bp, Rattus norvegicus
tacacgtaacgctcttacctgcagg

SEQ ID NO: 609612 - DNA, 25 bp, Rattus norvegicus
cgtgggggcggcaaccagacaccaa

SEQ ID NO: 609613 - DNA, 25 bp, Rattus norvegicus
tccctggagtctgggtgtacacgta

SEQ ID NO: 609614 - DNA, 25 bp, Rattus norvegicus
cggccacagtcacggccacttgtgg

SEQ ID NO: 609615 - DNA, 25 bp, Rattus norvegicus
ctggttacaggcagtagagctcgca

SEQ ID NO: 609616 - DNA, 25 bp, Rattus norvegicus
cagctggttacaggcagtagagctc

SEQ ID NO: 609617 - DNA, 25 bp, Rattus norvegicus
tcagctggttacaggcagtagagct

SEQ ID NO: 609618 - DNA, 25 bp, Rattus norvegicus
gtcagctggttacaggcagtagagc

SEQ ID NO: 609619 - DNA, 25 bp, Rattus norvegicus
cggtcagctggttacaggcagtaga

SEQ ID NO: 609620 - DNA, 25 bp, Rattus norvegicus
gctccagggacgagtgcggtcagct

SEQ ID NO: 609621 - DNA, 25 bp, Rattus norvegicus
cgctgcagccatcgggacgcccgga

SEQ ID NO: 609622 - DNA, 25 bp, Rattus norvegicus
cagcccgctgcagccatcgggacgc

SEQ ID NO: 609623 - DNA, 25 bp, Rattus norvegicus
cccgcgagtgggctagagggctgca

SEQ ID NO: 609624 - DNA, 25 bp, Rattus norvegicus
tggttacaggcagtagagctcgcag

SEQ ID NO: 609625 - DNA, 25 bp, Rattus norvegicus
ttacaggcagtagagctcgcagggc

SEQ ID NO: 609626 - DNA, 25 bp, Rattus norvegicus
tacaggcagtagagctcgcagggcc

SEQ ID NO: 609627 - DNA, 25 bp, Rattus norvegicus
acaggcagtagagctcgcagggccc

SEQ ID NO: 609628 - DNA, 25 bp, Rattus norvegicus
agtagagctcgcagggcccgcgagt

SEQ ID NO: 609629 - DNA, 25 bp, Rattus norvegicus
gtcacacatctgatcatccagcacg

SEQ ID NO: 609630 - DNA, 25 bp, Rattus norvegicus
tgctggcccagcagtattcacagta

SEQ ID NO: 609631 - DNA, 25 bp, Rattus norvegicus
cacagtagtactgcagacaggtgac

SEQ ID NO: 609632 - DNA, 25 bp, Rattus norvegicus
tgacgttggcacagaaaaacggggc

SEQ ID NO: 609633 - DNA, 25 bp, Rattus norvegicus
ggcgaacttcccaccgcagcgtgtg

SEQ ID NO: 609634 - DNA, 25 bp, Rattus norvegicus
ctgacactcgtcacacatctgatca

SEQ ID NO: 609635 - DNA, 25 bp, Rattus norvegicus
tttgtggaactcacggccggctcgg

SEQ ID NO: 609636 - DNA, 25 bp, Rattus norvegicus
tggcccagcagtattcacagtagta

SEQ ID NO: 609637 - DNA, 25 bp, Rattus norvegicus
cacatctgatcatccagcacgtacg

SEQ ID NO: 609638 - DNA, 25 bp, Rattus norvegicus
agcgtgtgccctgacactcgtcaca

SEQ ID NO: 609639 - DNA, 25 bp, Rattus norvegicus
cttcaccagtggtttgtggaactca

SEQ ID NO: 609640 - DNA, 25 bp, Rattus norvegicus
ctccctccttcaccagtggtttgtg

SEQ ID NO: 609641 - DNA, 25 bp, Rattus norvegicus
actgcagacaggtgacgttggcaca

SEQ ID NO: 609642 - DNA, 25 bp, Rattus norvegicus
ccagtggtttgtggaactcacggcc

SEQ ID NO: 609643 - DNA, 25 bp, Rattus norvegicus
tgaagacggcttgctggtcatgatg

SEQ ID NO: 609644 - DNA, 25 bp, Rattus norvegicus
ggtccggaaagcgttatcctccatc

SEQ ID NO: 609645 - DNA, 25 bp, Rattus norvegicus
gcgttatcctccatccaagacttgg

SEQ ID NO: 609646 - DNA, 25 bp, Rattus norvegicus
aacttgggtggagcgatcacattgc

SEQ ID NO: 609647 - DNA, 25 bp, Rattus norvegicus
tcacattgctggagaagggcttttt

SEQ ID NO: 609648 - DNA, 25 bp, Rattus norvegicus
cgttcacgctttggtgcgtgttcca

SEQ ID NO: 609649 - DNA, 25 bp, Rattus norvegicus
gccggcactgcgctactgtcttcag

SEQ ID NO: 609650 - DNA, 25 bp, Rattus norvegicus
agcggcgactccatctgcatcttgt

SEQ ID NO: 609651 - DNA, 25 bp, Rattus norvegicus
tgcccgttgaccaggtgctgccgaa

SEQ ID NO: 609652 - DNA, 25 bp, Rattus norvegicus
cccacgggttggacggagcactcca

SEQ ID NO: 609653 - DNA, 25 bp, Rattus norvegicus
aagctgtcctccaccgcgttcgtag

SEQ ID NO: 609654 - DNA, 25 bp, Rattus norvegicus
cggcgagaaggtgcctccgaagacc

SEQ ID NO: 609655 - DNA, 25 bp, Rattus norvegicus
cgtgttccagctggacgaggccgaa

SEQ ID NO: 609656 - DNA, 25 bp, Rattus norvegicus
tgatggaaactcaagcccggcagga

SEQ ID NO: 609657 - DNA, 25 bp, Rattus norvegicus
agatgccggaccaagcccttcaaca

SEQ ID NO: 609658 - DNA, 25 bp, Rattus norvegicus
cccttcaacagatgctggacaggta

SEQ ID NO: 609659 - DNA, 25 bp, Rattus norvegicus
cgcctctcagtgctattgtcccggg

SEQ ID NO: 609660 - DNA, 25 bp, Rattus norvegicus
ttacctcacagaggtagctcctccg

SEQ ID NO: 609661 - DNA, 25 bp, Rattus norvegicus
cacggaggcggtgactcttacctca

SEQ ID NO: 609662 - DNA, 25 bp, Rattus norvegicus
ggggacggtccgaggactacatctc

SEQ ID NO: 609663 - DNA, 25 bp, Rattus norvegicus
ctactgacagcggagcgccacatgc

SEQ ID NO: 609664 - DNA, 25 bp, Rattus norvegicus
ggcgctgaccttgttgctactgaca

SEQ ID NO: 609665 - DNA, 25 bp, Rattus norvegicus
ggctctgtcccacctgagcgcgaga

SEQ ID NO: 609666 - DNA, 25 bp, Rattus norvegicus
cggcgtgcttgacccggcccagaaa

SEQ ID NO: 609667 - DNA, 25 bp, Rattus norvegicus
ggaggctgacccaagagcccggcct

SEQ ID NO: 609668 - DNA, 25 bp, Rattus norvegicus
cccgaaaatgggttctgacgcggcg

SEQ ID NO: 609669 - DNA, 25 bp, Rattus norvegicus
ccggtgggaacagtcgagtcaccca

SEQ ID NO: 609670 - DNA, 25 bp, Rattus norvegicus
gaactgccggccttagtcctgggcc

SEQ ID NO: 609671 - DNA, 25 bp, Rattus norvegicus
ggctgccctacggaaacgtatccgc

SEQ ID NO: 609672 - DNA, 25 bp, Rattus norvegicus
cagcaggtgttggagccaagtcctc

SEQ ID NO: 609673 - DNA, 25 bp, Rattus norvegicus
cagcagtgtcctagccggggtccaa

SEQ ID NO: 609674 - DNA, 25 bp, Rattus norvegicus
cagtccttcctaggccagcagtgtc

SEQ ID NO: 609675 - DNA, 25 bp, Rattus norvegicus
tcgtcgtttaagcaccggagcctcg

SEQ ID NO: 609676 - DNA, 25 bp, Rattus norvegicus
tgcgatctcggcgaacgcttccttt

SEQ ID NO: 609677 - DNA, 25 bp, Rattus norvegicus
tgaatcaccactttgcagcagcaca

SEQ ID NO: 609678 - DNA, 25 bp, Rattus norvegicus
ggcggcgctaagtgctgaatcacca

SEQ ID NO: 609679 - DNA, 25 bp, Rattus norvegicus
gcgttctcctagctatccgtggaca

SEQ ID NO: 609680 - DNA, 25 bp, Rattus norvegicus
ccgctgcacttgtggcgttctccta

SEQ ID NO: 609681 - DNA, 25 bp, Rattus norvegicus
gcggtctctcacgactcactggatc

SEQ ID NO: 609682 - DNA, 25 bp, Rattus norvegicus
acgcttccttttggcgctgggagcc

SEQ ID NO: 609683 - DNA, 25 bp, Rattus norvegicus
tcacggcaaacagccggagtgcgca

SEQ ID NO: 609684 - DNA, 25 bp, Rattus norvegicus
gggacgcttacccacacagtcgctt

SEQ ID NO: 609685 - DNA, 25 bp, Rattus norvegicus
agtcttggtccttcttccctggtca

SEQ ID NO: 609686 - DNA, 25 bp, Rattus norvegicus
gccagcggcagcacagagtacaacg

SEQ ID NO: 609687 - DNA, 25 bp, Rattus norvegicus
acgacacggggtcccatgatgcctt

SEQ ID NO: 609688 - DNA, 25 bp, Rattus norvegicus
gtggccacggccaaaaggtctgcgt

SEQ ID NO: 609689 - DNA, 25 bp, Rattus norvegicus
gccaacgtcgccgaaaatttatctg

SEQ ID NO: 609690 - DNA, 25 bp, Rattus norvegicus
ttcttactgtgtcggagtcaccgcc

SEQ ID NO: 609691 - DNA, 25 bp, Rattus norvegicus
tcccagccgagttcttcttcgaaga

SEQ ID NO: 609692 - DNA, 25 bp, Rattus norvegicus
gcgccgatttgtttaccttttctga

SEQ ID NO: 609693 - DNA, 25 bp, Rattus norvegicus
agctaccacgttcaggtctaaatta

SEQ ID NO: 609694 - DNA, 25 bp, Rattus norvegicus
atggttgctcttcgctgaaaagtgc

SEQ ID NO: 609695 - DNA, 25 bp, Rattus norvegicus
aagtgcgttcccatctaaaagccaa

SEQ ID NO: 609696 - DNA, 25 bp, Rattus norvegicus
ttgccctttgctacaccgtgcgagt

SEQ ID NO: 609697 - DNA, 25 bp, Rattus norvegicus
aaatcatcggtttctgggctcctcc

SEQ ID NO: 609698 - DNA, 25 bp, Rattus norvegicus
gcgccgaatcgttgctagtttctga

SEQ ID NO: 609699 - DNA, 25 bp, Rattus norvegicus
gtctacagtcactcttgttcgaccc

SEQ ID NO: 609700 - DNA, 25 bp, Rattus norvegicus
cccggaagctagtgggtgatgtctc

SEQ ID NO: 609701 - DNA, 25 bp, Rattus norvegicus
gagcctgcgcgaatgcccgcttccc

SEQ ID NO: 609702 - DNA, 25 bp, Rattus norvegicus
agtctgcgcgggtgctcgaagcact

SEQ ID NO: 609703 - DNA, 25 bp, Rattus norvegicus
gtgctcgaagcactcgcggccgcgt

SEQ ID NO: 609704 - DNA, 25 bp, Rattus norvegicus
gcggccgcgtcagcctttcacaggc

SEQ ID NO: 609705 - DNA, 25 bp, Rattus norvegicus
tgatgtctcctaccgggtccttccg

SEQ ID NO: 609706 - DNA, 25 bp, Rattus norvegicus
ccgcctcatttgtacagactgcgca

SEQ ID NO: 609707 - DNA, 25 bp, Rattus norvegicus
agctagtgggtgatgtctcctaccg

SEQ ID NO: 609708 - DNA, 25 bp, Rattus norvegicus
catttgtacagactgcgcaggtcta

SEQ ID NO: 609709 - DNA, 25 bp, Rattus norvegicus
caggtctacagtcactcttgttcga

SEQ ID NO: 609710 - DNA, 25 bp, Rattus norvegicus
cgcccttcacgaggggactgcgcag

SEQ ID NO: 609711 - DNA, 25 bp, Rattus norvegicus
gctacgtcctcgaacccggaagcta

SEQ ID NO: 609712 - DNA, 25 bp, Rattus norvegicus
ctgcgcaggtctacagtcactcttg

SEQ ID NO: 609713 - DNA, 25 bp, Rattus norvegicus
gcaaataaatgtagcgcggccgcgc

SEQ ID NO: 609714 - DNA, 25 bp, Rattus norvegicus
atcgcttctccaggtgccagaggcc

SEQ ID NO: 609715 - DNA, 25 bp, Rattus norvegicus
ccatgtgttctcttcgacggtcgca

SEQ ID NO: 609716 - DNA, 25 bp, Rattus norvegicus
tgggatccgcgcctccagtgcatac

SEQ ID NO: 609717 - DNA, 25 bp, Rattus norvegicus
cttcgacggtcgcagtcgcacacta

SEQ ID NO: 609718 - DNA, 25 bp, Rattus norvegicus
gccagagcctatcgccgggagcgca

SEQ ID NO: 609719 - DNA, 25 bp, Rattus norvegicus
cttgcaccttgcagacatcggggca

SEQ ID NO: 609720 - DNA, 25 bp, Rattus norvegicus
ctgcggagcagccatgcagttcccg

SEQ ID NO: 609721 - DNA, 25 bp, Rattus norvegicus
cgacgcctttctacatcgacgacat

SEQ ID NO: 609722 - DNA, 25 bp, Rattus norvegicus
ttcccgcggacggtgaacgactaca

SEQ ID NO: 609723 - DNA, 25 bp, Rattus norvegicus
ggtgaacgactacacgcacgcccta

SEQ ID NO: 609724 - DNA, 25 bp, Rattus norvegicus
cagtcgaaagttgcggtgagcgctc

SEQ ID NO: 609725 - DNA, 25 bp, Rattus norvegicus
cgctcggcgactcagattgcttttc

SEQ ID NO: 609726 - DNA, 25 bp, Rattus norvegicus
tcgcacactaggtgcctggagcctc

SEQ ID NO: 609727 - DNA, 25 bp, Rattus norvegicus
tcacctgcaggtggctggagtgact

SEQ ID NO: 609728 - DNA, 25 bp, Rattus norvegicus
gagcgggagacaccagcacccttct

SEQ ID NO: 609729 - DNA, 25 bp, Rattus norvegicus
ccgggcatgggagaattgaaattga

SEQ ID NO: 609730 - DNA, 25 bp, Rattus norvegicus
ctggaaacctcagcgcacagactgc

SEQ ID NO: 609731 - DNA, 25 bp, Rattus norvegicus
ccaagttgcgcgctgctggaaacct

SEQ ID NO: 609732 - DNA, 25 bp, Rattus norvegicus
actgatcctgggtgccaagttgcgc

SEQ ID NO: 609733 - DNA, 25 bp, Rattus norvegicus
ctttgctggggacgaaggtcacctg

SEQ ID NO: 609734 - DNA, 25 bp, Rattus norvegicus
tcagtgtgtctctgacctcgggagc

SEQ ID NO: 609735 - DNA, 25 bp, Rattus norvegicus
cctgaccagggactccttaggagcc

SEQ ID NO: 609736 - DNA, 25 bp, Rattus norvegicus
aagttctcatatgccggggctttcg

SEQ ID NO: 609737 - DNA, 25 bp, Rattus norvegicus
cacccttcggtaaagttctcatatg

SEQ ID NO: 609738 - DNA, 25 bp, Rattus norvegicus
cgaaagcacggacaccgcctgcgta

SEQ ID NO: 609739 - DNA, 25 bp, Rattus norvegicus
ccgcttccagccaagatggcggaga

SEQ ID NO: 609740 - DNA, 25 bp, Rattus norvegicus
gcacgagcggatcttgcaggagatc

SEQ ID NO: 609741 - DNA, 25 bp, Rattus norvegicus
cccgcatccatttgtctgaaccaag

SEQ ID NO: 609742 - DNA, 25 bp, Rattus norvegicus
cacacagtacaggtcccagagcttg

SEQ ID NO: 609743 - DNA, 25 bp, Rattus norvegicus
tgcagaaacttcctccgctgagagg

SEQ ID NO: 609744 - DNA, 25 bp, Rattus norvegicus
agccgtatttcctgcgcttcatctg

SEQ ID NO: 609745 - DNA, 25 bp, Rattus norvegicus
cgtcttgtagatgaagccgtatttc

SEQ ID NO: 609746 - DNA, 25 bp, Rattus norvegicus
gccgcccaaacagatgcgtcttgta

SEQ ID NO: 609747 - DNA, 25 bp, Rattus norvegicus
gccagtgcactgacaccaaccggtg

SEQ ID NO: 609748 - DNA, 25 bp, Rattus norvegicus
tcgcgaggacaattatcccggcttc

SEQ ID NO: 609749 - DNA, 25 bp, Rattus norvegicus
atgaggtctccctgctagccaagga

SEQ ID NO: 609750 - DNA, 25 bp, Rattus norvegicus
tgcataatcacctgagcccggcaag

SEQ ID NO: 609751 - DNA, 25 bp, Rattus norvegicus
agcgcctctcggttgaaggcctgca

SEQ ID NO: 609752 - DNA, 25 bp, Rattus norvegicus
aatcactggcacgtagcactggagc

SEQ ID NO: 609753 - DNA, 25 bp, Rattus norvegicus
cgctgcttgtgcgaggaatcatgca

SEQ ID NO: 609754 - DNA, 25 bp, Rattus norvegicus
ttcacctcggggtagaccaggaggc

SEQ ID NO: 609755 - DNA, 25 bp, Rattus norvegicus
gttgcagcaccgcttgcgctagctc

SEQ ID NO: 609756 - DNA, 25 bp, Rattus norvegicus
cagtgagtcagaagggtgacccgtc

SEQ ID NO: 609757 - DNA, 25 bp, Rattus norvegicus
ccaaggctagagacgcagtgagtca

SEQ ID NO: 609758 - DNA, 25 bp, Rattus norvegicus
gcgccgccaccgaacgggatgtaat

SEQ ID NO: 609759 - DNA, 25 bp, Rattus norvegicus
cgggatgtaatgaaagcggccacca

SEQ ID NO: 609760 - DNA, 25 bp, Rattus norvegicus
aaagcgctctggatcgaagccctcg

SEQ ID NO: 609761 - DNA, 25 bp, Rattus norvegicus
gctacggtatactgcggctgtctca

SEQ ID NO: 609762 - DNA, 25 bp, Rattus norvegicus
gcggctgtctcatgtgtgtctctga

SEQ ID NO: 609763 - DNA, 25 bp, Rattus norvegicus
tatatgcgcagtgaagacctagggc

SEQ ID NO: 609764 - DNA, 25 bp, Rattus norvegicus
tcacgctccagcctttgggaatctg

SEQ ID NO: 609765 - DNA, 25 bp, Rattus norvegicus
ggaatctggtaaccctgcgaagtga

SEQ ID NO: 609766 - DNA, 25 bp, Rattus norvegicus
gggcccgtgttgatcgataggcaca

SEQ ID NO: 609767 - DNA, 25 bp, Rattus norvegicus
gtgcagcagctactgggcaagccaa

SEQ ID NO: 609768 - DNA, 25 bp, Rattus norvegicus
tgcacgatgggcaccgtctgcatta

SEQ ID NO: 609769 - DNA, 25 bp, Rattus norvegicus
ctggaaaagagcagcccgaggatgc

SEQ ID NO: 609770 - DNA, 25 bp, Rattus norvegicus
tcccactcgggactctggaggactt

SEQ ID NO: 609771 - DNA, 25 bp, Rattus norvegicus
tggtacatcatcgacaccgagaggc

SEQ ID NO: 609772 - DNA, 25 bp, Rattus norvegicus
cggccatcggcaccgacttctggta

SEQ ID NO: 609773 - DNA, 25 bp, Rattus norvegicus
agcggagctctgagcttcgtgctgc

SEQ ID NO: 609774 - DNA, 25 bp, Rattus norvegicus
ctggagtgcagtgaacagacgaaga

SEQ ID NO: 609775 - DNA, 25 bp, Rattus norvegicus
tccacgctggagaatctggagtgca

SEQ ID NO: 609776 - DNA, 25 bp, Rattus norvegicus
tgagccggattccagatccacgctg

SEQ ID NO: 609777 - DNA, 25 bp, Rattus norvegicus
gagccagagtttgagccggattcca

SEQ ID NO: 609778 - DNA, 25 bp, Rattus norvegicus
gagcacgtgcaagtggaatcgctta

SEQ ID NO: 609779 - DNA, 25 bp, Rattus norvegicus
acagggatccctgaggtctccggtc

SEQ ID NO: 609780 - DNA, 25 bp, Rattus norvegicus
aaggagcactctggaactgagcgcc

SEQ ID NO: 609781 - DNA, 25 bp, Rattus norvegicus
gccctgaaccggagctgtgagaagc

SEQ ID NO: 609782 - DNA, 25 bp, Rattus norvegicus
gacttgccggggtaagggtcatcca

SEQ ID NO: 609783 - DNA, 25 bp, Rattus norvegicus
ccagcactgccaggctaaggtccgg

SEQ ID NO: 609784 - DNA, 25 bp, Rattus norvegicus
ccaggctaaggtccggctcacagct

SEQ ID NO: 609785 - DNA, 25 bp, Rattus norvegicus
gctaaggtccggctcacagctgcag

SEQ ID NO: 609786 - DNA, 25 bp, Rattus norvegicus
ctcacagctgcagtccggtcgcgat

SEQ ID NO: 609787 - DNA, 25 bp, Rattus norvegicus
agtccggtcgcgatcctgaggccct

SEQ ID NO: 609788 - DNA, 25 bp, Rattus norvegicus
tgcagtgcggtagcccccggacaca

SEQ ID NO: 609789 - DNA, 25 bp, Rattus norvegicus
tacgcagtcgacgtagcgcaaacgg

SEQ ID NO: 609790 - DNA, 25 bp, Rattus norvegicus
tccttcactacgcagtcgacgtagc

SEQ ID NO: 609791 - DNA, 25 bp, Rattus norvegicus
ggtaggaggcgcagcacctccttca

SEQ ID NO: 609792 - DNA, 25 bp, Rattus norvegicus
tacgtccagctcaaaggtgcgcagt

SEQ ID NO: 609793 - DNA, 25 bp, Rattus norvegicus
tgcggcgcacttacgtccagctcaa

SEQ ID NO: 609794 - DNA, 25 bp, Rattus norvegicus
gcagtgcggcgcacttacgtccagc

SEQ ID NO: 609795 - DNA, 25 bp, Rattus norvegicus
acgtagcgcaaacggcccagcactg

SEQ ID NO: 609796 - DNA, 25 bp, Rattus norvegicus
aggaggcgcagcacctccttcacta

SEQ ID NO: 609797 - DNA, 25 bp, Rattus norvegicus
gcatcgcgcttcatctagctgcaga

SEQ ID NO: 609798 - DNA, 25 bp, Rattus norvegicus
ctcctgtagccgtggcacgaattgc

SEQ ID NO: 609799 - DNA, 25 bp, Rattus norvegicus
agcgcctcctgtagccgtggcacga

SEQ ID NO: 609800 - DNA, 25 bp, Rattus norvegicus
aggagcgcacctctcgccgcagcgc

SEQ ID NO: 609801 - DNA, 25 bp, Rattus norvegicus
tttggccgcctggtaaacagctacg

SEQ ID NO: 609802 - DNA, 25 bp, Rattus norvegicus
cggtgcatcgcgcttcatctagctg

SEQ ID NO: 609803 - DNA, 25 bp, Rattus norvegicus
gccagctcggtgcatcgcgcttcat

SEQ ID NO: 609804 - DNA, 25 bp, Rattus norvegicus
cgctcaaaggtctgggccagctcgg

SEQ ID NO: 609805 - DNA, 25 bp, Rattus norvegicus
cagccgctcaaaggtctgggccagc

SEQ ID NO: 609806 - DNA, 25 bp, Rattus norvegicus
acggtacgtccaagggcagtgagaa

SEQ ID NO: 609807 - DNA, 25 bp, Rattus norvegicus
ctaaacggtacgtccaagggcagtg

SEQ ID NO: 609808 - DNA, 25 bp, Rattus norvegicus
tgcgtaggccgctaaacggtacgtc

SEQ ID NO: 609809 - DNA, 25 bp, Rattus norvegicus
gcattaccttgcgtaggccgctaaa

SEQ ID NO: 609810 - DNA, 25 bp, Rattus norvegicus
cctggtaaacagctacgggtcgttg

SEQ ID NO: 609811 - DNA, 25 bp, Rattus norvegicus
cttaaacactgtcccgtagcgctcg

SEQ ID NO: 609812 - DNA, 25 bp, Rattus norvegicus
aaacactgtcccgtagcgctcgcgg

SEQ ID NO: 609813 - DNA, 25 bp, Rattus norvegicus
tgcgtcttaaacactgtcccgtagc

SEQ ID NO: 609814 - DNA, 25 bp, Rattus norvegicus
ggtgcgtcttaaacactgtcccgta

SEQ ID NO: 609815 - DNA, 25 bp, Rattus norvegicus
gaaggtgcgtcttaaacactgtccc

SEQ ID NO: 609816 - DNA, 25 bp, Rattus norvegicus
cccagaaggtgcgtcttaaacactg

SEQ ID NO: 609817 - DNA, 25 bp, Rattus norvegicus
ggcctgcccagaaggtgcgtcttaa

SEQ ID NO: 609818 - DNA, 25 bp, Rattus norvegicus
actggcctgcccagaaggtgcgtct

SEQ ID NO: 609819 - DNA, 25 bp, Rattus norvegicus
cggatcactggcctgcccagaaggt

SEQ ID NO: 609820 - DNA, 25 bp, Rattus norvegicus
gccgctcacccggatcactggcctg

SEQ ID NO: 609821 - DNA, 25 bp, Rattus norvegicus
tggtgcgcacgttctcagcgccgct

SEQ ID NO: 609822 - DNA, 25 bp, Rattus norvegicus
ctgcccagaaggtgcgtcttaaaca

SEQ ID NO: 609823 - DNA, 25 bp, Rattus norvegicus
aggatggtgcgcacgttctcagcgc

SEQ ID NO: 609824 - DNA, 25 bp, Rattus norvegicus
gctcgcggcgggaactatggaaacg

SEQ ID NO: 609825 - DNA, 25 bp, Rattus norvegicus
tgctcacccagcaggatggtgcgca

SEQ ID NO: 609826 - DNA, 25 bp, Rattus norvegicus
tgaacctagaagaatatgtgcgctc

SEQ ID NO: 609827 - DNA, 25 bp, Rattus norvegicus
tgtgtgaacctagaagaatatgtgc

SEQ ID NO: 609828 - DNA, 25 bp, Rattus norvegicus
agaagaatatgtgcgctctgcggcc

SEQ ID NO: 609829 - DNA, 25 bp, Rattus norvegicus
gaatatgtgcgctctgcggccactg

SEQ ID NO: 609830 - DNA, 25 bp, Rattus norvegicus
tatgtgcgctctgcggccactggct

SEQ ID NO: 609831 - DNA, 25 bp, Rattus norvegicus
ggccactggctacgcaccaggcggt

SEQ ID NO: 609832 - DNA, 25 bp, Rattus norvegicus
cggtgctcacccagcaggatggtgc

SEQ ID NO: 609833 - DNA, 25 bp, Rattus norvegicus
ccaaggagtgtgtgtgaacctagaa

SEQ ID NO: 609834 - DNA, 25 bp, Rattus norvegicus
gccgctgccgatgacgctcaccaac

SEQ ID NO: 609835 - DNA, 25 bp, Rattus norvegicus
tggctacgcaccaggcggtgctcac

SEQ ID NO: 609836 - DNA, 25 bp, Rattus norvegicus
gcgccaaggagtgtgtgtgaaccta

SEQ ID NO: 609837 - DNA, 25 bp, Rattus norvegicus
aaccgcgccaaggagtgtgtgtgaa

SEQ ID NO: 609838 - DNA, 25 bp, Rattus norvegicus
caccaaccgcgccaaggagtgtgtg

SEQ ID NO: 609839 - DNA, 25 bp, Rattus norvegicus
ctgtcttctctcagattgcaggccc

SEQ ID NO: 609840 - DNA, 25 bp, Rattus norvegicus
ctccggccttctctcagattgcaga

SEQ ID NO: 609841 - DNA, 25 bp, Rattus norvegicus
caggccgagttctcgccctttttcg

SEQ ID NO: 609842 - DNA, 25 bp, Rattus norvegicus
ctttttcggctttacgtcttgctcg

SEQ ID NO: 609843 - DNA, 25 bp, Rattus norvegicus
ggtcccgactctttctctcagattg

SEQ ID NO: 609844 - DNA, 25 bp, Rattus norvegicus
tgcagccgcgggattcaaactcccg

SEQ ID NO: 609845 - DNA, 25 bp, Rattus norvegicus
ctccgtctgcgctagtttcctgaga

SEQ ID NO: 609846 - DNA, 25 bp, Rattus norvegicus
gctttggtgagcagataacgccgca

SEQ ID NO: 609847 - DNA, 25 bp, Rattus norvegicus
tttcctgagagacaccacgctgggt

SEQ ID NO: 609848 - DNA, 25 bp, Rattus norvegicus
gactggacctctccggaggagcttt

SEQ ID NO: 609849 - DNA, 25 bp, Rattus norvegicus
gcgaccgctgtgtttgtctcaggca

SEQ ID NO: 609850 - DNA, 25 bp, Rattus norvegicus
gtcctgccggttgtcttttcgattc

SEQ ID NO: 609851 - DNA, 25 bp, Rattus norvegicus
tttcttaacagagaagccggcgacc

SEQ ID NO: 609852 - DNA, 25 bp, Rattus norvegicus
accaggtctctcaggtctctcgtgc

SEQ ID NO: 609853 - DNA, 25 bp, Rattus norvegicus
ccaccgttctgggactcatctttgt

SEQ ID NO: 609854 - DNA, 25 bp, Rattus norvegicus
gcgggttggaaatcaggatctgacc

SEQ ID NO: 609855 - DNA, 25 bp, Rattus norvegicus
atctttgtggtctcactgctgggca

SEQ ID NO: 609856 - DNA, 25 bp, Rattus norvegicus
cgtgcaacgcaacaagtgtccaggc

SEQ ID NO: 609857 - DNA, 25 bp, Rattus norvegicus
gcgacagtcagcttggtgctcaacc

SEQ ID NO: 609858 - DNA, 25 bp, Rattus norvegicus
gtgctcaacctcttctgcgcggatt

SEQ ID NO: 609859 - DNA, 25 bp, Rattus norvegicus
agcgccatccctctagtgctcgtgg

SEQ ID NO: 609860 - DNA, 25 bp, Rattus norvegicus
gcggatttgctcttcaccagcgcca

SEQ ID NO: 609861 - DNA, 25 bp, Rattus norvegicus
cttctacgtgatgaccatgagcggc

SEQ ID NO: 609862 - DNA, 25 bp, Rattus norvegicus
atgagcggcagcgtcacgatcctca

SEQ ID NO: 609863 - DNA, 25 bp, Rattus norvegicus
tgctggctttcatatggggttactc

SEQ ID NO: 609864 - DNA, 25 bp, Rattus norvegicus
gtcgtctgtcacctgctcttctacg

SEQ ID NO: 609865 - DNA, 25 bp, Rattus norvegicus
ttccctttcttctcggatgtcaagg

SEQ ID NO: 609866 - DNA, 25 bp, Rattus norvegicus
ccctctgcatcttgttccgcgtggt

SEQ ID NO: 609867 - DNA, 25 bp, Rattus norvegicus
gcgctttcgtaaccacgcggggtga

SEQ ID NO: 609868 - DNA, 25 bp, Rattus norvegicus
cttgactctgaagctgctcaccctg

SEQ ID NO: 609869 - DNA, 25 bp, Rattus norvegicus
ggagcttgcataaccctccctgact

SEQ ID NO: 609870 - DNA, 25 bp, Rattus norvegicus
catgatgcctaggctacgagctccg

SEQ ID NO: 609871 - DNA, 25 bp, Rattus norvegicus
gaccggggctgatacctacacgagc

SEQ ID NO: 609872 - DNA, 25 bp, Rattus norvegicus
tcgaagttctccttgactctgaagc

SEQ ID NO: 609873 - DNA, 25 bp, Rattus norvegicus
tgaagctgctcaccctgcagtcgcg

SEQ ID NO: 609874 - DNA, 25 bp, Rattus norvegicus
atttcacaccggagtctgccctgca

SEQ ID NO: 609875 - DNA, 25 bp, Rattus norvegicus
gagtctgccctgcaggacaggcgcc

SEQ ID NO: 609876 - DNA, 25 bp, Rattus norvegicus
gctcaccagcagaagccgcgtgcaa

SEQ ID NO: 609877 - DNA, 25 bp, Rattus norvegicus
agaagccgcgtgcaagcctggccgc

SEQ ID NO: 609878 - DNA, 25 bp, Rattus norvegicus
cggcttcccgacctttatagctccg

SEQ ID NO: 609879 - DNA, 25 bp, Rattus norvegicus
ggcggcggagcttgcataaccctcc

SEQ ID NO: 609880 - DNA, 25 bp, Rattus norvegicus
ctacacgagccttgtcgaagttctc

SEQ ID NO: 609881 - DNA, 25 bp, Rattus norvegicus
cgtactcctcatcatcatacttgtg

SEQ ID NO: 609882 - DNA, 25 bp, Rattus norvegicus
tgacagccacagctagaggcgcgtc

SEQ ID NO: 609883 - DNA, 25 bp, Rattus norvegicus
tcaaggagaagcgtgtggcgtcctc

SEQ ID NO: 609884 - DNA, 25 bp, Rattus norvegicus
gccaggagctggagagtagcatctc

SEQ ID NO: 609885 - DNA, 25 bp, Rattus norvegicus
cggcataggcgagaatgacatgact

SEQ ID NO: 609886 - DNA, 25 bp, Rattus norvegicus
atgacatgactctgccgagcaagcg

SEQ ID NO: 609887 - DNA, 25 bp, Rattus norvegicus
tcccagtctctgcaagcgatggcgc

SEQ ID NO: 609888 - DNA, 25 bp, Rattus norvegicus
cgagcaagcggagcatcagtgtcct

SEQ ID NO: 609889 - DNA, 25 bp, Rattus norvegicus
catctgttgctgatagccgcgcgct

SEQ ID NO: 609890 - DNA, 25 bp, Rattus norvegicus
ccctccgcagggtcgaagacctggt

SEQ ID NO: 609891 - DNA, 25 bp, Rattus norvegicus
ctctggatgaccaggatggcttctg

SEQ ID NO: 609892 - DNA, 25 bp, Rattus norvegicus
acttgtgcttctcattgagcagcga

SEQ ID NO: 609893 - DNA, 25 bp, Rattus norvegicus
agcaactgcttctccaggtggcgcc

SEQ ID NO: 609894 - DNA, 25 bp, Rattus norvegicus
tgagcagcgacaccttgagcactgg

SEQ ID NO: 609895 - DNA, 25 bp, Rattus norvegicus
acggcctcagcgagccgctgcaggt

SEQ ID NO: 609896 - DNA, 25 bp, Rattus norvegicus
tccagagccacgcagcgtcgccgcc

SEQ ID NO: 609897 - DNA, 25 bp, Rattus norvegicus
cagctagaacggctcggggtaaaca

SEQ ID NO: 609898 - DNA, 25 bp, Rattus norvegicus
agccaccgcccgctgtacgcctgtc

SEQ ID NO: 609899 - DNA, 25 bp, Rattus norvegicus
gctgtacgcctgtccctacgggtac

SEQ ID NO: 609900 - DNA, 25 bp, Rattus norvegicus
tgggaaccgcttccggcccggctca

SEQ ID NO: 609901 - DNA, 25 bp, Rattus norvegicus
ggctcagaggcgtgtcacatctaca

SEQ ID NO: 609902 - DNA, 25 bp, Rattus norvegicus
agaggcgtgtcacatctacaagaca

SEQ ID NO: 609903 - DNA, 25 bp, Rattus norvegicus
tctacaagacaccttctccggcgtg

SEQ ID NO: 609904 - DNA, 25 bp, Rattus norvegicus
accttctccggcgtgccgacggtgt

SEQ ID NO: 609905 - DNA, 25 bp, Rattus norvegicus
tgccgacggtgtgctgcagctagaa

SEQ ID NO: 609906 - DNA, 25 bp, Rattus norvegicus
acggtgtgctgcagctagaacggct

SEQ ID NO: 609907 - DNA, 25 bp, Rattus norvegicus
cgcgccggtcctccagagccacgca

SEQ ID NO: 609908 - DNA, 25 bp, Rattus norvegicus
gcccggctcagaggcgtgtcacatc

SEQ ID NO: 609909 - DNA, 25 bp, Rattus norvegicus
ccggcttctgttcgctcctgggaat

SEQ ID NO: 609910 - DNA, 25 bp, Rattus norvegicus
ttcgctcctgggaatcggctgtgcg

SEQ ID NO: 609911 - DNA, 25 bp, Rattus norvegicus
gctgtgcggctgacactctgtaact

SEQ ID NO: 609912 - DNA, 25 bp, Rattus norvegicus
gttcgtgtacctggtggcccagtca

SEQ ID NO: 609913 - DNA, 25 bp, Rattus norvegicus
ggcagcctgagttcgtgtacctggt

SEQ ID NO: 609914 - DNA, 25 bp, Rattus norvegicus
tgctctccgggttggagtcgctccc

SEQ ID NO: 609915 - DNA, 25 bp, Rattus norvegicus
ctgaggaccgcagatccggagagct

SEQ ID NO: 609916 - DNA, 25 bp, Rattus norvegicus
gactctgtctcttggtcactgagga

SEQ ID NO: 609917 - DNA, 25 bp, Rattus norvegicus
tctaaggtgagcctgcgactctgtc

SEQ ID NO: 609918 - DNA, 25 bp, Rattus norvegicus
acgtctggctggagatctaaggtga

SEQ ID NO: 609919 - DNA, 25 bp, Rattus norvegicus
tcccgccgcacgtctggctggagat

SEQ ID NO: 609920 - DNA, 25 bp, Rattus norvegicus
gactctccacggctctggggacgca

SEQ ID NO: 609921 - DNA, 25 bp, Rattus norvegicus
taactgggactctccacggctctgg

SEQ ID NO: 609922 - DNA, 25 bp, Rattus norvegicus
ctgacactctgtaactgggactctc

SEQ ID NO: 609923 - DNA, 25 bp, Rattus norvegicus
ctcgaggacccgctgcggagctgct

SEQ ID NO: 609924 - DNA, 25 bp, Rattus norvegicus
gaacacgttcgaggtgagccgccgt

SEQ ID NO: 609925 - DNA, 25 bp, Rattus norvegicus
ccaggtatcgcactggccgcgcgag

SEQ ID NO: 609926 - DNA, 25 bp, Rattus norvegicus
gatttcttcgccaggtatcgcactg

SEQ ID NO: 609927 - DNA, 25 bp, Rattus norvegicus
ggtggcttcgcggatttcttcgcca

SEQ ID NO: 609928 - DNA, 25 bp, Rattus norvegicus
gcacccttgccagcggcagagcagg

SEQ ID NO: 609929 - DNA, 25 bp, Rattus norvegicus
cagctaccacctctgccgggaggga

SEQ ID NO: 609930 - DNA, 25 bp, Rattus norvegicus
agactcgggctttttgctgctccag

SEQ ID NO: 609931 - DNA, 25 bp, Rattus norvegicus
gctcaggcatgaccaacggagactc

SEQ ID NO: 609932 - DNA, 25 bp, Rattus norvegicus
ctcgggaaggaacgccgagctgctc

SEQ ID NO: 609933 - DNA, 25 bp, Rattus norvegicus
ctcagatgatgggtcccgaggatgc

SEQ ID NO: 609934 - DNA, 25 bp, Rattus norvegicus
ccgtctctatggttcggggacgcgc

SEQ ID NO: 609935 - DNA, 25 bp, Rattus norvegicus
gggtcgctctagctgccgtctctat

SEQ ID NO: 609936 - DNA, 25 bp, Rattus norvegicus
cgcttcggctctcggaacacgttcg

SEQ ID NO: 609937 - DNA, 25 bp, Rattus norvegicus
gcgctccgccgctaacgacaaagtg

SEQ ID NO: 609938 - DNA, 25 bp, Rattus norvegicus
tcgagctgctgcagtcggaaacgca

SEQ ID NO: 609939 - DNA, 25 bp, Rattus norvegicus
tgcagtttttggcacgcaaagacgc

SEQ ID NO: 609940 - DNA, 25 bp, Rattus norvegicus
cgacaaagtgcgtacccattggctg

SEQ ID NO: 609941 - DNA, 25 bp, Rattus norvegicus
ctggcccagaccaaacccttgtgtg

SEQ ID NO: 609942 - DNA, 25 bp, Rattus norvegicus
acagttcactgcttctcgggacagc

SEQ ID NO: 609943 - DNA, 25 bp, Rattus norvegicus
cgggatgacgccacagttcactgct

SEQ ID NO: 609944 - DNA, 25 bp, Rattus norvegicus
ccggtaaggcactgctcgggatgac

SEQ ID NO: 609945 - DNA, 25 bp, Rattus norvegicus
gtgaagcagcacaataccggtaagg

SEQ ID NO: 609946 - DNA, 25 bp, Rattus norvegicus
aagtcgttggacctgtcgctccatg

SEQ ID NO: 609947 - DNA, 25 bp, Rattus norvegicus
accggaacgtctggcgaagtcgttg

SEQ ID NO: 609948 - DNA, 25 bp, Rattus norvegicus
cgtggacgctcactttgctcaggtc

SEQ ID NO: 609949 - DNA, 25 bp, Rattus norvegicus
cgatggctgccaagatgtccttctc

SEQ ID NO: 609950 - DNA, 25 bp, Rattus norvegicus
actaaccgagccttccgattgctgc

SEQ ID NO: 609951 - DNA, 25 bp, Rattus norvegicus
tgctcggctcagagcgcacctggat

SEQ ID NO: 609952 - DNA, 25 bp, Rattus norvegicus
aaaactgcctttggccttgactcgg

SEQ ID NO: 609953 - DNA, 25 bp, Rattus norvegicus
gatggcatagagtgctcggctcaga

SEQ ID NO: 609954 - DNA, 25 bp, Rattus norvegicus
acagatccgccctggtcgtgtcgct

SEQ ID NO: 609955 - DNA, 25 bp, Rattus norvegicus
ccaagacgctcttacccgggaaatg

SEQ ID NO: 609956 - DNA, 25 bp, Rattus norvegicus
agaggttgctcaaagtccttgccgc

SEQ ID NO: 609957 - DNA, 25 bp, Rattus norvegicus
cttccggggcgcagaaagaaaactg

SEQ ID NO: 609958 - DNA, 25 bp, Rattus norvegicus
ctggagaacaatctgctgggtggtc

SEQ ID NO: 609959 - DNA, 25 bp, Rattus norvegicus
tgggtggtcattgctaggcacaatc

SEQ ID NO: 609960 - DNA, 25 bp, Rattus norvegicus
tcccggagcagctgtcggagaaaga

SEQ ID NO: 609961 - DNA, 25 bp, Rattus norvegicus
taggcacaatcggagggaacagacc

SEQ ID NO: 609962 - DNA, 25 bp, Rattus norvegicus
ggaacagaccggcaaggcacagaac

SEQ ID NO: 609963 - DNA, 25 bp, Rattus norvegicus
ggcacagaacaccacggcgcgcagg

SEQ ID NO: 609964 - DNA, 25 bp, Rattus norvegicus
gtccttgccgcccacgagtcggaaa

SEQ ID NO: 609965 - DNA, 25 bp, Rattus norvegicus
agagcccgccgccaagcctgcgtcc

SEQ ID NO: 609966 - DNA, 25 bp, Rattus norvegicus
ggcctggaacggtccactccggcag

SEQ ID NO: 609967 - DNA, 25 bp, Rattus norvegicus
tagcatggcctggaacggtccactc

SEQ ID NO: 609968 - DNA, 25 bp, Rattus norvegicus
cctctcattagcatggcctggaacg

SEQ ID NO: 609969 - DNA, 25 bp, Rattus norvegicus
ttcaccaacactggggccggccaat

SEQ ID NO: 609970 - DNA, 25 bp, Rattus norvegicus
tgctactccgggctgacttcaccaa

SEQ ID NO: 609971 - DNA, 25 bp, Rattus norvegicus
ctgtttttctgctactccgggctga

SEQ ID NO: 609972 - DNA, 25 bp, Rattus norvegicus
cgctctgtttttctgctactccggg

SEQ ID NO: 609973 - DNA, 25 bp, Rattus norvegicus
ggcaagggcttacgcgcgtcctgcc

SEQ ID NO: 609974 - DNA, 25 bp, Rattus norvegicus
aagcctgcgtccctgtgagccgggc

SEQ ID NO: 609975 - DNA, 25 bp, Rattus norvegicus
gcgcgcggaacaaaggcgccgctcc

SEQ ID NO: 609976 - DNA, 25 bp, Rattus norvegicus
gcgaccagcctctcattagcatggc

SEQ ID NO: 609977 - DNA, 25 bp, Rattus norvegicus
agccgccgcccgcttacctcgcggg

SEQ ID NO: 609978 - DNA, 25 bp, Rattus norvegicus
gggctgacttcaccaacactggggc

SEQ ID NO: 609979 - DNA, 25 bp, Rattus norvegicus
tgggcgatcggtccgacccgcgcta

SEQ ID NO: 609980 - DNA, 25 bp, Rattus norvegicus
gcgggtacccttgcccagtgctgcc

SEQ ID NO: 609981 - DNA, 25 bp, Rattus norvegicus
ttcttccgtctacgtcccggctctc

SEQ ID NO: 609982 - DNA, 25 bp, Rattus norvegicus
ccggctctccggagttgcgtcagct

SEQ ID NO: 609983 - DNA, 25 bp, Rattus norvegicus
ggagttgcgtcagctgcgttacact

SEQ ID NO: 609984 - DNA, 25 bp, Rattus norvegicus
gttgcgtcagctgcgttacactgaa

SEQ ID NO: 609985 - DNA, 25 bp, Rattus norvegicus
gcgtcagctgcgttacactgaaccc

SEQ ID NO: 609986 - DNA, 25 bp, Rattus norvegicus
ctgacgttgggcgatcggtccgacc

SEQ ID NO: 609987 - DNA, 25 bp, Rattus norvegicus
cgacccgcgctacgccacgctaacg

SEQ ID NO: 609988 - DNA, 25 bp, Rattus norvegicus
tacgccacgctaacggcgcaggcgc

SEQ ID NO: 609989 - DNA, 25 bp, Rattus norvegicus
gcgcaggcgcttctgagaatcgcgc

SEQ ID NO: 609990 - DNA, 25 bp, Rattus norvegicus
ggcgcttctgagaatcgcgcccacg

SEQ ID NO: 609991 - DNA, 25 bp, Rattus norvegicus
gaatcgcgcccacgctccacgtggc

SEQ ID NO: 609992 - DNA, 25 bp, Rattus norvegicus
gctgcgttacactgaacccccgtag

SEQ ID NO: 609993 - DNA, 25 bp, Rattus norvegicus
cagccaatggaagaccgtgttgtta

SEQ ID NO: 609994 - DNA, 25 bp, Rattus norvegicus
gcagctgcggagtgcacataaggca

SEQ ID NO: 609995 - DNA, 25 bp, Rattus norvegicus
catctgtgcattggctcaagcggga

SEQ ID NO: 609996 - DNA, 25 bp, Rattus norvegicus
ggagccgtgtgctcttcagccaatg

SEQ ID NO: 609997 - DNA, 25 bp, Rattus norvegicus
agctacgtagcgaagcaatattgtc

SEQ ID NO: 609998 - DNA, 25 bp, Rattus norvegicus
cccgagtctccagatagatcctaga

SEQ ID NO: 609999 - DNA, 25 bp, Rattus norvegicus
gcgtcagaaagcatcaggcccacta

SEQ ID NO: 610000 - DNA, 25 bp, Rattus norvegicus
ctgtagttggtacttcgggcgtcac

SEQ ID NO: 610001 - DNA, 25 bp, Rattus norvegicus
ctcagacaagtctggaggcgctgta

SEQ ID NO: 610002 - DNA, 25 bp, Rattus norvegicus
cgttctcgggcatcgatagtgtcca

SEQ ID NO: 610003 - DNA, 25 bp, Rattus norvegicus
tatcccgccgcatcacctgggaagg

SEQ ID NO: 610004 - DNA, 25 bp, Rattus norvegicus
gtcagtatttccatcccgtatcccg

SEQ ID NO: 610005 - DNA, 25 bp, Rattus norvegicus
tacacaattttagatccgagaagtc

SEQ ID NO: 610006 - DNA, 25 bp, Rattus norvegicus
gacgtcatcagcttccatctgtgca

SEQ ID NO: 610007 - DNA, 25 bp, Rattus norvegicus
atcgcgcatgctcctgggctgcagg

SEQ ID NO: 610008 - DNA, 25 bp, Rattus norvegicus
acgagaggctgaccacactgggcga

SEQ ID NO: 610009 - DNA, 25 bp, Rattus norvegicus
tccggaggcttgagggagcagctca

SEQ ID NO: 610010 - DNA, 25 bp, Rattus norvegicus
agcagctcaggcgatcgatcacgtg

SEQ ID NO: 610011 - DNA, 25 bp, Rattus norvegicus
cagctcaggcgatcgatcacgtgca

SEQ ID NO: 610012 - DNA, 25 bp, Rattus norvegicus
tcaggcgatcgatcacgtgcacgga

SEQ ID NO: 610013 - DNA, 25 bp, Rattus norvegicus
cgatcgatcacgtgcacggaggctg

SEQ ID NO: 610014 - DNA, 25 bp, Rattus norvegicus
atcacgtgcacggaggctggatcaa

SEQ ID NO: 610015 - DNA, 25 bp, Rattus norvegicus
tgcacggaggctggatcaaaacctg

SEQ ID NO: 610016 - DNA, 25 bp, Rattus norvegicus
acggaggctggatcaaaacctggtg

SEQ ID NO: 610017 - DNA, 25 bp, Rattus norvegicus
aggggcacgagaggctgaccacact

SEQ ID NO: 610018 - DNA, 25 bp, Rattus norvegicus
gcagaacgctcgcatcgcgcatgct

SEQ ID NO: 610019 - DNA, 25 bp, Rattus norvegicus
tcctgggctgcaggcgttagtagct

SEQ ID NO: 610020 - DNA, 25 bp, Rattus norvegicus
gcagagggcagaacgctcgcatcgc

SEQ ID NO: 610021 - DNA, 25 bp, Rattus norvegicus
agagtcagggctcctgcgcctatgt

SEQ ID NO: 610022 - DNA, 25 bp, Rattus norvegicus
atcggagattctctgcaggtgagca

SEQ ID NO: 610023 - DNA, 25 bp, Rattus norvegicus
tggctttgtacagcgagccgcctgc

SEQ ID NO: 610024 - DNA, 25 bp, Rattus norvegicus
tcctttaacaatgggcggcgcgagc

SEQ ID NO: 610025 - DNA, 25 bp, Rattus norvegicus
ttcgaacccaggactcagagagcgc

SEQ ID NO: 610026 - DNA, 25 bp, Rattus norvegicus
agctttccgagctcgcacttttctg

SEQ ID NO: 610027 - DNA, 25 bp, Rattus norvegicus
cttttctgtagctcgtgcagcggac

SEQ ID NO: 610028 - DNA, 25 bp, Rattus norvegicus
cgattgcagactaagccggagcttc

SEQ ID NO: 610029 - DNA, 25 bp, Rattus norvegicus
tcccaactgggtagatcgggcctta

SEQ ID NO: 610030 - DNA, 25 bp, Rattus norvegicus
ccttactggccttggaggatggctt

SEQ ID NO: 610031 - DNA, 25 bp, Rattus norvegicus
cgcggggtgacctgagatcacatcc

SEQ ID NO: 610032 - DNA, 25 bp, Rattus norvegicus
tcttccagactgaagttgcggcgtc

SEQ ID NO: 610033 - DNA, 25 bp, Rattus norvegicus
cgcctccggcttccatggagctgga

SEQ ID NO: 610034 - DNA, 25 bp, Rattus norvegicus
ccgcctgccggtcctttaacaatgg

SEQ ID NO: 610035 - DNA, 25 bp, Rattus norvegicus
ccggcccgccttttcctgtaagatg

SEQ ID NO: 610036 - DNA, 25 bp, Rattus norvegicus
ccaagtcctgagtctcccggaagtg

SEQ ID NO: 610037 - DNA, 25 bp, Rattus norvegicus
tccgggtatgatgatgagccaagtc

SEQ ID NO: 610038 - DNA, 25 bp, Rattus norvegicus
gccatgacagttacatccgggtatg

SEQ ID NO: 610039 - DNA, 25 bp, Rattus norvegicus
gctcacagacgtcggccatgacagt

SEQ ID NO: 610040 - DNA, 25 bp, Rattus norvegicus
cacgtccattgcgagcgctcacaga

SEQ ID NO: 610041 - DNA, 25 bp, Rattus norvegicus
cgtcgcacttggtgatgggtcccta

SEQ ID NO: 610042 - DNA, 25 bp, Rattus norvegicus
tgaaaagcctttcggacagccctta

SEQ ID NO: 610043 - DNA, 25 bp, Rattus norvegicus
ccgttgcgtctagataacaggcttc

SEQ ID NO: 610044 - DNA, 25 bp, Rattus norvegicus
tcgcggcatcttgtccgttgcgtct

SEQ ID NO: 610045 - DNA, 25 bp, Rattus norvegicus
caggtctgggaaagcctgacaggtt

SEQ ID NO: 610046 - DNA, 25 bp, Rattus norvegicus
aaagaaagtcttgagtgggccgcgc

SEQ ID NO: 610047 - DNA, 25 bp, Rattus norvegicus
tgtaagatgcagtcgcaatgcccgc

SEQ ID NO: 610048 - DNA, 25 bp, Rattus norvegicus
cagagcctggactgcaaaaggatca

SEQ ID NO: 610049 - DNA, 25 bp, Rattus norvegicus
catggccctgtcctacggccgagcc

SEQ ID NO: 610050 - DNA, 25 bp, Rattus norvegicus
gaatgcgtcactttcggcgcgccca

SEQ ID NO: 610051 - DNA, 25 bp, Rattus norvegicus
gcgggtttgaatgcgtcactttcgg

SEQ ID NO: 610052 - DNA, 25 bp, Rattus norvegicus
aaagcagccggggccgattctccga

SEQ ID NO: 610053 - DNA, 25 bp, Rattus norvegicus
ctggggacgttacctgtgccgtcag

SEQ ID NO: 610054 - DNA, 25 bp, Rattus norvegicus
gtcaggccttgctcctcgtcgtctt

SEQ ID NO: 610055 - DNA, 25 bp, Rattus norvegicus
tcaggacgcgccgtagcttctccat

SEQ ID NO: 610056 - DNA, 25 bp, Rattus norvegicus
gagcctccggccacttgttcgtccg

SEQ ID NO: 610057 - DNA, 25 bp, Rattus norvegicus
caggaacccacaccctcacgggtcg

SEQ ID NO: 610058 - DNA, 25 bp, Rattus norvegicus
cgggcttccgcttctttcgagcatg

SEQ ID NO: 610059 - DNA, 25 bp, Rattus norvegicus
ttctttcgagcatgcgcacctcttc

SEQ ID NO: 610060 - DNA, 25 bp, Rattus norvegicus
gcacctcttcgctcttttgctgctg

SEQ ID NO: 610061 - DNA, 25 bp, Rattus norvegicus
tcttcgctcttttgctgctggggcg

SEQ ID NO: 610062 - DNA, 25 bp, Rattus norvegicus
tcctcgtcgtcttggccgctcagga

SEQ ID NO: 610063 - DNA, 25 bp, Rattus norvegicus
ggagccgccaagaccagttaggatg

SEQ ID NO: 610064 - DNA, 25 bp, Rattus norvegicus
tctcggcttgggcttgttgtaagtt

SEQ ID NO: 610065 - DNA, 25 bp, Rattus norvegicus
cagcgccatggcctactatcgtaag

SEQ ID NO: 610066 - DNA, 25 bp, Rattus norvegicus
ctgtgggcccagtctatggctattg

SEQ ID NO: 610067 - DNA, 25 bp, Rattus norvegicus
tttggcgcgcgaagccatcactcgt

SEQ ID NO: 610068 - DNA, 25 bp, Rattus norvegicus
cgacagtgtacttccgcgcgtcgga

SEQ ID NO: 610069 - DNA, 25 bp, Rattus norvegicus
cccacggtctcagaggctaggactt

SEQ ID NO: 610070 - DNA, 25 bp, Rattus norvegicus
ctatcgtaaggctaaggcgcgtacc

SEQ ID NO: 610071 - DNA, 25 bp, Rattus norvegicus
aaccaggggctcttgccagctatta

SEQ ID NO: 610072 - DNA, 25 bp, Rattus norvegicus
gccaggttttcctcgaagtggtcta

SEQ ID NO: 610073 - DNA, 25 bp, Rattus norvegicus
caatggggaccacgacaggtattcc

SEQ ID NO: 610074 - DNA, 25 bp, Rattus norvegicus
ccgccatctgggactcgcaggcaat

SEQ ID NO: 610075 - DNA, 25 bp, Rattus norvegicus
ccagctattagggttggtcattgtc

SEQ ID NO: 610076 - DNA, 25 bp, Rattus norvegicus
tccgcctcttgtgataggaagctca

SEQ ID NO: 610077 - DNA, 25 bp, Rattus norvegicus
agcggtcgcctgaggcatagtgaca

SEQ ID NO: 610078 - DNA, 25 bp, Rattus norvegicus
ttcgcgccctacctcattctagtaa

SEQ ID NO: 610079 - DNA, 25 bp, Rattus norvegicus
tcaacactgaggctaggcttcgcgc

SEQ ID NO: 610080 - DNA, 25 bp, Rattus norvegicus
gtcgtgcaggcagtaatgctcctca

SEQ ID NO: 610081 - DNA, 25 bp, Rattus norvegicus
aatcttgttttgacgctgtcgtgca

SEQ ID NO: 610082 - DNA, 25 bp, Rattus norvegicus
gcccacctggccaaatacaatcttg

SEQ ID NO: 610083 - DNA, 25 bp, Rattus norvegicus
ttccctgcacctcagtaacttcgga

SEQ ID NO: 610084 - DNA, 25 bp, Rattus norvegicus
ccaatcacttatgcgccctaggcga

SEQ ID NO: 610085 - DNA, 25 bp, Rattus norvegicus
ccggagaagccgctgctcaacacga

SEQ ID NO: 610086 - DNA, 25 bp, Rattus norvegicus
aaggcgttcctgtctggtctggaca

SEQ ID NO: 610087 - DNA, 25 bp, Rattus norvegicus
acggagcaagcccagtaaggcgttc

SEQ ID NO: 610088 - DNA, 25 bp, Rattus norvegicus
gcccgagggacttaacgtgcacaga

SEQ ID NO: 610089 - DNA, 25 bp, Rattus norvegicus
tagcagcaacagtagcaccagggtg

SEQ ID NO: 610090 - DNA, 25 bp, Rattus norvegicus
tcagatccagcgagacaccacgttc

SEQ ID NO: 610091 - DNA, 25 bp, Rattus norvegicus
taaggtttacaacaaagcccgcgca

SEQ ID NO: 610092 - DNA, 25 bp, Rattus norvegicus
gacttttattccaagcgcgctgggg

SEQ ID NO: 610093 - DNA, 25 bp, Rattus norvegicus
gaaggaccgccaccaaagatccgca

SEQ ID NO: 610094 - DNA, 25 bp, Rattus norvegicus
gatccgcacgttcccaaaccaccga

SEQ ID NO: 610095 - DNA, 25 bp, Rattus norvegicus
caaaccaccgaaaccagattcaatg

SEQ ID NO: 610096 - DNA, 25 bp, Rattus norvegicus
cagattcaatgcaaccagcaagagg

SEQ ID NO: 610097 - DNA, 25 bp, Rattus norvegicus
gcaaccagcaagaggacttttattc

SEQ ID NO: 610098 - DNA, 25 bp, Rattus norvegicus
attccaagcgcgctggggtccaaga

SEQ ID NO: 610099 - DNA, 25 bp, Rattus norvegicus
ccgagtgcagaatcgggacagcttt

SEQ ID NO: 610100 - DNA, 25 bp, Rattus norvegicus
agaatcgggacagcttttataaggt

SEQ ID NO: 610101 - DNA, 25 bp, Rattus norvegicus
gtttacaacaaagcccgcgcatcgc

SEQ ID NO: 610102 - DNA, 25 bp, Rattus norvegicus
cgcgcatcgcaaaccaatcatttca

SEQ ID NO: 610103 - DNA, 25 bp, Rattus norvegicus
tttcattgcatcaagagcccgcggg

SEQ ID NO: 610104 - DNA, 25 bp, Rattus norvegicus
gtgcagaatcgggacagcttttata

SEQ ID NO: 610105 - DNA, 25 bp, Rattus norvegicus
cgcatccatcttccgccgtgtagtg

SEQ ID NO: 610106 - DNA, 25 bp, Rattus norvegicus
accaagtgcctgaagggtgaggacc

SEQ ID NO: 610107 - DNA, 25 bp, Rattus norvegicus
caggctagcgagacgtcagctcaga

SEQ ID NO: 610108 - DNA, 25 bp, Rattus norvegicus
gggctactcgctcagcctcggctta

SEQ ID NO: 610109 - DNA, 25 bp, Rattus norvegicus
tccgcggtgttgaagggttccgcac

SEQ ID NO: 610110 - DNA, 25 bp, Rattus norvegicus
gattcacatccaccgggcgcggaca

SEQ ID NO: 610111 - DNA, 25 bp, Rattus norvegicus
gagtgctcggaaatgcctcctccca

SEQ ID NO: 610112 - DNA, 25 bp, Rattus norvegicus
tcgtcagaccgagcccggggcaaca

SEQ ID NO: 610113 - DNA, 25 bp, Rattus norvegicus
tggcaagcgcctggatcaccacgca

SEQ ID NO: 610114 - DNA, 25 bp, Rattus norvegicus
tgggtatttcctggttggcaagcgc

SEQ ID NO: 610115 - DNA, 25 bp, Rattus norvegicus
cccgccgtgaagtgatgggtatttc

SEQ ID NO: 610116 - DNA, 25 bp, Rattus norvegicus
cctgtccgcgtgtaagctgttcaca

SEQ ID NO: 610117 - DNA, 25 bp, Rattus norvegicus
tcaccgtgtgttcgtgctcgtcaga

SEQ ID NO: 610118 - DNA, 25 bp, Rattus norvegicus
gggccttcagaccatgccgggcctg

SEQ ID NO: 610119 - DNA, 25 bp, Rattus norvegicus
gggaggaaaccacgaagcaatcata

SEQ ID NO: 610120 - DNA, 25 bp, Rattus norvegicus
gtaacaaaatcacacggcgagcggc

SEQ ID NO: 610121 - DNA, 25 bp, Rattus norvegicus
ggcgctagtaacaaaatcacacggc

SEQ ID NO: 610122 - DNA, 25 bp, Rattus norvegicus
cgaagcaatcatacagccaagagat

SEQ ID NO: 610123 - DNA, 25 bp, Rattus norvegicus
gcagacttatacgaaaacgacgacg

SEQ ID NO: 610124 - DNA, 25 bp, Rattus norvegicus
acgacgacgataaagaacagggaca

SEQ ID NO: 610125 - DNA, 25 bp, Rattus norvegicus
cgacgataaagaacagggacacacc

SEQ ID NO: 610126 - DNA, 25 bp, Rattus norvegicus
caccaaggaggcagaatagaaagaa

SEQ ID NO: 610127 - DNA, 25 bp, Rattus norvegicus
agtcggaacagcgacgataacccac

SEQ ID NO: 610128 - DNA, 25 bp, Rattus norvegicus
tagcccaaacggacacgcgcgagac

SEQ ID NO: 610129 - DNA, 25 bp, Rattus norvegicus
cgcgagacccgccacaaacaccggg

SEQ ID NO: 610130 - DNA, 25 bp, Rattus norvegicus
gggaaccgcagccacagaagaggac

SEQ ID NO: 610131 - DNA, 25 bp, Rattus norvegicus
gacgagaggcgctagtaacaaaatc

SEQ ID NO: 610132 - DNA, 25 bp, Rattus norvegicus
tagaaagaagcgaagtcggaacagc

SEQ ID NO: 610133 - DNA, 25 bp, Rattus norvegicus
ctgccatgccgtcgcgggagcagct

SEQ ID NO: 610134 - DNA, 25 bp, Rattus norvegicus
gtgccacgtgtgtcccgtgcctcag

SEQ ID NO: 610135 - DNA, 25 bp, Rattus norvegicus
cggacagccgccagctcccgacgcc

SEQ ID NO: 610136 - DNA, 25 bp, Rattus norvegicus
gtgagatgtccaccggacagccgcc

SEQ ID NO: 610137 - DNA, 25 bp, Rattus norvegicus
ggaagtgagatgtccaccggacagc

SEQ ID NO: 610138 - DNA, 25 bp, Rattus norvegicus
tccgcgtggcacctgcacgcgcggc

SEQ ID NO: 610139 - DNA, 25 bp, Rattus norvegicus
acagtggcgactctggcgcttcctc

SEQ ID NO: 610140 - DNA, 25 bp, Rattus norvegicus
ctgtgctcaggacagtggcgactct

SEQ ID NO: 610141 - DNA, 25 bp, Rattus norvegicus
agctgcgcttgctacccacctgagg

SEQ ID NO: 610142 - DNA, 25 bp, Rattus norvegicus
gagcacggtatccggcgtccgcagc

SEQ ID NO: 610143 - DNA, 25 bp, Rattus norvegicus
ttgctacccacctgaggctgccatg

SEQ ID NO: 610144 - DNA, 25 bp, Rattus norvegicus
gtcccgtgcctcagggaagcaggca

SEQ ID NO: 610145 - DNA, 25 bp, Rattus norvegicus
ctggggcgagctgcgcttgctaccc

SEQ ID NO: 610146 - DNA, 25 bp, Rattus norvegicus
caggagtggcgcccagctgtgctca

SEQ ID NO: 610147 - DNA, 25 bp, Rattus norvegicus
atgctccgttgagagacgcggcttt

SEQ ID NO: 610148 - DNA, 25 bp, Rattus norvegicus
catccactgtgtaggtgaggctctc

SEQ ID NO: 610149 - DNA, 25 bp, Rattus norvegicus
gcggctttcggcaagaactggactc

SEQ ID NO: 610150 - DNA, 25 bp, Rattus norvegicus
acaagctcatccactgtgtaggtga

SEQ ID NO: 610151 - DNA, 25 bp, Rattus norvegicus
tttcggcaagaactggactcgtggc

SEQ ID NO: 610152 - DNA, 25 bp, Rattus norvegicus
cggcagcaatgctccgttgagagac

SEQ ID NO: 610153 - DNA, 25 bp, Rattus norvegicus
ctccgttgagagacgcggctttcgg

SEQ ID NO: 610154 - DNA, 25 bp, Rattus norvegicus
caagaactggactcgtggcgccaca

SEQ ID NO: 610155 - DNA, 25 bp, Rattus norvegicus
tggcgccacaagctcatccactgtg

SEQ ID NO: 610156 - DNA, 25 bp, Rattus norvegicus
ccactgtgtaggtgaggctctccac

SEQ ID NO: 610157 - DNA, 25 bp, Rattus norvegicus
taggtgaggctctccaccggtgccg

SEQ ID NO: 610158 - DNA, 25 bp, Rattus norvegicus
ggcctctgctcagcgggcgcattgt

SEQ ID NO: 610159 - DNA, 25 bp, Rattus norvegicus
agggagccggagctgtcacaggccc

SEQ ID NO: 610160 - DNA, 25 bp, Rattus norvegicus
tgtgtaggcggcagcaatgctccgt

SEQ ID NO: 610161 - DNA, 25 bp, Rattus norvegicus
ctagggaatcaggtcttcctcagac

SEQ ID NO: 610162 - DNA, 25 bp, Rattus norvegicus
gagattctgaccgtccgcttgggcc

SEQ ID NO: 610163 - DNA, 25 bp, Rattus norvegicus
gacctgggagattctgaccgtccgc

SEQ ID NO: 610164 - DNA, 25 bp, Rattus norvegicus
agacggacctgggagattctgaccg

SEQ ID NO: 610165 - DNA, 25 bp, Rattus norvegicus
tcctcagacggacctgggagattct

SEQ ID NO: 610166 - DNA, 25 bp, Rattus norvegicus
gggaatcaggtcttcctcagacgga

SEQ ID NO: 610167 - DNA, 25 bp, Rattus norvegicus
cccatgttgatggggcgcgttctag

SEQ ID NO: 610168 - DNA, 25 bp, Rattus norvegicus
cacgcccagtcctcggggaggcccg

SEQ ID NO: 610169 - DNA, 25 bp, Rattus norvegicus
gaaatgccctctcgtcgtcctctgt

SEQ ID NO: 610170 - DNA, 25 bp, Rattus norvegicus
tggggaaatgccctctcgtcgtcct

SEQ ID NO: 610171 - DNA, 25 bp, Rattus norvegicus
atgtgtggggaaatgccctctcgtc

SEQ ID NO: 610172 - DNA, 25 bp, Rattus norvegicus
ctgatgtgtggggaaatgccctctc

SEQ ID NO: 610173 - DNA, 25 bp, Rattus norvegicus
gtctttgcttcggtgcggctgatgt

SEQ ID NO: 610174 - DNA, 25 bp, Rattus norvegicus
gtcttcctcagacggacctgggaga

SEQ ID NO: 610175 - DNA, 25 bp, Rattus norvegicus
ctcagcaaacgaggtcccatcgctg

SEQ ID NO: 610176 - DNA, 25 bp, Rattus norvegicus
cgtggtctggcagatggcatagccc

SEQ ID NO: 610177 - DNA, 25 bp, Rattus norvegicus
aagcgctatcctggtgatgcccgcc

SEQ ID NO: 610178 - DNA, 25 bp, Rattus norvegicus
atcgctgcactcgaaggtgagcttc

SEQ ID NO: 610179 - DNA, 25 bp, Rattus norvegicus
ttccacccatgacagtgggcgcgtg

SEQ ID NO: 610180 - DNA, 25 bp, Rattus norvegicus
ggacccaagcgctatcctggtgatg

SEQ ID NO: 610181 - DNA, 25 bp, Rattus norvegicus
ctgctagtgtgccacccgcacgtta

SEQ ID NO: 610182 - DNA, 25 bp, Rattus norvegicus
cgcacgttacgcacacggggcacag

SEQ ID NO: 610183 - DNA, 25 bp, Rattus norvegicus
cacacggggcacagccgcacttggt

SEQ ID NO: 610184 - DNA, 25 bp, Rattus norvegicus
gcacagccgcacttggtgggcttct

SEQ ID NO: 610185 - DNA, 25 bp, Rattus norvegicus
ggtcccatcgctgcactcgaaggtg

SEQ ID NO: 610186 - DNA, 25 bp, Rattus norvegicus
tgcactcgaaggtgagcttcctccg

SEQ ID NO: 610187 - DNA, 25 bp, Rattus norvegicus
aaggtgagcttcctccgcttcagcc

SEQ ID NO: 610188 - DNA, 25 bp, Rattus norvegicus
acccatgacagtgggcgcgtggtct

SEQ ID NO: 610189 - DNA, 25 bp, Rattus norvegicus
agctgacggaatgcgtgactgcccg

SEQ ID NO: 610190 - DNA, 25 bp, Rattus norvegicus
accgcagatcgctggctggtgcgtt

SEQ ID NO: 610191 - DNA, 25 bp, Rattus norvegicus
tttcttcatgcttcccgcgttcctt

SEQ ID NO: 610192 - DNA, 25 bp, Rattus norvegicus
ccttttggtagagaagcggaccgca

SEQ ID NO: 610193 - DNA, 25 bp, Rattus norvegicus
gaagtgtttgtccttttggtagaga

SEQ ID NO: 610194 - DNA, 25 bp, Rattus norvegicus
tggccagcctcactagcaggcctga

SEQ ID NO: 610195 - DNA, 25 bp, Rattus norvegicus
ccgcggagtcatatgcgcaagcgca

SEQ ID NO: 610196 - DNA, 25 bp, Rattus norvegicus
gctcgccttcggtttccactgagtc

SEQ ID NO: 610197 - DNA, 25 bp, Rattus norvegicus
gaaatccctttcttcatgcttcccg

SEQ ID NO: 610198 - DNA, 25 bp, Rattus norvegicus
tttccgctcgcaagaaatccctttc

SEQ ID NO: 610199 - DNA, 25 bp, Rattus norvegicus
gcagaggacactcgaccgcgggaaa

SEQ ID NO: 610200 - DNA, 25 bp, Rattus norvegicus
ctggccgacacccacgaggagctga

SEQ ID NO: 610201 - DNA, 25 bp, Rattus norvegicus
agggaacttgtgtgactggccgaca

SEQ ID NO: 610202 - DNA, 25 bp, Rattus norvegicus
cgcctgtttccgctcgcaagaaatc

SEQ ID NO: 610203 - DNA, 25 bp, Rattus norvegicus
ccctggactccaagccaatggaaaa

SEQ ID NO: 610204 - DNA, 25 bp, Rattus norvegicus
caatcccactcacgggatcctgagg

SEQ ID NO: 610205 - DNA, 25 bp, Rattus norvegicus
gtgcctccagcagtgcccaagggac

SEQ ID NO: 610206 - DNA, 25 bp, Rattus norvegicus
ttacacttctctcccactgtgctga

SEQ ID NO: 610207 - DNA, 25 bp, Rattus norvegicus
ccagaggaccctacggtgcatcctg

SEQ ID NO: 610208 - DNA, 25 bp, Rattus norvegicus
ttcctatggacaggctccgtgctca

SEQ ID NO: 610209 - DNA, 25 bp, Rattus norvegicus
tgctcatggagcacgctacccaggt

SEQ ID NO: 610210 - DNA, 25 bp, Rattus norvegicus
cgtggcttccaacacagccggaagg

SEQ ID NO: 610211 - DNA, 25 bp, Rattus norvegicus
ggaaaccgcaccgagccaatgactg

SEQ ID NO: 610212 - DNA, 25 bp, Rattus norvegicus
accgagccaatgactgcaggggacc

SEQ ID NO: 610213 - DNA, 25 bp, Rattus norvegicus
agctgctagagccagggacgaagcc

SEQ ID NO: 610214 - DNA, 25 bp, Rattus norvegicus
tggaaaagacgtcgcacccaggctc

SEQ ID NO: 610215 - DNA, 25 bp, Rattus norvegicus
agcggctgctcaaagcggggccaat

SEQ ID NO: 610216 - DNA, 25 bp, Rattus norvegicus
ggctgtcacacaccgagcggctgct

SEQ ID NO: 610217 - DNA, 25 bp, Rattus norvegicus
ctacgtcgtcctgcccagaagcgtt

SEQ ID NO: 610218 - DNA, 25 bp, Rattus norvegicus
ccttctgcgtctgtcaaggactgga

SEQ ID NO: 610219 - DNA, 25 bp, Rattus norvegicus
cggggcagaagctctgtaccctgtc

SEQ ID NO: 610220 - DNA, 25 bp, Rattus norvegicus
tgcaagggtgacactcctctgcctg

SEQ ID NO: 610221 - DNA, 25 bp, Rattus norvegicus
ggccatgattggctggcgctaccga

SEQ ID NO: 610222 - DNA, 25 bp, Rattus norvegicus
tccgccaatgaggacgcgctaggcc

SEQ ID NO: 610223 - DNA, 25 bp, Rattus norvegicus
tcacgacaaccagagaagccttacg

SEQ ID NO: 610224 - DNA, 25 bp, Rattus norvegicus
ggtgaagccgcttcctaaacggatg

SEQ ID NO: 610225 - DNA, 25 bp, Rattus norvegicus
atagtccgctgctttgcgcaccaga

SEQ ID NO: 610226 - DNA, 25 bp, Rattus norvegicus
cggaagtccttgctccggacatagt

SEQ ID NO: 610227 - DNA, 25 bp, Rattus norvegicus
cctcatgagatagtcccggaagtcc

SEQ ID NO: 610228 - DNA, 25 bp, Rattus norvegicus
cgtcccttcagtagcctaagtcatg

SEQ ID NO: 610229 - DNA, 25 bp, Rattus norvegicus
ggtcgccttccctaagagcactgta

SEQ ID NO: 610230 - DNA, 25 bp, Rattus norvegicus
cccgtctttcagttcgcggggcaga

SEQ ID NO: 610231 - DNA, 25 bp, Rattus norvegicus
ctggcgagtagcacatatacaattt

SEQ ID NO: 610232 - DNA, 25 bp, Rattus norvegicus
gcagtgcccacccaatgagagatca

SEQ ID NO: 610233 - DNA, 25 bp, Rattus norvegicus
gagagatcatccgtccacccactgg

SEQ ID NO: 610234 - DNA, 25 bp, Rattus norvegicus
cccaaggcgagcgaagctgccctaa

SEQ ID NO: 610235 - DNA, 25 bp, Rattus norvegicus
cgggaacagtccgaccgtgctactc

SEQ ID NO: 610236 - DNA, 25 bp, Rattus norvegicus
tgcacgccagagcacgagtcttaac

SEQ ID NO: 610237 - DNA, 25 bp, Rattus norvegicus
gcagcggtttgaccttgaaggccta

SEQ ID NO: 610238 - DNA, 25 bp, Rattus norvegicus
ggcgcttctctccacatccaatgga

SEQ ID NO: 610239 - DNA, 25 bp, Rattus norvegicus
agggccaatggccaccgtcaaagta

SEQ ID NO: 610240 - DNA, 25 bp, Rattus norvegicus
gccagagcggttgagcctatcaaag

SEQ ID NO: 610241 - DNA, 25 bp, Rattus norvegicus
atcggccaagtccaccaatcaaggg

SEQ ID NO: 610242 - DNA, 25 bp, Rattus norvegicus
cctacgggagtaatgacaagctatc

SEQ ID NO: 610243 - DNA, 25 bp, Rattus norvegicus
ggacacactggggtctgcaccaatg

SEQ ID NO: 610244 - DNA, 25 bp, Rattus norvegicus
agggccaataaacaagacgcttcca

SEQ ID NO: 610245 - DNA, 25 bp, Rattus norvegicus
tccgcagaagatggaactgacgatg

SEQ ID NO: 610246 - DNA, 25 bp, Rattus norvegicus
gatccgagagcggagtagccactgt

SEQ ID NO: 610247 - DNA, 25 bp, Rattus norvegicus
aaacagcgagtgtcacggcgtccag

SEQ ID NO: 610248 - DNA, 25 bp, Rattus norvegicus
cgtccagctcgactttgcccaggtg

SEQ ID NO: 610249 - DNA, 25 bp, Rattus norvegicus
actttgcccaggtgtccgcagaaga

SEQ ID NO: 610250 - DNA, 25 bp, Rattus norvegicus
actgacgatgctgatgagaaagatc

SEQ ID NO: 610251 - DNA, 25 bp, Rattus norvegicus
tgcgccaggaactgcaaggagcaga

SEQ ID NO: 610252 - DNA, 25 bp, Rattus norvegicus
gcttcctgccgcacgtcggaggaca

SEQ ID NO: 610253 - DNA, 25 bp, Rattus norvegicus
acgtcggaggacagcgcttctcgca

SEQ ID NO: 610254 - DNA, 25 bp, Rattus norvegicus
gcgcttctcgcaggcccagcaggat

SEQ ID NO: 610255 - DNA, 25 bp, Rattus norvegicus
aggatccgcaggctgcgctccggta

SEQ ID NO: 610256 - DNA, 25 bp, Rattus norvegicus
agaaagatcatcagctgcgccagga

SEQ ID NO: 610257 - DNA, 25 bp, Rattus norvegicus
tacaggctcagatggtggcgcgatc

SEQ ID NO: 610258 - DNA, 25 bp, Rattus norvegicus
gccggctccatggtacaggctcaga

SEQ ID NO: 610259 - DNA, 25 bp, Rattus norvegicus
tgaccacactacgagaaggccaagg

SEQ ID NO: 610260 - DNA, 25 bp, Rattus norvegicus
gaccaaacttgcagccaggggcctg

SEQ ID NO: 610261 - DNA, 25 bp, Rattus norvegicus
acacggcgtgtggttatagtatata

SEQ ID NO: 610262 - DNA, 25 bp, Rattus norvegicus
tggatttgctcagctgcctcccttc

SEQ ID NO: 610263 - DNA, 25 bp, Rattus norvegicus
cccaactttcgatctcactgcggtg

SEQ ID NO: 610264 - DNA, 25 bp, Rattus norvegicus
ggtggtggtctccaagaagagtccc

SEQ ID NO: 610265 - DNA, 25 bp, Rattus norvegicus
cggatcggtgggatttctcaagcta

SEQ ID NO: 610266 - DNA, 25 bp, Rattus norvegicus
ccggccggtgtttctgtctcaaaca

SEQ ID NO: 610267 - DNA, 25 bp, Rattus norvegicus
gaccagggcatcttttctccgctga

SEQ ID NO: 610268 - DNA, 25 bp, Rattus norvegicus
tgagccctttcccaggcctggagtg

SEQ ID NO: 610269 - DNA, 25 bp, Rattus norvegicus
cctctccagtctttggggctaaaca

SEQ ID NO: 610270 - DNA, 25 bp, Rattus norvegicus
cccttggaaggagcgatacgtctgt

SEQ ID NO: 610271 - DNA, 25 bp, Rattus norvegicus
ggtctgtcctttctcgtgtctcgtt

SEQ ID NO: 610272 - DNA, 25 bp, Rattus norvegicus
tcttgacgacgactggaccagggca

SEQ ID NO: 610273 - DNA, 25 bp, Rattus norvegicus
tagacagggactagattggggtccc

SEQ ID NO: 610274 - DNA, 25 bp, Rattus norvegicus
ccggggctgtgaagcctctgtcccg

SEQ ID NO: 610275 - DNA, 25 bp, Rattus norvegicus
ttacagccactgcaaggactggggc

SEQ ID NO: 610276 - DNA, 25 bp, Rattus norvegicus
ggtctgggttttgttacagccactg

SEQ ID NO: 610277 - DNA, 25 bp, Rattus norvegicus
aaacgcctccattggccgggacctg

SEQ ID NO: 610278 - DNA, 25 bp, Rattus norvegicus
gctccagtctaaaacgcctccattg

SEQ ID NO: 610279 - DNA, 25 bp, Rattus norvegicus
ttgacagacgcggtccagctccagt

SEQ ID NO: 610280 - DNA, 25 bp, Rattus norvegicus
tgcggagtcgagcttttgacagacg

SEQ ID NO: 610281 - DNA, 25 bp, Rattus norvegicus
cggtggctccagctcgtcttctgga

SEQ ID NO: 610282 - DNA, 25 bp, Rattus norvegicus
tgttgcagcggtaccagaaatagac

SEQ ID NO: 610283 - DNA, 25 bp, Rattus norvegicus
agaagctgcaaagaaccgggtatcc

SEQ ID NO: 610284 - DNA, 25 bp, Rattus norvegicus
ggcatcctggcgtccttcccaattg

SEQ ID NO: 610285 - DNA, 25 bp, Rattus norvegicus
ttcccaattggttctggcgtctgtg

SEQ ID NO: 610286 - DNA, 25 bp, Rattus norvegicus
tctgcgtccacccagtgggatgttg

SEQ ID NO: 610287 - DNA, 25 bp, Rattus norvegicus
tcggcctgtggctcatcgaacgatt

SEQ ID NO: 610288 - DNA, 25 bp, Rattus norvegicus
ggtctgtttacaccaacgtctggtc

SEQ ID NO: 610289 - DNA, 25 bp, Rattus norvegicus
ccgcagtgtttggacaggggattac

SEQ ID NO: 610290 - DNA, 25 bp, Rattus norvegicus
cgcagtgtacacaaaatccgggtga

SEQ ID NO: 610291 - DNA, 25 bp, Rattus norvegicus
aggcacgatcgactcccaataaatg

SEQ ID NO: 610292 - DNA, 25 bp, Rattus norvegicus
ttgggcggacgtttcagatgtttcc

SEQ ID NO: 610293 - DNA, 25 bp, Rattus norvegicus
acctgcgctgggtttagatttcatc

SEQ ID NO: 610294 - DNA, 25 bp, Rattus norvegicus
cgtcctgtgcgcgtcagaagtctag

SEQ ID NO: 610295 - DNA, 25 bp, Rattus norvegicus
agaacacctccgtgactccgttaga

SEQ ID NO: 610296 - DNA, 25 bp, Rattus norvegicus
ctccgttagaacgacaggcacgatc

SEQ ID NO: 610297 - DNA, 25 bp, Rattus norvegicus
tgtcccaagccacatgcgtgcagcg

SEQ ID NO: 610298 - DNA, 25 bp, Rattus norvegicus
gggccagctcccgtggttacattag

SEQ ID NO: 610299 - DNA, 25 bp, Rattus norvegicus
gcctcggtttgtgcgtatgtcccaa

SEQ ID NO: 610300 - DNA, 25 bp, Rattus norvegicus
ttacattagcgcaagcggaggcctc

SEQ ID NO: 610301 - DNA, 25 bp, Rattus norvegicus
ccggtgaaggtgagagtctcctcca

SEQ ID NO: 610302 - DNA, 25 bp, Rattus norvegicus
gatgatcccgatccccgcaaggtta

SEQ ID NO: 610303 - DNA, 25 bp, Rattus norvegicus
gcggacttccgggatgatcccgatc

SEQ ID NO: 610304 - DNA, 25 bp, Rattus norvegicus
ctcattgcggacttccgggatgatc

SEQ ID NO: 610305 - DNA, 25 bp, Rattus norvegicus
ctggtctttaagctcattgcggact

SEQ ID NO: 610306 - DNA, 25 bp, Rattus norvegicus
attctttgcccaggttccacaggcc

SEQ ID NO: 610307 - DNA, 25 bp, Rattus norvegicus
tccatcattctttgcccaggttcca

SEQ ID NO: 610308 - DNA, 25 bp, Rattus norvegicus
ggtcccctcagattccatcgcgatg

SEQ ID NO: 610309 - DNA, 25 bp, Rattus norvegicus
agctcgtgctcgaggtcccctcaga

SEQ ID NO: 610310 - DNA, 25 bp, Rattus norvegicus
tgagagtctcctccagtcacaggtc

SEQ ID NO: 610311 - DNA, 25 bp, Rattus norvegicus
cgccggttctggtctttaagctcat

SEQ ID NO: 610312 - DNA, 25 bp, Rattus norvegicus
gctcggtcattggaagccgcgggct

SEQ ID NO: 610313 - DNA, 25 bp, Rattus norvegicus
agcagctcccagctcgtgctcgagg

SEQ ID NO: 610314 - DNA, 25 bp, Rattus norvegicus
tttaagctcattgcggacttccggg

SEQ ID NO: 610315 - DNA, 25 bp, Rattus norvegicus
gattcaacccgctgcagcgagaagg

SEQ ID NO: 610316 - DNA, 25 bp, Rattus norvegicus
actgcgctctcggtttggagactcg

SEQ ID NO: 610317 - DNA, 25 bp, Rattus norvegicus
gaagtcactgcgctctcggtttgga

SEQ ID NO: 610318 - DNA, 25 bp, Rattus norvegicus
ctgcgtgttgctcccgccgaagtca

SEQ ID NO: 610319 - DNA, 25 bp, Rattus norvegicus
ttgctgcacagctgcgtgttgctcc

SEQ ID NO: 610320 - DNA, 25 bp, Rattus norvegicus
ggaacgattcaacccgctgcagcga

SEQ ID NO: 610321 - DNA, 25 bp, Rattus norvegicus
tgtgtagaggttgttgctgcacagc

SEQ ID NO: 610322 - DNA, 25 bp, Rattus norvegicus
cgctgaggatgtgcacagagtagtc

SEQ ID NO: 610323 - DNA, 25 bp, Rattus norvegicus
ttcacaaactgcacatcgctgagga

SEQ ID NO: 610324 - DNA, 25 bp, Rattus norvegicus
ccctcctggaggagttaccttcaca

SEQ ID NO: 610325 - DNA, 25 bp, Rattus norvegicus
ctgccctcctggaggagttaccttc

SEQ ID NO: 610326 - DNA, 25 bp, Rattus norvegicus
tgatgcctcggtctgtcccgctcgt

SEQ ID NO: 610327 - DNA, 25 bp, Rattus norvegicus
cggtttggagactcggaacgattca

SEQ ID NO: 610328 - DNA, 25 bp, Rattus norvegicus
tggcacgcgcatgatgcctcggtct

SEQ ID NO: 610329 - DNA, 25 bp, Rattus norvegicus
ctgaacagggcggacagggccaaca

SEQ ID NO: 610330 - DNA, 25 bp, Rattus norvegicus
agccgggttaggcacacactgtgag

SEQ ID NO: 610331 - DNA, 25 bp, Rattus norvegicus
gcacacactgtgagaggcgatggcc

SEQ ID NO: 610332 - DNA, 25 bp, Rattus norvegicus
atggccagcccgtggcgtgagcaca

SEQ ID NO: 610333 - DNA, 25 bp, Rattus norvegicus
tgagcacacggagtacggacagatc

SEQ ID NO: 610334 - DNA, 25 bp, Rattus norvegicus
aggctcaggcgcaggccgctgaaca

SEQ ID NO: 610335 - DNA, 25 bp, Rattus norvegicus
ccgtcccaggcgcacagcgaaaaga

SEQ ID NO: 610336 - DNA, 25 bp, Rattus norvegicus
agtcgctctgctcgcgacagcgctg

SEQ ID NO: 610337 - DNA, 25 bp, Rattus norvegicus
ctcgatgaatacgagccgcggggcc

SEQ ID NO: 610338 - DNA, 25 bp, Rattus norvegicus
cccaggctggaagtagacccgcaag

SEQ ID NO: 610339 - DNA, 25 bp, Rattus norvegicus
acccgcaagaggaagctggtgcctt

SEQ ID NO: 610340 - DNA, 25 bp, Rattus norvegicus
cctccggcagtgtcttcaggtctca

SEQ ID NO: 610341 - DNA, 25 bp, Rattus norvegicus
aggtctcagacctagcagccaggca

SEQ ID NO: 610342 - DNA, 25 bp, Rattus norvegicus
taactccaccgggtccagcgagagc

SEQ ID NO: 610343 - DNA, 25 bp, Rattus norvegicus
agtttcggaggtcgtcgccactaat

SEQ ID NO: 610344 - DNA, 25 bp, Rattus norvegicus
attgcattgctccagctgcgcggac

SEQ ID NO: 610345 - DNA, 25 bp, Rattus norvegicus
attggctgtgcaggctttatccgga

SEQ ID NO: 610346 - DNA, 25 bp, Rattus norvegicus
ttgcctgctgcggaaaaattctgga

SEQ ID NO: 610347 - DNA, 25 bp, Rattus norvegicus
tcaacttcaggtctgcggacgcagc

SEQ ID NO: 610348 - DNA, 25 bp, Rattus norvegicus
tgcgcggactcctccgagttttttc

SEQ ID NO: 610349 - DNA, 25 bp, Rattus norvegicus
ggtgcaacagggcttttcctaaatg

SEQ ID NO: 610350 - DNA, 25 bp, Rattus norvegicus
gaccgcttctctgaattcatccaaa

SEQ ID NO: 610351 - DNA, 25 bp, Rattus norvegicus
gcttttctgtgcagcagaccgcttc

SEQ ID NO: 610352 - DNA, 25 bp, Rattus norvegicus
cccggtatcatccttgaaagctttt

SEQ ID NO: 610353 - DNA, 25 bp, Rattus norvegicus
gggaacagcgctgcctacccggtat

SEQ ID NO: 610354 - DNA, 25 bp, Rattus norvegicus
cggggttccagaaggtacagctctt

SEQ ID NO: 610355 - DNA, 25 bp, Rattus norvegicus
tcagggcagcatagccaaaagtttc

SEQ ID NO: 610356 - DNA, 25 bp, Rattus norvegicus
tgtcagcttgttcgcgctaaatatt

SEQ ID NO: 610357 - DNA, 25 bp, Rattus norvegicus
cagaagccagccagttgcgccttgg

SEQ ID NO: 610358 - DNA, 25 bp, Rattus norvegicus
tggttgttactagcgagccgccgca

SEQ ID NO: 610359 - DNA, 25 bp, Rattus norvegicus
aaagcgggcagcttggttgttacta

SEQ ID NO: 610360 - DNA, 25 bp, Rattus norvegicus
tcagttcgtcggacatcaaggtgtc

SEQ ID NO: 610361 - DNA, 25 bp, Rattus norvegicus
ctccagtcctttagaaatcagttcg

SEQ ID NO: 610362 - DNA, 25 bp, Rattus norvegicus
cgaacttcggcttgaaagtttggca

SEQ ID NO: 610363 - DNA, 25 bp, Rattus norvegicus
cgctcggaacaaacacatctccagt

SEQ ID NO: 610364 - DNA, 25 bp, Rattus norvegicus
gcttgaaagtttggcaacagtcaga

SEQ ID NO: 610365 - DNA, 25 bp, Rattus norvegicus
agcgagccgccgcaaaagcagtccg

SEQ ID NO: 610366 - DNA, 25 bp, Rattus norvegicus
aacagtcagaggttggcggtccact

SEQ ID NO: 610367 - DNA, 25 bp, Rattus norvegicus
cgctttcctggtagtggcagaagcc

SEQ ID NO: 610368 - DNA, 25 bp, Rattus norvegicus
cgtctgtgccaggagcgctttcctg

SEQ ID NO: 610369 - DNA, 25 bp, Rattus norvegicus
gcggtccactccatgcgcgtctgtg

SEQ ID NO: 610370 - DNA, 25 bp, Rattus norvegicus
ccaagttcggcacgcaagtgccgca

SEQ ID NO: 610371 - DNA, 25 bp, Rattus norvegicus
cgcggggaccgacctcagtctcgtg

SEQ ID NO: 610372 - DNA, 25 bp, Rattus norvegicus
attgctagagtgctaaacagctgta

SEQ ID NO: 610373 - DNA, 25 bp, Rattus norvegicus
agggtgtcattgctagagtgctaaa

SEQ ID NO: 610374 - DNA, 25 bp, Rattus norvegicus
gagccacgcagtgacgcggtgctaa

SEQ ID NO: 610375 - DNA, 25 bp, Rattus norvegicus
acgtcaggatttgagggtgtcattg

SEQ ID NO: 610376 - DNA, 25 bp, Rattus norvegicus
cctcagtctcgtgcccttttggagc

SEQ ID NO: 610377 - DNA, 25 bp, Rattus norvegicus
ccgcccagccctctcagcttggaga

SEQ ID NO: 610378 - DNA, 25 bp, Rattus norvegicus
gcatcttgggtgaccgagcgccgcc

SEQ ID NO: 610379 - DNA, 25 bp, Rattus norvegicus
tcagactggctacacgctgggcggt

SEQ ID NO: 610380 - DNA, 25 bp, Rattus norvegicus
aagcgcgcctcagactggctacacg

SEQ ID NO: 610381 - DNA, 25 bp, Rattus norvegicus
ggctgggtcacgtgtcccacccgga

SEQ ID NO: 610382 - DNA, 25 bp, Rattus norvegicus
acccacaaaacaggcccgggtcatg

SEQ ID NO: 610383 - DNA, 25 bp, Rattus norvegicus
taaacagctgtagggcggagccacg

SEQ ID NO: 610384 - DNA, 25 bp, Rattus norvegicus
tgcccttttggagcgggcgtctcgc

SEQ ID NO: 610385 - DNA, 25 bp, Rattus norvegicus
gtcaggctctggtgacacgctctgt

SEQ ID NO: 610386 - DNA, 25 bp, Rattus norvegicus
ccttcctaggggctgtttctaagcg

SEQ ID NO: 610387 - DNA, 25 bp, Rattus norvegicus
tccaggcagcagagtctgcaggttc

SEQ ID NO: 610388 - DNA, 25 bp, Rattus norvegicus
cgccgcaccttgatacgattcagca

SEQ ID NO: 610389 - DNA, 25 bp, Rattus norvegicus
cttgcctctgtgtgtgcgtatacac

SEQ ID NO: 610390 - DNA, 25 bp, Rattus norvegicus
ttctaagcgggagcaacgtgtaggc

SEQ ID NO: 610391 - DNA, 25 bp, Rattus norvegicus
cgtaccggtccctctaactgaagtg

SEQ ID NO: 610392 - DNA, 25 bp, Rattus norvegicus
gaagagtccactccggctgaacgta

SEQ ID NO: 610393 - DNA, 25 bp, Rattus norvegicus
ttcctgtgtgagagagaagagtcca

SEQ ID NO: 610394 - DNA, 25 bp, Rattus norvegicus
tgtcactaggttgcacttaattccc

SEQ ID NO: 610395 - DNA, 25 bp, Rattus norvegicus
cacgctctgtggcatattataatta

SEQ ID NO: 610396 - DNA, 25 bp, Rattus norvegicus
ctgcaggttccatgacgtgaagggc

SEQ ID NO: 610397 - DNA, 25 bp, Rattus norvegicus
gttctccagcgtctgcaccagcagg

SEQ ID NO: 610398 - DNA, 25 bp, Rattus norvegicus
aacgtgtaggcggtctgttcttgcc

SEQ ID NO: 610399 - DNA, 25 bp, Rattus norvegicus
cggggacccacaggcctgaaagact

SEQ ID NO: 610400 - DNA, 25 bp, Rattus norvegicus
agaagtttgcagtagcgctggaagc

SEQ ID NO: 610401 - DNA, 25 bp, Rattus norvegicus
cgcgccagaacagaagtttgcagta

SEQ ID NO: 610402 - DNA, 25 bp, Rattus norvegicus
ggcagcgctctgacgcgccagaaca

SEQ ID NO: 610403 - DNA, 25 bp, Rattus norvegicus
cgcctctctaaagggcagcgctctg

SEQ ID NO: 610404 - DNA, 25 bp, Rattus norvegicus
agtatctgcgaccttggatgcaccc

SEQ ID NO: 610405 - DNA, 25 bp, Rattus norvegicus
cgcaggacccgccaggaccaagaga

SEQ ID NO: 610406 - DNA, 25 bp, Rattus norvegicus
ctccatgtggcctccgtgctgtcgg

SEQ ID NO: 610407 - DNA, 25 bp, Rattus norvegicus
ggctcctccaagacctccatgtggc

SEQ ID NO: 610408 - DNA, 25 bp, Rattus norvegicus
gccagacagcaacaggcggcgcagc

SEQ ID NO: 610409 - DNA, 25 bp, Rattus norvegicus
agctcctcttgaaagccagacagca

SEQ ID NO: 610410 - DNA, 25 bp, Rattus norvegicus
agagagcccgcagctcctcttgaaa

SEQ ID NO: 610411 - DNA, 25 bp, Rattus norvegicus
cgctggaagcgaacgaacgaaaagt

SEQ ID NO: 610412 - DNA, 25 bp, Rattus norvegicus
aacgaacgaaaagtgcgctgaggcg

SEQ ID NO: 610413 - DNA, 25 bp, Rattus norvegicus
cgttagacagaggagaaaaccgtgc

SEQ ID NO: 610414 - DNA, 25 bp, Rattus norvegicus
agccctgatcggctcgttagacaga

SEQ ID NO: 610415 - DNA, 25 bp, Rattus norvegicus
cccacgggatccagacctaagacta

SEQ ID NO: 610416 - DNA, 25 bp, Rattus norvegicus
cctaagactatgaggcgctcagttc

SEQ ID NO: 610417 - DNA, 25 bp, Rattus norvegicus
ggctcaatgggacacagccctgatc

SEQ ID NO: 610418 - DNA, 25 bp, Rattus norvegicus
tcccaatgaagaagttaacccagtc

SEQ ID NO: 610419 - DNA, 25 bp, Rattus norvegicus
taacccagtccctggtgggtcacaa

SEQ ID NO: 610420 - DNA, 25 bp, Rattus norvegicus
ggactcgcagacctgatccttgaca

SEQ ID NO: 610421 - DNA, 25 bp, Rattus norvegicus
acctctggatccagccggtgagctc

SEQ ID NO: 610422 - DNA, 25 bp, Rattus norvegicus
tctcctgtctgcctcttgctgtctg

SEQ ID NO: 610423 - DNA, 25 bp, Rattus norvegicus
gtctgttcttttcttctcgcgggtg

SEQ ID NO: 610424 - DNA, 25 bp, Rattus norvegicus
cctctgagggtactaagggctccga

SEQ ID NO: 610425 - DNA, 25 bp, Rattus norvegicus
ggcgctcagttctataggctcaatg

SEQ ID NO: 610426 - DNA, 25 bp, Rattus norvegicus
aaaccgtgccagcagagggactcgc

SEQ ID NO: 610427 - DNA, 25 bp, Rattus norvegicus
gtgtctctttcctcgtccacaggcg

SEQ ID NO: 610428 - DNA, 25 bp, Rattus norvegicus
cgagcagcggagcagacttgccact

SEQ ID NO: 610429 - DNA, 25 bp, Rattus norvegicus
cctgtggactggagacgatttttac

SEQ ID NO: 610430 - DNA, 25 bp, Rattus norvegicus
cgagaagcattaggaccgaggccca

SEQ ID NO: 610431 - DNA, 25 bp, Rattus norvegicus
cgcccaggggctccaacaggtcgaa

SEQ ID NO: 610432 - DNA, 25 bp, Rattus norvegicus
gtcgaagggcggaagcttcccaata

SEQ ID NO: 610433 - DNA, 25 bp, Rattus norvegicus
ccgcgcgtcacgtgaggaaaagaaa

SEQ ID NO: 610434 - DNA, 25 bp, Rattus norvegicus
acaggggacaaccagcaccagctca

SEQ ID NO: 610435 - DNA, 25 bp, Rattus norvegicus
caccagctcagggtgagaaagaatc

SEQ ID NO: 610436 - DNA, 25 bp, Rattus norvegicus
tgtagtcttcgcgagaccctgtcgc

SEQ ID NO: 610437 - DNA, 25 bp, Rattus norvegicus
gcgttgacgctcctctatctccaga

SEQ ID NO: 610438 - DNA, 25 bp, Rattus norvegicus
gtcctactcaatcataccgtgtctc

SEQ ID NO: 610439 - DNA, 25 bp, Rattus norvegicus
caggcgagtttcttcgagcgtaatc

SEQ ID NO: 610440 - DNA, 25 bp, Rattus norvegicus
cctcagctgtgaatgcgctcaaatc

SEQ ID NO: 610441 - DNA, 25 bp, Rattus norvegicus
taaagatcgactcggagctcgctcc

SEQ ID NO: 610442 - DNA, 25 bp, Rattus norvegicus
ccagaggatggctccgagcgctgac

SEQ ID NO: 610443 - DNA, 25 bp, Rattus norvegicus
ttgtataaagcgagcgcgcggcgtc

SEQ ID NO: 610444 - DNA, 25 bp, Rattus norvegicus
gcgcgctcgagtggagttgtataaa

SEQ ID NO: 610445 - DNA, 25 bp, Rattus norvegicus
gcctttacataagcccgggcgcgct

SEQ ID NO: 610446 - DNA, 25 bp, Rattus norvegicus
gggcctccgccagcctttacataag

SEQ ID NO: 610447 - DNA, 25 bp, Rattus norvegicus
tcggacacgtcccttggctggataa

SEQ ID NO: 610448 - DNA, 25 bp, Rattus norvegicus
aatcccggctcctaaatcagcgcgg

SEQ ID NO: 610449 - DNA, 25 bp, Rattus norvegicus
gacccgggcgtgagtatccgctcct

SEQ ID NO: 610450 - DNA, 25 bp, Rattus norvegicus
cgctgcctcctgaaggttacgcggc

SEQ ID NO: 610451 - DNA, 25 bp, Rattus norvegicus
atctcggaggcagaaagaaggcagc

SEQ ID NO: 610452 - DNA, 25 bp, Rattus norvegicus
ccgggagacgcctgatcgttatctc

SEQ ID NO: 610453 - DNA, 25 bp, Rattus norvegicus
agaaatctcgccatcggcgtggctc

SEQ ID NO: 610454 - DNA, 25 bp, Rattus norvegicus
cccttggctggataaagatcgactc

SEQ ID NO: 610455 - DNA, 25 bp, Rattus norvegicus
ttaattgtgatggaaggcatgtgcg

SEQ ID NO: 610456 - DNA, 25 bp, Rattus norvegicus
actcggggaggagcagaaaatgacc

SEQ ID NO: 610457 - DNA, 25 bp, Rattus norvegicus
tctcgagttaattgtgatggaaggc

SEQ ID NO: 610458 - DNA, 25 bp, Rattus norvegicus
gagcagaaaatgaccgccctttgtt

SEQ ID NO: 610459 - DNA, 25 bp, Rattus norvegicus
accgccctttgttctgcggggatgg

SEQ ID NO: 610460 - DNA, 25 bp, Rattus norvegicus
tcctcggccacagctgggcgagtgc

SEQ ID NO: 610461 - DNA, 25 bp, Rattus norvegicus
cacagctgggcgagtgcctgcgcat

SEQ ID NO: 610462 - DNA, 25 bp, Rattus norvegicus
gcctgcgcatgtggagggcttatct

SEQ ID NO: 610463 - DNA, 25 bp, Rattus norvegicus
catgtggagggcttatctgctaacc

SEQ ID NO: 610464 - DNA, 25 bp, Rattus norvegicus
gggcttatctgctaacccgcaggtg

SEQ ID NO: 610465 - DNA, 25 bp, Rattus norvegicus
tctgctaacccgcaggtgcgtgatt

SEQ ID NO: 610466 - DNA, 25 bp, Rattus norvegicus
acccgcaggtgcgtgattgaggtct

SEQ ID NO: 610467 - DNA, 25 bp, Rattus norvegicus
ttgaggtctgcggatagctgcctcc

SEQ ID NO: 610468 - DNA, 25 bp, Rattus norvegicus
aaggcatgtgcgtgcctctgactcg

SEQ ID NO: 610469 - DNA, 25 bp, Rattus norvegicus
gctgatttgaagagcggtcaaggcc

SEQ ID NO: 610470 - DNA, 25 bp, Rattus norvegicus
tcaccgctcgatcgcctgctgccag

SEQ ID NO: 610471 - DNA, 25 bp, Rattus norvegicus
cggtgctgatttgaagagcggtcaa

SEQ ID NO: 610472 - DNA, 25 bp, Rattus norvegicus
ggcaatggcccggttttatctttga

SEQ ID NO: 610473 - DNA, 25 bp, Rattus norvegicus
gttttatctttgacagcggcagcag

SEQ ID NO: 610474 - DNA, 25 bp, Rattus norvegicus
cagggctcctgcaggcaatggcccg

SEQ ID NO: 610475 - DNA, 25 bp, Rattus norvegicus
tggcccggttttatctttgacagcg

SEQ ID NO: 610476 - DNA, 25 bp, Rattus norvegicus
cgcccgaggctcctcaccgctcgat

SEQ ID NO: 610477 - DNA, 25 bp, Rattus norvegicus
ttcctgcgagccgaggggtccctga

SEQ ID NO: 610478 - DNA, 25 bp, Rattus norvegicus
aacccgtagagtgttcctgcgagcc

SEQ ID NO: 610479 - DNA, 25 bp, Rattus norvegicus
tgagatcgccgaaacccgtagagtg

SEQ ID NO: 610480 - DNA, 25 bp, Rattus norvegicus
cggtactgatgagatcgccgaaacc

SEQ ID NO: 610481 - DNA, 25 bp, Rattus norvegicus
tgtccgcggtactgatgagatcgcc

SEQ ID NO: 610482 - DNA, 25 bp, Rattus norvegicus
tcctgcaggcaatggcccggtttta

SEQ ID NO: 610483 - DNA, 25 bp, Rattus norvegicus
tgcagtttgggcacctgcctgccac

SEQ ID NO: 610484 - DNA, 25 bp, Rattus norvegicus
gctgcactgccacaagtttcctctg

SEQ ID NO: 610485 - DNA, 25 bp, Rattus norvegicus
ttcccttggcctgagatgctgcact

SEQ ID NO: 610486 - DNA, 25 bp, Rattus norvegicus
atggaggcctatggcttcccttggc

SEQ ID NO: 610487 - DNA, 25 bp, Rattus norvegicus
gttgccactcggacacccaggtctt

SEQ ID NO: 610488 - DNA, 25 bp, Rattus norvegicus
tgctggccaagcgttgccactcgga

SEQ ID NO: 610489 - DNA, 25 bp, Rattus norvegicus
tgccgaacctcctggagcacgaaag

SEQ ID NO: 610490 - DNA, 25 bp, Rattus norvegicus
ccacacagtgggctacaagcgcatg

SEQ ID NO: 610491 - DNA, 25 bp, Rattus norvegicus
tacgactactatggttggcaaactg

SEQ ID NO: 610492 - DNA, 25 bp, Rattus norvegicus
gcgcggccaggaatacgactactat

SEQ ID NO: 610493 - DNA, 25 bp, Rattus norvegicus
gcctggatcactccggcagcggagc

SEQ ID NO: 610494 - DNA, 25 bp, Rattus norvegicus
tgcctcctacttggacgaccagagc

SEQ ID NO: 610495 - DNA, 25 bp, Rattus norvegicus
gtttcctctggacaacgacctctgc

SEQ ID NO: 610496 - DNA, 25 bp, Rattus norvegicus
gcggcaatatccagccatgcgggtg

SEQ ID NO: 610497 - DNA, 25 bp, Rattus norvegicus
aaacccgggctagcgcgagacaggc

SEQ ID NO: 610498 - DNA, 25 bp, Rattus norvegicus
cccggacactgtcccaggaatggga

SEQ ID NO: 610499 - DNA, 25 bp, Rattus norvegicus
gcccaaggggacagaagggccacca

SEQ ID NO: 610500 - DNA, 25 bp, Rattus norvegicus
cacagacgctccgaaatcgcaagtc

SEQ ID NO: 610501 - DNA, 25 bp, Rattus norvegicus
atcgcaagtccaccagagaacagtc

SEQ ID NO: 610502 - DNA, 25 bp, Rattus norvegicus
tccgggacgcgactcactctgcggt

SEQ ID NO: 610503 - DNA, 25 bp, Rattus norvegicus
acccaagcgcaggtgatcgagctcg

SEQ ID NO: 610504 - DNA, 25 bp, Rattus norvegicus
atcgagctcgtcgatactgcgcctg

SEQ ID NO: 610505 - DNA, 25 bp, Rattus norvegicus
taaataaatacagtggggctggggc

SEQ ID NO: 610506 - DNA, 25 bp, Rattus norvegicus
acgggagcaccaggctctgtaaata

SEQ ID NO: 610507 - DNA, 25 bp, Rattus norvegicus
cacgcctaagatcgctgtgccagca

SEQ ID NO: 610508 - DNA, 25 bp, Rattus norvegicus
tcaatgcggacagaggcctcgacca

SEQ ID NO: 610509 - DNA, 25 bp, Rattus norvegicus
gtgatggtcgtcacctacccggaca

SEQ ID NO: 610510 - DNA, 25 bp, Rattus norvegicus
cgagacaggctcagcaggtcaatgc

SEQ ID NO: 610511 - DNA, 25 bp, Rattus norvegicus
tcctgcttgcccagcagcgtgatga

SEQ ID NO: 610512 - DNA, 25 bp, Rattus norvegicus
gaaagggacttccaggcttcgcctg

SEQ ID NO: 610513 - DNA, 25 bp, Rattus norvegicus
tgcgcgagtccctggaagctgatat

SEQ ID NO: 610514 - DNA, 25 bp, Rattus norvegicus
ctgatatctgggctgagctgagcca

SEQ ID NO: 610515 - DNA, 25 bp, Rattus norvegicus
gctgagccacagcagtcagactaga

SEQ ID NO: 610516 - DNA, 25 bp, Rattus norvegicus
actagaactgaacgtcggggatcca

SEQ ID NO: 610517 - DNA, 25 bp, Rattus norvegicus
ccttgccctggtagcgacggcagca

SEQ ID NO: 610518 - DNA, 25 bp, Rattus norvegicus
cagcagccgtagagtgccgagagca

SEQ ID NO: 610519 - DNA, 25 bp, Rattus norvegicus
gccggtaactcttgaggttgcagta

SEQ ID NO: 610520 - DNA, 25 bp, Rattus norvegicus
ctgcgtctggtcgatcatgatgccc

SEQ ID NO: 610521 - DNA, 25 bp, Rattus norvegicus
gtgcgccacgttgaccacgagccag

SEQ ID NO: 610522 - DNA, 25 bp, Rattus norvegicus
accgacacgaagagcgcgaagtgca

SEQ ID NO: 610523 - DNA, 25 bp, Rattus norvegicus
cacgtctagctctcgacagggaatg

SEQ ID NO: 610524 - DNA, 25 bp, Rattus norvegicus
ttgctggtcgcgatggtgatccaga

SEQ ID NO: 610525 - DNA, 25 bp, Rattus norvegicus
gtgtaccctgcaagacgcgccgtct

SEQ ID NO: 610526 - DNA, 25 bp, Rattus norvegicus
ctgctcgctggaaggctatgacgga

SEQ ID NO: 610527 - DNA, 25 bp, Rattus norvegicus
ggcagccaagacaaccaggtaggta

SEQ ID NO: 610528 - DNA, 25 bp, Rattus norvegicus
ctcttaggaactgtggctgtgatcc

SEQ ID NO: 610529 - DNA, 25 bp, Rattus norvegicus
ggctcggagcgctttctcttaggaa

SEQ ID NO: 610530 - DNA, 25 bp, Rattus norvegicus
gggcatttgtcacgtgtaccctgca

SEQ ID NO: 610531 - DNA, 25 bp, Rattus norvegicus
ctcgccgataatccgcggatgattg

SEQ ID NO: 610532 - DNA, 25 bp, Rattus norvegicus
ctccgtgttcgatttggtgaagttg

SEQ ID NO: 610533 - DNA, 25 bp, Rattus norvegicus
gcccagaggaaaggggcatttgtca

SEQ ID NO: 610534 - DNA, 25 bp, Rattus norvegicus
gccgcacccggtgtcaggaatgcga

SEQ ID NO: 610535 - DNA, 25 bp, Rattus norvegicus
tggactcaaggaatctccgcacttg

SEQ ID NO: 610536 - DNA, 25 bp, Rattus norvegicus
attggctcgcggagtctccgtgttc

SEQ ID NO: 610537 - DNA, 25 bp, Rattus norvegicus
cgcacttgatttggaggcggtcacg

SEQ ID NO: 610538 - DNA, 25 bp, Rattus norvegicus
cctctgcagcagctgattggctcgc

SEQ ID NO: 610539 - DNA, 25 bp, Rattus norvegicus
atgctctaggagacaaacccgggtc

SEQ ID NO: 610540 - DNA, 25 bp, Rattus norvegicus
cttctgtgaagaccgcgcatgctct

SEQ ID NO: 610541 - DNA, 25 bp, Rattus norvegicus
cggctttcgcgtcaccttctgtgaa

SEQ ID NO: 610542 - DNA, 25 bp, Rattus norvegicus
ggccaatcagaaactgcgcctacgc

SEQ ID NO: 610543 - DNA, 25 bp, Rattus norvegicus
ctcgcgctcgaatagtggccaatca

SEQ ID NO: 610544 - DNA, 25 bp, Rattus norvegicus
tgtcctgtttacttggcgacgcgta

SEQ ID NO: 610545 - DNA, 25 bp, Rattus norvegicus
ccggtacctgcggaaagtgagctcc

SEQ ID NO: 610546 - DNA, 25 bp, Rattus norvegicus
cgagaccgacgggaaggtgtactca

SEQ ID NO: 610547 - DNA, 25 bp, Rattus norvegicus
ccctgagagtccttgacgaagtagc

SEQ ID NO: 610548 - DNA, 25 bp, Rattus norvegicus
tgcactcgatggctatctcggcctg

SEQ ID NO: 610549 - DNA, 25 bp, Rattus norvegicus
tgacgaagtagcttccactggagcc

SEQ ID NO: 610550 - DNA, 25 bp, Rattus norvegicus
cgctcgggatagatgctgcactcga

SEQ ID NO: 610551 - DNA, 25 bp, Rattus norvegicus
ggcgctgaagtttctttcctgcacc

SEQ ID NO: 610552 - DNA, 25 bp, Rattus norvegicus
acactagcgggctcgtctcgtccat

SEQ ID NO: 610553 - DNA, 25 bp, Rattus norvegicus
tcagcagaccggttagggatgacaa

SEQ ID NO: 610554 - DNA, 25 bp, Rattus norvegicus
cgctgttccttcgtccggattgtgg

SEQ ID NO: 610555 - DNA, 25 bp, Rattus norvegicus
ttactattatttcccggcgctgttc

SEQ ID NO: 610556 - DNA, 25 bp, Rattus norvegicus
agcgacaccctagaggacggctaga

SEQ ID NO: 610557 - DNA, 25 bp, Rattus norvegicus
gagaacccgagagagcgacacccta

SEQ ID NO: 610558 - DNA, 25 bp, Rattus norvegicus
aaaggcctcgcttcaccggctcgtt

SEQ ID NO: 610559 - DNA, 25 bp, Rattus norvegicus
atgacaagggccgaccaagcgggca

SEQ ID NO: 610560 - DNA, 25 bp, Rattus norvegicus
cggaggtccagaatagagcgttgtc

SEQ ID NO: 610561 - DNA, 25 bp, Rattus norvegicus
cccaaaggatgccaagctgtcattc

SEQ ID NO: 610562 - DNA, 25 bp, Rattus norvegicus
ttcccagttactgtccctcctagga

SEQ ID NO: 610563 - DNA, 25 bp, Rattus norvegicus
ggatttcagaatcccgcggctccga

SEQ ID NO: 610564 - DNA, 25 bp, Rattus norvegicus
ttcggcgacaaacgtttggctcttc

SEQ ID NO: 610565 - DNA, 25 bp, Rattus norvegicus
acctacggggcacacagtgttggga

SEQ ID NO: 610566 - DNA, 25 bp, Rattus norvegicus
gggaccctattgacagccgctgcaa

SEQ ID NO: 610567 - DNA, 25 bp, Rattus norvegicus
ggcctgcgttctctacagtgccaca

SEQ ID NO: 610568 - DNA, 25 bp, Rattus norvegicus
cgcccttgaggctcccggcaaatgg

SEQ ID NO: 610569 - DNA, 25 bp, Rattus norvegicus
gcagctcggaggctctcgtccagct

SEQ ID NO: 610570 - DNA, 25 bp, Rattus norvegicus
acagggacgctccacgagttctctg

SEQ ID NO: 610571 - DNA, 25 bp, Rattus norvegicus
ctacagtgccacacgggttctggga

SEQ ID NO: 610572 - DNA, 25 bp, Rattus norvegicus
acaaccggagctggcctatttcctg

SEQ ID NO: 610573 - DNA, 25 bp, Rattus norvegicus
tggcagttaccacagacaaccggag

SEQ ID NO: 610574 - DNA, 25 bp, Rattus norvegicus
gtcaccgagtcacagggctcgggca

SEQ ID NO: 610575 - DNA, 25 bp, Rattus norvegicus
tcacagagcagagcggtcaccgagt

SEQ ID NO: 610576 - DNA, 25 bp, Rattus norvegicus
tggggcgctccaaggaatccaccct

SEQ ID NO: 610577 - DNA, 25 bp, Rattus norvegicus
aggaatccaccctccggcgggctga

SEQ ID NO: 610578 - DNA, 25 bp, Rattus norvegicus
tacaaggggaaacgggtcacagagc

SEQ ID NO: 610579 - DNA, 25 bp, Rattus norvegicus
caaaggttcaaaagctgagccgggc

SEQ ID NO: 610580 - DNA, 25 bp, Rattus norvegicus
cagcagggctcttacaaggggaaac

SEQ ID NO: 610581 - DNA, 25 bp, Rattus norvegicus
tttcagcgtgggagcgtgtccgtca

SEQ ID NO: 610582 - DNA, 25 bp, Rattus norvegicus
tgtccgtcaggtgggtcaggacctt

SEQ ID NO: 610583 - DNA, 25 bp, Rattus norvegicus
cccgggactttctgggctgggacat

SEQ ID NO: 610584 - DNA, 25 bp, Rattus norvegicus
cggaagcctgaggtgaagagtcgct

SEQ ID NO: 610585 - DNA, 25 bp, Rattus norvegicus
tcaggacctttgggtgtctggagcc

SEQ ID NO: 610586 - DNA, 25 bp, Rattus norvegicus
gtggcttaaggttatccggtgctgc

SEQ ID NO: 610587 - DNA, 25 bp, Rattus norvegicus
taagtttggtgccaggaaccgagcc

SEQ ID NO: 610588 - DNA, 25 bp, Rattus norvegicus
tcaagtaagtttggtgccaggaacc

SEQ ID NO: 610589 - DNA, 25 bp, Rattus norvegicus
ctaagcatcggggtcaagtaagttt

SEQ ID NO: 610590 - DNA, 25 bp, Rattus norvegicus
aaggcctaagcatcggggtcaagta

SEQ ID NO: 610591 - DNA, 25 bp, Rattus norvegicus
ggggctgatctctttggaaggccta

SEQ ID NO: 610592 - DNA, 25 bp, Rattus norvegicus
tctgtcaggtcccaagcagttgggg

SEQ ID NO: 610593 - DNA, 25 bp, Rattus norvegicus
gatctctttggaaggcctaagcatc

SEQ ID NO: 610594 - DNA, 25 bp, Rattus norvegicus
gcttaaggttatccggtgctgcgca

SEQ ID NO: 610595 - DNA, 25 bp, Rattus norvegicus
gttgctcgcggttgcctaggtaaca

SEQ ID NO: 610596 - DNA, 25 bp, Rattus norvegicus
cttcgagaagccgagctcaggttgg

SEQ ID NO: 610597 - DNA, 25 bp, Rattus norvegicus
cgtaacagtcgtcttcgagaagccg

SEQ ID NO: 610598 - DNA, 25 bp, Rattus norvegicus
ggggcgtaacagtcgtcttcgagaa

SEQ ID NO: 610599 - DNA, 25 bp, Rattus norvegicus
tcaagtcggggcgtaacagtcgtct

SEQ ID NO: 610600 - DNA, 25 bp, Rattus norvegicus
gcaaagatcctagctgctggagccc

SEQ ID NO: 610601 - DNA, 25 bp, Rattus norvegicus
ggagcccggagcagcaaagatccta

SEQ ID NO: 610602 - DNA, 25 bp, Rattus norvegicus
cccagtgcggccgtaagggatggcg

SEQ ID NO: 610603 - DNA, 25 bp, Rattus norvegicus
aatgaacagcgggaattgtgcccag

SEQ ID NO: 610604 - DNA, 25 bp, Rattus norvegicus
tcgcggttgcctaggtaacagccaa

SEQ ID NO: 610605 - DNA, 25 bp, Rattus norvegicus
cgagaagccgagctcaggttggcct

SEQ ID NO: 610606 - DNA, 25 bp, Rattus norvegicus
cggttgcctaggtaacagccaatga

SEQ ID NO: 610607 - DNA, 25 bp, Rattus norvegicus
gcctaggtaacagccaatgaacagc

SEQ ID NO: 610608 - DNA, 25 bp, Rattus norvegicus
aacagcgggaattgtgcccagtgcg

SEQ ID NO: 610609 - DNA, 25 bp, Rattus norvegicus
acccgacggagttgattggctgagc

SEQ ID NO: 610610 - DNA, 25 bp, Rattus norvegicus
aaaaccactcctcctgtctactagg

SEQ ID NO: 610611 - DNA, 25 bp, Rattus norvegicus
tcctgtctactaggccgctaccaag

SEQ ID NO: 610612 - DNA, 25 bp, Rattus norvegicus
tctactaggccgctaccaagggccg

SEQ ID NO: 610613 - DNA, 25 bp, Rattus norvegicus
tccagaagcaattgtgaaaaaccac

SEQ ID NO: 610614 - DNA, 25 bp, Rattus norvegicus
cgctgttccagaagcaattgtgaaa

SEQ ID NO: 610615 - DNA, 25 bp, Rattus norvegicus
actcgctgttccagaagcaattgtg

SEQ ID NO: 610616 - DNA, 25 bp, Rattus norvegicus
cccactcgctgttccagaagcaatt

SEQ ID NO: 610617 - DNA, 25 bp, Rattus norvegicus
tgagctgtcctggacccgcccaact

SEQ ID NO: 610618 - DNA, 25 bp, Rattus norvegicus
gaacccgacggagttgattggctga

SEQ ID NO: 610619 - DNA, 25 bp, Rattus norvegicus
gctgcagaacccgacggagttgatt

SEQ ID NO: 610620 - DNA, 25 bp, Rattus norvegicus
aacacgcgctgcagaacccgacgga

SEQ ID NO: 610621 - DNA, 25 bp, Rattus norvegicus
aagcaattgtgaaaaaccactcctc

SEQ ID NO: 610622 - DNA, 25 bp, Rattus norvegicus
cccgcccaactgtagccacccactc

SEQ ID NO: 610623 - DNA, 25 bp, Rattus norvegicus
ctcgaggtactacccgggcgtggat

SEQ ID NO: 610624 - DNA, 25 bp, Rattus norvegicus
cgggaaccggtgtacctgtctgccg

SEQ ID NO: 610625 - DNA, 25 bp, Rattus norvegicus
ccctagaaccggaagcagccttggg

SEQ ID NO: 610626 - DNA, 25 bp, Rattus norvegicus
agatgtggcggatggtggggaagct

SEQ ID NO: 610627 - DNA, 25 bp, Rattus norvegicus
ggaaccggtgtacctgtctgccgcg

SEQ ID NO: 610628 - DNA, 25 bp, Rattus norvegicus
atgcgggaaccggtgtacctgtctg

SEQ ID NO: 610629 - DNA, 25 bp, Rattus norvegicus
gcgcacgcgcagactcccctagaac

SEQ ID NO: 610630 - DNA, 25 bp, Rattus norvegicus
cctagaaccggaagcagccttgggt

SEQ ID NO: 610631 - DNA, 25 bp, Rattus norvegicus
ctagaaccggaagcagccttgggtc

SEQ ID NO: 610632 - DNA, 25 bp, Rattus norvegicus
tagaaccggaagcagccttgggtcg

SEQ ID NO: 610633 - DNA, 25 bp, Rattus norvegicus
aagcagccttgggtcgggcatggcg

SEQ ID NO: 610634 - DNA, 25 bp, Rattus norvegicus
tcccggcgacgcgacgggaggagcc

SEQ ID NO: 610635 - DNA, 25 bp, Rattus norvegicus
gggaggagccgcctcgaggtactac

SEQ ID NO: 610636 - DNA, 25 bp, Rattus norvegicus
cgtggatggagatgtggcggatggt

SEQ ID NO: 610637 - DNA, 25 bp, Rattus norvegicus
ttgcatcggtagactcagacacata

SEQ ID NO: 610638 - DNA, 25 bp, Rattus norvegicus
cctattggctgagctgtgtgacgtc

SEQ ID NO: 610639 - DNA, 25 bp, Rattus norvegicus
tgacgtcatatttctgcgctccggc

SEQ ID NO: 610640 - DNA, 25 bp, Rattus norvegicus
cgttccaaccttgagcgcgcatttg

SEQ ID NO: 610641 - DNA, 25 bp, Rattus norvegicus
tttctagcatttggtggcggctccc

SEQ ID NO: 610642 - DNA, 25 bp, Rattus norvegicus
ttaccaatgactcagaagccgctgc

SEQ ID NO: 610643 - DNA, 25 bp, Rattus norvegicus
aagccgctgcgtctgtgagtgacct

SEQ ID NO: 610644 - DNA, 25 bp, Rattus norvegicus
gtgagggtctttctccagaccggaa

SEQ ID NO: 610645 - DNA, 25 bp, Rattus norvegicus
gtggaggcttcctgttctgtctcta

SEQ ID NO: 610646 - DNA, 25 bp, Rattus norvegicus
gtctctattcattttcgcccaggtg

SEQ ID NO: 610647 - DNA, 25 bp, Rattus norvegicus
cgcccaggtgtctttcgaatctctc

SEQ ID NO: 610648 - DNA, 25 bp, Rattus norvegicus
tctctcgggagaaccaaaaacttgc

SEQ ID NO: 610649 - DNA, 25 bp, Rattus norvegicus
cggaccgcttatttcttaggcctct

SEQ ID NO: 610650 - DNA, 25 bp, Rattus norvegicus
tgcctgcgacacaccgtctttcttt

SEQ ID NO: 610651 - DNA, 25 bp, Rattus norvegicus
tttgcttgcggaagctagcggaagt

SEQ ID NO: 610652 - DNA, 25 bp, Rattus norvegicus
ctcgtatgcaccaatcccagtgtga

SEQ ID NO: 610653 - DNA, 25 bp, Rattus norvegicus
tctgtctgggcgtccctggaacacg

SEQ ID NO: 610654 - DNA, 25 bp, Rattus norvegicus
acgccgggtctgtctgggcgtccct

SEQ ID NO: 610655 - DNA, 25 bp, Rattus norvegicus
cagtctgtaccagcaccgggtgagg

SEQ ID NO: 610656 - DNA, 25 bp, Rattus norvegicus
gaacgtcagtctgtaccagcaccgg

SEQ ID NO: 610657 - DNA, 25 bp, Rattus norvegicus
gcttcgggaacgtcagtctgtacca

SEQ ID NO: 610658 - DNA, 25 bp, Rattus norvegicus
caccggcggcttcgggaacgtcagt

SEQ ID NO: 610659 - DNA, 25 bp, Rattus norvegicus
cgagaaggaggactcgcaagcctcg

SEQ ID NO: 610660 - DNA, 25 bp, Rattus norvegicus
cggaagtgacgcagtctcgcgagaa

SEQ ID NO: 610661 - DNA, 25 bp, Rattus norvegicus
cgggactttgcttgcggaagctagc

SEQ ID NO: 610662 - DNA, 25 bp, Rattus norvegicus
accaatcccagtgtgactcgagacg

SEQ ID NO: 610663 - DNA, 25 bp, Rattus norvegicus
ctcgtgcccagcctactcgtatgca

SEQ ID NO: 610664 - DNA, 25 bp, Rattus norvegicus
ctcgcgagaaggaggactcgcaagc

SEQ ID NO: 610665 - DNA, 25 bp, Rattus norvegicus
gcgcgcccgagccaattttgtcccg

SEQ ID NO: 610666 - DNA, 25 bp, Rattus norvegicus
cgctagctgagagaaagccaggggc

SEQ ID NO: 610667 - DNA, 25 bp, Rattus norvegicus
cggttctccgggtgcctgagaccaa

SEQ ID NO: 610668 - DNA, 25 bp, Rattus norvegicus
agccaattttgtcccgcccgcgcac

SEQ ID NO: 610669 - DNA, 25 bp, Rattus norvegicus
ccgcgcaccgtctagcgggcgaggg

SEQ ID NO: 610670 - DNA, 25 bp, Rattus norvegicus
cccgcgcagccgcagtgtcggacag

SEQ ID NO: 610671 - DNA, 25 bp, Rattus norvegicus
tcactgaccggtgaggcgaggctca

SEQ ID NO: 610672 - DNA, 25 bp, Rattus norvegicus
gtgcctgagaccaaggcggttctca

SEQ ID NO: 610673 - DNA, 25 bp, Rattus norvegicus
agaccaaggcggttctcagtcggga

SEQ ID NO: 610674 - DNA, 25 bp, Rattus norvegicus
gcggttctcagtcgggaccttctac

SEQ ID NO: 610675 - DNA, 25 bp, Rattus norvegicus
gttctcagtcgggaccttctacttg

SEQ ID NO: 610676 - DNA, 25 bp, Rattus norvegicus
cagtcgggaccttctacttggggag

SEQ ID NO: 610677 - DNA, 25 bp, Rattus norvegicus
aaggggtgtcacgacgtacgccgag

SEQ ID NO: 610678 - DNA, 25 bp, Rattus norvegicus
gaccttctacttggggagccaggga

SEQ ID NO: 610679 - DNA, 25 bp, Rattus norvegicus
ttccatccatgaaccctgacggcta

SEQ ID NO: 610680 - DNA, 25 bp, Rattus norvegicus
aacgagtgccagtaggcagtgcgtc

SEQ ID NO: 610681 - DNA, 25 bp, Rattus norvegicus
cgacatcttatgaaacgagtgccag

SEQ ID NO: 610682 - DNA, 25 bp, Rattus norvegicus
ctgtgaaaaaactaacgacatctta

SEQ ID NO: 610683 - DNA, 25 bp, Rattus norvegicus
ccgagggagatctgtgaaaaaacta

SEQ ID NO: 610684 - DNA, 25 bp, Rattus norvegicus
cccaggtacgcgatccgagggagat

SEQ ID NO: 610685 - DNA, 25 bp, Rattus norvegicus
gaaccctgacggctacgaggtggct

SEQ ID NO: 610686 - DNA, 25 bp, Rattus norvegicus
ggaaccggaaccagcgcatcctgcg

SEQ ID NO: 610687 - DNA, 25 bp, Rattus norvegicus
tctgcgaggagttccggaaccggaa

SEQ ID NO: 610688 - DNA, 25 bp, Rattus norvegicus
agctgtcggaattcctctgcgagga

SEQ ID NO: 610689 - DNA, 25 bp, Rattus norvegicus
tgctgcagctgtcggaattcctctg

SEQ ID NO: 610690 - DNA, 25 bp, Rattus norvegicus
aagtcaagtacgtggggaacatgca

SEQ ID NO: 610691 - DNA, 25 bp, Rattus norvegicus
tggctgctgcccaggtacgcgatcc

SEQ ID NO: 610692 - DNA, 25 bp, Rattus norvegicus
gcctcatccaggacacccgcattca

SEQ ID NO: 610693 - DNA, 25 bp, Rattus norvegicus
gcgcctgacctctcgtagccaatca

SEQ ID NO: 610694 - DNA, 25 bp, Rattus norvegicus
gaggagcgcacgtccctaacgtccg

SEQ ID NO: 610695 - DNA, 25 bp, Rattus norvegicus
aggagcgcacgtccctaacgtccgt

SEQ ID NO: 610696 - DNA, 25 bp, Rattus norvegicus
gcacgtccctaacgtccgtctcctc

SEQ ID NO: 610697 - DNA, 25 bp, Rattus norvegicus
cctctctgccgtgggcgggcctagg

SEQ ID NO: 610698 - DNA, 25 bp, Rattus norvegicus
gcctaggggcccagacgccttcaga

SEQ ID NO: 610699 - DNA, 25 bp, Rattus norvegicus
taggggcccagacgccttcagagac

SEQ ID NO: 610700 - DNA, 25 bp, Rattus norvegicus
gggcccagacgccttcagagacctg

SEQ ID NO: 610701 - DNA, 25 bp, Rattus norvegicus
ggcccagacgccttcagagacctgg

SEQ ID NO: 610702 - DNA, 25 bp, Rattus norvegicus
cctgacctctcgtagccaatcagca

SEQ ID NO: 610703 - DNA, 25 bp, Rattus norvegicus
ccacagcgcctgacctctcgtagcc

SEQ ID NO: 610704 - DNA, 25 bp, Rattus norvegicus
cgctgtggctctgcgggtgccggct

SEQ ID NO: 610705 - DNA, 25 bp, Rattus norvegicus
tgccggctccaatcaggaggcgccg

SEQ ID NO: 610706 - DNA, 25 bp, Rattus norvegicus
cagacgccttcagagacctggggaa

SEQ ID NO: 610707 - DNA, 25 bp, Rattus norvegicus
agggccttgtcagctcttgagcttc

SEQ ID NO: 610708 - DNA, 25 bp, Rattus norvegicus
gcagcagccacctcgagagtgacat

SEQ ID NO: 610709 - DNA, 25 bp, Rattus norvegicus
agccacctcgagagtgacatcatcc

SEQ ID NO: 610710 - DNA, 25 bp, Rattus norvegicus
cgagagtgacatcatcccgagggcg

SEQ ID NO: 610711 - DNA, 25 bp, Rattus norvegicus
gggccaaactcttcagggccttgtc

SEQ ID NO: 610712 - DNA, 25 bp, Rattus norvegicus
tcttcagggccttgtcagctcttga

SEQ ID NO: 610713 - DNA, 25 bp, Rattus norvegicus
tgaggaaaccagaaatgcctacacg

SEQ ID NO: 610714 - DNA, 25 bp, Rattus norvegicus
tgtcagctcttgagcttcctctcct

SEQ ID NO: 610715 - DNA, 25 bp, Rattus norvegicus
tcttcctcaccaaatgccttcgacc

SEQ ID NO: 610716 - DNA, 25 bp, Rattus norvegicus
gggttcaccaccatcctctctcgca

SEQ ID NO: 610717 - DNA, 25 bp, Rattus norvegicus
tacacgtcctgcaacgccagggccc

SEQ ID NO: 610718 - DNA, 25 bp, Rattus norvegicus
gaaatgcctacacgtcctgcaacgc

SEQ ID NO: 610719 - DNA, 25 bp, Rattus norvegicus
accagaaatgcctacacgtcctgca

SEQ ID NO: 610720 - DNA, 25 bp, Rattus norvegicus
ccaaactcttcagggccttgtcagc

SEQ ID NO: 610721 - DNA, 25 bp, Rattus norvegicus
gaaagccgcgcccttgtcattcacg

SEQ ID NO: 610722 - DNA, 25 bp, Rattus norvegicus
ccttcaacggttcggccatggtcta

SEQ ID NO: 610723 - DNA, 25 bp, Rattus norvegicus
caggttcttggccacgacagatgca

SEQ ID NO: 610724 - DNA, 25 bp, Rattus norvegicus
aggggcgattgttacctaggcaaca

SEQ ID NO: 610725 - DNA, 25 bp, Rattus norvegicus
cttgccgacccagtgatgagtgttc

SEQ ID NO: 610726 - DNA, 25 bp, Rattus norvegicus
ccctctgtgggctacgaagcaggac

SEQ ID NO: 610727 - DNA, 25 bp, Rattus norvegicus
caagggtccaccaagttcgtgtgca

SEQ ID NO: 610728 - DNA, 25 bp, Rattus norvegicus
cttctgagtttaccggctccacagg

SEQ ID NO: 610729 - DNA, 25 bp, Rattus norvegicus
agatcgtcccgagggcttctcagtt

SEQ ID NO: 610730 - DNA, 25 bp, Rattus norvegicus
gccggaagttctggacgccttatcc

SEQ ID NO: 610731 - DNA, 25 bp, Rattus norvegicus
cctaggggatttgctgcgcactctt

SEQ ID NO: 610732 - DNA, 25 bp, Rattus norvegicus
cttgttagcttcatctcctagggga

SEQ ID NO: 610733 - DNA, 25 bp, Rattus norvegicus
tccctcgcaggttcttttggctctt

SEQ ID NO: 610734 - DNA, 25 bp, Rattus norvegicus
ctggactcgctcacttatcaaggac

SEQ ID NO: 610735 - DNA, 25 bp, Rattus norvegicus
taatgaggctcactgtgagatcgga

SEQ ID NO: 610736 - DNA, 25 bp, Rattus norvegicus
gctagacctcaaagtgcgcgcgcac

SEQ ID NO: 610737 - DNA, 25 bp, Rattus norvegicus
gcgcgcacctccagccagcagagcc

SEQ ID NO: 610738 - DNA, 25 bp, Rattus norvegicus
gcgtgcctcgctgggcgtctacact

SEQ ID NO: 610739 - DNA, 25 bp, Rattus norvegicus
cgctgggcgtctacactcatgacca

SEQ ID NO: 610740 - DNA, 25 bp, Rattus norvegicus
gtctacactcatgaccagcccgggg

SEQ ID NO: 610741 - DNA, 25 bp, Rattus norvegicus
cactcatgaccagcccggggcgtga

SEQ ID NO: 610742 - DNA, 25 bp, Rattus norvegicus
tgggctgagggtccaacgcccaccg

SEQ ID NO: 610743 - DNA, 25 bp, Rattus norvegicus
acgcccaccgcaatgagctggcgga

SEQ ID NO: 610744 - DNA, 25 bp, Rattus norvegicus
accgcaatgagctggcggaggctct

SEQ ID NO: 610745 - DNA, 25 bp, Rattus norvegicus
gtcctcggtttatggagtttaatga

SEQ ID NO: 610746 - DNA, 25 bp, Rattus norvegicus
aggttaacgaatggctgtagcggcc

SEQ ID NO: 610747 - DNA, 25 bp, Rattus norvegicus
ttatggagtttaatgaggctcactg

SEQ ID NO: 610748 - DNA, 25 bp, Rattus norvegicus
tttacgaggttaacgaatggctgta

SEQ ID NO: 610749 - DNA, 25 bp, Rattus norvegicus
gcacgtgtaagtgccacggcgtgtc

SEQ ID NO: 610750 - DNA, 25 bp, Rattus norvegicus
tgcctggagaacaagaccctggggc

SEQ ID NO: 610751 - DNA, 25 bp, Rattus norvegicus
cgttccatctctacacgcgagctgg

SEQ ID NO: 610752 - DNA, 25 bp, Rattus norvegicus
tcaccaagtacttctgcagccgtgc

SEQ ID NO: 610753 - DNA, 25 bp, Rattus norvegicus
gcagtccgctgcgagcagtgtcgcc

SEQ ID NO: 610754 - DNA, 25 bp, Rattus norvegicus
ccgagacagtgtccagctgcaactg

SEQ ID NO: 610755 - DNA, 25 bp, Rattus norvegicus
tacacgcgagctggtgcatctggag

SEQ ID NO: 610756 - DNA, 25 bp, Rattus norvegicus
tgtcgggcagttgcaccacacagac

SEQ ID NO: 610757 - DNA, 25 bp, Rattus norvegicus
cagcgctcaaggtggacctgctgca

SEQ ID NO: 610758 - DNA, 25 bp, Rattus norvegicus
aggagaagtatcacgcagcgctcaa

SEQ ID NO: 610759 - DNA, 25 bp, Rattus norvegicus
ggcgcgcatctgaaggagaagtatc

SEQ ID NO: 610760 - DNA, 25 bp, Rattus norvegicus
cggcgggtcaccaagtacttctgca

SEQ ID NO: 610761 - DNA, 25 bp, Rattus norvegicus
acacagacctgctggttgcagttgc

SEQ ID NO: 610762 - DNA, 25 bp, Rattus norvegicus
tttcactggtgctgcgcagtccgct

SEQ ID NO: 610763 - DNA, 25 bp, Rattus norvegicus
ggcctgccctttgtgcttgcagtcc

SEQ ID NO: 610764 - DNA, 25 bp, Rattus norvegicus
agccccagggcgtgcggctacagtc

SEQ ID NO: 610765 - DNA, 25 bp, Rattus norvegicus
gaagttcacggtgcgcaggttcttc

SEQ ID NO: 610766 - DNA, 25 bp, Rattus norvegicus
gccctttgtgcttgcagtccgcatc

SEQ ID NO: 610767 - DNA, 25 bp, Rattus norvegicus
ttgtgcttgcagtccgcatccgcgc

SEQ ID NO: 610768 - DNA, 25 bp, Rattus norvegicus
cgatggagctgaacatgaagaagtt

SEQ ID NO: 610769 - DNA, 25 bp, Rattus norvegicus
aacatgaagaagttcacggtgcgca

SEQ ID NO: 610770 - DNA, 25 bp, Rattus norvegicus
gtgcgcaggttcttctcagtgtacc

SEQ ID NO: 610771 - DNA, 25 bp, Rattus norvegicus
tctcagtgtacctgcgcaagaagtc

SEQ ID NO: 610772 - DNA, 25 bp, Rattus norvegicus
ctgcgcaagaagtcgcgctccaaga

SEQ ID NO: 610773 - DNA, 25 bp, Rattus norvegicus
aagtcgcgctccaagagctccagtc

SEQ ID NO: 610774 - DNA, 25 bp, Rattus norvegicus
aagagctccagtctgagtcgcctcg

SEQ ID NO: 610775 - DNA, 25 bp, Rattus norvegicus
cctagagtgggcatgtggagcccca

SEQ ID NO: 610776 - DNA, 25 bp, Rattus norvegicus
gagtcgcctcgaggtaaaggccctc

SEQ ID NO: 610777 - DNA, 25 bp, Rattus norvegicus
cagagtgcaccgcactgcggatggc

SEQ ID NO: 610778 - DNA, 25 bp, Rattus norvegicus
gtaaatttgccctggccacagctgg

SEQ ID NO: 610779 - DNA, 25 bp, Rattus norvegicus
ggcggctgcctagggccaaaagtaa

SEQ ID NO: 610780 - DNA, 25 bp, Rattus norvegicus
tagcgcttcagagtgcaccgcactg

SEQ ID NO: 610781 - DNA, 25 bp, Rattus norvegicus
tgtctcagcctagcgcttcagagtg

SEQ ID NO: 610782 - DNA, 25 bp, Rattus norvegicus
ggcgacctcctgaaccggtcctgtc

SEQ ID NO: 610783 - DNA, 25 bp, Rattus norvegicus
gagaaaacccacctgtaccgagcgc

SEQ ID NO: 610784 - DNA, 25 bp, Rattus norvegicus
attcgtacggctgttccagaggcgc

SEQ ID NO: 610785 - DNA, 25 bp, Rattus norvegicus
acctcgtccatgaggggggtattcg

SEQ ID NO: 610786 - DNA, 25 bp, Rattus norvegicus
ccgagtcaagtcaaggcctggagaa

SEQ ID NO: 610787 - DNA, 25 bp, Rattus norvegicus
gctcctggccgagtcaagtcaaggc

SEQ ID NO: 610788 - DNA, 25 bp, Rattus norvegicus
tgcctagggccaaaagtaaatttgc

SEQ ID NO: 610789 - DNA, 25 bp, Rattus norvegicus
tctgctcgcttagcggagctccgca

SEQ ID NO: 610790 - DNA, 25 bp, Rattus norvegicus
agcggagctccgcaacactaatccg

SEQ ID NO: 610791 - DNA, 25 bp, Rattus norvegicus
ctgaagtccgggtgtcaagctggac

SEQ ID NO: 610792 - DNA, 25 bp, Rattus norvegicus
ttgaagctagcgctgaagtccgggt

SEQ ID NO: 610793 - DNA, 25 bp, Rattus norvegicus
acgcgatcgttgaagctagcgctga

SEQ ID NO: 610794 - DNA, 25 bp, Rattus norvegicus
ctgagcggggacaaacgcgatcgtt

SEQ ID NO: 610795 - DNA, 25 bp, Rattus norvegicus
cacatgcgcaaaggcgggtcacggt

SEQ ID NO: 610796 - DNA, 25 bp, Rattus norvegicus
gacgctcgccgtgcacatgcgcaaa

SEQ ID NO: 610797 - DNA, 25 bp, Rattus norvegicus
gatgtcctttgcagccaccggactc

SEQ ID NO: 610798 - DNA, 25 bp, Rattus norvegicus
agcgggatgtcctttgcagccaccg

SEQ ID NO: 610799 - DNA, 25 bp, Rattus norvegicus
cacgcagcgggatgtcctttgcagc

SEQ ID NO: 610800 - DNA, 25 bp, Rattus norvegicus
tgcctcaagtggcaccacgcagcgg

SEQ ID NO: 610801 - DNA, 25 bp, Rattus norvegicus
caccgtgcagacctctccgtgcctc

SEQ ID NO: 610802 - DNA, 25 bp, Rattus norvegicus
tgtcaagctggacgggctttaaata

SEQ ID NO: 610803 - DNA, 25 bp, Rattus norvegicus
ctggacgggctttaaatacgctgta

SEQ ID NO: 610804 - DNA, 25 bp, Rattus norvegicus
ctttaaatacgctgtagagcctgcg

SEQ ID NO: 610805 - DNA, 25 bp, Rattus norvegicus
aagggcggagctcccacttccggtg

SEQ ID NO: 610806 - DNA, 25 bp, Rattus norvegicus
cgaggttgcggcctctgcctctgga

SEQ ID NO: 610807 - DNA, 25 bp, Rattus norvegicus
cccggcctgggatgagtcccagcta

SEQ ID NO: 610808 - DNA, 25 bp, Rattus norvegicus
gggatgagtcccagctacgaagtta

SEQ ID NO: 610809 - DNA, 25 bp, Rattus norvegicus
tgagtcccagctacgaagttacagc

SEQ ID NO: 610810 - DNA, 25 bp, Rattus norvegicus
acgaagttacagctttccgaccagg

SEQ ID NO: 610811 - DNA, 25 bp, Rattus norvegicus
agttacagctttccgaccaggccca

SEQ ID NO: 610812 - DNA, 25 bp, Rattus norvegicus
aggcccatcccacgtttgagccaga

SEQ ID NO: 610813 - DNA, 25 bp, Rattus norvegicus
atcccacgtttgagccagagcgacc

SEQ ID NO: 610814 - DNA, 25 bp, Rattus norvegicus
cacgtttgagccagagcgaccctcg

SEQ ID NO: 610815 - DNA, 25 bp, Rattus norvegicus
gtttgagccagagcgaccctcgggc

SEQ ID NO: 610816 - DNA, 25 bp, Rattus norvegicus
gaccctcgggcggaagagctcatcg

SEQ ID NO: 610817 - DNA, 25 bp, Rattus norvegicus
ccgtccctagagtagagatggcggc

SEQ ID NO: 610818 - DNA, 25 bp, Rattus norvegicus
tccctagagtagagatggcggcgac

SEQ ID NO: 610819 - DNA, 25 bp, Rattus norvegicus
cccacagctctcacccagccgcccg

SEQ ID NO: 610820 - DNA, 25 bp, Rattus norvegicus
agaattcaatttccgcccgtaagtg

SEQ ID NO: 610821 - DNA, 25 bp, Rattus norvegicus
gccgcttagcaagtctgggaactcg

SEQ ID NO: 610822 - DNA, 25 bp, Rattus norvegicus
cttagcaagtctgggaactcggtcc

SEQ ID NO: 610823 - DNA, 25 bp, Rattus norvegicus
caagtctgggaactcggtcccagcc

SEQ ID NO: 610824 - DNA, 25 bp, Rattus norvegicus
ctccgcgctttcatcagaattcaat

SEQ ID NO: 610825 - DNA, 25 bp, Rattus norvegicus
cgcgctttcatcagaattcaatttc

SEQ ID NO: 610826 - DNA, 25 bp, Rattus norvegicus
caatttccgcccgtaagtgactccg

SEQ ID NO: 610827 - DNA, 25 bp, Rattus norvegicus
atttccgcccgtaagtgactccgcg

SEQ ID NO: 610828 - DNA, 25 bp, Rattus norvegicus
gggcccctgatccttctcttgatga

SEQ ID NO: 610829 - DNA, 25 bp, Rattus norvegicus
atccttctcttgatgaatgagccgc

SEQ ID NO: 610830 - DNA, 25 bp, Rattus norvegicus
tctcttgatgaatgagccgcccggc

SEQ ID NO: 610831 - DNA, 25 bp, Rattus norvegicus
cttgatgaatgagccgcccggccag

SEQ ID NO: 610832 - DNA, 25 bp, Rattus norvegicus
gtccgtcaccgtcaccctctcctcg

SEQ ID NO: 610833 - DNA, 25 bp, Rattus norvegicus
gttccaacaagtcctgtcaggattg

SEQ ID NO: 610834 - DNA, 25 bp, Rattus norvegicus
cacattctggattactgtagcgtgc

SEQ ID NO: 610835 - DNA, 25 bp, Rattus norvegicus
taaagaagcatgttccaacaagtcc

SEQ ID NO: 610836 - DNA, 25 bp, Rattus norvegicus
cccgcacaatctcggtgctgacagc

SEQ ID NO: 610837 - DNA, 25 bp, Rattus norvegicus
ttctggattactgtagcgtgcccgg

SEQ ID NO: 610838 - DNA, 25 bp, Rattus norvegicus
tcatctgcagaaatacacattctgg

SEQ ID NO: 610839 - DNA, 25 bp, Rattus norvegicus
gtattgatttaatcatctgcagaaa

SEQ ID NO: 610840 - DNA, 25 bp, Rattus norvegicus
gtcctgtcaggattgtattgattta

SEQ ID NO: 610841 - DNA, 25 bp, Rattus norvegicus
gcatgttccaacaagtcctgtcagg

SEQ ID NO: 610842 - DNA, 25 bp, Rattus norvegicus
aggaattgcgcaaaataaagaagca

SEQ ID NO: 610843 - DNA, 25 bp, Rattus norvegicus
cgcggggaaggaattgcgcaaaata

SEQ ID NO: 610844 - DNA, 25 bp, Rattus norvegicus
acagccgagtgggtgataaatgccg

SEQ ID NO: 610845 - DNA, 25 bp, Rattus norvegicus
tgacagccgagtgggtgataaatgc

SEQ ID NO: 610846 - DNA, 25 bp, Rattus norvegicus
tggattactgtagcgtgcccgggcc

SEQ ID NO: 610847 - DNA, 25 bp, Rattus norvegicus
ggaaggtcacctccttcatcacgga

SEQ ID NO: 610848 - DNA, 25 bp, Rattus norvegicus
cgagcccgcgcgtgactttagcgcg

SEQ ID NO: 610849 - DNA, 25 bp, Rattus norvegicus
cgcgtgactttagcgcgcgcgcgca

SEQ ID NO: 610850 - DNA, 25 bp, Rattus norvegicus
cgcggtaacctttgcagatggcgcc

SEQ ID NO: 610851 - DNA, 25 bp, Rattus norvegicus
cctgatgcgcggtaacctttgcaga

SEQ ID NO: 610852 - DNA, 25 bp, Rattus norvegicus
aaattctgtgccgagcctgatgcgc

SEQ ID NO: 610853 - DNA, 25 bp, Rattus norvegicus
cccgactgcagacgcagatgaaatt

SEQ ID NO: 610854 - DNA, 25 bp, Rattus norvegicus
tgaaaaatgtgtccgcgtgcggccc

SEQ ID NO: 610855 - DNA, 25 bp, Rattus norvegicus
catgaaaaatgtgtccgcgtgcggc

SEQ ID NO: 610856 - DNA, 25 bp, Rattus norvegicus
cggaatcgcatgtacatgaaaaatg

SEQ ID NO: 610857 - DNA, 25 bp, Rattus norvegicus
tgcatccggaatcgcatgtacatga

SEQ ID NO: 610858 - DNA, 25 bp, Rattus norvegicus
acggattctatttgcatccggaatc

SEQ ID NO: 610859 - DNA, 25 bp, Rattus norvegicus
cctccttcatcacggattctatttg

SEQ ID NO: 610860 - DNA, 25 bp, Rattus norvegicus
agatgaaattctgtgccgagcctga

SEQ ID NO: 610861 - DNA, 25 bp, Rattus norvegicus
agataaccattagcgcggccgccga

SEQ ID NO: 610862 - DNA, 25 bp, Rattus norvegicus
ggcacggctgcgagataaccattag

SEQ ID NO: 610863 - DNA, 25 bp, Rattus norvegicus
ccgataaagcgggaggctgcatttc

SEQ ID NO: 610864 - DNA, 25 bp, Rattus norvegicus
aggctgcatttctaaaggctccgcg

SEQ ID NO: 610865 - DNA, 25 bp, Rattus norvegicus
atttctaaaggctccgcggccatta

SEQ ID NO: 610866 - DNA, 25 bp, Rattus norvegicus
ctccgcggccattactggaaagtta

SEQ ID NO: 610867 - DNA, 25 bp, Rattus norvegicus
ccgcgcccaccgatgtccaccaggg

SEQ ID NO: 610868 - DNA, 25 bp, Rattus norvegicus
acgagcctcagtctgccggctcgga

SEQ ID NO: 610869 - DNA, 25 bp, Rattus norvegicus
ctggaaagttagtgtgaaacatgtt

SEQ ID NO: 610870 - DNA, 25 bp, Rattus norvegicus
ctgccctgcagtaagggcggccctt

SEQ ID NO: 610871 - DNA, 25 bp, Rattus norvegicus
ggggtccagtccactagacgttgca

SEQ ID NO: 610872 - DNA, 25 bp, Rattus norvegicus
ccagtccactagacgttgcatctta

SEQ ID NO: 610873 - DNA, 25 bp, Rattus norvegicus
ctagacgttgcatcttatagccgcg

SEQ ID NO: 610874 - DNA, 25 bp, Rattus norvegicus
cgcggccattactggaaagttagtg

SEQ ID NO: 610875 - DNA, 25 bp, Rattus norvegicus
tgggtcgtaaacaacactgcgcctg

SEQ ID NO: 610876 - DNA, 25 bp, Rattus norvegicus
ctgcgcactcttgcctttacgcgaa

SEQ ID NO: 610877 - DNA, 25 bp, Rattus norvegicus
agtgaagtcacagtccctgcgggtc

SEQ ID NO: 610878 - DNA, 25 bp, Rattus norvegicus
tttccggcctgcgagcttcaagcat

SEQ ID NO: 610879 - DNA, 25 bp, Rattus norvegicus
caagcatggccaggagagtgaagtc

SEQ ID NO: 610880 - DNA, 25 bp, Rattus norvegicus
ttgcctttacgcgaactcgtcaccg

SEQ ID NO: 610881 - DNA, 25 bp, Rattus norvegicus
agtcccggtgctgcttctcagtata

SEQ ID NO: 610882 - DNA, 25 bp, Rattus norvegicus
taactctagcacgtgaccttccgcg

SEQ ID NO: 610883 - DNA, 25 bp, Rattus norvegicus
tctcctggagagaggtaactctagc

SEQ ID NO: 610884 - DNA, 25 bp, Rattus norvegicus
tgtggccacagcgacatctcctgga

SEQ ID NO: 610885 - DNA, 25 bp, Rattus norvegicus
tgcggtcgctgcatgtggccacagc

SEQ ID NO: 610886 - DNA, 25 bp, Rattus norvegicus
caactgtggcgcctgtgcggtcgct

SEQ ID NO: 610887 - DNA, 25 bp, Rattus norvegicus
gagatgcccgctggaccacactgcg

SEQ ID NO: 610888 - DNA, 25 bp, Rattus norvegicus
tctcagtatacagctttccggcctg

SEQ ID NO: 610889 - DNA, 25 bp, Rattus norvegicus
cagagcagaatgaaatgcagatgca

SEQ ID NO: 610890 - DNA, 25 bp, Rattus norvegicus
ctgccaaagccgagattttaatctt

SEQ ID NO: 610891 - DNA, 25 bp, Rattus norvegicus
tgcagatgcaaaacgtgctcgtaag

SEQ ID NO: 610892 - DNA, 25 bp, Rattus norvegicus
cccatctgccaaagccgagatttta

SEQ ID NO: 610893 - DNA, 25 bp, Rattus norvegicus
cgtgctcgtaagagtttcctctctc

SEQ ID NO: 610894 - DNA, 25 bp, Rattus norvegicus
ttgttggtcagacaagcagcgctgg

SEQ ID NO: 610895 - DNA, 25 bp, Rattus norvegicus
atctttaatccatgagcaatcagcg

SEQ ID NO: 610896 - DNA, 25 bp, Rattus norvegicus
gcgcagggaacagagcagaatgaaa

SEQ ID NO: 610897 - DNA, 25 bp, Rattus norvegicus
cttccgtgctttgcacaggcgcgga

SEQ ID NO: 610898 - DNA, 25 bp, Rattus norvegicus
ggcgttctcagcttccgtgctttgc

SEQ ID NO: 610899 - DNA, 25 bp, Rattus norvegicus
agatgttttactgtcgcgggcgttc

SEQ ID NO: 610900 - DNA, 25 bp, Rattus norvegicus
ggcgaatggcacattacagatgttt

SEQ ID NO: 610901 - DNA, 25 bp, Rattus norvegicus
gagcagcggcgaatggcacattaca

SEQ ID NO: 610902 - DNA, 25 bp, Rattus norvegicus
tccatgagcaatcagcgagcagcgg

SEQ ID NO: 610903 - DNA, 25 bp, Rattus norvegicus
cgccgtctgtcgcaggccgccccga

SEQ ID NO: 610904 - DNA, 25 bp, Rattus norvegicus
catctcgtatctgcctcctgccagg

SEQ ID NO: 610905 - DNA, 25 bp, Rattus norvegicus
aattcatctcgtatctgcctcctgc

SEQ ID NO: 610906 - DNA, 25 bp, Rattus norvegicus
gaattcatctcgtatctgcctcctg

SEQ ID NO: 610907 - DNA, 25 bp, Rattus norvegicus
aggaattcatctcgtatctgcctcc

SEQ ID NO: 610908 - DNA, 25 bp, Rattus norvegicus
agaggaattcatctcgtatctgcct

SEQ ID NO: 610909 - DNA, 25 bp, Rattus norvegicus
aagaggaattcatctcgtatctgcc

SEQ ID NO: 610910 - DNA, 25 bp, Rattus norvegicus
tattatttctgattaaagaggaatt

SEQ ID NO: 610911 - DNA, 25 bp, Rattus norvegicus
agcgtagccgcgtgtgtgtttttat

SEQ ID NO: 610912 - DNA, 25 bp, Rattus norvegicus
cgaggcgccgccattggggttaacg

SEQ ID NO: 610913 - DNA, 25 bp, Rattus norvegicus
ccacaggcggccctgagaggtggcg

SEQ ID NO: 610914 - DNA, 25 bp, Rattus norvegicus
cgtagccgcgtgtgtgtttttatta

SEQ ID NO: 610915 - DNA, 25 bp, Rattus norvegicus
cgcgagggaagctggggcgagaggc

SEQ ID NO: 610916 - DNA, 25 bp, Rattus norvegicus
cagcgtagccgcgtgtgtgttttta

SEQ ID NO: 610917 - DNA, 25 bp, Rattus norvegicus
ccggggagaccgcagacactttgcg

SEQ ID NO: 610918 - DNA, 25 bp, Rattus norvegicus
gagcgattttaattctcattcggta

SEQ ID NO: 610919 - DNA, 25 bp, Rattus norvegicus
cactttgcggagatgttactccgga

SEQ ID NO: 610920 - DNA, 25 bp, Rattus norvegicus
tactccggagttggagacgatgata

SEQ ID NO: 610921 - DNA, 25 bp, Rattus norvegicus
tgtaagccgggcgagctttgcgact

SEQ ID NO: 610922 - DNA, 25 bp, Rattus norvegicus
tcattcggtacctgcagatgccgcg

SEQ ID NO: 610923 - DNA, 25 bp, Rattus norvegicus
tattggattggcgagagcgatttta

SEQ ID NO: 610924 - DNA, 25 bp, Rattus norvegicus
ccgactcccagatagatggctgata

SEQ ID NO: 610925 - DNA, 25 bp, Rattus norvegicus
tgaatgggcccgactcccagataga

SEQ ID NO: 610926 - DNA, 25 bp, Rattus norvegicus
aatgcctcggatgatgaatgggccc

SEQ ID NO: 610927 - DNA, 25 bp, Rattus norvegicus
gtcttgttttcagggagaatgcctc

SEQ ID NO: 610928 - DNA, 25 bp, Rattus norvegicus
ttgtataaaatctgaatgggtcttg

SEQ ID NO: 610929 - DNA, 25 bp, Rattus norvegicus
agctttgcgactgcagccgccaggc

SEQ ID NO: 610930 - DNA, 25 bp, Rattus norvegicus
tccggaggctcctgaaatgactcta

SEQ ID NO: 610931 - DNA, 25 bp, Rattus norvegicus
ggccgcacgaggacacaggaagaac

SEQ ID NO: 610932 - DNA, 25 bp, Rattus norvegicus
gagatagcgcacgacacgaagcaaa

SEQ ID NO: 610933 - DNA, 25 bp, Rattus norvegicus
gcacgacacgaagcaaacaacggga

SEQ ID NO: 610934 - DNA, 25 bp, Rattus norvegicus
cgacacgaagcaaacaacgggagcg

SEQ ID NO: 610935 - DNA, 25 bp, Rattus norvegicus
tagcgcacgacacgaagcaaacaac

SEQ ID NO: 610936 - DNA, 25 bp, Rattus norvegicus
gatagcgcacgacacgaagcaaaca

SEQ ID NO: 610937 - DNA, 25 bp, Rattus norvegicus
cggagatagcgcacgacacgaagca

SEQ ID NO: 610938 - DNA, 25 bp, Rattus norvegicus
agcagcgcgatagcggagagcaacc

SEQ ID NO: 610939 - DNA, 25 bp, Rattus norvegicus
caaacgacgggagcagcgcgatagc

SEQ ID NO: 610940 - DNA, 25 bp, Rattus norvegicus
gacaaacgacgggagcagcgcgata

SEQ ID NO: 610941 - DNA, 25 bp, Rattus norvegicus
acgaggacacaggaagaacgagaga

SEQ ID NO: 610942 - DNA, 25 bp, Rattus norvegicus
ccgcacgaggacacaggaagaacga

SEQ ID NO: 610943 - DNA, 25 bp, Rattus norvegicus
gcacgaggacacaggaagaacgaga

SEQ ID NO: 610944 - DNA, 25 bp, Rattus norvegicus
gcgcacgacacgaagcaaacaacgg

SEQ ID NO: 610945 - DNA, 25 bp, Rattus norvegicus
gatcggctcgaagctgtccctccaa

SEQ ID NO: 610946 - DNA, 25 bp, Rattus norvegicus
cggtttctcaacgttctcttcctga

SEQ ID NO: 610947 - DNA, 25 bp, Rattus norvegicus
tgatttattcgcctcactcgacgga

SEQ ID NO: 610948 - DNA, 25 bp, Rattus norvegicus
ctcgacggaatcaggtgctgaaccc

SEQ ID NO: 610949 - DNA, 25 bp, Rattus norvegicus
tttaacgatgctaattacggggtgc

SEQ ID NO: 610950 - DNA, 25 bp, Rattus norvegicus
ggaactttcctgtctgagttaacta

SEQ ID NO: 610951 - DNA, 25 bp, Rattus norvegicus
ccgttgacgagaggcaattttcttc

SEQ ID NO: 610952 - DNA, 25 bp, Rattus norvegicus
cccgcagagaagatggaaaaagccc

SEQ ID NO: 610953 - DNA, 25 bp, Rattus norvegicus
tcagcgatttccttttcgtcctgga

SEQ ID NO: 610954 - DNA, 25 bp, Rattus norvegicus
ttaacatgcaaacggggaggcgatc

SEQ ID NO: 610955 - DNA, 25 bp, Rattus norvegicus
tgacccagccagtacccgcagagaa

SEQ ID NO: 610956 - DNA, 25 bp, Rattus norvegicus
ctgagtgctccgtctttttcttact

SEQ ID NO: 610957 - DNA, 25 bp, Rattus norvegicus
cgccggacagcggaaaactacagcc

SEQ ID NO: 610958 - DNA, 25 bp, Rattus norvegicus
tcgtcctggaagcagattaacatgc

SEQ ID NO: 610959 - DNA, 25 bp, Rattus norvegicus
gagccgggaagccaagacccaggcc

SEQ ID NO: 610960 - DNA, 25 bp, Rattus norvegicus
gccggcagccgctgttatctgagcc

SEQ ID NO: 610961 - DNA, 25 bp, Rattus norvegicus
gcagccgctgttatctgagccgctc

SEQ ID NO: 610962 - DNA, 25 bp, Rattus norvegicus
gccgctgttatctgagccgctccgt

SEQ ID NO: 610963 - DNA, 25 bp, Rattus norvegicus
cgctgttatctgagccgctccgtcg

SEQ ID NO: 610964 - DNA, 25 bp, Rattus norvegicus
ttatctgagccgctccgtcgcgggt

SEQ ID NO: 610965 - DNA, 25 bp, Rattus norvegicus
ctgaggagccgggaagccaagaccc

SEQ ID NO: 610966 - DNA, 25 bp, Rattus norvegicus
gaagccaagacccaggcccgggcag

SEQ ID NO: 610967 - DNA, 25 bp, Rattus norvegicus
agtgcacgatcggagcggagcgcac

SEQ ID NO: 610968 - DNA, 25 bp, Rattus norvegicus
aagacccaggcccgggcagcagcga

SEQ ID NO: 610969 - DNA, 25 bp, Rattus norvegicus
gtcttcgggtgcctctgggtagcga

SEQ ID NO: 610970 - DNA, 25 bp, Rattus norvegicus
cctggtgtgcgagccagtgcacgat

SEQ ID NO: 610971 - DNA, 25 bp, Rattus norvegicus
tgtggcggccaaggcgagaccgact

SEQ ID NO: 610972 - DNA, 25 bp, Rattus norvegicus
cctggcggccggcagccgctgttat

SEQ ID NO: 610973 - DNA, 25 bp, Rattus norvegicus
tcccgggaaactctgccctggtgct

SEQ ID NO: 610974 - DNA, 25 bp, Rattus norvegicus
ggccgtgcccacaaggcctcccttg

SEQ ID NO: 610975 - DNA, 25 bp, Rattus norvegicus
ccttcctttctcgacgtgttggccg

SEQ ID NO: 610976 - DNA, 25 bp, Rattus norvegicus
gccgagagcccttgttcacacacgg

SEQ ID NO: 610977 - DNA, 25 bp, Rattus norvegicus
gtagggccgagagcccttgttcaca

SEQ ID NO: 610978 - DNA, 25 bp, Rattus norvegicus
ctattcctcggcacggtagggccga

SEQ ID NO: 610979 - DNA, 25 bp, Rattus norvegicus
tgtctgctcgcaactcccgggaaac

SEQ ID NO: 610980 - DNA, 25 bp, Rattus norvegicus
acagtagatttggtgtctgctcgca

SEQ ID NO: 610981 - DNA, 25 bp, Rattus norvegicus
cggatggatccgagacagtagattt

SEQ ID NO: 610982 - DNA, 25 bp, Rattus norvegicus
acatccactcggctgcggcgagagg

SEQ ID NO: 610983 - DNA, 25 bp, Rattus norvegicus
tcccttgcctcgctggcgggtttcg

SEQ ID NO: 610984 - DNA, 25 bp, Rattus norvegicus
gggtttcgctctgccttaccggctc

SEQ ID NO: 610985 - DNA, 25 bp, Rattus norvegicus
tccgcctgctcctcacatccactcg

SEQ ID NO: 610986 - DNA, 25 bp, Rattus norvegicus
tcccaactattcctcggcacggtag

SEQ ID NO: 610987 - DNA, 25 bp, Rattus norvegicus
gtctgacaagtcatccatctcccgg

SEQ ID NO: 610988 - DNA, 25 bp, Rattus norvegicus
cccggaatgagaatcaggcgtgcgt

SEQ ID NO: 610989 - DNA, 25 bp, Rattus norvegicus
tgaatattcattaggctggccgctc

SEQ ID NO: 610990 - DNA, 25 bp, Rattus norvegicus
gctggccgctctttatccttatcta

SEQ ID NO: 610991 - DNA, 25 bp, Rattus norvegicus
ctaacgtttatcttctcggcgagtt

SEQ ID NO: 610992 - DNA, 25 bp, Rattus norvegicus
tcggcgagtttcgtttctcagtgta

SEQ ID NO: 610993 - DNA, 25 bp, Rattus norvegicus
ccggggattgctacttctctgccaa

SEQ ID NO: 610994 - DNA, 25 bp, Rattus norvegicus
tcacagagtggtggaatctattgcc

SEQ ID NO: 610995 - DNA, 25 bp, Rattus norvegicus
ttttagagagacacacaccgggagc

SEQ ID NO: 610996 - DNA, 25 bp, Rattus norvegicus
agtctccggccgagtcttcttgcag

SEQ ID NO: 610997 - DNA, 25 bp, Rattus norvegicus
ttggttcagagcctctcggacgacg

SEQ ID NO: 610998 - DNA, 25 bp, Rattus norvegicus
ccgccctgagctctcttggttcaga

SEQ ID NO: 610999 - DNA, 25 bp, Rattus norvegicus
cgcccgcttggacatcccggggatt

SEQ ID NO: 611000 - DNA, 25 bp, Rattus norvegicus
tcagtgtagttttaatccggggctc

SEQ ID NO: 611001 - DNA, 25 bp, Rattus norvegicus
gcgccagcggcagttgcgcattcta

SEQ ID NO: 611002 - DNA, 25 bp, Rattus norvegicus
tcataccggtaacgcgagttctccc

SEQ ID NO: 611003 - DNA, 25 bp, Rattus norvegicus
cagctgccgccttttcataccggta

SEQ ID NO: 611004 - DNA, 25 bp, Rattus norvegicus
ttcatctttaatctgcccgcagctg

SEQ ID NO: 611005 - DNA, 25 bp, Rattus norvegicus
ggagcccggtgagactgaattattc

SEQ ID NO: 611006 - DNA, 25 bp, Rattus norvegicus
agttgcgcattctaggcctgatccc

SEQ ID NO: 611007 - DNA, 25 bp, Rattus norvegicus
acttcgggccgctgcgaatctctca

SEQ ID NO: 611008 - DNA, 25 bp, Rattus norvegicus
cgaatctctcagtcggccgggaagc

SEQ ID NO: 611009 - DNA, 25 bp, Rattus norvegicus
cgggaagcctcgctctttttcggag

SEQ ID NO: 611010 - DNA, 25 bp, Rattus norvegicus
ttcggagggaatgaaacagaacgcc

SEQ ID NO: 611011 - DNA, 25 bp, Rattus norvegicus
ggttcacccaagcagccggtctctg

SEQ ID NO: 611012 - DNA, 25 bp, Rattus norvegicus
tgccgctgcctcacttgggtttttt

SEQ ID NO: 611013 - DNA, 25 bp, Rattus norvegicus
agaattgcttctttggacccgccag

SEQ ID NO: 611014 - DNA, 25 bp, Rattus norvegicus
cggggctagtgacagggaaccactt

SEQ ID NO: 611015 - DNA, 25 bp, Rattus norvegicus
aagagcgagactcttcgccgcctcg

SEQ ID NO: 611016 - DNA, 25 bp, Rattus norvegicus
agcagccaggcgtttttgcagcggc

SEQ ID NO: 611017 - DNA, 25 bp, Rattus norvegicus
accctagcagccaggcgtttttgca

SEQ ID NO: 611018 - DNA, 25 bp, Rattus norvegicus
gtaggcaagcgaaccctagcagcca

SEQ ID NO: 611019 - DNA, 25 bp, Rattus norvegicus
cgtggtaggcaagcgaaccctagca

SEQ ID NO: 611020 - DNA, 25 bp, Rattus norvegicus
cagcgtggtaggcaagcgaacccta

SEQ ID NO: 611021 - DNA, 25 bp, Rattus norvegicus
ctagccttgtgcagcgtggtaggca

SEQ ID NO: 611022 - DNA, 25 bp, Rattus norvegicus
gcagtccctaccacaccaccttcgg

SEQ ID NO: 611023 - DNA, 25 bp, Rattus norvegicus
aagtccgcaggtgcagtccctacca

SEQ ID NO: 611024 - DNA, 25 bp, Rattus norvegicus
gtcctaagtccgcaggtgcagtccc

SEQ ID NO: 611025 - DNA, 25 bp, Rattus norvegicus
gactggcaacgcagagtcctaagtc

SEQ ID NO: 611026 - DNA, 25 bp, Rattus norvegicus
cttcgactggcaacgcagagtccta

SEQ ID NO: 611027 - DNA, 25 bp, Rattus norvegicus
aactggcttcgactggcaacgcaga

SEQ ID NO: 611028 - DNA, 25 bp, Rattus norvegicus
ctcgcggtctctgagcgcagcggat

SEQ ID NO: 611029 - DNA, 25 bp, Rattus norvegicus
gcccacaggagagcgagggtctccc

SEQ ID NO: 611030 - DNA, 25 bp, Rattus norvegicus
aacagggccgccaggtctctgccat

SEQ ID NO: 611031 - DNA, 25 bp, Rattus norvegicus
tcccacgcggaacaaaaggcagctg

SEQ ID NO: 611032 - DNA, 25 bp, Rattus norvegicus
caaaaggcagctggagcctggcttc

SEQ ID NO: 611033 - DNA, 25 bp, Rattus norvegicus
gttgttccaaactgaaggctcggga

SEQ ID NO: 611034 - DNA, 25 bp, Rattus norvegicus
ggctgggaggcaaacgtcctctctc

SEQ ID NO: 611035 - DNA, 25 bp, Rattus norvegicus
ggcaaacgtcctctctcagctcaga

SEQ ID NO: 611036 - DNA, 25 bp, Rattus norvegicus
aagccggtgctctaggggagtccac

SEQ ID NO: 611037 - DNA, 25 bp, Rattus norvegicus
taggggagtccacgcactggaaaga

SEQ ID NO: 611038 - DNA, 25 bp, Rattus norvegicus
acccgagcccgtgcagcgtttgaca

SEQ ID NO: 611039 - DNA, 25 bp, Rattus norvegicus
ccagcgcgagtgcaaggctgcagcc

SEQ ID NO: 611040 - DNA, 25 bp, Rattus norvegicus
cgcactggaaagaaggtccgcgccc

SEQ ID NO: 611041 - DNA, 25 bp, Rattus norvegicus
ctgttcccggccagcgcgagtgcaa

SEQ ID NO: 611042 - DNA, 25 bp, Rattus norvegicus
tctcagctcagagcgggctcaggtg

SEQ ID NO: 611043 - DNA, 25 bp, Rattus norvegicus
gacagcccactttggacgcccggga

SEQ ID NO: 611044 - DNA, 25 bp, Rattus norvegicus
cttggagggaactgacgaccgaact

SEQ ID NO: 611045 - DNA, 25 bp, Rattus norvegicus
cgctgcctatgaccgccactagtta

SEQ ID NO: 611046 - DNA, 25 bp, Rattus norvegicus
gggaccacatcaagcttcaggcaga

SEQ ID NO: 611047 - DNA, 25 bp, Rattus norvegicus
ttcacgtcaccctatcaaggccaga

SEQ ID NO: 611048 - DNA, 25 bp, Rattus norvegicus
gcgccggacacgtttctgtgacaca

SEQ ID NO: 611049 - DNA, 25 bp, Rattus norvegicus
acaatcagcgtagcccacccgggga

SEQ ID NO: 611050 - DNA, 25 bp, Rattus norvegicus
atctcctgctgcagtggctcgactc

SEQ ID NO: 611051 - DNA, 25 bp, Rattus norvegicus
ttggctcatcccacgacaccttgtg

SEQ ID NO: 611052 - DNA, 25 bp, Rattus norvegicus
cgacaccttgtgtttggtcctaagc

SEQ ID NO: 611053 - DNA, 25 bp, Rattus norvegicus
ttggtcctaagcacgcagtcacgtc

SEQ ID NO: 611054 - DNA, 25 bp, Rattus norvegicus
ctgcggctgtgagcattgatctttc

SEQ ID NO: 611055 - DNA, 25 bp, Rattus norvegicus
acctgcgggcgcaaagaacttggag

SEQ ID NO: 611056 - DNA, 25 bp, Rattus norvegicus
agcctgccaggctgaatccgcctta

SEQ ID NO: 611057 - DNA, 25 bp, Rattus norvegicus
aggccgaggctttctattgcgctac

SEQ ID NO: 611058 - DNA, 25 bp, Rattus norvegicus
ctcagcgagctcaggccttgatgtt

SEQ ID NO: 611059 - DNA, 25 bp, Rattus norvegicus
acggctggtcttcagttcccgccat

SEQ ID NO: 611060 - DNA, 25 bp, Rattus norvegicus
acagagagtcctggggacaggtacc

SEQ ID NO: 611061 - DNA, 25 bp, Rattus norvegicus
ctgctgcagcgggaaaaagaacaga

SEQ ID NO: 611062 - DNA, 25 bp, Rattus norvegicus
ctgccatctgagacccggtagtacc

SEQ ID NO: 611063 - DNA, 25 bp, Rattus norvegicus
atgacaaggcgctgcatgcccgcta

SEQ ID NO: 611064 - DNA, 25 bp, Rattus norvegicus
ccgagtcccagcagcaagacggcaa

SEQ ID NO: 611065 - DNA, 25 bp, Rattus norvegicus
gtcacttccgaagagagaaccgcca

SEQ ID NO: 611066 - DNA, 25 bp, Rattus norvegicus
tgatggtcctcaggttccttcccgc

SEQ ID NO: 611067 - DNA, 25 bp, Rattus norvegicus
gagtgacctctacgtcagccaattg

SEQ ID NO: 611068 - DNA, 25 bp, Rattus norvegicus
ctggggagggcagttttcattctcc

SEQ ID NO: 611069 - DNA, 25 bp, Rattus norvegicus
ccttgatgttctggggcctgcaagc

SEQ ID NO: 611070 - DNA, 25 bp, Rattus norvegicus
tgagacacggcacctcaagtaaggc

SEQ ID NO: 611071 - DNA, 25 bp, Rattus norvegicus
ggcaaaaccttgtccacgtccattc

SEQ ID NO: 611072 - DNA, 25 bp, Rattus norvegicus
tcgaaggagagcttgtcctcgagcc

SEQ ID NO: 611073 - DNA, 25 bp, Rattus norvegicus
ggagccgcacatcgctgtcttcatg

SEQ ID NO: 611074 - DNA, 25 bp, Rattus norvegicus
catcgctgtcttcatgggcccggat

SEQ ID NO: 611075 - DNA, 25 bp, Rattus norvegicus
gcccggatcccagcgcaaaggtgag

SEQ ID NO: 611076 - DNA, 25 bp, Rattus norvegicus
ttccatcctccaagctaggctaggc

SEQ ID NO: 611077 - DNA, 25 bp, Rattus norvegicus
cccaatcctgcataaaaggttctaa

SEQ ID NO: 611078 - DNA, 25 bp, Rattus norvegicus
tgcataaaaggttctaaaggggcac

SEQ ID NO: 611079 - DNA, 25 bp, Rattus norvegicus
tcgtgtagggcgcaaaccggccttc

SEQ ID NO: 611080 - DNA, 25 bp, Rattus norvegicus
gatccgcgtggagaacagtgttccc

SEQ ID NO: 611081 - DNA, 25 bp, Rattus norvegicus
ccctggatctgggtcatgtctcctg

SEQ ID NO: 611082 - DNA, 25 bp, Rattus norvegicus
atctgggtcatgtctcctggcgtcc

SEQ ID NO: 611083 - DNA, 25 bp, Rattus norvegicus
ggctaggcctttttcaccgccgaga

SEQ ID NO: 611084 - DNA, 25 bp, Rattus norvegicus
cgggatcgaaggagagcttgtcctc

SEQ ID NO: 611085 - DNA, 25 bp, Rattus norvegicus
ggggattttatagtttcaagatgga

SEQ ID NO: 611086 - DNA, 25 bp, Rattus norvegicus
tctcacaaaaaatatcttccgactc

SEQ ID NO: 611087 - DNA, 25 bp, Rattus norvegicus
tccctctcggcgacacatgcctcta

SEQ ID NO: 611088 - DNA, 25 bp, Rattus norvegicus
cctggggcggcccttttctgtgcga

SEQ ID NO: 611089 - DNA, 25 bp, Rattus norvegicus
ggcggcccttttctgtgcgagctcc

SEQ ID NO: 611090 - DNA, 25 bp, Rattus norvegicus
tttcataacaaacaggccggcggaa

SEQ ID NO: 611091 - DNA, 25 bp, Rattus norvegicus
tcataacaaacaggccggcggaaga

SEQ ID NO: 611092 - DNA, 25 bp, Rattus norvegicus
tccaaaacaaaccaggaaggatgcc

SEQ ID NO: 611093 - DNA, 25 bp, Rattus norvegicus
acaccgccggcgcagcgacgagcca

SEQ ID NO: 611094 - DNA, 25 bp, Rattus norvegicus
aaggcggggacgcaattgaacgaca

SEQ ID NO: 611095 - DNA, 25 bp, Rattus norvegicus
cggggacgcaattgaacgacagttg

SEQ ID NO: 611096 - DNA, 25 bp, Rattus norvegicus
cgcaattgaacgacagttggaccca

SEQ ID NO: 611097 - DNA, 25 bp, Rattus norvegicus
caattgaacgacagttggacccaag

SEQ ID NO: 611098 - DNA, 25 bp, Rattus norvegicus
attttatagtttcaagatggaacca

SEQ ID NO: 611099 - DNA, 25 bp, Rattus norvegicus
tcgctggcaagttcgtcacacctca

SEQ ID NO: 611100 - DNA, 25 bp, Rattus norvegicus
tgtgtcacggggacccttttcagga

SEQ ID NO: 611101 - DNA, 25 bp, Rattus norvegicus
tcttcctacagtcgggacgcggatc

SEQ ID NO: 611102 - DNA, 25 bp, Rattus norvegicus
cggtttctttgatggcgtcttccta

SEQ ID NO: 611103 - DNA, 25 bp, Rattus norvegicus
acccttttcaggacacgcacttgtg

SEQ ID NO: 611104 - DNA, 25 bp, Rattus norvegicus
acgcacctggacgtgcacttgtgtc

SEQ ID NO: 611105 - DNA, 25 bp, Rattus norvegicus
cacctgcgtgcggagacgcacctgg

SEQ ID NO: 611106 - DNA, 25 bp, Rattus norvegicus
ccagggcgacttggtagcccttgca

SEQ ID NO: 611107 - DNA, 25 bp, Rattus norvegicus
cggcctgaggtgttcctgcccatcg

SEQ ID NO: 611108 - DNA, 25 bp, Rattus norvegicus
tctagactcacagcgccggcacaga

SEQ ID NO: 611109 - DNA, 25 bp, Rattus norvegicus
acagagcaagtactgcccgcagaca

SEQ ID NO: 611110 - DNA, 25 bp, Rattus norvegicus
gacccaacgcggtctcaggaccaag

SEQ ID NO: 611111 - DNA, 25 bp, Rattus norvegicus
accaagcggttccagtctagactca

SEQ ID NO: 611112 - DNA, 25 bp, Rattus norvegicus
ctaggggcgctcgtccttgtcgcct

SEQ ID NO: 611113 - DNA, 25 bp, Rattus norvegicus
tctgcaccagcgatgtgatctcctc

SEQ ID NO: 611114 - DNA, 25 bp, Rattus norvegicus
cgccctggagagttttgcttccgga

SEQ ID NO: 611115 - DNA, 25 bp, Rattus norvegicus
tagcccattatggaggacgctggtc

SEQ ID NO: 611116 - DNA, 25 bp, Rattus norvegicus
ctgcacgtagcgacctagcccatta

SEQ ID NO: 611117 - DNA, 25 bp, Rattus norvegicus
tgagtacggtgacccgaacccagtc

SEQ ID NO: 611118 - DNA, 25 bp, Rattus norvegicus
aagtccgtcacttcgcgttccacga

SEQ ID NO: 611119 - DNA, 25 bp, Rattus norvegicus
cgggcgagggttcaagtatattacg

SEQ ID NO: 611120 - DNA, 25 bp, Rattus norvegicus
cactcacggtattcggccactattc

SEQ ID NO: 611121 - DNA, 25 bp, Rattus norvegicus
acaagtagaatccagcgggcaagca

SEQ ID NO: 611122 - DNA, 25 bp, Rattus norvegicus
cgccaggtcggaagtcaaacaagta

SEQ ID NO: 611123 - DNA, 25 bp, Rattus norvegicus
gcgggcaacccacgttttggacaga

SEQ ID NO: 611124 - DNA, 25 bp, Rattus norvegicus
tgcggatcacatccaagccggactg

SEQ ID NO: 611125 - DNA, 25 bp, Rattus norvegicus
gttgacattttcctcgcgcacagcc

SEQ ID NO: 611126 - DNA, 25 bp, Rattus norvegicus
ctccaccgacttgctgttgacattt

SEQ ID NO: 611127 - DNA, 25 bp, Rattus norvegicus
gagcgcaggcgaaacttgcataaac

SEQ ID NO: 611128 - DNA, 25 bp, Rattus norvegicus
cttaaaccggattgggatgagaaag

SEQ ID NO: 611129 - DNA, 25 bp, Rattus norvegicus
aaacttgcataaacgcacctacgcg

SEQ ID NO: 611130 - DNA, 25 bp, Rattus norvegicus
ctggagcaggagtcgagccaaaaag

SEQ ID NO: 611131 - DNA, 25 bp, Rattus norvegicus
ccacactttttagagcgcaggcgaa

SEQ ID NO: 611132 - DNA, 25 bp, Rattus norvegicus
ccgagcccgctgaagaaccagagtt

SEQ ID NO: 611133 - DNA, 25 bp, Rattus norvegicus
tatcgcagtgaggaagcaggcacgc

SEQ ID NO: 611134 - DNA, 25 bp, Rattus norvegicus
caggagtcgagccaaaaagggagca

SEQ ID NO: 611135 - DNA, 25 bp, Rattus norvegicus
ggtgcaggaacttcggcctcccaca

SEQ ID NO: 611136 - DNA, 25 bp, Rattus norvegicus
cggcctcccacacatcttcactttg

SEQ ID NO: 611137 - DNA, 25 bp, Rattus norvegicus
ttggagagaactttacgcgtcttaa

SEQ ID NO: 611138 - DNA, 25 bp, Rattus norvegicus
acgcgtcttaaaccggattgggatg

SEQ ID NO: 611139 - DNA, 25 bp, Rattus norvegicus
aggggtccacactttttagagcgca

SEQ ID NO: 611140 - DNA, 25 bp, Rattus norvegicus
aaccagagttctatcgcagtgagga

SEQ ID NO: 611141 - DNA, 25 bp, Rattus norvegicus
agctgaacctcctaacacacgcagt

SEQ ID NO: 611142 - DNA, 25 bp, Rattus norvegicus
tctaggccactctgggaggaatccc

SEQ ID NO: 611143 - DNA, 25 bp, Rattus norvegicus
cactcgtgacgtgggttgcttgcgc

SEQ ID NO: 611144 - DNA, 25 bp, Rattus norvegicus
taacacacgcagtctctaggccact

SEQ ID NO: 611145 - DNA, 25 bp, Rattus norvegicus
gaggaatcccaagcgccgccgtgca

SEQ ID NO: 611146 - DNA, 25 bp, Rattus norvegicus
ccgcgctttggttctttgtgctgga

SEQ ID NO: 611147 - DNA, 25 bp, Rattus norvegicus
gttctttgtgctggaacaatgacca

SEQ ID NO: 611148 - DNA, 25 bp, Rattus norvegicus
ggaacaatgaccagctgccgccggc

SEQ ID NO: 611149 - DNA, 25 bp, Rattus norvegicus
gctccggcagggataaacgatgacc

SEQ ID NO: 611150 - DNA, 25 bp, Rattus norvegicus
gggataaacgatgacccgctcgaca

SEQ ID NO: 611151 - DNA, 25 bp, Rattus norvegicus
cgatgacccgctcgacaagtctcga

SEQ ID NO: 611152 - DNA, 25 bp, Rattus norvegicus
acgcagtctctaggccactctggga

SEQ ID NO: 611153 - DNA, 25 bp, Rattus norvegicus
gtctcgagccagctgaacctcctaa

SEQ ID NO: 611154 - DNA, 25 bp, Rattus norvegicus
tcgacaagtctcgagccagctgaac

SEQ ID NO: 611155 - DNA, 25 bp, Rattus norvegicus
aggtggaacggttgcgccaagaact

SEQ ID NO: 611156 - DNA, 25 bp, Rattus norvegicus
cacaggagctacagcggtaccgcca

SEQ ID NO: 611157 - DNA, 25 bp, Rattus norvegicus
agctggagctggaggcctgctcaca

SEQ ID NO: 611158 - DNA, 25 bp, Rattus norvegicus
cccgggctgccttgcgggtcagtga

SEQ ID NO: 611159 - DNA, 25 bp, Rattus norvegicus
tgcgccaagaactgcagcgggagca

SEQ ID NO: 611160 - DNA, 25 bp, Rattus norvegicus
tgctcacaggagctacagcggtacc

SEQ ID NO: 611161 - DNA, 25 bp, Rattus norvegicus
gctacagcggtaccgccaggaggct

SEQ ID NO: 611162 - DNA, 25 bp, Rattus norvegicus
agctccgggagaaggctaggcattt

SEQ ID NO: 611163 - DNA, 25 bp, Rattus norvegicus
ctaggcatttggatgctgaagcagc

SEQ ID NO: 611164 - DNA, 25 bp, Rattus norvegicus
tttggatgctgaagcagcaggactc

SEQ ID NO: 611165 - DNA, 25 bp, Rattus norvegicus
acccgttcctcctggcggagagtga

SEQ ID NO: 611166 - DNA, 25 bp, Rattus norvegicus
cggagagtgatgaggctaaggtgca

SEQ ID NO: 611167 - DNA, 25 bp, Rattus norvegicus
gaacggttgcgccaagaactgcagc

SEQ ID NO: 611168 - DNA, 25 bp, Rattus norvegicus
aggcagcccgagctcgggagctgga

SEQ ID NO: 611169 - DNA, 25 bp, Rattus norvegicus
ctcccaattaggacgtgagaaaccg

SEQ ID NO: 611170 - DNA, 25 bp, Rattus norvegicus
tctcacctgctgcagcgccctcgcg

SEQ ID NO: 611171 - DNA, 25 bp, Rattus norvegicus
gcggtgatgaagaggcccattagcc

SEQ ID NO: 611172 - DNA, 25 bp, Rattus norvegicus
tcctggcggtgatgaagaggcccat

SEQ ID NO: 611173 - DNA, 25 bp, Rattus norvegicus
ccattagccgcttctacctttaggg

SEQ ID NO: 611174 - DNA, 25 bp, Rattus norvegicus
cttctacctttagggcggactgagc

SEQ ID NO: 611175 - DNA, 25 bp, Rattus norvegicus
ttagggcggactgagccgctccctc

SEQ ID NO: 611176 - DNA, 25 bp, Rattus norvegicus
tccacctcccaattaggacgtgaga

SEQ ID NO: 611177 - DNA, 25 bp, Rattus norvegicus
cgtgagaaaccgtcaaccaagatta

SEQ ID NO: 611178 - DNA, 25 bp, Rattus norvegicus
tcaaccaagattaatagttgcccgg

SEQ ID NO: 611179 - DNA, 25 bp, Rattus norvegicus
gatgagcccagactccgggccgctg

SEQ ID NO: 611180 - DNA, 25 bp, Rattus norvegicus
ggccgctgctgcttgctctgttcgg

SEQ ID NO: 611181 - DNA, 25 bp, Rattus norvegicus
tgcttgctctgttcggggccaagcc

SEQ ID NO: 611182 - DNA, 25 bp, Rattus norvegicus
tcgcgctccgccagggacctgttcc

SEQ ID NO: 611183 - DNA, 25 bp, Rattus norvegicus
ctcgaccgcagtcttctgctgaatc

SEQ ID NO: 611184 - DNA, 25 bp, Rattus norvegicus
gaatccttcaggtgcggttcgcaga

SEQ ID NO: 611185 - DNA, 25 bp, Rattus norvegicus
gccatggccttctcccaggtgcagt

SEQ ID NO: 611186 - DNA, 25 bp, Rattus norvegicus
tctggacgacaaccacgtgaactgg

SEQ ID NO: 611187 - DNA, 25 bp, Rattus norvegicus
tccagcgagtcgaagcccgagttct

SEQ ID NO: 611188 - DNA, 25 bp, Rattus norvegicus
ccgagttcttctacagcgaggagca

SEQ ID NO: 611189 - DNA, 25 bp, Rattus norvegicus
gcgacgccttctacgaggtgctgaa

SEQ ID NO: 611190 - DNA, 25 bp, Rattus norvegicus
tcacttctgactagggcgaggttcc

SEQ ID NO: 611191 - DNA, 25 bp, Rattus norvegicus
gctttcgcgtattgtggaggccatc

SEQ ID NO: 611192 - DNA, 25 bp, Rattus norvegicus
gcaagtccctcctccgggtttgcga

SEQ ID NO: 611193 - DNA, 25 bp, Rattus norvegicus
ccatcgaggtgtacgatccgggctc

SEQ ID NO: 611194 - DNA, 25 bp, Rattus norvegicus
ggcctgacaccattgcctaccgagg

SEQ ID NO: 611195 - DNA, 25 bp, Rattus norvegicus
agcgtctacatgcagccacccattg

SEQ ID NO: 611196 - DNA, 25 bp, Rattus norvegicus
cgcgactttctttcggagctggagc

SEQ ID NO: 611197 - DNA, 25 bp, Rattus norvegicus
ccctctagcaggagcagcgtctctg

SEQ ID NO: 611198 - DNA, 25 bp, Rattus norvegicus
tgctcctttgaggatggctcggtca

SEQ ID NO: 611199 - DNA, 25 bp, Rattus norvegicus
atggctcggtcaaagtcagaactgc

SEQ ID NO: 611200 - DNA, 25 bp, Rattus norvegicus
tcagaactgcatgacgaccgtagta

SEQ ID NO: 611201 - DNA, 25 bp, Rattus norvegicus
gaccgtagtatagcccgtcgcagtg

SEQ ID NO: 611202 - DNA, 25 bp, Rattus norvegicus
gggcgcacgcgcagtcagaacttat

SEQ ID NO: 611203 - DNA, 25 bp, Rattus norvegicus
tctctgctgactgaatgctcctttg

SEQ ID NO: 611204 - DNA, 25 bp, Rattus norvegicus
gtcagaacttatggcgcctcctggg

SEQ ID NO: 611205 - DNA, 25 bp, Rattus norvegicus
tctgtgtacagctctcgtccaagtc

SEQ ID NO: 611206 - DNA, 25 bp, Rattus norvegicus
cggagtttgggattgtctgtgtaca

SEQ ID NO: 611207 - DNA, 25 bp, Rattus norvegicus
cttttggacgtctagctcgccgttc

SEQ ID NO: 611208 - DNA, 25 bp, Rattus norvegicus
tcgcgtgaaattcgcttcctgtctc

SEQ ID NO: 611209 - DNA, 25 bp, Rattus norvegicus
gacagtcccgaaacctcgcgtgaaa

SEQ ID NO: 611210 - DNA, 25 bp, Rattus norvegicus
cgccgttctgattctcgcgacagtc

SEQ ID NO: 611211 - DNA, 25 bp, Rattus norvegicus
ggccggacgctaacctcactgtggt

SEQ ID NO: 611212 - DNA, 25 bp, Rattus norvegicus
atgcgccaacctggagggccagctc

SEQ ID NO: 611213 - DNA, 25 bp, Rattus norvegicus
acgctaacctcactgtggtgcatcc

SEQ ID NO: 611214 - DNA, 25 bp, Rattus norvegicus
tctgccgactgcaggaggtcgcccg

SEQ ID NO: 611215 - DNA, 25 bp, Rattus norvegicus
tacgcacaggtctgccgactgcagg

SEQ ID NO: 611216 - DNA, 25 bp, Rattus norvegicus
tctgtggttccgacggccgtaccta

SEQ ID NO: 611217 - DNA, 25 bp, Rattus norvegicus
agcagctcgaatgcaggctggacgc

SEQ ID NO: 611218 - DNA, 25 bp, Rattus norvegicus
cgctgcggcgagcagctcgaatgca

SEQ ID NO: 611219 - DNA, 25 bp, Rattus norvegicus
agggccagctctgcgatctggaccc

SEQ ID NO: 611220 - DNA, 25 bp, Rattus norvegicus
gctgctgctgggaatgcgccaacct

SEQ ID NO: 611221 - DNA, 25 bp, Rattus norvegicus
cgagggttgtgctccctgccggcca

SEQ ID NO: 611222 - DNA, 25 bp, Rattus norvegicus
acggccgtacctacgcacaggtctg

SEQ ID NO: 611223 - DNA, 25 bp, Rattus norvegicus
cgctaacttctacgggcgctgcggc

SEQ ID NO: 611224 - DNA, 25 bp, Rattus norvegicus
agcgcccgctctgtggttccgacgg

SEQ ID NO: 611225 - DNA, 25 bp, Rattus norvegicus
tgcctaggattattcaccgcaaata

SEQ ID NO: 611226 - DNA, 25 bp, Rattus norvegicus
caaacccgaatctgtcgcgtctgga

SEQ ID NO: 611227 - DNA, 25 bp, Rattus norvegicus
atctgtcgcgtctggagactctgta

SEQ ID NO: 611228 - DNA, 25 bp, Rattus norvegicus
agactctgtagggagtaacctcctc

SEQ ID NO: 611229 - DNA, 25 bp, Rattus norvegicus
cctctgcagccatgacggtttgggc

SEQ ID NO: 611230 - DNA, 25 bp, Rattus norvegicus
agtggaaggacgctctgccgcccac

SEQ ID NO: 611231 - DNA, 25 bp, Rattus norvegicus
cagcggacggggtttaataatgtcg

SEQ ID NO: 611232 - DNA, 25 bp, Rattus norvegicus
ataatgtcgccggaaagtgacacgc

SEQ ID NO: 611233 - DNA, 25 bp, Rattus norvegicus
agtgacacgcgatttattattaaag

SEQ ID NO: 611234 - DNA, 25 bp, Rattus norvegicus
aataaacgcgctgagatgcctagga

SEQ ID NO: 611235 - DNA, 25 bp, Rattus norvegicus
ccggaaagtgacacgcgatttatta

SEQ ID NO: 611236 - DNA, 25 bp, Rattus norvegicus
ttcaccgcaaataaatgagagcgcg

SEQ ID NO: 611237 - DNA, 25 bp, Rattus norvegicus
tgtgcggcgggcactctcggctcct

SEQ ID NO: 611238 - DNA, 25 bp, Rattus norvegicus
aggtttaataaacgcgctgagatgc

SEQ ID NO: 611239 - DNA, 25 bp, Rattus norvegicus
cttcctcgtaactctgggcccgcgg

SEQ ID NO: 611240 - DNA, 25 bp, Rattus norvegicus
ggccgccgcttcctcgtaactctgg

SEQ ID NO: 611241 - DNA, 25 bp, Rattus norvegicus
ttcaattagttaggcggccgccgct

SEQ ID NO: 611242 - DNA, 25 bp, Rattus norvegicus
aattcaattagttaggcggccgccg

SEQ ID NO: 611243 - DNA, 25 bp, Rattus norvegicus
gggctaggccgacctaattcaatta

SEQ ID NO: 611244 - DNA, 25 bp, Rattus norvegicus
ctcggtaccctatgagcgcctgcgg

SEQ ID NO: 611245 - DNA, 25 bp, Rattus norvegicus
gctaggccgacctaattcaattagt

SEQ ID NO: 611246 - DNA, 25 bp, Rattus norvegicus
gggtccctcggtaccctatgagcgc

SEQ ID NO: 611247 - DNA, 25 bp, Rattus norvegicus
atgggtccctcggtaccctatgagc

SEQ ID NO: 611248 - DNA, 25 bp, Rattus norvegicus
tcaatgggtccctcggtaccctatg

SEQ ID NO: 611249 - DNA, 25 bp, Rattus norvegicus
tcttccctcaatgggtccctcggta

SEQ ID NO: 611250 - DNA, 25 bp, Rattus norvegicus
cggtaccctatgagcgcctgcggcg

SEQ ID NO: 611251 - DNA, 25 bp, Rattus norvegicus
ggctcaggcggcagagccttcttcc

SEQ ID NO: 611252 - DNA, 25 bp, Rattus norvegicus
gtggcagggctaggccgacctaatt

SEQ ID NO: 611253 - DNA, 25 bp, Rattus norvegicus
gtcggaggcgcctacacttatggcg

SEQ ID NO: 611254 - DNA, 25 bp, Rattus norvegicus
aaacagctaggctcgctcgctcagg

SEQ ID NO: 611255 - DNA, 25 bp, Rattus norvegicus
ccgcagatacacaaaggacaggttc

SEQ ID NO: 611256 - DNA, 25 bp, Rattus norvegicus
ttttcgcccggtgattgatgtccca

SEQ ID NO: 611257 - DNA, 25 bp, Rattus norvegicus
tgatgtcccagagtcaacagcgagc

SEQ ID NO: 611258 - DNA, 25 bp, Rattus norvegicus
acaggttcacaggtgagtccggccc

SEQ ID NO: 611259 - DNA, 25 bp, Rattus norvegicus
ggggaagaatacagctctccctctc

SEQ ID NO: 611260 - DNA, 25 bp, Rattus norvegicus
ttctgcgcacttcgccttcaagtct

SEQ ID NO: 611261 - DNA, 25 bp, Rattus norvegicus
atacggccttggctgtttggtcgga

SEQ ID NO: 611262 - DNA, 25 bp, Rattus norvegicus
cctggatggagagtaaccgcagata

SEQ ID NO: 611263 - DNA, 25 bp, Rattus norvegicus
ccaatggagagacccggccgaaaca

SEQ ID NO: 611264 - DNA, 25 bp, Rattus norvegicus
tgccgggtgtcaacaacctcaccgg

SEQ ID NO: 611265 - DNA, 25 bp, Rattus norvegicus
ggccggctcctacaacgtgaacatg

SEQ ID NO: 611266 - DNA, 25 bp, Rattus norvegicus
ctccaggacggagaatacggccttg

SEQ ID NO: 611267 - DNA, 25 bp, Rattus norvegicus
agtttccagtactcgggcggccagg

SEQ ID NO: 611268 - DNA, 25 bp, Rattus norvegicus
tccagtttccagtactcgggcggcc

SEQ ID NO: 611269 - DNA, 25 bp, Rattus norvegicus
caatggcggacggaggggagctaga

SEQ ID NO: 611270 - DNA, 25 bp, Rattus norvegicus
cacagcgacgctgttgggcgcttgc

SEQ ID NO: 611271 - DNA, 25 bp, Rattus norvegicus
ccacagcgacgctgttgggcgcttg

SEQ ID NO: 611272 - DNA, 25 bp, Rattus norvegicus
caggccggccggctcctgagttcgt

SEQ ID NO: 611273 - DNA, 25 bp, Rattus norvegicus
ggcttcccacacaggccggccggct

SEQ ID NO: 611274 - DNA, 25 bp, Rattus norvegicus
aggactggccctggcttcccacaca

SEQ ID NO: 611275 - DNA, 25 bp, Rattus norvegicus
ggcttcccacacaggactggccctg

SEQ ID NO: 611276 - DNA, 25 bp, Rattus norvegicus
gggcgcttcaccctggctgggctct

SEQ ID NO: 611277 - DNA, 25 bp, Rattus norvegicus
gcgcttcaccctggctgggctctgg

SEQ ID NO: 611278 - DNA, 25 bp, Rattus norvegicus
gggactggccctggcttcccacaca

SEQ ID NO: 611279 - DNA, 25 bp, Rattus norvegicus
cccgcgcggcgcgagtatgggactg

SEQ ID NO: 611280 - DNA, 25 bp, Rattus norvegicus
gccggccggctcctgagttcgttcg

SEQ ID NO: 611281 - DNA, 25 bp, Rattus norvegicus
tccttgctggactgcgccgccaaga

SEQ ID NO: 611282 - DNA, 25 bp, Rattus norvegicus
agtccttgctggactgcgccgccaa

SEQ ID NO: 611283 - DNA, 25 bp, Rattus norvegicus
agccggagtccttgctggactgcgc

SEQ ID NO: 611284 - DNA, 25 bp, Rattus norvegicus
tgcagccggagtccttgctggactg

SEQ ID NO: 611285 - DNA, 25 bp, Rattus norvegicus
gaggctgtgctcttggcccagcccg

SEQ ID NO: 611286 - DNA, 25 bp, Rattus norvegicus
caagaggctgtgctcttggcccagc

SEQ ID NO: 611287 - DNA, 25 bp, Rattus norvegicus
atctctccggccaagaggctgtgct

SEQ ID NO: 611288 - DNA, 25 bp, Rattus norvegicus
aggagcgtttcgagcggatcccaga

SEQ ID NO: 611289 - DNA, 25 bp, Rattus norvegicus
tcagtcagtccccagcaatggcgga

SEQ ID NO: 611290 - DNA, 25 bp, Rattus norvegicus
gcgtttcgagcggatcccagagccg

SEQ ID NO: 611291 - DNA, 25 bp, Rattus norvegicus
tcgagcggatcccagagccggtgca

SEQ ID NO: 611292 - DNA, 25 bp, Rattus norvegicus
cgtctactggtccttcccgcggaat

SEQ ID NO: 611293 - DNA, 25 bp, Rattus norvegicus
ctactggtccttcccgcggaatgag

SEQ ID NO: 611294 - DNA, 25 bp, Rattus norvegicus
gatctctccggccaagaggctgtgc

SEQ ID NO: 611295 - DNA, 25 bp, Rattus norvegicus
cgtctgtctgtctcccgctccagtg

SEQ ID NO: 611296 - DNA, 25 bp, Rattus norvegicus
tgtcgggcctgggacgcctcctgac

SEQ ID NO: 611297 - DNA, 25 bp, Rattus norvegicus
gcctctgccgtctgtctgtctcccg

SEQ ID NO: 611298 - DNA, 25 bp, Rattus norvegicus
gctccagtggccctctcacccttca

SEQ ID NO: 611299 - DNA, 25 bp, Rattus norvegicus
acccttcactgtaacacgccgtata

SEQ ID NO: 611300 - DNA, 25 bp, Rattus norvegicus
ttcactgtaacacgccgtataggtc

SEQ ID NO: 611301 - DNA, 25 bp, Rattus norvegicus
ctgtaacacgccgtataggtcaccc

SEQ ID NO: 611302 - DNA, 25 bp, Rattus norvegicus
tatcagaaccggacgccccctaaga

SEQ ID NO: 611303 - DNA, 25 bp, Rattus norvegicus
ccctaagaagaagaagccgcgtaca

SEQ ID NO: 611304 - DNA, 25 bp, Rattus norvegicus
agaagccgcgtacatccttcacacg

SEQ ID NO: 611305 - DNA, 25 bp, Rattus norvegicus
gtacatccttcacacgcctgcagat

SEQ ID NO: 611306 - DNA, 25 bp, Rattus norvegicus
tccttcacacgcctgcagatctgtg

SEQ ID NO: 611307 - DNA, 25 bp, Rattus norvegicus
cttcacacgcctgcagatctgtgag

SEQ ID NO: 611308 - DNA, 25 bp, Rattus norvegicus
cctcctgacgctctgccgcttgcct

SEQ ID NO: 611309 - DNA, 25 bp, Rattus norvegicus
tgtcgtctaccgacgacagcgctca

SEQ ID NO: 611310 - DNA, 25 bp, Rattus norvegicus
ggaaaaatcaatctgcgccggctgt

SEQ ID NO: 611311 - DNA, 25 bp, Rattus norvegicus
gaaaaatcaatctgcgccggctgtg

SEQ ID NO: 611312 - DNA, 25 bp, Rattus norvegicus
aaaaatcaatctgcgccggctgtgg

SEQ ID NO: 611313 - DNA, 25 bp, Rattus norvegicus
aatcaatctgcgccggctgtggcgg

SEQ ID NO: 611314 - DNA, 25 bp, Rattus norvegicus
ctgtggcggggattctccggtccca

SEQ ID NO: 611315 - DNA, 25 bp, Rattus norvegicus
ggcggggattctccggtcccactga

SEQ ID NO: 611316 - DNA, 25 bp, Rattus norvegicus
atccattaggagcagatgggtgtgc

SEQ ID NO: 611317 - DNA, 25 bp, Rattus norvegicus
agcagatgggtgtgcggaggaagaa

SEQ ID NO: 611318 - DNA, 25 bp, Rattus norvegicus
gcggaggaagaaagagacatttccc

SEQ ID NO: 611319 - DNA, 25 bp, Rattus norvegicus
gagacatttcccttctgtcgtctac

SEQ ID NO: 611320 - DNA, 25 bp, Rattus norvegicus
acatttcccttctgtcgtctaccga

SEQ ID NO: 611321 - DNA, 25 bp, Rattus norvegicus
tttcccttctgtcgtctaccgacga

SEQ ID NO: 611322 - DNA, 25 bp, Rattus norvegicus
tctaccgacgacagcgctcaccacg

SEQ ID NO: 611323 - DNA, 25 bp, Rattus norvegicus
taatagcttgtttccaacgcaggcg

SEQ ID NO: 611324 - DNA, 25 bp, Rattus norvegicus
tcactagcgtcacgtccgtggcttc

SEQ ID NO: 611325 - DNA, 25 bp, Rattus norvegicus
gacgactccaccaaaatcactagcg

SEQ ID NO: 611326 - DNA, 25 bp, Rattus norvegicus
gccgtggtctgacgactccaccaaa

SEQ ID NO: 611327 - DNA, 25 bp, Rattus norvegicus
accaaaatcactagcgtcacgtccg

SEQ ID NO: 611328 - DNA, 25 bp, Rattus norvegicus
gcagaacctgcagccgtggtctgac

SEQ ID NO: 611329 - DNA, 25 bp, Rattus norvegicus
gacccactgtgcgtgcacaactcgt

SEQ ID NO: 611330 - DNA, 25 bp, Rattus norvegicus
tgcctgcagacccactgtgcgtgca

SEQ ID NO: 611331 - DNA, 25 bp, Rattus norvegicus
gcatcctcttgcagctgcagcagga

SEQ ID NO: 611332 - DNA, 25 bp, Rattus norvegicus
ggcgaaccgcatcctcttgcagctg

SEQ ID NO: 611333 - DNA, 25 bp, Rattus norvegicus
gtttccaacgcaggcgacagacagc

SEQ ID NO: 611334 - DNA, 25 bp, Rattus norvegicus
tagcgtcttggctagtaatagcttg

SEQ ID NO: 611335 - DNA, 25 bp, Rattus norvegicus
aagagggttagcgtcttggctagta

SEQ ID NO: 611336 - DNA, 25 bp, Rattus norvegicus
ccgagaggcagcaggcgaaccgcat

SEQ ID NO: 611337 - DNA, 25 bp, Rattus norvegicus
gctctgccctgaaagtccctcaatg

SEQ ID NO: 611338 - DNA, 25 bp, Rattus norvegicus
gccacgcgtgcaactctgccgaata

SEQ ID NO: 611339 - DNA, 25 bp, Rattus norvegicus
ttcacctactacaggaaagcccatc

SEQ ID NO: 611340 - DNA, 25 bp, Rattus norvegicus
atcgtccttcggttcaggatggggt

SEQ ID NO: 611341 - DNA, 25 bp, Rattus norvegicus
caacccatcgtccttcggttcagga

SEQ ID NO: 611342 - DNA, 25 bp, Rattus norvegicus
aatgctcttctgtctccttgtccac

SEQ ID NO: 611343 - DNA, 25 bp, Rattus norvegicus
gaaagtccctcaatgctcttctgtc

SEQ ID NO: 611344 - DNA, 25 bp, Rattus norvegicus
tgccctgaaagtccctcaatgctct

SEQ ID NO: 611345 - DNA, 25 bp, Rattus norvegicus
cttctggcttcaggccatcagctct

SEQ ID NO: 611346 - DNA, 25 bp, Rattus norvegicus
ggccatcagctctgccctgaaagtc

SEQ ID NO: 611347 - DNA, 25 bp, Rattus norvegicus
tgttctccttcacctactacaggaa

SEQ ID NO: 611348 - DNA, 25 bp, Rattus norvegicus
cggtcttcttttctgttctccttca

SEQ ID NO: 611349 - DNA, 25 bp, Rattus norvegicus
cccttagctccggtcttcttttctg

SEQ ID NO: 611350 - DNA, 25 bp, Rattus norvegicus
agctccggtcttcttttctgttctc

SEQ ID NO: 611351 - DNA, 25 bp, Rattus norvegicus
tggcgactccaagcgcgagaaagtc

SEQ ID NO: 611352 - DNA, 25 bp, Rattus norvegicus
ctcggctgccgaaggaaaagagctc

SEQ ID NO: 611353 - DNA, 25 bp, Rattus norvegicus
agagctcagagctccgcacagcgtc

SEQ ID NO: 611354 - DNA, 25 bp, Rattus norvegicus
tcagagctccgcacagcgtcttaca

SEQ ID NO: 611355 - DNA, 25 bp, Rattus norvegicus
ccgcacagcgtcttacagcaaaatg

SEQ ID NO: 611356 - DNA, 25 bp, Rattus norvegicus
cacagcgtcttacagcaaaatggcg

SEQ ID NO: 611357 - DNA, 25 bp, Rattus norvegicus
tggcccacttgggtgggcgtggtca

SEQ ID NO: 611358 - DNA, 25 bp, Rattus norvegicus
agcaaaatggcgactccaagcgcga

SEQ ID NO: 611359 - DNA, 25 bp, Rattus norvegicus
actccaagcgcgagaaagtcgtgcg

SEQ ID NO: 611360 - DNA, 25 bp, Rattus norvegicus
ccaagcgcgagaaagtcgtgcgaga

SEQ ID NO: 611361 - DNA, 25 bp, Rattus norvegicus
aactgactggagtgggcgaggccat

SEQ ID NO: 611362 - DNA, 25 bp, Rattus norvegicus
atggaaagcggtgcatttgatgctg

SEQ ID NO: 611363 - DNA, 25 bp, Rattus norvegicus
tgcatttgatgctgtgggcgtggcc

SEQ ID NO: 611364 - DNA, 25 bp, Rattus norvegicus
gtcttacagcaaaatggcgactcca

SEQ ID NO: 611365 - DNA, 25 bp, Rattus norvegicus
gaacaggagccagggtccgagcaca

SEQ ID NO: 611366 - DNA, 25 bp, Rattus norvegicus
ctcaaagcccgcgacatggagtagc

SEQ ID NO: 611367 - DNA, 25 bp, Rattus norvegicus
cgacatggagtagcgcgggctttta

SEQ ID NO: 611368 - DNA, 25 bp, Rattus norvegicus
gggctggagcgactttgaaacccta

SEQ ID NO: 611369 - DNA, 25 bp, Rattus norvegicus
ttgaaaccctagaggaacaggagcc

SEQ ID NO: 611370 - DNA, 25 bp, Rattus norvegicus
tttcacaggcgaggtgaaagcggac

SEQ ID NO: 611371 - DNA, 25 bp, Rattus norvegicus
ccaaaggctttcacaggcgaggtga

SEQ ID NO: 611372 - DNA, 25 bp, Rattus norvegicus
ccagggtccgagcacactgcttaca

SEQ ID NO: 611373 - DNA, 25 bp, Rattus norvegicus
cgagcacactgcttacagaaataga

SEQ ID NO: 611374 - DNA, 25 bp, Rattus norvegicus
ttacagaaatagaaggacaatcagc

SEQ ID NO: 611375 - DNA, 25 bp, Rattus norvegicus
ggacaatcagcgtacatcaaggacc

SEQ ID NO: 611376 - DNA, 25 bp, Rattus norvegicus
agcgtacatcaaggaccgggaagca

SEQ ID NO: 611377 - DNA, 25 bp, Rattus norvegicus
ggaagcagccttcgcttaccaaagg

SEQ ID NO: 611378 - DNA, 25 bp, Rattus norvegicus
ttcgcttaccaaaggctttcacagg

SEQ ID NO: 611379 - DNA, 25 bp, Rattus norvegicus
gcacccaaagccttctttccaggaa

SEQ ID NO: 611380 - DNA, 25 bp, Rattus norvegicus
agccttctttccaggaaatttcaca

SEQ ID NO: 611381 - DNA, 25 bp, Rattus norvegicus
tttatcgggagcagatttacgtttc

SEQ ID NO: 611382 - DNA, 25 bp, Rattus norvegicus
gcagatttacgtttctgggtttcca

SEQ ID NO: 611383 - DNA, 25 bp, Rattus norvegicus
ctgggtttccagtctcggggcgtct

SEQ ID NO: 611384 - DNA, 25 bp, Rattus norvegicus
cgtctgggtaggctattaagagtaa

SEQ ID NO: 611385 - DNA, 25 bp, Rattus norvegicus
gagtgcctccctccaaagccgaatg

SEQ ID NO: 611386 - DNA, 25 bp, Rattus norvegicus
ggagccctgacttcagactcggctt

SEQ ID NO: 611387 - DNA, 25 bp, Rattus norvegicus
gtaattagcatcttttgcgcatgca

SEQ ID NO: 611388 - DNA, 25 bp, Rattus norvegicus
tgcgcatgcagatttacttcgctca

SEQ ID NO: 611389 - DNA, 25 bp, Rattus norvegicus
gcagatttacttcgctcattgccac

SEQ ID NO: 611390 - DNA, 25 bp, Rattus norvegicus
taaaagccggcgcaggcaaacacag

SEQ ID NO: 611391 - DNA, 25 bp, Rattus norvegicus
cataactcatccctaaaagccggcg

SEQ ID NO: 611392 - DNA, 25 bp, Rattus norvegicus
gcaaacacaggctctgccgccagag

SEQ ID NO: 611393 - DNA, 25 bp, Rattus norvegicus
ggctattgtcgcctgtcagcggccg

SEQ ID NO: 611394 - DNA, 25 bp, Rattus norvegicus
aaaccatatggtcgccagcgctggc

SEQ ID NO: 611395 - DNA, 25 bp, Rattus norvegicus
tgggcccggctattgtcgcctgtca

SEQ ID NO: 611396 - DNA, 25 bp, Rattus norvegicus
ttcaaaaaccatatggtcgccagcg

SEQ ID NO: 611397 - DNA, 25 bp, Rattus norvegicus
gtctacaaattgtgaagaaaattca

SEQ ID NO: 611398 - DNA, 25 bp, Rattus norvegicus
tccatcaaattgtctacaaattgtg

SEQ ID NO: 611399 - DNA, 25 bp, Rattus norvegicus
cgcgcgcggggacctaatccatcaa

SEQ ID NO: 611400 - DNA, 25 bp, Rattus norvegicus
gggcccattcgtcccggccttcatg

SEQ ID NO: 611401 - DNA, 25 bp, Rattus norvegicus
ggccttcatggtccgcgctccgaat

SEQ ID NO: 611402 - DNA, 25 bp, Rattus norvegicus
atggtccgcgctccgaattacagac

SEQ ID NO: 611403 - DNA, 25 bp, Rattus norvegicus
tacagacccatccatcctaagagag

SEQ ID NO: 611404 - DNA, 25 bp, Rattus norvegicus
ccatcctaagagagggcgatttatg

SEQ ID NO: 611405 - DNA, 25 bp, Rattus norvegicus
gcgatttatgtcgcccgggaggaac

SEQ ID NO: 611406 - DNA, 25 bp, Rattus norvegicus
ctaagagagggcgatttatgtcgcc

SEQ ID NO: 611407 - DNA, 25 bp, Rattus norvegicus
ccggcccggatttattgcttcgaga

SEQ ID NO: 611408 - DNA, 25 bp, Rattus norvegicus
gggcccagtttcttggcagactcca

SEQ ID NO: 611409 - DNA, 25 bp, Rattus norvegicus
gcgtctgcctctgcccaaagatggt

SEQ ID NO: 611410 - DNA, 25 bp, Rattus norvegicus
agttccgccagtgccacgatgtcca

SEQ ID NO: 611411 - DNA, 25 bp, Rattus norvegicus
tgcgcaatttggtcgcggtctgcag

SEQ ID NO: 611412 - DNA, 25 bp, Rattus norvegicus
tcccatcgcggcctggaaagaaatg

SEQ ID NO: 611413 - DNA, 25 bp, Rattus norvegicus
gcaggggacaggtacttctggtata

SEQ ID NO: 611414 - DNA, 25 bp, Rattus norvegicus
gcgtttctccaattcgtatatctga

SEQ ID NO: 611415 - DNA, 25 bp, Rattus norvegicus
ggagaacccggcctagacttggctc

SEQ ID NO: 611416 - DNA, 25 bp, Rattus norvegicus
gaaatgacagtgtacgctcgcgacg

SEQ ID NO: 611417 - DNA, 25 bp, Rattus norvegicus
cgtgcgtgattttcgccgtttcttg

SEQ ID NO: 611418 - DNA, 25 bp, Rattus norvegicus
tccgagttctgctcgagttccgcca

SEQ ID NO: 611419 - DNA, 25 bp, Rattus norvegicus
tcatcctctgagcagtcctggctgc

SEQ ID NO: 611420 - DNA, 25 bp, Rattus norvegicus
agggtgcagctcaatcgtccacgtc

SEQ ID NO: 611421 - DNA, 25 bp, Rattus norvegicus
cacggacggcttgttgaggatgtcc

SEQ ID NO: 611422 - DNA, 25 bp, Rattus norvegicus
taggcttgtgcctaccttcggctgc

SEQ ID NO: 611423 - DNA, 25 bp, Rattus norvegicus
gctggggaatctaggcttgtgccta

SEQ ID NO: 611424 - DNA, 25 bp, Rattus norvegicus
ccttaaaggtcttgctggcgagctc

SEQ ID NO: 611425 - DNA, 25 bp, Rattus norvegicus
atttaaaggtgtcaggtggctccgc

SEQ ID NO: 611426 - DNA, 25 bp, Rattus norvegicus
agcgagtaacttctccgcacggacg

SEQ ID NO: 611427 - DNA, 25 bp, Rattus norvegicus
ccagcccgggtgctatttaaaggtg

SEQ ID NO: 611428 - DNA, 25 bp, Rattus norvegicus
gaggatgtcctcgatgctgaacggc

SEQ ID NO: 611429 - DNA, 25 bp, Rattus norvegicus
tgctgaacggcgtcagcggcttgtt

SEQ ID NO: 611430 - DNA, 25 bp, Rattus norvegicus
gccttgccgtcctccttggaagtca

SEQ ID NO: 611431 - DNA, 25 bp, Rattus norvegicus
ttggaagtcatctcggcctcgtttg

SEQ ID NO: 611432 - DNA, 25 bp, Rattus norvegicus
caacgggccgattagagcggcgacc

SEQ ID NO: 611433 - DNA, 25 bp, Rattus norvegicus
cttcggctgcctgcaggacgctgac

SEQ ID NO: 611434 - DNA, 25 bp, Rattus norvegicus
tggcgagctcctccaaggcgcacag

SEQ ID NO: 611435 - DNA, 25 bp, Rattus norvegicus
aattctcgcctttcctgttcagcta

SEQ ID NO: 611436 - DNA, 25 bp, Rattus norvegicus
ttgagtcgaggctggaaatcattca

SEQ ID NO: 611437 - DNA, 25 bp, Rattus norvegicus
gctcggggaccgctctaaattctcc

SEQ ID NO: 611438 - DNA, 25 bp, Rattus norvegicus
aaggctgtttctgggagcccagctc

SEQ ID NO: 611439 - DNA, 25 bp, Rattus norvegicus
aaataaacgtgtaaggctgtttctg

SEQ ID NO: 611440 - DNA, 25 bp, Rattus norvegicus
gtcctcagcgggctgtaccgaagtc

SEQ ID NO: 611441 - DNA, 25 bp, Rattus norvegicus
ctcctcttattgagtcgaggctgga

SEQ ID NO: 611442 - DNA, 25 bp, Rattus norvegicus
gtaccgaagtctcgccctcacgaag

SEQ ID NO: 611443 - DNA, 25 bp, Rattus norvegicus
gaaatcattcagctcggcggcgcgc

SEQ ID NO: 611444 - DNA, 25 bp, Rattus norvegicus
ggcgcctgtcctataaatccacata

SEQ ID NO: 611445 - DNA, 25 bp, Rattus norvegicus
gggtacgtcctagcaagcgcgcgca

SEQ ID NO: 611446 - DNA, 25 bp, Rattus norvegicus
tgtaattaaagcgatctgcaagggg

SEQ ID NO: 611447 - DNA, 25 bp, Rattus norvegicus
cgccctcacgaaggacaggaacaaa

SEQ ID NO: 611448 - DNA, 25 bp, Rattus norvegicus
cctgttcagctaaggaaaataaacg

SEQ ID NO: 611449 - DNA, 25 bp, Rattus norvegicus
ccgctcggtgcccacatctcccgga

SEQ ID NO: 611450 - DNA, 25 bp, Rattus norvegicus
cctaggtggggtgggacctatcact

SEQ ID NO: 611451 - DNA, 25 bp, Rattus norvegicus
tttgcgacgccccaggtcacagcgg

SEQ ID NO: 611452 - DNA, 25 bp, Rattus norvegicus
agtgctgctcgtagtcgcgcgccca

SEQ ID NO: 611453 - DNA, 25 bp, Rattus norvegicus
cgccagtgctgctcgtagtcgcgcg

SEQ ID NO: 611454 - DNA, 25 bp, Rattus norvegicus
actcgcgcttgctgcgtggcgcgca

SEQ ID NO: 611455 - DNA, 25 bp, Rattus norvegicus
ttgcttcttaccagctgctcccgta

SEQ ID NO: 611456 - DNA, 25 bp, Rattus norvegicus
attccacacaactgcgcccggatcg

SEQ ID NO: 611457 - DNA, 25 bp, Rattus norvegicus
ggcctctccgttcgcacattccaca

SEQ ID NO: 611458 - DNA, 25 bp, Rattus norvegicus
cacgcagcctcgcatctggcctctc

SEQ ID NO: 611459 - DNA, 25 bp, Rattus norvegicus
ttccgcgcgcggctttccagctcgc

SEQ ID NO: 611460 - DNA, 25 bp, Rattus norvegicus
atctcccggacgctcaaccgccgca

SEQ ID NO: 611461 - DNA, 25 bp, Rattus norvegicus
cgcaccaaggttgtatccgccgttg

SEQ ID NO: 611462 - DNA, 25 bp, Rattus norvegicus
ccaaggttgtatccgccgttgaggc

SEQ ID NO: 611463 - DNA, 25 bp, Rattus norvegicus
ccctgccagtgccaggaggtaaaga

SEQ ID NO: 611464 - DNA, 25 bp, Rattus norvegicus
gtgacattccggctttgccttctta

SEQ ID NO: 611465 - DNA, 25 bp, Rattus norvegicus
tcgtttggtaaccacggtgacattc

SEQ ID NO: 611466 - DNA, 25 bp, Rattus norvegicus
tcttaaaggctggaaactacgattc

SEQ ID NO: 611467 - DNA, 25 bp, Rattus norvegicus
tctcgagtgcgctacatttggcttg

SEQ ID NO: 611468 - DNA, 25 bp, Rattus norvegicus
tggcttgcacacagccgcgactcta

SEQ ID NO: 611469 - DNA, 25 bp, Rattus norvegicus
ctctacgcagtgacccgtgggagtt

SEQ ID NO: 611470 - DNA, 25 bp, Rattus norvegicus
actacacgtcccgtgaggcagcgga

SEQ ID NO: 611471 - DNA, 25 bp, Rattus norvegicus
ctagcagggcccttcccggtatcag

SEQ ID NO: 611472 - DNA, 25 bp, Rattus norvegicus
tccgccatcttgtggaagacaagcc

SEQ ID NO: 611473 - DNA, 25 bp, Rattus norvegicus
agccaagtgacagcgggagctcatt

SEQ ID NO: 611474 - DNA, 25 bp, Rattus norvegicus
cagttactgaagagcggaggaaccc

SEQ ID NO: 611475 - DNA, 25 bp, Rattus norvegicus
tggagaaacgcctgtagacgctagc

SEQ ID NO: 611476 - DNA, 25 bp, Rattus norvegicus
ttttgccgctcgagcctccagaact

SEQ ID NO: 611477 - DNA, 25 bp, Rattus norvegicus
gaacgcgtgtccagcaggcccatgt

SEQ ID NO: 611478 - DNA, 25 bp, Rattus norvegicus
cagccgcctgtgtccttgcacgatg

SEQ ID NO: 611479 - DNA, 25 bp, Rattus norvegicus
cagctgtgcacacacatggcctgca

SEQ ID NO: 611480 - DNA, 25 bp, Rattus norvegicus
gcctgccaggacacgcagctgtgca

SEQ ID NO: 611481 - DNA, 25 bp, Rattus norvegicus
ccgcggcggaggaacaaagcaacgc

SEQ ID NO: 611482 - DNA, 25 bp, Rattus norvegicus
gtaacgggagccgatccggctccgc

SEQ ID NO: 611483 - DNA, 25 bp, Rattus norvegicus
cccattacgctgtaataacagaaga

SEQ ID NO: 611484 - DNA, 25 bp, Rattus norvegicus
cgaacgaggccgatgacaaatgggc

SEQ ID NO: 611485 - DNA, 25 bp, Rattus norvegicus
ccgttatcagcgaacgaggccgatg

SEQ ID NO: 611486 - DNA, 25 bp, Rattus norvegicus
gtgatgacaaatgcccgttatcagc

SEQ ID NO: 611487 - DNA, 25 bp, Rattus norvegicus
acattggcagaggaaagtgatgaca

SEQ ID NO: 611488 - DNA, 25 bp, Rattus norvegicus
ctccctccgtcagcggtgctgatga

SEQ ID NO: 611489 - DNA, 25 bp, Rattus norvegicus
tccagcaggcccatgtgcgtgtgcc

SEQ ID NO: 611490 - DNA, 25 bp, Rattus norvegicus
tgtgtccttgcacgatgcacctgcg

SEQ ID NO: 611491 - DNA, 25 bp, Rattus norvegicus
cagagcaggtcgcagctggtgaaac

SEQ ID NO: 611492 - DNA, 25 bp, Rattus norvegicus
ctcctcgagaggaggcgacatcacg

SEQ ID NO: 611493 - DNA, 25 bp, Rattus norvegicus
gctcgacgcacagcggagccgaaga

SEQ ID NO: 611494 - DNA, 25 bp, Rattus norvegicus
accctcgcctcctgcagtttcctcg

SEQ ID NO: 611495 - DNA, 25 bp, Rattus norvegicus
tgctcttgtgctctctccaggctgt

SEQ ID NO: 611496 - DNA, 25 bp, Rattus norvegicus
ctgggtttccgggatgccgccgcac

SEQ ID NO: 611497 - DNA, 25 bp, Rattus norvegicus
gccgccatggccgtctgggtttccg

SEQ ID NO: 611498 - DNA, 25 bp, Rattus norvegicus
cccgcatgtcgaggtaggagcagat

SEQ ID NO: 611499 - DNA, 25 bp, Rattus norvegicus
cttacaggtcggtgccgagccgcgt

SEQ ID NO: 611500 - DNA, 25 bp, Rattus norvegicus
cgcagctggtgaaacgccgcagcca

SEQ ID NO: 611501 - DNA, 25 bp, Rattus norvegicus
ctatcgggcgccagagcaggtcgca

SEQ ID NO: 611502 - DNA, 25 bp, Rattus norvegicus
tcacgcctgtttttcggggtgcgaa

SEQ ID NO: 611503 - DNA, 25 bp, Rattus norvegicus
acatcacgacggaccgggtcacatg

SEQ ID NO: 611504 - DNA, 25 bp, Rattus norvegicus
gtgaaacgccgcagccagcggcaca

SEQ ID NO: 611505 - DNA, 25 bp, Rattus norvegicus
ttcaacagagcggatggctatttcc

SEQ ID NO: 611506 - DNA, 25 bp, Rattus norvegicus
gcgggtcttgtaacaccagtcctta

SEQ ID NO: 611507 - DNA, 25 bp, Rattus norvegicus
accttctctgagctaacgttggaca

SEQ ID NO: 611508 - DNA, 25 bp, Rattus norvegicus
tacccacgtgctagcaatgccaatg

SEQ ID NO: 611509 - DNA, 25 bp, Rattus norvegicus
cagcagcagcgaatggtacccacgt

SEQ ID NO: 611510 - DNA, 25 bp, Rattus norvegicus
ccaggatttcatcgcccgctgcaaa

SEQ ID NO: 611511 - DNA, 25 bp, Rattus norvegicus
agggcatctcccacgactgcaatta

SEQ ID NO: 611512 - DNA, 25 bp, Rattus norvegicus
tcgctcgccttacctgaagggcatc

SEQ ID NO: 611513 - DNA, 25 bp, Rattus norvegicus
gcgcagggcgaattcagatcgtatc

SEQ ID NO: 611514 - DNA, 25 bp, Rattus norvegicus
aagcgaatcgatccaccctctggtc

SEQ ID NO: 611515 - DNA, 25 bp, Rattus norvegicus
gagctgaacttacctaccctgtgta

SEQ ID NO: 611516 - DNA, 25 bp, Rattus norvegicus
ccctgtgtaattcactcgctggaca

SEQ ID NO: 611517 - DNA, 25 bp, Rattus norvegicus
tgcgtcctgccattgcctctcaagg

SEQ ID NO: 611518 - DNA, 25 bp, Rattus norvegicus
gtatcccacaggactccggagctga

SEQ ID NO: 611519 - DNA, 25 bp, Rattus norvegicus
tgaagtgcacctcgcgctggtgctg

SEQ ID NO: 611520 - DNA, 25 bp, Rattus norvegicus
gcagtgcggccgagctctccctgga

SEQ ID NO: 611521 - DNA, 25 bp, Rattus norvegicus
gagctctccctggagtccgcaggca

SEQ ID NO: 611522 - DNA, 25 bp, Rattus norvegicus
tctccctggagtccgcaggcaggca

SEQ ID NO: 611523 - DNA, 25 bp, Rattus norvegicus
ttgaggaactcgaagcggaggctct

SEQ ID NO: 611524 - DNA, 25 bp, Rattus norvegicus
cttcatgaagtgcacctcgcgctgg

SEQ ID NO: 611525 - DNA, 25 bp, Rattus norvegicus
tgctggcgcgtcttggaacccttgc

SEQ ID NO: 611526 - DNA, 25 bp, Rattus norvegicus
ggcccttgcgggtaaaggccatgta

SEQ ID NO: 611527 - DNA, 25 bp, Rattus norvegicus
gggtaaaggccatgtaccagccctc

SEQ ID NO: 611528 - DNA, 25 bp, Rattus norvegicus
tgtaccagccctcgtacttggcgtt

SEQ ID NO: 611529 - DNA, 25 bp, Rattus norvegicus
gccctcgtacttggcgttctgcagc

SEQ ID NO: 611530 - DNA, 25 bp, Rattus norvegicus
ttctgcagcgccgtgtagttgttct

SEQ ID NO: 611531 - DNA, 25 bp, Rattus norvegicus
ttctccagcacgatctccgtgaaca

SEQ ID NO: 611532 - DNA, 25 bp, Rattus norvegicus
cggcaggcgcttcatgaagtgcacc

SEQ ID NO: 611533 - DNA, 25 bp, Rattus norvegicus
aaggatcggtcctcgtgtccctgcc

SEQ ID NO: 611534 - DNA, 25 bp, Rattus norvegicus
cttacctgggcttggaggcagagaa

SEQ ID NO: 611535 - DNA, 25 bp, Rattus norvegicus
ctggccgaaggatcggtcctcgtgt

SEQ ID NO: 611536 - DNA, 25 bp, Rattus norvegicus
tcctcgtgtccctgcccgagagtgt

SEQ ID NO: 611537 - DNA, 25 bp, Rattus norvegicus
gtgtccctgcccgagagtgtcagct

SEQ ID NO: 611538 - DNA, 25 bp, Rattus norvegicus
tgtccctgcccgagagtgtcagctg

SEQ ID NO: 611539 - DNA, 25 bp, Rattus norvegicus
tccttacctgggcttggaggcagag

SEQ ID NO: 611540 - DNA, 25 bp, Rattus norvegicus
ccgaaggatcggtcctcgtgtccct

SEQ ID NO: 611541 - DNA, 25 bp, Rattus norvegicus
tgcccgagagtgtcagctgggtccc

SEQ ID NO: 611542 - DNA, 25 bp, Rattus norvegicus
cgagagtgtcagctgggtcccccgc

SEQ ID NO: 611543 - DNA, 25 bp, Rattus norvegicus
ttctgcgcggcgctccttacctggg

SEQ ID NO: 611544 - DNA, 25 bp, Rattus norvegicus
cggcgctccttacctgggcttggag

SEQ ID NO: 611545 - DNA, 25 bp, Rattus norvegicus
cgctccttacctgggcttggaggca

SEQ ID NO: 611546 - DNA, 25 bp, Rattus norvegicus
ccctgcccgagagtgtcagctgggt

SEQ ID NO: 611547 - DNA, 25 bp, Rattus norvegicus
tcttcgaaggtctctgagtcgccta

SEQ ID NO: 611548 - DNA, 25 bp, Rattus norvegicus
tgctgagcgtcctttgggcgccgct

SEQ ID NO: 611549 - DNA, 25 bp, Rattus norvegicus
taacatagtgaactggcccgggtgc

SEQ ID NO: 611550 - DNA, 25 bp, Rattus norvegicus
cttggaagcggcaactaacatagtg

SEQ ID NO: 611551 - DNA, 25 bp, Rattus norvegicus
tcactcgctcctcttggaagcggca

SEQ ID NO: 611552 - DNA, 25 bp, Rattus norvegicus
ctctgagtcgcctaatgtgtgtttc

SEQ ID NO: 611553 - DNA, 25 bp, Rattus norvegicus
ctgcttatctctggcctcttcgaag

SEQ ID NO: 611554 - DNA, 25 bp, Rattus norvegicus
tcgggatctgcttatctctggcctc

SEQ ID NO: 611555 - DNA, 25 bp, Rattus norvegicus
tagaactgtttctccgcgtggggtc

SEQ ID NO: 611556 - DNA, 25 bp, Rattus norvegicus
cgcttgagtcctgtagaactgtttc

SEQ ID NO: 611557 - DNA, 25 bp, Rattus norvegicus
gacccgtacgcttgagtcctgtaga

SEQ ID NO: 611558 - DNA, 25 bp, Rattus norvegicus
catgtttggtgaggacccgtacgct

SEQ ID NO: 611559 - DNA, 25 bp, Rattus norvegicus
ctgcctgggacagcatgtttggtga

SEQ ID NO: 611560 - DNA, 25 bp, Rattus norvegicus
taatgtgtgtttcggcctcactcgc

SEQ ID NO: 611561 - DNA, 25 bp, Rattus norvegicus
ttcaagaacgccaaagcagccgcgg

SEQ ID NO: 611562 - DNA, 25 bp, Rattus norvegicus
ccgcactggcgtgagagcagctgtc

SEQ ID NO: 611563 - DNA, 25 bp, Rattus norvegicus
cgcgaggcacgtgaaacgccgcact

SEQ ID NO: 611564 - DNA, 25 bp, Rattus norvegicus
gccatgctgaaacggccgtgagagc

SEQ ID NO: 611565 - DNA, 25 bp, Rattus norvegicus
tggctcggctctcttggttcaagaa

SEQ ID NO: 611566 - DNA, 25 bp, Rattus norvegicus
attgtgaccggagccggaaccctca

SEQ ID NO: 611567 - DNA, 25 bp, Rattus norvegicus
agaagaaactatccattgtgaccgg

SEQ ID NO: 611568 - DNA, 25 bp, Rattus norvegicus
ttcccgtgttcaataccgaagaaga

SEQ ID NO: 611569 - DNA, 25 bp, Rattus norvegicus
tctcggcccgtacaggccgcgaagg

SEQ ID NO: 611570 - DNA, 25 bp, Rattus norvegicus
cctagaacacgtggaccggcgtctc

SEQ ID NO: 611571 - DNA, 25 bp, Rattus norvegicus
tgacgggccgtttactcgcctagaa

SEQ ID NO: 611572 - DNA, 25 bp, Rattus norvegicus
ggggcgtttcacaaactccgctgtc

SEQ ID NO: 611573 - DNA, 25 bp, Rattus norvegicus
ttcgcctgagaggagcactcgtgga

SEQ ID NO: 611574 - DNA, 25 bp, Rattus norvegicus
cactcttccattcccgtgttcaata

SEQ ID NO: 611575 - DNA, 25 bp, Rattus norvegicus
ggcaccggctcgagccctttgtcag

SEQ ID NO: 611576 - DNA, 25 bp, Rattus norvegicus
agtccctaagcagctactgccgctg

SEQ ID NO: 611577 - DNA, 25 bp, Rattus norvegicus
caccggagtccctaagcagctactg

SEQ ID NO: 611578 - DNA, 25 bp, Rattus norvegicus
gagccttatttctctggctatctcc

SEQ ID NO: 611579 - DNA, 25 bp, Rattus norvegicus
gccctccaaagagccttatttctct

SEQ ID NO: 611580 - DNA, 25 bp, Rattus norvegicus
gcctgcgctggaagccaagagacta

SEQ ID NO: 611581 - DNA, 25 bp, Rattus norvegicus
gccacaggtccggagccctgcaaag

SEQ ID NO: 611582 - DNA, 25 bp, Rattus norvegicus
ttcggcctcggtccgttgggccaca

SEQ ID NO: 611583 - DNA, 25 bp, Rattus norvegicus
gcaggattggcgttgcgctcactct

SEQ ID NO: 611584 - DNA, 25 bp, Rattus norvegicus
agctgcagacggctccaacgaagcc

SEQ ID NO: 611585 - DNA, 25 bp, Rattus norvegicus
agcccattgcactctctttgctagg

SEQ ID NO: 611586 - DNA, 25 bp, Rattus norvegicus
acaaaaggcgccgtggacaccgcgg

SEQ ID NO: 611587 - DNA, 25 bp, Rattus norvegicus
tcctttccttgggatcagcccattg

SEQ ID NO: 611588 - DNA, 25 bp, Rattus norvegicus
cgcctccgggtcttcacggaaggag

SEQ ID NO: 611589 - DNA, 25 bp, Rattus norvegicus
aaagctgaccggctcagggtcagcc

SEQ ID NO: 611590 - DNA, 25 bp, Rattus norvegicus
gacacttttccctagtccgccgcgc

SEQ ID NO: 611591 - DNA, 25 bp, Rattus norvegicus
ttggccaggttcaaggacccagccg

SEQ ID NO: 611592 - DNA, 25 bp, Rattus norvegicus
gacccgcaaaggttggccaggttca

SEQ ID NO: 611593 - DNA, 25 bp, Rattus norvegicus
ccaggcctagtagggcggacccgca

SEQ ID NO: 611594 - DNA, 25 bp, Rattus norvegicus
gccgcctctgggtccaggcctagta

SEQ ID NO: 611595 - DNA, 25 bp, Rattus norvegicus
gtcacccgtgtctccgcggcactta

SEQ ID NO: 611596 - DNA, 25 bp, Rattus norvegicus
gagcactctgagttcccaggcccga

SEQ ID NO: 611597 - DNA, 25 bp, Rattus norvegicus
actaagccggtagcaggcgttcgaa

SEQ ID NO: 611598 - DNA, 25 bp, Rattus norvegicus
tctaaggggcaggactaagccggta

SEQ ID NO: 611599 - DNA, 25 bp, Rattus norvegicus
ccagcaggacctctaaggggcagga

SEQ ID NO: 611600 - DNA, 25 bp, Rattus norvegicus
cgctggggtcaaaggtcagcgcctc

SEQ ID NO: 611601 - DNA, 25 bp, Rattus norvegicus
gcttctctagcaccctagcagctcg

SEQ ID NO: 611602 - DNA, 25 bp, Rattus norvegicus
gggtcaaaggtcagcgcctcgcccg

SEQ ID NO: 611603 - DNA, 25 bp, Rattus norvegicus
gatggccgtcacctgctactgttaa

SEQ ID NO: 611604 - DNA, 25 bp, Rattus norvegicus
atcctagtccgctgcagccctgatg

SEQ ID NO: 611605 - DNA, 25 bp, Rattus norvegicus
tttttcgttccatggctggcgcgac

SEQ ID NO: 611606 - DNA, 25 bp, Rattus norvegicus
tggcaggggacccagctatcctagt

SEQ ID NO: 611607 - DNA, 25 bp, Rattus norvegicus
tctgagcaacttcactggcgcggcc

SEQ ID NO: 611608 - DNA, 25 bp, Rattus norvegicus
aactctgcgcctgctttcggatctg

SEQ ID NO: 611609 - DNA, 25 bp, Rattus norvegicus
tgaagcgtgcaggaactctgcgcct

SEQ ID NO: 611610 - DNA, 25 bp, Rattus norvegicus
cgccagaggcgtcatgaagcgtgca

SEQ ID NO: 611611 - DNA, 25 bp, Rattus norvegicus
ccaccgggcgatcaggccttggcaa

SEQ ID NO: 611612 - DNA, 25 bp, Rattus norvegicus
gtaccacggagtagcagccaggcct

SEQ ID NO: 611613 - DNA, 25 bp, Rattus norvegicus
aacttctagtggctgtgcgtgggcc

SEQ ID NO: 611614 - DNA, 25 bp, Rattus norvegicus
tcgccgctggacgtctttttcgttc

SEQ ID NO: 611615 - DNA, 25 bp, Rattus norvegicus
tactgttaagacctcccggatcgcc

SEQ ID NO: 611616 - DNA, 25 bp, Rattus norvegicus
ggccttggcaagctcctacgccaga

SEQ ID NO: 611617 - DNA, 25 bp, Rattus norvegicus
gggaaactagggttatttgacagca

SEQ ID NO: 611618 - DNA, 25 bp, Rattus norvegicus
tcgcgttcgcacaccggatcttcgc

SEQ ID NO: 611619 - DNA, 25 bp, Rattus norvegicus
ctcacggtaagtcccgggacgcgct

SEQ ID NO: 611620 - DNA, 25 bp, Rattus norvegicus
ctagggttatttgacagcagcaggg

SEQ ID NO: 611621 - DNA, 25 bp, Rattus norvegicus
cagccgaagaagagttcgtggagcc

SEQ ID NO: 611622 - DNA, 25 bp, Rattus norvegicus
taggaccgcagagcagttcttgacc

SEQ ID NO: 611623 - DNA, 25 bp, Rattus norvegicus
aagttctcggcgctcacggtaagtc

SEQ ID NO: 611624 - DNA, 25 bp, Rattus norvegicus
atcttcgccgagtgcctgggtgcag

SEQ ID NO: 611625 - DNA, 25 bp, Rattus norvegicus
agcgtcaccatgctgccgccacagc

SEQ ID NO: 611626 - DNA, 25 bp, Rattus norvegicus
cgccacagctgtgctggctgccgct

SEQ ID NO: 611627 - DNA, 25 bp, Rattus norvegicus
ctgctcgctgcgttgctgccgccag

SEQ ID NO: 611628 - DNA, 25 bp, Rattus norvegicus
agtgcccgcgcagaagttctcggcg

SEQ ID NO: 611629 - DNA, 25 bp, Rattus norvegicus
cgcagaagttctcggcgctcacggt

SEQ ID NO: 611630 - DNA, 25 bp, Rattus norvegicus
ccaccagaggcggtaggaccgcaga

SEQ ID NO: 611631 - DNA, 25 bp, Rattus norvegicus
cctgcctgcagcgaggggcctgtca

SEQ ID NO: 611632 - DNA, 25 bp, Rattus norvegicus
gaggcgaagcctcacgctcggcgtc

SEQ ID NO: 611633 - DNA, 25 bp, Rattus norvegicus
taaaaaacgagacggaggcagagac

SEQ ID NO: 611634 - DNA, 25 bp, Rattus norvegicus
cgcagctcttaaaaaacgagacgga

SEQ ID NO: 611635 - DNA, 25 bp, Rattus norvegicus
ccgcatgcatgtgacgcagctctta

SEQ ID NO: 611636 - DNA, 25 bp, Rattus norvegicus
cgctcccgggaaccgcatgcatgtg

SEQ ID NO: 611637 - DNA, 25 bp, Rattus norvegicus
cctcgagcgacgacgtgcgtgcgct

SEQ ID NO: 611638 - DNA, 25 bp, Rattus norvegicus
ccgtgtcaaagtgacccgggcgagc

SEQ ID NO: 611639 - DNA, 25 bp, Rattus norvegicus
atatgctaattgtcctggtagtggg

SEQ ID NO: 611640 - DNA, 25 bp, Rattus norvegicus
gggccgggctttattaatatgctaa

SEQ ID NO: 611641 - DNA, 25 bp, Rattus norvegicus
gctgggccgggctttattaatatgc

SEQ ID NO: 611642 - DNA, 25 bp, Rattus norvegicus
gtgtgcgtgtctgtgcgctcccgcc

SEQ ID NO: 611643 - DNA, 25 bp, Rattus norvegicus
agctgcctctgcgtgtgtacgcgcg

SEQ ID NO: 611644 - DNA, 25 bp, Rattus norvegicus
cgcggagcaaacaggaaggaagcca

SEQ ID NO: 611645 - DNA, 25 bp, Rattus norvegicus
cctgcggcgattcctgggaacgcca

SEQ ID NO: 611646 - DNA, 25 bp, Rattus norvegicus
cacaggaaagggaggaagcacttgc

SEQ ID NO: 611647 - DNA, 25 bp, Rattus norvegicus
aagcacttgcgtgccgatgctgcgg

SEQ ID NO: 611648 - DNA, 25 bp, Rattus norvegicus
cagtgtcgggcgtcagaaacgtgac

SEQ ID NO: 611649 - DNA, 25 bp, Rattus norvegicus
aaacgtgaccctagctggggcgtca

SEQ ID NO: 611650 - DNA, 25 bp, Rattus norvegicus
gggataagacttctaaggatgccga

SEQ ID NO: 611651 - DNA, 25 bp, Rattus norvegicus
atgccgaagaagctccaccagcttg

SEQ ID NO: 611652 - DNA, 25 bp, Rattus norvegicus
tcccgggagaagttgtctgcctccc

SEQ ID NO: 611653 - DNA, 25 bp, Rattus norvegicus
ggatgtccacgtggctcctgtccca

SEQ ID NO: 611654 - DNA, 25 bp, Rattus norvegicus
tcctgtcccaggctgtcgggcatct

SEQ ID NO: 611655 - DNA, 25 bp, Rattus norvegicus
tcgggcatctagtatccgcgctgga

SEQ ID NO: 611656 - DNA, 25 bp, Rattus norvegicus
gcgagtcgaagtcaagcgccgcatg

SEQ ID NO: 611657 - DNA, 25 bp, Rattus norvegicus
cggtgacacgtggacgccacaggaa

SEQ ID NO: 611658 - DNA, 25 bp, Rattus norvegicus
cagcttggcgccgtagttccttttt

SEQ ID NO: 611659 - DNA, 25 bp, Rattus norvegicus
tccctccgccgagaaaaggagtgcg

SEQ ID NO: 611660 - DNA, 25 bp, Rattus norvegicus
ccctgcgacagtgacagcaagcaca

SEQ ID NO: 611661 - DNA, 25 bp, Rattus norvegicus
acccggacaagcacattatactgtg

SEQ ID NO: 611662 - DNA, 25 bp, Rattus norvegicus
tggggtcttagtcgcttcgggacca

SEQ ID NO: 611663 - DNA, 25 bp, Rattus norvegicus
gcttcccggagaagcacttcggtta

SEQ ID NO: 611664 - DNA, 25 bp, Rattus norvegicus
cggttacccagcacacactgtcagg

SEQ ID NO: 611665 - DNA, 25 bp, Rattus norvegicus
aagaacataagtggctctgcgcccg

SEQ ID NO: 611666 - DNA, 25 bp, Rattus norvegicus
agcggctctggcctccaaaacaaac

SEQ ID NO: 611667 - DNA, 25 bp, Rattus norvegicus
gcccggacggacactcatgccgaga

SEQ ID NO: 611668 - DNA, 25 bp, Rattus norvegicus
aggtcccgcttgctgtactcgaagt

SEQ ID NO: 611669 - DNA, 25 bp, Rattus norvegicus
cgtcacagggcgtacccggagctac

SEQ ID NO: 611670 - DNA, 25 bp, Rattus norvegicus
actaccggtccagtgcgacgtcagc

SEQ ID NO: 611671 - DNA, 25 bp, Rattus norvegicus
agcgcgtcttgtaggacgatgcacc

SEQ ID NO: 611672 - DNA, 25 bp, Rattus norvegicus
cttcgcaccagacaagcaggcgggc

SEQ ID NO: 611673 - DNA, 25 bp, Rattus norvegicus
ggctgtgctctggagttcttcagtc

SEQ ID NO: 611674 - DNA, 25 bp, Rattus norvegicus
gccctttacaggatgacgacgcgtg

SEQ ID NO: 611675 - DNA, 25 bp, Rattus norvegicus
tttcccgcctcggacgggagcgtga

SEQ ID NO: 611676 - DNA, 25 bp, Rattus norvegicus
aggctagtgggctccgccctttaca

SEQ ID NO: 611677 - DNA, 25 bp, Rattus norvegicus
cgtgtgagaccggaaggaacttata

SEQ ID NO: 611678 - DNA, 25 bp, Rattus norvegicus
ggaacttatagatttcgcatgcgtc

SEQ ID NO: 611679 - DNA, 25 bp, Rattus norvegicus
cgccgcgcgacgtgatgacgacact

SEQ ID NO: 611680 - DNA, 25 bp, Rattus norvegicus
ttcttcagtcgtaccgcgtgcgcaa

SEQ ID NO: 611681 - DNA, 25 bp, Rattus norvegicus
gtgcgcaacggtagtgacgcgttta

SEQ ID NO: 611682 - DNA, 25 bp, Rattus norvegicus
tgacgcgtttaacccggagtatggc

SEQ ID NO: 611683 - DNA, 25 bp, Rattus norvegicus
agtatggcggataccggcttgcgcc

SEQ ID NO: 611684 - DNA, 25 bp, Rattus norvegicus
gcgtggttcccagcgacctttatcc

SEQ ID NO: 611685 - DNA, 25 bp, Rattus norvegicus
atttcgcatgcgtcctgcctccggg

SEQ ID NO: 611686 - DNA, 25 bp, Rattus norvegicus
gtgacctctgacgtaaagctccgcc

SEQ ID NO: 611687 - DNA, 25 bp, Rattus norvegicus
cacctcctcgtagggtggcaccagg

SEQ ID NO: 611688 - DNA, 25 bp, Rattus norvegicus
cccacgttgaccgagttgaaggcga

SEQ ID NO: 611689 - DNA, 25 bp, Rattus norvegicus
tgtagcccgggtacacctcctcgta

SEQ ID NO: 611690 - DNA, 25 bp, Rattus norvegicus
atacaggttgtgaagccagaggccc

SEQ ID NO: 611691 - DNA, 25 bp, Rattus norvegicus
acacctgcgggcgtcggagaaacgc

SEQ ID NO: 611692 - DNA, 25 bp, Rattus norvegicus
cgattcctctggaaggtggcctcca

SEQ ID NO: 611693 - DNA, 25 bp, Rattus norvegicus
tcacgcatagtaggatcgagcccgg

SEQ ID NO: 611694 - DNA, 25 bp, Rattus norvegicus
gcaccgagcccgagaaaagaagcta

SEQ ID NO: 611695 - DNA, 25 bp, Rattus norvegicus
accggtcgggatcaaagaaagatga

SEQ ID NO: 611696 - DNA, 25 bp, Rattus norvegicus
gtcccagccgaggaatcgcgtgata

SEQ ID NO: 611697 - DNA, 25 bp, Rattus norvegicus
atcctgggacggaaactgggctcga

SEQ ID NO: 611698 - DNA, 25 bp, Rattus norvegicus
cggcgatctcttcgcgcgtgctcat

SEQ ID NO: 611699 - DNA, 25 bp, Rattus norvegicus
ctcatgtcggggtagcgattcctct

SEQ ID NO: 611700 - DNA, 25 bp, Rattus norvegicus
cggccagttgccgtacgtgtagccc

SEQ ID NO: 611701 - DNA, 25 bp, Rattus norvegicus
agcttgggccctgtaactcgcagcg

SEQ ID NO: 611702 - DNA, 25 bp, Rattus norvegicus
gcggccatctgacccagtagcgact

SEQ ID NO: 611703 - DNA, 25 bp, Rattus norvegicus
cagcggccatctgacccagtagcga

SEQ ID NO: 611704 - DNA, 25 bp, Rattus norvegicus
tcgcagcggccatctgacccagtag

SEQ ID NO: 611705 - DNA, 25 bp, Rattus norvegicus
ctgtaactcgcagcggccatctgac

SEQ ID NO: 611706 - DNA, 25 bp, Rattus norvegicus
cctgtaactcgcagcggccatctga

SEQ ID NO: 611707 - DNA, 25 bp, Rattus norvegicus
tgggccctgtaactcgcagcggcca

SEQ ID NO: 611708 - DNA, 25 bp, Rattus norvegicus
gcagcttgggccctgtaactcgcag

SEQ ID NO: 611709 - DNA, 25 bp, Rattus norvegicus
ggctggcagcttgggccctgtaact

SEQ ID NO: 611710 - DNA, 25 bp, Rattus norvegicus
cctgccagtcgtgtcgcgttgggct

SEQ ID NO: 611711 - DNA, 25 bp, Rattus norvegicus
agacctgccagtcgtgtcgcgttgg

SEQ ID NO: 611712 - DNA, 25 bp, Rattus norvegicus
ggccatctgacccagtagcgactct

SEQ ID NO: 611713 - DNA, 25 bp, Rattus norvegicus
acagacctgccagtcgtgtcgcgtt

SEQ ID NO: 611714 - DNA, 25 bp, Rattus norvegicus
cacgacagacctgccagtcgtgtcg

SEQ ID NO: 611715 - DNA, 25 bp, Rattus norvegicus
cgcaacacggctcctattccaactg

SEQ ID NO: 611716 - DNA, 25 bp, Rattus norvegicus
tgggagccgcctgttgcccttacac

SEQ ID NO: 611717 - DNA, 25 bp, Rattus norvegicus
cctgggtcaagtggcgttgggagcc

SEQ ID NO: 611718 - DNA, 25 bp, Rattus norvegicus
tctgtctaagcctgggtcaagtggc

SEQ ID NO: 611719 - DNA, 25 bp, Rattus norvegicus
gagtctgtctaagcctgggtcaagt

SEQ ID NO: 611720 - DNA, 25 bp, Rattus norvegicus
tggagtctgtctaagcctgggtcaa

SEQ ID NO: 611721 - DNA, 25 bp, Rattus norvegicus
agccgctggagtctgtctaagcctg

SEQ ID NO: 611722 - DNA, 25 bp, Rattus norvegicus
tccagccgctggagtctgtctaagc

SEQ ID NO: 611723 - DNA, 25 bp, Rattus norvegicus
acttccagccgctggagtctgtcta

SEQ ID NO: 611724 - DNA, 25 bp, Rattus norvegicus
aaaagcatgagctactatgcgcacc

SEQ ID NO: 611725 - DNA, 25 bp, Rattus norvegicus
ctgggaagaaaagcatgagctacta

SEQ ID NO: 611726 - DNA, 25 bp, Rattus norvegicus
agcagctgggaagaaaagcatgagc

SEQ ID NO: 611727 - DNA, 25 bp, Rattus norvegicus
ctgttgcccttacaccgggcgaccg

SEQ ID NO: 611728 - DNA, 25 bp, Rattus norvegicus
attccaactgcggagcagctgggaa

SEQ ID NO: 611729 - DNA, 25 bp, Rattus norvegicus
gaatgagcctcaccgtgcagtgcca

SEQ ID NO: 611730 - DNA, 25 bp, Rattus norvegicus
ggcagccaagaactccgccctatgg

SEQ ID NO: 611731 - DNA, 25 bp, Rattus norvegicus
ctccggttcggcaaagccagcaaaa

SEQ ID NO: 611732 - DNA, 25 bp, Rattus norvegicus
tccagccggatttgtggcgaattga

SEQ ID NO: 611733 - DNA, 25 bp, Rattus norvegicus
gcgaattgaggtcttgggctctccc

SEQ ID NO: 611734 - DNA, 25 bp, Rattus norvegicus
cccggagcgatcttaagcagtgccg

SEQ ID NO: 611735 - DNA, 25 bp, Rattus norvegicus
gggtctcagcgcttaccctttgctg

SEQ ID NO: 611736 - DNA, 25 bp, Rattus norvegicus
gctgctgctggtttcgctgattttc

SEQ ID NO: 611737 - DNA, 25 bp, Rattus norvegicus
gattttctccacttgtcgctgtctg

SEQ ID NO: 611738 - DNA, 25 bp, Rattus norvegicus
cgctgtctgtctttccactcttttg

SEQ ID NO: 611739 - DNA, 25 bp, Rattus norvegicus
cgtgcgccttcctactatcttctga

SEQ ID NO: 611740 - DNA, 25 bp, Rattus norvegicus
tactatcttctgaccgccgctttgc

SEQ ID NO: 611741 - DNA, 25 bp, Rattus norvegicus
gccggcgcccattcactttatggca

SEQ ID NO: 611742 - DNA, 25 bp, Rattus norvegicus
tcactttatggcagcccagggcgcc

SEQ ID NO: 611743 - DNA, 25 bp, Rattus norvegicus
tccagcgtcgtgagggccgcctgac

SEQ ID NO: 611744 - DNA, 25 bp, Rattus norvegicus
ggcccacttattccggcctgcagtg

SEQ ID NO: 611745 - DNA, 25 bp, Rattus norvegicus
agttagggtcgacttccagacgaca

SEQ ID NO: 611746 - DNA, 25 bp, Rattus norvegicus
ttattccggcctgcagtgaggtctc

SEQ ID NO: 611747 - DNA, 25 bp, Rattus norvegicus
cggcctgcagtgaggtctcacccta

SEQ ID NO: 611748 - DNA, 25 bp, Rattus norvegicus
agtgaggtctcaccctaaagttagg

SEQ ID NO: 611749 - DNA, 25 bp, Rattus norvegicus
ttcccttctctcactcgctgccggc

SEQ ID NO: 611750 - DNA, 25 bp, Rattus norvegicus
gcctccggggccaagctggacatga

SEQ ID NO: 611751 - DNA, 25 bp, Rattus norvegicus
aagctggacatgagctgcggctgcc

SEQ ID NO: 611752 - DNA, 25 bp, Rattus norvegicus
attttggatcctctgacaggtcagc

SEQ ID NO: 611753 - DNA, 25 bp, Rattus norvegicus
agcgaagtctcttctttgggttcca

SEQ ID NO: 611754 - DNA, 25 bp, Rattus norvegicus
gggtcgacttccagacgacaggctc

SEQ ID NO: 611755 - DNA, 25 bp, Rattus norvegicus
ttctttgggttccagcgtcgtgagg

SEQ ID NO: 611756 - DNA, 25 bp, Rattus norvegicus
tctgacaggtcagcgaagtctcttc

SEQ ID NO: 611757 - DNA, 25 bp, Rattus norvegicus
tcaccaggcacacaagacattaggg

SEQ ID NO: 611758 - DNA, 25 bp, Rattus norvegicus
ctggctgaaaatcccaaggttgctc

SEQ ID NO: 611759 - DNA, 25 bp, Rattus norvegicus
gccgtgtcctccacactggctgaaa

SEQ ID NO: 611760 - DNA, 25 bp, Rattus norvegicus
ccctaggtgaatcagccgtgtcctc

SEQ ID NO: 611761 - DNA, 25 bp, Rattus norvegicus
gagaatccgggaagctaagacgttc

SEQ ID NO: 611762 - DNA, 25 bp, Rattus norvegicus
gcgcaatacacatggctttgggatt

SEQ ID NO: 611763 - DNA, 25 bp, Rattus norvegicus
gggatgaaacgcacattcctgtagc

SEQ ID NO: 611764 - DNA, 25 bp, Rattus norvegicus
atgctcacttgcacgtgccacgttg

SEQ ID NO: 611765 - DNA, 25 bp, Rattus norvegicus
actcacctgtgtggacgaatgctca

SEQ ID NO: 611766 - DNA, 25 bp, Rattus norvegicus
tgcctgcacacggacatccagacgt

SEQ ID NO: 611767 - DNA, 25 bp, Rattus norvegicus
atcgacacgtatgcctgcccttagc

SEQ ID NO: 611768 - DNA, 25 bp, Rattus norvegicus
cctccagtgagtgcgcacaggaaca

SEQ ID NO: 611769 - DNA, 25 bp, Rattus norvegicus
ccaccacggtgagtggctggattca

SEQ ID NO: 611770 - DNA, 25 bp, Rattus norvegicus
tcctgtagcggacacacgcgcaata

SEQ ID NO: 611771 - DNA, 25 bp, Rattus norvegicus
ctggactacggcgtcaccgcggacg

SEQ ID NO: 611772 - DNA, 25 bp, Rattus norvegicus
acacgctgcagcgaggtaggtctta

SEQ ID NO: 611773 - DNA, 25 bp, Rattus norvegicus
agcagcaggccctggacacgctgca

SEQ ID NO: 611774 - DNA, 25 bp, Rattus norvegicus
agcgaggtaggtcttaggaactctg

SEQ ID NO: 611775 - DNA, 25 bp, Rattus norvegicus
ctgtcgtccctagctcgcgagtaca

SEQ ID NO: 611776 - DNA, 25 bp, Rattus norvegicus
agctcgcgagtacaacgcgcgcctg

SEQ ID NO: 611777 - DNA, 25 bp, Rattus norvegicus
acaacgcgcgcctgttcggtctggc

SEQ ID NO: 611778 - DNA, 25 bp, Rattus norvegicus
agcgttgctggactacggcgtcacc

SEQ ID NO: 611779 - DNA, 25 bp, Rattus norvegicus
acggagacacgtaagcaaccaccac

SEQ ID NO: 611780 - DNA, 25 bp, Rattus norvegicus
acgcgcgtgctctgctagcgggaca

SEQ ID NO: 611781 - DNA, 25 bp, Rattus norvegicus
tctgctagcgggacagcgccacctg

SEQ ID NO: 611782 - DNA, 25 bp, Rattus norvegicus
gccacctgctgatggcacaggacga

SEQ ID NO: 611783 - DNA, 25 bp, Rattus norvegicus
cacaggacgagaacggagacacgta

SEQ ID NO: 611784 - DNA, 25 bp, Rattus norvegicus
cctgttcggtctggcgcagcgcagc

SEQ ID NO: 611785 - DNA, 25 bp, Rattus norvegicus
gcctttttcttcttgcggctctgca

SEQ ID NO: 611786 - DNA, 25 bp, Rattus norvegicus
ctgtctgagacacgcggccggcctt

SEQ ID NO: 611787 - DNA, 25 bp, Rattus norvegicus
gctaaagggaccactcggcctgctc

SEQ ID NO: 611788 - DNA, 25 bp, Rattus norvegicus
gaatcgagggctaaagggaccactc

SEQ ID NO: 611789 - DNA, 25 bp, Rattus norvegicus
ttcagcttgtaagaatcgagggcta

SEQ ID NO: 611790 - DNA, 25 bp, Rattus norvegicus
ctgcggagcacccttcagcttgtaa

SEQ ID NO: 611791 - DNA, 25 bp, Rattus norvegicus
acgtcgcgcgactgagcagcacggc

SEQ ID NO: 611792 - DNA, 25 bp, Rattus norvegicus
tgttgacgccgatcatgctggcccg

SEQ ID NO: 611793 - DNA, 25 bp, Rattus norvegicus
cgctgctgtggatgctgttgacgcc

SEQ ID NO: 611794 - DNA, 25 bp, Rattus norvegicus
gcccgtagcgcaccgagcagagcga

SEQ ID NO: 611795 - DNA, 25 bp, Rattus norvegicus
agccgtagcatagggtctccgcgcc

SEQ ID NO: 611796 - DNA, 25 bp, Rattus norvegicus
agcgctgcggccagccgtagcatag

SEQ ID NO: 611797 - DNA, 25 bp, Rattus norvegicus
accaccaggtcggtgtagagcacgg

SEQ ID NO: 611798 - DNA, 25 bp, Rattus norvegicus
ctctgcaggcggctgaccaccaggt

SEQ ID NO: 611799 - DNA, 25 bp, Rattus norvegicus
cttagttgcagtattggctacgcca

SEQ ID NO: 611800 - DNA, 25 bp, Rattus norvegicus
gccactcctgcaggctggtgtctgc

SEQ ID NO: 611801 - DNA, 25 bp, Rattus norvegicus
tcgggccaacacaaccgcggccact

SEQ ID NO: 611802 - DNA, 25 bp, Rattus norvegicus
tgagagcgtccacctcgggccaaca

SEQ ID NO: 611803 - DNA, 25 bp, Rattus norvegicus
aggtgccagaaaccgcgctgtggat

SEQ ID NO: 611804 - DNA, 25 bp, Rattus norvegicus
tattggctacgccaaggcgcgaggt

SEQ ID NO: 611805 - DNA, 25 bp, Rattus norvegicus
tgcagtattggctacgccaaggcgc

SEQ ID NO: 611806 - DNA, 25 bp, Rattus norvegicus
tgccagggagcgctcccgagcgcgt

SEQ ID NO: 611807 - DNA, 25 bp, Rattus norvegicus
tggcactgtggttgaccgctctaag

SEQ ID NO: 611808 - DNA, 25 bp, Rattus norvegicus
tgtggttgaccgctctaagtttgtc

SEQ ID NO: 611809 - DNA, 25 bp, Rattus norvegicus
gaccgctctaagtttgtctctctta

SEQ ID NO: 611810 - DNA, 25 bp, Rattus norvegicus
aagtttgtctctcttagttgcagta

SEQ ID NO: 611811 - DNA, 25 bp, Rattus norvegicus
caggctggtgtctgcagagcccagc

SEQ ID NO: 611812 - DNA, 25 bp, Rattus norvegicus
tgtctctcttagttgcagtattggc

SEQ ID NO: 611813 - DNA, 25 bp, Rattus norvegicus
aagtcccgaagttaggcggctgcca

SEQ ID NO: 611814 - DNA, 25 bp, Rattus norvegicus
gcagtatacagcgatggagccacca

SEQ ID NO: 611815 - DNA, 25 bp, Rattus norvegicus
ccagctgggactctggggtataaca

SEQ ID NO: 611816 - DNA, 25 bp, Rattus norvegicus
ggtataacagaaggactcgcacgta

SEQ ID NO: 611817 - DNA, 25 bp, Rattus norvegicus
tgctcccgcacgtcctgaactgggt

SEQ ID NO: 611818 - DNA, 25 bp, Rattus norvegicus
tcgttcagctgcacctggctaggct

SEQ ID NO: 611819 - DNA, 25 bp, Rattus norvegicus
cagctgcgcggtaaaccctttccaa

SEQ ID NO: 611820 - DNA, 25 bp, Rattus norvegicus
ggggacagactgatctccgtgcctc

SEQ ID NO: 611821 - DNA, 25 bp, Rattus norvegicus
ctccgtgtcacgaatggctgttgga

SEQ ID NO: 611822 - DNA, 25 bp, Rattus norvegicus
ctggcacggaatccacagctacgga

SEQ ID NO: 611823 - DNA, 25 bp, Rattus norvegicus
ggccaactgagtcgccgagcactcg

SEQ ID NO: 611824 - DNA, 25 bp, Rattus norvegicus
gcatttcgctcgctcactgtgactg

SEQ ID NO: 611825 - DNA, 25 bp, Rattus norvegicus
tagtaaagcttactgcgcacgcgca

SEQ ID NO: 611826 - DNA, 25 bp, Rattus norvegicus
cactagtccggctactgcgagatgc

SEQ ID NO: 611827 - DNA, 25 bp, Rattus norvegicus
ttcgaaaagcctgggccagcactgc

SEQ ID NO: 611828 - DNA, 25 bp, Rattus norvegicus
gagccgctgcactagtccgaaaaca

SEQ ID NO: 611829 - DNA, 25 bp, Rattus norvegicus
attggcagcattaccctgcctggtc

SEQ ID NO: 611830 - DNA, 25 bp, Rattus norvegicus
tcctcgcgtcggtgaaccaactctt

SEQ ID NO: 611831 - DNA, 25 bp, Rattus norvegicus
cctgctgaagtctcccggtgatcgt

SEQ ID NO: 611832 - DNA, 25 bp, Rattus norvegicus
tgagcctcctcttcgaaaagcctgg

SEQ ID NO: 611833 - DNA, 25 bp, Rattus norvegicus
gctgctgccgccatgttatcaacaa

SEQ ID NO: 611834 - DNA, 25 bp, Rattus norvegicus
ccacgcagccttttcgcggaatttt

SEQ ID NO: 611835 - DNA, 25 bp, Rattus norvegicus
cggaattttgctaaatgccgcaggc

SEQ ID NO: 611836 - DNA, 25 bp, Rattus norvegicus
tgccgcaggctgattggcagcatta

SEQ ID NO: 611837 - DNA, 25 bp, Rattus norvegicus
ctttccgccggaagaaggacatggc

SEQ ID NO: 611838 - DNA, 25 bp, Rattus norvegicus
gacgaaacccttgcaggtttgccgc

SEQ ID NO: 611839 - DNA, 25 bp, Rattus norvegicus
ggccgagcggctcaccgagagcctt

SEQ ID NO: 611840 - DNA, 25 bp, Rattus norvegicus
ggtgatcgtgtatctactgagcctc

SEQ ID NO: 611841 - DNA, 25 bp, Rattus norvegicus
gcacctacatgacgcgctgagacgc

SEQ ID NO: 611842 - DNA, 25 bp, Rattus norvegicus
tgacgcgctgagacgctcattttgg

SEQ ID NO: 611843 - DNA, 25 bp, Rattus norvegicus
tgagacgctcattttggtcctagct

SEQ ID NO: 611844 - DNA, 25 bp, Rattus norvegicus
tagctttttcttccggcggctacgc

SEQ ID NO: 611845 - DNA, 25 bp, Rattus norvegicus
ccgggccaccttgtattcgggctcg

SEQ ID NO: 611846 - DNA, 25 bp, Rattus norvegicus
ttgtattcgggctcgcccacgcgcg

SEQ ID NO: 611847 - DNA, 25 bp, Rattus norvegicus
ggctcggcccgcagcaagaactggc

SEQ ID NO: 611848 - DNA, 25 bp, Rattus norvegicus
tagacgcgccgcaagtcgcggcgca

SEQ ID NO: 611849 - DNA, 25 bp, Rattus norvegicus
ctgccttccggccacgcggcttcgc

SEQ ID NO: 611850 - DNA, 25 bp, Rattus norvegicus
gccgggcccgtaccatggaagcagt

SEQ ID NO: 611851 - DNA, 25 bp, Rattus norvegicus
ccgtaccatggaagcagtggagttc

SEQ ID NO: 611852 - DNA, 25 bp, Rattus norvegicus
ccatggaagcagtggagttctcgcg

SEQ ID NO: 611853 - DNA, 25 bp, Rattus norvegicus
taggtgccgtagacgcgccgcaagt

SEQ ID NO: 611854 - DNA, 25 bp, Rattus norvegicus
gcagcaagaactggccgccgcgctg

SEQ ID NO: 611855 - DNA, 25 bp, Rattus norvegicus
gtcacctgcctgagctatcgggaga

SEQ ID NO: 611856 - DNA, 25 bp, Rattus norvegicus
aataagcaatcgtctgccaggactg

SEQ ID NO: 611857 - DNA, 25 bp, Rattus norvegicus
caatcgtctgccaggactgcggtga

SEQ ID NO: 611858 - DNA, 25 bp, Rattus norvegicus
cgcagccgcggaataagcaatcgtc

SEQ ID NO: 611859 - DNA, 25 bp, Rattus norvegicus
cccgcagccgcggaataagcaatcg

SEQ ID NO: 611860 - DNA, 25 bp, Rattus norvegicus
gaagccctgggctgctagcgcgcag

SEQ ID NO: 611861 - DNA, 25 bp, Rattus norvegicus
ccatgcggaaccaatagcgggaagg

SEQ ID NO: 611862 - DNA, 25 bp, Rattus norvegicus
gagagccatgcggaaccaatagcgg

SEQ ID NO: 611863 - DNA, 25 bp, Rattus norvegicus
atcgggagagccatgcggaaccaat

SEQ ID NO: 611864 - DNA, 25 bp, Rattus norvegicus
ccgcggaataagcaatcgtctgcca

SEQ ID NO: 611865 - DNA, 25 bp, Rattus norvegicus
ctgcctgagctatcgggagagccat

SEQ ID NO: 611866 - DNA, 25 bp, Rattus norvegicus
tctgccaggactgcggtgagctgct

SEQ ID NO: 611867 - DNA, 25 bp, Rattus norvegicus
aggcgcggtcacctgcctgagctat

SEQ ID NO: 611868 - DNA, 25 bp, Rattus norvegicus
agctatcgggagagccatgcggaac

SEQ ID NO: 611869 - DNA, 25 bp, Rattus norvegicus
catcctctggccgacgtcttgaagg

SEQ ID NO: 611870 - DNA, 25 bp, Rattus norvegicus
cgcaggcgcggagttagacctcgcc

SEQ ID NO: 611871 - DNA, 25 bp, Rattus norvegicus
gcggagttagacctcgccgtagccc

SEQ ID NO: 611872 - DNA, 25 bp, Rattus norvegicus
ggactcttcatccacagtgggtccg

SEQ ID NO: 611873 - DNA, 25 bp, Rattus norvegicus
ttcatccacagtgggtccgctggcc

SEQ ID NO: 611874 - DNA, 25 bp, Rattus norvegicus
tccgctggcccataggggcgctttc

SEQ ID NO: 611875 - DNA, 25 bp, Rattus norvegicus
cccaatggcggagctgaggcctagc

SEQ ID NO: 611876 - DNA, 25 bp, Rattus norvegicus
gggactccacgccatctacggagag

SEQ ID NO: 611877 - DNA, 25 bp, Rattus norvegicus
atctacggagagtgccgccgcctct

SEQ ID NO: 611878 - DNA, 25 bp, Rattus norvegicus
cgctccaggttaccgctatcgtcaa

SEQ ID NO: 611879 - DNA, 25 bp, Rattus norvegicus
ccgctatcgtcaagtactggtatgc

SEQ ID NO: 611880 - DNA, 25 bp, Rattus norvegicus
caagtactggtatgctctgggcctc

SEQ ID NO: 611881 - DNA, 25 bp, Rattus norvegicus
ccgacgtcttgaaggctccgacttg

SEQ ID NO: 611882 - DNA, 25 bp, Rattus norvegicus
cttgaaggctccgacttgggcggac

SEQ ID NO: 611883 - DNA, 25 bp, Rattus norvegicus
gcttctatcgcccttatccgggagc

SEQ ID NO: 611884 - DNA, 25 bp, Rattus norvegicus
ccgtcagtgggtctcgcgggcccaa

SEQ ID NO: 611885 - DNA, 25 bp, Rattus norvegicus
aaccggggccagagacagtgtgccc

SEQ ID NO: 611886 - DNA, 25 bp, Rattus norvegicus
ctcactctgcttctaacccattgta

SEQ ID NO: 611887 - DNA, 25 bp, Rattus norvegicus
ccagagacagtgtgcccagtgtgcc

SEQ ID NO: 611888 - DNA, 25 bp, Rattus norvegicus
gaccggccttgatgtagggacaccc

SEQ ID NO: 611889 - DNA, 25 bp, Rattus norvegicus
tccgagtagcgggaccggccttgat

SEQ ID NO: 611890 - DNA, 25 bp, Rattus norvegicus
gtgctgattaaaggcgccgcctgcc

SEQ ID NO: 611891 - DNA, 25 bp, Rattus norvegicus
ccagcgggtgctgattaaaggcgcc

SEQ ID NO: 611892 - DNA, 25 bp, Rattus norvegicus
gagcgcccttcctcgctgagctggt

SEQ ID NO: 611893 - DNA, 25 bp, Rattus norvegicus
ctagtaccgggtgggctgaaccagc

SEQ ID NO: 611894 - DNA, 25 bp, Rattus norvegicus
cccgtgctgttccaggcagggacga

SEQ ID NO: 611895 - DNA, 25 bp, Rattus norvegicus
tatttcgctagtaccgggtgggctg

SEQ ID NO: 611896 - DNA, 25 bp, Rattus norvegicus
aacccattgtatgcggggcagctgc

SEQ ID NO: 611897 - DNA, 25 bp, Rattus norvegicus
agctgccgtgcaaacacaacttctg

SEQ ID NO: 611898 - DNA, 25 bp, Rattus norvegicus
tccgtttctatttgtgaagggagga

SEQ ID NO: 611899 - DNA, 25 bp, Rattus norvegicus
ggccggggactggaatttcatctga

SEQ ID NO: 611900 - DNA, 25 bp, Rattus norvegicus
cgcggccgaactagatttcctggtc

SEQ ID NO: 611901 - DNA, 25 bp, Rattus norvegicus
gctcgcagcagccaagagggagcca

SEQ ID NO: 611902 - DNA, 25 bp, Rattus norvegicus
accgtcaccgccaaaggaagagtgc

SEQ ID NO: 611903 - DNA, 25 bp, Rattus norvegicus
ggcggcctgttatatggaatttgga

SEQ ID NO: 611904 - DNA, 25 bp, Rattus norvegicus
ggaatttggaccacggcgctcctct

SEQ ID NO: 611905 - DNA, 25 bp, Rattus norvegicus
tcccgctaggctctcgccaggagga

SEQ ID NO: 611906 - DNA, 25 bp, Rattus norvegicus
tgggtcctcagctgcaccagactga

SEQ ID NO: 611907 - DNA, 25 bp, Rattus norvegicus
ggcggagaattggaagaactgcttt

SEQ ID NO: 611908 - DNA, 25 bp, Rattus norvegicus
actgctttgaggaggagctcatctg

SEQ ID NO: 611909 - DNA, 25 bp, Rattus norvegicus
cccatctgcctgcacgttttcgtgg

SEQ ID NO: 611910 - DNA, 25 bp, Rattus norvegicus
cacgttttcgtggaaccggtgcagc

SEQ ID NO: 611911 - DNA, 25 bp, Rattus norvegicus
ttcctagtcagcttcgtctggtggc

SEQ ID NO: 611912 - DNA, 25 bp, Rattus norvegicus
ttctgctttcctagtcagcttcgtc

SEQ ID NO: 611913 - DNA, 25 bp, Rattus norvegicus
gcgacacttcagttctgctttccta

SEQ ID NO: 611914 - DNA, 25 bp, Rattus norvegicus
ggcctagccgcgacacttcagttct

SEQ ID NO: 611915 - DNA, 25 bp, Rattus norvegicus
tcagcttcgtctggtggctgtcgcg

SEQ ID NO: 611916 - DNA, 25 bp, Rattus norvegicus
cctgtggcctgtgattggtcggaaa

SEQ ID NO: 611917 - DNA, 25 bp, Rattus norvegicus
ggaggtgcaaaaccgcccacgtggc

SEQ ID NO: 611918 - DNA, 25 bp, Rattus norvegicus
gcgcgccaaagcacccgcccattgc

SEQ ID NO: 611919 - DNA, 25 bp, Rattus norvegicus
caaagtgcgcaagcgcgccaaagca

SEQ ID NO: 611920 - DNA, 25 bp, Rattus norvegicus
tctctacccaaagtgcgcaagcgcg

SEQ ID NO: 611921 - DNA, 25 bp, Rattus norvegicus
cacgcacagcgaaggagcagagcag

SEQ ID NO: 611922 - DNA, 25 bp, Rattus norvegicus
aaaccgcccacgtggctggccggag

SEQ ID NO: 611923 - DNA, 25 bp, Rattus norvegicus
gtccctcgcacgcacagcgaaggag

SEQ ID NO: 611924 - DNA, 25 bp, Rattus norvegicus
cctgcgggaggtgcaaaaccgccca

SEQ ID NO: 611925 - DNA, 25 bp, Rattus norvegicus
ttcccccgcgccgaacaagtcatcc

SEQ ID NO: 611926 - DNA, 25 bp, Rattus norvegicus
cccaacacttgtccaacttgtttct

SEQ ID NO: 611927 - DNA, 25 bp, Rattus norvegicus
cttattttacctaccgcgcgcgcga

SEQ ID NO: 611928 - DNA, 25 bp, Rattus norvegicus
gcgccgaacaagtcatccttccccg

SEQ ID NO: 611929 - DNA, 25 bp, Rattus norvegicus
cgaacaagtcatccttccccgtccg

SEQ ID NO: 611930 - DNA, 25 bp, Rattus norvegicus
cgctggcgtcctctgtgttcgccgt

SEQ ID NO: 611931 - DNA, 25 bp, Rattus norvegicus
gctggcgtcctctgtgttcgccgtt

SEQ ID NO: 611932 - DNA, 25 bp, Rattus norvegicus
ttattttacctaccgcgcgcgcgac

SEQ ID NO: 611933 - DNA, 25 bp, Rattus norvegicus
tattttacctaccgcgcgcgcgacc

SEQ ID NO: 611934 - DNA, 25 bp, Rattus norvegicus
tttcgccatcatcccgttgtctctt

SEQ ID NO: 611935 - DNA, 25 bp, Rattus norvegicus
ttcgccatcatcccgttgtctcttt

SEQ ID NO: 611936 - DNA, 25 bp, Rattus norvegicus
tgtctctttcccctcttggcgctag

SEQ ID NO: 611937 - DNA, 25 bp, Rattus norvegicus
ctttcccctcttggcgctagagctt

SEQ ID NO: 611938 - DNA, 25 bp, Rattus norvegicus
gtctctttcccctcttggcgctaga

SEQ ID NO: 611939 - DNA, 25 bp, Rattus norvegicus
caagcccgatttggtcagtcggtga

SEQ ID NO: 611940 - DNA, 25 bp, Rattus norvegicus
aacacctgcggcaccgacgtaatcg

SEQ ID NO: 611941 - DNA, 25 bp, Rattus norvegicus
cgatccttcctcttcgcacgattgg

SEQ ID NO: 611942 - DNA, 25 bp, Rattus norvegicus
cgttcgctagttgagatgatggcga

SEQ ID NO: 611943 - DNA, 25 bp, Rattus norvegicus
caggtgctgaaaggctcgcgaagct

SEQ ID NO: 611944 - DNA, 25 bp, Rattus norvegicus
tgcggcaccgacgtaatcgcgctca

SEQ ID NO: 611945 - DNA, 25 bp, Rattus norvegicus
tctcacggaaaaggtgaacacctgc

SEQ ID NO: 611946 - DNA, 25 bp, Rattus norvegicus
gggcttctcacggaaaaggtgaaca

SEQ ID NO: 611947 - DNA, 25 bp, Rattus norvegicus
acgccggattcgcaagcccgatttg

SEQ ID NO: 611948 - DNA, 25 bp, Rattus norvegicus
ctgaggcgttcgctagttgagatga

SEQ ID NO: 611949 - DNA, 25 bp, Rattus norvegicus
actcgccgtcgtccggctgaggcgt

SEQ ID NO: 611950 - DNA, 25 bp, Rattus norvegicus
tggacgctgtgcgtctttttggccc

SEQ ID NO: 611951 - DNA, 25 bp, Rattus norvegicus
cctcttcgcacgattggacgctgtg

SEQ ID NO: 611952 - DNA, 25 bp, Rattus norvegicus
atcgcgctcaccaagcaggtgctga

SEQ ID NO: 611953 - DNA, 25 bp, Rattus norvegicus
tcttgattggttggcagacctgcct

SEQ ID NO: 611954 - DNA, 25 bp, Rattus norvegicus
cgccgcactgcccacttggaagatg

SEQ ID NO: 611955 - DNA, 25 bp, Rattus norvegicus
gagatcgagatcaaaccgctgcgca

SEQ ID NO: 611956 - DNA, 25 bp, Rattus norvegicus
taccacgacggtgaggacaccaaga

SEQ ID NO: 611957 - DNA, 25 bp, Rattus norvegicus
gagaccacctggatttaccacgacg

SEQ ID NO: 611958 - DNA, 25 bp, Rattus norvegicus
gcaagtcttattacctgtgcacgtc

SEQ ID NO: 611959 - DNA, 25 bp, Rattus norvegicus
ccgctgcgcaagatggagaagagca

SEQ ID NO: 611960 - DNA, 25 bp, Rattus norvegicus
ccgcacatcgggcatcattgagatc

SEQ ID NO: 611961 - DNA, 25 bp, Rattus norvegicus
atggtcccgcatcgccttcactgag

SEQ ID NO: 611962 - DNA, 25 bp, Rattus norvegicus
gactgtgatcatcggactgcggctg

SEQ ID NO: 611963 - DNA, 25 bp, Rattus norvegicus
ctgtggagcttgtgaacccgaagta

SEQ ID NO: 611964 - DNA, 25 bp, Rattus norvegicus
caccctatgattggctgtggagctt

SEQ ID NO: 611965 - DNA, 25 bp, Rattus norvegicus
agctggctcagtccgaatcagtgtc

SEQ ID NO: 611966 - DNA, 25 bp, Rattus norvegicus
cgggtgtacgggcagaacatcaaca

SEQ ID NO: 611967 - DNA, 25 bp, Rattus norvegicus
ccgttctcgcgagagcctggaattg

SEQ ID NO: 611968 - DNA, 25 bp, Rattus norvegicus
gagcctggaattgcctcacttccga

SEQ ID NO: 611969 - DNA, 25 bp, Rattus norvegicus
ttaggcccgagtcagtcccaaaagc

SEQ ID NO: 611970 - DNA, 25 bp, Rattus norvegicus
tgaaactcacccataacgcatgccg

SEQ ID NO: 611971 - DNA, 25 bp, Rattus norvegicus
gagtcagtcccaaaagccctcgctt

SEQ ID NO: 611972 - DNA, 25 bp, Rattus norvegicus
tgactacactacttccgggcgcggc

SEQ ID NO: 611973 - DNA, 25 bp, Rattus norvegicus
caggaaagctgctccgttctcgcga

SEQ ID NO: 611974 - DNA, 25 bp, Rattus norvegicus
cgctatggttacaggaaagctgctc

SEQ ID NO: 611975 - DNA, 25 bp, Rattus norvegicus
cgcatgccgcgtcgctatggttaca

SEQ ID NO: 611976 - DNA, 25 bp, Rattus norvegicus
cagcccttcgccgtccgggagtagg

SEQ ID NO: 611977 - DNA, 25 bp, Rattus norvegicus
ccgggagtaggcttcccagtcaact

SEQ ID NO: 611978 - DNA, 25 bp, Rattus norvegicus
gccagcggcaatcccaagcagtctt

SEQ ID NO: 611979 - DNA, 25 bp, Rattus norvegicus
aatcccaagcagtcttaccagccgt

SEQ ID NO: 611980 - DNA, 25 bp, Rattus norvegicus
gcttcctgactacactacttccggg

SEQ ID NO: 611981 - DNA, 25 bp, Rattus norvegicus
aaccacggcaggtgagttggagtcc

SEQ ID NO: 611982 - DNA, 25 bp, Rattus norvegicus
cgccggcgggatcgctaggaccttc

SEQ ID NO: 611983 - DNA, 25 bp, Rattus norvegicus
cccagagcatccgtgagcttggaaa

SEQ ID NO: 611984 - DNA, 25 bp, Rattus norvegicus
agtcctgtgcgagagaaccacggca

SEQ ID NO: 611985 - DNA, 25 bp, Rattus norvegicus
gggctgctcggtcctctgtttctca

SEQ ID NO: 611986 - DNA, 25 bp, Rattus norvegicus
tgtttctcagctgccttgtctcagg

SEQ ID NO: 611987 - DNA, 25 bp, Rattus norvegicus
ttgtctcaggtctggcgaacaagac

SEQ ID NO: 611988 - DNA, 25 bp, Rattus norvegicus
cttctggaaagacgcgctgcggtcc

SEQ ID NO: 611989 - DNA, 25 bp, Rattus norvegicus
cagcctagtgtgagcgcaacagtgc

SEQ ID NO: 611990 - DNA, 25 bp, Rattus norvegicus
actgtgtggatgctactgcgtgtcc

SEQ ID NO: 611991 - DNA, 25 bp, Rattus norvegicus
cagatgatcgcctagggctcgggct

SEQ ID NO: 611992 - DNA, 25 bp, Rattus norvegicus
ccggagtattcgtccacagagctgc

SEQ ID NO: 611993 - DNA, 25 bp, Rattus norvegicus
ccctccggacaggtgtgtgcgcttc

SEQ ID NO: 611994 - DNA, 25 bp, Rattus norvegicus
cgtggggctgcccttctggaaagac

SEQ ID NO: 611995 - DNA, 25 bp, Rattus norvegicus
gccaggctcgcagcccatgagggct

SEQ ID NO: 611996 - DNA, 25 bp, Rattus norvegicus
ggcagatccaaaccctgccaggctc

SEQ ID NO: 611997 - DNA, 25 bp, Rattus norvegicus
gcgcaccacaaaactggctcgtggg

SEQ ID NO: 611998 - DNA, 25 bp, Rattus norvegicus
cggacgctgggaaacaatggcgcga

SEQ ID NO: 611999 - DNA, 25 bp, Rattus norvegicus
cgctcggctgtgcatcctcctcagc

SEQ ID NO: 612000 - DNA, 25 bp, Rattus norvegicus
caaaactggctcgtgggccattccc

SEQ ID NO: 612001 - DNA, 25 bp, Rattus norvegicus
tacagggccctgaggaaagagacgc

SEQ ID NO: 612002 - DNA, 25 bp, Rattus norvegicus
accaaaggaactgagcgcgtcgccc

SEQ ID NO: 612003 - DNA, 25 bp, Rattus norvegicus
ctgccgagagagaccaaaggaactg

SEQ ID NO: 612004 - DNA, 25 bp, Rattus norvegicus
aggatgcctgccgagagagaccaaa

SEQ ID NO: 612005 - DNA, 25 bp, Rattus norvegicus
gaactgaggccaggatgcctgccga

SEQ ID NO: 612006 - DNA, 25 bp, Rattus norvegicus
tcacgagaactgaggccaggatgcc

SEQ ID NO: 612007 - DNA, 25 bp, Rattus norvegicus
agggctcccgtctcacgagaactga

SEQ ID NO: 612008 - DNA, 25 bp, Rattus norvegicus
atgagggctcccgtctcacgagaac

SEQ ID NO: 612009 - DNA, 25 bp, Rattus norvegicus
atccgcgcccagtatgagtccttgg

SEQ ID NO: 612010 - DNA, 25 bp, Rattus norvegicus
ctgtggctaaaccagacctgacttc

SEQ ID NO: 612011 - DNA, 25 bp, Rattus norvegicus
ggccacgctgcaggcgtcttcgcaa

SEQ ID NO: 612012 - DNA, 25 bp, Rattus norvegicus
tgcaccagctggagacgcagaaccg

SEQ ID NO: 612013 - DNA, 25 bp, Rattus norvegicus
tgttcatcgaaaaggtgcaccagct

SEQ ID NO: 612014 - DNA, 25 bp, Rattus norvegicus
tccgcactaacgagaaggagcagct

SEQ ID NO: 612015 - DNA, 25 bp, Rattus norvegicus
gcagcggcgcgcaccaacgagtaca

SEQ ID NO: 612016 - DNA, 25 bp, Rattus norvegicus
ctccgacgggctggacctgagccaa

SEQ ID NO: 612017 - DNA, 25 bp, Rattus norvegicus
gtcgctgtcccgcagcaatgtggcc

SEQ ID NO: 612018 - DNA, 25 bp, Rattus norvegicus
ggcagctttcgctcgcagtcgctgt

SEQ ID NO: 612019 - DNA, 25 bp, Rattus norvegicus
cttcggatcagagcactacttgtgc

SEQ ID NO: 612020 - DNA, 25 bp, Rattus norvegicus
ccttggccgctaagaacctgcagtc

SEQ ID NO: 612021 - DNA, 25 bp, Rattus norvegicus
gaccgcttcgcggtgttcatcgaaa

SEQ ID NO: 612022 - DNA, 25 bp, Rattus norvegicus
ccggcaccatgagcttcggatcaga

SEQ ID NO: 612023 - DNA, 25 bp, Rattus norvegicus
cgtccggactccagacgcagagaga

SEQ ID NO: 612024 - DNA, 25 bp, Rattus norvegicus
atgtggttcacctaggcagtcccta

SEQ ID NO: 612025 - DNA, 25 bp, Rattus norvegicus
agctccagcgtcaacggcaaccgta

SEQ ID NO: 612026 - DNA, 25 bp, Rattus norvegicus
ctagcgcgcgagtagagcacgagcc

SEQ ID NO: 612027 - DNA, 25 bp, Rattus norvegicus
cagaaaccaggcgagctgagcgcga

SEQ ID NO: 612028 - DNA, 25 bp, Rattus norvegicus
gggttgtcgatacctcttcctcgtc

SEQ ID NO: 612029 - DNA, 25 bp, Rattus norvegicus
ctccatggcggggatcagaaaccag

SEQ ID NO: 612030 - DNA, 25 bp, Rattus norvegicus
cgcttgttttccgtggcgtccgtct

SEQ ID NO: 612031 - DNA, 25 bp, Rattus norvegicus
cttggcctcagaggcgcgcttgttt

SEQ ID NO: 612032 - DNA, 25 bp, Rattus norvegicus
catggccgaggctcgcttggcctca

SEQ ID NO: 612033 - DNA, 25 bp, Rattus norvegicus
gtagtcctcgaagcggcctctcaag

SEQ ID NO: 612034 - DNA, 25 bp, Rattus norvegicus
cgcagagagaagtggctcatctctt

SEQ ID NO: 612035 - DNA, 25 bp, Rattus norvegicus
agctacactggtgccgcgagctcca

SEQ ID NO: 612036 - DNA, 25 bp, Rattus norvegicus
ttccaactcttcatcgtagtcctcg

SEQ ID NO: 612037 - DNA, 25 bp, Rattus norvegicus
agcaacctccgcgaggccgaagagg

SEQ ID NO: 612038 - DNA, 25 bp, Rattus norvegicus
agcctcaggtcctgcggctccggga

SEQ ID NO: 612039 - DNA, 25 bp, Rattus norvegicus
cgaggccgaagaggcactgcgccgt

SEQ ID NO: 612040 - DNA, 25 bp, Rattus norvegicus
cactgcgccgtgaggcccggctgct

SEQ ID NO: 612041 - DNA, 25 bp, Rattus norvegicus
gaggcggctagtgcgcttctcagcc

SEQ ID NO: 612042 - DNA, 25 bp, Rattus norvegicus
ttctcagccgggtcaccgcttcagt

SEQ ID NO: 612043 - DNA, 25 bp, Rattus norvegicus
caccgcttcagttcccggctctgcg

SEQ ID NO: 612044 - DNA, 25 bp, Rattus norvegicus
cttcggtgacctcagtgttctcagg

SEQ ID NO: 612045 - DNA, 25 bp, Rattus norvegicus
cggtgacctcagtgttctcaggttc

SEQ ID NO: 612046 - DNA, 25 bp, Rattus norvegicus
gacctcagtgttctcaggttcagcc

SEQ ID NO: 612047 - DNA, 25 bp, Rattus norvegicus
ctcagtgttctcaggttcagcctca

SEQ ID NO: 612048 - DNA, 25 bp, Rattus norvegicus
agtgttctcaggttcagcctcaggt

SEQ ID NO: 612049 - DNA, 25 bp, Rattus norvegicus
agtctcggggtaccgggtgagcagt

SEQ ID NO: 612050 - DNA, 25 bp, Rattus norvegicus
ggcagagcaacctccgcgaggccga

SEQ ID NO: 612051 - DNA, 25 bp, Rattus norvegicus
gctgtcggctcactgttctgtgcgt

SEQ ID NO: 612052 - DNA, 25 bp, Rattus norvegicus
aaactcgcggtgctgaggcttgtta

SEQ ID NO: 612053 - DNA, 25 bp, Rattus norvegicus
cccacaaaaagaaaacctcgcgctg

SEQ ID NO: 612054 - DNA, 25 bp, Rattus norvegicus
cggccagattctagtcgtccctaca

SEQ ID NO: 612055 - DNA, 25 bp, Rattus norvegicus
gtccctacaaagctcagtcaccgat

SEQ ID NO: 612056 - DNA, 25 bp, Rattus norvegicus
cgatccgagcaaccgagaacgtctt

SEQ ID NO: 612057 - DNA, 25 bp, Rattus norvegicus
tcgtccgaatcacaaactctgcagc

SEQ ID NO: 612058 - DNA, 25 bp, Rattus norvegicus
agccgatgtccttcaacaaacccag

SEQ ID NO: 612059 - DNA, 25 bp, Rattus norvegicus
ggctataaaatcaagtcccgccctc

SEQ ID NO: 612060 - DNA, 25 bp, Rattus norvegicus
ctgtctcagccggagtctgatccga

SEQ ID NO: 612061 - DNA, 25 bp, Rattus norvegicus
gagtctgatccgacgtcataacgga

SEQ ID NO: 612062 - DNA, 25 bp, Rattus norvegicus
tcataacggaaataggcctggcctt

SEQ ID NO: 612063 - DNA, 25 bp, Rattus norvegicus
cctggccttacctgggctcttggaa

SEQ ID NO: 612064 - DNA, 25 bp, Rattus norvegicus
tctgtgcgtgcgattgctttgaagc

SEQ ID NO: 612065 - DNA, 25 bp, Rattus norvegicus
cgaagccaaagaaacggcgcacgtt

SEQ ID NO: 612066 - DNA, 25 bp, Rattus norvegicus
tcatccttgttgagagccacgaagc

SEQ ID NO: 612067 - DNA, 25 bp, Rattus norvegicus
gctgtgtgccttccaccgggaactt

SEQ ID NO: 612068 - DNA, 25 bp, Rattus norvegicus
tgagagccacgaagccaaagaaacg

SEQ ID NO: 612069 - DNA, 25 bp, Rattus norvegicus
ccgggaacttggtgaccagctcttc

SEQ ID NO: 612070 - DNA, 25 bp, Rattus norvegicus
accagctcttcgtcatccttgttga

SEQ ID NO: 612071 - DNA, 25 bp, Rattus norvegicus
gtactgcgcccagtaggcctcctgg

SEQ ID NO: 612072 - DNA, 25 bp, Rattus norvegicus
gtcctcgttggtgcggtactgcgcc

SEQ ID NO: 612073 - DNA, 25 bp, Rattus norvegicus
tgcgctggaacagctggtcctcgtt

SEQ ID NO: 612074 - DNA, 25 bp, Rattus norvegicus
tgcacctctgccgtgcgctggaaca

SEQ ID NO: 612075 - DNA, 25 bp, Rattus norvegicus
tcgaatgcacctctgccgtgcgctg

SEQ ID NO: 612076 - DNA, 25 bp, Rattus norvegicus
ttggcggccagcaccctcgaatgca

SEQ ID NO: 612077 - DNA, 25 bp, Rattus norvegicus
aaacggcgcacgttgttggcggcca

SEQ ID NO: 612078 - DNA, 25 bp, Rattus norvegicus
cccggtgatagcgttccactgtggc

SEQ ID NO: 612079 - DNA, 25 bp, Rattus norvegicus
ccatcgtagatttcagggcaaggta

SEQ ID NO: 612080 - DNA, 25 bp, Rattus norvegicus
accacaggggcgatgagcgctcgct

SEQ ID NO: 612081 - DNA, 25 bp, Rattus norvegicus
ttcagggcaaggtacacgagccagc

SEQ ID NO: 612082 - DNA, 25 bp, Rattus norvegicus
cacgagccagcaggcgagcaagttc

SEQ ID NO: 612083 - DNA, 25 bp, Rattus norvegicus
agcaagttctggagcaggcaggccc

SEQ ID NO: 612084 - DNA, 25 bp, Rattus norvegicus
accaggctcccattgcctagcgtgg

SEQ ID NO: 612085 - DNA, 25 bp, Rattus norvegicus
attgcctagcgtggccaccggcacg

SEQ ID NO: 612086 - DNA, 25 bp, Rattus norvegicus
ccggcacggctgtgcagaaagcaca

SEQ ID NO: 612087 - DNA, 25 bp, Rattus norvegicus
aagcacagaggaaacacttgccgtc

SEQ ID NO: 612088 - DNA, 25 bp, Rattus norvegicus
acttgccgtccagcagtgtgactgc

SEQ ID NO: 612089 - DNA, 25 bp, Rattus norvegicus
gtgtgactgccacccagaccacagg

SEQ ID NO: 612090 - DNA, 25 bp, Rattus norvegicus
tcgctgggccatggaacagaacatg

SEQ ID NO: 612091 - DNA, 25 bp, Rattus norvegicus
gccagcagccagttcccatcgtaga

SEQ ID NO: 612092 - DNA, 25 bp, Rattus norvegicus
acagaacatgtagcgtagcacggca

SEQ ID NO: 612093 - DNA, 25 bp, Rattus norvegicus
cgcgcgcgtgtcactaagacgctca

SEQ ID NO: 612094 - DNA, 25 bp, Rattus norvegicus
cccacatctggtagtgcgggcgcgc

SEQ ID NO: 612095 - DNA, 25 bp, Rattus norvegicus
taagacgctcattcaccggcgcagc

SEQ ID NO: 612096 - DNA, 25 bp, Rattus norvegicus
attcaccggcgcagctgtcgccata

SEQ ID NO: 612097 - DNA, 25 bp, Rattus norvegicus
tgtcgccataacaaccggagcccgg

SEQ ID NO: 612098 - DNA, 25 bp, Rattus norvegicus
accgccaagcccagggagagccaga

SEQ ID NO: 612099 - DNA, 25 bp, Rattus norvegicus
agagccagagacagcgaaccgcccg

SEQ ID NO: 612100 - DNA, 25 bp, Rattus norvegicus
ggccgatgccatgggtaacaacttc

SEQ ID NO: 612101 - DNA, 25 bp, Rattus norvegicus
tgggtaacaacttctccagtgtctc

SEQ ID NO: 612102 - DNA, 25 bp, Rattus norvegicus
tccagtgtctcctctctgcagcgag

SEQ ID NO: 612103 - DNA, 25 bp, Rattus norvegicus
ctcaaaggtaagcttcgccggccgg

SEQ ID NO: 612104 - DNA, 25 bp, Rattus norvegicus
tgccacctgttgtgtgcatttggac

SEQ ID NO: 612105 - DNA, 25 bp, Rattus norvegicus
cggtagcagctgaccggtgctgacc

SEQ ID NO: 612106 - DNA, 25 bp, Rattus norvegicus
cttcgagaacttatagccagcggga

SEQ ID NO: 612107 - DNA, 25 bp, Rattus norvegicus
acatcctgggcctggtggtcaatgc

SEQ ID NO: 612108 - DNA, 25 bp, Rattus norvegicus
tctggatgctcttcagcctgcacgg

SEQ ID NO: 612109 - DNA, 25 bp, Rattus norvegicus
gcatgcagctatgcgtggacgcctc

SEQ ID NO: 612110 - DNA, 25 bp, Rattus norvegicus
aatgcggacggagagctgcacctaa

SEQ ID NO: 612111 - DNA, 25 bp, Rattus norvegicus
gcctctgcacagtggtgacatcctg

SEQ ID NO: 612112 - DNA, 25 bp, Rattus norvegicus
tccttcggggtcaccacgtgtgacc

SEQ ID NO: 612113 - DNA, 25 bp, Rattus norvegicus
tcttcatcaaggtcacgcgctcagg

SEQ ID NO: 612114 - DNA, 25 bp, Rattus norvegicus
gcgtggccgagaccatcttcatcaa

SEQ ID NO: 612115 - DNA, 25 bp, Rattus norvegicus
ccgcatcctggacgagcaaaccgtg

SEQ ID NO: 612116 - DNA, 25 bp, Rattus norvegicus
tgtctgtgagcctgtgcgacctcaa

SEQ ID NO: 612117 - DNA, 25 bp, Rattus norvegicus
catctttagtgctggtggcgcactc

SEQ ID NO: 612118 - DNA, 25 bp, Rattus norvegicus
tgcacctgagcataacatctttagt

SEQ ID NO: 612119 - DNA, 25 bp, Rattus norvegicus
ttcgcttcccgtctttgcacctgag

SEQ ID NO: 612120 - DNA, 25 bp, Rattus norvegicus
gctgcacctaagtcacaacggcgcg

SEQ ID NO: 612121 - DNA, 25 bp, Rattus norvegicus
gctccgagttctcttgtttcttata

SEQ ID NO: 612122 - DNA, 25 bp, Rattus norvegicus
aggcactcaccgctttcgttcttct

SEQ ID NO: 612123 - DNA, 25 bp, Rattus norvegicus
accgctttcgttcttctcgatgaca

SEQ ID NO: 612124 - DNA, 25 bp, Rattus norvegicus
tggaggctcagctccgagttctctt

SEQ ID NO: 612125 - DNA, 25 bp, Rattus norvegicus
ctcttgtttcttatagttggacacc

SEQ ID NO: 612126 - DNA, 25 bp, Rattus norvegicus
agttggacaccaccacgtactgttc

SEQ ID NO: 612127 - DNA, 25 bp, Rattus norvegicus
caccacgtactgttccaggatcatg

SEQ ID NO: 612128 - DNA, 25 bp, Rattus norvegicus
tactgttccaggatcatgggctcgg

SEQ ID NO: 612129 - DNA, 25 bp, Rattus norvegicus
aaagcacgcggtgagccagcggcca

SEQ ID NO: 612130 - DNA, 25 bp, Rattus norvegicus
tccatcgccctcgagggaggctgca

SEQ ID NO: 612131 - DNA, 25 bp, Rattus norvegicus
aggctgcacggtcgccagctctgca

SEQ ID NO: 612132 - DNA, 25 bp, Rattus norvegicus
caaggacaggccatatagcaaggcc

SEQ ID NO: 612133 - DNA, 25 bp, Rattus norvegicus
tcttctcgatgacatctactacctc

SEQ ID NO: 612134 - DNA, 25 bp, Rattus norvegicus
ccgtggccagggctcgcagcttgct

SEQ ID NO: 612135 - DNA, 25 bp, Rattus norvegicus
gtctccgctttggaatgcgctaatg

SEQ ID NO: 612136 - DNA, 25 bp, Rattus norvegicus
catgggcaaccactcagcgaagctg

SEQ ID NO: 612137 - DNA, 25 bp, Rattus norvegicus
tgaaattacctgtgctcgctgggcg

SEQ ID NO: 612138 - DNA, 25 bp, Rattus norvegicus
gcgctaatggggttgtgaaattacc

SEQ ID NO: 612139 - DNA, 25 bp, Rattus norvegicus
gggctcgaggcaaggtgaacttccc

SEQ ID NO: 612140 - DNA, 25 bp, Rattus norvegicus
ctggaggaacccgagacaggtctgt

SEQ ID NO: 612141 - DNA, 25 bp, Rattus norvegicus
caaggtgaacttcccgggccgtgag

SEQ ID NO: 612142 - DNA, 25 bp, Rattus norvegicus
tcggaatctgccgaacatgggcaac

SEQ ID NO: 612143 - DNA, 25 bp, Rattus norvegicus
ccagctggcggccatcggaatctgc

SEQ ID NO: 612144 - DNA, 25 bp, Rattus norvegicus
agtggaccagcggacgctaccgcct

SEQ ID NO: 612145 - DNA, 25 bp, Rattus norvegicus
ctctttctttgactggagtggacca

SEQ ID NO: 612146 - DNA, 25 bp, Rattus norvegicus
gcgctcggctctttctttgactgga

SEQ ID NO: 612147 - DNA, 25 bp, Rattus norvegicus
gggaactggaaagcgctcggctctt

SEQ ID NO: 612148 - DNA, 25 bp, Rattus norvegicus
gagcctcgtctgacggactacagga

SEQ ID NO: 612149 - DNA, 25 bp, Rattus norvegicus
gaacccacgttctgccaactcggga

SEQ ID NO: 612150 - DNA, 25 bp, Rattus norvegicus
ttgggcagcgcgctccgctcacctt

SEQ ID NO: 612151 - DNA, 25 bp, Rattus norvegicus
cactgcgctcccgaacccggcccgg

SEQ ID NO: 612152 - DNA, 25 bp, Rattus norvegicus
cgccgcacttgttgcttggggaccc

SEQ ID NO: 612153 - DNA, 25 bp, Rattus norvegicus
caccgttcgccgcacttgttgcttg

SEQ ID NO: 612154 - DNA, 25 bp, Rattus norvegicus
aggtctccctgaggtccgcgcccac

SEQ ID NO: 612155 - DNA, 25 bp, Rattus norvegicus
gacaacttcccacccgccgcgcagg

SEQ ID NO: 612156 - DNA, 25 bp, Rattus norvegicus
gttctgccaactcgggaccacgagc

SEQ ID NO: 612157 - DNA, 25 bp, Rattus norvegicus
tgggtgtgaacccacgttctgccaa

SEQ ID NO: 612158 - DNA, 25 bp, Rattus norvegicus
gtcacttcggctggccgagtctgtg

SEQ ID NO: 612159 - DNA, 25 bp, Rattus norvegicus
ccacagtgaggttcacaggggagca

SEQ ID NO: 612160 - DNA, 25 bp, Rattus norvegicus
gcccggccacagtgaggttcacagg

SEQ ID NO: 612161 - DNA, 25 bp, Rattus norvegicus
ccgagtctgtgggtgtgaacccacg

SEQ ID NO: 612162 - DNA, 25 bp, Rattus norvegicus
taaccactcttcgcgagtcttccgg

SEQ ID NO: 612163 - DNA, 25 bp, Rattus norvegicus
ggctgcgccgctccgggtgcttctg

SEQ ID NO: 612164 - DNA, 25 bp, Rattus norvegicus
cgcgctgcaatacccgcccgccgcc

SEQ ID NO: 612165 - DNA, 25 bp, Rattus norvegicus
ttctgctcatgtgatgccgcggccg

SEQ ID NO: 612166 - DNA, 25 bp, Rattus norvegicus
tctgctcatgtgatgccgcggccgg

SEQ ID NO: 612167 - DNA, 25 bp, Rattus norvegicus
cggcgcgctccgcagttgcacgcac

SEQ ID NO: 612168 - DNA, 25 bp, Rattus norvegicus
gcagttgcacgcactgcgcgctgca

SEQ ID NO: 612169 - DNA, 25 bp, Rattus norvegicus
cagttgcacgcactgcgcgctgcaa

SEQ ID NO: 612170 - DNA, 25 bp, Rattus norvegicus
gttgcacgcactgcgcgctgcaata

SEQ ID NO: 612171 - DNA, 25 bp, Rattus norvegicus
tccgcagcctgaacccgaaccgcgc

SEQ ID NO: 612172 - DNA, 25 bp, Rattus norvegicus
cgccagcggcgcgatcatactcctc

SEQ ID NO: 612173 - DNA, 25 bp, Rattus norvegicus
agcggcgcgatcatactcctcgccc

SEQ ID NO: 612174 - DNA, 25 bp, Rattus norvegicus
tgcagctccgcagcctgaacccgaa

SEQ ID NO: 612175 - DNA, 25 bp, Rattus norvegicus
cttctgctcatgtgatgccgcggcc

SEQ ID NO: 612176 - DNA, 25 bp, Rattus norvegicus
acgcactgcgcgctgcaatacccgc

SEQ ID NO: 612177 - DNA, 25 bp, Rattus norvegicus
gagcatcacttacgaggaaatgacc

SEQ ID NO: 612178 - DNA, 25 bp, Rattus norvegicus
gcggggcagtcaaccgtgcctccga

SEQ ID NO: 612179 - DNA, 25 bp, Rattus norvegicus
gggcagtcaaccgtgcctccgagac

SEQ ID NO: 612180 - DNA, 25 bp, Rattus norvegicus
agtcaaccgtgcctccgagaccaca

SEQ ID NO: 612181 - DNA, 25 bp, Rattus norvegicus
cgagaccacagaccacatttgccta

SEQ ID NO: 612182 - DNA, 25 bp, Rattus norvegicus
cacatttgcctactcgtgtctggag

SEQ ID NO: 612183 - DNA, 25 bp, Rattus norvegicus
ttgcctactcgtgtctggagtcaga

SEQ ID NO: 612184 - DNA, 25 bp, Rattus norvegicus
tactcgtgtctggagtcagagcatc

SEQ ID NO: 612185 - DNA, 25 bp, Rattus norvegicus
ggagtcagagcatcacttacgagga

SEQ ID NO: 612186 - DNA, 25 bp, Rattus norvegicus
gtctggagtcagagcatcacttacg

SEQ ID NO: 612187 - DNA, 25 bp, Rattus norvegicus
aagggtcacgtccagaggagggata

SEQ ID NO: 612188 - DNA, 25 bp, Rattus norvegicus
gataaaaggaaaagccacaattctc

SEQ ID NO: 612189 - DNA, 25 bp, Rattus norvegicus
cgtgtctggagtcagagcatcactt

SEQ ID NO: 612190 - DNA, 25 bp, Rattus norvegicus
tcagagcatcacttacgaggaaatg

SEQ ID NO: 612191 - DNA, 25 bp, Rattus norvegicus
aaaagcatcccaggccgagtgcgtg

SEQ ID NO: 612192 - DNA, 25 bp, Rattus norvegicus
cacaatggttttaagaaggaaatca

SEQ ID NO: 612193 - DNA, 25 bp, Rattus norvegicus
agccacaattctcctcacaccgcgg

SEQ ID NO: 612194 - DNA, 25 bp, Rattus norvegicus
cacaccgcgggacacaatggtttta

SEQ ID NO: 612195 - DNA, 25 bp, Rattus norvegicus
cgcgggacacaatggttttaagaag

SEQ ID NO: 612196 - DNA, 25 bp, Rattus norvegicus
cccagccggtgcaggcagagtagca

SEQ ID NO: 612197 - DNA, 25 bp, Rattus norvegicus
aggaaatcaaagctcgaaacgaaga

SEQ ID NO: 612198 - DNA, 25 bp, Rattus norvegicus
caaagctcgaaacgaagagtagagg

SEQ ID NO: 612199 - DNA, 25 bp, Rattus norvegicus
ccggtgcaggcagagtagcaaacgt

SEQ ID NO: 612200 - DNA, 25 bp, Rattus norvegicus
aaagagaagcgtgggtctccggtca

SEQ ID NO: 612201 - DNA, 25 bp, Rattus norvegicus
aattaaaagcatcccaggccgagtg

SEQ ID NO: 612202 - DNA, 25 bp, Rattus norvegicus
cccaggccgagtgcgtgagtgtccc

SEQ ID NO: 612203 - DNA, 25 bp, Rattus norvegicus
gagaagcgtgggtctccggtcaaaa

SEQ ID NO: 612204 - DNA, 25 bp, Rattus norvegicus
gtagcaaacgtggaaggcagaaaga

SEQ ID NO: 612205 - DNA, 25 bp, Rattus norvegicus
ccgagactcccgacgtccacagctg

SEQ ID NO: 612206 - DNA, 25 bp, Rattus norvegicus
ctagtcgccaccgagactcccgacg

SEQ ID NO: 612207 - DNA, 25 bp, Rattus norvegicus
gccaccgagactcccgacgtccaca

SEQ ID NO: 612208 - DNA, 25 bp, Rattus norvegicus
agactcccgacgtccacagctgcga

SEQ ID NO: 612209 - DNA, 25 bp, Rattus norvegicus
tcccgacgtccacagctgcgactcc

SEQ ID NO: 612210 - DNA, 25 bp, Rattus norvegicus
acgtccacagctgcgactcccaggc

SEQ ID NO: 612211 - DNA, 25 bp, Rattus norvegicus
ggcaggcgactgtcccggagggcac

SEQ ID NO: 612212 - DNA, 25 bp, Rattus norvegicus
gactgtcccggagggcacgagggct

SEQ ID NO: 612213 - DNA, 25 bp, Rattus norvegicus
cggagggcacgagggctccgtgcac

SEQ ID NO: 612214 - DNA, 25 bp, Rattus norvegicus
ctccgtgcaccccaggctgctcccg

SEQ ID NO: 612215 - DNA, 25 bp, Rattus norvegicus
ctgcccgctctctctgccgcccgat

SEQ ID NO: 612216 - DNA, 25 bp, Rattus norvegicus
cccgctctctctgccgcccgatggg

SEQ ID NO: 612217 - DNA, 25 bp, Rattus norvegicus
gccgggcctgctgtcagcgcgccgg

SEQ ID NO: 612218 - DNA, 25 bp, Rattus norvegicus
tcgccaccgagactcccgacgtcca

SEQ ID NO: 612219 - DNA, 25 bp, Rattus norvegicus
ccttctcccgttgcacgggtccctg

SEQ ID NO: 612220 - DNA, 25 bp, Rattus norvegicus
gggttcctccgcttctccacgtcca

SEQ ID NO: 612221 - DNA, 25 bp, Rattus norvegicus
agtcggtggaagcagtactcacgta

SEQ ID NO: 612222 - DNA, 25 bp, Rattus norvegicus
caccacggtggcatcttgcacgcag

SEQ ID NO: 612223 - DNA, 25 bp, Rattus norvegicus
cggtggaagcagtactcacgtaatg

SEQ ID NO: 612224 - DNA, 25 bp, Rattus norvegicus
acggtggcatcttgcacgcagtagg

SEQ ID NO: 612225 - DNA, 25 bp, Rattus norvegicus
gtggcatcttgcacgcagtaggcga

SEQ ID NO: 612226 - DNA, 25 bp, Rattus norvegicus
atcttgcacgcagtaggcgagcatc

SEQ ID NO: 612227 - DNA, 25 bp, Rattus norvegicus
ttgcacgcagtaggcgagcatcttc

SEQ ID NO: 612228 - DNA, 25 bp, Rattus norvegicus
gagcatcttccccacaaagcgagtg

SEQ ID NO: 612229 - DNA, 25 bp, Rattus norvegicus
ttcaccttctcatcctggccgggtt

SEQ ID NO: 612230 - DNA, 25 bp, Rattus norvegicus
ttgcacgggtccctgcggttacgcg

SEQ ID NO: 612231 - DNA, 25 bp, Rattus norvegicus
ggaagcagtactcacgtaatgttta

SEQ ID NO: 612232 - DNA, 25 bp, Rattus norvegicus
agtactcacgtaatgtttagagggg

SEQ ID NO: 612233 - DNA, 25 bp, Rattus norvegicus
cccgggaattcctgctgctcaaatc

SEQ ID NO: 612234 - DNA, 25 bp, Rattus norvegicus
agttccggttgcgagaaggaagcta

SEQ ID NO: 612235 - DNA, 25 bp, Rattus norvegicus
ttcacgtcacgtttgtcactccgat

SEQ ID NO: 612236 - DNA, 25 bp, Rattus norvegicus
ggaattcctgctgctcaaatcccgc

SEQ ID NO: 612237 - DNA, 25 bp, Rattus norvegicus
gaagaagcccgggaattcctgctgc

SEQ ID NO: 612238 - DNA, 25 bp, Rattus norvegicus
atctcggagattcccgaagaagccc

SEQ ID NO: 612239 - DNA, 25 bp, Rattus norvegicus
gggtctcggataatctcggagattc

SEQ ID NO: 612240 - DNA, 25 bp, Rattus norvegicus
gcttttcggggtctcggataatctc

SEQ ID NO: 612241 - DNA, 25 bp, Rattus norvegicus
acgctgcgcaggcttttcggggtct

SEQ ID NO: 612242 - DNA, 25 bp, Rattus norvegicus
aggacacgcccattacacgcatagg

SEQ ID NO: 612243 - DNA, 25 bp, Rattus norvegicus
tggctaccgccagccactcccgctg

SEQ ID NO: 612244 - DNA, 25 bp, Rattus norvegicus
gaaatagttccggttgcgagaagga

SEQ ID NO: 612245 - DNA, 25 bp, Rattus norvegicus
aaggaagctagcacactcccgccgg

SEQ ID NO: 612246 - DNA, 25 bp, Rattus norvegicus
aatcccgcctttcacgtcacgtttg

SEQ ID NO: 612247 - DNA, 25 bp, Rattus norvegicus
gatggaggcgctcaaacatccacca

SEQ ID NO: 612248 - DNA, 25 bp, Rattus norvegicus
gccagcgcaatcaacagggtcgcgc

SEQ ID NO: 612249 - DNA, 25 bp, Rattus norvegicus
tcgcgccgaaggagacctcgtcaac

SEQ ID NO: 612250 - DNA, 25 bp, Rattus norvegicus
ccgaaggagacctcgtcaacgacgc

SEQ ID NO: 612251 - DNA, 25 bp, Rattus norvegicus
ggagacctcgtcaacgacgctccgg

SEQ ID NO: 612252 - DNA, 25 bp, Rattus norvegicus
acgacgctccggctcacggaggtca

SEQ ID NO: 612253 - DNA, 25 bp, Rattus norvegicus
tccggctcacggaggtcaacgtgaa

SEQ ID NO: 612254 - DNA, 25 bp, Rattus norvegicus
tcaacgtgaaacacgctgggaggat

SEQ ID NO: 612255 - DNA, 25 bp, Rattus norvegicus
aacatccaccacacctcccgccgca

SEQ ID NO: 612256 - DNA, 25 bp, Rattus norvegicus
accagcccggcggacccaacgcgcg

SEQ ID NO: 612257 - DNA, 25 bp, Rattus norvegicus
ggccagagggtacgccctcgcgagc

SEQ ID NO: 612258 - DNA, 25 bp, Rattus norvegicus
tccgtgcgcgctgcagtccgaggct

SEQ ID NO: 612259 - DNA, 25 bp, Rattus norvegicus
acgcttcggagcagacgcggtgccc

SEQ ID NO: 612260 - DNA, 25 bp, Rattus norvegicus
tcacggaggtcaacgtgaaacacgc

SEQ ID NO: 612261 - DNA, 25 bp, Rattus norvegicus
cgcacgcgtagtcggaattggacaa

SEQ ID NO: 612262 - DNA, 25 bp, Rattus norvegicus
ccgtccaaaggcctgacactatttt

SEQ ID NO: 612263 - DNA, 25 bp, Rattus norvegicus
tgccttggaagccacccttagcctg

SEQ ID NO: 612264 - DNA, 25 bp, Rattus norvegicus
ttggacaaagcacatccgcccgcta

SEQ ID NO: 612265 - DNA, 25 bp, Rattus norvegicus
tacggtcaagctagccaatcgcacg

SEQ ID NO: 612266 - DNA, 25 bp, Rattus norvegicus
aatcgcacgtctctcctccggtggg

SEQ ID NO: 612267 - DNA, 25 bp, Rattus norvegicus
gaggtcagtgtactccgggcgctac

SEQ ID NO: 612268 - DNA, 25 bp, Rattus norvegicus
tacgctggttgtgtacgctgtgtct

SEQ ID NO: 612269 - DNA, 25 bp, Rattus norvegicus
ctgtgtctgctgtgagcatggctga

SEQ ID NO: 612270 - DNA, 25 bp, Rattus norvegicus
gtattgagctttctccctggggctg

SEQ ID NO: 612271 - DNA, 25 bp, Rattus norvegicus
caggcctgcgggtgtctgcatatct

SEQ ID NO: 612272 - DNA, 25 bp, Rattus norvegicus
tgcatatctgatagagaagctcttc

SEQ ID NO: 612273 - DNA, 25 bp, Rattus norvegicus
tagagaagctcttcccggcgtcgcg

SEQ ID NO: 612274 - DNA, 25 bp, Rattus norvegicus
tgacactattttttgccttggaagc

SEQ ID NO: 612275 - DNA, 25 bp, Rattus norvegicus
tgtggcagaggcctcgtcgcgctcc

SEQ ID NO: 612276 - DNA, 25 bp, Rattus norvegicus
ccattggctggctggcccgcctata

SEQ ID NO: 612277 - DNA, 25 bp, Rattus norvegicus
tggcccgcctataggcgagcggcaa

SEQ ID NO: 612278 - DNA, 25 bp, Rattus norvegicus
ttacatctgtatccgggagaccggg

SEQ ID NO: 612279 - DNA, 25 bp, Rattus norvegicus
ggtgccgcacctcaccgacagggag

SEQ ID NO: 612280 - DNA, 25 bp, Rattus norvegicus
caccgacagggaggctccggagtaa

SEQ ID NO: 612281 - DNA, 25 bp, Rattus norvegicus
gaagactccactgtttacatctgta

SEQ ID NO: 612282 - DNA, 25 bp, Rattus norvegicus
gtatgactgtggcagaggcctcgtc

SEQ ID NO: 612283 - DNA, 25 bp, Rattus norvegicus
cgctcccggccttgcgacatgccga

SEQ ID NO: 612284 - DNA, 25 bp, Rattus norvegicus
gacatgccgactcagcccacccggg

SEQ ID NO: 612285 - DNA, 25 bp, Rattus norvegicus
gggctgcggccgttactccgtagcc

SEQ ID NO: 612286 - DNA, 25 bp, Rattus norvegicus
gtcgggctaagacgcccgcgaagac

SEQ ID NO: 612287 - DNA, 25 bp, Rattus norvegicus
gcccgcgaagactccactgtttaca

SEQ ID NO: 612288 - DNA, 25 bp, Rattus norvegicus
ctccggagtaatgggcagaggcaga

SEQ ID NO: 612289 - DNA, 25 bp, Rattus norvegicus
aacgagagcaggaccctcttggctc

SEQ ID NO: 612290 - DNA, 25 bp, Rattus norvegicus
cctgaaggccaagggaatccggtga

SEQ ID NO: 612291 - DNA, 25 bp, Rattus norvegicus
tccctttgctcagaggacgctgatg

SEQ ID NO: 612292 - DNA, 25 bp, Rattus norvegicus
atgaggttctgtccctttgctcaga

SEQ ID NO: 612293 - DNA, 25 bp, Rattus norvegicus
tccgagtctacagcatgaggttctg

SEQ ID NO: 612294 - DNA, 25 bp, Rattus norvegicus
gggccagatccgagtctacagcatg

SEQ ID NO: 612295 - DNA, 25 bp, Rattus norvegicus
cgtgctatccgggacgtgaccgcct

SEQ ID NO: 612296 - DNA, 25 bp, Rattus norvegicus
gacgctgatggtcctgaaggccaag

SEQ ID NO: 612297 - DNA, 25 bp, Rattus norvegicus
tgagtcacccgcaaacgagagcagg

SEQ ID NO: 612298 - DNA, 25 bp, Rattus norvegicus
cttcctgagtcacccgcaaacgaga

SEQ ID NO: 612299 - DNA, 25 bp, Rattus norvegicus
acttggccacgtgcttcctgagtca

SEQ ID NO: 612300 - DNA, 25 bp, Rattus norvegicus
accaggcgagacttggccacgtgct

SEQ ID NO: 612301 - DNA, 25 bp, Rattus norvegicus
tgagttctaggccaccaggcgagac

SEQ ID NO: 612302 - DNA, 25 bp, Rattus norvegicus
tcccggagggccagatccgagtcta

SEQ ID NO: 612303 - DNA, 25 bp, Rattus norvegicus
cgttcttccaaatgcgccaggtatt

SEQ ID NO: 612304 - DNA, 25 bp, Rattus norvegicus
ttctgccaccgccactgggtggttc

SEQ ID NO: 612305 - DNA, 25 bp, Rattus norvegicus
acccgactccggcttggagccgtag

SEQ ID NO: 612306 - DNA, 25 bp, Rattus norvegicus
tggttcggtctcactcgcgctgtat

SEQ ID NO: 612307 - DNA, 25 bp, Rattus norvegicus
cgcggtcgcctattggttcgttctt

SEQ ID NO: 612308 - DNA, 25 bp, Rattus norvegicus
tctagctagctgctgtaacgcggtc

SEQ ID NO: 612309 - DNA, 25 bp, Rattus norvegicus
ggcctgactctcgtttctctagcta

SEQ ID NO: 612310 - DNA, 25 bp, Rattus norvegicus
tagccctagatttccggcctgactc

SEQ ID NO: 612311 - DNA, 25 bp, Rattus norvegicus
cgacttcctcttgcggtagccctag

SEQ ID NO: 612312 - DNA, 25 bp, Rattus norvegicus
agaggaacggcctgctaccgacttc

SEQ ID NO: 612313 - DNA, 25 bp, Rattus norvegicus
ccagtaggatgtgagaccagcggct

SEQ ID NO: 612314 - DNA, 25 bp, Rattus norvegicus
cggttcctcgcggatttccagtagg

SEQ ID NO: 612315 - DNA, 25 bp, Rattus norvegicus
agcgaagccgtctgtgcggccgacc

SEQ ID NO: 612316 - DNA, 25 bp, Rattus norvegicus
agccgtagccgcctgaaggttgctc

SEQ ID NO: 612317 - DNA, 25 bp, Rattus norvegicus
tcgcgctcacctcccggctgtgccg

SEQ ID NO: 612318 - DNA, 25 bp, Rattus norvegicus
cagtgaagtgcctccggtgtcgaag

SEQ ID NO: 612319 - DNA, 25 bp, Rattus norvegicus
gttctcttgcgacgcctcagctgcg

SEQ ID NO: 612320 - DNA, 25 bp, Rattus norvegicus
aggggcgttctcttgcgacgcctca

SEQ ID NO: 612321 - DNA, 25 bp, Rattus norvegicus
tgacaggggcgttctcttgcgacgc

SEQ ID NO: 612322 - DNA, 25 bp, Rattus norvegicus
aaacgggcagtgaagtgcctccggt

SEQ ID NO: 612323 - DNA, 25 bp, Rattus norvegicus
ctcttgcgacgcctcagctgcgggg

SEQ ID NO: 612324 - DNA, 25 bp, Rattus norvegicus
gcctccgctgacaggaggaccgctg

SEQ ID NO: 612325 - DNA, 25 bp, Rattus norvegicus
cgcgcccctcagagcggcaggtaag

SEQ ID NO: 612326 - DNA, 25 bp, Rattus norvegicus
agaccactggcacgcgggcttgacc

SEQ ID NO: 612327 - DNA, 25 bp, Rattus norvegicus
tcaccggagaccactggcacgcggg

SEQ ID NO: 612328 - DNA, 25 bp, Rattus norvegicus
gtgcggtcctcaccggagaccactg

SEQ ID NO: 612329 - DNA, 25 bp, Rattus norvegicus
ccgactgaggcgcggatcctccgtg

SEQ ID NO: 612330 - DNA, 25 bp, Rattus norvegicus
aaggcaggctgcctctgaatgtggg

SEQ ID NO: 612331 - DNA, 25 bp, Rattus norvegicus
agcccgagcttggacctgaagtgca

SEQ ID NO: 612332 - DNA, 25 bp, Rattus norvegicus
tgggcttctgcacggactttcacag

SEQ ID NO: 612333 - DNA, 25 bp, Rattus norvegicus
catattctggacacctggcagggga

SEQ ID NO: 612334 - DNA, 25 bp, Rattus norvegicus
tgcttcgtgctggtgctcacacaga

SEQ ID NO: 612335 - DNA, 25 bp, Rattus norvegicus
tgtcgaccggtatctggccattcgc

SEQ ID NO: 612336 - DNA, 25 bp, Rattus norvegicus
acgtggctgtgggactcttcgccat

SEQ ID NO: 612337 - DNA, 25 bp, Rattus norvegicus
gtggccaagcttcgaggctccggcc

SEQ ID NO: 612338 - DNA, 25 bp, Rattus norvegicus
aactactttctggtgtccctggcga

SEQ ID NO: 612339 - DNA, 25 bp, Rattus norvegicus
gctccggcccgaggaaagttcacga

SEQ ID NO: 612340 - DNA, 25 bp, Rattus norvegicus
attcttcccggagctcaagagcagc

SEQ ID NO: 612341 - DNA, 25 bp, Rattus norvegicus
acctgctcttggcagtcggccaatg

SEQ ID NO: 612342 - DNA, 25 bp, Rattus norvegicus
gcccggccatgcagctagagacgca

SEQ ID NO: 612343 - DNA, 25 bp, Rattus norvegicus
tgggagcctcgagtgctttacagac

SEQ ID NO: 612344 - DNA, 25 bp, Rattus norvegicus
tcagttcagagtgcgtagctccggc

SEQ ID NO: 612345 - DNA, 25 bp, Rattus norvegicus
cgcagaccaggtcggagagaccaga

SEQ ID NO: 612346 - DNA, 25 bp, Rattus norvegicus
gcgttgtcacggaaactttttgctc

SEQ ID NO: 612347 - DNA, 25 bp, Rattus norvegicus
tttaagagatggacggtcccggctc

SEQ ID NO: 612348 - DNA, 25 bp, Rattus norvegicus
gtcccggctctaggcacaaacacgt

SEQ ID NO: 612349 - DNA, 25 bp, Rattus norvegicus
tcggaagcagaagctgcccgccttt

SEQ ID NO: 612350 - DNA, 25 bp, Rattus norvegicus
tgcccgcctttcagattgctggagg

SEQ ID NO: 612351 - DNA, 25 bp, Rattus norvegicus
ccagagagcatcacacccggagagt

SEQ ID NO: 612352 - DNA, 25 bp, Rattus norvegicus
ggagacaatgcccacttcgtacgag

SEQ ID NO: 612353 - DNA, 25 bp, Rattus norvegicus
tacgagtgcattaaaggagtccctg

SEQ ID NO: 612354 - DNA, 25 bp, Rattus norvegicus
tcactccgagttcctggtcacagtc

SEQ ID NO: 612355 - DNA, 25 bp, Rattus norvegicus
tgcagtgttactcatttccgcgttg

SEQ ID NO: 612356 - DNA, 25 bp, Rattus norvegicus
cacacactcagcttgagaggcagca

SEQ ID NO: 612357 - DNA, 25 bp, Rattus norvegicus
ggcagcaaagcctctcaagtccggc

SEQ ID NO: 612358 - DNA, 25 bp, Rattus norvegicus
ggatccagagatgcgggctaccaga

SEQ ID NO: 612359 - DNA, 25 bp, Rattus norvegicus
gtgaccaggccacaaacacgcggcg

SEQ ID NO: 612360 - DNA, 25 bp, Rattus norvegicus
gccgctagccaggttcccaggactg

SEQ ID NO: 612361 - DNA, 25 bp, Rattus norvegicus
tcccaggactggagtcaccgccatg

SEQ ID NO: 612362 - DNA, 25 bp, Rattus norvegicus
ggactggagtcaccgccatgctctt

SEQ ID NO: 612363 - DNA, 25 bp, Rattus norvegicus
catgctcttccgcttcggcgtggtg

SEQ ID NO: 612364 - DNA, 25 bp, Rattus norvegicus
ctggagctgctgctcgcaggatcgc

SEQ ID NO: 612365 - DNA, 25 bp, Rattus norvegicus
tgctcgcaggatcgcggcccgagtt

SEQ ID NO: 612366 - DNA, 25 bp, Rattus norvegicus
cgctggcattgcaggagcctggcct

SEQ ID NO: 612367 - DNA, 25 bp, Rattus norvegicus
gagccgggccgtattgacacgttct

SEQ ID NO: 612368 - DNA, 25 bp, Rattus norvegicus
ggccgtattgacacgttctggtaca

SEQ ID NO: 612369 - DNA, 25 bp, Rattus norvegicus
acacgttctggtacaagttcctgca

SEQ ID NO: 612370 - DNA, 25 bp, Rattus norvegicus
gtacaagttcctgcagcgcgagccg

SEQ ID NO: 612371 - DNA, 25 bp, Rattus norvegicus
tgcactgggaaggtacaacgcaccc

SEQ ID NO: 612372 - DNA, 25 bp, Rattus norvegicus
gcgagctgcactgggaaggtacaac

SEQ ID NO: 612373 - DNA, 25 bp, Rattus norvegicus
cctaaactcggtttcgcgatggtca

SEQ ID NO: 612374 - DNA, 25 bp, Rattus norvegicus
gcgagtcatcagagagcgccgcatc

SEQ ID NO: 612375 - DNA, 25 bp, Rattus norvegicus
gccgcatcccggaagttggagaaga

SEQ ID NO: 612376 - DNA, 25 bp, Rattus norvegicus
agtgtcatcagtgagcgccgcatcc

SEQ ID NO: 612377 - DNA, 25 bp, Rattus norvegicus
tgccgctgagcactagtctcgcgct

SEQ ID NO: 612378 - DNA, 25 bp, Rattus norvegicus
ttgatcgtttcacccggacgcctag

SEQ ID NO: 612379 - DNA, 25 bp, Rattus norvegicus
tcgccgctccatcttgatcgtttca

SEQ ID NO: 612380 - DNA, 25 bp, Rattus norvegicus
ctctcttagacgacaccggggattg

SEQ ID NO: 612381 - DNA, 25 bp, Rattus norvegicus
ttctcgaacatgctaggcctccttt

SEQ ID NO: 612382 - DNA, 25 bp, Rattus norvegicus
actcactgactccttctcgaacatg

SEQ ID NO: 612383 - DNA, 25 bp, Rattus norvegicus
ttggcctccggtcttcactcactga

SEQ ID NO: 612384 - DNA, 25 bp, Rattus norvegicus
tcatctaaagggtggaaaggctgtc

SEQ ID NO: 612385 - DNA, 25 bp, Rattus norvegicus
agggacgcgcgagtcatcagaaagc

SEQ ID NO: 612386 - DNA, 25 bp, Rattus norvegicus
tgacagggaacgagcttcatctaaa

SEQ ID NO: 612387 - DNA, 25 bp, Rattus norvegicus
ttgtccctcggaccccaagtgctgg

SEQ ID NO: 612388 - DNA, 25 bp, Rattus norvegicus
tcaggggtggagtctccggaaacca

SEQ ID NO: 612389 - DNA, 25 bp, Rattus norvegicus
tggacgggttgtttaatttctgctc

SEQ ID NO: 612390 - DNA, 25 bp, Rattus norvegicus
gttgtttaatttctgctcctggtta

SEQ ID NO: 612391 - DNA, 25 bp, Rattus norvegicus
ttctgctcctggttatgcctttccc

SEQ ID NO: 612392 - DNA, 25 bp, Rattus norvegicus
tgcctttcccccaggagaaggagaa

SEQ ID NO: 612393 - DNA, 25 bp, Rattus norvegicus
gagaagctgtacgtggaactgaagc

SEQ ID NO: 612394 - DNA, 25 bp, Rattus norvegicus
gctgtacgtggaactgaagcacatc

SEQ ID NO: 612395 - DNA, 25 bp, Rattus norvegicus
tggaactgaagcacatcttggcccg

SEQ ID NO: 612396 - DNA, 25 bp, Rattus norvegicus
tgaagcacatcttggcccggcagcc

SEQ ID NO: 612397 - DNA, 25 bp, Rattus norvegicus
tgcggaacagctgcagatctaccgg

SEQ ID NO: 612398 - DNA, 25 bp, Rattus norvegicus
gctgcagatctaccggtacacgctg

SEQ ID NO: 612399 - DNA, 25 bp, Rattus norvegicus
tgccagctaccgagcggatgtgatc

SEQ ID NO: 612400 - DNA, 25 bp, Rattus norvegicus
accgagcggatgtgatcagtgctca

SEQ ID NO: 612401 - DNA, 25 bp, Rattus norvegicus
ggaccagcgcgcattgcggagctcc

SEQ ID NO: 612402 - DNA, 25 bp, Rattus norvegicus
cctgttcagccctgggaatgggtta

SEQ ID NO: 612403 - DNA, 25 bp, Rattus norvegicus
tggttgcgcttctcccgttttgtaa

SEQ ID NO: 612404 - DNA, 25 bp, Rattus norvegicus
gcgcttctcccgttttgtaatgccc

SEQ ID NO: 612405 - DNA, 25 bp, Rattus norvegicus
ttatgcgtgaggagataggggtctc

SEQ ID NO: 612406 - DNA, 25 bp, Rattus norvegicus
taggggtctcttcgggcggccgcca

SEQ ID NO: 612407 - DNA, 25 bp, Rattus norvegicus
gccagcctgttcagccctgggaatg

SEQ ID NO: 612408 - DNA, 25 bp, Rattus norvegicus
gttcagccctgggaatgggttaatc

SEQ ID NO: 612409 - DNA, 25 bp, Rattus norvegicus
cagccctgggaatgggttaatcggt

SEQ ID NO: 612410 - DNA, 25 bp, Rattus norvegicus
cctgggaatgggttaatcggtacag

SEQ ID NO: 612411 - DNA, 25 bp, Rattus norvegicus
tgggttaatcggtacagggaccagc

SEQ ID NO: 612412 - DNA, 25 bp, Rattus norvegicus
ttaatcggtacagggaccagcgcgc

SEQ ID NO: 612413 - DNA, 25 bp, Rattus norvegicus
atcggtacagggaccagcgcgcatt

SEQ ID NO: 612414 - DNA, 25 bp, Rattus norvegicus
ccgcgcggtggccgattcacgagca

SEQ ID NO: 612415 - DNA, 25 bp, Rattus norvegicus
cgcagaagcccagcggcccggtgat

SEQ ID NO: 612416 - DNA, 25 bp, Rattus norvegicus
tccaggtagtgtgacgtcaggaacg

SEQ ID NO: 612417 - DNA, 25 bp, Rattus norvegicus
gaccactcagcatggcggctaaatc

SEQ ID NO: 612418 - DNA, 25 bp, Rattus norvegicus
tgtggcgccagccatgaccactcag

SEQ ID NO: 612419 - DNA, 25 bp, Rattus norvegicus
gaagacttggatgtggcgccagcca

SEQ ID NO: 612420 - DNA, 25 bp, Rattus norvegicus
ccgctacgtcccggaagacttggat

SEQ ID NO: 612421 - DNA, 25 bp, Rattus norvegicus
ggcccggtgatgctcagcacagagc

SEQ ID NO: 612422 - DNA, 25 bp, Rattus norvegicus
gatgctcagcacagagcccaaaatc

SEQ ID NO: 612423 - DNA, 25 bp, Rattus norvegicus
ctcaactgtgaatggtgggtagcga

SEQ ID NO: 612424 - DNA, 25 bp, Rattus norvegicus
ctggaggaaaggctctcaactgtga

SEQ ID NO: 612425 - DNA, 25 bp, Rattus norvegicus
acgaaggtcactggaggaaaggctc

SEQ ID NO: 612426 - DNA, 25 bp, Rattus norvegicus
cgcaccgacagcgaaggagacgaag

SEQ ID NO: 612427 - DNA, 25 bp, Rattus norvegicus
gtcaggaacgcaccgacagcgaagg

SEQ ID NO: 612428 - DNA, 25 bp, Rattus norvegicus
gtgtgacgtcaggaacgcaccgaca

SEQ ID NO: 612429 - DNA, 25 bp, Rattus norvegicus
gtgcccatgtggctccaatggtctc

SEQ ID NO: 612430 - DNA, 25 bp, Rattus norvegicus
ccctgtgcccatgtggctccaatgg

SEQ ID NO: 612431 - DNA, 25 bp, Rattus norvegicus
acaccgagccgcgaagccagctccc

SEQ ID NO: 612432 - DNA, 25 bp, Rattus norvegicus
taaaccatgcctggtcgcccggctc

SEQ ID NO: 612433 - DNA, 25 bp, Rattus norvegicus
atgtggctccaatggtctcccctgc

SEQ ID NO: 612434 - DNA, 25 bp, Rattus norvegicus
tgcccatgtggctccaatggtctcc

SEQ ID NO: 612435 - DNA, 25 bp, Rattus norvegicus
acccgccgatcccaaagccaccgcg

SEQ ID NO: 612436 - DNA, 25 bp, Rattus norvegicus
gccgatcccaaagccaccgcgcacc

SEQ ID NO: 612437 - DNA, 25 bp, Rattus norvegicus
agccggagttcgcaccccgctgaag

SEQ ID NO: 612438 - DNA, 25 bp, Rattus norvegicus
catccgccaacagccggagttcgca

SEQ ID NO: 612439 - DNA, 25 bp, Rattus norvegicus
cccatccgccaacagccggagttcg

SEQ ID NO: 612440 - DNA, 25 bp, Rattus norvegicus
aagccaccgcgcaccacccgcacct

SEQ ID NO: 612441 - DNA, 25 bp, Rattus norvegicus
ctgtgcccatgtggctccaatggtc

SEQ ID NO: 612442 - DNA, 25 bp, Rattus norvegicus
cctgtgcccatgtggctccaatggt

SEQ ID NO: 612443 - DNA, 25 bp, Rattus norvegicus
gccgagatcacttggggcgcaaccg

SEQ ID NO: 612444 - DNA, 25 bp, Rattus norvegicus
tcccaagaacagacccgaagagtga

SEQ ID NO: 612445 - DNA, 25 bp, Rattus norvegicus
ttggaggttgatttccgagagactc

SEQ ID NO: 612446 - DNA, 25 bp, Rattus norvegicus
ctcctccaggatccggctagcattg

SEQ ID NO: 612447 - DNA, 25 bp, Rattus norvegicus
ctagcattgcccgttttaaaagagg

SEQ ID NO: 612448 - DNA, 25 bp, Rattus norvegicus
tagcaacagcatcaaaccctccaga

SEQ ID NO: 612449 - DNA, 25 bp, Rattus norvegicus
agcaccgagggagcatttagtaatt

SEQ ID NO: 612450 - DNA, 25 bp, Rattus norvegicus
gttttggaatcaccctctggacctg

SEQ ID NO: 612451 - DNA, 25 bp, Rattus norvegicus
ctggtctccagatcaagaactgttg

SEQ ID NO: 612452 - DNA, 25 bp, Rattus norvegicus
ctgctgctcttgtcaacgtgggtcc

SEQ ID NO: 612453 - DNA, 25 bp, Rattus norvegicus
aactccgctcccgaagctggttgga

SEQ ID NO: 612454 - DNA, 25 bp, Rattus norvegicus
tctggacctgggagcaagcgatcca

SEQ ID NO: 612455 - DNA, 25 bp, Rattus norvegicus
cctagagcacagtcgtgggtccatc

SEQ ID NO: 612456 - DNA, 25 bp, Rattus norvegicus
gactccggattagggtctgctgtga

SEQ ID NO: 612457 - DNA, 25 bp, Rattus norvegicus
aggaccacaactccatccaagttgg

SEQ ID NO: 612458 - DNA, 25 bp, Rattus norvegicus
tggagccgaactgaagtcacgggca

SEQ ID NO: 612459 - DNA, 25 bp, Rattus norvegicus
agggtgtgcgctcaggaccacaact

SEQ ID NO: 612460 - DNA, 25 bp, Rattus norvegicus
tcccgaaccgaaggcaggcagcgga

SEQ ID NO: 612461 - DNA, 25 bp, Rattus norvegicus
ggcgccaacttttcccatctctgga

SEQ ID NO: 612462 - DNA, 25 bp, Rattus norvegicus
ccggctcccgttaggagcgcgctaa

SEQ ID NO: 612463 - DNA, 25 bp, Rattus norvegicus
ctaagagcatcagaagcccggctcc

SEQ ID NO: 612464 - DNA, 25 bp, Rattus norvegicus
agcaagaaaggctgctgcagatgcc

SEQ ID NO: 612465 - DNA, 25 bp, Rattus norvegicus
gccactgcgaacaggggtctcatga

SEQ ID NO: 612466 - DNA, 25 bp, Rattus norvegicus
tgaagcggtcgccactgacaccctg

SEQ ID NO: 612467 - DNA, 25 bp, Rattus norvegicus
tctcctacggccagagcgtgaagcg

SEQ ID NO: 612468 - DNA, 25 bp, Rattus norvegicus
ccgggttcagtcttctcaggatcca

SEQ ID NO: 612469 - DNA, 25 bp, Rattus norvegicus
ctgcagatgccaggggctaagagca

SEQ ID NO: 612470 - DNA, 25 bp, Rattus norvegicus
ccgccggcgagctgcgctgtgtaca

SEQ ID NO: 612471 - DNA, 25 bp, Rattus norvegicus
aaaggtgccggttctgtgtttcgtg

SEQ ID NO: 612472 - DNA, 25 bp, Rattus norvegicus
ccctatcgattcaagaagcggacag

SEQ ID NO: 612473 - DNA, 25 bp, Rattus norvegicus
tccctatcgattcaagaagcggaca

SEQ ID NO: 612474 - DNA, 25 bp, Rattus norvegicus
atccctatcgattcaagaagcggac

SEQ ID NO: 612475 - DNA, 25 bp, Rattus norvegicus
gatccctatcgattcaagaagcgga

SEQ ID NO: 612476 - DNA, 25 bp, Rattus norvegicus
cgcgtctgcgtgctgtggacttcgc

SEQ ID NO: 612477 - DNA, 25 bp, Rattus norvegicus
ccgcgcgtctgcgtgctgtggactt

SEQ ID NO: 612478 - DNA, 25 bp, Rattus norvegicus
gtgccggttctgtgtttcgtgcgca

SEQ ID NO: 612479 - DNA, 25 bp, Rattus norvegicus
aaggtgccggttctgtgtttcgtgc

SEQ ID NO: 612480 - DNA, 25 bp, Rattus norvegicus
ccagaggaaaggtgccggttctgtg

SEQ ID NO: 612481 - DNA, 25 bp, Rattus norvegicus
cctatcgattcaagaagcggacaga

SEQ ID NO: 612482 - DNA, 25 bp, Rattus norvegicus
cgcgcgtctgcgtgctgtggacttc

SEQ ID NO: 612483 - DNA, 25 bp, Rattus norvegicus
aggtgccggttctgtgtttcgtgcg

SEQ ID NO: 612484 - DNA, 25 bp, Rattus norvegicus
tgccggttctgtgtttcgtgcgcac

SEQ ID NO: 612485 - DNA, 25 bp, Rattus norvegicus
caggcttcagggacagagctataca

SEQ ID NO: 612486 - DNA, 25 bp, Rattus norvegicus
gcagcgctcgcctggttctcgcgaa

SEQ ID NO: 612487 - DNA, 25 bp, Rattus norvegicus
ggtgacctctgagccgcttctcgca

SEQ ID NO: 612488 - DNA, 25 bp, Rattus norvegicus
catcacgcgtcatcgcgcatgcgga

SEQ ID NO: 612489 - DNA, 25 bp, Rattus norvegicus
gctgcgaactctttgcgcgcggcag

SEQ ID NO: 612490 - DNA, 25 bp, Rattus norvegicus
tgacgtctagtcattcaaagtcctc

SEQ ID NO: 612491 - DNA, 25 bp, Rattus norvegicus
acttctcttcccgtgggctgcgaac

SEQ ID NO: 612492 - DNA, 25 bp, Rattus norvegicus
cggaggcagagatcatccagctgct

SEQ ID NO: 612493 - DNA, 25 bp, Rattus norvegicus
agcgatttaacgagcacaggcttca

SEQ ID NO: 612494 - DNA, 25 bp, Rattus norvegicus
aagttcgcgggccatacttctcgcg

SEQ ID NO: 612495 - DNA, 25 bp, Rattus norvegicus
acagcggcggctatctcgctcagga

SEQ ID NO: 612496 - DNA, 25 bp, Rattus norvegicus
ctcgcactcagggatctgacgtcta

SEQ ID NO: 612497 - DNA, 25 bp, Rattus norvegicus
tccgggagcgtgaccgccatagcac

SEQ ID NO: 612498 - DNA, 25 bp, Rattus norvegicus
agtcctctagtttagcgatttaacg

SEQ ID NO: 612499 - DNA, 25 bp, Rattus norvegicus
ctcttccctaccctcccggtgtgca

SEQ ID NO: 612500 - DNA, 25 bp, Rattus norvegicus
tgggtagtaaggatcgccgcctgcc

SEQ ID NO: 612501 - DNA, 25 bp, Rattus norvegicus
gcgaggcagttcctcggtcacacta

SEQ ID NO: 612502 - DNA, 25 bp, Rattus norvegicus
tcggtcacactagtccctggacagg

SEQ ID NO: 612503 - DNA, 25 bp, Rattus norvegicus
tagtccctggacaggctccggcagc

SEQ ID NO: 612504 - DNA, 25 bp, Rattus norvegicus
tcctgccgggctgcacagatcggtc

SEQ ID NO: 612505 - DNA, 25 bp, Rattus norvegicus
tcaccttactcgcggcggctttctg

SEQ ID NO: 612506 - DNA, 25 bp, Rattus norvegicus
cggctttctggaggctgccattcgt

SEQ ID NO: 612507 - DNA, 25 bp, Rattus norvegicus
aggctgccattcgtcggtgacgtgc

SEQ ID NO: 612508 - DNA, 25 bp, Rattus norvegicus
ccaacccacgtcaggggagcgcaga

SEQ ID NO: 612509 - DNA, 25 bp, Rattus norvegicus
ggagcgcagaccagctgatcaccga

SEQ ID NO: 612510 - DNA, 25 bp, Rattus norvegicus
gaccagctgatcaccgacggccagg

SEQ ID NO: 612511 - DNA, 25 bp, Rattus norvegicus
ctgtggcgtgctcacgcagagactc

SEQ ID NO: 612512 - DNA, 25 bp, Rattus norvegicus
gagctgagtcctgccgggctgcaca

SEQ ID NO: 612513 - DNA, 25 bp, Rattus norvegicus
ccgcatggctatcttcatcataacc

SEQ ID NO: 612514 - DNA, 25 bp, Rattus norvegicus
cgcatggctatcttcatcataacca

SEQ ID NO: 612515 - DNA, 25 bp, Rattus norvegicus
gctatcttcatcataaccattgcgc

SEQ ID NO: 612516 - DNA, 25 bp, Rattus norvegicus
tgcccgcatggctatcttcatcata

SEQ ID NO: 612517 - DNA, 25 bp, Rattus norvegicus
ggctatcttcatcataaccattgcg

SEQ ID NO: 612518 - DNA, 25 bp, Rattus norvegicus
cccgcatggctatcttcatcataac

SEQ ID NO: 612519 - DNA, 25 bp, Rattus norvegicus
tgcggactgacggagcggccggtgg

SEQ ID NO: 612520 - DNA, 25 bp, Rattus norvegicus
atcttcatcataaccattgcgcctg

SEQ ID NO: 612521 - DNA, 25 bp, Rattus norvegicus
gcccgcatggctatcttcatcataa

SEQ ID NO: 612522 - DNA, 25 bp, Rattus norvegicus
tatactacgggggtgcggactgacg

SEQ ID NO: 612523 - DNA, 25 bp, Rattus norvegicus
tcttcatcataaccattgcgcctgg

SEQ ID NO: 612524 - DNA, 25 bp, Rattus norvegicus
cttcatcataaccattgcgcctggg

SEQ ID NO: 612525 - DNA, 25 bp, Rattus norvegicus
tcatcataaccattgcgcctgggta

SEQ ID NO: 612526 - DNA, 25 bp, Rattus norvegicus
catcataaccattgcgcctgggtat

SEQ ID NO: 612527 - DNA, 25 bp, Rattus norvegicus
aatggagtcgaaagggcaggcattt

SEQ ID NO: 612528 - DNA, 25 bp, Rattus norvegicus
cggcctcagcaacgcgtgacgtcag

SEQ ID NO: 612529 - DNA, 25 bp, Rattus norvegicus
ctcagcgaacccgaaatggagtcga

SEQ ID NO: 612530 - DNA, 25 bp, Rattus norvegicus
acgctaccggcgcatctcgagaaca

SEQ ID NO: 612531 - DNA, 25 bp, Rattus norvegicus
cgtgatcagacgctaccggcgcatc

SEQ ID NO: 612532 - DNA, 25 bp, Rattus norvegicus
catctcgagaacagctcagcgaacc

SEQ ID NO: 612533 - DNA, 25 bp, Rattus norvegicus
ctcagcaacgcgtgacgtcaggaga

SEQ ID NO: 612534 - DNA, 25 bp, Rattus norvegicus
cgaaagggcaggcatttgtctgaga

SEQ ID NO: 612535 - DNA, 25 bp, Rattus norvegicus
gcatttgtctgagagaagagagccc

SEQ ID NO: 612536 - DNA, 25 bp, Rattus norvegicus
ctttaagaaaagactggaccagctg

SEQ ID NO: 612537 - DNA, 25 bp, Rattus norvegicus
gactggaccagctggctgcactaca

SEQ ID NO: 612538 - DNA, 25 bp, Rattus norvegicus
ggctgcactacagcgcctagagatt

SEQ ID NO: 612539 - DNA, 25 bp, Rattus norvegicus
gcgcctagagatttcctggctccgc

SEQ ID NO: 612540 - DNA, 25 bp, Rattus norvegicus
accggcgcatctcgagaacagctca

SEQ ID NO: 612541 - DNA, 25 bp, Rattus norvegicus
tctggcttccagtccacgggtaagt

SEQ ID NO: 612542 - DNA, 25 bp, Rattus norvegicus
gaccggtatctcttccactatcgca

SEQ ID NO: 612543 - DNA, 25 bp, Rattus norvegicus
ggctgtctggaaatcccaccggtga

SEQ ID NO: 612544 - DNA, 25 bp, Rattus norvegicus
agtggcttccttcgcaggcctatta

SEQ ID NO: 612545 - DNA, 25 bp, Rattus norvegicus
tcccaagagagcttgcagtggcttc

SEQ ID NO: 612546 - DNA, 25 bp, Rattus norvegicus
cgcctgctttctggttttgtcttaa

SEQ ID NO: 612547 - DNA, 25 bp, Rattus norvegicus
tcccagagtgttctagaccggtatc

SEQ ID NO: 612548 - DNA, 25 bp, Rattus norvegicus
tatgtccctgacaagagctctgcga

SEQ ID NO: 612549 - DNA, 25 bp, Rattus norvegicus
gcctctcggctccaggtgtgatatc

SEQ ID NO: 612550 - DNA, 25 bp, Rattus norvegicus
tggacgcccttgctctcctagagta

SEQ ID NO: 612551 - DNA, 25 bp, Rattus norvegicus
gcccagatgttcagcttaattccca

SEQ ID NO: 612552 - DNA, 25 bp, Rattus norvegicus
ccggccgctcgcataactaatgaga

SEQ ID NO: 612553 - DNA, 25 bp, Rattus norvegicus
cccaatctggcgagagctgtcacaa

SEQ ID NO: 612554 - DNA, 25 bp, Rattus norvegicus
gcctcgcgtcttcctcaagaattca

SEQ ID NO: 612555 - DNA, 25 bp, Rattus norvegicus
ggccgccttgcagagcgaacactca

SEQ ID NO: 612556 - DNA, 25 bp, Rattus norvegicus
ctcctcgagtttgcgggagggtcac

SEQ ID NO: 612557 - DNA, 25 bp, Rattus norvegicus
ggtcaccctcgcctgcgtgagctgt

SEQ ID NO: 612558 - DNA, 25 bp, Rattus norvegicus
ggctgttggcatcacgtcatttcga

SEQ ID NO: 612559 - DNA, 25 bp, Rattus norvegicus
gtcatttcgagccaaacagcagcgg

SEQ ID NO: 612560 - DNA, 25 bp, Rattus norvegicus
tgctaaaaatactcccgcggggagc

SEQ ID NO: 612561 - DNA, 25 bp, Rattus norvegicus
cccaataaagcgagacagatgtagg

SEQ ID NO: 612562 - DNA, 25 bp, Rattus norvegicus
aagttgactttgactggggtgcaga

SEQ ID NO: 612563 - DNA, 25 bp, Rattus norvegicus
tgtgcagcgagcagaaaacaacggc

SEQ ID NO: 612564 - DNA, 25 bp, Rattus norvegicus
cccggctctctgcttacgtgactag

SEQ ID NO: 612565 - DNA, 25 bp, Rattus norvegicus
ttacgtgactagtggccacgccgga

SEQ ID NO: 612566 - DNA, 25 bp, Rattus norvegicus
cttctgttagcaaaggtggataatc

SEQ ID NO: 612567 - DNA, 25 bp, Rattus norvegicus
ccgactcgcgttattgctgtgcaca

SEQ ID NO: 612568 - DNA, 25 bp, Rattus norvegicus
gccgagggactgattacgcacatga

SEQ ID NO: 612569 - DNA, 25 bp, Rattus norvegicus
cttgccgagcctcgctgcgtgcggt

SEQ ID NO: 612570 - DNA, 25 bp, Rattus norvegicus
tctcgctgtgtggatctgtgtgtat

SEQ ID NO: 612571 - DNA, 25 bp, Rattus norvegicus
ctcgcagcgcgcctccttgcgcggc

SEQ ID NO: 612572 - DNA, 25 bp, Rattus norvegicus
ccgcgtttgcccatggaggcacggt

SEQ ID NO: 612573 - DNA, 25 bp, Rattus norvegicus
tttgcccatggaggcacggtggtcc

SEQ ID NO: 612574 - DNA, 25 bp, Rattus norvegicus
agatccggcctgctgaagccgagga

SEQ ID NO: 612575 - DNA, 25 bp, Rattus norvegicus
ctgacttgccgagcctcgctgcgtg

SEQ ID NO: 612576 - DNA, 25 bp, Rattus norvegicus
tgtcgctctcgctgtgtggatctgt

SEQ ID NO: 612577 - DNA, 25 bp, Rattus norvegicus
ctgtgtgtatgggagattgaatgaa

SEQ ID NO: 612578 - DNA, 25 bp, Rattus norvegicus
tgggagattgaatgaacctacagga

SEQ ID NO: 612579 - DNA, 25 bp, Rattus norvegicus
tgaatgaacctacaggacagacgga

SEQ ID NO: 612580 - DNA, 25 bp, Rattus norvegicus
gtcctagtgcgagcctgtcgccatc

SEQ ID NO: 612581 - DNA, 25 bp, Rattus norvegicus
agtgcgagcctgtcgccatctgacc

SEQ ID NO: 612582 - DNA, 25 bp, Rattus norvegicus
agtgtgagtgtgtgtcgctctcgct

SEQ ID NO: 612583 - DNA, 25 bp, Rattus norvegicus
gctctggcgggaccagccgaactac

SEQ ID NO: 612584 - DNA, 25 bp, Rattus norvegicus
ttaaagccctttcctctcgctgcag

SEQ ID NO: 612585 - DNA, 25 bp, Rattus norvegicus
cgctgcctcaaaacatcatttaaag

SEQ ID NO: 612586 - DNA, 25 bp, Rattus norvegicus
gcgtctagctctcgctgcctcaaaa

SEQ ID NO: 612587 - DNA, 25 bp, Rattus norvegicus
cgacacctagtctgcgacgcgtcta

SEQ ID NO: 612588 - DNA, 25 bp, Rattus norvegicus
gaagcggcgacacctagtctgcgac

SEQ ID NO: 612589 - DNA, 25 bp, Rattus norvegicus
ctcttaacgtctctcggctccgggg

SEQ ID NO: 612590 - DNA, 25 bp, Rattus norvegicus
caggcacggttcacctgaggccgcg

SEQ ID NO: 612591 - DNA, 25 bp, Rattus norvegicus
cccacaggcgggagagccttagctc

SEQ ID NO: 612592 - DNA, 25 bp, Rattus norvegicus
ggcgggagagccttagctcctccca

SEQ ID NO: 612593 - DNA, 25 bp, Rattus norvegicus
ctgcaggcttgacccttccagcacc

SEQ ID NO: 612594 - DNA, 25 bp, Rattus norvegicus
gggccctcgtagctcaagagcgtgc

SEQ ID NO: 612595 - DNA, 25 bp, Rattus norvegicus
gccagcgttcttgctcgtcccaata

SEQ ID NO: 612596 - DNA, 25 bp, Rattus norvegicus
cgttcttgctcgtcccaataggcca

SEQ ID NO: 612597 - DNA, 25 bp, Rattus norvegicus
taaacaaaccgcgcgcgggctgcag

SEQ ID NO: 612598 - DNA, 25 bp, Rattus norvegicus
aggcgtgcaagaagctcgcgagcga

SEQ ID NO: 612599 - DNA, 25 bp, Rattus norvegicus
gtcgcttcgaccacagcctcgggct

SEQ ID NO: 612600 - DNA, 25 bp, Rattus norvegicus
aggtaacggctggacgccgtcgctt

SEQ ID NO: 612601 - DNA, 25 bp, Rattus norvegicus
tgcggatgatcaacgtgcagcgcct

SEQ ID NO: 612602 - DNA, 25 bp, Rattus norvegicus
gactgtagccgtctgtggcgcctcc

SEQ ID NO: 612603 - DNA, 25 bp, Rattus norvegicus
tcgtcgtgggactgtagccgtctgt

SEQ ID NO: 612604 - DNA, 25 bp, Rattus norvegicus
cgccgcacatgtccagggtcgtcgt

SEQ ID NO: 612605 - DNA, 25 bp, Rattus norvegicus
cgtgctcgcgcggagaagtaaacaa

SEQ ID NO: 612606 - DNA, 25 bp, Rattus norvegicus
ctacatttcccatggggcagcggaa

SEQ ID NO: 612607 - DNA, 25 bp, Rattus norvegicus
acacccgacgtgtactggcttgggg

SEQ ID NO: 612608 - DNA, 25 bp, Rattus norvegicus
tcgacacccgacgtgtactggcttg

SEQ ID NO: 612609 - DNA, 25 bp, Rattus norvegicus
tgctccacgcgcaagcgcatggagg

SEQ ID NO: 612610 - DNA, 25 bp, Rattus norvegicus
cacatgtccagggtcgtcgtgggac

SEQ ID NO: 612611 - DNA, 25 bp, Rattus norvegicus
cgacaagtcccgtaaagtgtacgca

SEQ ID NO: 612612 - DNA, 25 bp, Rattus norvegicus
cgtcagttccgcctcgtagtgggaa

SEQ ID NO: 612613 - DNA, 25 bp, Rattus norvegicus
cttcagaggctcgttaccttgggtg

SEQ ID NO: 612614 - DNA, 25 bp, Rattus norvegicus
tgtacgcagactaaacatacgggtc

SEQ ID NO: 612615 - DNA, 25 bp, Rattus norvegicus
tcctcttgaacaaactgcggcttcg

SEQ ID NO: 612616 - DNA, 25 bp, Rattus norvegicus
gaagcctggaatcccggccgagcct

SEQ ID NO: 612617 - DNA, 25 bp, Rattus norvegicus
aggcaggttcgtcttacgtcagttc

SEQ ID NO: 612618 - DNA, 25 bp, Rattus norvegicus
ggaaatttccaccacgacgagattc

SEQ ID NO: 612619 - DNA, 25 bp, Rattus norvegicus
gactaggcctgaccctccttcagag

SEQ ID NO: 612620 - DNA, 25 bp, Rattus norvegicus
tcacagaggacctcgtcggaacggc

SEQ ID NO: 612621 - DNA, 25 bp, Rattus norvegicus
tttcggaccaggaaacctcagcttc

SEQ ID NO: 612622 - DNA, 25 bp, Rattus norvegicus
ggggttagacaagccagccctcctc

SEQ ID NO: 612623 - DNA, 25 bp, Rattus norvegicus
ccgagccttccagtctgaggggtta

SEQ ID NO: 612624 - DNA, 25 bp, Rattus norvegicus
gatgtacaaactctcgcgaaatggc

SEQ ID NO: 612625 - DNA, 25 bp, Rattus norvegicus
ttggccttatatgggcactcacgtc

SEQ ID NO: 612626 - DNA, 25 bp, Rattus norvegicus
cgcttgggaggtctttgcaaacgtc

SEQ ID NO: 612627 - DNA, 25 bp, Rattus norvegicus
tttttctcgctctgactaagacgcc

SEQ ID NO: 612628 - DNA, 25 bp, Rattus norvegicus
gccggctgcgcaagatgctccgcaa

SEQ ID NO: 612629 - DNA, 25 bp, Rattus norvegicus
tcacgtcacaggacgcgcactcatt

SEQ ID NO: 612630 - DNA, 25 bp, Rattus norvegicus
tcattcacataaaacgcagcgctgc

SEQ ID NO: 612631 - DNA, 25 bp, Rattus norvegicus
ggcatgaaggtcacgtcgctcgacg

SEQ ID NO: 612632 - DNA, 25 bp, Rattus norvegicus
tcaacctcaactccgtggtgctgcg

SEQ ID NO: 612633 - DNA, 25 bp, Rattus norvegicus
ggcatcctctctgtcctctggtctg

SEQ ID NO: 612634 - DNA, 25 bp, Rattus norvegicus
acttccttaaaggtgagcttgttcg

SEQ ID NO: 612635 - DNA, 25 bp, Rattus norvegicus
tcctgcctaggaactctgcaccgga

SEQ ID NO: 612636 - DNA, 25 bp, Rattus norvegicus
ctgcaccggagaaagtcaccacttg

SEQ ID NO: 612637 - DNA, 25 bp, Rattus norvegicus
tttcctcgaaagctctggcatcctc

SEQ ID NO: 612638 - DNA, 25 bp, Rattus norvegicus
tgcaaacgtcagctcccagggcttc

SEQ ID NO: 612639 - DNA, 25 bp, Rattus norvegicus
gtgccgcgccagttcttttcaagtt

SEQ ID NO: 612640 - DNA, 25 bp, Rattus norvegicus
tactcggcctggagcgtcaccgcga

SEQ ID NO: 612641 - DNA, 25 bp, Rattus norvegicus
gagccgagcctactcaccgggagct

SEQ ID NO: 612642 - DNA, 25 bp, Rattus norvegicus
ggctgggatgcacgttaatttcaca

SEQ ID NO: 612643 - DNA, 25 bp, Rattus norvegicus
agagagaaacccgagcccacgtggc

SEQ ID NO: 612644 - DNA, 25 bp, Rattus norvegicus
gtcctcgccgaagagagaaacccga

SEQ ID NO: 612645 - DNA, 25 bp, Rattus norvegicus
tggcgcgggactaaccttgcgaccc

SEQ ID NO: 612646 - DNA, 25 bp, Rattus norvegicus
ggcagccatcgcgtactcggcctgg

SEQ ID NO: 612647 - DNA, 25 bp, Rattus norvegicus
ttcacaccgagtgtccatcggaatg

SEQ ID NO: 612648 - DNA, 25 bp, Rattus norvegicus
ggcggagcgcgtctcttacctcggc

SEQ ID NO: 612649 - DNA, 25 bp, Rattus norvegicus
ccgatccgaggctggcgccctagga

SEQ ID NO: 612650 - DNA, 25 bp, Rattus norvegicus
gagagtaacagaccagcggctcgga

SEQ ID NO: 612651 - DNA, 25 bp, Rattus norvegicus
gaagcctccattcggctagcctgaa

SEQ ID NO: 612652 - DNA, 25 bp, Rattus norvegicus
aaagcggctgcacggtcctcgccga

SEQ ID NO: 612653 - DNA, 25 bp, Rattus norvegicus
tccttcgcactcacgggccatgaga

SEQ ID NO: 612654 - DNA, 25 bp, Rattus norvegicus
ctacgttcaagtccgacaggccatc

SEQ ID NO: 612655 - DNA, 25 bp, Rattus norvegicus
tgggctgaaggctatctctcccttg

SEQ ID NO: 612656 - DNA, 25 bp, Rattus norvegicus
ggcgcggagccatgtacatcaagca

SEQ ID NO: 612657 - DNA, 25 bp, Rattus norvegicus
ttgcggttctgaggtgaagctttcc

SEQ ID NO: 612658 - DNA, 25 bp, Rattus norvegicus
cgccgccattttatttgaccacagg

SEQ ID NO: 612659 - DNA, 25 bp, Rattus norvegicus
cgcgcctgcacactcggttgtttac

SEQ ID NO: 612660 - DNA, 25 bp, Rattus norvegicus
tcaattccagagtggttccttcggc

SEQ ID NO: 612661 - DNA, 25 bp, Rattus norvegicus
tcttttcgacgccacagagcggggc

SEQ ID NO: 612662 - DNA, 25 bp, Rattus norvegicus
tcgagcaaggctcctccgagtccag

SEQ ID NO: 612663 - DNA, 25 bp, Rattus norvegicus
cgcgaccatagtcccggcgtacgga

SEQ ID NO: 612664 - DNA, 25 bp, Rattus norvegicus
ctcgtctcactctaggctttggcgc

SEQ ID NO: 612665 - DNA, 25 bp, Rattus norvegicus
tgtcaaaatggtcttcccgcgcaag

SEQ ID NO: 612666 - DNA, 25 bp, Rattus norvegicus
tccttttaaagcagaccggcggcca

SEQ ID NO: 612667 - DNA, 25 bp, Rattus norvegicus
tctgcagctcactgcgtctcgggtg

SEQ ID NO: 612668 - DNA, 25 bp, Rattus norvegicus
gtgtcgccctctcacgaggctgtcg

SEQ ID NO: 612669 - DNA, 25 bp, Rattus norvegicus
cctgtgcgctctggaagaagctaca

SEQ ID NO: 612670 - DNA, 25 bp, Rattus norvegicus
gtgcacttcgcgctggtgatgtcct

SEQ ID NO: 612671 - DNA, 25 bp, Rattus norvegicus
tccagcttcaggaggatgccaaacc

SEQ ID NO: 612672 - DNA, 25 bp, Rattus norvegicus
tgtcccacccacctagggaaggatg

SEQ ID NO: 612673 - DNA, 25 bp, Rattus norvegicus
cgcgcagttagaagagccggtgaac

SEQ ID NO: 612674 - DNA, 25 bp, Rattus norvegicus
agttccgggacctgatcatctgagc

SEQ ID NO: 612675 - DNA, 25 bp, Rattus norvegicus
gaccacgaagcgacagctggaactg

SEQ ID NO: 612676 - DNA, 25 bp, Rattus norvegicus
gcctgttgcctctgggaccacgaag

SEQ ID NO: 612677 - DNA, 25 bp, Rattus norvegicus
ttcttttgctcttatggggtcctgg

SEQ ID NO: 612678 - DNA, 25 bp, Rattus norvegicus
acgtgtgcctgattttcttttgctc

SEQ ID NO: 612679 - DNA, 25 bp, Rattus norvegicus
tcacggagacgtgccaataaatacg

SEQ ID NO: 612680 - DNA, 25 bp, Rattus norvegicus
ggcaggcacagttgtccaggtcacc

SEQ ID NO: 612681 - DNA, 25 bp, Rattus norvegicus
gagcttcttttaccagcactttggt

SEQ ID NO: 612682 - DNA, 25 bp, Rattus norvegicus
tgcgggtgctcgctctccgaggcca

SEQ ID NO: 612683 - DNA, 25 bp, Rattus norvegicus
ttacaagtatctagttttttgaata

SEQ ID NO: 612684 - DNA, 25 bp, Rattus norvegicus
ccttagagttgaacttacaagtatc

SEQ ID NO: 612685 - DNA, 25 bp, Rattus norvegicus
gagatgacttctccttagagttgaa

SEQ ID NO: 612686 - DNA, 25 bp, Rattus norvegicus
aataaagatgtggagatgacttctc

SEQ ID NO: 612687 - DNA, 25 bp, Rattus norvegicus
ggtgtgtcaattcaaaataaagatg

SEQ ID NO: 612688 - DNA, 25 bp, Rattus norvegicus
ggggaggaccatttaaatcaatcaa

SEQ ID NO: 612689 - DNA, 25 bp, Rattus norvegicus
gcactttggttatttctaagccttg

SEQ ID NO: 612690 - DNA, 25 bp, Rattus norvegicus
gaatttttatccttgcatgcaatgt

SEQ ID NO: 612691 - DNA, 25 bp, Rattus norvegicus
gttctgatattgagcttcttttacc

SEQ ID NO: 612692 - DNA, 25 bp, Rattus norvegicus
ggacgtcctcctctcggccaataaa

SEQ ID NO: 612693 - DNA, 25 bp, Rattus norvegicus
ccttgcatgcaatgttctgatattg

SEQ ID NO: 612694 - DNA, 25 bp, Rattus norvegicus
agccttgttaaggtgtgtcaattca

SEQ ID NO: 612695 - DNA, 25 bp, Rattus norvegicus
ccctccctgctgttcatccggcctg

SEQ ID NO: 612696 - DNA, 25 bp, Rattus norvegicus
ggcagcctcgccctacagggaacct

SEQ ID NO: 612697 - DNA, 25 bp, Rattus norvegicus
gctagtagtcttctccgagctccct

SEQ ID NO: 612698 - DNA, 25 bp, Rattus norvegicus
cctacagggaacctcagaggggcgg

SEQ ID NO: 612699 - DNA, 25 bp, Rattus norvegicus
gcggagggaaggctggccaccgccc

SEQ ID NO: 612700 - DNA, 25 bp, Rattus norvegicus
caccagccggaaaggaaaccttctg

SEQ ID NO: 612701 - DNA, 25 bp, Rattus norvegicus
cagccggaaaggaaaccttctgcca

SEQ ID NO: 612702 - DNA, 25 bp, Rattus norvegicus
gaaaggaaaccttctgccagcggaa

SEQ ID NO: 612703 - DNA, 25 bp, Rattus norvegicus
aaggaaaccttctgccagcggaagc

SEQ ID NO: 612704 - DNA, 25 bp, Rattus norvegicus
gccctgggccttagctagtagtctt

SEQ ID NO: 612705 - DNA, 25 bp, Rattus norvegicus
tagctagtagtcttctccgagctcc

SEQ ID NO: 612706 - DNA, 25 bp, Rattus norvegicus
cgcgtgtcccacagtgcagacctag

SEQ ID NO: 612707 - DNA, 25 bp, Rattus norvegicus
tgtgtcgcgtgtcccacagtgcaga

SEQ ID NO: 612708 - DNA, 25 bp, Rattus norvegicus
cagacctagggtctgcgggtcctct

SEQ ID NO: 612709 - DNA, 25 bp, Rattus norvegicus
tcgtggccagccgaagagagtcacg

SEQ ID NO: 612710 - DNA, 25 bp, Rattus norvegicus
ccgaagagagtcacgcgtgcacctc

SEQ ID NO: 612711 - DNA, 25 bp, Rattus norvegicus
acgcgtgcacctcgctcggaacttt

SEQ ID NO: 612712 - DNA, 25 bp, Rattus norvegicus
tcggaactttccacgcgcggcctgt

SEQ ID NO: 612713 - DNA, 25 bp, Rattus norvegicus
cctgcgctgatttccatgacaaagc

SEQ ID NO: 612714 - DNA, 25 bp, Rattus norvegicus
tccttcctcggaatcgtgggttgtc

SEQ ID NO: 612715 - DNA, 25 bp, Rattus norvegicus
tcggaatcgtgggttgtctgctccg

SEQ ID NO: 612716 - DNA, 25 bp, Rattus norvegicus
ggctgtcctgcgctgatttccatga

SEQ ID NO: 612717 - DNA, 25 bp, Rattus norvegicus
gctgccgcgcagatgacagatcgcc

SEQ ID NO: 612718 - DNA, 25 bp, Rattus norvegicus
ttccatgacaaagcgcgtgtttacc

SEQ ID NO: 612719 - DNA, 25 bp, Rattus norvegicus
gcgtgtttacctgcggctgcagccc

SEQ ID NO: 612720 - DNA, 25 bp, Rattus norvegicus
gcgggcctttgtccctggatcagat

SEQ ID NO: 612721 - DNA, 25 bp, Rattus norvegicus
ttaccctagcagctgctcgtggcca

SEQ ID NO: 612722 - DNA, 25 bp, Rattus norvegicus
ctggatcagattaccctagcagctg

SEQ ID NO: 612723 - DNA, 25 bp, Rattus norvegicus
cacagaccgaccctgcggggagatc

SEQ ID NO: 612724 - DNA, 25 bp, Rattus norvegicus
gggagcaaccggctgcccctgacag

SEQ ID NO: 612725 - DNA, 25 bp, Rattus norvegicus
ctctgccttcctgcctgtccgggga

SEQ ID NO: 612726 - DNA, 25 bp, Rattus norvegicus
ccggtcggtcagtcgcgctccggtt

SEQ ID NO: 612727 - DNA, 25 bp, Rattus norvegicus
gcgctccggttgctcccggctctcg

SEQ ID NO: 612728 - DNA, 25 bp, Rattus norvegicus
cggccgtggttatgtggggctatga

SEQ ID NO: 612729 - DNA, 25 bp, Rattus norvegicus
aaggggaggcccacaggtcctgaca

SEQ ID NO: 612730 - DNA, 25 bp, Rattus norvegicus
gccctgctaaacacgcctgatggca

SEQ ID NO: 612731 - DNA, 25 bp, Rattus norvegicus
taaacacgcctgatggcaatctccg

SEQ ID NO: 612732 - DNA, 25 bp, Rattus norvegicus
tgatggcaatctccgcgtcggcttt

SEQ ID NO: 612733 - DNA, 25 bp, Rattus norvegicus
ggcaatctccgcgtcggctttgagg

SEQ ID NO: 612734 - DNA, 25 bp, Rattus norvegicus
ctttgagggctagaggaaaagtagt

SEQ ID NO: 612735 - DNA, 25 bp, Rattus norvegicus
gctagaggaaaagtagtgtaactcc

SEQ ID NO: 612736 - DNA, 25 bp, Rattus norvegicus
tggccgccgagaccgccctgctaaa

SEQ ID NO: 612737 - DNA, 25 bp, Rattus norvegicus
gacaccttggggtgcatggcgctca

SEQ ID NO: 612738 - DNA, 25 bp, Rattus norvegicus
gagccagcagctcgcggaatcctct

SEQ ID NO: 612739 - DNA, 25 bp, Rattus norvegicus
tcttgcaaacccttgcgggcccagg

SEQ ID NO: 612740 - DNA, 25 bp, Rattus norvegicus
ctgtcagcgggtggtcccatgagcc

SEQ ID NO: 612741 - DNA, 25 bp, Rattus norvegicus
tgcatggcgctcagcccgatctggc

SEQ ID NO: 612742 - DNA, 25 bp, Rattus norvegicus
gcagctcgcacagcgctcgggtcca

SEQ ID NO: 612743 - DNA, 25 bp, Rattus norvegicus
ccggactcttgcaaacccttgcggg

SEQ ID NO: 612744 - DNA, 25 bp, Rattus norvegicus
ggtccctggagcaatacggtgccca

SEQ ID NO: 612745 - DNA, 25 bp, Rattus norvegicus
agccctgcgggtgctgccactgcag

SEQ ID NO: 612746 - DNA, 25 bp, Rattus norvegicus
ggaatcctctgctgcctcggtttcc

SEQ ID NO: 612747 - DNA, 25 bp, Rattus norvegicus
gtggtcccatgagccagcagctcgc

SEQ ID NO: 612748 - DNA, 25 bp, Rattus norvegicus
ccgatctggcgtagcagctgtcagc

SEQ ID NO: 612749 - DNA, 25 bp, Rattus norvegicus
tcagcccgatctggcgtagcagctg

SEQ ID NO: 612750 - DNA, 25 bp, Rattus norvegicus
tgccagcgcttcagccctgcgcttg

SEQ ID NO: 612751 - DNA, 25 bp, Rattus norvegicus
cacgtcaactgaatggctcgccgtc

SEQ ID NO: 612752 - DNA, 25 bp, Rattus norvegicus
gtggttcctcattttatctattctg

SEQ ID NO: 612753 - DNA, 25 bp, Rattus norvegicus
ctggctttctgagccgaggaaccgg

SEQ ID NO: 612754 - DNA, 25 bp, Rattus norvegicus
ctcagcgaggtgtgtctggctttct

SEQ ID NO: 612755 - DNA, 25 bp, Rattus norvegicus
ttgtctcagcgaggtgtgtctggct

SEQ ID NO: 612756 - DNA, 25 bp, Rattus norvegicus
ttctgttgtctcagcgaggtgtgtc

SEQ ID NO: 612757 - DNA, 25 bp, Rattus norvegicus
tatctattctgttgtctcagcgagg

SEQ ID NO: 612758 - DNA, 25 bp, Rattus norvegicus
cgtcctagtggttcctcattttatc

SEQ ID NO: 612759 - DNA, 25 bp, Rattus norvegicus
gccgtcctagtggttcctcatttta

SEQ ID NO: 612760 - DNA, 25 bp, Rattus norvegicus
gctcgccgtcctagtggttcctcat

SEQ ID NO: 612761 - DNA, 25 bp, Rattus norvegicus
aactgaatggctcgccgtcctagtg

SEQ ID NO: 612762 - DNA, 25 bp, Rattus norvegicus
gaaaaggagccacgtcaactgaatg

SEQ ID NO: 612763 - DNA, 25 bp, Rattus norvegicus
tcaactgaatggctcgccgtcctag

SEQ ID NO: 612764 - DNA, 25 bp, Rattus norvegicus
cggcggaaaaggagccacgtcaact

SEQ ID NO: 612765 - DNA, 25 bp, Rattus norvegicus
gcggcccttcacagggtaagggatc

SEQ ID NO: 612766 - DNA, 25 bp, Rattus norvegicus
ggcttggaattcacagctcgctgtg

SEQ ID NO: 612767 - DNA, 25 bp, Rattus norvegicus
ttggaattcacagctcgctgtgccc

SEQ ID NO: 612768 - DNA, 25 bp, Rattus norvegicus
ggaagcggcttggaattcacagctc

SEQ ID NO: 612769 - DNA, 25 bp, Rattus norvegicus
ttcaggaagcggcttggaattcaca

SEQ ID NO: 612770 - DNA, 25 bp, Rattus norvegicus
ggcatcccgaatccctcctccctgt

SEQ ID NO: 612771 - DNA, 25 bp, Rattus norvegicus
ccacttcaggaagcggcttggaatt

SEQ ID NO: 612772 - DNA, 25 bp, Rattus norvegicus
tccctgtccacttcaggaagcggct

SEQ ID NO: 612773 - DNA, 25 bp, Rattus norvegicus
ttcgtgcgcgtgacagaggcatccc

SEQ ID NO: 612774 - DNA, 25 bp, Rattus norvegicus
tgtgatcctaggacggggttcgtgc

SEQ ID NO: 612775 - DNA, 25 bp, Rattus norvegicus
tggaaccgggtgtgatcctaggacg

SEQ ID NO: 612776 - DNA, 25 bp, Rattus norvegicus
cccttcacagggtaagggatctgga

SEQ ID NO: 612777 - DNA, 25 bp, Rattus norvegicus
ttcacagggtaagggatctggaacc

SEQ ID NO: 612778 - DNA, 25 bp, Rattus norvegicus
tgtccacttcaggaagcggcttgga

SEQ ID NO: 612779 - DNA, 25 bp, Rattus norvegicus
tgtcaataatctccgctcccagact

SEQ ID NO: 612780 - DNA, 25 bp, Rattus norvegicus
gtccgcattgtctttcggaacccgc

SEQ ID NO: 612781 - DNA, 25 bp, Rattus norvegicus
tcgcacgcagcgcacaggccgcacc

SEQ ID NO: 612782 - DNA, 25 bp, Rattus norvegicus
tcccggcgcccaaaggatcattgtt

SEQ ID NO: 612783 - DNA, 25 bp, Rattus norvegicus
cccaaaggatcattgttggccgccc

SEQ ID NO: 612784 - DNA, 25 bp, Rattus norvegicus
ccggctgtttatttatgcacacgtc

SEQ ID NO: 612785 - DNA, 25 bp, Rattus norvegicus
tttatttatgcacacgtcacccgcg

SEQ ID NO: 612786 - DNA, 25 bp, Rattus norvegicus
tttatgcacacgtcacccgcgaggc

SEQ ID NO: 612787 - DNA, 25 bp, Rattus norvegicus
ccctggcatctcattaaggcgagtg

SEQ ID NO: 612788 - DNA, 25 bp, Rattus norvegicus
tctcattaaggcgagtgtgttcctc

SEQ ID NO: 612789 - DNA, 25 bp, Rattus norvegicus
gagtgtgttcctctcgccctgtcaa

SEQ ID NO: 612790 - DNA, 25 bp, Rattus norvegicus
cctccaggagcgaggcccgcaccgt

SEQ ID NO: 612791 - DNA, 25 bp, Rattus norvegicus
gttcctctcgccctgtcaataatct

SEQ ID NO: 612792 - DNA, 25 bp, Rattus norvegicus
tccgctcccagactactccgttcct

SEQ ID NO: 612793 - DNA, 25 bp, Rattus norvegicus
ccacttacccggcatggaagtggtg

SEQ ID NO: 612794 - DNA, 25 bp, Rattus norvegicus
gaagccgggcccttgtagtgatcgc

SEQ ID NO: 612795 - DNA, 25 bp, Rattus norvegicus
aacgaatgaggtctccggagcaggc

SEQ ID NO: 612796 - DNA, 25 bp, Rattus norvegicus
actcagcggaacgaatgaggtctcc

SEQ ID NO: 612797 - DNA, 25 bp, Rattus norvegicus
ggtttggaactcagcggaacgaatg

SEQ ID NO: 612798 - DNA, 25 bp, Rattus norvegicus
cgtggctgtcctgacttggggcttc

SEQ ID NO: 612799 - DNA, 25 bp, Rattus norvegicus
ccttgtagtgatcgcgcacccggac

SEQ ID NO: 612800 - DNA, 25 bp, Rattus norvegicus
ttttcccgcagggagcccgagtcca

SEQ ID NO: 612801 - DNA, 25 bp, Rattus norvegicus
tttcagcgggttcagttttcccgca

SEQ ID NO: 612802 - DNA, 25 bp, Rattus norvegicus
cttagccacggaacgcagtttcagc

SEQ ID NO: 612803 - DNA, 25 bp, Rattus norvegicus
agcctcggcgctcttagccacggaa

SEQ ID NO: 612804 - DNA, 25 bp, Rattus norvegicus
gcaatcttgttctccagcctcggcg

SEQ ID NO: 612805 - DNA, 25 bp, Rattus norvegicus
ggccggccagcaatcttgttctcca

SEQ ID NO: 612806 - DNA, 25 bp, Rattus norvegicus
gcttcctccgggtttggaactcagc

SEQ ID NO: 612807 - DNA, 25 bp, Rattus norvegicus
gctaaaaagtttctcccgctctctc

SEQ ID NO: 612808 - DNA, 25 bp, Rattus norvegicus
gctccgaaagtttccgagataaatc

SEQ ID NO: 612809 - DNA, 25 bp, Rattus norvegicus
ctcgctccgaaagtttccgagataa

SEQ ID NO: 612810 - DNA, 25 bp, Rattus norvegicus
tggctgcgaaaacttgtaaccgtgt

SEQ ID NO: 612811 - DNA, 25 bp, Rattus norvegicus
gctgctggctgcgaaaacttgtaac

SEQ ID NO: 612812 - DNA, 25 bp, Rattus norvegicus
tccgattccgaggtaggaagagccc

SEQ ID NO: 612813 - DNA, 25 bp, Rattus norvegicus
atgttagcggccaagaggcaagatg

SEQ ID NO: 612814 - DNA, 25 bp, Rattus norvegicus
agacgaatcaaaacagctcctccga

SEQ ID NO: 612815 - DNA, 25 bp, Rattus norvegicus
cccaacggatcgctctcgcccaccg

SEQ ID NO: 612816 - DNA, 25 bp, Rattus norvegicus
ttggtcaatgaatcagagacgaatc

SEQ ID NO: 612817 - DNA, 25 bp, Rattus norvegicus
tcaagtcgtcgttggtcaatgaatc

SEQ ID NO: 612818 - DNA, 25 bp, Rattus norvegicus
agccgatgtcaagtcgtcgttggtc

SEQ ID NO: 612819 - DNA, 25 bp, Rattus norvegicus
cagctcctccgattccgaggtagga

SEQ ID NO: 612820 - DNA, 25 bp, Rattus norvegicus
cccgccatgttagcggccaagaggc

SEQ ID NO: 612821 - DNA, 25 bp, Rattus norvegicus
ctttggccgcagaaggagaggcatt

SEQ ID NO: 612822 - DNA, 25 bp, Rattus norvegicus
acctcgaaatcaacaggctgtccta

SEQ ID NO: 612823 - DNA, 25 bp, Rattus norvegicus
tggtaatgctcgtgtcggggcacac

SEQ ID NO: 612824 - DNA, 25 bp, Rattus norvegicus
acaggctgtcctagttttaagagac

SEQ ID NO: 612825 - DNA, 25 bp, Rattus norvegicus
cgggcgatcgagttttcaggcgctt

SEQ ID NO: 612826 - DNA, 25 bp, Rattus norvegicus
tcctagttttaagagacgtgcacta

SEQ ID NO: 612827 - DNA, 25 bp, Rattus norvegicus
ggacctagacagtcggcaactggga

SEQ ID NO: 612828 - DNA, 25 bp, Rattus norvegicus
acgtgcactaggacagcttcgaacc

SEQ ID NO: 612829 - DNA, 25 bp, Rattus norvegicus
gtcggggcacacctcgaaatcaaca

SEQ ID NO: 612830 - DNA, 25 bp, Rattus norvegicus
taggacagcttcgaaccacctttgg

SEQ ID NO: 612831 - DNA, 25 bp, Rattus norvegicus
ttcgaaccacctttggccgcagaag

SEQ ID NO: 612832 - DNA, 25 bp, Rattus norvegicus
agaggcattgaacgaatgggtctta

SEQ ID NO: 612833 - DNA, 25 bp, Rattus norvegicus
ataacttcggacctagacagtcggc

SEQ ID NO: 612834 - DNA, 25 bp, Rattus norvegicus
ttgaacgaatgggtcttaagcggta

SEQ ID NO: 612835 - DNA, 25 bp, Rattus norvegicus
ctgtgaatggaactgtgcctgagca

SEQ ID NO: 612836 - DNA, 25 bp, Rattus norvegicus
tccgtgcggcagcatgcctgcgagc

SEQ ID NO: 612837 - DNA, 25 bp, Rattus norvegicus
catccgtgcggcagcatgcctgcga

SEQ ID NO: 612838 - DNA, 25 bp, Rattus norvegicus
aactgtgcctgagcatcccgcgcag

SEQ ID NO: 612839 - DNA, 25 bp, Rattus norvegicus
atggaactgtgcctgagcatcccgc

SEQ ID NO: 612840 - DNA, 25 bp, Rattus norvegicus
tgaatggaactgtgcctgagcatcc

SEQ ID NO: 612841 - DNA, 25 bp, Rattus norvegicus
tcgctgtgaatggaactgtgcctga

SEQ ID NO: 612842 - DNA, 25 bp, Rattus norvegicus
cgcttcgctgtgaatggaactgtgc

SEQ ID NO: 612843 - DNA, 25 bp, Rattus norvegicus
tgtgcgcttcgctgtgaatggaact

SEQ ID NO: 612844 - DNA, 25 bp, Rattus norvegicus
gttattgtgcgcttcgctgtgaatg

SEQ ID NO: 612845 - DNA, 25 bp, Rattus norvegicus
cccggttattgtgcgcttcgctgtg

SEQ ID NO: 612846 - DNA, 25 bp, Rattus norvegicus
atcccggttattgtgcgcttcgctg

SEQ ID NO: 612847 - DNA, 25 bp, Rattus norvegicus
ggagatcccggttattgtgcgcttc

SEQ ID NO: 612848 - DNA, 25 bp, Rattus norvegicus
agatcccggttattgtgcgcttcgc

SEQ ID NO: 612849 - DNA, 25 bp, Rattus norvegicus
ctgcttgcaaggcactgtggctctg

SEQ ID NO: 612850 - DNA, 25 bp, Rattus norvegicus
caaagcttgcagaaggcgggacaca

SEQ ID NO: 612851 - DNA, 25 bp, Rattus norvegicus
tggcgagggcttcccgctcgagctt

SEQ ID NO: 612852 - DNA, 25 bp, Rattus norvegicus
ttcagtttccctaaagctgccctcg

SEQ ID NO: 612853 - DNA, 25 bp, Rattus norvegicus
cgccagttctgtagagagcgctcta

SEQ ID NO: 612854 - DNA, 25 bp, Rattus norvegicus
ctgccgctgtgggaacggtaacttg

SEQ ID NO: 612855 - DNA, 25 bp, Rattus norvegicus
gaacggtaacttgggccgccatcgc

SEQ ID NO: 612856 - DNA, 25 bp, Rattus norvegicus
aacttgggccgccatcgcggctttc

SEQ ID NO: 612857 - DNA, 25 bp, Rattus norvegicus
caggctcgcagaacctgcttgcaag

SEQ ID NO: 612858 - DNA, 25 bp, Rattus norvegicus
tcctggtctggggtctggcgacatc

SEQ ID NO: 612859 - DNA, 25 bp, Rattus norvegicus
tttgctcagcatggcgtcccgtggc

SEQ ID NO: 612860 - DNA, 25 bp, Rattus norvegicus
cagcgctggctttgctcagcatggc

SEQ ID NO: 612861 - DNA, 25 bp, Rattus norvegicus
gtctggcgacatccggtgccattcc

SEQ ID NO: 612862 - DNA, 25 bp, Rattus norvegicus
ctggggtcgcccaaagcttgcagaa

SEQ ID NO: 612863 - DNA, 25 bp, Rattus norvegicus
ctctggagtttaattacgcgccggg

SEQ ID NO: 612864 - DNA, 25 bp, Rattus norvegicus
ccctttggactttggcgtctgaagg

SEQ ID NO: 612865 - DNA, 25 bp, Rattus norvegicus
tttggcgtctgaaggaaagcttaga

SEQ ID NO: 612866 - DNA, 25 bp, Rattus norvegicus
tctgaaggaaagcttagagtaggcg

SEQ ID NO: 612867 - DNA, 25 bp, Rattus norvegicus
ggtcgggtccctttctgagacaaga

SEQ ID NO: 612868 - DNA, 25 bp, Rattus norvegicus
gagcccttgggagctcgcgcaacat

SEQ ID NO: 612869 - DNA, 25 bp, Rattus norvegicus
ggagctcgcgcaacatggcggtccc

SEQ ID NO: 612870 - DNA, 25 bp, Rattus norvegicus
gcggcgcgagtctctcgggtcttct

SEQ ID NO: 612871 - DNA, 25 bp, Rattus norvegicus
gagtctctcgggtcttctgcccgcg

SEQ ID NO: 612872 - DNA, 25 bp, Rattus norvegicus
acctctctagagtacgccctgctgg

SEQ ID NO: 612873 - DNA, 25 bp, Rattus norvegicus
ctagagtacgccctgctggacgccg

SEQ ID NO: 612874 - DNA, 25 bp, Rattus norvegicus
tcgaatcaggcgctctgaacgtcca

SEQ ID NO: 612875 - DNA, 25 bp, Rattus norvegicus
tggacagctctggagtttaattacg

SEQ ID NO: 612876 - DNA, 25 bp, Rattus norvegicus
aggcgctctgaacgtccaggctcca

SEQ ID NO: 612877 - DNA, 25 bp, Rattus norvegicus
ccttcgtcctttacttccagttatg

SEQ ID NO: 612878 - DNA, 25 bp, Rattus norvegicus
ttctccgagcggaagtgcaataacg

SEQ ID NO: 612879 - DNA, 25 bp, Rattus norvegicus
aaccaggctcttctccgagcggaag

SEQ ID NO: 612880 - DNA, 25 bp, Rattus norvegicus
agcttcgctttgtcaaaccaggctc

SEQ ID NO: 612881 - DNA, 25 bp, Rattus norvegicus
atgtaagcacaagcttcgctttgtc

SEQ ID NO: 612882 - DNA, 25 bp, Rattus norvegicus
gccaccctctctagcgcttgcgtac

SEQ ID NO: 612883 - DNA, 25 bp, Rattus norvegicus
cggaagtgcaataacggaagcggaa

SEQ ID NO: 612884 - DNA, 25 bp, Rattus norvegicus
gtctgaaatcaggttgacgcatcta

SEQ ID NO: 612885 - DNA, 25 bp, Rattus norvegicus
ttgacgcatctacagacactgactg

SEQ ID NO: 612886 - DNA, 25 bp, Rattus norvegicus
tacagacactgactgctgtgctcct

SEQ ID NO: 612887 - DNA, 25 bp, Rattus norvegicus
tgctcctctgggtaggcaaggctcc

SEQ ID NO: 612888 - DNA, 25 bp, Rattus norvegicus
atccggcgctccttccagccttaaa

SEQ ID NO: 612889 - DNA, 25 bp, Rattus norvegicus
actgcgggtctgaaatcaggttgac

SEQ ID NO: 612890 - DNA, 25 bp, Rattus norvegicus
ttccagttatgtaagcacaagcttc

SEQ ID NO: 612891 - DNA, 25 bp, Rattus norvegicus
cgtgctatgtgtgacggccagcatc

SEQ ID NO: 612892 - DNA, 25 bp, Rattus norvegicus
tcctggccaacgtggtgaaagcttt

SEQ ID NO: 612893 - DNA, 25 bp, Rattus norvegicus
catcatcatgggtgtgttcacgctc

SEQ ID NO: 612894 - DNA, 25 bp, Rattus norvegicus
gctgctcatcgtagtgggcaacgtg

SEQ ID NO: 612895 - DNA, 25 bp, Rattus norvegicus
ggcgctcaagacactgggcatcatc

SEQ ID NO: 612896 - DNA, 25 bp, Rattus norvegicus
ccctgtgcatcatggccttcgtgta

SEQ ID NO: 612897 - DNA, 25 bp, Rattus norvegicus
gcgatttcgtcaccaaccgggccta

SEQ ID NO: 612898 - DNA, 25 bp, Rattus norvegicus
tgcccatcctcatgcactggtggcg

SEQ ID NO: 612899 - DNA, 25 bp, Rattus norvegicus
gtgaaagctttccaccgcgacctgg

SEQ ID NO: 612900 - DNA, 25 bp, Rattus norvegicus
atcgagaccctgtgtgtcatcgccc

SEQ ID NO: 612901 - DNA, 25 bp, Rattus norvegicus
tctggacttcggtagacgtgctatg

SEQ ID NO: 612902 - DNA, 25 bp, Rattus norvegicus
ccttcttctgtgagctctggacttc

SEQ ID NO: 612903 - DNA, 25 bp, Rattus norvegicus
caacgtgttggtgatcgtggccatc

SEQ ID NO: 612904 - DNA, 25 bp, Rattus norvegicus
ccctcgtgtgcacagtgtgggccat

SEQ ID NO: 612905 - DNA, 25 bp, Rattus norvegicus
agtcgcgtacctctcggagctagca

SEQ ID NO: 612906 - DNA, 25 bp, Rattus norvegicus
ggcttggtttcgaggcaccgcctcc

SEQ ID NO: 612907 - DNA, 25 bp, Rattus norvegicus
tcacgtccacgcgtggagtcgcgta

SEQ ID NO: 612908 - DNA, 25 bp, Rattus norvegicus
ccgcaccctagcgaggccgatgaag

SEQ ID NO: 612909 - DNA, 25 bp, Rattus norvegicus
aggccgatgaagctccggctccgga

SEQ ID NO: 612910 - DNA, 25 bp, Rattus norvegicus
gccggcgaatccatggcagcgtcta

SEQ ID NO: 612911 - DNA, 25 bp, Rattus norvegicus
gtgaggaagtcactcgcggagacca

SEQ ID NO: 612912 - DNA, 25 bp, Rattus norvegicus
gcggagaccacagccgattcctggc

SEQ ID NO: 612913 - DNA, 25 bp, Rattus norvegicus
attcctggctctcagccgaggttta

SEQ ID NO: 612914 - DNA, 25 bp, Rattus norvegicus
cccgcggagctgacacatcaacaaa

SEQ ID NO: 612915 - DNA, 25 bp, Rattus norvegicus
ccttgagggagccaatcagtgcgac

SEQ ID NO: 612916 - DNA, 25 bp, Rattus norvegicus
cagtgcgacgcagaccgcgtgacgc

SEQ ID NO: 612917 - DNA, 25 bp, Rattus norvegicus
cgcgtgacgctaagtacctggaggt

SEQ ID NO: 612918 - DNA, 25 bp, Rattus norvegicus
gagggctccgccagcatcgtcacgt

SEQ ID NO: 612919 - DNA, 25 bp, Rattus norvegicus
gtatggcaaacaccggcgtgagtga

SEQ ID NO: 612920 - DNA, 25 bp, Rattus norvegicus
gccttagagaccgatcagggccagc

SEQ ID NO: 612921 - DNA, 25 bp, Rattus norvegicus
ctcagcgccactgcacctgcccgca

SEQ ID NO: 612922 - DNA, 25 bp, Rattus norvegicus
agcacgggtgaagctcttggacttc

SEQ ID NO: 612923 - DNA, 25 bp, Rattus norvegicus
cgttaggagccggaagtccagagct

SEQ ID NO: 612924 - DNA, 25 bp, Rattus norvegicus
tggatcgttaggagccggaagtcca

SEQ ID NO: 612925 - DNA, 25 bp, Rattus norvegicus
ctttcgcctttttctgggtcaggcg

SEQ ID NO: 612926 - DNA, 25 bp, Rattus norvegicus
aagtccagagctggacgttgaggtc

SEQ ID NO: 612927 - DNA, 25 bp, Rattus norvegicus
gcgtgagtgattagccttagagacc

SEQ ID NO: 612928 - DNA, 25 bp, Rattus norvegicus
acaccggcgtgagtgattagcctta

SEQ ID NO: 612929 - DNA, 25 bp, Rattus norvegicus
tgaagctcttggacttcggggctgc

SEQ ID NO: 612930 - DNA, 25 bp, Rattus norvegicus
cacgcggcagccttgagcgtccgag

SEQ ID NO: 612931 - DNA, 25 bp, Rattus norvegicus
gggatcaacagcacgcggcagcctt

SEQ ID NO: 612932 - DNA, 25 bp, Rattus norvegicus
gctcggtgtcaagatcgcctcgggc

SEQ ID NO: 612933 - DNA, 25 bp, Rattus norvegicus
tgcggaatagccaacgcgctctgtg

SEQ ID NO: 612934 - DNA, 25 bp, Rattus norvegicus
ccagtaagcgggcaagcgatagtgc

SEQ ID NO: 612935 - DNA, 25 bp, Rattus norvegicus
cctcaggtgtggaatcgataaaacc

SEQ ID NO: 612936 - DNA, 25 bp, Rattus norvegicus
taccatcccggagaacgcatgcggc

SEQ ID NO: 612937 - DNA, 25 bp, Rattus norvegicus
gggctttgttcgctttgtcctcacg

SEQ ID NO: 612938 - DNA, 25 bp, Rattus norvegicus
tacctgccgagtcaagaggagcgcc

SEQ ID NO: 612939 - DNA, 25 bp, Rattus norvegicus
ctcaccttccaacaggcggggcagg

SEQ ID NO: 612940 - DNA, 25 bp, Rattus norvegicus
cctccgctgggagagaccaacaggt

SEQ ID NO: 612941 - DNA, 25 bp, Rattus norvegicus
ctcacaggctgcattcgagcggtct

SEQ ID NO: 612942 - DNA, 25 bp, Rattus norvegicus
gccaaagtcaacatttcctcaggtg

SEQ ID NO: 612943 - DNA, 25 bp, Rattus norvegicus
cgctctctcggaagtgtttacagtg

SEQ ID NO: 612944 - DNA, 25 bp, Rattus norvegicus
ttgcgggtcgcccagtagaaagaga

SEQ ID NO: 612945 - DNA, 25 bp, Rattus norvegicus
ctcacgctgaacgtagggatcctca

SEQ ID NO: 612946 - DNA, 25 bp, Rattus norvegicus
ctgtgaccacagtgcaccgtttgtg

SEQ ID NO: 612947 - DNA, 25 bp, Rattus norvegicus
gcctagtgcctagagagtctaatga

SEQ ID NO: 612948 - DNA, 25 bp, Rattus norvegicus
taatgagatcactcctccacctgcg

SEQ ID NO: 612949 - DNA, 25 bp, Rattus norvegicus
ggccctagtcctgctctggtagcgc

SEQ ID NO: 612950 - DNA, 25 bp, Rattus norvegicus
ctttgaggacagctgcgaactggcc

SEQ ID NO: 612951 - DNA, 25 bp, Rattus norvegicus
gttgccgcttctggaacgtctccca

SEQ ID NO: 612952 - DNA, 25 bp, Rattus norvegicus
cctcgaagctgagccgttgccgctt

SEQ ID NO: 612953 - DNA, 25 bp, Rattus norvegicus
ctcacaaggtgtccagcagcagctt

SEQ ID NO: 612954 - DNA, 25 bp, Rattus norvegicus
cgtgcaaatagggtaaaacagtctt

SEQ ID NO: 612955 - DNA, 25 bp, Rattus norvegicus
cacttcccgaaagcacgtgcaaata

SEQ ID NO: 612956 - DNA, 25 bp, Rattus norvegicus
actgatcagaacaaccggccttcga

SEQ ID NO: 612957 - DNA, 25 bp, Rattus norvegicus
cccttcctccggagaactgatcaga

SEQ ID NO: 612958 - DNA, 25 bp, Rattus norvegicus
tgcgcgtttctctccaagatcaata

SEQ ID NO: 612959 - DNA, 25 bp, Rattus norvegicus
gtctggacatcgctttgcgcgtttc

SEQ ID NO: 612960 - DNA, 25 bp, Rattus norvegicus
tcttagtagctaggaaaccgaggga

SEQ ID NO: 612961 - DNA, 25 bp, Rattus norvegicus
accaccttgcattcctgccgcgggg

SEQ ID NO: 612962 - DNA, 25 bp, Rattus norvegicus
gctccagctgctgcggtagcaaatg

SEQ ID NO: 612963 - DNA, 25 bp, Rattus norvegicus
gtcttctggctgaaaccactcgctc

SEQ ID NO: 612964 - DNA, 25 bp, Rattus norvegicus
tgcacgcagaccgatggcctctgcg

SEQ ID NO: 612965 - DNA, 25 bp, Rattus norvegicus
cagaccgatggcctctgcggaggct

SEQ ID NO: 612966 - DNA, 25 bp, Rattus norvegicus
ccaagaccgggcagcctcgcgaagt

SEQ ID NO: 612967 - DNA, 25 bp, Rattus norvegicus
gcaaatgcaaaattccagcgcccta

SEQ ID NO: 612968 - DNA, 25 bp, Rattus norvegicus
ggacgctgtcttctggctgaaacca

SEQ ID NO: 612969 - DNA, 25 bp, Rattus norvegicus
ccggtcactgacaccaccttgcatt

SEQ ID NO: 612970 - DNA, 25 bp, Rattus norvegicus
tggctgaaaccactcgctccagctg

SEQ ID NO: 612971 - DNA, 25 bp, Rattus norvegicus
tgcaaaattccagcgccctaatctc

SEQ ID NO: 612972 - DNA, 25 bp, Rattus norvegicus
gcgccctaatctccggtcactgaca

SEQ ID NO: 612973 - DNA, 25 bp, Rattus norvegicus
tgctgcggtagcaaatgcaaaattc

SEQ ID NO: 612974 - DNA, 25 bp, Rattus norvegicus
cccggacgctgtcttctggctgaaa

SEQ ID NO: 612975 - DNA, 25 bp, Rattus norvegicus
cagggcttgtttttgctttcatgcg

SEQ ID NO: 612976 - DNA, 25 bp, Rattus norvegicus
ccaagtgtgcacactgcgccggtca

SEQ ID NO: 612977 - DNA, 25 bp, Rattus norvegicus
aacgtctacgcgtcgctgccaagtg

SEQ ID NO: 612978 - DNA, 25 bp, Rattus norvegicus
gtacagcacgcaagcgcaacgtcta

SEQ ID NO: 612979 - DNA, 25 bp, Rattus norvegicus
gcggcttccagacttgccctacgta

SEQ ID NO: 612980 - DNA, 25 bp, Rattus norvegicus
gctgatatttccctagcggcttcca

SEQ ID NO: 612981 - DNA, 25 bp, Rattus norvegicus
ttggcgttcgggaagctgatatttc

SEQ ID NO: 612982 - DNA, 25 bp, Rattus norvegicus
attcctagcacgtggacccgctgtt

SEQ ID NO: 612983 - DNA, 25 bp, Rattus norvegicus
aaccaccgggtctacgtggccagcg

SEQ ID NO: 612984 - DNA, 25 bp, Rattus norvegicus
cgggacaggatgttctccaagctca

SEQ ID NO: 612985 - DNA, 25 bp, Rattus norvegicus
gcgcatcgaggagctctccaggtca

SEQ ID NO: 612986 - DNA, 25 bp, Rattus norvegicus
cgcaccggccttcactatggagcgg

SEQ ID NO: 612987 - DNA, 25 bp, Rattus norvegicus
ccagcgccgcgcaagacaaaagaac

SEQ ID NO: 612988 - DNA, 25 bp, Rattus norvegicus
gattgcagccgaacgtcctcggagc

SEQ ID NO: 612989 - DNA, 25 bp, Rattus norvegicus
ctgctcctgtttgctcgcagtattg

SEQ ID NO: 612990 - DNA, 25 bp, Rattus norvegicus
cgtgcgcagcagtgttagcggaccc

SEQ ID NO: 612991 - DNA, 25 bp, Rattus norvegicus
attgacttcccgtgcgcagcagtgt

SEQ ID NO: 612992 - DNA, 25 bp, Rattus norvegicus
tgctttaccattgacttcccgtgcg

SEQ ID NO: 612993 - DNA, 25 bp, Rattus norvegicus
gccgctttgcgaaattgctttacca

SEQ ID NO: 612994 - DNA, 25 bp, Rattus norvegicus
gtttgctctctgaaagccgctttgc

SEQ ID NO: 612995 - DNA, 25 bp, Rattus norvegicus
ccaattagcacatgccgggttgaga

SEQ ID NO: 612996 - DNA, 25 bp, Rattus norvegicus
tgctcgcagtattgttttaagccaa

SEQ ID NO: 612997 - DNA, 25 bp, Rattus norvegicus
ttcgcagcagcgttgatgtacgctc

SEQ ID NO: 612998 - DNA, 25 bp, Rattus norvegicus
agctgtcattttcgcagcagcgttg

SEQ ID NO: 612999 - DNA, 25 bp, Rattus norvegicus
cccggtttatttgaagctgtcattt

SEQ ID NO: 613000 - DNA, 25 bp, Rattus norvegicus
gtgtggctcccggtttatttgaagc

SEQ ID NO: 613001 - DNA, 25 bp, Rattus norvegicus
tttaagccaattagcacatgccggg

SEQ ID NO: 613002 - DNA, 25 bp, Rattus norvegicus
gatgtacgctcactgctcctgtttg

SEQ ID NO: 613003 - DNA, 25 bp, Rattus norvegicus
ggactggatcgcaagcccaggtttc

SEQ ID NO: 613004 - DNA, 25 bp, Rattus norvegicus
gaccaggctaaggcgttctccgccg

SEQ ID NO: 613005 - DNA, 25 bp, Rattus norvegicus
ctgctggcaggtacccgcccgggta

SEQ ID NO: 613006 - DNA, 25 bp, Rattus norvegicus
aaggagaagctgctggcaggtaccc

SEQ ID NO: 613007 - DNA, 25 bp, Rattus norvegicus
ccgagctgctgaaccggctgaagga

SEQ ID NO: 613008 - DNA, 25 bp, Rattus norvegicus
aaagggcccacttcagccgagctgc

SEQ ID NO: 613009 - DNA, 25 bp, Rattus norvegicus
gtgcacaagcccaaagggcccactt

SEQ ID NO: 613010 - DNA, 25 bp, Rattus norvegicus
cagcggcgtgttcgccgtgcacaag

SEQ ID NO: 613011 - DNA, 25 bp, Rattus norvegicus
ctcatgtcgctcagcggcgtgttcg

SEQ ID NO: 613012 - DNA, 25 bp, Rattus norvegicus
ctggctgctaagctcatgtcgctca

SEQ ID NO: 613013 - DNA, 25 bp, Rattus norvegicus
ccgctctggctgctaagctcatgtc

SEQ ID NO: 613014 - DNA, 25 bp, Rattus norvegicus
tcgcaagcccaggtttccaaggccg

SEQ ID NO: 613015 - DNA, 25 bp, Rattus norvegicus
cagcggctaggactggatcgcaagc

SEQ ID NO: 613016 - DNA, 25 bp, Rattus norvegicus
caaggccgctctggctgctaagctc

SEQ ID NO: 613017 - DNA, 25 bp, Rattus norvegicus
cgccgaagttcgtcagacaccgaga

SEQ ID NO: 613018 - DNA, 25 bp, Rattus norvegicus
ccagaaacaccgaagaacatggctt

SEQ ID NO: 613019 - DNA, 25 bp, Rattus norvegicus
ggaggacggagcttccagaaacacc

SEQ ID NO: 613020 - DNA, 25 bp, Rattus norvegicus
gccatccggattctttccggagttc

SEQ ID NO: 613021 - DNA, 25 bp, Rattus norvegicus
gcgattatagatgtgtggagcgttc

SEQ ID NO: 613022 - DNA, 25 bp, Rattus norvegicus
gacaccgagactgggatatcactct

SEQ ID NO: 613023 - DNA, 25 bp, Rattus norvegicus
catggcttcgctgtgtggcaaccaa

SEQ ID NO: 613024 - DNA, 25 bp, Rattus norvegicus
tggcaaccaaatgagaggacagccc

SEQ ID NO: 613025 - DNA, 25 bp, Rattus norvegicus
agtatctccgaatgcgccgaagttc

SEQ ID NO: 613026 - DNA, 25 bp, Rattus norvegicus
actcacaagtatctccgaatgcgcc

SEQ ID NO: 613027 - DNA, 25 bp, Rattus norvegicus
cccgtggagcgcatcgcgattatag

SEQ ID NO: 613028 - DNA, 25 bp, Rattus norvegicus
aggcgataagcaccactcacaagta

SEQ ID NO: 613029 - DNA, 25 bp, Rattus norvegicus
tggagcgttctgtttgaggcgataa

SEQ ID NO: 613030 - DNA, 25 bp, Rattus norvegicus
ccgctgagttccgaagccatccgga

SEQ ID NO: 613031 - DNA, 25 bp, Rattus norvegicus
gccgcctctacgacgactgtgtctg

SEQ ID NO: 613032 - DNA, 25 bp, Rattus norvegicus
aagaaacgtgcaggagaccagggta

SEQ ID NO: 613033 - DNA, 25 bp, Rattus norvegicus
gtgcggagctccgattccacgataa

SEQ ID NO: 613034 - DNA, 25 bp, Rattus norvegicus
tcccgtgacaggagtgggtttctcc

SEQ ID NO: 613035 - DNA, 25 bp, Rattus norvegicus
cggagtgcaaggctgcctttccacc

SEQ ID NO: 613036 - DNA, 25 bp, Rattus norvegicus
ctcagctctttgtgtgtagttggga

SEQ ID NO: 613037 - DNA, 25 bp, Rattus norvegicus
ctggctgcacatgctcagctctttg

SEQ ID NO: 613038 - DNA, 25 bp, Rattus norvegicus
agttcgcggtgcctttaagactttg

SEQ ID NO: 613039 - DNA, 25 bp, Rattus norvegicus
ccctgcaacgtggtcagttcgcggt

SEQ ID NO: 613040 - DNA, 25 bp, Rattus norvegicus
tgttcctgcaccctgcaacgtggtc

SEQ ID NO: 613041 - DNA, 25 bp, Rattus norvegicus
tgaggtcgtcccacgggagcagctt

SEQ ID NO: 613042 - DNA, 25 bp, Rattus norvegicus
taaagagctgttcgtggctgaggtc

SEQ ID NO: 613043 - DNA, 25 bp, Rattus norvegicus
ccgattccacgataaagagctgttc

SEQ ID NO: 613044 - DNA, 25 bp, Rattus norvegicus
tttccaccgaggtcccgtgacagga

SEQ ID NO: 613045 - DNA, 25 bp, Rattus norvegicus
gcacaacctggatctgccgattccg

SEQ ID NO: 613046 - DNA, 25 bp, Rattus norvegicus
ccaggactcaaccaagatgagcgca

SEQ ID NO: 613047 - DNA, 25 bp, Rattus norvegicus
tgagcgcagcacacccaggatttta

SEQ ID NO: 613048 - DNA, 25 bp, Rattus norvegicus
ttaccctccgttgaaggcataaggc

SEQ ID NO: 613049 - DNA, 25 bp, Rattus norvegicus
ggcataaggcgagaaacgcatctgc

SEQ ID NO: 613050 - DNA, 25 bp, Rattus norvegicus
aaacgcatctgcacagggccggcgg

SEQ ID NO: 613051 - DNA, 25 bp, Rattus norvegicus
cccggtaagcggcagtggaaagcat

SEQ ID NO: 613052 - DNA, 25 bp, Rattus norvegicus
cagtggaaagcatcgcgcctaactc

SEQ ID NO: 613053 - DNA, 25 bp, Rattus norvegicus
aagcatcgcgcctaactcctgctgt

SEQ ID NO: 613054 - DNA, 25 bp, Rattus norvegicus
ctcctgctgtctcacggcaaaatgg

SEQ ID NO: 613055 - DNA, 25 bp, Rattus norvegicus
caaaatggccgctgggaccggtcca

SEQ ID NO: 613056 - DNA, 25 bp, Rattus norvegicus
cttgggctcctctagcctgtactcg

SEQ ID NO: 613057 - DNA, 25 bp, Rattus norvegicus
agcctgtactcgtcgctgctcttgg

SEQ ID NO: 613058 - DNA, 25 bp, Rattus norvegicus
tgctcttggaggtccacgcctgcat

SEQ ID NO: 613059 - DNA, 25 bp, Rattus norvegicus
gccagcgtcgctccctgtcccgctc

SEQ ID NO: 613060 - DNA, 25 bp, Rattus norvegicus
ggtgctttccgcacgtcctcagcgg

SEQ ID NO: 613061 - DNA, 25 bp, Rattus norvegicus
tgactcggtgctttccgcacgtcct

SEQ ID NO: 613062 - DNA, 25 bp, Rattus norvegicus
gctgactcggtgctttccgcacgtc

SEQ ID NO: 613063 - DNA, 25 bp, Rattus norvegicus
cgggctgactcggtgctttccgcac

SEQ ID NO: 613064 - DNA, 25 bp, Rattus norvegicus
gtcctcagcggcttgtcatcctctg

SEQ ID NO: 613065 - DNA, 25 bp, Rattus norvegicus
aactcgggctgactcggtgctttcc

SEQ ID NO: 613066 - DNA, 25 bp, Rattus norvegicus
tttccgcacgtcctcagcggcttgt

SEQ ID NO: 613067 - DNA, 25 bp, Rattus norvegicus
ccaactcgggctgactcggtgcttt

SEQ ID NO: 613068 - DNA, 25 bp, Rattus norvegicus
gcccaactcgggctgactcggtgct

SEQ ID NO: 613069 - DNA, 25 bp, Rattus norvegicus
gctgcacccttccagcctcgggctg

SEQ ID NO: 613070 - DNA, 25 bp, Rattus norvegicus
ccgcgctgcacccttccagcctcgg

SEQ ID NO: 613071 - DNA, 25 bp, Rattus norvegicus
gtgtcccgagctcagagcgcccggg

SEQ ID NO: 613072 - DNA, 25 bp, Rattus norvegicus
ggtcccggtgtcccgagctcagagc

SEQ ID NO: 613073 - DNA, 25 bp, Rattus norvegicus
tggcagactgccacctgttcacgta

SEQ ID NO: 613074 - DNA, 25 bp, Rattus norvegicus
gtaccgatagagatgtcaacgctcg

SEQ ID NO: 613075 - DNA, 25 bp, Rattus norvegicus
caaggccgtgcaagaagccgtgctc

SEQ ID NO: 613076 - DNA, 25 bp, Rattus norvegicus
aagaagccgtgctccctgcggacct

SEQ ID NO: 613077 - DNA, 25 bp, Rattus norvegicus
tcctgtgccaactgcacgagcaatg

SEQ ID NO: 613078 - DNA, 25 bp, Rattus norvegicus
cacgagcaatggcatggagtgcatg

SEQ ID NO: 613079 - DNA, 25 bp, Rattus norvegicus
tgcatgtggtgcagcagcacgaagc

SEQ ID NO: 613080 - DNA, 25 bp, Rattus norvegicus
agcacgaagcgctgcgtggactcca

SEQ ID NO: 613081 - DNA, 25 bp, Rattus norvegicus
tgcgtggactccaacgcctacatca

SEQ ID NO: 613082 - DNA, 25 bp, Rattus norvegicus
cacgtaagtaccgatagagatgtca

SEQ ID NO: 613083 - DNA, 25 bp, Rattus norvegicus
cagtgtctggagtggcagactgcca

SEQ ID NO: 613084 - DNA, 25 bp, Rattus norvegicus
tgccacctgttcacgtaagtaccga

SEQ ID NO: 613085 - DNA, 25 bp, Rattus norvegicus
tgtcaacgctcgagggcatttcaaa

SEQ ID NO: 613086 - DNA, 25 bp, Rattus norvegicus
cctacggacagtgtctggagtggca

SEQ ID NO: 613087 - DNA, 25 bp, Rattus norvegicus
agcgagctagcccacagcatctgca

SEQ ID NO: 613088 - DNA, 25 bp, Rattus norvegicus
cattactttccgagcaagcgccgga

SEQ ID NO: 613089 - DNA, 25 bp, Rattus norvegicus
cgcgaagtacagagtggctaggaac

SEQ ID NO: 613090 - DNA, 25 bp, Rattus norvegicus
ccgcttggaactgaaacctggcttc

SEQ ID NO: 613091 - DNA, 25 bp, Rattus norvegicus
gctggctcgatcactaccgttctag

SEQ ID NO: 613092 - DNA, 25 bp, Rattus norvegicus
ccaagaatctgaacgctagcaaata

SEQ ID NO: 613093 - DNA, 25 bp, Rattus norvegicus
ggctatcgcgcacagcccaagaatc

SEQ ID NO: 613094 - DNA, 25 bp, Rattus norvegicus
ccaacgttcaaagctggaggctatc

SEQ ID NO: 613095 - DNA, 25 bp, Rattus norvegicus
agaggttcgctagggctcccaacgt

SEQ ID NO: 613096 - DNA, 25 bp, Rattus norvegicus
ggaggtgcaagttcatctattacga

SEQ ID NO: 613097 - DNA, 25 bp, Rattus norvegicus
agagcccagagtgctgaagcctccc

SEQ ID NO: 613098 - DNA, 25 bp, Rattus norvegicus
gcgcgctttgaaatgagagcccaga

SEQ ID NO: 613099 - DNA, 25 bp, Rattus norvegicus
tcaaagttcagctccatccagggtg

SEQ ID NO: 613100 - DNA, 25 bp, Rattus norvegicus
gaggaaactgacctcccgcttggaa

SEQ ID NO: 613101 - DNA, 25 bp, Rattus norvegicus
cgtggcgccaagaggaattattttc

SEQ ID NO: 613102 - DNA, 25 bp, Rattus norvegicus
tcagtattttgcgaagaccagaggc

SEQ ID NO: 613103 - DNA, 25 bp, Rattus norvegicus
ccgcaagcaggacccgtcagtattt

SEQ ID NO: 613104 - DNA, 25 bp, Rattus norvegicus
gggtcgcaattcaccctgtgacgta

SEQ ID NO: 613105 - DNA, 25 bp, Rattus norvegicus
ctagcgtccagccagtgcaagtaga

SEQ ID NO: 613106 - DNA, 25 bp, Rattus norvegicus
ggaatcccgggcctctcatttagta

SEQ ID NO: 613107 - DNA, 25 bp, Rattus norvegicus
ctttgcttcggttctgaggaatcca

SEQ ID NO: 613108 - DNA, 25 bp, Rattus norvegicus
cggaactactttcggtggcgcagga

SEQ ID NO: 613109 - DNA, 25 bp, Rattus norvegicus
cgctcagtgacgagaggctttgtcc

SEQ ID NO: 613110 - DNA, 25 bp, Rattus norvegicus
acaggtacttgtctgccgcgtttga

SEQ ID NO: 613111 - DNA, 25 bp, Rattus norvegicus
ctgggcggtttgttccttcatcgca

SEQ ID NO: 613112 - DNA, 25 bp, Rattus norvegicus
tgcacatgcgcactcggttacttag

SEQ ID NO: 613113 - DNA, 25 bp, Rattus norvegicus
tttccagagctttcgagggagggcc

SEQ ID NO: 613114 - DNA, 25 bp, Rattus norvegicus
gagggccctttaccttggattcatc

SEQ ID NO: 613115 - DNA, 25 bp, Rattus norvegicus
ggtgacatgggaatatcggggtgac

SEQ ID NO: 613116 - DNA, 25 bp, Rattus norvegicus
aatatcggggtgacatgggaatatc

SEQ ID NO: 613117 - DNA, 25 bp, Rattus norvegicus
atattggggtgacgtggggaatatc

SEQ ID NO: 613118 - DNA, 25 bp, Rattus norvegicus
atatcggggtgacatgggaatatcg

SEQ ID NO: 613119 - DNA, 25 bp, Rattus norvegicus
atatcggggtgacatgggaatatca

SEQ ID NO: 613120 - DNA, 25 bp, Rattus norvegicus
tatcggggtgacatgggaatatcag

SEQ ID NO: 613121 - DNA, 25 bp, Rattus norvegicus
ggggtgacatgggaatatcagggtg

SEQ ID NO: 613122 - DNA, 25 bp, Rattus norvegicus
gaatatcggggtgacatgggaatat

SEQ ID NO: 613123 - DNA, 25 bp, Rattus norvegicus
gaatatcggggtgacatggggaata

SEQ ID NO: 613124 - DNA, 25 bp, Rattus norvegicus
ggaatatcggggtgacatgggaata

SEQ ID NO: 613125 - DNA, 25 bp, Rattus norvegicus
tgacatgggaatatcggggtgacat

SEQ ID NO: 613126 - DNA, 25 bp, Rattus norvegicus
aatatcggggtgacatggggaatat

SEQ ID NO: 613127 - DNA, 25 bp, Rattus norvegicus
aatattggggtgacgtggggaatat

SEQ ID NO: 613128 - DNA, 25 bp, Rattus norvegicus
ggtgacatgggaatatcagggtgac

SEQ ID NO: 613129 - DNA, 25 bp, Rattus norvegicus
ctgggtcggtgatgaagctgacatc

SEQ ID NO: 613130 - DNA, 25 bp, Rattus norvegicus
ggcgcaccttgataacggcaggatc

SEQ ID NO: 613131 - DNA, 25 bp, Rattus norvegicus
agcacgcccactccgtaggtgagag

SEQ ID NO: 613132 - DNA, 25 bp, Rattus norvegicus
ttcccttccacgtagcggttcagca

SEQ ID NO: 613133 - DNA, 25 bp, Rattus norvegicus
cagcttctctggagggtgcttccct

SEQ ID NO: 613134 - DNA, 25 bp, Rattus norvegicus
agtgcaccaacgtgtgccgtccttc

SEQ ID NO: 613135 - DNA, 25 bp, Rattus norvegicus
aacttgtcaaagacgtcagtgcacc

SEQ ID NO: 613136 - DNA, 25 bp, Rattus norvegicus
actggtcagcagagatgaacttgtc

SEQ ID NO: 613137 - DNA, 25 bp, Rattus norvegicus
ctggtccctgtgagatccaagcgga

SEQ ID NO: 613138 - DNA, 25 bp, Rattus norvegicus
tgttgatgatgatgaccagctggga

SEQ ID NO: 613139 - DNA, 25 bp, Rattus norvegicus
atccaggccgaagaggacagcgccc

SEQ ID NO: 613140 - DNA, 25 bp, Rattus norvegicus
tgacatcgtcgttctcagagctgta

SEQ ID NO: 613141 - DNA, 25 bp, Rattus norvegicus
ggtgtagctacgcttgaccagctcc

SEQ ID NO: 613142 - DNA, 25 bp, Rattus norvegicus
ccaagcggagcgtgccgcacttctt

SEQ ID NO: 613143 - DNA, 25 bp, Rattus norvegicus
aaggctagagttggctcctccctcg

SEQ ID NO: 613144 - DNA, 25 bp, Rattus norvegicus
ttcaagcccgggagttcccgccaga

SEQ ID NO: 613145 - DNA, 25 bp, Rattus norvegicus
accagggagcccacttttctaatgc

SEQ ID NO: 613146 - DNA, 25 bp, Rattus norvegicus
cgggctgcggtatatagcacacctc

SEQ ID NO: 613147 - DNA, 25 bp, Rattus norvegicus
ttccttgtccgccatggtcctgcag

SEQ ID NO: 613148 - DNA, 25 bp, Rattus norvegicus
aaggcgcctccggtgctaatcttag

SEQ ID NO: 613149 - DNA, 25 bp, Rattus norvegicus
tcttaggctctcgagctaggtctga

SEQ ID NO: 613150 - DNA, 25 bp, Rattus norvegicus
ctaggtctgagcttctggacagcgg

SEQ ID NO: 613151 - DNA, 25 bp, Rattus norvegicus
tccctcgagctctgagaccgcgggt

SEQ ID NO: 613152 - DNA, 25 bp, Rattus norvegicus
acccggactctgcttgggcagtgga

SEQ ID NO: 613153 - DNA, 25 bp, Rattus norvegicus
gggtcatagccaagcaggggtcttt

SEQ ID NO: 613154 - DNA, 25 bp, Rattus norvegicus
gtgcagtcattagcgcacccggact

SEQ ID NO: 613155 - DNA, 25 bp, Rattus norvegicus
acagaagctcgcaaggtcgggtttc

SEQ ID NO: 613156 - DNA, 25 bp, Rattus norvegicus
tgcagcttccagtccggcggacaca

SEQ ID NO: 613157 - DNA, 25 bp, Rattus norvegicus
gcgtctgcaaaactgtccgaggaac

SEQ ID NO: 613158 - DNA, 25 bp, Rattus norvegicus
ccagctaagcactgggcgagcttgt

SEQ ID NO: 613159 - DNA, 25 bp, Rattus norvegicus
tcccgcgcaagctggaagagctgct

SEQ ID NO: 613160 - DNA, 25 bp, Rattus norvegicus
tactaccaggagaacgacgtcccgc

SEQ ID NO: 613161 - DNA, 25 bp, Rattus norvegicus
agcagcaggcgatggcgtactacca

SEQ ID NO: 613162 - DNA, 25 bp, Rattus norvegicus
tctagggacctgctgaagctgaagc

SEQ ID NO: 613163 - DNA, 25 bp, Rattus norvegicus
ctcgcgagatctaggggtcgtgatc

SEQ ID NO: 613164 - DNA, 25 bp, Rattus norvegicus
tagccctaagtatcctaccatgggg

SEQ ID NO: 613165 - DNA, 25 bp, Rattus norvegicus
accaaaggacgctagcgggcccact

SEQ ID NO: 613166 - DNA, 25 bp, Rattus norvegicus
tcgtgatctcgttgcgttgcctagc

SEQ ID NO: 613167 - DNA, 25 bp, Rattus norvegicus
ttccaccgagggcaggaagcctcgc

SEQ ID NO: 613168 - DNA, 25 bp, Rattus norvegicus
ggtcccgaacagaaagctgaggttc

SEQ ID NO: 613169 - DNA, 25 bp, Rattus norvegicus
ccgagagagcactaggaaccatgca

SEQ ID NO: 613170 - DNA, 25 bp, Rattus norvegicus
ttgcgttgcctagcgaccaaaggac

SEQ ID NO: 613171 - DNA, 25 bp, Rattus norvegicus
tccgagctgttcattttggcgggtg

SEQ ID NO: 613172 - DNA, 25 bp, Rattus norvegicus
tccctgtggtaagcggccctactaa

SEQ ID NO: 613173 - DNA, 25 bp, Rattus norvegicus
gcacgcggtgagatcatcccacgca

SEQ ID NO: 613174 - DNA, 25 bp, Rattus norvegicus
ggaagttgggatcgctcccgctcct

SEQ ID NO: 613175 - DNA, 25 bp, Rattus norvegicus
cgtgcggctgcactacccggaagtt

SEQ ID NO: 613176 - DNA, 25 bp, Rattus norvegicus
gaggcgcgcaccaagaagactaacc

SEQ ID NO: 613177 - DNA, 25 bp, Rattus norvegicus
cttcaagctggtgatgagctgcagc

SEQ ID NO: 613178 - DNA, 25 bp, Rattus norvegicus
cacctaccttgttccttcaagctgg

SEQ ID NO: 613179 - DNA, 25 bp, Rattus norvegicus
tgcgaggtgaccacggcggcctcac

SEQ ID NO: 613180 - DNA, 25 bp, Rattus norvegicus
tgggatcccactgcgggaagaccct

SEQ ID NO: 613181 - DNA, 25 bp, Rattus norvegicus
ctgcgatcctccctgtggtaagcgg

SEQ ID NO: 613182 - DNA, 25 bp, Rattus norvegicus
cgctactcccgcgtggacttgggtg

SEQ ID NO: 613183 - DNA, 25 bp, Rattus norvegicus
agctgcttctcctcgtccgagctgt

SEQ ID NO: 613184 - DNA, 25 bp, Rattus norvegicus
ggtgcgtgccgtgaccctgtccacg

SEQ ID NO: 613185 - DNA, 25 bp, Rattus norvegicus
tacagggtaacacttaaaatcagtc

SEQ ID NO: 613186 - DNA, 25 bp, Rattus norvegicus
agtctttaccctggtccttcttctg

SEQ ID NO: 613187 - DNA, 25 bp, Rattus norvegicus
gaggcgacaacaggcggccttgctc

SEQ ID NO: 613188 - DNA, 25 bp, Rattus norvegicus
gcgacagagcctagcagcgacggca

SEQ ID NO: 613189 - DNA, 25 bp, Rattus norvegicus
tagcgaaccagccatcgtcaacggg

SEQ ID NO: 613190 - DNA, 25 bp, Rattus norvegicus
gttcttgcaaattcccggctagcga

SEQ ID NO: 613191 - DNA, 25 bp, Rattus norvegicus
acgggctgagagttcttgcaaattc

SEQ ID NO: 613192 - DNA, 25 bp, Rattus norvegicus
ccttcttctgcttggtccgccgatt

SEQ ID NO: 613193 - DNA, 25 bp, Rattus norvegicus
ttaaaatcagtccagcgcttttttc

SEQ ID NO: 613194 - DNA, 25 bp, Rattus norvegicus
accgagcgcagctccgagtctttac

SEQ ID NO: 613195 - DNA, 25 bp, Rattus norvegicus
tccataaataccaccacaagagatg

SEQ ID NO: 613196 - DNA, 25 bp, Rattus norvegicus
cctaacgcgcgcgagtccataaata

SEQ ID NO: 613197 - DNA, 25 bp, Rattus norvegicus
ctcgaaggccgaggagctcaggtaa

SEQ ID NO: 613198 - DNA, 25 bp, Rattus norvegicus
agcccagagcgcctgtagcacaggg

SEQ ID NO: 613199 - DNA, 25 bp, Rattus norvegicus
tacctcggactaggatccggcggca

SEQ ID NO: 613200 - DNA, 25 bp, Rattus norvegicus
cgctctggtagaaatgcggcaggtc

SEQ ID NO: 613201 - DNA, 25 bp, Rattus norvegicus
acctaagctgggtcgcccgccagaa

SEQ ID NO: 613202 - DNA, 25 bp, Rattus norvegicus
gtctgttttcccgaacataggcaaa

SEQ ID NO: 613203 - DNA, 25 bp, Rattus norvegicus
tggcaccggacgtccattttgtctg

SEQ ID NO: 613204 - DNA, 25 bp, Rattus norvegicus
ctccttgtgcgcgttcttcgatacc

SEQ ID NO: 613205 - DNA, 25 bp, Rattus norvegicus
cggaagcgccagacgccgaaaaggc

SEQ ID NO: 613206 - DNA, 25 bp, Rattus norvegicus
ttttgttacaatcttcggaagcgcc

SEQ ID NO: 613207 - DNA, 25 bp, Rattus norvegicus
tcctcgctcagtgctccatcaggtg

SEQ ID NO: 613208 - DNA, 25 bp, Rattus norvegicus
ccggcggcagtaatctgggtctgct

SEQ ID NO: 613209 - DNA, 25 bp, Rattus norvegicus
cccaggctctgagagagcgctttga

SEQ ID NO: 613210 - DNA, 25 bp, Rattus norvegicus
cgaagccaccgcaggagaattaccc

SEQ ID NO: 613211 - DNA, 25 bp, Rattus norvegicus
tgggtctgctgaggaattggattta

SEQ ID NO: 613212 - DNA, 25 bp, Rattus norvegicus
cgcagacacttgcaggccgaaggtc

SEQ ID NO: 613213 - DNA, 25 bp, Rattus norvegicus
acacgctgtcagtctttaggttcga

SEQ ID NO: 613214 - DNA, 25 bp, Rattus norvegicus
ggcatcagatgtgcgtcaggcgttc

SEQ ID NO: 613215 - DNA, 25 bp, Rattus norvegicus
cgcacgcttctttatttacacgctg

SEQ ID NO: 613216 - DNA, 25 bp, Rattus norvegicus
cgtcagaagctcgagattcaagctc

SEQ ID NO: 613217 - DNA, 25 bp, Rattus norvegicus
gttcttgagacggagcatctcgtca

SEQ ID NO: 613218 - DNA, 25 bp, Rattus norvegicus
gaagacagttttacccaggcctgcg

SEQ ID NO: 613219 - DNA, 25 bp, Rattus norvegicus
ggcgcaccgtacatctcagctgctt

SEQ ID NO: 613220 - DNA, 25 bp, Rattus norvegicus
gcggggtcatgaaatccagtgccaa

SEQ ID NO: 613221 - DNA, 25 bp, Rattus norvegicus
tccgggagtaccagtctctggacca

SEQ ID NO: 613222 - DNA, 25 bp, Rattus norvegicus
caaaagcgacttctgcagcgggtcc

SEQ ID NO: 613223 - DNA, 25 bp, Rattus norvegicus
tttctctgcttggaggccttaacaa

SEQ ID NO: 613224 - DNA, 25 bp, Rattus norvegicus
cgcagtgcccaggtaacggttcttt

SEQ ID NO: 613225 - DNA, 25 bp, Rattus norvegicus
cggtcgcgtcattttctccgcagtg

SEQ ID NO: 613226 - DNA, 25 bp, Rattus norvegicus
cagtgccaagtgtgagcctctccaa

SEQ ID NO: 613227 - DNA, 25 bp, Rattus norvegicus
ccttaggggcaaccgctttggtcag

SEQ ID NO: 613228 - DNA, 25 bp, Rattus norvegicus
tgttgttcactgagcggggagcatt

SEQ ID NO: 613229 - DNA, 25 bp, Rattus norvegicus
cagggtatctgtcgcaccacaggca

SEQ ID NO: 613230 - DNA, 25 bp, Rattus norvegicus
tctagaagttctgcccgcgccgtct

SEQ ID NO: 613231 - DNA, 25 bp, Rattus norvegicus
agccagcacgccgactctagaagtt

SEQ ID NO: 613232 - DNA, 25 bp, Rattus norvegicus
gggtctctccttggcgagccagcac

SEQ ID NO: 613233 - DNA, 25 bp, Rattus norvegicus
ctagaacgtccacccagcaggaacg

SEQ ID NO: 613234 - DNA, 25 bp, Rattus norvegicus
cctggcggcaagtgcctagaacgtc

SEQ ID NO: 613235 - DNA, 25 bp, Rattus norvegicus
gacaggttgagagcccaaagatata

SEQ ID NO: 613236 - DNA, 25 bp, Rattus norvegicus
gggatacttggggtaattctgttga

SEQ ID NO: 613237 - DNA, 25 bp, Rattus norvegicus
cgactttatatgattggggatactt

SEQ ID NO: 613238 - DNA, 25 bp, Rattus norvegicus
gcagacctcgggcttcgactttata

SEQ ID NO: 613239 - DNA, 25 bp, Rattus norvegicus
cgctttggtcagttcccagggtatc

SEQ ID NO: 613240 - DNA, 25 bp, Rattus norvegicus
atatagatctctgcgggagctgtcc

SEQ ID NO: 613241 - DNA, 25 bp, Rattus norvegicus
actgggtaaactgagcagggctctg

SEQ ID NO: 613242 - DNA, 25 bp, Rattus norvegicus
cctctcagtgctatccgtgacgtca

SEQ ID NO: 613243 - DNA, 25 bp, Rattus norvegicus
acgtcagagccggactgggtaaact

SEQ ID NO: 613244 - DNA, 25 bp, Rattus norvegicus
gccactcgcgcaaactgatcctgtt

SEQ ID NO: 613245 - DNA, 25 bp, Rattus norvegicus
acccaggctgtgtggcgctataacc

SEQ ID NO: 613246 - DNA, 25 bp, Rattus norvegicus
tataaccgcgcagacagtcacaggc

SEQ ID NO: 613247 - DNA, 25 bp, Rattus norvegicus
cccttggggatcctctaaggcagcg

SEQ ID NO: 613248 - DNA, 25 bp, Rattus norvegicus
ttcatcgtgttccttgcgctgctgc

SEQ ID NO: 613249 - DNA, 25 bp, Rattus norvegicus
ctggaacgctattccggcgcctgag

SEQ ID NO: 613250 - DNA, 25 bp, Rattus norvegicus
agcgtgacactctctgtcgtcccgg

SEQ ID NO: 613251 - DNA, 25 bp, Rattus norvegicus
cacctctggtggacaagactccttg

SEQ ID NO: 613252 - DNA, 25 bp, Rattus norvegicus
tccctcagtgcagcagagccatggc

SEQ ID NO: 613253 - DNA, 25 bp, Rattus norvegicus
gctgctggacaacatgctgctcacc

SEQ ID NO: 613254 - DNA, 25 bp, Rattus norvegicus
caatgtcctcgggtcccaggtttgg

SEQ ID NO: 613255 - DNA, 25 bp, Rattus norvegicus
acctggtctgaagcgcaggggtttc

SEQ ID NO: 613256 - DNA, 25 bp, Rattus norvegicus
tgacgctgatttgggagcagcagcc

SEQ ID NO: 613257 - DNA, 25 bp, Rattus norvegicus
gtcagccgcgccctagaactgggcg

SEQ ID NO: 613258 - DNA, 25 bp, Rattus norvegicus
taagggaacctggtgtccaaggcca

SEQ ID NO: 613259 - DNA, 25 bp, Rattus norvegicus
cctggtgtccaaggccacctggtct

SEQ ID NO: 613260 - DNA, 25 bp, Rattus norvegicus
gataggtcctctcagatctgccctg

SEQ ID NO: 613261 - DNA, 25 bp, Rattus norvegicus
gacgctcggagttgtctgctccgga

SEQ ID NO: 613262 - DNA, 25 bp, Rattus norvegicus
tccagatgcgatctgcgcgactcgc

SEQ ID NO: 613263 - DNA, 25 bp, Rattus norvegicus
cgcgactcgctggtggtttctcgga

SEQ ID NO: 613264 - DNA, 25 bp, Rattus norvegicus
ccctatctgaggtagcagccgctgc

SEQ ID NO: 613265 - DNA, 25 bp, Rattus norvegicus
cgctgcgactgacacttctggactc

SEQ ID NO: 613266 - DNA, 25 bp, Rattus norvegicus
acacttctggactccagacggagga

SEQ ID NO: 613267 - DNA, 25 bp, Rattus norvegicus
atctgccctgagctggaggacgctc

SEQ ID NO: 613268 - DNA, 25 bp, Rattus norvegicus
ggaactagaaaggaggtgaccttca

SEQ ID NO: 613269 - DNA, 25 bp, Rattus norvegicus
cccgcagagcctgagctcattggac

SEQ ID NO: 613270 - DNA, 25 bp, Rattus norvegicus
cgatgctgccttgcggcgccttagt

SEQ ID NO: 613271 - DNA, 25 bp, Rattus norvegicus
atcggtcgcagatgagcagctccct

SEQ ID NO: 613272 - DNA, 25 bp, Rattus norvegicus
ctccatcttgaggacatcggtcgca

SEQ ID NO: 613273 - DNA, 25 bp, Rattus norvegicus
acggccgacgccaagatcatgagca

SEQ ID NO: 613274 - DNA, 25 bp, Rattus norvegicus
tctgcggtagagcagcaggaactgt

SEQ ID NO: 613275 - DNA, 25 bp, Rattus norvegicus
cgccgccatagaggtactccctgag

SEQ ID NO: 613276 - DNA, 25 bp, Rattus norvegicus
gcaccagccggatggtcttgatgta

SEQ ID NO: 613277 - DNA, 25 bp, Rattus norvegicus
tgtcacccaggaacacgtcgcgcag

SEQ ID NO: 613278 - DNA, 25 bp, Rattus norvegicus
cttgatgtagggcacggtgtcaccc

SEQ ID NO: 613279 - DNA, 25 bp, Rattus norvegicus
gcaggcccggcaccggcttaaggta

SEQ ID NO: 613280 - DNA, 25 bp, Rattus norvegicus
tcgtctcaggagctcgggaggtaat

SEQ ID NO: 613281 - DNA, 25 bp, Rattus norvegicus
ctcccggaacaggaacaggatggtg

SEQ ID NO: 613282 - DNA, 25 bp, Rattus norvegicus
gcgttgaggaagtagcaggtctcca

SEQ ID NO: 613283 - DNA, 25 bp, Rattus norvegicus
cggttgtaaagaccagcgcccggtg

SEQ ID NO: 613284 - DNA, 25 bp, Rattus norvegicus
ttgcaatcactttaactcttggtgg

SEQ ID NO: 613285 - DNA, 25 bp, Rattus norvegicus
aactcttggtggctggttctcttcc

SEQ ID NO: 613286 - DNA, 25 bp, Rattus norvegicus
cgtagtctgtagcactcacctcaga

SEQ ID NO: 613287 - DNA, 25 bp, Rattus norvegicus
gtcaatattatctcagatgggcaca

SEQ ID NO: 613288 - DNA, 25 bp, Rattus norvegicus
tgggcacaatagactggaatgaaaa

SEQ ID NO: 613289 - DNA, 25 bp, Rattus norvegicus
tgaaccaatgcggtccctgctcacg

SEQ ID NO: 613290 - DNA, 25 bp, Rattus norvegicus
gcgatgccaccctttgttgcgcagc

SEQ ID NO: 613291 - DNA, 25 bp, Rattus norvegicus
ctgcttgcggcccagctaagcggaa

SEQ ID NO: 613292 - DNA, 25 bp, Rattus norvegicus
gtatgtgttcactgcgggttagaga

SEQ ID NO: 613293 - DNA, 25 bp, Rattus norvegicus
gccctggtgagttgcagctacagca

SEQ ID NO: 613294 - DNA, 25 bp, Rattus norvegicus
cagcaacccgggaggctccttagca

SEQ ID NO: 613295 - DNA, 25 bp, Rattus norvegicus
gcgaggagcgtttatttgcaatcac

SEQ ID NO: 613296 - DNA, 25 bp, Rattus norvegicus
ttccaaattccagacgccggttgta

SEQ ID NO: 613297 - DNA, 25 bp, Rattus norvegicus
gcgccgactccgttccattctggga

SEQ ID NO: 613298 - DNA, 25 bp, Rattus norvegicus
gggcgagtaatagcgaccaatcatc

SEQ ID NO: 613299 - DNA, 25 bp, Rattus norvegicus
ccatttaccaggcttcggaggaagc

SEQ ID NO: 613300 - DNA, 25 bp, Rattus norvegicus
cggaggaagctgtttatgtgatccc

SEQ ID NO: 613301 - DNA, 25 bp, Rattus norvegicus
ccgcactaattaggctcatgaacta

SEQ ID NO: 613302 - DNA, 25 bp, Rattus norvegicus
ctactagtgaagaagcgaacacttc

SEQ ID NO: 613303 - DNA, 25 bp, Rattus norvegicus
cgaacacttccatggattgtccttg

SEQ ID NO: 613304 - DNA, 25 bp, Rattus norvegicus
attgtccttggacttagggcgccct

SEQ ID NO: 613305 - DNA, 25 bp, Rattus norvegicus
aatccacgcctgcaaattcttctgg

SEQ ID NO: 613306 - DNA, 25 bp, Rattus norvegicus
cgtttggtgcaagattctcgggatc

SEQ ID NO: 613307 - DNA, 25 bp, Rattus norvegicus
cagcatgtttcagccggcgcctaag

SEQ ID NO: 613308 - DNA, 25 bp, Rattus norvegicus
taagcgctgcttcaccatcgagtcg

SEQ ID NO: 613309 - DNA, 25 bp, Rattus norvegicus
gcctccctctgacgcactttaaaga

SEQ ID NO: 613310 - DNA, 25 bp, Rattus norvegicus
cccttccacctcagggcgagtaata

SEQ ID NO: 613311 - DNA, 25 bp, Rattus norvegicus
agtcccttcaccgtcctctcctagc

SEQ ID NO: 613312 - DNA, 25 bp, Rattus norvegicus
tgcgtgcgagtacccgcaacttggt

SEQ ID NO: 613313 - DNA, 25 bp, Rattus norvegicus
cgtatcgcggactgcctagatcttc

SEQ ID NO: 613314 - DNA, 25 bp, Rattus norvegicus
ctgcctagatcttcgcggccacaga

SEQ ID NO: 613315 - DNA, 25 bp, Rattus norvegicus
ccacagaccatcgtgcgtgcgagta

SEQ ID NO: 613316 - DNA, 25 bp, Rattus norvegicus
gcgagtacccgcaacttggtcaccg

SEQ ID NO: 613317 - DNA, 25 bp, Rattus norvegicus
agctctccgagaccagggacatcta

SEQ ID NO: 613318 - DNA, 25 bp, Rattus norvegicus
ccagggacatctagaaccgggtact

SEQ ID NO: 613319 - DNA, 25 bp, Rattus norvegicus
gcggcggccaaagatactgggcaca

SEQ ID NO: 613320 - DNA, 25 bp, Rattus norvegicus
gatactgggcacactcgactcaaga

SEQ ID NO: 613321 - DNA, 25 bp, Rattus norvegicus
gggcacactcgactcaagatttctg

SEQ ID NO: 613322 - DNA, 25 bp, Rattus norvegicus
tcgactcaagatttctgtcccggcc

SEQ ID NO: 613323 - DNA, 25 bp, Rattus norvegicus
atcttcgcggccacagaccatcgtg

SEQ ID NO: 613324 - DNA, 25 bp, Rattus norvegicus
tctcctagctctccgagaccaggga

SEQ ID NO: 613325 - DNA, 25 bp, Rattus norvegicus
ggctcgccttgatccactgcaaaca

SEQ ID NO: 613326 - DNA, 25 bp, Rattus norvegicus
tcccggcccaaagaaggatttgata

SEQ ID NO: 613327 - DNA, 25 bp, Rattus norvegicus
aaggatttgatagccgctctgttca

SEQ ID NO: 613328 - DNA, 25 bp, Rattus norvegicus
aaagtgaagcagaggcggctcgcct

SEQ ID NO: 613329 - DNA, 25 bp, Rattus norvegicus
aatttggcgcactttcgagtcctcc

SEQ ID NO: 613330 - DNA, 25 bp, Rattus norvegicus
ctcaaaaaggcaggacagtcggctt

SEQ ID NO: 613331 - DNA, 25 bp, Rattus norvegicus
gccgctcgtttgctttattaattca

SEQ ID NO: 613332 - DNA, 25 bp, Rattus norvegicus
tttaaagtggcaggattagagcgtc

SEQ ID NO: 613333 - DNA, 25 bp, Rattus norvegicus
ctgccgtggcgctgaagaatataaa

SEQ ID NO: 613334 - DNA, 25 bp, Rattus norvegicus
ataaatatttgcgagatgccatccc

SEQ ID NO: 613335 - DNA, 25 bp, Rattus norvegicus
gcgagatgccatcccacgatgccta

SEQ ID NO: 613336 - DNA, 25 bp, Rattus norvegicus
cacgatgcctatctgggcgaagggc

SEQ ID NO: 613337 - DNA, 25 bp, Rattus norvegicus
agtcggcttattagccgctcgtttg

SEQ ID NO: 613338 - DNA, 25 bp, Rattus norvegicus
gccgctctgttcaaactagataatt

SEQ ID NO: 613339 - DNA, 25 bp, Rattus norvegicus
ctctgaggacgtgagaacccgcgga

SEQ ID NO: 613340 - DNA, 25 bp, Rattus norvegicus
ggtccctttcttccgtagaagcaca

SEQ ID NO: 613341 - DNA, 25 bp, Rattus norvegicus
cgtagaagcacaggggcccacatca

SEQ ID NO: 613342 - DNA, 25 bp, Rattus norvegicus
acccggctgatacgaaccgtcggca

SEQ ID NO: 613343 - DNA, 25 bp, Rattus norvegicus
tgatacgaaccgtcggcagccgccg

SEQ ID NO: 613344 - DNA, 25 bp, Rattus norvegicus
tcggaagcggccgtcctggaccgac

SEQ ID NO: 613345 - DNA, 25 bp, Rattus norvegicus
agcctgtcggttactgcgctctgag

SEQ ID NO: 613346 - DNA, 25 bp, Rattus norvegicus
accaggcgaggcctggacagcgacc

SEQ ID NO: 613347 - DNA, 25 bp, Rattus norvegicus
cacttccgggttggccgtctccatg

SEQ ID NO: 613348 - DNA, 25 bp, Rattus norvegicus
ccgtctccatgttgagcgggactgc

SEQ ID NO: 613349 - DNA, 25 bp, Rattus norvegicus
agcgcctccctggttgccgtgacga

SEQ ID NO: 613350 - DNA, 25 bp, Rattus norvegicus
tgctgaggttccagcctgtcggtta

SEQ ID NO: 613351 - DNA, 25 bp, Rattus norvegicus
actgcgctctgaggacgtgagaacc

SEQ ID NO: 613352 - DNA, 25 bp, Rattus norvegicus
tcttccgtagaagcacaggggccca

SEQ ID NO: 613353 - DNA, 25 bp, Rattus norvegicus
cttcggcagctcagccaatcggctg

SEQ ID NO: 613354 - DNA, 25 bp, Rattus norvegicus
ccttctgattggcttcggcagctca

SEQ ID NO: 613355 - DNA, 25 bp, Rattus norvegicus
cttacagggtaggaaacagcggctc

SEQ ID NO: 613356 - DNA, 25 bp, Rattus norvegicus
agcgctgcgcaaagccgaacttaca

SEQ ID NO: 613357 - DNA, 25 bp, Rattus norvegicus
aatcttgctgcccagtagcgctgcg

SEQ ID NO: 613358 - DNA, 25 bp, Rattus norvegicus
accggacaggctgccgcaaatcttg

SEQ ID NO: 613359 - DNA, 25 bp, Rattus norvegicus
gaatatctgcgagaacgagccgccc

SEQ ID NO: 613360 - DNA, 25 bp, Rattus norvegicus
tccggcgtctgcacggaatatctgc

SEQ ID NO: 613361 - DNA, 25 bp, Rattus norvegicus
agagttttcctagcccactccggcg

SEQ ID NO: 613362 - DNA, 25 bp, Rattus norvegicus
ggacaggacggctatctcacgatgc

SEQ ID NO: 613363 - DNA, 25 bp, Rattus norvegicus
tagccgaagtcgctgtcctgacacg

SEQ ID NO: 613364 - DNA, 25 bp, Rattus norvegicus
gcaagcctcgctctggttagccgaa

SEQ ID NO: 613365 - DNA, 25 bp, Rattus norvegicus
tgtcagaatccgcaccgggacgccg

SEQ ID NO: 613366 - DNA, 25 bp, Rattus norvegicus
agctctcgagccctgtcagaatccg

SEQ ID NO: 613367 - DNA, 25 bp, Rattus norvegicus
ggtcccgcagcaggttgaaaatgtg

SEQ ID NO: 613368 - DNA, 25 bp, Rattus norvegicus
tgagcacatcggacaaggccaggtt

SEQ ID NO: 613369 - DNA, 25 bp, Rattus norvegicus
cacaggcggcacacatgagcacatc

SEQ ID NO: 613370 - DNA, 25 bp, Rattus norvegicus
cccagccacgaggttcaaaggcgta

SEQ ID NO: 613371 - DNA, 25 bp, Rattus norvegicus
acagcgattgtggtgagtgtgaaca

SEQ ID NO: 613372 - DNA, 25 bp, Rattus norvegicus
gtagcgggtgcaccagaaccacata

SEQ ID NO: 613373 - DNA, 25 bp, Rattus norvegicus
agcttcagtgaaatgcgccgacgta

SEQ ID NO: 613374 - DNA, 25 bp, Rattus norvegicus
cggcagcgccagcactgcagataga

SEQ ID NO: 613375 - DNA, 25 bp, Rattus norvegicus
ctctacatggtaggtgtgcaccgcg

SEQ ID NO: 613376 - DNA, 25 bp, Rattus norvegicus
acgtcgtggggcttgagctctacat

SEQ ID NO: 613377 - DNA, 25 bp, Rattus norvegicus
gcatagatctgtcgctggcgctcct

SEQ ID NO: 613378 - DNA, 25 bp, Rattus norvegicus
cgacacccggacgtaagacaggaga

SEQ ID NO: 613379 - DNA, 25 bp, Rattus norvegicus
tgccgatgaggaagttggtcacgtt

SEQ ID NO: 613380 - DNA, 25 bp, Rattus norvegicus
ggcagccagcagaccgcgaacacga

SEQ ID NO: 613381 - DNA, 25 bp, Rattus norvegicus
cggtgcgtacacttgcagcaggaag

SEQ ID NO: 613382 - DNA, 25 bp, Rattus norvegicus
caggaaccagtcgtcctacgtccgg

SEQ ID NO: 613383 - DNA, 25 bp, Rattus norvegicus
ctacgtccggggttcagccgccgtg

SEQ ID NO: 613384 - DNA, 25 bp, Rattus norvegicus
caacacagcggctctcgacagcaga

SEQ ID NO: 613385 - DNA, 25 bp, Rattus norvegicus
ggctctcgacagcagaagagaaaga

SEQ ID NO: 613386 - DNA, 25 bp, Rattus norvegicus
gctacggtggaaggcttcgtcccga

SEQ ID NO: 613387 - DNA, 25 bp, Rattus norvegicus
acccggaagcggtgcgtacacttgc

SEQ ID NO: 613388 - DNA, 25 bp, Rattus norvegicus
gcccgcccactttgcttggaaactg

SEQ ID NO: 613389 - DNA, 25 bp, Rattus norvegicus
aactccaccgtaactggcacaacgg

SEQ ID NO: 613390 - DNA, 25 bp, Rattus norvegicus
taactggcacaacggcagccatgct

SEQ ID NO: 613391 - DNA, 25 bp, Rattus norvegicus
ggactctgcccaccagaccggaaga

SEQ ID NO: 613392 - DNA, 25 bp, Rattus norvegicus
ccagaccggaagagtgtggtcacgt

SEQ ID NO: 613393 - DNA, 25 bp, Rattus norvegicus
tacaatcacccgcaggaaccagtcg

SEQ ID NO: 613394 - DNA, 25 bp, Rattus norvegicus
ttgcttggaaactgctcgctgcgca

SEQ ID NO: 613395 - DNA, 25 bp, Rattus norvegicus
ttgcctcgtaggtgagcatttcctc

SEQ ID NO: 613396 - DNA, 25 bp, Rattus norvegicus
cccatcagtttaggccaggtgtcca

SEQ ID NO: 613397 - DNA, 25 bp, Rattus norvegicus
tgagtcacctcaacgcgaatgcacc

SEQ ID NO: 613398 - DNA, 25 bp, Rattus norvegicus
gcgacgtccctcacgacattttaca

SEQ ID NO: 613399 - DNA, 25 bp, Rattus norvegicus
gtgctctcgccttctgtcaggacga

SEQ ID NO: 613400 - DNA, 25 bp, Rattus norvegicus
cctgaactagtctgggtgtgcccga

SEQ ID NO: 613401 - DNA, 25 bp, Rattus norvegicus
cacgcgcggtctctaacttgttgcc

SEQ ID NO: 613402 - DNA, 25 bp, Rattus norvegicus
acagaagccgcctcgagttcacatc

SEQ ID NO: 613403 - DNA, 25 bp, Rattus norvegicus
tctggtcgtccatcattgcctcgta

SEQ ID NO: 613404 - DNA, 25 bp, Rattus norvegicus
cccggccgacattacgtgataaagg

SEQ ID NO: 613405 - DNA, 25 bp, Rattus norvegicus
ttcctgtccatggagcccgcatgca

SEQ ID NO: 613406 - DNA, 25 bp, Rattus norvegicus
tgcgtcgcagctcttcaacatcata

SEQ ID NO: 613407 - DNA, 25 bp, Rattus norvegicus
ctcccggggtctagttctgagagaa

SEQ ID NO: 613408 - DNA, 25 bp, Rattus norvegicus
ataaaggactttggtctgcgcacgc

SEQ ID NO: 613409 - DNA, 25 bp, Rattus norvegicus
cgggccgcacttcctctctcagtcc

SEQ ID NO: 613410 - DNA, 25 bp, Rattus norvegicus
ctctgtccactgtgtgagacgaaca

SEQ ID NO: 613411 - DNA, 25 bp, Rattus norvegicus
ccactgtgtgagacgaacaggtgga

SEQ ID NO: 613412 - DNA, 25 bp, Rattus norvegicus
gtggacgacgcagagaaagctcgga

SEQ ID NO: 613413 - DNA, 25 bp, Rattus norvegicus
ggaggttcccacagccccattactg

SEQ ID NO: 613414 - DNA, 25 bp, Rattus norvegicus
ttactgtcagcgttgagccgcaccc

SEQ ID NO: 613415 - DNA, 25 bp, Rattus norvegicus
ttggcttcagcctgcggggtaagtc

SEQ ID NO: 613416 - DNA, 25 bp, Rattus norvegicus
ccgctaggctcggtgatcctagcct

SEQ ID NO: 613417 - DNA, 25 bp, Rattus norvegicus
tcggtgatcctagcctgcagtttgc

SEQ ID NO: 613418 - DNA, 25 bp, Rattus norvegicus
gatcctagcctgcagtttgccgccg

SEQ ID NO: 613419 - DNA, 25 bp, Rattus norvegicus
gtttgccgccgctacaccttggctt

SEQ ID NO: 613420 - DNA, 25 bp, Rattus norvegicus
accttggcttcagcctgcggggtaa

SEQ ID NO: 613421 - DNA, 25 bp, Rattus norvegicus
cctgctctgtccactgtgtgagacg

SEQ ID NO: 613422 - DNA, 25 bp, Rattus norvegicus
cccattactgtcagcgttgagccgc

SEQ ID NO: 613423 - DNA, 25 bp, Rattus norvegicus
cgcagcccttcagctactggaacga

SEQ ID NO: 613424 - DNA, 25 bp, Rattus norvegicus
gttctgccggaacaacaaggaggcg

SEQ ID NO: 613425 - DNA, 25 bp, Rattus norvegicus
aggcggtggcgctctacaccacaca

SEQ ID NO: 613426 - DNA, 25 bp, Rattus norvegicus
catggaggctttcccttgggcgcca

SEQ ID NO: 613427 - DNA, 25 bp, Rattus norvegicus
actggaacgactacctggggctagc

SEQ ID NO: 613428 - DNA, 25 bp, Rattus norvegicus
tcatcaccagggctagcgaccgcgg

SEQ ID NO: 613429 - DNA, 25 bp, Rattus norvegicus
atgaagacgacgacggcgatgagcc

SEQ ID NO: 613430 - DNA, 25 bp, Rattus norvegicus
aactgcgcgcgctagagctgtgcgc

SEQ ID NO: 613431 - DNA, 25 bp, Rattus norvegicus
gcttcgctgagctgaacccatttgc

SEQ ID NO: 613432 - DNA, 25 bp, Rattus norvegicus
gtgggcagccgagcctcgtctgcac

SEQ ID NO: 613433 - DNA, 25 bp, Rattus norvegicus
cgcgtctgctgaaaccggagcttca

SEQ ID NO: 613434 - DNA, 25 bp, Rattus norvegicus
caggtgtgtgtgttctgccggaaca

SEQ ID NO: 613435 - DNA, 25 bp, Rattus norvegicus
tggggctagccacgctcatcaccag

SEQ ID NO: 613436 - DNA, 25 bp, Rattus norvegicus
gcgataaaaggaagcaagggtgccc

SEQ ID NO: 613437 - DNA, 25 bp, Rattus norvegicus
aagaagttttctccggccaccactg

SEQ ID NO: 613438 - DNA, 25 bp, Rattus norvegicus
tgagggcattttccggcctctggaa

SEQ ID NO: 613439 - DNA, 25 bp, Rattus norvegicus
cctctggaaataggccggcatcttg

SEQ ID NO: 613440 - DNA, 25 bp, Rattus norvegicus
gacggttcctgatccgcgctttccg

SEQ ID NO: 613441 - DNA, 25 bp, Rattus norvegicus
atcttggcggtacgctcagttcacc

SEQ ID NO: 613442 - DNA, 25 bp, Rattus norvegicus
tcagcgaactccctagtggcctgga

SEQ ID NO: 613443 - DNA, 25 bp, Rattus norvegicus
tttgcgcatgctccgcctttctctg

SEQ ID NO: 613444 - DNA, 25 bp, Rattus norvegicus
aggaggccgatcgtggctaagaatc

SEQ ID NO: 613445 - DNA, 25 bp, Rattus norvegicus
ctgcggtcagatctgcgactaaaaa

SEQ ID NO: 613446 - DNA, 25 bp, Rattus norvegicus
cccaaaatgacgtgcgcagaatctg

SEQ ID NO: 613447 - DNA, 25 bp, Rattus norvegicus
atctggccgcgttaaggtcgcaacg

SEQ ID NO: 613448 - DNA, 25 bp, Rattus norvegicus
cggagacatcgcctggaaaggttca

SEQ ID NO: 613449 - DNA, 25 bp, Rattus norvegicus
ggcttcccaagcagtccacggtctg

SEQ ID NO: 613450 - DNA, 25 bp, Rattus norvegicus
gccttactcaccgttggcgcgcttg

SEQ ID NO: 613451 - DNA, 25 bp, Rattus norvegicus
cggaagatggctgcagttgtagcaa

SEQ ID NO: 613452 - DNA, 25 bp, Rattus norvegicus
tgttggaacccgtgcagggtgaccc

SEQ ID NO: 613453 - DNA, 25 bp, Rattus norvegicus
cccgcttgggttctgggatctcccg

SEQ ID NO: 613454 - DNA, 25 bp, Rattus norvegicus
tggacacccagctgatgctcggagt

SEQ ID NO: 613455 - DNA, 25 bp, Rattus norvegicus
cggagccgatgttggaacccgtgca

SEQ ID NO: 613456 - DNA, 25 bp, Rattus norvegicus
ctgcagttgtagcaatggacaccca

SEQ ID NO: 613457 - DNA, 25 bp, Rattus norvegicus
aggacgcaggctctctgtccgccag

SEQ ID NO: 613458 - DNA, 25 bp, Rattus norvegicus
ccctccagggaggatctagatttgt

SEQ ID NO: 613459 - DNA, 25 bp, Rattus norvegicus
ttgtgctgaggactttggcctcttc

SEQ ID NO: 613460 - DNA, 25 bp, Rattus norvegicus
ttggcctcttcagctccgaggctga

SEQ ID NO: 613461 - DNA, 25 bp, Rattus norvegicus
gcggggctcgatactcccgctgacg

SEQ ID NO: 613462 - DNA, 25 bp, Rattus norvegicus
ctgacggcccgctttgggactatgg

SEQ ID NO: 613463 - DNA, 25 bp, Rattus norvegicus
ccaggctgcgcttgtttgcggctcc

SEQ ID NO: 613464 - DNA, 25 bp, Rattus norvegicus
tgcggctcccgggagtatgacaccc

SEQ ID NO: 613465 - DNA, 25 bp, Rattus norvegicus
cccggagtacttggcgttcggagat

SEQ ID NO: 613466 - DNA, 25 bp, Rattus norvegicus
gaccagatagctctgcagctcaagg

SEQ ID NO: 613467 - DNA, 25 bp, Rattus norvegicus
cagggcagccggtcaaggtcactct

SEQ ID NO: 613468 - DNA, 25 bp, Rattus norvegicus
gtcaaggtcactctgcccaggccag

SEQ ID NO: 613469 - DNA, 25 bp, Rattus norvegicus
cttggcgttcggagatccagaaatg

SEQ ID NO: 613470 - DNA, 25 bp, Rattus norvegicus
atccagaaatgcaggttgggttcca

SEQ ID NO: 613471 - DNA, 25 bp, Rattus norvegicus
agaaatgcaggttgggttccatgtg

SEQ ID NO: 613472 - DNA, 25 bp, Rattus norvegicus
gttccatgtggaccgcggcgccact

SEQ ID NO: 613473 - DNA, 25 bp, Rattus norvegicus
cgccactgcgcccttggcaacgcca

SEQ ID NO: 613474 - DNA, 25 bp, Rattus norvegicus
tggcaacgccagcaagcgcctcctc

SEQ ID NO: 613475 - DNA, 25 bp, Rattus norvegicus
ctcctcttcctgaaacgaaccggag

SEQ ID NO: 613476 - DNA, 25 bp, Rattus norvegicus
gcggtgcaggaccagatagctctgc

SEQ ID NO: 613477 - DNA, 25 bp, Rattus norvegicus
cagctcaaggggaggagcctaccga

SEQ ID NO: 613478 - DNA, 25 bp, Rattus norvegicus
agccggtcaaggtcactctgcccag

SEQ ID NO: 613479 - DNA, 25 bp, Rattus norvegicus
cgatccggtcctggaagcaagtgct

SEQ ID NO: 613480 - DNA, 25 bp, Rattus norvegicus
ataagggctagtggccagcagaccc

SEQ ID NO: 613481 - DNA, 25 bp, Rattus norvegicus
ctaggacttggggagcacactacac

SEQ ID NO: 613482 - DNA, 25 bp, Rattus norvegicus
tacacgcgcggggaagagaaaagct

SEQ ID NO: 613483 - DNA, 25 bp, Rattus norvegicus
agaaaagctgtcctgcgcaggcgca

SEQ ID NO: 613484 - DNA, 25 bp, Rattus norvegicus
caagacggcctttcgggctacaaga

SEQ ID NO: 613485 - DNA, 25 bp, Rattus norvegicus
cccgaggttcccgagctgagaactc

SEQ ID NO: 613486 - DNA, 25 bp, Rattus norvegicus
caagtgctggtcagagtgtctgtta

SEQ ID NO: 613487 - DNA, 25 bp, Rattus norvegicus
gtctgttatgtcatgcgcctgccca

SEQ ID NO: 613488 - DNA, 25 bp, Rattus norvegicus
gaggaccagagcaaccttcccgcag

SEQ ID NO: 613489 - DNA, 25 bp, Rattus norvegicus
gccgccatcttcagagaacgcaaga

SEQ ID NO: 613490 - DNA, 25 bp, Rattus norvegicus
agagccacgataggcggagacaccc

SEQ ID NO: 613491 - DNA, 25 bp, Rattus norvegicus
cggagacacccacgagcagctggag

SEQ ID NO: 613492 - DNA, 25 bp, Rattus norvegicus
gaactccctcccataagggctagtg

SEQ ID NO: 613493 - DNA, 25 bp, Rattus norvegicus
attcccttcattcccggtgtccaga

SEQ ID NO: 613494 - DNA, 25 bp, Rattus norvegicus
tcgaggcgttcttgactgagactgc

SEQ ID NO: 613495 - DNA, 25 bp, Rattus norvegicus
tggccaacacggtcttgctgaaagc

SEQ ID NO: 613496 - DNA, 25 bp, Rattus norvegicus
ctgccgactgtcaatggagctggaa

SEQ ID NO: 613497 - DNA, 25 bp, Rattus norvegicus
ccgcgggctcgtagaaagaataatg

SEQ ID NO: 613498 - DNA, 25 bp, Rattus norvegicus
ggaggctgaagcatccgaagcatta

SEQ ID NO: 613499 - DNA, 25 bp, Rattus norvegicus
cgggacaggaaagggactctacgct

SEQ ID NO: 613500 - DNA, 25 bp, Rattus norvegicus
cgctttctcggatcttggcgggaca

SEQ ID NO: 613501 - DNA, 25 bp, Rattus norvegicus
ttggcttgtgctttccgctttctcg

SEQ ID NO: 613502 - DNA, 25 bp, Rattus norvegicus
ggtctcagcctctacacctgggctt

SEQ ID NO: 613503 - DNA, 25 bp, Rattus norvegicus
agtgcacctttgtcagcgacctggc

SEQ ID NO: 613504 - DNA, 25 bp, Rattus norvegicus
ttgctgcccggaaacaaagtgcacc

SEQ ID NO: 613505 - DNA, 25 bp, Rattus norvegicus
ggcgctcacgctacgtgcctagaga

SEQ ID NO: 613506 - DNA, 25 bp, Rattus norvegicus
cagggctcgagcctagagtaccaca

SEQ ID NO: 613507 - DNA, 25 bp, Rattus norvegicus
tgagcgcgcacttgtgtcacgctga

SEQ ID NO: 613508 - DNA, 25 bp, Rattus norvegicus
ctgcctgtcagtcagggtacaattc

SEQ ID NO: 613509 - DNA, 25 bp, Rattus norvegicus
tccaccaattgacagacagctggcc

SEQ ID NO: 613510 - DNA, 25 bp, Rattus norvegicus
ggctgacaggagaatccaccaattg

SEQ ID NO: 613511 - DNA, 25 bp, Rattus norvegicus
cttctgaggagttccgaggctgaca

SEQ ID NO: 613512 - DNA, 25 bp, Rattus norvegicus
gccgccgttcgtccttctgaggagt

SEQ ID NO: 613513 - DNA, 25 bp, Rattus norvegicus
tcgcctgtactcatggtccagaatc

SEQ ID NO: 613514 - DNA, 25 bp, Rattus norvegicus
gctggtcttgaaggtttcgcctgta

SEQ ID NO: 613515 - DNA, 25 bp, Rattus norvegicus
gcctagaaagtctcgctggtcttga

SEQ ID NO: 613516 - DNA, 25 bp, Rattus norvegicus
ccctgcacgaatcaggtggtgtcca

SEQ ID NO: 613517 - DNA, 25 bp, Rattus norvegicus
tctaatttaggggatatggggtctc

SEQ ID NO: 613518 - DNA, 25 bp, Rattus norvegicus
agcgcgcaggcgcatacttattctc

SEQ ID NO: 613519 - DNA, 25 bp, Rattus norvegicus
atacttattctctgcgcggcgtccg

SEQ ID NO: 613520 - DNA, 25 bp, Rattus norvegicus
tctcacgggctgagcctagaaagtc

SEQ ID NO: 613521 - DNA, 25 bp, Rattus norvegicus
gatcccggcgtatcggtgcagtgac

SEQ ID NO: 613522 - DNA, 25 bp, Rattus norvegicus
gttgcccaatagttccctagctgcc

SEQ ID NO: 613523 - DNA, 25 bp, Rattus norvegicus
tccggccggactccggacacccagc

SEQ ID NO: 613524 - DNA, 25 bp, Rattus norvegicus
ctccgttttggatcccggcgtatcg

SEQ ID NO: 613525 - DNA, 25 bp, Rattus norvegicus
actgatcgtaggacccgcttcccag

SEQ ID NO: 613526 - DNA, 25 bp, Rattus norvegicus
ggtgcagtgacctcagcgcccatct

SEQ ID NO: 613527 - DNA, 25 bp, Rattus norvegicus
cccaggcgaaagccagaggtagcgc

SEQ ID NO: 613528 - DNA, 25 bp, Rattus norvegicus
aggctcggctagaccgagtggcttc

SEQ ID NO: 613529 - DNA, 25 bp, Rattus norvegicus
cgctcgatcgcggtcttggcgtcgt

SEQ ID NO: 613530 - DNA, 25 bp, Rattus norvegicus
aggcgccttcggtacttcccgctcg

SEQ ID NO: 613531 - DNA, 25 bp, Rattus norvegicus
gcgcccggagatgaactgatcgtag

SEQ ID NO: 613532 - DNA, 25 bp, Rattus norvegicus
atgaactgatcgtaggacccgcttc

SEQ ID NO: 613533 - DNA, 25 bp, Rattus norvegicus
ttcgccctgtgcccgccggtaagga

SEQ ID NO: 613534 - DNA, 25 bp, Rattus norvegicus
cagtcctcggcctccgttttggatc

SEQ ID NO: 613535 - DNA, 25 bp, Rattus norvegicus
tgatacacctactactgcatccggc

SEQ ID NO: 613536 - DNA, 25 bp, Rattus norvegicus
tgagcatgcccagcaaggcctcgga

SEQ ID NO: 613537 - DNA, 25 bp, Rattus norvegicus
ctgagagcccgggaatccgcgactc

SEQ ID NO: 613538 - DNA, 25 bp, Rattus norvegicus
atccgcgactcaggttagccactca

SEQ ID NO: 613539 - DNA, 25 bp, Rattus norvegicus
ggttagccactcaccattggtaaag

SEQ ID NO: 613540 - DNA, 25 bp, Rattus norvegicus
attggtaaaggtctccatcttcgcc

SEQ ID NO: 613541 - DNA, 25 bp, Rattus norvegicus
cccaagctttctactccgagagctg

SEQ ID NO: 613542 - DNA, 25 bp, Rattus norvegicus
tctactccgagagctgaagcggccc

SEQ ID NO: 613543 - DNA, 25 bp, Rattus norvegicus
acccttggcggggatgcctgcagcc

SEQ ID NO: 613544 - DNA, 25 bp, Rattus norvegicus
aacccttggcctactccgcggagag

SEQ ID NO: 613545 - DNA, 25 bp, Rattus norvegicus
tctctgccgcagagctgtagtaccc

SEQ ID NO: 613546 - DNA, 25 bp, Rattus norvegicus
ccggttcagacaactgatacaccta

SEQ ID NO: 613547 - DNA, 25 bp, Rattus norvegicus
actgcatccggctgtgttccgggtg

SEQ ID NO: 613548 - DNA, 25 bp, Rattus norvegicus
gacgctgagcatagcccaacccttg

SEQ ID NO: 613549 - DNA, 25 bp, Rattus norvegicus
aggaagttagtttcgcgaggcatta

SEQ ID NO: 613550 - DNA, 25 bp, Rattus norvegicus
ccacggcagcggcatttaagttgtg

SEQ ID NO: 613551 - DNA, 25 bp, Rattus norvegicus
tcatgcgttatccacggcagcggca

SEQ ID NO: 613552 - DNA, 25 bp, Rattus norvegicus
tggatcctcgctgtctcatgcgtta

SEQ ID NO: 613553 - DNA, 25 bp, Rattus norvegicus
tcataaaagaagcatctggatcctc

SEQ ID NO: 613554 - DNA, 25 bp, Rattus norvegicus
cgtcacgtcaccagcgcgatcataa

SEQ ID NO: 613555 - DNA, 25 bp, Rattus norvegicus
ttcttgctgatgatgccgtcacgtc

SEQ ID NO: 613556 - DNA, 25 bp, Rattus norvegicus
gcacgaagacaccagttcttgctga

SEQ ID NO: 613557 - DNA, 25 bp, Rattus norvegicus
atggaaagaagcgtgcgcgcctgtc

SEQ ID NO: 613558 - DNA, 25 bp, Rattus norvegicus
cgagccggggattctcttaccataa

SEQ ID NO: 613559 - DNA, 25 bp, Rattus norvegicus
tcgcgaggcattacgtgagtaaagt

SEQ ID NO: 613560 - DNA, 25 bp, Rattus norvegicus
agtctgagtagcaaagttacggtcg

SEQ ID NO: 613561 - DNA, 25 bp, Rattus norvegicus
tgtcttcaaatgtctcggatccgcg

SEQ ID NO: 613562 - DNA, 25 bp, Rattus norvegicus
cctgtcagctgtgaggtcagctcta

SEQ ID NO: 613563 - DNA, 25 bp, Rattus norvegicus
cgcgtttacaaaggactgtgaattc

SEQ ID NO: 613564 - DNA, 25 bp, Rattus norvegicus
gcgggtatcgactgcactgatgaaa

SEQ ID NO: 613565 - DNA, 25 bp, Rattus norvegicus
agcctggtaagtcgaggtctccatc

SEQ ID NO: 613566 - DNA, 25 bp, Rattus norvegicus
agctggtactttcgccatggcctgc

SEQ ID NO: 613567 - DNA, 25 bp, Rattus norvegicus
gttcctcatcttcctgtagctggta

SEQ ID NO: 613568 - DNA, 25 bp, Rattus norvegicus
ggccatcatgggatcatgttcctca

SEQ ID NO: 613569 - DNA, 25 bp, Rattus norvegicus
ttgctctttctctgcggccatcatg

SEQ ID NO: 613570 - DNA, 25 bp, Rattus norvegicus
taggacgctcacacgttgctctttc

SEQ ID NO: 613571 - DNA, 25 bp, Rattus norvegicus
agtggtctgttccaagcccttaaga

SEQ ID NO: 613572 - DNA, 25 bp, Rattus norvegicus
tgcgctggaagttcccgtgagcctt

SEQ ID NO: 613573 - DNA, 25 bp, Rattus norvegicus
ggcggtggagaccactcgctcaaca

SEQ ID NO: 613574 - DNA, 25 bp, Rattus norvegicus
ctgcactctttgctacccagaattc

SEQ ID NO: 613575 - DNA, 25 bp, Rattus norvegicus
cacgcaggcgcactggaattcactg

SEQ ID NO: 613576 - DNA, 25 bp, Rattus norvegicus
ggccgattccgcgattaaaccacca

SEQ ID NO: 613577 - DNA, 25 bp, Rattus norvegicus
gctggatggaattttttcccctgga

SEQ ID NO: 613578 - DNA, 25 bp, Rattus norvegicus
gaagccaggccgaactgggctgggc

SEQ ID NO: 613579 - DNA, 25 bp, Rattus norvegicus
ggcctggatttctggcttctggctt

SEQ ID NO: 613580 - DNA, 25 bp, Rattus norvegicus
ctggatttctggcttctggcttgga

SEQ ID NO: 613581 - DNA, 25 bp, Rattus norvegicus
atttctggcttctggcttggatggc

SEQ ID NO: 613582 - DNA, 25 bp, Rattus norvegicus
cttctggcttggatggcgaagtggt

SEQ ID NO: 613583 - DNA, 25 bp, Rattus norvegicus
cccaggggaggaggtagccagcctg

SEQ ID NO: 613584 - DNA, 25 bp, Rattus norvegicus
gaggacactgggtccccgcgacgct

SEQ ID NO: 613585 - DNA, 25 bp, Rattus norvegicus
gagccgggtcgctcagtgccgggag

SEQ ID NO: 613586 - DNA, 25 bp, Rattus norvegicus
ctggacccaggccagcttcagggca

SEQ ID NO: 613587 - DNA, 25 bp, Rattus norvegicus
ctccctagggctggatggaattttt

SEQ ID NO: 613588 - DNA, 25 bp, Rattus norvegicus
agcctgggcctggatttctggcttc

SEQ ID NO: 613589 - DNA, 25 bp, Rattus norvegicus
tggacccaggccagcttcagggcag

SEQ ID NO: 613590 - DNA, 25 bp, Rattus norvegicus
tcctccctagggctggatggaattt

SEQ ID NO: 613591 - DNA, 25 bp, Rattus norvegicus
ttcctgcgtgatcctgcacgaccag

SEQ ID NO: 613592 - DNA, 25 bp, Rattus norvegicus
caggacgtttcctacttccgtgatt

SEQ ID NO: 613593 - DNA, 25 bp, Rattus norvegicus
acttccgtgatttgccggggtctca

SEQ ID NO: 613594 - DNA, 25 bp, Rattus norvegicus
ttccgggaagtgatgcgttggacac

SEQ ID NO: 613595 - DNA, 25 bp, Rattus norvegicus
tgagctccaggtcacgttccgggaa

SEQ ID NO: 613596 - DNA, 25 bp, Rattus norvegicus
ctaacgtgtacgctctggcagtgac

SEQ ID NO: 613597 - DNA, 25 bp, Rattus norvegicus
ggagctctgccctctaacgtgtacg

SEQ ID NO: 613598 - DNA, 25 bp, Rattus norvegicus
tggcgcggctctacttctatctgaa

SEQ ID NO: 613599 - DNA, 25 bp, Rattus norvegicus
cacagtggaaccttttcctgcgtga

SEQ ID NO: 613600 - DNA, 25 bp, Rattus norvegicus
tgcaacccaggcacagtggaacctt

SEQ ID NO: 613601 - DNA, 25 bp, Rattus norvegicus
acgaatccggccagtgcaacccagg

SEQ ID NO: 613602 - DNA, 25 bp, Rattus norvegicus
gcaggtccggactcaggacgtttcc

SEQ ID NO: 613603 - DNA, 25 bp, Rattus norvegicus
ctcacgggtacctggcacgaatccg

SEQ ID NO: 613604 - DNA, 25 bp, Rattus norvegicus
cttctatctgaacggtacgggcggg

SEQ ID NO: 613605 - DNA, 25 bp, Rattus norvegicus
gtagtccacggagtcacccagtgcc

SEQ ID NO: 613606 - DNA, 25 bp, Rattus norvegicus
cccagtgccttgaaagccgtgtaca

SEQ ID NO: 613607 - DNA, 25 bp, Rattus norvegicus
cgtgtacatgacttcgcgcttgcca

SEQ ID NO: 613608 - DNA, 25 bp, Rattus norvegicus
cagctggctcccaaggctgatggta

SEQ ID NO: 613609 - DNA, 25 bp, Rattus norvegicus
ggtagttgccatcccacacataagt

SEQ ID NO: 613610 - DNA, 25 bp, Rattus norvegicus
acacataagtggcagggtcctcatc

SEQ ID NO: 613611 - DNA, 25 bp, Rattus norvegicus
gtcctcatctgcgaagacttctcgg

SEQ ID NO: 613612 - DNA, 25 bp, Rattus norvegicus
gacttctcggaacatgtccaccatg

SEQ ID NO: 613613 - DNA, 25 bp, Rattus norvegicus
catgtacagatcctccgcgcgattg

SEQ ID NO: 613614 - DNA, 25 bp, Rattus norvegicus
cgcgcgattgccgtctacaaccata

SEQ ID NO: 613615 - DNA, 25 bp, Rattus norvegicus
gtctacaaccataagcacgcgcagc

SEQ ID NO: 613616 - DNA, 25 bp, Rattus norvegicus
aggtcaagcactggcgcaggtaagt

SEQ ID NO: 613617 - DNA, 25 bp, Rattus norvegicus
atccaggggtcccttcgcaaaagcg

SEQ ID NO: 613618 - DNA, 25 bp, Rattus norvegicus
tcacccttcggtgctccaggtaagc

SEQ ID NO: 613619 - DNA, 25 bp, Rattus norvegicus
gaattcctatagctgataaacaact

SEQ ID NO: 613620 - DNA, 25 bp, Rattus norvegicus
agtatcaccatttgcagaagatgca

SEQ ID NO: 613621 - DNA, 25 bp, Rattus norvegicus
gcagaagatgcaaaagtatacataa

SEQ ID NO: 613622 - DNA, 25 bp, Rattus norvegicus
gaaaaactcaaagtatcaccatttg

SEQ ID NO: 613623 - DNA, 25 bp, Rattus norvegicus
gtctacttgagaattcctatagctg

SEQ ID NO: 613624 - DNA, 25 bp, Rattus norvegicus
tcagcaaagtggctagatacaaaat

SEQ ID NO: 613625 - DNA, 25 bp, Rattus norvegicus
caaagtggctagatacaaaatttac

SEQ ID NO: 613626 - DNA, 25 bp, Rattus norvegicus
ctagaagaaataaatcagagacatc

SEQ ID NO: 613627 - DNA, 25 bp, Rattus norvegicus
tcagagacatcgctagaggagctcc

SEQ ID NO: 613628 - DNA, 25 bp, Rattus norvegicus
atcgctagaggagctccgagcgcgc

SEQ ID NO: 613629 - DNA, 25 bp, Rattus norvegicus
tgctacctcaaacgctggcagtacg

SEQ ID NO: 613630 - DNA, 25 bp, Rattus norvegicus
caaacgctggcagtacgtggactca

SEQ ID NO: 613631 - DNA, 25 bp, Rattus norvegicus
ctggcagtacgtggactcagaaggc

SEQ ID NO: 613632 - DNA, 25 bp, Rattus norvegicus
gcaaaccaaaatagtctacttgaga

SEQ ID NO: 613633 - DNA, 25 bp, Rattus norvegicus
cgtccttcggaaaaacatctgattc

SEQ ID NO: 613634 - DNA, 25 bp, Rattus norvegicus
agcagcggcggccaatcagaattca

SEQ ID NO: 613635 - DNA, 25 bp, Rattus norvegicus
ctgcgcaatgaggacgttcaggtgc

SEQ ID NO: 613636 - DNA, 25 bp, Rattus norvegicus
aggttcgatgagatggcagccttca

SEQ ID NO: 613637 - DNA, 25 bp, Rattus norvegicus
gcagccttcattgggtgcccagcca

SEQ ID NO: 613638 - DNA, 25 bp, Rattus norvegicus
tgccgccttccagtcggtgattggc

SEQ ID NO: 613639 - DNA, 25 bp, Rattus norvegicus
ttggcggccgacacagaatggctct

SEQ ID NO: 613640 - DNA, 25 bp, Rattus norvegicus
aatggctctctgtagggaatcggcg

SEQ ID NO: 613641 - DNA, 25 bp, Rattus norvegicus
cccattgcggtgctcatagatgaac

SEQ ID NO: 613642 - DNA, 25 bp, Rattus norvegicus
tgccgacggcgacgattcgctctac

SEQ ID NO: 613643 - DNA, 25 bp, Rattus norvegicus
tgcctgatagaaacgccagggagtc

SEQ ID NO: 613644 - DNA, 25 bp, Rattus norvegicus
caggcgggcacaattctggtcacta

SEQ ID NO: 613645 - DNA, 25 bp, Rattus norvegicus
ctcatctttcttgatggcaaggttc

SEQ ID NO: 613646 - DNA, 25 bp, Rattus norvegicus
tccggccaatggtgaatgagaagta

SEQ ID NO: 613647 - DNA, 25 bp, Rattus norvegicus
aatcggcgccagagtccctctttgc

SEQ ID NO: 613648 - DNA, 25 bp, Rattus norvegicus
taaaggcgcatacgcaccgtgatcc

SEQ ID NO: 613649 - DNA, 25 bp, Rattus norvegicus
cccgcgccaccatgagaagttatca

SEQ ID NO: 613650 - DNA, 25 bp, Rattus norvegicus
ccaccatgagaagttatcaagaccc

SEQ ID NO: 613651 - DNA, 25 bp, Rattus norvegicus
cgtaaaggccgctatataacctata

SEQ ID NO: 613652 - DNA, 25 bp, Rattus norvegicus
atataacctataccgccatggagcc

SEQ ID NO: 613653 - DNA, 25 bp, Rattus norvegicus
acgtgcgcgggacgcagtaattcca

SEQ ID NO: 613654 - DNA, 25 bp, Rattus norvegicus
cgggacgcagtaattccaccctata

SEQ ID NO: 613655 - DNA, 25 bp, Rattus norvegicus
agtaattccaccctatacgcgcata

SEQ ID NO: 613656 - DNA, 25 bp, Rattus norvegicus
gccggacgttaacagaagcccaatc

SEQ ID NO: 613657 - DNA, 25 bp, Rattus norvegicus
cagaagcccaatcggcgccagagtc

SEQ ID NO: 613658 - DNA, 25 bp, Rattus norvegicus
agagtccctctttgcccgccgatat

SEQ ID NO: 613659 - DNA, 25 bp, Rattus norvegicus
gggtaaaggcgcatacgcaccgtga

SEQ ID NO: 613660 - DNA, 25 bp, Rattus norvegicus
ctttgcccgccgatatcgacggacg

SEQ ID NO: 613661 - DNA, 25 bp, Rattus norvegicus
gcagggacacggatgtagaagcttc

SEQ ID NO: 613662 - DNA, 25 bp, Rattus norvegicus
cccggaagcggttttcctctgcata

SEQ ID NO: 613663 - DNA, 25 bp, Rattus norvegicus
caggtaacagagtggcagaggaaca

SEQ ID NO: 613664 - DNA, 25 bp, Rattus norvegicus
gggaggatacacgactagcgcttgt

SEQ ID NO: 613665 - DNA, 25 bp, Rattus norvegicus
atgcagcctggaagaagcagggaca

SEQ ID NO: 613666 - DNA, 25 bp, Rattus norvegicus
ttcctctgcatagatcgcgtagcta

SEQ ID NO: 613667 - DNA, 25 bp, Rattus norvegicus
atcgcgtagctaggtgagttttccc

SEQ ID NO: 613668 - DNA, 25 bp, Rattus norvegicus
taggtgagttttcccagatctttta

SEQ ID NO: 613669 - DNA, 25 bp, Rattus norvegicus
ctgcgagactgagaaagtaggaacg

SEQ ID NO: 613670 - DNA, 25 bp, Rattus norvegicus
cccagatcttttaggccggttgctg

SEQ ID NO: 613671 - DNA, 25 bp, Rattus norvegicus
gccggttgctggtactcagaaccca

SEQ ID NO: 613672 - DNA, 25 bp, Rattus norvegicus
ccctggaatccctatcttgcgtgca

SEQ ID NO: 613673 - DNA, 25 bp, Rattus norvegicus
ttgcgtgcaaagctccactcgggga

SEQ ID NO: 613674 - DNA, 25 bp, Rattus norvegicus
cacgactagcgcttgtgtgggcagt

SEQ ID NO: 613675 - DNA, 25 bp, Rattus norvegicus
accgctgccagagctggactcaact

SEQ ID NO: 613676 - DNA, 25 bp, Rattus norvegicus
gaggcccagcgctgaggaggggatt

SEQ ID NO: 613677 - DNA, 25 bp, Rattus norvegicus
acagccccaagttggctggcgccga

SEQ ID NO: 613678 - DNA, 25 bp, Rattus norvegicus
tctctccctgcgctcagtagagctt

SEQ ID NO: 613679 - DNA, 25 bp, Rattus norvegicus
tctccctgcgctcagtagagcttcg

SEQ ID NO: 613680 - DNA, 25 bp, Rattus norvegicus
tgcgctcagtagagcttcgccactg

SEQ ID NO: 613681 - DNA, 25 bp, Rattus norvegicus
ggcgccgcggtgacttgtaggctcc

SEQ ID NO: 613682 - DNA, 25 bp, Rattus norvegicus
cctggtcgagttcctcgtgcggggc

SEQ ID NO: 613683 - DNA, 25 bp, Rattus norvegicus
gctgccagagctggactcaactgcg

SEQ ID NO: 613684 - DNA, 25 bp, Rattus norvegicus
gagactaacggtggggcctggtcga

SEQ ID NO: 613685 - DNA, 25 bp, Rattus norvegicus
cccgctgacagtcggggctcgcccg

SEQ ID NO: 613686 - DNA, 25 bp, Rattus norvegicus
cctgtgtgagccgagactaacggtg

SEQ ID NO: 613687 - DNA, 25 bp, Rattus norvegicus
cgcgcctgtgtgagccgagactaac

SEQ ID NO: 613688 - DNA, 25 bp, Rattus norvegicus
cgcccgaagggagggaggcccagcg

SEQ ID NO: 613689 - DNA, 25 bp, Rattus norvegicus
acgccgcacccgtagatgagggaga

SEQ ID NO: 613690 - DNA, 25 bp, Rattus norvegicus
tcctactagagaagcccattacccg

SEQ ID NO: 613691 - DNA, 25 bp, Rattus norvegicus
ccctcagtgaatggtggatttttct

SEQ ID NO: 613692 - DNA, 25 bp, Rattus norvegicus
ctgctgctcacgctatggcgctgtt

SEQ ID NO: 613693 - DNA, 25 bp, Rattus norvegicus
tggcgctgttgattgatgattttgc

SEQ ID NO: 613694 - DNA, 25 bp, Rattus norvegicus
tgtcactctgtccaggttccttgga

SEQ ID NO: 613695 - DNA, 25 bp, Rattus norvegicus
gattttgctcaggacacctcacgcc

SEQ ID NO: 613696 - DNA, 25 bp, Rattus norvegicus
ggtggatttttctgtcactctgtcc

SEQ ID NO: 613697 - DNA, 25 bp, Rattus norvegicus
cacccgtagatgagggagactttca

SEQ ID NO: 613698 - DNA, 25 bp, Rattus norvegicus
agggagactttcaggtcctactaga

SEQ ID NO: 613699 - DNA, 25 bp, Rattus norvegicus
tttcaggtcctactagagaagccca

SEQ ID NO: 613700 - DNA, 25 bp, Rattus norvegicus
acgctatggcgctgttgattgatga

SEQ ID NO: 613701 - DNA, 25 bp, Rattus norvegicus
ttgatgattttgctcaggacacctc

SEQ ID NO: 613702 - DNA, 25 bp, Rattus norvegicus
ccagtccctcagtgaatggtggatt

SEQ ID NO: 613703 - DNA, 25 bp, Rattus norvegicus
gcccttatagcaacgtcgcctgtcg

SEQ ID NO: 613704 - DNA, 25 bp, Rattus norvegicus
gaagtaaccaagacgctcacctacg

SEQ ID NO: 613705 - DNA, 25 bp, Rattus norvegicus
ccgcttgcggctgcgccaatcaaaa

SEQ ID NO: 613706 - DNA, 25 bp, Rattus norvegicus
tgcggctgcgccaatcaaaagcgga

SEQ ID NO: 613707 - DNA, 25 bp, Rattus norvegicus
tgcgccaatcaaaagcggaaaagca

SEQ ID NO: 613708 - DNA, 25 bp, Rattus norvegicus
cggaaaagcaatagagacgagcagg

SEQ ID NO: 613709 - DNA, 25 bp, Rattus norvegicus
caggcccgtgacaaagagaaacgtg

SEQ ID NO: 613710 - DNA, 25 bp, Rattus norvegicus
caaagagaaacgtggccgccggatc

SEQ ID NO: 613711 - DNA, 25 bp, Rattus norvegicus
cggatcgcgcccttatagcaacgtc

SEQ ID NO: 613712 - DNA, 25 bp, Rattus norvegicus
aacgtcgcctgtcgtgatgtcatca

SEQ ID NO: 613713 - DNA, 25 bp, Rattus norvegicus
ctgggcggacttaccagcgaagtga

SEQ ID NO: 613714 - DNA, 25 bp, Rattus norvegicus
gatgtcatcacgcaccgcttgcggc

SEQ ID NO: 613715 - DNA, 25 bp, Rattus norvegicus
agcggcactttgctgggcggactta

SEQ ID NO: 613716 - DNA, 25 bp, Rattus norvegicus
aagacgctcacctacgaactcaggc

SEQ ID NO: 613717 - DNA, 25 bp, Rattus norvegicus
ttcaccgcttccctccatgagagga

SEQ ID NO: 613718 - DNA, 25 bp, Rattus norvegicus
gcgcctccgtggcagattcgactca

SEQ ID NO: 613719 - DNA, 25 bp, Rattus norvegicus
ccttcctagcctcgtccagagttgg

SEQ ID NO: 613720 - DNA, 25 bp, Rattus norvegicus
cccgtgaacactcgagcttggacat

SEQ ID NO: 613721 - DNA, 25 bp, Rattus norvegicus
cagctcctgggcttcgctgagacct

SEQ ID NO: 613722 - DNA, 25 bp, Rattus norvegicus
tggacatcgtacctgtccctcgggc

SEQ ID NO: 613723 - DNA, 25 bp, Rattus norvegicus
aacgctgcgcgtccgtagagccaat

SEQ ID NO: 613724 - DNA, 25 bp, Rattus norvegicus
ttcgactcagagctgcacaaggggc

SEQ ID NO: 613725 - DNA, 25 bp, Rattus norvegicus
agagctgcacaaggggctcagcttc

SEQ ID NO: 613726 - DNA, 25 bp, Rattus norvegicus
ctccatgagaggagcccagagcctc

SEQ ID NO: 613727 - DNA, 25 bp, Rattus norvegicus
cactgcgcatgtgctagtggagaac

SEQ ID NO: 613728 - DNA, 25 bp, Rattus norvegicus
catgtgctagtggagaacgctgcgc

SEQ ID NO: 613729 - DNA, 25 bp, Rattus norvegicus
tccgtagagccaatgggaaaccgaa

SEQ ID NO: 613730 - DNA, 25 bp, Rattus norvegicus
ctcgagcttggacatcgtacctgtc

SEQ ID NO: 613731 - DNA, 25 bp, Rattus norvegicus
ttggcagcgaccaagaactgcggtg

SEQ ID NO: 613732 - DNA, 25 bp, Rattus norvegicus
agtgcgcagacgcacccagagcttg

SEQ ID NO: 613733 - DNA, 25 bp, Rattus norvegicus
cctgggctgcaccaggtgagtgctc

SEQ ID NO: 613734 - DNA, 25 bp, Rattus norvegicus
ccgggtttgatttcaagttggcagc

SEQ ID NO: 613735 - DNA, 25 bp, Rattus norvegicus
agacgcacccagagcttggtcacgc

SEQ ID NO: 613736 - DNA, 25 bp, Rattus norvegicus
tccgagctccctgtcggaccagaga

SEQ ID NO: 613737 - DNA, 25 bp, Rattus norvegicus
cggcggacagcgtgtcctggagcct

SEQ ID NO: 613738 - DNA, 25 bp, Rattus norvegicus
agctccgagcgagacgccgcggccc

SEQ ID NO: 613739 - DNA, 25 bp, Rattus norvegicus
cgaccaagaactgcggtgcccgcgg

SEQ ID NO: 613740 - DNA, 25 bp, Rattus norvegicus
tttgatttcaagttggcagcgacca

SEQ ID NO: 613741 - DNA, 25 bp, Rattus norvegicus
gcttgccgggtttgatttcaagttg

SEQ ID NO: 613742 - DNA, 25 bp, Rattus norvegicus
gaggacccagtaagaggggcttgcc

SEQ ID NO: 613743 - DNA, 25 bp, Rattus norvegicus
cgcgcgcactcctatacagccctca

SEQ ID NO: 613744 - DNA, 25 bp, Rattus norvegicus
ctgtcggaccagagaacgcttttga

SEQ ID NO: 613745 - DNA, 25 bp, Rattus norvegicus
ggtcggatcagacgcctagccgctc

SEQ ID NO: 613746 - DNA, 25 bp, Rattus norvegicus
cgcacgctggagttttccctctaca

SEQ ID NO: 613747 - DNA, 25 bp, Rattus norvegicus
atccgctgagggagcccaaggttcc

SEQ ID NO: 613748 - DNA, 25 bp, Rattus norvegicus
tcctccggggaaggacgactccaca

SEQ ID NO: 613749 - DNA, 25 bp, Rattus norvegicus
cgactccacaactttgtgcgcgaga

SEQ ID NO: 613750 - DNA, 25 bp, Rattus norvegicus
agccgtggatcccacgggtcggatc

SEQ ID NO: 613751 - DNA, 25 bp, Rattus norvegicus
cggcccagcaactttgttctccggg

SEQ ID NO: 613752 - DNA, 25 bp, Rattus norvegicus
ttgttctccgggagagacctgtccc

SEQ ID NO: 613753 - DNA, 25 bp, Rattus norvegicus
aacgtggcgcctcgggtcacctgac

SEQ ID NO: 613754 - DNA, 25 bp, Rattus norvegicus
ggtcaatcagcactagccctaagcg

SEQ ID NO: 613755 - DNA, 25 bp, Rattus norvegicus
ggaatcccggaaccagtcgtgcatg

SEQ ID NO: 613756 - DNA, 25 bp, Rattus norvegicus
tcgtgcatgctggaaggcagaagct

SEQ ID NO: 613757 - DNA, 25 bp, Rattus norvegicus
tggagtaggcaccatgcgcacgcac

SEQ ID NO: 613758 - DNA, 25 bp, Rattus norvegicus
cacccgggaaggagctcgcttctct

SEQ ID NO: 613759 - DNA, 25 bp, Rattus norvegicus
acgctgtggctcctcttcaatctgc

SEQ ID NO: 613760 - DNA, 25 bp, Rattus norvegicus
tttccgaaacaagccgaagcgtgta

SEQ ID NO: 613761 - DNA, 25 bp, Rattus norvegicus
gcctacttcgtgctgcgttcctaga

SEQ ID NO: 613762 - DNA, 25 bp, Rattus norvegicus
tctgactctcctacgtcgccggatt

SEQ ID NO: 613763 - DNA, 25 bp, Rattus norvegicus
ctggcatttgacctgaaaagcattc

SEQ ID NO: 613764 - DNA, 25 bp, Rattus norvegicus
tctcgccagcaaggcttgacgtttc

SEQ ID NO: 613765 - DNA, 25 bp, Rattus norvegicus
cgtcatcccgtcaggtcagcaaagc

SEQ ID NO: 613766 - DNA, 25 bp, Rattus norvegicus
ttcaatctgccgtactgtccctggg

SEQ ID NO: 613767 - DNA, 25 bp, Rattus norvegicus
tcttgcgccagctgtacgatgttcc

SEQ ID NO: 613768 - DNA, 25 bp, Rattus norvegicus
cagcaagcgttcagccttcggaaga

SEQ ID NO: 613769 - DNA, 25 bp, Rattus norvegicus
cttccgaacgcttgcgggagatctc

SEQ ID NO: 613770 - DNA, 25 bp, Rattus norvegicus
tcgagcctagccagatccggtcatt

SEQ ID NO: 613771 - DNA, 25 bp, Rattus norvegicus
tccggtcattcttcagttgtggccc

SEQ ID NO: 613772 - DNA, 25 bp, Rattus norvegicus
cctgggcacaggcaataagtcaaca

SEQ ID NO: 613773 - DNA, 25 bp, Rattus norvegicus
cgccttccgcatgcgcttctacgtg

SEQ ID NO: 613774 - DNA, 25 bp, Rattus norvegicus
tgcggttgcattgccgcgggcttcg

SEQ ID NO: 613775 - DNA, 25 bp, Rattus norvegicus
gctctttggcctgctcttcctgctg

SEQ ID NO: 613776 - DNA, 25 bp, Rattus norvegicus
ggaagccgtgcccagcctgaggccc

SEQ ID NO: 613777 - DNA, 25 bp, Rattus norvegicus
tttggcctgctcttcctgctgtcct

SEQ ID NO: 613778 - DNA, 25 bp, Rattus norvegicus
ctcttcccactggaagctgtgcgtg

SEQ ID NO: 613779 - DNA, 25 bp, Rattus norvegicus
tcccactggaagctgtgcgtgagga

SEQ ID NO: 613780 - DNA, 25 bp, Rattus norvegicus
aagctgtgcgtgaggatgccttcta

SEQ ID NO: 613781 - DNA, 25 bp, Rattus norvegicus
gcgtgaggatgccttctacgcccgc

SEQ ID NO: 613782 - DNA, 25 bp, Rattus norvegicus
ctgcccacccgcctcttctacatga

SEQ ID NO: 613783 - DNA, 25 bp, Rattus norvegicus
acatgatcccggtcttcttcgcctt

SEQ ID NO: 613784 - DNA, 25 bp, Rattus norvegicus
gattgcggccgagtgcggttgcatt

SEQ ID NO: 613785 - DNA, 25 bp, Rattus norvegicus
ctcttctacatgatcccggtcttct

SEQ ID NO: 613786 - DNA, 25 bp, Rattus norvegicus
gggcctaccctgtggctgccaaagc

SEQ ID NO: 613787 - DNA, 25 bp, Rattus norvegicus
ttcagggatcaaggaaaggcctggc

SEQ ID NO: 613788 - DNA, 25 bp, Rattus norvegicus
agtcgaacctgacgctcaccgcagg

SEQ ID NO: 613789 - DNA, 25 bp, Rattus norvegicus
cgccgctgcggagcgtatcgcgaca

SEQ ID NO: 613790 - DNA, 25 bp, Rattus norvegicus
cgctatcgcgataagagggcgcgaa

SEQ ID NO: 613791 - DNA, 25 bp, Rattus norvegicus
ttctagacgaccgagtaggggattc

SEQ ID NO: 613792 - DNA, 25 bp, Rattus norvegicus
tggcctcccgctcaacttgcttgga

SEQ ID NO: 613793 - DNA, 25 bp, Rattus norvegicus
gccgacggctccacggaagctgaac

SEQ ID NO: 613794 - DNA, 25 bp, Rattus norvegicus
taggtccgtcattgctcccgcagca

SEQ ID NO: 613795 - DNA, 25 bp, Rattus norvegicus
cccattggttcctagtgagaatgag

SEQ ID NO: 613796 - DNA, 25 bp, Rattus norvegicus
gagaatgaggctagtcctctcgcta

SEQ ID NO: 613797 - DNA, 25 bp, Rattus norvegicus
tccaagtccagccagacgcggagga

SEQ ID NO: 613798 - DNA, 25 bp, Rattus norvegicus
tcctctcgctaggattggctgctct

SEQ ID NO: 613799 - DNA, 25 bp, Rattus norvegicus
cttgcttggattggctcgggttttt

SEQ ID NO: 613800 - DNA, 25 bp, Rattus norvegicus
tgagcccgggattgttctagacgac

SEQ ID NO: 613801 - DNA, 25 bp, Rattus norvegicus
cgtcgacactgcgagaagacaggaa

SEQ ID NO: 613802 - DNA, 25 bp, Rattus norvegicus
agttgacaacatagacgatcggtgg

SEQ ID NO: 613803 - DNA, 25 bp, Rattus norvegicus
tgccgccgataaatttgtaacttga

SEQ ID NO: 613804 - DNA, 25 bp, Rattus norvegicus
gatgacgctttacttgccgccgata

SEQ ID NO: 613805 - DNA, 25 bp, Rattus norvegicus
gcttcggcgctctttgatgacgctt

SEQ ID NO: 613806 - DNA, 25 bp, Rattus norvegicus
ctctcacgatcgtttctaagaaatc

SEQ ID NO: 613807 - DNA, 25 bp, Rattus norvegicus
tgtaacttgattggccactccacga

SEQ ID NO: 613808 - DNA, 25 bp, Rattus norvegicus
tccacgacatttccggcaatgtttg

SEQ ID NO: 613809 - DNA, 25 bp, Rattus norvegicus
cggcaatgtttgaacaacaacttta

SEQ ID NO: 613810 - DNA, 25 bp, Rattus norvegicus
attagcagccgcctcgcgggatggc

SEQ ID NO: 613811 - DNA, 25 bp, Rattus norvegicus
gatgtaagtagggttcagggaactc

SEQ ID NO: 613812 - DNA, 25 bp, Rattus norvegicus
tcagggaactcatacgccgccgtga

SEQ ID NO: 613813 - DNA, 25 bp, Rattus norvegicus
ggagaaccgctttggctcgtcgaca

SEQ ID NO: 613814 - DNA, 25 bp, Rattus norvegicus
ccgtgagtctgttaagcggagaacc

SEQ ID NO: 613815 - DNA, 25 bp, Rattus norvegicus
gacccgtaaataacactcgcacctg

SEQ ID NO: 613816 - DNA, 25 bp, Rattus norvegicus
aagcgtccggctttgctcgccacta

SEQ ID NO: 613817 - DNA, 25 bp, Rattus norvegicus
tgggctcgacccgtaaataacactc

SEQ ID NO: 613818 - DNA, 25 bp, Rattus norvegicus
ctgctgcgctcgctccctgcctcgc

SEQ ID NO: 613819 - DNA, 25 bp, Rattus norvegicus
gccactacccagtcagccctccgga

SEQ ID NO: 613820 - DNA, 25 bp, Rattus norvegicus
ataacactcgcacctgtcgcaggcg

SEQ ID NO: 613821 - DNA, 25 bp, Rattus norvegicus
caccggctattttgggctcgacccg

SEQ ID NO: 613822 - DNA, 25 bp, Rattus norvegicus
tgcctccgaagcgtccggctttgct

SEQ ID NO: 613823 - DNA, 25 bp, Rattus norvegicus
cgatgcctccgaagcgtccggcttt

SEQ ID NO: 613824 - DNA, 25 bp, Rattus norvegicus
ggcacgggtcccttgagctctcctg

SEQ ID NO: 613825 - DNA, 25 bp, Rattus norvegicus
atcgctccagactcagctcggggtc

SEQ ID NO: 613826 - DNA, 25 bp, Rattus norvegicus
gtaaataacactcgcacctgtcgca

SEQ ID NO: 613827 - DNA, 25 bp, Rattus norvegicus
ggccaggatcgctccagactcagct

SEQ ID NO: 613828 - DNA, 25 bp, Rattus norvegicus
ggctttgctcgccactacccagtca

SEQ ID NO: 613829 - DNA, 25 bp, Rattus norvegicus
caaggtccctgcttcggagcgtgaa

SEQ ID NO: 613830 - DNA, 25 bp, Rattus norvegicus
tcgcccgcgtttgccgatatgtaca

SEQ ID NO: 613831 - DNA, 25 bp, Rattus norvegicus
cgaatagtggtttttcttctcctcg

SEQ ID NO: 613832 - DNA, 25 bp, Rattus norvegicus
agaaggaccagccatacgaatagtg

SEQ ID NO: 613833 - DNA, 25 bp, Rattus norvegicus
tgacagcccgccgaagtagaaggac

SEQ ID NO: 613834 - DNA, 25 bp, Rattus norvegicus
tcacctcggccaggatgaatgacag

SEQ ID NO: 613835 - DNA, 25 bp, Rattus norvegicus
atgttgacggctagcacgccgatca

SEQ ID NO: 613836 - DNA, 25 bp, Rattus norvegicus
ggctgcgctcgatgtagatgttgac

SEQ ID NO: 613837 - DNA, 25 bp, Rattus norvegicus
gccttgagtaggtccgagcgtgatt

SEQ ID NO: 613838 - DNA, 25 bp, Rattus norvegicus
gacgcatcccgcgatggcgaggcct

SEQ ID NO: 613839 - DNA, 25 bp, Rattus norvegicus
cgcgactgagcgtgtacatggagat

SEQ ID NO: 613840 - DNA, 25 bp, Rattus norvegicus
aggaagcccgctgagctccctcggt

SEQ ID NO: 613841 - DNA, 25 bp, Rattus norvegicus
gctagaaggcccagcggtgtccagc

SEQ ID NO: 613842 - DNA, 25 bp, Rattus norvegicus
ttttcctgttgagcgtgttggtgtt

SEQ ID NO: 613843 - DNA, 25 bp, Rattus norvegicus
tgctgccacgaacaggatccctgcg

SEQ ID NO: 613844 - DNA, 25 bp, Rattus norvegicus
gcacgcgcccatgcacccgcagaca

SEQ ID NO: 613845 - DNA, 25 bp, Rattus norvegicus
agcgagggcggtcaggcggaccact

SEQ ID NO: 613846 - DNA, 25 bp, Rattus norvegicus
cctctgcctctcacctgctgccacg

SEQ ID NO: 613847 - DNA, 25 bp, Rattus norvegicus
gaacaggatccctgcgcccaggatg

SEQ ID NO: 613848 - DNA, 25 bp, Rattus norvegicus
ccctgcgcccaggatgatgttcctt

SEQ ID NO: 613849 - DNA, 25 bp, Rattus norvegicus
ctgcgcccaggatgatgttcctttt

SEQ ID NO: 613850 - DNA, 25 bp, Rattus norvegicus
tccttttggatttgtagacgcgaga

SEQ ID NO: 613851 - DNA, 25 bp, Rattus norvegicus
tttggatttgtagacgcgagaggca

SEQ ID NO: 613852 - DNA, 25 bp, Rattus norvegicus
ttgtagacgcgagaggcagctacgc

SEQ ID NO: 613853 - DNA, 25 bp, Rattus norvegicus
acgcgagaggcagctacgcacacgc

SEQ ID NO: 613854 - DNA, 25 bp, Rattus norvegicus
atggcgctcaggataggaaagatgc

SEQ ID NO: 613855 - DNA, 25 bp, Rattus norvegicus
ctggaggcccggactactcctaggg

SEQ ID NO: 613856 - DNA, 25 bp, Rattus norvegicus
cacgcacgcgcgttcgtgggtgggc

SEQ ID NO: 613857 - DNA, 25 bp, Rattus norvegicus
ggtgcgggcgatacatctcctcctc

SEQ ID NO: 613858 - DNA, 25 bp, Rattus norvegicus
tgaataagtacacggacatgactcc

SEQ ID NO: 613859 - DNA, 25 bp, Rattus norvegicus
cgcttggtgaataagtacacggaca

SEQ ID NO: 613860 - DNA, 25 bp, Rattus norvegicus
acttgatggccggagggtaattttg

SEQ ID NO: 613861 - DNA, 25 bp, Rattus norvegicus
tcctcctccgcgtagcgcttggtga

SEQ ID NO: 613862 - DNA, 25 bp, Rattus norvegicus
actggcccgagtagtcggagcagtc

SEQ ID NO: 613863 - DNA, 25 bp, Rattus norvegicus
gttgcagaaactggcccgagtagtc

SEQ ID NO: 613864 - DNA, 25 bp, Rattus norvegicus
gccacgcttcgggttgcagaaactg

SEQ ID NO: 613865 - DNA, 25 bp, Rattus norvegicus
ggccacgacgccacgcttcgggttg

SEQ ID NO: 613866 - DNA, 25 bp, Rattus norvegicus
tcgctagaaatgtcggaagggctgc

SEQ ID NO: 613867 - DNA, 25 bp, Rattus norvegicus
tggagacgtcgctagaaatgtcgga

SEQ ID NO: 613868 - DNA, 25 bp, Rattus norvegicus
cgtcatctggatggagacgtcgcta

SEQ ID NO: 613869 - DNA, 25 bp, Rattus norvegicus
ccggagggtaattttgcgtcatctg

SEQ ID NO: 613870 - DNA, 25 bp, Rattus norvegicus
ccgcgtagcgcttggtgaataagta

SEQ ID NO: 613871 - DNA, 25 bp, Rattus norvegicus
tctgcagaccgcagtggagcagagc

SEQ ID NO: 613872 - DNA, 25 bp, Rattus norvegicus
atcgtcgagcgtgggccttggaccc

SEQ ID NO: 613873 - DNA, 25 bp, Rattus norvegicus
ttggacccgcagacctcgtctactt

SEQ ID NO: 613874 - DNA, 25 bp, Rattus norvegicus
acctcgtctacttttggcctcagta

SEQ ID NO: 613875 - DNA, 25 bp, Rattus norvegicus
tggcctcagtatcctcaccacgttt

SEQ ID NO: 613876 - DNA, 25 bp, Rattus norvegicus
cgtttcctcggcatttgttttgtct

SEQ ID NO: 613877 - DNA, 25 bp, Rattus norvegicus
tgttttgtctgcagaccgcagtgga

SEQ ID NO: 613878 - DNA, 25 bp, Rattus norvegicus
tgcagcgagctgctgccagctcagc

SEQ ID NO: 613879 - DNA, 25 bp, Rattus norvegicus
cagccctgtcgccagggcagctgta

SEQ ID NO: 613880 - DNA, 25 bp, Rattus norvegicus
cagggcagctgtacactaggagatc

SEQ ID NO: 613881 - DNA, 25 bp, Rattus norvegicus
actaggagatcgtgctcagagatgc

SEQ ID NO: 613882 - DNA, 25 bp, Rattus norvegicus
cccgagtgccggatccgatggccat

SEQ ID NO: 613883 - DNA, 25 bp, Rattus norvegicus
atccgatggccatctggcgttgtca

SEQ ID NO: 613884 - DNA, 25 bp, Rattus norvegicus
tcggcatttgttttgtctgcagacc

SEQ ID NO: 613885 - DNA, 25 bp, Rattus norvegicus
tgcacccataaacgcggtggtttta

SEQ ID NO: 613886 - DNA, 25 bp, Rattus norvegicus
agcatccaaggggaagcggctgcac

SEQ ID NO: 613887 - DNA, 25 bp, Rattus norvegicus
ttttcagcatccaaggggaagcggc

SEQ ID NO: 613888 - DNA, 25 bp, Rattus norvegicus
ggttttatgtgatacgcagctcact

SEQ ID NO: 613889 - DNA, 25 bp, Rattus norvegicus
cggaatggcgcccttttcagcatcc

SEQ ID NO: 613890 - DNA, 25 bp, Rattus norvegicus
ctcctcatcccttaacggaatggcg

SEQ ID NO: 613891 - DNA, 25 bp, Rattus norvegicus
tatccgtctctttttcttcacaccg

SEQ ID NO: 613892 - DNA, 25 bp, Rattus norvegicus
gctggtttatcatcacaggtgcacc

SEQ ID NO: 613893 - DNA, 25 bp, Rattus norvegicus
atggcgcccttttcagcatccaagg

SEQ ID NO: 613894 - DNA, 25 bp, Rattus norvegicus
acgcggtggttttatgtgatacgca

SEQ ID NO: 613895 - DNA, 25 bp, Rattus norvegicus
atcacaggtgcacccataaacgcgg

SEQ ID NO: 613896 - DNA, 25 bp, Rattus norvegicus
ccggacctgctggtttatcatcaca

SEQ ID NO: 613897 - DNA, 25 bp, Rattus norvegicus
cctcttctccggacctgctggttta

SEQ ID NO: 613898 - DNA, 25 bp, Rattus norvegicus
cgcagctcacttttaatcttcggga

SEQ ID NO: 613899 - DNA, 25 bp, Rattus norvegicus
tcattggctaatgcggaggagggga

SEQ ID NO: 613900 - DNA, 25 bp, Rattus norvegicus
ccaacattggaaccctcgggatccg

SEQ ID NO: 613901 - DNA, 25 bp, Rattus norvegicus
gatccggttcctggagctcctctaa

SEQ ID NO: 613902 - DNA, 25 bp, Rattus norvegicus
ggagctcctctaacatcccggagcc

SEQ ID NO: 613903 - DNA, 25 bp, Rattus norvegicus
cccaaccccggctgagagtggtcta

SEQ ID NO: 613904 - DNA, 25 bp, Rattus norvegicus
gtctagcttggagcccccttgcctt

SEQ ID NO: 613905 - DNA, 25 bp, Rattus norvegicus
tcgctcttacctctctcagggctgg

SEQ ID NO: 613906 - DNA, 25 bp, Rattus norvegicus
tcttacctctctcagggctgggcgg

SEQ ID NO: 613907 - DNA, 25 bp, Rattus norvegicus
tctctcagggctgggcggacgctct

SEQ ID NO: 613908 - DNA, 25 bp, Rattus norvegicus
cgcgtccgcgtcttcactcagcgga

SEQ ID NO: 613909 - DNA, 25 bp, Rattus norvegicus
gaccggcggccgctcattggctaat

SEQ ID NO: 613910 - DNA, 25 bp, Rattus norvegicus
cagagagggaatgagatgagccttc

SEQ ID NO: 613911 - DNA, 25 bp, Rattus norvegicus
gagagagaatagaaacagaggcaga

SEQ ID NO: 613912 - DNA, 25 bp, Rattus norvegicus
cttcactcagcggacgcagcccgga

SEQ ID NO: 613913 - DNA, 25 bp, Rattus norvegicus
cagagcagtagaagactggggcatc

SEQ ID NO: 613914 - DNA, 25 bp, Rattus norvegicus
aacgcagcagggatcacgagctggc

SEQ ID NO: 613915 - DNA, 25 bp, Rattus norvegicus
gcgataggggcactccgcagactct

SEQ ID NO: 613916 - DNA, 25 bp, Rattus norvegicus
cgcagactctgagatcggaaggaca

SEQ ID NO: 613917 - DNA, 25 bp, Rattus norvegicus
cggcaccagctgtaccgagccggga

SEQ ID NO: 613918 - DNA, 25 bp, Rattus norvegicus
cagggcacctaacggtgcgcagcgc

SEQ ID NO: 613919 - DNA, 25 bp, Rattus norvegicus
cagcgcagggcagaaagcagcaccc

SEQ ID NO: 613920 - DNA, 25 bp, Rattus norvegicus
cagctgtaccgagccgggagaaagc

SEQ ID NO: 613921 - DNA, 25 bp, Rattus norvegicus
aagactggggcatctaggagccgca

SEQ ID NO: 613922 - DNA, 25 bp, Rattus norvegicus
tccgctatccgcacctgctgaaatg

SEQ ID NO: 613923 - DNA, 25 bp, Rattus norvegicus
cccaggaacgcagcagggatcacga

SEQ ID NO: 613924 - DNA, 25 bp, Rattus norvegicus
cgagctggccttttttctgaggaaa

SEQ ID NO: 613925 - DNA, 25 bp, Rattus norvegicus
ttttctgaggaaacaggtggacggc

SEQ ID NO: 613926 - DNA, 25 bp, Rattus norvegicus
ccgcacctgctgaaatgtagaagtc

SEQ ID NO: 613927 - DNA, 25 bp, Rattus norvegicus
ttcttgcccacagtaggtgcgcggg

SEQ ID NO: 613928 - DNA, 25 bp, Rattus norvegicus
tcgtcctcgttttcttggttactca

SEQ ID NO: 613929 - DNA, 25 bp, Rattus norvegicus
cttggttactcaaggacgcttctga

SEQ ID NO: 613930 - DNA, 25 bp, Rattus norvegicus
tcaaggacgcttctgagcgggtcgc

SEQ ID NO: 613931 - DNA, 25 bp, Rattus norvegicus
cccggctacagagactcggtggctg

SEQ ID NO: 613932 - DNA, 25 bp, Rattus norvegicus
gcgctggctcttcttgcccacagta

SEQ ID NO: 613933 - DNA, 25 bp, Rattus norvegicus
tcctttccttcctcatcagtgcggt

SEQ ID NO: 613934 - DNA, 25 bp, Rattus norvegicus
gggcgcgacaaacaaactccacagc

SEQ ID NO: 613935 - DNA, 25 bp, Rattus norvegicus
acagcaaacttctgggctccggagc

SEQ ID NO: 613936 - DNA, 25 bp, Rattus norvegicus
tgtgagcacgggtccgccaagtcca

SEQ ID NO: 613937 - DNA, 25 bp, Rattus norvegicus
gccaagtccaccctcagtgtttctt

SEQ ID NO: 613938 - DNA, 25 bp, Rattus norvegicus
tgtttcttctaaatcgaatgggttc

SEQ ID NO: 613939 - DNA, 25 bp, Rattus norvegicus
ttcctcatcagtgcggtttagaccg

SEQ ID NO: 613940 - DNA, 25 bp, Rattus norvegicus
cgaaggaactgcatgaacggcgcgc

SEQ ID NO: 613941 - DNA, 25 bp, Rattus norvegicus
cgcactacagagcgcgcggactcta

SEQ ID NO: 613942 - DNA, 25 bp, Rattus norvegicus
ttctcgtgccggctgctgccccccg

SEQ ID NO: 613943 - DNA, 25 bp, Rattus norvegicus
gagcgccgcggactgatgggaagaa

SEQ ID NO: 613944 - DNA, 25 bp, Rattus norvegicus
cactacagagcgcgcggactctagc

SEQ ID NO: 613945 - DNA, 25 bp, Rattus norvegicus
ccgtcctgcgcctcctgcagcaacg

SEQ ID NO: 613946 - DNA, 25 bp, Rattus norvegicus
tgcgcctcctgcagcaacgacacga

SEQ ID NO: 613947 - DNA, 25 bp, Rattus norvegicus
gcctcctgcagcaacgacacgaact

SEQ ID NO: 613948 - DNA, 25 bp, Rattus norvegicus
ctgagcagagctcgtgggctccgcc

SEQ ID NO: 613949 - DNA, 25 bp, Rattus norvegicus
cggccctgacgtccgctgcccggga

SEQ ID NO: 613950 - DNA, 25 bp, Rattus norvegicus
ccggcagaggaggtgcgcggactcc

SEQ ID NO: 613951 - DNA, 25 bp, Rattus norvegicus
cccgcgttcaccagtccctggagcc

SEQ ID NO: 613952 - DNA, 25 bp, Rattus norvegicus
ctggagccgcgaagctcgcgcgcgg

SEQ ID NO: 613953 - DNA, 25 bp, Rattus norvegicus
agaacgcgccgcactacagagcgcg

SEQ ID NO: 613954 - DNA, 25 bp, Rattus norvegicus
cttggtggtgagcaaccccaggctc

SEQ ID NO: 613955 - DNA, 25 bp, Rattus norvegicus
cgatctactgctatgcgcggcactg

SEQ ID NO: 613956 - DNA, 25 bp, Rattus norvegicus
agggtcttcgcgatctagcgatcta

SEQ ID NO: 613957 - DNA, 25 bp, Rattus norvegicus
aggtcatctaactggcagggtcttc

SEQ ID NO: 613958 - DNA, 25 bp, Rattus norvegicus
tgcagttaacccgatcgccaggtca

SEQ ID NO: 613959 - DNA, 25 bp, Rattus norvegicus
acagtggacatcagagtgccgtctc

SEQ ID NO: 613960 - DNA, 25 bp, Rattus norvegicus
ccacgcagatgatgcaggagtcctg

SEQ ID NO: 613961 - DNA, 25 bp, Rattus norvegicus
cagaatcccgggagaatccaggctc

SEQ ID NO: 613962 - DNA, 25 bp, Rattus norvegicus
agggtcccgcgatcttagggtcata

SEQ ID NO: 613963 - DNA, 25 bp, Rattus norvegicus
ccgcagagatgccatttaggtgata

SEQ ID NO: 613964 - DNA, 25 bp, Rattus norvegicus
cgccagggtgattgacaaggctgca

SEQ ID NO: 613965 - DNA, 25 bp, Rattus norvegicus
gcagaccatatcacggctcgccagg

SEQ ID NO: 613966 - DNA, 25 bp, Rattus norvegicus
gtgcactagactgccgaccctggtc

SEQ ID NO: 613967 - DNA, 25 bp, Rattus norvegicus
ccagcggcatgcacccttttgaata

SEQ ID NO: 613968 - DNA, 25 bp, Rattus norvegicus
tgtagaggcgaaccacccagaatcc

SEQ ID NO: 613969 - DNA, 25 bp, Rattus norvegicus
ggtttgaaagtcatcccgcggcatt

SEQ ID NO: 613970 - DNA, 25 bp, Rattus norvegicus
gccaagcgcgctgtgtccgggctct

SEQ ID NO: 613971 - DNA, 25 bp, Rattus norvegicus
tccgggctctggacgcttcataaac

SEQ ID NO: 613972 - DNA, 25 bp, Rattus norvegicus
gctctggacgcttcataaacgggaa

SEQ ID NO: 613973 - DNA, 25 bp, Rattus norvegicus
acgcttcataaacgggaagcctcag

SEQ ID NO: 613974 - DNA, 25 bp, Rattus norvegicus
ctcaggctggacagcacgggagctt

SEQ ID NO: 613975 - DNA, 25 bp, Rattus norvegicus
cagcacgggagcttctgggacttgt

SEQ ID NO: 613976 - DNA, 25 bp, Rattus norvegicus
attccactccgggtgaccgctggct

SEQ ID NO: 613977 - DNA, 25 bp, Rattus norvegicus
tggggacttgggtttgaaagtcatc

SEQ ID NO: 613978 - DNA, 25 bp, Rattus norvegicus
tttgaaagtcatcccgcggcattcc

SEQ ID NO: 613979 - DNA, 25 bp, Rattus norvegicus
ggagcgcttgtagcgcgctcgtctt

SEQ ID NO: 613980 - DNA, 25 bp, Rattus norvegicus
gcagagcatcgcaggagcgcttgta

SEQ ID NO: 613981 - DNA, 25 bp, Rattus norvegicus
acttgtagtcctgtgggcggtgccc

SEQ ID NO: 613982 - DNA, 25 bp, Rattus norvegicus
cgctcgtcttgctggggactacatt

SEQ ID NO: 613983 - DNA, 25 bp, Rattus norvegicus
tgaaggatccgaccctcagacagtt

SEQ ID NO: 613984 - DNA, 25 bp, Rattus norvegicus
cggacctccaccaggccagggcttt

SEQ ID NO: 613985 - DNA, 25 bp, Rattus norvegicus
ggctttgtgcagagcacgccgcgcc

SEQ ID NO: 613986 - DNA, 25 bp, Rattus norvegicus
ccgaggttcgcaggaccccatactg

SEQ ID NO: 613987 - DNA, 25 bp, Rattus norvegicus
catgtcacgcgaggggcgcacgctc

SEQ ID NO: 613988 - DNA, 25 bp, Rattus norvegicus
gaggggcgcacgctctccttgccag

SEQ ID NO: 613989 - DNA, 25 bp, Rattus norvegicus
ttgccaggctgcaggcaccccaaga

SEQ ID NO: 613990 - DNA, 25 bp, Rattus norvegicus
ggacgcccacgagcagctgtagtcc

SEQ ID NO: 613991 - DNA, 25 bp, Rattus norvegicus
ggactttgcttgagcgcaaggcccg

SEQ ID NO: 613992 - DNA, 25 bp, Rattus norvegicus
cgaccctcagacagttcggccggaa

SEQ ID NO: 613993 - DNA, 25 bp, Rattus norvegicus
cctcagacagttcggccggaacgcg

SEQ ID NO: 613994 - DNA, 25 bp, Rattus norvegicus
acgcgccggaagtggactttgcttg

SEQ ID NO: 613995 - DNA, 25 bp, Rattus norvegicus
cggaagtggactttgcttgagcgca

SEQ ID NO: 613996 - DNA, 25 bp, Rattus norvegicus
cggacctgaaggatccgaccctcag

SEQ ID NO: 613997 - DNA, 25 bp, Rattus norvegicus
gtttcaaacacacgccggcctggca

SEQ ID NO: 613998 - DNA, 25 bp, Rattus norvegicus
cctaatctgagaaaggcggggctta

SEQ ID NO: 613999 - DNA, 25 bp, Rattus norvegicus
gtgccagcgacaacagaaaaaccta

SEQ ID NO: 614000 - DNA, 25 bp, Rattus norvegicus
cagcctgtgccagcgacaacagaaa

SEQ ID NO: 614001 - DNA, 25 bp, Rattus norvegicus
caagctaaatgtgcgcaagcgcagc

SEQ ID NO: 614002 - DNA, 25 bp, Rattus norvegicus
ctgggaggtgtcatacaagctaaat

SEQ ID NO: 614003 - DNA, 25 bp, Rattus norvegicus
tccagacgctgtcaaccgagggacg

SEQ ID NO: 614004 - DNA, 25 bp, Rattus norvegicus
tcgggctcctactccctaacaagag

SEQ ID NO: 614005 - DNA, 25 bp, Rattus norvegicus
aaaacacagggaccacgaggatctc

SEQ ID NO: 614006 - DNA, 25 bp, Rattus norvegicus
gcctacctccagacagaaaacacag

SEQ ID NO: 614007 - DNA, 25 bp, Rattus norvegicus
agttccggacgcctgtcgtctgagc

SEQ ID NO: 614008 - DNA, 25 bp, Rattus norvegicus
tggcacacccaagcacagacttagt

SEQ ID NO: 614009 - DNA, 25 bp, Rattus norvegicus
gcacagacttagttccggacgcctg

SEQ ID NO: 614010 - DNA, 25 bp, Rattus norvegicus
gccagctaccttatccagacgctgt

SEQ ID NO: 614011 - DNA, 25 bp, Rattus norvegicus
gcgcagcctgagttctggttcttaa

SEQ ID NO: 614012 - DNA, 25 bp, Rattus norvegicus
cgggctaagggacccggcagagcaa

SEQ ID NO: 614013 - DNA, 25 bp, Rattus norvegicus
agctcctgcgcagcctgagttctgg

SEQ ID NO: 614014 - DNA, 25 bp, Rattus norvegicus
cgcgcctttgtgagctctacctgct

SEQ ID NO: 614015 - DNA, 25 bp, Rattus norvegicus
ctgagttctggttcttaagaccgga

SEQ ID NO: 614016 - DNA, 25 bp, Rattus norvegicus
ggaaggaaaggaaacgaattcagca

SEQ ID NO: 614017 - DNA, 25 bp, Rattus norvegicus
ggaaacgaattcagcagagactcta

SEQ ID NO: 614018 - DNA, 25 bp, Rattus norvegicus
gaattcagcagagactctaggaccc

SEQ ID NO: 614019 - DNA, 25 bp, Rattus norvegicus
gaaagccgcgccctgaaaggcgttc

SEQ ID NO: 614020 - DNA, 25 bp, Rattus norvegicus
gccctgaaaggcgttcccagcatgc

SEQ ID NO: 614021 - DNA, 25 bp, Rattus norvegicus
ccagcatgccctacgccgctccagt

SEQ ID NO: 614022 - DNA, 25 bp, Rattus norvegicus
acctcccagaggtccgtgcgcggag

SEQ ID NO: 614023 - DNA, 25 bp, Rattus norvegicus
ctcagccgcgcctttgtgagctcta

SEQ ID NO: 614024 - DNA, 25 bp, Rattus norvegicus
agctctacctgctccgcgagatcga

SEQ ID NO: 614025 - DNA, 25 bp, Rattus norvegicus
ctacgctaagcgattttctaagggg

SEQ ID NO: 614026 - DNA, 25 bp, Rattus norvegicus
gtgcgcaaccgcgagcttgtaccgc

SEQ ID NO: 614027 - DNA, 25 bp, Rattus norvegicus
ttgggctcacttggcttccacgcgc

SEQ ID NO: 614028 - DNA, 25 bp, Rattus norvegicus
acaccttgggctcacttggcttcca

SEQ ID NO: 614029 - DNA, 25 bp, Rattus norvegicus
ttcttctagcgctccacaccttggg

SEQ ID NO: 614030 - DNA, 25 bp, Rattus norvegicus
tattcccgggtgcttcttctagcgc

SEQ ID NO: 614031 - DNA, 25 bp, Rattus norvegicus
ccctcgatcaagacgtaggccagta

SEQ ID NO: 614032 - DNA, 25 bp, Rattus norvegicus
tctaaggggtaccaacaagctcgtc

SEQ ID NO: 614033 - DNA, 25 bp, Rattus norvegicus
gtgtgtgcgctcctacgctaagcga

SEQ ID NO: 614034 - DNA, 25 bp, Rattus norvegicus
ctcttctgcggacgcgtgtgtgcgc

SEQ ID NO: 614035 - DNA, 25 bp, Rattus norvegicus
ataatttgcatagagggcgcagagg

SEQ ID NO: 614036 - DNA, 25 bp, Rattus norvegicus
agccacgcccttaataatttgcata

SEQ ID NO: 614037 - DNA, 25 bp, Rattus norvegicus
acaactggacgctgctctcgccggg

SEQ ID NO: 614038 - DNA, 25 bp, Rattus norvegicus
cacagcattcctctattcccgggtg

SEQ ID NO: 614039 - DNA, 25 bp, Rattus norvegicus
gctaagctagctcgcgattggccaa

SEQ ID NO: 614040 - DNA, 25 bp, Rattus norvegicus
cctgcacccaggcagaagtacctgg

SEQ ID NO: 614041 - DNA, 25 bp, Rattus norvegicus
ggcagacaagtgcacctgcgcaacc

SEQ ID NO: 614042 - DNA, 25 bp, Rattus norvegicus
caggcagaagtacctggcggccgct

SEQ ID NO: 614043 - DNA, 25 bp, Rattus norvegicus
gctcgttgagcagggcggaaaccca

SEQ ID NO: 614044 - DNA, 25 bp, Rattus norvegicus
attggccaagccctgcgtgcagccg

SEQ ID NO: 614045 - DNA, 25 bp, Rattus norvegicus
acaaccgcactgcaaggccgccctg

SEQ ID NO: 614046 - DNA, 25 bp, Rattus norvegicus
ccctggcgggcagacaagtgcacct

SEQ ID NO: 614047 - DNA, 25 bp, Rattus norvegicus
gaagggaactcgcacccagcctgca

SEQ ID NO: 614048 - DNA, 25 bp, Rattus norvegicus
gagcccgctcccacgaagggaactc

SEQ ID NO: 614049 - DNA, 25 bp, Rattus norvegicus
gctagctcgcgattggccaagccct

SEQ ID NO: 614050 - DNA, 25 bp, Rattus norvegicus
gcgcaacccgcgcacttcagcaccg

SEQ ID NO: 614051 - DNA, 25 bp, Rattus norvegicus
tgggcggatctgctaagctagctcg

SEQ ID NO: 614052 - DNA, 25 bp, Rattus norvegicus
gagcagggcggaaacccaaccgaca

SEQ ID NO: 614053 - DNA, 25 bp, Rattus norvegicus
ttctcgccggagtggctttgccggt

SEQ ID NO: 614054 - DNA, 25 bp, Rattus norvegicus
tgctcacgccagtagaaggtcttgc

SEQ ID NO: 614055 - DNA, 25 bp, Rattus norvegicus
tctggacccggtgctgaagtccctt

SEQ ID NO: 614056 - DNA, 25 bp, Rattus norvegicus
tgctgaagtcccttgcgctaccgcg

SEQ ID NO: 614057 - DNA, 25 bp, Rattus norvegicus
cgctggtgacggagcacatgctcac

SEQ ID NO: 614058 - DNA, 25 bp, Rattus norvegicus
gagcacatgctcacgtctcccgaag

SEQ ID NO: 614059 - DNA, 25 bp, Rattus norvegicus
ttgagggcacctctgtctcggagga

SEQ ID NO: 614060 - DNA, 25 bp, Rattus norvegicus
ccggctcctgcttgtacggacgcat

SEQ ID NO: 614061 - DNA, 25 bp, Rattus norvegicus
agaaggtcttgccacactcgcagca

SEQ ID NO: 614062 - DNA, 25 bp, Rattus norvegicus
ttaggggagacttgccacactccgg

SEQ ID NO: 614063 - DNA, 25 bp, Rattus norvegicus
ggcgcaccaggtgctcacgccagta

SEQ ID NO: 614064 - DNA, 25 bp, Rattus norvegicus
ccgcaggtgctccttgcgccggaat

SEQ ID NO: 614065 - DNA, 25 bp, Rattus norvegicus
catgcggcttctcgcgcgctggcag

SEQ ID NO: 614066 - DNA, 25 bp, Rattus norvegicus
actccgggcacgacacagtgcctgg

SEQ ID NO: 614067 - DNA, 25 bp, Rattus norvegicus
gtgcgtcccgagctagtcatctctg

SEQ ID NO: 614068 - DNA, 25 bp, Rattus norvegicus
acatggtatttcctccctctaccgg

SEQ ID NO: 614069 - DNA, 25 bp, Rattus norvegicus
agagcgcttctgattttggactaca

SEQ ID NO: 614070 - DNA, 25 bp, Rattus norvegicus
gcagacctcaggaatacgcagacgt

SEQ ID NO: 614071 - DNA, 25 bp, Rattus norvegicus
attggctcatactggcgcaaacaga

SEQ ID NO: 614072 - DNA, 25 bp, Rattus norvegicus
ggaaaacccgcttcctattggctca

SEQ ID NO: 614073 - DNA, 25 bp, Rattus norvegicus
ctctgccatcccgaaaactacgttt

SEQ ID NO: 614074 - DNA, 25 bp, Rattus norvegicus
cagcacacttgggagaccggtctcc

SEQ ID NO: 614075 - DNA, 25 bp, Rattus norvegicus
ctctcgtaacgttcgtgcgtcccga

SEQ ID NO: 614076 - DNA, 25 bp, Rattus norvegicus
tcctactaagatgactctcgtaacg

SEQ ID NO: 614077 - DNA, 25 bp, Rattus norvegicus
aatacgcagacgtgtcggggaccga

SEQ ID NO: 614078 - DNA, 25 bp, Rattus norvegicus
gaccgaccggaggaatcgctgcttt

SEQ ID NO: 614079 - DNA, 25 bp, Rattus norvegicus
atcgctgctttcgttgtcctggaaa

SEQ ID NO: 614080 - DNA, 25 bp, Rattus norvegicus
tcctggaaaccggtggaggcagcac

SEQ ID NO: 614081 - DNA, 25 bp, Rattus norvegicus
cccatggtcagtctaggccctagtt

SEQ ID NO: 614082 - DNA, 25 bp, Rattus norvegicus
gacacccggaagtgtgcgcctaacg

SEQ ID NO: 614083 - DNA, 25 bp, Rattus norvegicus
cgccatagagcaggacggaggacca

SEQ ID NO: 614084 - DNA, 25 bp, Rattus norvegicus
aattccggaagtggcgtcatgagac

SEQ ID NO: 614085 - DNA, 25 bp, Rattus norvegicus
agacgactctcggtaccatagagca

SEQ ID NO: 614086 - DNA, 25 bp, Rattus norvegicus
ctcctatgcctagagcggcgaggta

SEQ ID NO: 614087 - DNA, 25 bp, Rattus norvegicus
ccgcaggcagctcgattattggaac

SEQ ID NO: 614088 - DNA, 25 bp, Rattus norvegicus
attattggaaccgtggagccaggcc

SEQ ID NO: 614089 - DNA, 25 bp, Rattus norvegicus
ccagggtcctagataattccggaag

SEQ ID NO: 614090 - DNA, 25 bp, Rattus norvegicus
cccattgcctggactgggctgaccg

SEQ ID NO: 614091 - DNA, 25 bp, Rattus norvegicus
aggccctagttctcccatgtccttt

SEQ ID NO: 614092 - DNA, 25 bp, Rattus norvegicus
gtcctttcccaaatctagtcgcctg

SEQ ID NO: 614093 - DNA, 25 bp, Rattus norvegicus
aggcctcccggactgtacttgcagc

SEQ ID NO: 614094 - DNA, 25 bp, Rattus norvegicus
tacttgcagccgatcttggccggaa

SEQ ID NO: 614095 - DNA, 25 bp, Rattus norvegicus
cgcttaatgctactgaggcgcctca

SEQ ID NO: 614096 - DNA, 25 bp, Rattus norvegicus
tctccttcatggagcgcagcttctg

SEQ ID NO: 614097 - DNA, 25 bp, Rattus norvegicus
tgctgagcctctgcctgttcgctca

SEQ ID NO: 614098 - DNA, 25 bp, Rattus norvegicus
agggtcttctgcacgttgagctcga

SEQ ID NO: 614099 - DNA, 25 bp, Rattus norvegicus
ctcgatgacgttcagcgtgtccgcc

SEQ ID NO: 614100 - DNA, 25 bp, Rattus norvegicus
accagcactgccatctgcaggaaga

SEQ ID NO: 614101 - DNA, 25 bp, Rattus norvegicus
gaagagctcatgcacgtcgcgaatg

SEQ ID NO: 614102 - DNA, 25 bp, Rattus norvegicus
gttctcggagaatacatcccacttg

SEQ ID NO: 614103 - DNA, 25 bp, Rattus norvegicus
cgtctttgcccatgatctccagctg

SEQ ID NO: 614104 - DNA, 25 bp, Rattus norvegicus
ccagctgccgctggatgcggatctt

SEQ ID NO: 614105 - DNA, 25 bp, Rattus norvegicus
tcatacatggcctgctggaaggcgc

SEQ ID NO: 614106 - DNA, 25 bp, Rattus norvegicus
ctcggcctggttatactcatacatg

SEQ ID NO: 614107 - DNA, 25 bp, Rattus norvegicus
tgtcgcgttgtttcatctcggcctg

SEQ ID NO: 614108 - DNA, 25 bp, Rattus norvegicus
tgcggatcttgcagttgtcgcgttg

SEQ ID NO: 614109 - DNA, 25 bp, Rattus norvegicus
ggccgcagcttcacacagagcaaga

SEQ ID NO: 614110 - DNA, 25 bp, Rattus norvegicus
ggcctaacgcctgtaccgactgcgg

SEQ ID NO: 614111 - DNA, 25 bp, Rattus norvegicus
gcggcaagaccttctcgcagagctc

SEQ ID NO: 614112 - DNA, 25 bp, Rattus norvegicus
gaagccgtacgcctgctctgaatgc

SEQ ID NO: 614113 - DNA, 25 bp, Rattus norvegicus
cggcaagcgctttagctggagctca

SEQ ID NO: 614114 - DNA, 25 bp, Rattus norvegicus
accggcgctcccacagtggtctaaa

SEQ ID NO: 614115 - DNA, 25 bp, Rattus norvegicus
cctacggttgcacccagagctgtca

SEQ ID NO: 614116 - DNA, 25 bp, Rattus norvegicus
cggcgaaatcgccatcccagtaggc

SEQ ID NO: 614117 - DNA, 25 bp, Rattus norvegicus
cgcccaagccgtacgtgtgcataga

SEQ ID NO: 614118 - DNA, 25 bp, Rattus norvegicus
aggagcctgcacacatctgcgtgga

SEQ ID NO: 614119 - DNA, 25 bp, Rattus norvegicus
ggtgccgcacttcggagacacaaga

SEQ ID NO: 614120 - DNA, 25 bp, Rattus norvegicus
aagattcatgcagttggggcgccct

SEQ ID NO: 614121 - DNA, 25 bp, Rattus norvegicus
gcagcagctgcggacagagtttcta

SEQ ID NO: 614122 - DNA, 25 bp, Rattus norvegicus
gggcatcatcgtggtgggcccacca

SEQ ID NO: 614123 - DNA, 25 bp, Rattus norvegicus
ttgccgcgacggaggccagcattgc

SEQ ID NO: 614124 - DNA, 25 bp, Rattus norvegicus
gacgcgtccttgtgcccttgcgtca

SEQ ID NO: 614125 - DNA, 25 bp, Rattus norvegicus
ggcagcctccacttccgcaaccaaa

SEQ ID NO: 614126 - DNA, 25 bp, Rattus norvegicus
cgagacggggacactgacaatccca

SEQ ID NO: 614127 - DNA, 25 bp, Rattus norvegicus
ccgggcacagcggtacaaaagcagc

SEQ ID NO: 614128 - DNA, 25 bp, Rattus norvegicus
ggtacaaaagcagccacaagccatc

SEQ ID NO: 614129 - DNA, 25 bp, Rattus norvegicus
ccacaagccatcagcggctggaaca

SEQ ID NO: 614130 - DNA, 25 bp, Rattus norvegicus
tggaacaccggctccgagtctggct

SEQ ID NO: 614131 - DNA, 25 bp, Rattus norvegicus
atttccggcgcacgggacgcgtcct

SEQ ID NO: 614132 - DNA, 25 bp, Rattus norvegicus
tcggaacaccggacttgccgcgacg

SEQ ID NO: 614133 - DNA, 25 bp, Rattus norvegicus
acgcacagacgcacggagggccgca

SEQ ID NO: 614134 - DNA, 25 bp, Rattus norvegicus
agcctccgagtggacgggaagcaac

SEQ ID NO: 614135 - DNA, 25 bp, Rattus norvegicus
ccggcatcatttccggcgcacggga

SEQ ID NO: 614136 - DNA, 25 bp, Rattus norvegicus
ctgcccaggtcggaacaccggactt

SEQ ID NO: 614137 - DNA, 25 bp, Rattus norvegicus
ctgttcaagcggtcagtcacttcca

SEQ ID NO: 614138 - DNA, 25 bp, Rattus norvegicus
tcacccgaagcgaggatttttgccg

SEQ ID NO: 614139 - DNA, 25 bp, Rattus norvegicus
cgcacagtgatttgagaggggtttc

SEQ ID NO: 614140 - DNA, 25 bp, Rattus norvegicus
tgtacgggacaatagcagccagttg

SEQ ID NO: 614141 - DNA, 25 bp, Rattus norvegicus
cggagtctcagctttggcacttagc

SEQ ID NO: 614142 - DNA, 25 bp, Rattus norvegicus
tgttgtttcggctcctttcggctta

SEQ ID NO: 614143 - DNA, 25 bp, Rattus norvegicus
cctctagagattaaacccgattgta

SEQ ID NO: 614144 - DNA, 25 bp, Rattus norvegicus
tctggccgcctctggaaattagtcc

SEQ ID NO: 614145 - DNA, 25 bp, Rattus norvegicus
ccagcctcctctaaagatacgggtt

SEQ ID NO: 614146 - DNA, 25 bp, Rattus norvegicus
tagcgtttcaacgttcggaggattc

SEQ ID NO: 614147 - DNA, 25 bp, Rattus norvegicus
ttgcggtaacttttcggagactagc

SEQ ID NO: 614148 - DNA, 25 bp, Rattus norvegicus
gctgccgctcgaactcgtcgaagtc

SEQ ID NO: 614149 - DNA, 25 bp, Rattus norvegicus
agcctgtcggctattctcggagaga

SEQ ID NO: 614150 - DNA, 25 bp, Rattus norvegicus
ggagaatatcgttcccttccgccac

SEQ ID NO: 614151 - DNA, 25 bp, Rattus norvegicus
tcaccgcttgaagcggtaggtgatt

SEQ ID NO: 614152 - DNA, 25 bp, Rattus norvegicus
ctccttggatggatcgaactctccc

SEQ ID NO: 614153 - DNA, 25 bp, Rattus norvegicus
cttttcgggagccacaatgagtagc

SEQ ID NO: 614154 - DNA, 25 bp, Rattus norvegicus
gagtctcgtcgtccagtgccaggaa

SEQ ID NO: 614155 - DNA, 25 bp, Rattus norvegicus
tctagcaggcgctccttggatggat

SEQ ID NO: 614156 - DNA, 25 bp, Rattus norvegicus
ggcaggagcagtttgctcttcttga

SEQ ID NO: 614157 - DNA, 25 bp, Rattus norvegicus
caatgagtagctctgcgatgggcgt

SEQ ID NO: 614158 - DNA, 25 bp, Rattus norvegicus
acctcagccagcttttcgggagcca

SEQ ID NO: 614159 - DNA, 25 bp, Rattus norvegicus
ggatggatcgaactctcccacctca

SEQ ID NO: 614160 - DNA, 25 bp, Rattus norvegicus
ggaatactctagcaggcgctccttg

SEQ ID NO: 614161 - DNA, 25 bp, Rattus norvegicus
aagcagcggcgggaatactctagca

SEQ ID NO: 614162 - DNA, 25 bp, Rattus norvegicus
cttcttgagagcctgcaccttcttg

SEQ ID NO: 614163 - DNA, 25 bp, Rattus norvegicus
gagcctgcaccttcttgagagtctc

SEQ ID NO: 614164 - DNA, 25 bp, Rattus norvegicus
gtcagcgccacggtgttcctgtcca

SEQ ID NO: 614165 - DNA, 25 bp, Rattus norvegicus
aaccagcatggggtatcgaccgtgg

SEQ ID NO: 614166 - DNA, 25 bp, Rattus norvegicus
tctcggaactggatggcggagaacg

SEQ ID NO: 614167 - DNA, 25 bp, Rattus norvegicus
acccaccagaaagcgggcgcagcgg

SEQ ID NO: 614168 - DNA, 25 bp, Rattus norvegicus
aaagaagcgcccacccaccagaaag

SEQ ID NO: 614169 - DNA, 25 bp, Rattus norvegicus
tgtcgcggaaagaagcgcccaccca

SEQ ID NO: 614170 - DNA, 25 bp, Rattus norvegicus
gagcgtctgcaaagtgtcgcggaaa

SEQ ID NO: 614171 - DNA, 25 bp, Rattus norvegicus
cgctctcacccaccggggcacggac

SEQ ID NO: 614172 - DNA, 25 bp, Rattus norvegicus
cccgcccttaggtgctcagggtaca

SEQ ID NO: 614173 - DNA, 25 bp, Rattus norvegicus
cagaatgggcaaccagcatggggta

SEQ ID NO: 614174 - DNA, 25 bp, Rattus norvegicus
gcaaagggtcccagaatgggcaacc

SEQ ID NO: 614175 - DNA, 25 bp, Rattus norvegicus
cgaccgtggcaaagggtcccagaat

SEQ ID NO: 614176 - DNA, 25 bp, Rattus norvegicus
cgccctttgtcccgcaagtgggagg

SEQ ID NO: 614177 - DNA, 25 bp, Rattus norvegicus
tcccgcactcgcgtgggcgagtaaa

SEQ ID NO: 614178 - DNA, 25 bp, Rattus norvegicus
gcccttaggtgctcagggtacaagg

SEQ ID NO: 614179 - DNA, 25 bp, Rattus norvegicus
tggctggagcgcttgaaagctttgc

SEQ ID NO: 614180 - DNA, 25 bp, Rattus norvegicus
caccacaagtaaagggcttgaggtc

SEQ ID NO: 614181 - DNA, 25 bp, Rattus norvegicus
ggcttgaggtccgagtgcgacacac

SEQ ID NO: 614182 - DNA, 25 bp, Rattus norvegicus
tccgagtgcgacacacggtggctct

SEQ ID NO: 614183 - DNA, 25 bp, Rattus norvegicus
gacacacggtggctctgcagccgca

SEQ ID NO: 614184 - DNA, 25 bp, Rattus norvegicus
agccgcagagggctggcaaagacac

SEQ ID NO: 614185 - DNA, 25 bp, Rattus norvegicus
ctggcaaagacacgagcgcactctg

SEQ ID NO: 614186 - DNA, 25 bp, Rattus norvegicus
agacacgagcgcactctgggcagct

SEQ ID NO: 614187 - DNA, 25 bp, Rattus norvegicus
tgtagcccttgcgaggacctggctc

SEQ ID NO: 614188 - DNA, 25 bp, Rattus norvegicus
cctccagctgcaccgtgtacgtgta

SEQ ID NO: 614189 - DNA, 25 bp, Rattus norvegicus
gaaagctttgccacaagcaccacaa

SEQ ID NO: 614190 - DNA, 25 bp, Rattus norvegicus
agcagcagcatctggagcggcagct

SEQ ID NO: 614191 - DNA, 25 bp, Rattus norvegicus
tcgatgagcagatggcggcccagcc

SEQ ID NO: 614192 - DNA, 25 bp, Rattus norvegicus
tgcaccgtgtacgtgtaggggaccc

SEQ ID NO: 614193 - DNA, 25 bp, Rattus norvegicus
gaacttctcgggttagctctgagtc

SEQ ID NO: 614194 - DNA, 25 bp, Rattus norvegicus
gaactccagtcccacctggcagaga

SEQ ID NO: 614195 - DNA, 25 bp, Rattus norvegicus
ccagtctgcactgggatcccggatg

SEQ ID NO: 614196 - DNA, 25 bp, Rattus norvegicus
aggggacgaagctcaagaactacga

SEQ ID NO: 614197 - DNA, 25 bp, Rattus norvegicus
cctggcagagaacgaccactggatc

SEQ ID NO: 614198 - DNA, 25 bp, Rattus norvegicus
gcctgacaaaggctacgaacttctc

SEQ ID NO: 614199 - DNA, 25 bp, Rattus norvegicus
ctctgagtcgcgcatgcgtgacatt

SEQ ID NO: 614200 - DNA, 25 bp, Rattus norvegicus
catgcgtgacattctgcggggcaag

SEQ ID NO: 614201 - DNA, 25 bp, Rattus norvegicus
gggcaaggctaggaactacaactcc

SEQ ID NO: 614202 - DNA, 25 bp, Rattus norvegicus
aactcccagaagcaactgcgcgttg

SEQ ID NO: 614203 - DNA, 25 bp, Rattus norvegicus
accaagagtggctcagcggtacagc

SEQ ID NO: 614204 - DNA, 25 bp, Rattus norvegicus
gctcagcggtacagcaggatccctc

SEQ ID NO: 614205 - DNA, 25 bp, Rattus norvegicus
aggatccctccctctcgcgagagaa

SEQ ID NO: 614206 - DNA, 25 bp, Rattus norvegicus
ctggatcaccctagaggtaaacgga

SEQ ID NO: 614207 - DNA, 25 bp, Rattus norvegicus
taggagcgagcttccgggcagctcc

SEQ ID NO: 614208 - DNA, 25 bp, Rattus norvegicus
tcaacggctctaaagggagcgcgta

SEQ ID NO: 614209 - DNA, 25 bp, Rattus norvegicus
cgaggctggagtcaacggctctaaa

SEQ ID NO: 614210 - DNA, 25 bp, Rattus norvegicus
tccacagacgaaggttccgaggctg

SEQ ID NO: 614211 - DNA, 25 bp, Rattus norvegicus
acgcacgctccacagacgaaggttc

SEQ ID NO: 614212 - DNA, 25 bp, Rattus norvegicus
ttcagaaacgcacgctccacagacg

SEQ ID NO: 614213 - DNA, 25 bp, Rattus norvegicus
ctgggaaagagcaccgttcagaaac

SEQ ID NO: 614214 - DNA, 25 bp, Rattus norvegicus
acggacccgggcttgccctgacgag

SEQ ID NO: 614215 - DNA, 25 bp, Rattus norvegicus
gctccgacccacacccagagacctg

SEQ ID NO: 614216 - DNA, 25 bp, Rattus norvegicus
tctgggcgtcgctttcgtcgcctca

SEQ ID NO: 614217 - DNA, 25 bp, Rattus norvegicus
gacattcctctctccggctctgggc

SEQ ID NO: 614218 - DNA, 25 bp, Rattus norvegicus
ttcgtcgcctcaccgctccgaccca

SEQ ID NO: 614219 - DNA, 25 bp, Rattus norvegicus
agagcaccgttcagaaacgcacgct

SEQ ID NO: 614220 - DNA, 25 bp, Rattus norvegicus
acacccagagacctgccggcctcgc

SEQ ID NO: 614221 - DNA, 25 bp, Rattus norvegicus
tcacggagcaatctttgccctcagg

SEQ ID NO: 614222 - DNA, 25 bp, Rattus norvegicus
aattcgtcgctagggtgtggccgac

SEQ ID NO: 614223 - DNA, 25 bp, Rattus norvegicus
tgtggccgacctcccagctgcaagt

SEQ ID NO: 614224 - DNA, 25 bp, Rattus norvegicus
cccagctgcaagttcagtctatcta

SEQ ID NO: 614225 - DNA, 25 bp, Rattus norvegicus
gcaagttcagtctatctacgtgggg

SEQ ID NO: 614226 - DNA, 25 bp, Rattus norvegicus
gggactgacaggtattgaatttttg

SEQ ID NO: 614227 - DNA, 25 bp, Rattus norvegicus
ttttgccgcgttcggcctattgcac

SEQ ID NO: 614228 - DNA, 25 bp, Rattus norvegicus
gcaatctttgccctcagggacaggg

SEQ ID NO: 614229 - DNA, 25 bp, Rattus norvegicus
gacagggcttaggtacaagatggcc

SEQ ID NO: 614230 - DNA, 25 bp, Rattus norvegicus
gcttaggtacaagatggccgccgcg

SEQ ID NO: 614231 - DNA, 25 bp, Rattus norvegicus
taggtacaagatggccgccgcgcgc

SEQ ID NO: 614232 - DNA, 25 bp, Rattus norvegicus
gattccgagctcaccgacccaggag

SEQ ID NO: 614233 - DNA, 25 bp, Rattus norvegicus
ttcacggcgaagacatcgcagggca

SEQ ID NO: 614234 - DNA, 25 bp, Rattus norvegicus
caggtattgaatttttgccgcgttc

SEQ ID NO: 614235 - DNA, 25 bp, Rattus norvegicus
tgccacagcagaacgtcttgcctgg

SEQ ID NO: 614236 - DNA, 25 bp, Rattus norvegicus
aacgtcttgccgcaggcgtcacagc

SEQ ID NO: 614237 - DNA, 25 bp, Rattus norvegicus
ccggcgcaccaagtgcacatactta

SEQ ID NO: 614238 - DNA, 25 bp, Rattus norvegicus
tgcttgctcagatggaaggactccc

SEQ ID NO: 614239 - DNA, 25 bp, Rattus norvegicus
gccgtacggtttttctgacatgtga

SEQ ID NO: 614240 - DNA, 25 bp, Rattus norvegicus
gagcagatcgtatgcgcccgcaaag

SEQ ID NO: 614241 - DNA, 25 bp, Rattus norvegicus
ttctcgatgaaaccgaacgtcttgc

SEQ ID NO: 614242 - DNA, 25 bp, Rattus norvegicus
ttgtgccacatgaggttctcgatga

SEQ ID NO: 614243 - DNA, 25 bp, Rattus norvegicus
gcctggtgaaccagcttgtgccaca

SEQ ID NO: 614244 - DNA, 25 bp, Rattus norvegicus
agccagtccgttgtccagcacgctg

SEQ ID NO: 614245 - DNA, 25 bp, Rattus norvegicus
gcatgtggcacagctgaagcgctca

SEQ ID NO: 614246 - DNA, 25 bp, Rattus norvegicus
aggcccaggaaatgcttgaagcttt

SEQ ID NO: 614247 - DNA, 25 bp, Rattus norvegicus
tacttatgagtcaccaggcccagga

SEQ ID NO: 614248 - DNA, 25 bp, Rattus norvegicus
gcttccttgtgactcatgacgtgga

SEQ ID NO: 614249 - DNA, 25 bp, Rattus norvegicus
aagcgccggcgtggaggatggtggc

SEQ ID NO: 614250 - DNA, 25 bp, Rattus norvegicus
gttctgggtactgcggtagggcagg

SEQ ID NO: 614251 - DNA, 25 bp, Rattus norvegicus
actgcggtagggcagggcgaggccc

SEQ ID NO: 614252 - DNA, 25 bp, Rattus norvegicus
gggccgcacacccagtcactcaccg

SEQ ID NO: 614253 - DNA, 25 bp, Rattus norvegicus
actcaccggcgctggggtctccgcc

SEQ ID NO: 614254 - DNA, 25 bp, Rattus norvegicus
gaagggaaattacgccggcacaaga

SEQ ID NO: 614255 - DNA, 25 bp, Rattus norvegicus
aaattacgccggcacaagacactgg

SEQ ID NO: 614256 - DNA, 25 bp, Rattus norvegicus
aattacgccggcacaagacactgga

SEQ ID NO: 614257 - DNA, 25 bp, Rattus norvegicus
ttacgccggcacaagacactggagg

SEQ ID NO: 614258 - DNA, 25 bp, Rattus norvegicus
tacgccggcacaagacactggaggg

SEQ ID NO: 614259 - DNA, 25 bp, Rattus norvegicus
gccgcttccggtgggcgaacggagc

SEQ ID NO: 614260 - DNA, 25 bp, Rattus norvegicus
gcgaacggagcctagtgcgcatgcg

SEQ ID NO: 614261 - DNA, 25 bp, Rattus norvegicus
tagtgcgcatgcgcccactgcgccc

SEQ ID NO: 614262 - DNA, 25 bp, Rattus norvegicus
cgcacacccagtcactcaccggcgc

SEQ ID NO: 614263 - DNA, 25 bp, Rattus norvegicus
gcagtccagagcatttccgaggcta

SEQ ID NO: 614264 - DNA, 25 bp, Rattus norvegicus
tagcctgacaccctactagagactc

SEQ ID NO: 614265 - DNA, 25 bp, Rattus norvegicus
ccggaggttgtggatcttgaagaca

SEQ ID NO: 614266 - DNA, 25 bp, Rattus norvegicus
agacccgcgcgatggttgaaccgga

SEQ ID NO: 614267 - DNA, 25 bp, Rattus norvegicus
cgggtggctgagaacctagacacga

SEQ ID NO: 614268 - DNA, 25 bp, Rattus norvegicus
ctcggcatgaatgacatttgcagtc

SEQ ID NO: 614269 - DNA, 25 bp, Rattus norvegicus
gagcgggattcgtcggactttccaa

SEQ ID NO: 614270 - DNA, 25 bp, Rattus norvegicus
atgggaagcctctggacaaacacgg

SEQ ID NO: 614271 - DNA, 25 bp, Rattus norvegicus
tcccgtgacgaaacgaaccgtgatc

SEQ ID NO: 614272 - DNA, 25 bp, Rattus norvegicus
acacgcaatgctcgcgtcccggagg

SEQ ID NO: 614273 - DNA, 25 bp, Rattus norvegicus
aggctctgcctcttctgcttcttga

SEQ ID NO: 614274 - DNA, 25 bp, Rattus norvegicus
gcgcagtttctcgtcctcacggacg

SEQ ID NO: 614275 - DNA, 25 bp, Rattus norvegicus
gctaggacgctagaaaccgtttctg

SEQ ID NO: 614276 - DNA, 25 bp, Rattus norvegicus
ccgatgcccaaagagtttgagaacc

SEQ ID NO: 614277 - DNA, 25 bp, Rattus norvegicus
gacattggtatggtcgctcaccgga

SEQ ID NO: 614278 - DNA, 25 bp, Rattus norvegicus
caccctgcatgagggacattggtat

SEQ ID NO: 614279 - DNA, 25 bp, Rattus norvegicus
ccagcatggatgttgcaatggcgcc

SEQ ID NO: 614280 - DNA, 25 bp, Rattus norvegicus
ccggaggccagcatggatgttgcaa

SEQ ID NO: 614281 - DNA, 25 bp, Rattus norvegicus
cacacatcggaatggccggaggcca

SEQ ID NO: 614282 - DNA, 25 bp, Rattus norvegicus
cgagggcagagcacacatcggaatg

SEQ ID NO: 614283 - DNA, 25 bp, Rattus norvegicus
ctgcctctcggaatcggcgagggca

SEQ ID NO: 614284 - DNA, 25 bp, Rattus norvegicus
ggcctcggtgaagcgcaccctgcat

SEQ ID NO: 614285 - DNA, 25 bp, Rattus norvegicus
agagtattggcctcggtgaagcgca

SEQ ID NO: 614286 - DNA, 25 bp, Rattus norvegicus
taatggcgccggagagtattggcct

SEQ ID NO: 614287 - DNA, 25 bp, Rattus norvegicus
gccgcaagtggctggaccgtttgaa

SEQ ID NO: 614288 - DNA, 25 bp, Rattus norvegicus
ggctggaccgtttgaaggtcttgcc

SEQ ID NO: 614289 - DNA, 25 bp, Rattus norvegicus
tatggtcgctcaccggagtggatgc

SEQ ID NO: 614290 - DNA, 25 bp, Rattus norvegicus
tggatgttgcaatggcgccgcaagt

SEQ ID NO: 614291 - DNA, 25 bp, Rattus norvegicus
cgcctctgggtacctcatttgcatg

SEQ ID NO: 614292 - DNA, 25 bp, Rattus norvegicus
ggttcgacgcctgcctgttaggcgc

SEQ ID NO: 614293 - DNA, 25 bp, Rattus norvegicus
ctgttaggcgcgactggcccagcct

SEQ ID NO: 614294 - DNA, 25 bp, Rattus norvegicus
ttaggcgcgactggcccagcctgca

SEQ ID NO: 614295 - DNA, 25 bp, Rattus norvegicus
gactggcccagcctgcaagcggggc

SEQ ID NO: 614296 - DNA, 25 bp, Rattus norvegicus
cctcagggtgcggtggccaatgagc

SEQ ID NO: 614297 - DNA, 25 bp, Rattus norvegicus
tctgcgcgcgcgagcccagaccgct

SEQ ID NO: 614298 - DNA, 25 bp, Rattus norvegicus
cagaccgctcggcagggcgcgaggt

SEQ ID NO: 614299 - DNA, 25 bp, Rattus norvegicus
gacgcctgcctgttaggcgcgactg

SEQ ID NO: 614300 - DNA, 25 bp, Rattus norvegicus
agcaaagaagcagggagcaggtgcc

SEQ ID NO: 614301 - DNA, 25 bp, Rattus norvegicus
tctgggtacctcatttgcatgctgc

SEQ ID NO: 614302 - DNA, 25 bp, Rattus norvegicus
catttgcatgctgcctgggctcgcg

SEQ ID NO: 614303 - DNA, 25 bp, Rattus norvegicus
atgctgcctgggctcgcgtgtgtac

SEQ ID NO: 614304 - DNA, 25 bp, Rattus norvegicus
ggcgtgcgcaggagagagcaaagaa

SEQ ID NO: 614305 - DNA, 25 bp, Rattus norvegicus
caagacctccgcaacgcaaaagcaa

SEQ ID NO: 614306 - DNA, 25 bp, Rattus norvegicus
cgcaaaagcaaggtggtctcgccta

SEQ ID NO: 614307 - DNA, 25 bp, Rattus norvegicus
caggaaagcggacagactttcccgg

SEQ ID NO: 614308 - DNA, 25 bp, Rattus norvegicus
aagcaaggtggtctcgcctagtccc

SEQ ID NO: 614309 - DNA, 25 bp, Rattus norvegicus
tccgcaacgcaaaagcaaggtggtc

SEQ ID NO: 614310 - DNA, 25 bp, Rattus norvegicus
gggtcctgcctggtctccaagacct

SEQ ID NO: 614311 - DNA, 25 bp, Rattus norvegicus
taattaaacaggaaagcggacagac

SEQ ID NO: 614312 - DNA, 25 bp, Rattus norvegicus
ccctcaggtggaagtgacgctgacc

SEQ ID NO: 614313 - DNA, 25 bp, Rattus norvegicus
tgcccaaaatgtcggcgcccagagg

SEQ ID NO: 614314 - DNA, 25 bp, Rattus norvegicus
gacctcgctgcccaaaatgtcggcg

SEQ ID NO: 614315 - DNA, 25 bp, Rattus norvegicus
gctgacctcgctgcccaaaatgtcg

SEQ ID NO: 614316 - DNA, 25 bp, Rattus norvegicus
aggtggaagtgacgctgacctcgct

SEQ ID NO: 614317 - DNA, 25 bp, Rattus norvegicus
gcccagagggaggtgtaagtaatta

SEQ ID NO: 614318 - DNA, 25 bp, Rattus norvegicus
agaaaagagccgaggcggaagtcga

SEQ ID NO: 614319 - DNA, 25 bp, Rattus norvegicus
ttccgttaccgatccgacctgaggc

SEQ ID NO: 614320 - DNA, 25 bp, Rattus norvegicus
ggtgagcgaccctaccgatgttccg

SEQ ID NO: 614321 - DNA, 25 bp, Rattus norvegicus
ctgcagcgaatgtggcaagagcttc

SEQ ID NO: 614322 - DNA, 25 bp, Rattus norvegicus
acctgaggcgccattttgctcgaca

SEQ ID NO: 614323 - DNA, 25 bp, Rattus norvegicus
ggcgccattttgctcgacacacagc

SEQ ID NO: 614324 - DNA, 25 bp, Rattus norvegicus
cacgcatgtcctcgatgcggcaagg

SEQ ID NO: 614325 - DNA, 25 bp, Rattus norvegicus
catgtcctcgatgcggcaagggctt

SEQ ID NO: 614326 - DNA, 25 bp, Rattus norvegicus
cggcaagggcttcaagcatagcttc

SEQ ID NO: 614327 - DNA, 25 bp, Rattus norvegicus
ggcttcaagcatagcttcaacttgg

SEQ ID NO: 614328 - DNA, 25 bp, Rattus norvegicus
ttcaacttggctaaccacctgcgct

SEQ ID NO: 614329 - DNA, 25 bp, Rattus norvegicus
acaccggtgagcgaccctaccgatg

SEQ ID NO: 614330 - DNA, 25 bp, Rattus norvegicus
tggcaagagcttccgttaccgatcc

SEQ ID NO: 614331 - DNA, 25 bp, Rattus norvegicus
ccctttcactgcagcgaatgtggca

SEQ ID NO: 614332 - DNA, 25 bp, Rattus norvegicus
ccgatccgacctgaggcgccatttt

SEQ ID NO: 614333 - DNA, 25 bp, Rattus norvegicus
catcggcgtgcaagccatggtaagg

SEQ ID NO: 614334 - DNA, 25 bp, Rattus norvegicus
gcatcctcagaagacacactgtacc

SEQ ID NO: 614335 - DNA, 25 bp, Rattus norvegicus
gacacactgtaccaatgcgactgcg

SEQ ID NO: 614336 - DNA, 25 bp, Rattus norvegicus
gtaccaatgcgactgcgggaccttc

SEQ ID NO: 614337 - DNA, 25 bp, Rattus norvegicus
actgcgggaccttcttcgcgtctgc

SEQ ID NO: 614338 - DNA, 25 bp, Rattus norvegicus
ccctgctttagccagccatctagag

SEQ ID NO: 614339 - DNA, 25 bp, Rattus norvegicus
ttagccagccatctagaggcgcact

SEQ ID NO: 614340 - DNA, 25 bp, Rattus norvegicus
tctggcccagccacgtacggctgtg

SEQ ID NO: 614341 - DNA, 25 bp, Rattus norvegicus
gccacgtacggctgtggccattgcg

SEQ ID NO: 614342 - DNA, 25 bp, Rattus norvegicus
tgtacgcagcactggccgccctgga

SEQ ID NO: 614343 - DNA, 25 bp, Rattus norvegicus
cactggccgccctggaggagcatcg

SEQ ID NO: 614344 - DNA, 25 bp, Rattus norvegicus
gcagccgaagcatcctcagaagaca

SEQ ID NO: 614345 - DNA, 25 bp, Rattus norvegicus
agcatcggcgtgcaagccatggtaa

SEQ ID NO: 614346 - DNA, 25 bp, Rattus norvegicus
tgcggcagccgaagcatcctcagaa

SEQ ID NO: 614347 - DNA, 25 bp, Rattus norvegicus
gcccacctccgcctcagagactctg

SEQ ID NO: 614348 - DNA, 25 bp, Rattus norvegicus
gccctcacggtatagatccgcctat

SEQ ID NO: 614349 - DNA, 25 bp, Rattus norvegicus
tcctattgcgcgtggacccgctctt

SEQ ID NO: 614350 - DNA, 25 bp, Rattus norvegicus
atagatccgcctatcgcctgctggt

SEQ ID NO: 614351 - DNA, 25 bp, Rattus norvegicus
ggagttgctccctcccacgaagtgg

SEQ ID NO: 614352 - DNA, 25 bp, Rattus norvegicus
cacgaagtggcttcctggtgtgttc

SEQ ID NO: 614353 - DNA, 25 bp, Rattus norvegicus
tcgtgacgttgatagtagaaccgga

SEQ ID NO: 614354 - DNA, 25 bp, Rattus norvegicus
ttgatagtagaaccggaacgcgttg

SEQ ID NO: 614355 - DNA, 25 bp, Rattus norvegicus
aaccggaacgcgttgcagctgcgct

SEQ ID NO: 614356 - DNA, 25 bp, Rattus norvegicus
agctgcgctgtcgtggctcccggaa

SEQ ID NO: 614357 - DNA, 25 bp, Rattus norvegicus
gttggcacctggtccgtcatgttgt

SEQ ID NO: 614358 - DNA, 25 bp, Rattus norvegicus
tggtccgtcatgttgtcgcaggtga

SEQ ID NO: 614359 - DNA, 25 bp, Rattus norvegicus
ccctcgaggcttttgggtccgtgtg

SEQ ID NO: 614360 - DNA, 25 bp, Rattus norvegicus
tcctggtgtgttcgtgacgttgata

SEQ ID NO: 614361 - DNA, 25 bp, Rattus norvegicus
ggtaagaactgctcccagagactgg

SEQ ID NO: 614362 - DNA, 25 bp, Rattus norvegicus
gaggcggaggtaagaactgctccca

SEQ ID NO: 614363 - DNA, 25 bp, Rattus norvegicus
ctcccagagactggggcgagccctg

SEQ ID NO: 614364 - DNA, 25 bp, Rattus norvegicus
cctgagcaagccctcgacccgctgc

SEQ ID NO: 614365 - DNA, 25 bp, Rattus norvegicus
gacccgctgccctagttctgcagat

SEQ ID NO: 614366 - DNA, 25 bp, Rattus norvegicus
cgctgccctagttctgcagatcata

SEQ ID NO: 614367 - DNA, 25 bp, Rattus norvegicus
gccctagttctgcagatcataccta

SEQ ID NO: 614368 - DNA, 25 bp, Rattus norvegicus
gttctgcagatcatacctacccgga

SEQ ID NO: 614369 - DNA, 25 bp, Rattus norvegicus
gcagatcatacctacccggaacaga

SEQ ID NO: 614370 - DNA, 25 bp, Rattus norvegicus
catacctacccggaacagatagacc

SEQ ID NO: 614371 - DNA, 25 bp, Rattus norvegicus
cagatagacccctcttagacctaga

SEQ ID NO: 614372 - DNA, 25 bp, Rattus norvegicus
tagagcccccgacagccggcaggat

SEQ ID NO: 614373 - DNA, 25 bp, Rattus norvegicus
acagccggcaggatccacgccctcc

SEQ ID NO: 614374 - DNA, 25 bp, Rattus norvegicus
gaaggaagaaaggagcgcaggaggc

SEQ ID NO: 614375 - DNA, 25 bp, Rattus norvegicus
tcctgagtgtggcaaaggtttccga

SEQ ID NO: 614376 - DNA, 25 bp, Rattus norvegicus
ggcgagatggacctgacaacgcaga

SEQ ID NO: 614377 - DNA, 25 bp, Rattus norvegicus
gttgcagaggaagcgaccgcacagt

SEQ ID NO: 614378 - DNA, 25 bp, Rattus norvegicus
ccgatcctcgggaatcggaagctga

SEQ ID NO: 614379 - DNA, 25 bp, Rattus norvegicus
tcgcgaagccttcgccaccaagggg

SEQ ID NO: 614380 - DNA, 25 bp, Rattus norvegicus
ggggagctcaaagcccacccgtgtc

SEQ ID NO: 614381 - DNA, 25 bp, Rattus norvegicus
acgccctttccagtgcgtgcgttgc

SEQ ID NO: 614382 - DNA, 25 bp, Rattus norvegicus
agccacgtttctggtgtcctgagtg

SEQ ID NO: 614383 - DNA, 25 bp, Rattus norvegicus
caccagtgttccatctgcctcaagg

SEQ ID NO: 614384 - DNA, 25 bp, Rattus norvegicus
caaggctttcgccaggccctggtct

SEQ ID NO: 614385 - DNA, 25 bp, Rattus norvegicus
ccgatcggccttttgtgtgtccaga

SEQ ID NO: 614386 - DNA, 25 bp, Rattus norvegicus
ccagcaagaaggacgacaaggcctc

SEQ ID NO: 614387 - DNA, 25 bp, Rattus norvegicus
ggagttcaagcgactggcagacctg

SEQ ID NO: 614388 - DNA, 25 bp, Rattus norvegicus
acaaggcctcaggtggacggaactc

SEQ ID NO: 614389 - DNA, 25 bp, Rattus norvegicus
ccggcacatccatggggacctgaga

SEQ ID NO: 614390 - DNA, 25 bp, Rattus norvegicus
gtgccagacttccaggcggccggca

SEQ ID NO: 614391 - DNA, 25 bp, Rattus norvegicus
gtcccatccatcatcgcagacagta

SEQ ID NO: 614392 - DNA, 25 bp, Rattus norvegicus
ctacaggccactgctgcgtctcgga

SEQ ID NO: 614393 - DNA, 25 bp, Rattus norvegicus
cactgctgcgtctcggaggtcccat

SEQ ID NO: 614394 - DNA, 25 bp, Rattus norvegicus
gcgtctcggaggtcccatccatcat

SEQ ID NO: 614395 - DNA, 25 bp, Rattus norvegicus
ccacatcctagctccctacaggcca

SEQ ID NO: 614396 - DNA, 25 bp, Rattus norvegicus
atccatggggacctgagaccagacg

SEQ ID NO: 614397 - DNA, 25 bp, Rattus norvegicus
aatctggcacctccaggggcggcca

SEQ ID NO: 614398 - DNA, 25 bp, Rattus norvegicus
tggggacctgagaccagacgcagcc

SEQ ID NO: 614399 - DNA, 25 bp, Rattus norvegicus
aggtccgaatctggcacctccaggg

SEQ ID NO: 614400 - DNA, 25 bp, Rattus norvegicus
gggtccctcaccaggtccgaatctg

SEQ ID NO: 614401 - DNA, 25 bp, Rattus norvegicus
atcgtccatccacacgggtccctca

SEQ ID NO: 614402 - DNA, 25 bp, Rattus norvegicus
cggaggtcccatccatcatcgcaga

SEQ ID NO: 614403 - DNA, 25 bp, Rattus norvegicus
tgagagcagatatgagccttccagc

SEQ ID NO: 614404 - DNA, 25 bp, Rattus norvegicus
ggcaggccactgcagcatcccgaag

SEQ ID NO: 614405 - DNA, 25 bp, Rattus norvegicus
ctccgcagcccaacacacggcaggc

SEQ ID NO: 614406 - DNA, 25 bp, Rattus norvegicus
tcactgagccacacgggcccagtgc

SEQ ID NO: 614407 - DNA, 25 bp, Rattus norvegicus
aggccagctcactgagccacacggg

SEQ ID NO: 614408 - DNA, 25 bp, Rattus norvegicus
gggacagatacccagctgtccctca

SEQ ID NO: 614409 - DNA, 25 bp, Rattus norvegicus
aggccactgcagcatcccgaaggtc

SEQ ID NO: 614410 - DNA, 25 bp, Rattus norvegicus
agagcagatatgagccttccagccc

SEQ ID NO: 614411 - DNA, 25 bp, Rattus norvegicus
ctcgtgagagcagatatgagccttc

SEQ ID NO: 614412 - DNA, 25 bp, Rattus norvegicus
gtcctcctcgtgagagcagatatga

SEQ ID NO: 614413 - DNA, 25 bp, Rattus norvegicus
gtcccatccgtcatcacacacggtg

SEQ ID NO: 614414 - DNA, 25 bp, Rattus norvegicus
agcatcccgaaggtcccatccgtca

SEQ ID NO: 614415 - DNA, 25 bp, Rattus norvegicus
cgcgtcctcctcgtgagagcagata

SEQ ID NO: 614416 - DNA, 25 bp, Rattus norvegicus
ccggtggggacagatacccagctgt

SEQ ID NO: 614417 - DNA, 25 bp, Rattus norvegicus
cgcgaggcactcaacctttatcggc

SEQ ID NO: 614418 - DNA, 25 bp, Rattus norvegicus
gtcgtgcgtcatgacgcaacgcgcc

SEQ ID NO: 614419 - DNA, 25 bp, Rattus norvegicus
caccgtcgtgcgtcatgacgcaacg

SEQ ID NO: 614420 - DNA, 25 bp, Rattus norvegicus
tcggcggcctctcgcgcacacaaac

SEQ ID NO: 614421 - DNA, 25 bp, Rattus norvegicus
ctcaacctttatcggcggcctctcg

SEQ ID NO: 614422 - DNA, 25 bp, Rattus norvegicus
ggcactcaacctttatcggcggcct

SEQ ID NO: 614423 - DNA, 25 bp, Rattus norvegicus
gcgaggcactcaacctttatcggcg

SEQ ID NO: 614424 - DNA, 25 bp, Rattus norvegicus
gcgcgaggcactcaacctttatcgg

SEQ ID NO: 614425 - DNA, 25 bp, Rattus norvegicus
ggcgcgaggcactcaacctttatcg

SEQ ID NO: 614426 - DNA, 25 bp, Rattus norvegicus
cggcgcgaggcactcaacctttatc

SEQ ID NO: 614427 - DNA, 25 bp, Rattus norvegicus
ggctgacgggaagcggggcccggca

SEQ ID NO: 614428 - DNA, 25 bp, Rattus norvegicus
gccctccggtctctcacctgtggcc

SEQ ID NO: 614429 - DNA, 25 bp, Rattus norvegicus
ccctccgcgccctccggtctctcac

SEQ ID NO: 614430 - DNA, 25 bp, Rattus norvegicus
gaggcactcaacctttatcggcggc

SEQ ID NO: 614431 - DNA, 25 bp, Rattus norvegicus
tccgagtcagcttttcgatagttga

SEQ ID NO: 614432 - DNA, 25 bp, Rattus norvegicus
atcgcctgacctgcttacctgtgga

SEQ ID NO: 614433 - DNA, 25 bp, Rattus norvegicus
cctgcgccagcacgaatagagcttt

SEQ ID NO: 614434 - DNA, 25 bp, Rattus norvegicus
attctccgttgggtgtatcgcctga

SEQ ID NO: 614435 - DNA, 25 bp, Rattus norvegicus
actgctcctacatgggtcacttcga

SEQ ID NO: 614436 - DNA, 25 bp, Rattus norvegicus
gccatctgtggaccgatcctcctga

SEQ ID NO: 614437 - DNA, 25 bp, Rattus norvegicus
cgcgtgcgtttcaacctgatggaga

SEQ ID NO: 614438 - DNA, 25 bp, Rattus norvegicus
cgagcatctgcagtccaagtacatc

SEQ ID NO: 614439 - DNA, 25 bp, Rattus norvegicus
atctgtggcctgacctcgaagccta

SEQ ID NO: 614440 - DNA, 25 bp, Rattus norvegicus
gtctctctgatttgaacgccgaaca

SEQ ID NO: 614441 - DNA, 25 bp, Rattus norvegicus
gagacggcccactgtttcctaggca

SEQ ID NO: 614442 - DNA, 25 bp, Rattus norvegicus
aggaccatcatgcaacgctcttcga

SEQ ID NO: 614443 - DNA, 25 bp, Rattus norvegicus
ggcttgtgaaccagcatcgggattc

SEQ ID NO: 614444 - DNA, 25 bp, Rattus norvegicus
cgccgaacagcggtagcttctcatc

SEQ ID NO: 614445 - DNA, 25 bp, Rattus norvegicus
aagtcccattcgctacttttgcgtg

SEQ ID NO: 614446 - DNA, 25 bp, Rattus norvegicus
ggaccttagagtaagtcccattcgc

SEQ ID NO: 614447 - DNA, 25 bp, Rattus norvegicus
gctcggccttggagggcagaacaga

SEQ ID NO: 614448 - DNA, 25 bp, Rattus norvegicus
gcagaacagagacccgcggctcgga

SEQ ID NO: 614449 - DNA, 25 bp, Rattus norvegicus
gcggctcggactacgtgtccgcaaa

SEQ ID NO: 614450 - DNA, 25 bp, Rattus norvegicus
ctacgtgtccgcaaagggcaaaaag

SEQ ID NO: 614451 - DNA, 25 bp, Rattus norvegicus
aggagacccagtaaagagtccggag

SEQ ID NO: 614452 - DNA, 25 bp, Rattus norvegicus
cccagtaaagagtccggagtccgtg

SEQ ID NO: 614453 - DNA, 25 bp, Rattus norvegicus
cagcggagaaaggtcacgggacttc

SEQ ID NO: 614454 - DNA, 25 bp, Rattus norvegicus
tacttttgcgtgctgtttgcaaacc

SEQ ID NO: 614455 - DNA, 25 bp, Rattus norvegicus
ggagaaaggtcacgggacttcttga

SEQ ID NO: 614456 - DNA, 25 bp, Rattus norvegicus
cgctacttttgcgtgctgtttgcaa

SEQ ID NO: 614457 - DNA, 25 bp, Rattus norvegicus
gtttgcaaacccaccatcccgcagt

SEQ ID NO: 614458 - DNA, 25 bp, Rattus norvegicus
ccatcccgcagttcaaacagggaaa

SEQ ID NO: 614459 - DNA, 25 bp, Rattus norvegicus
ccacatctgcactgggtgccggtgc

SEQ ID NO: 614460 - DNA, 25 bp, Rattus norvegicus
cccttggagatcagagtgttcaaac

SEQ ID NO: 614461 - DNA, 25 bp, Rattus norvegicus
gtggtccttactcgcccaagacgca

SEQ ID NO: 614462 - DNA, 25 bp, Rattus norvegicus
atagttgctgctccgtggtccttac

SEQ ID NO: 614463 - DNA, 25 bp, Rattus norvegicus
tccggaaagtgaggtgagcgcatcc

SEQ ID NO: 614464 - DNA, 25 bp, Rattus norvegicus
gattccctgaaggtcccgcatccgg

SEQ ID NO: 614465 - DNA, 25 bp, Rattus norvegicus
attttgcgccgggaacacacagctc

SEQ ID NO: 614466 - DNA, 25 bp, Rattus norvegicus
aaaggcctggcaccagtcacctagc

SEQ ID NO: 614467 - DNA, 25 bp, Rattus norvegicus
cggggacctaggagtcccagccatc

SEQ ID NO: 614468 - DNA, 25 bp, Rattus norvegicus
ccatggcaacgggagtctattttgc

SEQ ID NO: 614469 - DNA, 25 bp, Rattus norvegicus
cgccagagatgcaaggaccagtcca

SEQ ID NO: 614470 - DNA, 25 bp, Rattus norvegicus
gaaggcatcctgtgtccgccagaga

SEQ ID NO: 614471 - DNA, 25 bp, Rattus norvegicus
ccagccttggggacctttgaaggca

SEQ ID NO: 614472 - DNA, 25 bp, Rattus norvegicus
gtgttcaaactctacctacagacgc

SEQ ID NO: 614473 - DNA, 25 bp, Rattus norvegicus
gctactacgatgtcatgggccagta

SEQ ID NO: 614474 - DNA, 25 bp, Rattus norvegicus
ccgagctctgccatggctactacga

SEQ ID NO: 614475 - DNA, 25 bp, Rattus norvegicus
tttctgctgcgagcaccgccacatg

SEQ ID NO: 614476 - DNA, 25 bp, Rattus norvegicus
gccactaccgtttctgctgcgagca

SEQ ID NO: 614477 - DNA, 25 bp, Rattus norvegicus
gtggcacctgccactaccgtttctg

SEQ ID NO: 614478 - DNA, 25 bp, Rattus norvegicus
ggctcctaccgcttctgctgtggca

SEQ ID NO: 614479 - DNA, 25 bp, Rattus norvegicus
ttgatcgggaccgtcgcgctgctag

SEQ ID NO: 614480 - DNA, 25 bp, Rattus norvegicus
accatgccggccctgctgttgatcg

SEQ ID NO: 614481 - DNA, 25 bp, Rattus norvegicus
tggcgtcccggtgtgcaccatgccg

SEQ ID NO: 614482 - DNA, 25 bp, Rattus norvegicus
attcggctccgggatccgcagcctg

SEQ ID NO: 614483 - DNA, 25 bp, Rattus norvegicus
accgctgcaattcggctccgggatc

SEQ ID NO: 614484 - DNA, 25 bp, Rattus norvegicus
tttcttttctcctgctgagcccttc

SEQ ID NO: 614485 - DNA, 25 bp, Rattus norvegicus
tgggccagtacgacgccaccttcaa

SEQ ID NO: 614486 - DNA, 25 bp, Rattus norvegicus
cccgctaattctttcttttctcctg

SEQ ID NO: 614487 - DNA, 25 bp, Rattus norvegicus
tggataaccctcttcacaaacttgg

SEQ ID NO: 614488 - DNA, 25 bp, Rattus norvegicus
ggcctgcgggtagctataaaagtgc

SEQ ID NO: 614489 - DNA, 25 bp, Rattus norvegicus
cgttgacgtagcagcccagacgtgc

SEQ ID NO: 614490 - DNA, 25 bp, Rattus norvegicus
ggttcgaacttctgctcctattctg

SEQ ID NO: 614491 - DNA, 25 bp, Rattus norvegicus
ctggcgcgagccctcattggataac

SEQ ID NO: 614492 - DNA, 25 bp, Rattus norvegicus
gccgcttggtttcctcaggtctact

SEQ ID NO: 614493 - DNA, 25 bp, Rattus norvegicus
ttcaaacggtccaatcagcggccgc

SEQ ID NO: 614494 - DNA, 25 bp, Rattus norvegicus
gtggcggcgtctcattcaaacggtc

SEQ ID NO: 614495 - DNA, 25 bp, Rattus norvegicus
gtgcgcgtctttctccatgcaggag

SEQ ID NO: 614496 - DNA, 25 bp, Rattus norvegicus
gctaaccgttagttgcgtgcgcgtc

SEQ ID NO: 614497 - DNA, 25 bp, Rattus norvegicus
gcagacgtaacgttgcgtgcgtttt

SEQ ID NO: 614498 - DNA, 25 bp, Rattus norvegicus
cccggcctgttgaagtcatggtgag

SEQ ID NO: 614499 - DNA, 25 bp, Rattus norvegicus
ctctgctcggggtttttagccgctt

SEQ ID NO: 614500 - DNA, 25 bp, Rattus norvegicus
ttgaccgccaagcaacgtgcgcgtt

SEQ ID NO: 614501 - DNA, 25 bp, Rattus norvegicus
tggaggggctgaaggctcttaaccc

SEQ ID NO: 614502 - DNA, 25 bp, Rattus norvegicus
gtgttgctcttcgtctccaccatcg

SEQ ID NO: 614503 - DNA, 25 bp, Rattus norvegicus
tcacatcgcggtgctagtgttgctc

SEQ ID NO: 614504 - DNA, 25 bp, Rattus norvegicus
ggggatcctgttccttcacatcgcg

SEQ ID NO: 614505 - DNA, 25 bp, Rattus norvegicus
gcttctactcttgttggggatcctg

SEQ ID NO: 614506 - DNA, 25 bp, Rattus norvegicus
aagatgttggatcgcggttgagctc

SEQ ID NO: 614507 - DNA, 25 bp, Rattus norvegicus
cgtgcgtaccacttgcttgttttgt

SEQ ID NO: 614508 - DNA, 25 bp, Rattus norvegicus
gtggcctccgctcatccttcaggaa

SEQ ID NO: 614509 - DNA, 25 bp, Rattus norvegicus
acgtggcctcggtagcctcccaagt

SEQ ID NO: 614510 - DNA, 25 bp, Rattus norvegicus
ggaatccgccctgtgactccggcag

SEQ ID NO: 614511 - DNA, 25 bp, Rattus norvegicus
ccgccagcatctaggccgagtctgg

SEQ ID NO: 614512 - DNA, 25 bp, Rattus norvegicus
tcagcctagctgtccgtggggcgat

SEQ ID NO: 614513 - DNA, 25 bp, Rattus norvegicus
tccaccatcgtcagcgtgagtgcgg

SEQ ID NO: 614514 - DNA, 25 bp, Rattus norvegicus
cttagaggcaagtaacggaacacgg

SEQ ID NO: 614515 - DNA, 25 bp, Rattus norvegicus
gggccacacttaccgtgctgtacgt

SEQ ID NO: 614516 - DNA, 25 bp, Rattus norvegicus
acgatgctgctggtcggaagttttc

SEQ ID NO: 614517 - DNA, 25 bp, Rattus norvegicus
ttcgtctgtagatcccagcgagttc

SEQ ID NO: 614518 - DNA, 25 bp, Rattus norvegicus
gaaccttcggaaatcttcgtctgta

SEQ ID NO: 614519 - DNA, 25 bp, Rattus norvegicus
agctttctccgatccttgggttccg

SEQ ID NO: 614520 - DNA, 25 bp, Rattus norvegicus
aacgcatttccgcttcctccggtgg

SEQ ID NO: 614521 - DNA, 25 bp, Rattus norvegicus
gcggggcgacacctttaaaatgaca

SEQ ID NO: 614522 - DNA, 25 bp, Rattus norvegicus
cttgggtacgaggagagaaaacaca

SEQ ID NO: 614523 - DNA, 25 bp, Rattus norvegicus
ttccggcgaggaataaggactatga

SEQ ID NO: 614524 - DNA, 25 bp, Rattus norvegicus
tttgcaaggccggaatgagtgacca

SEQ ID NO: 614525 - DNA, 25 bp, Rattus norvegicus
tgtcaaatagagaagcatgccgtgg

SEQ ID NO: 614526 - DNA, 25 bp, Rattus norvegicus
aggcagagtgccttctcccacacgg

SEQ ID NO: 614527 - DNA, 25 bp, Rattus norvegicus
tgggctcctggggaataaatttaga

SEQ ID NO: 614528 - DNA, 25 bp, Rattus norvegicus
taggcgtctaggtaatcggaagcac

SEQ ID NO: 614529 - DNA, 25 bp, Rattus norvegicus
cgctgctggttttcctgagcctgct

SEQ ID NO: 614530 - DNA, 25 bp, Rattus norvegicus
tctgcagctcgccacgcttgaggcg

SEQ ID NO: 614531 - DNA, 25 bp, Rattus norvegicus
agtgcgtctgcagctcgccacgctt

SEQ ID NO: 614532 - DNA, 25 bp, Rattus norvegicus
gtaccacagccggtctccgctcagc

SEQ ID NO: 614533 - DNA, 25 bp, Rattus norvegicus
attgcccgcctagcgcgcaagctgt

SEQ ID NO: 614534 - DNA, 25 bp, Rattus norvegicus
gagcgcgactatggcctgcggcctt

SEQ ID NO: 614535 - DNA, 25 bp, Rattus norvegicus
acatcgagatctcgcgccaggagct

SEQ ID NO: 614536 - DNA, 25 bp, Rattus norvegicus
tggtacaccggcaacatcgagatct

SEQ ID NO: 614537 - DNA, 25 bp, Rattus norvegicus
ggctggattctctggtacaccggca

SEQ ID NO: 614538 - DNA, 25 bp, Rattus norvegicus
agcctgctgggctggattctctggt

SEQ ID NO: 614539 - DNA, 25 bp, Rattus norvegicus
tactccggggcgctgctggttttcc

SEQ ID NO: 614540 - DNA, 25 bp, Rattus norvegicus
ggacctgctcatctactccggggcg

SEQ ID NO: 614541 - DNA, 25 bp, Rattus norvegicus
gacttcggggacctgctcatctact

SEQ ID NO: 614542 - DNA, 25 bp, Rattus norvegicus
cgcatcaccggtgtgcggctcgcag

SEQ ID NO: 614543 - DNA, 25 bp, Rattus norvegicus
gacgcaacggcccagccttctgcag

SEQ ID NO: 614544 - DNA, 25 bp, Rattus norvegicus
aatccgtgtgtttgggtgtcagctc

SEQ ID NO: 614545 - DNA, 25 bp, Rattus norvegicus
tcctggagaggaatccgtgtgtttg

SEQ ID NO: 614546 - DNA, 25 bp, Rattus norvegicus
ccaggcgccttcctggagaggaatc

SEQ ID NO: 614547 - DNA, 25 bp, Rattus norvegicus
agtctctggctcctactcctgttcc

SEQ ID NO: 614548 - DNA, 25 bp, Rattus norvegicus
ttctgcagccacctttgtgggcata

SEQ ID NO: 614549 - DNA, 25 bp, Rattus norvegicus
cctgagcgcctctccgaccaggtgc

SEQ ID NO: 614550 - DNA, 25 bp, Rattus norvegicus
tgggtctccagctgcgtgcgtccct

SEQ ID NO: 614551 - DNA, 25 bp, Rattus norvegicus
ccggcaaaggagctgtccttagccc

SEQ ID NO: 614552 - DNA, 25 bp, Rattus norvegicus
ggactcgggctttgcgacctgccct

SEQ ID NO: 614553 - DNA, 25 bp, Rattus norvegicus
gcagccggcaaaggagctgtcctta

SEQ ID NO: 614554 - DNA, 25 bp, Rattus norvegicus
aactaggcacagctagaggggacca

SEQ ID NO: 614555 - DNA, 25 bp, Rattus norvegicus
aggggcttgcgaagaactaggcaca

SEQ ID NO: 614556 - DNA, 25 bp, Rattus norvegicus
cagccacctttgtgggcatatggga

SEQ ID NO: 614557 - DNA, 25 bp, Rattus norvegicus
tcgtcagatacagccgccgcgcctc

SEQ ID NO: 614558 - DNA, 25 bp, Rattus norvegicus
agtgaggagcgcgtagatccgcggt

SEQ ID NO: 614559 - DNA, 25 bp, Rattus norvegicus
cgtagatccgcggtgctggagactg

SEQ ID NO: 614560 - DNA, 25 bp, Rattus norvegicus
gctggagactgggacagcaaggctc

SEQ ID NO: 614561 - DNA, 25 bp, Rattus norvegicus
tcctccggctctcgtcagatacagc

SEQ ID NO: 614562 - DNA, 25 bp, Rattus norvegicus
ccctcggccggaaagacagacaact

SEQ ID NO: 614563 - DNA, 25 bp, Rattus norvegicus
ttcctccgttgctatgaaactcgcg

SEQ ID NO: 614564 - DNA, 25 bp, Rattus norvegicus
cgccgtcattcctccgttgctatga

SEQ ID NO: 614565 - DNA, 25 bp, Rattus norvegicus
tctattggcccaacccgccgtcatt

SEQ ID NO: 614566 - DNA, 25 bp, Rattus norvegicus
gacaactcaaccttctattggccca

SEQ ID NO: 614567 - DNA, 25 bp, Rattus norvegicus
gacagacaactcaaccttctattgg

SEQ ID NO: 614568 - DNA, 25 bp, Rattus norvegicus
cggaaagacagacaactcaaccttc

SEQ ID NO: 614569 - DNA, 25 bp, Rattus norvegicus
tcggccggaaagacagacaactcaa

SEQ ID NO: 614570 - DNA, 25 bp, Rattus norvegicus
gcccgcgttgcagccgccacctcca

SEQ ID NO: 614571 - DNA, 25 bp, Rattus norvegicus
cggatggagttgagacgacttctcc

SEQ ID NO: 614572 - DNA, 25 bp, Rattus norvegicus
tgcggatggagttgagacgacttct

SEQ ID NO: 614573 - DNA, 25 bp, Rattus norvegicus
tggaagcgaggggagcccaggaagc

SEQ ID NO: 614574 - DNA, 25 bp, Rattus norvegicus
tcccccgacgccaccgcctgggctg

SEQ ID NO: 614575 - DNA, 25 bp, Rattus norvegicus
gatggagttgagacgacttctccag

SEQ ID NO: 614576 - DNA, 25 bp, Rattus norvegicus
gcggatggagttgagacgacttctc

SEQ ID NO: 614577 - DNA, 25 bp, Rattus norvegicus
acgacttctccaggcggctcccccg

SEQ ID NO: 614578 - DNA, 25 bp, Rattus norvegicus
gtggtccaggcaagggcgtggaacg

SEQ ID NO: 614579 - DNA, 25 bp, Rattus norvegicus
gcggggagcctggtggtccaggcaa

SEQ ID NO: 614580 - DNA, 25 bp, Rattus norvegicus
aggcgtgtgcagaggtgagtgcaag

SEQ ID NO: 614581 - DNA, 25 bp, Rattus norvegicus
agggctggctcgaggcgtgtgcaga

SEQ ID NO: 614582 - DNA, 25 bp, Rattus norvegicus
agcccaggaagctgttgcggatgga

SEQ ID NO: 614583 - DNA, 25 bp, Rattus norvegicus
ggagtcccggtagggctggctcgag

SEQ ID NO: 614584 - DNA, 25 bp, Rattus norvegicus
tggtgtagttcctggagtcccggta

SEQ ID NO: 614585 - DNA, 25 bp, Rattus norvegicus
ttgactgggtcaggccgaaacgcct

SEQ ID NO: 614586 - DNA, 25 bp, Rattus norvegicus
ctgaagttccaggtactaagaggcg

SEQ ID NO: 614587 - DNA, 25 bp, Rattus norvegicus
agctcgccacgagagtgtcgtattc

SEQ ID NO: 614588 - DNA, 25 bp, Rattus norvegicus
gtgtcgtattcgctaaggtacttag

SEQ ID NO: 614589 - DNA, 25 bp, Rattus norvegicus
ggggcttataacaaaagcgcgaatg

SEQ ID NO: 614590 - DNA, 25 bp, Rattus norvegicus
agctaagtgccgcatccgccaaggg

SEQ ID NO: 614591 - DNA, 25 bp, Rattus norvegicus
atccgccaaggggtgctgcttagaa

SEQ ID NO: 614592 - DNA, 25 bp, Rattus norvegicus
gcgtggccgaacaggacaagctgaa

SEQ ID NO: 614593 - DNA, 25 bp, Rattus norvegicus
ctgcttagaactgggcaaacagctt

SEQ ID NO: 614594 - DNA, 25 bp, Rattus norvegicus
aaacagcttggggtgaggcacttcc

SEQ ID NO: 614595 - DNA, 25 bp, Rattus norvegicus
cttccgagtgagatctgcgtatttc

SEQ ID NO: 614596 - DNA, 25 bp, Rattus norvegicus
gcgtatttccggcaaagatggcggc

SEQ ID NO: 614597 - DNA, 25 bp, Rattus norvegicus
cggcgtccaacagagtcaggtgcag

SEQ ID NO: 614598 - DNA, 25 bp, Rattus norvegicus
tgcaggcgagtctgtctttaggcgt

SEQ ID NO: 614599 - DNA, 25 bp, Rattus norvegicus
tcacgattcccttttctctgggtcc

SEQ ID NO: 614600 - DNA, 25 bp, Rattus norvegicus
ggactcacccactgttggagtactc

SEQ ID NO: 614601 - DNA, 25 bp, Rattus norvegicus
gccacaggggactcacccactgttg

SEQ ID NO: 614602 - DNA, 25 bp, Rattus norvegicus
tgtgcacctcacgattcccttttct

SEQ ID NO: 614603 - DNA, 25 bp, Rattus norvegicus
ggccttttgtgtgcacctcacgatt

SEQ ID NO: 614604 - DNA, 25 bp, Rattus norvegicus
tccttggccttttgtgtgcacctca

SEQ ID NO: 614605 - DNA, 25 bp, Rattus norvegicus
gcacgggctccttggccttttgtgt

SEQ ID NO: 614606 - DNA, 25 bp, Rattus norvegicus
agggaacgaccaccttctggtgcgc

SEQ ID NO: 614607 - DNA, 25 bp, Rattus norvegicus
tggccacaagggaacgaccaccttc

SEQ ID NO: 614608 - DNA, 25 bp, Rattus norvegicus
ggtctctgtggccacaagggaacga

SEQ ID NO: 614609 - DNA, 25 bp, Rattus norvegicus
ggtccaagcaaggtaccccgcatgc

SEQ ID NO: 614610 - DNA, 25 bp, Rattus norvegicus
ccctaggagcaggaattttgcaagt

SEQ ID NO: 614611 - DNA, 25 bp, Rattus norvegicus
cccgcatgccctaggagcaggaatt

SEQ ID NO: 614612 - DNA, 25 bp, Rattus norvegicus
ttctggtgcgcgctcagctggccgc

SEQ ID NO: 614613 - DNA, 25 bp, Rattus norvegicus
tgagcaccatagctgccttcccggg

SEQ ID NO: 614614 - DNA, 25 bp, Rattus norvegicus
ccgtttcgggcgacactgaagtcga

SEQ ID NO: 614615 - DNA, 25 bp, Rattus norvegicus
gcagtgggccctctagatttattca

SEQ ID NO: 614616 - DNA, 25 bp, Rattus norvegicus
tcagggagagaacattggcaacggc

SEQ ID NO: 614617 - DNA, 25 bp, Rattus norvegicus
aggttctgggctccagcgttcacag

SEQ ID NO: 614618 - DNA, 25 bp, Rattus norvegicus
gaactagtggcctctcgcgcacctg

SEQ ID NO: 614619 - DNA, 25 bp, Rattus norvegicus
acctgcgcacggagagcgaccacga

SEQ ID NO: 614620 - DNA, 25 bp, Rattus norvegicus
tgcagctctgcacccgttgaggctg

SEQ ID NO: 614621 - DNA, 25 bp, Rattus norvegicus
tgcggcggcttctttttcctgttcc

SEQ ID NO: 614622 - DNA, 25 bp, Rattus norvegicus
gcgtctgccacggagctttgccgtg

SEQ ID NO: 614623 - DNA, 25 bp, Rattus norvegicus
cgtggaacgagtgcgcctacttttt

SEQ ID NO: 614624 - DNA, 25 bp, Rattus norvegicus
ccttcccgggcgtgtgccttcttat

SEQ ID NO: 614625 - DNA, 25 bp, Rattus norvegicus
attccctgtgaccagagggcgcttg

SEQ ID NO: 614626 - DNA, 25 bp, Rattus norvegicus
ccgaactcgttgacgctcggtggtg

SEQ ID NO: 614627 - DNA, 25 bp, Rattus norvegicus
tctaccaacgccgatggcatcagcg

SEQ ID NO: 614628 - DNA, 25 bp, Rattus norvegicus
gaggatcccgcctgctctgtggccg

SEQ ID NO: 614629 - DNA, 25 bp, Rattus norvegicus
tctgtggccgcctcttctctgtcat

SEQ ID NO: 614630 - DNA, 25 bp, Rattus norvegicus
ttgcttacttccgtgcccacgcagg

SEQ ID NO: 614631 - DNA, 25 bp, Rattus norvegicus
gcagcattgcttacttccgtgccca

SEQ ID NO: 614632 - DNA, 25 bp, Rattus norvegicus
cgtgcatcttttgcagcattgctta

SEQ ID NO: 614633 - DNA, 25 bp, Rattus norvegicus
tctctgtcattcgtgctgtcatctc

SEQ ID NO: 614634 - DNA, 25 bp, Rattus norvegicus
gtgcggtgctcgactctaccaacgc

SEQ ID NO: 614635 - DNA, 25 bp, Rattus norvegicus
tgcagcggatcctggtcccgggtcc

SEQ ID NO: 614636 - DNA, 25 bp, Rattus norvegicus
ctcgcctgatgctgcgtgcagcgga

SEQ ID NO: 614637 - DNA, 25 bp, Rattus norvegicus
tgatctggacgaggctcgcctgatg

SEQ ID NO: 614638 - DNA, 25 bp, Rattus norvegicus
cgccgagtttctggcggcctgtgca

SEQ ID NO: 614639 - DNA, 25 bp, Rattus norvegicus
gcgtgacgtcaatacaccgagcggg

SEQ ID NO: 614640 - DNA, 25 bp, Rattus norvegicus
gctgtcatctctcccgtgcatcttt

SEQ ID NO: 614641 - DNA, 25 bp, Rattus norvegicus
cctgggatgaatcgctttctgctgc

SEQ ID NO: 614642 - DNA, 25 bp, Rattus norvegicus
cccaaagccgggttctggtggctgt

SEQ ID NO: 614643 - DNA, 25 bp, Rattus norvegicus
ctgctcaagtgagtctgcgcgtctc

SEQ ID NO: 614644 - DNA, 25 bp, Rattus norvegicus
gcgcgtctctgcgtgctcggtgttc

SEQ ID NO: 614645 - DNA, 25 bp, Rattus norvegicus
tttctgctgccggtgtccgtagtgg

SEQ ID NO: 614646 - DNA, 25 bp, Rattus norvegicus
accctgttctccagcctgggatgaa

SEQ ID NO: 614647 - DNA, 25 bp, Rattus norvegicus
gtgcaaatacactgataccctgttc

SEQ ID NO: 614648 - DNA, 25 bp, Rattus norvegicus
gagtggccgtggagtgcaaatacac

SEQ ID NO: 614649 - DNA, 25 bp, Rattus norvegicus
cagcgcattcgtccgcggagtggcc

SEQ ID NO: 614650 - DNA, 25 bp, Rattus norvegicus
gctgtgtcgttccacttcctcgcta

SEQ ID NO: 614651 - DNA, 25 bp, Rattus norvegicus
aagtgcgtcgtaggtctgctttcta

SEQ ID NO: 614652 - DNA, 25 bp, Rattus norvegicus
tacgtttcccagcattaagtgcgtc

SEQ ID NO: 614653 - DNA, 25 bp, Rattus norvegicus
ggccgcgtccaatctccagaaacta

SEQ ID NO: 614654 - DNA, 25 bp, Rattus norvegicus
ttcctcgctacacgagcgcacgtgg

SEQ ID NO: 614655 - DNA, 25 bp, Rattus norvegicus
ctcacgaagagcatctggccgagcg

SEQ ID NO: 614656 - DNA, 25 bp, Rattus norvegicus
tgtagtccgagatggccctggtcac

SEQ ID NO: 614657 - DNA, 25 bp, Rattus norvegicus
ggcccttagtcttgcccaggcagtg

SEQ ID NO: 614658 - DNA, 25 bp, Rattus norvegicus
ccttcttgaggcacgggaagccctt

SEQ ID NO: 614659 - DNA, 25 bp, Rattus norvegicus
ggaagcccttggtctggttgaagta

SEQ ID NO: 614660 - DNA, 25 bp, Rattus norvegicus
atgtccggccgcttggacagcgtct

SEQ ID NO: 614661 - DNA, 25 bp, Rattus norvegicus
cgcttgaggcccaggaaatcctgca

SEQ ID NO: 614662 - DNA, 25 bp, Rattus norvegicus
tgcttggcgtacagaccgatctgga

SEQ ID NO: 614663 - DNA, 25 bp, Rattus norvegicus
atggcgctccaggacgtgtctatga

SEQ ID NO: 614664 - DNA, 25 bp, Rattus norvegicus
aacgtcaggctctcgaagctgggga

SEQ ID NO: 614665 - DNA, 25 bp, Rattus norvegicus
cgcggccggtcatctggtaaaattt

SEQ ID NO: 614666 - DNA, 25 bp, Rattus norvegicus
agggccggtaaaagtcacgcagctg

SEQ ID NO: 614667 - DNA, 25 bp, Rattus norvegicus
gtcgcgcaccaccacgatgagcttg

SEQ ID NO: 614668 - DNA, 25 bp, Rattus norvegicus
tagaagtgcttgtcggtgatgatgc

SEQ ID NO: 614669 - DNA, 25 bp, Rattus norvegicus
aaagcctccgcattctgatattaca

SEQ ID NO: 614670 - DNA, 25 bp, Rattus norvegicus
tggcacgccataagcaaggcgccgt

SEQ ID NO: 614671 - DNA, 25 bp, Rattus norvegicus
acgccataagcaaggcgccgtgcaa

SEQ ID NO: 614672 - DNA, 25 bp, Rattus norvegicus
aagcaaggcgccgtgcaattcgcgg

SEQ ID NO: 614673 - DNA, 25 bp, Rattus norvegicus
ccaaagcctccgcattctgatatta

SEQ ID NO: 614674 - DNA, 25 bp, Rattus norvegicus
catgctcctggtggcccgctttata

SEQ ID NO: 614675 - DNA, 25 bp, Rattus norvegicus
cgcattctgatattacatgctcctg

SEQ ID NO: 614676 - DNA, 25 bp, Rattus norvegicus
attctgatattacatgctcctggtg

SEQ ID NO: 614677 - DNA, 25 bp, Rattus norvegicus
tctgatattacatgctcctggtggc

SEQ ID NO: 614678 - DNA, 25 bp, Rattus norvegicus
tgatattacatgctcctggtggccc

SEQ ID NO: 614679 - DNA, 25 bp, Rattus norvegicus
atattacatgctcctggtggcccgc

SEQ ID NO: 614680 - DNA, 25 bp, Rattus norvegicus
attacatgctcctggtggcccgctt

SEQ ID NO: 614681 - DNA, 25 bp, Rattus norvegicus
cctggtggcccgctttataccgccg

SEQ ID NO: 614682 - DNA, 25 bp, Rattus norvegicus
agcaaggcgccgtgcaattcgcggc

SEQ ID NO: 614683 - DNA, 25 bp, Rattus norvegicus
cgtgcctcccgtactgaccttattt

SEQ ID NO: 614684 - DNA, 25 bp, Rattus norvegicus
cctgaggcccggtctaagaagcctg

SEQ ID NO: 614685 - DNA, 25 bp, Rattus norvegicus
tcctttggcgtccttccacctgagg

SEQ ID NO: 614686 - DNA, 25 bp, Rattus norvegicus
gctcctggcgtcacagttggtgatc

SEQ ID NO: 614687 - DNA, 25 bp, Rattus norvegicus
cagttggtgatcaacgctgcggaca

SEQ ID NO: 614688 - DNA, 25 bp, Rattus norvegicus
gctgcggacagagaccacttagtgc

SEQ ID NO: 614689 - DNA, 25 bp, Rattus norvegicus
ccgcttcttcctagagggccgctgt

SEQ ID NO: 614690 - DNA, 25 bp, Rattus norvegicus
agaagcctgctctgcgtactgctgc

SEQ ID NO: 614691 - DNA, 25 bp, Rattus norvegicus
ctgctgctgacgtcatccggcgtat

SEQ ID NO: 614692 - DNA, 25 bp, Rattus norvegicus
gcctggatcccgctgacttttctgt

SEQ ID NO: 614693 - DNA, 25 bp, Rattus norvegicus
ctgacttttctgtgggctacactga

SEQ ID NO: 614694 - DNA, 25 bp, Rattus norvegicus
ctgaccttatttttggctcgggctc

SEQ ID NO: 614695 - DNA, 25 bp, Rattus norvegicus
cattctgtgccttttgctgggacga

SEQ ID NO: 614696 - DNA, 25 bp, Rattus norvegicus
acactgaccgcttcctgggtgtgca

SEQ ID NO: 614697 - DNA, 25 bp, Rattus norvegicus
tccgggcccgtgtaggacaggccca

SEQ ID NO: 614698 - DNA, 25 bp, Rattus norvegicus
ccgcccgtgctcgatgggtgctcag

SEQ ID NO: 614699 - DNA, 25 bp, Rattus norvegicus
taggacaggcccaagggctctagga

SEQ ID NO: 614700 - DNA, 25 bp, Rattus norvegicus
cgaaggccaactcggcctgcaggta

SEQ ID NO: 614701 - DNA, 25 bp, Rattus norvegicus
gcctcgccctcgaaggccaactcgg

SEQ ID NO: 614702 - DNA, 25 bp, Rattus norvegicus
caggcccaagggctctaggaaggcc

SEQ ID NO: 614703 - DNA, 25 bp, Rattus norvegicus
cccgtgtaggacaggcccaagggct

SEQ ID NO: 614704 - DNA, 25 bp, Rattus norvegicus
ccacgctggagttgtccgggcccgt

SEQ ID NO: 614705 - DNA, 25 bp, Rattus norvegicus
cagtccacgctggagttgtccgggc

SEQ ID NO: 614706 - DNA, 25 bp, Rattus norvegicus
cggcagtccacgctggagttgtccg

SEQ ID NO: 614707 - DNA, 25 bp, Rattus norvegicus
ccaggctgaggcggcagtccacgct

SEQ ID NO: 614708 - DNA, 25 bp, Rattus norvegicus
gctcagaaggctggcagctgcgcca

SEQ ID NO: 614709 - DNA, 25 bp, Rattus norvegicus
cccgtgctcgatgggtgctcagaag

SEQ ID NO: 614710 - DNA, 25 bp, Rattus norvegicus
ctgcaggtaggagacgggcagcgca

SEQ ID NO: 614711 - DNA, 25 bp, Rattus norvegicus
gcgtcggttggcctcaccaaacagg

SEQ ID NO: 614712 - DNA, 25 bp, Rattus norvegicus
accctttacagacgcagggcgcggc

SEQ ID NO: 614713 - DNA, 25 bp, Rattus norvegicus
acccgaaagagttcctgtgctcgcc

SEQ ID NO: 614714 - DNA, 25 bp, Rattus norvegicus
accactcgctcctgggattcgttgc

SEQ ID NO: 614715 - DNA, 25 bp, Rattus norvegicus
ccggcggcccaaagcagaagataca

SEQ ID NO: 614716 - DNA, 25 bp, Rattus norvegicus
accaagagtgcgttcagtcaccggc

SEQ ID NO: 614717 - DNA, 25 bp, Rattus norvegicus
gcgtgatgacgttacaaggacgtcc

SEQ ID NO: 614718 - DNA, 25 bp, Rattus norvegicus
ctcgtgtcgcgcacagccaatagaa

SEQ ID NO: 614719 - DNA, 25 bp, Rattus norvegicus
gccaatagaagtcaccgctgggttt

SEQ ID NO: 614720 - DNA, 25 bp, Rattus norvegicus
gctgggtttgaaccgtcctccactc

SEQ ID NO: 614721 - DNA, 25 bp, Rattus norvegicus
ccggaagctggctttagacggtagc

SEQ ID NO: 614722 - DNA, 25 bp, Rattus norvegicus
tggggacaagaaccgcgagccctcc

SEQ ID NO: 614723 - DNA, 25 bp, Rattus norvegicus
gtccacgacgctaggtggaagttga

SEQ ID NO: 614724 - DNA, 25 bp, Rattus norvegicus
ttgaggccgccctgaactcaagcga

SEQ ID NO: 614725 - DNA, 25 bp, Rattus norvegicus
gggacctggcccaggtttgccatcc

SEQ ID NO: 614726 - DNA, 25 bp, Rattus norvegicus
agccaggatactgggatttctcttt

SEQ ID NO: 614727 - DNA, 25 bp, Rattus norvegicus
tgagctctctacctctaatcttgga

SEQ ID NO: 614728 - DNA, 25 bp, Rattus norvegicus
ctctaatcttggacttgtactcaca

SEQ ID NO: 614729 - DNA, 25 bp, Rattus norvegicus
tgtactcacaaatgcaggccaggtc

SEQ ID NO: 614730 - DNA, 25 bp, Rattus norvegicus
cctaagacgctggaactctgaccca

SEQ ID NO: 614731 - DNA, 25 bp, Rattus norvegicus
ctgttcccaggggacctggcccagg

SEQ ID NO: 614732 - DNA, 25 bp, Rattus norvegicus
tcagtgctgcctctggtggccaccg

SEQ ID NO: 614733 - DNA, 25 bp, Rattus norvegicus
tggtctttgcgagtcagtggtatgc

SEQ ID NO: 614734 - DNA, 25 bp, Rattus norvegicus
ggctgtgcttgctgagagcaaaatg

SEQ ID NO: 614735 - DNA, 25 bp, Rattus norvegicus
gagcaaaatggattagcctgccttg

SEQ ID NO: 614736 - DNA, 25 bp, Rattus norvegicus
attagcctgccttgtccctgtccgt

SEQ ID NO: 614737 - DNA, 25 bp, Rattus norvegicus
ccctgtccgtacaagagccaggata

SEQ ID NO: 614738 - DNA, 25 bp, Rattus norvegicus
tcccacctgctggtactcttggtcg

SEQ ID NO: 614739 - DNA, 25 bp, Rattus norvegicus
gggcaagcaccctggacacgtccac

SEQ ID NO: 614740 - DNA, 25 bp, Rattus norvegicus
caagcaccctggacacgtccacagg

SEQ ID NO: 614741 - DNA, 25 bp, Rattus norvegicus
ggcaagcaccctggacacgtccaca

SEQ ID NO: 614742 - DNA, 25 bp, Rattus norvegicus
ggggcaagcaccctggacacgtcca

SEQ ID NO: 614743 - DNA, 25 bp, Rattus norvegicus
tgggggcaagcaccctggacacgtc

SEQ ID NO: 614744 - DNA, 25 bp, Rattus norvegicus
tgtgggggcaagcaccctggacacg

SEQ ID NO: 614745 - DNA, 25 bp, Rattus norvegicus
gtgtgggggcaagcaccctggacac

SEQ ID NO: 614746 - DNA, 25 bp, Rattus norvegicus
ggtgtgggggcaagcaccctggaca

SEQ ID NO: 614747 - DNA, 25 bp, Rattus norvegicus
cggtgtgggggcaagcaccctggac

SEQ ID NO: 614748 - DNA, 25 bp, Rattus norvegicus
acggtgtgggggcaagcaccctgga

SEQ ID NO: 614749 - DNA, 25 bp, Rattus norvegicus
aacggtgtgggggcaagcaccctgg

SEQ ID NO: 614750 - DNA, 25 bp, Rattus norvegicus
gaacggtgtgggggcaagcaccctg

SEQ ID NO: 614751 - DNA, 25 bp, Rattus norvegicus
tgaacggtgtgggggcaagcaccct

SEQ ID NO: 614752 - DNA, 25 bp, Rattus norvegicus
gcaagcaccctggacacgtccacag

SEQ ID NO: 614753 - DNA, 25 bp, Rattus norvegicus
cacaagcaccatggagcacaggagg

SEQ ID NO: 614754 - DNA, 25 bp, Rattus norvegicus
acaccattcgggaagggtatgcacc

SEQ ID NO: 614755 - DNA, 25 bp, Rattus norvegicus
gcacacaccattcgggaagggtatg

SEQ ID NO: 614756 - DNA, 25 bp, Rattus norvegicus
gtgcacacaccattcgggaagggta

SEQ ID NO: 614757 - DNA, 25 bp, Rattus norvegicus
cgcgtgcacacaccattcgggaagg

SEQ ID NO: 614758 - DNA, 25 bp, Rattus norvegicus
ggcgcgtgcacacaccattcgggaa

SEQ ID NO: 614759 - DNA, 25 bp, Rattus norvegicus
aggagcaccgcaaggctcacacaaa

SEQ ID NO: 614760 - DNA, 25 bp, Rattus norvegicus
caggagcaccgcaaggctcacacaa

SEQ ID NO: 614761 - DNA, 25 bp, Rattus norvegicus
aagcgggcaccttggtggtcaaagc

SEQ ID NO: 614762 - DNA, 25 bp, Rattus norvegicus
caagcaccatggagcacaggaggca

SEQ ID NO: 614763 - DNA, 25 bp, Rattus norvegicus
ggcacaagcaccatggagcacagga

SEQ ID NO: 614764 - DNA, 25 bp, Rattus norvegicus
aggcacaagcaccatggagcacagg

SEQ ID NO: 614765 - DNA, 25 bp, Rattus norvegicus
taaaggcacaagcaccatggagcac

SEQ ID NO: 614766 - DNA, 25 bp, Rattus norvegicus
tcagaagcgggcaccttggtggtca

SEQ ID NO: 614767 - DNA, 25 bp, Rattus norvegicus
cgtgcaacgggtgccttctcttttt

SEQ ID NO: 614768 - DNA, 25 bp, Rattus norvegicus
ttctctttttctcgccgactcggtg

SEQ ID NO: 614769 - DNA, 25 bp, Rattus norvegicus
tctcggccacggaaacaagcataac

SEQ ID NO: 614770 - DNA, 25 bp, Rattus norvegicus
atcggggtatttcgccggatttgcg

SEQ ID NO: 614771 - DNA, 25 bp, Rattus norvegicus
taacgaccacggagaagcagcgcct

SEQ ID NO: 614772 - DNA, 25 bp, Rattus norvegicus
atttgcgatggacgcgccctgaaaa

SEQ ID NO: 614773 - DNA, 25 bp, Rattus norvegicus
ctgacttccggtagcagcgtgaagc

SEQ ID NO: 614774 - DNA, 25 bp, Rattus norvegicus
cgtgaagcgctcctcctagaaacta

SEQ ID NO: 614775 - DNA, 25 bp, Rattus norvegicus
aactcccaatagtcctcgcggtgtg

SEQ ID NO: 614776 - DNA, 25 bp, Rattus norvegicus
tgtccctggccaaggtaaggcctta

SEQ ID NO: 614777 - DNA, 25 bp, Rattus norvegicus
ggccttattccagaccgaggggcta

SEQ ID NO: 614778 - DNA, 25 bp, Rattus norvegicus
actgatgtcgttgtcgtggagagcc

SEQ ID NO: 614779 - DNA, 25 bp, Rattus norvegicus
agcctggcaggtcgtggtaacgacc

SEQ ID NO: 614780 - DNA, 25 bp, Rattus norvegicus
caagcataacctaaatcggggtatt

SEQ ID NO: 614781 - DNA, 25 bp, Rattus norvegicus
ataaactccgatccttggtgtcccg

SEQ ID NO: 614782 - DNA, 25 bp, Rattus norvegicus
ctttaacgataactgggcactcccg

SEQ ID NO: 614783 - DNA, 25 bp, Rattus norvegicus
gcacttattcgggatgctttaacga

SEQ ID NO: 614784 - DNA, 25 bp, Rattus norvegicus
tcccttgggcgaaacgcacttattc

SEQ ID NO: 614785 - DNA, 25 bp, Rattus norvegicus
agccgcggtccttacaacctggtga

SEQ ID NO: 614786 - DNA, 25 bp, Rattus norvegicus
atgcaacgaaaaggctctgggtccc

SEQ ID NO: 614787 - DNA, 25 bp, Rattus norvegicus
cttcgggctccgaggtgataaactc

SEQ ID NO: 614788 - DNA, 25 bp, Rattus norvegicus
atccggctcggataggtaagtgaca

SEQ ID NO: 614789 - DNA, 25 bp, Rattus norvegicus
cgagccttgatttagacggggtccg

SEQ ID NO: 614790 - DNA, 25 bp, Rattus norvegicus
agcccacggcgtctgtgatttgtca

SEQ ID NO: 614791 - DNA, 25 bp, Rattus norvegicus
cctcatcccacgtgacatcggaatg

SEQ ID NO: 614792 - DNA, 25 bp, Rattus norvegicus
ctgtgcgtagacagccgatgagtca

SEQ ID NO: 614793 - DNA, 25 bp, Rattus norvegicus
tggcgatggagcgatcaatactaca

SEQ ID NO: 614794 - DNA, 25 bp, Rattus norvegicus
tacacgcagatattcgggcagactc

SEQ ID NO: 614795 - DNA, 25 bp, Rattus norvegicus
tgcggaaggactcactacaggttgc

SEQ ID NO: 614796 - DNA, 25 bp, Rattus norvegicus
caggcgcccaaaggatctcggcaaa

SEQ ID NO: 614797 - DNA, 25 bp, Rattus norvegicus
gctcgagacaaggacgccataagta

SEQ ID NO: 614798 - DNA, 25 bp, Rattus norvegicus
cgccataagtaacgcgccggaaaga

SEQ ID NO: 614799 - DNA, 25 bp, Rattus norvegicus
cgagacagtctcacccgatagaaga

SEQ ID NO: 614800 - DNA, 25 bp, Rattus norvegicus
gaggagcgtctacaccagccagaca

SEQ ID NO: 614801 - DNA, 25 bp, Rattus norvegicus
cgtgcacacccgtgaggacagcggt

SEQ ID NO: 614802 - DNA, 25 bp, Rattus norvegicus
gttgtcgctcacaccctctgggtga

SEQ ID NO: 614803 - DNA, 25 bp, Rattus norvegicus
gggtgagcccgaaactcccacagtc

SEQ ID NO: 614804 - DNA, 25 bp, Rattus norvegicus
agacgccgatcctgtgacgcgcacg

SEQ ID NO: 614805 - DNA, 25 bp, Rattus norvegicus
cactcagaggggtaactaagaaaca

SEQ ID NO: 614806 - DNA, 25 bp, Rattus norvegicus
tggtggccatatttgcagcaactgc

SEQ ID NO: 614807 - DNA, 25 bp, Rattus norvegicus
actcggcccgaaaccggcaaatctg

SEQ ID NO: 614808 - DNA, 25 bp, Rattus norvegicus
cgtgaaacccgacgcagacgctctg

SEQ ID NO: 614809 - DNA, 25 bp, Rattus norvegicus
gcacccatcttatgttttattcgta

SEQ ID NO: 614810 - DNA, 25 bp, Rattus norvegicus
agctgacgcagttcgggacaagacc

SEQ ID NO: 614811 - DNA, 25 bp, Rattus norvegicus
ccaacagaacggacgccgcctgatt

SEQ ID NO: 614812 - DNA, 25 bp, Rattus norvegicus
acgccgcctgattgctgccgctaaa

SEQ ID NO: 614813 - DNA, 25 bp, Rattus norvegicus
ctggagcctagtgtcggcttcgtta

SEQ ID NO: 614814 - DNA, 25 bp, Rattus norvegicus
tagttcggaccagtgagctgacgca

SEQ ID NO: 614815 - DNA, 25 bp, Rattus norvegicus
tagtgactccacttctacggacccg

SEQ ID NO: 614816 - DNA, 25 bp, Rattus norvegicus
agcgccattgtgtctttcgcagtca

SEQ ID NO: 614817 - DNA, 25 bp, Rattus norvegicus
tcgcagtcacttgtaacgcttcgtg

SEQ ID NO: 614818 - DNA, 25 bp, Rattus norvegicus
taacgcttcgtgagagtccgtcgga

SEQ ID NO: 614819 - DNA, 25 bp, Rattus norvegicus
gtccgtcggacagcacccatcttat

SEQ ID NO: 614820 - DNA, 25 bp, Rattus norvegicus
tttattcgtaacttctggagcctag

SEQ ID NO: 614821 - DNA, 25 bp, Rattus norvegicus
agtgtcggcttcgttagtgactcca

SEQ ID NO: 614822 - DNA, 25 bp, Rattus norvegicus
ttgctgccgctaaacctccgcgggg

SEQ ID NO: 614823 - DNA, 25 bp, Rattus norvegicus
ggacacttgcgcttctgcggctaga

SEQ ID NO: 614824 - DNA, 25 bp, Rattus norvegicus
tctgcggctagatgactaggtcatg

SEQ ID NO: 614825 - DNA, 25 bp, Rattus norvegicus
gcgcggaccggacacttgcgcttct

SEQ ID NO: 614826 - DNA, 25 bp, Rattus norvegicus
ctagatgactaggtcatggctgcgg

SEQ ID NO: 614827 - DNA, 25 bp, Rattus norvegicus
tggcgcccgaaggaaaatgaccctg

SEQ ID NO: 614828 - DNA, 25 bp, Rattus norvegicus
cccgcggcctgttagagaccaagag

SEQ ID NO: 614829 - DNA, 25 bp, Rattus norvegicus
cctgttagagaccaagaggctcgca

SEQ ID NO: 614830 - DNA, 25 bp, Rattus norvegicus
ttagagaccaagaggctcgcaaggc

SEQ ID NO: 614831 - DNA, 25 bp, Rattus norvegicus
caagaggctcgcaaggctgctggca

SEQ ID NO: 614832 - DNA, 25 bp, Rattus norvegicus
gctactctccggcagtgctctccgc

SEQ ID NO: 614833 - DNA, 25 bp, Rattus norvegicus
ctccgccgccgctggagaggagcga

SEQ ID NO: 614834 - DNA, 25 bp, Rattus norvegicus
agcgagggcctccagagccccaagg

SEQ ID NO: 614835 - DNA, 25 bp, Rattus norvegicus
gcgcttctgcggctagatgactagg

SEQ ID NO: 614836 - DNA, 25 bp, Rattus norvegicus
cacttgcgcttctgcggctagatga

SEQ ID NO: 614837 - DNA, 25 bp, Rattus norvegicus
tctaagacacatttgagggtccgga

SEQ ID NO: 614838 - DNA, 25 bp, Rattus norvegicus
ggtgtcggtctcacgaaagtttctg

SEQ ID NO: 614839 - DNA, 25 bp, Rattus norvegicus
cgaagttcaaaagaggtggctatta

SEQ ID NO: 614840 - DNA, 25 bp, Rattus norvegicus
ttgcgctctcaggtgagtctgcgga

SEQ ID NO: 614841 - DNA, 25 bp, Rattus norvegicus
ccgatcgactgagaagcccggtttg

SEQ ID NO: 614842 - DNA, 25 bp, Rattus norvegicus
cggcctcttcctgtctgtgccagaa

SEQ ID NO: 614843 - DNA, 25 bp, Rattus norvegicus
acgaaagtttctgcgcatgtgcgcc

SEQ ID NO: 614844 - DNA, 25 bp, Rattus norvegicus
gttttacttaaaagcgctggcctgc

SEQ ID NO: 614845 - DNA, 25 bp, Rattus norvegicus
cgccgttttcaactgcgcgtgcgtc

SEQ ID NO: 614846 - DNA, 25 bp, Rattus norvegicus
cggctcgaacagcacgccgttttca

SEQ ID NO: 614847 - DNA, 25 bp, Rattus norvegicus
gtggcgctctttctaaacggctcga

SEQ ID NO: 614848 - DNA, 25 bp, Rattus norvegicus
tgtgcgccgactcacaagcttggca

SEQ ID NO: 614849 - DNA, 25 bp, Rattus norvegicus
gcaagtacttcagacatccgccaga

SEQ ID NO: 614850 - DNA, 25 bp, Rattus norvegicus
gctggcctgctacgttcggcctctt

SEQ ID NO: 614851 - DNA, 25 bp, Rattus norvegicus
ggccacgtattctgtctcgaatgtc

SEQ ID NO: 614852 - DNA, 25 bp, Rattus norvegicus
ggtgtctacatcttcttcctcatcc

SEQ ID NO: 614853 - DNA, 25 bp, Rattus norvegicus
gtctcgtggtctctggtgtctacat

SEQ ID NO: 614854 - DNA, 25 bp, Rattus norvegicus
tgggccttcaatgcggcagtggcac

SEQ ID NO: 614855 - DNA, 25 bp, Rattus norvegicus
gagcagtccagcgtgggccttcaat

SEQ ID NO: 614856 - DNA, 25 bp, Rattus norvegicus
ggccacgcaagagccgcacagtgcg

SEQ ID NO: 614857 - DNA, 25 bp, Rattus norvegicus
ggggctcctgtatctgcggccacca

SEQ ID NO: 614858 - DNA, 25 bp, Rattus norvegicus
acgccagggttctgtgcgctttgac

SEQ ID NO: 614859 - DNA, 25 bp, Rattus norvegicus
ttttcaagctgcctaaacgcctgga

SEQ ID NO: 614860 - DNA, 25 bp, Rattus norvegicus
tctcgaatgtctggcacgcctgtcg

SEQ ID NO: 614861 - DNA, 25 bp, Rattus norvegicus
aaacgcctggactgcggccacgtat

SEQ ID NO: 614862 - DNA, 25 bp, Rattus norvegicus
aggcctcagatcgtggcgctggccc

SEQ ID NO: 614863 - DNA, 25 bp, Rattus norvegicus
aaaatggcttttgggtctcaccgcg

SEQ ID NO: 614864 - DNA, 25 bp, Rattus norvegicus
cagcccggtctgctgccttgcgatg

SEQ ID NO: 614865 - DNA, 25 bp, Rattus norvegicus
gggagtgctcacgttcacgaacgca

SEQ ID NO: 614866 - DNA, 25 bp, Rattus norvegicus
tccggactacgacgcccagagagca

SEQ ID NO: 614867 - DNA, 25 bp, Rattus norvegicus
cagagagcatttcgttaaacctttc

SEQ ID NO: 614868 - DNA, 25 bp, Rattus norvegicus
taaacctttctctgggttcagaagc

SEQ ID NO: 614869 - DNA, 25 bp, Rattus norvegicus
gttcagaagctagcccagcggacgc

SEQ ID NO: 614870 - DNA, 25 bp, Rattus norvegicus
cctcccgaaccgtggttgccatgga

SEQ ID NO: 614871 - DNA, 25 bp, Rattus norvegicus
gcggtgattggtgcagaaccctgca

SEQ ID NO: 614872 - DNA, 25 bp, Rattus norvegicus
cctgcaaatcctgggaaggcctgta

SEQ ID NO: 614873 - DNA, 25 bp, Rattus norvegicus
aaggcctgtagagaactgaccgaga

SEQ ID NO: 614874 - DNA, 25 bp, Rattus norvegicus
aaggcggtgctaccatctgttgccc

SEQ ID NO: 614875 - DNA, 25 bp, Rattus norvegicus
ccctgacgcctggattcgagacggg

SEQ ID NO: 614876 - DNA, 25 bp, Rattus norvegicus
tgcgacctgattattgcgaccagcg

SEQ ID NO: 614877 - DNA, 25 bp, Rattus norvegicus
tgcgaccagcgcaatcccttgggga

SEQ ID NO: 614878 - DNA, 25 bp, Rattus norvegicus
tccggtgatgctgcgtttgcgcaca

SEQ ID NO: 614879 - DNA, 25 bp, Rattus norvegicus
tttcacgcaggtgtctcggctcacc

SEQ ID NO: 614880 - DNA, 25 bp, Rattus norvegicus
tccacacaggcgagagaccgttcgt

SEQ ID NO: 614881 - DNA, 25 bp, Rattus norvegicus
tggccgaagtttcagccgcagctct

SEQ ID NO: 614882 - DNA, 25 bp, Rattus norvegicus
cacgcatactgaggaacggcctttc

SEQ ID NO: 614883 - DNA, 25 bp, Rattus norvegicus
aacggcctttcgtgtgccgcgactg

SEQ ID NO: 614884 - DNA, 25 bp, Rattus norvegicus
gagctttcggcagcgctccaaccta

SEQ ID NO: 614885 - DNA, 25 bp, Rattus norvegicus
gagagcttcccacgacgcgcagtac

SEQ ID NO: 614886 - DNA, 25 bp, Rattus norvegicus
cgcgcagtactgctcgagcaccaag

SEQ ID NO: 614887 - DNA, 25 bp, Rattus norvegicus
ggtgcacaccggagacaagtccttc

SEQ ID NO: 614888 - DNA, 25 bp, Rattus norvegicus
aacgacctttcgcatgtgccgagtg

SEQ ID NO: 614889 - DNA, 25 bp, Rattus norvegicus
ccgagtgcggtcaaagcttccggca

SEQ ID NO: 614890 - DNA, 25 bp, Rattus norvegicus
cggcccttcgcctgcacagaatgtg

SEQ ID NO: 614891 - DNA, 25 bp, Rattus norvegicus
ctgtcccgaatgtggccagagcttc

SEQ ID NO: 614892 - DNA, 25 bp, Rattus norvegicus
cgagaagccctaccgctgcagtgaa

SEQ ID NO: 614893 - DNA, 25 bp, Rattus norvegicus
gatggaccgccaaatagtcacctcc

SEQ ID NO: 614894 - DNA, 25 bp, Rattus norvegicus
aagcggacagacgacggaaagtgcc

SEQ ID NO: 614895 - DNA, 25 bp, Rattus norvegicus
ccgcagcctcctagcaaagggagca

SEQ ID NO: 614896 - DNA, 25 bp, Rattus norvegicus
ggggactcacaagacccgagcggaa

SEQ ID NO: 614897 - DNA, 25 bp, Rattus norvegicus
gatagccgagtcctcccgagcactt

SEQ ID NO: 614898 - DNA, 25 bp, Rattus norvegicus
agcacttccgaacacacccgaggtg

SEQ ID NO: 614899 - DNA, 25 bp, Rattus norvegicus
gctaagccaggccagagccggacta

SEQ ID NO: 614900 - DNA, 25 bp, Rattus norvegicus
gcggcaggatgatcaagctgttctc

SEQ ID NO: 614901 - DNA, 25 bp, Rattus norvegicus
aagctgttctcgctgaagcagcaga

SEQ ID NO: 614902 - DNA, 25 bp, Rattus norvegicus
accctgcgttcgaggtcagggaccg

SEQ ID NO: 614903 - DNA, 25 bp, Rattus norvegicus
gcgtgaaattgccaccgctgatatt

SEQ ID NO: 614904 - DNA, 25 bp, Rattus norvegicus
cgctgatatttggtatcgagggtca

SEQ ID NO: 614905 - DNA, 25 bp, Rattus norvegicus
caaactacaacgaggagcaagcagg

SEQ ID NO: 614906 - DNA, 25 bp, Rattus norvegicus
gcgcagccgagccaggaaaaaccga

SEQ ID NO: 614907 - DNA, 25 bp, Rattus norvegicus
ggctgtgcgcgtgcgtcttagcact

SEQ ID NO: 614908 - DNA, 25 bp, Rattus norvegicus
tctgctgagccgcaggtcccgtttg

SEQ ID NO: 614909 - DNA, 25 bp, Rattus norvegicus
tggtctctgctgagccgcaggtccc

SEQ ID NO: 614910 - DNA, 25 bp, Rattus norvegicus
aagcggaagcccatccttctctcgg

SEQ ID NO: 614911 - DNA, 25 bp, Rattus norvegicus
cgcagcagaggctaccgaaccgagg

SEQ ID NO: 614912 - DNA, 25 bp, Rattus norvegicus
tcagatcgtttaatccggaaacggc

SEQ ID NO: 614913 - DNA, 25 bp, Rattus norvegicus
gtgacgtcagatcgtttaatccgga

SEQ ID NO: 614914 - DNA, 25 bp, Rattus norvegicus
gggtcgtgtgacgtcagatcgttta

SEQ ID NO: 614915 - DNA, 25 bp, Rattus norvegicus
cttcccagcattcccggagagggtg

SEQ ID NO: 614916 - DNA, 25 bp, Rattus norvegicus
tgcgtcttagcacttcccagcattc

SEQ ID NO: 614917 - DNA, 25 bp, Rattus norvegicus
cgcttttatggctggctgtgcgcgt

SEQ ID NO: 614918 - DNA, 25 bp, Rattus norvegicus
tgcgcatgcgcttttatggctggct

SEQ ID NO: 614919 - DNA, 25 bp, Rattus norvegicus
cttgtaccttctgctgaggtgcggg

SEQ ID NO: 614920 - DNA, 25 bp, Rattus norvegicus
ttagcacttcccagcattcccggag

SEQ ID NO: 614921 - DNA, 25 bp, Rattus norvegicus
cgagtcgtgcagaaccgtaccttag

SEQ ID NO: 614922 - DNA, 25 bp, Rattus norvegicus
ctaggtccaggatagcaagactacc

SEQ ID NO: 614923 - DNA, 25 bp, Rattus norvegicus
cgaattattagctgcggcgggtgta

SEQ ID NO: 614924 - DNA, 25 bp, Rattus norvegicus
ccgtacagtgcaccgaggcttattc

SEQ ID NO: 614925 - DNA, 25 bp, Rattus norvegicus
aattcacccgcggagtacgtgcgtg

SEQ ID NO: 614926 - DNA, 25 bp, Rattus norvegicus
aggcttattcctcgcgtgctggaaa

SEQ ID NO: 614927 - DNA, 25 bp, Rattus norvegicus
aggcagattacgcacgcgccagggc

SEQ ID NO: 614928 - DNA, 25 bp, Rattus norvegicus
gcctggaggcgggacagaaatatct

SEQ ID NO: 614929 - DNA, 25 bp, Rattus norvegicus
agaattgcgaacaaccgcccgaccg

SEQ ID NO: 614930 - DNA, 25 bp, Rattus norvegicus
gctgctgagactcgcgccgcaagaa

SEQ ID NO: 614931 - DNA, 25 bp, Rattus norvegicus
gacacacgccgcagtgctccaaaag

SEQ ID NO: 614932 - DNA, 25 bp, Rattus norvegicus
gccgaatgcagacagggcagcagcc

SEQ ID NO: 614933 - DNA, 25 bp, Rattus norvegicus
caaggcaggcactacaggccgaatg

SEQ ID NO: 614934 - DNA, 25 bp, Rattus norvegicus
agtacgtgcgtgatgtctcccatgc

SEQ ID NO: 614935 - DNA, 25 bp, Rattus norvegicus
ccctgcctcagagtctcagagaagg

SEQ ID NO: 614936 - DNA, 25 bp, Rattus norvegicus
tcaagttgacaagcaggaggcagcc

SEQ ID NO: 614937 - DNA, 25 bp, Rattus norvegicus
cggaagtgcggccttcaagttgaca

SEQ ID NO: 614938 - DNA, 25 bp, Rattus norvegicus
tgcgccgcggctatcggttccgctt

SEQ ID NO: 614939 - DNA, 25 bp, Rattus norvegicus
cagcggaaacgtgctcccgactatc

SEQ ID NO: 614940 - DNA, 25 bp, Rattus norvegicus
atcggtgtgcaggttgcgaacgcaa

SEQ ID NO: 614941 - DNA, 25 bp, Rattus norvegicus
cccagctctgcgattttggttctgg

SEQ ID NO: 614942 - DNA, 25 bp, Rattus norvegicus
taccggaagttctgctcaacgactc

SEQ ID NO: 614943 - DNA, 25 bp, Rattus norvegicus
aagcgtgctccagcctagggatccc

SEQ ID NO: 614944 - DNA, 25 bp, Rattus norvegicus
atcagccaggagacgacggaagcgt

SEQ ID NO: 614945 - DNA, 25 bp, Rattus norvegicus
tgacagctcactcggatcagccagg

SEQ ID NO: 614946 - DNA, 25 bp, Rattus norvegicus
tggcccgaggactgattgacagctc

SEQ ID NO: 614947 - DNA, 25 bp, Rattus norvegicus
tggcgcggaccataccggaagttct

SEQ ID NO: 614948 - DNA, 25 bp, Rattus norvegicus
gattttggttctggcgcggaccata

SEQ ID NO: 614949 - DNA, 25 bp, Rattus norvegicus
ggcttgtatcacagggacggagtta

SEQ ID NO: 614950 - DNA, 25 bp, Rattus norvegicus
gcaaagagccaatcgccgaggagcc

SEQ ID NO: 614951 - DNA, 25 bp, Rattus norvegicus
gcacgtcacacgatggcatggcaaa

SEQ ID NO: 614952 - DNA, 25 bp, Rattus norvegicus
gacaggtctaggacagcacgtcaca

SEQ ID NO: 614953 - DNA, 25 bp, Rattus norvegicus
ctctacacgtgggtagacaggtcta

SEQ ID NO: 614954 - DNA, 25 bp, Rattus norvegicus
accatctttctccttccgaagtgca

SEQ ID NO: 614955 - DNA, 25 bp, Rattus norvegicus
gtatctcccggcagctctacacgtg

SEQ ID NO: 614956 - DNA, 25 bp, Rattus norvegicus
catgatgaggcagggactccctttc

SEQ ID NO: 614957 - DNA, 25 bp, Rattus norvegicus
gagcaccgcggttttctcaccatga

SEQ ID NO: 614958 - DNA, 25 bp, Rattus norvegicus
cagggagcggcgaacagacataacc

SEQ ID NO: 614959 - DNA, 25 bp, Rattus norvegicus
gccagtggcctaagccagccgcagg

SEQ ID NO: 614960 - DNA, 25 bp, Rattus norvegicus
aggagccgctagactgcagccggaa

SEQ ID NO: 614961 - DNA, 25 bp, Rattus norvegicus
gatagtgactggtttcggggcacca

SEQ ID NO: 614962 - DNA, 25 bp, Rattus norvegicus
tgcacccggggtgacgaagatgact

SEQ ID NO: 614963 - DNA, 25 bp, Rattus norvegicus
catccgtgaggcttctctgcgtgct

SEQ ID NO: 614964 - DNA, 25 bp, Rattus norvegicus
cagtgttgactgctgcgcctgaaga

SEQ ID NO: 614965 - DNA, 25 bp, Rattus norvegicus
gggcctgataccgagccagtgttga

SEQ ID NO: 614966 - DNA, 25 bp, Rattus norvegicus
acagatcatcgctcgtgcccgtgtc

SEQ ID NO: 614967 - DNA, 25 bp, Rattus norvegicus
accgtcattgatgagtgcacacaga

SEQ ID NO: 614968 - DNA, 25 bp, Rattus norvegicus
gtgcttcgcatccagaccgtcattg

SEQ ID NO: 614969 - DNA, 25 bp, Rattus norvegicus
caggtactcactgcagcatcggtgc

SEQ ID NO: 614970 - DNA, 25 bp, Rattus norvegicus
caaggcgaagcactgcaggtactca

SEQ ID NO: 614971 - DNA, 25 bp, Rattus norvegicus
gccagctggtcgagttcctgtacag

SEQ ID NO: 614972 - DNA, 25 bp, Rattus norvegicus
gtgccaccagtggtgcctgcgcaga

SEQ ID NO: 614973 - DNA, 25 bp, Rattus norvegicus
ccactcggagattcgtgtgccacca

SEQ ID NO: 614974 - DNA, 25 bp, Rattus norvegicus
taagctgttgcttggccactcggag

SEQ ID NO: 614975 - DNA, 25 bp, Rattus norvegicus
ccgatgaagaaaccgacgctgaaga

SEQ ID NO: 614976 - DNA, 25 bp, Rattus norvegicus
gcaggctcacccttctttcaggata

SEQ ID NO: 614977 - DNA, 25 bp, Rattus norvegicus
gagctcgtcccgctcgtcccgggct

SEQ ID NO: 614978 - DNA, 25 bp, Rattus norvegicus
tctcgatgcctgttcttggggatga

SEQ ID NO: 614979 - DNA, 25 bp, Rattus norvegicus
ggctctcgatgcctgttcttgggga

SEQ ID NO: 614980 - DNA, 25 bp, Rattus norvegicus
tctgcatcttcagggctgcctgggg

SEQ ID NO: 614981 - DNA, 25 bp, Rattus norvegicus
ttgtctgcatcttcagggctgcctg

SEQ ID NO: 614982 - DNA, 25 bp, Rattus norvegicus
ctcttctgctctggagcgtcgtcct

SEQ ID NO: 614983 - DNA, 25 bp, Rattus norvegicus
cagtggggcttctgcgctcggactc

SEQ ID NO: 614984 - DNA, 25 bp, Rattus norvegicus
tgtggctccgtcctggggctcgctt

SEQ ID NO: 614985 - DNA, 25 bp, Rattus norvegicus
atgcctgttcttggggatgaggaaa

SEQ ID NO: 614986 - DNA, 25 bp, Rattus norvegicus
ttctgcgctcggactcggggtccgc

SEQ ID NO: 614987 - DNA, 25 bp, Rattus norvegicus
ttctctcagcttgtctgcatcttca

SEQ ID NO: 614988 - DNA, 25 bp, Rattus norvegicus
atgaggaaagaagcaggcgcctccc

SEQ ID NO: 614989 - DNA, 25 bp, Rattus norvegicus
agcctcaacctcttctgctctggag

SEQ ID NO: 614990 - DNA, 25 bp, Rattus norvegicus
tcaacctcttctgctctggagcgtc

SEQ ID NO: 614991 - DNA, 25 bp, Rattus norvegicus
cgcttcactcagaagagttcactca

SEQ ID NO: 614992 - DNA, 25 bp, Rattus norvegicus
ggcgatccttctcgctacgcgacta

SEQ ID NO: 614993 - DNA, 25 bp, Rattus norvegicus
cgcgactatctgctcaaacatatgg

SEQ ID NO: 614994 - DNA, 25 bp, Rattus norvegicus
aaacatatggtcacacacaccggtg

SEQ ID NO: 614995 - DNA, 25 bp, Rattus norvegicus
acacaccggtgtgcgagccttccag

SEQ ID NO: 614996 - DNA, 25 bp, Rattus norvegicus
agccttccagtgtgcagtgtgtgcc

SEQ ID NO: 614997 - DNA, 25 bp, Rattus norvegicus
tgccaagcgcttcactcagaagagt

SEQ ID NO: 614998 - DNA, 25 bp, Rattus norvegicus
agttcactcaacgtgcacatgcgca

SEQ ID NO: 614999 - DNA, 25 bp, Rattus norvegicus
acataggcctgaacgtgcgccctgc

SEQ ID NO: 615000 - DNA, 25 bp, Rattus norvegicus
ctgccctgcctgtggcaaagttttc

SEQ ID NO: 615001 - DNA, 25 bp, Rattus norvegicus
tggcaaagttttctcacaccgtgcg

SEQ ID NO: 615002 - DNA, 25 bp, Rattus norvegicus
ttctcacaccgtgcgctgctagagc

SEQ ID NO: 615003 - DNA, 25 bp, Rattus norvegicus
ctgtgtgctggcgatccttctcgct

SEQ ID NO: 615004 - DNA, 25 bp, Rattus norvegicus
acatgcgcacacataggcctgaacg

SEQ ID NO: 615005 - DNA, 25 bp, Rattus norvegicus
ccttcctgacttggcagcggttctt

SEQ ID NO: 615006 - DNA, 25 bp, Rattus norvegicus
tcagccgtaggactcacgtacagcc

SEQ ID NO: 615007 - DNA, 25 bp, Rattus norvegicus
gcctgcacagctaggagtgcgctca

SEQ ID NO: 615008 - DNA, 25 bp, Rattus norvegicus
aggagtgcgctcacctctgacgcgt

SEQ ID NO: 615009 - DNA, 25 bp, Rattus norvegicus
gcccgagaagcttgaggcacttcca

SEQ ID NO: 615010 - DNA, 25 bp, Rattus norvegicus
aagtgacacggagcgcgtcccacta

SEQ ID NO: 615011 - DNA, 25 bp, Rattus norvegicus
ttggactacgtctcccgtgagcctc

SEQ ID NO: 615012 - DNA, 25 bp, Rattus norvegicus
gcaaggacgacagcacgcttccagg

SEQ ID NO: 615013 - DNA, 25 bp, Rattus norvegicus
ttccagggcctctaacgcgggaggc

SEQ ID NO: 615014 - DNA, 25 bp, Rattus norvegicus
tctcctcggggtcgctttgccgcag

SEQ ID NO: 615015 - DNA, 25 bp, Rattus norvegicus
gggattataaagctgcgcctgcaca

SEQ ID NO: 615016 - DNA, 25 bp, Rattus norvegicus
tggcagcggttcttctcttgcaacc

SEQ ID NO: 615017 - DNA, 25 bp, Rattus norvegicus
tcttgcaacctcagccgtaggactc

SEQ ID NO: 615018 - DNA, 25 bp, Rattus norvegicus
gaggctcttcgttcctctcctcggg

SEQ ID NO: 615019 - DNA, 25 bp, Rattus norvegicus
ggcgctcacggaaagcgcggccaca

SEQ ID NO: 615020 - DNA, 25 bp, Rattus norvegicus
cacactgtgtgcacacgaagggctt

SEQ ID NO: 615021 - DNA, 25 bp, Rattus norvegicus
gccagtgtgcagcagctgatgctgt

SEQ ID NO: 615022 - DNA, 25 bp, Rattus norvegicus
cgaagggcttttcacccgtgtggat

SEQ ID NO: 615023 - DNA, 25 bp, Rattus norvegicus
ggacgccctcctgcgtggatcttgc

SEQ ID NO: 615024 - DNA, 25 bp, Rattus norvegicus
agcaacactgctcccttggcaaagg

SEQ ID NO: 615025 - DNA, 25 bp, Rattus norvegicus
tgcacaggcatagggacgccctcct

SEQ ID NO: 615026 - DNA, 25 bp, Rattus norvegicus
tcgtgctggataagatgtgagttgc

SEQ ID NO: 615027 - DNA, 25 bp, Rattus norvegicus
agccctgactaaaggctgcgccaca

SEQ ID NO: 615028 - DNA, 25 bp, Rattus norvegicus
aggcttctctccagtatgcacacgc

SEQ ID NO: 615029 - DNA, 25 bp, Rattus norvegicus
cactgtggacacgagaaaggcttct

SEQ ID NO: 615030 - DNA, 25 bp, Rattus norvegicus
gtggctgaaggcacggccacactgt

SEQ ID NO: 615031 - DNA, 25 bp, Rattus norvegicus
atgcgcctgtggctgagcaacactg

SEQ ID NO: 615032 - DNA, 25 bp, Rattus norvegicus
gccgcactgtgcacaggcataggga

SEQ ID NO: 615033 - DNA, 25 bp, Rattus norvegicus
cacttctgcagcaactcagaggcta

SEQ ID NO: 615034 - DNA, 25 bp, Rattus norvegicus
actcagaggctatcgagcacgagcg

SEQ ID NO: 615035 - DNA, 25 bp, Rattus norvegicus
aggcgagaagccgtatgggtgctcc

SEQ ID NO: 615036 - DNA, 25 bp, Rattus norvegicus
gaggctatcgagcacgagcgcacgc

SEQ ID NO: 615037 - DNA, 25 bp, Rattus norvegicus
tcagaggctatcgagcacgagcgca

SEQ ID NO: 615038 - DNA, 25 bp, Rattus norvegicus
tgtggtgcggactttagtcagggct

SEQ ID NO: 615039 - DNA, 25 bp, Rattus norvegicus
gcaactcagaggctatcgagcacga

SEQ ID NO: 615040 - DNA, 25 bp, Rattus norvegicus
tgcagcaactcagaggctatcgagc

SEQ ID NO: 615041 - DNA, 25 bp, Rattus norvegicus
cttctgcagcaactcagaggctatc

SEQ ID NO: 615042 - DNA, 25 bp, Rattus norvegicus
cgacacttctgcagcaactcagagg

SEQ ID NO: 615043 - DNA, 25 bp, Rattus norvegicus
gtgcggccgacacttctgcagcaac

SEQ ID NO: 615044 - DNA, 25 bp, Rattus norvegicus
cagtgcggccgacacttctgcagca

SEQ ID NO: 615045 - DNA, 25 bp, Rattus norvegicus
cacagtgcggccgacacttctgcag

SEQ ID NO: 615046 - DNA, 25 bp, Rattus norvegicus
tctgcagcaactcagaggctatcga

SEQ ID NO: 615047 - DNA, 25 bp, Rattus norvegicus
tgagccacggctcgaatcgggcaac

SEQ ID NO: 615048 - DNA, 25 bp, Rattus norvegicus
gagtaccgtcctcacttgccctagt

SEQ ID NO: 615049 - DNA, 25 bp, Rattus norvegicus
gtggcttcggcacaaccctaacggc

SEQ ID NO: 615050 - DNA, 25 bp, Rattus norvegicus
taacggcctcaactgcggcttatga

SEQ ID NO: 615051 - DNA, 25 bp, Rattus norvegicus
ttgccctagtcttgggtcaccagaa

SEQ ID NO: 615052 - DNA, 25 bp, Rattus norvegicus
agtcggccaggtccttcaagcacca

SEQ ID NO: 615053 - DNA, 25 bp, Rattus norvegicus
atggccacggccaaagcatcttttc

SEQ ID NO: 615054 - DNA, 25 bp, Rattus norvegicus
tgatcacccgtatggcctgaagccg

SEQ ID NO: 615055 - DNA, 25 bp, Rattus norvegicus
tactaccatcatcgggtttcggcgg

SEQ ID NO: 615056 - DNA, 25 bp, Rattus norvegicus
tgctaagtgacatcccagaccgccg

SEQ ID NO: 615057 - DNA, 25 bp, Rattus norvegicus
gccctggcagaacgctggaaagtga

SEQ ID NO: 615058 - DNA, 25 bp, Rattus norvegicus
gctcgagtaaacgtagttcctgctg

SEQ ID NO: 615059 - DNA, 25 bp, Rattus norvegicus
gttcgcccaatgcacaacacgaatg

SEQ ID NO: 615060 - DNA, 25 bp, Rattus norvegicus
ttcctgctgactagcctgaatgaca

SEQ ID NO: 615061 - DNA, 25 bp, Rattus norvegicus
tccctttcgctgtcttgccttgcta

SEQ ID NO: 615062 - DNA, 25 bp, Rattus norvegicus
atggcacctgtagcggatgccttcc

SEQ ID NO: 615063 - DNA, 25 bp, Rattus norvegicus
agcggatgccttccgttctagtccc

SEQ ID NO: 615064 - DNA, 25 bp, Rattus norvegicus
ccgcaggcttgaaggtagtgcacta

SEQ ID NO: 615065 - DNA, 25 bp, Rattus norvegicus
tagtgcactaggcattgagtccctg

SEQ ID NO: 615066 - DNA, 25 bp, Rattus norvegicus
ctaggcattgagtccctgaaccctc

SEQ ID NO: 615067 - DNA, 25 bp, Rattus norvegicus
tgagtccctgaaccctcagggcctg

SEQ ID NO: 615068 - DNA, 25 bp, Rattus norvegicus
cggtgaggctgctgacggatttccc

SEQ ID NO: 615069 - DNA, 25 bp, Rattus norvegicus
ggcaatctatggactctcctccttc

SEQ ID NO: 615070 - DNA, 25 bp, Rattus norvegicus
tgtcttgccttgctacggaaacgta

SEQ ID NO: 615071 - DNA, 25 bp, Rattus norvegicus
gccttgctacggaaacgtagattca

SEQ ID NO: 615072 - DNA, 25 bp, Rattus norvegicus
cgtagattcacgtcagttttaaggt

SEQ ID NO: 615073 - DNA, 25 bp, Rattus norvegicus
gattcacgtcagttttaaggtccca

SEQ ID NO: 615074 - DNA, 25 bp, Rattus norvegicus
cctgaacaggaaaggcaatctatgg

SEQ ID NO: 615075 - DNA, 25 bp, Rattus norvegicus
cgcaccgccagtcaatcagagaaga

SEQ ID NO: 615076 - DNA, 25 bp, Rattus norvegicus
gacccacctgctgcgcagcgttgcc

SEQ ID NO: 615077 - DNA, 25 bp, Rattus norvegicus
cagcctcgaacaccgagcggcgatg

SEQ ID NO: 615078 - DNA, 25 bp, Rattus norvegicus
gatggcggcccactgcactacgcgt

SEQ ID NO: 615079 - DNA, 25 bp, Rattus norvegicus
tgcgcggcctgaagcaccgtaaact

SEQ ID NO: 615080 - DNA, 25 bp, Rattus norvegicus
tgctatgaccgcaccgccagtcaat

SEQ ID NO: 615081 - DNA, 25 bp, Rattus norvegicus
accctgtgcaccagccgaacaccta

SEQ ID NO: 615082 - DNA, 25 bp, Rattus norvegicus
gtcaatcagagaagactggctccgc

SEQ ID NO: 615083 - DNA, 25 bp, Rattus norvegicus
gagaagactggctccgcttcgcctc

SEQ ID NO: 615084 - DNA, 25 bp, Rattus norvegicus
acgtgcactcgcgtcacttccgatg

SEQ ID NO: 615085 - DNA, 25 bp, Rattus norvegicus
cgcgtcacttccgatgccattggca

SEQ ID NO: 615086 - DNA, 25 bp, Rattus norvegicus
tccgatgccattggcaacggagtaa

SEQ ID NO: 615087 - DNA, 25 bp, Rattus norvegicus
acggagtaaaacaagcgatcgtgcg

SEQ ID NO: 615088 - DNA, 25 bp, Rattus norvegicus
ctgaagcaccgtaaactgcgaaccc

SEQ ID NO: 615089 - DNA, 25 bp, Rattus norvegicus
cgaccagctgcaccggggtgcaagt

SEQ ID NO: 615090 - DNA, 25 bp, Rattus norvegicus
cgaagcatcgtgtccaggggcccgc

SEQ ID NO: 615091 - DNA, 25 bp, Rattus norvegicus
cgtgccgaagtaggggctaagcacc

SEQ ID NO: 615092 - DNA, 25 bp, Rattus norvegicus
tagcgtgtcttcgtgccgaagtagg

SEQ ID NO: 615093 - DNA, 25 bp, Rattus norvegicus
ccagcagccaggggttgacatcttc

SEQ ID NO: 615094 - DNA, 25 bp, Rattus norvegicus
accacagcggccattggtccagagc

SEQ ID NO: 615095 - DNA, 25 bp, Rattus norvegicus
ggctaagcaccgaagccaccgggtc

SEQ ID NO: 615096 - DNA, 25 bp, Rattus norvegicus
acggatgagggcgaccagctgcacc

SEQ ID NO: 615097 - DNA, 25 bp, Rattus norvegicus
agtcatcgtaccacagcggccattg

SEQ ID NO: 615098 - DNA, 25 bp, Rattus norvegicus
cattggtccagagcggcggccactc

SEQ ID NO: 615099 - DNA, 25 bp, Rattus norvegicus
acggactcgcgggtctgcagcagcc

SEQ ID NO: 615100 - DNA, 25 bp, Rattus norvegicus
ctgcagctgcctcagcttgcggatc

SEQ ID NO: 615101 - DNA, 25 bp, Rattus norvegicus
tcagcttgcggatctgcttggtcgt

SEQ ID NO: 615102 - DNA, 25 bp, Rattus norvegicus
cagggccagctgtcgcatgtcctgc

SEQ ID NO: 615103 - DNA, 25 bp, Rattus norvegicus
tttgcgtctccgagcgagctagtgt

SEQ ID NO: 615104 - DNA, 25 bp, Rattus norvegicus
atttggggctttcgagtttgcgtct

SEQ ID NO: 615105 - DNA, 25 bp, Rattus norvegicus
ccagcatgctatgcgggacagcgcc

SEQ ID NO: 615106 - DNA, 25 bp, Rattus norvegicus
ttgcggcgcgctttactcgcaagcc

SEQ ID NO: 615107 - DNA, 25 bp, Rattus norvegicus
tgtggtgtcccgcaaagtgatttgg

SEQ ID NO: 615108 - DNA, 25 bp, Rattus norvegicus
cgcttgtagctggtgagcttcgctg

SEQ ID NO: 615109 - DNA, 25 bp, Rattus norvegicus
cgcgaaatctgtgtggcgcgaattt

SEQ ID NO: 615110 - DNA, 25 bp, Rattus norvegicus
ccgccaaggtctgcgcgcgaaatct

SEQ ID NO: 615111 - DNA, 25 bp, Rattus norvegicus
ccagcagcctctgggcgatagttgc

SEQ ID NO: 615112 - DNA, 25 bp, Rattus norvegicus
ttactctgtcccatttccagactgc

SEQ ID NO: 615113 - DNA, 25 bp, Rattus norvegicus
tcaccggctcatccacggggaggat

SEQ ID NO: 615114 - DNA, 25 bp, Rattus norvegicus
gactgtcacctttacgacctcgcag

SEQ ID NO: 615115 - DNA, 25 bp, Rattus norvegicus
cccagtgcctgacaaggtggctttc

SEQ ID NO: 615116 - DNA, 25 bp, Rattus norvegicus
tccagactgcctcacgctctagaga

SEQ ID NO: 615117 - DNA, 25 bp, Rattus norvegicus
cagactcgtgcgcaaatggcgtttc

SEQ ID NO: 615118 - DNA, 25 bp, Rattus norvegicus
gcgggaatgtttctcctgctctcga

SEQ ID NO: 615119 - DNA, 25 bp, Rattus norvegicus
tgtttctcctgctctcgaagtttcg

SEQ ID NO: 615120 - DNA, 25 bp, Rattus norvegicus
tgctctcgaagtttcgccctttttc

SEQ ID NO: 615121 - DNA, 25 bp, Rattus norvegicus
cgccctttttcaaaacagactcgtg

SEQ ID NO: 615122 - DNA, 25 bp, Rattus norvegicus
tggagagaaaccaaagcccggggca

SEQ ID NO: 615123 - DNA, 25 bp, Rattus norvegicus
aatggcgtttctcggaactttctgg

SEQ ID NO: 615124 - DNA, 25 bp, Rattus norvegicus
tgcgcaaatggcgtttctcggaact

SEQ ID NO: 615125 - DNA, 25 bp, Rattus norvegicus
tctcggaactttctggctttccaag

SEQ ID NO: 615126 - DNA, 25 bp, Rattus norvegicus
ttccaagttatctggagagaaacca

SEQ ID NO: 615127 - DNA, 25 bp, Rattus norvegicus
agcgcggacaccgaggtctggccca

SEQ ID NO: 615128 - DNA, 25 bp, Rattus norvegicus
cggacaccgaggtctggcccatggc

SEQ ID NO: 615129 - DNA, 25 bp, Rattus norvegicus
tcaaaacagactcgtgcgcaaatgg

SEQ ID NO: 615130 - DNA, 25 bp, Rattus norvegicus
ctttctggctttccaagttatctgg

SEQ ID NO: 615131 - DNA, 25 bp, Rattus norvegicus
ccagcaccgctgaagaagctcgaga

SEQ ID NO: 615132 - DNA, 25 bp, Rattus norvegicus
caagtttctgtaggtggctgtctca

SEQ ID NO: 615133 - DNA, 25 bp, Rattus norvegicus
ccagcggtgccaagctacaagtttc

SEQ ID NO: 615134 - DNA, 25 bp, Rattus norvegicus
tccgcaactatccaaccgcaatgtg

SEQ ID NO: 615135 - DNA, 25 bp, Rattus norvegicus
ccgccctaggttgaccgaagttgtg

SEQ ID NO: 615136 - DNA, 25 bp, Rattus norvegicus
tcaccggtaccaggcaagacctttg

SEQ ID NO: 615137 - DNA, 25 bp, Rattus norvegicus
gcgcctactgtcttatccttgcctg

SEQ ID NO: 615138 - DNA, 25 bp, Rattus norvegicus
tccttgcctgcaaccagtgagttgg

SEQ ID NO: 615139 - DNA, 25 bp, Rattus norvegicus
tcttaggggatgtctcattcggagc

SEQ ID NO: 615140 - DNA, 25 bp, Rattus norvegicus
cggcgcacgagtacaggaacatgta

SEQ ID NO: 615141 - DNA, 25 bp, Rattus norvegicus
tggctcagcacatggcacgagtccc

SEQ ID NO: 615142 - DNA, 25 bp, Rattus norvegicus
attcggtttattgccctcgtgcgcg

SEQ ID NO: 615143 - DNA, 25 bp, Rattus norvegicus
agcggcgatggctcttgacatgatg

SEQ ID NO: 615144 - DNA, 25 bp, Rattus norvegicus
gtagcggcccttgtaaggaaactca

SEQ ID NO: 615145 - DNA, 25 bp, Rattus norvegicus
acaaagcgaggacccgacccactag

SEQ ID NO: 615146 - DNA, 25 bp, Rattus norvegicus
atgcgaagaccgaggttccagagca

SEQ ID NO: 615147 - DNA, 25 bp, Rattus norvegicus
agtcggagcaaaccaagtacgtggg

SEQ ID NO: 615148 - DNA, 25 bp, Rattus norvegicus
ggacccgacccactagcagcaagga

SEQ ID NO: 615149 - DNA, 25 bp, Rattus norvegicus
tagcgccattgctgcacgtcgcatc

SEQ ID NO: 615150 - DNA, 25 bp, Rattus norvegicus
cccactagcagcaaggacttcaatc

SEQ ID NO: 615151 - DNA, 25 bp, Rattus norvegicus
actcgaacggctagcgccattgctg

SEQ ID NO: 615152 - DNA, 25 bp, Rattus norvegicus
gtgcgcacagccgagtacctcaaga

SEQ ID NO: 615153 - DNA, 25 bp, Rattus norvegicus
cgagtacctcaagagtcggagcaaa

SEQ ID NO: 615154 - DNA, 25 bp, Rattus norvegicus
aaggacttcaatctctgcgcgtggg

SEQ ID NO: 615155 - DNA, 25 bp, Rattus norvegicus
gaccgaggttccagagcacgacgaa

SEQ ID NO: 615156 - DNA, 25 bp, Rattus norvegicus
gttccagagcacgacgaaggctgtg

SEQ ID NO: 615157 - DNA, 25 bp, Rattus norvegicus
gacttcaatctctgcgcgtggggcc

SEQ ID NO: 615158 - DNA, 25 bp, Rattus norvegicus
ctcaagagtcggagcaaaccaagta

SEQ ID NO: 615159 - DNA, 25 bp, Rattus norvegicus
ctggcttttcgagccgcgcttatca

SEQ ID NO: 615160 - DNA, 25 bp, Rattus norvegicus
gtatatacgacgcacttcccgtttg

SEQ ID NO: 615161 - DNA, 25 bp, Rattus norvegicus
cgtgcgcaattcagtgacgtatata

SEQ ID NO: 615162 - DNA, 25 bp, Rattus norvegicus
ccggtttggaacgtgcgcaattcag

SEQ ID NO: 615163 - DNA, 25 bp, Rattus norvegicus
cttcttaaaggaagagcgtagtcgc

SEQ ID NO: 615164 - DNA, 25 bp, Rattus norvegicus
tacccgcagccatcttcttaaagga

SEQ ID NO: 615165 - DNA, 25 bp, Rattus norvegicus
gcctcagagcgggatccaccgaggt

SEQ ID NO: 615166 - DNA, 25 bp, Rattus norvegicus
cagccgcgcttcttgtttctggggc

SEQ ID NO: 615167 - DNA, 25 bp, Rattus norvegicus
tccaggaactggtctacctctagcc

SEQ ID NO: 615168 - DNA, 25 bp, Rattus norvegicus
gtagccgtacatcttccaggaactg

SEQ ID NO: 615169 - DNA, 25 bp, Rattus norvegicus
tcgtgcgctcttgtagccgtacatc

SEQ ID NO: 615170 - DNA, 25 bp, Rattus norvegicus
ggtccatcatgcaccaggccgcaaa

SEQ ID NO: 615171 - DNA, 25 bp, Rattus norvegicus
gcgtagtcgctcaaactccgatatc

SEQ ID NO: 615172 - DNA, 25 bp, Rattus norvegicus
cagaaagttagagtccgcctggctt

SEQ ID NO: 615173 - DNA, 25 bp, Rattus norvegicus
tcagctgctgtgtctccaccatgtc

SEQ ID NO: 615174 - DNA, 25 bp, Rattus norvegicus
cgcgcccgcttcactaggtcattga

SEQ ID NO: 615175 - DNA, 25 bp, Rattus norvegicus
acgcggatcttgtcctcgtggccac

SEQ ID NO: 615176 - DNA, 25 bp, Rattus norvegicus
caccatgtctgccttgttgagtacc

SEQ ID NO: 615177 - DNA, 25 bp, Rattus norvegicus
cccatagacgcgcatcagctgctgt

SEQ ID NO: 615178 - DNA, 25 bp, Rattus norvegicus
cgaaggacttcaggcgtgcccacca

SEQ ID NO: 615179 - DNA, 25 bp, Rattus norvegicus
gccgatgtagacacgaaggacttca

SEQ ID NO: 615180 - DNA, 25 bp, Rattus norvegicus
ggaccagaaggagccgatgtagaca

SEQ ID NO: 615181 - DNA, 25 bp, Rattus norvegicus
aagagacgccggttgtctggcacaa

SEQ ID NO: 615182 - DNA, 25 bp, Rattus norvegicus
tgttcctccagctcgaagagacgcc

SEQ ID NO: 615183 - DNA, 25 bp, Rattus norvegicus
tatcacggaagaggtcctgttcctc

SEQ ID NO: 615184 - DNA, 25 bp, Rattus norvegicus
gcggtaggccttggatatcacggaa

SEQ ID NO: 615185 - DNA, 25 bp, Rattus norvegicus
taggtcattgagcttccgcagcgcc

SEQ ID NO: 615186 - DNA, 25 bp, Rattus norvegicus
tgttgagtaccacgcggatcttgtc

SEQ ID NO: 615187 - DNA, 25 bp, Rattus norvegicus
atcagcccactggtggcttcgtcta

SEQ ID NO: 615188 - DNA, 25 bp, Rattus norvegicus
gcccatgttttctcggtaggtcttg

SEQ ID NO: 615189 - DNA, 25 bp, Rattus norvegicus
cactggtggcttcgtctaccttggt

SEQ ID NO: 615190 - DNA, 25 bp, Rattus norvegicus
ttttctcggtaggtcttgcgcagtg

SEQ ID NO: 615191 - DNA, 25 bp, Rattus norvegicus
cagaacccgctgatacaattcgtcc

SEQ ID NO: 615192 - DNA, 25 bp, Rattus norvegicus
tcttgcgcagtggtagacgtgggca

SEQ ID NO: 615193 - DNA, 25 bp, Rattus norvegicus
agctcccggatcagcccactggtgg

SEQ ID NO: 615194 - DNA, 25 bp, Rattus norvegicus
tgatacaattcgtcctccaccgctg

SEQ ID NO: 615195 - DNA, 25 bp, Rattus norvegicus
aggatcgcccatgttttctcggtag

SEQ ID NO: 615196 - DNA, 25 bp, Rattus norvegicus
tggcactaggatcgcccatgttttc

SEQ ID NO: 615197 - DNA, 25 bp, Rattus norvegicus
ctcagtggcactaggatcgcccatg

SEQ ID NO: 615198 - DNA, 25 bp, Rattus norvegicus
ctgtgcaccctcagtggcactagga

SEQ ID NO: 615199 - DNA, 25 bp, Rattus norvegicus
ggccgcccttcagaacccgctgata

SEQ ID NO: 615200 - DNA, 25 bp, Rattus norvegicus
cttcgtctaccttggtgggcagtgg

SEQ ID NO: 615201 - DNA, 25 bp, Rattus norvegicus
ccctgagggacgatcgcgctcgccc

SEQ ID NO: 615202 - DNA, 25 bp, Rattus norvegicus
agctgcctctctatggcccttggcg

SEQ ID NO: 615203 - DNA, 25 bp, Rattus norvegicus
tctcctccgttgcattgtatcccgg

SEQ ID NO: 615204 - DNA, 25 bp, Rattus norvegicus
ctcctccgttgcattgtatcccggg

SEQ ID NO: 615205 - DNA, 25 bp, Rattus norvegicus
cctccgttgcattgtatcccgggaa

SEQ ID NO: 615206 - DNA, 25 bp, Rattus norvegicus
tccgttgcattgtatcccgggaagg

SEQ ID NO: 615207 - DNA, 25 bp, Rattus norvegicus
ccgttgcattgtatcccgggaagga

SEQ ID NO: 615208 - DNA, 25 bp, Rattus norvegicus
atggatccagctgcctctctatggc

SEQ ID NO: 615209 - DNA, 25 bp, Rattus norvegicus
agatggatccagctgcctctctatg

SEQ ID NO: 615210 - DNA, 25 bp, Rattus norvegicus
ggagatggatccagctgcctctcta

SEQ ID NO: 615211 - DNA, 25 bp, Rattus norvegicus
gggagatggatccagctgcctctct

SEQ ID NO: 615212 - DNA, 25 bp, Rattus norvegicus
aaccggggcgcaaggtttgagatcg

SEQ ID NO: 615213 - DNA, 25 bp, Rattus norvegicus
cttggcgctccccagaaaaggcggg

SEQ ID NO: 615214 - DNA, 25 bp, Rattus norvegicus
gttgcattgtatcccgggaaggacc

SEQ ID NO: 615215 - DNA, 25 bp, Rattus norvegicus
aacattggggatgacccggactcca

SEQ ID NO: 615216 - DNA, 25 bp, Rattus norvegicus
agcgggcattttagcactgcgcagc

SEQ ID NO: 615217 - DNA, 25 bp, Rattus norvegicus
aggtctattcgcagagcacttggtg

SEQ ID NO: 615218 - DNA, 25 bp, Rattus norvegicus
atgcgcagggcacttcagaagattt

SEQ ID NO: 615219 - DNA, 25 bp, Rattus norvegicus
ctccgtggcccaagatagtggcttc

SEQ ID NO: 615220 - DNA, 25 bp, Rattus norvegicus
ggatccgtacgtgtccgcatccctg

SEQ ID NO: 615221 - DNA, 25 bp, Rattus norvegicus
acgcttggattcacaggtctattcg

SEQ ID NO: 615222 - DNA, 25 bp, Rattus norvegicus
cagccgcgcagatccgaagctcaaa

SEQ ID NO: 615223 - DNA, 25 bp, Rattus norvegicus
agagagcctgcttcttcatgcctgg

SEQ ID NO: 615224 - DNA, 25 bp, Rattus norvegicus
ggaccatggtcagccctgctagaga

SEQ ID NO: 615225 - DNA, 25 bp, Rattus norvegicus
ctctccgagcctggggattttgagc

SEQ ID NO: 615226 - DNA, 25 bp, Rattus norvegicus
cgtggcgtatcaagtctctccgagc

SEQ ID NO: 615227 - DNA, 25 bp, Rattus norvegicus
ttctggtgccgtaggtctgcaacct

SEQ ID NO: 615228 - DNA, 25 bp, Rattus norvegicus
ggacagtagtgtgctttcccgcatc

SEQ ID NO: 615229 - DNA, 25 bp, Rattus norvegicus
agtccttcttctccggcctctttgg

SEQ ID NO: 615230 - DNA, 25 bp, Rattus norvegicus
tcagctgatcagtgcttcccagttc

SEQ ID NO: 615231 - DNA, 25 bp, Rattus norvegicus
cggaacagatctatggagcctgctg

SEQ ID NO: 615232 - DNA, 25 bp, Rattus norvegicus
cctgctgattggttggaaggagtca

SEQ ID NO: 615233 - DNA, 25 bp, Rattus norvegicus
gcggtgcgagcttatgattggctta

SEQ ID NO: 615234 - DNA, 25 bp, Rattus norvegicus
attggcttacttggtgtcacgtggc

SEQ ID NO: 615235 - DNA, 25 bp, Rattus norvegicus
tctaggaggctagcagcgtcagacc

SEQ ID NO: 615236 - DNA, 25 bp, Rattus norvegicus
acgagagtgcttcgcagcttgaacc

SEQ ID NO: 615237 - DNA, 25 bp, Rattus norvegicus
gaaccctctggttggctctcacggt

SEQ ID NO: 615238 - DNA, 25 bp, Rattus norvegicus
tagcagacccgggtgacgtcaacgt

SEQ ID NO: 615239 - DNA, 25 bp, Rattus norvegicus
gaacgaaccttgaggcgtcacgtga

SEQ ID NO: 615240 - DNA, 25 bp, Rattus norvegicus
acgtcatggacacctccgggaagca

SEQ ID NO: 615241 - DNA, 25 bp, Rattus norvegicus
cacggttcacgtgggatagcagacc

SEQ ID NO: 615242 - DNA, 25 bp, Rattus norvegicus
tcccaggccggtaaccgtggatctg

SEQ ID NO: 615243 - DNA, 25 bp, Rattus norvegicus
gcctgtggccaaagagctgcaattc

SEQ ID NO: 615244 - DNA, 25 bp, Rattus norvegicus
gcttctcgtcgcagagcaacgtgta

SEQ ID NO: 615245 - DNA, 25 bp, Rattus norvegicus
cgccactcttaaaggcaaggtgctc

SEQ ID NO: 615246 - DNA, 25 bp, Rattus norvegicus
caaggtgctcggcttccgctatcaa

SEQ ID NO: 615247 - DNA, 25 bp, Rattus norvegicus
ttgctggccgccactcttaaaggca

SEQ ID NO: 615248 - DNA, 25 bp, Rattus norvegicus
cagaagggccctgtccactgcgaga

SEQ ID NO: 615249 - DNA, 25 bp, Rattus norvegicus
cctccgacagaaaatcaggcctgtg

SEQ ID NO: 615250 - DNA, 25 bp, Rattus norvegicus
aggacagcttcacgcgcttctcgtc

SEQ ID NO: 615251 - DNA, 25 bp, Rattus norvegicus
cgacagaaaatcaggcctgtggcca

SEQ ID NO: 615252 - DNA, 25 bp, Rattus norvegicus
ttccgctatcaagacctccgacaga

SEQ ID NO: 615253 - DNA, 25 bp, Rattus norvegicus
aagagctgcaattcaactacatccc

SEQ ID NO: 615254 - DNA, 25 bp, Rattus norvegicus
tcgcagagcaacgtgtatgggcttg

SEQ ID NO: 615255 - DNA, 25 bp, Rattus norvegicus
tccactgcgagaggacagcttcacg

SEQ ID NO: 615256 - DNA, 25 bp, Rattus norvegicus
gccgtggcagaagggccctgtccac

SEQ ID NO: 615257 - DNA, 25 bp, Rattus norvegicus
agcacccggataaggacctggagca

SEQ ID NO: 615258 - DNA, 25 bp, Rattus norvegicus
ggtgggcatcgccaagtactatgca

SEQ ID NO: 615259 - DNA, 25 bp, Rattus norvegicus
tgctgcaccagcagaagagccgtgc

SEQ ID NO: 615260 - DNA, 25 bp, Rattus norvegicus
ggcgcgaggtcatccagattcttaa

SEQ ID NO: 615261 - DNA, 25 bp, Rattus norvegicus
agcatcgagctggatggcacattcg

SEQ ID NO: 615262 - DNA, 25 bp, Rattus norvegicus
taaggacttaaagcagaagcacccg

SEQ ID NO: 615263 - DNA, 25 bp, Rattus norvegicus
gagacccgcccaagagcatcgagct

SEQ ID NO: 615264 - DNA, 25 bp, Rattus norvegicus
tggcggacaagcgactgctcttcta

SEQ ID NO: 615265 - DNA, 25 bp, Rattus norvegicus
gactgctcttctacaagtacgtgta

SEQ ID NO: 615266 - DNA, 25 bp, Rattus norvegicus
aagtacgtgtacaagcgctatcgca

SEQ ID NO: 615267 - DNA, 25 bp, Rattus norvegicus
accctcgcagcggaatcatcatcgg

SEQ ID NO: 615268 - DNA, 25 bp, Rattus norvegicus
gaagagccgtgccttctaccgcatc

SEQ ID NO: 615269 - DNA, 25 bp, Rattus norvegicus
cacattcgtgggcactgaggtccca

SEQ ID NO: 615270 - DNA, 25 bp, Rattus norvegicus
cgcatccaggccacgcggctgatga

SEQ ID NO: 615271 - DNA, 25 bp, Rattus norvegicus
tggcgcacgtggcaccgtacgcctt

SEQ ID NO: 615272 - DNA, 25 bp, Rattus norvegicus
cacttcttcgtgaggctgctgaacc

SEQ ID NO: 615273 - DNA, 25 bp, Rattus norvegicus
tcttcgaggaggacgagcacttctt

SEQ ID NO: 615274 - DNA, 25 bp, Rattus norvegicus
tcgacgacgacatcttcgaggagga

SEQ ID NO: 615275 - DNA, 25 bp, Rattus norvegicus
tgcgcatcggcatcatcgacgacga

SEQ ID NO: 615276 - DNA, 25 bp, Rattus norvegicus
tgaacctgcgtgtgggcgatgctca

SEQ ID NO: 615277 - DNA, 25 bp, Rattus norvegicus
cgatgctcagggcatgttcgagccc

SEQ ID NO: 615278 - DNA, 25 bp, Rattus norvegicus
tgctggccaccgtcaccattctgga

SEQ ID NO: 615279 - DNA, 25 bp, Rattus norvegicus
gtcaccattctggacgacgaccacg

SEQ ID NO: 615280 - DNA, 25 bp, Rattus norvegicus
cctgctgcatgtgagcgagtgcatg

SEQ ID NO: 615281 - DNA, 25 bp, Rattus norvegicus
ctaccgcacagtggacggcacggct

SEQ ID NO: 615282 - DNA, 25 bp, Rattus norvegicus
tggtgtgcactacgaggatgcttgt

SEQ ID NO: 615283 - DNA, 25 bp, Rattus norvegicus
ggacgacgaccacgcgggcatcttc

SEQ ID NO: 615284 - DNA, 25 bp, Rattus norvegicus
tcggcgatgacgagaccatgtaagc

SEQ ID NO: 615285 - DNA, 25 bp, Rattus norvegicus
tggaacccattttccgcaagaccga

SEQ ID NO: 615286 - DNA, 25 bp, Rattus norvegicus
gtcttcttagaaactgtcagcgctg

SEQ ID NO: 615287 - DNA, 25 bp, Rattus norvegicus
gaaaggcttccaacaccaggctgtg

SEQ ID NO: 615288 - DNA, 25 bp, Rattus norvegicus
cgcggttccgggacagaattttcat

SEQ ID NO: 615289 - DNA, 25 bp, Rattus norvegicus
gaggtgactcactctgcggccacag

SEQ ID NO: 615290 - DNA, 25 bp, Rattus norvegicus
tgggcgaagcggaaccgactttatc

SEQ ID NO: 615291 - DNA, 25 bp, Rattus norvegicus
gcctttgctcgagtatttgggacca

SEQ ID NO: 615292 - DNA, 25 bp, Rattus norvegicus
ccagtgtgcgggtaatcagagcgca

SEQ ID NO: 615293 - DNA, 25 bp, Rattus norvegicus
agcgcatactctcccttccggaata

SEQ ID NO: 615294 - DNA, 25 bp, Rattus norvegicus
tccggaataaatgttcccaagcgtc

SEQ ID NO: 615295 - DNA, 25 bp, Rattus norvegicus
gtcggtggagccacgctgcaaaagt

SEQ ID NO: 615296 - DNA, 25 bp, Rattus norvegicus
catctcagatttgaaagtgcggctc

SEQ ID NO: 615297 - DNA, 25 bp, Rattus norvegicus
ggccaaattcctgccctggcgacga

SEQ ID NO: 615298 - DNA, 25 bp, Rattus norvegicus
tgctgaagttcacccaggtggcggc

SEQ ID NO: 615299 - DNA, 25 bp, Rattus norvegicus
agccgagggacaccaagcctctgca

SEQ ID NO: 615300 - DNA, 25 bp, Rattus norvegicus
gtcacccttacctgagccggagatg

SEQ ID NO: 615301 - DNA, 25 bp, Rattus norvegicus
cgcaaagagctgtgctgtccgccgc

SEQ ID NO: 615302 - DNA, 25 bp, Rattus norvegicus
cgccatccgctttaggctccaggag

SEQ ID NO: 615303 - DNA, 25 bp, Rattus norvegicus
gacatctcagggctcctgccagctt

SEQ ID NO: 615304 - DNA, 25 bp, Rattus norvegicus
ctcgaggccgacgacaggtcgctct

SEQ ID NO: 615305 - DNA, 25 bp, Rattus norvegicus
cagggaagatcaccacactgcgacc

SEQ ID NO: 615306 - DNA, 25 bp, Rattus norvegicus
tgcccaccaacgtccagggaagatc

SEQ ID NO: 615307 - DNA, 25 bp, Rattus norvegicus
acgacagcttttgcccttgctctcg

SEQ ID NO: 615308 - DNA, 25 bp, Rattus norvegicus
cgatgtgaggacgacagcttttgcc

SEQ ID NO: 615309 - DNA, 25 bp, Rattus norvegicus
caagcctctgcagcccagcaggagg

SEQ ID NO: 615310 - DNA, 25 bp, Rattus norvegicus
tttgcacaggaaggagccgcctaca

SEQ ID NO: 615311 - DNA, 25 bp, Rattus norvegicus
cgcgcagaagagaggcgcacccact

SEQ ID NO: 615312 - DNA, 25 bp, Rattus norvegicus
ggcgccgcacaacctagcaggagtc

SEQ ID NO: 615313 - DNA, 25 bp, Rattus norvegicus
gccggccacacatcggcggcgagct

SEQ ID NO: 615314 - DNA, 25 bp, Rattus norvegicus
atgcggtgaacgtgttcctgggcct

SEQ ID NO: 615315 - DNA, 25 bp, Rattus norvegicus
ctccaatgcggtgaacgtgttcctg

SEQ ID NO: 615316 - DNA, 25 bp, Rattus norvegicus
acgtgaccggctccaatgcggtgaa

SEQ ID NO: 615317 - DNA, 25 bp, Rattus norvegicus
tcggtaacgtgaccggctccaatgc

SEQ ID NO: 615318 - DNA, 25 bp, Rattus norvegicus
cgtccatcggtaacgtgaccggctc

SEQ ID NO: 615319 - DNA, 25 bp, Rattus norvegicus
ccttcgaggtgcgtacaggcacgct

SEQ ID NO: 615320 - DNA, 25 bp, Rattus norvegicus
tgttcaccgtcttcgccttcgtggg

SEQ ID NO: 615321 - DNA, 25 bp, Rattus norvegicus
ctggccttctcggtcacactgttca

SEQ ID NO: 615322 - DNA, 25 bp, Rattus norvegicus
tcggtcacactgttcaccgtcttcg

SEQ ID NO: 615323 - DNA, 25 bp, Rattus norvegicus
tcttcgccttcgtgggcatcgcagt

SEQ ID NO: 615324 - DNA, 25 bp, Rattus norvegicus
agtgctcttgtaccggcgccggcca

SEQ ID NO: 615325 - DNA, 25 bp, Rattus norvegicus
atcgcagtgctcttgtaccggcgcc

SEQ ID NO: 615326 - DNA, 25 bp, Rattus norvegicus
tgggcatcgcagtgctcttgtaccg

SEQ ID NO: 615327 - DNA, 25 bp, Rattus norvegicus
ggttaagcgtctccgcgtgaacttc

SEQ ID NO: 615328 - DNA, 25 bp, Rattus norvegicus
acagcgggttaagcgtctccgcgtg

SEQ ID NO: 615329 - DNA, 25 bp, Rattus norvegicus
gcagacagcgggttaagcgtctccg

SEQ ID NO: 615330 - DNA, 25 bp, Rattus norvegicus
cgggttaagcgtctccgcgtgaact

SEQ ID NO: 615331 - DNA, 25 bp, Rattus norvegicus
aagcgtctccgcgtgaacttccgga

SEQ ID NO: 615332 - DNA, 25 bp, Rattus norvegicus
ctccggcagacagcgggttaagcgt

SEQ ID NO: 615333 - DNA, 25 bp, Rattus norvegicus
cgtctccgcgtgaacttccggatgt

SEQ ID NO: 615334 - DNA, 25 bp, Rattus norvegicus
aacttccggatgtgacacaggccgg

SEQ ID NO: 615335 - DNA, 25 bp, Rattus norvegicus
tccggatgtgacacaggccgggccc

SEQ ID NO: 615336 - DNA, 25 bp, Rattus norvegicus
gcgatccgcgggtcttggccactcg

SEQ ID NO: 615337 - DNA, 25 bp, Rattus norvegicus
atccgcgggtcttggccactcggag

SEQ ID NO: 615338 - DNA, 25 bp, Rattus norvegicus
gcgccggctcatggcccggagggta

SEQ ID NO: 615339 - DNA, 25 bp, Rattus norvegicus
ccaggccgtgacctcccgagcccag

SEQ ID NO: 615340 - DNA, 25 bp, Rattus norvegicus
cctcggggacctccggccgcgatga

SEQ ID NO: 615341 - DNA, 25 bp, Rattus norvegicus
tgcgggagaccacgtggatgcccaa

SEQ ID NO: 615342 - DNA, 25 bp, Rattus norvegicus
cacctccgtgctttgcgggagacca

SEQ ID NO: 615343 - DNA, 25 bp, Rattus norvegicus
agagccacctccgtgctttgcggga

SEQ ID NO: 615344 - DNA, 25 bp, Rattus norvegicus
tgcgcagagccacctccgtgctttg

SEQ ID NO: 615345 - DNA, 25 bp, Rattus norvegicus
gcgcttgcgcctgcgtagacagccg

SEQ ID NO: 615346 - DNA, 25 bp, Rattus norvegicus
cgccccggatcacgtgacagagacg

SEQ ID NO: 615347 - DNA, 25 bp, Rattus norvegicus
cgctctcgctaaccgccggcggaga

SEQ ID NO: 615348 - DNA, 25 bp, Rattus norvegicus
gcgccggctttcagctcacccgatc

SEQ ID NO: 615349 - DNA, 25 bp, Rattus norvegicus
tccttctccaccatggcgccggctt

SEQ ID NO: 615350 - DNA, 25 bp, Rattus norvegicus
ctgcctcctcctcgctgatgccgcc

SEQ ID NO: 615351 - DNA, 25 bp, Rattus norvegicus
gagaccacgtggatgcccaagaccc

SEQ ID NO: 615352 - DNA, 25 bp, Rattus norvegicus
ggatctgtcggtcatactgcgctgc

SEQ ID NO: 615353 - DNA, 25 bp, Rattus norvegicus
tgtcggtcatactgcgctgcctcct

SEQ ID NO: 615354 - DNA, 25 bp, Rattus norvegicus
agctcacccgatcccgctctcgcta

SEQ ID NO: 615355 - DNA, 25 bp, Rattus norvegicus
gatccgcttcacgttgcttcagtga

SEQ ID NO: 615356 - DNA, 25 bp, Rattus norvegicus
ctgggatcccttcactgacttcggc

SEQ ID NO: 615357 - DNA, 25 bp, Rattus norvegicus
tttaggtgggtctttgatccgcttc

SEQ ID NO: 615358 - DNA, 25 bp, Rattus norvegicus
gcttcagtgacctagatccttcttc

SEQ ID NO: 615359 - DNA, 25 bp, Rattus norvegicus
ggctctttccggctcattttagtct

SEQ ID NO: 615360 - DNA, 25 bp, Rattus norvegicus
ttctcagctgtgttcggttctttcc

SEQ ID NO: 615361 - DNA, 25 bp, Rattus norvegicus
tttgtgtcaattcctgaccgcggcg

SEQ ID NO: 615362 - DNA, 25 bp, Rattus norvegicus
ggaaggggacctctcgtcccgatga

SEQ ID NO: 615363 - DNA, 25 bp, Rattus norvegicus
tatgcccaatttccatcaggagccc

SEQ ID NO: 615364 - DNA, 25 bp, Rattus norvegicus
agccctggagagctgaagtgtgccc

SEQ ID NO: 615365 - DNA, 25 bp, Rattus norvegicus
cgcccaagcagtcctttttcgtgca

SEQ ID NO: 615366 - DNA, 25 bp, Rattus norvegicus
ctcaaaggaacgatggaggccgtgc

SEQ ID NO: 615367 - DNA, 25 bp, Rattus norvegicus
gtgacgcttcttcggcctcccagtt

SEQ ID NO: 615368 - DNA, 25 bp, Rattus norvegicus
ggctctttccggattatcgcaagtc

SEQ ID NO: 615369 - DNA, 25 bp, Rattus norvegicus
ttgagttgcgggcagatcaccaatg

SEQ ID NO: 615370 - DNA, 25 bp, Rattus norvegicus
gcagatcaccaatggccgcgtcgtt

SEQ ID NO: 615371 - DNA, 25 bp, Rattus norvegicus
ggccgcgtcgtttctcatgagtgat

SEQ ID NO: 615372 - DNA, 25 bp, Rattus norvegicus
ctcatgagtgatgtgacttccagcc

SEQ ID NO: 615373 - DNA, 25 bp, Rattus norvegicus
gtgacttccagcctacagtaggtcc

SEQ ID NO: 615374 - DNA, 25 bp, Rattus norvegicus
ccagcctacagtaggtccgtggggc

SEQ ID NO: 615375 - DNA, 25 bp, Rattus norvegicus
tccgagctggatcgagcggacgctt

SEQ ID NO: 615376 - DNA, 25 bp, Rattus norvegicus
gagcggacgcttggctcctccgcaa

SEQ ID NO: 615377 - DNA, 25 bp, Rattus norvegicus
tggctcctccgcaaggcacatgaga

SEQ ID NO: 615378 - DNA, 25 bp, Rattus norvegicus
aggcacatgagacaggtcagtggca

SEQ ID NO: 615379 - DNA, 25 bp, Rattus norvegicus
ccggggtcgtttgcgatacaagtag

SEQ ID NO: 615380 - DNA, 25 bp, Rattus norvegicus
tgcgatacaagtagaaggacactcc

SEQ ID NO: 615381 - DNA, 25 bp, Rattus norvegicus
ggacactccctgtgtgcacgtggga

SEQ ID NO: 615382 - DNA, 25 bp, Rattus norvegicus
tccgcaaggcacatgagacaggtca

SEQ ID NO: 615383 - DNA, 25 bp, Rattus norvegicus
tcagtccaagttgctctaggacctc

SEQ ID NO: 615384 - DNA, 25 bp, Rattus norvegicus
cgtcagctccacctgccggtgatgg

SEQ ID NO: 615385 - DNA, 25 bp, Rattus norvegicus
tcgaagacgctgctgcccgtcagct

SEQ ID NO: 615386 - DNA, 25 bp, Rattus norvegicus
tagtcgaagacgctgctgcccgtca

SEQ ID NO: 615387 - DNA, 25 bp, Rattus norvegicus
ggggtgtccaccagcgaggaggaag

SEQ ID NO: 615388 - DNA, 25 bp, Rattus norvegicus
ggccagtggttgcggccctcagtcc

SEQ ID NO: 615389 - DNA, 25 bp, Rattus norvegicus
tccaagttgctctaggacctccgag

SEQ ID NO: 615390 - DNA, 25 bp, Rattus norvegicus
agttgctctaggacctccgagtggt

SEQ ID NO: 615391 - DNA, 25 bp, Rattus norvegicus
tgctctaggacctccgagtggtccc

SEQ ID NO: 615392 - DNA, 25 bp, Rattus norvegicus
cccaggatggatgtagtcgaagacg

SEQ ID NO: 615393 - DNA, 25 bp, Rattus norvegicus
tggatgtagtcgaagacgctgctgc

SEQ ID NO: 615394 - DNA, 25 bp, Rattus norvegicus
tcagctccacctgccggtgatggag

SEQ ID NO: 615395 - DNA, 25 bp, Rattus norvegicus
atgtagtcgaagacgctgctgcccg

SEQ ID NO: 615396 - DNA, 25 bp, Rattus norvegicus
ggaagtggaggacacagaaggcggc

SEQ ID NO: 615397 - DNA, 25 bp, Rattus norvegicus
ttgcgggacttctctttgcgctgcg

SEQ ID NO: 615398 - DNA, 25 bp, Rattus norvegicus
gggaggcgctcccagagccgcaaac

SEQ ID NO: 615399 - DNA, 25 bp, Rattus norvegicus
cggaggtatgtgacgctaagacgca

SEQ ID NO: 615400 - DNA, 25 bp, Rattus norvegicus
gtgacgctaagacgcactatggacg

SEQ ID NO: 615401 - DNA, 25 bp, Rattus norvegicus
taagacgcactatggacgccttgtc

SEQ ID NO: 615402 - DNA, 25 bp, Rattus norvegicus
tggacgccttgtccagctgactgga

SEQ ID NO: 615403 - DNA, 25 bp, Rattus norvegicus
tccagctgactggagatggcaccgg

SEQ ID NO: 615404 - DNA, 25 bp, Rattus norvegicus
agggagcaacttggccagctcgaag

SEQ ID NO: 615405 - DNA, 25 bp, Rattus norvegicus
aacttggccagctcgaagaactcga

SEQ ID NO: 615406 - DNA, 25 bp, Rattus norvegicus
ccagctcgaagaactcgagattttc

SEQ ID NO: 615407 - DNA, 25 bp, Rattus norvegicus
agaactcgagattttcctttccgcg

SEQ ID NO: 615408 - DNA, 25 bp, Rattus norvegicus
cgcaaaccgacgcaggcggaggtat

SEQ ID NO: 615409 - DNA, 25 bp, Rattus norvegicus
agcgcgccgcgttgcgggacttctc

SEQ ID NO: 615410 - DNA, 25 bp, Rattus norvegicus
ggacttctctttgcgctgcgcctgc

SEQ ID NO: 615411 - DNA, 25 bp, Rattus norvegicus
cacgcggcgcgcatacggatcggac

SEQ ID NO: 615412 - DNA, 25 bp, Rattus norvegicus
agtcgcaggtggggctcagttccct

SEQ ID NO: 615413 - DNA, 25 bp, Rattus norvegicus
tgcgtgccaagcatgcccaagctgc

SEQ ID NO: 615414 - DNA, 25 bp, Rattus norvegicus
cggctcccgcataccaatgggcgca

SEQ ID NO: 615415 - DNA, 25 bp, Rattus norvegicus
gaagccgcggttcccaccctggcgc

SEQ ID NO: 615416 - DNA, 25 bp, Rattus norvegicus
tggtttggatgccttcctcagtttc

SEQ ID NO: 615417 - DNA, 25 bp, Rattus norvegicus
accaggagctggtttggatgccttc

SEQ ID NO: 615418 - DNA, 25 bp, Rattus norvegicus
agttccctgggggaagaatgtcttg

SEQ ID NO: 615419 - DNA, 25 bp, Rattus norvegicus
ctcgagaattcaggcgcgaaggagt

SEQ ID NO: 615420 - DNA, 25 bp, Rattus norvegicus
tcgaccgggactcgagaattcaggc

SEQ ID NO: 615421 - DNA, 25 bp, Rattus norvegicus
ggtcgccatctcgaccgggactcga

SEQ ID NO: 615422 - DNA, 25 bp, Rattus norvegicus
cctcggccaccgcttctgggatagg

SEQ ID NO: 615423 - DNA, 25 bp, Rattus norvegicus
gcacttaacttcacctcggccaccg

SEQ ID NO: 615424 - DNA, 25 bp, Rattus norvegicus
cccaagggtcaaaccaggagctggt

SEQ ID NO: 615425 - DNA, 25 bp, Rattus norvegicus
cacccgcagggatcccgacagggtt

SEQ ID NO: 615426 - DNA, 25 bp, Rattus norvegicus
cgcagacttcgagaccacggacagc

SEQ ID NO: 615427 - DNA, 25 bp, Rattus norvegicus
ctcgcagacttcgagaccacggaca

SEQ ID NO: 615428 - DNA, 25 bp, Rattus norvegicus
ggcggtctcgcagacttcgagacca

SEQ ID NO: 615429 - DNA, 25 bp, Rattus norvegicus
acggcggtctcgcagacttcgagac

SEQ ID NO: 615430 - DNA, 25 bp, Rattus norvegicus
ccacggcggtctcgcagacttcgag

SEQ ID NO: 615431 - DNA, 25 bp, Rattus norvegicus
cgtggaggggccgctccatagaccc

SEQ ID NO: 615432 - DNA, 25 bp, Rattus norvegicus
ccgacagggttacctggcctctggg

SEQ ID NO: 615433 - DNA, 25 bp, Rattus norvegicus
tcccgacagggttacctggcctctg

SEQ ID NO: 615434 - DNA, 25 bp, Rattus norvegicus
gatcccgacagggttacctggcctc

SEQ ID NO: 615435 - DNA, 25 bp, Rattus norvegicus
tcgagaccacggacagcggcagcga

SEQ ID NO: 615436 - DNA, 25 bp, Rattus norvegicus
cgcagggatcccgacagggttacct

SEQ ID NO: 615437 - DNA, 25 bp, Rattus norvegicus
gccaaaccttcaggcgtcccgcacc

SEQ ID NO: 615438 - DNA, 25 bp, Rattus norvegicus
cagggatcccgacagggttacctgg

SEQ ID NO: 615439 - DNA, 25 bp, Rattus norvegicus
gggcgcacgacaccaacatcacgga

SEQ ID NO: 615440 - DNA, 25 bp, Rattus norvegicus
ctataactcgagtgccgaggtggtg

SEQ ID NO: 615441 - DNA, 25 bp, Rattus norvegicus
cgctgacagctataactcgagtgcc

SEQ ID NO: 615442 - DNA, 25 bp, Rattus norvegicus
cgcagctcttcgctgacagctataa

SEQ ID NO: 615443 - DNA, 25 bp, Rattus norvegicus
gggcaacttttccgcggacgaggca

SEQ ID NO: 615444 - DNA, 25 bp, Rattus norvegicus
ccaacatcacggaggagaatgcgcg

SEQ ID NO: 615445 - DNA, 25 bp, Rattus norvegicus
accctggattgcagccgggcaactt

SEQ ID NO: 615446 - DNA, 25 bp, Rattus norvegicus
cccggcgcttgaccctggattgcag

SEQ ID NO: 615447 - DNA, 25 bp, Rattus norvegicus
accgccgctcttgatgctgtcgctg

SEQ ID NO: 615448 - DNA, 25 bp, Rattus norvegicus
tggccgttgtcaccgccgctcttga

SEQ ID NO: 615449 - DNA, 25 bp, Rattus norvegicus
ttttataatccgcagggcggtcgcg

SEQ ID NO: 615450 - DNA, 25 bp, Rattus norvegicus
gcggcggtgactgggttttataatc

SEQ ID NO: 615451 - DNA, 25 bp, Rattus norvegicus
ggtgatgttccagagcaccgcagcc

SEQ ID NO: 615452 - DNA, 25 bp, Rattus norvegicus
ccgaggtggtgatgttccagagcac

SEQ ID NO: 615453 - DNA, 25 bp, Rattus norvegicus
gccaggtcattgatggactgtttta

SEQ ID NO: 615454 - DNA, 25 bp, Rattus norvegicus
actgttttatcagcccaccgccgtg

SEQ ID NO: 615455 - DNA, 25 bp, Rattus norvegicus
ttgcgattttgatgtggtaagaacc

SEQ ID NO: 615456 - DNA, 25 bp, Rattus norvegicus
ttgatgtggtaagaaccgggcagta

SEQ ID NO: 615457 - DNA, 25 bp, Rattus norvegicus
aaccgggcagtacccgatgctatta

SEQ ID NO: 615458 - DNA, 25 bp, Rattus norvegicus
cccgatgctattagcccgttctgtg

SEQ ID NO: 615459 - DNA, 25 bp, Rattus norvegicus
tgtgcttcctttaatgccttcgttt

SEQ ID NO: 615460 - DNA, 25 bp, Rattus norvegicus
ccaggtctgcgaacgctgagtcaga

SEQ ID NO: 615461 - DNA, 25 bp, Rattus norvegicus
cgctgagtcagatacctggttctgc

SEQ ID NO: 615462 - DNA, 25 bp, Rattus norvegicus
gatacctggttctgcgctcttccgt

SEQ ID NO: 615463 - DNA, 25 bp, Rattus norvegicus
ctcttccgtgtgagcagctggacca

SEQ ID NO: 615464 - DNA, 25 bp, Rattus norvegicus
tgagcagctggaccaatcttattcc

SEQ ID NO: 615465 - DNA, 25 bp, Rattus norvegicus
tcttattccatgttgctctcatttg

SEQ ID NO: 615466 - DNA, 25 bp, Rattus norvegicus
gctctcatttgtcgccaggtcattg

SEQ ID NO: 615467 - DNA, 25 bp, Rattus norvegicus
tgcgcgcctgaggaaaatgccgcta

SEQ ID NO: 615468 - DNA, 25 bp, Rattus norvegicus
agcgcacctcgaggacagtagccca

SEQ ID NO: 615469 - DNA, 25 bp, Rattus norvegicus
cccggcgctgaagaaaaacctgtgg

SEQ ID NO: 615470 - DNA, 25 bp, Rattus norvegicus
tctacgttggccagcccggaagagt

SEQ ID NO: 615471 - DNA, 25 bp, Rattus norvegicus
gcagcccaatccaagctctacgttg

SEQ ID NO: 615472 - DNA, 25 bp, Rattus norvegicus
gcgtacccagcgacggagtcgattg

SEQ ID NO: 615473 - DNA, 25 bp, Rattus norvegicus
gggtacttagggctccatcccgctc

SEQ ID NO: 615474 - DNA, 25 bp, Rattus norvegicus
cctggatcttcagggcgggtactta

SEQ ID NO: 615475 - DNA, 25 bp, Rattus norvegicus
ctctgagaggcatggcctggatctt

SEQ ID NO: 615476 - DNA, 25 bp, Rattus norvegicus
cggctccaggagaaagccagctctg

SEQ ID NO: 615477 - DNA, 25 bp, Rattus norvegicus
gccagattcacacagcgcgaggaca

SEQ ID NO: 615478 - DNA, 25 bp, Rattus norvegicus
gccaggcgcgttgatacaagttacc

SEQ ID NO: 615479 - DNA, 25 bp, Rattus norvegicus
tggagaccctctcgcaagtgcgcgt

SEQ ID NO: 615480 - DNA, 25 bp, Rattus norvegicus
aggacacccgcgaactggcacagga

SEQ ID NO: 615481 - DNA, 25 bp, Rattus norvegicus
cacctgcgggagaggtcagcgtcac

SEQ ID NO: 615482 - DNA, 25 bp, Rattus norvegicus
gaacctcaagttcggtaggcgcagt

SEQ ID NO: 615483 - DNA, 25 bp, Rattus norvegicus
taggcgcagtcttgacacgcattca

SEQ ID NO: 615484 - DNA, 25 bp, Rattus norvegicus
cggagccaacttcgtgagcagcctc

SEQ ID NO: 615485 - DNA, 25 bp, Rattus norvegicus
gcctttgacgtctatgggcggagcc

SEQ ID NO: 615486 - DNA, 25 bp, Rattus norvegicus
tgttgcgcaggcctttgacgtctat

SEQ ID NO: 615487 - DNA, 25 bp, Rattus norvegicus
cccactgagctggtggtgttgcgca

SEQ ID NO: 615488 - DNA, 25 bp, Rattus norvegicus
atcttggacaacaccggcgccaggc

SEQ ID NO: 615489 - DNA, 25 bp, Rattus norvegicus
ccctacctgcgggactgtggacaga

SEQ ID NO: 615490 - DNA, 25 bp, Rattus norvegicus
ggtcactgacgatcgcacattttcg

SEQ ID NO: 615491 - DNA, 25 bp, Rattus norvegicus
acactgcccggcatccgggaaagcg

SEQ ID NO: 615492 - DNA, 25 bp, Rattus norvegicus
agcgccacaaacagcaacagccgga

SEQ ID NO: 615493 - DNA, 25 bp, Rattus norvegicus
acacgcattcaaggacgcctgcgcg

SEQ ID NO: 615494 - DNA, 25 bp, Rattus norvegicus
ttcgacagcaaagagtggcaggacc

SEQ ID NO: 615495 - DNA, 25 bp, Rattus norvegicus
cctgatgtttctgccgctactgctg

SEQ ID NO: 615496 - DNA, 25 bp, Rattus norvegicus
agcctggttcgaccaggccaagttc

SEQ ID NO: 615497 - DNA, 25 bp, Rattus norvegicus
tgccagcctggttcgaccaggccaa

SEQ ID NO: 615498 - DNA, 25 bp, Rattus norvegicus
gagtctctggacagacgcccgctgc

SEQ ID NO: 615499 - DNA, 25 bp, Rattus norvegicus
agcccttagctatgaccccacgtgg

SEQ ID NO: 615500 - DNA, 25 bp, Rattus norvegicus
gccgtgacagcccttagctatgacc

SEQ ID NO: 615501 - DNA, 25 bp, Rattus norvegicus
gctttcccagtgacttgcggttccc

SEQ ID NO: 615502 - DNA, 25 bp, Rattus norvegicus
gctactgctgctggcaacccggtac

SEQ ID NO: 615503 - DNA, 25 bp, Rattus norvegicus
ggaaggacagcgctaggcagcctct

SEQ ID NO: 615504 - DNA, 25 bp, Rattus norvegicus
taggcagcctctgcggctgacagaa

SEQ ID NO: 615505 - DNA, 25 bp, Rattus norvegicus
agcctctgcggctgacagaaaaggt

SEQ ID NO: 615506 - DNA, 25 bp, Rattus norvegicus
cccggctttcccagtgacttgcggt

SEQ ID NO: 615507 - DNA, 25 bp, Rattus norvegicus
ggggctcctgatgtttctgccgcta

SEQ ID NO: 615508 - DNA, 25 bp, Rattus norvegicus
tgctgctggcaacccggtaccgggc

SEQ ID NO: 615509 - DNA, 25 bp, Rattus norvegicus
acccgggcctctggggtccagacag

SEQ ID NO: 615510 - DNA, 25 bp, Rattus norvegicus
tcggtttggagctgacaagcttcct

SEQ ID NO: 615511 - DNA, 25 bp, Rattus norvegicus
cagttacagcgggacccgggcctct

SEQ ID NO: 615512 - DNA, 25 bp, Rattus norvegicus
cctctggggtccagacaggggtcgc

SEQ ID NO: 615513 - DNA, 25 bp, Rattus norvegicus
cagagggagggttcatatacggtcc

SEQ ID NO: 615514 - DNA, 25 bp, Rattus norvegicus
gggagcgtcgtaccggggacaggca

SEQ ID NO: 615515 - DNA, 25 bp, Rattus norvegicus
tttcggtttggagctgacaagcttc

SEQ ID NO: 615516 - DNA, 25 bp, Rattus norvegicus
aagcttcctcttgccgcggatgatc

SEQ ID NO: 615517 - DNA, 25 bp, Rattus norvegicus
ctcttgccgcggatgatccgggccg

SEQ ID NO: 615518 - DNA, 25 bp, Rattus norvegicus
cgcaggttctcggaattcgggtcag

SEQ ID NO: 615519 - DNA, 25 bp, Rattus norvegicus
caggttctcggaattcgggtcagga

SEQ ID NO: 615520 - DNA, 25 bp, Rattus norvegicus
gttctcggaattcgggtcaggaatg

SEQ ID NO: 615521 - DNA, 25 bp, Rattus norvegicus
ggttaggggctcgacgctgcgctgc

SEQ ID NO: 615522 - DNA, 25 bp, Rattus norvegicus
ggtttcggtttggagctgacaagct

SEQ ID NO: 615523 - DNA, 25 bp, Rattus norvegicus
tttatttctcccgactggaagatga

SEQ ID NO: 615524 - DNA, 25 bp, Rattus norvegicus
gtcaatattcttgtgcctcagctta

SEQ ID NO: 615525 - DNA, 25 bp, Rattus norvegicus
tgtgcctcagcttaccaaatgttgg

SEQ ID NO: 615526 - DNA, 25 bp, Rattus norvegicus
ctcagcttaccaaatgttggggttt

SEQ ID NO: 615527 - DNA, 25 bp, Rattus norvegicus
tggggtttttgagcttgacccacca

SEQ ID NO: 615528 - DNA, 25 bp, Rattus norvegicus
ttgagcttgacccaccatatctgtc

SEQ ID NO: 615529 - DNA, 25 bp, Rattus norvegicus
ccaccatatctgtctcaccagatta

SEQ ID NO: 615530 - DNA, 25 bp, Rattus norvegicus
atcaaagattttaggcgagtagtgg

SEQ ID NO: 615531 - DNA, 25 bp, Rattus norvegicus
attttaggcgagtagtggtggcaca

SEQ ID NO: 615532 - DNA, 25 bp, Rattus norvegicus
agccggctgccgctctaaagtcaat

SEQ ID NO: 615533 - DNA, 25 bp, Rattus norvegicus
tggtggcacaggttaaagtcaattt

SEQ ID NO: 615534 - DNA, 25 bp, Rattus norvegicus
cccgactggaagatgaccatcatta

SEQ ID NO: 615535 - DNA, 25 bp, Rattus norvegicus
agatgaccatcattacgagtggata

SEQ ID NO: 615536 - DNA, 25 bp, Rattus norvegicus
ggctgccgctctaaagtcaatattc

SEQ ID NO: 615537 - DNA, 25 bp, Rattus norvegicus
ggatcccaccgcgaactgtggctcg

SEQ ID NO: 615538 - DNA, 25 bp, Rattus norvegicus
tggccttggccctggcgctgaagcc

SEQ ID NO: 615539 - DNA, 25 bp, Rattus norvegicus
tctcttcggctctcggcgtggcctt

SEQ ID NO: 615540 - DNA, 25 bp, Rattus norvegicus
tgctctttttcctggtcaccacact

SEQ ID NO: 615541 - DNA, 25 bp, Rattus norvegicus
accctagcgcgctcggccgtttggg

SEQ ID NO: 615542 - DNA, 25 bp, Rattus norvegicus
tgcagccagtctggaccctagcgcg

SEQ ID NO: 615543 - DNA, 25 bp, Rattus norvegicus
cagcctgatcggaggtgcagccagt

SEQ ID NO: 615544 - DNA, 25 bp, Rattus norvegicus
gcgtctgctggagatgatcatcctg

SEQ ID NO: 615545 - DNA, 25 bp, Rattus norvegicus
agctgctgttgcgtctgctggagat

SEQ ID NO: 615546 - DNA, 25 bp, Rattus norvegicus
acgcgcgctttaccgctttcgcctt

SEQ ID NO: 615547 - DNA, 25 bp, Rattus norvegicus
acctgctggttctgctcaccgtggc

SEQ ID NO: 615548 - DNA, 25 bp, Rattus norvegicus
ttcccgggaccaagtgtgccgctgc

SEQ ID NO: 615549 - DNA, 25 bp, Rattus norvegicus
cgaaagcaggtggatgctgcagttc

SEQ ID NO: 615550 - DNA, 25 bp, Rattus norvegicus
gtggatgctgcagttcccgggacca

SEQ ID NO: 615551 - DNA, 25 bp, Rattus norvegicus
tagtcccacgggatgatgtcgccat

SEQ ID NO: 615552 - DNA, 25 bp, Rattus norvegicus
gggccacgaactctgtggctacata

SEQ ID NO: 615553 - DNA, 25 bp, Rattus norvegicus
ttcgctccagatgtcctggtgactc

SEQ ID NO: 615554 - DNA, 25 bp, Rattus norvegicus
agctgacgttcagtgccaggcaccg

SEQ ID NO: 615555 - DNA, 25 bp, Rattus norvegicus
tcgccatccaaagcgtcgcagcggg

SEQ ID NO: 615556 - DNA, 25 bp, Rattus norvegicus
tcaccaggcggataccaagagagcg

SEQ ID NO: 615557 - DNA, 25 bp, Rattus norvegicus
gcgggctctccttgctgcagccaaa

SEQ ID NO: 615558 - DNA, 25 bp, Rattus norvegicus
gttgcccacgtcctccaggtagatg

SEQ ID NO: 615559 - DNA, 25 bp, Rattus norvegicus
tccagcggccctcgtacaggtaggc

SEQ ID NO: 615560 - DNA, 25 bp, Rattus norvegicus
aggaaggaatccactagctccggca

SEQ ID NO: 615561 - DNA, 25 bp, Rattus norvegicus
tggctacatatgtctccgggcgcga

SEQ ID NO: 615562 - DNA, 25 bp, Rattus norvegicus
agatgcccagatctacgtcgtagtc

SEQ ID NO: 615563 - DNA, 25 bp, Rattus norvegicus
gtgtgtcgcccactaccgtaccgaa

SEQ ID NO: 615564 - DNA, 25 bp, Rattus norvegicus
ccgcgttgtcaaaagcctcaaattc

SEQ ID NO: 615565 - DNA, 25 bp, Rattus norvegicus
agtgggcacgcttcgaagccgagaa

SEQ ID NO: 615566 - DNA, 25 bp, Rattus norvegicus
cttcgaagccgagaaggcccgctgg

SEQ ID NO: 615567 - DNA, 25 bp, Rattus norvegicus
aagtgtgaatctgcgcgtccgcgca

SEQ ID NO: 615568 - DNA, 25 bp, Rattus norvegicus
gcacgcttcgaagccgagaaggccc

SEQ ID NO: 615569 - DNA, 25 bp, Rattus norvegicus
tgtgtaagtgtgaatctgcgcgtcc

SEQ ID NO: 615570 - DNA, 25 bp, Rattus norvegicus
aacacgagtgggcacgcttcgaagc

SEQ ID NO: 615571 - DNA, 25 bp, Rattus norvegicus
ctgcactttatccaacacgagtggg

SEQ ID NO: 615572 - DNA, 25 bp, Rattus norvegicus
tcctgcactttatccaacacgagtg

SEQ ID NO: 615573 - DNA, 25 bp, Rattus norvegicus
ggcatcctgcactttatccaacacg

SEQ ID NO: 615574 - DNA, 25 bp, Rattus norvegicus
tgcctggcatcctgcactttatcca

SEQ ID NO: 615575 - DNA, 25 bp, Rattus norvegicus
cggctcccaacccaacagccgcggc

SEQ ID NO: 615576 - DNA, 25 bp, Rattus norvegicus
tcgggcacggctcccaacccaacag

SEQ ID NO: 615577 - DNA, 25 bp, Rattus norvegicus
cctccatgatggaggagcgagcggc

SEQ ID NO: 615578 - DNA, 25 bp, Rattus norvegicus
cgcttcgaagccgagaaggcccgct

SEQ ID NO: 615579 - DNA, 25 bp, Rattus norvegicus
tgccctgcgttgattggctagctgc

SEQ ID NO: 615580 - DNA, 25 bp, Rattus norvegicus
tgagacttccttctgggccgccgcc

SEQ ID NO: 615581 - DNA, 25 bp, Rattus norvegicus
atgcgtgccagcctgacagctcagt

SEQ ID NO: 615582 - DNA, 25 bp, Rattus norvegicus
agctcagtctccttcaacgaccaag

SEQ ID NO: 615583 - DNA, 25 bp, Rattus norvegicus
gcgttgattggctagctgcgccatc

SEQ ID NO: 615584 - DNA, 25 bp, Rattus norvegicus
tagctgcgccatcgctcctgagact

SEQ ID NO: 615585 - DNA, 25 bp, Rattus norvegicus
gtaacgtcacggtgccctgcgttga

SEQ ID NO: 615586 - DNA, 25 bp, Rattus norvegicus
aggcccgccctgtaacgtcacggtg

SEQ ID NO: 615587 - DNA, 25 bp, Rattus norvegicus
atccaacttttctccaactttcgcg

SEQ ID NO: 615588 - DNA, 25 bp, Rattus norvegicus
tgtgcagaggaagcgctgacccttt

SEQ ID NO: 615589 - DNA, 25 bp, Rattus norvegicus
tttccaggctggactgtgcagagga

SEQ ID NO: 615590 - DNA, 25 bp, Rattus norvegicus
aaagtcaactttccaggctggactg

SEQ ID NO: 615591 - DNA, 25 bp, Rattus norvegicus
ggattgcggcgaaaagtcaactttc

SEQ ID NO: 615592 - DNA, 25 bp, Rattus norvegicus
cctcctcatgccgcggtggattgcg

SEQ ID NO: 615593 - DNA, 25 bp, Rattus norvegicus
ctccgagagaggcaggaataccgcg

SEQ ID NO: 615594 - DNA, 25 bp, Rattus norvegicus
gcagcggcgcgtagggccgcggcag

SEQ ID NO: 615595 - DNA, 25 bp, Rattus norvegicus
acgaggatgcggcagcggcgcgtag

SEQ ID NO: 615596 - DNA, 25 bp, Rattus norvegicus
agaggcaggaataccgcgtgcagca

SEQ ID NO: 615597 - DNA, 25 bp, Rattus norvegicus
tccgagagaggcaggaataccgcgt

SEQ ID NO: 615598 - DNA, 25 bp, Rattus norvegicus
gccctggaggagcagctggtgaggg

SEQ ID NO: 615599 - DNA, 25 bp, Rattus norvegicus
tggctccgagagaggcaggaatacc

SEQ ID NO: 615600 - DNA, 25 bp, Rattus norvegicus
ttggctccgagagaggcaggaatac

SEQ ID NO: 615601 - DNA, 25 bp, Rattus norvegicus
agttgcattggctccgagagaggca

SEQ ID NO: 615602 - DNA, 25 bp, Rattus norvegicus
ttctcgttcccggtgagcccggagc

SEQ ID NO: 615603 - DNA, 25 bp, Rattus norvegicus
cattggctccgagagaggcaggaat

SEQ ID NO: 615604 - DNA, 25 bp, Rattus norvegicus
agctggtgaggggtcgcctgtccgt

SEQ ID NO: 615605 - DNA, 25 bp, Rattus norvegicus
tctcgttcccggtgagcccggagcg

SEQ ID NO: 615606 - DNA, 25 bp, Rattus norvegicus
ctgcggggatggttggaaggcagcc

SEQ ID NO: 615607 - DNA, 25 bp, Rattus norvegicus
aggccagaaggctggagtcccactc

SEQ ID NO: 615608 - DNA, 25 bp, Rattus norvegicus
tgcttgctcccttgctgagactatc

SEQ ID NO: 615609 - DNA, 25 bp, Rattus norvegicus
agtcgagctctgtgcagctaggctc

SEQ ID NO: 615610 - DNA, 25 bp, Rattus norvegicus
cggaccaagctaaggatgcgcgatc

SEQ ID NO: 615611 - DNA, 25 bp, Rattus norvegicus
gtggccgctcagaaccctgctaagc

SEQ ID NO: 615612 - DNA, 25 bp, Rattus norvegicus
taaccagagcgcacacagttctttg

SEQ ID NO: 615613 - DNA, 25 bp, Rattus norvegicus
agcggctgggaaaaaggtcactctc

SEQ ID NO: 615614 - DNA, 25 bp, Rattus norvegicus
cgggcgcgtttcagacccgagacta

SEQ ID NO: 615615 - DNA, 25 bp, Rattus norvegicus
cctggcacagtcttggcctagcatg

SEQ ID NO: 615616 - DNA, 25 bp, Rattus norvegicus
gtcgcgcagtatcttcaggaagttc

SEQ ID NO: 615617 - DNA, 25 bp, Rattus norvegicus
aagttcttgctgatgctctgctcgc

SEQ ID NO: 615618 - DNA, 25 bp, Rattus norvegicus
tacgtcttctactgcctggccgagc

SEQ ID NO: 615619 - DNA, 25 bp, Rattus norvegicus
cggcgttcctgctggacccaaggaa

SEQ ID NO: 615620 - DNA, 25 bp, Rattus norvegicus
tgatcctagttcagcaccggtggcc

SEQ ID NO: 615621 - DNA, 25 bp, Rattus norvegicus
tcggtggcgatccacagctgagatc

SEQ ID NO: 615622 - DNA, 25 bp, Rattus norvegicus
acagctgagatcgacgcgcccgatg

SEQ ID NO: 615623 - DNA, 25 bp, Rattus norvegicus
ctcggccgtcggatgccgtctggat

SEQ ID NO: 615624 - DNA, 25 bp, Rattus norvegicus
cgcagtctgagaccagtctactggg

SEQ ID NO: 615625 - DNA, 25 bp, Rattus norvegicus
agcgagggcgagtcgcccgccttca

SEQ ID NO: 615626 - DNA, 25 bp, Rattus norvegicus
agaccagtctactgggccgcgcgca

SEQ ID NO: 615627 - DNA, 25 bp, Rattus norvegicus
caaagcggcgcgctcgcagtctgag

SEQ ID NO: 615628 - DNA, 25 bp, Rattus norvegicus
tccagcgactccgacggcagcggag

SEQ ID NO: 615629 - DNA, 25 bp, Rattus norvegicus
aggcacagtacatctcgggcgcgcc

SEQ ID NO: 615630 - DNA, 25 bp, Rattus norvegicus
tcgcctggtgaaggcacagtacatc

SEQ ID NO: 615631 - DNA, 25 bp, Rattus norvegicus
tggacggctacatctcggcgctcct

SEQ ID NO: 615632 - DNA, 25 bp, Rattus norvegicus
tgtacggctgcgcaggcagcgactc

SEQ ID NO: 615633 - DNA, 25 bp, Rattus norvegicus
cagcccacggccaagtggacgtgta

SEQ ID NO: 615634 - DNA, 25 bp, Rattus norvegicus
aagtggacgtgtaccctgcggctcc

SEQ ID NO: 615635 - DNA, 25 bp, Rattus norvegicus
agatccggggatgaaaaccagctgc

SEQ ID NO: 615636 - DNA, 25 bp, Rattus norvegicus
ctactggcggcctaggccagatccg

SEQ ID NO: 615637 - DNA, 25 bp, Rattus norvegicus
gagacgggtcgtcgccctgtctttc

SEQ ID NO: 615638 - DNA, 25 bp, Rattus norvegicus
cctgtctttccagctttaagtaagc

SEQ ID NO: 615639 - DNA, 25 bp, Rattus norvegicus
tccagctttaagtaagctgggtttc

SEQ ID NO: 615640 - DNA, 25 bp, Rattus norvegicus
agtaagctgggtttcctccctactg

SEQ ID NO: 615641 - DNA, 25 bp, Rattus norvegicus
aggcgccaggctcggcgcacgccca

SEQ ID NO: 615642 - DNA, 25 bp, Rattus norvegicus
gctgggtttcctccctactggcggc

SEQ ID NO: 615643 - DNA, 25 bp, Rattus norvegicus
cctaggccagatccggggatgaaaa

SEQ ID NO: 615644 - DNA, 25 bp, Rattus norvegicus
atccggggatgaaaaccagctgcgg

SEQ ID NO: 615645 - DNA, 25 bp, Rattus norvegicus
ctaggcgccggcagacaccgttctt

SEQ ID NO: 615646 - DNA, 25 bp, Rattus norvegicus
ggcgccggcagacaccgttcttcgg

SEQ ID NO: 615647 - DNA, 25 bp, Rattus norvegicus
cccaggccctggcacgtccggcgcg

SEQ ID NO: 615648 - DNA, 25 bp, Rattus norvegicus
aagctgggtttcctccctactggcg

SEQ ID NO: 615649 - DNA, 25 bp, Rattus norvegicus
atctctatccctcgcctgcaggtgt

SEQ ID NO: 615650 - DNA, 25 bp, Rattus norvegicus
ccgagaatcccttccgcgacaaacg

SEQ ID NO: 615651 - DNA, 25 bp, Rattus norvegicus
gcccgcaagacggtggagcaactga

SEQ ID NO: 615652 - DNA, 25 bp, Rattus norvegicus
ttggctttctgcgaaacgcacgcta

SEQ ID NO: 615653 - DNA, 25 bp, Rattus norvegicus
aagctggaggtgaacatcgatcgca

SEQ ID NO: 615654 - DNA, 25 bp, Rattus norvegicus
ggtgcatagaccgatgtgggaaata

SEQ ID NO: 615655 - DNA, 25 bp, Rattus norvegicus
ttgagggtctgcgttaggctccgtt

SEQ ID NO: 615656 - DNA, 25 bp, Rattus norvegicus
gatttggacgctcccgcggactaag

SEQ ID NO: 615657 - DNA, 25 bp, Rattus norvegicus
cccgcggactaagccagggtcaact

SEQ ID NO: 615658 - DNA, 25 bp, Rattus norvegicus
agccagggtcaactgcatctctatc

SEQ ID NO: 615659 - DNA, 25 bp, Rattus norvegicus
cagcggagctattggctttctgcga

SEQ ID NO: 615660 - DNA, 25 bp, Rattus norvegicus
aacgcacgctaaggatgacccactg

SEQ ID NO: 615661 - DNA, 25 bp, Rattus norvegicus
ggatgacccactggtgactcctgtc

SEQ ID NO: 615662 - DNA, 25 bp, Rattus norvegicus
tcgatcgcatgaaggtgcatagacc

SEQ ID NO: 615663 - DNA, 25 bp, Rattus norvegicus
gtccgcaaatagctcccgggtgcct

SEQ ID NO: 615664 - DNA, 25 bp, Rattus norvegicus
tgtccgtacaggagaccgaaaagtg

SEQ ID NO: 615665 - DNA, 25 bp, Rattus norvegicus
ggagtccaccactgttccagacggc

SEQ ID NO: 615666 - DNA, 25 bp, Rattus norvegicus
tatggaagagaaagtggagtccacc

SEQ ID NO: 615667 - DNA, 25 bp, Rattus norvegicus
tctctgagagaaggcgatatggaag

SEQ ID NO: 615668 - DNA, 25 bp, Rattus norvegicus
ccttggcccggagtctctgagagaa

SEQ ID NO: 615669 - DNA, 25 bp, Rattus norvegicus
gacctgggtccgtccgcaaatagct

SEQ ID NO: 615670 - DNA, 25 bp, Rattus norvegicus
cggcttactgatccggacctgggtc

SEQ ID NO: 615671 - DNA, 25 bp, Rattus norvegicus
cagcggagcagcaacgcttacggtc

SEQ ID NO: 615672 - DNA, 25 bp, Rattus norvegicus
tttgcgcagaggctgtagccagagc

SEQ ID NO: 615673 - DNA, 25 bp, Rattus norvegicus
cggcgctaggtgctcttcagaaacc

SEQ ID NO: 615674 - DNA, 25 bp, Rattus norvegicus
tcttccgtcaatctggcccggatct

SEQ ID NO: 615675 - DNA, 25 bp, Rattus norvegicus
cccaaacgtttctttgcgcagaggc

SEQ ID NO: 615676 - DNA, 25 bp, Rattus norvegicus
tggcccggatctctggcagaagcga

SEQ ID NO: 615677 - DNA, 25 bp, Rattus norvegicus
tgggacgatgctgtgtgacactttc

SEQ ID NO: 615678 - DNA, 25 bp, Rattus norvegicus
acggaggtcacacccatcggcgttt

SEQ ID NO: 615679 - DNA, 25 bp, Rattus norvegicus
gtgtgacactttcgccttcgctatg

SEQ ID NO: 615680 - DNA, 25 bp, Rattus norvegicus
aaacagctctttgctgggcctggcc

SEQ ID NO: 615681 - DNA, 25 bp, Rattus norvegicus
tggctctcagtcatccctacctgta

SEQ ID NO: 615682 - DNA, 25 bp, Rattus norvegicus
gctcatcctcttcgccatggctgtg

SEQ ID NO: 615683 - DNA, 25 bp, Rattus norvegicus
tacctgtacgcccagctggacgggc

SEQ ID NO: 615684 - DNA, 25 bp, Rattus norvegicus
tatgactttcttcggcctggcctcc

SEQ ID NO: 615685 - DNA, 25 bp, Rattus norvegicus
tcgccttcgctatgactttcttcgg

SEQ ID NO: 615686 - DNA, 25 bp, Rattus norvegicus
ccatcggcgtttgcagtgttggtca

SEQ ID NO: 615687 - DNA, 25 bp, Rattus norvegicus
tcactgggctggcagtgacggatct

SEQ ID NO: 615688 - DNA, 25 bp, Rattus norvegicus
atctgctgggcacgtgcttcttgag

SEQ ID NO: 615689 - DNA, 25 bp, Rattus norvegicus
ttgtggcctatgctcgaaacagctc

SEQ ID NO: 615690 - DNA, 25 bp, Rattus norvegicus
agcggtgcctggctctcagtcatcc

SEQ ID NO: 615691 - DNA, 25 bp, Rattus norvegicus
cttccctgcaatgcgtcaaactggg

SEQ ID NO: 615692 - DNA, 25 bp, Rattus norvegicus
acgcaactccgattggtccggcctt

SEQ ID NO: 615693 - DNA, 25 bp, Rattus norvegicus
actcaccatggcgaggcaccggtat

SEQ ID NO: 615694 - DNA, 25 bp, Rattus norvegicus
caccggtatccggagctcggggatc

SEQ ID NO: 615695 - DNA, 25 bp, Rattus norvegicus
gctgcactgcggcttcctacggatc

SEQ ID NO: 615696 - DNA, 25 bp, Rattus norvegicus
acagagcccggcgaagctgctgccg

SEQ ID NO: 615697 - DNA, 25 bp, Rattus norvegicus
cgctttcctctctggcggaagggca

SEQ ID NO: 615698 - DNA, 25 bp, Rattus norvegicus
agtgacgcgtccctgtgtgagccac

SEQ ID NO: 615699 - DNA, 25 bp, Rattus norvegicus
ctgtgtgagccacgccgctattgga

SEQ ID NO: 615700 - DNA, 25 bp, Rattus norvegicus
tcaaactggggcgagccaccgcacg

SEQ ID NO: 615701 - DNA, 25 bp, Rattus norvegicus
gtggcggaaatgagaacgcaactcc

SEQ ID NO: 615702 - DNA, 25 bp, Rattus norvegicus
tccgcgtcaggaccctgaggttcgc

SEQ ID NO: 615703 - DNA, 25 bp, Rattus norvegicus
ttggacccgcctcgtggcggaaatg

SEQ ID NO: 615704 - DNA, 25 bp, Rattus norvegicus
cgctgcgaggactactttccgtctc

SEQ ID NO: 615705 - DNA, 25 bp, Rattus norvegicus
gccagcccggagaacgtacacgtaa

SEQ ID NO: 615706 - DNA, 25 bp, Rattus norvegicus
ccacgcccaccaggtgcattgattg

SEQ ID NO: 615707 - DNA, 25 bp, Rattus norvegicus
gctccagactccgcgggagcacagg

SEQ ID NO: 615708 - DNA, 25 bp, Rattus norvegicus
tctagacctggctacgcgcttcgct

SEQ ID NO: 615709 - DNA, 25 bp, Rattus norvegicus
accaggtgcattgattgccgtcctc

SEQ ID NO: 615710 - DNA, 25 bp, Rattus norvegicus
gcattgattgccgtcctcctgtacc

SEQ ID NO: 615711 - DNA, 25 bp, Rattus norvegicus
gccgcgtccagtcgtctgggttgtc

SEQ ID NO: 615712 - DNA, 25 bp, Rattus norvegicus
gaacgtacacgtaagccccctgcag

SEQ ID NO: 615713 - DNA, 25 bp, Rattus norvegicus
tgcagaccctcggattgccccaggg

SEQ ID NO: 615714 - DNA, 25 bp, Rattus norvegicus
caggggaagatcgttgcgtcgtccc

SEQ ID NO: 615715 - DNA, 25 bp, Rattus norvegicus
ccgctgagcgtctagacctggctac

SEQ ID NO: 615716 - DNA, 25 bp, Rattus norvegicus
actgaggctgccgttccgcagcggc

SEQ ID NO: 615717 - DNA, 25 bp, Rattus norvegicus
caggcgcagactgaggctgccgttc

SEQ ID NO: 615718 - DNA, 25 bp, Rattus norvegicus
accagccgcgtccagtcgtctgggt

SEQ ID NO: 615719 - DNA, 25 bp, Rattus norvegicus
aatgccgttagtgccgcagatgtca

SEQ ID NO: 615720 - DNA, 25 bp, Rattus norvegicus
accgaggaccatgcggggaacaaca

SEQ ID NO: 615721 - DNA, 25 bp, Rattus norvegicus
tgctgttcccaagtctacccgcgga

SEQ ID NO: 615722 - DNA, 25 bp, Rattus norvegicus
aagccgcgcgccaagagagcgcgca

SEQ ID NO: 615723 - DNA, 25 bp, Rattus norvegicus
agcgcgcaccggctccaaaggcttg

SEQ ID NO: 615724 - DNA, 25 bp, Rattus norvegicus
cgggcacgcaaaacccgcaggggtg

SEQ ID NO: 615725 - DNA, 25 bp, Rattus norvegicus
cggaaagaaagcacgcaggggccca

SEQ ID NO: 615726 - DNA, 25 bp, Rattus norvegicus
gagcggggcttcaaccgaggaccat

SEQ ID NO: 615727 - DNA, 25 bp, Rattus norvegicus
aagaaagcacgcaggggcccaaggc

SEQ ID NO: 615728 - DNA, 25 bp, Rattus norvegicus
gggacagccagctgctgttcccaag

SEQ ID NO: 615729 - DNA, 25 bp, Rattus norvegicus
gaccatgcggggaacaacaaaaaga

SEQ ID NO: 615730 - DNA, 25 bp, Rattus norvegicus
gtgccgcagatgtcactacgagccc

SEQ ID NO: 615731 - DNA, 25 bp, Rattus norvegicus
cgggcgcccaaatgccgttagtgcc

SEQ ID NO: 615732 - DNA, 25 bp, Rattus norvegicus
gcggtgtcaccccagagaagaaagc

SEQ ID NO: 615733 - DNA, 25 bp, Rattus norvegicus
gccatctttgtctgcagagtcctcc

SEQ ID NO: 615734 - DNA, 25 bp, Rattus norvegicus
tccaccgcagactgagcgcaaggtc

SEQ ID NO: 615735 - DNA, 25 bp, Rattus norvegicus
agactgagcgcaaggtcagtttgga

SEQ ID NO: 615736 - DNA, 25 bp, Rattus norvegicus
ctgggcggaggcctttaagcgcctc

SEQ ID NO: 615737 - DNA, 25 bp, Rattus norvegicus
gcctttaagcgcctcgccatattga

SEQ ID NO: 615738 - DNA, 25 bp, Rattus norvegicus
taagcgcctcgccatattgaacggc

SEQ ID NO: 615739 - DNA, 25 bp, Rattus norvegicus
tcgccatattgaacggccacgctga

SEQ ID NO: 615740 - DNA, 25 bp, Rattus norvegicus
gaacggccacgctgagccatctttg

SEQ ID NO: 615741 - DNA, 25 bp, Rattus norvegicus
acgctgagccatctttgtctgcaga

SEQ ID NO: 615742 - DNA, 25 bp, Rattus norvegicus
caagggagcagcgatcggagctcgt

SEQ ID NO: 615743 - DNA, 25 bp, Rattus norvegicus
acttcatcccggtgtctggggcaag

SEQ ID NO: 615744 - DNA, 25 bp, Rattus norvegicus
actttcaacttcatcccggtgtctg

SEQ ID NO: 615745 - DNA, 25 bp, Rattus norvegicus
acgaactttcaacttcatcccggtg

SEQ ID NO: 615746 - DNA, 25 bp, Rattus norvegicus
gcagagtcctcccacgaactttcaa

SEQ ID NO: 615747 - DNA, 25 bp, Rattus norvegicus
ggcctgtgtcttgagctcctctgcc

SEQ ID NO: 615748 - DNA, 25 bp, Rattus norvegicus
cacaagtgtcgtaaagcgcgggccc

SEQ ID NO: 615749 - DNA, 25 bp, Rattus norvegicus
gccgctgccgcacaagtgtcgtaaa

SEQ ID NO: 615750 - DNA, 25 bp, Rattus norvegicus
ccgaaccgtcgcgaaggagtgccga

SEQ ID NO: 615751 - DNA, 25 bp, Rattus norvegicus
ggcaccaggccgaaccgtcgcgaag

SEQ ID NO: 615752 - DNA, 25 bp, Rattus norvegicus
ctccgccatcgccatgccgcaaagc

SEQ ID NO: 615753 - DNA, 25 bp, Rattus norvegicus
gggctcagcacactcagtccgctcg

SEQ ID NO: 615754 - DNA, 25 bp, Rattus norvegicus
gtgtcttgagctcctctgcccgctt

SEQ ID NO: 615755 - DNA, 25 bp, Rattus norvegicus
tttgaagtagtcgttggcctgtgtc

SEQ ID NO: 615756 - DNA, 25 bp, Rattus norvegicus
ggccggacgcacctttgaagtagtc

SEQ ID NO: 615757 - DNA, 25 bp, Rattus norvegicus
ggctactcagtagtgcctgcccggc

SEQ ID NO: 615758 - DNA, 25 bp, Rattus norvegicus
ctcgcgccgggctactcagtagtgc

SEQ ID NO: 615759 - DNA, 25 bp, Rattus norvegicus
tctgccgtccatccttggccttctc

SEQ ID NO: 615760 - DNA, 25 bp, Rattus norvegicus
tctgcccgcttcagagtgccttcgg

SEQ ID NO: 615761 - DNA, 25 bp, Rattus norvegicus
gcacgcatctcagccatgtccaagg

SEQ ID NO: 615762 - DNA, 25 bp, Rattus norvegicus
ttttaccagatgaccggccgcgact

SEQ ID NO: 615763 - DNA, 25 bp, Rattus norvegicus
tgcgtgacttttaccggcccttcaa

SEQ ID NO: 615764 - DNA, 25 bp, Rattus norvegicus
cactgcctgggcaagactaagggcc

SEQ ID NO: 615765 - DNA, 25 bp, Rattus norvegicus
aagggcttcccgtgcctcaagaagg

SEQ ID NO: 615766 - DNA, 25 bp, Rattus norvegicus
ctacttcaaccagaccaagggcttc

SEQ ID NO: 615767 - DNA, 25 bp, Rattus norvegicus
gcatcatcaccgacaagcacttcta

SEQ ID NO: 615768 - DNA, 25 bp, Rattus norvegicus
gatttcctgggcctcaagcgcatca

SEQ ID NO: 615769 - DNA, 25 bp, Rattus norvegicus
cgctcggccagatgctcttcgtgag

SEQ ID NO: 615770 - DNA, 25 bp, Rattus norvegicus
gatcggtctgtacgccaagcacctg

SEQ ID NO: 615771 - DNA, 25 bp, Rattus norvegicus
ggagcgccatccagatcggtctgta

SEQ ID NO: 615772 - DNA, 25 bp, Rattus norvegicus
gcgggcctcatagacacgtcctgga

SEQ ID NO: 615773 - DNA, 25 bp, Rattus norvegicus
gcttcgagagcctgacgttccgcaa

SEQ ID NO: 615774 - DNA, 25 bp, Rattus norvegicus
tgaccagggccatctcggactacac

SEQ ID NO: 615775 - DNA, 25 bp, Rattus norvegicus
gcggtgcatgcgcaagtagctgatt

SEQ ID NO: 615776 - DNA, 25 bp, Rattus norvegicus
aggccttgtccaggtgcgcgctgac

SEQ ID NO: 615777 - DNA, 25 bp, Rattus norvegicus
aagtagctgattgtgaggcgcatga

SEQ ID NO: 615778 - DNA, 25 bp, Rattus norvegicus
agtctcgcctagagagcggatcccg

SEQ ID NO: 615779 - DNA, 25 bp, Rattus norvegicus
tccagcactcgaaggggcggagtct

SEQ ID NO: 615780 - DNA, 25 bp, Rattus norvegicus
cgactggtccagcactcgaaggggc

SEQ ID NO: 615781 - DNA, 25 bp, Rattus norvegicus
tgaacccagggctccgactggtcca

SEQ ID NO: 615782 - DNA, 25 bp, Rattus norvegicus
gcgccagttggtacagcacctccgt

SEQ ID NO: 615783 - DNA, 25 bp, Rattus norvegicus
acgtgggacacctccgcttggcgtt

SEQ ID NO: 615784 - DNA, 25 bp, Rattus norvegicus
cggcaggtcgcacgtgggacacctc

SEQ ID NO: 615785 - DNA, 25 bp, Rattus norvegicus
acctgtggaaaggaaatggcacgcg

SEQ ID NO: 615786 - DNA, 25 bp, Rattus norvegicus
cggtgctcgacctgtggaaaggaaa

SEQ ID NO: 615787 - DNA, 25 bp, Rattus norvegicus
ttccgcagctcggtgctcgacctgt

SEQ ID NO: 615788 - DNA, 25 bp, Rattus norvegicus
aggcgcatgatggaggccttgtcca

SEQ ID NO: 615789 - DNA, 25 bp, Rattus norvegicus
tgggtacaacgcctaccttacacca

SEQ ID NO: 615790 - DNA, 25 bp, Rattus norvegicus
tgagtcggttagtgctcgtgcctat

SEQ ID NO: 615791 - DNA, 25 bp, Rattus norvegicus
ctgagtcggttagtgctcgtgccta

SEQ ID NO: 615792 - DNA, 25 bp, Rattus norvegicus
tctgagtcggttagtgctcgtgcct

SEQ ID NO: 615793 - DNA, 25 bp, Rattus norvegicus
tctctgagtcggttagtgctcgtgc

SEQ ID NO: 615794 - DNA, 25 bp, Rattus norvegicus
ctctctgagtcggttagtgctcgtg

SEQ ID NO: 615795 - DNA, 25 bp, Rattus norvegicus
cactctctgagtcggttagtgctcg

SEQ ID NO: 615796 - DNA, 25 bp, Rattus norvegicus
ccactctctgagtcggttagtgctc

SEQ ID NO: 615797 - DNA, 25 bp, Rattus norvegicus
gccactctctgagtcggttagtgct

SEQ ID NO: 615798 - DNA, 25 bp, Rattus norvegicus
gggccactctctgagtcggttagtg

SEQ ID NO: 615799 - DNA, 25 bp, Rattus norvegicus
gcaaagagactgtttttgggtacaa

SEQ ID NO: 615800 - DNA, 25 bp, Rattus norvegicus
cgcaaagagactgtttttgggtaca

SEQ ID NO: 615801 - DNA, 25 bp, Rattus norvegicus
cgcgcaaagagactgtttttgggta

SEQ ID NO: 615802 - DNA, 25 bp, Rattus norvegicus
ggccactctctgagtcggttagtgc

SEQ ID NO: 615803 - DNA, 25 bp, Rattus norvegicus
ctacggggccagctattgggccagc

SEQ ID NO: 615804 - DNA, 25 bp, Rattus norvegicus
attgtccgcagcagccgtactaccc

SEQ ID NO: 615805 - DNA, 25 bp, Rattus norvegicus
ttgggccagcgctacgggccactct

SEQ ID NO: 615806 - DNA, 25 bp, Rattus norvegicus
gctattgggccagcgctacgggcca

SEQ ID NO: 615807 - DNA, 25 bp, Rattus norvegicus
cagctattgggccagcgctacgggc

SEQ ID NO: 615808 - DNA, 25 bp, Rattus norvegicus
gggccagctattgggccagcgctac

SEQ ID NO: 615809 - DNA, 25 bp, Rattus norvegicus
tacctgaggctacggggccagctat

SEQ ID NO: 615810 - DNA, 25 bp, Rattus norvegicus
agtttcggacccagtatatccgccg

SEQ ID NO: 615811 - DNA, 25 bp, Rattus norvegicus
ccacagtttcggacccagtatatcc

SEQ ID NO: 615812 - DNA, 25 bp, Rattus norvegicus
gcagcagccgtactacccttgatcg

SEQ ID NO: 615813 - DNA, 25 bp, Rattus norvegicus
tttccacagtttcggacccagtata

SEQ ID NO: 615814 - DNA, 25 bp, Rattus norvegicus
cagtacctgaggctacggggccagc

SEQ ID NO: 615815 - DNA, 25 bp, Rattus norvegicus
tccacagtttcggacccagtatatc

SEQ ID NO: 615816 - DNA, 25 bp, Rattus norvegicus
cacagtttcggacccagtatatccg

SEQ ID NO: 615817 - DNA, 25 bp, Rattus norvegicus
atagcaggccgaggtccaccgcagc

SEQ ID NO: 615818 - DNA, 25 bp, Rattus norvegicus
gacgccaagcgggtcaccctgcgga

SEQ ID NO: 615819 - DNA, 25 bp, Rattus norvegicus
cagctcccgcttctctgacgccaag

SEQ ID NO: 615820 - DNA, 25 bp, Rattus norvegicus
ccgacccgccagagcctcctctcgg

SEQ ID NO: 615821 - DNA, 25 bp, Rattus norvegicus
agcgactcggcttcctggcgagctg

SEQ ID NO: 615822 - DNA, 25 bp, Rattus norvegicus
cgctcttgccgtaactccagctcta

SEQ ID NO: 615823 - DNA, 25 bp, Rattus norvegicus
ctccctcacctccttagctagtctg

SEQ ID NO: 615824 - DNA, 25 bp, Rattus norvegicus
aggtccatagcaggccgaggtccac

SEQ ID NO: 615825 - DNA, 25 bp, Rattus norvegicus
acagggaccgctgaggtccatagca

SEQ ID NO: 615826 - DNA, 25 bp, Rattus norvegicus
cagattgcgctctgacgcctttacc

SEQ ID NO: 615827 - DNA, 25 bp, Rattus norvegicus
ctgcggaaggaaaacagggaccgct

SEQ ID NO: 615828 - DNA, 25 bp, Rattus norvegicus
cctcctcgagctgcggaaggaaaac

SEQ ID NO: 615829 - DNA, 25 bp, Rattus norvegicus
gcctttacctcctcgagctgcggaa

SEQ ID NO: 615830 - DNA, 25 bp, Rattus norvegicus
cgacaatcctggctgcggcggccag

SEQ ID NO: 615831 - DNA, 25 bp, Rattus norvegicus
cagcttgcataggttctggcgtcca

SEQ ID NO: 615832 - DNA, 25 bp, Rattus norvegicus
ctctgtgaaatctccagcttgcata

SEQ ID NO: 615833 - DNA, 25 bp, Rattus norvegicus
tgaagaggcgttcctaacacgtgtg

SEQ ID NO: 615834 - DNA, 25 bp, Rattus norvegicus
ttagtctattttgaagaggcgttcc

SEQ ID NO: 615835 - DNA, 25 bp, Rattus norvegicus
cgccttccgaagtttgcaattagtc

SEQ ID NO: 615836 - DNA, 25 bp, Rattus norvegicus
cataagtcaaaacgaacgcccgtca

SEQ ID NO: 615837 - DNA, 25 bp, Rattus norvegicus
ggccttacaggcagtcatgtttcca

SEQ ID NO: 615838 - DNA, 25 bp, Rattus norvegicus
gccgaagtttcagttccgcccacat

SEQ ID NO: 615839 - DNA, 25 bp, Rattus norvegicus
ctaacacgtgtgaggagatcgccaa

SEQ ID NO: 615840 - DNA, 25 bp, Rattus norvegicus
tccacctgcgtgaaaggacctgtgc

SEQ ID NO: 615841 - DNA, 25 bp, Rattus norvegicus
cacttctgattggtagggccttaca

SEQ ID NO: 615842 - DNA, 25 bp, Rattus norvegicus
cgtatatcgggagcgacaacatagc

SEQ ID NO: 615843 - DNA, 25 bp, Rattus norvegicus
cacatccgggcttctcacttctgat

SEQ ID NO: 615844 - DNA, 25 bp, Rattus norvegicus
catagcgcaataaagactctgtgaa

SEQ ID NO: 615845 - DNA, 25 bp, Rattus norvegicus
cgcagtgatcgacccaatgagttga

SEQ ID NO: 615846 - DNA, 25 bp, Rattus norvegicus
gggacggtcctcactgcgccctgaa

SEQ ID NO: 615847 - DNA, 25 bp, Rattus norvegicus
gaccgcacacgagacaacttctacg

SEQ ID NO: 615848 - DNA, 25 bp, Rattus norvegicus
tggaaaagttatccgaccgcacacg

SEQ ID NO: 615849 - DNA, 25 bp, Rattus norvegicus
ggtcagaagaaatctggaaaagtta

SEQ ID NO: 615850 - DNA, 25 bp, Rattus norvegicus
caatgagttgaggtaaggacccttc

SEQ ID NO: 615851 - DNA, 25 bp, Rattus norvegicus
cctgaaattaaaaatcgcagtgatc

SEQ ID NO: 615852 - DNA, 25 bp, Rattus norvegicus
tgagcatgtcgcgaacctgaaatta

SEQ ID NO: 615853 - DNA, 25 bp, Rattus norvegicus
tgtcgaggtttcacttgagcatgtc

SEQ ID NO: 615854 - DNA, 25 bp, Rattus norvegicus
aatgcgaatccgtgtcgaggtttca

SEQ ID NO: 615855 - DNA, 25 bp, Rattus norvegicus
tgcaactgggaaatgcgaatccgtg

SEQ ID NO: 615856 - DNA, 25 bp, Rattus norvegicus
tgtcctttacctacatgcaactggg

SEQ ID NO: 615857 - DNA, 25 bp, Rattus norvegicus
gcgccctgaacgtgtcctttaccta

SEQ ID NO: 615858 - DNA, 25 bp, Rattus norvegicus
gtggatccggggtcagaagaaatct

SEQ ID NO: 615859 - DNA, 25 bp, Rattus norvegicus
tcctggcgtcctacacgggtgacgc

SEQ ID NO: 615860 - DNA, 25 bp, Rattus norvegicus
gatctccaagaagggcgagttcctg

SEQ ID NO: 615861 - DNA, 25 bp, Rattus norvegicus
aacacgttggccagctacggctaca

SEQ ID NO: 615862 - DNA, 25 bp, Rattus norvegicus
atcagcacggcgctcaacacgttgg

SEQ ID NO: 615863 - DNA, 25 bp, Rattus norvegicus
ggcaccgacctgctggcaatcagca

SEQ ID NO: 615864 - DNA, 25 bp, Rattus norvegicus
ctcaacatcagctacgccaacgtgg

SEQ ID NO: 615865 - DNA, 25 bp, Rattus norvegicus
gcgccatcgtgcagaaggtacagga

SEQ ID NO: 615866 - DNA, 25 bp, Rattus norvegicus
tgcacaaggccgtgagcgccatcgt

SEQ ID NO: 615867 - DNA, 25 bp, Rattus norvegicus
gcgaacccgagcaggtgcacaaggc

SEQ ID NO: 615868 - DNA, 25 bp, Rattus norvegicus
gcatcaacctgcaggagcgcgtggt

SEQ ID NO: 615869 - DNA, 25 bp, Rattus norvegicus
tcgcagaagcccgagggcatcaacc

SEQ ID NO: 615870 - DNA, 25 bp, Rattus norvegicus
cacggcgggactgatcatcggtaag

SEQ ID NO: 615871 - DNA, 25 bp, Rattus norvegicus
aaccggcgggtcaccatcacgggca

SEQ ID NO: 615872 - DNA, 25 bp, Rattus norvegicus
tacaggaagacccacagagcagcag

SEQ ID NO: 615873 - DNA, 25 bp, Rattus norvegicus
atgcgcgctgtagatatgcacatgc

SEQ ID NO: 615874 - DNA, 25 bp, Rattus norvegicus
gaggccgcagaagccgaagccctga

SEQ ID NO: 615875 - DNA, 25 bp, Rattus norvegicus
gcatgcgcgttgactcccgatgcta

SEQ ID NO: 615876 - DNA, 25 bp, Rattus norvegicus
tcagggtgtctggagacagcgttcc

SEQ ID NO: 615877 - DNA, 25 bp, Rattus norvegicus
acgcagttctagctgtcagggtgtc

SEQ ID NO: 615878 - DNA, 25 bp, Rattus norvegicus
tgagaagcacggctgagcgaacgca

SEQ ID NO: 615879 - DNA, 25 bp, Rattus norvegicus
tgcgcttgcgccgtgctgagaagca

SEQ ID NO: 615880 - DNA, 25 bp, Rattus norvegicus
aggcaaccggcagttctgcgcttgc

SEQ ID NO: 615881 - DNA, 25 bp, Rattus norvegicus
cttctggtaaagcaaggcaaccggc

SEQ ID NO: 615882 - DNA, 25 bp, Rattus norvegicus
ctgcgcagttatggccttctggtaa

SEQ ID NO: 615883 - DNA, 25 bp, Rattus norvegicus
cgctaagtgtgcgactgcgcagtta

SEQ ID NO: 615884 - DNA, 25 bp, Rattus norvegicus
cagggaacctatttcagcgctaagt

SEQ ID NO: 615885 - DNA, 25 bp, Rattus norvegicus
tgcacatgcgcaattgggcacaaga

SEQ ID NO: 615886 - DNA, 25 bp, Rattus norvegicus
tgggcacaagagaacagggaaccta

SEQ ID NO: 615887 - DNA, 25 bp, Rattus norvegicus
ccagatcttgatccgggaggtgcgc

SEQ ID NO: 615888 - DNA, 25 bp, Rattus norvegicus
gacagcatcgccaccaagatcaacg

SEQ ID NO: 615889 - DNA, 25 bp, Rattus norvegicus
atcaacggcatcaccagctggaagc

SEQ ID NO: 615890 - DNA, 25 bp, Rattus norvegicus
ccaggaggttcagaagcgttggaac

SEQ ID NO: 615891 - DNA, 25 bp, Rattus norvegicus
cgttggaacgacttcaagcgccgca

SEQ ID NO: 615892 - DNA, 25 bp, Rattus norvegicus
ttcaagcgccgcaccaaggagaagc

SEQ ID NO: 615893 - DNA, 25 bp, Rattus norvegicus
ggagactattttcgccatcctgggg

SEQ ID NO: 615894 - DNA, 25 bp, Rattus norvegicus
gccgcaggcttcaaccgctagtaca

SEQ ID NO: 615895 - DNA, 25 bp, Rattus norvegicus
tcagaggaccgcaggcaggatcgac

SEQ ID NO: 615896 - DNA, 25 bp, Rattus norvegicus
tccttcgaggagaaccagatcttga

SEQ ID NO: 615897 - DNA, 25 bp, Rattus norvegicus
agccacttttgcaccggagaccaga

SEQ ID NO: 615898 - DNA, 25 bp, Rattus norvegicus
acctctgattgcactcagcaccttg

SEQ ID NO: 615899 - DNA, 25 bp, Rattus norvegicus
tgtcacctacgaggaagcacctctg

SEQ ID NO: 615900 - DNA, 25 bp, Rattus norvegicus
ccgctagtacacaacggtatgtgtt

SEQ ID NO: 615901 - DNA, 25 bp, Rattus norvegicus
ccgattcaagaaggaccatgggctg

SEQ ID NO: 615902 - DNA, 25 bp, Rattus norvegicus
ccggaccgctatgacagggctactt

SEQ ID NO: 615903 - DNA, 25 bp, Rattus norvegicus
tgcgacctgcccaagatgccgtggg

SEQ ID NO: 615904 - DNA, 25 bp, Rattus norvegicus
cgggcttcaagtacctcgaatatga

SEQ ID NO: 615905 - DNA, 25 bp, Rattus norvegicus
ccctggcctcatcgggcttcaagta

SEQ ID NO: 615906 - DNA, 25 bp, Rattus norvegicus
cacgcagggctttgcttggctccat

SEQ ID NO: 615907 - DNA, 25 bp, Rattus norvegicus
gctcgtccacttttcggctccgatt

SEQ ID NO: 615908 - DNA, 25 bp, Rattus norvegicus
tgccttcgccggctttggagtacac

SEQ ID NO: 615909 - DNA, 25 bp, Rattus norvegicus
tgggacgggtatttgcctttgatgc

SEQ ID NO: 615910 - DNA, 25 bp, Rattus norvegicus
tgcccgccctcctggctatgagttt

SEQ ID NO: 615911 - DNA, 25 bp, Rattus norvegicus
agctcttcaccgagtatccctgtgg

SEQ ID NO: 615912 - DNA, 25 bp, Rattus norvegicus
atccctgtggttctggcaatgtgta

SEQ ID NO: 615913 - DNA, 25 bp, Rattus norvegicus
gtggctcgccagatgtttcatgatg

SEQ ID NO: 615914 - DNA, 25 bp, Rattus norvegicus
tgacgctggcacctggcttaagccc

SEQ ID NO: 615915 - DNA, 25 bp, Rattus norvegicus
tgcgacagaaatagagggacccgcc

SEQ ID NO: 615916 - DNA, 25 bp, Rattus norvegicus
gaaatagagggacccgcctgccagg

SEQ ID NO: 615917 - DNA, 25 bp, Rattus norvegicus
cagaaatagagggacccgcctgcca

SEQ ID NO: 615918 - DNA, 25 bp, Rattus norvegicus
cgacagaaatagagggacccgcctg

SEQ ID NO: 615919 - DNA, 25 bp, Rattus norvegicus
gactgcgacagaaatagagggaccc

SEQ ID NO: 615920 - DNA, 25 bp, Rattus norvegicus
gcaaggcgggactgcgacagaaata

SEQ ID NO: 615921 - DNA, 25 bp, Rattus norvegicus
acggctgacaactgggagccagcaa

SEQ ID NO: 615922 - DNA, 25 bp, Rattus norvegicus
ggagaagccagaaaccgcagggctt

SEQ ID NO: 615923 - DNA, 25 bp, Rattus norvegicus
ggaggaattccccaggacagccagc

SEQ ID NO: 615924 - DNA, 25 bp, Rattus norvegicus
ggcttcctgcttcgggccggcgacc

SEQ ID NO: 615925 - DNA, 25 bp, Rattus norvegicus
aaccgcagggcttcctgcttcgggc

SEQ ID NO: 615926 - DNA, 25 bp, Rattus norvegicus
agccagaaaccgcagggcttcctgc

SEQ ID NO: 615927 - DNA, 25 bp, Rattus norvegicus
ccagcctggtgggacggctgacaac

SEQ ID NO: 615928 - DNA, 25 bp, Rattus norvegicus
cgccggggagaagccagaaaccgca

SEQ ID NO: 615929 - DNA, 25 bp, Rattus norvegicus
cgtcgacaccgggaaagcaggaata

SEQ ID NO: 615930 - DNA, 25 bp, Rattus norvegicus
gcgctgctctctacgtcttctcgga

SEQ ID NO: 615931 - DNA, 25 bp, Rattus norvegicus
ggggcccgaacaccgtgtacctgca

SEQ ID NO: 615932 - DNA, 25 bp, Rattus norvegicus
cgacacctgcgcacgagggagaagc

SEQ ID NO: 615933 - DNA, 25 bp, Rattus norvegicus
ctgattggtcagttccgccatgcgg

SEQ ID NO: 615934 - DNA, 25 bp, Rattus norvegicus
ccttatgattggatacggcgctttg

SEQ ID NO: 615935 - DNA, 25 bp, Rattus norvegicus
cgagctccaagcttccttatgattg

SEQ ID NO: 615936 - DNA, 25 bp, Rattus norvegicus
cctagattgacaggctccgagctcc

SEQ ID NO: 615937 - DNA, 25 bp, Rattus norvegicus
gacgttctcgttttcgcttactcta

SEQ ID NO: 615938 - DNA, 25 bp, Rattus norvegicus
tgacagtatccggaaaacgtcgaca

SEQ ID NO: 615939 - DNA, 25 bp, Rattus norvegicus
gttccgcctccgacaagtgacagta

SEQ ID NO: 615940 - DNA, 25 bp, Rattus norvegicus
tacttgcactccgagaagttccgcc

SEQ ID NO: 615941 - DNA, 25 bp, Rattus norvegicus
gcttactctacgtcggcctagattg

SEQ ID NO: 615942 - DNA, 25 bp, Rattus norvegicus
cgtcttctcggaatacaacaggtca

SEQ ID NO: 615943 - DNA, 25 bp, Rattus norvegicus
cccgagttcagacctgaggcataca

SEQ ID NO: 615944 - DNA, 25 bp, Rattus norvegicus
tcggccaggtcatgggcctccatct

SEQ ID NO: 615945 - DNA, 25 bp, Rattus norvegicus
agcgcttcggtctctctacgggcac

SEQ ID NO: 615946 - DNA, 25 bp, Rattus norvegicus
ggaaccgagcgcttcggtctctcta

SEQ ID NO: 615947 - DNA, 25 bp, Rattus norvegicus
tccatcttcactgagcccagcatcc

SEQ ID NO: 615948 - DNA, 25 bp, Rattus norvegicus
gcctccgggtagtagctccactcgg

SEQ ID NO: 615949 - DNA, 25 bp, Rattus norvegicus
ggtcatgggcctccatcttcactga

SEQ ID NO: 615950 - DNA, 25 bp, Rattus norvegicus
caggcgccttgggaggcagccactt

SEQ ID NO: 615951 - DNA, 25 bp, Rattus norvegicus
ctgaggcatacagcccgggagtccc

SEQ ID NO: 615952 - DNA, 25 bp, Rattus norvegicus
tagtagctccactcggccaggtcat

SEQ ID NO: 615953 - DNA, 25 bp, Rattus norvegicus
tcatgggcctccatcttcactgagc

SEQ ID NO: 615954 - DNA, 25 bp, Rattus norvegicus
cagccactttttatagccgggacac

SEQ ID NO: 615955 - DNA, 25 bp, Rattus norvegicus
gcttcggtctctctacgggcactcg

SEQ ID NO: 615956 - DNA, 25 bp, Rattus norvegicus
ccttgggaggcagccactttttata

SEQ ID NO: 615957 - DNA, 25 bp, Rattus norvegicus
ctagtgcagcgcctgcgctgtgtca

SEQ ID NO: 615958 - DNA, 25 bp, Rattus norvegicus
cgcggtgtcggactccatttcccgg

SEQ ID NO: 615959 - DNA, 25 bp, Rattus norvegicus
acggaccgcggtgtcggactccatt

SEQ ID NO: 615960 - DNA, 25 bp, Rattus norvegicus
cctactagtgcagcgcctgcgctgt

SEQ ID NO: 615961 - DNA, 25 bp, Rattus norvegicus
ggaccgctgggaactccatttccca

SEQ ID NO: 615962 - DNA, 25 bp, Rattus norvegicus
ctcgaaggccggaaatggcggccgc

SEQ ID NO: 615963 - DNA, 25 bp, Rattus norvegicus
agtgcagcgcctgcgctgtgtcacg

SEQ ID NO: 615964 - DNA, 25 bp, Rattus norvegicus
cccagaaggcatggcgctcgaaggc

SEQ ID NO: 615965 - DNA, 25 bp, Rattus norvegicus
tttcccagaaggcatggcgctcgaa

SEQ ID NO: 615966 - DNA, 25 bp, Rattus norvegicus
gcgcctgcgcagcttggactacatt

SEQ ID NO: 615967 - DNA, 25 bp, Rattus norvegicus
gttcccatttccgtccggcgcctgc

SEQ ID NO: 615968 - DNA, 25 bp, Rattus norvegicus
tcccagaagcctccgttcccatttc

SEQ ID NO: 615969 - DNA, 25 bp, Rattus norvegicus
ctgccgacgcggcacgccttagggg

SEQ ID NO: 615970 - DNA, 25 bp, Rattus norvegicus
ggcggccctactagtgcagcgcctg

SEQ ID NO: 615971 - DNA, 25 bp, Rattus norvegicus
ccggccatcttcatcagcatggacg

SEQ ID NO: 615972 - DNA, 25 bp, Rattus norvegicus
cagaagcccacaggcgtcggagcgc

SEQ ID NO: 615973 - DNA, 25 bp, Rattus norvegicus
tcagtgtcctcgacacccttggtgg

SEQ ID NO: 615974 - DNA, 25 bp, Rattus norvegicus
ctcgacacccttggtggggccagca

SEQ ID NO: 615975 - DNA, 25 bp, Rattus norvegicus
cccggctgaggaggttatggaatac

SEQ ID NO: 615976 - DNA, 25 bp, Rattus norvegicus
ataccgggaggaaggtcctgaatgc

SEQ ID NO: 615977 - DNA, 25 bp, Rattus norvegicus
gaggaaggtcctgaatgcgagaccc

SEQ ID NO: 615978 - DNA, 25 bp, Rattus norvegicus
tcatcagcatggacgacgactcagg

SEQ ID NO: 615979 - DNA, 25 bp, Rattus norvegicus
catggacgacgactcagggctggcc

SEQ ID NO: 615980 - DNA, 25 bp, Rattus norvegicus
tcaggacctcatcggccttcgattg

SEQ ID NO: 615981 - DNA, 25 bp, Rattus norvegicus
tcggccttcgattggctcaggagaa

SEQ ID NO: 615982 - DNA, 25 bp, Rattus norvegicus
agaaggccttgaagcggcagctcga

SEQ ID NO: 615983 - DNA, 25 bp, Rattus norvegicus
gaacagaagcagaagcccacaggcg

SEQ ID NO: 615984 - DNA, 25 bp, Rattus norvegicus
cggcagctcgaagaagaacagaagc

SEQ ID NO: 615985 - DNA, 25 bp, Rattus norvegicus
ggccaactatctgcgcgcacaaatt

SEQ ID NO: 615986 - DNA, 25 bp, Rattus norvegicus
gcttctaccagttcggcgaggagga

SEQ ID NO: 615987 - DNA, 25 bp, Rattus norvegicus
tgcgcgcacaaattgcgcgcatctc

SEQ ID NO: 615988 - DNA, 25 bp, Rattus norvegicus
agcccgctgggcttctaccagttcg

SEQ ID NO: 615989 - DNA, 25 bp, Rattus norvegicus
agccgcagtggaagccgccgccagt

SEQ ID NO: 615990 - DNA, 25 bp, Rattus norvegicus
cggcaacgaggccaactatctgcgc

SEQ ID NO: 615991 - DNA, 25 bp, Rattus norvegicus
ggcttcctggacactccggtcatca

SEQ ID NO: 615992 - DNA, 25 bp, Rattus norvegicus
caaaaagttcttcaccggcttcctg

SEQ ID NO: 615993 - DNA, 25 bp, Rattus norvegicus
gtgcgcgcgcaagatcaaaaagttc

SEQ ID NO: 615994 - DNA, 25 bp, Rattus norvegicus
tgacgcccgcgcagatcgtgtgcgc

SEQ ID NO: 615995 - DNA, 25 bp, Rattus norvegicus
caaatacctgtacttcgtgtgcaac

SEQ ID NO: 615996 - DNA, 25 bp, Rattus norvegicus
acgccgtgcccaagccgcagtggaa

SEQ ID NO: 615997 - DNA, 25 bp, Rattus norvegicus
agaaggtagtggacgccgtgcccaa

SEQ ID NO: 615998 - DNA, 25 bp, Rattus norvegicus
tacttcgtgtgcaacgagccgggcc

SEQ ID NO: 615999 - DNA, 25 bp, Rattus norvegicus
gcaaacggttcccagggcgatgttg

SEQ ID NO: 616000 - DNA, 25 bp, Rattus norvegicus
tcgcgtcgaccacgcctacatcttg

SEQ ID NO: 616001 - DNA, 25 bp, Rattus norvegicus
gttcccaacagtcacgcctcgtagc

SEQ ID NO: 616002 - DNA, 25 bp, Rattus norvegicus
ctgggtgccaatcgtagaggcgtca

SEQ ID NO: 616003 - DNA, 25 bp, Rattus norvegicus
cccagggcgatgttgttagggtcta

SEQ ID NO: 616004 - DNA, 25 bp, Rattus norvegicus
gcgagcatctgtcgcgtcgaccacg

SEQ ID NO: 616005 - DNA, 25 bp, Rattus norvegicus
ttgctgggcaaacggttcccagggc

SEQ ID NO: 616006 - DNA, 25 bp, Rattus norvegicus
acagttccagaaccgttacctcagc

SEQ ID NO: 616007 - DNA, 25 bp, Rattus norvegicus
gcctccgcgtctgggtgccaatcgt

SEQ ID NO: 616008 - DNA, 25 bp, Rattus norvegicus
agaaccgttacctcagcaactgtcc

SEQ ID NO: 616009 - DNA, 25 bp, Rattus norvegicus
ggtgccagccctgcaacttccggct

SEQ ID NO: 616010 - DNA, 25 bp, Rattus norvegicus
gtagaggcgtcacccggacgacgac

SEQ ID NO: 616011 - DNA, 25 bp, Rattus norvegicus
gccaatcgtagaggcgtcacccgga

SEQ ID NO: 616012 - DNA, 25 bp, Rattus norvegicus
gtagccaaccacacgcgagcatctg

SEQ ID NO: 616013 - DNA, 25 bp, Rattus norvegicus
tccggagcaactgaggtgccagacg

SEQ ID NO: 616014 - DNA, 25 bp, Rattus norvegicus
atcgcctccggagcaactgaggtgc

SEQ ID NO: 616015 - DNA, 25 bp, Rattus norvegicus
ccgtgggatcgcctccggagcaact

SEQ ID NO: 616016 - DNA, 25 bp, Rattus norvegicus
ggcgtcatctgcgtcattctaccgc

SEQ ID NO: 616017 - DNA, 25 bp, Rattus norvegicus
ctctggcgtcatctgcgtcattcta

SEQ ID NO: 616018 - DNA, 25 bp, Rattus norvegicus
gcctggtgtcatctctggcgtcatc

SEQ ID NO: 616019 - DNA, 25 bp, Rattus norvegicus
gaaaagctgcttcgctgtgcccggc

SEQ ID NO: 616020 - DNA, 25 bp, Rattus norvegicus
gagggcagaaaagctgcttcgctgt

SEQ ID NO: 616021 - DNA, 25 bp, Rattus norvegicus
accagatgggatctgagcgggtaat

SEQ ID NO: 616022 - DNA, 25 bp, Rattus norvegicus
cgctaccgtgttaccagatgggatc

SEQ ID NO: 616023 - DNA, 25 bp, Rattus norvegicus
ggagatgctcgctaccgtgttacca

SEQ ID NO: 616024 - DNA, 25 bp, Rattus norvegicus
gcagcagggagatgctcgctaccgt

SEQ ID NO: 616025 - DNA, 25 bp, Rattus norvegicus
gaccgaaccggtcctgatccggcat

SEQ ID NO: 616026 - DNA, 25 bp, Rattus norvegicus
ggactggaccgaaccggtcctgatc

SEQ ID NO: 616027 - DNA, 25 bp, Rattus norvegicus
gcagtcgcgccaccgcccttcttcg

SEQ ID NO: 616028 - DNA, 25 bp, Rattus norvegicus
tccggaaccgagacctggaggcgca

SEQ ID NO: 616029 - DNA, 25 bp, Rattus norvegicus
aaccgagacctggaggcgcatgttc

SEQ ID NO: 616030 - DNA, 25 bp, Rattus norvegicus
acctggaggcgcatgttcggcagct

SEQ ID NO: 616031 - DNA, 25 bp, Rattus norvegicus
gcgcatgttcggcagctacaggagc

SEQ ID NO: 616032 - DNA, 25 bp, Rattus norvegicus
atgttcggcagctacaggagcggat

SEQ ID NO: 616033 - DNA, 25 bp, Rattus norvegicus
gagcggatggagatgctgcaggccc

SEQ ID NO: 616034 - DNA, 25 bp, Rattus norvegicus
ccaggagctgcaggcgagtccctca

SEQ ID NO: 616035 - DNA, 25 bp, Rattus norvegicus
gagctgcaggcgagtccctcacgca

SEQ ID NO: 616036 - DNA, 25 bp, Rattus norvegicus
gtccctcacgcactcccagccagga

SEQ ID NO: 616037 - DNA, 25 bp, Rattus norvegicus
cccagccaggaggacgccgggtgga

SEQ ID NO: 616038 - DNA, 25 bp, Rattus norvegicus
atggggcacgttgggtgtatgaacc

SEQ ID NO: 616039 - DNA, 25 bp, Rattus norvegicus
agtccaggctgggacaccgcagtcg

SEQ ID NO: 616040 - DNA, 25 bp, Rattus norvegicus
cgttgggtgtatgaaccctggggca

SEQ ID NO: 616041 - DNA, 25 bp, Rattus norvegicus
cggagcgtctacgtggcagcgatcc

SEQ ID NO: 616042 - DNA, 25 bp, Rattus norvegicus
cagcggggtgaatatgccgagctct

SEQ ID NO: 616043 - DNA, 25 bp, Rattus norvegicus
ttccagcggggtgaatatgccgagc

SEQ ID NO: 616044 - DNA, 25 bp, Rattus norvegicus
ccttccagcggggtgaatatgccga

SEQ ID NO: 616045 - DNA, 25 bp, Rattus norvegicus
cgcgggccctagtggccttccagcg

SEQ ID NO: 616046 - DNA, 25 bp, Rattus norvegicus
cgtctacgtggcagcgatccggtgc

SEQ ID NO: 616047 - DNA, 25 bp, Rattus norvegicus
acgccggccgcttgagccgcttcct

SEQ ID NO: 616048 - DNA, 25 bp, Rattus norvegicus
catgcgtgtgcgaggccctgctgca

SEQ ID NO: 616049 - DNA, 25 bp, Rattus norvegicus
cttcgcttctcgcccgagcaggtgg

SEQ ID NO: 616050 - DNA, 25 bp, Rattus norvegicus
ctggccttcgcttctcgcccgagca

SEQ ID NO: 616051 - DNA, 25 bp, Rattus norvegicus
accgaggcgcccactggccttcgct

SEQ ID NO: 616052 - DNA, 25 bp, Rattus norvegicus
tctccacgcgagaccgggaccgagg

SEQ ID NO: 616053 - DNA, 25 bp, Rattus norvegicus
ccagggtctccacgcgagaccggga

SEQ ID NO: 616054 - DNA, 25 bp, Rattus norvegicus
ctacgtggcagcgatccggtgctgc

SEQ ID NO: 616055 - DNA, 25 bp, Rattus norvegicus
gcgacagcgcgaccgtactgggacc

SEQ ID NO: 616056 - DNA, 25 bp, Rattus norvegicus
ggaccggccctcatccaaggtggct

SEQ ID NO: 616057 - DNA, 25 bp, Rattus norvegicus
gtggagcgccctgcaaaaggtgagg

SEQ ID NO: 616058 - DNA, 25 bp, Rattus norvegicus
accggcggtggagcgccctgcaaaa

SEQ ID NO: 616059 - DNA, 25 bp, Rattus norvegicus
gaccggccctcatccaaggtggctg

SEQ ID NO: 616060 - DNA, 25 bp, Rattus norvegicus
acagcgcgaccgtactgggaccggc

SEQ ID NO: 616061 - DNA, 25 bp, Rattus norvegicus
ccctccttggcgtcggcgagtgcat

SEQ ID NO: 616062 - DNA, 25 bp, Rattus norvegicus
tctgcgcgagtgacccttcacaccc

SEQ ID NO: 616063 - DNA, 25 bp, Rattus norvegicus
cctccttggcgtcggcgagtgcatg

SEQ ID NO: 616064 - DNA, 25 bp, Rattus norvegicus
agtctgcgcgagtgacccttcacac

SEQ ID NO: 616065 - DNA, 25 bp, Rattus norvegicus
gagtctgcgcgagtgacccttcaca

SEQ ID NO: 616066 - DNA, 25 bp, Rattus norvegicus
tggagtctgcgcgagtgacccttca

SEQ ID NO: 616067 - DNA, 25 bp, Rattus norvegicus
ctgctggagtctgcgcgagtgaccc

SEQ ID NO: 616068 - DNA, 25 bp, Rattus norvegicus
ccggccctcatccaaggtggctgct

SEQ ID NO: 616069 - DNA, 25 bp, Rattus norvegicus
tgcaaaatggcgttaagtctcgact

SEQ ID NO: 616070 - DNA, 25 bp, Rattus norvegicus
tcctagggatgcagaccgcgttcct

SEQ ID NO: 616071 - DNA, 25 bp, Rattus norvegicus
gggtgcgactcaaacgactcccgtc

SEQ ID NO: 616072 - DNA, 25 bp, Rattus norvegicus
gcagctctaacacgtgctcctgttc

SEQ ID NO: 616073 - DNA, 25 bp, Rattus norvegicus
aggctgtcgcgcgaagtcaccagag

SEQ ID NO: 616074 - DNA, 25 bp, Rattus norvegicus
aaggactccgaagggttctggcagc

SEQ ID NO: 616075 - DNA, 25 bp, Rattus norvegicus
tgggctcacgcttcgacagtccgaa

SEQ ID NO: 616076 - DNA, 25 bp, Rattus norvegicus
gacttctgctttggcactgggctca

SEQ ID NO: 616077 - DNA, 25 bp, Rattus norvegicus
agtctcgacttctgctttggcactg

SEQ ID NO: 616078 - DNA, 25 bp, Rattus norvegicus
ggtcaccagcactcgcctcaggatt

SEQ ID NO: 616079 - DNA, 25 bp, Rattus norvegicus
actcgcctcaggatttgcaaaatgg

SEQ ID NO: 616080 - DNA, 25 bp, Rattus norvegicus
aagtcagctagagccgtggcgtcca

SEQ ID NO: 616081 - DNA, 25 bp, Rattus norvegicus
ctctctgtcacctcaagtcagctag

SEQ ID NO: 616082 - DNA, 25 bp, Rattus norvegicus
gaagtcaccagagcgcctgaggcga

SEQ ID NO: 616083 - DNA, 25 bp, Rattus norvegicus
gtgccacacccggagcctccctagg

SEQ ID NO: 616084 - DNA, 25 bp, Rattus norvegicus
agacgcacaagctccaggccgggca

SEQ ID NO: 616085 - DNA, 25 bp, Rattus norvegicus
ccagcctcagcctggcgagcgaacc

SEQ ID NO: 616086 - DNA, 25 bp, Rattus norvegicus
ccgccgcatccttctctgtgccaca

SEQ ID NO: 616087 - DNA, 25 bp, Rattus norvegicus
agagagcacctccacctagtccgcc

SEQ ID NO: 616088 - DNA, 25 bp, Rattus norvegicus
gccgcagggttacatggctcccgcg

SEQ ID NO: 616089 - DNA, 25 bp, Rattus norvegicus
gagcccgccgcagggttacatggct

SEQ ID NO: 616090 - DNA, 25 bp, Rattus norvegicus
atcacctgcgcctggcagatgcagc

SEQ ID NO: 616091 - DNA, 25 bp, Rattus norvegicus
ttaaactgcttcttcatcgtggccc

SEQ ID NO: 616092 - DNA, 25 bp, Rattus norvegicus
ctggcgcatacggttaaactgcttc

SEQ ID NO: 616093 - DNA, 25 bp, Rattus norvegicus
ggccaactggcgcatacggttaaac

SEQ ID NO: 616094 - DNA, 25 bp, Rattus norvegicus
tgcccaccgtctggttggccaactg

SEQ ID NO: 616095 - DNA, 25 bp, Rattus norvegicus
agcagccagcgggtgacctacctgc

SEQ ID NO: 616096 - DNA, 25 bp, Rattus norvegicus
aaagacggagctgcccggagcccgc

SEQ ID NO: 616097 - DNA, 25 bp, Rattus norvegicus
ccacaaggctagagtgcgcatgctt

SEQ ID NO: 616098 - DNA, 25 bp, Rattus norvegicus
tgctcattggctcgggccgtcacgc

SEQ ID NO: 616099 - DNA, 25 bp, Rattus norvegicus
tactcgtcctgtctcgcttgtcctg

SEQ ID NO: 616100 - DNA, 25 bp, Rattus norvegicus
ctttgccagggccttccttatttgg

SEQ ID NO: 616101 - DNA, 25 bp, Rattus norvegicus
ccagggccttccttatttgggcacg

SEQ ID NO: 616102 - DNA, 25 bp, Rattus norvegicus
tccttatttgggcacggctccgaac

SEQ ID NO: 616103 - DNA, 25 bp, Rattus norvegicus
ccggctgctcattggctcgggccgt

SEQ ID NO: 616104 - DNA, 25 bp, Rattus norvegicus
gtcacgcgcgcgtctgtcaacaaag

SEQ ID NO: 616105 - DNA, 25 bp, Rattus norvegicus
cgcgcgtctgtcaacaaaggggcgt

SEQ ID NO: 616106 - DNA, 25 bp, Rattus norvegicus
ggcccacaaggctagagtgcgcatg

SEQ ID NO: 616107 - DNA, 25 bp, Rattus norvegicus
agtgcgcatgcttgtgggtcgccat

SEQ ID NO: 616108 - DNA, 25 bp, Rattus norvegicus
atgcttgtgggtcgccattctccct

SEQ ID NO: 616109 - DNA, 25 bp, Rattus norvegicus
gccattctccctgccgcctggagga

SEQ ID NO: 616110 - DNA, 25 bp, Rattus norvegicus
gccagagcgctcagcgcgccagccc

SEQ ID NO: 616111 - DNA, 25 bp, Rattus norvegicus
cccacgggagagaaacaggcaatga

SEQ ID NO: 616112 - DNA, 25 bp, Rattus norvegicus
gcccttctcttgctgtgctccaaag

SEQ ID NO: 616113 - DNA, 25 bp, Rattus norvegicus
cgcctctcggaggttacaaatgcca

SEQ ID NO: 616114 - DNA, 25 bp, Rattus norvegicus
tcgattgcgattggctctcctaagc

SEQ ID NO: 616115 - DNA, 25 bp, Rattus norvegicus
ggagtgatctgctagcgaaaccttc

SEQ ID NO: 616116 - DNA, 25 bp, Rattus norvegicus
cccacagtcgtgattgcgcaggcgt

SEQ ID NO: 616117 - DNA, 25 bp, Rattus norvegicus
tcactatggtaacagggcacgccca

SEQ ID NO: 616118 - DNA, 25 bp, Rattus norvegicus
ttttctgcaggagagcgtagcctta

SEQ ID NO: 616119 - DNA, 25 bp, Rattus norvegicus
ttccgcatgagcagacaacctattg

SEQ ID NO: 616120 - DNA, 25 bp, Rattus norvegicus
gaaccgattggtttgcctgaagcca

SEQ ID NO: 616121 - DNA, 25 bp, Rattus norvegicus
ggcggcatccatccctaaaacaagg

SEQ ID NO: 616122 - DNA, 25 bp, Rattus norvegicus
aggcaatgagctgtgtccgaatata

SEQ ID NO: 616123 - DNA, 25 bp, Rattus norvegicus
taagcgccgcaccacccaaaaggga

SEQ ID NO: 616124 - DNA, 25 bp, Rattus norvegicus
tgaagccatgccctcaagaaaattg

SEQ ID NO: 616125 - DNA, 25 bp, Rattus norvegicus
gtacctgacgatcacccaggggatg

SEQ ID NO: 616126 - DNA, 25 bp, Rattus norvegicus
cagaccctgcaactcactgcgtgtt

SEQ ID NO: 616127 - DNA, 25 bp, Rattus norvegicus
ctgcaactcactgcgtgttctcgta

SEQ ID NO: 616128 - DNA, 25 bp, Rattus norvegicus
gcaactcactgcgtgttctcgtaca

SEQ ID NO: 616129 - DNA, 25 bp, Rattus norvegicus
ctcactgcgtgttctcgtacaggta

SEQ ID NO: 616130 - DNA, 25 bp, Rattus norvegicus
ctgcgtgttctcgtacaggtacctg

SEQ ID NO: 616131 - DNA, 25 bp, Rattus norvegicus
cgtgttctcgtacaggtacctgacg

SEQ ID NO: 616132 - DNA, 25 bp, Rattus norvegicus
tcacccaggggatgacgaaaagcgc

SEQ ID NO: 616133 - DNA, 25 bp, Rattus norvegicus
gcagctgtcagcgtgcacacgagcc

SEQ ID NO: 616134 - DNA, 25 bp, Rattus norvegicus
gcgtcccacatagctccgccctcag

SEQ ID NO: 616135 - DNA, 25 bp, Rattus norvegicus
gccgcagctgtcagcgtgcacacga

SEQ ID NO: 616136 - DNA, 25 bp, Rattus norvegicus
gtacaggtacctgacgatcacccag

SEQ ID NO: 616137 - DNA, 25 bp, Rattus norvegicus
ttctcgtacaggtacctgacgatca

SEQ ID NO: 616138 - DNA, 25 bp, Rattus norvegicus
ctgacgatcacccaggggatgacga

SEQ ID NO: 616139 - DNA, 25 bp, Rattus norvegicus
aaaaggcagagagcgtggctgatcc

SEQ ID NO: 616140 - DNA, 25 bp, Rattus norvegicus
cgcgcgaggagcatccctaagggtc

SEQ ID NO: 616141 - DNA, 25 bp, Rattus norvegicus
cccaggttgcgaaaaggcagagagc

SEQ ID NO: 616142 - DNA, 25 bp, Rattus norvegicus
tgcgaagaacaaggcgcagcgctgc

SEQ ID NO: 616143 - DNA, 25 bp, Rattus norvegicus
cccgaaaagctggaggcactctcct

SEQ ID NO: 616144 - DNA, 25 bp, Rattus norvegicus
ggaggcactctcctgatctttgtag

SEQ ID NO: 616145 - DNA, 25 bp, Rattus norvegicus
gcactctcctgatctttgtagcgcc

SEQ ID NO: 616146 - DNA, 25 bp, Rattus norvegicus
ctgcagcccgcatctcctctgcttt

SEQ ID NO: 616147 - DNA, 25 bp, Rattus norvegicus
ctcctctgctttctagatgacaatc

SEQ ID NO: 616148 - DNA, 25 bp, Rattus norvegicus
tagatgacaatctgtccggcaccag

SEQ ID NO: 616149 - DNA, 25 bp, Rattus norvegicus
ctgcaagaagatgagctggcggtcc

SEQ ID NO: 616150 - DNA, 25 bp, Rattus norvegicus
agaagatgagctggcggtcctaaag

SEQ ID NO: 616151 - DNA, 25 bp, Rattus norvegicus
tcgcctgcgggcatgcgaagaacaa

SEQ ID NO: 616152 - DNA, 25 bp, Rattus norvegicus
gagcatccctaagggtcgggcgccc

SEQ ID NO: 616153 - DNA, 25 bp, Rattus norvegicus
atgacgagctctttcgtgatcgcta

SEQ ID NO: 616154 - DNA, 25 bp, Rattus norvegicus
actcggcaccgctctttcatgacga

SEQ ID NO: 616155 - DNA, 25 bp, Rattus norvegicus
agtcaagatcaaacgcctggccctg

SEQ ID NO: 616156 - DNA, 25 bp, Rattus norvegicus
cgagcgccaggagaaagtcaagatc

SEQ ID NO: 616157 - DNA, 25 bp, Rattus norvegicus
ggccgtacagagcagtgtgtccacc

SEQ ID NO: 616158 - DNA, 25 bp, Rattus norvegicus
atgttgctgtgctaccgcggcatcc

SEQ ID NO: 616159 - DNA, 25 bp, Rattus norvegicus
cctgggcactcatgttgctgtgcta

SEQ ID NO: 616160 - DNA, 25 bp, Rattus norvegicus
tggatgaacctgtaccgcgtctttg

SEQ ID NO: 616161 - DNA, 25 bp, Rattus norvegicus
tgggccaccgagctaggcgccaact

SEQ ID NO: 616162 - DNA, 25 bp, Rattus norvegicus
ttcgtgatcgctacaaccacacctt

SEQ ID NO: 616163 - DNA, 25 bp, Rattus norvegicus
agcagtagctgtgagctccgtggtc

SEQ ID NO: 616164 - DNA, 25 bp, Rattus norvegicus
gcgccgggtcaagacagcagtagct

SEQ ID NO: 616165 - DNA, 25 bp, Rattus norvegicus
ggctgtggcccatccgctgcgcttt

SEQ ID NO: 616166 - DNA, 25 bp, Rattus norvegicus
ccacaccttctgcttcgagaagttc

SEQ ID NO: 616167 - DNA, 25 bp, Rattus norvegicus
ttaattgggactaagcagacacctc

SEQ ID NO: 616168 - DNA, 25 bp, Rattus norvegicus
ttgggcatccggcaagttagcaagc

SEQ ID NO: 616169 - DNA, 25 bp, Rattus norvegicus
gcgaagctgttctacttgggcatcc

SEQ ID NO: 616170 - DNA, 25 bp, Rattus norvegicus
cagtcagcaaggttgcgcgtgccca

SEQ ID NO: 616171 - DNA, 25 bp, Rattus norvegicus
gtaggcaagtccctccttacgcagg

SEQ ID NO: 616172 - DNA, 25 bp, Rattus norvegicus
acgcacgctcgtacgtaggcacgta

SEQ ID NO: 616173 - DNA, 25 bp, Rattus norvegicus
tttgcatacacaacgtaggacgtcg

SEQ ID NO: 616174 - DNA, 25 bp, Rattus norvegicus
tctgacgcttcacttccgccgtata

SEQ ID NO: 616175 - DNA, 25 bp, Rattus norvegicus
tcctatgggcagagaagccgactca

SEQ ID NO: 616176 - DNA, 25 bp, Rattus norvegicus
acctgggacgccttagacttaattg

SEQ ID NO: 616177 - DNA, 25 bp, Rattus norvegicus
tgtgactacgcgctgactcgcttca

SEQ ID NO: 616178 - DNA, 25 bp, Rattus norvegicus
cacgcaagacgtggtgatgtcagta

SEQ ID NO: 616179 - DNA, 25 bp, Rattus norvegicus
gccgctggccaaccgcatcaaggat

SEQ ID NO: 616180 - DNA, 25 bp, Rattus norvegicus
tccttacgcaggcacgcacggacta

SEQ ID NO: 616181 - DNA, 25 bp, Rattus norvegicus
cagacacgctcagcctgggcgagga

SEQ ID NO: 616182 - DNA, 25 bp, Rattus norvegicus
atccgatgacgtcgctggctgagtc

SEQ ID NO: 616183 - DNA, 25 bp, Rattus norvegicus
tagtaacttctgttcggggaggcgc

SEQ ID NO: 616184 - DNA, 25 bp, Rattus norvegicus
gctgccaggaataacccggtgcgtc

SEQ ID NO: 616185 - DNA, 25 bp, Rattus norvegicus
tgccggagctcgagcaacttgaaag

SEQ ID NO: 616186 - DNA, 25 bp, Rattus norvegicus
cttaaggaaatgctaccagacaccc

SEQ ID NO: 616187 - DNA, 25 bp, Rattus norvegicus
tggtttttctggttcagcctccctc

SEQ ID NO: 616188 - DNA, 25 bp, Rattus norvegicus
ccgcggcagcaagaacaagggcatc

SEQ ID NO: 616189 - DNA, 25 bp, Rattus norvegicus
cctcctgcgctgctgtgactttaca

SEQ ID NO: 616190 - DNA, 25 bp, Rattus norvegicus
gagggtctcctcaaaaagagaaaga

SEQ ID NO: 616191 - DNA, 25 bp, Rattus norvegicus
agacatcttcggtgactgtggcaca

SEQ ID NO: 616192 - DNA, 25 bp, Rattus norvegicus
gcacaagtatttgccaagttgagtc

SEQ ID NO: 616193 - DNA, 25 bp, Rattus norvegicus
cttggacattgaagcttgccggagc

SEQ ID NO: 616194 - DNA, 25 bp, Rattus norvegicus
cctccctctgtccttaaggaaatgc

SEQ ID NO: 616195 - DNA, 25 bp, Rattus norvegicus
agctgcgagcagagctgcatacgga

SEQ ID NO: 616196 - DNA, 25 bp, Rattus norvegicus
cccaggagcacactgggcgagctgc

SEQ ID NO: 616197 - DNA, 25 bp, Rattus norvegicus
ccttgcccaggagcacactgggcga

SEQ ID NO: 616198 - DNA, 25 bp, Rattus norvegicus
tgcaggtgcaggaagccttgcccag

SEQ ID NO: 616199 - DNA, 25 bp, Rattus norvegicus
accacctggaggacgtgctggacga

SEQ ID NO: 616200 - DNA, 25 bp, Rattus norvegicus
atttggaccacctggaggacgtgct

SEQ ID NO: 616201 - DNA, 25 bp, Rattus norvegicus
cgctccgggaggatttggaccacct

SEQ ID NO: 616202 - DNA, 25 bp, Rattus norvegicus
atgtcgctccgggaggatttggacc

SEQ ID NO: 616203 - DNA, 25 bp, Rattus norvegicus
cgcgcacggccacggtgatgtcgct

SEQ ID NO: 616204 - DNA, 25 bp, Rattus norvegicus
aacgccgcaaggaagtggcgcgcac

SEQ ID NO: 616205 - DNA, 25 bp, Rattus norvegicus
agaagacatcgaaacgccgcaagga

SEQ ID NO: 616206 - DNA, 25 bp, Rattus norvegicus
cagagctgcatacggagttgcggac

SEQ ID NO: 616207 - DNA, 25 bp, Rattus norvegicus
gtctgctgctggagttctggcgcca

SEQ ID NO: 616208 - DNA, 25 bp, Rattus norvegicus
tctggcgccagaagacatcgaaacg

SEQ ID NO: 616209 - DNA, 25 bp, Rattus norvegicus
tccaagagacatcggcccagatctg

SEQ ID NO: 616210 - DNA, 25 bp, Rattus norvegicus
catcggcccagatctgggacgctca

SEQ ID NO: 616211 - DNA, 25 bp, Rattus norvegicus
tctgggacgctcaaagcgctgtgtc

SEQ ID NO: 616212 - DNA, 25 bp, Rattus norvegicus
tcacctcatggctgcgcagagggca

SEQ ID NO: 616213 - DNA, 25 bp, Rattus norvegicus
tccaggttctgctcagtctctctcg

SEQ ID NO: 616214 - DNA, 25 bp, Rattus norvegicus
cccatagagtccagcttcctgggga

SEQ ID NO: 616215 - DNA, 25 bp, Rattus norvegicus
cagcttcctggggagaacgtggacc

SEQ ID NO: 616216 - DNA, 25 bp, Rattus norvegicus
ctccggtgctctgatgtgctgggat

SEQ ID NO: 616217 - DNA, 25 bp, Rattus norvegicus
cggcagcacctacgcggttactctt

SEQ ID NO: 616218 - DNA, 25 bp, Rattus norvegicus
cgcggttactcttactactgtactc

SEQ ID NO: 616219 - DNA, 25 bp, Rattus norvegicus
actgtactctctttgctacatttcg

SEQ ID NO: 616220 - DNA, 25 bp, Rattus norvegicus
ttgctacatttcgttccaaaattcc

SEQ ID NO: 616221 - DNA, 25 bp, Rattus norvegicus
gggtgtcgatatttagagatcgctc

SEQ ID NO: 616222 - DNA, 25 bp, Rattus norvegicus
ttagagatcgctccaagagacatcg

SEQ ID NO: 616223 - DNA, 25 bp, Rattus norvegicus
acagctgcgcacagagtagttccgg

SEQ ID NO: 616224 - DNA, 25 bp, Rattus norvegicus
tggcagcccaggcaaagccaactga

SEQ ID NO: 616225 - DNA, 25 bp, Rattus norvegicus
gcttgctccgaagcgcagaccagat

SEQ ID NO: 616226 - DNA, 25 bp, Rattus norvegicus
gggcgctaccaggagtctccaagga

SEQ ID NO: 616227 - DNA, 25 bp, Rattus norvegicus
ccatggccatccaggaccgcgaaaa

SEQ ID NO: 616228 - DNA, 25 bp, Rattus norvegicus
tacgaagagcctggcgcacaccatc

SEQ ID NO: 616229 - DNA, 25 bp, Rattus norvegicus
gcttgctcagctgagagtctgcgtg

SEQ ID NO: 616230 - DNA, 25 bp, Rattus norvegicus
cgaagtcacctagggctcgcgacac

SEQ ID NO: 616231 - DNA, 25 bp, Rattus norvegicus
cggtgcctgcttgtaggcgaagtca

SEQ ID NO: 616232 - DNA, 25 bp, Rattus norvegicus
accgcgaaaaaagcccatcctgatg

SEQ ID NO: 616233 - DNA, 25 bp, Rattus norvegicus
acgaactcatcctcgtcctggcgtg

SEQ ID NO: 616234 - DNA, 25 bp, Rattus norvegicus
cggaagccaagagcacgaactcatc

SEQ ID NO: 616235 - DNA, 25 bp, Rattus norvegicus
agagcgtcccaaacgccatcggaag

SEQ ID NO: 616236 - DNA, 25 bp, Rattus norvegicus
gccaggtccgcaccagacagagcgt

SEQ ID NO: 616237 - DNA, 25 bp, Rattus norvegicus
gcgggactacctgagacccggctct

SEQ ID NO: 616238 - DNA, 25 bp, Rattus norvegicus
agcgaaggcgggactacctgagacc

SEQ ID NO: 616239 - DNA, 25 bp, Rattus norvegicus
acttccggaagctggacggctgcgc

SEQ ID NO: 616240 - DNA, 25 bp, Rattus norvegicus
acctacgcgcttacctctgccctgg

SEQ ID NO: 616241 - DNA, 25 bp, Rattus norvegicus
gctagagcgattccaggtttgaccc

SEQ ID NO: 616242 - DNA, 25 bp, Rattus norvegicus
gcgcgagctagagcgattccaggtt

SEQ ID NO: 616243 - DNA, 25 bp, Rattus norvegicus
gcagctcactcacgacagggcgcga

SEQ ID NO: 616244 - DNA, 25 bp, Rattus norvegicus
gggcctcaccgttcggaatctctct

SEQ ID NO: 616245 - DNA, 25 bp, Rattus norvegicus
cgagcaacccggaagagcccacttt

SEQ ID NO: 616246 - DNA, 25 bp, Rattus norvegicus
tcggaatctctctcccagggcgagc

SEQ ID NO: 616247 - DNA, 25 bp, Rattus norvegicus
tgcccagttcgggactggcgttccc

SEQ ID NO: 616248 - DNA, 25 bp, Rattus norvegicus
ctcactcacgacagggcgcgagcta

SEQ ID NO: 616249 - DNA, 25 bp, Rattus norvegicus
acacgcctgtcgtccgcgagtgcga

SEQ ID NO: 616250 - DNA, 25 bp, Rattus norvegicus
tgtcgtccgcgagtgcgacaggcac

SEQ ID NO: 616251 - DNA, 25 bp, Rattus norvegicus
ccctctcgcgccgtgcggagcagag

SEQ ID NO: 616252 - DNA, 25 bp, Rattus norvegicus
ttacattccgagtatgcgtattctg

SEQ ID NO: 616253 - DNA, 25 bp, Rattus norvegicus
agatgagtgcccgtggccccaggcc

SEQ ID NO: 616254 - DNA, 25 bp, Rattus norvegicus
cccagcgctgcagtgcctgctcctc

SEQ ID NO: 616255 - DNA, 25 bp, Rattus norvegicus
cttaagccccgccttcaattctagg

SEQ ID NO: 616256 - DNA, 25 bp, Rattus norvegicus
aggctgcgctatcggaaacccagac

SEQ ID NO: 616257 - DNA, 25 bp, Rattus norvegicus
ttaaggctgcgctatcggaaaccca

SEQ ID NO: 616258 - DNA, 25 bp, Rattus norvegicus
ccacttttaaggctgcgctatcgga

SEQ ID NO: 616259 - DNA, 25 bp, Rattus norvegicus
gtattctgggcactccagctcctca

SEQ ID NO: 616260 - DNA, 25 bp, Rattus norvegicus
tatgcgtattctgggcactccagct

SEQ ID NO: 616261 - DNA, 25 bp, Rattus norvegicus
agtatgcgtattctgggcactccag

SEQ ID NO: 616262 - DNA, 25 bp, Rattus norvegicus
tccgagtatgcgtattctgggcact

SEQ ID NO: 616263 - DNA, 25 bp, Rattus norvegicus
cattccgagtatgcgtattctgggc

SEQ ID NO: 616264 - DNA, 25 bp, Rattus norvegicus
ccatggggcaggtcctgccggtctt

SEQ ID NO: 616265 - DNA, 25 bp, Rattus norvegicus
gtcgccgaggacttgaacttcactg

SEQ ID NO: 616266 - DNA, 25 bp, Rattus norvegicus
tgaggacaaacgaggaagtgtacga

SEQ ID NO: 616267 - DNA, 25 bp, Rattus norvegicus
cgaggaagtgtacgaagggctaaca

SEQ ID NO: 616268 - DNA, 25 bp, Rattus norvegicus
ggacttgaacttcactgtgtgtaaa

SEQ ID NO: 616269 - DNA, 25 bp, Rattus norvegicus
ctgtgtgtaaagagagaagccgtca

SEQ ID NO: 616270 - DNA, 25 bp, Rattus norvegicus
agccgaagccgtcttccttagcgga

SEQ ID NO: 616271 - DNA, 25 bp, Rattus norvegicus
ttccttagcggatgttgaccctggc

SEQ ID NO: 616272 - DNA, 25 bp, Rattus norvegicus
ccctcttcgtaagggatcttgcagc

SEQ ID NO: 616273 - DNA, 25 bp, Rattus norvegicus
tcttgcagcccggtttgtgggccac

SEQ ID NO: 616274 - DNA, 25 bp, Rattus norvegicus
ttgtgggccaccaggacaaactcca

SEQ ID NO: 616275 - DNA, 25 bp, Rattus norvegicus
caggacaaactccaggcgttccttc

SEQ ID NO: 616276 - DNA, 25 bp, Rattus norvegicus
caggcgttccttctctttttgcagc

SEQ ID NO: 616277 - DNA, 25 bp, Rattus norvegicus
cttctctttttgcagctcggcgatc

SEQ ID NO: 616278 - DNA, 25 bp, Rattus norvegicus
tgttgaccctggcaaatctctcacc

SEQ ID NO: 616279 - DNA, 25 bp, Rattus norvegicus
cgaaggagtccaccgaagacaggta

SEQ ID NO: 616280 - DNA, 25 bp, Rattus norvegicus
cccggacgaatcagaagaacgatct

SEQ ID NO: 616281 - DNA, 25 bp, Rattus norvegicus
tccagaagcccacagaaagtaagtc

SEQ ID NO: 616282 - DNA, 25 bp, Rattus norvegicus
gcagcgtgcgattcagatacctttc

SEQ ID NO: 616283 - DNA, 25 bp, Rattus norvegicus
aagtccaggctctgtcggtttcacg

SEQ ID NO: 616284 - DNA, 25 bp, Rattus norvegicus
agacctccgctgtacctcctgaaag

SEQ ID NO: 616285 - DNA, 25 bp, Rattus norvegicus
aagttccctctgttgcgctcccagg

SEQ ID NO: 616286 - DNA, 25 bp, Rattus norvegicus
cccaagtttcgatgcaagttccctc

SEQ ID NO: 616287 - DNA, 25 bp, Rattus norvegicus
gcaaaccgagtctattggattccta

SEQ ID NO: 616288 - DNA, 25 bp, Rattus norvegicus
acgtctccaaagtgcgctgctcggg

SEQ ID NO: 616289 - DNA, 25 bp, Rattus norvegicus
gagtcaccagtagtcaagtccagca

SEQ ID NO: 616290 - DNA, 25 bp, Rattus norvegicus
ctttgagatctagaacttacctggg

SEQ ID NO: 616291 - DNA, 25 bp, Rattus norvegicus
ctccggttcggagaactgcccaagt

SEQ ID NO: 616292 - DNA, 25 bp, Rattus norvegicus
ttgcacagggcatcgccaacgtttg

SEQ ID NO: 616293 - DNA, 25 bp, Rattus norvegicus
ctgtcgctaggcaacggcgtgccac

SEQ ID NO: 616294 - DNA, 25 bp, Rattus norvegicus
cgctgtggtttgttgacgttgctag

SEQ ID NO: 616295 - DNA, 25 bp, Rattus norvegicus
ctcaaggagtcgctccggcgctgtg

SEQ ID NO: 616296 - DNA, 25 bp, Rattus norvegicus
acagactgccgcgtcactgcgtcag

SEQ ID NO: 616297 - DNA, 25 bp, Rattus norvegicus
taggcaacggcgtgccacagactgc

SEQ ID NO: 616298 - DNA, 25 bp, Rattus norvegicus
acaaccttcctgtcgctaggcaacg

SEQ ID NO: 616299 - DNA, 25 bp, Rattus norvegicus
gggacaaacaaccttcctgtcgcta

SEQ ID NO: 616300 - DNA, 25 bp, Rattus norvegicus
tggtaatttggggacacaggtgtcc

SEQ ID NO: 616301 - DNA, 25 bp, Rattus norvegicus
cagacggtggtaatttggggacaca

SEQ ID NO: 616302 - DNA, 25 bp, Rattus norvegicus
tccggacagacaggcactccggaga

SEQ ID NO: 616303 - DNA, 25 bp, Rattus norvegicus
gtggtttgttgacgttgctaggcaa

SEQ ID NO: 616304 - DNA, 25 bp, Rattus norvegicus
gaggctccggacagacaggcactcc

SEQ ID NO: 616305 - DNA, 25 bp, Rattus norvegicus
cgcagacagaaagcagacggtggta

SEQ ID NO: 616306 - DNA, 25 bp, Rattus norvegicus
tgcgctgcccaggcaacgcgaatcg

SEQ ID NO: 616307 - DNA, 25 bp, Rattus norvegicus
tgagtcgtcgctgccttatctggag

SEQ ID NO: 616308 - DNA, 25 bp, Rattus norvegicus
gggcatcacggaataaggaaaccga

SEQ ID NO: 616309 - DNA, 25 bp, Rattus norvegicus
tgggcagacagatgcaggacctgac

SEQ ID NO: 616310 - DNA, 25 bp, Rattus norvegicus
tcaccaccgcgcagaaccttccagg

SEQ ID NO: 616311 - DNA, 25 bp, Rattus norvegicus
taaaaatggacccagcgcgcgcgcg

SEQ ID NO: 616312 - DNA, 25 bp, Rattus norvegicus
acagatgcaggacctgacagggccg

SEQ ID NO: 616313 - DNA, 25 bp, Rattus norvegicus
tcgggtaaaaatggacccagcgcgc

SEQ ID NO: 616314 - DNA, 25 bp, Rattus norvegicus
cggtgactatttttagcggcgttcg

SEQ ID NO: 616315 - DNA, 25 bp, Rattus norvegicus
cagcagcgcggtgactatttttagc

SEQ ID NO: 616316 - DNA, 25 bp, Rattus norvegicus
tgccttatctggaggccgctatttc

SEQ ID NO: 616317 - DNA, 25 bp, Rattus norvegicus
gaagcgctgagtcgtcgctgcctta

SEQ ID NO: 616318 - DNA, 25 bp, Rattus norvegicus
gatggacagagagatgcggaaatca

SEQ ID NO: 616319 - DNA, 25 bp, Rattus norvegicus
gatgcggaaatcagatgggcagaca

SEQ ID NO: 616320 - DNA, 25 bp, Rattus norvegicus
ctatttcgggctccgcttcgcagca

SEQ ID NO: 616321 - DNA, 25 bp, Rattus norvegicus
cgctataaatagaggttctcagagc

SEQ ID NO: 616322 - DNA, 25 bp, Rattus norvegicus
gaggctcccacgtcatccaggccgc

SEQ ID NO: 616323 - DNA, 25 bp, Rattus norvegicus
ccacgtcatccaggccgctctgctc

SEQ ID NO: 616324 - DNA, 25 bp, Rattus norvegicus
cgctctgctccacgctatttcgggc

SEQ ID NO: 616325 - DNA, 25 bp, Rattus norvegicus
cgtcaccgcggctaagtttagaggc

SEQ ID NO: 616326 - DNA, 25 bp, Rattus norvegicus
tcgggtccggtgtgctccactgtcc

SEQ ID NO: 616327 - DNA, 25 bp, Rattus norvegicus
ggcgctataaatagaggttctcaga

SEQ ID NO: 616328 - DNA, 25 bp, Rattus norvegicus
gaggttctcagagccgaagcgagcc

SEQ ID NO: 616329 - DNA, 25 bp, Rattus norvegicus
acgccggcctggtcactgcggtccc

SEQ ID NO: 616330 - DNA, 25 bp, Rattus norvegicus
tcaccgcggctaagtttagaggcgg

SEQ ID NO: 616331 - DNA, 25 bp, Rattus norvegicus
ttctcagagccgaagcgagccagcc

SEQ ID NO: 616332 - DNA, 25 bp, Rattus norvegicus
cggcccgccgcgatcgccgtcaccg

SEQ ID NO: 616333 - DNA, 25 bp, Rattus norvegicus
ccgtcaccgcggctaagtttagagg

SEQ ID NO: 616334 - DNA, 25 bp, Rattus norvegicus
ctatttcgggctccgggcgctataa

SEQ ID NO: 616335 - DNA, 25 bp, Rattus norvegicus
cattcctggccggtgtgtcagcgtc

SEQ ID NO: 616336 - DNA, 25 bp, Rattus norvegicus
gccaagtaaacagcggcacgtggac

SEQ ID NO: 616337 - DNA, 25 bp, Rattus norvegicus
tgactggactgcattcctggccggt

SEQ ID NO: 616338 - DNA, 25 bp, Rattus norvegicus
ttttgagaacagagggagccaagcc

SEQ ID NO: 616339 - DNA, 25 bp, Rattus norvegicus
ccctctgcggagattttggagactc

SEQ ID NO: 616340 - DNA, 25 bp, Rattus norvegicus
gagccaagcctacgaaggggtgttc

SEQ ID NO: 616341 - DNA, 25 bp, Rattus norvegicus
cggagattttggagactcctccaga

SEQ ID NO: 616342 - DNA, 25 bp, Rattus norvegicus
cccgcgtgccaagtaaacagcggca

SEQ ID NO: 616343 - DNA, 25 bp, Rattus norvegicus
actcctccagaattggggtgccttc

SEQ ID NO: 616344 - DNA, 25 bp, Rattus norvegicus
tggggtgccttcttctgaggctttt

SEQ ID NO: 616345 - DNA, 25 bp, Rattus norvegicus
gccttcttctgaggcttttgagaac

SEQ ID NO: 616346 - DNA, 25 bp, Rattus norvegicus
aggtgtagctggtcgacccctctct

SEQ ID NO: 616347 - DNA, 25 bp, Rattus norvegicus
cgagacagggtgactggactgcatt

SEQ ID NO: 616348 - DNA, 25 bp, Rattus norvegicus
gcgagaaactctgcggctcgccctt

SEQ ID NO: 616349 - DNA, 25 bp, Rattus norvegicus
cggcggctggccgagacctagtttc

SEQ ID NO: 616350 - DNA, 25 bp, Rattus norvegicus
gcactggccgcggaccgcccagcct

SEQ ID NO: 616351 - DNA, 25 bp, Rattus norvegicus
ggtgcaaggcctgtcagaggctgcc

SEQ ID NO: 616352 - DNA, 25 bp, Rattus norvegicus
agcaccctggttgctcaagggctcc

SEQ ID NO: 616353 - DNA, 25 bp, Rattus norvegicus
tcaggtggcctcttgcgggactgca

SEQ ID NO: 616354 - DNA, 25 bp, Rattus norvegicus
agtttcggggcccacgctgagcacc

SEQ ID NO: 616355 - DNA, 25 bp, Rattus norvegicus
gctctcggcggctggccgagaccta

SEQ ID NO: 616356 - DNA, 25 bp, Rattus norvegicus
cttcctgccaggagaaagtggggct

SEQ ID NO: 616357 - DNA, 25 bp, Rattus norvegicus
tcccctgctgtcagtgcacaacagg

SEQ ID NO: 616358 - DNA, 25 bp, Rattus norvegicus
ggagctgactgcgatgacgtctccc

SEQ ID NO: 616359 - DNA, 25 bp, Rattus norvegicus
cggccgtcagaaaggagctgactgc

SEQ ID NO: 616360 - DNA, 25 bp, Rattus norvegicus
ccctgcccacagctgacctttggcc

SEQ ID NO: 616361 - DNA, 25 bp, Rattus norvegicus
cctcttgcgggactgcagacccggg

SEQ ID NO: 616362 - DNA, 25 bp, Rattus norvegicus
gggcccacgctgagcaccctggttg

SEQ ID NO: 616363 - DNA, 25 bp, Rattus norvegicus
tcccaaggtgctctaggcaaccgca

SEQ ID NO: 616364 - DNA, 25 bp, Rattus norvegicus
aggtgctctaggcaaccgcagctcc

SEQ ID NO: 616365 - DNA, 25 bp, Rattus norvegicus
aatggatcgcgcctgactccaaatg

SEQ ID NO: 616366 - DNA, 25 bp, Rattus norvegicus
gatcgcgcctgactccaaatggaaa

SEQ ID NO: 616367 - DNA, 25 bp, Rattus norvegicus
cgcgcctgactccaaatggaaatgt

SEQ ID NO: 616368 - DNA, 25 bp, Rattus norvegicus
caaatggaaatgtccctggcagcgc

SEQ ID NO: 616369 - DNA, 25 bp, Rattus norvegicus
gactacaaatcccaaggtgctctag

SEQ ID NO: 616370 - DNA, 25 bp, Rattus norvegicus
ggaaatgtccctggcagcgctccgc

SEQ ID NO: 616371 - DNA, 25 bp, Rattus norvegicus
cctccagtcagagtcacgtcgtcta

SEQ ID NO: 616372 - DNA, 25 bp, Rattus norvegicus
agtcagagtcacgtcgtctaacctg

SEQ ID NO: 616373 - DNA, 25 bp, Rattus norvegicus
agtcacgtcgtctaacctgttcccg

SEQ ID NO: 616374 - DNA, 25 bp, Rattus norvegicus
gtctaacctgttcccgggagactgc

SEQ ID NO: 616375 - DNA, 25 bp, Rattus norvegicus
gatctgccccgacgcgtgagttcca

SEQ ID NO: 616376 - DNA, 25 bp, Rattus norvegicus
ggacacgcctccctccagtcagagt

SEQ ID NO: 616377 - DNA, 25 bp, Rattus norvegicus
ccgcagctgtttttctacccggcta

SEQ ID NO: 616378 - DNA, 25 bp, Rattus norvegicus
tgcaccgtacttcgcgtcacaaggc

SEQ ID NO: 616379 - DNA, 25 bp, Rattus norvegicus
gaggccacgcccctgtaggtgctca

SEQ ID NO: 616380 - DNA, 25 bp, Rattus norvegicus
aaatcctcagtctaggatcggggtg

SEQ ID NO: 616381 - DNA, 25 bp, Rattus norvegicus
ggtcgacacacattgagaaatcctc

SEQ ID NO: 616382 - DNA, 25 bp, Rattus norvegicus
cgccctcggtcgacacacattgaga

SEQ ID NO: 616383 - DNA, 25 bp, Rattus norvegicus
agacccgactgctcccgctgcgaag

SEQ ID NO: 616384 - DNA, 25 bp, Rattus norvegicus
ggtctgaaccgcctcgctgcgcgga

SEQ ID NO: 616385 - DNA, 25 bp, Rattus norvegicus
tcccgtgcccacctgacggccgccg

SEQ ID NO: 616386 - DNA, 25 bp, Rattus norvegicus
ctcgggaatcccgaagcagccgccg

SEQ ID NO: 616387 - DNA, 25 bp, Rattus norvegicus
atccgagccgccagacccatagccc

SEQ ID NO: 616388 - DNA, 25 bp, Rattus norvegicus
cccgaggctcatccgagccgccaga

SEQ ID NO: 616389 - DNA, 25 bp, Rattus norvegicus
cagctgtttttctacccggctaggg

SEQ ID NO: 616390 - DNA, 25 bp, Rattus norvegicus
ggagaccctgcaccgtacttcgcgt

SEQ ID NO: 616391 - DNA, 25 bp, Rattus norvegicus
cacccggcggtcagcagcatgcagg

SEQ ID NO: 616392 - DNA, 25 bp, Rattus norvegicus
cgcggcctgtgagccgctgcgtccc

SEQ ID NO: 616393 - DNA, 25 bp, Rattus norvegicus
tcgcgaggcgcttggccgagccgcg

SEQ ID NO: 616394 - DNA, 25 bp, Rattus norvegicus
cagcagcatgcagggtaaggacagc

SEQ ID NO: 616395 - DNA, 25 bp, Rattus norvegicus
cccggggcccatcgggcctccagct

SEQ ID NO: 616396 - DNA, 25 bp, Rattus norvegicus
aacaatggcggctccgagcccgagc

SEQ ID NO: 616397 - DNA, 25 bp, Rattus norvegicus
atttccaacaatggcggctccgagc

SEQ ID NO: 616398 - DNA, 25 bp, Rattus norvegicus
caaggcggcgcacgccgcgccctca

SEQ ID NO: 616399 - DNA, 25 bp, Rattus norvegicus
ggctcctcatttccaacaatggcgg

SEQ ID NO: 616400 - DNA, 25 bp, Rattus norvegicus
gctcggctcctcatttccaacaatg

SEQ ID NO: 616401 - DNA, 25 bp, Rattus norvegicus
cgagcttgctgcattgcagccgccg

SEQ ID NO: 616402 - DNA, 25 bp, Rattus norvegicus
aggccgagcttgctgcattgcagcc

SEQ ID NO: 616403 - DNA, 25 bp, Rattus norvegicus
agaggccgagcttgctgcattgcag

SEQ ID NO: 616404 - DNA, 25 bp, Rattus norvegicus
ctcatttccaacaatggcggctccg

SEQ ID NO: 616405 - DNA, 25 bp, Rattus norvegicus
gcggtccctgcatctctgctcttgt

SEQ ID NO: 616406 - DNA, 25 bp, Rattus norvegicus
gaagctggaaaaaggccagtccatc

SEQ ID NO: 616407 - DNA, 25 bp, Rattus norvegicus
gcgactttccgaggcgtttgcagtt

SEQ ID NO: 616408 - DNA, 25 bp, Rattus norvegicus
tgcgcagaagtaggcgccgcacaga

SEQ ID NO: 616409 - DNA, 25 bp, Rattus norvegicus
aggccagtccatcgacgacatgatc

SEQ ID NO: 616410 - DNA, 25 bp, Rattus norvegicus
atggcgtaaagcttatggtggagat

SEQ ID NO: 616411 - DNA, 25 bp, Rattus norvegicus
tcttccgaggtcgaacaggtgcagc

SEQ ID NO: 616412 - DNA, 25 bp, Rattus norvegicus
tccaacgccgatcggctgggctctt

SEQ ID NO: 616413 - DNA, 25 bp, Rattus norvegicus
ggcgccgtgttcgacatctccaacg

SEQ ID NO: 616414 - DNA, 25 bp, Rattus norvegicus
aatgcctccgtgatgtctgctcccg

SEQ ID NO: 616415 - DNA, 25 bp, Rattus norvegicus
ctgctcttgttcaatgcctccgtga

SEQ ID NO: 616416 - DNA, 25 bp, Rattus norvegicus
ggtgacttgtgaacagcgactttcc

SEQ ID NO: 616417 - DNA, 25 bp, Rattus norvegicus
tgcagttgggcacaaggcggtccct

SEQ ID NO: 616418 - DNA, 25 bp, Rattus norvegicus
acgacatgatccctgcgcagaagta

SEQ ID NO: 616419 - DNA, 25 bp, Rattus norvegicus
cacctctacttcgaaatgggacagg

SEQ ID NO: 616420 - DNA, 25 bp, Rattus norvegicus
cacacctctacttcgaaatgggaca

SEQ ID NO: 616421 - DNA, 25 bp, Rattus norvegicus
aatgcgggtgacaagggttcggaag

SEQ ID NO: 616422 - DNA, 25 bp, Rattus norvegicus
ttcggaaggccagggcggtgcccgc

SEQ ID NO: 616423 - DNA, 25 bp, Rattus norvegicus
gctggcacacctctacttcgaaatg

SEQ ID NO: 616424 - DNA, 25 bp, Rattus norvegicus
ctggcacacctctacttcgaaatgg

SEQ ID NO: 616425 - DNA, 25 bp, Rattus norvegicus
tggcacacctctacttcgaaatggg

SEQ ID NO: 616426 - DNA, 25 bp, Rattus norvegicus
ctctacttcgaaatgggacaggggc

SEQ ID NO: 616427 - DNA, 25 bp, Rattus norvegicus
ctacttcgaaatgggacaggggctc

SEQ ID NO: 616428 - DNA, 25 bp, Rattus norvegicus
tcgaaatgggacaggggctcgggcc

SEQ ID NO: 616429 - DNA, 25 bp, Rattus norvegicus
aggtcgttggaaatgcgggtgacaa

SEQ ID NO: 616430 - DNA, 25 bp, Rattus norvegicus
cccgtgcaggcaggccagcaggaac

SEQ ID NO: 616431 - DNA, 25 bp, Rattus norvegicus
caggcaggccagcaggaacggctgc

SEQ ID NO: 616432 - DNA, 25 bp, Rattus norvegicus
ggcacacctctacttcgaaatggga

SEQ ID NO: 616433 - DNA, 25 bp, Rattus norvegicus
ggaccggcaagtccgctctttcttg

SEQ ID NO: 616434 - DNA, 25 bp, Rattus norvegicus
gtagtgtctcgatacggctcatgca

SEQ ID NO: 616435 - DNA, 25 bp, Rattus norvegicus
ctatcaactctaggggtagtgtctc

SEQ ID NO: 616436 - DNA, 25 bp, Rattus norvegicus
gcgcatcgcctcaccgttgtatcta

SEQ ID NO: 616437 - DNA, 25 bp, Rattus norvegicus
cactgtcaggtgagtggggactcct

SEQ ID NO: 616438 - DNA, 25 bp, Rattus norvegicus
cagaaagactggtgcctgcaggcga

SEQ ID NO: 616439 - DNA, 25 bp, Rattus norvegicus
ggcgggcatccctggcagaaagact

SEQ ID NO: 616440 - DNA, 25 bp, Rattus norvegicus
ctggctttcctgagactcggacgtg

SEQ ID NO: 616441 - DNA, 25 bp, Rattus norvegicus
gccgctcgaagactggctttcctga

SEQ ID NO: 616442 - DNA, 25 bp, Rattus norvegicus
ttccgaacccatggcgacgaggagc

SEQ ID NO: 616443 - DNA, 25 bp, Rattus norvegicus
cggcttcaggggttccgaacccatg

SEQ ID NO: 616444 - DNA, 25 bp, Rattus norvegicus
gctcagcagatttcggcctcttaaa

SEQ ID NO: 616445 - DNA, 25 bp, Rattus norvegicus
gccgccgggccacactggagaagct

SEQ ID NO: 616446 - DNA, 25 bp, Rattus norvegicus
catacggaggagctcagcagatttc

SEQ ID NO: 616447 - DNA, 25 bp, Rattus norvegicus
ctggcgcgagcggacgagcacatcc

SEQ ID NO: 616448 - DNA, 25 bp, Rattus norvegicus
gcgctgctgtacgaggcgctgcagc

SEQ ID NO: 616449 - DNA, 25 bp, Rattus norvegicus
cgcagctgggcctcgtgctgctgca

SEQ ID NO: 616450 - DNA, 25 bp, Rattus norvegicus
gcggcccgcaagctacgcgcgcact

SEQ ID NO: 616451 - DNA, 25 bp, Rattus norvegicus
ggctgcgcgccggtgctgtctacct

SEQ ID NO: 616452 - DNA, 25 bp, Rattus norvegicus
gtgctgtctacctgcgcggctacca

SEQ ID NO: 616453 - DNA, 25 bp, Rattus norvegicus
gcaggctccctctggccgatcgtta

SEQ ID NO: 616454 - DNA, 25 bp, Rattus norvegicus
tccctctggccgatcgttacgcatt

SEQ ID NO: 616455 - DNA, 25 bp, Rattus norvegicus
ctggccgatcgttacgcattgctgc

SEQ ID NO: 616456 - DNA, 25 bp, Rattus norvegicus
cgttacgcattgctgcactggcaca

SEQ ID NO: 616457 - DNA, 25 bp, Rattus norvegicus
tgcactggcacaatcaggtgtaccc

SEQ ID NO: 616458 - DNA, 25 bp, Rattus norvegicus
tcaggtgtaccccaggtgagcccgg

SEQ ID NO: 616459 - DNA, 25 bp, Rattus norvegicus
gagcggacgagcacatcctggagct

SEQ ID NO: 616460 - DNA, 25 bp, Rattus norvegicus
acgagcacatcctggagctggaggc

SEQ ID NO: 616461 - DNA, 25 bp, Rattus norvegicus
gagagttcccatcgcgtcaggagtg

SEQ ID NO: 616462 - DNA, 25 bp, Rattus norvegicus
ggtggcgtgtgtcggatctcattaa

SEQ ID NO: 616463 - DNA, 25 bp, Rattus norvegicus
tctcattaagggtttggtaggatga

SEQ ID NO: 616464 - DNA, 25 bp, Rattus norvegicus
atgaggggatcggagtctgacttta

SEQ ID NO: 616465 - DNA, 25 bp, Rattus norvegicus
cggcacagttgcagcggttgtttcg

SEQ ID NO: 616466 - DNA, 25 bp, Rattus norvegicus
tctgactttattggacggggcactc

SEQ ID NO: 616467 - DNA, 25 bp, Rattus norvegicus
atcgcgtcaggagtgtcccgcctgt

SEQ ID NO: 616468 - DNA, 25 bp, Rattus norvegicus
cgcctgtgtggtcagagcgtgaaac

SEQ ID NO: 616469 - DNA, 25 bp, Rattus norvegicus
gagcgatctagagcgtttccgggtc

SEQ ID NO: 616470 - DNA, 25 bp, Rattus norvegicus
gagcgtttccgggtctcccactgtc

SEQ ID NO: 616471 - DNA, 25 bp, Rattus norvegicus
tgtgtcggatctcattaagggtttg

SEQ ID NO: 616472 - DNA, 25 bp, Rattus norvegicus
cgcctgcgctgtcgttctgcgagga

SEQ ID NO: 616473 - DNA, 25 bp, Rattus norvegicus
tgtcgttctgcgaggacccgcagcc

SEQ ID NO: 616474 - DNA, 25 bp, Rattus norvegicus
agtacgtgcggccactgctccgcgg

SEQ ID NO: 616475 - DNA, 25 bp, Rattus norvegicus
tggcatccgtcccagcgtttcctgg

SEQ ID NO: 616476 - DNA, 25 bp, Rattus norvegicus
ttaatacgatttccctccttctgcc

SEQ ID NO: 616477 - DNA, 25 bp, Rattus norvegicus
aagggctggccctgcagggaaccgc

SEQ ID NO: 616478 - DNA, 25 bp, Rattus norvegicus
aaacaagcggccacaggaagccggg

SEQ ID NO: 616479 - DNA, 25 bp, Rattus norvegicus
tcgcaaacaaacaagcggccacagg

SEQ ID NO: 616480 - DNA, 25 bp, Rattus norvegicus
cgccatcagggctcgcaaacaaaca

SEQ ID NO: 616481 - DNA, 25 bp, Rattus norvegicus
ccagggcattcttaatacgatttcc

SEQ ID NO: 616482 - DNA, 25 bp, Rattus norvegicus
ctgggaccagggcattcttaatacg

SEQ ID NO: 616483 - DNA, 25 bp, Rattus norvegicus
tcctgctgggaccagggcattctta

SEQ ID NO: 616484 - DNA, 25 bp, Rattus norvegicus
cgtgtctgacggctgtttcctgctg

SEQ ID NO: 616485 - DNA, 25 bp, Rattus norvegicus
agagcgtgtctgacggctgtttcct

SEQ ID NO: 616486 - DNA, 25 bp, Rattus norvegicus
ccagcgtttcctggcccgcgccaag

SEQ ID NO: 616487 - DNA, 25 bp, Rattus norvegicus
acacacgggcatgtgggcgcaagct

SEQ ID NO: 616488 - DNA, 25 bp, Rattus norvegicus
tcagggctcgcaaacaaacaagcgg

SEQ ID NO: 616489 - DNA, 25 bp, Rattus norvegicus
caggcgctaggacaggggtctcctc

SEQ ID NO: 616490 - DNA, 25 bp, Rattus norvegicus
tcgtatgtccggcagcaggcgacaa

SEQ ID NO: 616491 - DNA, 25 bp, Rattus norvegicus
gcaggcgacaaccagccacaatatc

SEQ ID NO: 616492 - DNA, 25 bp, Rattus norvegicus
aatatccaggcgctccgcaagcgcg

SEQ ID NO: 616493 - DNA, 25 bp, Rattus norvegicus
gcagccgctacgtcgtggtccaggc

SEQ ID NO: 616494 - DNA, 25 bp, Rattus norvegicus
atgatgatgcagacagctccgagtc

SEQ ID NO: 616495 - DNA, 25 bp, Rattus norvegicus
cagccaacctgagctgcagcagaga

SEQ ID NO: 616496 - DNA, 25 bp, Rattus norvegicus
cgaccttgggacgacgccatggcac

SEQ ID NO: 616497 - DNA, 25 bp, Rattus norvegicus
actgcatcccgttgcaccacgaggg

SEQ ID NO: 616498 - DNA, 25 bp, Rattus norvegicus
gctcaggctcggagtcggtctccgc

SEQ ID NO: 616499 - DNA, 25 bp, Rattus norvegicus
cccgagggacccaggtatagctcct

SEQ ID NO: 616500 - DNA, 25 bp, Rattus norvegicus
aggtatagctcctcctcggatgatg

SEQ ID NO: 616501 - DNA, 25 bp, Rattus norvegicus
cctcggatgatgatgcagacagctc

SEQ ID NO: 616502 - DNA, 25 bp, Rattus norvegicus
gcgtctggctctcagccaacctgag

SEQ ID NO: 616503 - DNA, 25 bp, Rattus norvegicus
gggctcagccaatcgggtgtccaaa

SEQ ID NO: 616504 - DNA, 25 bp, Rattus norvegicus
gtgaacaccgaaaggacgaccgctc

SEQ ID NO: 616505 - DNA, 25 bp, Rattus norvegicus
tcgtgcgcaactcaacgtcttaatc

SEQ ID NO: 616506 - DNA, 25 bp, Rattus norvegicus
tcctggggcaccgttgataattagg

SEQ ID NO: 616507 - DNA, 25 bp, Rattus norvegicus
atcgagccttttggcaggtcactgc

SEQ ID NO: 616508 - DNA, 25 bp, Rattus norvegicus
cgagtttctgcacaccgagatggtg

SEQ ID NO: 616509 - DNA, 25 bp, Rattus norvegicus
ggggacacttaactagagccaccga

SEQ ID NO: 616510 - DNA, 25 bp, Rattus norvegicus
ctgcctcccgagctgaccaatggga

SEQ ID NO: 616511 - DNA, 25 bp, Rattus norvegicus
tcctcacacgaatcaggggctcagc

SEQ ID NO: 616512 - DNA, 25 bp, Rattus norvegicus
cgcttccgtgttgtggtcctattta

SEQ ID NO: 616513 - DNA, 25 bp, Rattus norvegicus
acgtgagtcgaggtctggccaataa

SEQ ID NO: 616514 - DNA, 25 bp, Rattus norvegicus
gaggcgttctcttcgcgtagcgtca

SEQ ID NO: 616515 - DNA, 25 bp, Rattus norvegicus
accagagtctcggaaggccataccc

SEQ ID NO: 616516 - DNA, 25 bp, Rattus norvegicus
gcggacgcagtactgttcgagtttc

SEQ ID NO: 616517 - DNA, 25 bp, Rattus norvegicus
tcacgccctttctggagagttcata

SEQ ID NO: 616518 - DNA, 25 bp, Rattus norvegicus
tcctctgccgtgctgtccgtgagct

SEQ ID NO: 616519 - DNA, 25 bp, Rattus norvegicus
gcattaccgcatggaggttcccaga

SEQ ID NO: 616520 - DNA, 25 bp, Rattus norvegicus
ggaggcgacttacatgctcgcatta

SEQ ID NO: 616521 - DNA, 25 bp, Rattus norvegicus
ctccgagctgggaggcgacttacat

SEQ ID NO: 616522 - DNA, 25 bp, Rattus norvegicus
tgcgagcacagaaacccgtagaggt

SEQ ID NO: 616523 - DNA, 25 bp, Rattus norvegicus
tcacccgtcggctgcgagcacagaa

SEQ ID NO: 616524 - DNA, 25 bp, Rattus norvegicus
ccggccacccgaaggcagaggcaaa

SEQ ID NO: 616525 - DNA, 25 bp, Rattus norvegicus
cgatcggaggacagaggaccgtcct

SEQ ID NO: 616526 - DNA, 25 bp, Rattus norvegicus
gctgagatcaccaggctccggagcc

SEQ ID NO: 616527 - DNA, 25 bp, Rattus norvegicus
cggcggagaactttcccaagagttg

SEQ ID NO: 616528 - DNA, 25 bp, Rattus norvegicus
gccgcggagttcaagagtaggtccc

SEQ ID NO: 616529 - DNA, 25 bp, Rattus norvegicus
tcatagggtttcctggcagctgctc

SEQ ID NO: 616530 - DNA, 25 bp, Rattus norvegicus
tccgtgagctccaccgaaggggacc

SEQ ID NO: 616531 - DNA, 25 bp, Rattus norvegicus
gcggcagcggctctgtccagttcgc

SEQ ID NO: 616532 - DNA, 25 bp, Rattus norvegicus
gcccgcatgggaccagccagcgccc

SEQ ID NO: 616533 - DNA, 25 bp, Rattus norvegicus
ctctgtccagttcgcggggcccaga

SEQ ID NO: 616534 - DNA, 25 bp, Rattus norvegicus
ggcccagaaagggtcacctgcgatc

SEQ ID NO: 616535 - DNA, 25 bp, Rattus norvegicus
agaaagggtcacctgcgatcgccgc

SEQ ID NO: 616536 - DNA, 25 bp, Rattus norvegicus
tgcgatcgccgctgcccgcatggga

SEQ ID NO: 616537 - DNA, 25 bp, Rattus norvegicus
accgcagtaccacccacggccagca

SEQ ID NO: 616538 - DNA, 25 bp, Rattus norvegicus
cagcagcggcccagccttgccctct

SEQ ID NO: 616539 - DNA, 25 bp, Rattus norvegicus
ccttgccctctgcagccggcgccct

SEQ ID NO: 616540 - DNA, 25 bp, Rattus norvegicus
cagccggcgccctcctggagcccag

SEQ ID NO: 616541 - DNA, 25 bp, Rattus norvegicus
cgagcccaccgaggcgcggcctctg

SEQ ID NO: 616542 - DNA, 25 bp, Rattus norvegicus
gcagcctgcggctccttcacctcct

SEQ ID NO: 616543 - DNA, 25 bp, Rattus norvegicus
cggctccttcacctcctacggcgcg

SEQ ID NO: 616544 - DNA, 25 bp, Rattus norvegicus
cggctgtcgccggtgtcctcagccc

SEQ ID NO: 616545 - DNA, 25 bp, Rattus norvegicus
atccagaccgggtctcactaccagg

SEQ ID NO: 616546 - DNA, 25 bp, Rattus norvegicus
cggactgaaccaccagcagcgggca

SEQ ID NO: 616547 - DNA, 25 bp, Rattus norvegicus
ccgcggcggcattatgatccaggaa

SEQ ID NO: 616548 - DNA, 25 bp, Rattus norvegicus
tgtgcctgcgcaacgctcccaggtg

SEQ ID NO: 616549 - DNA, 25 bp, Rattus norvegicus
gcgctgccagctgcagcgtccgttt

SEQ ID NO: 616550 - DNA, 25 bp, Rattus norvegicus
cagcgtccgtttccctagcgacgga

SEQ ID NO: 616551 - DNA, 25 bp, Rattus norvegicus
tagcgacggagatgccaggccctcc

SEQ ID NO: 616552 - DNA, 25 bp, Rattus norvegicus
cccactaagttaataaggtaggcag

SEQ ID NO: 616553 - DNA, 25 bp, Rattus norvegicus
ccgcctctgctctccttatattggg

SEQ ID NO: 616554 - DNA, 25 bp, Rattus norvegicus
ggtcctgcatccagaccgggtctca

SEQ ID NO: 616555 - DNA, 25 bp, Rattus norvegicus
aaggctgtgatttcccggaggctcg

SEQ ID NO: 616556 - DNA, 25 bp, Rattus norvegicus
agcctggttgggctccggtcctgca

SEQ ID NO: 616557 - DNA, 25 bp, Rattus norvegicus
tatattgggcactggacggtagctc

SEQ ID NO: 616558 - DNA, 25 bp, Rattus norvegicus
caccgtgccgcgaaggctgtgattt

SEQ ID NO: 616559 - DNA, 25 bp, Rattus norvegicus
ctgttcgtgagccagcgcaagaaga

SEQ ID NO: 616560 - DNA, 25 bp, Rattus norvegicus
gtccatgaggcgcatcgtcaacacg

SEQ ID NO: 616561 - DNA, 25 bp, Rattus norvegicus
gtgcccgacaacgtggtgtccatga

SEQ ID NO: 616562 - DNA, 25 bp, Rattus norvegicus
gggtgactgcctatacgaatacgtg

SEQ ID NO: 616563 - DNA, 25 bp, Rattus norvegicus
agttgacgatcaagctgcagccgca

SEQ ID NO: 616564 - DNA, 25 bp, Rattus norvegicus
acgatctgctgtttcgggagttgac

SEQ ID NO: 616565 - DNA, 25 bp, Rattus norvegicus
ggccgtcgcaccaagttgcagttcc

SEQ ID NO: 616566 - DNA, 25 bp, Rattus norvegicus
cacggttacgcttcccttctcggtg

SEQ ID NO: 616567 - DNA, 25 bp, Rattus norvegicus
tgctgtacctgtctctgggaggcca

SEQ ID NO: 616568 - DNA, 25 bp, Rattus norvegicus
cgcgccctttatcttcatcctggtg

SEQ ID NO: 616569 - DNA, 25 bp, Rattus norvegicus
tggagatttaccagcgacgccggct

SEQ ID NO: 616570 - DNA, 25 bp, Rattus norvegicus
gtgctcgccaaccagtggccttgtc

SEQ ID NO: 616571 - DNA, 25 bp, Rattus norvegicus
agcggacaatggctacctgttcctc

SEQ ID NO: 616572 - DNA, 25 bp, Rattus norvegicus
actccgtgggcaagcatctgttcgt

SEQ ID NO: 616573 - DNA, 25 bp, Rattus norvegicus
ctcccggaggtccagtctcaggagg

SEQ ID NO: 616574 - DNA, 25 bp, Rattus norvegicus
catgagcccgcctgtcttgatctcg

SEQ ID NO: 616575 - DNA, 25 bp, Rattus norvegicus
gagcccgcctgtcttgatctcgttc

SEQ ID NO: 616576 - DNA, 25 bp, Rattus norvegicus
cctgtcttgatctcgttctcccgga

SEQ ID NO: 616577 - DNA, 25 bp, Rattus norvegicus
ttgatctcgttctcccggaggtcca

SEQ ID NO: 616578 - DNA, 25 bp, Rattus norvegicus
tcggcgatgaactctgccacggcca

SEQ ID NO: 616579 - DNA, 25 bp, Rattus norvegicus
tctgccacggccaccgcgcctggga

SEQ ID NO: 616580 - DNA, 25 bp, Rattus norvegicus
cccatgcctggccactggccggccg

SEQ ID NO: 616581 - DNA, 25 bp, Rattus norvegicus
gcgcctggcccgcatcctaccctcg

SEQ ID NO: 616582 - DNA, 25 bp, Rattus norvegicus
atcctaccctcgcatgtgagcttgg

SEQ ID NO: 616583 - DNA, 25 bp, Rattus norvegicus
taccctcgcatgtgagcttggttga

SEQ ID NO: 616584 - DNA, 25 bp, Rattus norvegicus
tcgcatgtgagcttggttgaggcaa

SEQ ID NO: 616585 - DNA, 25 bp, Rattus norvegicus
ttggttgaggcaaggccgaggcgca

SEQ ID NO: 616586 - DNA, 25 bp, Rattus norvegicus
tcttgatctcgttctcccggaggtc

SEQ ID NO: 616587 - DNA, 25 bp, Rattus norvegicus
gccacgttcgggagccctctgctgg

SEQ ID NO: 616588 - DNA, 25 bp, Rattus norvegicus
gacacatcggccacgttcgggagcc

SEQ ID NO: 616589 - DNA, 25 bp, Rattus norvegicus
gctgcagcctatgacacatcggcca

SEQ ID NO: 616590 - DNA, 25 bp, Rattus norvegicus
tcgttttggacgctcagagagtgcc

SEQ ID NO: 616591 - DNA, 25 bp, Rattus norvegicus
cttttgactacctaggccgcgcagg

SEQ ID NO: 616592 - DNA, 25 bp, Rattus norvegicus
cgccttcgagggaacaggcagtccc

SEQ ID NO: 616593 - DNA, 25 bp, Rattus norvegicus
tacagcagcctggatcgggcgccat

SEQ ID NO: 616594 - DNA, 25 bp, Rattus norvegicus
gcctatgacacatcggccacgttcg

SEQ ID NO: 616595 - DNA, 25 bp, Rattus norvegicus
tctacctgcagcctacaacacctga

SEQ ID NO: 616596 - DNA, 25 bp, Rattus norvegicus
cgccgcgcacctccatctacctgca

SEQ ID NO: 616597 - DNA, 25 bp, Rattus norvegicus
gtccctgcacccttacagccctctg

SEQ ID NO: 616598 - DNA, 25 bp, Rattus norvegicus
cgtagaggctcgttttggacgctca

SEQ ID NO: 616599 - DNA, 25 bp, Rattus norvegicus
ccgcgccttcgagggaacaggcagt

SEQ ID NO: 616600 - DNA, 25 bp, Rattus norvegicus
ccaggccttcttcccggagcgagga

SEQ ID NO: 616601 - DNA, 25 bp, Rattus norvegicus
cccggagcagttctcctacatgctg

SEQ ID NO: 616602 - DNA, 25 bp, Rattus norvegicus
ccgccatgaagtgagatggggtctc

SEQ ID NO: 616603 - DNA, 25 bp, Rattus norvegicus
gattctctcgacattctactttctg

SEQ ID NO: 616604 - DNA, 25 bp, Rattus norvegicus
tacatgctggagctcaagcgcacgc

SEQ ID NO: 616605 - DNA, 25 bp, Rattus norvegicus
ctgtgttctgttcgaagtcttcggc

SEQ ID NO: 616606 - DNA, 25 bp, Rattus norvegicus
aagtcttcggcgatcctcagcgatg

SEQ ID NO: 616607 - DNA, 25 bp, Rattus norvegicus
ctcagcgatgccttgggcaccgctt

SEQ ID NO: 616608 - DNA, 25 bp, Rattus norvegicus
cgcacgcgccagttttccgattgga

SEQ ID NO: 616609 - DNA, 25 bp, Rattus norvegicus
tcagccaatggcatcgcgaggaagg

SEQ ID NO: 616610 - DNA, 25 bp, Rattus norvegicus
ctcgttgaatattcaggaggcgggc

SEQ ID NO: 616611 - DNA, 25 bp, Rattus norvegicus
acgccgggacaagccgccatgaagt

SEQ ID NO: 616612 - DNA, 25 bp, Rattus norvegicus
tgctggtctacttcccgtacgacta

SEQ ID NO: 616613 - DNA, 25 bp, Rattus norvegicus
gtacgactacatctacccggagcag

SEQ ID NO: 616614 - DNA, 25 bp, Rattus norvegicus
ccaggctcaacgtggatgggctgct

SEQ ID NO: 616615 - DNA, 25 bp, Rattus norvegicus
aagcgcatgccacgctgctttggct

SEQ ID NO: 616616 - DNA, 25 bp, Rattus norvegicus
gggcaccagacgaggcatctcactc

SEQ ID NO: 616617 - DNA, 25 bp, Rattus norvegicus
aggatgctgccagccgagcgaccct

SEQ ID NO: 616618 - DNA, 25 bp, Rattus norvegicus
agtcttgctggcttcagtgctgctc

SEQ ID NO: 616619 - DNA, 25 bp, Rattus norvegicus
gccgttctccttaatatattcgtcg

SEQ ID NO: 616620 - DNA, 25 bp, Rattus norvegicus
gacgaggcatctcactcagctgtgc

SEQ ID NO: 616621 - DNA, 25 bp, Rattus norvegicus
aatatattcgtcgatgatttctgcg

SEQ ID NO: 616622 - DNA, 25 bp, Rattus norvegicus
cagagtgacgctgctcagtgaggcc

SEQ ID NO: 616623 - DNA, 25 bp, Rattus norvegicus
cagctgggcccagagtgacgctgct

SEQ ID NO: 616624 - DNA, 25 bp, Rattus norvegicus
cgggtgataccagcctgcccagtgt

SEQ ID NO: 616625 - DNA, 25 bp, Rattus norvegicus
atgaccaagtatggccgtgggcatg

SEQ ID NO: 616626 - DNA, 25 bp, Rattus norvegicus
ggctgctctgtgatgaccaagtatg

SEQ ID NO: 616627 - DNA, 25 bp, Rattus norvegicus
ctcgcactcgtagcggaagcgcatg

SEQ ID NO: 616628 - DNA, 25 bp, Rattus norvegicus
gtccaggccgaagccgttctcctta

SEQ ID NO: 616629 - DNA, 25 bp, Rattus norvegicus
agaggttccactttgcttacccaag

SEQ ID NO: 616630 - DNA, 25 bp, Rattus norvegicus
tagcgggacgcctaccttgaatgtc

SEQ ID NO: 616631 - DNA, 25 bp, Rattus norvegicus
ttctcactctttagcgggacgccta

SEQ ID NO: 616632 - DNA, 25 bp, Rattus norvegicus
gtactctccgcaccgaagcgcgaaa

SEQ ID NO: 616633 - DNA, 25 bp, Rattus norvegicus
ccgaagcgcgaaacctgcgggaatc

SEQ ID NO: 616634 - DNA, 25 bp, Rattus norvegicus
tgcgggaatccgcagatgactccga

SEQ ID NO: 616635 - DNA, 25 bp, Rattus norvegicus
ttctttgcctcaggctcatgacccg

SEQ ID NO: 616636 - DNA, 25 bp, Rattus norvegicus
gaatccgcagatgactccgagcgcc

SEQ ID NO: 616637 - DNA, 25 bp, Rattus norvegicus
cggactctctggcagcgcggcgact

SEQ ID NO: 616638 - DNA, 25 bp, Rattus norvegicus
cgtagggaccgacagcccaaaggca

SEQ ID NO: 616639 - DNA, 25 bp, Rattus norvegicus
caagctcagggcgaagcgcgcacga

SEQ ID NO: 616640 - DNA, 25 bp, Rattus norvegicus
gcccagtctgttgggacgatcaccg

SEQ ID NO: 616641 - DNA, 25 bp, Rattus norvegicus
gggcagccggacagcccagtctgtt

SEQ ID NO: 616642 - DNA, 25 bp, Rattus norvegicus
cccaaaggcaagctcagggcgaagc

SEQ ID NO: 616643 - DNA, 25 bp, Rattus norvegicus
ttgtacaccgccaggcgcttctgca

SEQ ID NO: 616644 - DNA, 25 bp, Rattus norvegicus
tgcaggcgtatctgctgggtctgct

SEQ ID NO: 616645 - DNA, 25 bp, Rattus norvegicus
acctcgttgcggtactgcccgagtc

SEQ ID NO: 616646 - DNA, 25 bp, Rattus norvegicus
cccagcatggtgtttacctcgttgc

SEQ ID NO: 616647 - DNA, 25 bp, Rattus norvegicus
gctctggcccagcatggtgtttacc

SEQ ID NO: 616648 - DNA, 25 bp, Rattus norvegicus
ccgcatcaggcgcttgcgcatcttg

SEQ ID NO: 616649 - DNA, 25 bp, Rattus norvegicus
tgggtctgctcctccatcttggagc

SEQ ID NO: 616650 - DNA, 25 bp, Rattus norvegicus
ccagcgcctaggttggctgtgcgct

SEQ ID NO: 616651 - DNA, 25 bp, Rattus norvegicus
tcactcaaagcctgggcgcgatcgc

SEQ ID NO: 616652 - DNA, 25 bp, Rattus norvegicus
cctcggatgcggtcactcaaagcct

SEQ ID NO: 616653 - DNA, 25 bp, Rattus norvegicus
aaccagcccttgatgcgggcctgga

SEQ ID NO: 616654 - DNA, 25 bp, Rattus norvegicus
cgggcctggaagatctcggcctgca

SEQ ID NO: 616655 - DNA, 25 bp, Rattus norvegicus
ggtctcgggcctggttgcccacttc

SEQ ID NO: 616656 - DNA, 25 bp, Rattus norvegicus
caggcgctcacggatagcactcaca

SEQ ID NO: 616657 - DNA, 25 bp, Rattus norvegicus
cttccttttccctcgggcgatgcgg

SEQ ID NO: 616658 - DNA, 25 bp, Rattus norvegicus
tgcacttccggtggcactcctcgaa

SEQ ID NO: 616659 - DNA, 25 bp, Rattus norvegicus
gcagccgcagttcccatcgttcgag

SEQ ID NO: 616660 - DNA, 25 bp, Rattus norvegicus
ttcccatcgttcgaggacgccgcag

SEQ ID NO: 616661 - DNA, 25 bp, Rattus norvegicus
gttccgaaccgcgaccagcgtttga

SEQ ID NO: 616662 - DNA, 25 bp, Rattus norvegicus
ccatggagcttattggttcggtatc

SEQ ID NO: 616663 - DNA, 25 bp, Rattus norvegicus
gaccagcgtttgacccagtgcccag

SEQ ID NO: 616664 - DNA, 25 bp, Rattus norvegicus
tggttcggtatcctccgagatccgc

SEQ ID NO: 616665 - DNA, 25 bp, Rattus norvegicus
gcgctatgcgcaaccgaacccgctg

SEQ ID NO: 616666 - DNA, 25 bp, Rattus norvegicus
ctgggctctcactggcggcagctgc

SEQ ID NO: 616667 - DNA, 25 bp, Rattus norvegicus
ccaacgcagactgggctctcactgg

SEQ ID NO: 616668 - DNA, 25 bp, Rattus norvegicus
tcaggcacttcccacccaacgcaga

SEQ ID NO: 616669 - DNA, 25 bp, Rattus norvegicus
cggagagctagcagccaacacgttc

SEQ ID NO: 616670 - DNA, 25 bp, Rattus norvegicus
aggccacctccaagtggcggcagcg

SEQ ID NO: 616671 - DNA, 25 bp, Rattus norvegicus
actcgcaagtgtaattgccctcgtc

SEQ ID NO: 616672 - DNA, 25 bp, Rattus norvegicus
ttgaactgagagttggggaaatcca

SEQ ID NO: 616673 - DNA, 25 bp, Rattus norvegicus
aggtcacctgagagacgcgctccgt

SEQ ID NO: 616674 - DNA, 25 bp, Rattus norvegicus
tccaggcgctgccaggtcacctgag

SEQ ID NO: 616675 - DNA, 25 bp, Rattus norvegicus
ggaaggcagccacaactgtgccatc

SEQ ID NO: 616676 - DNA, 25 bp, Rattus norvegicus
ttggggaaatccacgccgaaggatg

SEQ ID NO: 616677 - DNA, 25 bp, Rattus norvegicus
tggcatggtaactccaccgtgcctc

SEQ ID NO: 616678 - DNA, 25 bp, Rattus norvegicus
acagacggtccttgttgaactgaga

SEQ ID NO: 616679 - DNA, 25 bp, Rattus norvegicus
cgctcggacgaaggacagacggtcc

SEQ ID NO: 616680 - DNA, 25 bp, Rattus norvegicus
tttgcttcttgtttcgctcggacga

SEQ ID NO: 616681 - DNA, 25 bp, Rattus norvegicus
agtgtaattgccctcgtcctctacc

SEQ ID NO: 616682 - DNA, 25 bp, Rattus norvegicus
cgttgggaaacgtggcaaactcgca

SEQ ID NO: 616683 - DNA, 25 bp, Rattus norvegicus
ggccacgaacctcggggagcactcg

SEQ ID NO: 616684 - DNA, 25 bp, Rattus norvegicus
cgcaggtccgcgtttgcttcttgtt

SEQ ID NO: 616685 - DNA, 25 bp, Rattus norvegicus
ccaccacaggatctcgcttgtcatg

SEQ ID NO: 616686 - DNA, 25 bp, Rattus norvegicus
atggtgctgtatgctcttaaactgc

SEQ ID NO: 616687 - DNA, 25 bp, Rattus norvegicus
tatgctcttaaactgcgcgggcagc

SEQ ID NO: 616688 - DNA, 25 bp, Rattus norvegicus
aagcgccacttcctactagcgggtc

SEQ ID NO: 616689 - DNA, 25 bp, Rattus norvegicus
cctactagcgggtcacagacacttc

SEQ ID NO: 616690 - DNA, 25 bp, Rattus norvegicus
agcgggtcacagacacttccgcttc

SEQ ID NO: 616691 - DNA, 25 bp, Rattus norvegicus
gcttccgccttctagcgcggcaata

SEQ ID NO: 616692 - DNA, 25 bp, Rattus norvegicus
cacacttccgttgccgagatgcttg

SEQ ID NO: 616693 - DNA, 25 bp, Rattus norvegicus
ggatctcgcttgtcatgctcctgcg

SEQ ID NO: 616694 - DNA, 25 bp, Rattus norvegicus
tgctcctgcgccgttctcaaatggt

SEQ ID NO: 616695 - DNA, 25 bp, Rattus norvegicus
actcacagtagtaggccaccacagg

SEQ ID NO: 616696 - DNA, 25 bp, Rattus norvegicus
cggcgactcggagagactcacagta

SEQ ID NO: 616697 - DNA, 25 bp, Rattus norvegicus
cgccgttctcaaatggtgctgtatg

SEQ ID NO: 616698 - DNA, 25 bp, Rattus norvegicus
agatgcttgtctgcgacggatgccc

SEQ ID NO: 616699 - DNA, 25 bp, Rattus norvegicus
agcccacatcttgactcctatttgc

SEQ ID NO: 616700 - DNA, 25 bp, Rattus norvegicus
tgggtatctgcaactcggacacgag

SEQ ID NO: 616701 - DNA, 25 bp, Rattus norvegicus
tcctttagagcgtgcctcgctgttc

SEQ ID NO: 616702 - DNA, 25 bp, Rattus norvegicus
tcggactgaaaaggggacctcactg

SEQ ID NO: 616703 - DNA, 25 bp, Rattus norvegicus
ggcagaaccgtctcgaagggagttc

SEQ ID NO: 616704 - DNA, 25 bp, Rattus norvegicus
gcaagagccgcgctttcccaaaagg

SEQ ID NO: 616705 - DNA, 25 bp, Rattus norvegicus
ttggcgactgcaaaacaactttgaa

SEQ ID NO: 616706 - DNA, 25 bp, Rattus norvegicus
cgaaccgggctggattatttagcaa

SEQ ID NO: 616707 - DNA, 25 bp, Rattus norvegicus
tctctgctgcagagtttcgagcgcc

SEQ ID NO: 616708 - DNA, 25 bp, Rattus norvegicus
ctcggacacgaggttcctttagagc

SEQ ID NO: 616709 - DNA, 25 bp, Rattus norvegicus
gtagacagatattccagcccacatc

SEQ ID NO: 616710 - DNA, 25 bp, Rattus norvegicus
ccctgggccggaatgtagacagata

SEQ ID NO: 616711 - DNA, 25 bp, Rattus norvegicus
cgggacccttctctggcagagttga

SEQ ID NO: 616712 - DNA, 25 bp, Rattus norvegicus
cctcactgtggcattgggtatctgc

SEQ ID NO: 616713 - DNA, 25 bp, Rattus norvegicus
cacagctcaccggatcagttctttc

SEQ ID NO: 616714 - DNA, 25 bp, Rattus norvegicus
ccctactggtcgttctaataagacg

SEQ ID NO: 616715 - DNA, 25 bp, Rattus norvegicus
tccgccttctcctggaattaaacta

SEQ ID NO: 616716 - DNA, 25 bp, Rattus norvegicus
ctgtctggcctcacgattctatctc

SEQ ID NO: 616717 - DNA, 25 bp, Rattus norvegicus
ggatcagttctttcggcccagcttt

SEQ ID NO: 616718 - DNA, 25 bp, Rattus norvegicus
gagcagtcacaggtctgaagtgtcc

SEQ ID NO: 616719 - DNA, 25 bp, Rattus norvegicus
accactctcgtgtaccgatcgggtg

SEQ ID NO: 616720 - DNA, 25 bp, Rattus norvegicus
tgcctagggaccactctcgtgtacc

SEQ ID NO: 616721 - DNA, 25 bp, Rattus norvegicus
cagcgtcggtgacaatctggacggc

SEQ ID NO: 616722 - DNA, 25 bp, Rattus norvegicus
cagcggcaacaacggcagcgtcggt

SEQ ID NO: 616723 - DNA, 25 bp, Rattus norvegicus
ttcctgaagcaggagcagtagcagc

SEQ ID NO: 616724 - DNA, 25 bp, Rattus norvegicus
ccgcgcgttttcacctgtttcctga

SEQ ID NO: 616725 - DNA, 25 bp, Rattus norvegicus
ttctgacgaaggcatccgcgcgttt

SEQ ID NO: 616726 - DNA, 25 bp, Rattus norvegicus
gggccggactcatgacgtcacaggc

SEQ ID NO: 616727 - DNA, 25 bp, Rattus norvegicus
gtgaccgttcttgccgtggatgtta

SEQ ID NO: 616728 - DNA, 25 bp, Rattus norvegicus
gacgctgactgccacggccatgaca

SEQ ID NO: 616729 - DNA, 25 bp, Rattus norvegicus
cgtcccttgcgtctcatgcagtaga

SEQ ID NO: 616730 - DNA, 25 bp, Rattus norvegicus
ctcatgcagtagaaagcagcgacta

SEQ ID NO: 616731 - DNA, 25 bp, Rattus norvegicus
cagcgactacgagtagcaagagacc

SEQ ID NO: 616732 - DNA, 25 bp, Rattus norvegicus
tagcaagagaccgacgctgactgcc

SEQ ID NO: 616733 - DNA, 25 bp, Rattus norvegicus
gccaaagtggaacacgtgaccgttc

SEQ ID NO: 616734 - DNA, 25 bp, Rattus norvegicus
agtctgaggggccactgtatggaaa

SEQ ID NO: 616735 - DNA, 25 bp, Rattus norvegicus
ggccactgtatggaaaagacaacga

SEQ ID NO: 616736 - DNA, 25 bp, Rattus norvegicus
caacgaagatgtgctcagtactaca

SEQ ID NO: 616737 - DNA, 25 bp, Rattus norvegicus
gtactacattagctgcctgcgtgtc

SEQ ID NO: 616738 - DNA, 25 bp, Rattus norvegicus
tagaagcttcgcaggacacgccctc

SEQ ID NO: 616739 - DNA, 25 bp, Rattus norvegicus
tggttacgtaccagagccaaagtgg

SEQ ID NO: 616740 - DNA, 25 bp, Rattus norvegicus
tcttgccgtggatgttagaagcttc

SEQ ID NO: 616741 - DNA, 25 bp, Rattus norvegicus
atctaaaagacaccgcgcggagacc

SEQ ID NO: 616742 - DNA, 25 bp, Rattus norvegicus
gacacgcattcccaaggtggcttgc

SEQ ID NO: 616743 - DNA, 25 bp, Rattus norvegicus
gactttgacacgcattcccaaggtg

SEQ ID NO: 616744 - DNA, 25 bp, Rattus norvegicus
cctgcgggactttgacacgcattcc

SEQ ID NO: 616745 - DNA, 25 bp, Rattus norvegicus
ggtcccttccttcctggccacctgc

SEQ ID NO: 616746 - DNA, 25 bp, Rattus norvegicus
gcattcccaaggtggcttgcggccc

SEQ ID NO: 616747 - DNA, 25 bp, Rattus norvegicus
ggatctaaaagacaccgcgcggaga

SEQ ID NO: 616748 - DNA, 25 bp, Rattus norvegicus
tagtgccccgagctgggatctaaaa

SEQ ID NO: 616749 - DNA, 25 bp, Rattus norvegicus
cgcccgatcagtctagttagtgccc

SEQ ID NO: 616750 - DNA, 25 bp, Rattus norvegicus
accgcccgatcagtctagttagtgc

SEQ ID NO: 616751 - DNA, 25 bp, Rattus norvegicus
gggaccgcccgatcagtctagttag

SEQ ID NO: 616752 - DNA, 25 bp, Rattus norvegicus
cagccatggggaccgcccgatcagt

SEQ ID NO: 616753 - DNA, 25 bp, Rattus norvegicus
tccatccaacccatgcccgcggctg

SEQ ID NO: 616754 - DNA, 25 bp, Rattus norvegicus
ggccacctgcgggactttgacacgc

SEQ ID NO: 616755 - DNA, 25 bp, Rattus norvegicus
ggtcttatcgctccgggcttttgcc

SEQ ID NO: 616756 - DNA, 25 bp, Rattus norvegicus
gcgctggagcaactttaccgcccgg

SEQ ID NO: 616757 - DNA, 25 bp, Rattus norvegicus
cattgctcttccaggcgctggagca

SEQ ID NO: 616758 - DNA, 25 bp, Rattus norvegicus
ctgcattgctcttccaggcgctgga

SEQ ID NO: 616759 - DNA, 25 bp, Rattus norvegicus
gcctgagatccctgcattgctcttc

SEQ ID NO: 616760 - DNA, 25 bp, Rattus norvegicus
ggggccccacgaacagcctgagatc

SEQ ID NO: 616761 - DNA, 25 bp, Rattus norvegicus
acctctcgaagtagctgtgcggtgc

SEQ ID NO: 616762 - DNA, 25 bp, Rattus norvegicus
cactgccacccttgcggggctgtag

SEQ ID NO: 616763 - DNA, 25 bp, Rattus norvegicus
cttgcggggctgtagccgcagccat

SEQ ID NO: 616764 - DNA, 25 bp, Rattus norvegicus
tttgccacctctcgaagtagctgtg

SEQ ID NO: 616765 - DNA, 25 bp, Rattus norvegicus
cgggcttttgccacctctcgaagta

SEQ ID NO: 616766 - DNA, 25 bp, Rattus norvegicus
ccctggtcttatcgctccgggcttt

SEQ ID NO: 616767 - DNA, 25 bp, Rattus norvegicus
taccgcccggccaagcgcgcgtggc

SEQ ID NO: 616768 - DNA, 25 bp, Rattus norvegicus
tgtagccgcagccatgggtcgctcg

SEQ ID NO: 616769 - DNA, 25 bp, Rattus norvegicus
ggccctgtgctctcaccctgcggct

SEQ ID NO: 616770 - DNA, 25 bp, Rattus norvegicus
agcccgcggccagacgcggaatgca

SEQ ID NO: 616771 - DNA, 25 bp, Rattus norvegicus
ccatgaggggtgtgtcattgtgaca

SEQ ID NO: 616772 - DNA, 25 bp, Rattus norvegicus
tcattgtgacagttcttgaggccgc

SEQ ID NO: 616773 - DNA, 25 bp, Rattus norvegicus
gacagttcttgaggccgctgtcagc

SEQ ID NO: 616774 - DNA, 25 bp, Rattus norvegicus
acggggaaattcgagtcaagagcca

SEQ ID NO: 616775 - DNA, 25 bp, Rattus norvegicus
gtgcgcaccagaggcagaagcccgc

SEQ ID NO: 616776 - DNA, 25 bp, Rattus norvegicus
ccagacgcggaatgcagagccgagc

SEQ ID NO: 616777 - DNA, 25 bp, Rattus norvegicus
cagagccgagctgccagagtacatc

SEQ ID NO: 616778 - DNA, 25 bp, Rattus norvegicus
ctgccagagtacatctgagcgttca

SEQ ID NO: 616779 - DNA, 25 bp, Rattus norvegicus
acatctgagcgttcacgttggcgcc

SEQ ID NO: 616780 - DNA, 25 bp, Rattus norvegicus
agcgttcacgttggcgccgtgctgt

SEQ ID NO: 616781 - DNA, 25 bp, Rattus norvegicus
ccaccatgaggggtgtgtcattgtg

SEQ ID NO: 616782 - DNA, 25 bp, Rattus norvegicus
accagtgtgcgcaccagaggcagaa

SEQ ID NO: 616783 - DNA, 25 bp, Rattus norvegicus
gtctcgccgggctgcgggacttccc

SEQ ID NO: 616784 - DNA, 25 bp, Rattus norvegicus
tccaggggtccagcaggacctcgcg

SEQ ID NO: 616785 - DNA, 25 bp, Rattus norvegicus
tccagcaggacctcgcggggctgcg

SEQ ID NO: 616786 - DNA, 25 bp, Rattus norvegicus
gggctctggagacgcgggacgcagc

SEQ ID NO: 616787 - DNA, 25 bp, Rattus norvegicus
acgcagcgggcgcttgcggagtggc

SEQ ID NO: 616788 - DNA, 25 bp, Rattus norvegicus
gcagcgcggcgcctgagatgccctt

SEQ ID NO: 616789 - DNA, 25 bp, Rattus norvegicus
cagcgcggcgcctgagatgcccttg

SEQ ID NO: 616790 - DNA, 25 bp, Rattus norvegicus
gcggcgcctgagatgcccttgggcc

SEQ ID NO: 616791 - DNA, 25 bp, Rattus norvegicus
cttgggccgggtgcgtaggtccacg

SEQ ID NO: 616792 - DNA, 25 bp, Rattus norvegicus
tcgcagttgctgcgcagggcgtcca

SEQ ID NO: 616793 - DNA, 25 bp, Rattus norvegicus
ctcagcacgggaaggcggtctcgcc

SEQ ID NO: 616794 - DNA, 25 bp, Rattus norvegicus
gcgtccaggggtccagcaggacctc

SEQ ID NO: 616795 - DNA, 25 bp, Rattus norvegicus
ggacgtcgcagttgctgcgcagggc

SEQ ID NO: 616796 - DNA, 25 bp, Rattus norvegicus
gggcatcggggcatcgggccgcccg

SEQ ID NO: 616797 - DNA, 25 bp, Rattus norvegicus
taagtctagatggaggcagcatggc

SEQ ID NO: 616798 - DNA, 25 bp, Rattus norvegicus
tgggtcaagcgtccctagatgcgca

SEQ ID NO: 616799 - DNA, 25 bp, Rattus norvegicus
ctagatgcgcatgcgcccagcctgg

SEQ ID NO: 616800 - DNA, 25 bp, Rattus norvegicus
catgctgtgggctgggtaccaaagc

SEQ ID NO: 616801 - DNA, 25 bp, Rattus norvegicus
gcccgcatccgtgctgcaggtgagc

SEQ ID NO: 616802 - DNA, 25 bp, Rattus norvegicus
tgggtaccaaagcaagctgcgcttg

SEQ ID NO: 616803 - DNA, 25 bp, Rattus norvegicus
cacagttcggcgctaagtctagatg

SEQ ID NO: 616804 - DNA, 25 bp, Rattus norvegicus
actgggcagctctcccacagttcgg

SEQ ID NO: 616805 - DNA, 25 bp, Rattus norvegicus
ggacgtttatggactgggcagctct

SEQ ID NO: 616806 - DNA, 25 bp, Rattus norvegicus
ccacgtgcattcattgggacgttta

SEQ ID NO: 616807 - DNA, 25 bp, Rattus norvegicus
ggaaaggctgacaaccacgtgcatt

SEQ ID NO: 616808 - DNA, 25 bp, Rattus norvegicus
tgctgcaagggcacgattctctcca

SEQ ID NO: 616809 - DNA, 25 bp, Rattus norvegicus
cagcggcctgcgctgctactgaaga

SEQ ID NO: 616810 - DNA, 25 bp, Rattus norvegicus
ttgtcagtcaacaggaggaccttcc

SEQ ID NO: 616811 - DNA, 25 bp, Rattus norvegicus
tgcctcctccctgcggacgccatgc

SEQ ID NO: 616812 - DNA, 25 bp, Rattus norvegicus
ttcagcggctcgctgcggctgacgc

SEQ ID NO: 616813 - DNA, 25 bp, Rattus norvegicus
cagcgcagtgtcgttggccatgacc

SEQ ID NO: 616814 - DNA, 25 bp, Rattus norvegicus
tacgctccaccagcgcagtgtcgtt

SEQ ID NO: 616815 - DNA, 25 bp, Rattus norvegicus
gaagggtatccctacgctccaccag

SEQ ID NO: 616816 - DNA, 25 bp, Rattus norvegicus
ctacagatgagacgaagggtatccc

SEQ ID NO: 616817 - DNA, 25 bp, Rattus norvegicus
acctcacactggtaggcgcctgcct

SEQ ID NO: 616818 - DNA, 25 bp, Rattus norvegicus
attgaagaaccagcggacctcagcg

SEQ ID NO: 616819 - DNA, 25 bp, Rattus norvegicus
gcgtcaccattgaagaaccagcgga

SEQ ID NO: 616820 - DNA, 25 bp, Rattus norvegicus
acgggcagagcgtcaccattgaaga

SEQ ID NO: 616821 - DNA, 25 bp, Rattus norvegicus
catcaggggacaggcccaagcggac

SEQ ID NO: 616822 - DNA, 25 bp, Rattus norvegicus
atcctgccatcaggggacaggccca

SEQ ID NO: 616823 - DNA, 25 bp, Rattus norvegicus
atgccgggtcagcatcctgccatca

SEQ ID NO: 616824 - DNA, 25 bp, Rattus norvegicus
ggctgacgctgaccgggttccacac

SEQ ID NO: 616825 - DNA, 25 bp, Rattus norvegicus
aatctcagcgcacgggtgtcaccct

SEQ ID NO: 616826 - DNA, 25 bp, Rattus norvegicus
ggtccgattcagtccctgtagtcca

SEQ ID NO: 616827 - DNA, 25 bp, Rattus norvegicus
ctttaagcgaggtcttcggcgcgca

SEQ ID NO: 616828 - DNA, 25 bp, Rattus norvegicus
gtgtcaccctttaagcgaggtcttc

SEQ ID NO: 616829 - DNA, 25 bp, Rattus norvegicus
agcgtaaagcaggacagcagcagca

SEQ ID NO: 616830 - DNA, 25 bp, Rattus norvegicus
tccaagctagcagcgagcgggcaag

SEQ ID NO: 616831 - DNA, 25 bp, Rattus norvegicus
gtagctggcgtcatctggaatctca

SEQ ID NO: 616832 - DNA, 25 bp, Rattus norvegicus
tacccgctttctggagcgtaaagca

SEQ ID NO: 616833 - DNA, 25 bp, Rattus norvegicus
gaccacacccgggagcgagaggcac

SEQ ID NO: 616834 - DNA, 25 bp, Rattus norvegicus
atgtggttccgggtccgattcagtc

SEQ ID NO: 616835 - DNA, 25 bp, Rattus norvegicus
gtagtccacgcggatccaagctagc

SEQ ID NO: 616836 - DNA, 25 bp, Rattus norvegicus
gcaagcgtcctttctctcccggtag

SEQ ID NO: 616837 - DNA, 25 bp, Rattus norvegicus
tttctctcccggtagctggcgtcat

SEQ ID NO: 616838 - DNA, 25 bp, Rattus norvegicus
cgcggggctacttacccgctttctg

SEQ ID NO: 616839 - DNA, 25 bp, Rattus norvegicus
tcatgtcggatgtgcttcaggatcg

SEQ ID NO: 616840 - DNA, 25 bp, Rattus norvegicus
agaggtcaccgttgtacgcatgtgc

SEQ ID NO: 616841 - DNA, 25 bp, Rattus norvegicus
ccggccactcgaatcatgtcggatg

SEQ ID NO: 616842 - DNA, 25 bp, Rattus norvegicus
atgctgactcgaagtggaggccaga

SEQ ID NO: 616843 - DNA, 25 bp, Rattus norvegicus
cccatttcgttctgacgttgagtcg

SEQ ID NO: 616844 - DNA, 25 bp, Rattus norvegicus
gacgttgagtcgtcagcggctcaga

SEQ ID NO: 616845 - DNA, 25 bp, Rattus norvegicus
acaccaagggctctcggacctgcag

SEQ ID NO: 616846 - DNA, 25 bp, Rattus norvegicus
ctcggacctgcaggttggtgatagc

SEQ ID NO: 616847 - DNA, 25 bp, Rattus norvegicus
atagcggagggacgttcacagtgct

SEQ ID NO: 616848 - DNA, 25 bp, Rattus norvegicus
tcacagtgctcgatatgcgcatgcg

SEQ ID NO: 616849 - DNA, 25 bp, Rattus norvegicus
cgggaatctggacgcgttagtgtca

SEQ ID NO: 616850 - DNA, 25 bp, Rattus norvegicus
tcagtccaggactctgtcgcggagg

SEQ ID NO: 616851 - DNA, 25 bp, Rattus norvegicus
agcgacctagcggatgctgactcga

SEQ ID NO: 616852 - DNA, 25 bp, Rattus norvegicus
ctggggttcctgtctcagtccagga

SEQ ID NO: 616853 - DNA, 25 bp, Rattus norvegicus
cgtctcgtaagtaacagtcgcgctg

SEQ ID NO: 616854 - DNA, 25 bp, Rattus norvegicus
cgctctcgctgttgttgcactcgaa

SEQ ID NO: 616855 - DNA, 25 bp, Rattus norvegicus
gctgttgttgcactcgaactccttg

SEQ ID NO: 616856 - DNA, 25 bp, Rattus norvegicus
tgttgcactcgaactccttgtcgta

SEQ ID NO: 616857 - DNA, 25 bp, Rattus norvegicus
aactccttgtcgtactggccgctca

SEQ ID NO: 616858 - DNA, 25 bp, Rattus norvegicus
cccagcacgtctcgtaagtaacagt

SEQ ID NO: 616859 - DNA, 25 bp, Rattus norvegicus
gtaagtaacagtcgcgctggccgcc

SEQ ID NO: 616860 - DNA, 25 bp, Rattus norvegicus
acccacgggcggtgctgttgagctc

SEQ ID NO: 616861 - DNA, 25 bp, Rattus norvegicus
ttgagctcgcggtcgcctcgggcca

SEQ ID NO: 616862 - DNA, 25 bp, Rattus norvegicus
agcggagaaggagcgctcagccctc

SEQ ID NO: 616863 - DNA, 25 bp, Rattus norvegicus
tcagccctcgaggagtgagtcccgg

SEQ ID NO: 616864 - DNA, 25 bp, Rattus norvegicus
ggctgcacctcagtcactcaccatg

SEQ ID NO: 616865 - DNA, 25 bp, Rattus norvegicus
caccatgcccggctgcgactgcagc

SEQ ID NO: 616866 - DNA, 25 bp, Rattus norvegicus
tactggccgctcacgtcgtagtagc

SEQ ID NO: 616867 - DNA, 25 bp, Rattus norvegicus
ttgaatgcctgaagttcgcggcccg

SEQ ID NO: 616868 - DNA, 25 bp, Rattus norvegicus
ccctcatgggcgagcacatacacta

SEQ ID NO: 616869 - DNA, 25 bp, Rattus norvegicus
tatgatggccatgaaccacggtcgc

SEQ ID NO: 616870 - DNA, 25 bp, Rattus norvegicus
ctttcaggactggaaatggcagacc

SEQ ID NO: 616871 - DNA, 25 bp, Rattus norvegicus
attaggccacttcagggaacccagg

SEQ ID NO: 616872 - DNA, 25 bp, Rattus norvegicus
gtgttccgagccgaaatcgcaaaga

SEQ ID NO: 616873 - DNA, 25 bp, Rattus norvegicus
ccctctatgtgctgctgagccggtc

SEQ ID NO: 616874 - DNA, 25 bp, Rattus norvegicus
ggctgctgcaagacctcggcgccaa

SEQ ID NO: 616875 - DNA, 25 bp, Rattus norvegicus
ggaacggctcggaatttgctccagc

SEQ ID NO: 616876 - DNA, 25 bp, Rattus norvegicus
cggagaaacacagctcattgttggc

SEQ ID NO: 616877 - DNA, 25 bp, Rattus norvegicus
actgtggccaaagcccggagaaaca

SEQ ID NO: 616878 - DNA, 25 bp, Rattus norvegicus
gcccttcctgagatccttatattaa

SEQ ID NO: 616879 - DNA, 25 bp, Rattus norvegicus
aatccgtatgttcgtgcttgccgcc

SEQ ID NO: 616880 - DNA, 25 bp, Rattus norvegicus
gcgtctgctcgtttcgctttcagga

SEQ ID NO: 616881 - DNA, 25 bp, Rattus norvegicus
ggctaataagccaaccagaacccga

SEQ ID NO: 616882 - DNA, 25 bp, Rattus norvegicus
cacaattactgtcgatctcagaagc

SEQ ID NO: 616883 - DNA, 25 bp, Rattus norvegicus
ttctcgccggagacacaattactgt

SEQ ID NO: 616884 - DNA, 25 bp, Rattus norvegicus
caactcaaacccaggggcacagatg

SEQ ID NO: 616885 - DNA, 25 bp, Rattus norvegicus
ccaggggcacagatggctaataagc

SEQ ID NO: 616886 - DNA, 25 bp, Rattus norvegicus
cagaacccgatgagttcccagaatt

SEQ ID NO: 616887 - DNA, 25 bp, Rattus norvegicus
ccagaattccgcgtggagaaactgt

SEQ ID NO: 616888 - DNA, 25 bp, Rattus norvegicus
agaaactgtgacgacgctcggctcc

SEQ ID NO: 616889 - DNA, 25 bp, Rattus norvegicus
gacgacgctcggctccgtggtaacg

SEQ ID NO: 616890 - DNA, 25 bp, Rattus norvegicus
tctcagaagcatctaggggacatcc

SEQ ID NO: 616891 - DNA, 25 bp, Rattus norvegicus
acgaagcgcgggatcactgcagaat

SEQ ID NO: 616892 - DNA, 25 bp, Rattus norvegicus
gggatcactgcagaatcaacttgcc

SEQ ID NO: 616893 - DNA, 25 bp, Rattus norvegicus
agctcgcgctgttccttacctttca

SEQ ID NO: 616894 - DNA, 25 bp, Rattus norvegicus
ggggacatcctgactaaaacaactc

SEQ ID NO: 616895 - DNA, 25 bp, Rattus norvegicus
tctggtcccagctgaagtcgcactt

SEQ ID NO: 616896 - DNA, 25 bp, Rattus norvegicus
ggaactgcatcttctctttgcggta

SEQ ID NO: 616897 - DNA, 25 bp, Rattus norvegicus
gatgccctcgtatggctcgtcctca

SEQ ID NO: 616898 - DNA, 25 bp, Rattus norvegicus
tcattcagaggctggtcggatgccc

SEQ ID NO: 616899 - DNA, 25 bp, Rattus norvegicus
actcctgcagggtgatgatcccatc

SEQ ID NO: 616900 - DNA, 25 bp, Rattus norvegicus
ccgtcctggtcgtacatgttgaaga

SEQ ID NO: 616901 - DNA, 25 bp, Rattus norvegicus
tcctggaaggtgatctcctccgcca

SEQ ID NO: 616902 - DNA, 25 bp, Rattus norvegicus
caggttccggttgtcgaagaaggca

SEQ ID NO: 616903 - DNA, 25 bp, Rattus norvegicus
atcctggagcggatcgggttgaact

SEQ ID NO: 616904 - DNA, 25 bp, Rattus norvegicus
caggtccaggacgttgtcgaagttc

SEQ ID NO: 616905 - DNA, 25 bp, Rattus norvegicus
tgcaactgcttgatctggtcccagc

SEQ ID NO: 616906 - DNA, 25 bp, Rattus norvegicus
ttcatgaacgcctcctggatgtgcg

SEQ ID NO: 616907 - DNA, 25 bp, Rattus norvegicus
gatgtgcgcccaccataagtcggtc

SEQ ID NO: 616908 - DNA, 25 bp, Rattus norvegicus
cggaacctctggtgcaactgcttga

SEQ ID NO: 616909 - DNA, 25 bp, Rattus norvegicus
gcccttcccaacctgagccaaggtg

SEQ ID NO: 616910 - DNA, 25 bp, Rattus norvegicus
gtccgcggttgtgctactgactact

SEQ ID NO: 616911 - DNA, 25 bp, Rattus norvegicus
cgcggttgtgctactgactactgca

SEQ ID NO: 616912 - DNA, 25 bp, Rattus norvegicus
ggttgtgctactgactactgcaaca

SEQ ID NO: 616913 - DNA, 25 bp, Rattus norvegicus
gtgctactgactactgcaacagcga

SEQ ID NO: 616914 - DNA, 25 bp, Rattus norvegicus
tactgactactgcaacagcgacctc

SEQ ID NO: 616915 - DNA, 25 bp, Rattus norvegicus
gactactgcaacagcgacctcaaga

SEQ ID NO: 616916 - DNA, 25 bp, Rattus norvegicus
tactgcaacagcgacctcaagactc

SEQ ID NO: 616917 - DNA, 25 bp, Rattus norvegicus
tgcaacagcgacctcaagactcacg

SEQ ID NO: 616918 - DNA, 25 bp, Rattus norvegicus
aagactcacgatgcccttcccaacc

SEQ ID NO: 616919 - DNA, 25 bp, Rattus norvegicus
ctgagccaaggtgcactaaggggcg

SEQ ID NO: 616920 - DNA, 25 bp, Rattus norvegicus
tcggaggcagggctggagaaatcgg

SEQ ID NO: 616921 - DNA, 25 bp, Rattus norvegicus
agctggagaaattggggtggcgcta

SEQ ID NO: 616922 - DNA, 25 bp, Rattus norvegicus
acagcgacctcaagactcacgatgc

SEQ ID NO: 616923 - DNA, 25 bp, Rattus norvegicus
tcaacgcgtcttaccgcagcatcgg

SEQ ID NO: 616924 - DNA, 25 bp, Rattus norvegicus
ctatacatgaacacgcacccgggtc

SEQ ID NO: 616925 - DNA, 25 bp, Rattus norvegicus
tggttcgtggccaaactatacatga

SEQ ID NO: 616926 - DNA, 25 bp, Rattus norvegicus
ccgccactggttcgtggccaaacta

SEQ ID NO: 616927 - DNA, 25 bp, Rattus norvegicus
accaagtccgattccgccactggtt

SEQ ID NO: 616928 - DNA, 25 bp, Rattus norvegicus
cttaccgcagcatcggggcgctcaa

SEQ ID NO: 616929 - DNA, 25 bp, Rattus norvegicus
gggtcctgctcaacgcgtcttaccg

SEQ ID NO: 616930 - DNA, 25 bp, Rattus norvegicus
tacttctgcgtagcggggtcctgct

SEQ ID NO: 616931 - DNA, 25 bp, Rattus norvegicus
gtgcctcgcgcggtacttctgcgta

SEQ ID NO: 616932 - DNA, 25 bp, Rattus norvegicus
tgctacgtctctacctggtgcctcg

SEQ ID NO: 616933 - DNA, 25 bp, Rattus norvegicus
ggccatgctgctacgtctctacctg

SEQ ID NO: 616934 - DNA, 25 bp, Rattus norvegicus
gttgctgtccctggccatgctgcta

SEQ ID NO: 616935 - DNA, 25 bp, Rattus norvegicus
tggcgcagatcctgctggagctgct

SEQ ID NO: 616936 - DNA, 25 bp, Rattus norvegicus
gggcgctcaaccaagtccgattccg

SEQ ID NO: 616937 - DNA, 25 bp, Rattus norvegicus
tcctctggagcttccgggacaccaa

SEQ ID NO: 616938 - DNA, 25 bp, Rattus norvegicus
gcgccgcgacccaggaactaatcgg

SEQ ID NO: 616939 - DNA, 25 bp, Rattus norvegicus
tccggcgccatttaccggacaggtg

SEQ ID NO: 616940 - DNA, 25 bp, Rattus norvegicus
ggacaccaaggcctgttccggaata

SEQ ID NO: 616941 - DNA, 25 bp, Rattus norvegicus
cctgacttgggctgtgtactgtgtc

SEQ ID NO: 616942 - DNA, 25 bp, Rattus norvegicus
caatgtagagcgcacgtttggttcg

SEQ ID NO: 616943 - DNA, 25 bp, Rattus norvegicus
ttcagtcacgcatgctcaatgtaga

SEQ ID NO: 616944 - DNA, 25 bp, Rattus norvegicus
tgcgtgttgaaaccagccactttca

SEQ ID NO: 616945 - DNA, 25 bp, Rattus norvegicus
ctactctgtaatccgcgcatgcgtg

SEQ ID NO: 616946 - DNA, 25 bp, Rattus norvegicus
aattgactccctcgcctactctgta

SEQ ID NO: 616947 - DNA, 25 bp, Rattus norvegicus
gcacgcgccttctctgcgcaattga

SEQ ID NO: 616948 - DNA, 25 bp, Rattus norvegicus
cccagcgaaacagcaggctcgatca

SEQ ID NO: 616949 - DNA, 25 bp, Rattus norvegicus
tcgaactcgaaatctccagagctgc

SEQ ID NO: 616950 - DNA, 25 bp, Rattus norvegicus
gaatagccggcacccgctttttctg

SEQ ID NO: 616951 - DNA, 25 bp, Rattus norvegicus
gcagtcttaagcacctgctcttgta

SEQ ID NO: 616952 - DNA, 25 bp, Rattus norvegicus
gaaggttgcatggtggtctccacga

SEQ ID NO: 616953 - DNA, 25 bp, Rattus norvegicus
ggccgaaatccacctccttcagata

SEQ ID NO: 616954 - DNA, 25 bp, Rattus norvegicus
ccagcgtgccaaatacagggatgcc

SEQ ID NO: 616955 - DNA, 25 bp, Rattus norvegicus
cttggtgcgcacaaagtaaaacttc

SEQ ID NO: 616956 - DNA, 25 bp, Rattus norvegicus
caccaggaagatgcggggatcactc

SEQ ID NO: 616957 - DNA, 25 bp, Rattus norvegicus
tggtcacgagcatcgggaaatcata

SEQ ID NO: 616958 - DNA, 25 bp, Rattus norvegicus
ctgcagagcctccagcgagatgtca

SEQ ID NO: 616959 - DNA, 25 bp, Rattus norvegicus
agcatgtccttcttcttctgcagag

SEQ ID NO: 616960 - DNA, 25 bp, Rattus norvegicus
gacaccggacaccaaggcagtctta

SEQ ID NO: 616961 - DNA, 25 bp, Rattus norvegicus
agcggataagcaaggcgtcgtcgta

SEQ ID NO: 616962 - DNA, 25 bp, Rattus norvegicus
gtctctggtgagacctcgttggcca

SEQ ID NO: 616963 - DNA, 25 bp, Rattus norvegicus
ctgcgagtagagtctcaggacagtc

SEQ ID NO: 616964 - DNA, 25 bp, Rattus norvegicus
tggcaccatctgaggactgcgagta

SEQ ID NO: 616965 - DNA, 25 bp, Rattus norvegicus
tggaggtccgagagcaagcagtgga

SEQ ID NO: 616966 - DNA, 25 bp, Rattus norvegicus
tggtggaggtccgagagcaagcagt

SEQ ID NO: 616967 - DNA, 25 bp, Rattus norvegicus
tgtggtggaggtccgagagcaagca

SEQ ID NO: 616968 - DNA, 25 bp, Rattus norvegicus
gcgcgccccttctctgcgcagtggc

SEQ ID NO: 616969 - DNA, 25 bp, Rattus norvegicus
aggtccgagagcaagcagtggaggg

SEQ ID NO: 616970 - DNA, 25 bp, Rattus norvegicus
gaggtccgagagcaagcagtggagg

SEQ ID NO: 616971 - DNA, 25 bp, Rattus norvegicus
cctgtggtggaggtccgagagcaag

SEQ ID NO: 616972 - DNA, 25 bp, Rattus norvegicus
tcctgtggtggaggtccgagagcaa

SEQ ID NO: 616973 - DNA, 25 bp, Rattus norvegicus
atcctgtggtggaggtccgagagca

SEQ ID NO: 616974 - DNA, 25 bp, Rattus norvegicus
aatcctgtggtggaggtccgagagc

SEQ ID NO: 616975 - DNA, 25 bp, Rattus norvegicus
gaatcctgtggtggaggtccgagag

SEQ ID NO: 616976 - DNA, 25 bp, Rattus norvegicus
agaatcctgtggtggaggtccgaga

SEQ ID NO: 616977 - DNA, 25 bp, Rattus norvegicus
cagtggctccggagaatcctgtggt

SEQ ID NO: 616978 - DNA, 25 bp, Rattus norvegicus
tgcgcagtggctccggagaatcctg

SEQ ID NO: 616979 - DNA, 25 bp, Rattus norvegicus
gggcctggataattgtgcactgaca

SEQ ID NO: 616980 - DNA, 25 bp, Rattus norvegicus
tggtatcgcgatcgcaaggagctga

SEQ ID NO: 616981 - DNA, 25 bp, Rattus norvegicus
aactcagctgcctggttccgcggtc

SEQ ID NO: 616982 - DNA, 25 bp, Rattus norvegicus
tcagctgcctggttccgcggtcgcg

SEQ ID NO: 616983 - DNA, 25 bp, Rattus norvegicus
ccgcagcggtcctgcgctggtatcg

SEQ ID NO: 616984 - DNA, 25 bp, Rattus norvegicus
tcctgcgctggtatcgcgatcgcaa

SEQ ID NO: 616985 - DNA, 25 bp, Rattus norvegicus
cgctggtatcgcgatcgcaaggagc

SEQ ID NO: 616986 - DNA, 25 bp, Rattus norvegicus
attgtgcactgacacttcgcgggcg

SEQ ID NO: 616987 - DNA, 25 bp, Rattus norvegicus
atcgcgatcgcaaggagctgaaagg

SEQ ID NO: 616988 - DNA, 25 bp, Rattus norvegicus
ctccgcgttcccgaaagaggcgagg

SEQ ID NO: 616989 - DNA, 25 bp, Rattus norvegicus
cccgaaagaggcgaggttagtggtg

SEQ ID NO: 616990 - DNA, 25 bp, Rattus norvegicus
cctggataattgtgcactgacactt

SEQ ID NO: 616991 - DNA, 25 bp, Rattus norvegicus
gataattgtgcactgacacttcgcg

SEQ ID NO: 616992 - DNA, 25 bp, Rattus norvegicus
gaggtggaactcagctgcctggttc

SEQ ID NO: 616993 - DNA, 25 bp, Rattus norvegicus
tgccctcggggcacagcaagcagac

SEQ ID NO: 616994 - DNA, 25 bp, Rattus norvegicus
atcgtcatctgtgaagcgcagaacc

SEQ ID NO: 616995 - DNA, 25 bp, Rattus norvegicus
acggcggtatcgtcatctgtgaagc

SEQ ID NO: 616996 - DNA, 25 bp, Rattus norvegicus
tctgtgaagcgcagaaccaggcgct

SEQ ID NO: 616997 - DNA, 25 bp, Rattus norvegicus
ccgcaaggacgacggcggtatcgtc

SEQ ID NO: 616998 - DNA, 25 bp, Rattus norvegicus
gttccgcgtggaccgcaaggacgac

SEQ ID NO: 616999 - DNA, 25 bp, Rattus norvegicus
gcaagcagacgcagtacgtgctgga

SEQ ID NO: 617000 - DNA, 25 bp, Rattus norvegicus
agacgcagtacgtgctggatgtgca

SEQ ID NO: 617001 - DNA, 25 bp, Rattus norvegicus
cagtacgtgctggatgtgcagtgta

SEQ ID NO: 617002 - DNA, 25 bp, Rattus norvegicus
ctggatgtgcagtgtaagtggctca

SEQ ID NO: 617003 - DNA, 25 bp, Rattus norvegicus
ccaggagaacggcaaggtgtggagc

SEQ ID NO: 617004 - DNA, 25 bp, Rattus norvegicus
cactgtgcggttccgcgtggaccgc

SEQ ID NO: 617005 - DNA, 25 bp, Rattus norvegicus
tgcagtgtaagtggctcaggcgtct

SEQ ID NO: 617006 - DNA, 25 bp, Rattus norvegicus
agaaccaggcgctgccctcggggca

SEQ ID NO: 617007 - DNA, 25 bp, Rattus norvegicus
ctgcggcgacttggcagagtgacca

SEQ ID NO: 617008 - DNA, 25 bp, Rattus norvegicus
gtggtcgttaaaggcccgaggcatc

SEQ ID NO: 617009 - DNA, 25 bp, Rattus norvegicus
aagcctcacggctaggagcgtttcg

SEQ ID NO: 617010 - DNA, 25 bp, Rattus norvegicus
tttctttttggtcgcacacgctctc

SEQ ID NO: 617011 - DNA, 25 bp, Rattus norvegicus
cacagcttcgcctcgaggcattgtg

SEQ ID NO: 617012 - DNA, 25 bp, Rattus norvegicus
agagtcctttgcttctcccagcacg

SEQ ID NO: 617013 - DNA, 25 bp, Rattus norvegicus
gagtgaccagccagagagtcctttg

SEQ ID NO: 617014 - DNA, 25 bp, Rattus norvegicus
aatggtctgtctgaccgcgcacgcg

SEQ ID NO: 617015 - DNA, 25 bp, Rattus norvegicus
accgatcgccgggaatggtctgtct

SEQ ID NO: 617016 - DNA, 25 bp, Rattus norvegicus
tgcagcctgtgcaattctctgagcc

SEQ ID NO: 617017 - DNA, 25 bp, Rattus norvegicus
actgtaccaagtctagcggggctgt

SEQ ID NO: 617018 - DNA, 25 bp, Rattus norvegicus
cgcacgcgcgattcttgaatcttct

SEQ ID NO: 617019 - DNA, 25 bp, Rattus norvegicus
tccctaaacgcaagcgcagtgctcg

SEQ ID NO: 617020 - DNA, 25 bp, Rattus norvegicus
tgaatcttcttcacccttcggaccg

SEQ ID NO: 617021 - DNA, 25 bp, Rattus norvegicus
tccacgaggccatcggggatgtact

SEQ ID NO: 617022 - DNA, 25 bp, Rattus norvegicus
acgtctctctgcgtcgaggtgccaa

SEQ ID NO: 617023 - DNA, 25 bp, Rattus norvegicus
ccattccaggattaagcagtgcacg

SEQ ID NO: 617024 - DNA, 25 bp, Rattus norvegicus
attaagcagtgcacgcgggtcacga

SEQ ID NO: 617025 - DNA, 25 bp, Rattus norvegicus
ggtcacgatggaccagctgtccaca

SEQ ID NO: 617026 - DNA, 25 bp, Rattus norvegicus
gctgtccacagtacaccacgagatg

SEQ ID NO: 617027 - DNA, 25 bp, Rattus norvegicus
ggtgccaaccctggcttccacgagg

SEQ ID NO: 617028 - DNA, 25 bp, Rattus norvegicus
gtacaccacgagatgggccacgtgc

SEQ ID NO: 617029 - DNA, 25 bp, Rattus norvegicus
atgggccacgtgcagtactatctcc

SEQ ID NO: 617030 - DNA, 25 bp, Rattus norvegicus
gtgcagtactatctccagtacaagg

SEQ ID NO: 617031 - DNA, 25 bp, Rattus norvegicus
ccctctccattccaggattaagcag

SEQ ID NO: 617032 - DNA, 25 bp, Rattus norvegicus
ggacctgcacgtctctctgcgtcga

SEQ ID NO: 617033 - DNA, 25 bp, Rattus norvegicus
gtcgaggtgccaaccctggcttcca

SEQ ID NO: 617034 - DNA, 25 bp, Rattus norvegicus
tctccagtacaaggacctgcacgtc

SEQ ID NO: 617035 - DNA, 25 bp, Rattus norvegicus
ctccttctgggtccggccgagttag

SEQ ID NO: 617036 - DNA, 25 bp, Rattus norvegicus
atggctgctttcttcgccctggccg

SEQ ID NO: 617037 - DNA, 25 bp, Rattus norvegicus
gctcatggctgctttcttcgccctg

SEQ ID NO: 617038 - DNA, 25 bp, Rattus norvegicus
acgcgctcatggctgctttcttcgc

SEQ ID NO: 617039 - DNA, 25 bp, Rattus norvegicus
gcgggcctgcaacgcgctcatggct

SEQ ID NO: 617040 - DNA, 25 bp, Rattus norvegicus
ctcctggcttgtggcgggcctgcaa

SEQ ID NO: 617041 - DNA, 25 bp, Rattus norvegicus
cagtggctccttgggctcctggctt

SEQ ID NO: 617042 - DNA, 25 bp, Rattus norvegicus
gtcagcagtggctccttgggctcct

SEQ ID NO: 617043 - DNA, 25 bp, Rattus norvegicus
gccatggcgtcagcagtggctcctt

SEQ ID NO: 617044 - DNA, 25 bp, Rattus norvegicus
gcttccaggccatggcgtcagcagt

SEQ ID NO: 617045 - DNA, 25 bp, Rattus norvegicus
ataggccagcttgctcctccggctt

SEQ ID NO: 617046 - DNA, 25 bp, Rattus norvegicus
tctataggccagcttgctcctccgg

SEQ ID NO: 617047 - DNA, 25 bp, Rattus norvegicus
tccggccgagttagcccggccgcgc

SEQ ID NO: 617048 - DNA, 25 bp, Rattus norvegicus
gcgccctctgaccacgccctctata

SEQ ID NO: 617049 - DNA, 25 bp, Rattus norvegicus
ttcctgtcctcctttgccgtacaag

SEQ ID NO: 617050 - DNA, 25 bp, Rattus norvegicus
aaagagctgccaagaattctgcgtc

SEQ ID NO: 617051 - DNA, 25 bp, Rattus norvegicus
tacgcaggcgtattggttgctggtc

SEQ ID NO: 617052 - DNA, 25 bp, Rattus norvegicus
gcctccgtgttctccaggcgtgtca

SEQ ID NO: 617053 - DNA, 25 bp, Rattus norvegicus
acgcgcgtgggctttattgtgccaa

SEQ ID NO: 617054 - DNA, 25 bp, Rattus norvegicus
tgtgccaatgcccaaacagccttag

SEQ ID NO: 617055 - DNA, 25 bp, Rattus norvegicus
ctctgctcggttggtgatttggaac

SEQ ID NO: 617056 - DNA, 25 bp, Rattus norvegicus
cagccgctgtcatttcgtcttaagg

SEQ ID NO: 617057 - DNA, 25 bp, Rattus norvegicus
ccacctgaaggagtccggatgtctc

SEQ ID NO: 617058 - DNA, 25 bp, Rattus norvegicus
ggaatgacgtcaggatagagccacc

SEQ ID NO: 617059 - DNA, 25 bp, Rattus norvegicus
cacccggtcgtggaaggaatgacgt

SEQ ID NO: 617060 - DNA, 25 bp, Rattus norvegicus
ggtagcactccaagacacacccggt

SEQ ID NO: 617061 - DNA, 25 bp, Rattus norvegicus
attctgcgtcttcgcggtagcactc

SEQ ID NO: 617062 - DNA, 25 bp, Rattus norvegicus
gaggggaaagaccatcctcgagttc

SEQ ID NO: 617063 - DNA, 25 bp, Rattus norvegicus
acatgattggggctgctcctttccc

SEQ ID NO: 617064 - DNA, 25 bp, Rattus norvegicus
ctgcaaacatgattggggctgctcc

SEQ ID NO: 617065 - DNA, 25 bp, Rattus norvegicus
gccgcgtgggtctgaaccctgcact

SEQ ID NO: 617066 - DNA, 25 bp, Rattus norvegicus
tcactgaagagctgctcgccgcgtg

SEQ ID NO: 617067 - DNA, 25 bp, Rattus norvegicus
ttcttcactgaagagctgctcgccg

SEQ ID NO: 617068 - DNA, 25 bp, Rattus norvegicus
ccggccggcaaaacgtcacgtgagc

SEQ ID NO: 617069 - DNA, 25 bp, Rattus norvegicus
agtgcacccgaaggcacagcccgga

SEQ ID NO: 617070 - DNA, 25 bp, Rattus norvegicus
aaaatccacacgttgcaccgctgca

SEQ ID NO: 617071 - DNA, 25 bp, Rattus norvegicus
cgccaagtgcaaaatccacacgttg

SEQ ID NO: 617072 - DNA, 25 bp, Rattus norvegicus
ccaagccgacgccaagtgcaaaatc

SEQ ID NO: 617073 - DNA, 25 bp, Rattus norvegicus
agcgagtcccgcgttccctcactca

SEQ ID NO: 617074 - DNA, 25 bp, Rattus norvegicus
cccgaaggcacagcccggagcgagt

SEQ ID NO: 617075 - DNA, 25 bp, Rattus norvegicus
ttgcaccgctgcaaacatgattggg

SEQ ID NO: 617076 - DNA, 25 bp, Rattus norvegicus
aacgtcacgtgagcccagtgcggaa

SEQ ID NO: 617077 - DNA, 25 bp, Rattus norvegicus
cccaatgtagtgctctggaccgttc

SEQ ID NO: 617078 - DNA, 25 bp, Rattus norvegicus
ccagtaccaggactgggctgggctt

SEQ ID NO: 617079 - DNA, 25 bp, Rattus norvegicus
ctcaggatgctctgcggttcggagc

SEQ ID NO: 617080 - DNA, 25 bp, Rattus norvegicus
aaagaaacctggcatcggggactca

SEQ ID NO: 617081 - DNA, 25 bp, Rattus norvegicus
tgcacgcagcgaaggaaagaaacct

SEQ ID NO: 617082 - DNA, 25 bp, Rattus norvegicus
gatgggaactcaggcgatgcacgca

SEQ ID NO: 617083 - DNA, 25 bp, Rattus norvegicus
agggcgaagatccacccgaggttct

SEQ ID NO: 617084 - DNA, 25 bp, Rattus norvegicus
ctcctacggaggagaactgggccca

SEQ ID NO: 617085 - DNA, 25 bp, Rattus norvegicus
aggccttgtgctggacatgctactg

SEQ ID NO: 617086 - DNA, 25 bp, Rattus norvegicus
cggcaccaccaacgtaggccttgtg

SEQ ID NO: 617087 - DNA, 25 bp, Rattus norvegicus
gagtactggccacgcgcacgcgctt

SEQ ID NO: 617088 - DNA, 25 bp, Rattus norvegicus
ggcatcgaacctgcggccgtggcac

SEQ ID NO: 617089 - DNA, 25 bp, Rattus norvegicus
ccagatgctccactcgtcggtgtgc

SEQ ID NO: 617090 - DNA, 25 bp, Rattus norvegicus
aacttggctgcagcgggcactgccc

SEQ ID NO: 617091 - DNA, 25 bp, Rattus norvegicus
tcctgcagcagccaggactcggtga

SEQ ID NO: 617092 - DNA, 25 bp, Rattus norvegicus
tttcccgaggctggacgtgcattcc

SEQ ID NO: 617093 - DNA, 25 bp, Rattus norvegicus
ctggacgtgcattccgagagagacc

SEQ ID NO: 617094 - DNA, 25 bp, Rattus norvegicus
tttggaagcgcaaagggagaacttc

SEQ ID NO: 617095 - DNA, 25 bp, Rattus norvegicus
ggagatcagcctccgccacgtcgtg

SEQ ID NO: 617096 - DNA, 25 bp, Rattus norvegicus
gtggacatgccggagatcagcctcc

SEQ ID NO: 617097 - DNA, 25 bp, Rattus norvegicus
ttcattatttggtcggtcgggcgtc

SEQ ID NO: 617098 - DNA, 25 bp, Rattus norvegicus
ccggagctggaacccttcttcttca

SEQ ID NO: 617099 - DNA, 25 bp, Rattus norvegicus
cactgagtcccgtgcagggcgcgca

SEQ ID NO: 617100 - DNA, 25 bp, Rattus norvegicus
cgagcctcgcgcttgcgcactgagt

SEQ ID NO: 617101 - DNA, 25 bp, Rattus norvegicus
ccgctgtttgaaaggaccgagcctc

SEQ ID NO: 617102 - DNA, 25 bp, Rattus norvegicus
agaggcccaaccgagcatgcgcact

SEQ ID NO: 617103 - DNA, 25 bp, Rattus norvegicus
ttctcccgcagcgaggcctgagagt

SEQ ID NO: 617104 - DNA, 25 bp, Rattus norvegicus
aagggagaacttcgtgggattctga

SEQ ID NO: 617105 - DNA, 25 bp, Rattus norvegicus
cttggatgggtacgagaaggccttc

SEQ ID NO: 617106 - DNA, 25 bp, Rattus norvegicus
cagtttggagggaaacgagaacgct

SEQ ID NO: 617107 - DNA, 25 bp, Rattus norvegicus
tgagtgtggcggtgggccgccaatt

SEQ ID NO: 617108 - DNA, 25 bp, Rattus norvegicus
gccgccaatttggacgggtagcaga

SEQ ID NO: 617109 - DNA, 25 bp, Rattus norvegicus
cgccaatttggacgggtagcagaag

SEQ ID NO: 617110 - DNA, 25 bp, Rattus norvegicus
atttggacgggtagcagaaggactt

SEQ ID NO: 617111 - DNA, 25 bp, Rattus norvegicus
gggtccagagatgcgccgccagctt

SEQ ID NO: 617112 - DNA, 25 bp, Rattus norvegicus
gccgccagcttggagcggtggccga

SEQ ID NO: 617113 - DNA, 25 bp, Rattus norvegicus
tgtgggcgagctccgctatgcgtga

SEQ ID NO: 617114 - DNA, 25 bp, Rattus norvegicus
cagccagcttggaggggtatgagaa

SEQ ID NO: 617115 - DNA, 25 bp, Rattus norvegicus
tatgagaaggccttgggacaatcgg

SEQ ID NO: 617116 - DNA, 25 bp, Rattus norvegicus
aaacgagaacgctttggggcagtgc

SEQ ID NO: 617117 - DNA, 25 bp, Rattus norvegicus
tagccggtgtgtggccagcttggat

SEQ ID NO: 617118 - DNA, 25 bp, Rattus norvegicus
tacgagaaggccttcgggcagtctg

SEQ ID NO: 617119 - DNA, 25 bp, Rattus norvegicus
aactgacctgactgagcccggggcg

SEQ ID NO: 617120 - DNA, 25 bp, Rattus norvegicus
aggcgaactgacctgactgagcccg

SEQ ID NO: 617121 - DNA, 25 bp, Rattus norvegicus
gcaacccttgctcgcagtcttcctg

SEQ ID NO: 617122 - DNA, 25 bp, Rattus norvegicus
ttcctgggtcgtgtgaactgcggtt

SEQ ID NO: 617123 - DNA, 25 bp, Rattus norvegicus
ggtcgtgtgaactgcggttccttta

SEQ ID NO: 617124 - DNA, 25 bp, Rattus norvegicus
gtcagccccggtgcgtaggactctg

SEQ ID NO: 617125 - DNA, 25 bp, Rattus norvegicus
ccatggcgagcacggccgtcagagt

SEQ ID NO: 617126 - DNA, 25 bp, Rattus norvegicus
cggcggctgagccagcaaagcgcat

SEQ ID NO: 617127 - DNA, 25 bp, Rattus norvegicus
tgagccagcaaagcgcatccggagc

SEQ ID NO: 617128 - DNA, 25 bp, Rattus norvegicus
aaagcgcatccggagcgccggtcct

SEQ ID NO: 617129 - DNA, 25 bp, Rattus norvegicus
tgtggagaggcgaactgacctgact

SEQ ID NO: 617130 - DNA, 25 bp, Rattus norvegicus
tgaactgcggttcctttaaggcagg

SEQ ID NO: 617131 - DNA, 25 bp, Rattus norvegicus
cgccggtcctcctgcgtcaggtgtg

SEQ ID NO: 617132 - DNA, 25 bp, Rattus norvegicus
gctctggcaccatggcgagcacggc

SEQ ID NO: 617133 - DNA, 25 bp, Rattus norvegicus
cagcaccctagaggagggctccttg

SEQ ID NO: 617134 - DNA, 25 bp, Rattus norvegicus
gctgggaccccggattcaaattctc

SEQ ID NO: 617135 - DNA, 25 bp, Rattus norvegicus
ttcaaattctcttcccacctctagg

SEQ ID NO: 617136 - DNA, 25 bp, Rattus norvegicus
tccttgccgcctcaggttccggaat

SEQ ID NO: 617137 - DNA, 25 bp, Rattus norvegicus
cctcaggttccggaatgcgcggtcg

SEQ ID NO: 617138 - DNA, 25 bp, Rattus norvegicus
cgaagcggccatggggacacccagc

SEQ ID NO: 617139 - DNA, 25 bp, Rattus norvegicus
ccacaggaatccgaagcggccatgg

SEQ ID NO: 617140 - DNA, 25 bp, Rattus norvegicus
tagggcacgcccacaaacatcggac

SEQ ID NO: 617141 - DNA, 25 bp, Rattus norvegicus
ctcttcccacctctaggtgtgtgtg

SEQ ID NO: 617142 - DNA, 25 bp, Rattus norvegicus
ttcggagccagtctctgaacctttg

SEQ ID NO: 617143 - DNA, 25 bp, Rattus norvegicus
cacgccctcggaatgttcggagcca

SEQ ID NO: 617144 - DNA, 25 bp, Rattus norvegicus
gagcgggtccctaggaaatccacgc

SEQ ID NO: 617145 - DNA, 25 bp, Rattus norvegicus
atcacgagcgggtccctaggaaatc

SEQ ID NO: 617146 - DNA, 25 bp, Rattus norvegicus
cagtctctgaacctttgggttccgc

SEQ ID NO: 617147 - DNA, 25 bp, Rattus norvegicus
tcccgccctctgagaaaggaggttc

SEQ ID NO: 617148 - DNA, 25 bp, Rattus norvegicus
agccgctccagctcagcgggcctga

SEQ ID NO: 617149 - DNA, 25 bp, Rattus norvegicus
cgctgcagccgctcagccgctccag

SEQ ID NO: 617150 - DNA, 25 bp, Rattus norvegicus
ttggccttctccagggcgctgcagc

SEQ ID NO: 617151 - DNA, 25 bp, Rattus norvegicus
ctttggccttctccagggcgctgca

SEQ ID NO: 617152 - DNA, 25 bp, Rattus norvegicus
cccgcccacttcaggaaactctcgg

SEQ ID NO: 617153 - DNA, 25 bp, Rattus norvegicus
agaaaggaggttcccccgagctgcg

SEQ ID NO: 617154 - DNA, 25 bp, Rattus norvegicus
agcggtcccgccctctgagaaagga

SEQ ID NO: 617155 - DNA, 25 bp, Rattus norvegicus
acagctgcggacgaaaaccacgccc

SEQ ID NO: 617156 - DNA, 25 bp, Rattus norvegicus
atcgggacagctgcggacgaaaacc

SEQ ID NO: 617157 - DNA, 25 bp, Rattus norvegicus
tcatcgggacagctgcggacgaaaa

SEQ ID NO: 617158 - DNA, 25 bp, Rattus norvegicus
ttggatggtcgtcatcgggacagct

SEQ ID NO: 617159 - DNA, 25 bp, Rattus norvegicus
aatttggatggtcgtcatcgggaca

SEQ ID NO: 617160 - DNA, 25 bp, Rattus norvegicus
tagacgcaccttccggcctttgagg

SEQ ID NO: 617161 - DNA, 25 bp, Rattus norvegicus
ctacagcagtgcaccgaggaccgat

SEQ ID NO: 617162 - DNA, 25 bp, Rattus norvegicus
ctgcggttccggaatcccgggcaag

SEQ ID NO: 617163 - DNA, 25 bp, Rattus norvegicus
cggggttgaagactgcagacgtcaa

SEQ ID NO: 617164 - DNA, 25 bp, Rattus norvegicus
gcggactggaccttcacgggctcct

SEQ ID NO: 617165 - DNA, 25 bp, Rattus norvegicus
cacgggcaattctctgtggcagtgc

SEQ ID NO: 617166 - DNA, 25 bp, Rattus norvegicus
tggccttcattcagctacagcagtg

SEQ ID NO: 617167 - DNA, 25 bp, Rattus norvegicus
agaacgaccgcggactggaccttca

SEQ ID NO: 617168 - DNA, 25 bp, Rattus norvegicus
gaggaccgatgcaacgccaaactca

SEQ ID NO: 617169 - DNA, 25 bp, Rattus norvegicus
gccaaactcaacctcactttgcgag

SEQ ID NO: 617170 - DNA, 25 bp, Rattus norvegicus
actttgcgaggcctcaaccctgcag

SEQ ID NO: 617171 - DNA, 25 bp, Rattus norvegicus
ggcctcaaccctgcaggtcggtcgt

SEQ ID NO: 617172 - DNA, 25 bp, Rattus norvegicus
tgggagctgaggcttactgcaagct

SEQ ID NO: 617173 - DNA, 25 bp, Rattus norvegicus
gcttactgcaagctgaggccgggct

SEQ ID NO: 617174 - DNA, 25 bp, Rattus norvegicus
tcacgggctcctggccttcattcag

SEQ ID NO: 617175 - DNA, 25 bp, Rattus norvegicus
cgggccatcaggagccgatcaccaa

SEQ ID NO: 617176 - DNA, 25 bp, Rattus norvegicus
aggagccgatcaccaaccctattgg

SEQ ID NO: 617177 - DNA, 25 bp, Rattus norvegicus
cccgctggcggcatgaacatcatac

SEQ ID NO: 617178 - DNA, 25 bp, Rattus norvegicus
cgcgctattggctggcgtgattgtt

SEQ ID NO: 617179 - DNA, 25 bp, Rattus norvegicus
gaaaagccgctcgagctggccgttc

SEQ ID NO: 617180 - DNA, 25 bp, Rattus norvegicus
aggctgtggtaaccacccgctggcg

SEQ ID NO: 617181 - DNA, 25 bp, Rattus norvegicus
tctcctggctgactgtgattcggct

SEQ ID NO: 617182 - DNA, 25 bp, Rattus norvegicus
aaccctattggttgcgcaccacagc

SEQ ID NO: 617183 - DNA, 25 bp, Rattus norvegicus
tgattcggctcgaggctgtggtaac

SEQ ID NO: 617184 - DNA, 25 bp, Rattus norvegicus
tggccgttcctcttcgccactttgt

SEQ ID NO: 617185 - DNA, 25 bp, Rattus norvegicus
ttcgccactttgtcgcccttgtctt

SEQ ID NO: 617186 - DNA, 25 bp, Rattus norvegicus
ttgcgcaccacagcaggagcgctgt

SEQ ID NO: 617187 - DNA, 25 bp, Rattus norvegicus
aggagcgctgtgcttggagctcatt

SEQ ID NO: 617188 - DNA, 25 bp, Rattus norvegicus
tggagctcattggtccttgtgtgaa

SEQ ID NO: 617189 - DNA, 25 bp, Rattus norvegicus
tatctgcatggagccttcggggctc

SEQ ID NO: 617190 - DNA, 25 bp, Rattus norvegicus
tgcgttcacagtgtcgccagctttg

SEQ ID NO: 617191 - DNA, 25 bp, Rattus norvegicus
tacggttagcggtggtgcgttcaca

SEQ ID NO: 617192 - DNA, 25 bp, Rattus norvegicus
ttcatggcggctcttgtacggttag

SEQ ID NO: 617193 - DNA, 25 bp, Rattus norvegicus
tctcctaaattcatggcggctcttg

SEQ ID NO: 617194 - DNA, 25 bp, Rattus norvegicus
cggccctaaggaggcgcggtctcct

SEQ ID NO: 617195 - DNA, 25 bp, Rattus norvegicus
tcacagtgtcgccagctttggcatc

SEQ ID NO: 617196 - DNA, 25 bp, Rattus norvegicus
gggtgagtatctgcatggagccttc

SEQ ID NO: 617197 - DNA, 25 bp, Rattus norvegicus
cgcccgaagcttggggtgagtatct

SEQ ID NO: 617198 - DNA, 25 bp, Rattus norvegicus
aagcggggtctcaccgcccgaagct

SEQ ID NO: 617199 - DNA, 25 bp, Rattus norvegicus
cccaagggcagtcaagcggggtctc

SEQ ID NO: 617200 - DNA, 25 bp, Rattus norvegicus
gcatctgttccctcgcggccatggg

SEQ ID NO: 617201 - DNA, 25 bp, Rattus norvegicus
agctttggcatctgttccctcgcgg

SEQ ID NO: 617202 - DNA, 25 bp, Rattus norvegicus
gaggcgcggtctcctaaattcatgg

SEQ ID NO: 617203 - DNA, 25 bp, Rattus norvegicus
gacatgcctgatcgccacagtccgg

SEQ ID NO: 617204 - DNA, 25 bp, Rattus norvegicus
gtcctctgtttttgtcgctctcgcg

SEQ ID NO: 617205 - DNA, 25 bp, Rattus norvegicus
gcgagccctccgaaatctcgcgaga

SEQ ID NO: 617206 - DNA, 25 bp, Rattus norvegicus
tcacccgggaactctgtcggaccta

SEQ ID NO: 617207 - DNA, 25 bp, Rattus norvegicus
acttccggccaggaagcagggtctt

SEQ ID NO: 617208 - DNA, 25 bp, Rattus norvegicus
cgaagccatattcgccctcagagag

SEQ ID NO: 617209 - DNA, 25 bp, Rattus norvegicus
cgttctctggtcacgcccaaggaaa

SEQ ID NO: 617210 - DNA, 25 bp, Rattus norvegicus
ctcagagaggcggagtcctctgttt

SEQ ID NO: 617211 - DNA, 25 bp, Rattus norvegicus
ttcaggggaagacgaagccatattc

SEQ ID NO: 617212 - DNA, 25 bp, Rattus norvegicus
caggccctcccatttcaggggaaga

SEQ ID NO: 617213 - DNA, 25 bp, Rattus norvegicus
agggtcttgcgctgaatcccgcctt

SEQ ID NO: 617214 - DNA, 25 bp, Rattus norvegicus
ccgccagacacacaaggctcaaatg

SEQ ID NO: 617215 - DNA, 25 bp, Rattus norvegicus
aggctcaaatgaaggcagatttccc

SEQ ID NO: 617216 - DNA, 25 bp, Rattus norvegicus
tcaccacgccgtggtgttgcgatcc

SEQ ID NO: 617217 - DNA, 25 bp, Rattus norvegicus
caagacagaccagagcggccctatt

SEQ ID NO: 617218 - DNA, 25 bp, Rattus norvegicus
gaagtttctcggagctggagcccta

SEQ ID NO: 617219 - DNA, 25 bp, Rattus norvegicus
acttgaagtttctcggagctggagc

SEQ ID NO: 617220 - DNA, 25 bp, Rattus norvegicus
ctggagccctaaaccggcgctggaa

SEQ ID NO: 617221 - DNA, 25 bp, Rattus norvegicus
gaagcgagggtcctccaagacagac

SEQ ID NO: 617222 - DNA, 25 bp, Rattus norvegicus
gctggaaccatcctccactcctgcg

SEQ ID NO: 617223 - DNA, 25 bp, Rattus norvegicus
cagagcggccctattgggccagcgt

SEQ ID NO: 617224 - DNA, 25 bp, Rattus norvegicus
tggcgccgtgtagcgctagaccagc

SEQ ID NO: 617225 - DNA, 25 bp, Rattus norvegicus
tgtagcgctagaccagcctgcagga

SEQ ID NO: 617226 - DNA, 25 bp, Rattus norvegicus
tagcgctagaccagcctgcaggagg

SEQ ID NO: 617227 - DNA, 25 bp, Rattus norvegicus
cgcaaaggcggcctctggctcggct

SEQ ID NO: 617228 - DNA, 25 bp, Rattus norvegicus
cctctggctcggctagagcgactct

SEQ ID NO: 617229 - DNA, 25 bp, Rattus norvegicus
ctcggctagagcgactctgcggcgc

SEQ ID NO: 617230 - DNA, 25 bp, Rattus norvegicus
caggggcagtcgaaatacggaagcg

SEQ ID NO: 617231 - DNA, 25 bp, Rattus norvegicus
gctgccggaagttaagcctccaagg

SEQ ID NO: 617232 - DNA, 25 bp, Rattus norvegicus
tcctcgtggtgaggcctgcggcctt

SEQ ID NO: 617233 - DNA, 25 bp, Rattus norvegicus
tgtacaccgaagagcgtcctcgtgg

SEQ ID NO: 617234 - DNA, 25 bp, Rattus norvegicus
tggtcatcgacttgtacaccgaaga

SEQ ID NO: 617235 - DNA, 25 bp, Rattus norvegicus
ggcgacgtggtcatcgacttgtaca

SEQ ID NO: 617236 - DNA, 25 bp, Rattus norvegicus
tcttggagaccactctgggcgacgt

SEQ ID NO: 617237 - DNA, 25 bp, Rattus norvegicus
gcgccatggcggttctcttggagac

SEQ ID NO: 617238 - DNA, 25 bp, Rattus norvegicus
gttcctgcggagaagccggcgccat

SEQ ID NO: 617239 - DNA, 25 bp, Rattus norvegicus
tcattgccggggtgtttgttcctgc

SEQ ID NO: 617240 - DNA, 25 bp, Rattus norvegicus
cgcctgcgcctgtcattgccggggt

SEQ ID NO: 617241 - DNA, 25 bp, Rattus norvegicus
cgtaaagcgtagacgcgcgctggct

SEQ ID NO: 617242 - DNA, 25 bp, Rattus norvegicus
cgcacacatcgtgacgtaaagcgta

SEQ ID NO: 617243 - DNA, 25 bp, Rattus norvegicus
cgcctgcggatgatgccagaagtcg

SEQ ID NO: 617244 - DNA, 25 bp, Rattus norvegicus
gatgccagaagtcgcacacatcgtg

SEQ ID NO: 617245 - DNA, 25 bp, Rattus norvegicus
gcgacgccgagcagaaatactactc

SEQ ID NO: 617246 - DNA, 25 bp, Rattus norvegicus
gcctgtgcacgggaagagcaacttc

SEQ ID NO: 617247 - DNA, 25 bp, Rattus norvegicus
ctcggccagcctgtgcacgggaaga

SEQ ID NO: 617248 - DNA, 25 bp, Rattus norvegicus
cctcagcctgcatccctcggccagc

SEQ ID NO: 617249 - DNA, 25 bp, Rattus norvegicus
caacgacgtggtcctccaggtaccg

SEQ ID NO: 617250 - DNA, 25 bp, Rattus norvegicus
tgcccaacgacgtggtcctccaggt

SEQ ID NO: 617251 - DNA, 25 bp, Rattus norvegicus
tgctcgagctgttccgggccgcgca

SEQ ID NO: 617252 - DNA, 25 bp, Rattus norvegicus
tcaacgggcgagtgctcgagctgtt

SEQ ID NO: 617253 - DNA, 25 bp, Rattus norvegicus
gcgacatcgagagcaccaagaaggt

SEQ ID NO: 617254 - DNA, 25 bp, Rattus norvegicus
ttctcctactgcgacatcgagagca

SEQ ID NO: 617255 - DNA, 25 bp, Rattus norvegicus
actcggatctcttctcctactgcga

SEQ ID NO: 617256 - DNA, 25 bp, Rattus norvegicus
gcagaaatactactcggatctcttc

SEQ ID NO: 617257 - DNA, 25 bp, Rattus norvegicus
tgagcgacgccgagcagaaatacta

SEQ ID NO: 617258 - DNA, 25 bp, Rattus norvegicus
aaggcttgacgctgagcgacgccga

SEQ ID NO: 617259 - DNA, 25 bp, Rattus norvegicus
cgactagaacccaggcggcgagagc

SEQ ID NO: 617260 - DNA, 25 bp, Rattus norvegicus
caccagagaggacctgcatcttgcg

SEQ ID NO: 617261 - DNA, 25 bp, Rattus norvegicus
tcggatcgctggatgtggcctccag

SEQ ID NO: 617262 - DNA, 25 bp, Rattus norvegicus
cggattagaacgtagcggagagtta

SEQ ID NO: 617263 - DNA, 25 bp, Rattus norvegicus
cggaagagctagaacgccagcaaga

SEQ ID NO: 617264 - DNA, 25 bp, Rattus norvegicus
gcatgaagccgggacgactagaacc

SEQ ID NO: 617265 - DNA, 25 bp, Rattus norvegicus
caccgacgagggagactagaccacc

SEQ ID NO: 617266 - DNA, 25 bp, Rattus norvegicus
caccgacaaggggtctagaacgcgg

SEQ ID NO: 617267 - DNA, 25 bp, Rattus norvegicus
actcaggatgtagggcggattagaa

SEQ ID NO: 617268 - DNA, 25 bp, Rattus norvegicus
catcttgcggtcgaggacctgggac

SEQ ID NO: 617269 - DNA, 25 bp, Rattus norvegicus
gcgcatgcagagaggttcgaactca

SEQ ID NO: 617270 - DNA, 25 bp, Rattus norvegicus
agcgcgtccactctgatttctcggc

SEQ ID NO: 617271 - DNA, 25 bp, Rattus norvegicus
tggattggggaattagcatgaagcc

SEQ ID NO: 617272 - DNA, 25 bp, Rattus norvegicus
actcgatcgggttgactagagcgca

SEQ ID NO: 617273 - DNA, 25 bp, Rattus norvegicus
gtcgcgagaaacgttgctggtccac

SEQ ID NO: 617274 - DNA, 25 bp, Rattus norvegicus
cacgcagtacaggatgaggcccaga

SEQ ID NO: 617275 - DNA, 25 bp, Rattus norvegicus
ggcactcacacgcagtacaggatga

SEQ ID NO: 617276 - DNA, 25 bp, Rattus norvegicus
cggatggtagcacggcgccgctcca

SEQ ID NO: 617277 - DNA, 25 bp, Rattus norvegicus
aacgttgctggtccacgaaggtgcc

SEQ ID NO: 617278 - DNA, 25 bp, Rattus norvegicus
gcgctggcaaagctcgcctacgttg

SEQ ID NO: 617279 - DNA, 25 bp, Rattus norvegicus
caaagctcgcctacgttgcggggtc

SEQ ID NO: 617280 - DNA, 25 bp, Rattus norvegicus
acgttgcgaaccaggcgctggcaaa

SEQ ID NO: 617281 - DNA, 25 bp, Rattus norvegicus
actccacgttgcgaaccaggcgctg

SEQ ID NO: 617282 - DNA, 25 bp, Rattus norvegicus
taatactccacgttgcgaaccaggc

SEQ ID NO: 617283 - DNA, 25 bp, Rattus norvegicus
cacgtagttgctttgataatactcc

SEQ ID NO: 617284 - DNA, 25 bp, Rattus norvegicus
gcccagaaacacaaacacgtagttg

SEQ ID NO: 617285 - DNA, 25 bp, Rattus norvegicus
tgaggcccagaaacacaaacacgta

SEQ ID NO: 617286 - DNA, 25 bp, Rattus norvegicus
gctttgataatactccacgttgcga

SEQ ID NO: 617287 - DNA, 25 bp, Rattus norvegicus
ccacccgagccggactcaatggaag

SEQ ID NO: 617288 - DNA, 25 bp, Rattus norvegicus
accctgcttgctcacgtggcgctca

SEQ ID NO: 617289 - DNA, 25 bp, Rattus norvegicus
acgtggcgctcagcccttccacttc

SEQ ID NO: 617290 - DNA, 25 bp, Rattus norvegicus
gtaaatatccccgagcccagcagca

SEQ ID NO: 617291 - DNA, 25 bp, Rattus norvegicus
cggactcaatggaagtggcgccgct

SEQ ID NO: 617292 - DNA, 25 bp, Rattus norvegicus
cggtagttgtgcctcggagcattgt

SEQ ID NO: 617293 - DNA, 25 bp, Rattus norvegicus
cggatctgggggtaacaccctgctt

SEQ ID NO: 617294 - DNA, 25 bp, Rattus norvegicus
ttcggcatccttctgctggtccttc

SEQ ID NO: 617295 - DNA, 25 bp, Rattus norvegicus
cgctgcagtgaatagaaccgctgta

SEQ ID NO: 617296 - DNA, 25 bp, Rattus norvegicus
ccatgtctgcgctgcagtgaataga

SEQ ID NO: 617297 - DNA, 25 bp, Rattus norvegicus
tgaatagaaccgctgtaaatatccc

SEQ ID NO: 617298 - DNA, 25 bp, Rattus norvegicus
catccttctgctggtccttctgggc

SEQ ID NO: 617299 - DNA, 25 bp, Rattus norvegicus
gctggtccttctgggccgccatgtc

SEQ ID NO: 617300 - DNA, 25 bp, Rattus norvegicus
ttccacttcggcatccttctgctgg

SEQ ID NO: 617301 - DNA, 25 bp, Rattus norvegicus
ctccgcgggaagagcggcggacagg

SEQ ID NO: 617302 - DNA, 25 bp, Rattus norvegicus
tctgtcggtccgtgggtcccacggc

SEQ ID NO: 617303 - DNA, 25 bp, Rattus norvegicus
ccgtgggtcccacggcacagaggct

SEQ ID NO: 617304 - DNA, 25 bp, Rattus norvegicus
ggcctccgcctcctcatatgcccgc

SEQ ID NO: 617305 - DNA, 25 bp, Rattus norvegicus
gcctcctcatatgcccgcgcccgcg

SEQ ID NO: 617306 - DNA, 25 bp, Rattus norvegicus
ggaggcggctctggccaatcaggag

SEQ ID NO: 617307 - DNA, 25 bp, Rattus norvegicus
agcggccctgagcagacggacagct

SEQ ID NO: 617308 - DNA, 25 bp, Rattus norvegicus
ggccctgagcagacggacagctaga

SEQ ID NO: 617309 - DNA, 25 bp, Rattus norvegicus
tgagcagacggacagctagaggccc

SEQ ID NO: 617310 - DNA, 25 bp, Rattus norvegicus
agacggacagctagaggcccggccc

SEQ ID NO: 617311 - DNA, 25 bp, Rattus norvegicus
accgctccaaccttgtttctgcaaa

SEQ ID NO: 617312 - DNA, 25 bp, Rattus norvegicus
accttgtttctgcaaagtggcggcg

SEQ ID NO: 617313 - DNA, 25 bp, Rattus norvegicus
ttgtttctgcaaagtggcggcgcca

SEQ ID NO: 617314 - DNA, 25 bp, Rattus norvegicus
agtggcggcgccaccgagaagctaa

SEQ ID NO: 617315 - DNA, 25 bp, Rattus norvegicus
taagaccgaccagaccctgggtctc

SEQ ID NO: 617316 - DNA, 25 bp, Rattus norvegicus
tctcgtcttcttcatccttcgggtc

SEQ ID NO: 617317 - DNA, 25 bp, Rattus norvegicus
gggttccttaatctcgtcttcttca

SEQ ID NO: 617318 - DNA, 25 bp, Rattus norvegicus
ctgcgggttccttaatctcgtcttc

SEQ ID NO: 617319 - DNA, 25 bp, Rattus norvegicus
cagctgcgggttccttaatctcgtc

SEQ ID NO: 617320 - DNA, 25 bp, Rattus norvegicus
gcttcgccagctgcgggttccttaa

SEQ ID NO: 617321 - DNA, 25 bp, Rattus norvegicus
cgagtccttgtaaaggctgaagggc

SEQ ID NO: 617322 - DNA, 25 bp, Rattus norvegicus
agaccctgggtctctgcgccaggca

SEQ ID NO: 617323 - DNA, 25 bp, Rattus norvegicus
cacgtaagaccgaccagaccctggg

SEQ ID NO: 617324 - DNA, 25 bp, Rattus norvegicus
accttgggacgtgtccttctgccgg

SEQ ID NO: 617325 - DNA, 25 bp, Rattus norvegicus
ggaaccttgggacgtgtccttctgc

SEQ ID NO: 617326 - DNA, 25 bp, Rattus norvegicus
accgcacgaagcagcttgacacggg

SEQ ID NO: 617327 - DNA, 25 bp, Rattus norvegicus
ggagcccgaggacaccgcacgaagc

SEQ ID NO: 617328 - DNA, 25 bp, Rattus norvegicus
agctcccgagtccttgtaaaggctg

SEQ ID NO: 617329 - DNA, 25 bp, Rattus norvegicus
cctgaagctcgcagcgcctggatgc

SEQ ID NO: 617330 - DNA, 25 bp, Rattus norvegicus
ttcatgctcagtcagctcgcggggt

SEQ ID NO: 617331 - DNA, 25 bp, Rattus norvegicus
acagtcactgcgaggcccgccgagt

SEQ ID NO: 617332 - DNA, 25 bp, Rattus norvegicus
agtccacggcccttaagagtcctcg

SEQ ID NO: 617333 - DNA, 25 bp, Rattus norvegicus
acaccctcgctggagtccactagga

SEQ ID NO: 617334 - DNA, 25 bp, Rattus norvegicus
ccgggcttggacttcaccagaaact

SEQ ID NO: 617335 - DNA, 25 bp, Rattus norvegicus
ctgaaggcaaaatcgcggcgtcctg

SEQ ID NO: 617336 - DNA, 25 bp, Rattus norvegicus
gcatcgcgtccctgcagtcagtcgg

SEQ ID NO: 617337 - DNA, 25 bp, Rattus norvegicus
ccgtccacggtcattcatgctcagt

SEQ ID NO: 617338 - DNA, 25 bp, Rattus norvegicus
tgcactcctggcagacgcgcacgtg

SEQ ID NO: 617339 - DNA, 25 bp, Rattus norvegicus
tagagcttgccgttgctgagtcgca

SEQ ID NO: 617340 - DNA, 25 bp, Rattus norvegicus
gaacgcgaggtcttgcggcaagaca

SEQ ID NO: 617341 - DNA, 25 bp, Rattus norvegicus
acaccgacacctggggcggcgagac

SEQ ID NO: 617342 - DNA, 25 bp, Rattus norvegicus
gcggaccgctttccaacgccaggag

SEQ ID NO: 617343 - DNA, 25 bp, Rattus norvegicus
gtgtcacctctacccagattgagct

SEQ ID NO: 617344 - DNA, 25 bp, Rattus norvegicus
agcgagttcaagctggagatcgacg

SEQ ID NO: 617345 - DNA, 25 bp, Rattus norvegicus
ccacccgggccaagacagagaagca

SEQ ID NO: 617346 - DNA, 25 bp, Rattus norvegicus
accctgcagcacgaggccaccgtgg

SEQ ID NO: 617347 - DNA, 25 bp, Rattus norvegicus
cggagctggcagagcagatcgacaa

SEQ ID NO: 617348 - DNA, 25 bp, Rattus norvegicus
cccgggccaagacagagaagcagcg

SEQ ID NO: 617349 - DNA, 25 bp, Rattus norvegicus
ccaccgtggccacgctgcggaagaa

SEQ ID NO: 617350 - DNA, 25 bp, Rattus norvegicus
agaagcagcgcagcgactacgcccg

SEQ ID NO: 617351 - DNA, 25 bp, Rattus norvegicus
agttcttgaagctgcgcagggacct

SEQ ID NO: 617352 - DNA, 25 bp, Rattus norvegicus
cgtgaggctgagttcttgaagctgc

SEQ ID NO: 617353 - DNA, 25 bp, Rattus norvegicus
agctgaacaagaagcgtgaggctga

SEQ ID NO: 617354 - DNA, 25 bp, Rattus norvegicus
cccagattgagctgaacaagaagcg

SEQ ID NO: 617355 - DNA, 25 bp, Rattus norvegicus
acctctacccagattgagctgaaca

SEQ ID NO: 617356 - DNA, 25 bp, Rattus norvegicus
cgtggccacgctgcggaagaagcac

SEQ ID NO: 617357 - DNA, 25 bp, Rattus norvegicus
ccgatctgggtgaggttgcaattga

SEQ ID NO: 617358 - DNA, 25 bp, Rattus norvegicus
aaggcgtaacgtgagttgaggacac

SEQ ID NO: 617359 - DNA, 25 bp, Rattus norvegicus
atgccgtagcccttggtgtcgagga

SEQ ID NO: 617360 - DNA, 25 bp, Rattus norvegicus
caattgaggcgcctgtggtactcgt

SEQ ID NO: 617361 - DNA, 25 bp, Rattus norvegicus
cctgtggtactcgttcatggtggac

SEQ ID NO: 617362 - DNA, 25 bp, Rattus norvegicus
tactcgttcatggtggactccagca

SEQ ID NO: 617363 - DNA, 25 bp, Rattus norvegicus
actccagcaggaaggcgtaacgtga

SEQ ID NO: 617364 - DNA, 25 bp, Rattus norvegicus
tcttgacgaacacgctgggctgctt

SEQ ID NO: 617365 - DNA, 25 bp, Rattus norvegicus
gggctgcttcgactgcatgtaattc

SEQ ID NO: 617366 - DNA, 25 bp, Rattus norvegicus
gcatgtaattccacatccgctggta

SEQ ID NO: 617367 - DNA, 25 bp, Rattus norvegicus
tccacatccgctggtacgtctggta

SEQ ID NO: 617368 - DNA, 25 bp, Rattus norvegicus
acatccgctggtacgtctggtaccg

SEQ ID NO: 617369 - DNA, 25 bp, Rattus norvegicus
catgccgatgccgtagcccttggtg

SEQ ID NO: 617370 - DNA, 25 bp, Rattus norvegicus
ctcctctgtgctcttgacgaacacg

SEQ ID NO: 617371 - DNA, 25 bp, Rattus norvegicus
cgacgtttgccaggcgcctccaaga

SEQ ID NO: 617372 - DNA, 25 bp, Rattus norvegicus
gtcattcggcctgcacgctgaaggc

SEQ ID NO: 617373 - DNA, 25 bp, Rattus norvegicus
cggtgcaaagggagctacagcccgc

SEQ ID NO: 617374 - DNA, 25 bp, Rattus norvegicus
caagcagtcgatgattgggcgcact

SEQ ID NO: 617375 - DNA, 25 bp, Rattus norvegicus
tggtctaacgacaggggcaagcagt

SEQ ID NO: 617376 - DNA, 25 bp, Rattus norvegicus
aatttgagcatcgattggtctaacg

SEQ ID NO: 617377 - DNA, 25 bp, Rattus norvegicus
ggccgaggcttcagaaatttgagca

SEQ ID NO: 617378 - DNA, 25 bp, Rattus norvegicus
ctccttactattggccgaggcttca

SEQ ID NO: 617379 - DNA, 25 bp, Rattus norvegicus
ttggctaagttctgcatgattccgc

SEQ ID NO: 617380 - DNA, 25 bp, Rattus norvegicus
gccgaccagtgagggaatattgcta

SEQ ID NO: 617381 - DNA, 25 bp, Rattus norvegicus
ctatccacttggaggccgaccagtg

SEQ ID NO: 617382 - DNA, 25 bp, Rattus norvegicus
ccatcaaaggcggagtccaagaaga

SEQ ID NO: 617383 - DNA, 25 bp, Rattus norvegicus
ccaagatggcgcctacagcttcgtc

SEQ ID NO: 617384 - DNA, 25 bp, Rattus norvegicus
ctgaaggcctgaaggatcgagtccc

SEQ ID NO: 617385 - DNA, 25 bp, Rattus norvegicus
gctgctagaggtccaccagcttgtg

SEQ ID NO: 617386 - DNA, 25 bp, Rattus norvegicus
ccctttgcttgcgaagtgtgtggca

SEQ ID NO: 617387 - DNA, 25 bp, Rattus norvegicus
ccatctgaaagaccacaggcgcttg

SEQ ID NO: 617388 - DNA, 25 bp, Rattus norvegicus
ttccgccagagtacccatctgaaag

SEQ ID NO: 617389 - DNA, 25 bp, Rattus norvegicus
gaagctcttcagcacggagacatca

SEQ ID NO: 617390 - DNA, 25 bp, Rattus norvegicus
gcccttggtggtacaacctctgctg

SEQ ID NO: 617391 - DNA, 25 bp, Rattus norvegicus
atgcagtgagtgcaagaagctcttc

SEQ ID NO: 617392 - DNA, 25 bp, Rattus norvegicus
aagggccactcgcacaccagttgct

SEQ ID NO: 617393 - DNA, 25 bp, Rattus norvegicus
gtcttggctaaggagcctccggctc

SEQ ID NO: 617394 - DNA, 25 bp, Rattus norvegicus
ctcgcctgcaggcacatgaagctgc

SEQ ID NO: 617395 - DNA, 25 bp, Rattus norvegicus
ccacggcgctttgagtgtggcacct

SEQ ID NO: 617396 - DNA, 25 bp, Rattus norvegicus
cactacggcttcgtgagcatcgctg

SEQ ID NO: 617397 - DNA, 25 bp, Rattus norvegicus
gcgcctggcagaacatcgacgcatc

SEQ ID NO: 617398 - DNA, 25 bp, Rattus norvegicus
atcactgcaggtccatcggcgcatc

SEQ ID NO: 617399 - DNA, 25 bp, Rattus norvegicus
cctgcgagggtcacacaaaggctca

SEQ ID NO: 617400 - DNA, 25 bp, Rattus norvegicus
gcgcacacctgcgagggtcacacaa

SEQ ID NO: 617401 - DNA, 25 bp, Rattus norvegicus
tccagcgcacagtggcgcagacaaa

SEQ ID NO: 617402 - DNA, 25 bp, Rattus norvegicus
acacaaaggctcaggactccagcgc

SEQ ID NO: 617403 - DNA, 25 bp, Rattus norvegicus
agctgagcttgagtccgcgaggttc

SEQ ID NO: 617404 - DNA, 25 bp, Rattus norvegicus
cggttttcctgaagcccgccagagg

SEQ ID NO: 617405 - DNA, 25 bp, Rattus norvegicus
agccctgcggttttcctgaagcccg

SEQ ID NO: 617406 - DNA, 25 bp, Rattus norvegicus
ctcagccctgcggttttcctgaagc

SEQ ID NO: 617407 - DNA, 25 bp, Rattus norvegicus
cttgagtccgcgaggttcctgtgga

SEQ ID NO: 617408 - DNA, 25 bp, Rattus norvegicus
ccgcgaggttcctgtggagcgcttt

SEQ ID NO: 617409 - DNA, 25 bp, Rattus norvegicus
aggttcctgtggagcgctttcggcc

SEQ ID NO: 617410 - DNA, 25 bp, Rattus norvegicus
agcgctttcggcctggcgctccgct

SEQ ID NO: 617411 - DNA, 25 bp, Rattus norvegicus
gcggcagcgtccagtcaatgggcgg

SEQ ID NO: 617412 - DNA, 25 bp, Rattus norvegicus
aggctcaggactccagcgcacagtg

SEQ ID NO: 617413 - DNA, 25 bp, Rattus norvegicus
tcctttgtgttgaatgcggacccgc

SEQ ID NO: 617414 - DNA, 25 bp, Rattus norvegicus
tgggtcaccgcaccgccgagttgca

SEQ ID NO: 617415 - DNA, 25 bp, Rattus norvegicus
caggtggttcccagccggcctttct

SEQ ID NO: 617416 - DNA, 25 bp, Rattus norvegicus
gcggcgctttcctgcctgcaaactt

SEQ ID NO: 617417 - DNA, 25 bp, Rattus norvegicus
aaacttcagcgggactcgccgcggc

SEQ ID NO: 617418 - DNA, 25 bp, Rattus norvegicus
tagccgcgcggcacccggctagtgt

SEQ ID NO: 617419 - DNA, 25 bp, Rattus norvegicus
aactgcccagggactctcctttgtg

SEQ ID NO: 617420 - DNA, 25 bp, Rattus norvegicus
acattttcggggagctcgagggcca

SEQ ID NO: 617421 - DNA, 25 bp, Rattus norvegicus
tatgcccttccaccaacggagcgtg

SEQ ID NO: 617422 - DNA, 25 bp, Rattus norvegicus
ctcttccgctcgctggagcaggtca

SEQ ID NO: 617423 - DNA, 25 bp, Rattus norvegicus
acctgtcgcgctgcgctggggacat

SEQ ID NO: 617424 - DNA, 25 bp, Rattus norvegicus
gaccaccggcgagtgaaaatccgtg

SEQ ID NO: 617425 - DNA, 25 bp, Rattus norvegicus
aaaatccgtgagtggctggtggccc

SEQ ID NO: 617426 - DNA, 25 bp, Rattus norvegicus
cggctagtgtctcggagccatcctc

SEQ ID NO: 617427 - DNA, 25 bp, Rattus norvegicus
tgatgcgcttgggaaacccagatca

SEQ ID NO: 617428 - DNA, 25 bp, Rattus norvegicus
tcccgaaggcccgccgccgctcatg

SEQ ID NO: 617429 - DNA, 25 bp, Rattus norvegicus
tggctccgcgaacgagctggtccgc

SEQ ID NO: 617430 - DNA, 25 bp, Rattus norvegicus
tccgccgcctggctccgcgaacgag

SEQ ID NO: 617431 - DNA, 25 bp, Rattus norvegicus
cccagagctcgaggctcccacgccc

SEQ ID NO: 617432 - DNA, 25 bp, Rattus norvegicus
gcgggaagctagtgcccgcgccggg

SEQ ID NO: 617433 - DNA, 25 bp, Rattus norvegicus
ccagcttcactccgggcggcgggaa

SEQ ID NO: 617434 - DNA, 25 bp, Rattus norvegicus
tactcacggcccagcttcactccgg

SEQ ID NO: 617435 - DNA, 25 bp, Rattus norvegicus
ccctaagtactcacggcccagcttc

SEQ ID NO: 617436 - DNA, 25 bp, Rattus norvegicus
acagggcgcccctaagtactcacgg

SEQ ID NO: 617437 - DNA, 25 bp, Rattus norvegicus
atgcgcttgggaaacccagatcacc

SEQ ID NO: 617438 - DNA, 25 bp, Rattus norvegicus
gtttgatgcgcttgggaaacccaga

SEQ ID NO: 617439 - DNA, 25 bp, Rattus norvegicus
ccgtttgatgcgcttgggaaaccca

SEQ ID NO: 617440 - DNA, 25 bp, Rattus norvegicus
gcgcttgggaaacccagatcaccac

SEQ ID NO: 617441 - DNA, 25 bp, Rattus norvegicus
tctgccgtcggcttcgttgtcacca

SEQ ID NO: 617442 - DNA, 25 bp, Rattus norvegicus
gccgggagatgaagtccctctgccg

SEQ ID NO: 617443 - DNA, 25 bp, Rattus norvegicus
cggcctcttccaggccgcgccgttc

SEQ ID NO: 617444 - DNA, 25 bp, Rattus norvegicus
tcgttgtcaccaccctcgactcgca

SEQ ID NO: 617445 - DNA, 25 bp, Rattus norvegicus
tcgactcgcacagcacgccgggaaa

SEQ ID NO: 617446 - DNA, 25 bp, Rattus norvegicus
actcgcacagcacgccgggaaatgg

SEQ ID NO: 617447 - DNA, 25 bp, Rattus norvegicus
cgggaaatggagttctcaagacctc

SEQ ID NO: 617448 - DNA, 25 bp, Rattus norvegicus
tcaagacctcagagtagctgaccgc

SEQ ID NO: 617449 - DNA, 25 bp, Rattus norvegicus
acctcagagtagctgaccgctgggg

SEQ ID NO: 617450 - DNA, 25 bp, Rattus norvegicus
gggtgtgacggctcgcgctgcacac

SEQ ID NO: 617451 - DNA, 25 bp, Rattus norvegicus
atgaagtccctctgccgtcggcttc

SEQ ID NO: 617452 - DNA, 25 bp, Rattus norvegicus
gtccctctgccgtcggcttcgttgt

SEQ ID NO: 617453 - DNA, 25 bp, Rattus norvegicus
ggagttctcaagacctcagagtagc

SEQ ID NO: 617454 - DNA, 25 bp, Rattus norvegicus
tcatggcgccgagcgcaggcccagg

SEQ ID NO: 617455 - DNA, 25 bp, Rattus norvegicus
aaatgtagtcgacaccaagagttaa

SEQ ID NO: 617456 - DNA, 25 bp, Rattus norvegicus
tagtcgacaccaagagttaagcgcg

SEQ ID NO: 617457 - DNA, 25 bp, Rattus norvegicus
agtcgacaccaagagttaagcgcgt

SEQ ID NO: 617458 - DNA, 25 bp, Rattus norvegicus
tgtagtcgacaccaagagttaagcg

SEQ ID NO: 617459 - DNA, 25 bp, Rattus norvegicus
gtcgacaccaagagttaagcgcgtc

SEQ ID NO: 617460 - DNA, 25 bp, Rattus norvegicus
gaaatgtagtcgacaccaagagtta

SEQ ID NO: 617461 - DNA, 25 bp, Rattus norvegicus
ggaaatgtagtcgacaccaagagtt

SEQ ID NO: 617462 - DNA, 25 bp, Rattus norvegicus
gggaaatgtagtcgacaccaagagt

SEQ ID NO: 617463 - DNA, 25 bp, Rattus norvegicus
cgggaaatgtagtcgacaccaagag

SEQ ID NO: 617464 - DNA, 25 bp, Rattus norvegicus
tccgggaaatgtagtcgacaccaag

SEQ ID NO: 617465 - DNA, 25 bp, Rattus norvegicus
gtagtcgacaccaagagttaagcgc

SEQ ID NO: 617466 - DNA, 25 bp, Rattus norvegicus
tcgacaccaagagttaagcgcgtcg

SEQ ID NO: 617467 - DNA, 25 bp, Rattus norvegicus
ccgggaaatgtagtcgacaccaaga

SEQ ID NO: 617468 - DNA, 25 bp, Rattus norvegicus
atgtagtcgacaccaagagttaagc

SEQ ID NO: 617469 - DNA, 25 bp, Rattus norvegicus
cgcattgcaggtatagaacggttga

SEQ ID NO: 617470 - DNA, 25 bp, Rattus norvegicus
cggtgacttcctgcacgcgtgcatt

SEQ ID NO: 617471 - DNA, 25 bp, Rattus norvegicus
ctgcacgcgtgcattctgggaaatc

SEQ ID NO: 617472 - DNA, 25 bp, Rattus norvegicus
cattctgggaaatcgagtccgcacc

SEQ ID NO: 617473 - DNA, 25 bp, Rattus norvegicus
agtccgcacccgtgattacttagta

SEQ ID NO: 617474 - DNA, 25 bp, Rattus norvegicus
agtactccggttgtgaggcactctg

SEQ ID NO: 617475 - DNA, 25 bp, Rattus norvegicus
gaaatgaagtcgtcaccacgccctc

SEQ ID NO: 617476 - DNA, 25 bp, Rattus norvegicus
acgccctcaccgcattgcaggtata

SEQ ID NO: 617477 - DNA, 25 bp, Rattus norvegicus
cggttgataaagcacgataggaaat

SEQ ID NO: 617478 - DNA, 25 bp, Rattus norvegicus
tgaagtctcaggtggtcctcaaacc

SEQ ID NO: 617479 - DNA, 25 bp, Rattus norvegicus
gtaggtactgtaactggaaggcata

SEQ ID NO: 617480 - DNA, 25 bp, Rattus norvegicus
aggaaatagaataggcatcgtgctc

SEQ ID NO: 617481 - DNA, 25 bp, Rattus norvegicus
gcatcgtgctctctctagccagtta

SEQ ID NO: 617482 - DNA, 25 bp, Rattus norvegicus
ccagttagcggcgtcgcagttcctt

SEQ ID NO: 617483 - DNA, 25 bp, Rattus norvegicus
acttccggcctctgggtaatactgg

SEQ ID NO: 617484 - DNA, 25 bp, Rattus norvegicus
cgggcgcaaagtccagcctgtgcaa

SEQ ID NO: 617485 - DNA, 25 bp, Rattus norvegicus
atgctgaccaactgcctgacttctg

SEQ ID NO: 617486 - DNA, 25 bp, Rattus norvegicus
ggttaactcttgcacacatcctttg

SEQ ID NO: 617487 - DNA, 25 bp, Rattus norvegicus
tgccgatttcatacgcacggtaatg

SEQ ID NO: 617488 - DNA, 25 bp, Rattus norvegicus
cacggtaatggacactgctaagagc

SEQ ID NO: 617489 - DNA, 25 bp, Rattus norvegicus
ggcctgtgaccaagtgtgccactga

SEQ ID NO: 617490 - DNA, 25 bp, Rattus norvegicus
ggcccgctgaaagaggcgcagaatc

SEQ ID NO: 617491 - DNA, 25 bp, Rattus norvegicus
cgtcggaggagagtacccaagtctc

SEQ ID NO: 617492 - DNA, 25 bp, Rattus norvegicus
gccgcgcgttctaaggtcggaaaca

SEQ ID NO: 617493 - DNA, 25 bp, Rattus norvegicus
ctgcgctttggaactttgcgactca

SEQ ID NO: 617494 - DNA, 25 bp, Rattus norvegicus
accgcgcaacgcagaaccgagcata

SEQ ID NO: 617495 - DNA, 25 bp, Rattus norvegicus
cccggagtgcaacgtgacagaacga

SEQ ID NO: 617496 - DNA, 25 bp, Rattus norvegicus
ctgagccaccttaaagccgcgcgtt

SEQ ID NO: 617497 - DNA, 25 bp, Rattus norvegicus
tgcagcccagcagaagtacaagaag

SEQ ID NO: 617498 - DNA, 25 bp, Rattus norvegicus
tgatgttggtgtcattgggcagctc

SEQ ID NO: 617499 - DNA, 25 bp, Rattus norvegicus
gccgacctgtcacgcttcgaatttg

SEQ ID NO: 617500 - DNA, 25 bp, Rattus norvegicus
cagtgaagccagcagtgtagcggcc

SEQ ID NO: 617501 - DNA, 25 bp, Rattus norvegicus
atgagacttcgagggacagtgaagc

SEQ ID NO: 617502 - DNA, 25 bp, Rattus norvegicus
agtttgactggggtgatgagacttc

SEQ ID NO: 617503 - DNA, 25 bp, Rattus norvegicus
cccgagaaggaagcactgagtttga

SEQ ID NO: 617504 - DNA, 25 bp, Rattus norvegicus
gccacctgtccatgagaaccaaaga

SEQ ID NO: 617505 - DNA, 25 bp, Rattus norvegicus
gtgctcgcacgccattgactgcagc

SEQ ID NO: 617506 - DNA, 25 bp, Rattus norvegicus
acccaatggcatccggaagaagttc

SEQ ID NO: 617507 - DNA, 25 bp, Rattus norvegicus
aaccaaagagatggagggcctggca

SEQ ID NO: 617508 - DNA, 25 bp, Rattus norvegicus
acggctgcatgaaggagtcccaacg

SEQ ID NO: 617509 - DNA, 25 bp, Rattus norvegicus
cgacgtggtttgcacacccaatggc

SEQ ID NO: 617510 - DNA, 25 bp, Rattus norvegicus
aagttcaacggcaagcagtggcgcc

SEQ ID NO: 617511 - DNA, 25 bp, Rattus norvegicus
caggaaaacggtgcacctggggctt

SEQ ID NO: 617512 - DNA, 25 bp, Rattus norvegicus
tcggctgaaagactggagtcggaca

SEQ ID NO: 617513 - DNA, 25 bp, Rattus norvegicus
atggccaaatccttcggctgggtgc

SEQ ID NO: 617514 - DNA, 25 bp, Rattus norvegicus
tagttaacccttacatggccaaatc

SEQ ID NO: 617515 - DNA, 25 bp, Rattus norvegicus
cggattggcagaggcttcccaccca

SEQ ID NO: 617516 - DNA, 25 bp, Rattus norvegicus
ttccattggttactgtcgcaccttc

SEQ ID NO: 617517 - DNA, 25 bp, Rattus norvegicus
cacctggggctttgtggacacagac

SEQ ID NO: 617518 - DNA, 25 bp, Rattus norvegicus
cccagtctctatttcggctgaaaga

SEQ ID NO: 617519 - DNA, 25 bp, Rattus norvegicus
ccaagccggttgctagcgaaaaaga

SEQ ID NO: 617520 - DNA, 25 bp, Rattus norvegicus
ccaaacccgtctgcacctatgggtg

SEQ ID NO: 617521 - DNA, 25 bp, Rattus norvegicus
cgcccgggcattaatggctccatta

SEQ ID NO: 617522 - DNA, 25 bp, Rattus norvegicus
tttgcggcatctcctgaaagcaagg

SEQ ID NO: 617523 - DNA, 25 bp, Rattus norvegicus
ggcgacggcgtctggctcccattac

SEQ ID NO: 617524 - DNA, 25 bp, Rattus norvegicus
ttgggttcagatgtcgtttgcggca

SEQ ID NO: 617525 - DNA, 25 bp, Rattus norvegicus
ctgagctcggggagcagatcgacaa

SEQ ID NO: 617526 - DNA, 25 bp, Rattus norvegicus
atcagcgagcggctggaagaagccg

SEQ ID NO: 617527 - DNA, 25 bp, Rattus norvegicus
gcggggccacttcagcccagatcga

SEQ ID NO: 617528 - DNA, 25 bp, Rattus norvegicus
gccacttcagcccagatcgagatga

SEQ ID NO: 617529 - DNA, 25 bp, Rattus norvegicus
tcagcccagatcgagatgaacaaga

SEQ ID NO: 617530 - DNA, 25 bp, Rattus norvegicus
gcccagatcgagatgaacaagaaga

SEQ ID NO: 617531 - DNA, 25 bp, Rattus norvegicus
aacaagaagagagaggccgagttcc

SEQ ID NO: 617532 - DNA, 25 bp, Rattus norvegicus
gagagaggccgagttccagaaaatg

SEQ ID NO: 617533 - DNA, 25 bp, Rattus norvegicus
gaggccgagttccagaaaatgcgca

SEQ ID NO: 617534 - DNA, 25 bp, Rattus norvegicus
ccgagttccagaaaatgcgcaggga

SEQ ID NO: 617535 - DNA, 25 bp, Rattus norvegicus
gttccagaaaatgcgcagggacttg

SEQ ID NO: 617536 - DNA, 25 bp, Rattus norvegicus
caccctgcagcacgaagccacagca

SEQ ID NO: 617537 - DNA, 25 bp, Rattus norvegicus
agccgctcttcggaagaagcacgcg

SEQ ID NO: 617538 - DNA, 25 bp, Rattus norvegicus
acagcagccgctcttcggaagaagc

SEQ ID NO: 617539 - DNA, 25 bp, Rattus norvegicus
gggagcagccaagggcggctggcag

SEQ ID NO: 617540 - DNA, 25 bp, Rattus norvegicus
ttcggagtgagtcggccagtcccta

SEQ ID NO: 617541 - DNA, 25 bp, Rattus norvegicus
cggtgcctcgcgggctcaataattg

SEQ ID NO: 617542 - DNA, 25 bp, Rattus norvegicus
ggctcaataattggggccatgagtt

SEQ ID NO: 617543 - DNA, 25 bp, Rattus norvegicus
ataattggggccatgagttcggagt

SEQ ID NO: 617544 - DNA, 25 bp, Rattus norvegicus
ccatgagttcggagtgagtcggcca

SEQ ID NO: 617545 - DNA, 25 bp, Rattus norvegicus
tgagtcggccagtccctaggtctgt

SEQ ID NO: 617546 - DNA, 25 bp, Rattus norvegicus
gccagtccctaggtctgtgagcatc

SEQ ID NO: 617547 - DNA, 25 bp, Rattus norvegicus
gtccctaggtctgtgagcatccctg

SEQ ID NO: 617548 - DNA, 25 bp, Rattus norvegicus
cctaggtctgtgagcatccctggca

SEQ ID NO: 617549 - DNA, 25 bp, Rattus norvegicus
aggtctgtgagcatccctggcagct

SEQ ID NO: 617550 - DNA, 25 bp, Rattus norvegicus
gtaggtgggtgtgtatgttgagagc

SEQ ID NO: 617551 - DNA, 25 bp, Rattus norvegicus
agcatccctggcagcttgccgcggg

SEQ ID NO: 617552 - DNA, 25 bp, Rattus norvegicus
ctgtgagcatccctggcagcttgcc

SEQ ID NO: 617553 - DNA, 25 bp, Rattus norvegicus
tgatacccgcgtctggcgcggcctc

SEQ ID NO: 617554 - DNA, 25 bp, Rattus norvegicus
tcgcttggagcgcacggacgctagc

SEQ ID NO: 617555 - DNA, 25 bp, Rattus norvegicus
tgttcggtcagtagcgtctggcgct

SEQ ID NO: 617556 - DNA, 25 bp, Rattus norvegicus
gcatgttcggtcagtagcgtctggc

SEQ ID NO: 617557 - DNA, 25 bp, Rattus norvegicus
ctcccgtggcctcggcatgttcggt

SEQ ID NO: 617558 - DNA, 25 bp, Rattus norvegicus
cggaccatgtactcggcccacaggc

SEQ ID NO: 617559 - DNA, 25 bp, Rattus norvegicus
ggttcccgctgctccggaccatgta

SEQ ID NO: 617560 - DNA, 25 bp, Rattus norvegicus
ccaaggagcaggttacgggcagagc

SEQ ID NO: 617561 - DNA, 25 bp, Rattus norvegicus
gtcgacctggtgtccaaccggcggc

SEQ ID NO: 617562 - DNA, 25 bp, Rattus norvegicus
gacccgaggtcgacctggtgtccaa

SEQ ID NO: 617563 - DNA, 25 bp, Rattus norvegicus
gctagtccgcctattcgccggggac

SEQ ID NO: 617564 - DNA, 25 bp, Rattus norvegicus
gctagcacgctagtccgcctattcg

SEQ ID NO: 617565 - DNA, 25 bp, Rattus norvegicus
gcgcacggacgctagcacgctagtc

SEQ ID NO: 617566 - DNA, 25 bp, Rattus norvegicus
cctcggcatgttcggtcagtagcgt

SEQ ID NO: 617567 - DNA, 25 bp, Rattus norvegicus
acgtcctgcacaggcgtgggcttgc

SEQ ID NO: 617568 - DNA, 25 bp, Rattus norvegicus
aggccgcacagtgggctcgtctgcc

SEQ ID NO: 617569 - DNA, 25 bp, Rattus norvegicus
gtcactcaccagagacatccagcgt

SEQ ID NO: 617570 - DNA, 25 bp, Rattus norvegicus
gcagacgagaccacgcggcacgcgt

SEQ ID NO: 617571 - DNA, 25 bp, Rattus norvegicus
gcggggtcactcaccagagacatcc

SEQ ID NO: 617572 - DNA, 25 bp, Rattus norvegicus
acagtgggctcgtctgccgcgcttc

SEQ ID NO: 617573 - DNA, 25 bp, Rattus norvegicus
ccgtcacataggaaggaatcctcga

SEQ ID NO: 617574 - DNA, 25 bp, Rattus norvegicus
ctcagactagaaaccgtcacatagg

SEQ ID NO: 617575 - DNA, 25 bp, Rattus norvegicus
ggacgccgcctttctcagactagaa

SEQ ID NO: 617576 - DNA, 25 bp, Rattus norvegicus
tcactcgcacgcagggcgaaggccg

SEQ ID NO: 617577 - DNA, 25 bp, Rattus norvegicus
ggccaacacaatggaccgtcccgct

SEQ ID NO: 617578 - DNA, 25 bp, Rattus norvegicus
atcagagtggagtccgcccgggaaa

SEQ ID NO: 617579 - DNA, 25 bp, Rattus norvegicus
cctgcacgtcctgcacaggcgtggg

SEQ ID NO: 617580 - DNA, 25 bp, Rattus norvegicus
tagtgccacagcgaccgaacgcagg

SEQ ID NO: 617581 - DNA, 25 bp, Rattus norvegicus
agccggagccgtgccgaggccagag

SEQ ID NO: 617582 - DNA, 25 bp, Rattus norvegicus
gacccaagaggggatgatgccgccc

SEQ ID NO: 617583 - DNA, 25 bp, Rattus norvegicus
tcctagcgttccctggcccgcggga

SEQ ID NO: 617584 - DNA, 25 bp, Rattus norvegicus
gcacaccgagacgtctcctagcgtt

SEQ ID NO: 617585 - DNA, 25 bp, Rattus norvegicus
tgagcacaccgagacgtctcctagc

SEQ ID NO: 617586 - DNA, 25 bp, Rattus norvegicus
ggtgagcacaccgagacgtctccta

SEQ ID NO: 617587 - DNA, 25 bp, Rattus norvegicus
ctccaaagaggtgagcacaccgaga

SEQ ID NO: 617588 - DNA, 25 bp, Rattus norvegicus
tcagctccaaagaggtgagcacacc

SEQ ID NO: 617589 - DNA, 25 bp, Rattus norvegicus
cctcagctccaaagaggtgagcaca

SEQ ID NO: 617590 - DNA, 25 bp, Rattus norvegicus
acgtgcggggcaacctcagctccaa

SEQ ID NO: 617591 - DNA, 25 bp, Rattus norvegicus
ccctcccggattggggcgtgagtgg

SEQ ID NO: 617592 - DNA, 25 bp, Rattus norvegicus
gaggaatggagccttcgcgcgcgcc

SEQ ID NO: 617593 - DNA, 25 bp, Rattus norvegicus
tctcgcctccgtcaccgggccggag

SEQ ID NO: 617594 - DNA, 25 bp, Rattus norvegicus
ggccaagtacgtgcggggcaacctc

SEQ ID NO: 617595 - DNA, 25 bp, Rattus norvegicus
cgactcggtgcccaacttcacggag

SEQ ID NO: 617596 - DNA, 25 bp, Rattus norvegicus
accggcttcaccgaatacttcagca

SEQ ID NO: 617597 - DNA, 25 bp, Rattus norvegicus
tcttgtgccaaacggtcccgcggga

SEQ ID NO: 617598 - DNA, 25 bp, Rattus norvegicus
gcccacgttgggtgcgctgcgtcct

SEQ ID NO: 617599 - DNA, 25 bp, Rattus norvegicus
cttctctctcctggcccaagggctc

SEQ ID NO: 617600 - DNA, 25 bp, Rattus norvegicus
tctgagcatccctttcccgcctctg

SEQ ID NO: 617601 - DNA, 25 bp, Rattus norvegicus
tacttcagcatgcacacagccgggg

SEQ ID NO: 617602 - DNA, 25 bp, Rattus norvegicus
gttctgggcagcctctgaccctgac

SEQ ID NO: 617603 - DNA, 25 bp, Rattus norvegicus
cacgtgcgtccatatctggggtggt

SEQ ID NO: 617604 - DNA, 25 bp, Rattus norvegicus
tccctgactgacacgtgcgtccata

SEQ ID NO: 617605 - DNA, 25 bp, Rattus norvegicus
cctccagagtttgccaggcgcaccc

SEQ ID NO: 617606 - DNA, 25 bp, Rattus norvegicus
tgccagactgggtcctggcgctgtt

SEQ ID NO: 617607 - DNA, 25 bp, Rattus norvegicus
gtgcccaacttcacggagctcttct

SEQ ID NO: 617608 - DNA, 25 bp, Rattus norvegicus
ctgcgcattggcgtctaagcccacc

SEQ ID NO: 617609 - DNA, 25 bp, Rattus norvegicus
acagctgcatgtgtacgtctcgatg

SEQ ID NO: 617610 - DNA, 25 bp, Rattus norvegicus
cgtgcagcacgggaagctcaccgtg

SEQ ID NO: 617611 - DNA, 25 bp, Rattus norvegicus
gtaagtgtcacacgtgcagcacggg

SEQ ID NO: 617612 - DNA, 25 bp, Rattus norvegicus
catgcagggacgtaagtgtcacacg

SEQ ID NO: 617613 - DNA, 25 bp, Rattus norvegicus
ggacatacggcatgcagggacgtaa

SEQ ID NO: 617614 - DNA, 25 bp, Rattus norvegicus
accgtgttctcctgtctctgccgta

SEQ ID NO: 617615 - DNA, 25 bp, Rattus norvegicus
gtcacccaacatctggctgagagtg

SEQ ID NO: 617616 - DNA, 25 bp, Rattus norvegicus
gtacgtctcgatgcacacctggtga

SEQ ID NO: 617617 - DNA, 25 bp, Rattus norvegicus
tggcacgcacggcagtgttgatact

SEQ ID NO: 617618 - DNA, 25 bp, Rattus norvegicus
ctgtctctgccgtaactgtagcgtc

SEQ ID NO: 617619 - DNA, 25 bp, Rattus norvegicus
ctgtagcgtcaggtcacccaacatc

SEQ ID NO: 617620 - DNA, 25 bp, Rattus norvegicus
tgcgctggtgacagctgcatgtgta

SEQ ID NO: 617621 - DNA, 25 bp, Rattus norvegicus
cagtgttgatactgcgctggtgaca

SEQ ID NO: 617622 - DNA, 25 bp, Rattus norvegicus
cacctggtgagggaacgagagtaat

SEQ ID NO: 617623 - DNA, 25 bp, Rattus norvegicus
gccatgctacgcctgtaaaggttgc

SEQ ID NO: 617624 - DNA, 25 bp, Rattus norvegicus
ggcgggttccagcttgcaagctcca

SEQ ID NO: 617625 - DNA, 25 bp, Rattus norvegicus
tgatctagcccatccgcctcgggtg

SEQ ID NO: 617626 - DNA, 25 bp, Rattus norvegicus
tagcctgtccttcccttagagactg

SEQ ID NO: 617627 - DNA, 25 bp, Rattus norvegicus
cactcattcggttgctggttcattc

SEQ ID NO: 617628 - DNA, 25 bp, Rattus norvegicus
tgcgggcaactacagcgtcaatggc

SEQ ID NO: 617629 - DNA, 25 bp, Rattus norvegicus
tacggtctgttttggccttgcagca

SEQ ID NO: 617630 - DNA, 25 bp, Rattus norvegicus
cagggcctcattcccgtagagtgtc

SEQ ID NO: 617631 - DNA, 25 bp, Rattus norvegicus
gtcgctggtacctccttggactaca

SEQ ID NO: 617632 - DNA, 25 bp, Rattus norvegicus
atccagggccttccatgggtccata

SEQ ID NO: 617633 - DNA, 25 bp, Rattus norvegicus
ggggtcagccctatccataacgact

SEQ ID NO: 617634 - DNA, 25 bp, Rattus norvegicus
ggctcgtgtctataggggaccctta

SEQ ID NO: 617635 - DNA, 25 bp, Rattus norvegicus
agagtgtccattcctggtcttcagg

SEQ ID NO: 617636 - DNA, 25 bp, Rattus norvegicus
tgcagcagcctgagtctaatcatta

SEQ ID NO: 617637 - DNA, 25 bp, Rattus norvegicus
caaagtcatcggagatgcggcaggc

SEQ ID NO: 617638 - DNA, 25 bp, Rattus norvegicus
gacaaaaccggtcaggaggtgcctg

SEQ ID NO: 617639 - DNA, 25 bp, Rattus norvegicus
cgcacctggatgtggtagcgttccc

SEQ ID NO: 617640 - DNA, 25 bp, Rattus norvegicus
tagcgttcccgcatgcctgtgcgca

SEQ ID NO: 617641 - DNA, 25 bp, Rattus norvegicus
cctgtgcgcagagagtgcagtcctc

SEQ ID NO: 617642 - DNA, 25 bp, Rattus norvegicus
cgcagagagtgcagtcctccaggca

SEQ ID NO: 617643 - DNA, 25 bp, Rattus norvegicus
cctccaggcaggtatggcgcacaac

SEQ ID NO: 617644 - DNA, 25 bp, Rattus norvegicus
aggtatggcgcacaacagcactccc

SEQ ID NO: 617645 - DNA, 25 bp, Rattus norvegicus
aagtgccacacagacctggacagga

SEQ ID NO: 617646 - DNA, 25 bp, Rattus norvegicus
tgaaggcaccgggaagacagttgta

SEQ ID NO: 617647 - DNA, 25 bp, Rattus norvegicus
gcaccgggaagacagttgtagagaa

SEQ ID NO: 617648 - DNA, 25 bp, Rattus norvegicus
ttgtagagaaggaaacgaagaccca

SEQ ID NO: 617649 - DNA, 25 bp, Rattus norvegicus
cgaagacccaaagcaatcggacttt

SEQ ID NO: 617650 - DNA, 25 bp, Rattus norvegicus
cacagtggagcgaaagtgccacaca

SEQ ID NO: 617651 - DNA, 25 bp, Rattus norvegicus
agccggatgcgctgcacgcacaact

SEQ ID NO: 617652 - DNA, 25 bp, Rattus norvegicus
tagagcccgactcggagcgcactca

SEQ ID NO: 617653 - DNA, 25 bp, Rattus norvegicus
ggagcgcactcatcacggaagcccg

SEQ ID NO: 617654 - DNA, 25 bp, Rattus norvegicus
cgcagaagggtgcaagaggtctttt

SEQ ID NO: 617655 - DNA, 25 bp, Rattus norvegicus
gttcccagctcaggtcagcggtgca

SEQ ID NO: 617656 - DNA, 25 bp, Rattus norvegicus
gggtctcacgacacagggctgctaa

SEQ ID NO: 617657 - DNA, 25 bp, Rattus norvegicus
gggctgctaagctcaggaaaccatg

SEQ ID NO: 617658 - DNA, 25 bp, Rattus norvegicus
actttcagcgtcacgggctggccca

SEQ ID NO: 617659 - DNA, 25 bp, Rattus norvegicus
aggtccttcagtcgccgcgcgaaca

SEQ ID NO: 617660 - DNA, 25 bp, Rattus norvegicus
gccgcgcgaacatgaccgagtcatc

SEQ ID NO: 617661 - DNA, 25 bp, Rattus norvegicus
tgaccgagtcatccagcatggggtc

SEQ ID NO: 617662 - DNA, 25 bp, Rattus norvegicus
ggtccagagcgcacgcctagagaga

SEQ ID NO: 617663 - DNA, 25 bp, Rattus norvegicus
atgcggcaggtcctctaccactttc

SEQ ID NO: 617664 - DNA, 25 bp, Rattus norvegicus
tgcaagaggtcttttagtgccgccc

SEQ ID NO: 617665 - DNA, 25 bp, Rattus norvegicus
ggcgtggccacaagccaagtcctta

SEQ ID NO: 617666 - DNA, 25 bp, Rattus norvegicus
gctcggcccttgagacctctgtcag

SEQ ID NO: 617667 - DNA, 25 bp, Rattus norvegicus
tatagttcattttgcagctcggccc

SEQ ID NO: 617668 - DNA, 25 bp, Rattus norvegicus
cccggagcctcggaactatagttca

SEQ ID NO: 617669 - DNA, 25 bp, Rattus norvegicus
tttacgttacctggcaagatggcgg

SEQ ID NO: 617670 - DNA, 25 bp, Rattus norvegicus
cggcctcttctgtttacgttacctg

SEQ ID NO: 617671 - DNA, 25 bp, Rattus norvegicus
ttacatggggaagtccggcctcttc

SEQ ID NO: 617672 - DNA, 25 bp, Rattus norvegicus
accacgtgttacatggggaagtccg

SEQ ID NO: 617673 - DNA, 25 bp, Rattus norvegicus
cacaagccaagtccttagtttttga

SEQ ID NO: 617674 - DNA, 25 bp, Rattus norvegicus
aaagcctgcgggaacagagcgtctc

SEQ ID NO: 617675 - DNA, 25 bp, Rattus norvegicus
gcctcctgaaaagcaaaagcctgcg

SEQ ID NO: 617676 - DNA, 25 bp, Rattus norvegicus
tagtttttgaaccacgtgttacatg

SEQ ID NO: 617677 - DNA, 25 bp, Rattus norvegicus
acagagcgtctcctgcgggacatct

SEQ ID NO: 617678 - DNA, 25 bp, Rattus norvegicus
agacctctgtcagcctcctgaaaag

SEQ ID NO: 617679 - DNA, 25 bp, Rattus norvegicus
acgctgcttcaggtcccggacggcg

SEQ ID NO: 617680 - DNA, 25 bp, Rattus norvegicus
gggcaccacctctcggggcagttgc

SEQ ID NO: 617681 - DNA, 25 bp, Rattus norvegicus
ggcagttgcgcctcttagctcactc

SEQ ID NO: 617682 - DNA, 25 bp, Rattus norvegicus
cccgggaagttgtctcgtgagcccg

SEQ ID NO: 617683 - DNA, 25 bp, Rattus norvegicus
ggagcccgcggagtccgagaaacca

SEQ ID NO: 617684 - DNA, 25 bp, Rattus norvegicus
gagtccgagaaaccagcgctgctgg

SEQ ID NO: 617685 - DNA, 25 bp, Rattus norvegicus
aagcagcgcgcttgactcggaagcc

SEQ ID NO: 617686 - DNA, 25 bp, Rattus norvegicus
gagctgctcacgctgcttcaggtcc

SEQ ID NO: 617687 - DNA, 25 bp, Rattus norvegicus
ccgccagctacgtgcaactgctgga

SEQ ID NO: 617688 - DNA, 25 bp, Rattus norvegicus
ctacgtgcaactgctggaggtgagc

SEQ ID NO: 617689 - DNA, 25 bp, Rattus norvegicus
ggcgtggacagcgttctcctcctac

SEQ ID NO: 617690 - DNA, 25 bp, Rattus norvegicus
acttgttgcctgtgcgagttctgga

SEQ ID NO: 617691 - DNA, 25 bp, Rattus norvegicus
tgctccggggaaagcgagaacttgt

SEQ ID NO: 617692 - DNA, 25 bp, Rattus norvegicus
ccttctctggggagcggcacagcca

SEQ ID NO: 617693 - DNA, 25 bp, Rattus norvegicus
ttgggaccgcccttgcaggtccgcg

SEQ ID NO: 617694 - DNA, 25 bp, Rattus norvegicus
gctcacagcacagtcacgacgcttt

SEQ ID NO: 617695 - DNA, 25 bp, Rattus norvegicus
acagtcacgacgctttcgggcggtg

SEQ ID NO: 617696 - DNA, 25 bp, Rattus norvegicus
tcgggcggtggcctcgaactagccc

SEQ ID NO: 617697 - DNA, 25 bp, Rattus norvegicus
tggcctctcttctctttgctcgttg

SEQ ID NO: 617698 - DNA, 25 bp, Rattus norvegicus
tcttctctttgctcgttgggaccgc

SEQ ID NO: 617699 - DNA, 25 bp, Rattus norvegicus
gccggcagccgaggacgcacagctt

SEQ ID NO: 617700 - DNA, 25 bp, Rattus norvegicus
agccgaggacgcacagcttcgaaga

SEQ ID NO: 617701 - DNA, 25 bp, Rattus norvegicus
aaacctttcccgcagtctcaccaga

SEQ ID NO: 617702 - DNA, 25 bp, Rattus norvegicus
agtctcaccagaaaaccagccctaa

SEQ ID NO: 617703 - DNA, 25 bp, Rattus norvegicus
gaaaaccagccctaactcgccagga

SEQ ID NO: 617704 - DNA, 25 bp, Rattus norvegicus
tcgccaggacgcgtctccctgtctg

SEQ ID NO: 617705 - DNA, 25 bp, Rattus norvegicus
cgcacagcttcgaagagggagtccg

SEQ ID NO: 617706 - DNA, 25 bp, Rattus norvegicus
tttgctcgttgggaccgcccttgca

SEQ ID NO: 617707 - DNA, 25 bp, Rattus norvegicus
agtgccctagattggcgcttgcgcg

SEQ ID NO: 617708 - DNA, 25 bp, Rattus norvegicus
ggccacttcgggagtgccctagatt

SEQ ID NO: 617709 - DNA, 25 bp, Rattus norvegicus
actgacaccggaacagagtccagcc

SEQ ID NO: 617710 - DNA, 25 bp, Rattus norvegicus
tacacggccggtagaactgcgcgtg

SEQ ID NO: 617711 - DNA, 25 bp, Rattus norvegicus
cccagcgcgcgtggtcagcggctat

SEQ ID NO: 617712 - DNA, 25 bp, Rattus norvegicus
agcaaagcgtgcagacgccaaggta

SEQ ID NO: 617713 - DNA, 25 bp, Rattus norvegicus
gacgccaaggtactcactgacaccg

SEQ ID NO: 617714 - DNA, 25 bp, Rattus norvegicus
gcagcctccggcactttgcttgtga

SEQ ID NO: 617715 - DNA, 25 bp, Rattus norvegicus
agcaaaacctgctgtcccggccgga

SEQ ID NO: 617716 - DNA, 25 bp, Rattus norvegicus
gccggatggatctgcttcttttctg

SEQ ID NO: 617717 - DNA, 25 bp, Rattus norvegicus
tctgcaaggtacgactttaacaagg

SEQ ID NO: 617718 - DNA, 25 bp, Rattus norvegicus
aaggtttaactcagcgcgcgccatc

SEQ ID NO: 617719 - DNA, 25 bp, Rattus norvegicus
gccgagccacgtgctagggccactt

SEQ ID NO: 617720 - DNA, 25 bp, Rattus norvegicus
ttgcttgtgagcaaaacctgctgtc

SEQ ID NO: 617721 - DNA, 25 bp, Rattus norvegicus
gggcaatagctccagactccgccta

SEQ ID NO: 617722 - DNA, 25 bp, Rattus norvegicus
tccagactccgcctatccgcggtgc

SEQ ID NO: 617723 - DNA, 25 bp, Rattus norvegicus
agaggcggggcaatagctccagact

SEQ ID NO: 617724 - DNA, 25 bp, Rattus norvegicus
tgagctgcgctttggtctctgcgcc

SEQ ID NO: 617725 - DNA, 25 bp, Rattus norvegicus
agctgctgagctgcgctttggtctc

SEQ ID NO: 617726 - DNA, 25 bp, Rattus norvegicus
ctgagagctgctgagctgcgctttg

SEQ ID NO: 617727 - DNA, 25 bp, Rattus norvegicus
gtaccccgtacagggtctgagagct

SEQ ID NO: 617728 - DNA, 25 bp, Rattus norvegicus
tgggtctcgcagggcacccaccttg

SEQ ID NO: 617729 - DNA, 25 bp, Rattus norvegicus
cgacctccttgggtctcgcagggca

SEQ ID NO: 617730 - DNA, 25 bp, Rattus norvegicus
cgcccacagccagacgcccgacctc

SEQ ID NO: 617731 - DNA, 25 bp, Rattus norvegicus
cccatcaattctcaccgcccacagc

SEQ ID NO: 617732 - DNA, 25 bp, Rattus norvegicus
ggaagagcaatgtccccatcaattc

SEQ ID NO: 617733 - DNA, 25 bp, Rattus norvegicus
tgaacccagagatcgggtgtcccgg

SEQ ID NO: 617734 - DNA, 25 bp, Rattus norvegicus
gcaggtctccgccaaaggttcgccc

SEQ ID NO: 617735 - DNA, 25 bp, Rattus norvegicus
tagcaccaatcatcagcgcacaggg

SEQ ID NO: 617736 - DNA, 25 bp, Rattus norvegicus
ccttttgaagcgtggctgatctacc

SEQ ID NO: 617737 - DNA, 25 bp, Rattus norvegicus
gcagctttcgcttctaacggtcaag

SEQ ID NO: 617738 - DNA, 25 bp, Rattus norvegicus
ggctaaagcagcactacatctgaga

SEQ ID NO: 617739 - DNA, 25 bp, Rattus norvegicus
aggagcgacgcatgcgctacgccta

SEQ ID NO: 617740 - DNA, 25 bp, Rattus norvegicus
gagggtaagaccgacgcagagttcc

SEQ ID NO: 617741 - DNA, 25 bp, Rattus norvegicus
cgcagagttcccaaaaatgtaccga

SEQ ID NO: 617742 - DNA, 25 bp, Rattus norvegicus
gaggccaggcccatgaactaccatc

SEQ ID NO: 617743 - DNA, 25 bp, Rattus norvegicus
ccagagggcaaatatagcaccaatc

SEQ ID NO: 617744 - DNA, 25 bp, Rattus norvegicus
aggctgcggacctatctacctcagg

SEQ ID NO: 617745 - DNA, 25 bp, Rattus norvegicus
tctaacggtcaagtacgcagaggta

SEQ ID NO: 617746 - DNA, 25 bp, Rattus norvegicus
catctgagacgcatgcgccttttga

SEQ ID NO: 617747 - DNA, 25 bp, Rattus norvegicus
gtaccgaatgactgcgtccatcaca

SEQ ID NO: 617748 - DNA, 25 bp, Rattus norvegicus
tacgcctaggggtagggctaaagca

SEQ ID NO: 617749 - DNA, 25 bp, Rattus norvegicus
gactatcacctacctttccttggga

SEQ ID NO: 617750 - DNA, 25 bp, Rattus norvegicus
ctgtccaaactaaggctcgccagtc

SEQ ID NO: 617751 - DNA, 25 bp, Rattus norvegicus
catccgtggccagatcctgtccaaa

SEQ ID NO: 617752 - DNA, 25 bp, Rattus norvegicus
actcccgtggcttctagtgctgacg

SEQ ID NO: 617753 - DNA, 25 bp, Rattus norvegicus
ctctggtgtcagagcgtcaccgcga

SEQ ID NO: 617754 - DNA, 25 bp, Rattus norvegicus
tggcatactgagacactctggtgtc

SEQ ID NO: 617755 - DNA, 25 bp, Rattus norvegicus
tctcgatttttatcccggtggcata

SEQ ID NO: 617756 - DNA, 25 bp, Rattus norvegicus
cccagagagcgctcatctcgatttt

SEQ ID NO: 617757 - DNA, 25 bp, Rattus norvegicus
cctcggacctgctggcaatagcttc

SEQ ID NO: 617758 - DNA, 25 bp, Rattus norvegicus
tttgagacttttccgctgctactgc

SEQ ID NO: 617759 - DNA, 25 bp, Rattus norvegicus
gaaacggaagcgcatcgaagccatc

SEQ ID NO: 617760 - DNA, 25 bp, Rattus norvegicus
tgctcaccgtcgtggacactcgatt

SEQ ID NO: 617761 - DNA, 25 bp, Rattus norvegicus
gacactcgattgctacccggcgttc

SEQ ID NO: 617762 - DNA, 25 bp, Rattus norvegicus
gacctgaggactccagacagccctg

SEQ ID NO: 617763 - DNA, 25 bp, Rattus norvegicus
ctttcctttccgtgcccaggaggag

SEQ ID NO: 617764 - DNA, 25 bp, Rattus norvegicus
tcccagttccttctacgggaggctg

SEQ ID NO: 617765 - DNA, 25 bp, Rattus norvegicus
gagctgaacgctggcaggctgtacc

SEQ ID NO: 617766 - DNA, 25 bp, Rattus norvegicus
aggaatctccacgtgggtgccacgc

SEQ ID NO: 617767 - DNA, 25 bp, Rattus norvegicus
tcggtaagggtgaggaatctccacg

SEQ ID NO: 617768 - DNA, 25 bp, Rattus norvegicus
agaggcagtcttcaaaacccaaatg

SEQ ID NO: 617769 - DNA, 25 bp, Rattus norvegicus
agacgaggcaggtccggatcccgcc

SEQ ID NO: 617770 - DNA, 25 bp, Rattus norvegicus
gggatactatgccatccaggcgaga

SEQ ID NO: 617771 - DNA, 25 bp, Rattus norvegicus
cgggcaggcagaacagggatactat

SEQ ID NO: 617772 - DNA, 25 bp, Rattus norvegicus
atactgggtcattgggaaggaatta

SEQ ID NO: 617773 - DNA, 25 bp, Rattus norvegicus
gagcgagtcctcaagaaatttagaa

SEQ ID NO: 617774 - DNA, 25 bp, Rattus norvegicus
gcgtaaaaaagcttgcgagcgggca

SEQ ID NO: 617775 - DNA, 25 bp, Rattus norvegicus
ccggaggtgtcacgagtgttttgct

SEQ ID NO: 617776 - DNA, 25 bp, Rattus norvegicus
aacctcgggccctaggggagctgct

SEQ ID NO: 617777 - DNA, 25 bp, Rattus norvegicus
cgacgacatgctgcgctgcggcctg

SEQ ID NO: 617778 - DNA, 25 bp, Rattus norvegicus
ggctgccagagcctcatggaatacg

SEQ ID NO: 617779 - DNA, 25 bp, Rattus norvegicus
gtgcgctctgagtcaccggaatcaa

SEQ ID NO: 617780 - DNA, 25 bp, Rattus norvegicus
tcaccggaatcaaggtgtggccgga

SEQ ID NO: 617781 - DNA, 25 bp, Rattus norvegicus
cctcttcctttagtggcggtgtcgg

SEQ ID NO: 617782 - DNA, 25 bp, Rattus norvegicus
cggtgtcggcgctcgcaggaccact

SEQ ID NO: 617783 - DNA, 25 bp, Rattus norvegicus
tcatggaatacggtgagtggccgcc

SEQ ID NO: 617784 - DNA, 25 bp, Rattus norvegicus
cctgcgagcgctgcaggtggatcct

SEQ ID NO: 617785 - DNA, 25 bp, Rattus norvegicus
tgctgctgctcagtgccatcgcctt

SEQ ID NO: 617786 - DNA, 25 bp, Rattus norvegicus
atcgccttcgacatcatcgcgctgt

SEQ ID NO: 617787 - DNA, 25 bp, Rattus norvegicus
ggctggctgcagtctagcaaccaca

SEQ ID NO: 617788 - DNA, 25 bp, Rattus norvegicus
acatccagacgtcctcgctttggtg

SEQ ID NO: 617789 - DNA, 25 bp, Rattus norvegicus
cctcgctttggtggaggtgtttcga

SEQ ID NO: 617790 - DNA, 25 bp, Rattus norvegicus
ggctcctacgacgatggctgccaga

SEQ ID NO: 617791 - DNA, 25 bp, Rattus norvegicus
tccggtcacacaagcgtctttaagc

SEQ ID NO: 617792 - DNA, 25 bp, Rattus norvegicus
gctgccacggcctccataacaagat

SEQ ID NO: 617793 - DNA, 25 bp, Rattus norvegicus
ccgacccagtaaccgccgcagcggg

SEQ ID NO: 617794 - DNA, 25 bp, Rattus norvegicus
gctccggaagttaggctggacccta

SEQ ID NO: 617795 - DNA, 25 bp, Rattus norvegicus
ccgtaagtacttccggtcacacaag

SEQ ID NO: 617796 - DNA, 25 bp, Rattus norvegicus
acttccggtcacacaagcgtcttta

SEQ ID NO: 617797 - DNA, 25 bp, Rattus norvegicus
cacaagcgtctttaagcggaacaga

SEQ ID NO: 617798 - DNA, 25 bp, Rattus norvegicus
acaagattctccgacccagtaaccg

SEQ ID NO: 617799 - DNA, 25 bp, Rattus norvegicus
tctttaagcggaacagagacaccta

SEQ ID NO: 617800 - DNA, 25 bp, Rattus norvegicus
taagcggaacagagacacctaagtt

SEQ ID NO: 617801 - DNA, 25 bp, Rattus norvegicus
cagagacacctaagttccgggtcaa

SEQ ID NO: 617802 - DNA, 25 bp, Rattus norvegicus
tcaaaggtgggccttctttatgcgc

SEQ ID NO: 617803 - DNA, 25 bp, Rattus norvegicus
aggtgggccttctttatgcgcatgc

SEQ ID NO: 617804 - DNA, 25 bp, Rattus norvegicus
gccacggcctccataacaagattct

SEQ ID NO: 617805 - DNA, 25 bp, Rattus norvegicus
cctcgtctttcctgttgcctttctg

SEQ ID NO: 617806 - DNA, 25 bp, Rattus norvegicus
tcctcgttgttgtgcccaggtaacc

SEQ ID NO: 617807 - DNA, 25 bp, Rattus norvegicus
agttcgttcaccttcaggcgacgca

SEQ ID NO: 617808 - DNA, 25 bp, Rattus norvegicus
acgagtctcaattggtcagcgcatg

SEQ ID NO: 617809 - DNA, 25 bp, Rattus norvegicus
gcgggcccgagaaccaagccaatca

SEQ ID NO: 617810 - DNA, 25 bp, Rattus norvegicus
atcacagtgtggctttcaaagaacg

SEQ ID NO: 617811 - DNA, 25 bp, Rattus norvegicus
ctgcctaagaggaagcgttagccta

SEQ ID NO: 617812 - DNA, 25 bp, Rattus norvegicus
cctacgttgaagtcgcggccaaagc

SEQ ID NO: 617813 - DNA, 25 bp, Rattus norvegicus
caagcactgattgggtagcgtccgc

SEQ ID NO: 617814 - DNA, 25 bp, Rattus norvegicus
cgccagctgcggtacagtcaaatga

SEQ ID NO: 617815 - DNA, 25 bp, Rattus norvegicus
ggagcaacgacttggagcaattagc

SEQ ID NO: 617816 - DNA, 25 bp, Rattus norvegicus
ggccaagcgggtaaaatcactacaa

SEQ ID NO: 617817 - DNA, 25 bp, Rattus norvegicus
tagattaattcaccgaaggcccgcc

SEQ ID NO: 617818 - DNA, 25 bp, Rattus norvegicus
tgagctctcagaatggccgtccagt

SEQ ID NO: 617819 - DNA, 25 bp, Rattus norvegicus
gagccaagggccagccttagcagcc

SEQ ID NO: 617820 - DNA, 25 bp, Rattus norvegicus
gttctgttccgaccgcaacattcct

SEQ ID NO: 617821 - DNA, 25 bp, Rattus norvegicus
cggttctgttccgaccgcaacattc

SEQ ID NO: 617822 - DNA, 25 bp, Rattus norvegicus
aagggccagccttagcagccccgga

SEQ ID NO: 617823 - DNA, 25 bp, Rattus norvegicus
tgttccgaccgcaacattcctgccc

SEQ ID NO: 617824 - DNA, 25 bp, Rattus norvegicus
ggagccaagggccagccttagcagc

SEQ ID NO: 617825 - DNA, 25 bp, Rattus norvegicus
cacgtggagccaagggccagcctta

SEQ ID NO: 617826 - DNA, 25 bp, Rattus norvegicus
acctggcacgtggagccaagggcca

SEQ ID NO: 617827 - DNA, 25 bp, Rattus norvegicus
agccacctggcacgtggagccaagg

SEQ ID NO: 617828 - DNA, 25 bp, Rattus norvegicus
acgtccagccacctggcacgtggag

SEQ ID NO: 617829 - DNA, 25 bp, Rattus norvegicus
gcgaacactggatcacgtccagcca

SEQ ID NO: 617830 - DNA, 25 bp, Rattus norvegicus
ggggcgaacactggatcacgtccag

SEQ ID NO: 617831 - DNA, 25 bp, Rattus norvegicus
atgcgtggccctgggacggcagact

SEQ ID NO: 617832 - DNA, 25 bp, Rattus norvegicus
gctcggttctgttccgaccgcaaca

SEQ ID NO: 617833 - DNA, 25 bp, Rattus norvegicus
tgatcgctctgcacatgaccacggc

SEQ ID NO: 617834 - DNA, 25 bp, Rattus norvegicus
gcatcacgcggcaggagttcgaaag

SEQ ID NO: 617835 - DNA, 25 bp, Rattus norvegicus
gggccttctcgctctacgacgtaga

SEQ ID NO: 617836 - DNA, 25 bp, Rattus norvegicus
agaagctcgagtgggccttctcgct

SEQ ID NO: 617837 - DNA, 25 bp, Rattus norvegicus
cgcggcaggagttcgaaagtatcta

SEQ ID NO: 617838 - DNA, 25 bp, Rattus norvegicus
tgcacatgaccacggcgggcaagcc

SEQ ID NO: 617839 - DNA, 25 bp, Rattus norvegicus
ttcaaggagtatgtgatcgctctgc

SEQ ID NO: 617840 - DNA, 25 bp, Rattus norvegicus
atggtacgctggacttcaaggagta

SEQ ID NO: 617841 - DNA, 25 bp, Rattus norvegicus
ttcgatgccaacagcgatggtacgc

SEQ ID NO: 617842 - DNA, 25 bp, Rattus norvegicus
ttccgcagcttcgatgccaacagcg

SEQ ID NO: 617843 - DNA, 25 bp, Rattus norvegicus
ccagcacgtgttccgcagcttcgat

SEQ ID NO: 617844 - DNA, 25 bp, Rattus norvegicus
ttccaagttctttccagactccgac

SEQ ID NO: 617845 - DNA, 25 bp, Rattus norvegicus
gttcgaaagtatctattccaagttc

SEQ ID NO: 617846 - DNA, 25 bp, Rattus norvegicus
gcaagcccacgcagaagctcgagtg

SEQ ID NO: 617847 - DNA, 25 bp, Rattus norvegicus
tgtccttgcgatcccttacccgtaa

SEQ ID NO: 617848 - DNA, 25 bp, Rattus norvegicus
gttaggatgtccttgcgatccctta

SEQ ID NO: 617849 - DNA, 25 bp, Rattus norvegicus
aggaggttccccagcaacggcagcg

SEQ ID NO: 617850 - DNA, 25 bp, Rattus norvegicus
tcctgggcagcgtcagagccagcag

SEQ ID NO: 617851 - DNA, 25 bp, Rattus norvegicus
caggtgctggctgcctccatctctg

SEQ ID NO: 617852 - DNA, 25 bp, Rattus norvegicus
tggctgcctccatctctgcaggtcg

SEQ ID NO: 617853 - DNA, 25 bp, Rattus norvegicus
tctgcaggtcggctgggtctgcacc

SEQ ID NO: 617854 - DNA, 25 bp, Rattus norvegicus
gggtctgcacctcctagaagctcct

SEQ ID NO: 617855 - DNA, 25 bp, Rattus norvegicus
aagctcctcgcggcccgactagtta

SEQ ID NO: 617856 - DNA, 25 bp, Rattus norvegicus
ggctccctcctcaacgaaatcaaga

SEQ ID NO: 617857 - DNA, 25 bp, Rattus norvegicus
tcaacgaaatcaagaggagtggggc

SEQ ID NO: 617858 - DNA, 25 bp, Rattus norvegicus
gggcagcctcctgcaaggcgtcgct

SEQ ID NO: 617859 - DNA, 25 bp, Rattus norvegicus
ttttcggcccgcagacatcagacgt

SEQ ID NO: 617860 - DNA, 25 bp, Rattus norvegicus
agacatcagacgtcccacaccaccg

SEQ ID NO: 617861 - DNA, 25 bp, Rattus norvegicus
ggccgcttccacactctagatccgc

SEQ ID NO: 617862 - DNA, 25 bp, Rattus norvegicus
gccttacaggaacagcccgggcggc

SEQ ID NO: 617863 - DNA, 25 bp, Rattus norvegicus
cccggttgatggagacgcagtcgtt

SEQ ID NO: 617864 - DNA, 25 bp, Rattus norvegicus
tgatggagacgcagtcgttgagatc

SEQ ID NO: 617865 - DNA, 25 bp, Rattus norvegicus
cgcagtcgttgagatcaggcatgtc

SEQ ID NO: 617866 - DNA, 25 bp, Rattus norvegicus
gatcaggcatgtccttgccgcggta

SEQ ID NO: 617867 - DNA, 25 bp, Rattus norvegicus
cttcctcagtgcagcacggccggcc

SEQ ID NO: 617868 - DNA, 25 bp, Rattus norvegicus
cacactctagatccgccgctcgccc

SEQ ID NO: 617869 - DNA, 25 bp, Rattus norvegicus
tcgcccgcccgatccgctccctgcg

SEQ ID NO: 617870 - DNA, 25 bp, Rattus norvegicus
aggcatgtccttgccgcggtagatg

SEQ ID NO: 617871 - DNA, 25 bp, Rattus norvegicus
cccgcgctcggaaggagagtttact

SEQ ID NO: 617872 - DNA, 25 bp, Rattus norvegicus
cgctcggaaggagagtttactcatt

SEQ ID NO: 617873 - DNA, 25 bp, Rattus norvegicus
aaggagagtttactcattgtctccc

SEQ ID NO: 617874 - DNA, 25 bp, Rattus norvegicus
tcgttgagatcaggcatgtccttgc

SEQ ID NO: 617875 - DNA, 25 bp, Rattus norvegicus
gtgacaggaggcttagaacacccta

SEQ ID NO: 617876 - DNA, 25 bp, Rattus norvegicus
gcaaccggacctctggttccttctc

SEQ ID NO: 617877 - DNA, 25 bp, Rattus norvegicus
cagtcgtccgcgtccggcaaccgga

SEQ ID NO: 617878 - DNA, 25 bp, Rattus norvegicus
cccaggtctttcacttcgcgcgacc

SEQ ID NO: 617879 - DNA, 25 bp, Rattus norvegicus
tcaccgagctttttcctccggcctc

SEQ ID NO: 617880 - DNA, 25 bp, Rattus norvegicus
ccgtttgtgccagccgccctgcgct

SEQ ID NO: 617881 - DNA, 25 bp, Rattus norvegicus
cgaggctcatttgcattacgtgccc

SEQ ID NO: 617882 - DNA, 25 bp, Rattus norvegicus
gccctgcgcttcacagcgcgccata

SEQ ID NO: 617883 - DNA, 25 bp, Rattus norvegicus
ctgcgcgtgcgcgaaccgcacagtg

SEQ ID NO: 617884 - DNA, 25 bp, Rattus norvegicus
tgcgcgaaccgcacagtgacaggag

SEQ ID NO: 617885 - DNA, 25 bp, Rattus norvegicus
ccgcacagtgacaggaggcttagaa

SEQ ID NO: 617886 - DNA, 25 bp, Rattus norvegicus
gaggcttagaacaccctacgggaga

SEQ ID NO: 617887 - DNA, 25 bp, Rattus norvegicus
cgcgaggctcatttgcattacgtgc

SEQ ID NO: 617888 - DNA, 25 bp, Rattus norvegicus
tcccggacgcgaggctcatttgcat

SEQ ID NO: 617889 - DNA, 25 bp, Rattus norvegicus
catagaagagcgattggtggagcaa

SEQ ID NO: 617890 - DNA, 25 bp, Rattus norvegicus
cagagacgagactccggattggtta

SEQ ID NO: 617891 - DNA, 25 bp, Rattus norvegicus
cacgctcgcccaacacagggattgg

SEQ ID NO: 617892 - DNA, 25 bp, Rattus norvegicus
aaaaatcggagcagagacgagactc

SEQ ID NO: 617893 - DNA, 25 bp, Rattus norvegicus
acggatttggtcaaaaatcggagca

SEQ ID NO: 617894 - DNA, 25 bp, Rattus norvegicus
ctgcgcccgacggaggaacggattt

SEQ ID NO: 617895 - DNA, 25 bp, Rattus norvegicus
aggcaaagatactgcgcccgacgga

SEQ ID NO: 617896 - DNA, 25 bp, Rattus norvegicus
tctcagccatggctcggtggcgacc

SEQ ID NO: 617897 - DNA, 25 bp, Rattus norvegicus
tccggattggttagacgtaggcatt

SEQ ID NO: 617898 - DNA, 25 bp, Rattus norvegicus
caaaaggggcgtgacatagaagagc

SEQ ID NO: 617899 - DNA, 25 bp, Rattus norvegicus
gctgagtcaaaaggggcgtgacata

SEQ ID NO: 617900 - DNA, 25 bp, Rattus norvegicus
acaagcagcgcggattggcagcatg

SEQ ID NO: 617901 - DNA, 25 bp, Rattus norvegicus
tcctcaccgtaggtctcagccatgg

SEQ ID NO: 617902 - DNA, 25 bp, Rattus norvegicus
tctggagctgcggataccaggccac

SEQ ID NO: 617903 - DNA, 25 bp, Rattus norvegicus
tcccattagtccacgtgcgcgaacg

SEQ ID NO: 617904 - DNA, 25 bp, Rattus norvegicus
tgtgctggttgcgagttctaccacg

SEQ ID NO: 617905 - DNA, 25 bp, Rattus norvegicus
cgccagtatcacgtgaccttcaagg

SEQ ID NO: 617906 - DNA, 25 bp, Rattus norvegicus
ctattctggagactgcctttcggga

SEQ ID NO: 617907 - DNA, 25 bp, Rattus norvegicus
ccaattgggacgtggttagagctcc

SEQ ID NO: 617908 - DNA, 25 bp, Rattus norvegicus
agggtacgagcttttggccaattgg

SEQ ID NO: 617909 - DNA, 25 bp, Rattus norvegicus
ttgcgttcccgccttagcgataagc

SEQ ID NO: 617910 - DNA, 25 bp, Rattus norvegicus
tgcctgcccaggaaaagaacgcttg

SEQ ID NO: 617911 - DNA, 25 bp, Rattus norvegicus
ggcccgcaaactccgtaagttcaga

SEQ ID NO: 617912 - DNA, 25 bp, Rattus norvegicus
ttccgcgagctaatcagggcccgca

SEQ ID NO: 617913 - DNA, 25 bp, Rattus norvegicus
cgccaagctacgctgcaaagacaca

SEQ ID NO: 617914 - DNA, 25 bp, Rattus norvegicus
cccggatgtcggagccagttaagaa

SEQ ID NO: 617915 - DNA, 25 bp, Rattus norvegicus
cccgcgtgttaaggaagatctagag

SEQ ID NO: 617916 - DNA, 25 bp, Rattus norvegicus
cggaacatcctagtctctcaaaaga

SEQ ID NO: 617917 - DNA, 25 bp, Rattus norvegicus
agctccaggccgctcggatatgtag

SEQ ID NO: 617918 - DNA, 25 bp, Rattus norvegicus
acagggttctgcctgtggaccgtcc

SEQ ID NO: 617919 - DNA, 25 bp, Rattus norvegicus
ggcgcaggcccgaagtcggtcctct

SEQ ID NO: 617920 - DNA, 25 bp, Rattus norvegicus
aagtcggtcctctccgcctctgagt

SEQ ID NO: 617921 - DNA, 25 bp, Rattus norvegicus
ttaaatcctacaaggggtgtggctg

SEQ ID NO: 617922 - DNA, 25 bp, Rattus norvegicus
gtctgacccggggtctaagtcgtgc

SEQ ID NO: 617923 - DNA, 25 bp, Rattus norvegicus
tatgtaggggttaaccgatactcca

SEQ ID NO: 617924 - DNA, 25 bp, Rattus norvegicus
aaaacacggccctcgccggatgtga

SEQ ID NO: 617925 - DNA, 25 bp, Rattus norvegicus
ccggatgtgacgaatcacgagtgtg

SEQ ID NO: 617926 - DNA, 25 bp, Rattus norvegicus
agcttcggttggcaccgtgtgtctc

SEQ ID NO: 617927 - DNA, 25 bp, Rattus norvegicus
ctcgtgttcgtctccacagggttct

SEQ ID NO: 617928 - DNA, 25 bp, Rattus norvegicus
tctcgctgggaaaggacactaggtt

SEQ ID NO: 617929 - DNA, 25 bp, Rattus norvegicus
acactaggtttctaggtctgacccg

SEQ ID NO: 617930 - DNA, 25 bp, Rattus norvegicus
tccgcctctgagtgcaggctgaacc

SEQ ID NO: 617931 - DNA, 25 bp, Rattus norvegicus
cggggttacactttgcatatacagc

SEQ ID NO: 617932 - DNA, 25 bp, Rattus norvegicus
gcagcactcgggtagccgggcccaa

SEQ ID NO: 617933 - DNA, 25 bp, Rattus norvegicus
gcaggttcccgcaaggccaggccaa

SEQ ID NO: 617934 - DNA, 25 bp, Rattus norvegicus
gtcggtctttgctcgggaggagacc

SEQ ID NO: 617935 - DNA, 25 bp, Rattus norvegicus
gaggagaccgggtagtgtttgtgtg

SEQ ID NO: 617936 - DNA, 25 bp, Rattus norvegicus
ggcggggttacactttgcatataca

SEQ ID NO: 617937 - DNA, 25 bp, Rattus norvegicus
acactttgcatatacagcaggcggc

SEQ ID NO: 617938 - DNA, 25 bp, Rattus norvegicus
tttgcatatacagcaggcggcgggc

SEQ ID NO: 617939 - DNA, 25 bp, Rattus norvegicus
tggctcgcgcgcttgcatcccgcac

SEQ ID NO: 617940 - DNA, 25 bp, Rattus norvegicus
ttgcatcccgcaccagccgtcggcc

SEQ ID NO: 617941 - DNA, 25 bp, Rattus norvegicus
cccggcccgcgtcagatcgagccgc

SEQ ID NO: 617942 - DNA, 25 bp, Rattus norvegicus
gcgtcagatcgagccgccgccacca

SEQ ID NO: 617943 - DNA, 25 bp, Rattus norvegicus
ccgggccctggatgtcccgcagcgc

SEQ ID NO: 617944 - DNA, 25 bp, Rattus norvegicus
agggcggggttacactttgcatata

SEQ ID NO: 617945 - DNA, 25 bp, Rattus norvegicus
gatcgccactctgcttctagccaga

SEQ ID NO: 617946 - DNA, 25 bp, Rattus norvegicus
ccatggatggtctgcgcgaggtcat

SEQ ID NO: 617947 - DNA, 25 bp, Rattus norvegicus
tctacggtggacaccactcggcctt

SEQ ID NO: 617948 - DNA, 25 bp, Rattus norvegicus
acttgctcaagtgagccacgggctg

SEQ ID NO: 617949 - DNA, 25 bp, Rattus norvegicus
ggctgaagatcaacggacgcgaacg

SEQ ID NO: 617950 - DNA, 25 bp, Rattus norvegicus
cacgacctgaacctcgccatggatg

SEQ ID NO: 617951 - DNA, 25 bp, Rattus norvegicus
aggtcatgccctatgcgcacgggcc

SEQ ID NO: 617952 - DNA, 25 bp, Rattus norvegicus
ttggcgagatctacggtggacacca

SEQ ID NO: 617953 - DNA, 25 bp, Rattus norvegicus
ttcggccgaatccaaggacttgctc

SEQ ID NO: 617954 - DNA, 25 bp, Rattus norvegicus
ctcggccttccactgtgggactgtg

SEQ ID NO: 617955 - DNA, 25 bp, Rattus norvegicus
actgtggggcattcggctggccacc

SEQ ID NO: 617956 - DNA, 25 bp, Rattus norvegicus
ggcggcgcgctctcctctggcaatg

SEQ ID NO: 617957 - DNA, 25 bp, Rattus norvegicus
aacatggcccggctttcggccgaat

SEQ ID NO: 617958 - DNA, 25 bp, Rattus norvegicus
cgcgaacgcaagaggatgcacgacc

SEQ ID NO: 617959 - DNA, 25 bp, Rattus norvegicus
agccgcctggccgagaaacgcagcg

SEQ ID NO: 617960 - DNA, 25 bp, Rattus norvegicus
agcgaaagctgcctggtgtattctc

SEQ ID NO: 617961 - DNA, 25 bp, Rattus norvegicus
cgacattcatctacgtctgagggca

SEQ ID NO: 617962 - DNA, 25 bp, Rattus norvegicus
tagggacgcggcgacattcatctac

SEQ ID NO: 617963 - DNA, 25 bp, Rattus norvegicus
gtgtattctcgcagcgtccaggagc

SEQ ID NO: 617964 - DNA, 25 bp, Rattus norvegicus
tcgcaggcacaggtgtagccgcctg

SEQ ID NO: 617965 - DNA, 25 bp, Rattus norvegicus
atctacgtctgagggcacagagccg

SEQ ID NO: 617966 - DNA, 25 bp, Rattus norvegicus
cacagagccggctagttacatgctg

SEQ ID NO: 617967 - DNA, 25 bp, Rattus norvegicus
ttacatgctggccagagagaggacc

SEQ ID NO: 617968 - DNA, 25 bp, Rattus norvegicus
gagagaggaccctccatctgagccc

SEQ ID NO: 617969 - DNA, 25 bp, Rattus norvegicus
tgcccaactcaccaatacagcgagt

SEQ ID NO: 617970 - DNA, 25 bp, Rattus norvegicus
ctcaccaatacagcgagtgccctgg

SEQ ID NO: 617971 - DNA, 25 bp, Rattus norvegicus
agccggaaacctgggtcgcaggcac

SEQ ID NO: 617972 - DNA, 25 bp, Rattus norvegicus
cggtgccgcacacgcagcgaaagct

SEQ ID NO: 617973 - DNA, 25 bp, Rattus norvegicus
agtagccgtcctcgcgtggcgcgct

SEQ ID NO: 617974 - DNA, 25 bp, Rattus norvegicus
gcgcacgggtgacaatcatgaacac

SEQ ID NO: 617975 - DNA, 25 bp, Rattus norvegicus
cggcagcatacttcctgcgtccgga

SEQ ID NO: 617976 - DNA, 25 bp, Rattus norvegicus
atacttcctgcgtccggagtcccgg

SEQ ID NO: 617977 - DNA, 25 bp, Rattus norvegicus
gcagcggcgatgcacactgtagaag

SEQ ID NO: 617978 - DNA, 25 bp, Rattus norvegicus
cacactgtagaagtgaagcgtgagc

SEQ ID NO: 617979 - DNA, 25 bp, Rattus norvegicus
cgggcctcgtctcacttcgcttccg

SEQ ID NO: 617980 - DNA, 25 bp, Rattus norvegicus
tgaaacagtaaccaaagccggaggc

SEQ ID NO: 617981 - DNA, 25 bp, Rattus norvegicus
ttcgcttccgcgcagttccctgaaa

SEQ ID NO: 617982 - DNA, 25 bp, Rattus norvegicus
aaccaaagccggaggcgtctgagta

SEQ ID NO: 617983 - DNA, 25 bp, Rattus norvegicus
cgcgctctgtgccagcactgtgtag

SEQ ID NO: 617984 - DNA, 25 bp, Rattus norvegicus
ggcgtctgagtagccgtcctcgcgt

SEQ ID NO: 617985 - DNA, 25 bp, Rattus norvegicus
tgccagcactgtgtagggcgccgcc

SEQ ID NO: 617986 - DNA, 25 bp, Rattus norvegicus
ttccgcgcagttccctgaaacagta

SEQ ID NO: 617987 - DNA, 25 bp, Rattus norvegicus
ccgtcacccgaagatatctggggtt

SEQ ID NO: 617988 - DNA, 25 bp, Rattus norvegicus
ccagcgctaggaactcggccagcag

SEQ ID NO: 617989 - DNA, 25 bp, Rattus norvegicus
ccagcaggtcggtgttgctgagaca

SEQ ID NO: 617990 - DNA, 25 bp, Rattus norvegicus
tgctgagacactgcaccaccgcgtt

SEQ ID NO: 617991 - DNA, 25 bp, Rattus norvegicus
tgcaccaccgcgttcatgaaacagg

SEQ ID NO: 617992 - DNA, 25 bp, Rattus norvegicus
ccgcgttcatgaaacaggtgttgcc

SEQ ID NO: 617993 - DNA, 25 bp, Rattus norvegicus
tattcgcgcgtccagagcgcgcgca

SEQ ID NO: 617994 - DNA, 25 bp, Rattus norvegicus
ctggggttgagatcccaaaggacga

SEQ ID NO: 617995 - DNA, 25 bp, Rattus norvegicus
ccaaaggacgatctggccctgggct

SEQ ID NO: 617996 - DNA, 25 bp, Rattus norvegicus
ttctccatcgccatcgtaggggctg

SEQ ID NO: 617997 - DNA, 25 bp, Rattus norvegicus
cgggtaaccagagctagcaggaagc

SEQ ID NO: 617998 - DNA, 25 bp, Rattus norvegicus
agctagcaggaagcggttaagcaga

SEQ ID NO: 617999 - DNA, 25 bp, Rattus norvegicus
atggttcttcaagccctgagcgccg

SEQ ID NO: 618000 - DNA, 25 bp, Rattus norvegicus
caggtgttgccatggttcttcaagc

SEQ ID NO: 618001 - DNA, 25 bp, Rattus norvegicus
cctggggctgccgaaaacagctgga

SEQ ID NO: 618002 - DNA, 25 bp, Rattus norvegicus
ctgggcgagctaggcatcttagccc

SEQ ID NO: 618003 - DNA, 25 bp, Rattus norvegicus
ccggactgctgagccaaaggaggcc

SEQ ID NO: 618004 - DNA, 25 bp, Rattus norvegicus
tccctctgatttgccctgactcacg

SEQ ID NO: 618005 - DNA, 25 bp, Rattus norvegicus
ccacatggccttctacctgactttg

SEQ ID NO: 618006 - DNA, 25 bp, Rattus norvegicus
caggtacctgatagcctagccgctc

SEQ ID NO: 618007 - DNA, 25 bp, Rattus norvegicus
ccactcctgggcgagctaggcatct

SEQ ID NO: 618008 - DNA, 25 bp, Rattus norvegicus
tgtaagctccgcctaacccaggtac

SEQ ID NO: 618009 - DNA, 25 bp, Rattus norvegicus
ctgccgaaaacagctggagacagct

SEQ ID NO: 618010 - DNA, 25 bp, Rattus norvegicus
cttctacctgactttgtaagctccg

SEQ ID NO: 618011 - DNA, 25 bp, Rattus norvegicus
ctggagacagctgcgctcaggagaa

SEQ ID NO: 618012 - DNA, 25 bp, Rattus norvegicus
gtgtgtgtgggatttttctgagcca

SEQ ID NO: 618013 - DNA, 25 bp, Rattus norvegicus
ttctgagccacaactgtacaaaagg

SEQ ID NO: 618014 - DNA, 25 bp, Rattus norvegicus
gccggacgtgtctttcgagggcacc

SEQ ID NO: 618015 - DNA, 25 bp, Rattus norvegicus
aagcgcacgcgaagacgctctcggg

SEQ ID NO: 618016 - DNA, 25 bp, Rattus norvegicus
cgccgctgtccacgctggtggtgtt

SEQ ID NO: 618017 - DNA, 25 bp, Rattus norvegicus
ccgctgtccacgctggtggtgttgc

SEQ ID NO: 618018 - DNA, 25 bp, Rattus norvegicus
ccagtgggcccgtggatgcaacgca

SEQ ID NO: 618019 - DNA, 25 bp, Rattus norvegicus
ccgtggatgcaacgcaggccgcaca

SEQ ID NO: 618020 - DNA, 25 bp, Rattus norvegicus
tgaagcgcacgcgaagacgctctcg

SEQ ID NO: 618021 - DNA, 25 bp, Rattus norvegicus
aatagcgacacccagagcagccgcg

SEQ ID NO: 618022 - DNA, 25 bp, Rattus norvegicus
gcgacacccagagcagccgcgcgcc

SEQ ID NO: 618023 - DNA, 25 bp, Rattus norvegicus
aagacgctctcggggtcggcccagt

SEQ ID NO: 618024 - DNA, 25 bp, Rattus norvegicus
agcagcaccaatagcgacacccaga

SEQ ID NO: 618025 - DNA, 25 bp, Rattus norvegicus
gcagcaccaatagcgacacccagag

SEQ ID NO: 618026 - DNA, 25 bp, Rattus norvegicus
gcaccaatagcgacacccagagcag

SEQ ID NO: 618027 - DNA, 25 bp, Rattus norvegicus
cactcacaggcgcggaagccgggtc

SEQ ID NO: 618028 - DNA, 25 bp, Rattus norvegicus
ggatgcaacgcaggccgcacacggc

SEQ ID NO: 618029 - DNA, 25 bp, Rattus norvegicus
gtctgggctggttcagcctcgctct

SEQ ID NO: 618030 - DNA, 25 bp, Rattus norvegicus
gtcccgcaatcttgggcattttgtg

SEQ ID NO: 618031 - DNA, 25 bp, Rattus norvegicus
atcttgggcattttgtgcccgggca

SEQ ID NO: 618032 - DNA, 25 bp, Rattus norvegicus
ggcggcaacaccgtgggaaccagac

SEQ ID NO: 618033 - DNA, 25 bp, Rattus norvegicus
gccaacccgcacaatcgcttttgtt

SEQ ID NO: 618034 - DNA, 25 bp, Rattus norvegicus
caatcgcttttgttgtctgggctgg

SEQ ID NO: 618035 - DNA, 25 bp, Rattus norvegicus
ttcttttcagcaatgcccgggccca

SEQ ID NO: 618036 - DNA, 25 bp, Rattus norvegicus
ccgtgggaaccagacggctttatct

SEQ ID NO: 618037 - DNA, 25 bp, Rattus norvegicus
tcacctcgtactgccggacgcaggg

SEQ ID NO: 618038 - DNA, 25 bp, Rattus norvegicus
agttctgtccctggctcacctcgta

SEQ ID NO: 618039 - DNA, 25 bp, Rattus norvegicus
ttggcctgcgtctagttctgtccct

SEQ ID NO: 618040 - DNA, 25 bp, Rattus norvegicus
ggtcagcgcctttggcctgcgtcta

SEQ ID NO: 618041 - DNA, 25 bp, Rattus norvegicus
ctcgctctctgctgggcgagttgcc

SEQ ID NO: 618042 - DNA, 25 bp, Rattus norvegicus
gacggctttatctggcccggaacca

SEQ ID NO: 618043 - DNA, 25 bp, Rattus norvegicus
aggccaatcggtaggcgacatggga

SEQ ID NO: 618044 - DNA, 25 bp, Rattus norvegicus
accgcgtcctcgacggcctggatag

SEQ ID NO: 618045 - DNA, 25 bp, Rattus norvegicus
atcgtgtcgggtgcagagtccggct

SEQ ID NO: 618046 - DNA, 25 bp, Rattus norvegicus
gcaatgtgtccagtgggtccggatc

SEQ ID NO: 618047 - DNA, 25 bp, Rattus norvegicus
ctgccagaggccgactcactttctc

SEQ ID NO: 618048 - DNA, 25 bp, Rattus norvegicus
actttctccaccgtgctagcctggg

SEQ ID NO: 618049 - DNA, 25 bp, Rattus norvegicus
actggaactggggccgctagcagat

SEQ ID NO: 618050 - DNA, 25 bp, Rattus norvegicus
tagcctggggctgtgaaacttcccg

SEQ ID NO: 618051 - DNA, 25 bp, Rattus norvegicus
ggggctgtgaaacttcccgccaatc

SEQ ID NO: 618052 - DNA, 25 bp, Rattus norvegicus
gctgtgaaacttcccgccaatcaga

SEQ ID NO: 618053 - DNA, 25 bp, Rattus norvegicus
aatcagagccctgcactgtcagcgc

SEQ ID NO: 618054 - DNA, 25 bp, Rattus norvegicus
cctgcactgtcagcgctccgggtga

SEQ ID NO: 618055 - DNA, 25 bp, Rattus norvegicus
ctccaccgtgctagcctggggctgt

SEQ ID NO: 618056 - DNA, 25 bp, Rattus norvegicus
tcagcgctccgggtgaggccaatcg

SEQ ID NO: 618057 - DNA, 25 bp, Rattus norvegicus
gcagtcgtcgggacagccatagccc

SEQ ID NO: 618058 - DNA, 25 bp, Rattus norvegicus
aagaggcgggcatcccgcctcggtc

SEQ ID NO: 618059 - DNA, 25 bp, Rattus norvegicus
atcccgcctcggtcccggaggatgg

SEQ ID NO: 618060 - DNA, 25 bp, Rattus norvegicus
cgcatttacgttctctgactcttta

SEQ ID NO: 618061 - DNA, 25 bp, Rattus norvegicus
tccactgcagtcgtcgggacagcca

SEQ ID NO: 618062 - DNA, 25 bp, Rattus norvegicus
acccacttccgggtgtgcacagacc

SEQ ID NO: 618063 - DNA, 25 bp, Rattus norvegicus
tgctcattggcctaaagactccagg

SEQ ID NO: 618064 - DNA, 25 bp, Rattus norvegicus
agactccaggctccaccgacgattg

SEQ ID NO: 618065 - DNA, 25 bp, Rattus norvegicus
ccaccgacgattggacagagagctc

SEQ ID NO: 618066 - DNA, 25 bp, Rattus norvegicus
cgattggacagagagctcgctcatc

SEQ ID NO: 618067 - DNA, 25 bp, Rattus norvegicus
tctgactctttaaagaggggcggtc

SEQ ID NO: 618068 - DNA, 25 bp, Rattus norvegicus
gagctcgctcatcgcatttacgttc

SEQ ID NO: 618069 - DNA, 25 bp, Rattus norvegicus
cctgcctcttgctcattggcctaaa

SEQ ID NO: 618070 - DNA, 25 bp, Rattus norvegicus
ccctacgttcagatgaatcacttcc

SEQ ID NO: 618071 - DNA, 25 bp, Rattus norvegicus
gccgatcgggccgaggtgtccgctc

SEQ ID NO: 618072 - DNA, 25 bp, Rattus norvegicus
accaccctctcgaggccgtggccgc

SEQ ID NO: 618073 - DNA, 25 bp, Rattus norvegicus
gagcctccctgagcaggggcggagc

SEQ ID NO: 618074 - DNA, 25 bp, Rattus norvegicus
ccctcgtgctgcactgtgtgagtgg

SEQ ID NO: 618075 - DNA, 25 bp, Rattus norvegicus
gaagccctcgtgctgcactgtgtga

SEQ ID NO: 618076 - DNA, 25 bp, Rattus norvegicus
aggaagccctcgtgctgcactgtgt

SEQ ID NO: 618077 - DNA, 25 bp, Rattus norvegicus
agcaggaagccctcgtgctgcactg

SEQ ID NO: 618078 - DNA, 25 bp, Rattus norvegicus
cgagctcgcgcttgcgcagcaggaa

SEQ ID NO: 618079 - DNA, 25 bp, Rattus norvegicus
ttagcgtcgagctcgcgcttgcgca

SEQ ID NO: 618080 - DNA, 25 bp, Rattus norvegicus
tgcggttagcgtcgagctcgcgctt

SEQ ID NO: 618081 - DNA, 25 bp, Rattus norvegicus
acgacttgcggttagcgtcgagctc

SEQ ID NO: 618082 - DNA, 25 bp, Rattus norvegicus
tcaccggttggacgacttgcggtta

SEQ ID NO: 618083 - DNA, 25 bp, Rattus norvegicus
acgcgctcaccggttggacgacttg

SEQ ID NO: 618084 - DNA, 25 bp, Rattus norvegicus
ctcaagcccgttgggcaggcgacca

SEQ ID NO: 618085 - DNA, 25 bp, Rattus norvegicus
tggactcctggcgttctgatcttcg

SEQ ID NO: 618086 - DNA, 25 bp, Rattus norvegicus
ctccatttgctcatagcgacccaga

SEQ ID NO: 618087 - DNA, 25 bp, Rattus norvegicus
acctccgctgacagcgtgtccgagg

SEQ ID NO: 618088 - DNA, 25 bp, Rattus norvegicus
gcttgagctcctggcgcacataacc

SEQ ID NO: 618089 - DNA, 25 bp, Rattus norvegicus
tccggcagccggtcaatgcgcggct

SEQ ID NO: 618090 - DNA, 25 bp, Rattus norvegicus
cgaggtctccggcagccggtcaatg

SEQ ID NO: 618091 - DNA, 25 bp, Rattus norvegicus
tcgtgtccaacgctgcggctgttgg

SEQ ID NO: 618092 - DNA, 25 bp, Rattus norvegicus
ttctgatcttcgtctccgtggcagc

SEQ ID NO: 618093 - DNA, 25 bp, Rattus norvegicus
tcctcgggttgatccgtggactcct

SEQ ID NO: 618094 - DNA, 25 bp, Rattus norvegicus
gcgctgcctcctcgggttgatccgt

SEQ ID NO: 618095 - DNA, 25 bp, Rattus norvegicus
tggtccgcggactcctggcgctcag

SEQ ID NO: 618096 - DNA, 25 bp, Rattus norvegicus
cgacccagagtaaggctgtgaggcc

SEQ ID NO: 618097 - DNA, 25 bp, Rattus norvegicus
tagactcctgtcgttctatccgccg

SEQ ID NO: 618098 - DNA, 25 bp, Rattus norvegicus
ttccaggggtgtccgtcgtgtccaa

SEQ ID NO: 618099 - DNA, 25 bp, Rattus norvegicus
tccaggagagcaagtctcgggcctg

SEQ ID NO: 618100 - DNA, 25 bp, Rattus norvegicus
atgcaccggtcctgcgcgggcacag

SEQ ID NO: 618101 - DNA, 25 bp, Rattus norvegicus
cctgagggacaagccaggtcatgca

SEQ ID NO: 618102 - DNA, 25 bp, Rattus norvegicus
tgcagctgccgcacctgagggacaa

SEQ ID NO: 618103 - DNA, 25 bp, Rattus norvegicus
cgcccgcgtacacagtccgcaactg

SEQ ID NO: 618104 - DNA, 25 bp, Rattus norvegicus
tggcgatggcctctgcgtgctcgcc

SEQ ID NO: 618105 - DNA, 25 bp, Rattus norvegicus
acctcctgctcacggctggcgatgg

SEQ ID NO: 618106 - DNA, 25 bp, Rattus norvegicus
gagcatcctcacaggctgccagcag

SEQ ID NO: 618107 - DNA, 25 bp, Rattus norvegicus
tgcagacgagcatcctcacaggctg

SEQ ID NO: 618108 - DNA, 25 bp, Rattus norvegicus
tcagccgtggagctgacgtgcagac

SEQ ID NO: 618109 - DNA, 25 bp, Rattus norvegicus
ccgtccatccaggagagcaagtctc

SEQ ID NO: 618110 - DNA, 25 bp, Rattus norvegicus
aagccaggtcatgcaccggtcctgc

SEQ ID NO: 618111 - DNA, 25 bp, Rattus norvegicus
ccgcgatgccgtccatccaggagag

SEQ ID NO: 618112 - DNA, 25 bp, Rattus norvegicus
gctgacgtgcagacgagcatcctca

SEQ ID NO: 618113 - DNA, 25 bp, Rattus norvegicus
gaagtccctgcggtcctgatgcgcc

SEQ ID NO: 618114 - DNA, 25 bp, Rattus norvegicus
ggcggcctaccaagtcgactaccta

SEQ ID NO: 618115 - DNA, 25 bp, Rattus norvegicus
cgactacctagtctgcggcggacgt

SEQ ID NO: 618116 - DNA, 25 bp, Rattus norvegicus
tgtctctgcggtactcgccgctttc

SEQ ID NO: 618117 - DNA, 25 bp, Rattus norvegicus
ccgccctgggctaagtggccctgaa

SEQ ID NO: 618118 - DNA, 25 bp, Rattus norvegicus
tcgggtaatctctccgagccgctgc

SEQ ID NO: 618119 - DNA, 25 bp, Rattus norvegicus
cgaggatcctaagccgccctcgggt

SEQ ID NO: 618120 - DNA, 25 bp, Rattus norvegicus
atgagcaccgaggatcctaagccgc

SEQ ID NO: 618121 - DNA, 25 bp, Rattus norvegicus
ggagctttgatgagcaccgaggatc

SEQ ID NO: 618122 - DNA, 25 bp, Rattus norvegicus
tgctggtggtcctgatgctgtctgc

SEQ ID NO: 618123 - DNA, 25 bp, Rattus norvegicus
ctgcagtcggcaggatgattctgct

SEQ ID NO: 618124 - DNA, 25 bp, Rattus norvegicus
ttgctcaggaatgggcccgcaggct

SEQ ID NO: 618125 - DNA, 25 bp, Rattus norvegicus
ctagggtgtcctttgctcaggaatg

SEQ ID NO: 618126 - DNA, 25 bp, Rattus norvegicus
aagtggccctgaatcctggaacgga

SEQ ID NO: 618127 - DNA, 25 bp, Rattus norvegicus
tccgggctgcgcaacgaggccagca

SEQ ID NO: 618128 - DNA, 25 bp, Rattus norvegicus
gcgtccagcgtctgctgccgccgtt

SEQ ID NO: 618129 - DNA, 25 bp, Rattus norvegicus
agtggcttcccgcagtccggtccag

SEQ ID NO: 618130 - DNA, 25 bp, Rattus norvegicus
ccgcagtccggtccaggcgctctgc

SEQ ID NO: 618131 - DNA, 25 bp, Rattus norvegicus
gtggcttcccgcagtccggtccagg

SEQ ID NO: 618132 - DNA, 25 bp, Rattus norvegicus
tccagcacctcctccaagcgcggcc

SEQ ID NO: 618133 - DNA, 25 bp, Rattus norvegicus
ctcaggccctgcggatgaggcatcg

SEQ ID NO: 618134 - DNA, 25 bp, Rattus norvegicus
gcctcaggccctgcggatgaggcat

SEQ ID NO: 618135 - DNA, 25 bp, Rattus norvegicus
gtgagcctggatctcccgcctcagg

SEQ ID NO: 618136 - DNA, 25 bp, Rattus norvegicus
ctggccgcggcgcaccgcctcagcc

SEQ ID NO: 618137 - DNA, 25 bp, Rattus norvegicus
tctgctgccgccgttcagtggcttc

SEQ ID NO: 618138 - DNA, 25 bp, Rattus norvegicus
cacctcctccaagcgcggcccgtga

SEQ ID NO: 618139 - DNA, 25 bp, Rattus norvegicus
gctgcgcaacgaggccagcacgccc

SEQ ID NO: 618140 - DNA, 25 bp, Rattus norvegicus
aacgaggccagcacgcccgcgcgct

SEQ ID NO: 618141 - DNA, 25 bp, Rattus norvegicus
gccgaaagccgcgttgacaaagtcc

SEQ ID NO: 618142 - DNA, 25 bp, Rattus norvegicus
ccagcttggcactccgcgttggaga

SEQ ID NO: 618143 - DNA, 25 bp, Rattus norvegicus
cgccacctggggtccttcataaata

SEQ ID NO: 618144 - DNA, 25 bp, Rattus norvegicus
tggcctcccggccaaccaaggagta

SEQ ID NO: 618145 - DNA, 25 bp, Rattus norvegicus
cgcccaacaaccctcggtagagtga

SEQ ID NO: 618146 - DNA, 25 bp, Rattus norvegicus
ctcaaacttcttgccgagcgacaga

SEQ ID NO: 618147 - DNA, 25 bp, Rattus norvegicus
ctggccggcgaacatgctaagcccg

SEQ ID NO: 618148 - DNA, 25 bp, Rattus norvegicus
ggtgcccgttctcatccgagcaagg

SEQ ID NO: 618149 - DNA, 25 bp, Rattus norvegicus
agcgtaacgttgtgcgggaactgca

SEQ ID NO: 618150 - DNA, 25 bp, Rattus norvegicus
gacacgcgcacgtccttgccgaaag

SEQ ID NO: 618151 - DNA, 25 bp, Rattus norvegicus
gcgttggagactttacctctaagtg

SEQ ID NO: 618152 - DNA, 25 bp, Rattus norvegicus
cggatgcgctttcttgggatcggaa

SEQ ID NO: 618153 - DNA, 25 bp, Rattus norvegicus
ctcagactgccagcacgtcaggttg

SEQ ID NO: 618154 - DNA, 25 bp, Rattus norvegicus
ttgcaggctcacataggtcacctca

SEQ ID NO: 618155 - DNA, 25 bp, Rattus norvegicus
agccttaaagatctgggaactcctc

SEQ ID NO: 618156 - DNA, 25 bp, Rattus norvegicus
ggttgggaccccctgcttcactcta

SEQ ID NO: 618157 - DNA, 25 bp, Rattus norvegicus
tcctcaagaccagggcaaattgatc

SEQ ID NO: 618158 - DNA, 25 bp, Rattus norvegicus
cgaaaacgcaaagccttaaagatct

SEQ ID NO: 618159 - DNA, 25 bp, Rattus norvegicus
tacagcaaatgcagactagcctagg

SEQ ID NO: 618160 - DNA, 25 bp, Rattus norvegicus
ttgatcccctcataggaaggttggg

SEQ ID NO: 618161 - DNA, 25 bp, Rattus norvegicus
caaaggcagaagctttcgcgggcgc

SEQ ID NO: 618162 - DNA, 25 bp, Rattus norvegicus
tgagcttccaggatggggaccttca

SEQ ID NO: 618163 - DNA, 25 bp, Rattus norvegicus
cgacgttggaggagcgttcctgcag

SEQ ID NO: 618164 - DNA, 25 bp, Rattus norvegicus
gcctccaggccctcctcctttgcgg

SEQ ID NO: 618165 - DNA, 25 bp, Rattus norvegicus
agcggcaaaggcagaagctttcgcg

SEQ ID NO: 618166 - DNA, 25 bp, Rattus norvegicus
tgggaactcctcaagaccagggcaa

SEQ ID NO: 618167 - DNA, 25 bp, Rattus norvegicus
cttctctgagcttccaggatgggga

SEQ ID NO: 618168 - DNA, 25 bp, Rattus norvegicus
tgcagactagcctaggctagctccc

SEQ ID NO: 618169 - DNA, 25 bp, Rattus norvegicus
tccacgatgcggttccacctgttcg

SEQ ID NO: 618170 - DNA, 25 bp, Rattus norvegicus
agcaacgcctcactggcagctacga

SEQ ID NO: 618171 - DNA, 25 bp, Rattus norvegicus
agagctgatagacgtgcgcctggac

SEQ ID NO: 618172 - DNA, 25 bp, Rattus norvegicus
caagccgagcagtttgtgccagcca

SEQ ID NO: 618173 - DNA, 25 bp, Rattus norvegicus
ttgtgccagccaacctcgagatgcg

SEQ ID NO: 618174 - DNA, 25 bp, Rattus norvegicus
cggcagccattcgtctagcgccaga

SEQ ID NO: 618175 - DNA, 25 bp, Rattus norvegicus
acctcctccttgagtgcggcatggc

SEQ ID NO: 618176 - DNA, 25 bp, Rattus norvegicus
acgcaccagccagtccaggaaagta

SEQ ID NO: 618177 - DNA, 25 bp, Rattus norvegicus
caggaaagtatccaaatcgcgcagg

SEQ ID NO: 618178 - DNA, 25 bp, Rattus norvegicus
cgcgcaggaaacgttgcaggcgacc

SEQ ID NO: 618179 - DNA, 25 bp, Rattus norvegicus
tcggccacctccagtacatggttct

SEQ ID NO: 618180 - DNA, 25 bp, Rattus norvegicus
agcgcctggcacaggtctctcagga

SEQ ID NO: 618181 - DNA, 25 bp, Rattus norvegicus
gcgctgttctaccagctccacgatg

SEQ ID NO: 618182 - DNA, 25 bp, Rattus norvegicus
gctcatctcctctttgcgctgttct

SEQ ID NO: 618183 - DNA, 25 bp, Rattus norvegicus
ggtcacctccgcgaacaactgttct

SEQ ID NO: 618184 - DNA, 25 bp, Rattus norvegicus
cacaggctccgagaggcttccagct

SEQ ID NO: 618185 - DNA, 25 bp, Rattus norvegicus
cgaagccactgtcgtctcagcgcgg

SEQ ID NO: 618186 - DNA, 25 bp, Rattus norvegicus
ggctcctcccagtgttgccagctga

SEQ ID NO: 618187 - DNA, 25 bp, Rattus norvegicus
tggacgcttcgtcgtgaccgaaatc

SEQ ID NO: 618188 - DNA, 25 bp, Rattus norvegicus
tgaccgaaatctccggcggctgcca

SEQ ID NO: 618189 - DNA, 25 bp, Rattus norvegicus
gctgccagacgatacgcgtcgcgaa

SEQ ID NO: 618190 - DNA, 25 bp, Rattus norvegicus
tccgccagaccagccaagtgcaagg

SEQ ID NO: 618191 - DNA, 25 bp, Rattus norvegicus
gcccagttcgccctgcaagatcttg

SEQ ID NO: 618192 - DNA, 25 bp, Rattus norvegicus
tcgtggcctctaggaggcgctcctt

SEQ ID NO: 618193 - DNA, 25 bp, Rattus norvegicus
tgcaccacctcaacgtcgtcgaggg

SEQ ID NO: 618194 - DNA, 25 bp, Rattus norvegicus
gctccgacagacaaccgtgcacgtg

SEQ ID NO: 618195 - DNA, 25 bp, Rattus norvegicus
gcgccaaactggtgcaacgcccgtg

SEQ ID NO: 618196 - DNA, 25 bp, Rattus norvegicus
gcaggcatgcacctctccaaacatg

SEQ ID NO: 618197 - DNA, 25 bp, Rattus norvegicus
ccctggcaacgtcacacactctctc

SEQ ID NO: 618198 - DNA, 25 bp, Rattus norvegicus
cagggtcaaaccttcgaaccgtctg

SEQ ID NO: 618199 - DNA, 25 bp, Rattus norvegicus
tcaaaccttcgaaccgtctgtcaca

SEQ ID NO: 618200 - DNA, 25 bp, Rattus norvegicus
cgcaagcttccaccgggctaaacag

SEQ ID NO: 618201 - DNA, 25 bp, Rattus norvegicus
tcgtacggggtcagtcagggtcaaa

SEQ ID NO: 618202 - DNA, 25 bp, Rattus norvegicus
tcactccttcgtacggggtcagtca

SEQ ID NO: 618203 - DNA, 25 bp, Rattus norvegicus
acattcacactctcacggtgtcact

SEQ ID NO: 618204 - DNA, 25 bp, Rattus norvegicus
agcgctcgaggcagcgtcacacact

SEQ ID NO: 618205 - DNA, 25 bp, Rattus norvegicus
gtgtgatgcacagccgcgctcgcga

SEQ ID NO: 618206 - DNA, 25 bp, Rattus norvegicus
acgcgtgtgatgcacagccgcgctc

SEQ ID NO: 618207 - DNA, 25 bp, Rattus norvegicus
acacaccgggccacgcgtgtgatgc

SEQ ID NO: 618208 - DNA, 25 bp, Rattus norvegicus
cagcaccgccctccctgcgggcgtt

SEQ ID NO: 618209 - DNA, 25 bp, Rattus norvegicus
ggatcgcaagcttccaccgggctaa

SEQ ID NO: 618210 - DNA, 25 bp, Rattus norvegicus
tcacggtgtcactccttcgtacggg

SEQ ID NO: 618211 - DNA, 25 bp, Rattus norvegicus
aagtcatgagcaccgggcggagctc

SEQ ID NO: 618212 - DNA, 25 bp, Rattus norvegicus
ggaccctgcaacatggctgtcaaga

SEQ ID NO: 618213 - DNA, 25 bp, Rattus norvegicus
ttctggggccgggtgaagaccacac

SEQ ID NO: 618214 - DNA, 25 bp, Rattus norvegicus
gctcaccacactggcgcaggcggtg

SEQ ID NO: 618215 - DNA, 25 bp, Rattus norvegicus
gtgccaccggaaggaccgggctcac

SEQ ID NO: 618216 - DNA, 25 bp, Rattus norvegicus
tggttggctcggtcccgccctttga

SEQ ID NO: 618217 - DNA, 25 bp, Rattus norvegicus
catggctgtcaagaagatcgcgatc

SEQ ID NO: 618218 - DNA, 25 bp, Rattus norvegicus
actcacgcttttcccagcaggaggc

SEQ ID NO: 618219 - DNA, 25 bp, Rattus norvegicus
ggccctggaccctgcaacatggctg

SEQ ID NO: 618220 - DNA, 25 bp, Rattus norvegicus
ttctcagcttttcgggccctggacc

SEQ ID NO: 618221 - DNA, 25 bp, Rattus norvegicus
tcggagttctcagcttttcgggccc

SEQ ID NO: 618222 - DNA, 25 bp, Rattus norvegicus
cgcgtcctcggagttctcagctttt

SEQ ID NO: 618223 - DNA, 25 bp, Rattus norvegicus
accttgcagctactgggttcccgcg

SEQ ID NO: 618224 - DNA, 25 bp, Rattus norvegicus
aagatcgcgatcttcggtgccaccg

SEQ ID NO: 618225 - DNA, 25 bp, Rattus norvegicus
gccgcctgtgtgagattttcctgga

SEQ ID NO: 618226 - DNA, 25 bp, Rattus norvegicus
caatcgtggcttgcgactggactcc

SEQ ID NO: 618227 - DNA, 25 bp, Rattus norvegicus
cagcactggtgggactcaacgctgc

SEQ ID NO: 618228 - DNA, 25 bp, Rattus norvegicus
cccagtgatggtcggggcctagcat

SEQ ID NO: 618229 - DNA, 25 bp, Rattus norvegicus
tagtcgtggcgaccctggcagccga

SEQ ID NO: 618230 - DNA, 25 bp, Rattus norvegicus
ctgcaggtttgtcgaaggtagtcgt

SEQ ID NO: 618231 - DNA, 25 bp, Rattus norvegicus
caacgctgcaggtttgtcgaaggta

SEQ ID NO: 618232 - DNA, 25 bp, Rattus norvegicus
tgggactcaacgctgcaggtttgtc

SEQ ID NO: 618233 - DNA, 25 bp, Rattus norvegicus
aaagtgagccggactcctacccagc

SEQ ID NO: 618234 - DNA, 25 bp, Rattus norvegicus
aggattccaaccaatcgtggcttgc

SEQ ID NO: 618235 - DNA, 25 bp, Rattus norvegicus
cgcggcgggcaggattccaaccaat

SEQ ID NO: 618236 - DNA, 25 bp, Rattus norvegicus
tccgtggctcctcttagccaatggt

SEQ ID NO: 618237 - DNA, 25 bp, Rattus norvegicus
tcctacccagcactggtgggactca

SEQ ID NO: 618238 - DNA, 25 bp, Rattus norvegicus
ggcctagcatccgtggctcctctta

SEQ ID NO: 618239 - DNA, 25 bp, Rattus norvegicus
gtggctccctcttcgttctgattgg

SEQ ID NO: 618240 - DNA, 25 bp, Rattus norvegicus
accaccaacgagagcggatcccgga

SEQ ID NO: 618241 - DNA, 25 bp, Rattus norvegicus
cttcagcgaaaagggcaaagactcg

SEQ ID NO: 618242 - DNA, 25 bp, Rattus norvegicus
cggcttgctatacccgggagagaca

SEQ ID NO: 618243 - DNA, 25 bp, Rattus norvegicus
gttcgccagagctgttcgagatcga

SEQ ID NO: 618244 - DNA, 25 bp, Rattus norvegicus
ctcagttaggtagatgttcgccaga

SEQ ID NO: 618245 - DNA, 25 bp, Rattus norvegicus
tagcgtgttcgatacctcagttagg

SEQ ID NO: 618246 - DNA, 25 bp, Rattus norvegicus
tcgttctgattggtcgggagtgatc

SEQ ID NO: 618247 - DNA, 25 bp, Rattus norvegicus
agaatctaaaggatcccggggtcag

SEQ ID NO: 618248 - DNA, 25 bp, Rattus norvegicus
ctagcgatgctacggcagccgcttc

SEQ ID NO: 618249 - DNA, 25 bp, Rattus norvegicus
agtcgtgcgcccgaatcagaactgc

SEQ ID NO: 618250 - DNA, 25 bp, Rattus norvegicus
aactagggattgtcgagtgtctgga

SEQ ID NO: 618251 - DNA, 25 bp, Rattus norvegicus
ggcgaccgggatatttagcgtgttc

SEQ ID NO: 618252 - DNA, 25 bp, Rattus norvegicus
ctccactgccttccggaagcgaggg

SEQ ID NO: 618253 - DNA, 25 bp, Rattus norvegicus
aggaatctttgtccgcgagctgcga

SEQ ID NO: 618254 - DNA, 25 bp, Rattus norvegicus
cttcaatgtagcaggcggcggcaaa

SEQ ID NO: 618255 - DNA, 25 bp, Rattus norvegicus
cggaccctgaccctcccggagagca

SEQ ID NO: 618256 - DNA, 25 bp, Rattus norvegicus
acctagggaaggaacgccatggcga

SEQ ID NO: 618257 - DNA, 25 bp, Rattus norvegicus
ccgtcctggagttccatggccaccc

SEQ ID NO: 618258 - DNA, 25 bp, Rattus norvegicus
agattatcgtggagacagaggcgca

SEQ ID NO: 618259 - DNA, 25 bp, Rattus norvegicus
caagagcctcagtttgcaggaaggt

SEQ ID NO: 618260 - DNA, 25 bp, Rattus norvegicus
ggtcagcggcttcaatgtagcaggc

SEQ ID NO: 618261 - DNA, 25 bp, Rattus norvegicus
cggcggcaaagaaggaatctttgtc

SEQ ID NO: 618262 - DNA, 25 bp, Rattus norvegicus
tccgcgagctgcgagaggactcacc

SEQ ID NO: 618263 - DNA, 25 bp, Rattus norvegicus
cctcagtttgcaggaaggtaggcgt

SEQ ID NO: 618264 - DNA, 25 bp, Rattus norvegicus
gcggagttaagaatctgccttggcc

SEQ ID NO: 618265 - DNA, 25 bp, Rattus norvegicus
cggagttaggaatctgctttgggta

SEQ ID NO: 618266 - DNA, 25 bp, Rattus norvegicus
cgcagaccggggtcagcggcttcaa

SEQ ID NO: 618267 - DNA, 25 bp, Rattus norvegicus
agcgccgcaagtacatgctcaaatc

SEQ ID NO: 618268 - DNA, 25 bp, Rattus norvegicus
agtagccactaccagccatcgagtc

SEQ ID NO: 618269 - DNA, 25 bp, Rattus norvegicus
tgacatgctggctccactcaaagta

SEQ ID NO: 618270 - DNA, 25 bp, Rattus norvegicus
cgggccgacatggtctctgacatgc

SEQ ID NO: 618271 - DNA, 25 bp, Rattus norvegicus
accagctcgatgacctgagtctgca

SEQ ID NO: 618272 - DNA, 25 bp, Rattus norvegicus
ctcccggaatgcagagagccatcga

SEQ ID NO: 618273 - DNA, 25 bp, Rattus norvegicus
cctgtcatagccaacgcagaggacg

SEQ ID NO: 618274 - DNA, 25 bp, Rattus norvegicus
ccttcgtgtccatgcagcagctgcg

SEQ ID NO: 618275 - DNA, 25 bp, Rattus norvegicus
acatgggagtctcacgagcgcatca

SEQ ID NO: 618276 - DNA, 25 bp, Rattus norvegicus
gtggagctgatcaaacgcatgctga

SEQ ID NO: 618277 - DNA, 25 bp, Rattus norvegicus
ggaacacgcggacctcaagagcatg

SEQ ID NO: 618278 - DNA, 25 bp, Rattus norvegicus
ttgagttttccagaccgggaggcac

SEQ ID NO: 618279 - DNA, 25 bp, Rattus norvegicus
ggcgctgtgaatcggttgagttttc

SEQ ID NO: 618280 - DNA, 25 bp, Rattus norvegicus
ggagcctatcctggccttctacggc

SEQ ID NO: 618281 - DNA, 25 bp, Rattus norvegicus
gcgatggccaccgagatgcccagca

SEQ ID NO: 618282 - DNA, 25 bp, Rattus norvegicus
agtcctgtgcgctggactctccatc

SEQ ID NO: 618283 - DNA, 25 bp, Rattus norvegicus
ggctgcgctggctctcagaagtaaa

SEQ ID NO: 618284 - DNA, 25 bp, Rattus norvegicus
cccatctggcagtgagggcgtagca

SEQ ID NO: 618285 - DNA, 25 bp, Rattus norvegicus
ttcttgagcaccagcacgccgatga

SEQ ID NO: 618286 - DNA, 25 bp, Rattus norvegicus
gcaggcagcgcttgaagactacgta

SEQ ID NO: 618287 - DNA, 25 bp, Rattus norvegicus
agcccgcgtgatccgaggaagttcc

SEQ ID NO: 618288 - DNA, 25 bp, Rattus norvegicus
gaagactacgtacatgggcaggctg

SEQ ID NO: 618289 - DNA, 25 bp, Rattus norvegicus
ttttgggagcccaaggaaccactca

SEQ ID NO: 618290 - DNA, 25 bp, Rattus norvegicus
tggagctggtcaggcactgcaccag

SEQ ID NO: 618291 - DNA, 25 bp, Rattus norvegicus
tgcaccagggtcaggaaggagaact

SEQ ID NO: 618292 - DNA, 25 bp, Rattus norvegicus
ctggtagcgactgatgaggaacttg

SEQ ID NO: 618293 - DNA, 25 bp, Rattus norvegicus
cttccttccggctcaatgcggggct

SEQ ID NO: 618294 - DNA, 25 bp, Rattus norvegicus
tccctcctgaggaaggggctgaaca

SEQ ID NO: 618295 - DNA, 25 bp, Rattus norvegicus
tgggtccagctcttttccgactttc

SEQ ID NO: 618296 - DNA, 25 bp, Rattus norvegicus
gcggcgatttattctgggagtgaca

SEQ ID NO: 618297 - DNA, 25 bp, Rattus norvegicus
tgcccgtgacacttacctgaggtgg

SEQ ID NO: 618298 - DNA, 25 bp, Rattus norvegicus
agcgctcggcgaatggcattttctg

SEQ ID NO: 618299 - DNA, 25 bp, Rattus norvegicus
ttccgccaggtggtgttacgcctgc

SEQ ID NO: 618300 - DNA, 25 bp, Rattus norvegicus
gcactaggtagatcctgctggattg

SEQ ID NO: 618301 - DNA, 25 bp, Rattus norvegicus
ggagcagactccactgcccgtgaca

SEQ ID NO: 618302 - DNA, 25 bp, Rattus norvegicus
tcagagatatctagcgcggagcaga

SEQ ID NO: 618303 - DNA, 25 bp, Rattus norvegicus
acaagcagtgcgtgctgaagctgcc

SEQ ID NO: 618304 - DNA, 25 bp, Rattus norvegicus
ttgctgctgccagagcgcaccaagt

SEQ ID NO: 618305 - DNA, 25 bp, Rattus norvegicus
taagcactgaatcaggcgcccgggc

SEQ ID NO: 618306 - DNA, 25 bp, Rattus norvegicus
gctgaccattctgaaacgccaaatt

SEQ ID NO: 618307 - DNA, 25 bp, Rattus norvegicus
ccggggtatgaatgcgcccattatc

SEQ ID NO: 618308 - DNA, 25 bp, Rattus norvegicus
ggaggagcgccctcttttaagactc

SEQ ID NO: 618309 - DNA, 25 bp, Rattus norvegicus
gtgtgcacgtcgtcggctgactccc

SEQ ID NO: 618310 - DNA, 25 bp, Rattus norvegicus
cagtgtgcacgtcgtcggctgactc

SEQ ID NO: 618311 - DNA, 25 bp, Rattus norvegicus
ccactgcagcgaggcgtctgcgcag

SEQ ID NO: 618312 - DNA, 25 bp, Rattus norvegicus
cgacaccggtcttactccgacgttg

SEQ ID NO: 618313 - DNA, 25 bp, Rattus norvegicus
gcgtctgcgcagtgtgcacgtcgtc

SEQ ID NO: 618314 - DNA, 25 bp, Rattus norvegicus
acggatcacgcccactgcagcgagg

SEQ ID NO: 618315 - DNA, 25 bp, Rattus norvegicus
aggggcgggacctccacggatcacg

SEQ ID NO: 618316 - DNA, 25 bp, Rattus norvegicus
cttctgcctgagcagctgagtaggg

SEQ ID NO: 618317 - DNA, 25 bp, Rattus norvegicus
tgctacttcggtggggccccagctt

SEQ ID NO: 618318 - DNA, 25 bp, Rattus norvegicus
ccgacgttggctgctacttcggtgg

SEQ ID NO: 618319 - DNA, 25 bp, Rattus norvegicus
ttactccgacgttggctgctacttc

SEQ ID NO: 618320 - DNA, 25 bp, Rattus norvegicus
ggtcttactccgacgttggctgcta

SEQ ID NO: 618321 - DNA, 25 bp, Rattus norvegicus
cagcttctgcctgagcagctgagta

SEQ ID NO: 618322 - DNA, 25 bp, Rattus norvegicus
accggtcttactccgacgttggctg

SEQ ID NO: 618323 - DNA, 25 bp, Rattus norvegicus
ggcaaaggctagacctgatcgtttc

SEQ ID NO: 618324 - DNA, 25 bp, Rattus norvegicus
agctgaccgtagtacccgcggaatg

SEQ ID NO: 618325 - DNA, 25 bp, Rattus norvegicus
agcgatttctttttctgagcctcag

SEQ ID NO: 618326 - DNA, 25 bp, Rattus norvegicus
gcagcccatatttacgatcagatca

SEQ ID NO: 618327 - DNA, 25 bp, Rattus norvegicus
ttccggtatcaagggcagaacttcc

SEQ ID NO: 618328 - DNA, 25 bp, Rattus norvegicus
gcgcattcgcgttagactgcgggca

SEQ ID NO: 618329 - DNA, 25 bp, Rattus norvegicus
tgatcgtttctgattggcggcgttc

SEQ ID NO: 618330 - DNA, 25 bp, Rattus norvegicus
ggacgtcagctcgtgcacacgcctg

SEQ ID NO: 618331 - DNA, 25 bp, Rattus norvegicus
gtctagagttccagtgcagcccata

SEQ ID NO: 618332 - DNA, 25 bp, Rattus norvegicus
tgcgtgttgtcacgtgacggccatc

SEQ ID NO: 618333 - DNA, 25 bp, Rattus norvegicus
tactcttccatccacgttacactga

SEQ ID NO: 618334 - DNA, 25 bp, Rattus norvegicus
tacactgatgatggatacccgcgcg

SEQ ID NO: 618335 - DNA, 25 bp, Rattus norvegicus
gaggttcagtctggcttccggtatc

SEQ ID NO: 618336 - DNA, 25 bp, Rattus norvegicus
tgctctcagcgcttcccatattact

SEQ ID NO: 618337 - DNA, 25 bp, Rattus norvegicus
ggtgccgcggtccataccactgcgg

SEQ ID NO: 618338 - DNA, 25 bp, Rattus norvegicus
ccgccggtgacaggtgagtacgcca

SEQ ID NO: 618339 - DNA, 25 bp, Rattus norvegicus
ggagctcactctgagtttgcgggca

SEQ ID NO: 618340 - DNA, 25 bp, Rattus norvegicus
tcgcctaaggtacgcaggcgcgctg

SEQ ID NO: 618341 - DNA, 25 bp, Rattus norvegicus
gctgctgtgagcctgcctccttctt

SEQ ID NO: 618342 - DNA, 25 bp, Rattus norvegicus
tccttcttgtccctgcgcttgcggt

SEQ ID NO: 618343 - DNA, 25 bp, Rattus norvegicus
tgcggtctgatgttttctgaggcca

SEQ ID NO: 618344 - DNA, 25 bp, Rattus norvegicus
tctgaggccattcccttggtctacc

SEQ ID NO: 618345 - DNA, 25 bp, Rattus norvegicus
cttggtctaccaacgtcagttcctg

SEQ ID NO: 618346 - DNA, 25 bp, Rattus norvegicus
acgtcagttcctgtttgtggctgga

SEQ ID NO: 618347 - DNA, 25 bp, Rattus norvegicus
ttgtggctggaaaaggcggtatttc

SEQ ID NO: 618348 - DNA, 25 bp, Rattus norvegicus
cctgactctgagaaggcgtcgctgc

SEQ ID NO: 618349 - DNA, 25 bp, Rattus norvegicus
aataaggagcgggaacgagctcagc

SEQ ID NO: 618350 - DNA, 25 bp, Rattus norvegicus
tgctgccgccagttaataaataagg

SEQ ID NO: 618351 - DNA, 25 bp, Rattus norvegicus
gactccctcactggtacgaggccgt

SEQ ID NO: 618352 - DNA, 25 bp, Rattus norvegicus
ggcggccgcaggagtttcccacaat

SEQ ID NO: 618353 - DNA, 25 bp, Rattus norvegicus
cccggtgctgatgctcagcgctgcc

SEQ ID NO: 618354 - DNA, 25 bp, Rattus norvegicus
tcgccatggctctgctcgctcgggt

SEQ ID NO: 618355 - DNA, 25 bp, Rattus norvegicus
tcgacagcagcctgcgggctgccgt

SEQ ID NO: 618356 - DNA, 25 bp, Rattus norvegicus
agggtcagcgttgttaccgagagaa

SEQ ID NO: 618357 - DNA, 25 bp, Rattus norvegicus
gcgttgttaccgagagaagaagttc

SEQ ID NO: 618358 - DNA, 25 bp, Rattus norvegicus
ccgagagaagaagttccgagaagcc

SEQ ID NO: 618359 - DNA, 25 bp, Rattus norvegicus
ttccgagaagccattggcaagtacc

SEQ ID NO: 618360 - DNA, 25 bp, Rattus norvegicus
cattggcaagtaccaccgggcactg

SEQ ID NO: 618361 - DNA, 25 bp, Rattus norvegicus
agtaccaccgggcactgctgcagct

SEQ ID NO: 618362 - DNA, 25 bp, Rattus norvegicus
acacagaggttgaatgttacgactc

SEQ ID NO: 618363 - DNA, 25 bp, Rattus norvegicus
tgttacgactccctcactggtacga

SEQ ID NO: 618364 - DNA, 25 bp, Rattus norvegicus
ttgaatgttacgactccctcactgg

SEQ ID NO: 618365 - DNA, 25 bp, Rattus norvegicus
ggggtccttcttgaagctctccagc

SEQ ID NO: 618366 - DNA, 25 bp, Rattus norvegicus
tcatcactgtcagagcgcagcaatg

SEQ ID NO: 618367 - DNA, 25 bp, Rattus norvegicus
agctctggaggctcccgctgtctca

SEQ ID NO: 618368 - DNA, 25 bp, Rattus norvegicus
agagccagatcacagcgcctccgag

SEQ ID NO: 618369 - DNA, 25 bp, Rattus norvegicus
gatgctcggaagaagacacgggtca

SEQ ID NO: 618370 - DNA, 25 bp, Rattus norvegicus
ccgtgggaagaagagaccgtccagc

SEQ ID NO: 618371 - DNA, 25 bp, Rattus norvegicus
gagcgcgtagagttgcaatcagata

SEQ ID NO: 618372 - DNA, 25 bp, Rattus norvegicus
tctacgtccacaagaggattggtgc

SEQ ID NO: 618373 - DNA, 25 bp, Rattus norvegicus
atccgatggtgtccgtctgtgtcca

SEQ ID NO: 618374 - DNA, 25 bp, Rattus norvegicus
ctcccaaggcggctgagcacaagga

SEQ ID NO: 618375 - DNA, 25 bp, Rattus norvegicus
ctcaccgtggttggtgagctctgga

SEQ ID NO: 618376 - DNA, 25 bp, Rattus norvegicus
tcgcctgtgaaaggtggcttgtaca

SEQ ID NO: 618377 - DNA, 25 bp, Rattus norvegicus
agacacgggtcagtcgcctgtgaaa

SEQ ID NO: 618378 - DNA, 25 bp, Rattus norvegicus
caggccaaagcctggggctgtctct

SEQ ID NO: 618379 - DNA, 25 bp, Rattus norvegicus
tgcagatctggcgataggttcacct

SEQ ID NO: 618380 - DNA, 25 bp, Rattus norvegicus
gctgtcactgctgggtcccgttcag

SEQ ID NO: 618381 - DNA, 25 bp, Rattus norvegicus
gcttcacgcaggctgcccgcggaat

SEQ ID NO: 618382 - DNA, 25 bp, Rattus norvegicus
ggcctccactggagcgaaggaatta

SEQ ID NO: 618383 - DNA, 25 bp, Rattus norvegicus
cccgcggaatgctgagcacgaagcc

SEQ ID NO: 618384 - DNA, 25 bp, Rattus norvegicus
cctcgtagtcgaacacggcggtcca

SEQ ID NO: 618385 - DNA, 25 bp, Rattus norvegicus
aaagcacctggacgcgatcgcctct

SEQ ID NO: 618386 - DNA, 25 bp, Rattus norvegicus
ccgcacagtcctgggaaagcacctg

SEQ ID NO: 618387 - DNA, 25 bp, Rattus norvegicus
atctcctgtggcagctggaggtctg

SEQ ID NO: 618388 - DNA, 25 bp, Rattus norvegicus
ccataaggcgcggtagaccttgcca

SEQ ID NO: 618389 - DNA, 25 bp, Rattus norvegicus
cccaaagatgtcagggcgcaaggag

SEQ ID NO: 618390 - DNA, 25 bp, Rattus norvegicus
tccgaatccaaccacgaacagcaag

SEQ ID NO: 618391 - DNA, 25 bp, Rattus norvegicus
tgcagctcgtgaaaggggatctcct

SEQ ID NO: 618392 - DNA, 25 bp, Rattus norvegicus
ccgttccctcggatctggctatgca

SEQ ID NO: 618393 - DNA, 25 bp, Rattus norvegicus
caccgatctcagttaattcaagaat

SEQ ID NO: 618394 - DNA, 25 bp, Rattus norvegicus
gaacaccgatctcagttaattcaag

SEQ ID NO: 618395 - DNA, 25 bp, Rattus norvegicus
gcccaagactgatcaatctgtacta

SEQ ID NO: 618396 - DNA, 25 bp, Rattus norvegicus
agtttattgaatgcatgctcccacc

SEQ ID NO: 618397 - DNA, 25 bp, Rattus norvegicus
ccggatctgagtatggcggccatcc

SEQ ID NO: 618398 - DNA, 25 bp, Rattus norvegicus
cacctgcccaagactgatcaatctg

SEQ ID NO: 618399 - DNA, 25 bp, Rattus norvegicus
tattgaatgcatgctcccacctgcc

SEQ ID NO: 618400 - DNA, 25 bp, Rattus norvegicus
tctgctggggttcaggaattgccac

SEQ ID NO: 618401 - DNA, 25 bp, Rattus norvegicus
cctgcccaagactgatcaatctgta

SEQ ID NO: 618402 - DNA, 25 bp, Rattus norvegicus
ggatctgagtatggcggccatccgc

SEQ ID NO: 618403 - DNA, 25 bp, Rattus norvegicus
ctgctggggttcaggaattgccaca

SEQ ID NO: 618404 - DNA, 25 bp, Rattus norvegicus
ccgcagggagaggagtcgccgccat

SEQ ID NO: 618405 - DNA, 25 bp, Rattus norvegicus
gactgatcaatctgtactacaaaaa

SEQ ID NO: 618406 - DNA, 25 bp, Rattus norvegicus
tgccacacaaatcatatgaacaccg

SEQ ID NO: 618407 - DNA, 25 bp, Rattus norvegicus
tgtgaatgctgcgtgcttaggggcc

SEQ ID NO: 618408 - DNA, 25 bp, Rattus norvegicus
cgcgggtctgtgtgtagacgcacct

SEQ ID NO: 618409 - DNA, 25 bp, Rattus norvegicus
ctccgcggagtaaggccgggagtca

SEQ ID NO: 618410 - DNA, 25 bp, Rattus norvegicus
gtcttcggtctccgcggagtaaggc

SEQ ID NO: 618411 - DNA, 25 bp, Rattus norvegicus
aattgttctgtgtcttcggtctccg

SEQ ID NO: 618412 - DNA, 25 bp, Rattus norvegicus
aaaattgttctgtgtcttcggtctc

SEQ ID NO: 618413 - DNA, 25 bp, Rattus norvegicus
ttcaggtgggagtagaaaattgttc

SEQ ID NO: 618414 - DNA, 25 bp, Rattus norvegicus
cgatcagatctttcaggtgggagta

SEQ ID NO: 618415 - DNA, 25 bp, Rattus norvegicus
cgcggacgatcagatctttcaggtg

SEQ ID NO: 618416 - DNA, 25 bp, Rattus norvegicus
cgcaatcgcggacgatcagatcttt

SEQ ID NO: 618417 - DNA, 25 bp, Rattus norvegicus
ctctggcggcgcaatcgcggacgat

SEQ ID NO: 618418 - DNA, 25 bp, Rattus norvegicus
aacaacttccggtgctctggcggcg

SEQ ID NO: 618419 - DNA, 25 bp, Rattus norvegicus
agtaaaacaacttccggtgctctgg

SEQ ID NO: 618420 - DNA, 25 bp, Rattus norvegicus
ggtctgtgtgtagacgcaccttgcg

SEQ ID NO: 618421 - DNA, 25 bp, Rattus norvegicus
taggtcagactgtgcaaacatttga

SEQ ID NO: 618422 - DNA, 25 bp, Rattus norvegicus
gtagctcagttgtaaaacacttctc

SEQ ID NO: 618423 - DNA, 25 bp, Rattus norvegicus
aggctctatacatccctaagattac

SEQ ID NO: 618424 - DNA, 25 bp, Rattus norvegicus
caactggacacattctatttcccta

SEQ ID NO: 618425 - DNA, 25 bp, Rattus norvegicus
tctcctgcatgtccaaggctctata

SEQ ID NO: 618426 - DNA, 25 bp, Rattus norvegicus
tctctgtggctcaggatgtagctca

SEQ ID NO: 618427 - DNA, 25 bp, Rattus norvegicus
actagggcccgcgagagcggtctct

SEQ ID NO: 618428 - DNA, 25 bp, Rattus norvegicus
gtgtgaaagaaggagactaggactc

SEQ ID NO: 618429 - DNA, 25 bp, Rattus norvegicus
tctgtaagaatgaagtgcaagtgtg

SEQ ID NO: 618430 - DNA, 25 bp, Rattus norvegicus
gtctttctcatgaagtgaatctgta

SEQ ID NO: 618431 - DNA, 25 bp, Rattus norvegicus
aggctgtgactttgtctttctcatg

SEQ ID NO: 618432 - DNA, 25 bp, Rattus norvegicus
cttagtggaagtttcaggctgtgac

SEQ ID NO: 618433 - DNA, 25 bp, Rattus norvegicus
tccctatactttctcttagtggaag

SEQ ID NO: 618434 - DNA, 25 bp, Rattus norvegicus
caccttctgttactataggtcagac

SEQ ID NO: 618435 - DNA, 25 bp, Rattus norvegicus
gggaaatacagtcctcgcggcggaa

SEQ ID NO: 618436 - DNA, 25 bp, Rattus norvegicus
gatccgttacttccggcgcggtgaa

SEQ ID NO: 618437 - DNA, 25 bp, Rattus norvegicus
agagcgatttcctccacctacgaaa

SEQ ID NO: 618438 - DNA, 25 bp, Rattus norvegicus
ccatactctgaggttcagggagatc

SEQ ID NO: 618439 - DNA, 25 bp, Rattus norvegicus
taggtttgcacgacaccggaattcg

SEQ ID NO: 618440 - DNA, 25 bp, Rattus norvegicus
cgcggtgaaccctgggaaatacagt

SEQ ID NO: 618441 - DNA, 25 bp, Rattus norvegicus
gaactccggaaagtaccatactctg

SEQ ID NO: 618442 - DNA, 25 bp, Rattus norvegicus
cagggagatccggttatactacttg

SEQ ID NO: 618443 - DNA, 25 bp, Rattus norvegicus
ctacttggaccaacccacctggttg

SEQ ID NO: 618444 - DNA, 25 bp, Rattus norvegicus
ccttaaaagctcctggcggtgctca

SEQ ID NO: 618445 - DNA, 25 bp, Rattus norvegicus
cggtgctcagaaggtacttccggtt

SEQ ID NO: 618446 - DNA, 25 bp, Rattus norvegicus
ttccggttctgcacgccactgattt

SEQ ID NO: 618447 - DNA, 25 bp, Rattus norvegicus
tgcgccggatagtttcagggatttt

SEQ ID NO: 618448 - DNA, 25 bp, Rattus norvegicus
atcggactttggactgtaggtttgc

SEQ ID NO: 618449 - DNA, 25 bp, Rattus norvegicus
gaaaagccgctctgggccaatgaca

SEQ ID NO: 618450 - DNA, 25 bp, Rattus norvegicus
tgaccggaccaggaagccacgctgt

SEQ ID NO: 618451 - DNA, 25 bp, Rattus norvegicus
agcacgtgaccggaccaggaagcca

SEQ ID NO: 618452 - DNA, 25 bp, Rattus norvegicus
cggcagcgagcacgtgaccggacca

SEQ ID NO: 618453 - DNA, 25 bp, Rattus norvegicus
aggacgctgccatcttggccggccg

SEQ ID NO: 618454 - DNA, 25 bp, Rattus norvegicus
acgcaggacgctgccatcttggccg

SEQ ID NO: 618455 - DNA, 25 bp, Rattus norvegicus
ggcctgccgcccacgcttccacaga

SEQ ID NO: 618456 - DNA, 25 bp, Rattus norvegicus
agcaccacaacgaccacatgtcgtg

SEQ ID NO: 618457 - DNA, 25 bp, Rattus norvegicus
tgggccaatgacagcgcgtggtact

SEQ ID NO: 618458 - DNA, 25 bp, Rattus norvegicus
accgaaaagccgctctgggccaatg

SEQ ID NO: 618459 - DNA, 25 bp, Rattus norvegicus
gcccacgcttccacagacccaccag

SEQ ID NO: 618460 - DNA, 25 bp, Rattus norvegicus
accaggaagccacgctgtgcgcagg

SEQ ID NO: 618461 - DNA, 25 bp, Rattus norvegicus
gcccacgtcgcccagcaccacaacg

SEQ ID NO: 618462 - DNA, 25 bp, Rattus norvegicus
accacatgtcgtgccctgccggcct

SEQ ID NO: 618463 - DNA, 25 bp, Rattus norvegicus
cacccgggcgcggaaacaatctcga

SEQ ID NO: 618464 - DNA, 25 bp, Rattus norvegicus
tggcgagcggcaacacgcgctcagc

SEQ ID NO: 618465 - DNA, 25 bp, Rattus norvegicus
acgcgctcagcagcgtgtcctatgc

SEQ ID NO: 618466 - DNA, 25 bp, Rattus norvegicus
gctcacccgcgatgccgtaatgctg

SEQ ID NO: 618467 - DNA, 25 bp, Rattus norvegicus
acccgcgatgccgtaatgctgcgca

SEQ ID NO: 618468 - DNA, 25 bp, Rattus norvegicus
tgccgtaatgctgcgcagcggcaca

SEQ ID NO: 618469 - DNA, 25 bp, Rattus norvegicus
taatgctgcgcagcggcacaggcca

SEQ ID NO: 618470 - DNA, 25 bp, Rattus norvegicus
ccggcaggtacggagagaactcgac

SEQ ID NO: 618471 - DNA, 25 bp, Rattus norvegicus
accgcatagccgtggcgacccggca

SEQ ID NO: 618472 - DNA, 25 bp, Rattus norvegicus
cacggccgaggttccctgagagaac

SEQ ID NO: 618473 - DNA, 25 bp, Rattus norvegicus
tctcgaggaagaagtgcacggccga

SEQ ID NO: 618474 - DNA, 25 bp, Rattus norvegicus
ggcgcggaaacaatctcgaggaaga

SEQ ID NO: 618475 - DNA, 25 bp, Rattus norvegicus
ccctgagagaacttagggaaggccg

SEQ ID NO: 618476 - DNA, 25 bp, Rattus norvegicus
tacggagagaactcgaccgcatagc

SEQ ID NO: 618477 - DNA, 25 bp, Rattus norvegicus
ttctggcgccatctttcttcgcggc

SEQ ID NO: 618478 - DNA, 25 bp, Rattus norvegicus
gttgaccggacaggccggattgcaa

SEQ ID NO: 618479 - DNA, 25 bp, Rattus norvegicus
cacatagagcatcttgggaaatgta

SEQ ID NO: 618480 - DNA, 25 bp, Rattus norvegicus
cggaagtccttcacatagagcatct

SEQ ID NO: 618481 - DNA, 25 bp, Rattus norvegicus
cgctgacgccaacggaagtccttca

SEQ ID NO: 618482 - DNA, 25 bp, Rattus norvegicus
acggcttccgctgacgccaacggaa

SEQ ID NO: 618483 - DNA, 25 bp, Rattus norvegicus
cccaagatgcgttcctgcactgtga

SEQ ID NO: 618484 - DNA, 25 bp, Rattus norvegicus
atgcgttcctgcactgtgagctccc

SEQ ID NO: 618485 - DNA, 25 bp, Rattus norvegicus
aaccggcgaggactttcctcgtgtg

SEQ ID NO: 618486 - DNA, 25 bp, Rattus norvegicus
ggactttcctcgtgtgctgcaactc

SEQ ID NO: 618487 - DNA, 25 bp, Rattus norvegicus
tcgtgtgctgcaactcgcattctgg

SEQ ID NO: 618488 - DNA, 25 bp, Rattus norvegicus
gcgggaaactcttggccctgggctc

SEQ ID NO: 618489 - DNA, 25 bp, Rattus norvegicus
aactcgcattctggcgccatctttc

SEQ ID NO: 618490 - DNA, 25 bp, Rattus norvegicus
cgcgttgcggaggtttctccagtag

SEQ ID NO: 618491 - DNA, 25 bp, Rattus norvegicus
ggaaacagtttcgtgcgcctgcgtg

SEQ ID NO: 618492 - DNA, 25 bp, Rattus norvegicus
caacaagaatcccaacgatgacctg

SEQ ID NO: 618493 - DNA, 25 bp, Rattus norvegicus
ttgtgccaccaacgaagtacttcga

SEQ ID NO: 618494 - DNA, 25 bp, Rattus norvegicus
tgccatagccttgtgccaccaacga

SEQ ID NO: 618495 - DNA, 25 bp, Rattus norvegicus
cctgagcaacaggaacccttccgtg

SEQ ID NO: 618496 - DNA, 25 bp, Rattus norvegicus
gagctccaggctgcgaccaatgcca

SEQ ID NO: 618497 - DNA, 25 bp, Rattus norvegicus
tcccaacgatgacctgaccgcagtg

SEQ ID NO: 618498 - DNA, 25 bp, Rattus norvegicus
tctgtggcctttgcgggaactacaa

SEQ ID NO: 618499 - DNA, 25 bp, Rattus norvegicus
tacgcaggctccctctgtggccttt

SEQ ID NO: 618500 - DNA, 25 bp, Rattus norvegicus
gtgtacctgccgcttacgcaggctc

SEQ ID NO: 618501 - DNA, 25 bp, Rattus norvegicus
tgcgcctgcgtgtacctgccgctta

SEQ ID NO: 618502 - DNA, 25 bp, Rattus norvegicus
ctttgcgggaactacaacaagaatc

SEQ ID NO: 618503 - DNA, 25 bp, Rattus norvegicus
cctgaccgcagtggacgggaaacct

SEQ ID NO: 618504 - DNA, 25 bp, Rattus norvegicus
ggctgcgaccaatgccagcctgagc

SEQ ID NO: 618505 - DNA, 25 bp, Rattus norvegicus
ggcgttgactccgacttccgggaga

SEQ ID NO: 618506 - DNA, 25 bp, Rattus norvegicus
tccacgtgtgaaagcctgagactcg

SEQ ID NO: 618507 - DNA, 25 bp, Rattus norvegicus
gtcgcgccaccagcacgcagtaatg

SEQ ID NO: 618508 - DNA, 25 bp, Rattus norvegicus
gcacgcagtaatgaagccaggtaaa

SEQ ID NO: 618509 - DNA, 25 bp, Rattus norvegicus
cttgccgcttcagacgggccggtac

SEQ ID NO: 618510 - DNA, 25 bp, Rattus norvegicus
ggccctgacccagagcttggacttg

SEQ ID NO: 618511 - DNA, 25 bp, Rattus norvegicus
gcttggacttggattcccgaccgtg

SEQ ID NO: 618512 - DNA, 25 bp, Rattus norvegicus
cgaccgtggttttgggcatccgact

SEQ ID NO: 618513 - DNA, 25 bp, Rattus norvegicus
catccgacttgggtcgcagatggaa

SEQ ID NO: 618514 - DNA, 25 bp, Rattus norvegicus
gtcactccgcattaccgatatcttg

SEQ ID NO: 618515 - DNA, 25 bp, Rattus norvegicus
ggtgcatgaggacctcccgctctgt

SEQ ID NO: 618516 - DNA, 25 bp, Rattus norvegicus
cgcaggcgcttttttccacgtgtga

SEQ ID NO: 618517 - DNA, 25 bp, Rattus norvegicus
agtgtgacgctcacaggcacggctg

SEQ ID NO: 618518 - DNA, 25 bp, Rattus norvegicus
cctcccgctctgtggagtgtgacgc

SEQ ID NO: 618519 - DNA, 25 bp, Rattus norvegicus
caggtctgagctcgggcttcccgag

SEQ ID NO: 618520 - DNA, 25 bp, Rattus norvegicus
tgctacgcacgtgcgcggctcagca

SEQ ID NO: 618521 - DNA, 25 bp, Rattus norvegicus
ggtcacatggtgcacgttccattgg

SEQ ID NO: 618522 - DNA, 25 bp, Rattus norvegicus
cacgccctcaggtaacggtactgcg

SEQ ID NO: 618523 - DNA, 25 bp, Rattus norvegicus
acgttccattggtggctgctacgca

SEQ ID NO: 618524 - DNA, 25 bp, Rattus norvegicus
cgggcttcccgagcagtttgaatcc

SEQ ID NO: 618525 - DNA, 25 bp, Rattus norvegicus
tcagcacccttaaggcgcaggcgca

SEQ ID NO: 618526 - DNA, 25 bp, Rattus norvegicus
aggcgcacagtgctccactaggtca

SEQ ID NO: 618527 - DNA, 25 bp, Rattus norvegicus
ccggtttgttgtggtcgccattttg

SEQ ID NO: 618528 - DNA, 25 bp, Rattus norvegicus
ggtcgccattttgctggttgcatta

SEQ ID NO: 618529 - DNA, 25 bp, Rattus norvegicus
ttgctggttgcattactgggtaatc

SEQ ID NO: 618530 - DNA, 25 bp, Rattus norvegicus
gcattactgggtaatcggggccctg

SEQ ID NO: 618531 - DNA, 25 bp, Rattus norvegicus
accctcagccagtgggcaggtctga

SEQ ID NO: 618532 - DNA, 25 bp, Rattus norvegicus
ctccactaggtcacgtgaggggtgt

SEQ ID NO: 618533 - DNA, 25 bp, Rattus norvegicus
acatgtcgcagctgcccgcagtcag

SEQ ID NO: 618534 - DNA, 25 bp, Rattus norvegicus
tgacccagcggtccgacatgtcgca

SEQ ID NO: 618535 - DNA, 25 bp, Rattus norvegicus
ggtgcaacggctcttccgacgacta

SEQ ID NO: 618536 - DNA, 25 bp, Rattus norvegicus
ttccgacgactaggtggcaatctca

SEQ ID NO: 618537 - DNA, 25 bp, Rattus norvegicus
cagttcctgcgccactacctggaga

SEQ ID NO: 618538 - DNA, 25 bp, Rattus norvegicus
ggcatcaattaccagcagttcctgc

SEQ ID NO: 618539 - DNA, 25 bp, Rattus norvegicus
gcagtcagcagcgtcccgcagacgg

SEQ ID NO: 618540 - DNA, 25 bp, Rattus norvegicus
caaagctcgccagcaagtgcccaga

SEQ ID NO: 618541 - DNA, 25 bp, Rattus norvegicus
tgcgcattgcgctcgtgtacgcgcc

SEQ ID NO: 618542 - DNA, 25 bp, Rattus norvegicus
cacgcgacgcttgccggtgcgcatt

SEQ ID NO: 618543 - DNA, 25 bp, Rattus norvegicus
tcctcggcttcgcagttggagctac

SEQ ID NO: 618544 - DNA, 25 bp, Rattus norvegicus
tgcccagagacacgcgtgcgcactg

SEQ ID NO: 618545 - DNA, 25 bp, Rattus norvegicus
actacctggagaactacccgatcgc

SEQ ID NO: 618546 - DNA, 25 bp, Rattus norvegicus
ccctcagcgtcttaggcatcaatta

SEQ ID NO: 618547 - DNA, 25 bp, Rattus norvegicus
acgagcagcggatgttcgaacacta

SEQ ID NO: 618548 - DNA, 25 bp, Rattus norvegicus
ggagccggttcctaagtgcatctga

SEQ ID NO: 618549 - DNA, 25 bp, Rattus norvegicus
cgcaatgtccgagctgcccggagaa

SEQ ID NO: 618550 - DNA, 25 bp, Rattus norvegicus
ctccgcgaaatcgaggagcgtcgcc

SEQ ID NO: 618551 - DNA, 25 bp, Rattus norvegicus
gcggtaatgatacgcggcacccgta

SEQ ID NO: 618552 - DNA, 25 bp, Rattus norvegicus
agcacttttgttttccagggcggcg

SEQ ID NO: 618553 - DNA, 25 bp, Rattus norvegicus
tctgaggactcaacggtccgcaatg

SEQ ID NO: 618554 - DNA, 25 bp, Rattus norvegicus
cggacctgtgccctatgaacggcgt

SEQ ID NO: 618555 - DNA, 25 bp, Rattus norvegicus
ctatgaacggcgtcggcaacgtcct

SEQ ID NO: 618556 - DNA, 25 bp, Rattus norvegicus
gaagccctggaaggcccgctggcca

SEQ ID NO: 618557 - DNA, 25 bp, Rattus norvegicus
gggcctgatggccataccgcacgtc

SEQ ID NO: 618558 - DNA, 25 bp, Rattus norvegicus
tccgccttctagagctgcacgagca

SEQ ID NO: 618559 - DNA, 25 bp, Rattus norvegicus
cggagaaagcaggatcccggacctg

SEQ ID NO: 618560 - DNA, 25 bp, Rattus norvegicus
ggcaccgtacttgcgcaagcacttt

SEQ ID NO: 618561 - DNA, 25 bp, Rattus norvegicus
cgtgggaaagctccgaccttgaatg

SEQ ID NO: 618562 - DNA, 25 bp, Rattus norvegicus
cgagcgtgagatcctttgagagaga

SEQ ID NO: 618563 - DNA, 25 bp, Rattus norvegicus
atcctttgagagagagccagcaccc

SEQ ID NO: 618564 - DNA, 25 bp, Rattus norvegicus
caaggccaagttccgtaagaatctc

SEQ ID NO: 618565 - DNA, 25 bp, Rattus norvegicus
ccgtaagaatctcactggagagatc

SEQ ID NO: 618566 - DNA, 25 bp, Rattus norvegicus
cactggagagatcgtgggaaagctc

SEQ ID NO: 618567 - DNA, 25 bp, Rattus norvegicus
gcgggcaaggccaagttccgtaaga

SEQ ID NO: 618568 - DNA, 25 bp, Rattus norvegicus
ccgaccttgaatggaggcccggact

SEQ ID NO: 618569 - DNA, 25 bp, Rattus norvegicus
ctgcttttgagcgagcgtgagatcc

SEQ ID NO: 618570 - DNA, 25 bp, Rattus norvegicus
cccggactggtgctggagtccgcac

SEQ ID NO: 618571 - DNA, 25 bp, Rattus norvegicus
tggatcgagggcttctgcttttgag

SEQ ID NO: 618572 - DNA, 25 bp, Rattus norvegicus
tggcctccgctaggctgtggatcga

SEQ ID NO: 618573 - DNA, 25 bp, Rattus norvegicus
ccctggatggcctccgctaggctgt

SEQ ID NO: 618574 - DNA, 25 bp, Rattus norvegicus
tgagcactggaaagggcccctggat

SEQ ID NO: 618575 - DNA, 25 bp, Rattus norvegicus
ctcttgagtttagcggattgagttc

SEQ ID NO: 618576 - DNA, 25 bp, Rattus norvegicus
ctcttcctagagcttcccaccgcca

SEQ ID NO: 618577 - DNA, 25 bp, Rattus norvegicus
cctagagcttcccaccgccaccgcc

SEQ ID NO: 618578 - DNA, 25 bp, Rattus norvegicus
gccaccgccactcttgagtttagcg

SEQ ID NO: 618579 - DNA, 25 bp, Rattus norvegicus
caccgccactcttgagtttagcgga

SEQ ID NO: 618580 - DNA, 25 bp, Rattus norvegicus
cgccactcttgagtttagcggattg

SEQ ID NO: 618581 - DNA, 25 bp, Rattus norvegicus
ccactcttgagtttagcggattgag

SEQ ID NO: 618582 - DNA, 25 bp, Rattus norvegicus
attgagttccttaagcgccctccta

SEQ ID NO: 618583 - DNA, 25 bp, Rattus norvegicus
tgagtttagcggattgagttcctta

SEQ ID NO: 618584 - DNA, 25 bp, Rattus norvegicus
tttagcggattgagttccttaagcg

SEQ ID NO: 618585 - DNA, 25 bp, Rattus norvegicus
tagcggattgagttccttaagcgcc

SEQ ID NO: 618586 - DNA, 25 bp, Rattus norvegicus
tgagttccttaagcgccctcctagc

SEQ ID NO: 618587 - DNA, 25 bp, Rattus norvegicus
cggattgagttccttaagcgccctc

SEQ ID NO: 618588 - DNA, 25 bp, Rattus norvegicus
gccactcttgagtttagcggattga

SEQ ID NO: 618589 - DNA, 25 bp, Rattus norvegicus
gcaaccgcaagcaggcactgttaca

SEQ ID NO: 618590 - DNA, 25 bp, Rattus norvegicus
cgcgccttgttattcatggggacca

SEQ ID NO: 618591 - DNA, 25 bp, Rattus norvegicus
gggttccgcgccttgttattcatgg

SEQ ID NO: 618592 - DNA, 25 bp, Rattus norvegicus
agggagccgactcttcctagagctt

SEQ ID NO: 618593 - DNA, 25 bp, Rattus norvegicus
tctcctcagatctcaccgaatagac

SEQ ID NO: 618594 - DNA, 25 bp, Rattus norvegicus
gggaggcactgctctcctcagatct

SEQ ID NO: 618595 - DNA, 25 bp, Rattus norvegicus
tattcatggggaccaggtgagaccc

SEQ ID NO: 618596 - DNA, 25 bp, Rattus norvegicus
ccacgctctgagctagggaggcact

SEQ ID NO: 618597 - DNA, 25 bp, Rattus norvegicus
tgttacaccggattccagtcaggca

SEQ ID NO: 618598 - DNA, 25 bp, Rattus norvegicus
ttctaaacccgaagcaaccgcaagc

SEQ ID NO: 618599 - DNA, 25 bp, Rattus norvegicus
gagaactttcgcacccagggttcta

SEQ ID NO: 618600 - DNA, 25 bp, Rattus norvegicus
tgggcggggagaactttcgcaccca

SEQ ID NO: 618601 - DNA, 25 bp, Rattus norvegicus
ttcgccctgcttccttgggcgggga

SEQ ID NO: 618602 - DNA, 25 bp, Rattus norvegicus
ggcagagattccacgctctgagcta

SEQ ID NO: 618603 - DNA, 25 bp, Rattus norvegicus
aagtgggcgtagcaacggcctccat

SEQ ID NO: 618604 - DNA, 25 bp, Rattus norvegicus
gtagcaacggcctccatgggcgcag

SEQ ID NO: 618605 - DNA, 25 bp, Rattus norvegicus
cgcagtcgtccaggtcgtgctcgca

SEQ ID NO: 618606 - DNA, 25 bp, Rattus norvegicus
tcccggaaagcaggcgagtcccagt

SEQ ID NO: 618607 - DNA, 25 bp, Rattus norvegicus
gcgagtcccagtatcccggccagga

SEQ ID NO: 618608 - DNA, 25 bp, Rattus norvegicus
agtatcccggccaggacctcggcgg

SEQ ID NO: 618609 - DNA, 25 bp, Rattus norvegicus
aagcgctgtgagtcagcctgcctca

SEQ ID NO: 618610 - DNA, 25 bp, Rattus norvegicus
gaactcgcatctcacacccatgtag

SEQ ID NO: 618611 - DNA, 25 bp, Rattus norvegicus
tgctcgcagcgtggcccggcgaatc

SEQ ID NO: 618612 - DNA, 25 bp, Rattus norvegicus
cagcgcagcgcatgtcccaggtcaa

SEQ ID NO: 618613 - DNA, 25 bp, Rattus norvegicus
gtcccaggtcaaggcagaggccgcc

SEQ ID NO: 618614 - DNA, 25 bp, Rattus norvegicus
tgcggggaaacggtgtcaacgccaa

SEQ ID NO: 618615 - DNA, 25 bp, Rattus norvegicus
ggtgtcaacgccaagcgatcacttg

SEQ ID NO: 618616 - DNA, 25 bp, Rattus norvegicus
gccaagcgatcacttgcaccttacg

SEQ ID NO: 618617 - DNA, 25 bp, Rattus norvegicus
cgacgctgttgagccccagaactgc

SEQ ID NO: 618618 - DNA, 25 bp, Rattus norvegicus
aaagatgccagtccgcaggggccac

SEQ ID NO: 618619 - DNA, 25 bp, Rattus norvegicus
ccaccctagcccgacgctgttgagc

SEQ ID NO: 618620 - DNA, 25 bp, Rattus norvegicus
agctcccgggcgctagcctcttgga

SEQ ID NO: 618621 - DNA, 25 bp, Rattus norvegicus
ccagaactgccggagacgccaggag

SEQ ID NO: 618622 - DNA, 25 bp, Rattus norvegicus
aactgccggagacgccaggagccag

SEQ ID NO: 618623 - DNA, 25 bp, Rattus norvegicus
gagccagggcgcgagtaactcccag

SEQ ID NO: 618624 - DNA, 25 bp, Rattus norvegicus
gggcgcgagtaactcccagcaagtg

SEQ ID NO: 618625 - DNA, 25 bp, Rattus norvegicus
gcgagtaactcccagcaagtgctgt

SEQ ID NO: 618626 - DNA, 25 bp, Rattus norvegicus
aactcccagcaagtgctgttacgga

SEQ ID NO: 618627 - DNA, 25 bp, Rattus norvegicus
ttacggaaagatgccagtccgcagg

SEQ ID NO: 618628 - DNA, 25 bp, Rattus norvegicus
cagcaagtgctgttacggaaagatg

SEQ ID NO: 618629 - DNA, 25 bp, Rattus norvegicus
tgctgttacggaaagatgccagtcc

SEQ ID NO: 618630 - DNA, 25 bp, Rattus norvegicus
tcccgggcgctagcctcttggagga

SEQ ID NO: 618631 - DNA, 25 bp, Rattus norvegicus
ggcagctcccgtcgcgtactagaat

SEQ ID NO: 618632 - DNA, 25 bp, Rattus norvegicus
gctgctaggaactgcgaccacaaga

SEQ ID NO: 618633 - DNA, 25 bp, Rattus norvegicus
tttactgctcgctgctaggaactgc

SEQ ID NO: 618634 - DNA, 25 bp, Rattus norvegicus
ggagatttactgctcgctgctagga

SEQ ID NO: 618635 - DNA, 25 bp, Rattus norvegicus
agaggatggaggagatttactgctc

SEQ ID NO: 618636 - DNA, 25 bp, Rattus norvegicus
cccagccggctgggacacctggaga

SEQ ID NO: 618637 - DNA, 25 bp, Rattus norvegicus
ccatagagcaggtggctagcgagga

SEQ ID NO: 618638 - DNA, 25 bp, Rattus norvegicus
acaagaaggcgctgcgtcggtaagc

SEQ ID NO: 618639 - DNA, 25 bp, Rattus norvegicus
gggacttgctgagagattgccgacc

SEQ ID NO: 618640 - DNA, 25 bp, Rattus norvegicus
acgctgtcgtggctgccatagagca

SEQ ID NO: 618641 - DNA, 25 bp, Rattus norvegicus
ttgctgagagattgccgaccgcagg

SEQ ID NO: 618642 - DNA, 25 bp, Rattus norvegicus
tgcgaccacaagaaggcgctgcgtc

SEQ ID NO: 618643 - DNA, 25 bp, Rattus norvegicus
cccgtcgcgtactagaatactattt

SEQ ID NO: 618644 - DNA, 25 bp, Rattus norvegicus
agaatactatttccacgctgtcgtg

SEQ ID NO: 618645 - DNA, 25 bp, Rattus norvegicus
tgtgcgctgcacatcgcgggcccac

SEQ ID NO: 618646 - DNA, 25 bp, Rattus norvegicus
gctaataggttccaggcgggcccta

SEQ ID NO: 618647 - DNA, 25 bp, Rattus norvegicus
ccacacgcgctaataggttccaggc

SEQ ID NO: 618648 - DNA, 25 bp, Rattus norvegicus
cggccacacgcgctaataggttcca

SEQ ID NO: 618649 - DNA, 25 bp, Rattus norvegicus
ctccagcagccaggcgtctgcgacc

SEQ ID NO: 618650 - DNA, 25 bp, Rattus norvegicus
agtgcaactcccatgcgcctgtgcg

SEQ ID NO: 618651 - DNA, 25 bp, Rattus norvegicus
gagaagtgcaactcccatgcgcctg

SEQ ID NO: 618652 - DNA, 25 bp, Rattus norvegicus
cgcggtatgagaagtgcaactccca

SEQ ID NO: 618653 - DNA, 25 bp, Rattus norvegicus
gcgcgcggtatgagaagtgcaactc

SEQ ID NO: 618654 - DNA, 25 bp, Rattus norvegicus
gcagtcctgggccacaccgcgaggg

SEQ ID NO: 618655 - DNA, 25 bp, Rattus norvegicus
acactcgtctgggaatggcgtgcag

SEQ ID NO: 618656 - DNA, 25 bp, Rattus norvegicus
ttcacactcgtctgggaatggcgtg

SEQ ID NO: 618657 - DNA, 25 bp, Rattus norvegicus
cggggcttcacactcgtctgggaat

SEQ ID NO: 618658 - DNA, 25 bp, Rattus norvegicus
tgcgaccggccacacgcgctaatag

SEQ ID NO: 618659 - DNA, 25 bp, Rattus norvegicus
tcggcaagcgacagcttgcggctcc

SEQ ID NO: 618660 - DNA, 25 bp, Rattus norvegicus
gccggcgctcggcaagcgacagctt

SEQ ID NO: 618661 - DNA, 25 bp, Rattus norvegicus
cctggctctccgtgcagcaacgagt

SEQ ID NO: 618662 - DNA, 25 bp, Rattus norvegicus
ctctccgtgcagcaacgagtgggcg

SEQ ID NO: 618663 - DNA, 25 bp, Rattus norvegicus
ccaccgcgcgtaaggtgttctccag

SEQ ID NO: 618664 - DNA, 25 bp, Rattus norvegicus
taaggtgttctccaggtagcgcagc

SEQ ID NO: 618665 - DNA, 25 bp, Rattus norvegicus
ccaagaggaggaagctctatccctt

SEQ ID NO: 618666 - DNA, 25 bp, Rattus norvegicus
ggaggaagctctatcccttcccgct

SEQ ID NO: 618667 - DNA, 25 bp, Rattus norvegicus
accgaagccggcgagggcatcactt

SEQ ID NO: 618668 - DNA, 25 bp, Rattus norvegicus
gagggcatcactttctccgtgccgc

SEQ ID NO: 618669 - DNA, 25 bp, Rattus norvegicus
cgcccattttgtccgcgggtttctg

SEQ ID NO: 618670 - DNA, 25 bp, Rattus norvegicus
gagcctgcagcccttgcttatgccg

SEQ ID NO: 618671 - DNA, 25 bp, Rattus norvegicus
caccgccgggcagtttctggaacgt

SEQ ID NO: 618672 - DNA, 25 bp, Rattus norvegicus
ctccaggtagcgcagcacccagagg

SEQ ID NO: 618673 - DNA, 25 bp, Rattus norvegicus
cccggtttcaggcagaccctgaaga

SEQ ID NO: 618674 - DNA, 25 bp, Rattus norvegicus
gcatcgcggaaaggcacacgcacga

SEQ ID NO: 618675 - DNA, 25 bp, Rattus norvegicus
gaaaggcacacgcacgaggccatca

SEQ ID NO: 618676 - DNA, 25 bp, Rattus norvegicus
gaggccatcaggcaacgacaaggca

SEQ ID NO: 618677 - DNA, 25 bp, Rattus norvegicus
tcaggcaacgacaaggcagccgctg

SEQ ID NO: 618678 - DNA, 25 bp, Rattus norvegicus
acaaggcagccgctggcactccagg

SEQ ID NO: 618679 - DNA, 25 bp, Rattus norvegicus
caggctgctccgtgtagaccgggcc

SEQ ID NO: 618680 - DNA, 25 bp, Rattus norvegicus
gctccgtgtagaccgggccgctcgt

SEQ ID NO: 618681 - DNA, 25 bp, Rattus norvegicus
gactcggcggcctcctgggagactc

SEQ ID NO: 618682 - DNA, 25 bp, Rattus norvegicus
gcctcctgggagactcccggtttca

SEQ ID NO: 618683 - DNA, 25 bp, Rattus norvegicus
actcccggtttcaggcagaccctga

SEQ ID NO: 618684 - DNA, 25 bp, Rattus norvegicus
ccaggcatcgcggaaaggcacacgc

SEQ ID NO: 618685 - DNA, 25 bp, Rattus norvegicus
cagaccctgaagaagaggcggcaag

SEQ ID NO: 618686 - DNA, 25 bp, Rattus norvegicus
ggagactcccggtttcaggcagacc

SEQ ID NO: 618687 - DNA, 25 bp, Rattus norvegicus
aacaccggctccgtcccactcagca

SEQ ID NO: 618688 - DNA, 25 bp, Rattus norvegicus
ctcagcaccctgaggtgcggtactc

SEQ ID NO: 618689 - DNA, 25 bp, Rattus norvegicus
aggtgcggtactccagactcgccgg

SEQ ID NO: 618690 - DNA, 25 bp, Rattus norvegicus
gccgggttgcgaccatacgcccaaa

SEQ ID NO: 618691 - DNA, 25 bp, Rattus norvegicus
tccggcgccacttacctgttctgga

SEQ ID NO: 618692 - DNA, 25 bp, Rattus norvegicus
tctcccgcccaggagaggactacga

SEQ ID NO: 618693 - DNA, 25 bp, Rattus norvegicus
ggagaggactacgaccaatgggatc

SEQ ID NO: 618694 - DNA, 25 bp, Rattus norvegicus
ggacaggagcccgacagggacaaaa

SEQ ID NO: 618695 - DNA, 25 bp, Rattus norvegicus
gcggagtaccttaggtgctctccta

SEQ ID NO: 618696 - DNA, 25 bp, Rattus norvegicus
cttaggtgctctcctagtcggtttt

SEQ ID NO: 618697 - DNA, 25 bp, Rattus norvegicus
cccgagcgcgaaattggaatactgt

SEQ ID NO: 618698 - DNA, 25 bp, Rattus norvegicus
tgggaccctaaggacggccaccatc

SEQ ID NO: 618699 - DNA, 25 bp, Rattus norvegicus
ggaatactgtcatctggtaccacgc

SEQ ID NO: 618700 - DNA, 25 bp, Rattus norvegicus
agcccgctccgcaagcgcgagaaga

SEQ ID NO: 618701 - DNA, 25 bp, Rattus norvegicus
tgtccgacatcttccgcaactgcag

SEQ ID NO: 618702 - DNA, 25 bp, Rattus norvegicus
gaactggcgcgttagcctcacctaa

SEQ ID NO: 618703 - DNA, 25 bp, Rattus norvegicus
aagttgctgtcttcgctgtccgaca

SEQ ID NO: 618704 - DNA, 25 bp, Rattus norvegicus
gctagagtagctcgagcggactgta

SEQ ID NO: 618705 - DNA, 25 bp, Rattus norvegicus
aactgcagaggaaaacggcggcctc

SEQ ID NO: 618706 - DNA, 25 bp, Rattus norvegicus
taacgcgagatttttcgggcctgcc

SEQ ID NO: 618707 - DNA, 25 bp, Rattus norvegicus
gcggactgtagagccgccatcttga

SEQ ID NO: 618708 - DNA, 25 bp, Rattus norvegicus
gcctgagcgctctctcgcgagaact

SEQ ID NO: 618709 - DNA, 25 bp, Rattus norvegicus
tgctgatcacacaacgcctagctgg

SEQ ID NO: 618710 - DNA, 25 bp, Rattus norvegicus
aagcttccgcgccagctgctgatca

SEQ ID NO: 618711 - DNA, 25 bp, Rattus norvegicus
ttaccgatcactgtccacctgaagc

SEQ ID NO: 618712 - DNA, 25 bp, Rattus norvegicus
aggcgatcgcgaacccgagtccttc

SEQ ID NO: 618713 - DNA, 25 bp, Rattus norvegicus
tcagtttccctgcaagttccactgg

SEQ ID NO: 618714 - DNA, 25 bp, Rattus norvegicus
cgccatctcggaagtggctagagta

SEQ ID NO: 618715 - DNA, 25 bp, Rattus norvegicus
cgcgcacgctgcagtacaaggtgtt

SEQ ID NO: 618716 - DNA, 25 bp, Rattus norvegicus
tcgcctttcgcagaaaacagccaca

SEQ ID NO: 618717 - DNA, 25 bp, Rattus norvegicus
caagtcttcggacgcaaggtgtgcc

SEQ ID NO: 618718 - DNA, 25 bp, Rattus norvegicus
ccgctgcagtccgttcaagtcttcg

SEQ ID NO: 618719 - DNA, 25 bp, Rattus norvegicus
tagctatgccgtccaagggtccgct

SEQ ID NO: 618720 - DNA, 25 bp, Rattus norvegicus
tgaggagctcgtgttcatacttgta

SEQ ID NO: 618721 - DNA, 25 bp, Rattus norvegicus
cgcctgcgcagaccctggaaaatcg

SEQ ID NO: 618722 - DNA, 25 bp, Rattus norvegicus
tgactcaacgctctgtgcgcctgcg

SEQ ID NO: 618723 - DNA, 25 bp, Rattus norvegicus
agctcgcttctgtcgtgactcaacg

SEQ ID NO: 618724 - DNA, 25 bp, Rattus norvegicus
acgttagccgtaaagctcgcttctg

SEQ ID NO: 618725 - DNA, 25 bp, Rattus norvegicus
cgtcctgacttcaacgttagccgta

SEQ ID NO: 618726 - DNA, 25 bp, Rattus norvegicus
cgccgcatttcatacgtcctgactt

SEQ ID NO: 618727 - DNA, 25 bp, Rattus norvegicus
gtggcccactgcaaacgaggaaatg

SEQ ID NO: 618728 - DNA, 25 bp, Rattus norvegicus
cacctgagaattagggtcccgaact

SEQ ID NO: 618729 - DNA, 25 bp, Rattus norvegicus
tggcagggatgcacggccacaaatc

SEQ ID NO: 618730 - DNA, 25 bp, Rattus norvegicus
cttggggttcttggactccagaatc

SEQ ID NO: 618731 - DNA, 25 bp, Rattus norvegicus
cggagtccgaagtcttggtgttcta

SEQ ID NO: 618732 - DNA, 25 bp, Rattus norvegicus
tcccgaatgagtgtcctggggctct

SEQ ID NO: 618733 - DNA, 25 bp, Rattus norvegicus
caggacttgcgggtctcttaagacg

SEQ ID NO: 618734 - DNA, 25 bp, Rattus norvegicus
ggccacaaatcctacggtcttcgaa

SEQ ID NO: 618735 - DNA, 25 bp, Rattus norvegicus
tactcgagtctcagaacagggcgct

SEQ ID NO: 618736 - DNA, 25 bp, Rattus norvegicus
gaagatgctgcaaccctctactcga

SEQ ID NO: 618737 - DNA, 25 bp, Rattus norvegicus
ggaccgcaaggactggctaactctc

SEQ ID NO: 618738 - DNA, 25 bp, Rattus norvegicus
gccctaagtcgaggcgcgagatcct

SEQ ID NO: 618739 - DNA, 25 bp, Rattus norvegicus
gtgatggatgttgcagccctaagtc

SEQ ID NO: 618740 - DNA, 25 bp, Rattus norvegicus
ctaactctcggtctcctggaggtga

SEQ ID NO: 618741 - DNA, 25 bp, Rattus norvegicus
ggactccagagtttccagaacccga

SEQ ID NO: 618742 - DNA, 25 bp, Rattus norvegicus
acccaggcttaaggtcgtgaacttg

SEQ ID NO: 618743 - DNA, 25 bp, Rattus norvegicus
tcacctcgtagatggcagagagatc

SEQ ID NO: 618744 - DNA, 25 bp, Rattus norvegicus
accgacagtcggttcgcagaagtca

SEQ ID NO: 618745 - DNA, 25 bp, Rattus norvegicus
atccgagagtgctgtctaaccagta

SEQ ID NO: 618746 - DNA, 25 bp, Rattus norvegicus
cctaagtttggtgcgtcgaggatcc

SEQ ID NO: 618747 - DNA, 25 bp, Rattus norvegicus
tctctcacttccagccagttagggc

SEQ ID NO: 618748 - DNA, 25 bp, Rattus norvegicus
agtgacagcagtgcgccagctttcc

SEQ ID NO: 618749 - DNA, 25 bp, Rattus norvegicus
tctctaggactctgaccgggtcaac

SEQ ID NO: 618750 - DNA, 25 bp, Rattus norvegicus
cccaggaggccagatctctctagga

SEQ ID NO: 618751 - DNA, 25 bp, Rattus norvegicus
gaagccggccaaagctgacccagga

SEQ ID NO: 618752 - DNA, 25 bp, Rattus norvegicus
gctgctcgccaattttgggccttta

SEQ ID NO: 618753 - DNA, 25 bp, Rattus norvegicus
gccgcaggagctttcgccttttatg

SEQ ID NO: 618754 - DNA, 25 bp, Rattus norvegicus
aggggatcgccggtatctagaccga

SEQ ID NO: 618755 - DNA, 25 bp, Rattus norvegicus
catcgggcgctcgtttcacaactta

SEQ ID NO: 618756 - DNA, 25 bp, Rattus norvegicus
gccatggacagcgaagggtactaga

SEQ ID NO: 618757 - DNA, 25 bp, Rattus norvegicus
ggccagaagcgacctgtccagtctt

SEQ ID NO: 618758 - DNA, 25 bp, Rattus norvegicus
tctgcctctaaagttggctggcctc

SEQ ID NO: 618759 - DNA, 25 bp, Rattus norvegicus
tggcctcctttcctagttagcgttg

SEQ ID NO: 618760 - DNA, 25 bp, Rattus norvegicus
ttagcgttgctttaccgacgagtca

SEQ ID NO: 618761 - DNA, 25 bp, Rattus norvegicus
tccgagggcttgactggaatatctt

SEQ ID NO: 618762 - DNA, 25 bp, Rattus norvegicus
accaatcattagaggcggtctccta

SEQ ID NO: 618763 - DNA, 25 bp, Rattus norvegicus
tctatttccctgaaggccttgcggc

SEQ ID NO: 618764 - DNA, 25 bp, Rattus norvegicus
cggaaacacgtcacaagcgcgtctg

SEQ ID NO: 618765 - DNA, 25 bp, Rattus norvegicus
tcagcgtcttggtagtagtcgaagc

SEQ ID NO: 618766 - DNA, 25 bp, Rattus norvegicus
cgacgccgtccacgctttaacttga

SEQ ID NO: 618767 - DNA, 25 bp, Rattus norvegicus
aacttgagtcacacccgagcctttc

SEQ ID NO: 618768 - DNA, 25 bp, Rattus norvegicus
gcagagcctgcgtcttgtccgcaga

SEQ ID NO: 618769 - DNA, 25 bp, Rattus norvegicus
cgcagatccggcgtctctcaaagtc

SEQ ID NO: 618770 - DNA, 25 bp, Rattus norvegicus
tgtgagggactgaccgcactctatt

SEQ ID NO: 618771 - DNA, 25 bp, Rattus norvegicus
cataggacgagtagccaccaaggaa

SEQ ID NO: 618772 - DNA, 25 bp, Rattus norvegicus
ccaccaaggaatgtgttgcgatcca

SEQ ID NO: 618773 - DNA, 25 bp, Rattus norvegicus
tgtgttgcgatccagaaggaagatg

SEQ ID NO: 618774 - DNA, 25 bp, Rattus norvegicus
ggaatgtgttgcgatccagaaggaa

SEQ ID NO: 618775 - DNA, 25 bp, Rattus norvegicus
ccaaggaatgtgttgcgatccagaa

SEQ ID NO: 618776 - DNA, 25 bp, Rattus norvegicus
tgttgcgatccagaaggaagatgtg

SEQ ID NO: 618777 - DNA, 25 bp, Rattus norvegicus
agccaccaaggaatgtgttgcgatc

SEQ ID NO: 618778 - DNA, 25 bp, Rattus norvegicus
agtagccaccaaggaatgtgttgcg

SEQ ID NO: 618779 - DNA, 25 bp, Rattus norvegicus
ggacgagtagccaccaaggaatgtg

SEQ ID NO: 618780 - DNA, 25 bp, Rattus norvegicus
ctgtggagacataggacgagtagcc

SEQ ID NO: 618781 - DNA, 25 bp, Rattus norvegicus
gacataggacgagtagccaccaagg

SEQ ID NO: 618782 - DNA, 25 bp, Rattus norvegicus
tggagacataggacgagtagccacc

SEQ ID NO: 618783 - DNA, 25 bp, Rattus norvegicus
tatatgtgctgtggagacataggac

SEQ ID NO: 618784 - DNA, 25 bp, Rattus norvegicus
acgagtagccaccaaggaatgtgtt

SEQ ID NO: 618785 - DNA, 25 bp, Rattus norvegicus
gcgtcttactcagtcctgtgccctt

SEQ ID NO: 618786 - DNA, 25 bp, Rattus norvegicus
tgccgcaggtacagtcaacaggtgc

SEQ ID NO: 618787 - DNA, 25 bp, Rattus norvegicus
gctggtgccgcaggtacagtcaaca

SEQ ID NO: 618788 - DNA, 25 bp, Rattus norvegicus
tgacggaatcccgtagccatgagcc

SEQ ID NO: 618789 - DNA, 25 bp, Rattus norvegicus
tgcccttccgggtctgacggaatcc

SEQ ID NO: 618790 - DNA, 25 bp, Rattus norvegicus
agtcctgtgcccttccgggtctgac

SEQ ID NO: 618791 - DNA, 25 bp, Rattus norvegicus
gacgcagtccggcttgttcggaacc

SEQ ID NO: 618792 - DNA, 25 bp, Rattus norvegicus
gccctgcgtcttactcagtcctgtg

SEQ ID NO: 618793 - DNA, 25 bp, Rattus norvegicus
gcaagtagccgttggctaggtgaca

SEQ ID NO: 618794 - DNA, 25 bp, Rattus norvegicus
tacagtcaacaggtgcacgggctcc

SEQ ID NO: 618795 - DNA, 25 bp, Rattus norvegicus
cccaggatatggagactcgcgcgcc

SEQ ID NO: 618796 - DNA, 25 bp, Rattus norvegicus
agtcaacaggtgcacgggctccgcc

SEQ ID NO: 618797 - DNA, 25 bp, Rattus norvegicus
ttcggaaccctgtgccagcgatcct

SEQ ID NO: 618798 - DNA, 25 bp, Rattus norvegicus
ccggcttgttcggaaccctgtgcca

SEQ ID NO: 618799 - DNA, 25 bp, Rattus norvegicus
gtctaactcagtggcggcgaaccga

SEQ ID NO: 618800 - DNA, 25 bp, Rattus norvegicus
gcccgtctaactcagtggcggcgaa

SEQ ID NO: 618801 - DNA, 25 bp, Rattus norvegicus
tcgcgcccgtctaactcagtggcgg

SEQ ID NO: 618802 - DNA, 25 bp, Rattus norvegicus
cgcgattggacctacgggcccgcag

SEQ ID NO: 618803 - DNA, 25 bp, Rattus norvegicus
accgagtcacaattcctcattctgg

SEQ ID NO: 618804 - DNA, 25 bp, Rattus norvegicus
agtctcgcgcccgtctaactcagtg

SEQ ID NO: 618805 - DNA, 25 bp, Rattus norvegicus
attcctcattctggcgttcaaggac

SEQ ID NO: 618806 - DNA, 25 bp, Rattus norvegicus
agtggcggcgaaccgagtcacaatt

SEQ ID NO: 618807 - DNA, 25 bp, Rattus norvegicus
gagcccgcgattggacctacgggcc

SEQ ID NO: 618808 - DNA, 25 bp, Rattus norvegicus
gtcacaattcctcattctggcgttc

SEQ ID NO: 618809 - DNA, 25 bp, Rattus norvegicus
gcgaaccgagtcacaattcctcatt

SEQ ID NO: 618810 - DNA, 25 bp, Rattus norvegicus
gcggcgaaccgagtcacaattcctc

SEQ ID NO: 618811 - DNA, 25 bp, Rattus norvegicus
tggcggcgaaccgagtcacaattcc

SEQ ID NO: 618812 - DNA, 25 bp, Rattus norvegicus
caattcctcattctggcgttcaagg

SEQ ID NO: 618813 - DNA, 25 bp, Rattus norvegicus
acggtgagcccagccaactggcggc

SEQ ID NO: 618814 - DNA, 25 bp, Rattus norvegicus
acaagaaggtgacggacagacggcc

SEQ ID NO: 618815 - DNA, 25 bp, Rattus norvegicus
ttggtctgacaagaaggtgacggac

SEQ ID NO: 618816 - DNA, 25 bp, Rattus norvegicus
ccggagggccactgtgcgccagcat

SEQ ID NO: 618817 - DNA, 25 bp, Rattus norvegicus
gccactgtgcgccagcattagctca

SEQ ID NO: 618818 - DNA, 25 bp, Rattus norvegicus
gccagcattagctcacacccgattg

SEQ ID NO: 618819 - DNA, 25 bp, Rattus norvegicus
agcattagctcacacccgattgaca

SEQ ID NO: 618820 - DNA, 25 bp, Rattus norvegicus
acacccgattgacagacggtgagcc

SEQ ID NO: 618821 - DNA, 25 bp, Rattus norvegicus
tggaacgaggcctgagaggcccgcc

SEQ ID NO: 618822 - DNA, 25 bp, Rattus norvegicus
cctcctcactacgattggtctgaca

SEQ ID NO: 618823 - DNA, 25 bp, Rattus norvegicus
cctcactacgattggtctgacaaga

SEQ ID NO: 618824 - DNA, 25 bp, Rattus norvegicus
ctacgattggtctgacaagaaggtg

SEQ ID NO: 618825 - DNA, 25 bp, Rattus norvegicus
gtcaccgcgccgtgcgtcaccgccc

SEQ ID NO: 618826 - DNA, 25 bp, Rattus norvegicus
tagctcacacccgattgacagacgg

SEQ ID NO: 618827 - DNA, 25 bp, Rattus norvegicus
tgaacttgaacaccctcacgctgga

SEQ ID NO: 618828 - DNA, 25 bp, Rattus norvegicus
ttgacgctttcctgtccaccgtgga

SEQ ID NO: 618829 - DNA, 25 bp, Rattus norvegicus
caccgtggaggacctggatctatcc

SEQ ID NO: 618830 - DNA, 25 bp, Rattus norvegicus
acgctggaccacaacctcattgatc

SEQ ID NO: 618831 - DNA, 25 bp, Rattus norvegicus
gagggcaccttcgtgcagctgcaca

SEQ ID NO: 618832 - DNA, 25 bp, Rattus norvegicus
aactcgtgcgcttggacatgacctc

SEQ ID NO: 618833 - DNA, 25 bp, Rattus norvegicus
gcatctcactgaccgctatttctgg

SEQ ID NO: 618834 - DNA, 25 bp, Rattus norvegicus
gtctcgaaacaccattggccaggta

SEQ ID NO: 618835 - DNA, 25 bp, Rattus norvegicus
tgcaactgtgaactgctctggcttc

SEQ ID NO: 618836 - DNA, 25 bp, Rattus norvegicus
cttcgccaatatgaccagcctggtc

SEQ ID NO: 618837 - DNA, 25 bp, Rattus norvegicus
gtgcgtcgtcgagacttcgccaata

SEQ ID NO: 618838 - DNA, 25 bp, Rattus norvegicus
tgcggctcactgacaacttcattgc

SEQ ID NO: 618839 - DNA, 25 bp, Rattus norvegicus
cgggccctgcatcttgacagcaatc

SEQ ID NO: 618840 - DNA, 25 bp, Rattus norvegicus
cttgggtaacctccgccacttgatc

SEQ ID NO: 618841 - DNA, 25 bp, Rattus norvegicus
accgtatcccatgattcccagaatg

SEQ ID NO: 618842 - DNA, 25 bp, Rattus norvegicus
ttaataccgtgttttgccgcgtaga

SEQ ID NO: 618843 - DNA, 25 bp, Rattus norvegicus
cgcgtagagttgaggccacatttca

SEQ ID NO: 618844 - DNA, 25 bp, Rattus norvegicus
acttggatgtcgacgatgaacacga

SEQ ID NO: 618845 - DNA, 25 bp, Rattus norvegicus
gaacacgaggaatcgccttcgaatc

SEQ ID NO: 618846 - DNA, 25 bp, Rattus norvegicus
agtcagctggttgcgtttattaata

SEQ ID NO: 618847 - DNA, 25 bp, Rattus norvegicus
ctacctcaggggtgagcacgctcag

SEQ ID NO: 618848 - DNA, 25 bp, Rattus norvegicus
ccacatttcagcctcgcgtcggaga

SEQ ID NO: 618849 - DNA, 25 bp, Rattus norvegicus
cgcccggaggaccaatctgaacaaa

SEQ ID NO: 618850 - DNA, 25 bp, Rattus norvegicus
acgcgtagaaactcgcctttccttg

SEQ ID NO: 618851 - DNA, 25 bp, Rattus norvegicus
gaagagcagcttgggcggatcccat

SEQ ID NO: 618852 - DNA, 25 bp, Rattus norvegicus
gggctgataccacctaacgcatgga

SEQ ID NO: 618853 - DNA, 25 bp, Rattus norvegicus
acgcatggaggccaacagtcagctg

SEQ ID NO: 618854 - DNA, 25 bp, Rattus norvegicus
cttcgaatcaaaccgcgcggaggcc

SEQ ID NO: 618855 - DNA, 25 bp, Rattus norvegicus
gtcatcgtagcctcggtcctcgttt

SEQ ID NO: 618856 - DNA, 25 bp, Rattus norvegicus
ggccttcaccagcaccgaatggatg

SEQ ID NO: 618857 - DNA, 25 bp, Rattus norvegicus
gggcgctgttccagagtcacagtta

SEQ ID NO: 618858 - DNA, 25 bp, Rattus norvegicus
gcggcaccatgatcatcgccatcgg

SEQ ID NO: 618859 - DNA, 25 bp, Rattus norvegicus
gtcctcgttttcatcgttctgctca

SEQ ID NO: 618860 - DNA, 25 bp, Rattus norvegicus
tctgctcatgattcgctacaaagtg

SEQ ID NO: 618861 - DNA, 25 bp, Rattus norvegicus
ccgcatcaaggggacgtccagatcg

SEQ ID NO: 618862 - DNA, 25 bp, Rattus norvegicus
cgtgtgctctcagaccaatggttca

SEQ ID NO: 618863 - DNA, 25 bp, Rattus norvegicus
tggttcaagtgcacagcaagcctcc

SEQ ID NO: 618864 - DNA, 25 bp, Rattus norvegicus
tgcagccatcgaggcaaaggccatg

SEQ ID NO: 618865 - DNA, 25 bp, Rattus norvegicus
cgaggcgacttccactgagctagag

SEQ ID NO: 618866 - DNA, 25 bp, Rattus norvegicus
tgctgccctccgaggaaacttcagg

SEQ ID NO: 618867 - DNA, 25 bp, Rattus norvegicus
cggccgaggccacaacaacgctatt

SEQ ID NO: 618868 - DNA, 25 bp, Rattus norvegicus
gtgtgcaattcaccaccgcgggaga

SEQ ID NO: 618869 - DNA, 25 bp, Rattus norvegicus
atctctaacgaacatccggggcctc

SEQ ID NO: 618870 - DNA, 25 bp, Rattus norvegicus
gaaagaacggctttcccgtggcaca

SEQ ID NO: 618871 - DNA, 25 bp, Rattus norvegicus
acctctaggaggagaatgacgagca

SEQ ID NO: 618872 - DNA, 25 bp, Rattus norvegicus
gttgtccaatcggagacctctagga

SEQ ID NO: 618873 - DNA, 25 bp, Rattus norvegicus
ctgctgattggtgtgggttgtccaa

SEQ ID NO: 618874 - DNA, 25 bp, Rattus norvegicus
cgcccactagtacccatggtaacgg

SEQ ID NO: 618875 - DNA, 25 bp, Rattus norvegicus
acggctttcccgtggcacagattcc

SEQ ID NO: 618876 - DNA, 25 bp, Rattus norvegicus
ccgccgccatgttgaatctctaacg

SEQ ID NO: 618877 - DNA, 25 bp, Rattus norvegicus
caaccacaagcgtcttgcaccgtaa

SEQ ID NO: 618878 - DNA, 25 bp, Rattus norvegicus
ttcctccaagagtgaactttgaccc

SEQ ID NO: 618879 - DNA, 25 bp, Rattus norvegicus
acgcgaccctttcctccaagagtga

SEQ ID NO: 618880 - DNA, 25 bp, Rattus norvegicus
gtgggcctaacctctgatcgcgaca

SEQ ID NO: 618881 - DNA, 25 bp, Rattus norvegicus
tgcattgatttcgaacccagccacg

SEQ ID NO: 618882 - DNA, 25 bp, Rattus norvegicus
ctagtacccatggtaacggagttga

SEQ ID NO: 618883 - DNA, 25 bp, Rattus norvegicus
atggcttcggggctgttaatctcgg

SEQ ID NO: 618884 - DNA, 25 bp, Rattus norvegicus
ggacactgctgatcactaacatctg

SEQ ID NO: 618885 - DNA, 25 bp, Rattus norvegicus
tcctacagtcaaaaccaagcggggc

SEQ ID NO: 618886 - DNA, 25 bp, Rattus norvegicus
accatgggtgcctggacttccagaa

SEQ ID NO: 618887 - DNA, 25 bp, Rattus norvegicus
cagaacccggatccctatgccggag

SEQ ID NO: 618888 - DNA, 25 bp, Rattus norvegicus
aggccctggacctgagtcgactgcc

SEQ ID NO: 618889 - DNA, 25 bp, Rattus norvegicus
tcctgctggtactgagccacgtgcc

SEQ ID NO: 618890 - DNA, 25 bp, Rattus norvegicus
atggccaggccctttggctgctgct

SEQ ID NO: 618891 - DNA, 25 bp, Rattus norvegicus
cccgctgggccaattctgcgcatta

SEQ ID NO: 618892 - DNA, 25 bp, Rattus norvegicus
ttaagaccgctaggacgcaacctcc

SEQ ID NO: 618893 - DNA, 25 bp, Rattus norvegicus
atcaggagagaaccgtagcgcaagg

SEQ ID NO: 618894 - DNA, 25 bp, Rattus norvegicus
cccaagaatgccaatcggcagagcc

SEQ ID NO: 618895 - DNA, 25 bp, Rattus norvegicus
cggagtcacgagacaattgatgggc

SEQ ID NO: 618896 - DNA, 25 bp, Rattus norvegicus
cggcagagccaagaaagaatcgacc

SEQ ID NO: 618897 - DNA, 25 bp, Rattus norvegicus
ttcacccagaggacaccggcgtcag

SEQ ID NO: 618898 - DNA, 25 bp, Rattus norvegicus
gaccgaagctcagcacatggctttg

SEQ ID NO: 618899 - DNA, 25 bp, Rattus norvegicus
agttgctgctgcaggtgctgagcca

SEQ ID NO: 618900 - DNA, 25 bp, Rattus norvegicus
catgtgcctcctcgcgcgttagtga

SEQ ID NO: 618901 - DNA, 25 bp, Rattus norvegicus
cgacctagtagatggcccaagcgta

SEQ ID NO: 618902 - DNA, 25 bp, Rattus norvegicus
gcccaagcgtatggctgctgcaact

SEQ ID NO: 618903 - DNA, 25 bp, Rattus norvegicus
tgctgcaactggctcgcgaccgcag

SEQ ID NO: 618904 - DNA, 25 bp, Rattus norvegicus
agggcagagccctctacgccttggc

SEQ ID NO: 618905 - DNA, 25 bp, Rattus norvegicus
atctacaactcctgcggagaacgtg

SEQ ID NO: 618906 - DNA, 25 bp, Rattus norvegicus
gaggggcctgacacttcgtgaaatg

SEQ ID NO: 618907 - DNA, 25 bp, Rattus norvegicus
gtgcaatctgtgaacccggccaacg

SEQ ID NO: 618908 - DNA, 25 bp, Rattus norvegicus
ggcgtggcctacgaaggtgctaaaa

SEQ ID NO: 618909 - DNA, 25 bp, Rattus norvegicus
gctcacaccgttgcataaaacatag

SEQ ID NO: 618910 - DNA, 25 bp, Rattus norvegicus
aaaacatagtgtgcgccacctgagc

SEQ ID NO: 618911 - DNA, 25 bp, Rattus norvegicus
tgctgaggcgtactcggcagcactt

SEQ ID NO: 618912 - DNA, 25 bp, Rattus norvegicus
cctccgtggggcccagacgcttagg

SEQ ID NO: 618913 - DNA, 25 bp, Rattus norvegicus
accacacccttcagctggggccggc

SEQ ID NO: 618914 - DNA, 25 bp, Rattus norvegicus
gataaatgtgcgcaacaccacaccc

SEQ ID NO: 618915 - DNA, 25 bp, Rattus norvegicus
ggcttcctgataaatgtgcgcaaca

SEQ ID NO: 618916 - DNA, 25 bp, Rattus norvegicus
cttcggcttcctgataaatgtgcgc

SEQ ID NO: 618917 - DNA, 25 bp, Rattus norvegicus
gggcttcttcggcttcctgataaat

SEQ ID NO: 618918 - DNA, 25 bp, Rattus norvegicus
tactcggcagcacttccggttggcg

SEQ ID NO: 618919 - DNA, 25 bp, Rattus norvegicus
gacagcctctttgccggtgctgagg

SEQ ID NO: 618920 - DNA, 25 bp, Rattus norvegicus
aagcagacagcctctttgccggtgc

SEQ ID NO: 618921 - DNA, 25 bp, Rattus norvegicus
cggggatgaagcagacagcctcttt

SEQ ID NO: 618922 - DNA, 25 bp, Rattus norvegicus
gccctcgccggggatgaagcagaca

SEQ ID NO: 618923 - DNA, 25 bp, Rattus norvegicus
gaccaccctccacgaggaccacgtg

SEQ ID NO: 618924 - DNA, 25 bp, Rattus norvegicus
cggagttgggcttcttcggcttcct

SEQ ID NO: 618925 - DNA, 25 bp, Rattus norvegicus
gcgagcttccttacttagacatgga

SEQ ID NO: 618926 - DNA, 25 bp, Rattus norvegicus
tgcgtgtgcaaccagaacccaagga

SEQ ID NO: 618927 - DNA, 25 bp, Rattus norvegicus
ctccggttccgaggacgctgcgtgt

SEQ ID NO: 618928 - DNA, 25 bp, Rattus norvegicus
ttcctggctcgccaggggctccggt

SEQ ID NO: 618929 - DNA, 25 bp, Rattus norvegicus
cccaaggaggagtttcgctacagaa

SEQ ID NO: 618930 - DNA, 25 bp, Rattus norvegicus
ttcgctacagaaaaacgagttcgga

SEQ ID NO: 618931 - DNA, 25 bp, Rattus norvegicus
gagttcggaacctcctgtacgaaca

SEQ ID NO: 618932 - DNA, 25 bp, Rattus norvegicus
tcctgtacgaacacgcacgcgaggg

SEQ ID NO: 618933 - DNA, 25 bp, Rattus norvegicus
tccatggcacggctcttgtggcctt

SEQ ID NO: 618934 - DNA, 25 bp, Rattus norvegicus
ggtacagcgagcttccttacttaga

SEQ ID NO: 618935 - DNA, 25 bp, Rattus norvegicus
ttacttagacatggagtcggtgtgc

SEQ ID NO: 618936 - DNA, 25 bp, Rattus norvegicus
gcatgcccagaaaaggccgcgcgct

SEQ ID NO: 618937 - DNA, 25 bp, Rattus norvegicus
aacacgcacgcgaggggtacagcga

SEQ ID NO: 618938 - DNA, 25 bp, Rattus norvegicus
cctgcctgcgattgtgagtgcgctt

SEQ ID NO: 618939 - DNA, 25 bp, Rattus norvegicus
gcctgtcgggagttgtatttttcta

SEQ ID NO: 618940 - DNA, 25 bp, Rattus norvegicus
gatggacattcgctcgctgagtttc

SEQ ID NO: 618941 - DNA, 25 bp, Rattus norvegicus
atcctctctcggctccttcttgttt

SEQ ID NO: 618942 - DNA, 25 bp, Rattus norvegicus
ttcttgtttccgctgccgtcacggg

SEQ ID NO: 618943 - DNA, 25 bp, Rattus norvegicus
tcacgggacagagcagtcggtgaca

SEQ ID NO: 618944 - DNA, 25 bp, Rattus norvegicus
ttgataacgtgaggggagcaccgta

SEQ ID NO: 618945 - DNA, 25 bp, Rattus norvegicus
ggcgccaagccttttgggatttgta

SEQ ID NO: 618946 - DNA, 25 bp, Rattus norvegicus
cccagattttccagacgccctttat

SEQ ID NO: 618947 - DNA, 25 bp, Rattus norvegicus
gcctctgtactgcaccagaaccaat

SEQ ID NO: 618948 - DNA, 25 bp, Rattus norvegicus
agcgcttccgccctattgggaattc

SEQ ID NO: 618949 - DNA, 25 bp, Rattus norvegicus
gttctgccgagagctccagcgcttc

SEQ ID NO: 618950 - DNA, 25 bp, Rattus norvegicus
cattcatcggcgtctgcagttttcc

SEQ ID NO: 618951 - DNA, 25 bp, Rattus norvegicus
aggccactgtcgcaccattcatcgg

SEQ ID NO: 618952 - DNA, 25 bp, Rattus norvegicus
cctttattaatatggccgccggcgc

SEQ ID NO: 618953 - DNA, 25 bp, Rattus norvegicus
cgcccacagggtggtaagccgactg

SEQ ID NO: 618954 - DNA, 25 bp, Rattus norvegicus
attccactgtgaaagccggtcccgc

SEQ ID NO: 618955 - DNA, 25 bp, Rattus norvegicus
agcttcgttcgggttgctaacgtct

SEQ ID NO: 618956 - DNA, 25 bp, Rattus norvegicus
ccgacgctacagagagacgtgacca

SEQ ID NO: 618957 - DNA, 25 bp, Rattus norvegicus
ggctcccagtttcagctgtccatct

SEQ ID NO: 618958 - DNA, 25 bp, Rattus norvegicus
ggcgtgagtgccagcctatgagatt

SEQ ID NO: 618959 - DNA, 25 bp, Rattus norvegicus
gggtgccgaggaaaaagcatcagta

SEQ ID NO: 618960 - DNA, 25 bp, Rattus norvegicus
gacagagctctagcgcacagacgga

SEQ ID NO: 618961 - DNA, 25 bp, Rattus norvegicus
gagcgggagccaataagcatcattc

SEQ ID NO: 618962 - DNA, 25 bp, Rattus norvegicus
tttggaactgagacgctggatcttt

SEQ ID NO: 618963 - DNA, 25 bp, Rattus norvegicus
gcgcgcaaaccgaccagtgggtctg

SEQ ID NO: 618964 - DNA, 25 bp, Rattus norvegicus
ctcccggaatttttgacaggcgtga

SEQ ID NO: 618965 - DNA, 25 bp, Rattus norvegicus
ccgcagaacgctcgagtgggtagca

SEQ ID NO: 618966 - DNA, 25 bp, Rattus norvegicus
ggcgcgtcaccagaggaaggtatct

SEQ ID NO: 618967 - DNA, 25 bp, Rattus norvegicus
agcgatgtctatgcaggcctggctg

SEQ ID NO: 618968 - DNA, 25 bp, Rattus norvegicus
tgaagcccgccctgtggaccaaact

SEQ ID NO: 618969 - DNA, 25 bp, Rattus norvegicus
gtggaccaaactccgaactctcaga

SEQ ID NO: 618970 - DNA, 25 bp, Rattus norvegicus
aaactccgaactctcagagcccagg

SEQ ID NO: 618971 - DNA, 25 bp, Rattus norvegicus
tcagagcccaggaactgcggcgact

SEQ ID NO: 618972 - DNA, 25 bp, Rattus norvegicus
tgcgccggcgccaaatagccttgag

SEQ ID NO: 618973 - DNA, 25 bp, Rattus norvegicus
ccggcgccaaatagccttgagggta

SEQ ID NO: 618974 - DNA, 25 bp, Rattus norvegicus
ccaaatagccttgagggtaggagca

SEQ ID NO: 618975 - DNA, 25 bp, Rattus norvegicus
acccgagggacagagcccggccttg

SEQ ID NO: 618976 - DNA, 25 bp, Rattus norvegicus
agagcccggccttgcggaaccgtat

SEQ ID NO: 618977 - DNA, 25 bp, Rattus norvegicus
ggccttgcggaaccgtatccacgca

SEQ ID NO: 618978 - DNA, 25 bp, Rattus norvegicus
gcggaaccgtatccacgcacgcctc

SEQ ID NO: 618979 - DNA, 25 bp, Rattus norvegicus
acgcacgcctcgctcacctgcacgc

SEQ ID NO: 618980 - DNA, 25 bp, Rattus norvegicus
gtgtgcagcgatgtctatgcaggcc

SEQ ID NO: 618981 - DNA, 25 bp, Rattus norvegicus
ggccaagctcgccgccgagctggta

SEQ ID NO: 618982 - DNA, 25 bp, Rattus norvegicus
cccactaccgcctctgacgtcgacg

SEQ ID NO: 618983 - DNA, 25 bp, Rattus norvegicus
cctagtgcggacagcccgccggagt

SEQ ID NO: 618984 - DNA, 25 bp, Rattus norvegicus
gtctagcctagtgcggacagcccgc

SEQ ID NO: 618985 - DNA, 25 bp, Rattus norvegicus
cacggtctagcctagtgcggacagc

SEQ ID NO: 618986 - DNA, 25 bp, Rattus norvegicus
tgaacacggtctagcctagtgcgga

SEQ ID NO: 618987 - DNA, 25 bp, Rattus norvegicus
cagtgaacacggtctagcctagtgc

SEQ ID NO: 618988 - DNA, 25 bp, Rattus norvegicus
ctagcagtgaacacggtctagccta

SEQ ID NO: 618989 - DNA, 25 bp, Rattus norvegicus
agccgctagcagtgaacacggtcta

SEQ ID NO: 618990 - DNA, 25 bp, Rattus norvegicus
gtacgagccgctagcagtgaacacg

SEQ ID NO: 618991 - DNA, 25 bp, Rattus norvegicus
gtgtacgagccgctagcagtgaaca

SEQ ID NO: 618992 - DNA, 25 bp, Rattus norvegicus
gggaggataggagacctcccgctcc

SEQ ID NO: 618993 - DNA, 25 bp, Rattus norvegicus
cccgagcgcgggtagtgtacgagcc

SEQ ID NO: 618994 - DNA, 25 bp, Rattus norvegicus
agcgggcaccggcaccagaagccgc

SEQ ID NO: 618995 - DNA, 25 bp, Rattus norvegicus
aacgccggcgaccaacacggaggag

SEQ ID NO: 618996 - DNA, 25 bp, Rattus norvegicus
gtgcgcgcaatccaaagcggggctt

SEQ ID NO: 618997 - DNA, 25 bp, Rattus norvegicus
gcggtctttccaatagaacggcgtg

SEQ ID NO: 618998 - DNA, 25 bp, Rattus norvegicus
aacggcgtgcgtactatccaataga

SEQ ID NO: 618999 - DNA, 25 bp, Rattus norvegicus
gaaatgagccgtatggaaacttccc

SEQ ID NO: 619000 - DNA, 25 bp, Rattus norvegicus
tggtcgctattacggcggcggcaac

SEQ ID NO: 619001 - DNA, 25 bp, Rattus norvegicus
cctaaacggctgaagactgaaaacg

SEQ ID NO: 619002 - DNA, 25 bp, Rattus norvegicus
tttgcgcgaggacaggcacttgcgc

SEQ ID NO: 619003 - DNA, 25 bp, Rattus norvegicus
cgctgcagccctcgcggtttttggt

SEQ ID NO: 619004 - DNA, 25 bp, Rattus norvegicus
tttctgtgtccctatgcgcaagcgc

SEQ ID NO: 619005 - DNA, 25 bp, Rattus norvegicus
tgcgcaagcgcgtttctacaactag

SEQ ID NO: 619006 - DNA, 25 bp, Rattus norvegicus
caactagctttagtgagcgggaagc

SEQ ID NO: 619007 - DNA, 25 bp, Rattus norvegicus
gcgcaggcctgacctgatggcctta

SEQ ID NO: 619008 - DNA, 25 bp, Rattus norvegicus
atggccttagtcttaatcgcgatcg

SEQ ID NO: 619009 - DNA, 25 bp, Rattus norvegicus
atactgcggccagtggcgtcgtgtc

SEQ ID NO: 619010 - DNA, 25 bp, Rattus norvegicus
tgggcctgaccggatgcccacgagt

SEQ ID NO: 619011 - DNA, 25 bp, Rattus norvegicus
tcgtgtccctgtcgcgtgggcctga

SEQ ID NO: 619012 - DNA, 25 bp, Rattus norvegicus
accttcagcgatactgcggccagtg

SEQ ID NO: 619013 - DNA, 25 bp, Rattus norvegicus
agcttcgctcggctgaccttcagcg

SEQ ID NO: 619014 - DNA, 25 bp, Rattus norvegicus
ctgaaccagagcttcgctcggctga

SEQ ID NO: 619015 - DNA, 25 bp, Rattus norvegicus
aactccgtgccaagacgcgggcttg

SEQ ID NO: 619016 - DNA, 25 bp, Rattus norvegicus
gtggcagacgaactccgtgccaaga

SEQ ID NO: 619017 - DNA, 25 bp, Rattus norvegicus
ggatgcccacgagtggtcccacgtc

SEQ ID NO: 619018 - DNA, 25 bp, Rattus norvegicus
ggcagcgttgccacccaagggtcgc

SEQ ID NO: 619019 - DNA, 25 bp, Rattus norvegicus
tgccacccaagggtcgccgggtctg

SEQ ID NO: 619020 - DNA, 25 bp, Rattus norvegicus
gtctgcggtgcctccggactccgaa

SEQ ID NO: 619021 - DNA, 25 bp, Rattus norvegicus
tgacagccctgaaccagagcttcgc

SEQ ID NO: 619022 - DNA, 25 bp, Rattus norvegicus
acgagtggtcccacgtcctgggcct

SEQ ID NO: 619023 - DNA, 25 bp, Rattus norvegicus
gcggtggacgctcttctcgctcgct

SEQ ID NO: 619024 - DNA, 25 bp, Rattus norvegicus
cagtaacgtgcgtgctggtccatca

SEQ ID NO: 619025 - DNA, 25 bp, Rattus norvegicus
ctagagtcaccgtcgaaggtacaga

SEQ ID NO: 619026 - DNA, 25 bp, Rattus norvegicus
aaggtacagacggagccaggatccc

SEQ ID NO: 619027 - DNA, 25 bp, Rattus norvegicus
gacttcagctctccacgtggcatcg

SEQ ID NO: 619028 - DNA, 25 bp, Rattus norvegicus
ggcgactgtcgctacgaactccagt

SEQ ID NO: 619029 - DNA, 25 bp, Rattus norvegicus
aactccagtccgcacggagccgaaa

SEQ ID NO: 619030 - DNA, 25 bp, Rattus norvegicus
acggagccgaaactgacctggaggc

SEQ ID NO: 619031 - DNA, 25 bp, Rattus norvegicus
agttcaaaggggaacaggagcgctc

SEQ ID NO: 619032 - DNA, 25 bp, Rattus norvegicus
gcgctacgcagagcgacccaggtga

SEQ ID NO: 619033 - DNA, 25 bp, Rattus norvegicus
tggtccatcagacacagaaaagcta

SEQ ID NO: 619034 - DNA, 25 bp, Rattus norvegicus
cggggaaccgtgagaatctgagcct

SEQ ID NO: 619035 - DNA, 25 bp, Rattus norvegicus
gtcacaacaggtggaagcaggcctg

SEQ ID NO: 619036 - DNA, 25 bp, Rattus norvegicus
tgacctggaggcttcagagttcaaa

SEQ ID NO: 619037 - DNA, 25 bp, Rattus norvegicus
gcggcaataagacgggaagtctacc

SEQ ID NO: 619038 - DNA, 25 bp, Rattus norvegicus
agtttccagcaaactcctcggcctg

SEQ ID NO: 619039 - DNA, 25 bp, Rattus norvegicus
acatggcgaacatttgtgcccgccc

SEQ ID NO: 619040 - DNA, 25 bp, Rattus norvegicus
cggtggcttctgtgcccttgaccaa

SEQ ID NO: 619041 - DNA, 25 bp, Rattus norvegicus
gaactaggtggagcctcgctgctaa

SEQ ID NO: 619042 - DNA, 25 bp, Rattus norvegicus
cgtgagttacctcttaatccgtggg

SEQ ID NO: 619043 - DNA, 25 bp, Rattus norvegicus
ccttgaccaacatggcgaacatttg

SEQ ID NO: 619044 - DNA, 25 bp, Rattus norvegicus
gtcatcgctcgttatagcggcaata

SEQ ID NO: 619045 - DNA, 25 bp, Rattus norvegicus
tttcttcggtagaaggtctcgcagc

SEQ ID NO: 619046 - DNA, 25 bp, Rattus norvegicus
tctcgcagcgtcagagctccagaga

SEQ ID NO: 619047 - DNA, 25 bp, Rattus norvegicus
tccagagatggctaccgcgatgaca

SEQ ID NO: 619048 - DNA, 25 bp, Rattus norvegicus
taccgcgatgacagtttccagcaaa

SEQ ID NO: 619049 - DNA, 25 bp, Rattus norvegicus
cggcctgctgatgcagcgtgagtta

SEQ ID NO: 619050 - DNA, 25 bp, Rattus norvegicus
cccgttgttgtgtcatcgctcgtta

SEQ ID NO: 619051 - DNA, 25 bp, Rattus norvegicus
ttcacgctgcgcatcttctcggagc

SEQ ID NO: 619052 - DNA, 25 bp, Rattus norvegicus
tgggcctctgggactctccgcgcag

SEQ ID NO: 619053 - DNA, 25 bp, Rattus norvegicus
gcgccgaccgctcggttttctgtgc

SEQ ID NO: 619054 - DNA, 25 bp, Rattus norvegicus
tgaagccgacttcacgctgcgcatc

SEQ ID NO: 619055 - DNA, 25 bp, Rattus norvegicus
ggagcgcagccacaccgcagtgtga

SEQ ID NO: 619056 - DNA, 25 bp, Rattus norvegicus
gccacaccgcagtgtgagccggtgc

SEQ ID NO: 619057 - DNA, 25 bp, Rattus norvegicus
acccaggaacctcaatctagaatca

SEQ ID NO: 619058 - DNA, 25 bp, Rattus norvegicus
ctagaatcatagaatccctggcacc

SEQ ID NO: 619059 - DNA, 25 bp, Rattus norvegicus
cactttcctttgactgtacccacgt

SEQ ID NO: 619060 - DNA, 25 bp, Rattus norvegicus
gcctgaacgcttcctttcttccgta

SEQ ID NO: 619061 - DNA, 25 bp, Rattus norvegicus
ttcttccgtaatttgcagggagatc

SEQ ID NO: 619062 - DNA, 25 bp, Rattus norvegicus
ttgcagggagatcgatgacgtgatc

SEQ ID NO: 619063 - DNA, 25 bp, Rattus norvegicus
atgacgtgatcagcgcggacctgga

SEQ ID NO: 619064 - DNA, 25 bp, Rattus norvegicus
gcgtgggcgatgaagccgacttcac

SEQ ID NO: 619065 - DNA, 25 bp, Rattus norvegicus
gttcgccgcgtgatagtccaccatc

SEQ ID NO: 619066 - DNA, 25 bp, Rattus norvegicus
tatgtcggagcctacgactcggccg

SEQ ID NO: 619067 - DNA, 25 bp, Rattus norvegicus
aggccgggtccaacagcaggtcccg

SEQ ID NO: 619068 - DNA, 25 bp, Rattus norvegicus
agtcatcctcctgggccatgtagtc

SEQ ID NO: 619069 - DNA, 25 bp, Rattus norvegicus
tgggccatgtagtcgcccatgcctc

SEQ ID NO: 619070 - DNA, 25 bp, Rattus norvegicus
gggcggggcccaatcatgaatgatt

SEQ ID NO: 619071 - DNA, 25 bp, Rattus norvegicus
gccgtactggtacgcctggttcgcc

SEQ ID NO: 619072 - DNA, 25 bp, Rattus norvegicus
aatgattcataaggcggggctcgtc

SEQ ID NO: 619073 - DNA, 25 bp, Rattus norvegicus
ccgcgagcgcgcatctaaaaggcga

SEQ ID NO: 619074 - DNA, 25 bp, Rattus norvegicus
atctaaaaggcgagcccgcccacgg

SEQ ID NO: 619075 - DNA, 25 bp, Rattus norvegicus
ggagcccacgcgcttctctagcgtg

SEQ ID NO: 619076 - DNA, 25 bp, Rattus norvegicus
acgcgcttctctagcgtgaacgcgc

SEQ ID NO: 619077 - DNA, 25 bp, Rattus norvegicus
gcccaagactgacgcctgcgcaggt

SEQ ID NO: 619078 - DNA, 25 bp, Rattus norvegicus
attgccgccgctgcttgggccgtac

SEQ ID NO: 619079 - DNA, 25 bp, Rattus norvegicus
tctgccttactacgcaggcgccagg

SEQ ID NO: 619080 - DNA, 25 bp, Rattus norvegicus
tgcacgcatgcgtagccataaatcc

SEQ ID NO: 619081 - DNA, 25 bp, Rattus norvegicus
gaaccttaagcttccgatgcgcgtg

SEQ ID NO: 619082 - DNA, 25 bp, Rattus norvegicus
cgcatgcgcattggtcacacctaaa

SEQ ID NO: 619083 - DNA, 25 bp, Rattus norvegicus
tagcagttgtaatttgcgcatgcgc

SEQ ID NO: 619084 - DNA, 25 bp, Rattus norvegicus
ccacatgatttcctgctagcagttg

SEQ ID NO: 619085 - DNA, 25 bp, Rattus norvegicus
ggaagcggaattacgtcacaccctc

SEQ ID NO: 619086 - DNA, 25 bp, Rattus norvegicus
acttgcccacgtttgctctcatctg

SEQ ID NO: 619087 - DNA, 25 bp, Rattus norvegicus
gtcgatacccttgagcaacttgccc

SEQ ID NO: 619088 - DNA, 25 bp, Rattus norvegicus
ccagccgagctcagacctgtcgata

SEQ ID NO: 619089 - DNA, 25 bp, Rattus norvegicus
ggagacatagttctctgcacgcatg

SEQ ID NO: 619090 - DNA, 25 bp, Rattus norvegicus
ccgcttgaaggcgtccattcttttc

SEQ ID NO: 619091 - DNA, 25 bp, Rattus norvegicus
cccagctggagtcgaacaccagtta

SEQ ID NO: 619092 - DNA, 25 bp, Rattus norvegicus
gccataaatccctatagccgcttga

SEQ ID NO: 619093 - DNA, 25 bp, Rattus norvegicus
ccctcgttcaccacgtcgaagatga

SEQ ID NO: 619094 - DNA, 25 bp, Rattus norvegicus
catgcctgccaagagctcggtcaca

SEQ ID NO: 619095 - DNA, 25 bp, Rattus norvegicus
ctcggtcacagtcaccttcttggcg

SEQ ID NO: 619096 - DNA, 25 bp, Rattus norvegicus
agtcaccttcttggcgctgtctacc

SEQ ID NO: 619097 - DNA, 25 bp, Rattus norvegicus
tcgccgcaggctccggtagctcaga

SEQ ID NO: 619098 - DNA, 25 bp, Rattus norvegicus
tcgccctccggctcagagatctgag

SEQ ID NO: 619099 - DNA, 25 bp, Rattus norvegicus
gatctgagcagcgatctgcatctcg

SEQ ID NO: 619100 - DNA, 25 bp, Rattus norvegicus
tctgcatctcgaagatcgtgtcctc

SEQ ID NO: 619101 - DNA, 25 bp, Rattus norvegicus
gaacagctccatcttctcggactcg

SEQ ID NO: 619102 - DNA, 25 bp, Rattus norvegicus
ctaggctgctgaccgtgcacctcgt

SEQ ID NO: 619103 - DNA, 25 bp, Rattus norvegicus
ggggctccactggtgtcgtgtcacc

SEQ ID NO: 619104 - DNA, 25 bp, Rattus norvegicus
gtgtcctcgcagaagctcacgaaca

SEQ ID NO: 619105 - DNA, 25 bp, Rattus norvegicus
tccttctggcctgaaggggctccca

SEQ ID NO: 619106 - DNA, 25 bp, Rattus norvegicus
aaggggctcccatcggctacggcca

SEQ ID NO: 619107 - DNA, 25 bp, Rattus norvegicus
cctcccgcatatggggcgctgggaa

SEQ ID NO: 619108 - DNA, 25 bp, Rattus norvegicus
ctgacgtcaggcctgcgacaacgtc

SEQ ID NO: 619109 - DNA, 25 bp, Rattus norvegicus
aggcaagcgtcacagggagccgacc

SEQ ID NO: 619110 - DNA, 25 bp, Rattus norvegicus
gctgggaaatcaagatccaaccctg

SEQ ID NO: 619111 - DNA, 25 bp, Rattus norvegicus
agtgggccacacctccgacagtaag

SEQ ID NO: 619112 - DNA, 25 bp, Rattus norvegicus
tccgacagtaaggaaggggcagtta

SEQ ID NO: 619113 - DNA, 25 bp, Rattus norvegicus
ttagagcggttggaacagttgtttc

SEQ ID NO: 619114 - DNA, 25 bp, Rattus norvegicus
ccagaggctgcctcacacgggagct

SEQ ID NO: 619115 - DNA, 25 bp, Rattus norvegicus
cacgggagctcaccgccaatgtgtc

SEQ ID NO: 619116 - DNA, 25 bp, Rattus norvegicus
gccaatgtgtcaaaagcgcatgttc

SEQ ID NO: 619117 - DNA, 25 bp, Rattus norvegicus
aaaagcgcatgttcgccgccgctcg

SEQ ID NO: 619118 - DNA, 25 bp, Rattus norvegicus
acacgtcaggggctccctgggtgtc

SEQ ID NO: 619119 - DNA, 25 bp, Rattus norvegicus
ctccctgggtgtcggaagccattct

SEQ ID NO: 619120 - DNA, 25 bp, Rattus norvegicus
tcggaagccattctgtgacgcacgg

SEQ ID NO: 619121 - DNA, 25 bp, Rattus norvegicus
atgcgacgcgatgcgcccatgattt

SEQ ID NO: 619122 - DNA, 25 bp, Rattus norvegicus
aactccaggaagttgcgcaggcgcg

SEQ ID NO: 619123 - DNA, 25 bp, Rattus norvegicus
tcgtggggcacatgctctgacaggt

SEQ ID NO: 619124 - DNA, 25 bp, Rattus norvegicus
ctctgacaggttggtgagcagcact

SEQ ID NO: 619125 - DNA, 25 bp, Rattus norvegicus
acaggttggtgagcagcactgccac

SEQ ID NO: 619126 - DNA, 25 bp, Rattus norvegicus
cagcactgccacgttgaagccaatg

SEQ ID NO: 619127 - DNA, 25 bp, Rattus norvegicus
aagtagatccgttctatgcgacgcg

SEQ ID NO: 619128 - DNA, 25 bp, Rattus norvegicus
cgcgatgcgcccatgatttcgatgc

SEQ ID NO: 619129 - DNA, 25 bp, Rattus norvegicus
catgatttcgatgcggcccaggtaa

SEQ ID NO: 619130 - DNA, 25 bp, Rattus norvegicus
caggtaaggccggaagtaatccagg

SEQ ID NO: 619131 - DNA, 25 bp, Rattus norvegicus
gccggaagtaatccaggatgctctc

SEQ ID NO: 619132 - DNA, 25 bp, Rattus norvegicus
caggatgctctcagccaactccagg

SEQ ID NO: 619133 - DNA, 25 bp, Rattus norvegicus
ccgcgctggttcctggaagcggttc

SEQ ID NO: 619134 - DNA, 25 bp, Rattus norvegicus
tgaagccaatgtcccgcgctggttc

SEQ ID NO: 619135 - DNA, 25 bp, Rattus norvegicus
ccgcgacagtcggtatactgtgtgc

SEQ ID NO: 619136 - DNA, 25 bp, Rattus norvegicus
tagcgggtaagtgccagcgcccatc

SEQ ID NO: 619137 - DNA, 25 bp, Rattus norvegicus
cagccagggcacaagtagcgggtaa

SEQ ID NO: 619138 - DNA, 25 bp, Rattus norvegicus
atgagcggcagcacagccagggcac

SEQ ID NO: 619139 - DNA, 25 bp, Rattus norvegicus
cgcacttggtgatgagcggcagcac

SEQ ID NO: 619140 - DNA, 25 bp, Rattus norvegicus
agtccaccatgatggcgcggtgctc

SEQ ID NO: 619141 - DNA, 25 bp, Rattus norvegicus
tactgtgtgcagcatggagtccacc

SEQ ID NO: 619142 - DNA, 25 bp, Rattus norvegicus
tatacctgaggaggacaagcccaga

SEQ ID NO: 619143 - DNA, 25 bp, Rattus norvegicus
cctcaatgacgtcgcgctgtgcttt

SEQ ID NO: 619144 - DNA, 25 bp, Rattus norvegicus
tgaggcagtcctcaatgacgtcgcg

SEQ ID NO: 619145 - DNA, 25 bp, Rattus norvegicus
tgcacagcgccatgaggcagtcctc

SEQ ID NO: 619146 - DNA, 25 bp, Rattus norvegicus
acaccaggcgtcgaagcaggtgctg

SEQ ID NO: 619147 - DNA, 25 bp, Rattus norvegicus
ctgcagcatggacgggcggatatac

SEQ ID NO: 619148 - DNA, 25 bp, Rattus norvegicus
cccagagagggcagagaactcacgc

SEQ ID NO: 619149 - DNA, 25 bp, Rattus norvegicus
ttctcagcgccttgtctcgcagagc

SEQ ID NO: 619150 - DNA, 25 bp, Rattus norvegicus
tagtagcctgcacgcagaggacccg

SEQ ID NO: 619151 - DNA, 25 bp, Rattus norvegicus
tgcacagggcatgagccacgcggtt

SEQ ID NO: 619152 - DNA, 25 bp, Rattus norvegicus
cacgcggttgttgcccagggcgcac

SEQ ID NO: 619153 - DNA, 25 bp, Rattus norvegicus
catgcagcagctgtgcctggtccac

SEQ ID NO: 619154 - DNA, 25 bp, Rattus norvegicus
cggcaagtgcgcgtcttccagagca

SEQ ID NO: 619155 - DNA, 25 bp, Rattus norvegicus
agaggacccggcaagtgcgcgtctt

SEQ ID NO: 619156 - DNA, 25 bp, Rattus norvegicus
tgatgaggaggtcatagtagcctgc

SEQ ID NO: 619157 - DNA, 25 bp, Rattus norvegicus
tactcagagagcatggagcgacggc

SEQ ID NO: 619158 - DNA, 25 bp, Rattus norvegicus
agcggcacaatgtactcagagagca

SEQ ID NO: 619159 - DNA, 25 bp, Rattus norvegicus
ggtctcctctgtgagcggcacaatg

SEQ ID NO: 619160 - DNA, 25 bp, Rattus norvegicus
cctggtccacgtggctgcacagggc

SEQ ID NO: 619161 - DNA, 25 bp, Rattus norvegicus
ctggcagggcgaccacaaaacacgg

SEQ ID NO: 619162 - DNA, 25 bp, Rattus norvegicus
catcttccgcgctacgaccgggtgg

SEQ ID NO: 619163 - DNA, 25 bp, Rattus norvegicus
tacattgtgcccgttctctgccagc

SEQ ID NO: 619164 - DNA, 25 bp, Rattus norvegicus
cctcgtcaagcaggcggtagggcac

SEQ ID NO: 619165 - DNA, 25 bp, Rattus norvegicus
gtttctgcgtgcagggatgtcctgc

SEQ ID NO: 619166 - DNA, 25 bp, Rattus norvegicus
gggatgtcctgcacagcgctatagc

SEQ ID NO: 619167 - DNA, 25 bp, Rattus norvegicus
ttgctgcgcttggtggcctcgtcaa

SEQ ID NO: 619168 - DNA, 25 bp, Rattus norvegicus
gcccatacattgtgcccgttctctg

SEQ ID NO: 619169 - DNA, 25 bp, Rattus norvegicus
ttgtgcccgttctctgccagccggt

SEQ ID NO: 619170 - DNA, 25 bp, Rattus norvegicus
agccggtccaccagagtcgtctgcg

SEQ ID NO: 619171 - DNA, 25 bp, Rattus norvegicus
tccaccagagtcgtctgcgcaggcg

SEQ ID NO: 619172 - DNA, 25 bp, Rattus norvegicus
gagtcgtctgcgcaggcgtcagcct

SEQ ID NO: 619173 - DNA, 25 bp, Rattus norvegicus
agcctcacgtggctcaggtccagag

SEQ ID NO: 619174 - DNA, 25 bp, Rattus norvegicus
cacgtggctcaggtccagaggagcc

SEQ ID NO: 619175 - DNA, 25 bp, Rattus norvegicus
gccacccggtctctcgcccatacat

SEQ ID NO: 619176 - DNA, 25 bp, Rattus norvegicus
acagcgctatagctccagccctgtg

SEQ ID NO: 619177 - DNA, 25 bp, Rattus norvegicus
tccgaaggcggctcgaaatagccga

SEQ ID NO: 619178 - DNA, 25 bp, Rattus norvegicus
ccgtggcttcccgctgaagctatcg

SEQ ID NO: 619179 - DNA, 25 bp, Rattus norvegicus
gccctcgatgggcagtgctgaccca

SEQ ID NO: 619180 - DNA, 25 bp, Rattus norvegicus
gtaggctcaggatgacgccctcgat

SEQ ID NO: 619181 - DNA, 25 bp, Rattus norvegicus
ctcgaaatagccgatgaggtcttgt

SEQ ID NO: 619182 - DNA, 25 bp, Rattus norvegicus
cagctcctccgaaggcggctcgaaa

SEQ ID NO: 619183 - DNA, 25 bp, Rattus norvegicus
ggtctgcttctcctcgtgctgcagc

SEQ ID NO: 619184 - DNA, 25 bp, Rattus norvegicus
ctgcggagcttggtctgcttctcct

SEQ ID NO: 619185 - DNA, 25 bp, Rattus norvegicus
tcctggaagaggctttgtcggttgc

SEQ ID NO: 619186 - DNA, 25 bp, Rattus norvegicus
ggtccttcactttctataagccctg

SEQ ID NO: 619187 - DNA, 25 bp, Rattus norvegicus
gaggcgtggtccttcactttctata

SEQ ID NO: 619188 - DNA, 25 bp, Rattus norvegicus
cctccttgaggcgtggtccttcact

SEQ ID NO: 619189 - DNA, 25 bp, Rattus norvegicus
cttattcccgcccaccctgaaggca

SEQ ID NO: 619190 - DNA, 25 bp, Rattus norvegicus
ccgatgaggtcttgtaggctcagga

SEQ ID NO: 619191 - DNA, 25 bp, Rattus norvegicus
cgcgcacagaagcaggtgtggacca

SEQ ID NO: 619192 - DNA, 25 bp, Rattus norvegicus
agctggcgctgcgtctggctgaaga

SEQ ID NO: 619193 - DNA, 25 bp, Rattus norvegicus
cgaagggtggctgaagagcgaagtc

SEQ ID NO: 619194 - DNA, 25 bp, Rattus norvegicus
ctgaagagcgaagtcgcagggaaga

SEQ ID NO: 619195 - DNA, 25 bp, Rattus norvegicus
cagggaagaggaagcgcgcaggctg

SEQ ID NO: 619196 - DNA, 25 bp, Rattus norvegicus
aggaagcgcgcaggctggaagctga

SEQ ID NO: 619197 - DNA, 25 bp, Rattus norvegicus
aaggtgagtagggtgctgggcgcca

SEQ ID NO: 619198 - DNA, 25 bp, Rattus norvegicus
cgcaagagagaggagctggcgctgc

SEQ ID NO: 619199 - DNA, 25 bp, Rattus norvegicus
cgtctggctgaagaggagcgggagc

SEQ ID NO: 619200 - DNA, 25 bp, Rattus norvegicus
caggtgtggaccacggggtttgcgg

SEQ ID NO: 619201 - DNA, 25 bp, Rattus norvegicus
ctgggcgccatcgtggtctctgcct

SEQ ID NO: 619202 - DNA, 25 bp, Rattus norvegicus
gggcgccatcgtggtctctgcctgc

SEQ ID NO: 619203 - DNA, 25 bp, Rattus norvegicus
catcgtggtctctgcctgcctgccc

SEQ ID NO: 619204 - DNA, 25 bp, Rattus norvegicus
ctggaagctgagcaggcgcgcaaga

SEQ ID NO: 619205 - DNA, 25 bp, Rattus norvegicus
atccaggagagtgcgcccttcccgt

SEQ ID NO: 619206 - DNA, 25 bp, Rattus norvegicus
gctcctattagcttggtgcgcgcca

SEQ ID NO: 619207 - DNA, 25 bp, Rattus norvegicus
cgcttcggcgctcctattagcttgg

SEQ ID NO: 619208 - DNA, 25 bp, Rattus norvegicus
tcacattctcgtgcgaaggcgcttc

SEQ ID NO: 619209 - DNA, 25 bp, Rattus norvegicus
ccgtctttatccaatcacattctcg

SEQ ID NO: 619210 - DNA, 25 bp, Rattus norvegicus
agcatttcacgcaccgtggccggcg

SEQ ID NO: 619211 - DNA, 25 bp, Rattus norvegicus
gtgtcagcaggtcactggctaccgc

SEQ ID NO: 619212 - DNA, 25 bp, Rattus norvegicus
gcgcgcgtcagtgcgagtccctctg

SEQ ID NO: 619213 - DNA, 25 bp, Rattus norvegicus
agtcgcgcgcacagcgccctgaagt

SEQ ID NO: 619214 - DNA, 25 bp, Rattus norvegicus
aagccatcagggagcagcgggttcc

SEQ ID NO: 619215 - DNA, 25 bp, Rattus norvegicus
aactgccgcaggaactcttcctctg

SEQ ID NO: 619216 - DNA, 25 bp, Rattus norvegicus
ctcccgcagcatggtggcgcagtct

SEQ ID NO: 619217 - DNA, 25 bp, Rattus norvegicus
cctctgggagggcatcgtacctgcg

SEQ ID NO: 619218 - DNA, 25 bp, Rattus norvegicus
ctgcttccgcgtatccaggagagtg

SEQ ID NO: 619219 - DNA, 25 bp, Rattus norvegicus
tggcctggctcacaagcacacgggt

SEQ ID NO: 619220 - DNA, 25 bp, Rattus norvegicus
cggaagagtgctcggcagtgcacac

SEQ ID NO: 619221 - DNA, 25 bp, Rattus norvegicus
agtgctcggcagtgcacacagcgcg

SEQ ID NO: 619222 - DNA, 25 bp, Rattus norvegicus
cacaggcagctgagcctgcgcacta

SEQ ID NO: 619223 - DNA, 25 bp, Rattus norvegicus
tggtacaacaagctctcagcgcacc

SEQ ID NO: 619224 - DNA, 25 bp, Rattus norvegicus
cgtccgacaggcagtggtacaacaa

SEQ ID NO: 619225 - DNA, 25 bp, Rattus norvegicus
caagcacacgggtcggagaagtcac

SEQ ID NO: 619226 - DNA, 25 bp, Rattus norvegicus
agagcagcccaacgcgcagcagggc

SEQ ID NO: 619227 - DNA, 25 bp, Rattus norvegicus
ggcactgccagggacagagcagcca

SEQ ID NO: 619228 - DNA, 25 bp, Rattus norvegicus
tagcaacagaggcagggcactgcca

SEQ ID NO: 619229 - DNA, 25 bp, Rattus norvegicus
tgcaacccagtgacaggcgcgcagg

SEQ ID NO: 619230 - DNA, 25 bp, Rattus norvegicus
acaccgtgctgcaacccagtgacag

SEQ ID NO: 619231 - DNA, 25 bp, Rattus norvegicus
ctgcgcactagcaggcgacctgggt

SEQ ID NO: 619232 - DNA, 25 bp, Rattus norvegicus
gagaagtcaccctcggcgtccgaca

SEQ ID NO: 619233 - DNA, 25 bp, Rattus norvegicus
cgggcgtacattcccgctgggtcct

SEQ ID NO: 619234 - DNA, 25 bp, Rattus norvegicus
agcaaggcgggcgtacattcccgct

SEQ ID NO: 619235 - DNA, 25 bp, Rattus norvegicus
ctccggcggcgctggagacgggcac

SEQ ID NO: 619236 - DNA, 25 bp, Rattus norvegicus
acctgcctgggaggctccggccggg

SEQ ID NO: 619237 - DNA, 25 bp, Rattus norvegicus
tcctggcaggcggtatcttcagccc

SEQ ID NO: 619238 - DNA, 25 bp, Rattus norvegicus
ccctcatcctggcaggcggtatctt

SEQ ID NO: 619239 - DNA, 25 bp, Rattus norvegicus
gttacagctgcgatcctggctgccc

SEQ ID NO: 619240 - DNA, 25 bp, Rattus norvegicus
cctagagaccggctcgagctacaac

SEQ ID NO: 619241 - DNA, 25 bp, Rattus norvegicus
agggttacagctgcgatcctggctg

SEQ ID NO: 619242 - DNA, 25 bp, Rattus norvegicus
agagggttacagctgcgatcctggc

SEQ ID NO: 619243 - DNA, 25 bp, Rattus norvegicus
caaggcgggcgtacattcccgctgg

SEQ ID NO: 619244 - DNA, 25 bp, Rattus norvegicus
ggcagagggttacagctgcgatcct

SEQ ID NO: 619245 - DNA, 25 bp, Rattus norvegicus
ctcatcctggcaggcggtatcttca

SEQ ID NO: 619246 - DNA, 25 bp, Rattus norvegicus
ctagagaccggctcgagctacaacg

SEQ ID NO: 619247 - DNA, 25 bp, Rattus norvegicus
cgtctggttccctggcagttccggg

SEQ ID NO: 619248 - DNA, 25 bp, Rattus norvegicus
aaaagagcaggcctcagaccgcgcc

SEQ ID NO: 619249 - DNA, 25 bp, Rattus norvegicus
actctcgtaggacgcctctggtgga

SEQ ID NO: 619250 - DNA, 25 bp, Rattus norvegicus
gaccttagaactgccctcgccagtg

SEQ ID NO: 619251 - DNA, 25 bp, Rattus norvegicus
ggcgaaaacccacgggcactgcagt

SEQ ID NO: 619252 - DNA, 25 bp, Rattus norvegicus
cagtgcctcggatccgcggtcttct

SEQ ID NO: 619253 - DNA, 25 bp, Rattus norvegicus
cggtcttctggaggcgagccatcgt

SEQ ID NO: 619254 - DNA, 25 bp, Rattus norvegicus
tggaacctcggaaacagctaccgcc

SEQ ID NO: 619255 - DNA, 25 bp, Rattus norvegicus
agcaccgtcgacttgtgacccgcag

SEQ ID NO: 619256 - DNA, 25 bp, Rattus norvegicus
cgcagaatcactctggcctcgtcgg

SEQ ID NO: 619257 - DNA, 25 bp, Rattus norvegicus
cccacagaaagccaggtcagacaca

SEQ ID NO: 619258 - DNA, 25 bp, Rattus norvegicus
tcagacacagcagcgagggtcaggc

SEQ ID NO: 619259 - DNA, 25 bp, Rattus norvegicus
agccatcgtggtcagggtgaccctc

SEQ ID NO: 619260 - DNA, 25 bp, Rattus norvegicus
gaccgcgcctcggactctcgtagga

SEQ ID NO: 619261 - DNA, 25 bp, Rattus norvegicus
caatgaggctttctgtcccgagacc

SEQ ID NO: 619262 - DNA, 25 bp, Rattus norvegicus
tggcgctaaccttccattcctagtc

SEQ ID NO: 619263 - DNA, 25 bp, Rattus norvegicus
aactcgttccatgtcctagccaggg

SEQ ID NO: 619264 - DNA, 25 bp, Rattus norvegicus
agccgtactgggatgaactcgttcc

SEQ ID NO: 619265 - DNA, 25 bp, Rattus norvegicus
ccgagacagtcttgctggcccagca

SEQ ID NO: 619266 - DNA, 25 bp, Rattus norvegicus
ttgtcccgggtaatccgcagccatc

SEQ ID NO: 619267 - DNA, 25 bp, Rattus norvegicus
cgctggattgcagccggtgagtttt

SEQ ID NO: 619268 - DNA, 25 bp, Rattus norvegicus
cttttgcggccatcgctggattgca

SEQ ID NO: 619269 - DNA, 25 bp, Rattus norvegicus
atgtagatctctttccttttgcggc

SEQ ID NO: 619270 - DNA, 25 bp, Rattus norvegicus
cagaaccggaagtcgcatgtagatc

SEQ ID NO: 619271 - DNA, 25 bp, Rattus norvegicus
tcgcgagatctcgtgtcaacttaca

SEQ ID NO: 619272 - DNA, 25 bp, Rattus norvegicus
ttcgctccgagactctcgcgagatc

SEQ ID NO: 619273 - DNA, 25 bp, Rattus norvegicus
tccaagagatgacgtcagaaccctc

SEQ ID NO: 619274 - DNA, 25 bp, Rattus norvegicus
cagcatcagccagcgagccgtactg

SEQ ID NO: 619275 - DNA, 25 bp, Rattus norvegicus
gatggccctcgagaaccgaatatgg

SEQ ID NO: 619276 - DNA, 25 bp, Rattus norvegicus
actcctgtccctgcaagtgctactg

SEQ ID NO: 619277 - DNA, 25 bp, Rattus norvegicus
ggtgcttaactcctgtccctgcaag

SEQ ID NO: 619278 - DNA, 25 bp, Rattus norvegicus
ggccgcctttcgaggtgcttaactc

SEQ ID NO: 619279 - DNA, 25 bp, Rattus norvegicus
gaacagctcgacactggccgccttt

SEQ ID NO: 619280 - DNA, 25 bp, Rattus norvegicus
agctggggcctctaacaagggaaca

SEQ ID NO: 619281 - DNA, 25 bp, Rattus norvegicus
tgttatccgtgaagaagggacttct

SEQ ID NO: 619282 - DNA, 25 bp, Rattus norvegicus
cggtggtagcaacggaacctccaca

SEQ ID NO: 619283 - DNA, 25 bp, Rattus norvegicus
ccgaatatggctccggtgactgaca

SEQ ID NO: 619284 - DNA, 25 bp, Rattus norvegicus
agggacttctggagatggccctcga

SEQ ID NO: 619285 - DNA, 25 bp, Rattus norvegicus
gcaagtgctactgccgccatcaacg

SEQ ID NO: 619286 - DNA, 25 bp, Rattus norvegicus
cctctaacaagggaacagctcgaca

SEQ ID NO: 619287 - DNA, 25 bp, Rattus norvegicus
ggctccggtgactgacagcagcagt

SEQ ID NO: 619288 - DNA, 25 bp, Rattus norvegicus
ggaacctccacagctggggcctcta

SEQ ID NO: 619289 - DNA, 25 bp, Rattus norvegicus
ccagctcttctccacatttactaag

SEQ ID NO: 619290 - DNA, 25 bp, Rattus norvegicus
gattcgggctcttccggttccactc

SEQ ID NO: 619291 - DNA, 25 bp, Rattus norvegicus
tccggttccactcgtctttgagttg

SEQ ID NO: 619292 - DNA, 25 bp, Rattus norvegicus
tttgagttgctcgtacatgccggcc

SEQ ID NO: 619293 - DNA, 25 bp, Rattus norvegicus
acatgccggccgctgcctgtaggat

SEQ ID NO: 619294 - DNA, 25 bp, Rattus norvegicus
ctgcctgtaggatcccgcccgaggt

SEQ ID NO: 619295 - DNA, 25 bp, Rattus norvegicus
ggccgccatctttcgtgatgcagca

SEQ ID NO: 619296 - DNA, 25 bp, Rattus norvegicus
gtgatgcagcaaacagccgacctga

SEQ ID NO: 619297 - DNA, 25 bp, Rattus norvegicus
cgacctgatttacggcaacgacgcc

SEQ ID NO: 619298 - DNA, 25 bp, Rattus norvegicus
ggcaacgacgccgagcaatgctctc

SEQ ID NO: 619299 - DNA, 25 bp, Rattus norvegicus
ccgagcaatgctctcccggcggaag

SEQ ID NO: 619300 - DNA, 25 bp, Rattus norvegicus
aggcggagctacgactgctagcttc

SEQ ID NO: 619301 - DNA, 25 bp, Rattus norvegicus
tccacatttactaagattcgggctc

SEQ ID NO: 619302 - DNA, 25 bp, Rattus norvegicus
tacgactgctagcttctgcccacgg

SEQ ID NO: 619303 - DNA, 25 bp, Rattus norvegicus
ggtcctggctcaggtaccgagtgtt

SEQ ID NO: 619304 - DNA, 25 bp, Rattus norvegicus
gttgaagtagttcgaatcctcgctc

SEQ ID NO: 619305 - DNA, 25 bp, Rattus norvegicus
ctggctcaggtaccgagtgttgaag

SEQ ID NO: 619306 - DNA, 25 bp, Rattus norvegicus
gagcgccgagttttgctgtagattg

SEQ ID NO: 619307 - DNA, 25 bp, Rattus norvegicus
ccggagtgttgtagttcgaatcttc

SEQ ID NO: 619308 - DNA, 25 bp, Rattus norvegicus
cctggctcaggtaccgagtgttgaa

SEQ ID NO: 619309 - DNA, 25 bp, Rattus norvegicus
ctcgagcgccgagttttgctgtaga

SEQ ID NO: 619310 - DNA, 25 bp, Rattus norvegicus
ccgagtgttgaagtagttcgaatcc

SEQ ID NO: 619311 - DNA, 25 bp, Rattus norvegicus
ccgagttttgctgtagattgggtcc

SEQ ID NO: 619312 - DNA, 25 bp, Rattus norvegicus
gacccggagtgttgtagttcgaatc

SEQ ID NO: 619313 - DNA, 25 bp, Rattus norvegicus
ttgaagtagttcgaatcctcgctcc

SEQ ID NO: 619314 - DNA, 25 bp, Rattus norvegicus
tcctggctcaggtaccgagtgttga

SEQ ID NO: 619315 - DNA, 25 bp, Rattus norvegicus
tcagacccggagtgttgtagttcga

SEQ ID NO: 619316 - DNA, 25 bp, Rattus norvegicus
ggtcctgactcgagcgccgagtttt

SEQ ID NO: 619317 - DNA, 25 bp, Rattus norvegicus
gtggatgatggacggcgctcactta

SEQ ID NO: 619318 - DNA, 25 bp, Rattus norvegicus
gagggtggccgagccctttcttgcc

SEQ ID NO: 619319 - DNA, 25 bp, Rattus norvegicus
acctggtgtgtaggaacagggacac

SEQ ID NO: 619320 - DNA, 25 bp, Rattus norvegicus
ggcacgcccaaacacctggtgtgta

SEQ ID NO: 619321 - DNA, 25 bp, Rattus norvegicus
gaaactgaggcacgcccaaacacct

SEQ ID NO: 619322 - DNA, 25 bp, Rattus norvegicus
ttgcccgtcgttcctgtgggagtcg

SEQ ID NO: 619323 - DNA, 25 bp, Rattus norvegicus
gcggaacgccctgccactgggaaac

SEQ ID NO: 619324 - DNA, 25 bp, Rattus norvegicus
acggcgctcacttacccacggtggt

SEQ ID NO: 619325 - DNA, 25 bp, Rattus norvegicus
gctcacttacccacggtggtgacta

SEQ ID NO: 619326 - DNA, 25 bp, Rattus norvegicus
ctttcttgcccgtcgttcctgtggg

SEQ ID NO: 619327 - DNA, 25 bp, Rattus norvegicus
tccgcttttagttccgggagcttca

SEQ ID NO: 619328 - DNA, 25 bp, Rattus norvegicus
ttccgggagcttcaggcgcggccac

SEQ ID NO: 619329 - DNA, 25 bp, Rattus norvegicus
ttttagttccgggagcttcaggcgc

SEQ ID NO: 619330 - DNA, 25 bp, Rattus norvegicus
aacgccctgccactgggaaactgag

SEQ ID NO: 619331 - DNA, 25 bp, Rattus norvegicus
tcgacttccgcgctcaacactagga

SEQ ID NO: 619332 - DNA, 25 bp, Rattus norvegicus
gttcgcggtggtggcttctaagcat

SEQ ID NO: 619333 - DNA, 25 bp, Rattus norvegicus
cctggagtttctaggtgtgcacagc

SEQ ID NO: 619334 - DNA, 25 bp, Rattus norvegicus
cacgagatcccggacctggagtttc

SEQ ID NO: 619335 - DNA, 25 bp, Rattus norvegicus
caggtcagacggaggtcacgagatc

SEQ ID NO: 619336 - DNA, 25 bp, Rattus norvegicus
ttggcgaggtcactccaggtcagac

SEQ ID NO: 619337 - DNA, 25 bp, Rattus norvegicus
tctaagcatgcacgcgacaggtttg

SEQ ID NO: 619338 - DNA, 25 bp, Rattus norvegicus
ccattccgaactgcggctgtggcgt

SEQ ID NO: 619339 - DNA, 25 bp, Rattus norvegicus
taccattggggtgtggctacggaaa

SEQ ID NO: 619340 - DNA, 25 bp, Rattus norvegicus
aaatctattgggtcgctcggtacca

SEQ ID NO: 619341 - DNA, 25 bp, Rattus norvegicus
actcgcgccatcgtgaaatctattg

SEQ ID NO: 619342 - DNA, 25 bp, Rattus norvegicus
cagttcccgcctcttatgtaagcca

SEQ ID NO: 619343 - DNA, 25 bp, Rattus norvegicus
cgcgctcaacactaggaacgttttc

SEQ ID NO: 619344 - DNA, 25 bp, Rattus norvegicus
gtgcacagcgcagggatgccacgtc

SEQ ID NO: 619345 - DNA, 25 bp, Rattus norvegicus
tggctcaccttccaccttgtacggt

SEQ ID NO: 619346 - DNA, 25 bp, Rattus norvegicus
tcccagccaaggtgctcttgtagcc

SEQ ID NO: 619347 - DNA, 25 bp, Rattus norvegicus
tgcgcagccggtactcatgtactgg

SEQ ID NO: 619348 - DNA, 25 bp, Rattus norvegicus
aataaacctgatgggctcggcgcgg

SEQ ID NO: 619349 - DNA, 25 bp, Rattus norvegicus
tgcggctcaagatcctggcccaggc

SEQ ID NO: 619350 - DNA, 25 bp, Rattus norvegicus
aggtgctcttgtagccagctgcaca

SEQ ID NO: 619351 - DNA, 25 bp, Rattus norvegicus
acactcatctcgcttgaccagggcc

SEQ ID NO: 619352 - DNA, 25 bp, Rattus norvegicus
gtacggtgaactgccggcctggcct

SEQ ID NO: 619353 - DNA, 25 bp, Rattus norvegicus
ttccaccttgtacggtgaactgccg

SEQ ID NO: 619354 - DNA, 25 bp, Rattus norvegicus
ggtactcatgtactggctcaccttc

SEQ ID NO: 619355 - DNA, 25 bp, Rattus norvegicus
catgtacttgactatggcggtggcg

SEQ ID NO: 619356 - DNA, 25 bp, Rattus norvegicus
ccagctgcgcatgtacttgactatg

SEQ ID NO: 619357 - DNA, 25 bp, Rattus norvegicus
tcggaaccagctgcgcatgtacttg

SEQ ID NO: 619358 - DNA, 25 bp, Rattus norvegicus
tgcacacccgcaacaataaacctga

SEQ ID NO: 619359 - DNA, 25 bp, Rattus norvegicus
ggaggggcctgcctagatatttagc

SEQ ID NO: 619360 - DNA, 25 bp, Rattus norvegicus
cccggctcgttaagtgcagttcaca

SEQ ID NO: 619361 - DNA, 25 bp, Rattus norvegicus
cagttcacaagaagggcgacacttt

SEQ ID NO: 619362 - DNA, 25 bp, Rattus norvegicus
ctctttaggacaaggccgagaagtc

SEQ ID NO: 619363 - DNA, 25 bp, Rattus norvegicus
agtcagcacctaagagcggcccttc

SEQ ID NO: 619364 - DNA, 25 bp, Rattus norvegicus
tgccggctacatcttctcgcgagac

SEQ ID NO: 619365 - DNA, 25 bp, Rattus norvegicus
ttgggctacagctcaacagcggttc

SEQ ID NO: 619366 - DNA, 25 bp, Rattus norvegicus
ctccttctggagtcgggaaatggcc

SEQ ID NO: 619367 - DNA, 25 bp, Rattus norvegicus
aggtaaatcctgagaatcgtgcttc

SEQ ID NO: 619368 - DNA, 25 bp, Rattus norvegicus
taggccttgcgctgcattccagtca

SEQ ID NO: 619369 - DNA, 25 bp, Rattus norvegicus
caggaccgttgggtgttgagaactc

SEQ ID NO: 619370 - DNA, 25 bp, Rattus norvegicus
cggagccgttacttgtgcgttttca

SEQ ID NO: 619371 - DNA, 25 bp, Rattus norvegicus
gcgttttcatcgtcacctcctcggg

SEQ ID NO: 619372 - DNA, 25 bp, Rattus norvegicus
tgcgcacgcgtgcttttttcctttc

SEQ ID NO: 619373 - DNA, 25 bp, Rattus norvegicus
tgggcatctgccacgacgtcattgc

SEQ ID NO: 619374 - DNA, 25 bp, Rattus norvegicus
gttctcgcttttccgtgtgggcatc

SEQ ID NO: 619375 - DNA, 25 bp, Rattus norvegicus
ggcgtggtcagcattggtcccgccc

SEQ ID NO: 619376 - DNA, 25 bp, Rattus norvegicus
tggctctgtcgcctgcacctggcag

SEQ ID NO: 619377 - DNA, 25 bp, Rattus norvegicus
agcgcagagggcctgcacctggctc

SEQ ID NO: 619378 - DNA, 25 bp, Rattus norvegicus
ctgggacacaggagaagttggcacc

SEQ ID NO: 619379 - DNA, 25 bp, Rattus norvegicus
gcctccacccgttggaggggcgcta

SEQ ID NO: 619380 - DNA, 25 bp, Rattus norvegicus
acgtcattgcgccttcgtgctttcg

SEQ ID NO: 619381 - DNA, 25 bp, Rattus norvegicus
gctcacatagctgcgccataacctg

SEQ ID NO: 619382 - DNA, 25 bp, Rattus norvegicus
ccctttttctggcttttggcgcgtg

SEQ ID NO: 619383 - DNA, 25 bp, Rattus norvegicus
acgtctaggtctctgctggccgcct

SEQ ID NO: 619384 - DNA, 25 bp, Rattus norvegicus
gccctcaccgtggacgtctaggtct

SEQ ID NO: 619385 - DNA, 25 bp, Rattus norvegicus
gtgcgacgccttagttgcctcccaa

SEQ ID NO: 619386 - DNA, 25 bp, Rattus norvegicus
ccggagagaagcagcgaggctaaca

SEQ ID NO: 619387 - DNA, 25 bp, Rattus norvegicus
cccaagcgcaagacagagcgtaaag

SEQ ID NO: 619388 - DNA, 25 bp, Rattus norvegicus
ttcgctaccgccagagggcgtaaca

SEQ ID NO: 619389 - DNA, 25 bp, Rattus norvegicus
ggacccagaggtcgaagcctgcaca

SEQ ID NO: 619390 - DNA, 25 bp, Rattus norvegicus
ggtcgaagcctgcacattagcctgc

SEQ ID NO: 619391 - DNA, 25 bp, Rattus norvegicus
gcacattagcctgcacgtctctgta

SEQ ID NO: 619392 - DNA, 25 bp, Rattus norvegicus
cctgcacgtctctgtaggaagggaa

SEQ ID NO: 619393 - DNA, 25 bp, Rattus norvegicus
gcccgttagagacccaagcgcaaga

SEQ ID NO: 619394 - DNA, 25 bp, Rattus norvegicus
cagagcgtaaagtgcagacagcgga

SEQ ID NO: 619395 - DNA, 25 bp, Rattus norvegicus
cgcgtgctgagcaagctgcagtccc

SEQ ID NO: 619396 - DNA, 25 bp, Rattus norvegicus
ccctagtgggctgcagaagcggcac

SEQ ID NO: 619397 - DNA, 25 bp, Rattus norvegicus
tgcagaagcggcacgcgcgagtcac

SEQ ID NO: 619398 - DNA, 25 bp, Rattus norvegicus
acgcgcgagtcaccgtcaaatacga

SEQ ID NO: 619399 - DNA, 25 bp, Rattus norvegicus
gacggacgcttggaagagctgtacc

SEQ ID NO: 619400 - DNA, 25 bp, Rattus norvegicus
cgtcaaatacgaccggcgagagctg

SEQ ID NO: 619401 - DNA, 25 bp, Rattus norvegicus
gaattccctccctttcggtctgtgc

SEQ ID NO: 619402 - DNA, 25 bp, Rattus norvegicus
acccggccgcctgggtctgaggcta

SEQ ID NO: 619403 - DNA, 25 bp, Rattus norvegicus
atactctctgagtgctggctgcctg

SEQ ID NO: 619404 - DNA, 25 bp, Rattus norvegicus
tctctccctgcaggagagcggcact

SEQ ID NO: 619405 - DNA, 25 bp, Rattus norvegicus
acagccggctccgagtgacaggagc

SEQ ID NO: 619406 - DNA, 25 bp, Rattus norvegicus
ctttcccaggcggtgacagccggct

SEQ ID NO: 619407 - DNA, 25 bp, Rattus norvegicus
cggatgccagcttcacctctttata

SEQ ID NO: 619408 - DNA, 25 bp, Rattus norvegicus
ctcctcgcttttttgccatcggatg

SEQ ID NO: 619409 - DNA, 25 bp, Rattus norvegicus
cggtctgtgctatactctctgagtg

SEQ ID NO: 619410 - DNA, 25 bp, Rattus norvegicus
gagcgccctccctctccgggaattc

SEQ ID NO: 619411 - DNA, 25 bp, Rattus norvegicus
catccctttggggaccggtgcctcg

SEQ ID NO: 619412 - DNA, 25 bp, Rattus norvegicus
cgcccatacccatctaatgcgagca

SEQ ID NO: 619413 - DNA, 25 bp, Rattus norvegicus
ggtcggctcggaccgcggcattcct

SEQ ID NO: 619414 - DNA, 25 bp, Rattus norvegicus
ttgccatcggatgccagcttcacct

SEQ ID NO: 619415 - DNA, 25 bp, Rattus norvegicus
gcctccgcagactagctcgggtaaa

SEQ ID NO: 619416 - DNA, 25 bp, Rattus norvegicus
tcctggcatccgtacagcgctgggc

SEQ ID NO: 619417 - DNA, 25 bp, Rattus norvegicus
gcagtttccggacggtcctggcatc

SEQ ID NO: 619418 - DNA, 25 bp, Rattus norvegicus
gccagaatcctaacttccttcacga

SEQ ID NO: 619419 - DNA, 25 bp, Rattus norvegicus
ctcgggtaaaggtgctccagctccc

SEQ ID NO: 619420 - DNA, 25 bp, Rattus norvegicus
cgctgcgttccagggacccgagtgt

SEQ ID NO: 619421 - DNA, 25 bp, Rattus norvegicus
gctcggctgtagctcttgagagtcc

SEQ ID NO: 619422 - DNA, 25 bp, Rattus norvegicus
tcccattggctgaggagccggctct

SEQ ID NO: 619423 - DNA, 25 bp, Rattus norvegicus
ccaaaccggttctagtagaggctga

SEQ ID NO: 619424 - DNA, 25 bp, Rattus norvegicus
atttcaagacttggagccggggtga

SEQ ID NO: 619425 - DNA, 25 bp, Rattus norvegicus
ggcaccctcccaatttcaagacttg

SEQ ID NO: 619426 - DNA, 25 bp, Rattus norvegicus
atgacctgggctagaggacgatcgc

SEQ ID NO: 619427 - DNA, 25 bp, Rattus norvegicus
ctgtggtcaggcaaacagagatgac

SEQ ID NO: 619428 - DNA, 25 bp, Rattus norvegicus
gctaccttgccacgctcattcttag

SEQ ID NO: 619429 - DNA, 25 bp, Rattus norvegicus
agtaatgcgcctgaagtcctatcgg

SEQ ID NO: 619430 - DNA, 25 bp, Rattus norvegicus
caggcccagaaagcttaagtaatgc

SEQ ID NO: 619431 - DNA, 25 bp, Rattus norvegicus
agcttaagtaatgcgcctgaagtcc

SEQ ID NO: 619432 - DNA, 25 bp, Rattus norvegicus
tctctcagtcacgatggattctcta

SEQ ID NO: 619433 - DNA, 25 bp, Rattus norvegicus
tcgagacaggcccagaaagcttaag

SEQ ID NO: 619434 - DNA, 25 bp, Rattus norvegicus
gtcacgatggattctctagagtttg

SEQ ID NO: 619435 - DNA, 25 bp, Rattus norvegicus
agtcctatcggcgaggatttgaacc

SEQ ID NO: 619436 - DNA, 25 bp, Rattus norvegicus
agagttatctctcagtcacgatgga

SEQ ID NO: 619437 - DNA, 25 bp, Rattus norvegicus
aggtggccgcgagagttatctctca

SEQ ID NO: 619438 - DNA, 25 bp, Rattus norvegicus
aatgacggcagttctgtagtgaggt

SEQ ID NO: 619439 - DNA, 25 bp, Rattus norvegicus
cccaagaagaatgacggcagttctg

SEQ ID NO: 619440 - DNA, 25 bp, Rattus norvegicus
atttgaacccaagaagaatgacggc

SEQ ID NO: 619441 - DNA, 25 bp, Rattus norvegicus
tatcggcgaggatttgaacccaaga

SEQ ID NO: 619442 - DNA, 25 bp, Rattus norvegicus
tctctagagtttggagtgccaggtg

SEQ ID NO: 619443 - DNA, 25 bp, Rattus norvegicus
tggcaagaatggtgtacgacgcgtt

SEQ ID NO: 619444 - DNA, 25 bp, Rattus norvegicus
aagaatggtgtacgacgcgttgctc

SEQ ID NO: 619445 - DNA, 25 bp, Rattus norvegicus
gcaagaatggtgtacgacgcgttgc

SEQ ID NO: 619446 - DNA, 25 bp, Rattus norvegicus
tctggcaagaatggtgtacgacgcg

SEQ ID NO: 619447 - DNA, 25 bp, Rattus norvegicus
acgcgttgctcctggacgggtggag

SEQ ID NO: 619448 - DNA, 25 bp, Rattus norvegicus
tacgacgcgttgctcctggacgggt

SEQ ID NO: 619449 - DNA, 25 bp, Rattus norvegicus
gtctggcaagaatggtgtacgacgc

SEQ ID NO: 619450 - DNA, 25 bp, Rattus norvegicus
tgtacgacgcgttgctcctggacgg

SEQ ID NO: 619451 - DNA, 25 bp, Rattus norvegicus
gtgtatgtgactgtgggtgtctggc

SEQ ID NO: 619452 - DNA, 25 bp, Rattus norvegicus
gaatggtgtacgacgcgttgctcct

SEQ ID NO: 619453 - DNA, 25 bp, Rattus norvegicus
agaatggtgtacgacgcgttgctcc

SEQ ID NO: 619454 - DNA, 25 bp, Rattus norvegicus
ggtgtacgacgcgttgctcctggac

SEQ ID NO: 619455 - DNA, 25 bp, Rattus norvegicus
aatggtgtacgacgcgttgctcctg

SEQ ID NO: 619456 - DNA, 25 bp, Rattus norvegicus
gtgtctggcaagaatggtgtacgac

SEQ ID NO: 619457 - DNA, 25 bp, Rattus norvegicus
tcagaccggcgtggctcagaacaac

SEQ ID NO: 619458 - DNA, 25 bp, Rattus norvegicus
acttctaccgggaggccatcgagca

SEQ ID NO: 619459 - DNA, 25 bp, Rattus norvegicus
aggccatcgagcactgccgcagcta

SEQ ID NO: 619460 - DNA, 25 bp, Rattus norvegicus
agcactgccgcagctacaacgcgcg

SEQ ID NO: 619461 - DNA, 25 bp, Rattus norvegicus
ttcctcgactctcagaccggcgtgg

SEQ ID NO: 619462 - DNA, 25 bp, Rattus norvegicus
cgaggacttctaccgggaggccatc

SEQ ID NO: 619463 - DNA, 25 bp, Rattus norvegicus
ggcgtggctcagaacaactgctaca

SEQ ID NO: 619464 - DNA, 25 bp, Rattus norvegicus
tggctcagaacaactgctacatctg

SEQ ID NO: 619465 - DNA, 25 bp, Rattus norvegicus
agaacaactgctacatctggatgga

SEQ ID NO: 619466 - DNA, 25 bp, Rattus norvegicus
tgctacatctggatggagaagaccc

SEQ ID NO: 619467 - DNA, 25 bp, Rattus norvegicus
atggagaagacccaccgcgggcctg

SEQ ID NO: 619468 - DNA, 25 bp, Rattus norvegicus
cgcagccttggcgaggacttctacc

SEQ ID NO: 619469 - DNA, 25 bp, Rattus norvegicus
tgggcctcctcgcaccagcccttgc

SEQ ID NO: 619470 - DNA, 25 bp, Rattus norvegicus
aacgcgcgcctgtgtgccgagcgca

SEQ ID NO: 619471 - DNA, 25 bp, Rattus norvegicus
tcgatggaggacgtgctgccatact

SEQ ID NO: 619472 - DNA, 25 bp, Rattus norvegicus
cacccgcaggagctcactgaggttc

SEQ ID NO: 619473 - DNA, 25 bp, Rattus norvegicus
gagctcactgaggttctgggagccc

SEQ ID NO: 619474 - DNA, 25 bp, Rattus norvegicus
agcctctggctgctcgctgcggaac

SEQ ID NO: 619475 - DNA, 25 bp, Rattus norvegicus
ctcattgaggatgtcgaagaaactc

SEQ ID NO: 619476 - DNA, 25 bp, Rattus norvegicus
atgtcgaagaaactctgctctggta

SEQ ID NO: 619477 - DNA, 25 bp, Rattus norvegicus
ggtctccgggttcctctacatcaca

SEQ ID NO: 619478 - DNA, 25 bp, Rattus norvegicus
gacgtgctgccatactctcggaaga

SEQ ID NO: 619479 - DNA, 25 bp, Rattus norvegicus
ccatactctcggaagaggggcagca

SEQ ID NO: 619480 - DNA, 25 bp, Rattus norvegicus
ctgctgctccgatgccgaagaggga

SEQ ID NO: 619481 - DNA, 25 bp, Rattus norvegicus
ctcactgagggtgatctcgctgctg

SEQ ID NO: 619482 - DNA, 25 bp, Rattus norvegicus
gaaactctgctctggtacgccctgc

SEQ ID NO: 619483 - DNA, 25 bp, Rattus norvegicus
ctctacatcacactcactgagggtg

SEQ ID NO: 619484 - DNA, 25 bp, Rattus norvegicus
tacgccctgcacgtcgatggaggac

SEQ ID NO: 619485 - DNA, 25 bp, Rattus norvegicus
cagggtggccgaagcagcaaactcg

SEQ ID NO: 619486 - DNA, 25 bp, Rattus norvegicus
ctcgcttgcggggatacataccagt

SEQ ID NO: 619487 - DNA, 25 bp, Rattus norvegicus
gcaaactcgggcacgatgaccgtgg

SEQ ID NO: 619488 - DNA, 25 bp, Rattus norvegicus
atacataccagtggggtcagccggg

SEQ ID NO: 619489 - DNA, 25 bp, Rattus norvegicus
acatctgacctagaggccgggcagc

SEQ ID NO: 619490 - DNA, 25 bp, Rattus norvegicus
gaaagccggggacacatctgaccta

SEQ ID NO: 619491 - DNA, 25 bp, Rattus norvegicus
cccgcagacctgaggagctgaaagc

SEQ ID NO: 619492 - DNA, 25 bp, Rattus norvegicus
ttggagatacccagtgcagaacctc

SEQ ID NO: 619493 - DNA, 25 bp, Rattus norvegicus
ggccgcgatttgcatcttggagata

SEQ ID NO: 619494 - DNA, 25 bp, Rattus norvegicus
gtgcggtttacgtgctacacctaaa

SEQ ID NO: 619495 - DNA, 25 bp, Rattus norvegicus
cggggaccttttctgaggatccctg

SEQ ID NO: 619496 - DNA, 25 bp, Rattus norvegicus
tgcgtcctacgctcttctccgggga

SEQ ID NO: 619497 - DNA, 25 bp, Rattus norvegicus
tggtcccggtgcttctgcgtcctac

SEQ ID NO: 619498 - DNA, 25 bp, Rattus norvegicus
gctgctgcagtctgtctcgcttgcg

SEQ ID NO: 619499 - DNA, 25 bp, Rattus norvegicus
cggggagaaaccctacgactgcaag

SEQ ID NO: 619500 - DNA, 25 bp, Rattus norvegicus
tggcgcacctcactcggcatcagag

SEQ ID NO: 619501 - DNA, 25 bp, Rattus norvegicus
ggacagctcagcctccaccagagga

SEQ ID NO: 619502 - DNA, 25 bp, Rattus norvegicus
ttcgggtgcggcagcagctcaccct

SEQ ID NO: 619503 - DNA, 25 bp, Rattus norvegicus
gaagccctacgggtgcaccgagtgc

SEQ ID NO: 619504 - DNA, 25 bp, Rattus norvegicus
agcttccggcaggtggcgcacctca

SEQ ID NO: 619505 - DNA, 25 bp, Rattus norvegicus
actcggcatcagaggctcaacggcg

SEQ ID NO: 619506 - DNA, 25 bp, Rattus norvegicus
ctcgcgccacgagtgcaaggagtgc

SEQ ID NO: 619507 - DNA, 25 bp, Rattus norvegicus
cggccaggctttcctgtgcagcacg

SEQ ID NO: 619508 - DNA, 25 bp, Rattus norvegicus
aaggccttccgagtccgaggacagc

SEQ ID NO: 619509 - DNA, 25 bp, Rattus norvegicus
tgcatcacaagctgcacaccgggga

SEQ ID NO: 619510 - DNA, 25 bp, Rattus norvegicus
ttcgactgcaaggagtgcggcaaga

SEQ ID NO: 619511 - DNA, 25 bp, Rattus norvegicus
agctcaccctgcacgagaggatcca

SEQ ID NO: 619512 - DNA, 25 bp, Rattus norvegicus
gggcctccggctgcatcacaagctg

SEQ ID NO: 619513 - DNA, 25 bp, Rattus norvegicus
ggtttgtgtcgacaagtgctccgta

SEQ ID NO: 619514 - DNA, 25 bp, Rattus norvegicus
gcagaacgccgcttcacttccgttt

SEQ ID NO: 619515 - DNA, 25 bp, Rattus norvegicus
acttccgtttcctcgcgagacttcg

SEQ ID NO: 619516 - DNA, 25 bp, Rattus norvegicus
tactagtgtcgcgagaggtttgtgt

SEQ ID NO: 619517 - DNA, 25 bp, Rattus norvegicus
aagtgctccgtaggcacccagtgga

SEQ ID NO: 619518 - DNA, 25 bp, Rattus norvegicus
ccagtggagcaggttgactgaagtc

SEQ ID NO: 619519 - DNA, 25 bp, Rattus norvegicus
gcgggaccctgaacttcgctgcgga

SEQ ID NO: 619520 - DNA, 25 bp, Rattus norvegicus
cctgaacttcgctgcggaggtgaga

SEQ ID NO: 619521 - DNA, 25 bp, Rattus norvegicus
cctggaggacgtgtctgtggcatta

SEQ ID NO: 619522 - DNA, 25 bp, Rattus norvegicus
cattaggtggcggtgtctcccatgt

SEQ ID NO: 619523 - DNA, 25 bp, Rattus norvegicus
cggtgtctcccatgtgtacgatgca

SEQ ID NO: 619524 - DNA, 25 bp, Rattus norvegicus
tgtgtacgatgcaaacctgtgtttc

SEQ ID NO: 619525 - DNA, 25 bp, Rattus norvegicus
aaacctgtgtttcggagcctgtagc

SEQ ID NO: 619526 - DNA, 25 bp, Rattus norvegicus
cgcgagacttcgaggtactagtgtc

SEQ ID NO: 619527 - DNA, 25 bp, Rattus norvegicus
cccgctttgcgtctagagagtttcc

SEQ ID NO: 619528 - DNA, 25 bp, Rattus norvegicus
cgtgcaatgcaacgggacggtgagt

SEQ ID NO: 619529 - DNA, 25 bp, Rattus norvegicus
cgctttcctggtgcggctattggtt

SEQ ID NO: 619530 - DNA, 25 bp, Rattus norvegicus
tccggtacgaagttgcttggcggct

SEQ ID NO: 619531 - DNA, 25 bp, Rattus norvegicus
agtggcacaggctccgtgaggcctt

SEQ ID NO: 619532 - DNA, 25 bp, Rattus norvegicus
ctccgtgaggccttggcttccggtc

SEQ ID NO: 619533 - DNA, 25 bp, Rattus norvegicus
cacgttgtgcttgcgctttcctggt

SEQ ID NO: 619534 - DNA, 25 bp, Rattus norvegicus
aaaactgggcgcacgttgtgcttgc

SEQ ID NO: 619535 - DNA, 25 bp, Rattus norvegicus
agcggttccggtacgaagttgcttg

SEQ ID NO: 619536 - DNA, 25 bp, Rattus norvegicus
ccgccaagcttgagagtcgaggctg

SEQ ID NO: 619537 - DNA, 25 bp, Rattus norvegicus
gttccggcccgccaagcttgagagt

SEQ ID NO: 619538 - DNA, 25 bp, Rattus norvegicus
gcgtcctctagcctcgtccaatggg

SEQ ID NO: 619539 - DNA, 25 bp, Rattus norvegicus
gttcttggccttccaatcacaggcg

SEQ ID NO: 619540 - DNA, 25 bp, Rattus norvegicus
gcggctattggttcttggccttcca

SEQ ID NO: 619541 - DNA, 25 bp, Rattus norvegicus
gcgggttctgtagcagcggcttccc

SEQ ID NO: 619542 - DNA, 25 bp, Rattus norvegicus
tgctggctctacagggcccgggctc

SEQ ID NO: 619543 - DNA, 25 bp, Rattus norvegicus
aggtctggccttctgtgtgcgagcc

SEQ ID NO: 619544 - DNA, 25 bp, Rattus norvegicus
acgcagggtagcacttcccagaggg

SEQ ID NO: 619545 - DNA, 25 bp, Rattus norvegicus
tccgttagacgcagggtagcacttc

SEQ ID NO: 619546 - DNA, 25 bp, Rattus norvegicus
cacaaacctgggtccgttagacgca

SEQ ID NO: 619547 - DNA, 25 bp, Rattus norvegicus
taccgcccagcactactaggctggg

SEQ ID NO: 619548 - DNA, 25 bp, Rattus norvegicus
gggctcacggcttccggggactcac

SEQ ID NO: 619549 - DNA, 25 bp, Rattus norvegicus
agagttctggcctccgggctcacgg

SEQ ID NO: 619550 - DNA, 25 bp, Rattus norvegicus
acagtcgcatcacggccgctgcaaa

SEQ ID NO: 619551 - DNA, 25 bp, Rattus norvegicus
acccagcacaaagagttctggcctc

SEQ ID NO: 619552 - DNA, 25 bp, Rattus norvegicus
gagcaaattacagtcgcatcacggc

SEQ ID NO: 619553 - DNA, 25 bp, Rattus norvegicus
gggctcccacccagcacaaagagtt

SEQ ID NO: 619554 - DNA, 25 bp, Rattus norvegicus
gggagaagctgcacaaacctgggtc

SEQ ID NO: 619555 - DNA, 25 bp, Rattus norvegicus
taggctcagccacctaggcgccttg

SEQ ID NO: 619556 - DNA, 25 bp, Rattus norvegicus
cctgtgctctgggacataacgggca

SEQ ID NO: 619557 - DNA, 25 bp, Rattus norvegicus
gctcggagtagctcggagtagcttt

SEQ ID NO: 619558 - DNA, 25 bp, Rattus norvegicus
tcggagtagctttgcggagtgctct

SEQ ID NO: 619559 - DNA, 25 bp, Rattus norvegicus
ccctctgagtctgtggacttggctg

SEQ ID NO: 619560 - DNA, 25 bp, Rattus norvegicus
aacgggcacgcgctgccctctgagt

SEQ ID NO: 619561 - DNA, 25 bp, Rattus norvegicus
ggtccttctgggagcacctgtgctc

SEQ ID NO: 619562 - DNA, 25 bp, Rattus norvegicus
acctaggcgccttgggctatcactc

SEQ ID NO: 619563 - DNA, 25 bp, Rattus norvegicus
ggttgcctgcatgtagtgtctctga

SEQ ID NO: 619564 - DNA, 25 bp, Rattus norvegicus
tctcgcggcgctaataggctcagcc

SEQ ID NO: 619565 - DNA, 25 bp, Rattus norvegicus
gggtcctgcagctgctcacgtccag

SEQ ID NO: 619566 - DNA, 25 bp, Rattus norvegicus
tgctctccgctagaaggcggtactc

SEQ ID NO: 619567 - DNA, 25 bp, Rattus norvegicus
tattcccgaaaagacgggtcctgca

SEQ ID NO: 619568 - DNA, 25 bp, Rattus norvegicus
tcaagccaagctctgaccggaagtt

SEQ ID NO: 619569 - DNA, 25 bp, Rattus norvegicus
tgaagccgttcacgccgtgcctgac

SEQ ID NO: 619570 - DNA, 25 bp, Rattus norvegicus
tgactccacgacttggcgcgctgtt

SEQ ID NO: 619571 - DNA, 25 bp, Rattus norvegicus
tgctctacctaaggcacgaggctcc

SEQ ID NO: 619572 - DNA, 25 bp, Rattus norvegicus
aagactagatttgcgcgggtcggaa

SEQ ID NO: 619573 - DNA, 25 bp, Rattus norvegicus
gagcgccaccgccaaagactagatt

SEQ ID NO: 619574 - DNA, 25 bp, Rattus norvegicus
ccgccaagttttactcacgtgaagc

SEQ ID NO: 619575 - DNA, 25 bp, Rattus norvegicus
cgaactcaggtaagaacccgccaag

SEQ ID NO: 619576 - DNA, 25 bp, Rattus norvegicus
ccacaccagggagcgaactcaggta

SEQ ID NO: 619577 - DNA, 25 bp, Rattus norvegicus
gtgagcaatggaaccacaccaggga

SEQ ID NO: 619578 - DNA, 25 bp, Rattus norvegicus
aggcacgaggctccagctggaccca

SEQ ID NO: 619579 - DNA, 25 bp, Rattus norvegicus
ctgacggggaaaacgacacggcctg

SEQ ID NO: 619580 - DNA, 25 bp, Rattus norvegicus
acacggcctggattcggtttgaatg

SEQ ID NO: 619581 - DNA, 25 bp, Rattus norvegicus
gcgctccagaaggatgctctaccta

SEQ ID NO: 619582 - DNA, 25 bp, Rattus norvegicus
cgcgctgttgcgtcatccatgagcg

SEQ ID NO: 619583 - DNA, 25 bp, Rattus norvegicus
cacctcttggaacagacgggcgcta

SEQ ID NO: 619584 - DNA, 25 bp, Rattus norvegicus
aaactggtccgccgcagcggagtgc

SEQ ID NO: 619585 - DNA, 25 bp, Rattus norvegicus
ccatggtgggagaaactggtccgcc

SEQ ID NO: 619586 - DNA, 25 bp, Rattus norvegicus
agtccatggtgggagaaactggtcc

SEQ ID NO: 619587 - DNA, 25 bp, Rattus norvegicus
aaatgtagtccatggtgggagaaac

SEQ ID NO: 619588 - DNA, 25 bp, Rattus norvegicus
tcttggaacagacgggcgctaggca

SEQ ID NO: 619589 - DNA, 25 bp, Rattus norvegicus
gcacgcggtgtccactcagcgccac

SEQ ID NO: 619590 - DNA, 25 bp, Rattus norvegicus
tgaccgactcacctcttggaacaga

SEQ ID NO: 619591 - DNA, 25 bp, Rattus norvegicus
tgcaagtgaccgactcacctcttgg

SEQ ID NO: 619592 - DNA, 25 bp, Rattus norvegicus
tcaatgcaagtgaccgactcacctc

SEQ ID NO: 619593 - DNA, 25 bp, Rattus norvegicus
gcgcccatttcctcaatgcaagtga

SEQ ID NO: 619594 - DNA, 25 bp, Rattus norvegicus
agtctctcaaaccaactgaaagcca

SEQ ID NO: 619595 - DNA, 25 bp, Rattus norvegicus
cgactcacctcttggaacagacggg

SEQ ID NO: 619596 - DNA, 25 bp, Rattus norvegicus
ctcagcgccacggactccaagtctc

SEQ ID NO: 619597 - DNA, 25 bp, Rattus norvegicus
cccaaggcgcggcactagtctgagg

SEQ ID NO: 619598 - DNA, 25 bp, Rattus norvegicus
tgcagcgccttcactacgttcagag

SEQ ID NO: 619599 - DNA, 25 bp, Rattus norvegicus
cttcactacgttcagaggaccggga

SEQ ID NO: 619600 - DNA, 25 bp, Rattus norvegicus
acctgggcaacttcgcgcgcacaat

SEQ ID NO: 619601 - DNA, 25 bp, Rattus norvegicus
aggtgacacccgctgcgtcttcaga

SEQ ID NO: 619602 - DNA, 25 bp, Rattus norvegicus
cctcgagggccttacagggcaatgc

SEQ ID NO: 619603 - DNA, 25 bp, Rattus norvegicus
cgcaggaacccaaggcgcggcacta

SEQ ID NO: 619604 - DNA, 25 bp, Rattus norvegicus
cgtcttcagaccctcgagggcctta

SEQ ID NO: 619605 - DNA, 25 bp, Rattus norvegicus
tgtgctattccgatgccctgccacg

SEQ ID NO: 619606 - DNA, 25 bp, Rattus norvegicus
gtcgctgtgctattccgatgccctg

SEQ ID NO: 619607 - DNA, 25 bp, Rattus norvegicus
ctggccgcactcagtcgctgtgcta

SEQ ID NO: 619608 - DNA, 25 bp, Rattus norvegicus
ttcgcgcgcacaatcgctctgcacc

SEQ ID NO: 619609 - DNA, 25 bp, Rattus norvegicus
attcacgcgcacaaaagccgtcgcg

SEQ ID NO: 619610 - DNA, 25 bp, Rattus norvegicus
agcaggcacagctcgccgcgctgtt

SEQ ID NO: 619611 - DNA, 25 bp, Rattus norvegicus
ttccaagcttcccaagccgtgcaat

SEQ ID NO: 619612 - DNA, 25 bp, Rattus norvegicus
tgaggatacacggaaccctgtatcc

SEQ ID NO: 619613 - DNA, 25 bp, Rattus norvegicus
cccaaatcgaaatgaggatacacgg

SEQ ID NO: 619614 - DNA, 25 bp, Rattus norvegicus
tgtcgcggacgagctgatgacaccc

SEQ ID NO: 619615 - DNA, 25 bp, Rattus norvegicus
tagtccgaggcaccgcggcggacaa

SEQ ID NO: 619616 - DNA, 25 bp, Rattus norvegicus
gaaatgtagtccgaggcaccgcggc

SEQ ID NO: 619617 - DNA, 25 bp, Rattus norvegicus
gaagccataggagcattctgggaaa

SEQ ID NO: 619618 - DNA, 25 bp, Rattus norvegicus
ttttaccgcgagaagccataggagc

SEQ ID NO: 619619 - DNA, 25 bp, Rattus norvegicus
ccgtgctcatgattttaccgcgaga

SEQ ID NO: 619620 - DNA, 25 bp, Rattus norvegicus
ctcttgccagcaaagctatgaggtc

SEQ ID NO: 619621 - DNA, 25 bp, Rattus norvegicus
agctgcacaattccgacttcaactc

SEQ ID NO: 619622 - DNA, 25 bp, Rattus norvegicus
tgctcacaaaatagctgcacaattc

SEQ ID NO: 619623 - DNA, 25 bp, Rattus norvegicus
gccgcgatcagtgctcacaaaatag

SEQ ID NO: 619624 - DNA, 25 bp, Rattus norvegicus
aagctatgaggtcacaccgtgctca

SEQ ID NO: 619625 - DNA, 25 bp, Rattus norvegicus
gccacagaccctcgcgagcagctga

SEQ ID NO: 619626 - DNA, 25 bp, Rattus norvegicus
gagcagctgactcccaccggcggca

SEQ ID NO: 619627 - DNA, 25 bp, Rattus norvegicus
cagccaaggggacgctggtgcaagc

SEQ ID NO: 619628 - DNA, 25 bp, Rattus norvegicus
agaggcgcgcaacaactaacgggtc

SEQ ID NO: 619629 - DNA, 25 bp, Rattus norvegicus
ggcgcgcaacaactaacgggtcgcc

SEQ ID NO: 619630 - DNA, 25 bp, Rattus norvegicus
agctgaggaccgcagtggatgctcc

SEQ ID NO: 619631 - DNA, 25 bp, Rattus norvegicus
gcgacggagagagcgaatccagatg

SEQ ID NO: 619632 - DNA, 25 bp, Rattus norvegicus
agaagaatgttaaagaagcaggatc

SEQ ID NO: 619633 - DNA, 25 bp, Rattus norvegicus
ttaaagaagcaggatctggacactc

SEQ ID NO: 619634 - DNA, 25 bp, Rattus norvegicus
agcaggatctggacactctatggta

SEQ ID NO: 619635 - DNA, 25 bp, Rattus norvegicus
tctggacactctatggtagcaccgg

SEQ ID NO: 619636 - DNA, 25 bp, Rattus norvegicus
tggcccgtaggcgtgaccctgacga

SEQ ID NO: 619637 - DNA, 25 bp, Rattus norvegicus
aggcgtgaccctgacgacgactgcc

SEQ ID NO: 619638 - DNA, 25 bp, Rattus norvegicus
cactctatggtagcaccgggcctca

SEQ ID NO: 619639 - DNA, 25 bp, Rattus norvegicus
ctcccgccatgacagaggacagctt

SEQ ID NO: 619640 - DNA, 25 bp, Rattus norvegicus
ccggttctgcacagtgtcctcggga

SEQ ID NO: 619641 - DNA, 25 bp, Rattus norvegicus
gcgtaacctccggccgctaaggcag

SEQ ID NO: 619642 - DNA, 25 bp, Rattus norvegicus
gttctgcacagtgtcctcgggagcc

SEQ ID NO: 619643 - DNA, 25 bp, Rattus norvegicus
tctgcacagtgtcctcgggagccgc

SEQ ID NO: 619644 - DNA, 25 bp, Rattus norvegicus
tatcgtgtcactccgcgcgtaacct

SEQ ID NO: 619645 - DNA, 25 bp, Rattus norvegicus
cggaactcccgccatgacagaggac

SEQ ID NO: 619646 - DNA, 25 bp, Rattus norvegicus
cagaggacagcttttctatcgtgtc

SEQ ID NO: 619647 - DNA, 25 bp, Rattus norvegicus
ggacagcttttctatcgtgtcactc

SEQ ID NO: 619648 - DNA, 25 bp, Rattus norvegicus
agcttttctatcgtgtcactccgcg

SEQ ID NO: 619649 - DNA, 25 bp, Rattus norvegicus
tttctatcgtgtcactccgcgcgta

SEQ ID NO: 619650 - DNA, 25 bp, Rattus norvegicus
acccggttctgcacagtgtcctcgg

SEQ ID NO: 619651 - DNA, 25 bp, Rattus norvegicus
gaccagcctctcacccggttctgca

SEQ ID NO: 619652 - DNA, 25 bp, Rattus norvegicus
gaggactggtttctccgcgccggaa

SEQ ID NO: 619653 - DNA, 25 bp, Rattus norvegicus
ggccgctaaggcagccatcatgctg

SEQ ID NO: 619654 - DNA, 25 bp, Rattus norvegicus
tcggagaccagcgtccgttacgctt

SEQ ID NO: 619655 - DNA, 25 bp, Rattus norvegicus
ccagcgtccgttacgcttcttaaca

SEQ ID NO: 619656 - DNA, 25 bp, Rattus norvegicus
cgttacgcttcttaacagccgcctg

SEQ ID NO: 619657 - DNA, 25 bp, Rattus norvegicus
acgcttcttaacagccgcctgtagc

SEQ ID NO: 619658 - DNA, 25 bp, Rattus norvegicus
cctgtagccagcacctactcgaata

SEQ ID NO: 619659 - DNA, 25 bp, Rattus norvegicus
ccagcacctactcgaatagcgaatg

SEQ ID NO: 619660 - DNA, 25 bp, Rattus norvegicus
cctactcgaatagcgaatggccgcg

SEQ ID NO: 619661 - DNA, 25 bp, Rattus norvegicus
tcgaatagcgaatggccgcgggaaa

SEQ ID NO: 619662 - DNA, 25 bp, Rattus norvegicus
gcctcccattggacgcagccggtag

SEQ ID NO: 619663 - DNA, 25 bp, Rattus norvegicus
ccattggacgcagccggtagcccgg

SEQ ID NO: 619664 - DNA, 25 bp, Rattus norvegicus
agcccggctggccaatcgcgaggct

SEQ ID NO: 619665 - DNA, 25 bp, Rattus norvegicus
atgctgtcggagaccagcgtccgtt

SEQ ID NO: 619666 - DNA, 25 bp, Rattus norvegicus
gcagccatcatgctgtcggagacca

SEQ ID NO: 619667 - DNA, 25 bp, Rattus norvegicus
ttcgacacgtgagcgcaagcatagg

SEQ ID NO: 619668 - DNA, 25 bp, Rattus norvegicus
taagtacagcagtgctccaacactg

SEQ ID NO: 619669 - DNA, 25 bp, Rattus norvegicus
gcccagactccagtgctactgctga

SEQ ID NO: 619670 - DNA, 25 bp, Rattus norvegicus
gactggcccgggtaggacagctaca

SEQ ID NO: 619671 - DNA, 25 bp, Rattus norvegicus
taggacagctacacataagtacagc

SEQ ID NO: 619672 - DNA, 25 bp, Rattus norvegicus
gctacacataagtacagcagtgctc

SEQ ID NO: 619673 - DNA, 25 bp, Rattus norvegicus
cacataagtacagcagtgctccaac

SEQ ID NO: 619674 - DNA, 25 bp, Rattus norvegicus
tacagcagtgctccaacactgcggg

SEQ ID NO: 619675 - DNA, 25 bp, Rattus norvegicus
cagtgctccaacactgcggggcgca

SEQ ID NO: 619676 - DNA, 25 bp, Rattus norvegicus
tgctccaacactgcggggcgcatgg

SEQ ID NO: 619677 - DNA, 25 bp, Rattus norvegicus
gacacccggcctgggagcttcgaca

SEQ ID NO: 619678 - DNA, 25 bp, Rattus norvegicus
acccggcctgggagcttcgacacgt

SEQ ID NO: 619679 - DNA, 25 bp, Rattus norvegicus
tgggagcttcgacacgtgagcgcaa

SEQ ID NO: 619680 - DNA, 25 bp, Rattus norvegicus
gcttcgacacgtgagcgcaagcata

SEQ ID NO: 619681 - DNA, 25 bp, Rattus norvegicus
gcgggacagggttcggcccagactc

SEQ ID NO: 619682 - DNA, 25 bp, Rattus norvegicus
ttgcagtgttgatcctccgtgggtt

SEQ ID NO: 619683 - DNA, 25 bp, Rattus norvegicus
tctccgtccgcgtgactggggcgta

SEQ ID NO: 619684 - DNA, 25 bp, Rattus norvegicus
tgacatgaggtggacggattgcacc

SEQ ID NO: 619685 - DNA, 25 bp, Rattus norvegicus
gttgatcctccgtgggttgacatga

SEQ ID NO: 619686 - DNA, 25 bp, Rattus norvegicus
tcacgtgttgcagtgttgatcctcc

SEQ ID NO: 619687 - DNA, 25 bp, Rattus norvegicus
tccgtcacgtgttgcagtgttgatc

SEQ ID NO: 619688 - DNA, 25 bp, Rattus norvegicus
cagttttccgtcacgtgttgcagtg

SEQ ID NO: 619689 - DNA, 25 bp, Rattus norvegicus
gccctcagttttccgtcacgtgttg

SEQ ID NO: 619690 - DNA, 25 bp, Rattus norvegicus
gcgccctcagttttccgtcacgtgt

SEQ ID NO: 619691 - DNA, 25 bp, Rattus norvegicus
ggaataccgtgtacgcctgcgccct

SEQ ID NO: 619692 - DNA, 25 bp, Rattus norvegicus
tagctcgaggaataccgtgtacgcc

SEQ ID NO: 619693 - DNA, 25 bp, Rattus norvegicus
cgtagtcacggtagctcgaggaata

SEQ ID NO: 619694 - DNA, 25 bp, Rattus norvegicus
atcctccgtgggttgacatgaggtg

SEQ ID NO: 619695 - DNA, 25 bp, Rattus norvegicus
tccggggcacggcttacacacgtct

SEQ ID NO: 619696 - DNA, 25 bp, Rattus norvegicus
cgtgtctcgctgaccattcgacgtg

SEQ ID NO: 619697 - DNA, 25 bp, Rattus norvegicus
tggaaccacggagcctgctggtgct

SEQ ID NO: 619698 - DNA, 25 bp, Rattus norvegicus
tgctggtggaaccacggagcctgct

SEQ ID NO: 619699 - DNA, 25 bp, Rattus norvegicus
aatgccgctgcctgccagtcggcgt

SEQ ID NO: 619700 - DNA, 25 bp, Rattus norvegicus
gggcacggcttacacacgtctgctc

SEQ ID NO: 619701 - DNA, 25 bp, Rattus norvegicus
ccacccgcgtagatgagctggactc

SEQ ID NO: 619702 - DNA, 25 bp, Rattus norvegicus
cccgcgtagatgagctggactccac

SEQ ID NO: 619703 - DNA, 25 bp, Rattus norvegicus
gactccacctcgctgccgcccaatg

SEQ ID NO: 619704 - DNA, 25 bp, Rattus norvegicus
ggcatcacagccacccgcgtagatg

SEQ ID NO: 619705 - DNA, 25 bp, Rattus norvegicus
cgcctggtgcgtggcacccgtgtct

SEQ ID NO: 619706 - DNA, 25 bp, Rattus norvegicus
acacgtctgctccacggcatcacag

SEQ ID NO: 619707 - DNA, 25 bp, Rattus norvegicus
tggcacccgtgtctcgctgaccatt

SEQ ID NO: 619708 - DNA, 25 bp, Rattus norvegicus
tctcgctgaccattcgacgtgtacc

SEQ ID NO: 619709 - DNA, 25 bp, Rattus norvegicus
ggcgcacgaaagtacccatggccgt

SEQ ID NO: 619710 - DNA, 25 bp, Rattus norvegicus
caggctcagaacttgcctctgcagc

SEQ ID NO: 619711 - DNA, 25 bp, Rattus norvegicus
gggcatcactatcgtccagcctgtt

SEQ ID NO: 619712 - DNA, 25 bp, Rattus norvegicus
cacaaggattctttagggcatcact

SEQ ID NO: 619713 - DNA, 25 bp, Rattus norvegicus
cccggcgatacagatactcgatacg

SEQ ID NO: 619714 - DNA, 25 bp, Rattus norvegicus
tactcgatacgcagcacgtcggagc

SEQ ID NO: 619715 - DNA, 25 bp, Rattus norvegicus
agcagttcgcggtacaggctcagaa

SEQ ID NO: 619716 - DNA, 25 bp, Rattus norvegicus
tggccggaacgcagcagctgtagct

SEQ ID NO: 619717 - DNA, 25 bp, Rattus norvegicus
ctaagccggctcatgaccgctgcgt

SEQ ID NO: 619718 - DNA, 25 bp, Rattus norvegicus
cccgacagacagtgctgagaagcta

SEQ ID NO: 619719 - DNA, 25 bp, Rattus norvegicus
ctgagaagctaacgggcagggccac

SEQ ID NO: 619720 - DNA, 25 bp, Rattus norvegicus
aagtggaccgggtctctagtgctcc

SEQ ID NO: 619721 - DNA, 25 bp, Rattus norvegicus
gtgctcccgtgccttcacaaggatt

SEQ ID NO: 619722 - DNA, 25 bp, Rattus norvegicus
catccgattggctagtactgcagta

SEQ ID NO: 619723 - DNA, 25 bp, Rattus norvegicus
ggttccatgtttccctctagagccg

SEQ ID NO: 619724 - DNA, 25 bp, Rattus norvegicus
gctacttcacgctgcggggtgcatc

SEQ ID NO: 619725 - DNA, 25 bp, Rattus norvegicus
gttggcttgttcacatccctgtagg

SEQ ID NO: 619726 - DNA, 25 bp, Rattus norvegicus
ggtttgtgcaagaacacttcccgca

SEQ ID NO: 619727 - DNA, 25 bp, Rattus norvegicus
tattgatcgtgagcgcgttggtttg

SEQ ID NO: 619728 - DNA, 25 bp, Rattus norvegicus
tctctccgggatgtgggtattgatc

SEQ ID NO: 619729 - DNA, 25 bp, Rattus norvegicus
ctctgtgctatgtgggtgtatgcca

SEQ ID NO: 619730 - DNA, 25 bp, Rattus norvegicus
ctcgccgcgtgctctttaaaggtta

SEQ ID NO: 619731 - DNA, 25 bp, Rattus norvegicus
cacagcagaggagcaaacggtcttc

SEQ ID NO: 619732 - DNA, 25 bp, Rattus norvegicus
cgggattcctgcacacgaacacagc

SEQ ID NO: 619733 - DNA, 25 bp, Rattus norvegicus
ccctgtaggattctgtggttcgatg

SEQ ID NO: 619734 - DNA, 25 bp, Rattus norvegicus
cggctttattgactcggtccctgtg

SEQ ID NO: 619735 - DNA, 25 bp, Rattus norvegicus
acctgttgtctgttgacgggcagtc

SEQ ID NO: 619736 - DNA, 25 bp, Rattus norvegicus
atgccacgttttcgttctctccggg

SEQ ID NO: 619737 - DNA, 25 bp, Rattus norvegicus
cagatgggtacaccactgcggatgg

SEQ ID NO: 619738 - DNA, 25 bp, Rattus norvegicus
acaccagtgcggatgggtacaccag

SEQ ID NO: 619739 - DNA, 25 bp, Rattus norvegicus
tacaccagcgcagatgggtacacca

SEQ ID NO: 619740 - DNA, 25 bp, Rattus norvegicus
caccagcgcagatgggtacaccagc

SEQ ID NO: 619741 - DNA, 25 bp, Rattus norvegicus
gcagatgggtacaccagcgcagatg

SEQ ID NO: 619742 - DNA, 25 bp, Rattus norvegicus
accagcgcagatgggtacaccactg

SEQ ID NO: 619743 - DNA, 25 bp, Rattus norvegicus
acaccactgcggatgggtacaccag

SEQ ID NO: 619744 - DNA, 25 bp, Rattus norvegicus
caccagcgcggatgggtacaccagc

SEQ ID NO: 619745 - DNA, 25 bp, Rattus norvegicus
atgggtacaccagcgcagatgggta

SEQ ID NO: 619746 - DNA, 25 bp, Rattus norvegicus
caccactgcggatgggtacaccagc

SEQ ID NO: 619747 - DNA, 25 bp, Rattus norvegicus
tacaccagcgcggatgggtacacca

SEQ ID NO: 619748 - DNA, 25 bp, Rattus norvegicus
accagcgcggatgggtacaccagcg

SEQ ID NO: 619749 - DNA, 25 bp, Rattus norvegicus
tacaccagtgcggatgggtacacca

SEQ ID NO: 619750 - DNA, 25 bp, Rattus norvegicus
gtacaccagcgcagatgggtacacc

SEQ ID NO: 619751 - DNA, 25 bp, Rattus norvegicus
cgcccatcggactaggtttcggctt

SEQ ID NO: 619752 - DNA, 25 bp, Rattus norvegicus
ggctcagtaattgcgtcacaaaaac

SEQ ID NO: 619753 - DNA, 25 bp, Rattus norvegicus
tgcgtcacaaaaaccgtagccaatg

SEQ ID NO: 619754 - DNA, 25 bp, Rattus norvegicus
aaaaccgtagccaatgagagcgggc

SEQ ID NO: 619755 - DNA, 25 bp, Rattus norvegicus
gtggcgttcagccaatgggcctaga

SEQ ID NO: 619756 - DNA, 25 bp, Rattus norvegicus
cgttcagccaatgggcctagagcgg

SEQ ID NO: 619757 - DNA, 25 bp, Rattus norvegicus
tagagcgggagattcgaaagtgttc

SEQ ID NO: 619758 - DNA, 25 bp, Rattus norvegicus
acgagcgcccatcggactaggtttc

SEQ ID NO: 619759 - DNA, 25 bp, Rattus norvegicus
gtgcccgccgatccgcctagaagga

SEQ ID NO: 619760 - DNA, 25 bp, Rattus norvegicus
cgatccgcctagaaggagaggtgca

SEQ ID NO: 619761 - DNA, 25 bp, Rattus norvegicus
gagaggtgcagtagtacccccgacc

SEQ ID NO: 619762 - DNA, 25 bp, Rattus norvegicus
gaccttggctgcgtgctgattcgct

SEQ ID NO: 619763 - DNA, 25 bp, Rattus norvegicus
tgcgtgctgattcgcttccttccgc

SEQ ID NO: 619764 - DNA, 25 bp, Rattus norvegicus
taggttctccggtgtacgagcgccc

SEQ ID NO: 619765 - DNA, 25 bp, Rattus norvegicus
tagaaacccacaaacgcagctgttg

SEQ ID NO: 619766 - DNA, 25 bp, Rattus norvegicus
acacagccggaagtcgggtttctca

SEQ ID NO: 619767 - DNA, 25 bp, Rattus norvegicus
atcaccacaagtgcccagcaggtgg

SEQ ID NO: 619768 - DNA, 25 bp, Rattus norvegicus
cgtcgggtctaggtaggctcgccca

SEQ ID NO: 619769 - DNA, 25 bp, Rattus norvegicus
cgcagctgttgagtctgagtgaacc

SEQ ID NO: 619770 - DNA, 25 bp, Rattus norvegicus
taagcggcggccctagaaacccaca

SEQ ID NO: 619771 - DNA, 25 bp, Rattus norvegicus
ctgcagccggggcatcaccacaagt

SEQ ID NO: 619772 - DNA, 25 bp, Rattus norvegicus
aagctgtgattaagcggcggcccta

SEQ ID NO: 619773 - DNA, 25 bp, Rattus norvegicus
taggctcgcccacgtggattcctca

SEQ ID NO: 619774 - DNA, 25 bp, Rattus norvegicus
accggttctgtctgtagcaccatcg

SEQ ID NO: 619775 - DNA, 25 bp, Rattus norvegicus
tagcaccatcgtcgcggccctttgg

SEQ ID NO: 619776 - DNA, 25 bp, Rattus norvegicus
ccctttgggcggtggcaacacacac

SEQ ID NO: 619777 - DNA, 25 bp, Rattus norvegicus
cccgttttccaagaaagctgtgatt

SEQ ID NO: 619778 - DNA, 25 bp, Rattus norvegicus
gtggcaacacacacacagccggaag

SEQ ID NO: 619779 - DNA, 25 bp, Rattus norvegicus
tggtgcagcacaaggccgaagtgca

SEQ ID NO: 619780 - DNA, 25 bp, Rattus norvegicus
ttggactccgtgcaccttgtagcgt

SEQ ID NO: 619781 - DNA, 25 bp, Rattus norvegicus
caccttgtagcgtagaagtagcacg

SEQ ID NO: 619782 - DNA, 25 bp, Rattus norvegicus
gaagaccagaacagaagcgacgatg

SEQ ID NO: 619783 - DNA, 25 bp, Rattus norvegicus
ggtctgggagcaaacgctgctgaca

SEQ ID NO: 619784 - DNA, 25 bp, Rattus norvegicus
cctcccagcgcaataatcatggtgc

SEQ ID NO: 619785 - DNA, 25 bp, Rattus norvegicus
caggctccgtggagaaccgagcgca

SEQ ID NO: 619786 - DNA, 25 bp, Rattus norvegicus
agcccggtggcactgtcctcataaa

SEQ ID NO: 619787 - DNA, 25 bp, Rattus norvegicus
gcactgtcctcataaactgcgagca

SEQ ID NO: 619788 - DNA, 25 bp, Rattus norvegicus
tgcgagcacacacagatcataggta

SEQ ID NO: 619789 - DNA, 25 bp, Rattus norvegicus
agatcataggtacggcctgacgcca

SEQ ID NO: 619790 - DNA, 25 bp, Rattus norvegicus
agtcagcaggaaggagcgactgtcc

SEQ ID NO: 619791 - DNA, 25 bp, Rattus norvegicus
agaagcgacgatgacacctcccagc

SEQ ID NO: 619792 - DNA, 25 bp, Rattus norvegicus
tgacgccaggtcagtcagcaggaag

SEQ ID NO: 619793 - DNA, 25 bp, Rattus norvegicus
tggggtgatacccaacgcactcgtg

SEQ ID NO: 619794 - DNA, 25 bp, Rattus norvegicus
atacccaacgcactcgtggctctgg

SEQ ID NO: 619795 - DNA, 25 bp, Rattus norvegicus
ggaggtgagcggtgggtcaccacgg

SEQ ID NO: 619796 - DNA, 25 bp, Rattus norvegicus
acctgcgggcactgccaggggaggt

SEQ ID NO: 619797 - DNA, 25 bp, Rattus norvegicus
ggcagctggccgacctgcgggcact

SEQ ID NO: 619798 - DNA, 25 bp, Rattus norvegicus
actgcccggcatcgcagggcagctg

SEQ ID NO: 619799 - DNA, 25 bp, Rattus norvegicus
acccaacgcactcgtggctctgggt

SEQ ID NO: 619800 - DNA, 25 bp, Rattus norvegicus
gggtgatacccaacgcactcgtggc

SEQ ID NO: 619801 - DNA, 25 bp, Rattus norvegicus
cctggggtgatacccaacgcactcg

SEQ ID NO: 619802 - DNA, 25 bp, Rattus norvegicus
accctggggtgatacccaacgcact

SEQ ID NO: 619803 - DNA, 25 bp, Rattus norvegicus
cgaccctggggtgatacccaacgca

SEQ ID NO: 619804 - DNA, 25 bp, Rattus norvegicus
acggctggagttgcccagcagccga

SEQ ID NO: 619805 - DNA, 25 bp, Rattus norvegicus
gcacggctggagttgcccagcagcc

SEQ ID NO: 619806 - DNA, 25 bp, Rattus norvegicus
ggtgatacccaacgcactcgtggct

SEQ ID NO: 619807 - DNA, 25 bp, Rattus norvegicus
aggtctcgacgacgcactgccgcga

SEQ ID NO: 619808 - DNA, 25 bp, Rattus norvegicus
tgatggcggcacgaacagaaggccc

SEQ ID NO: 619809 - DNA, 25 bp, Rattus norvegicus
cgatccagtgatggcggcacgaaca

SEQ ID NO: 619810 - DNA, 25 bp, Rattus norvegicus
agttgtctgccaggcgcaactccgc

SEQ ID NO: 619811 - DNA, 25 bp, Rattus norvegicus
cactgccgcgatgaagttgtctgcc

SEQ ID NO: 619812 - DNA, 25 bp, Rattus norvegicus
cgcaactccgctgcgcggcgatcca

SEQ ID NO: 619813 - DNA, 25 bp, Rattus norvegicus
tgttggccaggtctcgacgacgcac

SEQ ID NO: 619814 - DNA, 25 bp, Rattus norvegicus
aggcctgtcatgttggccaggtctc

SEQ ID NO: 619815 - DNA, 25 bp, Rattus norvegicus
aatgcagcaggcctgtcatgttggc

SEQ ID NO: 619816 - DNA, 25 bp, Rattus norvegicus
gataagctcaaatgcagcaggcctg

SEQ ID NO: 619817 - DNA, 25 bp, Rattus norvegicus
ggtgtttctagataagctcaaatgc

SEQ ID NO: 619818 - DNA, 25 bp, Rattus norvegicus
cggatggtgtttctagataagctca

SEQ ID NO: 619819 - DNA, 25 bp, Rattus norvegicus
ccacatggcggatggtgtttctaga

SEQ ID NO: 619820 - DNA, 25 bp, Rattus norvegicus
cgatgaagttgtctgccaggcgcaa

SEQ ID NO: 619821 - DNA, 25 bp, Rattus norvegicus
gatctgatcgccggctgcaagcgcc

SEQ ID NO: 619822 - DNA, 25 bp, Rattus norvegicus
ggggtttcagaatatctggatctga

SEQ ID NO: 619823 - DNA, 25 bp, Rattus norvegicus
cagaatatctggatctgatcgccgg

SEQ ID NO: 619824 - DNA, 25 bp, Rattus norvegicus
aatatctggatctgatcgccggctg

SEQ ID NO: 619825 - DNA, 25 bp, Rattus norvegicus
atctggatctgatcgccggctgcaa

SEQ ID NO: 619826 - DNA, 25 bp, Rattus norvegicus
tgccggccgacggtctggggcagca

SEQ ID NO: 619827 - DNA, 25 bp, Rattus norvegicus
tgtagaggagactggcccagaaaga

SEQ ID NO: 619828 - DNA, 25 bp, Rattus norvegicus
cgcgattgggttcgtggcctgtaga

SEQ ID NO: 619829 - DNA, 25 bp, Rattus norvegicus
gcctgtagaggagactggcccagaa

SEQ ID NO: 619830 - DNA, 25 bp, Rattus norvegicus
ggcctgggcgcggacagacggacag

SEQ ID NO: 619831 - DNA, 25 bp, Rattus norvegicus
ggaacccgggcaccgcaaggcaggc

SEQ ID NO: 619832 - DNA, 25 bp, Rattus norvegicus
cccgatgtcggggtgccggccgacg

SEQ ID NO: 619833 - DNA, 25 bp, Rattus norvegicus
cagacagacagggccacgcgggaac

SEQ ID NO: 619834 - DNA, 25 bp, Rattus norvegicus
cagcaatggcgcgattgggttcgtg

SEQ ID NO: 619835 - DNA, 25 bp, Rattus norvegicus
tggaagattcccttgcgtgagcgcc

SEQ ID NO: 619836 - DNA, 25 bp, Rattus norvegicus
cccgacgtttaagggagctggctga

SEQ ID NO: 619837 - DNA, 25 bp, Rattus norvegicus
caggggtccactctggtcgagacca

SEQ ID NO: 619838 - DNA, 25 bp, Rattus norvegicus
tgcatccttcgagttgccgttatgg

SEQ ID NO: 619839 - DNA, 25 bp, Rattus norvegicus
ccttcacccaaggaggggttgcatt

SEQ ID NO: 619840 - DNA, 25 bp, Rattus norvegicus
ggacgaagtgactcggactccttca

SEQ ID NO: 619841 - DNA, 25 bp, Rattus norvegicus
ttgactggagcgtaaagctgggccc

SEQ ID NO: 619842 - DNA, 25 bp, Rattus norvegicus
gcacgcgcctttctgaatgctttga

SEQ ID NO: 619843 - DNA, 25 bp, Rattus norvegicus
tgcatccaagaatcctcgaggtaag

SEQ ID NO: 619844 - DNA, 25 bp, Rattus norvegicus
gctgggatcctggacttctgagtcc

SEQ ID NO: 619845 - DNA, 25 bp, Rattus norvegicus
ggggcccacaatctgcatccaagaa

SEQ ID NO: 619846 - DNA, 25 bp, Rattus norvegicus
ccgccttgaaccaggcgtggccaaa

SEQ ID NO: 619847 - DNA, 25 bp, Rattus norvegicus
ttcacccgggactcctagaactgtg

SEQ ID NO: 619848 - DNA, 25 bp, Rattus norvegicus
ctaggaagcctgataccggggattc

SEQ ID NO: 619849 - DNA, 25 bp, Rattus norvegicus
cccacgtccacggacacgggcttcg

SEQ ID NO: 619850 - DNA, 25 bp, Rattus norvegicus
tcagccctgcacacatagtcgcccg

SEQ ID NO: 619851 - DNA, 25 bp, Rattus norvegicus
acccgttcgcctcggctcagccctg

SEQ ID NO: 619852 - DNA, 25 bp, Rattus norvegicus
gcatcctccagtgccacggacggaa

SEQ ID NO: 619853 - DNA, 25 bp, Rattus norvegicus
cagtgccacggacggaagccgcagt

SEQ ID NO: 619854 - DNA, 25 bp, Rattus norvegicus
gggcatcagagacaagcctcgggga

SEQ ID NO: 619855 - DNA, 25 bp, Rattus norvegicus
gcctcggggaggaagctccatctaa

SEQ ID NO: 619856 - DNA, 25 bp, Rattus norvegicus
ggaggaagctccatctaattccagc

SEQ ID NO: 619857 - DNA, 25 bp, Rattus norvegicus
gctccatctaattccagctactgtc

SEQ ID NO: 619858 - DNA, 25 bp, Rattus norvegicus
taattccagctactgtcacaagccc

SEQ ID NO: 619859 - DNA, 25 bp, Rattus norvegicus
cagatcggactccacctgagagcca

SEQ ID NO: 619860 - DNA, 25 bp, Rattus norvegicus
ggactccacctgagagccaccgagg

SEQ ID NO: 619861 - DNA, 25 bp, Rattus norvegicus
ccaggatatccgtggaagtgggttc

SEQ ID NO: 619862 - DNA, 25 bp, Rattus norvegicus
gccagacacagctgaaagacgcgtc

SEQ ID NO: 619863 - DNA, 25 bp, Rattus norvegicus
acgcgcacctcggtcacacccacgg

SEQ ID NO: 619864 - DNA, 25 bp, Rattus norvegicus
ctgcggttggcgcttccgaccgcgt

SEQ ID NO: 619865 - DNA, 25 bp, Rattus norvegicus
tggcgcttccgaccgcgttgctgac

SEQ ID NO: 619866 - DNA, 25 bp, Rattus norvegicus
accgcgttgctgacctcgcaggaca

SEQ ID NO: 619867 - DNA, 25 bp, Rattus norvegicus
tgacctcgcaggacaccggctcagt

SEQ ID NO: 619868 - DNA, 25 bp, Rattus norvegicus
caccggctcagtcaggaacgtggca

SEQ ID NO: 619869 - DNA, 25 bp, Rattus norvegicus
acacaacacttccagcgcggtgctg

SEQ ID NO: 619870 - DNA, 25 bp, Rattus norvegicus
ctcagtcaggaacgtggcatctgca

SEQ ID NO: 619871 - DNA, 25 bp, Rattus norvegicus
acgtggcatctgcaacgacctccaa

SEQ ID NO: 619872 - DNA, 25 bp, Rattus norvegicus
acgacctccaaccttggcccacgtg

SEQ ID NO: 619873 - DNA, 25 bp, Rattus norvegicus
cacctgcagagacaagcacgttatt

SEQ ID NO: 619874 - DNA, 25 bp, Rattus norvegicus
cagagacaagcacgttattaacatc

SEQ ID NO: 619875 - DNA, 25 bp, Rattus norvegicus
cgttattaacatcgtcctggctctc

SEQ ID NO: 619876 - DNA, 25 bp, Rattus norvegicus
attaacatcgtcctggctctcctcg

SEQ ID NO: 619877 - DNA, 25 bp, Rattus norvegicus
acggcgatgagactgtcgaagaccc

SEQ ID NO: 619878 - DNA, 25 bp, Rattus norvegicus
ggcgagagccgacaggtttcactag

SEQ ID NO: 619879 - DNA, 25 bp, Rattus norvegicus
tttcactagcgggagacgtgcactc

SEQ ID NO: 619880 - DNA, 25 bp, Rattus norvegicus
acgtgcactcgggactcgcttccgg

SEQ ID NO: 619881 - DNA, 25 bp, Rattus norvegicus
cttccggcgctgagggcggaactca

SEQ ID NO: 619882 - DNA, 25 bp, Rattus norvegicus
gcccggcgactcagttacctaggta

SEQ ID NO: 619883 - DNA, 25 bp, Rattus norvegicus
ttacctaggtaacagcggcagaggc

SEQ ID NO: 619884 - DNA, 25 bp, Rattus norvegicus
tgcgacactgggctgactggacagc

SEQ ID NO: 619885 - DNA, 25 bp, Rattus norvegicus
tcaagctctgagtgaccgcgctttg

SEQ ID NO: 619886 - DNA, 25 bp, Rattus norvegicus
cggctgtctctcctttccgtgagta

SEQ ID NO: 619887 - DNA, 25 bp, Rattus norvegicus
ctttccgtgagtatccggcaggcgc

SEQ ID NO: 619888 - DNA, 25 bp, Rattus norvegicus
ttgagctgctgcttccctagccctt

SEQ ID NO: 619889 - DNA, 25 bp, Rattus norvegicus
tgcgcaaagggactcccggaggctt

SEQ ID NO: 619890 - DNA, 25 bp, Rattus norvegicus
ccggaggcttttggatgctcgcaag

SEQ ID NO: 619891 - DNA, 25 bp, Rattus norvegicus
cccgaagacttcgagcggcagcatc

SEQ ID NO: 619892 - DNA, 25 bp, Rattus norvegicus
tcgacccggacgtactgagggatct

SEQ ID NO: 619893 - DNA, 25 bp, Rattus norvegicus
ctcaagatccgactgagtggcgccc

SEQ ID NO: 619894 - DNA, 25 bp, Rattus norvegicus
gtcgccaacaacctacaactcaaga

SEQ ID NO: 619895 - DNA, 25 bp, Rattus norvegicus
gccacggcgaccttactcactttgt

SEQ ID NO: 619896 - DNA, 25 bp, Rattus norvegicus
atcttcatccagtggcgaggccggc

SEQ ID NO: 619897 - DNA, 25 bp, Rattus norvegicus
gccttcaggacagccgcagcctgga

SEQ ID NO: 619898 - DNA, 25 bp, Rattus norvegicus
atagggctggccactcgtttcccag

SEQ ID NO: 619899 - DNA, 25 bp, Rattus norvegicus
ctcagcaagagggtgacgacgacga

SEQ ID NO: 619900 - DNA, 25 bp, Rattus norvegicus
gcaggacctttcgaccggagccgac

SEQ ID NO: 619901 - DNA, 25 bp, Rattus norvegicus
aggatcagccctccgctctgacggt

SEQ ID NO: 619902 - DNA, 25 bp, Rattus norvegicus
actttcagcggcaggccgtcccgaa

SEQ ID NO: 619903 - DNA, 25 bp, Rattus norvegicus
gaccaccaggccgtgactttcagcg

SEQ ID NO: 619904 - DNA, 25 bp, Rattus norvegicus
agatgaatgtggagctgcctcagca

SEQ ID NO: 619905 - DNA, 25 bp, Rattus norvegicus
ccctaggactgcgaaggacccacta

SEQ ID NO: 619906 - DNA, 25 bp, Rattus norvegicus
tgcaaccctaggactgcgaaggacc

SEQ ID NO: 619907 - DNA, 25 bp, Rattus norvegicus
ggggttgcaaccctaggactgcgaa

SEQ ID NO: 619908 - DNA, 25 bp, Rattus norvegicus
tctacaccgctcacggggttgcaac

SEQ ID NO: 619909 - DNA, 25 bp, Rattus norvegicus
cagtgctctacaccgctcacggggt

SEQ ID NO: 619910 - DNA, 25 bp, Rattus norvegicus
ctcgtccgcagtctccagtgctcta

SEQ ID NO: 619911 - DNA, 25 bp, Rattus norvegicus
aggactgcgaaggacccactaggcg

SEQ ID NO: 619912 - DNA, 25 bp, Rattus norvegicus
ctcttcccattgagaaactccggcg

SEQ ID NO: 619913 - DNA, 25 bp, Rattus norvegicus
cccattgagaaactccggcgccttg

SEQ ID NO: 619914 - DNA, 25 bp, Rattus norvegicus
ctgtccgcgcagcaagagggcgccc

SEQ ID NO: 619915 - DNA, 25 bp, Rattus norvegicus
cattgagaaactccggcgccttgtg

SEQ ID NO: 619916 - DNA, 25 bp, Rattus norvegicus
aaactccggcgccttgtgtgcggac

SEQ ID NO: 619917 - DNA, 25 bp, Rattus norvegicus
ctcagggtagctgtccgcgcagcaa

SEQ ID NO: 619918 - DNA, 25 bp, Rattus norvegicus
cagggtagctgtccgcgcagcaaga

SEQ ID NO: 619919 - DNA, 25 bp, Rattus norvegicus
tctcccgcgagctggtgttgatcat

SEQ ID NO: 619920 - DNA, 25 bp, Rattus norvegicus
cagcctctgaatctctaatgcatta

SEQ ID NO: 619921 - DNA, 25 bp, Rattus norvegicus
ggtcagctcagtgcgtctacgcagc

SEQ ID NO: 619922 - DNA, 25 bp, Rattus norvegicus
catcctggccaactcgtccgcgctg

SEQ ID NO: 619923 - DNA, 25 bp, Rattus norvegicus
gagccaagttctcctgcaaggcggg

SEQ ID NO: 619924 - DNA, 25 bp, Rattus norvegicus
ctacgcagctggtggtgcagtgtaa

SEQ ID NO: 619925 - DNA, 25 bp, Rattus norvegicus
gtgttgatcataggtccgccggaca

SEQ ID NO: 619926 - DNA, 25 bp, Rattus norvegicus
gagaagtccgggagcactttctccc

SEQ ID NO: 619927 - DNA, 25 bp, Rattus norvegicus
aggttcctcagcctctgaatctcta

SEQ ID NO: 619928 - DNA, 25 bp, Rattus norvegicus
tagagtccgaaccttgtagtccagg

SEQ ID NO: 619929 - DNA, 25 bp, Rattus norvegicus
ggcggtgtagagtccgaaccttgta

SEQ ID NO: 619930 - DNA, 25 bp, Rattus norvegicus
agttctcctgcaaggcgggtcagct

SEQ ID NO: 619931 - DNA, 25 bp, Rattus norvegicus
ctgaatctctaatgcattaagtccc

SEQ ID NO: 619932 - DNA, 25 bp, Rattus norvegicus
aggtccgccggacaaccgagccaag

SEQ ID NO: 619933 - DNA, 25 bp, Rattus norvegicus
ttcctggcagaaccgaataccgacg

SEQ ID NO: 619934 - DNA, 25 bp, Rattus norvegicus
ggcactcaccgcgtacagcagaatg

SEQ ID NO: 619935 - DNA, 25 bp, Rattus norvegicus
aggtcagccctgaagtcaatcctca

SEQ ID NO: 619936 - DNA, 25 bp, Rattus norvegicus
ctcgtacgtcccgtcaggttccata

SEQ ID NO: 619937 - DNA, 25 bp, Rattus norvegicus
ttccatagcgactgggctgattacc

SEQ ID NO: 619938 - DNA, 25 bp, Rattus norvegicus
gtcggatcgcgtagctgcactaaaa

SEQ ID NO: 619939 - DNA, 25 bp, Rattus norvegicus
gcacgtgagggctccttatcttatg

SEQ ID NO: 619940 - DNA, 25 bp, Rattus norvegicus
gacggcttgcgtctatcctttgata

SEQ ID NO: 619941 - DNA, 25 bp, Rattus norvegicus
ctccgagtggtttggatttaggaca

SEQ ID NO: 619942 - DNA, 25 bp, Rattus norvegicus
gccagtgcacatgcgccgagcttat

SEQ ID NO: 619943 - DNA, 25 bp, Rattus norvegicus
gcgggccaggataactccagccatt

SEQ ID NO: 619944 - DNA, 25 bp, Rattus norvegicus
gcttgcttccctcgcagctattgga

SEQ ID NO: 619945 - DNA, 25 bp, Rattus norvegicus
ctccttggggtacagcatgttatta

SEQ ID NO: 619946 - DNA, 25 bp, Rattus norvegicus
tgattacctttctgcgcttgcgcgg

SEQ ID NO: 619947 - DNA, 25 bp, Rattus norvegicus
tgcaatggcggctctaggaccgcgc

SEQ ID NO: 619948 - DNA, 25 bp, Rattus norvegicus
tccgctgtcctcagatctggcgaga

SEQ ID NO: 619949 - DNA, 25 bp, Rattus norvegicus
caggcgcagtctgcaatggcggctc

SEQ ID NO: 619950 - DNA, 25 bp, Rattus norvegicus
tgtcctcagatctggcgagacccta

SEQ ID NO: 619951 - DNA, 25 bp, Rattus norvegicus
cgcagtctgcaatggcggctctagg

SEQ ID NO: 619952 - DNA, 25 bp, Rattus norvegicus
ccgggatccgctgtcctcagatctg

SEQ ID NO: 619953 - DNA, 25 bp, Rattus norvegicus
agacggggcgcttcagtccagcacc

SEQ ID NO: 619954 - DNA, 25 bp, Rattus norvegicus
atccgtaagtgagacggggcgcttc

SEQ ID NO: 619955 - DNA, 25 bp, Rattus norvegicus
cggaccgccggatccgtaagtgaga

SEQ ID NO: 619956 - DNA, 25 bp, Rattus norvegicus
taacccggagctgcctgagtcaccg

SEQ ID NO: 619957 - DNA, 25 bp, Rattus norvegicus
ctttaacccggagctgcctgagtca

SEQ ID NO: 619958 - DNA, 25 bp, Rattus norvegicus
gcgagccggctttaacccggagctg

SEQ ID NO: 619959 - DNA, 25 bp, Rattus norvegicus
cctccagagccggacacagcgggag

SEQ ID NO: 619960 - DNA, 25 bp, Rattus norvegicus
tcagatctggcgagaccctaaagtc

SEQ ID NO: 619961 - DNA, 25 bp, Rattus norvegicus
gcttcactgggttcgcctacgacca

SEQ ID NO: 619962 - DNA, 25 bp, Rattus norvegicus
ttgagtgctgctctacttcacgccc

SEQ ID NO: 619963 - DNA, 25 bp, Rattus norvegicus
gccacgcccatggtcgcttggcatt

SEQ ID NO: 619964 - DNA, 25 bp, Rattus norvegicus
cgaagtttgacagcgccacgcccat

SEQ ID NO: 619965 - DNA, 25 bp, Rattus norvegicus
gctgtcagcgccctcctgagataca

SEQ ID NO: 619966 - DNA, 25 bp, Rattus norvegicus
gccctcctgagatacaaccctgtat

SEQ ID NO: 619967 - DNA, 25 bp, Rattus norvegicus
accctgtattctttatgctccgctg

SEQ ID NO: 619968 - DNA, 25 bp, Rattus norvegicus
tattctttatgctccgctgccgcca

SEQ ID NO: 619969 - DNA, 25 bp, Rattus norvegicus
tcctcggacgtgcttcactgggttc

SEQ ID NO: 619970 - DNA, 25 bp, Rattus norvegicus
ccctcaagcagccttttcgaaatgc

SEQ ID NO: 619971 - DNA, 25 bp, Rattus norvegicus
tcgcttggcattggctgtcagcgcc

SEQ ID NO: 619972 - DNA, 25 bp, Rattus norvegicus
tgcttactggctttgagtgctgctc

SEQ ID NO: 619973 - DNA, 25 bp, Rattus norvegicus
cccacaaggcggctgcttactggct

SEQ ID NO: 619974 - DNA, 25 bp, Rattus norvegicus
tttcctcacgaggtcgctcctcgga

SEQ ID NO: 619975 - DNA, 25 bp, Rattus norvegicus
tcggcgaaggcaagttggccttcaa

SEQ ID NO: 619976 - DNA, 25 bp, Rattus norvegicus
tagcttcgatattcgggactgagaa

SEQ ID NO: 619977 - DNA, 25 bp, Rattus norvegicus
gtacgcatgcgctcccaggaaacac

SEQ ID NO: 619978 - DNA, 25 bp, Rattus norvegicus
gcgctcccaggaaacactcgcttga

SEQ ID NO: 619979 - DNA, 25 bp, Rattus norvegicus
tgttcgtgggatgcccggccttccc

SEQ ID NO: 619980 - DNA, 25 bp, Rattus norvegicus
attcgggactgagaaggacaagtga

SEQ ID NO: 619981 - DNA, 25 bp, Rattus norvegicus
aatggctgaatatttagcttcgata

SEQ ID NO: 619982 - DNA, 25 bp, Rattus norvegicus
acgctcctgagcaacggaagtgacg

SEQ ID NO: 619983 - DNA, 25 bp, Rattus norvegicus
tacatttcccaacgctcctgagcaa

SEQ ID NO: 619984 - DNA, 25 bp, Rattus norvegicus
cacaggctgtgacgaactacatttc

SEQ ID NO: 619985 - DNA, 25 bp, Rattus norvegicus
tgcgcaatcgcgtcacaggctgtga

SEQ ID NO: 619986 - DNA, 25 bp, Rattus norvegicus
tggccttcaacacgcgtgcgcaatc

SEQ ID NO: 619987 - DNA, 25 bp, Rattus norvegicus
actcgcttgactgtcggcgaaggca

SEQ ID NO: 619988 - DNA, 25 bp, Rattus norvegicus
tccctacgggctggacggacagtgt

SEQ ID NO: 619989 - DNA, 25 bp, Rattus norvegicus
ggagctatccggagccctgcaagcc

SEQ ID NO: 619990 - DNA, 25 bp, Rattus norvegicus
acgcgcgcaccagcccacaggcggc

SEQ ID NO: 619991 - DNA, 25 bp, Rattus norvegicus
gagacccagcaaacggagcagggcc

SEQ ID NO: 619992 - DNA, 25 bp, Rattus norvegicus
acccagcaaacggagcagggccgtg

SEQ ID NO: 619993 - DNA, 25 bp, Rattus norvegicus
ccagcaaacggagcagggccgtgtc

SEQ ID NO: 619994 - DNA, 25 bp, Rattus norvegicus
gcaaacggagcagggccgtgtcctc

SEQ ID NO: 619995 - DNA, 25 bp, Rattus norvegicus
ccggcggagacccagcaaacggagc

SEQ ID NO: 619996 - DNA, 25 bp, Rattus norvegicus
ctgaacgcgcgcaccagcccacagg

SEQ ID NO: 619997 - DNA, 25 bp, Rattus norvegicus
ccggcctcgctgaacgcgcgcacca

SEQ ID NO: 619998 - DNA, 25 bp, Rattus norvegicus
ctccggcatgcagcctcggttcggg

SEQ ID NO: 619999 - DNA, 25 bp, Rattus norvegicus
cactgctctcttcctccggcatgca

SEQ ID NO: 620000 - DNA, 25 bp, Rattus norvegicus
cgctggagacacctccgaccgcctc

SEQ ID NO: 620001 - DNA, 25 bp, Rattus norvegicus
cggcggagacccagcaaacggagca

SEQ ID NO: 620002 - DNA, 25 bp, Rattus norvegicus
agacacctccgaccgcctcacctcc

SEQ ID NO: 620003 - DNA, 25 bp, Rattus norvegicus
cgacggacacacagcaaacgaagtt

SEQ ID NO: 620004 - DNA, 25 bp, Rattus norvegicus
ggcgcaacccggtagccgcattatc

SEQ ID NO: 620005 - DNA, 25 bp, Rattus norvegicus
gctgccctcgcgaattacaaccgta

SEQ ID NO: 620006 - DNA, 25 bp, Rattus norvegicus
aaatcgggacctgagtctgcgctcc

SEQ ID NO: 620007 - DNA, 25 bp, Rattus norvegicus
gagaggttggtctccagtcccttcc

SEQ ID NO: 620008 - DNA, 25 bp, Rattus norvegicus
tgggttagtctcacttccaggcgca

SEQ ID NO: 620009 - DNA, 25 bp, Rattus norvegicus
gtcggaactacctgtatggactacc

SEQ ID NO: 620010 - DNA, 25 bp, Rattus norvegicus
gactcctcccattgttctagtcgga

SEQ ID NO: 620011 - DNA, 25 bp, Rattus norvegicus
aaatgtagtccagtcgccttgctcc

SEQ ID NO: 620012 - DNA, 25 bp, Rattus norvegicus
ggcgcaaggtcttctgggaaatgta

SEQ ID NO: 620013 - DNA, 25 bp, Rattus norvegicus
aggacagcagactcaggtcgaaatc

SEQ ID NO: 620014 - DNA, 25 bp, Rattus norvegicus
tcaaggcgcacctgaagagcggacc

SEQ ID NO: 620015 - DNA, 25 bp, Rattus norvegicus
cggctgaggctcacgacaacaacca

SEQ ID NO: 620016 - DNA, 25 bp, Rattus norvegicus
cattcccagagtaccgttgccttcg

SEQ ID NO: 620017 - DNA, 25 bp, Rattus norvegicus
acagctggaactcgcggttattgcc

SEQ ID NO: 620018 - DNA, 25 bp, Rattus norvegicus
gttattgccggtccagcggatgcag

SEQ ID NO: 620019 - DNA, 25 bp, Rattus norvegicus
cctctttggggtcgcacagctggaa

SEQ ID NO: 620020 - DNA, 25 bp, Rattus norvegicus
aggggagctgtcttacctctttggg

SEQ ID NO: 620021 - DNA, 25 bp, Rattus norvegicus
gcaggtcttagtcctaatgggcgtg

SEQ ID NO: 620022 - DNA, 25 bp, Rattus norvegicus
accagtgtcttagttgctatgggcg

SEQ ID NO: 620023 - DNA, 25 bp, Rattus norvegicus
tgaggtcagagggaccagtgtctta

SEQ ID NO: 620024 - DNA, 25 bp, Rattus norvegicus
ttctcataattcattcccggcttcc

SEQ ID NO: 620025 - DNA, 25 bp, Rattus norvegicus
cctcggctcagcttctcataattca

SEQ ID NO: 620026 - DNA, 25 bp, Rattus norvegicus
atagtaacgtagacctcggctcagc

SEQ ID NO: 620027 - DNA, 25 bp, Rattus norvegicus
atgtcgcggcggtaatagtaacgta

SEQ ID NO: 620028 - DNA, 25 bp, Rattus norvegicus
caccgctcttgagcacgatgtcgcg

SEQ ID NO: 620029 - DNA, 25 bp, Rattus norvegicus
agcggtatgtgtacttgcgcccacc

SEQ ID NO: 620030 - DNA, 25 bp, Rattus norvegicus
ccgcacacaggcttgaggtcagagg

SEQ ID NO: 620031 - DNA, 25 bp, Rattus norvegicus
acagtcccagctggcggtgctccag

SEQ ID NO: 620032 - DNA, 25 bp, Rattus norvegicus
tggtgtagtccgaacccgcagaccc

SEQ ID NO: 620033 - DNA, 25 bp, Rattus norvegicus
cccacgacattttatagtccgcctg

SEQ ID NO: 620034 - DNA, 25 bp, Rattus norvegicus
acattttatagtccgcctgcgcttc

SEQ ID NO: 620035 - DNA, 25 bp, Rattus norvegicus
gcccaggccactgtcccagtaggtg

SEQ ID NO: 620036 - DNA, 25 bp, Rattus norvegicus
cccagtaggtggatccattggggcc

SEQ ID NO: 620037 - DNA, 25 bp, Rattus norvegicus
tccagtctcgcgaccacggaagggg

SEQ ID NO: 620038 - DNA, 25 bp, Rattus norvegicus
cagaacagtcccagctggcggtgct

SEQ ID NO: 620039 - DNA, 25 bp, Rattus norvegicus
gtggcagtattctggccggtcgccc

SEQ ID NO: 620040 - DNA, 25 bp, Rattus norvegicus
ggcctggcgtctgcgaagcacagct

SEQ ID NO: 620041 - DNA, 25 bp, Rattus norvegicus
gcgtctgcgaagcacagctccacgg

SEQ ID NO: 620042 - DNA, 25 bp, Rattus norvegicus
tccacgggtccgaggtgttgcaccc

SEQ ID NO: 620043 - DNA, 25 bp, Rattus norvegicus
aggtctgtccagtctcgcgaccacg

SEQ ID NO: 620044 - DNA, 25 bp, Rattus norvegicus
cattggggcccgcagaacagtccca

SEQ ID NO: 620045 - DNA, 25 bp, Rattus norvegicus
tctggtcccgggtaagacgtggaca

SEQ ID NO: 620046 - DNA, 25 bp, Rattus norvegicus
gggctcgtgccctctcgattcctga

SEQ ID NO: 620047 - DNA, 25 bp, Rattus norvegicus
gctcatctggtgattgtcatcactt

SEQ ID NO: 620048 - DNA, 25 bp, Rattus norvegicus
atcgcgagacttccggaggcagctg

SEQ ID NO: 620049 - DNA, 25 bp, Rattus norvegicus
catcactttgttctggtcccgggta

SEQ ID NO: 620050 - DNA, 25 bp, Rattus norvegicus
tctcgattcctgacgctcttggctc

SEQ ID NO: 620051 - DNA, 25 bp, Rattus norvegicus
ccatgggtcggatctccgggctcgt

SEQ ID NO: 620052 - DNA, 25 bp, Rattus norvegicus
gacttctacggcctccgctttgggc

SEQ ID NO: 620053 - DNA, 25 bp, Rattus norvegicus
tgatgagtgaccctcctcagacttc

SEQ ID NO: 620054 - DNA, 25 bp, Rattus norvegicus
cttaagtagagaggtctggcctgct

SEQ ID NO: 620055 - DNA, 25 bp, Rattus norvegicus
ttaccatggcaaccgggcggcgcct

SEQ ID NO: 620056 - DNA, 25 bp, Rattus norvegicus
aggacgcagttaccatggcaaccgg

SEQ ID NO: 620057 - DNA, 25 bp, Rattus norvegicus
tggcgcctgaggacgcagttaccat

SEQ ID NO: 620058 - DNA, 25 bp, Rattus norvegicus
acgctcttggctcatctggtgattg

SEQ ID NO: 620059 - DNA, 25 bp, Rattus norvegicus
tcgccctgcaagaaacggctccgag

SEQ ID NO: 620060 - DNA, 25 bp, Rattus norvegicus
actgggagccaagatccaaggtctc

SEQ ID NO: 620061 - DNA, 25 bp, Rattus norvegicus
ctgagtcaagttcaaggctcccgcc

SEQ ID NO: 620062 - DNA, 25 bp, Rattus norvegicus
ctacctgggagcctcagggaacctg

SEQ ID NO: 620063 - DNA, 25 bp, Rattus norvegicus
tcctgctgcaggtttcagctttctg

SEQ ID NO: 620064 - DNA, 25 bp, Rattus norvegicus
tttctgcagaacaggtgacccgggt

SEQ ID NO: 620065 - DNA, 25 bp, Rattus norvegicus
ctggcggtttagatcccaaaagcga

SEQ ID NO: 620066 - DNA, 25 bp, Rattus norvegicus
ggccagtacctgatagctcgaaaaa

SEQ ID NO: 620067 - DNA, 25 bp, Rattus norvegicus
cgggcgcggatagactttgtctctg

SEQ ID NO: 620068 - DNA, 25 bp, Rattus norvegicus
atcttccttagggtcgtctggtggc

SEQ ID NO: 620069 - DNA, 25 bp, Rattus norvegicus
ggccttgccagaggtgagctaccta

SEQ ID NO: 620070 - DNA, 25 bp, Rattus norvegicus
tgctgccggcctccagcacttagtg

SEQ ID NO: 620071 - DNA, 25 bp, Rattus norvegicus
acttagtgcccagtggcgaccgcca

SEQ ID NO: 620072 - DNA, 25 bp, Rattus norvegicus
ttcttgttccgatgcccagcggttg

SEQ ID NO: 620073 - DNA, 25 bp, Rattus norvegicus
cgtagtttaagaacaggggctaatg

SEQ ID NO: 620074 - DNA, 25 bp, Rattus norvegicus
tcttgcccgggatgccgacaccagg

SEQ ID NO: 620075 - DNA, 25 bp, Rattus norvegicus
gccatcgctgatgccatggccttcg

SEQ ID NO: 620076 - DNA, 25 bp, Rattus norvegicus
tggattaccgcgacggatgcgctgc

SEQ ID NO: 620077 - DNA, 25 bp, Rattus norvegicus
ccggccgatgacgtgtggattaccg

SEQ ID NO: 620078 - DNA, 25 bp, Rattus norvegicus
cagccgcgggttctacggtcgagtc

SEQ ID NO: 620079 - DNA, 25 bp, Rattus norvegicus
atgccatggccttcgccgctctttt

SEQ ID NO: 620080 - DNA, 25 bp, Rattus norvegicus
cgctgcgtgaggacgtagtttaaga

SEQ ID NO: 620081 - DNA, 25 bp, Rattus norvegicus
ggggctaatgagacatggccacacc

SEQ ID NO: 620082 - DNA, 25 bp, Rattus norvegicus
ggccacgccctcgtagaggaaggta

SEQ ID NO: 620083 - DNA, 25 bp, Rattus norvegicus
ctcacgtctgacagtcgcagcgtta

SEQ ID NO: 620084 - DNA, 25 bp, Rattus norvegicus
gcagcgttagggcaggccacgccct

SEQ ID NO: 620085 - DNA, 25 bp, Rattus norvegicus
ccaggacgagcacaagccaattaga

SEQ ID NO: 620086 - DNA, 25 bp, Rattus norvegicus
ttagagtgtcggaaagacaggtccc

SEQ ID NO: 620087 - DNA, 25 bp, Rattus norvegicus
tgaatcaggcggctactcttaaagg

SEQ ID NO: 620088 - DNA, 25 bp, Rattus norvegicus
cccagttgccgggtttctgaatcag

SEQ ID NO: 620089 - DNA, 25 bp, Rattus norvegicus
agcagactgccggtcccagttgccg

SEQ ID NO: 620090 - DNA, 25 bp, Rattus norvegicus
ccggttgccaagcagactgccggtc

SEQ ID NO: 620091 - DNA, 25 bp, Rattus norvegicus
tcaggagtgcgacgctgagatgtca

SEQ ID NO: 620092 - DNA, 25 bp, Rattus norvegicus
cccatctatgacgtcaggagtgcga

SEQ ID NO: 620093 - DNA, 25 bp, Rattus norvegicus
atggcgcccatctatgacgtcagga

SEQ ID NO: 620094 - DNA, 25 bp, Rattus norvegicus
ttggcgctccagtgtacgtagctta

SEQ ID NO: 620095 - DNA, 25 bp, Rattus norvegicus
tctctttaagtatggcgcccatcta

SEQ ID NO: 620096 - DNA, 25 bp, Rattus norvegicus
actcttaaaggctcttggcgctcca

SEQ ID NO: 620097 - DNA, 25 bp, Rattus norvegicus
gcttcccgcactctctttaagtatg

SEQ ID NO: 620098 - DNA, 25 bp, Rattus norvegicus
acgctgagatgtcaccggttgccaa

SEQ ID NO: 620099 - DNA, 25 bp, Rattus norvegicus
ccagtgtacgtagcttagtgaatga

SEQ ID NO: 620100 - DNA, 25 bp, Rattus norvegicus
ccgggtttctgaatcaggcggctac

SEQ ID NO: 620101 - DNA, 25 bp, Rattus norvegicus
gcgctgctcaagttctcggagttga

SEQ ID NO: 620102 - DNA, 25 bp, Rattus norvegicus
ttcgaccaatcgtcggagacctggc

SEQ ID NO: 620103 - DNA, 25 bp, Rattus norvegicus
cccagggattctagagggtgatgtc

SEQ ID NO: 620104 - DNA, 25 bp, Rattus norvegicus
ctggagtctccggtttcaatcctca

SEQ ID NO: 620105 - DNA, 25 bp, Rattus norvegicus
gtttcaatcctcacactggaccttg

SEQ ID NO: 620106 - DNA, 25 bp, Rattus norvegicus
tggaccttgcacacagcgcatcgtg

SEQ ID NO: 620107 - DNA, 25 bp, Rattus norvegicus
caacgccatgggttatcgggaccgc

SEQ ID NO: 620108 - DNA, 25 bp, Rattus norvegicus
gacgcatctgagactgcgctgctca

SEQ ID NO: 620109 - DNA, 25 bp, Rattus norvegicus
tctcggagttgacgttgggcaacgc

SEQ ID NO: 620110 - DNA, 25 bp, Rattus norvegicus
gcgcatcgtgatcggagacgcatct

SEQ ID NO: 620111 - DNA, 25 bp, Rattus norvegicus
tgtgccgcgtgctcaccctgtgcaa

SEQ ID NO: 620112 - DNA, 25 bp, Rattus norvegicus
tgccttcaagtctggccaggacgcc

SEQ ID NO: 620113 - DNA, 25 bp, Rattus norvegicus
gccagtgcccaaggtgagagaccca

SEQ ID NO: 620114 - DNA, 25 bp, Rattus norvegicus
tgcaaccgcgctgccttcaagtctg

SEQ ID NO: 620115 - DNA, 25 bp, Rattus norvegicus
acgcaaggtgatcggcgcagagaca

SEQ ID NO: 620116 - DNA, 25 bp, Rattus norvegicus
ttcccgaagtggaacagggtcatga

SEQ ID NO: 620117 - DNA, 25 bp, Rattus norvegicus
cacaggccgctgcatttgtacgtga

SEQ ID NO: 620118 - DNA, 25 bp, Rattus norvegicus
tgtactcagacctggagaagccggc

SEQ ID NO: 620119 - DNA, 25 bp, Rattus norvegicus
ttgaagaccgttgttccgacaatgc

SEQ ID NO: 620120 - DNA, 25 bp, Rattus norvegicus
gggcttctagagaccaacgcgtttg

SEQ ID NO: 620121 - DNA, 25 bp, Rattus norvegicus
ctctcccgcagcgttgtgcttgctt

SEQ ID NO: 620122 - DNA, 25 bp, Rattus norvegicus
agctgtgcgcactctggtttttatt

SEQ ID NO: 620123 - DNA, 25 bp, Rattus norvegicus
atttcattgttgacccggcggcagc

SEQ ID NO: 620124 - DNA, 25 bp, Rattus norvegicus
gcgccctcttttgaaggggagccga

SEQ ID NO: 620125 - DNA, 25 bp, Rattus norvegicus
gaggggcctttatttctctcggcta

SEQ ID NO: 620126 - DNA, 25 bp, Rattus norvegicus
cccggtgactgtagccatattcgtt

SEQ ID NO: 620127 - DNA, 25 bp, Rattus norvegicus
catattcgttgtcgtacctggggag

SEQ ID NO: 620128 - DNA, 25 bp, Rattus norvegicus
gcatttccagaaggcgttgtactca

SEQ ID NO: 620129 - DNA, 25 bp, Rattus norvegicus
cgcacacgatctttggtaggtacca

SEQ ID NO: 620130 - DNA, 25 bp, Rattus norvegicus
gatcactccgtacagtggccggcgg

SEQ ID NO: 620131 - DNA, 25 bp, Rattus norvegicus
ggatagcttgtactgcaccgggaaa

SEQ ID NO: 620132 - DNA, 25 bp, Rattus norvegicus
tgcaccgggaaagccactcccaggt

SEQ ID NO: 620133 - DNA, 25 bp, Rattus norvegicus
agccactcccaggtagcgttctatg

SEQ ID NO: 620134 - DNA, 25 bp, Rattus norvegicus
agcgttctatgctgatgcccgccag

SEQ ID NO: 620135 - DNA, 25 bp, Rattus norvegicus
cagccacgtgctgcagtagatactg

SEQ ID NO: 620136 - DNA, 25 bp, Rattus norvegicus
atactgctgtagaagccgaagcccg

SEQ ID NO: 620137 - DNA, 25 bp, Rattus norvegicus
cgaagcccgtgagcgcgcacacgat

SEQ ID NO: 620138 - DNA, 25 bp, Rattus norvegicus
taggtaccagcggaagttggatgca

SEQ ID NO: 620139 - DNA, 25 bp, Rattus norvegicus
ttggatgcagcttccacgatccgga

SEQ ID NO: 620140 - DNA, 25 bp, Rattus norvegicus
ttccacgatccggaagggcagcagc

SEQ ID NO: 620141 - DNA, 25 bp, Rattus norvegicus
agcaagtccgccagggtcagattaa

SEQ ID NO: 620142 - DNA, 25 bp, Rattus norvegicus
ccagggtcagattaagcaggaggat

SEQ ID NO: 620143 - DNA, 25 bp, Rattus norvegicus
gaagcgggatccagacccgggtcca

SEQ ID NO: 620144 - DNA, 25 bp, Rattus norvegicus
gcctcgggtcccttgtcgtggctgc

SEQ ID NO: 620145 - DNA, 25 bp, Rattus norvegicus
accagggtcagcactactgccgagc

SEQ ID NO: 620146 - DNA, 25 bp, Rattus norvegicus
gcctccattttgagccgggcccaga

SEQ ID NO: 620147 - DNA, 25 bp, Rattus norvegicus
gcgcgagctgtcggcgcgcttacct

SEQ ID NO: 620148 - DNA, 25 bp, Rattus norvegicus
ccgccgcgacttgagctttcttttt

SEQ ID NO: 620149 - DNA, 25 bp, Rattus norvegicus
agccgctcgcgctgattttgggaca

SEQ ID NO: 620150 - DNA, 25 bp, Rattus norvegicus
gctcgcgctgattttgggacaaaca

SEQ ID NO: 620151 - DNA, 25 bp, Rattus norvegicus
cgcgctgattttgggacaaacagtg

SEQ ID NO: 620152 - DNA, 25 bp, Rattus norvegicus
tttgggacaaacagtggggtcatgt

SEQ ID NO: 620153 - DNA, 25 bp, Rattus norvegicus
gctccgggccacagctcagctgccc

SEQ ID NO: 620154 - DNA, 25 bp, Rattus norvegicus
tgcttccctgagtgctcgccgccgc

SEQ ID NO: 620155 - DNA, 25 bp, Rattus norvegicus
gcgggatccagacccgggtccagca

SEQ ID NO: 620156 - DNA, 25 bp, Rattus norvegicus
cggcctggggcctgcttccctgagt

SEQ ID NO: 620157 - DNA, 25 bp, Rattus norvegicus
tgcctccagggcctgaaccaagtga

SEQ ID NO: 620158 - DNA, 25 bp, Rattus norvegicus
accaagtgaccgctttgccaggagg

SEQ ID NO: 620159 - DNA, 25 bp, Rattus norvegicus
aaggaccgaactccctgaggacaga

SEQ ID NO: 620160 - DNA, 25 bp, Rattus norvegicus
aggagggcgccctcaccataagcga

SEQ ID NO: 620161 - DNA, 25 bp, Rattus norvegicus
tctgggcgaattccacctgccgaga

SEQ ID NO: 620162 - DNA, 25 bp, Rattus norvegicus
gacctgtgcgcacctgttcgctgct

SEQ ID NO: 620163 - DNA, 25 bp, Rattus norvegicus
tgctctggccaaagttgaaaggacc

SEQ ID NO: 620164 - DNA, 25 bp, Rattus norvegicus
cgctctggaggagttctaacccata

SEQ ID NO: 620165 - DNA, 25 bp, Rattus norvegicus
ccctcccaagtatcccgagagtagg

SEQ ID NO: 620166 - DNA, 25 bp, Rattus norvegicus
gacacacgaagaccacggtagctgg

SEQ ID NO: 620167 - DNA, 25 bp, Rattus norvegicus
ccaatccttacctgggcagaaaatg

SEQ ID NO: 620168 - DNA, 25 bp, Rattus norvegicus
gaacttgggcgaagctcatgccttc

SEQ ID NO: 620169 - DNA, 25 bp, Rattus norvegicus
aatggaaccgcccaggtacacaagg

SEQ ID NO: 620170 - DNA, 25 bp, Rattus norvegicus
tcggtgagaacagcagccctctatc

SEQ ID NO: 620171 - DNA, 25 bp, Rattus norvegicus
tgtctggctccggacgctgctcgcg

SEQ ID NO: 620172 - DNA, 25 bp, Rattus norvegicus
cgcggcggcacctctgtgccaagtg

SEQ ID NO: 620173 - DNA, 25 bp, Rattus norvegicus
tgcatctccacgatccttccgtgtg

SEQ ID NO: 620174 - DNA, 25 bp, Rattus norvegicus
acgatccttccgtgtggtccagggt

SEQ ID NO: 620175 - DNA, 25 bp, Rattus norvegicus
cacattgcagtctgcggggctctgc

SEQ ID NO: 620176 - DNA, 25 bp, Rattus norvegicus
gcccaccacgagagccagcagcgtc

SEQ ID NO: 620177 - DNA, 25 bp, Rattus norvegicus
cgtccgggacatgcccgagttctca

SEQ ID NO: 620178 - DNA, 25 bp, Rattus norvegicus
gcttcgtggcttctgcgcaccggtt

SEQ ID NO: 620179 - DNA, 25 bp, Rattus norvegicus
caccggttgcgaggtctgggtcact

SEQ ID NO: 620180 - DNA, 25 bp, Rattus norvegicus
tcgcaccgcgcacaacttcccaggc

SEQ ID NO: 620181 - DNA, 25 bp, Rattus norvegicus
ctgtgggtgtcacattgcagtctgc

SEQ ID NO: 620182 - DNA, 25 bp, Rattus norvegicus
cctcacgcggctgtgggtgtcacat

SEQ ID NO: 620183 - DNA, 25 bp, Rattus norvegicus
cgagttctcactcggtatccatgtc

SEQ ID NO: 620184 - DNA, 25 bp, Rattus norvegicus
cactcggtatccatgtctcccggtt

SEQ ID NO: 620185 - DNA, 25 bp, Rattus norvegicus
gtcctttcatctgggtgccgggtca

SEQ ID NO: 620186 - DNA, 25 bp, Rattus norvegicus
ttactcgaacatggatgcggcgccc

SEQ ID NO: 620187 - DNA, 25 bp, Rattus norvegicus
ctggtgcttactcgaacatggatgc

SEQ ID NO: 620188 - DNA, 25 bp, Rattus norvegicus
gaggcctggtgcttactcgaacatg

SEQ ID NO: 620189 - DNA, 25 bp, Rattus norvegicus
tcgctcctacatgtcgctcgggaac

SEQ ID NO: 620190 - DNA, 25 bp, Rattus norvegicus
gatccttgtcgctcctacatgtcgc

SEQ ID NO: 620191 - DNA, 25 bp, Rattus norvegicus
cccatgcactagagacacgtgtacc

SEQ ID NO: 620192 - DNA, 25 bp, Rattus norvegicus
tcgggtctcgccaccggtctgcaat

SEQ ID NO: 620193 - DNA, 25 bp, Rattus norvegicus
gtacgcgtcccaggcccgcagtgat

SEQ ID NO: 620194 - DNA, 25 bp, Rattus norvegicus
ggagctccctgctgcctgtacgcgt

SEQ ID NO: 620195 - DNA, 25 bp, Rattus norvegicus
gactattccggcctaggggagctcc

SEQ ID NO: 620196 - DNA, 25 bp, Rattus norvegicus
gctgcagggcctgcacagtattgcg

SEQ ID NO: 620197 - DNA, 25 bp, Rattus norvegicus
tcagggctcctcgagggggactatt

SEQ ID NO: 620198 - DNA, 25 bp, Rattus norvegicus
cggaccctgccacccgcacaaaagg

SEQ ID NO: 620199 - DNA, 25 bp, Rattus norvegicus
cgtggatatcatgtttgtcgtggac

SEQ ID NO: 620200 - DNA, 25 bp, Rattus norvegicus
acagcgcggtacctgtggctatacc

SEQ ID NO: 620201 - DNA, 25 bp, Rattus norvegicus
cactaatgatgaggtggtcagccac

SEQ ID NO: 620202 - DNA, 25 bp, Rattus norvegicus
cgaaccacctacgtcaacactaatg

SEQ ID NO: 620203 - DNA, 25 bp, Rattus norvegicus
ggacatcgtcatcaacttccgaacc

SEQ ID NO: 620204 - DNA, 25 bp, Rattus norvegicus
tgtcgtggacatcgtcatcaacttc

SEQ ID NO: 620205 - DNA, 25 bp, Rattus norvegicus
tgtggctatacctgcagcccgctca

SEQ ID NO: 620206 - DNA, 25 bp, Rattus norvegicus
ccaggacgaatcacagcgcggtacc

SEQ ID NO: 620207 - DNA, 25 bp, Rattus norvegicus
cacgccctactctgccgcctttcta

SEQ ID NO: 620208 - DNA, 25 bp, Rattus norvegicus
gcctttctactcagcgaccaggacg

SEQ ID NO: 620209 - DNA, 25 bp, Rattus norvegicus
tctactcagcgaccaggacgaatca

SEQ ID NO: 620210 - DNA, 25 bp, Rattus norvegicus
gaggtggtcagccacccacgacgca

SEQ ID NO: 620211 - DNA, 25 bp, Rattus norvegicus
ggtggacctcatcgtggatatcatg

SEQ ID NO: 620212 - DNA, 25 bp, Rattus norvegicus
cgctcaccgtggtggacctcatcgt

SEQ ID NO: 620213 - DNA, 25 bp, Rattus norvegicus
agaacgctcagttcggtatccgacg

SEQ ID NO: 620214 - DNA, 25 bp, Rattus norvegicus
gcttcttccgcatggggactggcga

SEQ ID NO: 620215 - DNA, 25 bp, Rattus norvegicus
cgtcgctcagaacggtggcttcttc

SEQ ID NO: 620216 - DNA, 25 bp, Rattus norvegicus
gcgtcgcgctactgtggaggacaca

SEQ ID NO: 620217 - DNA, 25 bp, Rattus norvegicus
ccctacgcactttctcggtgctgga

SEQ ID NO: 620218 - DNA, 25 bp, Rattus norvegicus
cgcacctttgtgtcgcacttcgagg

SEQ ID NO: 620219 - DNA, 25 bp, Rattus norvegicus
agaacaggagagctggcctccgcca

SEQ ID NO: 620220 - DNA, 25 bp, Rattus norvegicus
tgcacgcaggcagcccagaacagga

SEQ ID NO: 620221 - DNA, 25 bp, Rattus norvegicus
gacgatgacctgctgctgccttacc

SEQ ID NO: 620222 - DNA, 25 bp, Rattus norvegicus
gcagggtttcccgagacgatgacct

SEQ ID NO: 620223 - DNA, 25 bp, Rattus norvegicus
aaacccgcgctgctcggtttgcttg

SEQ ID NO: 620224 - DNA, 25 bp, Rattus norvegicus
ggggctgttcttcaaacccgcgctg

SEQ ID NO: 620225 - DNA, 25 bp, Rattus norvegicus
gtgaccggagcaccaagccaatatg

SEQ ID NO: 620226 - DNA, 25 bp, Rattus norvegicus
tatccgacgcgacgggaccttagtc

SEQ ID NO: 620227 - DNA, 25 bp, Rattus norvegicus
atggtgccctccttggtcccggcgg

SEQ ID NO: 620228 - DNA, 25 bp, Rattus norvegicus
cagaccctggtacgttgtggtgagc

SEQ ID NO: 620229 - DNA, 25 bp, Rattus norvegicus
acgctgaggcagaccctggtacgtt

SEQ ID NO: 620230 - DNA, 25 bp, Rattus norvegicus
cactgacgctgaggcagaccctggt

SEQ ID NO: 620231 - DNA, 25 bp, Rattus norvegicus
gaccctggtacgttgtggtgagccc

SEQ ID NO: 620232 - DNA, 25 bp, Rattus norvegicus
tgcttggcactgacgctgaggcaga

SEQ ID NO: 620233 - DNA, 25 bp, Rattus norvegicus
ggccgcctccttctgacgctcactt

SEQ ID NO: 620234 - DNA, 25 bp, Rattus norvegicus
tgctctggccgcctccttctgacgc

SEQ ID NO: 620235 - DNA, 25 bp, Rattus norvegicus
tgcttgccctccctgtggctgcttg

SEQ ID NO: 620236 - DNA, 25 bp, Rattus norvegicus
cctgtggctgcttggcactgacgct

SEQ ID NO: 620237 - DNA, 25 bp, Rattus norvegicus
ctccctgtggctgcttggcactgac

SEQ ID NO: 620238 - DNA, 25 bp, Rattus norvegicus
ccctggcggggctctcactgaggcg

SEQ ID NO: 620239 - DNA, 25 bp, Rattus norvegicus
ttgccctccctgtggctgcttggca

SEQ ID NO: 620240 - DNA, 25 bp, Rattus norvegicus
gacatggtgccctccttggtcccgg

SEQ ID NO: 620241 - DNA, 25 bp, Rattus norvegicus
cctcagagctacatttccaaacgtc

SEQ ID NO: 620242 - DNA, 25 bp, Rattus norvegicus
aaagcctggaatatcgcaacgcgtc

SEQ ID NO: 620243 - DNA, 25 bp, Rattus norvegicus
ccagccttgctggttgggtaggtta

SEQ ID NO: 620244 - DNA, 25 bp, Rattus norvegicus
tgcccaggacagctttgaatctatc

SEQ ID NO: 620245 - DNA, 25 bp, Rattus norvegicus
ttgtccaggcgagcagcgaaccttc

SEQ ID NO: 620246 - DNA, 25 bp, Rattus norvegicus
tcttagaattcaaagggaaagcctg

SEQ ID NO: 620247 - DNA, 25 bp, Rattus norvegicus
ggacttctctgagcggcttttctta

SEQ ID NO: 620248 - DNA, 25 bp, Rattus norvegicus
agacccgggatcctgggacttctct

SEQ ID NO: 620249 - DNA, 25 bp, Rattus norvegicus
cgagcgacctactggcaggaaacca

SEQ ID NO: 620250 - DNA, 25 bp, Rattus norvegicus
cagagactcagaagcgagcgaccta

SEQ ID NO: 620251 - DNA, 25 bp, Rattus norvegicus
tgaaacttcagagccagcagagact

SEQ ID NO: 620252 - DNA, 25 bp, Rattus norvegicus
ccagcgtccaccaggtgaaacttca

SEQ ID NO: 620253 - DNA, 25 bp, Rattus norvegicus
ccttcggaaggcagaggctaaacct

SEQ ID NO: 620254 - DNA, 25 bp, Rattus norvegicus
tttgagctttatggtggcttcgccc

SEQ ID NO: 620255 - DNA, 25 bp, Rattus norvegicus
gctcaccaaagtagtctcgcgccgt

SEQ ID NO: 620256 - DNA, 25 bp, Rattus norvegicus
cgtaccccaggctgatgccgctgga

SEQ ID NO: 620257 - DNA, 25 bp, Rattus norvegicus
cggcatctctgaatccctagcggaa

SEQ ID NO: 620258 - DNA, 25 bp, Rattus norvegicus
gaggaaggagactgcgcagcggcct

SEQ ID NO: 620259 - DNA, 25 bp, Rattus norvegicus
agggactcctttgccccgtcagtga

SEQ ID NO: 620260 - DNA, 25 bp, Rattus norvegicus
cgcggcgaaggaatgcgcgcgcaac

SEQ ID NO: 620261 - DNA, 25 bp, Rattus norvegicus
ccgccgcatcgtccgcctgcccgca

SEQ ID NO: 620262 - DNA, 25 bp, Rattus norvegicus
cagcaggtctgcacaggcgccggct

SEQ ID NO: 620263 - DNA, 25 bp, Rattus norvegicus
cagcgacggcaatgggaaggggaac

SEQ ID NO: 620264 - DNA, 25 bp, Rattus norvegicus
accaaagtagtctcgcgccgtgcgc

SEQ ID NO: 620265 - DNA, 25 bp, Rattus norvegicus
gcgcacgctcaccaaagtagtctcg

SEQ ID NO: 620266 - DNA, 25 bp, Rattus norvegicus
ctagcggaagaacggcccctaccag

SEQ ID NO: 620267 - DNA, 25 bp, Rattus norvegicus
tctgaatccctagcggaagaacggc

SEQ ID NO: 620268 - DNA, 25 bp, Rattus norvegicus
tccagttcccgcgtgagcgcctcca

SEQ ID NO: 620269 - DNA, 25 bp, Rattus norvegicus
tgtaaatggggaaactgcctcggga

SEQ ID NO: 620270 - DNA, 25 bp, Rattus norvegicus
tcccagtgtaaatggggaaactgcc

SEQ ID NO: 620271 - DNA, 25 bp, Rattus norvegicus
tctcttcttgcatcatcccagtgta

SEQ ID NO: 620272 - DNA, 25 bp, Rattus norvegicus
atctacaggggtctcttcttgcatc

SEQ ID NO: 620273 - DNA, 25 bp, Rattus norvegicus
tcacagcatctacaggggtctcttc

SEQ ID NO: 620274 - DNA, 25 bp, Rattus norvegicus
taaagtcacagcatctacaggggtc

SEQ ID NO: 620275 - DNA, 25 bp, Rattus norvegicus
gccgcgagatcgttattttaagtta

SEQ ID NO: 620276 - DNA, 25 bp, Rattus norvegicus
tgcaaaccgctctgccgcgagatcg

SEQ ID NO: 620277 - DNA, 25 bp, Rattus norvegicus
gagccggagtccgacgtctcaccaa

SEQ ID NO: 620278 - DNA, 25 bp, Rattus norvegicus
atgaatgcatgtgtgctcgcccggg

SEQ ID NO: 620279 - DNA, 25 bp, Rattus norvegicus
gaggtatattcgaattaaagtcaca

SEQ ID NO: 620280 - DNA, 25 bp, Rattus norvegicus
tggcagactccggaatgaatgcatg

SEQ ID NO: 620281 - DNA, 25 bp, Rattus norvegicus
tgcggctggtggctgcaaaccgctc

SEQ ID NO: 620282 - DNA, 25 bp, Rattus norvegicus
gctctgccgcgagatcgttatttta

SEQ ID NO: 620283 - DNA, 25 bp, Rattus norvegicus
aaacgtacagaagccgatggaacgg

SEQ ID NO: 620284 - DNA, 25 bp, Rattus norvegicus
cctacctgcgcgtctggttgtcgct

SEQ ID NO: 620285 - DNA, 25 bp, Rattus norvegicus
acagggaacgttatccgcgcacgcg

SEQ ID NO: 620286 - DNA, 25 bp, Rattus norvegicus
acagcgcgagctacggtggctgaca

SEQ ID NO: 620287 - DNA, 25 bp, Rattus norvegicus
aactgggttctccacgtgacagcgc

SEQ ID NO: 620288 - DNA, 25 bp, Rattus norvegicus
tgacggccgccataacaactgggtt

SEQ ID NO: 620289 - DNA, 25 bp, Rattus norvegicus
gagtctcgaaatcccagcagcaccg

SEQ ID NO: 620290 - DNA, 25 bp, Rattus norvegicus
ttggggcagcccttcaccgccgagt

SEQ ID NO: 620291 - DNA, 25 bp, Rattus norvegicus
atcttgctagccgtccaggcggcgg

SEQ ID NO: 620292 - DNA, 25 bp, Rattus norvegicus
ggaacgccgcctatcttgctagccg

SEQ ID NO: 620293 - DNA, 25 bp, Rattus norvegicus
cagtacacctgcacgacgagcgcga

SEQ ID NO: 620294 - DNA, 25 bp, Rattus norvegicus
tgtcgctgcagtcccgacgggcaca

SEQ ID NO: 620295 - DNA, 25 bp, Rattus norvegicus
gggagccttccagcgggcagtacac

SEQ ID NO: 620296 - DNA, 25 bp, Rattus norvegicus
cgggcacaggcgaaaacgtacagaa

SEQ ID NO: 620297 - DNA, 25 bp, Rattus norvegicus
tgcctcaaaaagttcgcgcagcttg

SEQ ID NO: 620298 - DNA, 25 bp, Rattus norvegicus
gcaagtcagtaccagtgcgcgcagc

SEQ ID NO: 620299 - DNA, 25 bp, Rattus norvegicus
agcgcgcagcaagtcagtaccagtg

SEQ ID NO: 620300 - DNA, 25 bp, Rattus norvegicus
gaagcgctccggatctgcctcaaaa

SEQ ID NO: 620301 - DNA, 25 bp, Rattus norvegicus
gttggcagagttcgcccggtgccac

SEQ ID NO: 620302 - DNA, 25 bp, Rattus norvegicus
gaagtacacggagcagtacgtgcac

SEQ ID NO: 620303 - DNA, 25 bp, Rattus norvegicus
gcacctgaagtggttgaagcgctcc

SEQ ID NO: 620304 - DNA, 25 bp, Rattus norvegicus
ctccggatctgcctcaaaaagttcg

SEQ ID NO: 620305 - DNA, 25 bp, Rattus norvegicus
cagcttgaggttggcagagttcgcc

SEQ ID NO: 620306 - DNA, 25 bp, Rattus norvegicus
cacggagcagtacgtgcacggaaga

SEQ ID NO: 620307 - DNA, 25 bp, Rattus norvegicus
gcccggtgccactccagcagcttct

SEQ ID NO: 620308 - DNA, 25 bp, Rattus norvegicus
cagcagcttctggaactccgggttc

SEQ ID NO: 620309 - DNA, 25 bp, Rattus norvegicus
gccatggcgggacccgagaagtaca

SEQ ID NO: 620310 - DNA, 25 bp, Rattus norvegicus
ctccgtgcgtgcacctgaagtggtt

SEQ ID NO: 620311 - DNA, 25 bp, Rattus norvegicus
gccaggcatgcgcacgtacattctg

SEQ ID NO: 620312 - DNA, 25 bp, Rattus norvegicus
cccagttgagggacggttgtgcaca

SEQ ID NO: 620313 - DNA, 25 bp, Rattus norvegicus
ctcggtgaattagaaagcgcctgca

SEQ ID NO: 620314 - DNA, 25 bp, Rattus norvegicus
atgcgcacgtacattctggggcggc

SEQ ID NO: 620315 - DNA, 25 bp, Rattus norvegicus
accacgcgcatggaggccgcgagca

SEQ ID NO: 620316 - DNA, 25 bp, Rattus norvegicus
gcgagcacgcgcagcacctaggctg

SEQ ID NO: 620317 - DNA, 25 bp, Rattus norvegicus
cacctaggctggctgcgtgtaggct

SEQ ID NO: 620318 - DNA, 25 bp, Rattus norvegicus
caggtcggagctcggtgaattagaa

SEQ ID NO: 620319 - DNA, 25 bp, Rattus norvegicus
attagaaagcgcctgcatttgcacg

SEQ ID NO: 620320 - DNA, 25 bp, Rattus norvegicus
cgcctgcatttgcacgtctgggatg

SEQ ID NO: 620321 - DNA, 25 bp, Rattus norvegicus
gcatttgcacgtctgggatggttga

SEQ ID NO: 620322 - DNA, 25 bp, Rattus norvegicus
gaaatactctgcagtgcgcatgccc

SEQ ID NO: 620323 - DNA, 25 bp, Rattus norvegicus
acggttgtgcacacgcgctctccag

SEQ ID NO: 620324 - DNA, 25 bp, Rattus norvegicus
tctgggatggttgaaatactctgca

SEQ ID NO: 620325 - DNA, 25 bp, Rattus norvegicus
gcctcgatgccagtcgctcttgcga

SEQ ID NO: 620326 - DNA, 25 bp, Rattus norvegicus
accggaagtgacgtctgctgtcggc

SEQ ID NO: 620327 - DNA, 25 bp, Rattus norvegicus
gcgcccacgggctcaacgagagcta

SEQ ID NO: 620328 - DNA, 25 bp, Rattus norvegicus
gcccggaccggctgtgtacaccgga

SEQ ID NO: 620329 - DNA, 25 bp, Rattus norvegicus
gatgccagtcgctcttgcgactcgc

SEQ ID NO: 620330 - DNA, 25 bp, Rattus norvegicus
tgtgtacaccggaagtgacgtctgc

SEQ ID NO: 620331 - DNA, 25 bp, Rattus norvegicus
gcagccgcgtccttcagagcggacg

SEQ ID NO: 620332 - DNA, 25 bp, Rattus norvegicus
caaggcagccgcgtccttcagagcg

SEQ ID NO: 620333 - DNA, 25 bp, Rattus norvegicus
tgccgcgagcttccgggaacggatc

SEQ ID NO: 620334 - DNA, 25 bp, Rattus norvegicus
ccttggcgcacggtgccgcgagctt

SEQ ID NO: 620335 - DNA, 25 bp, Rattus norvegicus
aggccgctagcccttggcgcacggt

SEQ ID NO: 620336 - DNA, 25 bp, Rattus norvegicus
acccaggtcgcccacaggccgctag

SEQ ID NO: 620337 - DNA, 25 bp, Rattus norvegicus
cacgggctcaacgagagctaggaag

SEQ ID NO: 620338 - DNA, 25 bp, Rattus norvegicus
gcgcccgtacctcacctgcgacgcg

SEQ ID NO: 620339 - DNA, 25 bp, Rattus norvegicus
ctagaccttgcgtgaaaactggatg

SEQ ID NO: 620340 - DNA, 25 bp, Rattus norvegicus
cgccgtacctttggcgagggctaca

SEQ ID NO: 620341 - DNA, 25 bp, Rattus norvegicus
cggaaatgtttcacggcacctagac

SEQ ID NO: 620342 - DNA, 25 bp, Rattus norvegicus
tctcgcgagactcggtgtgctcacc

SEQ ID NO: 620343 - DNA, 25 bp, Rattus norvegicus
ttcttcagaaccaacatggcggctg

SEQ ID NO: 620344 - DNA, 25 bp, Rattus norvegicus
ggcgcctcacagcagcttcttcaga

SEQ ID NO: 620345 - DNA, 25 bp, Rattus norvegicus
ccgcgcactcgttccctggatggaa

SEQ ID NO: 620346 - DNA, 25 bp, Rattus norvegicus
ctggttcccgggactttgagatcgc

SEQ ID NO: 620347 - DNA, 25 bp, Rattus norvegicus
gtcttggaagacacgaacctgggtg

SEQ ID NO: 620348 - DNA, 25 bp, Rattus norvegicus
tccggctttgttcggcgcttcagaa

SEQ ID NO: 620349 - DNA, 25 bp, Rattus norvegicus
ctctaggtaggcgtcaagattcttc

SEQ ID NO: 620350 - DNA, 25 bp, Rattus norvegicus
ccgacccagatgaggaacgctgaga

SEQ ID NO: 620351 - DNA, 25 bp, Rattus norvegicus
atcccgcctggtgaagctgactgcg

SEQ ID NO: 620352 - DNA, 25 bp, Rattus norvegicus
cccggggaatcaacacatccgcatt

SEQ ID NO: 620353 - DNA, 25 bp, Rattus norvegicus
cgacagtagccgttgagagggaaac

SEQ ID NO: 620354 - DNA, 25 bp, Rattus norvegicus
ttgcacatgacatctccggtctccg

SEQ ID NO: 620355 - DNA, 25 bp, Rattus norvegicus
cgttgacagagttgcacatgacatc

SEQ ID NO: 620356 - DNA, 25 bp, Rattus norvegicus
gtcctggttccagccggcgttgaca

SEQ ID NO: 620357 - DNA, 25 bp, Rattus norvegicus
gagttgagtcgacagtagccgttga

SEQ ID NO: 620358 - DNA, 25 bp, Rattus norvegicus
tccgggaagacctcctcaatgaggg

SEQ ID NO: 620359 - DNA, 25 bp, Rattus norvegicus
ctcaatgagggccttctctccactg

SEQ ID NO: 620360 - DNA, 25 bp, Rattus norvegicus
agggccttctctccactgagtgcga

SEQ ID NO: 620361 - DNA, 25 bp, Rattus norvegicus
tctccactgagtgcgatccgttcgc

SEQ ID NO: 620362 - DNA, 25 bp, Rattus norvegicus
agtgcgatccgttcgcccaggtcag

SEQ ID NO: 620363 - DNA, 25 bp, Rattus norvegicus
atgacatctccggtctccgggaaga

SEQ ID NO: 620364 - DNA, 25 bp, Rattus norvegicus
ggggtgacccgcaccaccaggcagt

SEQ ID NO: 620365 - DNA, 25 bp, Rattus norvegicus
agtcacaggcccggctacgacgtcg

SEQ ID NO: 620366 - DNA, 25 bp, Rattus norvegicus
ccggcgttgacagagttgcacatga

SEQ ID NO: 620367 - DNA, 25 bp, Rattus norvegicus
ctctgccaagtcctctgcccgctac

SEQ ID NO: 620368 - DNA, 25 bp, Rattus norvegicus
gtgcccatgactgcgcgctggtgcc

SEQ ID NO: 620369 - DNA, 25 bp, Rattus norvegicus
gccgtcagtcatttcgggtcgaccc

SEQ ID NO: 620370 - DNA, 25 bp, Rattus norvegicus
gtcaccatggccgtcagtcatttcg

SEQ ID NO: 620371 - DNA, 25 bp, Rattus norvegicus
tagccagcgccagtcggagccagcg

SEQ ID NO: 620372 - DNA, 25 bp, Rattus norvegicus
aacccggtctcgtgcggtctggcac

SEQ ID NO: 620373 - DNA, 25 bp, Rattus norvegicus
cccgcggtccgctagagacgtgtcg

SEQ ID NO: 620374 - DNA, 25 bp, Rattus norvegicus
gctggccaggctggtgcccatgact

SEQ ID NO: 620375 - DNA, 25 bp, Rattus norvegicus
ctctcgtgccgctggccaggctggt

SEQ ID NO: 620376 - DNA, 25 bp, Rattus norvegicus
cgccatgtaagtcagccgcctgtca

SEQ ID NO: 620377 - DNA, 25 bp, Rattus norvegicus
gccgctgtcactgcctctgccaagt

SEQ ID NO: 620378 - DNA, 25 bp, Rattus norvegicus
tcccgggtagccagcgccagtcgga

SEQ ID NO: 620379 - DNA, 25 bp, Rattus norvegicus
cgctagagacgtgtcgcctgccgcg

SEQ ID NO: 620380 - DNA, 25 bp, Rattus norvegicus
agggagcggacccagcgtccaccct

SEQ ID NO: 620381 - DNA, 25 bp, Rattus norvegicus
cagcagtttggacgtccgcaggaaa

SEQ ID NO: 620382 - DNA, 25 bp, Rattus norvegicus
agccggttgcggacttaccttgaag

SEQ ID NO: 620383 - DNA, 25 bp, Rattus norvegicus
ttttttgcggttgccatgacaaccg

SEQ ID NO: 620384 - DNA, 25 bp, Rattus norvegicus
ccgcgggtccatttattaagtcaca

SEQ ID NO: 620385 - DNA, 25 bp, Rattus norvegicus
tccatttattaagtcacagcgtccc

SEQ ID NO: 620386 - DNA, 25 bp, Rattus norvegicus
tgtaaatgccacgacacagacggcg

SEQ ID NO: 620387 - DNA, 25 bp, Rattus norvegicus
gtccgcaggaaactcaggatgtagc

SEQ ID NO: 620388 - DNA, 25 bp, Rattus norvegicus
tgccgccagccggttgcggacttac

SEQ ID NO: 620389 - DNA, 25 bp, Rattus norvegicus
taccttgaagtcatctggaagcagc

SEQ ID NO: 620390 - DNA, 25 bp, Rattus norvegicus
tctggaagcagcagtttggacgtcc

SEQ ID NO: 620391 - DNA, 25 bp, Rattus norvegicus
ttgccatgacaaccgcgggtccatt

SEQ ID NO: 620392 - DNA, 25 bp, Rattus norvegicus
actcaggatgtagcggaaaatctcc

SEQ ID NO: 620393 - DNA, 25 bp, Rattus norvegicus
tttggacgtccgcaggaaactcagg

SEQ ID NO: 620394 - DNA, 25 bp, Rattus norvegicus
atgccacgacacagacggcgcaggg

SEQ ID NO: 620395 - DNA, 25 bp, Rattus norvegicus
taccagtgcgtctggcatgagactc

SEQ ID NO: 620396 - DNA, 25 bp, Rattus norvegicus
tttctcggcattgcagccactttgg

SEQ ID NO: 620397 - DNA, 25 bp, Rattus norvegicus
tgagcttggaaccactaccagtgcg

SEQ ID NO: 620398 - DNA, 25 bp, Rattus norvegicus
ggtctcgtcctggagttactttctc

SEQ ID NO: 620399 - DNA, 25 bp, Rattus norvegicus
ccagctacatggagccggtttcaga

SEQ ID NO: 620400 - DNA, 25 bp, Rattus norvegicus
tccttttctataatttgggcgccaa

SEQ ID NO: 620401 - DNA, 25 bp, Rattus norvegicus
aagggcagcgatccggttccaaatt

SEQ ID NO: 620402 - DNA, 25 bp, Rattus norvegicus
gggcgtcagaaaacgcacatctgtc

SEQ ID NO: 620403 - DNA, 25 bp, Rattus norvegicus
ttagagtcgcaattagctccgcgcg

SEQ ID NO: 620404 - DNA, 25 bp, Rattus norvegicus
tgcggaggacctggacgcatatacc

SEQ ID NO: 620405 - DNA, 25 bp, Rattus norvegicus
ggcactcgagcccatactggaacca

SEQ ID NO: 620406 - DNA, 25 bp, Rattus norvegicus
gccgcgctccgcgacaaaaaatgta

SEQ ID NO: 620407 - DNA, 25 bp, Rattus norvegicus
gtcaccagctctgcagggcactcga

SEQ ID NO: 620408 - DNA, 25 bp, Rattus norvegicus
catctgtcccgttagagactttttc

SEQ ID NO: 620409 - DNA, 25 bp, Rattus norvegicus
cccagattcaactctgagaggcagg

SEQ ID NO: 620410 - DNA, 25 bp, Rattus norvegicus
ctccatgctcggcagagcctgctta

SEQ ID NO: 620411 - DNA, 25 bp, Rattus norvegicus
gacgtggcgcagctccctgccggat

SEQ ID NO: 620412 - DNA, 25 bp, Rattus norvegicus
cctttgttcgccacctgggctcggt

SEQ ID NO: 620413 - DNA, 25 bp, Rattus norvegicus
gcctgcttagggtagtccagagtta

SEQ ID NO: 620414 - DNA, 25 bp, Rattus norvegicus
cgggcgaaagcgtctccagcgtcgc

SEQ ID NO: 620415 - DNA, 25 bp, Rattus norvegicus
cggccaactacctcgcgggcgaaag

SEQ ID NO: 620416 - DNA, 25 bp, Rattus norvegicus
gtcctcgctcaacgtcggccaacta

SEQ ID NO: 620417 - DNA, 25 bp, Rattus norvegicus
gaatcgcggcgaaatccgacagcca

SEQ ID NO: 620418 - DNA, 25 bp, Rattus norvegicus
gtttcaagcagctttgcaaagagcc

SEQ ID NO: 620419 - DNA, 25 bp, Rattus norvegicus
tgggagaagtttcaagcagctttgc

SEQ ID NO: 620420 - DNA, 25 bp, Rattus norvegicus
ccatggcgagtttgggagaagtttc

SEQ ID NO: 620421 - DNA, 25 bp, Rattus norvegicus
cgccgccacatccatggcgagtttg

SEQ ID NO: 620422 - DNA, 25 bp, Rattus norvegicus
tccagagttactttgctcggggagg

SEQ ID NO: 620423 - DNA, 25 bp, Rattus norvegicus
gctgagccaacgactgtccacggtg

SEQ ID NO: 620424 - DNA, 25 bp, Rattus norvegicus
gtccctgcagctggcatctttttga

SEQ ID NO: 620425 - DNA, 25 bp, Rattus norvegicus
ctgtacttggcgcaggcttcttgca

SEQ ID NO: 620426 - DNA, 25 bp, Rattus norvegicus
cttgggaacctcacagtacagcacg

SEQ ID NO: 620427 - DNA, 25 bp, Rattus norvegicus
gcttccagttggagcagcctgcctt

SEQ ID NO: 620428 - DNA, 25 bp, Rattus norvegicus
gaccgtgttgtgttggatatccgca

SEQ ID NO: 620429 - DNA, 25 bp, Rattus norvegicus
atgccctgccggtcgaaagtatcca

SEQ ID NO: 620430 - DNA, 25 bp, Rattus norvegicus
gggttcccggacaaagagcatcttg

SEQ ID NO: 620431 - DNA, 25 bp, Rattus norvegicus
ttccctggcgcatggatgagacgca

SEQ ID NO: 620432 - DNA, 25 bp, Rattus norvegicus
gacgaactcggggaactgcacacca

SEQ ID NO: 620433 - DNA, 25 bp, Rattus norvegicus
tggcgtcgtcctccatgctctcaaa

SEQ ID NO: 620434 - DNA, 25 bp, Rattus norvegicus
tgcctgtccttgaacctcgggaatg

SEQ ID NO: 620435 - DNA, 25 bp, Rattus norvegicus
cgggccaggatagccttaccaaaca

SEQ ID NO: 620436 - DNA, 25 bp, Rattus norvegicus
ctgttgggatgctcaaacttgtctc

SEQ ID NO: 620437 - DNA, 25 bp, Rattus norvegicus
gagcacaaaacaggccggggcccta

SEQ ID NO: 620438 - DNA, 25 bp, Rattus norvegicus
gacaccttacgcctcctggtaggga

SEQ ID NO: 620439 - DNA, 25 bp, Rattus norvegicus
gagctaaggtcgcttgtaacttccc

SEQ ID NO: 620440 - DNA, 25 bp, Rattus norvegicus
gtctcagttccaagcgcacgccaaa

SEQ ID NO: 620441 - DNA, 25 bp, Rattus norvegicus
agtttacacgcacccagcatccagg

SEQ ID NO: 620442 - DNA, 25 bp, Rattus norvegicus
ccaggcgcggagaaaaccaagaatc

SEQ ID NO: 620443 - DNA, 25 bp, Rattus norvegicus
cagcacctgcagcttgagactctga

SEQ ID NO: 620444 - DNA, 25 bp, Rattus norvegicus
ttgcgctcagaacggtcccggcttc

SEQ ID NO: 620445 - DNA, 25 bp, Rattus norvegicus
catccctgggtgaactaccagcgta

SEQ ID NO: 620446 - DNA, 25 bp, Rattus norvegicus
gatgtgggacgcagccacttacctg

SEQ ID NO: 620447 - DNA, 25 bp, Rattus norvegicus
cttacctggcacaaccggagctttc

SEQ ID NO: 620448 - DNA, 25 bp, Rattus norvegicus
gtctcttcccggctgtgctaccgaa

SEQ ID NO: 620449 - DNA, 25 bp, Rattus norvegicus
gcgtgctcctattgggtcctctgca

SEQ ID NO: 620450 - DNA, 25 bp, Rattus norvegicus
gagactctgaaccatgtctagtggc

SEQ ID NO: 620451 - DNA, 25 bp, Rattus norvegicus
gtggtattttcacactgtgctcgga

SEQ ID NO: 620452 - DNA, 25 bp, Rattus norvegicus
cgtggtctgaacgagtggtattttc

SEQ ID NO: 620453 - DNA, 25 bp, Rattus norvegicus
cgcagcggcaggtatggccctgctc

SEQ ID NO: 620454 - DNA, 25 bp, Rattus norvegicus
tgccataaagcgtgtgggcggccac

SEQ ID NO: 620455 - DNA, 25 bp, Rattus norvegicus
cagacaagttgtgccataaagcgtg

SEQ ID NO: 620456 - DNA, 25 bp, Rattus norvegicus
agagcctttaagcacagacaagttg

SEQ ID NO: 620457 - DNA, 25 bp, Rattus norvegicus
ccaggtttgttcagagcctttaagc

SEQ ID NO: 620458 - DNA, 25 bp, Rattus norvegicus
cttggttggtgtccaggtttgttca

SEQ ID NO: 620459 - DNA, 25 bp, Rattus norvegicus
cgcaatgacttctgcctccaggcag

SEQ ID NO: 620460 - DNA, 25 bp, Rattus norvegicus
aagttgccctccgactccgcaatga

SEQ ID NO: 620461 - DNA, 25 bp, Rattus norvegicus
ccctcagagccagaaaacgaagttg

SEQ ID NO: 620462 - DNA, 25 bp, Rattus norvegicus
ggcatatttcagacccggaaccctc

SEQ ID NO: 620463 - DNA, 25 bp, Rattus norvegicus
gtcgcggaggcatatttcagacccg

SEQ ID NO: 620464 - DNA, 25 bp, Rattus norvegicus
acacctggcggcatgattcgttcca

SEQ ID NO: 620465 - DNA, 25 bp, Rattus norvegicus
ggcaggttcagctgacgccgcactc

SEQ ID NO: 620466 - DNA, 25 bp, Rattus norvegicus
gcactccacgtgacgctagggccga

SEQ ID NO: 620467 - DNA, 25 bp, Rattus norvegicus
cacgtgacgctagggccgagtgaac

SEQ ID NO: 620468 - DNA, 25 bp, Rattus norvegicus
agtgaacatggcgtctaccgtgcgg

SEQ ID NO: 620469 - DNA, 25 bp, Rattus norvegicus
tctaccgtgcggtgagtctgagctt

SEQ ID NO: 620470 - DNA, 25 bp, Rattus norvegicus
agtctgagcttgtcccttgtgctgc

SEQ ID NO: 620471 - DNA, 25 bp, Rattus norvegicus
ccgcgtagaggttgcttgctttggt

SEQ ID NO: 620472 - DNA, 25 bp, Rattus norvegicus
gcttgctttggtgttcctggttaaa

SEQ ID NO: 620473 - DNA, 25 bp, Rattus norvegicus
cctggttaaatagtgtgtgacagcc

SEQ ID NO: 620474 - DNA, 25 bp, Rattus norvegicus
cccgagctctgactggagttgctgt

SEQ ID NO: 620475 - DNA, 25 bp, Rattus norvegicus
tccggggcaccggaaccgagagcca

SEQ ID NO: 620476 - DNA, 25 bp, Rattus norvegicus
gcgagtggtacttgcagagaccctg

SEQ ID NO: 620477 - DNA, 25 bp, Rattus norvegicus
gaagccgctccgcccatttaaaatc

SEQ ID NO: 620478 - DNA, 25 bp, Rattus norvegicus
tcagaggaaccctggcaggttcagc

SEQ ID NO: 620479 - DNA, 25 bp, Rattus norvegicus
gtgttgcccgcaggttgcatcagac

SEQ ID NO: 620480 - DNA, 25 bp, Rattus norvegicus
tgcccgcaggttgcatcagacgccg

SEQ ID NO: 620481 - DNA, 25 bp, Rattus norvegicus
ggccttccgggccaacctgctgaat

SEQ ID NO: 620482 - DNA, 25 bp, Rattus norvegicus
ttccgggccaacctgctgaatccgg

SEQ ID NO: 620483 - DNA, 25 bp, Rattus norvegicus
ctgaatccggcagggccgggtctcc

SEQ ID NO: 620484 - DNA, 25 bp, Rattus norvegicus
tccgagctagaacccgcggcctcct

SEQ ID NO: 620485 - DNA, 25 bp, Rattus norvegicus
ggtccgaccctacccaggcctcgca

SEQ ID NO: 620486 - DNA, 25 bp, Rattus norvegicus
gagcgacggttacgaaaccggcagc

SEQ ID NO: 620487 - DNA, 25 bp, Rattus norvegicus
gccgccgcagccgtgaccaatagaa

SEQ ID NO: 620488 - DNA, 25 bp, Rattus norvegicus
ccgtgaccaatagaagcgctgctcg

SEQ ID NO: 620489 - DNA, 25 bp, Rattus norvegicus
gcgctgctcggagaacgacgcgctc

SEQ ID NO: 620490 - DNA, 25 bp, Rattus norvegicus
gaacgacgcgctcgcttctcaagac

SEQ ID NO: 620491 - DNA, 25 bp, Rattus norvegicus
tctcaagaccggcagctccaccagc

SEQ ID NO: 620492 - DNA, 25 bp, Rattus norvegicus
gccaatcacagccagggtggcagca

SEQ ID NO: 620493 - DNA, 25 bp, Rattus norvegicus
ctcaccgccttggaaagtcacaaga

SEQ ID NO: 620494 - DNA, 25 bp, Rattus norvegicus
acagccggcagcaggagaaggccaa

SEQ ID NO: 620495 - DNA, 25 bp, Rattus norvegicus
ttcaacgacgagttcctggccgacc

SEQ ID NO: 620496 - DNA, 25 bp, Rattus norvegicus
gtctatagacatcagcgcctacatc

SEQ ID NO: 620497 - DNA, 25 bp, Rattus norvegicus
catctgcgagcacgagacgtctata

SEQ ID NO: 620498 - DNA, 25 bp, Rattus norvegicus
cgccatgccgggagaactctaactc

SEQ ID NO: 620499 - DNA, 25 bp, Rattus norvegicus
attcgcgacccaaagctgcgcgggc

SEQ ID NO: 620500 - DNA, 25 bp, Rattus norvegicus
ggcaggctctaagacccagcaggca

SEQ ID NO: 620501 - DNA, 25 bp, Rattus norvegicus
ggcgcctaaccacggaccacgtgtg

SEQ ID NO: 620502 - DNA, 25 bp, Rattus norvegicus
ggtagctcaagactaacatcctctc

SEQ ID NO: 620503 - DNA, 25 bp, Rattus norvegicus
taagacaagtctgcaccacggtagc

SEQ ID NO: 620504 - DNA, 25 bp, Rattus norvegicus
gagacaggcctagtcccagctttta

SEQ ID NO: 620505 - DNA, 25 bp, Rattus norvegicus
gcggctctccgccacagctttttaa

SEQ ID NO: 620506 - DNA, 25 bp, Rattus norvegicus
ggcgatgcccgaccctctataaaag

SEQ ID NO: 620507 - DNA, 25 bp, Rattus norvegicus
gacggcgcgacgcagcgatcgccag

SEQ ID NO: 620508 - DNA, 25 bp, Rattus norvegicus
tctgggctgcacctcccgatggctt

SEQ ID NO: 620509 - DNA, 25 bp, Rattus norvegicus
gcgatctgggctgcacctcccgatg

SEQ ID NO: 620510 - DNA, 25 bp, Rattus norvegicus
gccacaccgtgccagcctcgctccg

SEQ ID NO: 620511 - DNA, 25 bp, Rattus norvegicus
cgagtggcctcatcctcatgcaggg

SEQ ID NO: 620512 - DNA, 25 bp, Rattus norvegicus
gccgtctgccacaccgtgccagcct

SEQ ID NO: 620513 - DNA, 25 bp, Rattus norvegicus
acaaaagctgttccgccgtctgcca

SEQ ID NO: 620514 - DNA, 25 bp, Rattus norvegicus
agcacacaaaagctgttccgccgtc

SEQ ID NO: 620515 - DNA, 25 bp, Rattus norvegicus
cagcgatcgccagcagcacacaaaa

SEQ ID NO: 620516 - DNA, 25 bp, Rattus norvegicus
catcctcatgcaggggacggcgcga

SEQ ID NO: 620517 - DNA, 25 bp, Rattus norvegicus
cctcatcctcatgcaggggacggcg

SEQ ID NO: 620518 - DNA, 25 bp, Rattus norvegicus
agtggcctcatcctcatgcagggga

SEQ ID NO: 620519 - DNA, 25 bp, Rattus norvegicus
tcgccagcagcacacaaaagctgtt

SEQ ID NO: 620520 - DNA, 25 bp, Rattus norvegicus
tggcctcatcctcatgcaggggacg

SEQ ID NO: 620521 - DNA, 25 bp, Rattus norvegicus
gccaagagaacacgatgttccctag

SEQ ID NO: 620522 - DNA, 25 bp, Rattus norvegicus
agagaacacgatgttccctagtgcg

SEQ ID NO: 620523 - DNA, 25 bp, Rattus norvegicus
gaacacgatgttccctagtgcgctg

SEQ ID NO: 620524 - DNA, 25 bp, Rattus norvegicus
tgtcctgggccatcggccaagagaa

SEQ ID NO: 620525 - DNA, 25 bp, Rattus norvegicus
catgtcctgggccatcggccaagag

SEQ ID NO: 620526 - DNA, 25 bp, Rattus norvegicus
agtgcatgtcctgggccatcggcca

SEQ ID NO: 620527 - DNA, 25 bp, Rattus norvegicus
ggctgagtgcatgtcctgggccatc

SEQ ID NO: 620528 - DNA, 25 bp, Rattus norvegicus
ccgccttctgcctccgctttgacgt

SEQ ID NO: 620529 - DNA, 25 bp, Rattus norvegicus
cgccaaggctgagtgcatgtcctgg

SEQ ID NO: 620530 - DNA, 25 bp, Rattus norvegicus
ttctgcctccgctttgacgtcacct

SEQ ID NO: 620531 - DNA, 25 bp, Rattus norvegicus
ggcgccaaggctgagtgcatgtcct

SEQ ID NO: 620532 - DNA, 25 bp, Rattus norvegicus
aaggctgagtgcatgtcctgggcca

SEQ ID NO: 620533 - DNA, 25 bp, Rattus norvegicus
cctccgctttgacgtcacctccctc

SEQ ID NO: 620534 - DNA, 25 bp, Rattus norvegicus
atgttccctagtgcgctggccgccg

SEQ ID NO: 620535 - DNA, 25 bp, Rattus norvegicus
cagacgaaccgaccgacggaggact

SEQ ID NO: 620536 - DNA, 25 bp, Rattus norvegicus
atgcgcccgcctgtgggcgctgtcc

SEQ ID NO: 620537 - DNA, 25 bp, Rattus norvegicus
ggccgcgagcgcaccgacagacgaa

SEQ ID NO: 620538 - DNA, 25 bp, Rattus norvegicus
ccgacagacgaaccgaccgacggag

SEQ ID NO: 620539 - DNA, 25 bp, Rattus norvegicus
gatagacggggtagcgcagagagct

SEQ ID NO: 620540 - DNA, 25 bp, Rattus norvegicus
gcgggacagcgacatgacaggccat

SEQ ID NO: 620541 - DNA, 25 bp, Rattus norvegicus
ggacagcgacatgacaggccatata

SEQ ID NO: 620542 - DNA, 25 bp, Rattus norvegicus
agcgacatgacaggccatatacagc

SEQ ID NO: 620543 - DNA, 25 bp, Rattus norvegicus
tgacaggccatatacagcagccagg

SEQ ID NO: 620544 - DNA, 25 bp, Rattus norvegicus
aggccatatacagcagccaggcggg

SEQ ID NO: 620545 - DNA, 25 bp, Rattus norvegicus
ccatatacagcagccaggcgggcgc

SEQ ID NO: 620546 - DNA, 25 bp, Rattus norvegicus
ctcggagcgggtggcactcaagaaa

SEQ ID NO: 620547 - DNA, 25 bp, Rattus norvegicus
cactcaagaaagagatcgggctggt

SEQ ID NO: 620548 - DNA, 25 bp, Rattus norvegicus
gcgagcgcaccgacagacgaaccga

SEQ ID NO: 620549 - DNA, 25 bp, Rattus norvegicus
gcagcttttctggttgttgcaacga

SEQ ID NO: 620550 - DNA, 25 bp, Rattus norvegicus
taacccagtcgtagctccagctgca

SEQ ID NO: 620551 - DNA, 25 bp, Rattus norvegicus
ggccttcatacacctggacatagtc

SEQ ID NO: 620552 - DNA, 25 bp, Rattus norvegicus
aggcagtagcccttcacctggtatg

SEQ ID NO: 620553 - DNA, 25 bp, Rattus norvegicus
tggctctgagaagcagccctgttcc

SEQ ID NO: 620554 - DNA, 25 bp, Rattus norvegicus
accctcacagggatactggtccgga

SEQ ID NO: 620555 - DNA, 25 bp, Rattus norvegicus
gtagaaactgcctagccgccggcca

SEQ ID NO: 620556 - DNA, 25 bp, Rattus norvegicus
cgtgctcatcgctgccatcttggca

SEQ ID NO: 620557 - DNA, 25 bp, Rattus norvegicus
ccaccagccatgtgcagtgaaggtc

SEQ ID NO: 620558 - DNA, 25 bp, Rattus norvegicus
gcagttcttttcatcggcgccatcg

SEQ ID NO: 620559 - DNA, 25 bp, Rattus norvegicus
tctcaaagatgcacaggttcgtacc

SEQ ID NO: 620560 - DNA, 25 bp, Rattus norvegicus
ccgtcacagcgccatgtctcaaaga

SEQ ID NO: 620561 - DNA, 25 bp, Rattus norvegicus
ttggcagtcctcctgaccgtcacag

SEQ ID NO: 620562 - DNA, 25 bp, Rattus norvegicus
caacgatcggcaggtgcatagcaca

SEQ ID NO: 620563 - DNA, 25 bp, Rattus norvegicus
agccctgcctgcacaccgagacctc

SEQ ID NO: 620564 - DNA, 25 bp, Rattus norvegicus
agctctgaaccttggccctgcgatt

SEQ ID NO: 620565 - DNA, 25 bp, Rattus norvegicus
ggtcccgctagctctgaaccttggc

SEQ ID NO: 620566 - DNA, 25 bp, Rattus norvegicus
gtgctggacagctccacgcacgcgg

SEQ ID NO: 620567 - DNA, 25 bp, Rattus norvegicus
cctcggggtgctggacagctccacg

SEQ ID NO: 620568 - DNA, 25 bp, Rattus norvegicus
gtgcgtcgatcggtccgtccgtcct

SEQ ID NO: 620569 - DNA, 25 bp, Rattus norvegicus
cgccgcacgatgtcaacgagggtgc

SEQ ID NO: 620570 - DNA, 25 bp, Rattus norvegicus
agggaagacctgagcccgccgctgt

SEQ ID NO: 620571 - DNA, 25 bp, Rattus norvegicus
ctcagcagcggtcgccagggaagac

SEQ ID NO: 620572 - DNA, 25 bp, Rattus norvegicus
gcccgcaacgcgctgggccacatcg

SEQ ID NO: 620573 - DNA, 25 bp, Rattus norvegicus
actcacccaggcagacgactgcgag

SEQ ID NO: 620574 - DNA, 25 bp, Rattus norvegicus
agccatcgcagtgcgagctccaagc

SEQ ID NO: 620575 - DNA, 25 bp, Rattus norvegicus
cgatgtcaacgagggtgcgtcgatc

SEQ ID NO: 620576 - DNA, 25 bp, Rattus norvegicus
acccaggcagacgactgcgagcggc

SEQ ID NO: 620577 - DNA, 25 bp, Rattus norvegicus
tttttctcctttgcgcgcacacggg

SEQ ID NO: 620578 - DNA, 25 bp, Rattus norvegicus
ttcagagaagccaagatgtgagctc

SEQ ID NO: 620579 - DNA, 25 bp, Rattus norvegicus
ccataggcatggtattcagagaagc

SEQ ID NO: 620580 - DNA, 25 bp, Rattus norvegicus
caagagattacaggccataggcatg

SEQ ID NO: 620581 - DNA, 25 bp, Rattus norvegicus
tcttcacagcagtgaaagcctaact

SEQ ID NO: 620582 - DNA, 25 bp, Rattus norvegicus
aaagagctgccttgctcatggtgtc

SEQ ID NO: 620583 - DNA, 25 bp, Rattus norvegicus
tgttgtccttaaagagctgccttgc

SEQ ID NO: 620584 - DNA, 25 bp, Rattus norvegicus
tgtttctgccctgatgataatggac

SEQ ID NO: 620585 - DNA, 25 bp, Rattus norvegicus
gccactttcctaaccggctgggctg

SEQ ID NO: 620586 - DNA, 25 bp, Rattus norvegicus
gcgagaagtccaagtacgggagacc

SEQ ID NO: 620587 - DNA, 25 bp, Rattus norvegicus
cttgtcactttggtcgcttttttga

SEQ ID NO: 620588 - DNA, 25 bp, Rattus norvegicus
tgtgggcatctcactctgaagtagt

SEQ ID NO: 620589 - DNA, 25 bp, Rattus norvegicus
atgtgagctcaagggtctcgccagc

SEQ ID NO: 620590 - DNA, 25 bp, Rattus norvegicus
tggtcgcttttttgacaccgggcgc

SEQ ID NO: 620591 - DNA, 25 bp, Rattus norvegicus
agatggggcgtggtttcaaagatca

SEQ ID NO: 620592 - DNA, 25 bp, Rattus norvegicus
gggcgaggctacagacagctaagta

SEQ ID NO: 620593 - DNA, 25 bp, Rattus norvegicus
tggagaaagagagtgacgactactt

SEQ ID NO: 620594 - DNA, 25 bp, Rattus norvegicus
atgaccgacgcgctgctacctgcgg

SEQ ID NO: 620595 - DNA, 25 bp, Rattus norvegicus
tggggcccttagtatccactgcacc

SEQ ID NO: 620596 - DNA, 25 bp, Rattus norvegicus
agatatctggcgctttagggctcgg

SEQ ID NO: 620597 - DNA, 25 bp, Rattus norvegicus
cgcctatggccaggtcttgcttgga

SEQ ID NO: 620598 - DNA, 25 bp, Rattus norvegicus
tcggaacccgcctatggccaggtct

SEQ ID NO: 620599 - DNA, 25 bp, Rattus norvegicus
cgtggcagagcagagttccagactc

SEQ ID NO: 620600 - DNA, 25 bp, Rattus norvegicus
agggctccggattcgcctcttgaga

SEQ ID NO: 620601 - DNA, 25 bp, Rattus norvegicus
ggcggaactccagggctccggattc

SEQ ID NO: 620602 - DNA, 25 bp, Rattus norvegicus
tttcaaagatcaggggtggggctca

SEQ ID NO: 620603 - DNA, 25 bp, Rattus norvegicus
agctaagtatcagcctcccgtagga

SEQ ID NO: 620604 - DNA, 25 bp, Rattus norvegicus
tcagcctcccgtaggactggaaggt

SEQ ID NO: 620605 - DNA, 25 bp, Rattus norvegicus
ttttgcgctcgctggagaagcagca

SEQ ID NO: 620606 - DNA, 25 bp, Rattus norvegicus
ctgcaatcatcagccagcgactggg

SEQ ID NO: 620607 - DNA, 25 bp, Rattus norvegicus
ctgttcgtcagggtcattctcgccc

SEQ ID NO: 620608 - DNA, 25 bp, Rattus norvegicus
gagcgtgattcctgcgccagagcac

SEQ ID NO: 620609 - DNA, 25 bp, Rattus norvegicus
gagtggtgtccggaagcctaataaa

SEQ ID NO: 620610 - DNA, 25 bp, Rattus norvegicus
atctctcttaagaagtggtcggatc

SEQ ID NO: 620611 - DNA, 25 bp, Rattus norvegicus
cgccgggcataaagcgctggttttg

SEQ ID NO: 620612 - DNA, 25 bp, Rattus norvegicus
gacttacccagtcaggcgagctgtc

SEQ ID NO: 620613 - DNA, 25 bp, Rattus norvegicus
tgccgaggtgcgaacagacttaccc

SEQ ID NO: 620614 - DNA, 25 bp, Rattus norvegicus
tagcacagatgcgtagcgctacgtc

SEQ ID NO: 620615 - DNA, 25 bp, Rattus norvegicus
cctcgaaggtctcgcggatagcaca

SEQ ID NO: 620616 - DNA, 25 bp, Rattus norvegicus
ttgagaagcccttgcagagtcccgc

SEQ ID NO: 620617 - DNA, 25 bp, Rattus norvegicus
cagatgtccggtgtgcagtccagat

SEQ ID NO: 620618 - DNA, 25 bp, Rattus norvegicus
gccagcggatttcagatctctctta

SEQ ID NO: 620619 - DNA, 25 bp, Rattus norvegicus
ctgcatgtcggcttcgagcaggtcc

SEQ ID NO: 620620 - DNA, 25 bp, Rattus norvegicus
cgcgtagggtctttgcataactttc

SEQ ID NO: 620621 - DNA, 25 bp, Rattus norvegicus
gattgtcgcgcctgtacagtccagc

SEQ ID NO: 620622 - DNA, 25 bp, Rattus norvegicus
attttccctagacgcgctccgagtc

SEQ ID NO: 620623 - DNA, 25 bp, Rattus norvegicus
gtcgttcccacagacagaggtagtc

SEQ ID NO: 620624 - DNA, 25 bp, Rattus norvegicus
gccaatcttgggcagagcggactga

SEQ ID NO: 620625 - DNA, 25 bp, Rattus norvegicus
gtggtcttattgagcgcgtccagca

SEQ ID NO: 620626 - DNA, 25 bp, Rattus norvegicus
cggagccgcccacagtaagcactaa

SEQ ID NO: 620627 - DNA, 25 bp, Rattus norvegicus
cgggtcttctgcagttcttcgcgta

SEQ ID NO: 620628 - DNA, 25 bp, Rattus norvegicus
ttttcacggcggctccctgagaaac

SEQ ID NO: 620629 - DNA, 25 bp, Rattus norvegicus
aggcagcccgaaaaggccacccaga

SEQ ID NO: 620630 - DNA, 25 bp, Rattus norvegicus
ttgtcgatcatctcgcccacctgga

SEQ ID NO: 620631 - DNA, 25 bp, Rattus norvegicus
agcggggcacgttgactttcatttc

SEQ ID NO: 620632 - DNA, 25 bp, Rattus norvegicus
gcgctcctcggtagctaagctccgg

SEQ ID NO: 620633 - DNA, 25 bp, Rattus norvegicus
caacggcggagtaaagaggtaagct

SEQ ID NO: 620634 - DNA, 25 bp, Rattus norvegicus
gaattctgggcacgcgcactccctg

SEQ ID NO: 620635 - DNA, 25 bp, Rattus norvegicus
tgcgtccagagggatgcatctgttc

SEQ ID NO: 620636 - DNA, 25 bp, Rattus norvegicus
gcgcacgttgtccactgcgtccaga

SEQ ID NO: 620637 - DNA, 25 bp, Rattus norvegicus
ccgttcttctgctgtccgcagcgtg

SEQ ID NO: 620638 - DNA, 25 bp, Rattus norvegicus
cgttgcgggctaagcctcctagctc

SEQ ID NO: 620639 - DNA, 25 bp, Rattus norvegicus
taagtgtattctgcgggtgtcctcc

SEQ ID NO: 620640 - DNA, 25 bp, Rattus norvegicus
ctgtcgtagcacagaggtgaaacta

SEQ ID NO: 620641 - DNA, 25 bp, Rattus norvegicus
gtaagctgaagagtggaaccaccgc

SEQ ID NO: 620642 - DNA, 25 bp, Rattus norvegicus
acctcttattggacagactggagca

SEQ ID NO: 620643 - DNA, 25 bp, Rattus norvegicus
gtctcggctaagatgacctcttatt

SEQ ID NO: 620644 - DNA, 25 bp, Rattus norvegicus
ctgtttacgtgtcagtctcggctaa

SEQ ID NO: 620645 - DNA, 25 bp, Rattus norvegicus
cccgactgaactagacttaacgatt

SEQ ID NO: 620646 - DNA, 25 bp, Rattus norvegicus
tgggcactcaggtcccagcccagga

SEQ ID NO: 620647 - DNA, 25 bp, Rattus norvegicus
accatctctggagtccgcggtttga

SEQ ID NO: 620648 - DNA, 25 bp, Rattus norvegicus
tgctcaggcatcaagagtcgagttc

SEQ ID NO: 620649 - DNA, 25 bp, Rattus norvegicus
tccgcaccagagctcagaagagtcc

SEQ ID NO: 620650 - DNA, 25 bp, Rattus norvegicus
accgcaggggttgagcaccatctct

SEQ ID NO: 620651 - DNA, 25 bp, Rattus norvegicus
cagcgctgacttccggccagcaaga

SEQ ID NO: 620652 - DNA, 25 bp, Rattus norvegicus
gccagcaagacccaatccgaggaca

SEQ ID NO: 620653 - DNA, 25 bp, Rattus norvegicus
tcgacggcagcgaaaaccgagactt

SEQ ID NO: 620654 - DNA, 25 bp, Rattus norvegicus
tcacgcgggactctacgggaaccga

SEQ ID NO: 620655 - DNA, 25 bp, Rattus norvegicus
tgtggcccacgagcaaacgctgaga

SEQ ID NO: 620656 - DNA, 25 bp, Rattus norvegicus
ttctcagcgcctcgagttcttcgtc

SEQ ID NO: 620657 - DNA, 25 bp, Rattus norvegicus
cggtacactcggttggaatcgcttc

SEQ ID NO: 620658 - DNA, 25 bp, Rattus norvegicus
ggaatcgcttcagcctgagactcga

SEQ ID NO: 620659 - DNA, 25 bp, Rattus norvegicus
gagactcgagcacggcgccttttac

SEQ ID NO: 620660 - DNA, 25 bp, Rattus norvegicus
ccttttactgcgcagccgcgagtga

SEQ ID NO: 620661 - DNA, 25 bp, Rattus norvegicus
ggacgcgcccactttacgggctaca

SEQ ID NO: 620662 - DNA, 25 bp, Rattus norvegicus
gattcgcgtctggatggcaacaacc

SEQ ID NO: 620663 - DNA, 25 bp, Rattus norvegicus
ggcaacaacctcaccaactgggaaa

SEQ ID NO: 620664 - DNA, 25 bp, Rattus norvegicus
ccgcccacgtgtccggtagatacgg

SEQ ID NO: 620665 - DNA, 25 bp, Rattus norvegicus
caaaaagttgcttcggccagccgga

SEQ ID NO: 620666 - DNA, 25 bp, Rattus norvegicus
tggttccagcagctgttcgtcgacg

SEQ ID NO: 620667 - DNA, 25 bp, Rattus norvegicus
ccaggtactaattacgattcgcgtc

SEQ ID NO: 620668 - DNA, 25 bp, Rattus norvegicus
ggctacagcgagttgaagacccgga

SEQ ID NO: 620669 - DNA, 25 bp, Rattus norvegicus
agcacgcaaagcacccaggccttgg

SEQ ID NO: 620670 - DNA, 25 bp, Rattus norvegicus
ctacccgggattggcaaggaagcac

SEQ ID NO: 620671 - DNA, 25 bp, Rattus norvegicus
tagatacggcgcgtcctgttacctc

SEQ ID NO: 620672 - DNA, 25 bp, Rattus norvegicus
accggaaggcaattcctggactatg

SEQ ID NO: 620673 - DNA, 25 bp, Rattus norvegicus
cgaggcacaagctcccgctcagaga

SEQ ID NO: 620674 - DNA, 25 bp, Rattus norvegicus
gccgctgcattcattggttccagca

SEQ ID NO: 620675 - DNA, 25 bp, Rattus norvegicus
ctcacaagtggtcccggcaggtggc

SEQ ID NO: 620676 - DNA, 25 bp, Rattus norvegicus
cagggaccaggaaagaggacgaaat

SEQ ID NO: 620677 - DNA, 25 bp, Rattus norvegicus
tgcgagcgtgggagcgcagggtcgc

SEQ ID NO: 620678 - DNA, 25 bp, Rattus norvegicus
gggatcaaagctgccggcaaggggc

SEQ ID NO: 620679 - DNA, 25 bp, Rattus norvegicus
cggcaggtggccgtgccgggtcccg

SEQ ID NO: 620680 - DNA, 25 bp, Rattus norvegicus
cgctcacaagtggtcccggcaggtg

SEQ ID NO: 620681 - DNA, 25 bp, Rattus norvegicus
tcgctcacaagtggtcccggcaggt

SEQ ID NO: 620682 - DNA, 25 bp, Rattus norvegicus
ggtcgctcacaagtggtcccggcag

SEQ ID NO: 620683 - DNA, 25 bp, Rattus norvegicus
cgggtcgctcacaagtggtcccggc

SEQ ID NO: 620684 - DNA, 25 bp, Rattus norvegicus
agggcccccgggtcgctcacaagtg

SEQ ID NO: 620685 - DNA, 25 bp, Rattus norvegicus
aaagcccgcgcagggcgtcagggcc

SEQ ID NO: 620686 - DNA, 25 bp, Rattus norvegicus
agctcaggaggggagcggaaagccc

SEQ ID NO: 620687 - DNA, 25 bp, Rattus norvegicus
cagagggtggcggagagctcaggag

SEQ ID NO: 620688 - DNA, 25 bp, Rattus norvegicus
cgtgcgggatcaaagctgccggcaa

SEQ ID NO: 620689 - DNA, 25 bp, Rattus norvegicus
cgagcctcctttggctggccgggac

SEQ ID NO: 620690 - DNA, 25 bp, Rattus norvegicus
cctagcagagggacgacagtacaca

SEQ ID NO: 620691 - DNA, 25 bp, Rattus norvegicus
atggcggcgctgagactgatcacgt

SEQ ID NO: 620692 - DNA, 25 bp, Rattus norvegicus
ctcctcggccgtggctccaagatgg

SEQ ID NO: 620693 - DNA, 25 bp, Rattus norvegicus
acagtacacacaggaccctggcgct

SEQ ID NO: 620694 - DNA, 25 bp, Rattus norvegicus
ttctgcgagcctcctttggctggcc

SEQ ID NO: 620695 - DNA, 25 bp, Rattus norvegicus
tccagaaggcaacagcggggcctga

SEQ ID NO: 620696 - DNA, 25 bp, Rattus norvegicus
gtccgcctcgctcccgactcttttc

SEQ ID NO: 620697 - DNA, 25 bp, Rattus norvegicus
ctccataggcctagcagagggacga

SEQ ID NO: 620698 - DNA, 25 bp, Rattus norvegicus
ggacgacagtacacacaggaccctg

SEQ ID NO: 620699 - DNA, 25 bp, Rattus norvegicus
cggggtctccataggcctagcagag

SEQ ID NO: 620700 - DNA, 25 bp, Rattus norvegicus
gatttcacgtctccagaaggcaaca

SEQ ID NO: 620701 - DNA, 25 bp, Rattus norvegicus
tcacgtctccagaaggcaacagcgg

SEQ ID NO: 620702 - DNA, 25 bp, Rattus norvegicus
caggcccggggtctccataggccta

SEQ ID NO: 620703 - DNA, 25 bp, Rattus norvegicus
ttcacggggcacatcggccaagtct

SEQ ID NO: 620704 - DNA, 25 bp, Rattus norvegicus
aaggccagggtttgcagctcccagt

SEQ ID NO: 620705 - DNA, 25 bp, Rattus norvegicus
tacgcgacacacacatgcagcactg

SEQ ID NO: 620706 - DNA, 25 bp, Rattus norvegicus
ttcccggcctaagagctggcccagg

SEQ ID NO: 620707 - DNA, 25 bp, Rattus norvegicus
gcgcgccgaaatacagtgctgctcc

SEQ ID NO: 620708 - DNA, 25 bp, Rattus norvegicus
ggtctcctggtctacaagaaaaaga

SEQ ID NO: 620709 - DNA, 25 bp, Rattus norvegicus
accggtagggtgagatcttggtctc

SEQ ID NO: 620710 - DNA, 25 bp, Rattus norvegicus
gcgagcggagacttttgatcttacc

SEQ ID NO: 620711 - DNA, 25 bp, Rattus norvegicus
acatctgcattcagggaggcgtctg

SEQ ID NO: 620712 - DNA, 25 bp, Rattus norvegicus
gccggctttatagcccgggaggaca

SEQ ID NO: 620713 - DNA, 25 bp, Rattus norvegicus
aattcaactcccgagcgcctgggca

SEQ ID NO: 620714 - DNA, 25 bp, Rattus norvegicus
gatccacgccgggttaattcaactc

SEQ ID NO: 620715 - DNA, 25 bp, Rattus norvegicus
tgcagcactggagctcagccgcaac

SEQ ID NO: 620716 - DNA, 25 bp, Rattus norvegicus
ccaccagagtaagtgagcccacgtc

SEQ ID NO: 620717 - DNA, 25 bp, Rattus norvegicus
ctctgcgggcgcagagtaactccgg

SEQ ID NO: 620718 - DNA, 25 bp, Rattus norvegicus
agaagcgctctccaaccggtgcctt

SEQ ID NO: 620719 - DNA, 25 bp, Rattus norvegicus
ccggtgcctaccgggaccagagcga

SEQ ID NO: 620720 - DNA, 25 bp, Rattus norvegicus
tgtcccgggcagtacccggtgccta

SEQ ID NO: 620721 - DNA, 25 bp, Rattus norvegicus
gacacctttcgcgttgtcccgggca

SEQ ID NO: 620722 - DNA, 25 bp, Rattus norvegicus
gttctctgggacacctttcgcgttg

SEQ ID NO: 620723 - DNA, 25 bp, Rattus norvegicus
gctctccaaccggtgcctttcggtg

SEQ ID NO: 620724 - DNA, 25 bp, Rattus norvegicus
ctgcagcggagaagcgctctccaac

SEQ ID NO: 620725 - DNA, 25 bp, Rattus norvegicus
accctcccggggacgactgagctgg

SEQ ID NO: 620726 - DNA, 25 bp, Rattus norvegicus
cgcagagtaactccgggagcccggc

SEQ ID NO: 620727 - DNA, 25 bp, Rattus norvegicus
ctgtctgtctctgcgggcgcagagt

SEQ ID NO: 620728 - DNA, 25 bp, Rattus norvegicus
gcgcagcaggtacgagcggcttccc

SEQ ID NO: 620729 - DNA, 25 bp, Rattus norvegicus
gcatcatgccgaggaggaagcagca

SEQ ID NO: 620730 - DNA, 25 bp, Rattus norvegicus
ctatgttctccgctcgaccggctcg

SEQ ID NO: 620731 - DNA, 25 bp, Rattus norvegicus
gcctgttcagcaccgtgcagctcta

SEQ ID NO: 620732 - DNA, 25 bp, Rattus norvegicus
gaatgctacccgagcccagcctgtt

SEQ ID NO: 620733 - DNA, 25 bp, Rattus norvegicus
agcaccgtgcagctctaccgtcaga

SEQ ID NO: 620734 - DNA, 25 bp, Rattus norvegicus
tctaccgtcagagcagcaagctgta

SEQ ID NO: 620735 - DNA, 25 bp, Rattus norvegicus
gcagcaagctgtacggctccatctt

SEQ ID NO: 620736 - DNA, 25 bp, Rattus norvegicus
cttcaccggggccagcaagttccgg

SEQ ID NO: 620737 - DNA, 25 bp, Rattus norvegicus
caagttccggtgcaaagactgtagc

SEQ ID NO: 620738 - DNA, 25 bp, Rattus norvegicus
gcctacgacaccctggtagagctga

SEQ ID NO: 620739 - DNA, 25 bp, Rattus norvegicus
ccctggtagagctgacggtgcacat

SEQ ID NO: 620740 - DNA, 25 bp, Rattus norvegicus
cggtgcacatgaatgaaacgggtca

SEQ ID NO: 620741 - DNA, 25 bp, Rattus norvegicus
gaaacgggtcactatcgcgatgaca

SEQ ID NO: 620742 - DNA, 25 bp, Rattus norvegicus
cgcgatgacaaccacgagaccgaca

SEQ ID NO: 620743 - DNA, 25 bp, Rattus norvegicus
tgcaaagactgtagcgccgcctacg

SEQ ID NO: 620744 - DNA, 25 bp, Rattus norvegicus
aaacgctggtccaagcctcgcaagc

SEQ ID NO: 620745 - DNA, 25 bp, Rattus norvegicus
taggaaggcgcggacgccccactag

SEQ ID NO: 620746 - DNA, 25 bp, Rattus norvegicus
gcttccgtgcgaccggagagggaag

SEQ ID NO: 620747 - DNA, 25 bp, Rattus norvegicus
gtactcaggccgcgggcttccgtgc

SEQ ID NO: 620748 - DNA, 25 bp, Rattus norvegicus
cccttggagccgggccgtactcagg

SEQ ID NO: 620749 - DNA, 25 bp, Rattus norvegicus
ctgagggcctgcgagccggacacac

SEQ ID NO: 620750 - DNA, 25 bp, Rattus norvegicus
ttgtgcgaaccgagcgagccagcgg

SEQ ID NO: 620751 - DNA, 25 bp, Rattus norvegicus
aaactgagcgccgaccggtgcgcgc

SEQ ID NO: 620752 - DNA, 25 bp, Rattus norvegicus
tccctcacgctcgtacggaccgcgc

SEQ ID NO: 620753 - DNA, 25 bp, Rattus norvegicus
ctgctgccgcctccgtcacctcggc

SEQ ID NO: 620754 - DNA, 25 bp, Rattus norvegicus
cggactggagatcccgccgaggccc

SEQ ID NO: 620755 - DNA, 25 bp, Rattus norvegicus
cctgcaggacttggggggcctccct

SEQ ID NO: 620756 - DNA, 25 bp, Rattus norvegicus
agccgcgggactagagcggtgttcg

SEQ ID NO: 620757 - DNA, 25 bp, Rattus norvegicus
cgccgcctctcccacttgggcagcc

SEQ ID NO: 620758 - DNA, 25 bp, Rattus norvegicus
agcgccgtccgcttacccttcgccg

SEQ ID NO: 620759 - DNA, 25 bp, Rattus norvegicus
gacgccttagctgcgatcccttgtc

SEQ ID NO: 620760 - DNA, 25 bp, Rattus norvegicus
ggggctagaattcgtcaggaaccaa

SEQ ID NO: 620761 - DNA, 25 bp, Rattus norvegicus
gtacgccttcgcgacagctaggaga

SEQ ID NO: 620762 - DNA, 25 bp, Rattus norvegicus
agctctccgcaaagctaggcggcgg

SEQ ID NO: 620763 - DNA, 25 bp, Rattus norvegicus
cgagtctcaccggtaccctagaagc

SEQ ID NO: 620764 - DNA, 25 bp, Rattus norvegicus
aacccgggtccagccgtgatgagaa

SEQ ID NO: 620765 - DNA, 25 bp, Rattus norvegicus
cccagatgtgcgagtcagagcgcct

SEQ ID NO: 620766 - DNA, 25 bp, Rattus norvegicus
gtacaactttgcagccagggcgccg

SEQ ID NO: 620767 - DNA, 25 bp, Rattus norvegicus
tcccggcgctagaagtacaactttg

SEQ ID NO: 620768 - DNA, 25 bp, Rattus norvegicus
ttgtatgcgcgccatcccggcgcta

SEQ ID NO: 620769 - DNA, 25 bp, Rattus norvegicus
ttcccgaaatgggttttgtatgcgc

SEQ ID NO: 620770 - DNA, 25 bp, Rattus norvegicus
gagcgcctggaagcggtactttgtt

SEQ ID NO: 620771 - DNA, 25 bp, Rattus norvegicus
cccgctggccttcagacgaagcaga

SEQ ID NO: 620772 - DNA, 25 bp, Rattus norvegicus
gtgagattagcaccgtctgggtccc

SEQ ID NO: 620773 - DNA, 25 bp, Rattus norvegicus
tctgtcaccgccagcagttgcaaca

SEQ ID NO: 620774 - DNA, 25 bp, Rattus norvegicus
gtaggtgagagaggccggcctctta

SEQ ID NO: 620775 - DNA, 25 bp, Rattus norvegicus
cttagcgagtggctgcgcccacctt

SEQ ID NO: 620776 - DNA, 25 bp, Rattus norvegicus
agtggctgcgcccaccttgtgaacc

SEQ ID NO: 620777 - DNA, 25 bp, Rattus norvegicus
ttcgcccatggcagaatggcgttcc

SEQ ID NO: 620778 - DNA, 25 bp, Rattus norvegicus
gtctggggctctgtcaccgccagca

SEQ ID NO: 620779 - DNA, 25 bp, Rattus norvegicus
cgaagcgctcgctcgtttcagtgca

SEQ ID NO: 620780 - DNA, 25 bp, Rattus norvegicus
ctcgctcgtttcagtgcagtcggca

SEQ ID NO: 620781 - DNA, 25 bp, Rattus norvegicus
ctcgtttcagtgcagtcggcaagga

SEQ ID NO: 620782 - DNA, 25 bp, Rattus norvegicus
tttcagtgcagtcggcaaggagaga

SEQ ID NO: 620783 - DNA, 25 bp, Rattus norvegicus
caaggagagatgtgacggatttcgc

SEQ ID NO: 620784 - DNA, 25 bp, Rattus norvegicus
cggatttcgcccatggcagaatggc

SEQ ID NO: 620785 - DNA, 25 bp, Rattus norvegicus
cagttgcaacagctgcgaagcgctc

SEQ ID NO: 620786 - DNA, 25 bp, Rattus norvegicus
ctttcaatcttgtaaggagccggga

SEQ ID NO: 620787 - DNA, 25 bp, Rattus norvegicus
tctctttcatgttcccgggaccctg

SEQ ID NO: 620788 - DNA, 25 bp, Rattus norvegicus
gttgagcccgtgtgacaaaaattcc

SEQ ID NO: 620789 - DNA, 25 bp, Rattus norvegicus
accctgtaggttgtattcgagcgtc

SEQ ID NO: 620790 - DNA, 25 bp, Rattus norvegicus
gcactcagtgggcttctctttcatg

SEQ ID NO: 620791 - DNA, 25 bp, Rattus norvegicus
acaatccgggcactcagtgggcttc

SEQ ID NO: 620792 - DNA, 25 bp, Rattus norvegicus
cgagaatgcacgaccacctggtggt

SEQ ID NO: 620793 - DNA, 25 bp, Rattus norvegicus
tcactcttgcggtcccgcttgtgga

SEQ ID NO: 620794 - DNA, 25 bp, Rattus norvegicus
gtgcagagcatcctcgtcactcttg

SEQ ID NO: 620795 - DNA, 25 bp, Rattus norvegicus
ggactcctggtcactgcctgagcct

SEQ ID NO: 620796 - DNA, 25 bp, Rattus norvegicus
gagcggctcactgactgggactcct

SEQ ID NO: 620797 - DNA, 25 bp, Rattus norvegicus
ctcagtcacgttagaggagccgggt

SEQ ID NO: 620798 - DNA, 25 bp, Rattus norvegicus
ccactctcctcagtcacgttagagg

SEQ ID NO: 620799 - DNA, 25 bp, Rattus norvegicus
tcccgcttgtggactcgagaatgca

SEQ ID NO: 620800 - DNA, 25 bp, Rattus norvegicus
tgtattcgagcgtctggttgagccc

SEQ ID NO: 620801 - DNA, 25 bp, Rattus norvegicus
cttctcaccggtgtgagtgcgcatg

SEQ ID NO: 620802 - DNA, 25 bp, Rattus norvegicus
tgcagcagacggttctcctcacgta

SEQ ID NO: 620803 - DNA, 25 bp, Rattus norvegicus
gttctcctcacgtacccgcccgcgc

SEQ ID NO: 620804 - DNA, 25 bp, Rattus norvegicus
gcttgccacacagaggacacggata

SEQ ID NO: 620805 - DNA, 25 bp, Rattus norvegicus
aagttgcccagcttgtgggtccgca

SEQ ID NO: 620806 - DNA, 25 bp, Rattus norvegicus
gtggtcacagtaggggcacttgaat

SEQ ID NO: 620807 - DNA, 25 bp, Rattus norvegicus
tcaccggtgtgagtgcgcatgtgca

SEQ ID NO: 620808 - DNA, 25 bp, Rattus norvegicus
ggagaggatgctattgaaccggaaa

SEQ ID NO: 620809 - DNA, 25 bp, Rattus norvegicus
gctattgaaccggaaacgcttgcca

SEQ ID NO: 620810 - DNA, 25 bp, Rattus norvegicus
gaaccggaaacgcttgccacacaga

SEQ ID NO: 620811 - DNA, 25 bp, Rattus norvegicus
ggaaacgcttgccacacagaggaca

SEQ ID NO: 620812 - DNA, 25 bp, Rattus norvegicus
cagaggacacggatacttccggttc

SEQ ID NO: 620813 - DNA, 25 bp, Rattus norvegicus
gccacacagaggacacggatacttc

SEQ ID NO: 620814 - DNA, 25 bp, Rattus norvegicus
ttgcccagcttgtgggtccgcaggt

SEQ ID NO: 620815 - DNA, 25 bp, Rattus norvegicus
ggcggacaaacaagaaggactcaca

SEQ ID NO: 620816 - DNA, 25 bp, Rattus norvegicus
aactccgggacttgagtgtgcgctc

SEQ ID NO: 620817 - DNA, 25 bp, Rattus norvegicus
tccacgcatgcatccttccaggaga

SEQ ID NO: 620818 - DNA, 25 bp, Rattus norvegicus
tcctgcgaggcacccgttagacaaa

SEQ ID NO: 620819 - DNA, 25 bp, Rattus norvegicus
ccctgtcggatttctgctaaactgc

SEQ ID NO: 620820 - DNA, 25 bp, Rattus norvegicus
ggctgatgaatcacgtctcctgcga

SEQ ID NO: 620821 - DNA, 25 bp, Rattus norvegicus
ttctgctaaactgcacagcggcggc

SEQ ID NO: 620822 - DNA, 25 bp, Rattus norvegicus
gctcaagtgaaaactaaggcggctg

SEQ ID NO: 620823 - DNA, 25 bp, Rattus norvegicus
cggccgttattttccgctcaagtga

SEQ ID NO: 620824 - DNA, 25 bp, Rattus norvegicus
tggcccgctactcctaaagccggtg

SEQ ID NO: 620825 - DNA, 25 bp, Rattus norvegicus
tcgagtccctcctacgactgttttc

SEQ ID NO: 620826 - DNA, 25 bp, Rattus norvegicus
gggagcatctagatctggacacttc

SEQ ID NO: 620827 - DNA, 25 bp, Rattus norvegicus
cccagagaagcgctggaggaaccca

SEQ ID NO: 620828 - DNA, 25 bp, Rattus norvegicus
cctgtccctagagaaagaaaccttg

SEQ ID NO: 620829 - DNA, 25 bp, Rattus norvegicus
ggaggccgcagatccagggctccca

SEQ ID NO: 620830 - DNA, 25 bp, Rattus norvegicus
gtgtagagactccagccagagggca

SEQ ID NO: 620831 - DNA, 25 bp, Rattus norvegicus
ttacagacaagacggggcgcccaag

SEQ ID NO: 620832 - DNA, 25 bp, Rattus norvegicus
gccaccgccttacagacaagacggg

SEQ ID NO: 620833 - DNA, 25 bp, Rattus norvegicus
gaggttaataacacccgcgcgtgtc

SEQ ID NO: 620834 - DNA, 25 bp, Rattus norvegicus
aacacccgcgcgtgtctgtctctgt

SEQ ID NO: 620835 - DNA, 25 bp, Rattus norvegicus
gtctctgtctgtgcgcccgtctgac

SEQ ID NO: 620836 - DNA, 25 bp, Rattus norvegicus
gtgcgcccgtctgacctcggtatct

SEQ ID NO: 620837 - DNA, 25 bp, Rattus norvegicus
aggcgctcgccagctgctacttgtc

SEQ ID NO: 620838 - DNA, 25 bp, Rattus norvegicus
gctgctacttgtccggcttccgcga

SEQ ID NO: 620839 - DNA, 25 bp, Rattus norvegicus
gcttccgcgagtgcctgcttcgctt

SEQ ID NO: 620840 - DNA, 25 bp, Rattus norvegicus
cctgcttcgcttggcggcctttgcg

SEQ ID NO: 620841 - DNA, 25 bp, Rattus norvegicus
gccgtgctcccagacgaggttaata

SEQ ID NO: 620842 - DNA, 25 bp, Rattus norvegicus
gctcccagcttttctccgcgctaaa

SEQ ID NO: 620843 - DNA, 25 bp, Rattus norvegicus
gagtcatcagcgatcaaatgacgtt

SEQ ID NO: 620844 - DNA, 25 bp, Rattus norvegicus
agcgggacgtggagaatcagtcaca

SEQ ID NO: 620845 - DNA, 25 bp, Rattus norvegicus
taaccttgtggcgtatttaatgtaa

SEQ ID NO: 620846 - DNA, 25 bp, Rattus norvegicus
gcgctgtaaccttgtggcgtattta

SEQ ID NO: 620847 - DNA, 25 bp, Rattus norvegicus
caaatgacgttgatccgcgctgtaa

SEQ ID NO: 620848 - DNA, 25 bp, Rattus norvegicus
cgtttaagggagtcatcagcgatca

SEQ ID NO: 620849 - DNA, 25 bp, Rattus norvegicus
gcccgggcgtttaagggagtcatca

SEQ ID NO: 620850 - DNA, 25 bp, Rattus norvegicus
atttaatgtaaataaggccgttatg

SEQ ID NO: 620851 - DNA, 25 bp, Rattus norvegicus
taaggccgttatgttgccaatcgcc

SEQ ID NO: 620852 - DNA, 25 bp, Rattus norvegicus
aaacaccgagaggtcctcagcctcg

SEQ ID NO: 620853 - DNA, 25 bp, Rattus norvegicus
cgttatgttgccaatcgccgcgata

SEQ ID NO: 620854 - DNA, 25 bp, Rattus norvegicus
gccgcgatacaaacaccgagaggtc

SEQ ID NO: 620855 - DNA, 25 bp, Rattus norvegicus
gaatcagtcacagcccgggcgttta

SEQ ID NO: 620856 - DNA, 25 bp, Rattus norvegicus
cgttgatccgcgctgtaaccttgtg

SEQ ID NO: 620857 - DNA, 25 bp, Rattus norvegicus
tgcacagcacgcctctctctgaaga

SEQ ID NO: 620858 - DNA, 25 bp, Rattus norvegicus
aagctgctcagagtcgcggtcgcat

SEQ ID NO: 620859 - DNA, 25 bp, Rattus norvegicus
tcgcatgcggaagccggccaagacc

SEQ ID NO: 620860 - DNA, 25 bp, Rattus norvegicus
ccaagaccggaaccaagcgaggcct

SEQ ID NO: 620861 - DNA, 25 bp, Rattus norvegicus
gcagcacgccgggaatctctcaagc

SEQ ID NO: 620862 - DNA, 25 bp, Rattus norvegicus
ggctggccacgttagaagctgctca

SEQ ID NO: 620863 - DNA, 25 bp, Rattus norvegicus
gtcaaagggctaccgacaaaagaca

SEQ ID NO: 620864 - DNA, 25 bp, Rattus norvegicus
gaggcgaacaagtcctaaacaagtg

SEQ ID NO: 620865 - DNA, 25 bp, Rattus norvegicus
taaacaagtgtttatggaggcggcg

SEQ ID NO: 620866 - DNA, 25 bp, Rattus norvegicus
agcgaggcctgttaccttttcctgc

SEQ ID NO: 620867 - DNA, 25 bp, Rattus norvegicus
cctcagcgaggcgaacaagtcctaa

SEQ ID NO: 620868 - DNA, 25 bp, Rattus norvegicus
cgacaaaagacaacaaatgcacgtg

SEQ ID NO: 620869 - DNA, 25 bp, Rattus norvegicus
atctcggtctcacgcagagagggct

SEQ ID NO: 620870 - DNA, 25 bp, Rattus norvegicus
atgcacgtgacaaaagtttctcccg

SEQ ID NO: 620871 - DNA, 25 bp, Rattus norvegicus
cctggctgccaaagagactggcttg

SEQ ID NO: 620872 - DNA, 25 bp, Rattus norvegicus
tgcggtctgcccgttttaacgccca

SEQ ID NO: 620873 - DNA, 25 bp, Rattus norvegicus
ccgaacaaggtcctctgcggtctgc

SEQ ID NO: 620874 - DNA, 25 bp, Rattus norvegicus
cgacgggcgacacaaggccgaacaa

SEQ ID NO: 620875 - DNA, 25 bp, Rattus norvegicus
ggttcgacttccgacgggcgacaca

SEQ ID NO: 620876 - DNA, 25 bp, Rattus norvegicus
ccagaggcgtcacccggttcgactt

SEQ ID NO: 620877 - DNA, 25 bp, Rattus norvegicus
ctttgacccagaggcgtcacccggt

SEQ ID NO: 620878 - DNA, 25 bp, Rattus norvegicus
atttcatgcactttgacccagaggc

SEQ ID NO: 620879 - DNA, 25 bp, Rattus norvegicus
tatccaagcggattagaacgttccc

SEQ ID NO: 620880 - DNA, 25 bp, Rattus norvegicus
gactggcttgtcctatccaagcgga

SEQ ID NO: 620881 - DNA, 25 bp, Rattus norvegicus
tagggagccgacgagcaatcagccc

SEQ ID NO: 620882 - DNA, 25 bp, Rattus norvegicus
cttggtctgtagctagggagccgac

SEQ ID NO: 620883 - DNA, 25 bp, Rattus norvegicus
ttaacgcccaactaggcccgactga

SEQ ID NO: 620884 - DNA, 25 bp, Rattus norvegicus
ccttgtcgggtcgtcgcctgctgtt

SEQ ID NO: 620885 - DNA, 25 bp, Rattus norvegicus
atcacgtgggtaaacacgctgcacg

SEQ ID NO: 620886 - DNA, 25 bp, Rattus norvegicus
tgcacgtggagctcagcctgagcca

SEQ ID NO: 620887 - DNA, 25 bp, Rattus norvegicus
gaggaagccacgaggcccgaagtcc

SEQ ID NO: 620888 - DNA, 25 bp, Rattus norvegicus
tgcccagtgatccacctacgctttg

SEQ ID NO: 620889 - DNA, 25 bp, Rattus norvegicus
agtgatccacctacgctttgctctg

SEQ ID NO: 620890 - DNA, 25 bp, Rattus norvegicus
cacctacgctttgctctgttacaga

SEQ ID NO: 620891 - DNA, 25 bp, Rattus norvegicus
ctctgttacagaggcgcgttgcgtt

SEQ ID NO: 620892 - DNA, 25 bp, Rattus norvegicus
ttacagaggcgcgttgcgttagctt

SEQ ID NO: 620893 - DNA, 25 bp, Rattus norvegicus
tgcgttagcttgacgctgcgcagcc

SEQ ID NO: 620894 - DNA, 25 bp, Rattus norvegicus
ctgtgggcgggctctgaaatcacgt

SEQ ID NO: 620895 - DNA, 25 bp, Rattus norvegicus
gctctgaaatcacgtgggtaaacac

SEQ ID NO: 620896 - DNA, 25 bp, Rattus norvegicus
cggggccgcagaatcagaggaagga

SEQ ID NO: 620897 - DNA, 25 bp, Rattus norvegicus
gtaaacacgctgcacgtggagctca

SEQ ID NO: 620898 - DNA, 25 bp, Rattus norvegicus
cgggctctgaaatcacgtgggtaaa

SEQ ID NO: 620899 - DNA, 25 bp, Rattus norvegicus
ccctgggtccgaacctgaggttgag

SEQ ID NO: 620900 - DNA, 25 bp, Rattus norvegicus
gaggcctagccgacctttgagagga

SEQ ID NO: 620901 - DNA, 25 bp, Rattus norvegicus
cccgagctgatacctcaggggaccg

SEQ ID NO: 620902 - DNA, 25 bp, Rattus norvegicus
gtcccgggaatccaggcagcccgta

SEQ ID NO: 620903 - DNA, 25 bp, Rattus norvegicus
aggcagcccgtacccgaagctgtgt

SEQ ID NO: 620904 - DNA, 25 bp, Rattus norvegicus
gcccggcttcgagcgggacatttaa

SEQ ID NO: 620905 - DNA, 25 bp, Rattus norvegicus
acatttaaaaatcccagcgcgcggt

SEQ ID NO: 620906 - DNA, 25 bp, Rattus norvegicus
ggcttgaccgcagtgatgcacctga

SEQ ID NO: 620907 - DNA, 25 bp, Rattus norvegicus
acctcggcagattgcaataatcggc

SEQ ID NO: 620908 - DNA, 25 bp, Rattus norvegicus
ggccgcgcaagtggaatgttacctc

SEQ ID NO: 620909 - DNA, 25 bp, Rattus norvegicus
cgagcgcccgaaggattaggagctt

SEQ ID NO: 620910 - DNA, 25 bp, Rattus norvegicus
tctaatatgggcgtgtcctgcacaa

SEQ ID NO: 620911 - DNA, 25 bp, Rattus norvegicus
ttcccagagggcgtgttctaatatg

SEQ ID NO: 620912 - DNA, 25 bp, Rattus norvegicus
cgcggaccagcgaagagctctggtt

SEQ ID NO: 620913 - DNA, 25 bp, Rattus norvegicus
tgagccctttgtttccctggctctg

SEQ ID NO: 620914 - DNA, 25 bp, Rattus norvegicus
ccgacaacgaggctgagccctttgt

SEQ ID NO: 620915 - DNA, 25 bp, Rattus norvegicus
attgtctacggcctagcggcaagtc

SEQ ID NO: 620916 - DNA, 25 bp, Rattus norvegicus
aggctgagccctttgtttccctggc

SEQ ID NO: 620917 - DNA, 25 bp, Rattus norvegicus
tgccgggcgtccctgggcacagtcc

SEQ ID NO: 620918 - DNA, 25 bp, Rattus norvegicus
ttccctggctctgctgcgtggagcg

SEQ ID NO: 620919 - DNA, 25 bp, Rattus norvegicus
agcgggtgccatgcgtgtagtctcc

SEQ ID NO: 620920 - DNA, 25 bp, Rattus norvegicus
tgcgtgtagtctccccgcacagatg

SEQ ID NO: 620921 - DNA, 25 bp, Rattus norvegicus
atgccgcccggcttttgttttagag

SEQ ID NO: 620922 - DNA, 25 bp, Rattus norvegicus
ggcttttgttttagaggccgagaca

SEQ ID NO: 620923 - DNA, 25 bp, Rattus norvegicus
cttttgttttagaggccgagacaca

SEQ ID NO: 620924 - DNA, 25 bp, Rattus norvegicus
ttttagaggccgagacacagagagc

SEQ ID NO: 620925 - DNA, 25 bp, Rattus norvegicus
ccgagacacagagagccgggcgcac

SEQ ID NO: 620926 - DNA, 25 bp, Rattus norvegicus
cgaggctgagccctttgtttccctg

SEQ ID NO: 620927 - DNA, 25 bp, Rattus norvegicus
gcttcccgcctgcagcgtgtcggga

SEQ ID NO: 620928 - DNA, 25 bp, Rattus norvegicus
cagcgcccgagaaaaggaagccatc

SEQ ID NO: 620929 - DNA, 25 bp, Rattus norvegicus
ccgcagacgtctggggttgagatta

SEQ ID NO: 620930 - DNA, 25 bp, Rattus norvegicus
catgacaaccagtgcacgtgtgcga

SEQ ID NO: 620931 - DNA, 25 bp, Rattus norvegicus
agtgaccctggagatcatgacaacc

SEQ ID NO: 620932 - DNA, 25 bp, Rattus norvegicus
tcaaattgaaattccctggctgggg

SEQ ID NO: 620933 - DNA, 25 bp, Rattus norvegicus
acgtgagagcgtgcccacagctcca

SEQ ID NO: 620934 - DNA, 25 bp, Rattus norvegicus
tcgccgcagaaaacgtgagagcgtg

SEQ ID NO: 620935 - DNA, 25 bp, Rattus norvegicus
tcccggctggaagactcgccgcaga

SEQ ID NO: 620936 - DNA, 25 bp, Rattus norvegicus
gccctgcagttcatctaaattgttc

SEQ ID NO: 620937 - DNA, 25 bp, Rattus norvegicus
ctctgttatttcgtcctcgtagccc

SEQ ID NO: 620938 - DNA, 25 bp, Rattus norvegicus
acgccaccgactctgttatttcgtc

SEQ ID NO: 620939 - DNA, 25 bp, Rattus norvegicus
gggacgccaacattaacgccaccga

SEQ ID NO: 620940 - DNA, 25 bp, Rattus norvegicus
tgcgtttcgctctcggagtgaccct

SEQ ID NO: 620941 - DNA, 25 bp, Rattus norvegicus
cggtggctggtatagcgtacgccaa

SEQ ID NO: 620942 - DNA, 25 bp, Rattus norvegicus
gtggcctgtgaacgcctctctggag

SEQ ID NO: 620943 - DNA, 25 bp, Rattus norvegicus
agttggcctcagtacccgagcgtcc

SEQ ID NO: 620944 - DNA, 25 bp, Rattus norvegicus
gagcgtcccagactccagcacggta

SEQ ID NO: 620945 - DNA, 25 bp, Rattus norvegicus
actccagcacggtaaaggtgcgcgc

SEQ ID NO: 620946 - DNA, 25 bp, Rattus norvegicus
accctgctggaggtgtctggcacac

SEQ ID NO: 620947 - DNA, 25 bp, Rattus norvegicus
tggcacactgctggagctgttcatc

SEQ ID NO: 620948 - DNA, 25 bp, Rattus norvegicus
gttcatctcaatgcaaaggagccga

SEQ ID NO: 620949 - DNA, 25 bp, Rattus norvegicus
aggagccgaaacactgccgggccta

SEQ ID NO: 620950 - DNA, 25 bp, Rattus norvegicus
tgccgggcctaagctgcagcgccga

SEQ ID NO: 620951 - DNA, 25 bp, Rattus norvegicus
cccgcagagcggagttggcctcagt

SEQ ID NO: 620952 - DNA, 25 bp, Rattus norvegicus
aggagctgctcctagtgcttccagc

SEQ ID NO: 620953 - DNA, 25 bp, Rattus norvegicus
tacgccaagcgcttaggggactgca

SEQ ID NO: 620954 - DNA, 25 bp, Rattus norvegicus
aggttggagtaaggagctgctccta

SEQ ID NO: 620955 - DNA, 25 bp, Rattus norvegicus
tggcggcctgttgccagcagctgcc

SEQ ID NO: 620956 - DNA, 25 bp, Rattus norvegicus
tgtggcttatccattcctggcgctc

SEQ ID NO: 620957 - DNA, 25 bp, Rattus norvegicus
tcgatgtggcttatccattcctggc

SEQ ID NO: 620958 - DNA, 25 bp, Rattus norvegicus
actcttcgatgtggcttatccattc

SEQ ID NO: 620959 - DNA, 25 bp, Rattus norvegicus
cgcacgcactcttcgatgtggctta

SEQ ID NO: 620960 - DNA, 25 bp, Rattus norvegicus
ggatccagggcgctgcgtgctccgt

SEQ ID NO: 620961 - DNA, 25 bp, Rattus norvegicus
tccgttgccttgtcggggatccagg

SEQ ID NO: 620962 - DNA, 25 bp, Rattus norvegicus
atgtccgttgccttgtcggggatcc

SEQ ID NO: 620963 - DNA, 25 bp, Rattus norvegicus
atgcagatgtccgttgccttgtcgg

SEQ ID NO: 620964 - DNA, 25 bp, Rattus norvegicus
gcgcatgcagatgtccgttgccttg

SEQ ID NO: 620965 - DNA, 25 bp, Rattus norvegicus
tgcagcgcatgcagatgtccgttgc

SEQ ID NO: 620966 - DNA, 25 bp, Rattus norvegicus
ctgcgtgcagcgcatgcagatgtcc

SEQ ID NO: 620967 - DNA, 25 bp, Rattus norvegicus
agaagcgtgtctgcgtgcagcgcat

SEQ ID NO: 620968 - DNA, 25 bp, Rattus norvegicus
cgcactcttcgatgtggcttatcca

SEQ ID NO: 620969 - DNA, 25 bp, Rattus norvegicus
gagttctccagaaatgtgcgcgggc

SEQ ID NO: 620970 - DNA, 25 bp, Rattus norvegicus
cacactcaagactgggcgcgggtcc

SEQ ID NO: 620971 - DNA, 25 bp, Rattus norvegicus
gttcctagctttcctggttgccaca

SEQ ID NO: 620972 - DNA, 25 bp, Rattus norvegicus
tggagtccggttcctagctttcctg

SEQ ID NO: 620973 - DNA, 25 bp, Rattus norvegicus
ctgatccctggttggagtccggttc

SEQ ID NO: 620974 - DNA, 25 bp, Rattus norvegicus
ggcgtagttgaaccgctggacggta

SEQ ID NO: 620975 - DNA, 25 bp, Rattus norvegicus
gccggccgagttctccagaaatgtg

SEQ ID NO: 620976 - DNA, 25 bp, Rattus norvegicus
cggagccggccgagttctccagaaa

SEQ ID NO: 620977 - DNA, 25 bp, Rattus norvegicus
ccaattggagccctggcacgcaggc

SEQ ID NO: 620978 - DNA, 25 bp, Rattus norvegicus
ctctggaccaattggagccctggca

SEQ ID NO: 620979 - DNA, 25 bp, Rattus norvegicus
ccttcaaagacctctggaccaattg

SEQ ID NO: 620980 - DNA, 25 bp, Rattus norvegicus
cctggttgccacactcaagactggg

SEQ ID NO: 620981 - DNA, 25 bp, Rattus norvegicus
tccgggttccaattccctggtcaca

SEQ ID NO: 620982 - DNA, 25 bp, Rattus norvegicus
gctggacggtaaacgggtcagcgcc

SEQ ID NO: 620983 - DNA, 25 bp, Rattus norvegicus
accatggaggtcactagggcaactg

SEQ ID NO: 620984 - DNA, 25 bp, Rattus norvegicus
ataaccactgcggacacagaggctg

SEQ ID NO: 620985 - DNA, 25 bp, Rattus norvegicus
aggcccgtctcggatccttctgagg

SEQ ID NO: 620986 - DNA, 25 bp, Rattus norvegicus
tccagacaggtctgaaggcaccatg

SEQ ID NO: 620987 - DNA, 25 bp, Rattus norvegicus
cgggcccagcggaatgctttaagga

SEQ ID NO: 620988 - DNA, 25 bp, Rattus norvegicus
agcgctactccagcttcctgggcta

SEQ ID NO: 620989 - DNA, 25 bp, Rattus norvegicus
gacccaccaagccagagactcgagt

SEQ ID NO: 620990 - DNA, 25 bp, Rattus norvegicus
tctgggagcagcgtaacctcgaacc

SEQ ID NO: 620991 - DNA, 25 bp, Rattus norvegicus
gccgtctaaggcaaggtcacgattc

SEQ ID NO: 620992 - DNA, 25 bp, Rattus norvegicus
cccgtgcaaagatggggtcgcaagc

SEQ ID NO: 620993 - DNA, 25 bp, Rattus norvegicus
cccactttgaacacagcggagaagg

SEQ ID NO: 620994 - DNA, 25 bp, Rattus norvegicus
ctgccacgcagggatacagaaccca

SEQ ID NO: 620995 - DNA, 25 bp, Rattus norvegicus
cagtaccgagtgcatcaccatgata

SEQ ID NO: 620996 - DNA, 25 bp, Rattus norvegicus
ctttaaggaggacatacagggcatc

SEQ ID NO: 620997 - DNA, 25 bp, Rattus norvegicus
tggcatctatgtgcgtctgtctctg

SEQ ID NO: 620998 - DNA, 25 bp, Rattus norvegicus
gcaagctgacatagaaaggacgtga

SEQ ID NO: 620999 - DNA, 25 bp, Rattus norvegicus
ggacttgctccagccggcgtcaatt

SEQ ID NO: 621000 - DNA, 25 bp, Rattus norvegicus
cgtcatcggcgtgatggcatctatg

SEQ ID NO: 621001 - DNA, 25 bp, Rattus norvegicus
tgcgtctgtctctggcaacacatgc

SEQ ID NO: 621002 - DNA, 25 bp, Rattus norvegicus
ctggcaacacatgcgccttggggtt

SEQ ID NO: 621003 - DNA, 25 bp, Rattus norvegicus
gtcaatttcggatcaggcgcctctc

SEQ ID NO: 621004 - DNA, 25 bp, Rattus norvegicus
ccttggggttatctctgtggcttga

SEQ ID NO: 621005 - DNA, 25 bp, Rattus norvegicus
tttgcaggtcttcgctgtgtcgttc

SEQ ID NO: 621006 - DNA, 25 bp, Rattus norvegicus
gctgtgtcgttcactttgcaaccga

SEQ ID NO: 621007 - DNA, 25 bp, Rattus norvegicus
tttgcaaccgactgtgccgagagcg

SEQ ID NO: 621008 - DNA, 25 bp, Rattus norvegicus
cgagggtcaggattaatgaagtata

SEQ ID NO: 621009 - DNA, 25 bp, Rattus norvegicus
tgaagtatagcgaggcaagctgaca

SEQ ID NO: 621010 - DNA, 25 bp, Rattus norvegicus
ggcgcctctctgacgtcatcggcgt

SEQ ID NO: 621011 - DNA, 25 bp, Rattus norvegicus
ccgcgctgcggaaaatgcagtcgtc

SEQ ID NO: 621012 - DNA, 25 bp, Rattus norvegicus
tcccagcatctaggccagtgcgttc

SEQ ID NO: 621013 - DNA, 25 bp, Rattus norvegicus
gactctctaaatccaggtgcacgat

SEQ ID NO: 621014 - DNA, 25 bp, Rattus norvegicus
cggaaaatgcagtcgtcccagcatc

SEQ ID NO: 621015 - DNA, 25 bp, Rattus norvegicus
cgtctgtggttgtgtgtctgtctcc

SEQ ID NO: 621016 - DNA, 25 bp, Rattus norvegicus
gagaaagccgcgctgcggaaaatgc

SEQ ID NO: 621017 - DNA, 25 bp, Rattus norvegicus
taaatccaggtgcacgatcgccggc

SEQ ID NO: 621018 - DNA, 25 bp, Rattus norvegicus
ccctgggttctgagtgcgcgtctgt

SEQ ID NO: 621019 - DNA, 25 bp, Rattus norvegicus
tgttttctgccctgggttctgagtg

SEQ ID NO: 621020 - DNA, 25 bp, Rattus norvegicus
atcgccggccagtactgtggctttg

SEQ ID NO: 621021 - DNA, 25 bp, Rattus norvegicus
taggccagtgcgttcccggactcgc

SEQ ID NO: 621022 - DNA, 25 bp, Rattus norvegicus
agtcgtcccagcatctaggccagtg

SEQ ID NO: 621023 - DNA, 25 bp, Rattus norvegicus
agcatctaggccagtgcgttcccgg

SEQ ID NO: 621024 - DNA, 25 bp, Rattus norvegicus
ccagtactgtggctttgctgtcgcg

SEQ ID NO: 621025 - DNA, 25 bp, Rattus norvegicus
ccatgctccgggctcccgtttaagg

SEQ ID NO: 621026 - DNA, 25 bp, Rattus norvegicus
tttgctggtgacgtcacttcggtgc

SEQ ID NO: 621027 - DNA, 25 bp, Rattus norvegicus
cctctcgcttttgctggtgacgtca

SEQ ID NO: 621028 - DNA, 25 bp, Rattus norvegicus
tttgcgcagagctcagagcaaggtg

SEQ ID NO: 621029 - DNA, 25 bp, Rattus norvegicus
tccgaccgcgtttgcgcagagctca

SEQ ID NO: 621030 - DNA, 25 bp, Rattus norvegicus
tgttctggggcccaactctggtcag

SEQ ID NO: 621031 - DNA, 25 bp, Rattus norvegicus
aggcgggttcttcgccgccatgctc

SEQ ID NO: 621032 - DNA, 25 bp, Rattus norvegicus
tcccgtttaaggctgaccgaggtgc

SEQ ID NO: 621033 - DNA, 25 bp, Rattus norvegicus
cgtgagctccgctgcctgggtcagt

SEQ ID NO: 621034 - DNA, 25 bp, Rattus norvegicus
cagtcgagatcggaagccgcgccat

SEQ ID NO: 621035 - DNA, 25 bp, Rattus norvegicus
ccatggtgagcagaaggctgctgtc

SEQ ID NO: 621036 - DNA, 25 bp, Rattus norvegicus
ggctgctgtccttagaccgggaaga

SEQ ID NO: 621037 - DNA, 25 bp, Rattus norvegicus
gaacccgtctggtagagcctccttg

SEQ ID NO: 621038 - DNA, 25 bp, Rattus norvegicus
ctggtagagcctccttgtggctgga

SEQ ID NO: 621039 - DNA, 25 bp, Rattus norvegicus
cggtgattccgcgagagaattgaaa

SEQ ID NO: 621040 - DNA, 25 bp, Rattus norvegicus
acttctcgagcctcctagtggctgg

SEQ ID NO: 621041 - DNA, 25 bp, Rattus norvegicus
cttgcgcccgactgcgttgtcggta

SEQ ID NO: 621042 - DNA, 25 bp, Rattus norvegicus
actgtgtcttcagcgcggggacact

SEQ ID NO: 621043 - DNA, 25 bp, Rattus norvegicus
agcgatcggggcgactgtgtcttca

SEQ ID NO: 621044 - DNA, 25 bp, Rattus norvegicus
cttgtctgcggctgcgcgtagtgta

SEQ ID NO: 621045 - DNA, 25 bp, Rattus norvegicus
ctgccaggtccttgctggggtcctt

SEQ ID NO: 621046 - DNA, 25 bp, Rattus norvegicus
gcgctggactcagattgcggtctcc

SEQ ID NO: 621047 - DNA, 25 bp, Rattus norvegicus
ttgtcggtagttgcgttctcaggca

SEQ ID NO: 621048 - DNA, 25 bp, Rattus norvegicus
gctccggaaggtcctcctactctta

SEQ ID NO: 621049 - DNA, 25 bp, Rattus norvegicus
agccagtgataaggcgtaggctccg

SEQ ID NO: 621050 - DNA, 25 bp, Rattus norvegicus
gactcggttggagagccagtgataa

SEQ ID NO: 621051 - DNA, 25 bp, Rattus norvegicus
cgcgagagaattgaaaccctcccgg

SEQ ID NO: 621052 - DNA, 25 bp, Rattus norvegicus
agccctcgtgattcggtgaggagct

SEQ ID NO: 621053 - DNA, 25 bp, Rattus norvegicus
ttatcgctggtatcaggagctctga

SEQ ID NO: 621054 - DNA, 25 bp, Rattus norvegicus
ctgcgcagagcaaggaagtagcaaa

SEQ ID NO: 621055 - DNA, 25 bp, Rattus norvegicus
ctctcggctgcttctgcgcagagca

SEQ ID NO: 621056 - DNA, 25 bp, Rattus norvegicus
aacccgcgaagcaacctaggccgtg

SEQ ID NO: 621057 - DNA, 25 bp, Rattus norvegicus
gcggggccgacaacccgcgaagcaa

SEQ ID NO: 621058 - DNA, 25 bp, Rattus norvegicus
ctggtatcaggagctctgaggagaa

SEQ ID NO: 621059 - DNA, 25 bp, Rattus norvegicus
acaagggtacgagtgggccctgctt

SEQ ID NO: 621060 - DNA, 25 bp, Rattus norvegicus
ttctccgtggccgacaagggtacga

SEQ ID NO: 621061 - DNA, 25 bp, Rattus norvegicus
aggatctccggcaggcgggttttat

SEQ ID NO: 621062 - DNA, 25 bp, Rattus norvegicus
tccaatcaggatctccggcaggcgg

SEQ ID NO: 621063 - DNA, 25 bp, Rattus norvegicus
tggagcgttccgtccaatcaggatc

SEQ ID NO: 621064 - DNA, 25 bp, Rattus norvegicus
gccaatcagagtattggagcgttcc

SEQ ID NO: 621065 - DNA, 25 bp, Rattus norvegicus
ctgagccatcggagccgttgtgatg

SEQ ID NO: 621066 - DNA, 25 bp, Rattus norvegicus
gggccctgcttttatcgctggtatc

SEQ ID NO: 621067 - DNA, 25 bp, Rattus norvegicus
tgagtgaaacacagaaaccaaatga

SEQ ID NO: 621068 - DNA, 25 bp, Rattus norvegicus
aacacagaaaccaaatgagaagatg

SEQ ID NO: 621069 - DNA, 25 bp, Rattus norvegicus
gaagatgtcttcaaggaacaactgc

SEQ ID NO: 621070 - DNA, 25 bp, Rattus norvegicus
tgtcttcaaggaacaactgctaatg

SEQ ID NO: 621071 - DNA, 25 bp, Rattus norvegicus
ttcaaggaacaactgctaatgagtc

SEQ ID NO: 621072 - DNA, 25 bp, Rattus norvegicus
caactgctaatgagtctgcagagtc

SEQ ID NO: 621073 - DNA, 25 bp, Rattus norvegicus
ctgcagagtcgactgtgtgtctttc

SEQ ID NO: 621074 - DNA, 25 bp, Rattus norvegicus
agtcgactgtgtgtctttcagcgta

SEQ ID NO: 621075 - DNA, 25 bp, Rattus norvegicus
aagcctggagcgcagctgcgggcat

SEQ ID NO: 621076 - DNA, 25 bp, Rattus norvegicus
ttcggagcctgcgctccgggcgact

SEQ ID NO: 621077 - DNA, 25 bp, Rattus norvegicus
tagcgccagtgttgagtgaaacaca

SEQ ID NO: 621078 - DNA, 25 bp, Rattus norvegicus
gcttcggagcctgcgctccgggcga

SEQ ID NO: 621079 - DNA, 25 bp, Rattus norvegicus
gacaaaggcgacgatagcgccagtg

SEQ ID NO: 621080 - DNA, 25 bp, Rattus norvegicus
cgacgatagcgccagtgttgagtga

SEQ ID NO: 621081 - DNA, 25 bp, Rattus norvegicus
tgcaccactccacgtcgcgaatgga

SEQ ID NO: 621082 - DNA, 25 bp, Rattus norvegicus
tgtgatcccacgggttgcggtttct

SEQ ID NO: 621083 - DNA, 25 bp, Rattus norvegicus
cgcgaatggagaggggtgtgatccc

SEQ ID NO: 621084 - DNA, 25 bp, Rattus norvegicus
accactccacgtcgcgaatggagag

SEQ ID NO: 621085 - DNA, 25 bp, Rattus norvegicus
gtgcaccactccacgtcgcgaatgg

SEQ ID NO: 621086 - DNA, 25 bp, Rattus norvegicus
tgcatccgtgggtctccgtgcacca

SEQ ID NO: 621087 - DNA, 25 bp, Rattus norvegicus
ggttgcatccgtgggtctccgtgca

SEQ ID NO: 621088 - DNA, 25 bp, Rattus norvegicus
ccgtttggttgcatccgtgggtctc

SEQ ID NO: 621089 - DNA, 25 bp, Rattus norvegicus
agtcccggccgtttggttgcatccg

SEQ ID NO: 621090 - DNA, 25 bp, Rattus norvegicus
gtagtcccggccgtttggttgcatc

SEQ ID NO: 621091 - DNA, 25 bp, Rattus norvegicus
gcttctgccgtggggcgtgctcacc

SEQ ID NO: 621092 - DNA, 25 bp, Rattus norvegicus
tcccggccgtttggttgcatccgtg

SEQ ID NO: 621093 - DNA, 25 bp, Rattus norvegicus
ctcacacccggtacaaccctggtag

SEQ ID NO: 621094 - DNA, 25 bp, Rattus norvegicus
gtttggttgcatccgtgggtctccg

SEQ ID NO: 621095 - DNA, 25 bp, Rattus norvegicus
caaccctgcgggagatggaacagcg

SEQ ID NO: 621096 - DNA, 25 bp, Rattus norvegicus
cgctacggtcggacgccaggtcttc

SEQ ID NO: 621097 - DNA, 25 bp, Rattus norvegicus
tgagcgcccactcgccttgcggagt

SEQ ID NO: 621098 - DNA, 25 bp, Rattus norvegicus
ccagaaggagaccaggaggcagact

SEQ ID NO: 621099 - DNA, 25 bp, Rattus norvegicus
gactctggtgcctctcaggcgctca

SEQ ID NO: 621100 - DNA, 25 bp, Rattus norvegicus
gctcacttccttctccaaggatgga

SEQ ID NO: 621101 - DNA, 25 bp, Rattus norvegicus
tccaaggatggatagtggcacagtc

SEQ ID NO: 621102 - DNA, 25 bp, Rattus norvegicus
atagtggcacagtccggccgttgcc

SEQ ID NO: 621103 - DNA, 25 bp, Rattus norvegicus
ggccagagactgaactgcagatccc

SEQ ID NO: 621104 - DNA, 25 bp, Rattus norvegicus
attctcctgtggaccaccggactga

SEQ ID NO: 621105 - DNA, 25 bp, Rattus norvegicus
aggtaccgaccgaaggatccttctg

SEQ ID NO: 621106 - DNA, 25 bp, Rattus norvegicus
ccatggcaggctccgaggcgtccta

SEQ ID NO: 621107 - DNA, 25 bp, Rattus norvegicus
cggatacctgctacctctgctactg

SEQ ID NO: 621108 - DNA, 25 bp, Rattus norvegicus
tccttctggagggaccaggtctcct

SEQ ID NO: 621109 - DNA, 25 bp, Rattus norvegicus
ggcgcccggagcaaggtaatccgct

SEQ ID NO: 621110 - DNA, 25 bp, Rattus norvegicus
gcctatcagctggtcacgcctctct

SEQ ID NO: 621111 - DNA, 25 bp, Rattus norvegicus
cccaaagatgtaaccgtgcgggaag

SEQ ID NO: 621112 - DNA, 25 bp, Rattus norvegicus
ggagcaaggtaatccgctgcccttc

SEQ ID NO: 621113 - DNA, 25 bp, Rattus norvegicus
tgacgatatcgaaatgccctgcgcg

SEQ ID NO: 621114 - DNA, 25 bp, Rattus norvegicus
tatcgaaatgccctgcgcgttcagg

SEQ ID NO: 621115 - DNA, 25 bp, Rattus norvegicus
gcgttcagggcaagcggagccacct

SEQ ID NO: 621116 - DNA, 25 bp, Rattus norvegicus
ggagccacctcgtactcactggaga

SEQ ID NO: 621117 - DNA, 25 bp, Rattus norvegicus
ccacctcgtactcactggagattca

SEQ ID NO: 621118 - DNA, 25 bp, Rattus norvegicus
ctggagattcagtggtggtacctca

SEQ ID NO: 621119 - DNA, 25 bp, Rattus norvegicus
tcagtggtggtacctcaaggagcca

SEQ ID NO: 621120 - DNA, 25 bp, Rattus norvegicus
cccgggagctgttacacgagctggc

SEQ ID NO: 621121 - DNA, 25 bp, Rattus norvegicus
ggaaggtgacgatatcgaaatgccc

SEQ ID NO: 621122 - DNA, 25 bp, Rattus norvegicus
gctgttacacgagctggcgctcagc

SEQ ID NO: 621123 - DNA, 25 bp, Rattus norvegicus
gcgaaactagctctcaaaaccgttg

SEQ ID NO: 621124 - DNA, 25 bp, Rattus norvegicus
catcggcgaccgcggattggcttca

SEQ ID NO: 621125 - DNA, 25 bp, Rattus norvegicus
tgcaatcccgcctccaacagaatta

SEQ ID NO: 621126 - DNA, 25 bp, Rattus norvegicus
cggaatctagtaagactatcggggc

SEQ ID NO: 621127 - DNA, 25 bp, Rattus norvegicus
agaggcggaatctagtaagactatc

SEQ ID NO: 621128 - DNA, 25 bp, Rattus norvegicus
cttcaggagagaggcggaatctagt

SEQ ID NO: 621129 - DNA, 25 bp, Rattus norvegicus
gcgaccgcggattggcttcaggaga

SEQ ID NO: 621130 - DNA, 25 bp, Rattus norvegicus
cccgcacctcacggggcttgagagg

SEQ ID NO: 621131 - DNA, 25 bp, Rattus norvegicus
aatcccgcctccaacagaattacgt

SEQ ID NO: 621132 - DNA, 25 bp, Rattus norvegicus
gaaactagctctcaaaaccgttggc

SEQ ID NO: 621133 - DNA, 25 bp, Rattus norvegicus
actagctctcaaaaccgttggcagc

SEQ ID NO: 621134 - DNA, 25 bp, Rattus norvegicus
tagctctcaaaaccgttggcagcct

SEQ ID NO: 621135 - DNA, 25 bp, Rattus norvegicus
ctcaaaaccgttggcagcctcccgc

SEQ ID NO: 621136 - DNA, 25 bp, Rattus norvegicus
agaattacgtcacccgcccgcgaga

SEQ ID NO: 621137 - DNA, 25 bp, Rattus norvegicus
agcgacgatgacactcaggagcaca

SEQ ID NO: 621138 - DNA, 25 bp, Rattus norvegicus
ccaggcattgctgcgtgtgctatcg

SEQ ID NO: 621139 - DNA, 25 bp, Rattus norvegicus
tgacatctcacaccggcttcggctg

SEQ ID NO: 621140 - DNA, 25 bp, Rattus norvegicus
tgcgtgtgctatcgcgcttcacgcc

SEQ ID NO: 621141 - DNA, 25 bp, Rattus norvegicus
ggcttcggctgtccgccgtacgatt

SEQ ID NO: 621142 - DNA, 25 bp, Rattus norvegicus
tccgccgtacgattgcaggacgaag

SEQ ID NO: 621143 - DNA, 25 bp, Rattus norvegicus
caggacgaaggtgtttatgagtgtc

SEQ ID NO: 621144 - DNA, 25 bp, Rattus norvegicus
gcgtttcggactacagcgacgatga

SEQ ID NO: 621145 - DNA, 25 bp, Rattus norvegicus
ttcacgccgcccaacatgcaagctg

SEQ ID NO: 621146 - DNA, 25 bp, Rattus norvegicus
gctgcagaggcagtgtcccacattc

SEQ ID NO: 621147 - DNA, 25 bp, Rattus norvegicus
agtgtcccacattcagagcagcggc

SEQ ID NO: 621148 - DNA, 25 bp, Rattus norvegicus
ctcaggagcacaaggcccaggcatt

SEQ ID NO: 621149 - DNA, 25 bp, Rattus norvegicus
gtccagggcaatgacatctcacacc

SEQ ID NO: 621150 - DNA, 25 bp, Rattus norvegicus
tatgagtgtcgcgtttcggactaca

SEQ ID NO: 621151 - DNA, 25 bp, Rattus norvegicus
cactggtccagtgccaagagcatcg

SEQ ID NO: 621152 - DNA, 25 bp, Rattus norvegicus
ctggtccagtgccaagagcatcgag

SEQ ID NO: 621153 - DNA, 25 bp, Rattus norvegicus
tcactggtccagtgccaagagcatc

SEQ ID NO: 621154 - DNA, 25 bp, Rattus norvegicus
gacactcactggtccagtgccaaga

SEQ ID NO: 621155 - DNA, 25 bp, Rattus norvegicus
gcagcagctccggaagtctggcatg

SEQ ID NO: 621156 - DNA, 25 bp, Rattus norvegicus
acggagctcatggacctgatgggta

SEQ ID NO: 621157 - DNA, 25 bp, Rattus norvegicus
acacggagctcatggacctgatggg

SEQ ID NO: 621158 - DNA, 25 bp, Rattus norvegicus
gcgcacgcgacacggagctcatgga

SEQ ID NO: 621159 - DNA, 25 bp, Rattus norvegicus
cacgcgacacggagctcatggacct

SEQ ID NO: 621160 - DNA, 25 bp, Rattus norvegicus
cgcgacacggagctcatggacctga

SEQ ID NO: 621161 - DNA, 25 bp, Rattus norvegicus
acgtcgtccgggcaccggtggctgg

SEQ ID NO: 621162 - DNA, 25 bp, Rattus norvegicus
cgacacggagctcatggacctgatg

SEQ ID NO: 621163 - DNA, 25 bp, Rattus norvegicus
ccgaggcgctgctgagccctgcgct

SEQ ID NO: 621164 - DNA, 25 bp, Rattus norvegicus
cgtgcgcacgcgacacggagctcat

SEQ ID NO: 621165 - DNA, 25 bp, Rattus norvegicus
gcctcagctttaggcactggagcga

SEQ ID NO: 621166 - DNA, 25 bp, Rattus norvegicus
tttcttcagtggcatcttcgcgcgc

SEQ ID NO: 621167 - DNA, 25 bp, Rattus norvegicus
gctgctgcgtttcttcagtggcatc

SEQ ID NO: 621168 - DNA, 25 bp, Rattus norvegicus
agcaccggctgctgcgtttcttcag

SEQ ID NO: 621169 - DNA, 25 bp, Rattus norvegicus
ctggacaacagcgacctgcagcggc

SEQ ID NO: 621170 - DNA, 25 bp, Rattus norvegicus
gagaagcgcaacaccttggacgtgg

SEQ ID NO: 621171 - DNA, 25 bp, Rattus norvegicus
gctgagaagcgcaacaccttggacg

SEQ ID NO: 621172 - DNA, 25 bp, Rattus norvegicus
gctgcgtttcttcagtggcatcttc

SEQ ID NO: 621173 - DNA, 25 bp, Rattus norvegicus
cagctttaggcactggagcgagccc

SEQ ID NO: 621174 - DNA, 25 bp, Rattus norvegicus
cggagcctcagctttaggcactgga

SEQ ID NO: 621175 - DNA, 25 bp, Rattus norvegicus
cggcggagcctcagctttaggcact

SEQ ID NO: 621176 - DNA, 25 bp, Rattus norvegicus
ccctgcggcggagcctcagctttag

SEQ ID NO: 621177 - DNA, 25 bp, Rattus norvegicus
ggcccagcagtcctgatggggagga

SEQ ID NO: 621178 - DNA, 25 bp, Rattus norvegicus
ctttaggcactggagcgagcccgag

SEQ ID NO: 621179 - DNA, 25 bp, Rattus norvegicus
gtaatcctgatacttgcaccatagg

SEQ ID NO: 621180 - DNA, 25 bp, Rattus norvegicus
gaagagtggctcactgatggaaaaa

SEQ ID NO: 621181 - DNA, 25 bp, Rattus norvegicus
tgaggagatctgcaattagccttgg

SEQ ID NO: 621182 - DNA, 25 bp, Rattus norvegicus
gcaccataggcctccaagttaggtc

SEQ ID NO: 621183 - DNA, 25 bp, Rattus norvegicus
ctcggcggtggagatacaactcgaa

SEQ ID NO: 621184 - DNA, 25 bp, Rattus norvegicus
gcggaaagccacagtctatgtctta

SEQ ID NO: 621185 - DNA, 25 bp, Rattus norvegicus
gtctatgtcttaatggactccactc

SEQ ID NO: 621186 - DNA, 25 bp, Rattus norvegicus
ccactctttaaatcaggcactgggg

SEQ ID NO: 621187 - DNA, 25 bp, Rattus norvegicus
ttttccaatcccaatgaacgtgagc

SEQ ID NO: 621188 - DNA, 25 bp, Rattus norvegicus
tgaacgtgagcacatgcccaccacg

SEQ ID NO: 621189 - DNA, 25 bp, Rattus norvegicus
ctcagcctctaaagagatctgtata

SEQ ID NO: 621190 - DNA, 25 bp, Rattus norvegicus
tggaatcccgtagttcaacatgagg

SEQ ID NO: 621191 - DNA, 25 bp, Rattus norvegicus
gagtctcattctctatggaatcccg

SEQ ID NO: 621192 - DNA, 25 bp, Rattus norvegicus
tgcaggcagccatatccatcactca

SEQ ID NO: 621193 - DNA, 25 bp, Rattus norvegicus
cgagaacagggtgaatacgaaccaa

SEQ ID NO: 621194 - DNA, 25 bp, Rattus norvegicus
agcccgtccctcagcacagaccagc

SEQ ID NO: 621195 - DNA, 25 bp, Rattus norvegicus
acagaccagcgctccgcgcagtaca

SEQ ID NO: 621196 - DNA, 25 bp, Rattus norvegicus
agtacagcgtccctccttgcgccgc

SEQ ID NO: 621197 - DNA, 25 bp, Rattus norvegicus
ccgccgcggttcacctcacacagca

SEQ ID NO: 621198 - DNA, 25 bp, Rattus norvegicus
acagcacctcagagagctctgcaca

SEQ ID NO: 621199 - DNA, 25 bp, Rattus norvegicus
ttccaaaccacctcgcggatccgcc

SEQ ID NO: 621200 - DNA, 25 bp, Rattus norvegicus
gaagccaaagagtcccggatggaaa

SEQ ID NO: 621201 - DNA, 25 bp, Rattus norvegicus
cctatggaagccaaagagtcccgga

SEQ ID NO: 621202 - DNA, 25 bp, Rattus norvegicus
ttccgcctatggaagccaaagagtc

SEQ ID NO: 621203 - DNA, 25 bp, Rattus norvegicus
ggcgacttccgcctatggaagccaa

SEQ ID NO: 621204 - DNA, 25 bp, Rattus norvegicus
cagacggcgacttccgcctatggaa

SEQ ID NO: 621205 - DNA, 25 bp, Rattus norvegicus
ctgcacaccgcacgccagacggcga

SEQ ID NO: 621206 - DNA, 25 bp, Rattus norvegicus
aaccgtcgagaacagggtgaatacg

SEQ ID NO: 621207 - DNA, 25 bp, Rattus norvegicus
cgcagaaagaatgcggaggcaaaca

SEQ ID NO: 621208 - DNA, 25 bp, Rattus norvegicus
tagtcctagggaacgtaggcgcaga

SEQ ID NO: 621209 - DNA, 25 bp, Rattus norvegicus
aaaggcacgatgtgagtgtgggatc

SEQ ID NO: 621210 - DNA, 25 bp, Rattus norvegicus
atgcggaggcaaacaaacaaaggcg

SEQ ID NO: 621211 - DNA, 25 bp, Rattus norvegicus
ggagagaatccgcagaaagaatgcg

SEQ ID NO: 621212 - DNA, 25 bp, Rattus norvegicus
gacgctaggacaggagagaatccgc

SEQ ID NO: 621213 - DNA, 25 bp, Rattus norvegicus
gtagacgctaggacaggagagaatc

SEQ ID NO: 621214 - DNA, 25 bp, Rattus norvegicus
aaagtgtagacgctaggacaggaga

SEQ ID NO: 621215 - DNA, 25 bp, Rattus norvegicus
gaaggaaagtgtagacgctaggaca

SEQ ID NO: 621216 - DNA, 25 bp, Rattus norvegicus
gacactgggaagtcacggggaagga

SEQ ID NO: 621217 - DNA, 25 bp, Rattus norvegicus
ggacgagcggacactgggaagtcac

SEQ ID NO: 621218 - DNA, 25 bp, Rattus norvegicus
actcgggggagtcataaaggacgtg

SEQ ID NO: 621219 - DNA, 25 bp, Rattus norvegicus
gcacagggagagagtacgggactcg

SEQ ID NO: 621220 - DNA, 25 bp, Rattus norvegicus
cgtaggcgcagaggatgtgggcaca

SEQ ID NO: 621221 - DNA, 25 bp, Rattus norvegicus
aagcgcaacccgatccggccagaga

SEQ ID NO: 621222 - DNA, 25 bp, Rattus norvegicus
tttctctgagttttgcggcggttga

SEQ ID NO: 621223 - DNA, 25 bp, Rattus norvegicus
tctctgagttttgcggcggttgatt

SEQ ID NO: 621224 - DNA, 25 bp, Rattus norvegicus
cgcaggcgcagagacagatatgggg

SEQ ID NO: 621225 - DNA, 25 bp, Rattus norvegicus
cggactgtgcggctgtctgaattaa

SEQ ID NO: 621226 - DNA, 25 bp, Rattus norvegicus
gtcaagagggtcatcgacttcgccg

SEQ ID NO: 621227 - DNA, 25 bp, Rattus norvegicus
tgaattaagcgcaacccgatccggc

SEQ ID NO: 621228 - DNA, 25 bp, Rattus norvegicus
atccggccagagactgctgcgtgaa

SEQ ID NO: 621229 - DNA, 25 bp, Rattus norvegicus
ccagagactgctgcgtgaagatggc

SEQ ID NO: 621230 - DNA, 25 bp, Rattus norvegicus
cgctcgtggctgtcaagagggtcat

SEQ ID NO: 621231 - DNA, 25 bp, Rattus norvegicus
tggctgtcaagagggtcatcgactt

SEQ ID NO: 621232 - DNA, 25 bp, Rattus norvegicus
attggctttctctgagttttgcggc

SEQ ID NO: 621233 - DNA, 25 bp, Rattus norvegicus
agcggcccgccctggatcccgcctc

SEQ ID NO: 621234 - DNA, 25 bp, Rattus norvegicus
gctgtctgaattaagcgcaacccga

SEQ ID NO: 621235 - DNA, 25 bp, Rattus norvegicus
gcccggacgctcctgtcattagggt

SEQ ID NO: 621236 - DNA, 25 bp, Rattus norvegicus
agggtctcttcggaccgtgacgcca

SEQ ID NO: 621237 - DNA, 25 bp, Rattus norvegicus
ttcggaccgtgacgccagtcctgcg

SEQ ID NO: 621238 - DNA, 25 bp, Rattus norvegicus
agtcctgcgctctacgtcactgcgg

SEQ ID NO: 621239 - DNA, 25 bp, Rattus norvegicus
cgctctacgtcactgcgggcagcaa

SEQ ID NO: 621240 - DNA, 25 bp, Rattus norvegicus
tcactgcgggcagcaatgtgacctt

SEQ ID NO: 621241 - DNA, 25 bp, Rattus norvegicus
gcgggcagcaatgtgaccttgcatt

SEQ ID NO: 621242 - DNA, 25 bp, Rattus norvegicus
aatgtgaccttgcattgctcggccc

SEQ ID NO: 621243 - DNA, 25 bp, Rattus norvegicus
cgcctgcggacatcgcctggagtct

SEQ ID NO: 621244 - DNA, 25 bp, Rattus norvegicus
acatcgcctggagtctggcggaccc

SEQ ID NO: 621245 - DNA, 25 bp, Rattus norvegicus
gccatgcgggcgcttacgcctgcat

SEQ ID NO: 621246 - DNA, 25 bp, Rattus norvegicus
cttacgcctgcatcgccgcgaaccc

SEQ ID NO: 621247 - DNA, 25 bp, Rattus norvegicus
cctgtcattagggtctcttcggacc

SEQ ID NO: 621248 - DNA, 25 bp, Rattus norvegicus
acgctcctgtcattagggtctcttc

SEQ ID NO: 621249 - DNA, 25 bp, Rattus norvegicus
aagcagaccgcggtgtagccgcagc

SEQ ID NO: 621250 - DNA, 25 bp, Rattus norvegicus
agtgtgtcccggagcagtcggagca

SEQ ID NO: 621251 - DNA, 25 bp, Rattus norvegicus
gagaatcgggcgagcatatggccac

SEQ ID NO: 621252 - DNA, 25 bp, Rattus norvegicus
atcgggcgagcatatggccacttcc

SEQ ID NO: 621253 - DNA, 25 bp, Rattus norvegicus
gagcatatggccacttccctagcca

SEQ ID NO: 621254 - DNA, 25 bp, Rattus norvegicus
catatggccacttccctagccagtg

SEQ ID NO: 621255 - DNA, 25 bp, Rattus norvegicus
tggccacttccctagccagtgtgtc

SEQ ID NO: 621256 - DNA, 25 bp, Rattus norvegicus
ccaggaggaggagccttttcgtgag

SEQ ID NO: 621257 - DNA, 25 bp, Rattus norvegicus
cctttctctcggctgtgctgtgctg

SEQ ID NO: 621258 - DNA, 25 bp, Rattus norvegicus
tttctctcggctgtgctgtgctgag
